United States Patent 10,706,955 (BIOINFORMATIC PROCESSES FOR DETERMINATION OF PEPTIDE BINDING) - sequence listing, part 26

SEQ ID NO: 1003201 - protein, 8 aa, Mycobacterium
CSASGDWR

SEQ ID NO: 1003202 - protein, 6 aa, Mycobacterium
CSEQER

SEQ ID NO: 1003203 - protein, 16 aa, Mycobacterium
CSGGMHGSNRLGGNSL

SEQ ID NO: 1003204 - protein, 8 aa, Mycobacterium
CSGNGGFA

SEQ ID NO: 1003205 - protein, 6 aa, Mycobacterium
CSGPRT

SEQ ID NO: 1003206 - protein, 5 aa, Mycobacterium
CSNGV

SEQ ID NO: 1003207 - protein, 5 aa, Mycobacterium
CSPRT

SEQ ID NO: 1003208 - protein, 11 aa, Mycobacterium
CSPTSDGSGAA

SEQ ID NO: 1003209 - protein, 5 aa, Mycobacterium
CSRDN

SEQ ID NO: 1003210 - protein, 7 aa, Mycobacterium
CSSGDVE

SEQ ID NO: 1003211 - protein, 5 aa, Mycobacterium
CSTAE

SEQ ID NO: 1003212 - protein, 9 aa, Mycobacterium
CSTATRALR

SEQ ID NO: 1003213 - protein, 26 aa, Mycobacterium
CSTTRSPRGLSRYPTPSPCSTPPTWA

SEQ ID NO: 1003214 - protein, 5 aa, Mycobacterium
CSVSS

SEQ ID NO: 1003215 - protein, 9 aa, Mycobacterium
CSYRGKPAD

SEQ ID NO: 1003216 - protein, 10 aa, Mycobacterium
CTAEADAAFD

SEQ ID NO: 1003217 - protein, 13 aa, Mycobacterium
CTCQQKSASVTHF

SEQ ID NO: 1003218 - protein, 17 aa, Mycobacterium
CTGSPGCASSAADVRAD

SEQ ID NO: 1003219 - protein, 20 aa, Mycobacterium
CTGSPRKPADAGASSSEQVT

SEQ ID NO: 1003220 - protein, 12 aa, Mycobacterium
CTGSRTSTSTRR

SEQ ID NO: 1003221 - protein, 10 aa, Mycobacterium
CTGTGGEPQL

SEQ ID NO: 1003222 - protein, 8 aa, Mycobacterium
CTKSDTVD

SEQ ID NO: 1003223 - protein, 4 aa, Mycobacterium
CTND

SEQ ID NO: 1003224 - protein, 6 aa, Mycobacterium
CTNTER

SEQ ID NO: 1003225 - protein, 4 aa, Mycobacterium
CTPC

SEQ ID NO: 1003226 - protein, 12 aa, Mycobacterium
CTPRRAAPPAQH

SEQ ID NO: 1003227 - protein, 4 aa, Mycobacterium
CTTR

SEQ ID NO: 1003228 - protein, 17 aa, Mycobacterium
CTTRNKRRAARLQSSYD

SEQ ID NO: 1003229 - protein, 5 aa, Mycobacterium
CYGPP

SEQ ID NO: 1003230 - protein, 4 aa, Mycobacterium
DAAA

SEQ ID NO: 1003231 - protein, 7 aa, Mycobacterium
DAAAALE

SEQ ID NO: 1003232 - protein, 7 aa, Mycobacterium
DAAADPG

SEQ ID NO: 1003233 - protein, 7 aa, Mycobacterium
DAAAEPV

SEQ ID NO: 1003234 - protein, 6 aa, Mycobacterium
DAAAGA

SEQ ID NO: 1003235 - protein, 13 aa, Mycobacterium
DAAAGSGHNGGAG

SEQ ID NO: 1003236 - protein, 12 aa, Mycobacterium
DAAAKKAVKDVQ

SEQ ID NO: 1003237 - protein, 6 aa, Mycobacterium
DAAAVR

SEQ ID NO: 1003238 - protein, 8 aa, Mycobacterium
DAADASDR

SEQ ID NO: 1003239 - protein, 8 aa, Mycobacterium
DAADRDNV

SEQ ID NO: 1003240 - protein, 7 aa, Mycobacterium
DAADRGW

SEQ ID NO: 1003241 - protein, 7 aa, Mycobacterium
DAADSDM

SEQ ID NO: 1003242 - protein, 4 aa, Mycobacterium
DAAE

SEQ ID NO: 1003243 - protein, 9 aa, Mycobacterium
DAAEAERSG

SEQ ID NO: 1003244 - protein, 11 aa, Mycobacterium
DAAEGSGANRV

SEQ ID NO: 1003245 - protein, 11 aa, Mycobacterium
DAAESADKSAQ

SEQ ID NO: 1003246 - protein, 4 aa, Mycobacterium
DAAG

SEQ ID NO: 1003247 - protein, 5 aa, Mycobacterium
DAAGD

SEQ ID NO: 1003248 - protein, 14 aa, Mycobacterium
DAAGDGGDWAGPEA

SEQ ID NO: 1003249 - protein, 6 aa, Mycobacterium
DAAGDL

SEQ ID NO: 1003250 - protein, 6 aa, Mycobacterium
DAAGEL

SEQ ID NO: 1003251 - protein, 8 aa, Mycobacterium
DAAGEYPT

SEQ ID NO: 1003252 - protein, 12 aa, Mycobacterium
DAAGGTATGVTG

SEQ ID NO: 1003253 - protein, 6 aa, Mycobacterium
DAAGHD

SEQ ID NO: 1003254 - protein, 5 aa, Mycobacterium
DAAGI

SEQ ID NO: 1003255 - protein, 18 aa, Mycobacterium
DAAGLAEERYGAGNNQPG

SEQ ID NO: 1003256 - protein, 5 aa, Mycobacterium
DAAGR

SEQ ID NO: 1003257 - protein, 6 aa, Mycobacterium
DAAGRG

SEQ ID NO: 1003258 - protein, 13 aa, Mycobacterium
DAAGSVAQSATPT

SEQ ID NO: 1003259 - protein, 13 aa, Mycobacterium
DAAGTKSSFRTGD

SEQ ID NO: 1003260 - protein, 6 aa, Mycobacterium
DAAGVT

SEQ ID NO: 1003261 - protein, 4 aa, Mycobacterium
DAAH

SEQ ID NO: 1003262 - protein, 8 aa, Mycobacterium
DAAHAGEY

SEQ ID NO: 1003263 - protein, 18 aa, Mycobacterium
DAAKREAYEARARGETGE

SEQ ID NO: 1003264 - protein, 7 aa, Mycobacterium
DAALGRP

SEQ ID NO: 1003265 - protein, 11 aa, Mycobacterium
DAANDASHEHP

SEQ ID NO: 1003266 - protein, 8 aa, Mycobacterium
DAANGEPV

SEQ ID NO: 1003267 - protein, 9 aa, Mycobacterium
DAANGIEPY

SEQ ID NO: 1003268 - protein, 10 aa, Mycobacterium
DAAPAEPNAA

SEQ ID NO: 1003269 - protein, 6 aa, Mycobacterium
DAAPGM

SEQ ID NO: 1003270 - protein, 5 aa, Mycobacterium
DAAPI

SEQ ID NO: 1003271 - protein, 17 aa, Mycobacterium
DAAPKAEAVRSNGSGLT

SEQ ID NO: 1003272 - protein, 8 aa, Mycobacterium
DAAQASAV

SEQ ID NO: 1003273 - protein, 4 aa, Mycobacterium
DAAR

SEQ ID NO: 1003274 - protein, 8 aa, Mycobacterium
DAARDDAA

SEQ ID NO: 1003275 - protein, 6 aa, Mycobacterium
DAARDR

SEQ ID NO: 1003276 - protein, 7 aa, Mycobacterium
DAARNDD

SEQ ID NO: 1003277 - protein, 8 aa, Mycobacterium
DAARRARV

SEQ ID NO: 1003278 - protein, 8 aa, Mycobacterium
DAARTTYR

SEQ ID NO: 1003279 - protein, 6 aa, Mycobacterium
DAARYA

SEQ ID NO: 1003280 - protein, 7 aa, Mycobacterium
DAASDRM

SEQ ID NO: 1003281 - protein, 5 aa, Mycobacterium
DAASV

SEQ ID NO: 1003282 - protein, 5 aa, Mycobacterium
DAATE

SEQ ID NO: 1003283 - protein, 14 aa, Mycobacterium
DAATGWEPVTGTEI

SEQ ID NO: 1003284 - protein, 7 aa, Mycobacterium
DAATTAE

SEQ ID NO: 1003285 - protein, 6 aa, Mycobacterium
DAATTR

SEQ ID NO: 1003286 - protein, 8 aa, Mycobacterium
DAAVTDDA

SEQ ID NO: 1003287 - protein, 8 aa, Mycobacterium
DACTPSHT

SEQ ID NO: 1003288 - protein, 5 aa, Mycobacterium
DADAA

SEQ ID NO: 1003289 - protein, 7 aa, Mycobacterium
DADAADK

SEQ ID NO: 1003290 - protein, 8 aa, Mycobacterium
DADAARRR

SEQ ID NO: 1003291 - protein, 13 aa, Mycobacterium
DADADGYVRSEGA

SEQ ID NO: 1003292 - protein, 14 aa, Mycobacterium
DADAPARQARIGTR

SEQ ID NO: 1003293 - protein, 13 aa, Mycobacterium
DADAVASAGIEAR

SEQ ID NO: 1003294 - protein, 8 aa, Mycobacterium
DADDDAVK

SEQ ID NO: 1003295 - protein, 24 aa, Mycobacterium
DADDEETESDHDGYEEPLVDPLRS

SEQ ID NO: 1003296 - protein, 7 aa, Mycobacterium
DADEEAT

SEQ ID NO: 1003297 - protein, 5 aa, Mycobacterium
DADEL

SEQ ID NO: 1003298 - protein, 7 aa, Mycobacterium
DADEPTT

SEQ ID NO: 1003299 - protein, 5 aa, Mycobacterium
DADER

SEQ ID NO: 1003300 - protein, 8 aa, Mycobacterium
DADERPDL

SEQ ID NO: 1003301 - protein, 12 aa, Mycobacterium
DADGGPDQRLTG

SEQ ID NO: 1003302 - protein, 7 aa, Mycobacterium
DADGGYA

SEQ ID NO: 1003303 - protein, 20 aa, Mycobacterium
DADGLSRTQARTAEAGTGAR

SEQ ID NO: 1003304 - protein, 12 aa, Mycobacterium
DADGSVLALRRE

SEQ ID NO: 1003305 - protein, 9 aa, Mycobacterium
DADHDGPLG

SEQ ID NO: 1003306 - protein, 7 aa, Mycobacterium
DADKPAN

SEQ ID NO: 1003307 - protein, 4 aa, Mycobacterium
DADL

SEQ ID NO: 1003308 - protein, 13 aa, Mycobacterium
DADLDENAAPETL

SEQ ID NO: 1003309 - protein, 9 aa, Mycobacterium
DADPGYTAE

SEQ ID NO: 1003310 - protein, 8 aa, Mycobacterium
DADPSADR

SEQ ID NO: 1003311 - protein, 5 aa, Mycobacterium
DADRE

SEQ ID NO: 1003312 - protein, 5 aa, Mycobacterium
DADRM

SEQ ID NO: 1003313 - protein, 7 aa, Mycobacterium
DADRPGT

SEQ ID NO: 1003314 - protein, 8 aa, Mycobacterium
DADRPLTV

SEQ ID NO: 1003315 - protein, 14 aa, Mycobacterium
DADRPSGRLGPQAR

SEQ ID NO: 1003316 - protein, 7 aa, Mycobacterium
DADRSGR

SEQ ID NO: 1003317 - protein, 7 aa, Mycobacterium
DADSDEV

SEQ ID NO: 1003318 - protein, 11 aa, Mycobacterium
DADTDGREGST

SEQ ID NO: 1003319 - protein, 7 aa, Mycobacterium
DADTEEL

SEQ ID NO: 1003320 - protein, 9 aa, Mycobacterium
DADTGAATV

SEQ ID NO: 1003321 - protein, 8 aa, Mycobacterium
DADTGESP

SEQ ID NO: 1003322 - protein, 7 aa, Mycobacterium
DADTIGA

SEQ ID NO: 1003323 - protein, 8 aa, Mycobacterium
DADTVNAA

SEQ ID NO: 1003324 - protein, 7 aa, Mycobacterium
DAEAATP

SEQ ID NO: 1003325 - protein, 8 aa, Mycobacterium
DAEAGPTE

SEQ ID NO: 1003326 - protein, 6 aa, Mycobacterium
DAEARA

SEQ ID NO: 1003327 - protein, 9 aa, Mycobacterium
DAEASDKAT

SEQ ID NO: 1003328 - protein, 7 aa, Mycobacterium
DAEGGTG

SEQ ID NO: 1003329 - protein, 6 aa, Mycobacterium
DAEGVT

SEQ ID NO: 1003330 - protein, 4 aa, Mycobacterium
DAEH

SEQ ID NO: 1003331 - protein, 11 aa, Mycobacterium
DAEHDASQVSL

SEQ ID NO: 1003332 - protein, 11 aa, Mycobacterium
DAEHDASQVSV

SEQ ID NO: 1003333 - protein, 5 aa, Mycobacterium
DAELA

SEQ ID NO: 1003334 - protein, 14 aa, Mycobacterium
DAELEARSEVGLPP

SEQ ID NO: 1003335 - protein, 21 aa, Mycobacterium
DAELRAKTDEFKKRHAEGESL

SEQ ID NO: 1003336 - protein, 5 aa, Mycobacterium
DAELT

SEQ ID NO: 1003337 - protein, 8 aa, Mycobacterium
DAELTERP

SEQ ID NO: 1003338 - protein, 6 aa, Mycobacterium
DAELTV

SEQ ID NO: 1003339 - protein, 5 aa, Mycobacterium
DAEPA

SEQ ID NO: 1003340 - protein, 13 aa, Mycobacterium
DAEPPGEPSEQDP

SEQ ID NO: 1003341 - protein, 4 aa, Mycobacterium
DAER

SEQ ID NO: 1003342 - protein, 8 aa, Mycobacterium
DAERAGKP

SEQ ID NO: 1003343 - protein, 6 aa, Mycobacterium
DAEREF

SEQ ID NO: 1003344 - protein, 9 aa, Mycobacterium
DAERSGGRI

SEQ ID NO: 1003345 - protein, 8 aa, Mycobacterium
DAESEPEL

SEQ ID NO: 1003346 - protein, 6 aa, Mycobacterium
DAESNR

SEQ ID NO: 1003347 - protein, 7 aa, Mycobacterium
DAETAAT

SEQ ID NO: 1003348 - protein, 7 aa, Mycobacterium
DAETDEV

SEQ ID NO: 1003349 - protein, 7 aa, Mycobacterium
DAETGNA

SEQ ID NO: 1003350 - protein, 8 aa, Mycobacterium
DAETQASV

SEQ ID NO: 1003351 - protein, 10 aa, Mycobacterium
DAETQDIDDS

SEQ ID NO: 1003352 - protein, 7 aa, Mycobacterium
DAEVTPI

SEQ ID NO: 1003353 - protein, 4 aa, Mycobacterium
DAEY

SEQ ID NO: 1003354 - protein, 16 aa, Mycobacterium
DAGAEIARRSRGTPRI

SEQ ID NO: 1003355 - protein, 10 aa, Mycobacterium
DAGAERGRAE

SEQ ID NO: 1003356 - protein, 14 aa, Mycobacterium
DAGAGGSGGAGGTS

SEQ ID NO: 1003357 - protein, 8 aa, Mycobacterium
DAGAPATL

SEQ ID NO: 1003358 - protein, 7 aa, Mycobacterium
DAGAQDA

SEQ ID NO: 1003359 - protein, 11 aa, Mycobacterium
DAGASSAERSF

SEQ ID NO: 1003360 - protein, 12 aa, Mycobacterium
DAGASSAERSFY

SEQ ID NO: 1003361 - protein, 7 aa, Mycobacterium
DAGATAV

SEQ ID NO: 1003362 - protein, 7 aa, Mycobacterium
DAGDPVE

SEQ ID NO: 1003363 - protein, 9 aa, Mycobacterium
DAGEDVESS

SEQ ID NO: 1003364 - protein, 7 aa, Mycobacterium
DAGERAG

SEQ ID NO: 1003365 - protein, 8 aa, Mycobacterium
DAGETLPT

SEQ ID NO: 1003366 - protein, 5 aa, Mycobacterium
DAGGE

SEQ ID NO: 1003367 - protein, 7 aa, Mycobacterium
DAGGGAE

SEQ ID NO: 1003368 - protein, 8 aa, Mycobacterium
DAGGYKAG

SEQ ID NO: 1003369 - protein, 8 aa, Mycobacterium
DAGHGDSI

SEQ ID NO: 1003370 - protein, 7 aa, Mycobacterium
DAGKEGL

SEQ ID NO: 1003371 - protein, 5 aa, Mycobacterium
DAGLN

SEQ ID NO: 1003372 - protein, 17 aa, Mycobacterium
DAGLNGVAGTSGNAGQH

SEQ ID NO: 1003373 - protein, 6 aa, Mycobacterium
DAGLTG

SEQ ID NO: 1003374 - protein, 14 aa, Mycobacterium
DAGLTSSSWARGPH

SEQ ID NO: 1003375 - protein, 8 aa, Mycobacterium
DAGPGASY

SEQ ID NO: 1003376 - protein, 7 aa, Mycobacterium
DAGPGTR

SEQ ID NO: 1003377 - protein, 7 aa, Mycobacterium
DAGPHTE

SEQ ID NO: 1003378 - protein, 14 aa, Mycobacterium
DAGPRGQMVARKGE

SEQ ID NO: 1003379 - protein, 10 aa, Mycobacterium
DAGQDGVTEP

SEQ ID NO: 1003380 - protein, 9 aa, Mycobacterium
DAGQGEREL

SEQ ID NO: 1003381 - protein, 8 aa, Mycobacterium
DAGQPISR

SEQ ID NO: 1003382 - protein, 10 aa, Mycobacterium
DAGQRPQTDV

SEQ ID NO: 1003383 - protein, 13 aa, Mycobacterium
DAGQSTAEADTAF

SEQ ID NO: 1003384 - protein, 8 aa, Mycobacterium
DAGRDDDG

SEQ ID NO: 1003385 - protein, 10 aa, Mycobacterium
DAGSADDLTQ

SEQ ID NO: 1003386 - protein, 41 aa, Mycobacterium
DAGSDETPASDGQPQDATTSSGDAPPSTGDGGEDGLPAADP

SEQ ID NO: 1003387 - protein, 7 aa, Mycobacterium
DAGSTSM

SEQ ID NO: 1003388 - protein, 5 aa, Mycobacterium
DAGTA

SEQ ID NO: 1003389 - protein, 7 aa, Mycobacterium
DAGVDTT

SEQ ID NO: 1003390 - protein, 9 aa, Mycobacterium
DAGVEDGQQ

SEQ ID NO: 1003391 - protein, 6 aa, Mycobacterium
DAGVSN

SEQ ID NO: 1003392 - protein, 11 aa, Mycobacterium
DAGVSPEKPHN

SEQ ID NO: 1003393 - protein, 15 aa, Mycobacterium
DAGWRKGATQGHSGT

SEQ ID NO: 1003394 - protein, 7 aa, Mycobacterium
DAHAPGQ

SEQ ID NO: 1003395 - protein, 5 aa, Mycobacterium
DAHER

SEQ ID NO: 1003396 - protein, 4 aa, Mycobacterium
DAHG

SEQ ID NO: 1003397 - protein, 10 aa, Mycobacterium
DAHGAAQGHE

SEQ ID NO: 1003398 - protein, 6 aa, Mycobacterium
DAHGNE

SEQ ID NO: 1003399 - protein, 6 aa, Mycobacterium
DAHPGM

SEQ ID NO: 1003400 - protein, 6 aa, Mycobacterium
DAHPTA

SEQ ID NO: 1003401 - protein, 9 aa, Mycobacterium
DAIDGRPRG

SEQ ID NO: 1003402 - protein, 8 aa, Mycobacterium
DAIGQAAP

SEQ ID NO: 1003403 - protein, 12 aa, Mycobacterium
DAIPGGNVKRGD

SEQ ID NO: 1003404 - protein, 12 aa, Mycobacterium
DAIPNDSDDFDE

SEQ ID NO: 1003405 - protein, 9 aa, Mycobacterium
DAIRDTEDA

SEQ ID NO: 1003406 - protein, 8 aa, Mycobacterium
DAIRDTQA

SEQ ID NO: 1003407 - protein, 7 aa, Mycobacterium
DAITRPE

SEQ ID NO: 1003408 - protein, 8 aa, Mycobacterium
DAKAQADR

SEQ ID NO: 1003409 - protein, 11 aa, Mycobacterium
DAKDPNTKYPP

SEQ ID NO: 1003410 - protein, 19 aa, Mycobacterium
DAKEGPQAFAQKRKPNFQN

SEQ ID NO: 1003411 - protein, 12 aa, Mycobacterium
DAKFGESPLAQT

SEQ ID NO: 1003412 - protein, 10 aa, Mycobacterium
DAKGSQLGLP

SEQ ID NO: 1003413 - protein, 7 aa, Mycobacterium
DAKLGEK

SEQ ID NO: 1003414 - protein, 5 aa, Mycobacterium
DAKPR

SEQ ID NO: 1003415 - protein, 9 aa, Mycobacterium
DAKSAAAAE

SEQ ID NO: 1003416 - protein, 14 aa, Mycobacterium
DAKTDRSAMTGGTP

SEQ ID NO: 1003417 - protein, 15 aa, Mycobacterium
DALEPAEAAPSMQKS

SEQ ID NO: 1003418 - protein, 5 aa, Mycobacterium
DALGE

SEQ ID NO: 1003419 - protein, 6 aa, Mycobacterium
DALPDA

SEQ ID NO: 1003420 - protein, 6 aa, Mycobacterium
DALPDS

SEQ ID NO: 1003421 - protein, 7 aa, Mycobacterium
DALPTSS

SEQ ID NO: 1003422 - protein, 7 aa, Mycobacterium
DALRDVN

SEQ ID NO: 1003423 - protein, 6 aa, Mycobacterium
DALRTK

SEQ ID NO: 1003424 - protein, 13 aa, Mycobacterium
DALTAPHTVRPEY

SEQ ID NO: 1003425 - protein, 15 aa, Mycobacterium
DAMRPKKAARPATSM

SEQ ID NO: 1003426 - protein, 5 aa, Mycobacterium
DAMTQ

SEQ ID NO: 1003427 - protein, 10 aa, Mycobacterium
DANADSSPFS

SEQ ID NO: 1003428 - protein, 8 aa, Mycobacterium
DANGDPVQ

SEQ ID NO: 1003429 - protein, 9 aa, Mycobacterium
DANGTTVAA

SEQ ID NO: 1003430 - protein, 6 aa, Mycobacterium
DANIDT

SEQ ID NO: 1003431 - protein, 8 aa, Mycobacterium
DANPADVS

SEQ ID NO: 1003432 - protein, 8 aa, Mycobacterium
DANPETAR

SEQ ID NO: 1003433 - protein, 8 aa, Mycobacterium
DANPPEVK

SEQ ID NO: 1003434 - protein, 11 aa, Mycobacterium
DANRLGPEGGG

SEQ ID NO: 1003435 - protein, 7 aa, Mycobacterium
DANRNGH

SEQ ID NO: 1003436 - protein, 10 aa, Mycobacterium
DAPANIKQKD

SEQ ID NO: 1003437 - protein, 16 aa, Mycobacterium
DAPAPAPAAPAPPAIP

SEQ ID NO: 1003438 - protein, 7 aa, Mycobacterium
DAPAQVR

SEQ ID NO: 1003439 - protein, 13 aa, Mycobacterium
DAPATALPAATDA

SEQ ID NO: 1003440 - protein, 6 aa, Mycobacterium
DAPDRT

SEQ ID NO: 1003441 - protein, 10 aa, Mycobacterium
DAPEKPINDI

SEQ ID NO: 1003442 - protein, 95 aa, Mycobacterium
DAPGIGGDGGVGGAGDTGGNGGTDGGSTFGGQLGGAGGAGGDGGNAGSGTTAGDGGAGGRGGNGGAAGTAGTGGTFSSPIGGAGGTGGTGGNGGN

SEQ ID NO: 1003443 - protein, 7 aa, Mycobacterium
DAPGPMA

SEQ ID NO: 1003444 - protein, 13 aa, Mycobacterium
DAPGQQRRYSNPS

SEQ ID NO: 1003445 - protein, 5 aa, Mycobacterium
DAPGV

SEQ ID NO: 1003446 - protein, 7 aa, Mycobacterium
DAPHSQA

SEQ ID NO: 1003447 - protein, 6 aa, Mycobacterium
DAPIRA

SEQ ID NO: 1003448 - protein, 5 aa, Mycobacterium
DAPKL

SEQ ID NO: 1003449 - protein, 4 aa, Mycobacterium
DAPL

SEQ ID NO: 1003450 - protein, 5 aa, Mycobacterium
DAPLD

SEQ ID NO: 1003451 - protein, 6 aa, Mycobacterium
DAPLES

SEQ ID NO: 1003452 - protein, 4 aa, Mycobacterium
DAPN

SEQ ID NO: 1003453 - protein, 4 aa, Mycobacterium
DAPP

SEQ ID NO: 1003454 - protein, 10 aa, Mycobacterium
DAPPPAGSKQ

SEQ ID NO: 1003455 - protein, 7 aa, Mycobacterium
DAPPSVH

SEQ ID NO: 1003456 - protein, 11 aa, Mycobacterium
DAPQGDGPRRV

SEQ ID NO: 1003457 - protein, 10 aa, Mycobacterium
DAPQSPAEPA

SEQ ID NO: 1003458 - protein, 11 aa, Mycobacterium
DAPRDNAFDDT

SEQ ID NO: 1003459 - protein, 12 aa, Mycobacterium
DAPRSAAATEVS

SEQ ID NO: 1003460 - protein, 5 aa, Mycobacterium
DAPSA

SEQ ID NO: 1003461 - protein, 22 aa, Mycobacterium
DAPTQSGTESSVSGVEGLPAGS

SEQ ID NO: 1003462 - protein, 11 aa, Mycobacterium
DAPTSAPDSLA

SEQ ID NO: 1003463 - protein, 7 aa, Mycobacterium
DAPTTDR

SEQ ID NO: 1003464 - protein, 6 aa, Mycobacterium
DAPVTG

SEQ ID NO: 1003465 - protein, 15 aa, Mycobacterium
DAQAPRDDLSDRERA

SEQ ID NO: 1003466 - protein, 8 aa, Mycobacterium
DAQARTQL

SEQ ID NO: 1003467 - protein, 8 aa, Mycobacterium
DAQDTAEL

SEQ ID NO: 1003468 - protein, 10 aa, Mycobacterium
DAQEGSGQLG

SEQ ID NO: 1003469 - protein, 5 aa, Mycobacterium
DAQGA

SEQ ID NO: 1003470 - protein, 4 aa, Mycobacterium
DAQP

SEQ ID NO: 1003471 - protein, 7 aa, Mycobacterium
DAQPARR

SEQ ID NO: 1003472 - protein, 8 aa, Mycobacterium
DAQPEQDA

SEQ ID NO: 1003473 - protein, 13 aa, Mycobacterium
DAQPRYSAARRDA

SEQ ID NO: 1003474 - protein, 4 aa, Mycobacterium
DAQQ

SEQ ID NO: 1003475 - protein, 8 aa, Mycobacterium
DAQRAQRS

SEQ ID NO: 1003476 - protein, 9 aa, Mycobacterium
DAQRARAVG

SEQ ID NO: 1003477 - protein, 5 aa, Mycobacterium
DAQTP

SEQ ID NO: 1003478 - protein, 12 aa, Mycobacterium
DARAGGSGGSAG

SEQ ID NO: 1003479 - protein, 6 aa, Mycobacterium
DARATA

SEQ ID NO: 1003480 - protein, 4 aa, Mycobacterium
DARD

SEQ ID NO: 1003481 - protein, 8 aa, Mycobacterium
DARDGRKP

SEQ ID NO: 1003482 - protein, 5 aa, Mycobacterium
DARDI

SEQ ID NO: 1003483 - protein, 6 aa, Mycobacterium
DARDIA

SEQ ID NO: 1003484 - protein, 12 aa, Mycobacterium
DARDTKLGAEEI

SEQ ID NO: 1003485 - protein, 6 aa, Mycobacterium
DARDVA

SEQ ID NO: 1003486 - protein, 4 aa, Mycobacterium
DARF

SEQ ID NO: 1003487 - protein, 7 aa, Mycobacterium
DARGEAP

SEQ ID NO: 1003488 - protein, 5 aa, Mycobacterium
DARGH

SEQ ID NO: 1003489 - protein, 6 aa, Mycobacterium
DARGQV

SEQ ID NO: 1003490 - protein, 6 aa, Mycobacterium
DARGRR

SEQ ID NO: 1003491 - protein, 8 aa, Mycobacterium
DARGSYVP

SEQ ID NO: 1003492 - protein, 12 aa, Mycobacterium
DARHGSASFATA

SEQ ID NO: 1003493 - protein, 8 aa, Mycobacterium
DARMTPGS

SEQ ID NO: 1003494 - protein, 13 aa, Mycobacterium
DARNEPKGPQRPH

SEQ ID NO: 1003495 - protein, 5 aa, Mycobacterium
DARRP

SEQ ID NO: 1003496 - protein, 6 aa, Mycobacterium
DARRQG

SEQ ID NO: 1003497 - protein, 7 aa, Mycobacterium
DARRSAD

SEQ ID NO: 1003498 - protein, 22 aa, Mycobacterium
DASAAVPVGPANVGRPGGRNDI

SEQ ID NO: 1003499 - protein, 20 aa, Mycobacterium
DASAPNEIAPEPPPSSTVGG

SEQ ID NO: 1003500 - protein, 9 aa, Mycobacterium
DASAQVGAK

SEQ ID NO: 1003501 - protein, 8 aa, Mycobacterium
DASGAKRC

SEQ ID NO: 1003502 - protein, 9 aa, Mycobacterium
DASGDDPHA

SEQ ID NO: 1003503 - protein, 9 aa, Mycobacterium
DASGEYQPL

SEQ ID NO: 1003504 - protein, 10 aa, Mycobacterium
DASGNAPDST

SEQ ID NO: 1003505 - protein, 37 aa, Mycobacterium; identical to SEQ ID NO: 444428

SEQ ID NO: 1003506 - protein, 10 aa, Mycobacterium
DASPVGSADR

SEQ ID NO: 1003507 - protein, 7 aa, Mycobacterium
DASQQVT

SEQ ID NO: 1003508 - protein, 6 aa, Mycobacterium
DASRAT

SEQ ID NO: 1003509 - protein, 9 aa, Mycobacterium
DASRPPNAA

SEQ ID NO: 1003510 - protein, 9 aa, Mycobacterium
DASSGGHGG

SEQ ID NO: 1003511 - protein, 6 aa, Mycobacterium
DASSTD

SEQ ID NO: 1003512 - protein, 15 aa, Mycobacterium
DASTQLGATTSIGTG

SEQ ID NO: 1003513 - protein, 4 aa, Mycobacterium
DASY

SEQ ID NO: 1003514 - protein, 8 aa, Mycobacterium
DASYATGS

SEQ ID NO: 1003515 - protein, 6 aa, Mycobacterium
DASYTA

SEQ ID NO: 1003516 - protein, 4 aa, Mycobacterium
DATA

SEQ ID NO: 1003517 - protein, 12 aa, Mycobacterium
DATAARAELEAA

SEQ ID NO: 1003518 - protein, 7 aa, Mycobacterium
DATADSV

SEQ ID NO: 1003519 - protein, 12 aa, Mycobacterium
DATAEPWHGRPA

SEQ ID NO: 1003520 - protein, 5 aa, Mycobacterium
DATDA

SEQ ID NO: 1003521 - protein, 7 aa, Mycobacterium
DATDEAA

SEQ ID NO: 1003522 - protein, 8 aa, Mycobacterium
DATDGNEF

SEQ ID NO: 1003523 - protein, 4 aa, Mycobacterium
DATE

SEQ ID NO: 1003524 - protein, 14 aa, Mycobacterium
DATEDRPVSITEGG

SEQ ID NO: 1003525 - protein, 8 aa, Mycobacterium
DATEREAR

SEQ ID NO: 1003526 - protein, 8 aa, Mycobacterium
DATGASDQ

SEQ ID NO: 1003527 - protein, 6 aa, Mycobacterium
DATGDH

SEQ ID NO: 1003528 - protein, 9 aa, Mycobacterium
DATGGGTLA

SEQ ID NO: 1003529 - protein, 16 aa, Mycobacterium
DATGSALSGMPAEERA

SEQ ID NO: 1003530 - protein, 4 aa, Mycobacterium
DATH

SEQ ID NO: 1003531 - protein, 15 aa, Mycobacterium
DATHGPSLRDANERR

SEQ ID NO: 1003532 - protein, 8 aa, Mycobacterium
DATITEAA

SEQ ID NO: 1003533 - protein, 8 aa, Mycobacterium
DATNGIDP

SEQ ID NO: 1003534 - protein, 4 aa, Mycobacterium
DATR

SEQ ID NO: 1003535 - protein, 13 aa, Mycobacterium
DATRAAGEISAPG

SEQ ID NO: 1003536 - protein, 8 aa, Mycobacterium
DATRGPGL

SEQ ID NO: 1003537 - protein, 15 aa, Mycobacterium
DATSRARSRSRAKAR

SEQ ID NO: 1003538 - protein, 8 aa, Mycobacterium
DATSTSRH

SEQ ID NO: 1003539 - protein, 8 aa, Mycobacterium
DATTGRYI

SEQ ID NO: 1003540 - protein, 7 aa, Mycobacterium
DATTGTI

SEQ ID NO: 1003541 - protein, 7 aa, Mycobacterium
DATVNGR

SEQ ID NO: 1003542 - protein, 4 aa, Mycobacterium
DAVA

SEQ ID NO: 1003543 - protein, 7 aa, Mycobacterium
DAVDEAG

SEQ ID NO: 1003544 - protein, 10 aa, Mycobacterium
DAVDEVPADR

SEQ ID NO: 1003545 - protein, 12 aa, Mycobacterium
DAVDPISRQPEY

SEQ ID NO: 1003546 - protein, 6 aa, Mycobacterium
DAVEDR

SEQ ID NO: 1003547 - protein, 4 aa, Mycobacterium
DAVG

SEQ ID NO: 1003548 - protein, 4 aa, Mycobacterium
DAVK

SEQ ID NO: 1003549 - protein, 7 aa, Mycobacterium
DAVSTDD

SEQ ID NO: 1003550 - protein, 18 aa, Mycobacterium
DAVTTRTMQSSDPAQPLA

SEQ ID NO: 1003551 - protein, 5 aa, Mycobacterium
DAYGG

SEQ ID NO: 1003552 - protein, 4 aa, Mycobacterium
DAYP

SEQ ID NO: 1003553 - protein, 7 aa, Mycobacterium
DAYRPTL

SEQ ID NO: 1003554 - protein, 5 aa, Mycobacterium
DCGSS

SEQ ID NO: 1003555 - protein, 5 aa, Mycobacterium
DCGST

SEQ ID NO: 1003556 - protein, 13 aa, Mycobacterium
DCPFSTSASENLQ

SEQ ID NO: 1003557 - protein, 6 aa, Mycobacterium
DCRGSG

SEQ ID NO: 1003558 - protein, 5 aa, Mycobacterium
DCSGA

SEQ ID NO: 1003559 - protein, 11 aa, Mycobacterium
DCTAAARSAPS

SEQ ID NO: 1003560 - protein, 13 aa, Mycobacterium
DCTNAESLKQQSE

SEQ ID NO: 1003561 - protein, 4 aa, Mycobacterium
DDAA

SEQ ID NO: 1003562 - protein, 5 aa, Mycobacterium
DDAAK

SEQ ID NO: 1003563 - protein, 8 aa, Mycobacterium
DDAAPDRV

SEQ ID NO: 1003564 - protein, 8 aa, Mycobacterium
DDAARDRA

SEQ ID NO: 1003565 - protein, 6 aa, Mycobacterium
DDAATS

SEQ ID NO: 1003566 - protein, 4 aa, Mycobacterium
DDAD

SEQ ID NO: 1003567 - protein, 33 aa, Mycobacterium
DDADGDAGVDADGDTENSAEPADADSADTAQGA

SEQ ID NO: 1003568 - protein, 4 aa, Mycobacterium
DDAG

SEQ ID NO: 1003569 - protein, 8 aa, Mycobacterium
DDAGAAVE

SEQ ID NO: 1003570 - protein, 10 aa, Mycobacterium
DDAGKASAMR

SEQ ID NO: 1003571 - protein, 10 aa, Mycobacterium
DDAGLSPADV

SEQ ID NO: 1003572 - protein, 7 aa, Mycobacterium
DDAGNVT

SEQ ID NO: 1003573 - protein, 10 aa, Mycobacterium
DDAGRTSSVT

SEQ ID NO: 1003574 - protein, 6 aa, Mycobacterium
DDAGTI

SEQ ID NO: 1003575 - protein, 10 aa, Mycobacterium
DDAGVTPGEV

SEQ ID NO: 1003576 - protein, 6 aa, Mycobacterium
DDAKVE

SEQ ID NO: 1003577 - protein, 4 aa, Mycobacterium
DDAM

SEQ ID NO: 1003578 - protein, 10 aa, Mycobacterium
DDAPMAPGSA

SEQ ID NO: 1003579 - protein, 4 aa, Mycobacterium
DDAR

SEQ ID NO: 1003580 - protein, 7 aa, Mycobacterium
DDARGDG

SEQ ID NO: 1003581 - protein, 5 aa, Mycobacterium
DDARP

SEQ ID NO: 1003582 - protein, 11 aa, Mycobacterium
DDASADRADWQ

SEQ ID NO: 1003583 - protein, 6 aa, Mycobacterium
DDATNL

SEQ ID NO: 1003584 - protein, 11 aa, Mycobacterium
DDATWSRKTAA

SEQ ID NO: 1003585 - protein, 4 aa, Mycobacterium
DDAV

SEQ ID NO: 1003586 - protein, 8 aa, Mycobacterium
DDAVDPRI

SEQ ID NO: 1003587 - protein, 4 aa, Mycobacterium
DDAW

SEQ ID NO: 1003588 - protein, 12 aa, Mycobacterium
DDCQTDGGVASA

SEQ ID NO: 1003589 - protein, 15 aa, Mycobacterium
DDCRVPDGADVMHSG

SEQ ID NO: 1003590 - protein, 5 aa, Mycobacterium
DDDAA

SEQ ID NO: 1003591 - protein, 5 aa, Mycobacterium
DDDDA

SEQ ID NO: 1003592 - protein, 15 aa, Mycobacterium
DDDDHEKQQRERYAQ

SEQ ID NO: 1003593 - protein, 7 aa, Mycobacterium
DDDGAPR

SEQ ID NO: 1003594 - protein, 8 aa, Mycobacterium
DDDGNPLA

SEQ ID NO: 1003595 - protein, 6 aa, Mycobacterium
DDDGNV

SEQ ID NO: 1003596 - protein, 6 aa, Mycobacterium
DDDGPL

SEQ ID NO: 1003597 - protein, 5 aa, Mycobacterium
DDDGW

SEQ ID NO: 1003598 - protein, 6 aa, Mycobacterium
DDDGYP

SEQ ID NO: 1003599 - protein, 6 aa, Mycobacterium
DDDNNP

SEQ ID NO: 1003600 - protein, 4 aa, Mycobacterium
DDDP

SEQ ID NO: 1003601 - protein, 9 aa, Mycobacterium
DDDPDLSNV

SEQ ID NO: 1003602 - protein, 7 aa, Mycobacterium
DDDPEDA

SEQ ID NO: 1003603 - protein, 6 aa, Mycobacterium
DDDPLQ

SEQ ID NO: 1003604 - protein, 10 aa, Mycobacterium
DDDPQRPLGP

SEQ ID NO: 1003605 - protein, 4 aa, Mycobacterium
DDDQ

SEQ ID NO: 1003606 - protein, 6 aa, Mycobacterium
DDDRAA

SEQ ID NO: 1003607 - protein, 8 aa, Mycobacterium
DDDRPAAL

SEQ ID NO: 1003608 - protein, 8 aa, Mycobacterium
DDDRPVPM

SEQ ID NO: 1003609 - protein, 22 aa, Mycobacterium
DDDSAAAAAADSPAPADAATAS

SEQ ID NO: 1003610 - protein, 21 aa, Mycobacterium
DDDSGDGAAKARAYERSATEA

SEQ ID NO: 1003611 - protein, 6 aa, Mycobacterium
DDDSGF

SEQ ID NO: 1003612 - protein, 9 aa, Mycobacterium
DDDTDVAAA

SEQ ID NO: 1003613 - protein, 4 aa, Mycobacterium
DDDV

SEQ ID NO: 1003614 - protein, 8 aa, Mycobacterium
DDDYTTRP

SEQ ID NO: 1003615 - protein, 20 aa, Mycobacterium
DDEADGAGPNAPGAGPSASF

SEQ ID NO: 1003616 - protein, 5 aa, Mycobacterium
DDEAN

SEQ ID NO: 1003617 - protein, 10 aa, Mycobacterium
DDEEADRHYR

SEQ ID NO: 1003618 - protein, 8 aa, Mycobacterium
DDELPAEE

SEQ ID NO: 1003619 - protein, 7 aa, Mycobacterium
DDELRGL

SEQ ID NO: 1003620 - protein, 5 aa, Mycobacterium
DDEMG

SEQ ID NO: 1003621 - protein, 5 aa, Mycobacterium
DDEPR

SEQ ID NO: 1003622 - protein, 6 aa, Mycobacterium
DDERGR

SEQ ID NO: 1003623 - protein, 6 aa, Mycobacterium
DDETNL

SEQ ID NO: 1003624 - protein, 17 aa, Mycobacterium
DDETTADANANKSNDFE

SEQ ID NO: 1003625 - protein, 5 aa, Mycobacterium
DDEVT

SEQ ID NO: 1003626 - protein, 20 aa, Mycobacterium
DDEYYDDRGPSRGYSRPRFE

SEQ ID NO: 1003627 - protein, 8 aa, Mycobacterium
DDFGTPDA

SEQ ID NO: 1003628 - protein, 8 aa, Mycobacterium
DDFNRGDS

SEQ ID NO: 1003629 - protein, 4 aa, Mycobacterium
DDFP

SEQ ID NO: 1003630 - protein, 9 aa, Mycobacterium
DDFRGSGDQ

SEQ ID NO: 1003631 - protein, 4 aa, Mycobacterium
DDGA

SEQ ID NO: 1003632 - protein, 11 aa, Mycobacterium
DDGAEPISAPA

SEQ ID NO: 1003633 - protein, 9 aa, Mycobacterium
DDGAGGQVE

SEQ ID NO: 1003634 - protein, 4 aa, Mycobacterium
DDGC

SEQ ID NO: 1003635 - protein, 16 aa, Mycobacterium
DDGDGGRGGPVIARYD

SEQ ID NO: 1003636 - protein, 6 aa, Mycobacterium
DDGDWS

SEQ ID NO: 1003637 - protein, 9 aa, Mycobacterium
DDGEGNSVE

SEQ ID NO: 1003638 - protein, 20 aa, Mycobacterium
DDGEKGEPRQLRRRDGTSVY

SEQ ID NO: 1003639 - protein, 5 aa, Mycobacterium
DDGET

SEQ ID NO: 1003640 - protein, 4 aa, Mycobacterium
DDGG

SEQ ID NO: 1003641 - protein, 6 aa, Mycobacterium
DDGGKV

SEQ ID NO: 1003642 - protein, 7 aa, Mycobacterium
DDGGTAV

SEQ ID NO: 1003643 - protein, 7 aa, Mycobacterium
DDGMRGS

SEQ ID NO: 1003644 - protein, 4 aa, Mycobacterium
DDGP

SEQ ID NO: 1003645 - protein, 4 aa, Mycobacterium
DDGR

SEQ ID NO: 1003646 - protein, 5 aa, Mycobacterium
DDGRP

SEQ ID NO: 1003647 - protein, 9 aa, Mycobacterium
DDGRPRDTG

SEQ ID NO: 1003648 - protein, 8 aa, Mycobacterium
DDGRPSQV

SEQ ID NO: 1003649 - protein, 11 aa, Mycobacterium
DDGRRAVDAGA

SEQ ID NO: 1003650 - protein, 7 aa, Mycobacterium
DDGRSYA

SEQ ID NO: 1003651 - protein, 5 aa, Mycobacterium
DDGRW

SEQ ID NO: 1003652 - protein, 6 aa, Mycobacterium
DDGSAG

SEQ ID NO: 1003653 - protein, 7 aa, Mycobacterium
DDGSAMS

SEQ ID NO: 1003654 - protein, 12 aa, Mycobacterium
DDGSGAAELPGA

SEQ ID NO: 1003655 - protein, 7 aa, Mycobacterium
DDGSPAV

SEQ ID NO: 1003656 - protein, 8 aa, Mycobacterium
DDGTEMQV

SEQ ID NO: 1003657 - protein, 9 aa, Mycobacterium
DDGTGLPTG

SEQ ID NO: 1003658 - protein, 8 aa, Mycobacterium
DDGTHSAE

SEQ ID NO: 1003659 - protein, 8 aa, Mycobacterium
DDGTYVSS

SEQ ID NO: 1003660 - protein, 4 aa, Mycobacterium
DDGV

SEQ ID NO: 1003661 - protein, 17 aa, Mycobacterium
DDHAVAPSQAMGNEPES

SEQ ID NO: 1003662 - protein, 17 aa, Mycobacterium
DDHGDPLAPETDEGTHV

SEQ ID NO: 1003663 - protein, 13 aa, Mycobacterium
DDHGNALQPDIYN

SEQ ID NO: 1003664 - protein, 8 aa, Mycobacterium
DDHRRQSL

SEQ ID NO: 1003665 - protein, 8 aa, Mycobacterium
DDHSDTEG

SEQ ID NO: 1003666 - protein, 7 aa, Mycobacterium
DDIAADA

SEQ ID NO: 1003667 - protein, 11 aa, Mycobacterium
DDIAPPPRPAI

SEQ ID NO: 1003668 - protein, 5 aa, Mycobacterium
DDIDA

SEQ ID NO: 1003669 - protein, 5 aa, Mycobacterium
DDIDI

SEQ ID NO: 1003670 - protein, 5 aa, Mycobacterium
DDIGG

SEQ ID NO: 1003671 - protein, 13 aa, Mycobacterium
DDIPESGKMTGRS

SEQ ID NO: 1003672 - protein, 17 aa, Mycobacterium
DDKGPADADTIDTVRAL

SEQ ID NO: 1003673 - protein, 7 aa, Mycobacterium
DDKPAYI

SEQ ID NO: 1003674 - protein, 7 aa, Mycobacterium
DDKQLAA

SEQ ID NO: 1003675 - protein, 9 aa, Mycobacterium
DDKRPSYSL

SEQ ID NO: 1003676 - protein, 5 aa, Mycobacterium
DDKSY

SEQ ID NO: 1003677 - protein, 8 aa, Mycobacterium
DDKTNPAQ

SEQ ID NO: 1003678 - protein, 9 aa, Mycobacterium
DDKYDGSQN

SEQ ID NO: 1003679 - protein, 7 aa, Mycobacterium
DDLAGGI

SEQ ID NO: 1003680 - protein, 8 aa, Mycobacterium
DDLAPRAA

SEQ ID NO: 1003681 - protein, 4 aa, Mycobacterium
DDLQ

SEQ ID NO: 1003682 - protein, 5 aa, Mycobacterium
DDLRR

SEQ ID NO: 1003683 - protein, 8 aa, Mycobacterium
DDLSRTGL

SEQ ID NO: 1003684 - protein, 5 aa, Mycobacterium
DDMPE

SEQ ID NO: 1003685 - protein, 8 aa, Mycobacterium
DDNAQTRG

SEQ ID NO: 1003686 - protein, 9 aa, Mycobacterium
DDNGHWEAP

SEQ ID NO: 1003687 - protein, 34 aa, Mycobacterium
DDNLEANYGRTCPRRSGGASTAKARKRRARRDVA

SEQ ID NO: 1003688 - protein, 15 aa, Mycobacterium
DDNNGGAGGDGGGAG

SEQ ID NO: 1003689 - protein, 12 aa, Mycobacterium
DDNPRGEDPGAI

SEQ ID NO: 1003690 - protein, 20 aa, Mycobacterium
DDNRRVAAGKPHVGDRAPLP

SEQ ID NO: 1003691 - protein, 8 aa, Mycobacterium
DDNSPTFN

SEQ ID NO: 1003692 - protein, 7 aa, Mycobacterium
DDNTDKT

SEQ ID NO: 1003693 - protein, 9 aa, Mycobacterium
DDPAGYQSR

SEQ ID NO: 1003694 - protein, 5 aa, Mycobacterium
DDPAQ

SEQ ID NO: 1003695 - protein, 7 aa, Mycobacterium
DDPASAV

SEQ ID NO: 1003696 - protein, 6 aa, Mycobacterium
DDPAYP

SEQ ID NO: 1003697 - protein, 12 aa, Mycobacterium
DDPDAATPTAGA

SEQ ID NO: 1003698 - protein, 7 aa, Mycobacterium
DDPDEPG

SEQ ID NO: 1003699 - protein, 5 aa, Mycobacterium
DDPDL

SEQ ID NO: 1003700 - protein, 8 aa, Mycobacterium
DDPDLPSR

SEQ ID NO: 1003701 - protein, 5 aa, Mycobacterium
DDPDR

SEQ ID NO: 1003702 - protein, 5 aa, Mycobacterium
DDPEY

SEQ ID NO: 1003703 - protein, 8 aa, Mycobacterium
DDPFYDPP

SEQ ID NO: 1003704 - protein, 7 aa, Mycobacterium
DDPGDEL

SEQ ID NO: 1003705 - protein, 7 aa, Mycobacterium
DDPGNTT

SEQ ID NO: 1003706 - protein, 9 aa, Mycobacterium
DDPGRDDAV

SEQ ID NO: 1003707 - protein, 8 aa, Mycobacterium
DDPGRSGE

SEQ ID NO: 1003708 - protein, 13 aa, Mycobacterium
DDPGSAALAERSA

SEQ ID NO: 1003709 - protein, 9 aa, Mycobacterium
DDPGSSERI

SEQ ID NO: 1003710 - protein, 6 aa, Mycobacterium
DDPGVS

SEQ ID NO: 1003711 - protein, 20 aa, Mycobacterium
DDPHQDTSDSSVAAANYGSA

SEQ ID NO: 1003712 - protein, 15 aa, Mycobacterium
DDPHRRREGRPGAAQ

SEQ ID NO: 1003713 - protein, 4 aa, Mycobacterium
DDPM

SEQ ID NO: 1003714 - protein, 16 aa, Mycobacterium
DDPNQPVAPDPYGAMY

SEQ ID NO: 1003715 - protein, 8 aa, Mycobacterium
DDPNRGHD

SEQ ID NO: 1003716 - protein, 7 aa, Mycobacterium
DDPPQIE

SEQ ID NO: 1003717 - protein, 14 aa, Mycobacterium
DDPQGAFLSAAADA

SEQ ID NO: 1003718 - protein, 15 aa, Mycobacterium
DDPQPGWYDTGTGEL

SEQ ID NO: 1003719 - protein, 6 aa, Mycobacterium
DDPQSE

SEQ ID NO: 1003720 - protein, 28 aa, Mycobacterium
DDPRDDRSGRDKPGNNDPESGSDANPLG

SEQ ID NO: 1003721 - protein, 5 aa, Mycobacterium
DDPRE

SEQ ID NO: 1003722 - protein, 5 aa, Mycobacterium
DDPRL

SEQ ID NO: 1003723 - protein, 9 aa, Mycobacterium
DDPRRATTN

SEQ ID NO: 1003724 - protein, 9 aa, Mycobacterium
DDPSGSANV

SEQ ID NO: 1003725 - protein, 5 aa, Mycobacterium
DDPSL

SEQ ID NO: 1003726 - protein, 5 aa, Mycobacterium
DDPSV

SEQ ID NO: 1003727 - protein, 5 aa, Mycobacterium
DDPTF

SEQ ID NO: 1003728 - protein, 17 aa, Mycobacterium
DDPTPNTSPSSTASGAA

SEQ ID NO: 1003729 - protein, 9 aa, Mycobacterium
DDPTQGQDR

SEQ ID NO: 1003730 - protein, 6 aa, Mycobacterium
DDPVGA

SEQ ID NO: 1003731 - protein, 5 aa, Mycobacterium
DDPVL

SEQ ID NO: 1003732 - protein, 5 aa, Mycobacterium
DDPWP

SEQ ID NO: 1003733 - protein, 7 aa, Mycobacterium
DDPYPRA

SEQ ID NO: 1003734 - protein, 4 aa, Mycobacterium
DDQA

SEQ ID NO: 1003735 - protein, 14 aa, Mycobacterium
DDQAGTDDNAPHET

SEQ ID NO: 1003736 - protein, 8 aa, Mycobacterium
DDQDPATP

SEQ ID NO: 1003737 - protein, 11 aa, Mycobacterium
DDQLSDEARGV

SEQ ID NO: 1003738 - protein, 8 aa, Mycobacterium
DDQLSGEQ

SEQ ID NO: 1003739 - protein, 8 aa, Mycobacterium
DDQPVGTT

SEQ ID NO: 1003740 - protein, 7 aa, Mycobacterium
DDQQRQV

SEQ ID NO: 1003741 - protein, 4 aa, Mycobacterium
DDQR

SEQ ID NO: 1003742 - protein, 9 aa, Mycobacterium
DDQRAAGYA

SEQ ID NO: 1003743 - protein, 9 aa, Mycobacterium
DDQSPTGPA

SEQ ID NO: 1003744 - protein, 9 aa, Mycobacterium
DDQTGSPTY

SEQ ID NO: 1003745 - protein, 8 aa, Mycobacterium
DDQTGVKS

SEQ ID NO: 1003746 - protein, 13 aa, Mycobacterium
DDRAAKAKAAAAL

SEQ ID NO: 1003747 - protein, 14 aa, Mycobacterium
DDRAGLPAGTTSNY

SEQ ID NO: 1003748 - protein, 5 aa, Mycobacterium
DDRAY

SEQ ID NO: 1003749 - protein, 6 aa, Mycobacterium
DDREAV

SEQ ID NO: 1003750 - protein, 6 aa, Mycobacterium
DDRGDG

SEQ ID NO: 1003751 - protein, 5 aa, Mycobacterium
DDRGV

SEQ ID NO: 1003752 - protein, 5 aa, Mycobacterium
DDRHR

SEQ ID NO: 1003753 - protein, 9 aa, Mycobacterium
DDRLGDVRG

SEQ ID NO: 1003754 - protein, 7 aa, Mycobacterium
DDRLRGR

SEQ ID NO: 1003755 - protein, 6 aa, Mycobacterium
DDRNDR

SEQ ID NO: 1003756 - protein, 8 aa, Mycobacterium
DDRPIPMK

SEQ ID NO: 1003757 - protein, 18 aa, Mycobacterium
DDRPVAERAEAKQISAES

SEQ ID NO: 1003758 - protein, 8 aa, Mycobacterium
DDRRDGDV

SEQ ID NO: 1003759 - protein, 9 aa, Mycobacterium
DDRRKAAHR

SEQ ID NO: 1003760 - protein, 4 aa, Mycobacterium
DDRS

SEQ ID NO: 1003761 - protein, 7 aa, Mycobacterium
DDRSAGL

SEQ ID NO: 1003762 - protein, 7 aa, Mycobacterium
DDSAPLT

SEQ ID NO: 1003763 - protein, 7 aa, Mycobacterium
DDSCPPV

SEQ ID NO: 1003764 - protein, 17 aa, Mycobacterium
DDSDPTTRAGGAHTATD

SEQ ID NO: 1003765 - protein, 8 aa, Mycobacterium
DDSESRIS

SEQ ID NO: 1003766 - protein, 6 aa, Mycobacterium
DDSEVA

SEQ ID NO: 1003767 - protein, 7 aa, Mycobacterium
DDSGNGL

SEQ ID NO: 1003768 - protein, 8 aa, Mycobacterium
DDSGVTGP

SEQ ID NO: 1003769 - protein, 7 aa, Mycobacterium
DDSLGEL

SEQ ID NO: 1003770 - protein, 10 aa, Mycobacterium
DDSPYGGGPG

SEQ ID NO: 1003771 - protein, 8 aa, Mycobacterium
DDSRVGAN

SEQ ID NO: 1003772 - protein, 10 aa, Mycobacterium
DDSSGTTSRA

SEQ ID NO: 1003773 - protein, 5 aa, Mycobacterium
DDSVR

SEQ ID NO: 1003774 - protein, 9 aa, Mycobacterium
DDTASAEEF

SEQ ID NO: 1003775 - protein, 9 aa, Mycobacterium
DDTDWSRNT

SEQ ID NO: 1003776 - protein, 6 aa, Mycobacterium
DDTESG

SEQ ID NO: 1003777 - protein, 8 aa, Mycobacterium
DDTESRVE

SEQ ID NO: 1003778 - protein, 11 aa, Mycobacterium
DDTETDTATLR

SEQ ID NO: 1003779 - protein, 6 aa, Mycobacterium
DDTGEL

SEQ ID NO: 1003780 - protein, 7 aa, Mycobacterium
DDTGRYR

SEQ ID NO: 1003781 - protein, 13 aa, Mycobacterium
DDTLAEPRAPYPH

SEQ ID NO: 1003782 - protein, 10 aa, Mycobacterium
DDTLATPAQQ

SEQ ID NO: 1003783 - protein, 10 aa, Mycobacterium
DDTPVASASI

SEQ ID NO: 1003784 - protein, 7 aa, Mycobacterium
DDTRKSF

SEQ ID NO: 1003785 - protein, 8 aa, Mycobacterium
DDTRPTAE

SEQ ID NO: 1003786 - protein, 16 aa, Mycobacterium
DDTSATAMDYPRTDAE

SEQ ID NO: 1003787 - protein, 17 aa, Mycobacterium
DDTSATAMDYPRTDAEY

SEQ ID NO: 1003788 - protein, 5 aa, Mycobacterium
DDTSE

SEQ ID NO: 1003789 - protein, 9 aa, Mycobacterium
DDTSTAEAL

SEQ ID NO: 1003790 - protein, 7 aa, Mycobacterium
DDTTARQ

SEQ ID NO: 1003791 - protein, 5 aa, Mycobacterium
DDVAT

SEQ ID NO: 1003792 - protein, 11 aa, Mycobacterium
DDVDPERAADQ

SEQ ID NO: 1003793 - protein, 7 aa, Mycobacterium
DDVGGSL

SEQ ID NO: 1003794 - protein, 11 aa, Mycobacterium
DDVGRNQFPDA

SEQ ID NO: 1003795 - protein, 6 aa, Mycobacterium
DDYGPD

SEQ ID NO: 1003796 - protein, 8 aa, Mycobacterium
DDYPNSLQ

SEQ ID NO: 1003797 - protein, 14 aa, Mycobacterium
DDYPTTPLPPPSPH

SEQ ID NO: 1003798 - protein, 7 aa, Mycobacterium
DDYQDKA

SEQ ID NO: 1003799 - protein, 11 aa, Mycobacterium
DDYTDPAPATT

SEQ ID NO: 1003800 - protein, 17 aa, Mycobacterium
DDYTSGALDGYDKKDIE

SEQ ID NO: 1003801 - protein, 4 aa, Mycobacterium
DDYV

SEQ ID NO: 1003802 - protein, 6 aa, Mycobacterium
DEAAAE

SEQ ID NO: 1003803 - protein, 12 aa, Mycobacterium
DEAADKAAELAS

SEQ ID NO: 1003804 - protein, 7 aa, Mycobacterium
DEAADLS

SEQ ID NO: 1003805 - protein, 23 aa, Mycobacterium
DEAAKGYSIAGSRSGNDVKVLLK

SEQ ID NO: 1003806 - protein, 5 aa, Mycobacterium
DEADQ

SEQ ID NO: 1003807 - protein, 7 aa, Mycobacterium
DEAEMRA

SEQ ID NO: 1003808 - protein, 7 aa, Mycobacterium
DEAETGI

SEQ ID NO: 1003809 - protein, 4 aa, Mycobacterium
DEAG

SEQ ID NO: 1003810 - protein, 18 aa, Mycobacterium
DEAGPGAHEAAGAAVGQG

SEQ ID NO: 1003811 - protein, 7 aa, Mycobacterium
DEAGRAA

SEQ ID NO: 1003812 - protein, 8 aa, Mycobacterium
DEAHATEE

SEQ ID NO: 1003813 - protein, 7 aa, Mycobacterium
DEAKGAR

SEQ ID NO: 1003814 - protein, 10 aa, Mycobacterium
DEAKSTARRC

SEQ ID NO: 1003815 - protein, 6 aa, Mycobacterium
DEAPER

SEQ ID NO: 1003816 - protein, 8 aa, Mycobacterium
DEAPRHQG

SEQ ID NO: 1003817 - protein, 5 aa, Mycobacterium
DEAQW

SEQ ID NO: 1003818 - protein, 4 aa, Mycobacterium
DEAR

SEQ ID NO: 1003819 - protein, 5 aa, Mycobacterium
DEARA

SEQ ID NO: 1003820 - protein, 8 aa, Mycobacterium
DEARPRAG

SEQ ID NO: 1003821 - protein, 5 aa, Mycobacterium
DEART

SEQ ID NO: 1003822 - protein, 4 aa, Mycobacterium
DEAS

SEQ ID NO: 1003823 - protein, 6 aa, Mycobacterium
DEASAQ

SEQ ID NO: 1003824 - protein, 5 aa, Mycobacterium
DEASN

SEQ ID NO: 1003825 - protein, 22 aa, Mycobacterium
DEATGGGEASDGRAGSAGAEVP

SEQ ID NO: 1003826 - protein, 7 aa, Mycobacterium
DECSPED

SEQ ID NO: 1003827 - protein, 7 aa, Mycobacterium
DEDAPGP

SEQ ID NO: 1003828 - protein, 4 aa, Mycobacterium
DEDD

SEQ ID NO: 1003829 - protein, 10 aa, Mycobacterium
DEDEKLPPRR

SEQ ID NO: 1003830 - protein, 4 aa, Mycobacterium
DEDG

SEQ ID NO: 1003831 - protein, 17 aa, Mycobacterium
DEDGANSKAAMSPETPF

SEQ ID NO: 1003832 - protein, 10 aa, Mycobacterium
DEDGDRPTAA

SEQ ID NO: 1003833 - protein, 12 aa, Mycobacterium
DEDGNDLPGVTT

SEQ ID NO: 1003834 - protein, 8 aa, Mycobacterium
DEDGQGQF

SEQ ID NO: 1003835 - protein, 4 aa, Mycobacterium
DEDL

SEQ ID NO: 1003836 - protein, 7 aa, Mycobacterium
DEDLDAG

SEQ ID NO: 1003837 - protein, 11 aa, Mycobacterium
DEDLQKAAREL

SEQ ID NO: 1003838 - protein, 6 aa, Mycobacterium
DEDPAY

SEQ ID NO: 1003839 - protein, 7 aa, Mycobacterium
DEDPQAA

SEQ ID NO: 1003840 - protein, 5 aa, Mycobacterium
DEDQI

SEQ ID NO: 1003841 - protein, 12 aa, Mycobacterium
DEDRQRAHTGHG

SEQ ID NO: 1003842 - protein, 13 aa, Mycobacterium
DEDRQRTHTGNGA

SEQ ID NO: 1003843 - protein, 6 aa, Mycobacterium
DEDRTG

SEQ ID NO: 1003844 - protein, 9 aa, Mycobacterium
DEDSDERSL

SEQ ID NO: 1003845 - protein, 5 aa, Mycobacterium
DEDSV

SEQ ID NO: 1003846 - protein, 4 aa, Mycobacterium
DEDT

SEQ ID NO: 1003847 - protein, 6 aa, Mycobacterium
DEDTDE

SEQ ID NO: 1003848 - protein, 6 aa, Mycobacterium
DEDVER

SEQ ID NO: 1003849 - protein, 5 aa, Mycobacterium
DEEDR

SEQ ID NO: 1003850 - protein, 7 aa, Mycobacterium
DEELDQA

SEQ ID NO: 1003851 - protein, 40 aa, Mycobacterium; identical to SEQ ID NO: 446890

SEQ ID NO: 1003852 - protein, 6 aa, Mycobacterium
DEESAA

SEQ ID NO: 1003853 - protein, 7 aa, Mycobacterium
DEESASE

SEQ ID NO: 1003854 - protein, 4 aa, Mycobacterium
DEET

SEQ ID NO: 1003855 - protein, 7 aa, Mycobacterium
DEETGKR

SEQ ID NO: 1003856 - protein, 7 aa, Mycobacterium
DEFDDRD

SEQ ID NO: 1003857 - protein, 12 aa, Mycobacterium
DEFGGSLENRAK

SEQ ID NO: 1003858 - protein, 13 aa, Mycobacterium
DEFGQDREGAGLE

SEQ ID NO: 1003859 - protein, 4 aa, Mycobacterium
DEFP

SEQ ID NO: 1003860 - protein, 6 aa, Mycobacterium
DEFTKR

SEQ ID NO: 1003861 - protein, 6 aa, Mycobacterium
DEGADR

SEQ ID NO: 1003862 - protein, 6 aa, Mycobacterium
DEGAEE

SEQ ID NO: 1003863 - protein, 6 aa, Mycobacterium
DEGAGR

SEQ ID NO: 1003864 - protein, 16 aa, Mycobacterium
DEGDEEAGSAVREDEV

SEQ ID NO: 1003865 - protein, 11 aa, Mycobacterium
DEGDSKIGRPR

SEQ ID NO: 1003866 - protein, 4 aa, Mycobacterium
DEGI

SEQ ID NO: 1003867 - protein, 8 aa, Mycobacterium
DEGKAELK

SEQ ID NO: 1003868 - protein, 5 aa, Mycobacterium
DEGLS

SEQ ID NO: 1003869 - protein, 10 aa, Mycobacterium
DEGPRESSLE

SEQ ID NO: 1003870 - protein, 7 aa, Mycobacterium
DEGQQSA

SEQ ID NO: 1003871 - protein, 5 aa, Mycobacterium
DEGRI

SEQ ID NO: 1003872 - protein, 21 aa, Mycobacterium
DEGRNACASGGARRISADDSP

SEQ ID NO: 1003873 - protein, 16 aa, Mycobacterium
DEGRRTKSVVVIRPAT

SEQ ID NO: 1003874 - protein, 4 aa, Mycobacterium
DEGT

SEQ ID NO: 1003875 - protein, 8 aa, Mycobacterium
DEGTAAAE

SEQ ID NO: 1003876 - protein, 5 aa, Mycobacterium
DEGVD

SEQ ID NO: 1003877 - protein, 8 aa, Mycobacterium
DEHADPKV

SEQ ID NO: 1003878 - protein, 12 aa, Mycobacterium
DEHPRADTSVEA

SEQ ID NO: 1003879 - protein, 15 aa, Mycobacterium
DEHPSHSDEAAATEL

SEQ ID NO: 1003880 - protein, 5 aa, Mycobacterium
DEHQQ

SEQ ID NO: 1003881 - protein, 6 aa, Mycobacterium
DEHVGA

SEQ ID NO: 1003882 - protein, 8 aa, Mycobacterium
DEIDEAEY

SEQ ID NO: 1003883 - protein, 5 aa, Mycobacterium
DEIDG

SEQ ID NO: 1003884 - protein, 6 aa, Mycobacterium
DEIGPS

SEQ ID NO: 1003885 - protein, 11 aa, Mycobacterium
DEIPDPQDPQT

SEQ ID NO: 1003886 - protein, 4 aa, Mycobacterium
DEIT

SEQ ID NO: 1003887 - protein, 10 aa, Mycobacterium
DEKASRRGAP

SEQ ID NO: 1003888 - protein, 5 aa, Mycobacterium
DEKGI

SEQ ID NO: 1003889 - protein, 9 aa, Mycobacterium
DEKKTAETF

SEQ ID NO: 1003890 - protein, 6 aa, Mycobacterium
DEKPEL

SEQ ID NO: 1003891 - protein, 5 aa, Mycobacterium
DEKRR

SEQ ID NO: 1003892 - protein, 8 aa, Mycobacterium
DEKTAIDP

SEQ ID NO: 1003893 - protein, 5 aa, Mycobacterium
DELDN

SEQ ID NO: 1003894 - protein, 4 aa, Mycobacterium
DELG

SEQ ID NO: 1003895 - protein, 8 aa, Mycobacterium
DELGGGSL

SEQ ID NO: 1003896 - protein, 8 aa, Mycobacterium
DELGRRDD

SEQ ID NO: 1003897 - protein, 7 aa, Mycobacterium
DELGRSN

SEQ ID NO: 1003898 - protein, 4 aa, Mycobacterium
DELP

SEQ ID NO: 1003899 - protein, 8 aa, Mycobacterium
DELSKDET

SEQ ID NO: 1003900 - protein, 8 aa, Mycobacterium
DELSPSSV

SEQ ID NO: 1003901 - protein, 4 aa, Mycobacterium
DELT

SEQ ID NO: 1003902 - protein, 10 aa, Mycobacterium
DELTRSTHAE

SEQ ID NO: 1003903 - protein, 11 aa, Mycobacterium
DELTRSTHAER

SEQ ID NO: 1003904 - protein, 15 aa, Mycobacterium
DEMNGAHHDRAHHAD

SEQ ID NO: 1003905 - protein, 32 aa, Mycobacterium
DENGDPKAAGDRNAPAAKAKDVATAGKADGTG

SEQ ID NO: 1003906 - protein, 9 aa, Mycobacterium
DENGGYPHP

SEQ ID NO: 1003907 - protein, 11 aa, Mycobacterium
DENLGLGNSGF

SEQ ID NO: 1003908 - protein, 6 aa, Mycobacterium
DENNLG

SEQ ID NO: 1003909 - protein, 11 aa, Mycobacterium
DENRLNPNGGA

SEQ ID NO: 1003910 - protein, 12 aa, Mycobacterium
DENSPATADTLR

SEQ ID NO: 1003911 - protein, 8 aa, Mycobacterium
DENTKPAE

SEQ ID NO: 1003912 - protein, 17 aa, Mycobacterium
DEPADAGKVGASQAYTR

SEQ ID NO: 1003913 - protein, 7 aa, Mycobacterium
DEPAEDN

SEQ ID NO: 1003914 - protein, 7 aa, Mycobacterium
DEPAEYH

SEQ ID NO: 1003915 - protein, 13 aa, Mycobacterium
DEPAPLGGDARAP

SEQ ID NO: 1003916 - protein, 7 aa, Mycobacterium
DEPARRL

SEQ ID NO: 1003917 - protein, 12 aa, Mycobacterium
DEPDGDHGQLDQ

SEQ ID NO: 1003918 - protein, 8 aa, Mycobacterium
DEPDGDLN

SEQ ID NO: 1003919 - protein, 7 aa, Mycobacterium
DEPDSVT

SEQ ID NO: 1003920 - protein, 7 aa, Mycobacterium
DEPGYGE

SEQ ID NO: 1003921 - protein, 5 aa, Mycobacterium
DEPLP

SEQ ID NO: 1003922 - protein, 7 aa, Mycobacterium
DEPQFSQ

SEQ ID NO: 1003923 - protein, 13 aa, Mycobacterium
DEPQNKASEGTPT

SEQ ID NO: 1003924 - protein, 6 aa, Mycobacterium
DEPSAA

SEQ ID NO: 1003925 - protein, 6 aa, Mycobacterium
DEPSAI

SEQ ID NO: 1003926 - protein, 5 aa, Mycobacterium
DEPSF

SEQ ID NO: 1003927 - protein, 8 aa, Mycobacterium
DEPSGQVD

SEQ ID NO: 1003928 - protein, 5 aa, Mycobacterium
DEPSL

SEQ ID NO: 1003929 - protein, 6 aa, Mycobacterium
DEPSSA

SEQ ID NO: 1003930 - protein, 4 aa, Mycobacterium
DEPT

SEQ ID NO: 1003931 - protein, 14 aa, Mycobacterium
DEPTGNLDPDTSKD

SEQ ID NO: 1003932 - protein, 5 aa, Mycobacterium
DEPTL

SEQ ID NO: 1003933 - protein, 7 aa, Mycobacterium
DEPTQAR

SEQ ID NO: 1003934 - protein, 6 aa, Mycobacterium
DEPTVG

SEQ ID NO: 1003935 - protein, 7 aa, Mycobacterium
DEPVPPQ

SEQ ID NO: 1003936 - protein, 16 aa, Mycobacterium
DEQAHRIGQSREPDDG

SEQ ID NO: 1003937 - protein, 5 aa, Mycobacterium
DEQAL

SEQ ID NO: 1003938 - protein, 6 aa, Mycobacterium
DEQDLR

SEQ ID NO: 1003939 - protein, 8 aa, Mycobacterium
DEQDRSRW

SEQ ID NO: 1003940 - protein, 6 aa, Mycobacterium
DEQELG

SEQ ID NO: 1003941 - protein, 6 aa, Mycobacterium
DEQGRP

SEQ ID NO: 1003942 - protein, 5 aa, Mycobacterium
DEQGV

SEQ ID NO: 1003943 - protein, 7 aa, Mycobacterium
DEQIGAS

SEQ ID NO: 1003944 - protein, 7 aa, Mycobacterium
DEQKSTY

SEQ ID NO: 1003945 - protein, 10 aa, Mycobacterium
DEQPGEAELG

SEQ ID NO: 1003946 - protein, 6 aa, Mycobacterium
DEQPIA

SEQ ID NO: 1003947 - protein, 6 aa, Mycobacterium
DEQRPQ

SEQ ID NO: 1003948 - protein, 5 aa, Mycobacterium
DEQRQ

SEQ ID NO: 1003949 - protein, 6 aa, Mycobacterium
DEQRTE

SEQ ID NO: 1003950 - protein, 10 aa, Mycobacterium
DEQSGERPGA

SEQ ID NO: 1003951 - protein, 9 aa, Mycobacterium
DEQVQASAE

SEQ ID NO: 1003952 - protein, 4 aa, Mycobacterium
DERA

SEQ ID NO: 1003953 - protein, 9 aa, Mycobacterium
DERAGTPGL

SEQ ID NO: 1003954 - protein, 6 aa, Mycobacterium
DERASQ

SEQ ID NO: 1003955 - protein, 10 aa, Mycobacterium
DERDDSVPRT

SEQ ID NO: 1003956 - protein, 12 aa, Mycobacterium
DERKGKAPSDHA

SEQ ID NO: 1003957 - protein, 15 aa, Mycobacterium
DERLTESVSRAADSG

SEQ ID NO: 1003958 - protein, 6 aa, Mycobacterium
DERPVA

SEQ ID NO: 1003959 - protein, 6 aa, Mycobacterium
DERSLG

SEQ ID NO: 1003960 - protein, 4 aa, Mycobacterium
DERT

SEQ ID NO: 1003961 - protein, 8 aa, Mycobacterium
DERTARAE

SEQ ID NO: 1003962 - protein, 5 aa, Mycobacterium
DERTP

SEQ ID NO: 1003963 - protein, 8 aa, Mycobacterium
DERTVAPS

SEQ ID NO: 1003964 - protein, 4 aa, Mycobacterium
DERV

SEQ ID NO: 1003965 - protein, 7 aa, Mycobacterium
DERVGAE

SEQ ID NO: 1003966 - protein, 5 aa, Mycobacterium
DESAR

SEQ ID NO: 1003967 - protein, 11 aa, Mycobacterium
DESARGSRRER

SEQ ID NO: 1003968 - protein, 11 aa, Mycobacterium
DESARGTRRER

SEQ ID NO: 1003969 - protein, 12 aa, Mycobacterium
DESDPSKRDPDL

SEQ ID NO: 1003970 - protein, 20 aa, Mycobacterium
DESDQPESRRGSFGKPAPGF

SEQ ID NO: 1003971 - protein, 22 aa, Mycobacterium
DESEALRQARKDAELTASADSV

SEQ ID NO: 1003972 - protein, 8 aa, Mycobacterium
DESEPGTC

SEQ ID NO: 1003973 - protein, 5 aa, Mycobacterium
DESEQ

SEQ ID NO: 1003974 - protein, 5 aa, Mycobacterium
DESFD

SEQ ID NO: 1003975 - protein, 8 aa, Mycobacterium
DESGAQFT

SEQ ID NO: 1003976 - protein, 7 aa, Mycobacterium
DESGGAV

SEQ ID NO: 1003977 - protein, 11 aa, Mycobacterium
DESGNDPLPGA

SEQ ID NO: 1003978 - protein, 9 aa, Mycobacterium
DESGRFRGR

SEQ ID NO: 1003979 - protein, 8 aa, Mycobacterium
DESGTTDN

SEQ ID NO: 1003980 - protein, 5 aa, Mycobacterium
DESIP

SEQ ID NO: 1003981 - protein, 9 aa, Mycobacterium
DESKQVRQP

SEQ ID NO: 1003982 - protein, 7 aa, Mycobacterium
DESNTSG

SEQ ID NO: 1003983 - protein, 8 aa, Mycobacterium
DESPATVA

SEQ ID NO: 1003984 - protein, 11 aa, Mycobacterium
DESPDGTGQLA

SEQ ID NO: 1003985 - protein, 10 aa, Mycobacterium
DESPRAGELG

SEQ ID NO: 1003986 - protein, 7 aa, Mycobacterium
DESPTVV

SEQ ID NO: 1003987 - protein, 8 aa, Mycobacterium
DESQSRAA

SEQ ID NO: 1003988 - protein, 4 aa, Mycobacterium
DESS

SEQ ID NO: 1003989 - protein, 8 aa, Mycobacterium
DESTDIPA

SEQ ID NO: 1003990 - protein, 8 aa, Mycobacterium
DESTKLDE

SEQ ID NO: 1003991 - protein, 10 aa, Mycobacterium
DESTKPANSH

SEQ ID NO: 1003992 - protein, 15 aa, Mycobacterium
DESTPAVAAPAGLRG

SEQ ID NO: 1003993 - protein, 8 aa, Mycobacterium
DESVATGA

SEQ ID NO: 1003994 - protein, 7 aa, Mycobacterium
DETAEYS

SEQ ID NO: 1003995 - protein, 7 aa, Mycobacterium
DETDSAV

SEQ ID NO: 1003996 - protein, 6 aa, Mycobacterium
DETEVT

SEQ ID NO: 1003997 - protein, 11 aa, Mycobacterium
DETGEESGPGD

SEQ ID NO: 1003998 - protein, 5 aa, Mycobacterium
DETGG

SEQ ID NO: 1003999 - protein, 13 aa, Mycobacterium
DETGITPSYQQRE

SEQ ID NO: 1004000 - protein, 9 aa, Mycobacterium
DETGQPPMT

SEQ ID NO: 1004001 - protein, 9 aa, Mycobacterium
DETGSTNAD

SEQ ID NO: 1004002 - protein, 4 aa, Mycobacterium
DETI

SEQ ID NO: 1004003 - protein, 10 aa, Mycobacterium
DETMSGTHTT

SEQ ID NO: 1004004 - protein, 7 aa, Mycobacterium
DETRRRA

SEQ ID NO: 1004005 - protein, 8 aa, Mycobacterium
DETTGQMG

SEQ ID NO: 1004006 - protein, 16 aa, Mycobacterium
DETTLVEGAGDSDAIA

SEQ ID NO: 1004007 - protein, 14 aa, Mycobacterium
DETTRHTLSGGSEQ

SEQ ID NO: 1004008 - protein, 6 aa, Mycobacterium
DETTTT

SEQ ID NO: 1004009 - protein, 4 aa, Mycobacterium
DETV

SEQ ID NO: 1004010 - protein, 7 aa, Mycobacterium
DEVARNE

SEQ ID NO: 1004011 - protein, 10 aa, Mycobacterium
DEVRGTVGRY

SEQ ID NO: 1004012 - protein, 6 aa, Mycobacterium
DEVRTG

SEQ ID NO: 1004013 - protein, 4 aa, Mycobacterium
DEVS

SEQ ID NO: 1004014 - protein, 5 aa, Mycobacterium
DEVSG

SEQ ID NO: 1004015 - protein, 5 aa, Mycobacterium
DEVST

SEQ ID NO: 1004016 - protein, 5 aa, Mycobacterium
DEYAQ

SEQ ID NO: 1004017 - protein, 17 aa, Mycobacterium
DFEDEPVHSPAPTDTYH

SEQ ID NO: 1004018 - protein, 8 aa, Mycobacterium
DFESAGAE

SEQ ID NO: 1004019 - protein, 14 aa, Mycobacterium
DFGENAPKSRQSWP

SEQ ID NO: 1004020 - protein, 18 aa, Mycobacterium
DFGGPGGLGAAGTGGLGG

SEQ ID NO: 1004021 - protein, 4 aa, Mycobacterium
DFGK

SEQ ID NO: 1004022 - protein, 5 aa, Mycobacterium
DFGNK

SEQ ID NO: 1004023 - protein, 6 aa, Mycobacterium
DFKRPR

SEQ ID NO: 1004024 - protein, 4 aa, Mycobacterium
DFPA

SEQ ID NO: 1004025 - protein, 8 aa, Mycobacterium
DFPAPDDP

SEQ ID NO: 1004026 - protein, 8 aa, Mycobacterium
DFPAPSVA

SEQ ID NO: 1004027 - protein, 10 aa, Mycobacterium
DFPGGEPPTD

SEQ ID NO: 1004028 - protein, 4 aa, Mycobacterium
DFRD

SEQ ID NO: 1004029 - protein, 4 aa, Mycobacterium
DFRP

SEQ ID NO: 1004030 - protein, 4 aa, Mycobacterium
DFRT

SEQ ID NO: 1004031 - protein, 6 aa, Mycobacterium
DFSGND

SEQ ID NO: 1004032 - protein, 11 aa, Mycobacterium
DFSKNSGRSEL

SEQ ID NO: 1004033 - protein, 8 aa, Mycobacterium
DFTADGTI

SEQ ID NO: 1004034 - protein, 4 aa, Mycobacterium
DFTD

SEQ ID NO: 1004035 - protein, 6 aa, Mycobacterium
DFTGST

SEQ ID NO: 1004036 - protein, 8 aa, Mycobacterium
DGAAEADL

SEQ ID NO: 1004037 - protein, 16 aa, Mycobacterium
DGAAGTAASPNGGAGG

SEQ ID NO: 1004038 - protein, 14 aa, Mycobacterium
DGAAGTASHPDGYD

SEQ ID NO: 1004039 - protein, 16 aa, Mycobacterium
DGAAGTATDPNGGAGG

SEQ ID NO: 1004040 - protein, 16 aa, Mycobacterium
DGAAGTATNPNGGAGG

SEQ ID NO: 1004041 - protein, 15 aa, Mycobacterium
DGAAGTVANPNGGAG

SEQ ID NO: 1004042 - protein, 14 aa, Mycobacterium
DGAAPSELDSDEHV

SEQ ID NO: 1004043 - protein, 9 aa, Mycobacterium
DGAARDELP

SEQ ID NO: 1004044 - protein, 8 aa, Mycobacterium
DGAASGLR

SEQ ID NO: 1004045 - protein, 7 aa, Mycobacterium
DGAASPV

SEQ ID NO: 1004046 - protein, 10 aa, Mycobacterium
DGADAGAGQH

SEQ ID NO: 1004047 - protein, 10 aa, Mycobacterium
DGADDFGVPE

SEQ ID NO: 1004048 - protein, 15 aa, Mycobacterium
DGADGAPGESGQDGG

SEQ ID NO: 1004049 - protein, 14 aa, Mycobacterium
DGADGAPGQPGGAG

SEQ ID NO: 1004050 - protein, 17 aa, Mycobacterium
DGADGAPGTGQNGGDGG

SEQ ID NO: 1004051 - protein, 17 aa, Mycobacterium
DGADGAPGTGRDGGPGG

SEQ ID NO: 1004052 - protein, 12 aa, Mycobacterium
DGADGDSSEDPD

SEQ ID NO: 1004053 - protein, 4 aa, Mycobacterium
DGAE

SEQ ID NO: 1004054 - protein, 6 aa, Mycobacterium
DGAEAR

SEQ ID NO: 1004055 - protein, 8 aa, Mycobacterium
DGAEFDGQ

SEQ ID NO: 1004056 - protein, 7 aa, Mycobacterium
DGAEKFT

SEQ ID NO: 1004057 - protein, 9 aa, Mycobacterium
DGAEKFTKT

SEQ ID NO: 1004058 - protein, 6 aa, Mycobacterium
DGAELD

SEQ ID NO: 1004059 - protein, 4 aa, Mycobacterium
DGAG

SEQ ID NO: 1004060 - protein, 9 aa, Mycobacterium
DGAGAEHRG

SEQ ID NO: 1004061 - protein, 19 aa, Mycobacterium
DGAGARRVQPTGSGADENT

SEQ ID NO: 1004062 - protein, 9 aa, Mycobacterium
DGAGDASWE

SEQ ID NO: 1004063 - protein, 5 aa, Mycobacterium
DGAGE

SEQ ID NO: 1004064 - protein, 15 aa, Mycobacterium
DGAGGAPGQSGGDGG

SEQ ID NO: 1004065 - protein, 20 aa, Mycobacterium
DGAGGSGAAGSAGGAGGAAG

SEQ ID NO: 1004066 - protein, 22 aa, Mycobacterium
DGAGPLHRSGVEKSRAEADLSS

SEQ ID NO: 1004067 - protein, 16 aa, Mycobacterium
DGANATAAGGDGRPGG

SEQ ID NO: 1004068 - protein, 15 aa, Mycobacterium
DGANGTAPGQAGGAG

SEQ ID NO: 1004069 - protein, 15 aa, Mycobacterium
DGANGTATSPNGGAG

SEQ ID NO: 1004070 - protein, 17 aa, Mycobacterium
DGANGWPNTGGDGGAGG

SEQ ID NO: 1004071 - protein, 4 aa, Mycobacterium
DGAP

SEQ ID NO: 1004072 - protein, 8 aa, Mycobacterium
DGAPAGTR

SEQ ID NO: 1004073 - protein, 8 aa, Mycobacterium
DGAPDMGP

SEQ ID NO: 1004074 - protein, 5 aa, Mycobacterium
DGAPG

SEQ ID NO: 1004075 - protein, 7 aa, Mycobacterium
DGAPLDD

SEQ ID NO: 1004076 - protein, 7 aa, Mycobacterium
DGAPPEI

SEQ ID NO: 1004077 - protein, 8 aa, Mycobacterium
DGAQSGAP

SEQ ID NO: 1004078 - protein, 9 aa, Mycobacterium
DGARLQTGE

SEQ ID NO: 1004079 - protein, 8 aa, Mycobacterium
DGARQRAH

SEQ ID NO: 1004080 - protein, 11 aa, Mycobacterium
DGARSDDLADT

SEQ ID NO: 1004081 - protein, 6 aa, Mycobacterium
DGASGV

SEQ ID NO: 1004082 - protein, 4 aa, Mycobacterium
DGAT

SEQ ID NO: 1004083 - protein, 9 aa, Mycobacterium
DGATSEGDV

SEQ ID NO: 1004084 - protein, 12 aa, Mycobacterium
DGAVDDAARQCA

SEQ ID NO: 1004085 - protein, 5 aa, Mycobacterium
DGAVS

SEQ ID NO: 1004086 - protein, 6 aa, Mycobacterium
DGAYGD

SEQ ID NO: 1004087 - protein, 10 aa, Mycobacterium
DGAYGEAKSA

SEQ ID NO: 1004088 - protein, 12 aa, Mycobacterium
DGDAGESSEAID

SEQ ID NO: 1004089 - protein, 8 aa, Mycobacterium
DGDAGSVH

SEQ ID NO: 1004090 - protein, 7 aa, Mycobacterium
DGDALSI

SEQ ID NO: 1004091 - protein, 6 aa, Mycobacterium
DGDARN

SEQ ID NO: 1004092 - protein, 7 aa, Mycobacterium
DGDATDL

SEQ ID NO: 1004093 - protein, 7 aa, Mycobacterium
DGDDDAV

SEQ ID NO: 1004094 - protein, 4 aa, Mycobacterium
DGDE

SEQ ID NO: 1004095 - protein, 6 aa, Mycobacterium
DGDEGF

SEQ ID NO: 1004096 - protein, 7 aa, Mycobacterium
DGDEREH

SEQ ID NO: 1004097 - protein, 6 aa, Mycobacterium
DGDFSE

SEQ ID NO: 1004098 - protein, 8 aa, Mycobacterium
DGDGAGTV

SEQ ID NO: 1004099 - protein, 8 aa, Mycobacterium
DGDGKAKL

SEQ ID NO: 1004100 - protein, 8 aa, Mycobacterium
DGDGRTVV

SEQ ID NO: 1004101 - protein, 7 aa, Mycobacterium
DGDGTQL

SEQ ID NO: 1004102 - protein, 9 aa, Mycobacterium
DGDGVQATT

SEQ ID NO: 1004103 - protein, 4 aa, Mycobacterium
DGDH

SEQ ID NO: 1004104 - protein, 10 aa, Mycobacterium
DGDHSNLDRA

SEQ ID NO: 1004105 - protein, 5 aa, Mycobacterium
DGDLA

SEQ ID NO: 1004106 - protein, 9 aa, Mycobacterium
DGDLASNQH

SEQ ID NO: 1004107 - protein, 7 aa, Mycobacterium
DGDPAAE

SEQ ID NO: 1004108 - protein, 8 aa, Mycobacterium
DGDPADRF

SEQ ID NO: 1004109 - protein, 7 aa, Mycobacterium
DGDPFYS

SEQ ID NO: 1004110 - protein, 7 aa, Mycobacterium
DGDPGAI

SEQ ID NO: 1004111 - protein, 12 aa, Mycobacterium
DGDPKSREDDTV

SEQ ID NO: 1004112 - protein, 7 aa, Mycobacterium
DGDPTKG

SEQ ID NO: 1004113 - protein, 6 aa, Mycobacterium
DGDPTM

SEQ ID NO: 1004114 - protein, 4 aa, Mycobacterium
DGDR

SEQ ID NO: 1004115 - protein, 8 aa, Mycobacterium
DGDREGEA

SEQ ID NO: 1004116 - protein, 6 aa, Mycobacterium
DGDRIT

SEQ ID NO: 1004117 - protein, 7 aa, Mycobacterium
DGDRLTD

SEQ ID NO: 1004118 - protein, 7 aa, Mycobacterium
DGDTATV

SEQ ID NO: 1004119 - protein, 18 aa, Mycobacterium
DGDTRTGQAAGAVDSDPA

SEQ ID NO: 1004120 - protein, 13 aa, Mycobacterium
DGDTSGGGQQAAL

SEQ ID NO: 1004121 - protein, 7 aa, Mycobacterium
DGDTSMR

SEQ ID NO: 1004122 - protein, 6 aa, Mycobacterium
DGDTTL

SEQ ID NO: 1004123 - protein, 4 aa, Mycobacterium
DGDV

SEQ ID NO: 1004124 - protein, 8 aa, Mycobacterium
DGDVSDED

SEQ ID NO: 1004125 - protein, 6 aa, Mycobacterium
DGDYGE

SEQ ID NO: 1004126 - protein, 10 aa, Mycobacterium
DGEAETGPLA

SEQ ID NO: 1004127 - protein, 7 aa, Mycobacterium
DGEALAR

SEQ ID NO: 1004128 - protein, 8 aa, Mycobacterium
DGEASASP

SEQ ID NO: 1004129 - protein, 6 aa, Mycobacterium
DGEDHR

SEQ ID NO: 1004130 - protein, 6 aa, Mycobacterium
DGEEEF

SEQ ID NO: 1004131 - protein, 5 aa, Mycobacterium
DGEEG

SEQ ID NO: 1004132 - protein, 8 aa, Mycobacterium
DGEEPRAD

SEQ ID NO: 1004133 - protein, 4 aa, Mycobacterium
DGEF

SEQ ID NO: 1004134 - protein, 7 aa, Mycobacterium
DGEGRSV

SEQ ID NO: 1004135 - protein, 4 aa, Mycobacterium
DGEI

SEQ ID NO: 1004136 - protein, 11 aa, Mycobacterium
DGEIDSAARAA

SEQ ID NO: 1004137 - protein, 8 aa, Mycobacterium
DGEKLSDD

SEQ ID NO: 1004138 - protein, 8 aa, Mycobacterium
DGEKSLDD

SEQ ID NO: 1004139 - protein, 5 aa, Mycobacterium
DGELG

SEQ ID NO: 1004140 - protein, 4 aa, Mycobacterium
DGEP

SEQ ID NO: 1004141 - protein, 7 aa, Mycobacterium
DGEPGAG

SEQ ID NO: 1004142 - protein, 8 aa, Mycobacterium
DGEPQGEL

SEQ ID NO: 1004143 - protein, 6 aa, Mycobacterium
DGEPTA

SEQ ID NO: 1004144 - protein, 7 aa, Mycobacterium
DGEPVDV

SEQ ID NO: 1004145 - protein, 7 aa, Mycobacterium
DGEQANH

SEQ ID NO: 1004146 - protein, 5 aa, Mycobacterium
DGERF

SEQ ID NO: 1004147 - protein, 8 aa, Mycobacterium
DGERGQVQ

SEQ ID NO: 1004148 - protein, 16 aa, Mycobacterium
DGERGRARMQREQRAK

SEQ ID NO: 1004149 - protein, 7 aa, Mycobacterium
DGERITR

SEQ ID NO: 1004150 - protein, 8 aa, Mycobacterium
DGESGGAT

SEQ ID NO: 1004151 - protein, 9 aa, Mycobacterium
DGETTRHAT

SEQ ID NO: 1004152 - protein, 4 aa, Mycobacterium
DGFA

SEQ ID NO: 1004153 - protein, 8 aa, Mycobacterium
DGFHPDPS

SEQ ID NO: 1004154 - protein, 16 aa, Mycobacterium
DGGAASGEVELAALNI

SEQ ID NO: 1004155 - protein, 23 aa, Mycobacterium
DGGADGSGAMSTGADGGAGGAAG

SEQ ID NO: 1004156 - protein, 118 aa, Mycobacterium
DGGAGAPGAASFDPNVAGGAGGAGGDAGKIGDGGRGGDGGHGATGTAGDATHLEGGRGSDGGAGGKGGNAGDYGHGGAGGTGGQGGTGGAGLTPGDKGFQGGLGGSGGVGGAGGEGGL

SEQ ID NO: 1004157 - protein, 74 aa, Mycobacterium
DGGAGGAGGAGAQGLTGQTGQTGHDGGAGGAGGAGGAGATATTAGTSGGNGGNGGAGGNGGDGGAGGAGGGTGW

SEQ ID NO: 1004158 - protein, 18 aa, Mycobacterium
DGGAGGAGGKGGTGGQGL

SEQ ID NO: 1004159 - protein, 13 aa, Mycobacterium
DGGAGGAGGPVVP

SEQ ID NO: 1004160 - protein, 35 aa, Mycobacterium
DGGAGGDGGDGGDGGAASGFAGDGGQGGQGAVGGA

SEQ ID NO: 1004161 - protein, 25 aa, Mycobacterium
DGGAGGQGGAAAAGIGGGDPGQGGN

SEQ ID NO: 1004162 - protein, 35 aa, Mycobacterium
DGGAGGQGGVGGMGGTGGAGGSGVAGAHGGNATSA

SEQ ID NO: 1004163 - protein, 24 aa, Mycobacterium
DGGAGGSGAAGSGIAGGDGGAAGL

SEQ ID NO: 1004164 - protein, 22 aa, Mycobacterium
DGGAGGSGAPGLNGGAGGAAGL

SEQ ID NO: 1004165 - protein, 22 aa, Mycobacterium
DGGAGGSGAPGMAGGNGGAAGL

SEQ ID NO: 1004166 - protein, 51 aa, Mycobacterium; identical to SEQ ID NO: 448900

SEQ ID NO: 1004167 - protein, 20 aa, Mycobacterium
DGGAGGSGEAGQAGGAGGAA

SEQ ID NO: 1004168 - protein, 21 aa, Mycobacterium
DGGAGGSGGLEQQGGTGGAAG

SEQ ID NO: 1004169 - protein, 22 aa, Mycobacterium
DGGAGGSGGTGLDGGDGGAAGL

SEQ ID NO: 1004170 - protein, 4 aa, Mycobacterium
DGGC

SEQ ID NO: 1004171 - protein, 4 aa, Mycobacterium
DGGD

SEQ ID NO: 1004172 - protein, 9 aa, Mycobacterium
DGGDEPALS

SEQ ID NO: 1004173 - protein, 67 aa, Mycobacterium
DGGDGGAGGHGGDGGAGGDGNAGSLAGGTGGNGGDAKVIGNGGNGGDGGVRFGGGANGSGGTGGAAG

SEQ ID NO: 1004174 - protein, 41 aa, Mycobacterium
DGGDGGHGGAGFGGGNGSGNPIGGQGGNAGVAGNGGAGGSA

SEQ ID NO: 1004175 - protein, 26 aa, Mycobacterium
DGGDGGSGTPGTATSPAGGAGGAGGS

SEQ ID NO: 1004176 - protein, 9 aa, Mycobacterium
DGGDPRQPI

SEQ ID NO: 1004177 - protein, 6 aa, Mycobacterium
DGGDQV

SEQ ID NO: 1004178 - protein, 10 aa, Mycobacterium
DGGEGGTGAA

SEQ ID NO: 1004179 - protein, 6 aa, Mycobacterium
DGGGAA

SEQ ID NO: 1004180 - protein, 6 aa, Mycobacterium
DGGGAV

SEQ ID NO: 1004181 - protein, 29 aa, Mycobacterium
DGGGGGGGASGGGGGASGGTGGTGGAGGL

SEQ ID NO: 1004182 - protein, 8 aa, Mycobacterium
DGGGKGVT

SEQ ID NO: 1004183 - protein, 8 aa, Mycobacterium
DGGGLGKG

SEQ ID NO: 1004184 - protein, 11 aa, Mycobacterium
DGGGPASADFN

SEQ ID NO: 1004185 - protein, 6 aa, Mycobacterium
DGGGPE

SEQ ID NO: 1004186 - protein, 8 aa, Mycobacterium
DGGGPPDV

SEQ ID NO: 1004187 - protein, 6 aa, Mycobacterium
DGGGSY

SEQ ID NO: 1004188 - protein, 5 aa, Mycobacterium
DGGHE

SEQ ID NO: 1004189 - protein, 5 aa, Mycobacterium
DGGHN

SEQ ID NO: 1004190 - protein, 46 aa, Mycobacterium; identical to SEQ ID NO: 449007

SEQ ID NO: 1004191 - protein, 12 aa, Mycobacterium
DGGKGGDGGAPV

SEQ ID NO: 1004192 - protein, 7 aa, Mycobacterium
DGGKGWP

SEQ ID NO: 1004193 - protein, 6 aa, Mycobacterium
DGGKTS

SEQ ID NO: 1004194 - protein, 5 aa, Mycobacterium
DGGLD

SEQ ID NO: 1004195 - protein, 6 aa, Mycobacterium
DGGNDL

SEQ ID NO: 1004196 - protein, 19 aa, Mycobacterium
DGGNGADAGSPGAGQSSFG

SEQ ID NO: 1004197 - protein, 26 aa, Mycobacterium
DGGNGGIGGAGTGIGGAGGSGGQGGA

SEQ ID NO: 1004198 - protein, 34 aa, Mycobacterium
DGGNGGNGGNGGTGGTPGTGGSGGILIGADGTNG

SEQ ID NO: 1004199 - protein, 20 aa, Mycobacterium
DGGNGGTGATAGVGGTAGTG

SEQ ID NO: 1004200 - protein, 22 aa, Mycobacterium
DGGPGAAATATSAAGRGGDAGL

SEQ ID NO: 1004201 - protein, 95 aa, Mycobacterium
DGGPGSPGAASFDPTVAGGAGGPGGDARGIGDGGRGGDGGPGATGAPGGRGSDGGPGGKGGNAGDYGNTTATAEPAEPAEPAESAGPAAPAHPGN

SEQ ID NO: 1004202 - protein, 5 aa, Mycobacterium
DGGPL

SEQ ID NO: 1004203 - protein, 8 aa, Mycobacterium
DGGPRQGK

SEQ ID NO: 1004204 - protein, 7 aa, Mycobacterium
DGGPTAG

SEQ ID NO: 1004205 - protein, 4 aa, Mycobacterium
DGGR

SEQ ID NO: 1004206 - protein, 5 aa, Mycobacterium
DGGRG

SEQ ID NO: 1004207 - protein, 5 aa, Mycobacterium
DGGRK

SEQ ID NO: 1004208 - protein, 6 aa, Mycobacterium
DGGRSL

SEQ ID NO: 1004209 - protein, 4 aa, Mycobacterium
DGGS

SEQ ID NO: 1004210 - protein, 4 aa, Mycobacterium
DGGT

SEQ ID NO: 1004211 - protein, 21 aa, Mycobacterium
DGGTAAASDSRPVRADALACR

SEQ ID NO: 1004212 - protein, 7 aa, Mycobacterium
DGGTAAD

SEQ ID NO: 1004213 - protein, 9 aa, Mycobacterium
DGGTAVSHG

SEQ ID NO: 1004214 - protein, 20 aa, Mycobacterium
DGGTGAAATATTVAGRGGHA

SEQ ID NO: 1004215 - protein, 24 aa, Mycobacterium
DGGTGGAAGDLASGVGLPGGAGGH

SEQ ID NO: 1004216 - protein, 16 aa, Mycobacterium
DGGTGGDGGQGGGGHL

SEQ ID NO: 1004217 - protein, 153 aa, Mycobacterium
DGGTGGQGGTGLAGADGVNPTPTGTAGTGAAGGNVSGNNPLTGGNGGTGDTGGTGKTGGTGGAGGSATASSGSATGGKGGAGGDPGGGANGGAGGAGGDAESFSGQAHGGAGGDGSQGGIPGGSGGAGGDGGKATGLASGIGGDGGDGGRGFA

SEQ ID NO: 1004218 - protein, 7 aa, Mycobacterium
DGGTRPY

SEQ ID NO: 1004219 - protein, 13 aa, Mycobacterium
DGGTVAGKVIRRS

SEQ ID NO: 1004220 - protein, 4 aa, Mycobacterium
DGGV

SEQ ID NO: 1004221 - protein, 6 aa, Mycobacterium
DGHEQS

SEQ ID NO: 1004222 - protein, 35 aa, Mycobacterium
DGHGDLATARGGPYRSPDGGLHPDSRPHGRRGRRV

SEQ ID NO: 1004223 - protein, 8 aa, Mycobacterium
DGHPAYEA

SEQ ID NO: 1004224 - protein, 9 aa, Mycobacterium
DGHPVGPGA

SEQ ID NO: 1004225 - protein, 9 aa, Mycobacterium
DGHRGPGIT

SEQ ID NO: 1004226 - protein, 5 aa, Mycobacterium
DGHTI

SEQ ID NO: 1004227 - protein, 6 aa, Mycobacterium
DGIAAG

SEQ ID NO: 1004228 - protein, 9 aa, Mycobacterium
DGIAPPDST

SEQ ID NO: 1004229 - protein, 4 aa, Mycobacterium
DGID

SEQ ID NO: 1004230 - protein, 7 aa, Mycobacterium
DGIDGEE

SEQ ID NO: 1004231 - protein, 5 aa, Mycobacterium
DGIPS

SEQ ID NO: 1004232 - protein, 11 aa, Mycobacterium
DGISDDDAAAI

SEQ ID NO: 1004233 - protein, 7 aa, Mycobacterium
DGITESE

SEQ ID NO: 1004234 - protein, 13 aa, Mycobacterium
DGKFSDADRTRQR

SEQ ID NO: 1004235 - protein, 22 aa, Mycobacterium
DGKHAASPHVTAAGAAQPAAGE

SEQ ID NO: 1004236 - protein, 9 aa, Mycobacterium
DGKKVEGTW

SEQ ID NO: 1004237 - protein, 7 aa, Mycobacterium
DGKLGTR

SEQ ID NO: 1004238 - protein, 8 aa, Mycobacterium
DGKLTGDV

SEQ ID NO: 1004239 - protein, 10 aa, Mycobacterium
DGKNGEHREM

SEQ ID NO: 1004240 - protein, 24 aa, Mycobacterium
DGKPFGPLNRSSTPPVISPDPEGI

SEQ ID NO: 1004241 - protein, 9 aa, Mycobacterium
DGKPGHDGT

SEQ ID NO: 1004242 - protein, 8 aa, Mycobacterium
DGKPHGVE

SEQ ID NO: 1004243 - protein, 32 aa, Mycobacterium
DGKPLQSVAKGEVDLDSDGEGSEAEREEQQKE

SEQ ID NO: 1004244 - protein, 9 aa, Mycobacterium
DGKPVETAT

SEQ ID NO: 1004245 - protein, 11 aa, Mycobacterium
DGKRDGGTDEV

SEQ ID NO: 1004246 - protein, 10 aa, Mycobacterium
DGKRTSEMPM

SEQ ID NO: 1004247 - protein, 14 aa, Mycobacterium
DGKTVEAEAAHGTV

SEQ ID NO: 1004248 - protein, 6 aa, Mycobacterium
DGKTWS

SEQ ID NO: 1004249 - protein, 7 aa, Mycobacterium
DGKWTDS

SEQ ID NO: 1004250 - protein, 17 aa, Mycobacterium
DGLATTTTQMRASSPPW

SEQ ID NO: 1004251 - protein, 15 aa, Mycobacterium
DGLEAENTGDDYQAE

SEQ ID NO: 1004252 - protein, 7 aa, Mycobacterium
DGLGPGR

SEQ ID NO: 1004253 - protein, 8 aa, Mycobacterium
DGLPDGPP

SEQ ID NO: 1004254 - protein, 6 aa, Mycobacterium
DGLPDR

SEQ ID NO: 1004255 - protein, 9 aa, Mycobacterium
DGLPDSPGG

SEQ ID NO: 1004256 - protein, 5 aa, Mycobacterium
DGLPS

SEQ ID NO: 1004257 - protein, 10 aa, Mycobacterium
DGLPSTDAGE

SEQ ID NO: 1004258 - protein, 6 aa, Mycobacterium
DGLSPL

SEQ ID NO: 1004259 - protein, 6 aa, Mycobacterium
DGLTGE

SEQ ID NO: 1004260 - protein, 4 aa, Mycobacterium
DGNA

SEQ ID NO: 1004261 - protein, 5 aa, Mycobacterium
DGNAV

SEQ ID NO: 1004262 - protein, 4 aa, Mycobacterium
DGND

SEQ ID NO: 1004263 - protein, 7 aa, Mycobacterium
DGNDVGA

SEQ ID NO: 1004264 - protein, 6 aa, Mycobacterium
DGNIQA

SEQ ID NO: 1004265 - protein, 7 aa, Mycobacterium
DGNPDAL

SEQ ID NO: 1004266 - protein, 10 aa, Mycobacterium
DGNPRGKHGR

SEQ ID NO: 1004267 - protein, 4 aa, Mycobacterium
DGNQ

SEQ ID NO: 1004268 - protein, 10 aa, Mycobacterium
DGNQTPPADW

SEQ ID NO: 1004269 - protein, 6 aa, Mycobacterium
DGNSET

SEQ ID NO: 1004270 - protein, 5 aa, Mycobacterium
DGNVD

SEQ ID NO: 1004271 - protein, 7 aa, Mycobacterium
DGNVRPA

SEQ ID NO: 1004272 - protein, 5 aa, Mycobacterium
DGPAH

SEQ ID NO: 1004273 - protein, 10 aa, Mycobacterium
DGPAPEPAKH

SEQ ID NO: 1004274 - protein, 9 aa, Mycobacterium
DGPAPEPIK

SEQ ID NO: 1004275 - protein, 9 aa, Mycobacterium
DGPAPEVPG

SEQ ID NO: 1004276 - protein, 7 aa, Mycobacterium
DGPAQVR

SEQ ID NO: 1004277 - protein, 5 aa, Mycobacterium
DGPAS

SEQ ID NO: 1004278 - protein, 41 aa, Mycobacterium
DGPAWSTHTETDAPPPPEPTAAAEATASDTAQRVDTTPEAV

SEQ ID NO: 1004279 - protein, 9 aa, Mycobacterium
DGPCTQNGE

SEQ ID NO: 1004280 - protein, 10 aa, Mycobacterium
DGPDADATGI

SEQ ID NO: 1004281 - protein, 7 aa, Mycobacterium
DGPDEVH

SEQ ID NO: 1004282 - protein, 5 aa, Mycobacterium
DGPDG

SEQ ID NO: 1004283 - protein, 8 aa, Mycobacterium
DGPDPECV

SEQ ID NO: 1004284 - protein, 8 aa, Mycobacterium
DGPDPGRV

SEQ ID NO: 1004285 - protein, 16 aa, Mycobacterium
DGPDRERLQARTPERL

SEQ ID NO: 1004286 - protein, 6 aa, Mycobacterium
DGPDYD

SEQ ID NO: 1004287 - protein, 6 aa, Mycobacterium
DGPELS

SEQ ID NO: 1004288 - protein, 9 aa, Mycobacterium
DGPENGGRI

SEQ ID NO: 1004289 - protein, 16 aa, Mycobacterium
DGPESPRATHTSTGAR

SEQ ID NO: 1004290 - protein, 13 aa, Mycobacterium
DGPEVLTASPMWQ

SEQ ID NO: 1004291 - protein, 9 aa, Mycobacterium
DGPGAQTPL

SEQ ID NO: 1004292 - protein, 9 aa, Mycobacterium
DGPGGQPAL

SEQ ID NO: 1004293 - protein, 8 aa, Mycobacterium
DGPHRAAA

SEQ ID NO: 1004294 - protein, 5 aa, Mycobacterium
DGPLA

SEQ ID NO: 1004295 - protein, 7 aa, Mycobacterium
DGPMPQT

SEQ ID NO: 1004296 - protein, 8 aa, Mycobacterium
DGPNGDAF

SEQ ID NO: 1004297 - protein, 10 aa, Mycobacterium
DGPQYNKEQG

SEQ ID NO: 1004298 - protein, 4 aa, Mycobacterium
DGPS

SEQ ID NO: 1004299 - protein, 5 aa, Mycobacterium
DGPSV

SEQ ID NO: 1004300 - protein, 5 aa, Mycobacterium
DGPTY

SEQ ID NO: 1004301 - protein, 4 aa, Mycobacterium
DGPV

SEQ ID NO: 1004302 - protein, 8 aa, Mycobacterium
DGPVPADR

SEQ ID NO: 1004303 - protein, 8 aa, Mycobacterium
DGPVRGNG

SEQ ID NO: 1004304 - protein, 23 aa, Mycobacterium
DGPVSRDAADRDSRSVSQRQHDG

SEQ ID NO: 1004305 - protein, 8 aa, Mycobacterium
DGPVTSPT

SEQ ID NO: 1004306 - protein, 4 aa, Mycobacterium
DGQA

SEQ ID NO: 1004307 - protein, 19 aa, Mycobacterium
DGQADGSIRPELSATTTAN

SEQ ID NO: 1004308 - protein, 6 aa, Mycobacterium
DGQAEK

SEQ ID NO: 1004309 - protein, 11 aa, Mycobacterium
DGQARAGAGDL

SEQ ID NO: 1004310 - protein, 26 aa, Mycobacterium
DGQGQPAAPPAQQPLRHGAGTPAPTR

SEQ ID NO: 1004311 - protein, 6 aa, Mycobacterium
DGQGRG

SEQ ID NO: 1004312 - protein, 5 aa, Mycobacterium
DGQHR

SEQ ID NO: 1004313 - protein, 5 aa, Mycobacterium
DGQKF

SEQ ID NO: 1004314 - protein, 7 aa, Mycobacterium
DGQKRLK

SEQ ID NO: 1004315 - protein, 4 aa, Mycobacterium
DGQL

SEQ ID NO: 1004316 - protein, 5 aa, Mycobacterium
DGQLD

SEQ ID NO: 1004317 - protein, 14 aa, Mycobacterium
DGQLGDDEGEPGAR

SEQ ID NO: 1004318 - protein, 7 aa, Mycobacterium
DGQPRTL

SEQ ID NO: 1004319 - protein, 8 aa, Mycobacterium
DGQPRTLD

SEQ ID NO: 1004320 - protein, 32 aa, Mycobacterium
DGQRAQVRGSAGATGSALAARAAEREADGGVG

SEQ ID NO: 1004321 - protein, 7 aa, Mycobacterium
DGQRLTP

SEQ ID NO: 1004322 - protein, 5 aa, Mycobacterium
DGQSK

SEQ ID NO: 1004323 - protein, 6 aa, Mycobacterium
DGQSTE

SEQ ID NO: 1004324 - protein, 6 aa, Mycobacterium
DGQTVG

SEQ ID NO: 1004325 - protein, 7 aa, Mycobacterium
DGQTVSA

SEQ ID NO: 1004326 - protein, 4 aa, Mycobacterium
DGQV

SEQ ID NO: 1004327 - protein, 18 aa, Mycobacterium
DGQVERVQPSRRGPGRPP

SEQ ID NO: 1004328 - protein, 4 aa, Mycobacterium
DGQY

SEQ ID NO: 1004329 - protein, 14 aa, Mycobacterium
DGRAEEVGASGPDI

SEQ ID NO: 1004330 - protein, 7 aa, Mycobacterium
DGRASFS

SEQ ID NO: 1004331 - protein, 5 aa, Mycobacterium
DGRAT

SEQ ID NO: 1004332 - protein, 7 aa, Mycobacterium
DGRDDSG

SEQ ID NO: 1004333 - protein, 5 aa, Mycobacterium
DGRDG

SEQ ID NO: 1004334 - protein, 14 aa, Mycobacterium
DGRDPAETLRDGSA

SEQ ID NO: 1004335 - protein, 10 aa, Mycobacterium
DGRDPDPRAS

SEQ ID NO: 1004336 - protein, 4 aa, Mycobacterium
DGRE

SEQ ID NO: 1004337 - protein, 5 aa, Mycobacterium
DGREP

SEQ ID NO: 1004338 - protein, 8 aa, Mycobacterium
DGREVTPT

SEQ ID NO: 1004339 - protein, 13 aa, Mycobacterium
DGRFSDADQARQR

SEQ ID NO: 1004340 - protein, 4 aa, Mycobacterium
DGRG

SEQ ID NO: 1004341 - protein, 8 aa, Mycobacterium
DGRGLPSG

SEQ ID NO: 1004342 - protein, 7 aa, Mycobacterium
DGRGQAA

SEQ ID NO: 1004343 - protein, 8 aa, Mycobacterium
DGRGSRTV

SEQ ID NO: 1004344 - protein, 8 aa, Mycobacterium
DGRGSTVR

SEQ ID NO: 1004345 - protein, 9 aa, Mycobacterium
DGRKPVTRK

SEQ ID NO: 1004346 - protein, 4 aa, Mycobacterium
DGRL

SEQ ID NO: 1004347 - protein, 12 aa, Mycobacterium
DGRLRSGQLEFA

SEQ ID NO: 1004348 - protein, 10 aa, Mycobacterium
DGRPAGSAPA

SEQ ID NO: 1004349 - protein, 13 aa, Mycobacterium
DGRPGDPKLGAHN

SEQ ID NO: 1004350 - protein, 7 aa, Mycobacterium
DGRPHAL

SEQ ID NO: 1004351 - protein, 6 aa, Mycobacterium
DGRPHH

SEQ ID NO: 1004352 - protein, 9 aa, Mycobacterium
DGRPPEAAG

SEQ ID NO: 1004353 - protein, 6 aa, Mycobacterium
DGRPYN

SEQ ID NO: 1004354 - protein, 8 aa, Mycobacterium
DGRRRGVT

SEQ ID NO: 1004355 - protein, 10 aa, Mycobacterium
DGRSAPLPDF

SEQ ID NO: 1004356 - protein, 6 aa, Mycobacterium
DGRSGS

SEQ ID NO: 1004357 - protein, 4 aa, Mycobacterium
DGRT

SEQ ID NO: 1004358 - protein, 10 aa, Mycobacterium
DGRTDTSTVG

SEQ ID NO: 1004359 - protein, 6 aa, Mycobacterium
DGRTIA

SEQ ID NO: 1004360 - protein, 7 aa, Mycobacterium
DGRTRTR

SEQ ID NO: 1004361 - protein, 4 aa, Mycobacterium
DGRV

SEQ ID NO: 1004362 - protein, 9 aa, Mycobacterium
DGRVEDPVG

SEQ ID NO: 1004363 - protein, 6 aa, Mycobacterium
DGRYGP

SEQ ID NO: 1004364 - protein, 14 aa, Mycobacterium
DGRYRTQAAHQAPD

SEQ ID NO: 1004365 - protein, 17 aa, Mycobacterium
DGSAAASGSAQLTVGEQ

SEQ ID NO: 1004366 - protein, 4 aa, Mycobacterium
DGSD

SEQ ID NO: 1004367 - protein, 9 aa, Mycobacterium
DGSDIGGGA

SEQ ID NO: 1004368 - protein, 10 aa, Mycobacterium
DGSDKDYQRY

SEQ ID NO: 1004369 - protein, 8 aa, Mycobacterium
DGSDSSLR

SEQ ID NO: 1004370 - protein, 8 aa, Mycobacterium
DGSDTGYA

SEQ ID NO: 1004371 - protein, 5 aa, Mycobacterium
DGSEP

SEQ ID NO: 1004372 - protein, 11 aa, Mycobacterium
DGSGETDEDQK

SEQ ID NO: 1004373 - protein, 5 aa, Mycobacterium
DGSGL

SEQ ID NO: 1004374 - protein, 10 aa, Mycobacterium
DGSGPSGTDV

SEQ ID NO: 1004375 - protein, 5 aa, Mycobacterium
DGSGR

SEQ ID NO: 1004376 - protein, 9 aa, Mycobacterium
DGSGRTYQL

SEQ ID NO: 1004377 - protein, 6 aa, Mycobacterium
DGSGTL

SEQ ID NO: 1004378 - protein, 19 aa, Mycobacterium
DGSGTLSGAQIPVDKGALK

SEQ ID NO: 1004379 - protein, 8 aa, Mycobacterium
DGSGTTDN

SEQ ID NO: 1004380 - protein, 7 aa, Mycobacterium
DGSKEEM

SEQ ID NO: 1004381 - protein, 8 aa, Mycobacterium
DGSMDPAD

SEQ ID NO: 1004382 - protein, 9 aa, Mycobacterium
DGSNLPPRR

SEQ ID NO: 1004383 - protein, 10 aa, Mycobacterium
DGSPAAEAAT

SEQ ID NO: 1004384 - protein, 12 aa, Mycobacterium
DGSPAGGGSAAH

SEQ ID NO: 1004385 - protein, 9 aa, Mycobacterium
DGSPDGSLD

SEQ ID NO: 1004386 - protein, 11 aa, Mycobacterium
DGSPDGTGELA

SEQ ID NO: 1004387 - protein, 9 aa, Mycobacterium
DGSPGSDAA

SEQ ID NO: 1004388 - protein, 8 aa, Mycobacterium
DGSPQGRT

SEQ ID NO: 1004389 - protein, 8 aa, Mycobacterium
DGSPTGAI

SEQ ID NO: 1004390 - protein, 8 aa, Mycobacterium
DGSPTSEL

SEQ ID NO: 1004391 - protein, 4 aa, Mycobacterium
DGSQ

SEQ ID NO: 1004392 - protein, 7 aa, Mycobacterium
DGSQLTG

SEQ ID NO: 1004393 - protein, 4 aa, Mycobacterium
DGSS

SEQ ID NO: 1004394 - protein, 8 aa, Mycobacterium
DGSSQTTL

SEQ ID NO: 1004395 - protein, 8 aa, Mycobacterium
DGSSRAAG

SEQ ID NO: 1004396 - protein, 10 aa, Mycobacterium
DGSTDGTGDI

SEQ ID NO: 1004397 - protein, 6 aa, Mycobacterium
DGSTGL

SEQ ID NO: 1004398 - protein, 6 aa, Mycobacterium
DGSTLR

SEQ ID NO: 1004399 - protein, 8 aa, Mycobacterium
DGSTNLGA

SEQ ID NO: 1004400 - protein, 10 aa, Mycobacterium
DGSWPNTIPR

SEQ ID NO: 1004401 - protein, 7 aa, Mycobacterium
DGSYGVP

SEQ ID NO: 1004402 - protein, 4 aa, Mycobacterium
DGTA

SEQ ID NO: 1004403 - protein, 8 aa, Mycobacterium
DGTADGER

SEQ ID NO: 1004404 - protein, 5 aa, Mycobacterium
DGTCD

SEQ ID NO: 1004405 - protein, 5 aa, Mycobacterium
DGTDV

SEQ ID NO: 1004406 - protein, 8 aa, Mycobacterium
DGTEAALQ

SEQ ID NO: 1004407 - protein, 16 aa, Mycobacterium
DGTEKVTKTDMISESK

SEQ ID NO: 1004408 - protein, 6 aa, Mycobacterium
DGTELA

SEQ ID NO: 1004409 - protein, 4 aa, Mycobacterium
DGTF

SEQ ID NO: 1004410 - protein, 30 aa, Mycobacterium
DGTGGAGSIAGAGGDAGLFGSGGNGGFNGY

SEQ ID NO: 1004411 - protein, 6 aa, Mycobacterium
DGTGGT

SEQ ID NO: 1004412 - protein, 6 aa, Mycobacterium
DGTGKV

SEQ ID NO: 1004413 - protein, 5 aa, Mycobacterium
DGTGL

SEQ ID NO: 1004414 - protein, 8 aa, Mycobacterium
DGTGQVDV

SEQ ID NO: 1004415 - protein, 8 aa, Mycobacterium
DGTHHQHE

SEQ ID NO: 1004416 - protein, 13 aa, Mycobacterium
DGTHKTMPVRPDQ

SEQ ID NO: 1004417 - protein, 5 aa, Mycobacterium
DGTIT

SEQ ID NO: 1004418 - protein, 8 aa, Mycobacterium
DGTLGGPV

SEQ ID NO: 1004419 - protein, 6 aa, Mycobacterium
DGTLPG

SEQ ID NO: 1004420 - protein, 9 aa, Mycobacterium
DGTLPPAAG

SEQ ID NO: 1004421 - protein, 4 aa, Mycobacterium
DGTP

SEQ ID NO: 1004422 - protein, 20 aa, Mycobacterium
DGTPPPAPAAKKKSANRSDF

SEQ ID NO: 1004423 - protein, 5 aa, Mycobacterium
DGTQV

SEQ ID NO: 1004424 - protein, 4 aa, Mycobacterium
DGTR

SEQ ID NO: 1004425 - protein, 6 aa, Mycobacterium
DGTREF

SEQ ID NO: 1004426 - protein, 6 aa, Mycobacterium
DGTRHT

SEQ ID NO: 1004427 - protein, 6 aa, Mycobacterium
DGTRRT

SEQ ID NO: 1004428 - protein, 5 aa, Mycobacterium
DGTRT

SEQ ID NO: 1004429 - protein, 4 aa, Mycobacterium
DGTS

SEQ ID NO: 1004430 - protein, 7 aa, Mycobacterium
DGTSALP

SEQ ID NO: 1004431 - protein, 12 aa, Mycobacterium
DGTSIGAADGPT

SEQ ID NO: 1004432 - protein, 5 aa, Mycobacterium
DGTTR

SEQ ID NO: 1004433 - protein, 7 aa, Mycobacterium
DGTVTEG

SEQ ID NO: 1004434 - protein, 8 aa, Mycobacterium
DGVATAQR

SEQ ID NO: 1004435 - protein, 7 aa, Mycobacterium
DGVDPAL

SEQ ID NO: 1004436 - protein, 6 aa, Mycobacterium
DGVESI

SEQ ID NO: 1004437 - protein, 6 aa, Mycobacterium
DGVGGT

SEQ ID NO: 1004438 - protein, 18 aa, Mycobacterium
DGVGIAPGRLDEAAGQGH

SEQ ID NO: 1004439 - protein, 9 aa, Mycobacterium
DGVGKSPQQ

SEQ ID NO: 1004440 - protein, 5 aa, Mycobacterium
DGVGV

SEQ ID NO: 1004441 - protein, 7 aa, Mycobacterium
DGVGWGE

SEQ ID NO: 1004442 - protein, 5 aa, Mycobacterium
DGVRA

SEQ ID NO: 1004443 - protein, 6 aa, Mycobacterium
DGVRST

SEQ ID NO: 1004444 - protein, 5 aa, Mycobacterium
DGVRT

SEQ ID NO: 1004445 - protein, 5 aa, Mycobacterium
DGVSA

SEQ ID NO: 1004446 - protein, 6 aa, Mycobacterium
DGVSPG

SEQ ID NO: 1004447 - protein, 10 aa, Mycobacterium
DGVTDVPASA

SEQ ID NO: 1004448 - protein, 12 aa, Mycobacterium
DGWQSASHTAKE

SEQ ID NO: 1004449 - protein, 4 aa, Mycobacterium
DGYA

SEQ ID NO: 1004450 - protein, 5 aa, Mycobacterium
DGYEE

SEQ ID NO: 1004451 - protein, 8 aa, Mycobacterium
DGYGHGAT

SEQ ID NO: 1004452 - protein, 5 aa, Mycobacterium
DGYPH

SEQ ID NO: 1004453 - protein, 29 aa, Mycobacterium
DGYPTTVDPPAAEPSAVSEHGANASEFSR

SEQ ID NO: 1004454 - protein, 5 aa, Mycobacterium
DGYSE

SEQ ID NO: 1004455 - protein, 6 aa, Mycobacterium
DGYSEN

SEQ ID NO: 1004456 - protein, 9 aa, Mycobacterium
DGYVRSEGG

SEQ ID NO: 1004457 - protein, 5 aa, Mycobacterium
DHAAA

SEQ ID NO: 1004458 - protein, 9 aa, Mycobacterium
DHAASSTDT

SEQ ID NO: 1004459 - protein, 8 aa, Mycobacterium
DHAGNGAP

SEQ ID NO: 1004460 - protein, 8 aa, Mycobacterium
DHATPTAL

SEQ ID NO: 1004461 - protein, 12 aa, Mycobacterium
DHDEHDHPREQR

SEQ ID NO: 1004462 - protein, 6 aa, Mycobacterium
DHDGTE

SEQ ID NO: 1004463 - protein, 7 aa, Mycobacterium
DHDQTER

SEQ ID NO: 1004464 - protein, 8 aa, Mycobacterium
DHDYETKK

SEQ ID NO: 1004465 - protein, 4 aa, Mycobacterium
DHEG

SEQ ID NO: 1004466 - protein, 10 aa, Mycobacterium
DHEPSAAEGS

SEQ ID NO: 1004467 - protein, 6 aa, Mycobacterium
DHETGR

SEQ ID NO: 1004468 - protein, 11 aa, Mycobacterium
DHGDAAEAIQR

SEQ ID NO: 1004469 - protein, 13 aa, Mycobacterium
DHGDDGGAAEAAN

SEQ ID NO: 1004470 - protein, 11 aa, Mycobacterium
DHGDFGGEQAR

SEQ ID NO: 1004471 - protein, 7 aa, Mycobacterium
DHGGKGI

SEQ ID NO: 1004472 - protein, 6 aa, Mycobacterium
DHGGSF

SEQ ID NO: 1004473 - protein, 6 aa, Mycobacterium
DHGGSL

SEQ ID NO: 1004474 - protein, 4 aa, Mycobacterium
DHGP

SEQ ID NO: 1004475 - protein, 6 aa, Mycobacterium
DHGRPL

SEQ ID NO: 1004476 - protein, 6 aa, Mycobacterium
DHGRTG

SEQ ID NO: 1004477 - protein, 11 aa, Mycobacterium
DHGTDPKTRGA

SEQ ID NO: 1004478 - protein, 8 aa, Mycobacterium
DHHATPSQ

SEQ ID NO: 1004479 - protein, 9 aa, Mycobacterium
DHLDSTRAV

SEQ ID NO: 1004480 - protein, 7 aa, Mycobacterium
DHNPAER

SEQ ID NO: 1004481 - protein, 10 aa, Mycobacterium
DHNPVHTDRS

SEQ ID NO: 1004482 - protein, 18 aa, Mycobacterium
DHNTGNFNTGQSNTGSLN

SEQ ID NO: 1004483 - protein, 5 aa, Mycobacterium
DHNVP

SEQ ID NO: 1004484 - protein, 7 aa, Mycobacterium
DHPAPSQ

SEQ ID NO: 1004485 - protein, 6 aa, Mycobacterium
DHPDDV

SEQ ID NO: 1004486 - protein, 13 aa, Mycobacterium
DHPGAEGVWRDSG

SEQ ID NO: 1004487 - protein, 6 aa, Mycobacterium
DHPGAR

SEQ ID NO: 1004488 - protein, 9 aa, Mycobacterium
DHPGARPIG

SEQ ID NO: 1004489 - protein, 7 aa, Mycobacterium
DHPGDPR

SEQ ID NO: 1004490 - protein, 5 aa, Mycobacterium
DHPGR

SEQ ID NO: 1004491 - protein, 6 aa, Mycobacterium
DHPGRA

SEQ ID NO: 1004492 - protein, 9 aa, Mycobacterium
DHPHADTET

SEQ ID NO: 1004493 - protein, 9 aa, Mycobacterium
DHPLNDPFT

SEQ ID NO: 1004494 - protein, 16 aa, Mycobacterium
DHPLRRDTRSERQRTQ

SEQ ID NO: 1004495 - protein, 6 aa, Mycobacterium
DHPNGR

SEQ ID NO: 1004496 - protein, 10 aa, Mycobacterium
DHPPSSTSTG

SEQ ID NO: 1004497 - protein, 7 aa, Mycobacterium
DHPRTAA

SEQ ID NO: 1004498 - protein, 7 aa, Mycobacterium
DHPSAKA

SEQ ID NO: 1004499 - protein, 7 aa, Mycobacterium
DHPSRDA

SEQ ID NO: 1004500 - protein, 31 aa, Mycobacterium
DHQESSEQHHGRQPWSKSRDFTNDPQRGAAV

SEQ ID NO: 1004501 - protein, 6 aa, Mycobacterium
DHQPAS

SEQ ID NO: 1004502 - protein, 21 aa, Mycobacterium
DHQPHRGGRPGVRHRPDAPAA

SEQ ID NO: 1004503 - protein, 11 aa, Mycobacterium
DHRGRAAQGDD

SEQ ID NO: 1004504 - protein, 9 aa, Mycobacterium
DHRSYAGTV

SEQ ID NO: 1004505 - protein, 12 aa, Mycobacterium
DHSAAAPIPTSS

SEQ ID NO: 1004506 - protein, 17 aa, Mycobacterium
DHSAPRPDPRASGRSIG

SEQ ID NO: 1004507 - protein, 4 aa, Mycobacterium
DHSD

SEQ ID NO: 1004508 - protein, 8 aa, Mycobacterium
DHTAARRE

SEQ ID NO: 1004509 - protein, 6 aa, Mycobacterium
DHTGET

SEQ ID NO: 1004510 - protein, 20 aa, Mycobacterium
DHTPAVPRTAADRRPPVAAG

SEQ ID NO: 1004511 - protein, 7 aa, Mycobacterium
DHVPPDD

SEQ ID NO: 1004512 - protein, 18 aa, Mycobacterium
DHYQRDAGGGVSDTTTSI

SEQ ID NO: 1004513 - protein, 10 aa, Mycobacterium
DIAAASSADT

SEQ ID NO: 1004514 - protein, 8 aa, Mycobacterium
DIADYDPD

SEQ ID NO: 1004515 - protein, 7 aa, Mycobacterium
DIAPGKP

SEQ ID NO: 1004516 - protein, 12 aa, Mycobacterium
DIAPTDATEATR

SEQ ID NO: 1004517 - protein, 6 aa, Mycobacterium
DIARAA

SEQ ID NO: 1004518 - protein, 5 aa, Mycobacterium
DIARG

SEQ ID NO: 1004519 - protein, 9 aa, Mycobacterium
DIARPGSDR

SEQ ID NO: 1004520 - protein, 9 aa, Mycobacterium
DIDAARAEK

SEQ ID NO: 1004521 - protein, 8 aa, Mycobacterium
DIDEPTAN

SEQ ID NO: 1004522 - protein, 11 aa, Mycobacterium
DIDGPPPTLPI

SEQ ID NO: 1004523 - protein, 8 aa, Mycobacterium
DIDSEGEL

SEQ ID NO: 1004524 - protein, 12 aa, Mycobacterium
DIEDSRGERDAR

SEQ ID NO: 1004525 - protein, 9 aa, Mycobacterium
DIEESPSGL

SEQ ID NO: 1004526 - protein, 11 aa, Mycobacterium
DIEGPGSPLSA

SEQ ID NO: 1004527 - protein, 5 aa, Mycobacterium
DIENL

SEQ ID NO: 1004528 - protein, 4 aa, Mycobacterium
DIEQ

SEQ ID NO: 1004529 - protein, 4 aa, Mycobacterium
DIER

SEQ ID NO: 1004530 - protein, 8 aa, Mycobacterium
DIGAKSSA

SEQ ID NO: 1004531 - protein, 10 aa, Mycobacterium
DIGDGTPDDL

SEQ ID NO: 1004532 - protein, 11 aa, Mycobacterium
DIGGGNTGKRL

SEQ ID NO: 1004533 - protein, 8 aa, Mycobacterium
DIGQPASV

SEQ ID NO: 1004534 - protein, 7 aa, Mycobacterium
DINPQDL

SEQ ID NO: 1004535 - protein, 9 aa, Mycobacterium
DIPARSAEF

SEQ ID NO: 1004536 - protein, 4 aa, Mycobacterium
DIPP

SEQ ID NO: 1004537 - protein, 5 aa, Mycobacterium
DIPPG

SEQ ID NO: 1004538 - protein, 19 aa, Mycobacterium
DIPSSTRADHQAVPNSPHR

SEQ ID NO: 1004539 - protein, 13 aa, Mycobacterium
DIPSTLTTPEAPT

SEQ ID NO: 1004540 - protein, 10 aa, Mycobacterium
DIQGGTTAEG

SEQ ID NO: 1004541 - protein, 6 aa, Mycobacterium
DIRDPH

SEQ ID NO: 1004542 - protein, 4 aa, Mycobacterium
DIRN

SEQ ID NO: 1004543 - protein, 7 aa, Mycobacterium
DISDTAS

SEQ ID NO: 1004544 - protein, 7 aa, Mycobacterium
DISGCRP

SEQ ID NO: 1004545 - protein, 5 aa, Mycobacterium
DISRK

SEQ ID NO: 1004546 - protein, 6 aa, Mycobacterium
DITDGA

SEQ ID NO: 1004547 - protein, 5 aa, Mycobacterium
DITPT

SEQ ID NO: 1004548 - protein, 11 aa, Mycobacterium
DITRGKPDPQG

SEQ ID NO: 1004549 - protein, 7 aa, Mycobacterium
DITTAPP

SEQ ID NO: 1004550 - protein, 10 aa, Mycobacterium
DKAATTDQQA

SEQ ID NO: 1004551 - protein, 11 aa, Mycobacterium
DKAETKARYGE

SEQ ID NO: 1004552 - protein, 8 aa, Mycobacterium
DKAGIDPE

SEQ ID NO: 1004553 - protein, 7 aa, Mycobacterium
DKARAAK

SEQ ID NO: 1004554 - protein, 7 aa, Mycobacterium
DKARREL

SEQ ID NO: 1004555 - protein, 4 aa, Mycobacterium
DKAS

SEQ ID NO: 1004556 - protein, 13 aa, Mycobacterium
DKATAAAAPSVQA

SEQ ID NO: 1004557 - protein, 7 aa, Mycobacterium
DKATSIE

SEQ ID NO: 1004558 - protein, 18 aa, Mycobacterium
DKAVPRNAGKGSAKTLPK

SEQ ID NO: 1004559 - protein, 19 aa, Mycobacterium
DKAVSTAVTGRVQNNGQSC

SEQ ID NO: 1004560 - protein, 8 aa, Mycobacterium
DKDADEYF

SEQ ID NO: 1004561 - protein, 6 aa, Mycobacterium
DKDLTA

SEQ ID NO: 1004562 - protein, 5 aa, Mycobacterium
DKDMT

SEQ ID NO: 1004563 - protein, 7 aa, Mycobacterium
DKDNLGR

SEQ ID NO: 1004564 - protein, 10 aa, Mycobacterium
DKDRKLSETP

SEQ ID NO: 1004565 - protein, 14 aa, Mycobacterium
DKDTKATFSDEESE

SEQ ID NO: 1004566 - protein, 9 aa, Mycobacterium
DKDVPSAWS

SEQ ID NO: 1004567 - protein, 4 aa, Mycobacterium
DKEA

SEQ ID NO: 1004568 - protein, 8 aa, Mycobacterium
DKEIDADA

SEQ ID NO: 1004569 - protein, 7 aa, Mycobacterium
DKGEKDQ

SEQ ID NO: 1004570 - protein, 5 aa, Mycobacterium
DKGKL

SEQ ID NO: 1004571 - protein, 17 aa, Mycobacterium
DKGLDAARTDPNYADQD

SEQ ID NO: 1004572 - protein, 8 aa, Mycobacterium
DKGLGRKG

SEQ ID NO: 1004573 - protein, 8 aa, Mycobacterium
DKGLTSKP

SEQ ID NO: 1004574 - protein, 4 aa, Mycobacterium
DKGR

SEQ ID NO: 1004575 - protein, 10 aa, Mycobacterium
DKGSAGEQRF

SEQ ID NO: 1004576 - protein, 7 aa, Mycobacterium
DKGTATF

SEQ ID NO: 1004577 - protein, 5 aa, Mycobacterium
DKGVR

SEQ ID NO: 1004578 - protein, 7 aa, Mycobacterium
DKHGDPV

SEQ ID NO: 1004579 - protein, 5 aa, Mycobacterium
DKHSE

SEQ ID NO: 1004580 - protein, 5 aa, Mycobacterium
DKISS

SEQ ID NO: 1004581 - protein, 7 aa, Mycobacterium
DKKTRAG

SEQ ID NO: 1004582 - protein, 6 aa, Mycobacterium
DKLDET

SEQ ID NO: 1004583 - protein, 6 aa, Mycobacterium
DKMGHD

SEQ ID NO: 1004584 - protein, 7 aa, Mycobacterium
DKMGHDL

SEQ ID NO: 1004585 - protein, 17 aa, Mycobacterium
DKPAEPEDDGHGHHGHA

SEQ ID NO: 1004586 - protein, 8 aa, Mycobacterium
DKPGGAQA

SEQ ID NO: 1004587 - protein, 7 aa, Mycobacterium
DKPGGGH

SEQ ID NO: 1004588 - protein, 9 aa, Mycobacterium
DKPLGTGGG

SEQ ID NO: 1004589 - protein, 6 aa, Mycobacterium
DKPMSP

SEQ ID NO: 1004590 - protein, 5 aa, Mycobacterium
DKPRD

SEQ ID NO: 1004591 - protein, 6 aa, Mycobacterium
DKPRLD

SEQ ID NO: 1004592 - protein, 7 aa, Mycobacterium
DKPRPHR

SEQ ID NO: 1004593 - protein, 7 aa, Mycobacterium
DKPTGAV

SEQ ID NO: 1004594 - protein, 6 aa, Mycobacterium
DKPTVG

SEQ ID NO: 1004595 - protein, 5 aa, Mycobacterium
DKQAT

SEQ ID NO: 1004596 - protein, 9 aa, Mycobacterium
DKQDGSLSE

SEQ ID NO: 1004597 - protein, 5 aa, Mycobacterium
DKQRK

SEQ ID NO: 1004598 - protein, 7 aa, Mycobacterium
DKQRPGL

SEQ ID NO: 1004599 - protein, 11 aa, Mycobacterium
DKQYSSNGGAV

SEQ ID NO: 1004600 - protein, 4 aa, Mycobacterium
DKRG

SEQ ID NO: 1004601 - protein, 7 aa, Mycobacterium
DKRKGGV

SEQ ID NO: 1004602 - protein, 11 aa, Mycobacterium
DKRRVDPETGE

SEQ ID NO: 1004603 - protein, 10 aa, Mycobacterium
DKRVKRSPHA

SEQ ID NO: 1004604 - protein, 16 aa, Mycobacterium
DKRYSGKRDLAQPYGA

SEQ ID NO: 1004605 - protein, 8 aa, Mycobacterium
DKSDPTTL

SEQ ID NO: 1004606 - protein, 8 aa, Mycobacterium
DKSGDPDV

SEQ ID NO: 1004607 - protein, 12 aa, Mycobacterium
DKSTRQGADSAT

SEQ ID NO: 1004608 - protein, 11 aa, Mycobacterium
DKTNGQPFSDD

SEQ ID NO: 1004609 - protein, 6 aa, Mycobacterium
DKTVEQ

SEQ ID NO: 1004610 - protein, 5 aa, Mycobacterium
DKVSV

SEQ ID NO: 1004611 - protein, 14 aa, Mycobacterium
DLADGGAGAIAASD

SEQ ID NO: 1004612 - protein, 7 aa, Mycobacterium
DLADPGR

SEQ ID NO: 1004613 - protein, 4 aa, Mycobacterium
DLAE

SEQ ID NO: 1004614 - protein, 4 aa, Mycobacterium
DLAP

SEQ ID NO: 1004615 - protein, 10 aa, Mycobacterium
DLAPAEPPPV

SEQ ID NO: 1004616 - protein, 25 aa, Mycobacterium
DLAPEAGAQSSQTASQSDAVDTGSS

SEQ ID NO: 1004617 - protein, 8 aa, Mycobacterium
DLAPGGRA

SEQ ID NO: 1004618 - protein, 8 aa, Mycobacterium
DLAPPEPF

SEQ ID NO: 1004619 - protein, 5 aa, Mycobacterium
DLARS

SEQ ID NO: 1004620 - protein, 4 aa, Mycobacterium
DLAS

SEQ ID NO: 1004621 - protein, 5 aa, Mycobacterium
DLASG

SEQ ID NO: 1004622 - protein, 13 aa, Mycobacterium
DLASRSANTPYES

SEQ ID NO: 1004623 - protein, 11 aa, Mycobacterium
DLDDEAAAAAE

SEQ ID NO: 1004624 - protein, 8 aa, Mycobacterium
DLDGKQDN

SEQ ID NO: 1004625 - protein, 10 aa, Mycobacterium
DLDGQQAEDR

SEQ ID NO: 1004626 - protein, 7 aa, Mycobacterium
DLDNIPA

SEQ ID NO: 1004627 - protein, 8 aa, Mycobacterium
DLDTDTAR

SEQ ID NO: 1004628 - protein, 14 aa, Mycobacterium
DLEARKTIGSAVLL

SEQ ID NO: 1004629 - protein, 4 aa, Mycobacterium
DLED

SEQ ID NO: 1004630 - protein, 12 aa, Mycobacterium
DLERQESKEKTG

SEQ ID NO: 1004631 - protein, 8 aa, Mycobacterium
DLESRPAF

SEQ ID NO: 1004632 - protein, 5 aa, Mycobacterium
DLGAA

SEQ ID NO: 1004633 - protein, 9 aa, Mycobacterium
DLGGPSAYN

SEQ ID NO: 1004634 - protein, 13 aa, Mycobacterium
DLGGQPDKVNPLA

SEQ ID NO: 1004635 - protein, 5 aa, Mycobacterium
DLGGT

SEQ ID NO: 1004636 - protein, 7 aa, Mycobacterium
DLGHAPS

SEQ ID NO: 1004637 - protein, 15 aa, Mycobacterium
DLGPGTSTSAASQAL

SEQ ID NO: 1004638 - protein, 11 aa, Mycobacterium
DLGSAASALAG

SEQ ID NO: 1004639 - protein, 13 aa, Mycobacterium
DLGTGEQVSVSTD

SEQ ID NO: 1004640 - protein, 21 aa, Mycobacterium
DLGTLTDGAGPVNSKTAGQLQ

SEQ ID NO: 1004641 - protein, 10 aa, Mycobacterium
DLGYQGPDNT

SEQ ID NO: 1004642 - protein, 8 aa, Mycobacterium
DLKDKAPR

SEQ ID NO: 1004643 - protein, 5 aa, Mycobacterium
DLNPR

SEQ ID NO: 1004644 - protein, 7 aa, Mycobacterium
DLNTGLG

SEQ ID NO: 1004645 - protein, 4 aa, Mycobacterium
DLPA

SEQ ID NO: 1004646 - protein, 7 aa, Mycobacterium
DLPAARD

SEQ ID NO: 1004647 - protein, 6 aa, Mycobacterium
DLPAKA

SEQ ID NO: 1004648 - protein, 6 aa, Mycobacterium
DLPDGF

SEQ ID NO: 1004649 - protein, 5 aa, Mycobacterium
DLPDK

SEQ ID NO: 1004650 - protein, 13 aa, Mycobacterium
DLPEPKKVKPPRT

SEQ ID NO: 1004651 - protein, 6 aa, Mycobacterium
DLPGDD

SEQ ID NO: 1004652 - protein, 5 aa, Mycobacterium
DLPGF

SEQ ID NO: 1004653 - protein, 10 aa, Mycobacterium
DLPGGARSGL

SEQ ID NO: 1004654 - protein, 13 aa, Mycobacterium
DLPGTSGSSRPER

SEQ ID NO: 1004655 - protein, 5 aa, Mycobacterium
DLPPA

SEQ ID NO: 1004656 - protein, 13 aa, Mycobacterium
DLPPRPDGSEPKT

SEQ ID NO: 1004657 - protein, 6 aa, Mycobacterium
DLPPSH

SEQ ID NO: 1004658 - protein, 6 aa, Mycobacterium
DLPQPP

SEQ ID NO: 1004659 - protein, 6 aa, Mycobacterium
DLPQRA

SEQ ID NO: 1004660 - protein, 9 aa, Mycobacterium
DLPRKQARL

SEQ ID NO: 1004661 - protein, 8 aa, Mycobacterium
DLPSPEDI

SEQ ID NO: 1004662 - protein, 12 aa, Mycobacterium
DLPSRELNPNET

SEQ ID NO: 1004663 - protein, 15 aa, Mycobacterium
DLPSTPSGRGTVPQD

SEQ ID NO: 1004664 - protein, 12 aa, Mycobacterium
DLPSTTTDLSSG

SEQ ID NO: 1004665 - protein, 13 aa, Mycobacterium
DLPSVTPMSIRRD

SEQ ID NO: 1004666 - protein, 11 aa, Mycobacterium
DLPTQPETAAP

SEQ ID NO: 1004667 - protein, 7 aa, Mycobacterium
DLPTSEA

SEQ ID NO: 1004668 - protein, 5 aa, Mycobacterium
DLQPG

SEQ ID NO: 1004669 - protein, 7 aa, Mycobacterium
DLQPVGS

SEQ ID NO: 1004670 - protein, 5 aa, Mycobacterium
DLQSI

SEQ ID NO: 1004671 - protein, 8 aa, Mycobacterium
DLQTTSAA

SEQ ID NO: 1004672 - protein, 7 aa, Mycobacterium
DLRSNGV

SEQ ID NO: 1004673 - protein, 9 aa, Mycobacterium
DLSDSDVDE

SEQ ID NO: 1004674 - protein, 4 aa, Mycobacterium
DLSG

SEQ ID NO: 1004675 - protein, 6 aa, Mycobacterium
DLSGDA

SEQ ID NO: 1004676 - protein, 8 aa, Mycobacterium
DLSGTGGM

SEQ ID NO: 1004677 - protein, 21 aa, Mycobacterium
DLSGTGQPWTKATPTTPPFKA

SEQ ID NO: 1004678 - protein, 11 aa, Mycobacterium
DLSHPYQPPVQ

SEQ ID NO: 1004679 - protein, 8 aa, Mycobacterium
DLSNPDNF

SEQ ID NO: 1004680 - protein, 9 aa, Mycobacterium
DLSPKARDL

SEQ ID NO: 1004681 - protein, 6 aa, Mycobacterium
DLSQRG

SEQ ID NO: 1004682 - protein, 7 aa, Mycobacterium
DLSQRGT

SEQ ID NO: 1004683 - protein, 15 aa, Mycobacterium
DLSRPGRGADLSYGR

SEQ ID NO: 1004684 - protein, 13 aa, Mycobacterium
DLSTTSLAKRAET

SEQ ID NO: 1004685 - protein, 4 aa, Mycobacterium
DLTG

SEQ ID NO: 1004686 - protein, 9 aa, Mycobacterium
DLTGRGPGY

SEQ ID NO: 1004687 - protein, 5 aa, Mycobacterium
DLTNI

SEQ ID NO: 1004688 - protein, 8 aa, Mycobacterium
DLTPQNQD

SEQ ID NO: 1004689 - protein, 8 aa, Mycobacterium
DLTPQPPA

SEQ ID NO: 1004690 - protein, 38 aa, Mycobacterium
DLTTPPVTSPQEIPIEGGRQQTGGPGAGGNKPKGDDAW

SEQ ID NO: 1004691 - protein, 10 aa, Mycobacterium
DLVDGAPKPL

SEQ ID NO: 1004692 - protein, 7 aa, Mycobacterium
DMDADSA

SEQ ID NO: 1004693 - protein, 16 aa, Mycobacterium
DMDGAEPATPNIGADQ

SEQ ID NO: 1004694 - protein, 12 aa, Mycobacterium
DMDGIGSPITAA

SEQ ID NO: 1004695 - protein, 8 aa, Mycobacterium
DMDSPRHK

SEQ ID NO: 1004696 - protein, 10 aa, Mycobacterium
DMGTKIGNDR

SEQ ID NO: 1004697 - protein, 5 aa, Mycobacterium
DMNDD

SEQ ID NO: 1004698 - protein, 13 aa, Mycobacterium
DMPLDPKQARPGF

SEQ ID NO: 1004699 - protein, 13 aa, Mycobacterium
DMRGTAEDSNERI

SEQ ID NO: 1004700 - protein, 6 aa, Mycobacterium
DMSAHD

SEQ ID NO: 1004701 - protein, 8 aa, Mycobacterium
DNAADRDA

SEQ ID NO: 1004702 - protein, 5 aa, Mycobacterium
DNAAL

SEQ ID NO: 1004703 - protein, 6 aa, Mycobacterium
DNAEAL

SEQ ID NO: 1004704 - protein, 5 aa, Mycobacterium
DNAEE

SEQ ID NO: 1004705 - protein, 7 aa, Mycobacterium
DNAGTVE

SEQ ID NO: 1004706 - protein, 14 aa, Mycobacterium
DNAPHVHRGSGADR

SEQ ID NO: 1004707 - protein, 6 aa, Mycobacterium
DNAPIA

SEQ ID NO: 1004708 - protein, 6 aa, Mycobacterium
DNAQAA

SEQ ID NO: 1004709 - protein, 6 aa, Mycobacterium
DNATRR

SEQ ID NO: 1004710 - protein, 6 aa, Mycobacterium
DNCPQR

SEQ ID NO: 1004711 - protein, 15 aa, Mycobacterium
DNDGIGGAGGAGGAG

SEQ ID NO: 1004712 - protein, 14 aa, Mycobacterium
DNDGPDLRSRLPER

SEQ ID NO: 1004713 - protein, 6 aa, Mycobacterium
DNDLER

SEQ ID NO: 1004714 - protein, 4 aa, Mycobacterium
DNDP

SEQ ID NO: 1004715 - protein, 7 aa, Mycobacterium
DNDPARI

SEQ ID NO: 1004716 - protein, 8 aa, Mycobacterium
DNDPASYE

SEQ ID NO: 1004717 - protein, 4 aa, Mycobacterium
DNDR

SEQ ID NO: 1004718 - protein, 9 aa, Mycobacterium
DNDREATGR

SEQ ID NO: 1004719 - protein, 10 aa, Mycobacterium
DNDSARRTPD

SEQ ID NO: 1004720 - protein, 6 aa, Mycobacterium
DNDTMA

SEQ ID NO: 1004721 - protein, 4 aa, Mycobacterium
DNDV

SEQ ID NO: 1004722 - protein, 6 aa, Mycobacterium
DNEAEP

SEQ ID NO: 1004723 - protein, 9 aa, Mycobacterium
DNEASDKAA

SEQ ID NO: 1004724 - protein, 5 aa, Mycobacterium
DNERL

SEQ ID NO: 1004725 - protein, 10 aa, Mycobacterium
DNFTQTSDQE

SEQ ID NO: 1004726 - protein, 15 aa, Mycobacterium
DNGASGEGGPNGSFN

SEQ ID NO: 1004727 - protein, 16 aa, Mycobacterium
DNGASGEGGPNGSVNE

SEQ ID NO: 1004728 - protein, 11 aa, Mycobacterium
DNGDTGYPYGT

SEQ ID NO: 1004729 - protein, 8 aa, Mycobacterium
DNGDTTYG

SEQ ID NO: 1004730 - protein, 14 aa, Mycobacterium
DNGEALPNDGQAVG

SEQ ID NO: 1004731 - protein, 6 aa, Mycobacterium
DNGPET

SEQ ID NO: 1004732 - protein, 17 aa, Mycobacterium
DNGRCDPVQGTNTAESL

SEQ ID NO: 1004733 - protein, 16 aa, Mycobacterium
DNGRGMPKTYTSSGLT

SEQ ID NO: 1004734 - protein, 13 aa, Mycobacterium
DNGSTDGTPQAAV

SEQ ID NO: 1004735 - protein, 6 aa, Mycobacterium
DNGTHS

SEQ ID NO: 1004736 - protein, 7 aa, Mycobacterium
DNHRPAH

SEQ ID NO: 1004737 - protein, 14 aa, Mycobacterium
DNIDTFSFQDLSGG

SEQ ID NO: 1004738 - protein, 14 aa, Mycobacterium
DNIEPDQGAQDKAA

SEQ ID NO: 1004739 - protein, 10 aa, Mycobacterium
DNKSSGNSVQ

SEQ ID NO: 1004740 - protein, 5 aa, Mycobacterium
DNLPS

SEQ ID NO: 1004741 - protein, 7 aa, Mycobacterium
DNLSAER

SEQ ID NO: 1004742 - protein, 7 aa, Mycobacterium
DNNDDAE

SEQ ID NO: 1004743 - protein, 9 aa, Mycobacterium
DNNDLDDAA

SEQ ID NO: 1004744 - protein, 8 aa, Mycobacterium
DNNGPVTR

SEQ ID NO: 1004745 - protein, 6 aa, Mycobacterium
DNNTGV

SEQ ID NO: 1004746 - protein, 7 aa, Mycobacterium
DNPAGTG

SEQ ID NO: 1004747 - protein, 5 aa, Mycobacterium
DNPAL

SEQ ID NO: 1004748 - protein, 4 aa, Mycobacterium
DNPD

SEQ ID NO: 1004749 - protein, 12 aa, Mycobacterium
DNPDAFAETGGW

SEQ ID NO: 1004750 - protein, 8 aa, Mycobacterium
DNPDRLRS

SEQ ID NO: 1004751 - protein, 8 aa, Mycobacterium
DNPDSSTL

SEQ ID NO: 1004752 - protein, 6 aa, Mycobacterium
DNPGRL

SEQ ID NO: 1004753 - protein, 12 aa, Mycobacterium
DNPGYDADAARR

SEQ ID NO: 1004754 - protein, 6 aa, Mycobacterium
DNPLTT

SEQ ID NO: 1004755 - protein, 15 aa, Mycobacterium
DNPNATGSCACGDSF

SEQ ID NO: 1004756 - protein, 7 aa, Mycobacterium
DNPNRGR

SEQ ID NO: 1004757 - protein, 9 aa, Mycobacterium
DNPPGAKNV

SEQ ID NO: 1004758 - protein, 7 aa, Mycobacterium
DNPRPGL

SEQ ID NO: 1004759 - protein, 6 aa, Mycobacterium
DNPSEV

SEQ ID NO: 1004760 - protein, 4 aa, Mycobacterium
DNPT

SEQ ID NO: 1004761 - protein, 7 aa, Mycobacterium
DNPTKTV

SEQ ID NO: 1004762 - protein, 7 aa, Mycobacterium
DNQPGGI

SEQ ID NO: 1004763 - protein, 9 aa, Mycobacterium
DNQRGAPPQ

SEQ ID NO: 1004764 - protein, 10 aa, Mycobacterium
DNQSRRQTSF

SEQ ID NO: 1004765 - protein, 4 aa, Mycobacterium
DNQV

SEQ ID NO: 1004766 - protein, 10 aa, Mycobacterium
DNQVGIGSRA

SEQ ID NO: 1004767 - protein, 4 aa, Mycobacterium
DNRA

SEQ ID NO: 1004768 - protein, 8 aa, Mycobacterium
DNREEPRK

SEQ ID NO: 1004769 - protein, 7 aa, Mycobacterium
DNRPPSV

SEQ ID NO: 1004770 - protein, 7 aa, Mycobacterium
DNSASRC

SEQ ID NO: 1004771 - protein, 7 aa, Mycobacterium
DNSDNAL

SEQ ID NO: 1004772 - protein, 9 aa, Mycobacterium
DNSDQNDLM

SEQ ID NO: 1004773 - protein, 8 aa, Mycobacterium
DNSGPQTC

SEQ ID NO: 1004774 - protein, 10 aa, Mycobacterium
DNSPDGTGRL

SEQ ID NO: 1004775 - protein, 9 aa, Mycobacterium
DNSREEPIR

SEQ ID NO: 1004776 - protein, 6 aa, Mycobacterium
DNSTTW

SEQ ID NO: 1004777 - protein, 25 aa, Mycobacterium
DNSYMAPRRGECSGRRAVCPMMVWG

SEQ ID NO: 1004778 - protein, 5 aa, Mycobacterium
DNTEL

SEQ ID NO: 1004779 - protein, 6 aa, Mycobacterium
DNTEVS

SEQ ID NO: 1004780 - protein, 6 aa, Mycobacterium
DNTGGL

SEQ ID NO: 1004781 - protein, 7 aa, Mycobacterium
DNTGPFH

SEQ ID NO: 1004782 - protein, 4 aa, Mycobacterium
DNTN

SEQ ID NO: 1004783 - protein, 17 aa, Mycobacterium
DNTPSGTTAATQGSGVV

SEQ ID NO: 1004784 - protein, 5 aa, Mycobacterium
DNTTQ

SEQ ID NO: 1004785 - protein, 8 aa, Mycobacterium
DNTVSASL

SEQ ID NO: 1004786 - protein, 6 aa, Mycobacterium
DNVESI

SEQ ID NO: 1004787 - protein, 16 aa, Mycobacterium
DNVTAGYRTEAGFEPA

SEQ ID NO: 1004788 - protein, 6 aa, Mycobacterium
DNWSTD

SEQ ID NO: 1004789 - protein, 8 aa, Mycobacterium
DNYGSVER

SEQ ID NO: 1004790 - protein, 16 aa, Mycobacterium
DPAAAQQRARAARERL

SEQ ID NO: 1004791 - protein, 31 aa, Mycobacterium
DPAAHATDRQTAGPACAAQSDADADPLAEAA

SEQ ID NO: 1004792 - protein, 7 aa, Mycobacterium
DPAAQGA

SEQ ID NO: 1004793 - protein, 5 aa, Mycobacterium
DPAAR

SEQ ID NO: 1004794 - protein, 6 aa, Mycobacterium
DPAASR

SEQ ID NO: 1004795 - protein, 12 aa, Mycobacterium
DPAATGGDNPHK

SEQ ID NO: 1004796 - protein, 5 aa, Mycobacterium
DPAAV

SEQ ID NO: 1004797 - protein, 25 aa, Mycobacterium
DPAAVDSISRRSAAAPTVDRRPEQS

SEQ ID NO: 1004798 - protein, 11 aa, Mycobacterium
DPAAYSPDTAG

SEQ ID NO: 1004799 - protein, 4 aa, Mycobacterium
DPAD

SEQ ID NO: 1004800 - protein, 8 aa, Mycobacterium
DPADAEVP

SEQ ID NO: 1004801 - protein, 11 aa, Mycobacterium
DPADLNRPAGS

SEQ ID NO: 1004802 - protein, 7 aa, Mycobacterium
DPADPLP

SEQ ID NO: 1004803 - protein, 6 aa, Mycobacterium
DPADPS

SEQ ID NO: 1004804 - protein, 17 aa, Mycobacterium
DPADRRPGRAGGGVPTN

SEQ ID NO: 1004805 - protein, 7 aa, Mycobacterium
DPADTRT

SEQ ID NO: 1004806 - protein, 8 aa, Mycobacterium
DPAEQSVA

SEQ ID NO: 1004807 - protein, 14 aa, Mycobacterium
DPAESRAWITRLPG

SEQ ID NO: 1004808 - protein, 5 aa, Mycobacterium
DPAEV

SEQ ID NO: 1004809 - protein, 7 aa, Mycobacterium
DPAFGGR

SEQ ID NO: 1004810 - protein, 7 aa, Mycobacterium
DPAGAAA

SEQ ID NO: 1004811 - protein, 9 aa, Mycobacterium
DPAGATIGS

SEQ ID NO: 1004812 - protein, 14 aa, Mycobacterium
DPAGDAGYTDHPPR

SEQ ID NO: 1004813 - protein, 22 aa, Mycobacterium
DPAGGPDAARGKPLAEQDEQVR

SEQ ID NO: 1004814 - protein, 10 aa, Mycobacterium
DPAGLTGEHT

SEQ ID NO: 1004815 - protein, 7 aa, Mycobacterium
DPAGQPL

SEQ ID NO: 1004816 - protein, 6 aa, Mycobacterium
DPAGVT

SEQ ID NO: 1004817 - protein, 5 aa, Mycobacterium
DPAHQ

SEQ ID NO: 1004818 - protein, 5 aa, Mycobacterium
DPAKE

SEQ ID NO: 1004819 - protein, 9 aa, Mycobacterium
DPAKPKALH

SEQ ID NO: 1004820 - protein, 7 aa, Mycobacterium
DPANAEA

SEQ ID NO: 1004821 - protein, 14 aa, Mycobacterium
DPAPASPPTDDELA

SEQ ID NO: 1004822 - protein, 5 aa, Mycobacterium
DPAPC

SEQ ID NO: 1004823 - protein, 6 aa, Mycobacterium
DPAPDE

SEQ ID NO: 1004824 - protein, 9 aa, Mycobacterium
DPAPDPGKW

SEQ ID NO: 1004825 - protein, 9 aa, Mycobacterium
DPAPGGDGV

SEQ ID NO: 1004826 - protein, 7 aa, Mycobacterium
DPAPGVA

SEQ ID NO: 1004827 - protein, 11 aa, Mycobacterium
DPAPPLTPLPT

SEQ ID NO: 1004828 - protein, 6 aa, Mycobacterium
DPAPPS

SEQ ID NO: 1004829 - protein, 8 aa, Mycobacterium
DPAPRSIP

SEQ ID NO: 1004830 - protein, 6 aa, Mycobacterium
DPAQVN

SEQ ID NO: 1004831 - protein, 6 aa, Mycobacterium
DPARDG

SEQ ID NO: 1004832 - protein, 5 aa, Mycobacterium
DPARI

SEQ ID NO: 1004833 - protein, 8 aa, Mycobacterium
DPARRGET

SEQ ID NO: 1004834 - protein, 7 aa, Mycobacterium
DPASAHA

SEQ ID NO: 1004835 - protein, 8 aa, Mycobacterium
DPASGASL

SEQ ID NO: 1004836 - protein, 8 aa, Mycobacterium
DPASQAVD

SEQ ID NO: 1004837 - protein, 13 aa, Mycobacterium
DPASQGQDVERDP

SEQ ID NO: 1004838 - protein, 26 aa, Mycobacterium
DPASRRSRQRHDPATSIPLTAQTGPA

SEQ ID NO: 1004839 - protein, 4 aa, Mycobacterium
DPAT

SEQ ID NO: 1004840 - protein, 6 aa, Mycobacterium
DPATGF

SEQ ID NO: 1004841 - protein, 6 aa, Mycobacterium
DPAVQP

SEQ ID NO: 1004842 - protein, 15 aa, Mycobacterium
DPAYGWSTSPPNVPA

SEQ ID NO: 1004843 - protein, 5 aa, Mycobacterium
DPCDP

SEQ ID NO: 1004844 - protein, 4 aa, Mycobacterium
DPDA

SEQ ID NO: 1004845 - protein, 8 aa, Mycobacterium
DPDAADGR

SEQ ID NO: 1004846 - protein, 8 aa, Mycobacterium
DPDADAEK

SEQ ID NO: 1004847 - protein, 8 aa, Mycobacterium
DPDADYQA

SEQ ID NO: 1004848 - protein, 9 aa, Mycobacterium
DPDAPKHKG

SEQ ID NO: 1004849 - protein, 8 aa, Mycobacterium
DPDAPSGW

SEQ ID NO: 1004850 - protein, 10 aa, Mycobacterium
DPDARTDPRI

SEQ ID NO: 1004851 - protein, 10 aa, Mycobacterium
DPDASAAALR

SEQ ID NO: 1004852 - protein, 61 aa, Mycobacterium
DPDASGDDSDDEPADLDEDTDGGGEDTEQPASSGEPQPLPTGPTTVTLPNGDTITAASPEL

SEQ ID NO: 1004853 - protein, 9 aa, Mycobacterium
DPDASLGAG

SEQ ID NO: 1004854 - protein, 8 aa, Mycobacterium
DPDAVSAG

SEQ ID NO: 1004855 - protein, 11 aa, Mycobacterium
DPDDAPGDPPV

SEQ ID NO: 1004856 - protein, 5 aa, Mycobacterium
DPDDV

SEQ ID NO: 1004857 - protein, 8 aa, Mycobacterium
DPDDVGDG

SEQ ID NO: 1004858 - protein, 4 aa, Mycobacterium
DPDE

SEQ ID NO: 1004859 - protein, 6 aa, Mycobacterium
DPDEAW

SEQ ID NO: 1004860 - protein, 7 aa, Mycobacterium
DPDEQFR

SEQ ID NO: 1004861 - protein, 6 aa, Mycobacterium
DPDEVR

SEQ ID NO: 1004862 - protein, 6 aa, Mycobacterium
DPDFQA

SEQ ID NO: 1004863 - protein, 10 aa, Mycobacterium
DPDGGYGHPD

SEQ ID NO: 1004864 - protein, 5 aa, Mycobacterium
DPDGQ

SEQ ID NO: 1004865 - protein, 6 aa, Mycobacterium
DPDGRT

SEQ ID NO: 1004866 - protein, 9 aa, Mycobacterium
DPDGSVYPS

SEQ ID NO: 1004867 - protein, 13 aa, Mycobacterium
DPDGVEGPVAEAD

SEQ ID NO: 1004868 - protein, 7 aa, Mycobacterium
DPDISEP

SEQ ID NO: 1004869 - protein, 6 aa, Mycobacterium
DPDNLD

SEQ ID NO: 1004870 - protein, 5 aa, Mycobacterium
DPDNN

SEQ ID NO: 1004871 - protein, 9 aa, Mycobacterium
DPDNRRPVD

SEQ ID NO: 1004872 - protein, 10 aa, Mycobacterium
DPDPANVGRK

SEQ ID NO: 1004873 - protein, 12 aa, Mycobacterium
DPDPARAAAATT

SEQ ID NO: 1004874 - protein, 14 aa, Mycobacterium
DPDPDARGKTYTRR

SEQ ID NO: 1004875 - protein, 16 aa, Mycobacterium
DPDPDAVGKSYTRSGG

SEQ ID NO: 1004876 - protein, 17 aa, Mycobacterium
DPDPDTPHKSYASTGGF

SEQ ID NO: 1004877 - protein, 7 aa, Mycobacterium
DPDPEHV

SEQ ID NO: 1004878 - protein, 7 aa, Mycobacterium
DPDPRRR

SEQ ID NO: 1004879 - protein, 8 aa, Mycobacterium
DPDPSGPV

SEQ ID NO: 1004880 - protein, 4 aa, Mycobacterium
DPDR

SEQ ID NO: 1004881 - protein, 5 aa, Mycobacterium
DPDRD

SEQ ID NO: 1004882 - protein, 14 aa, Mycobacterium
DPDSATGKARKARK

SEQ ID NO: 1004883 - protein, 8 aa, Mycobacterium
DPDSGQAP

SEQ ID NO: 1004884 - protein, 6 aa, Mycobacterium
DPDTAE

SEQ ID NO: 1004885 - protein, 9 aa, Mycobacterium
DPDTAREYH

SEQ ID NO: 1004886 - protein, 16 aa, Mycobacterium
DPDTGAPLRDESGRVR

SEQ ID NO: 1004887 - protein, 6 aa, Mycobacterium
DPDTSG

SEQ ID NO: 1004888 - protein, 6 aa, Mycobacterium
DPDTTY

SEQ ID NO: 1004889 - protein, 6 aa, Mycobacterium
DPEAGL

SEQ ID NO: 1004890 - protein, 8 aa, Mycobacterium
DPEATRRT

SEQ ID NO: 1004891 - protein, 24 aa, Mycobacterium
DPEAYPADRARAIEPKAGAATSVE

SEQ ID NO: 1004892 - protein, 10 aa, Mycobacterium
DPEDAQAWEA

SEQ ID NO: 1004893 - protein, 11 aa, Mycobacterium
DPEDDPSESQA

SEQ ID NO: 1004894 - protein, 12 aa, Mycobacterium
DPEDQVAGPEAV

SEQ ID NO: 1004895 - protein, 4 aa, Mycobacterium
DPEF

SEQ ID NO: 1004896 - protein, 7 aa, Mycobacterium
DPEFDTG

SEQ ID NO: 1004897 - protein, 4 aa, Mycobacterium
DPEG

SEQ ID NO: 1004898 - protein, 5 aa, Mycobacterium
DPEGA

SEQ ID NO: 1004899 - protein, 5 aa, Mycobacterium
DPEGD

SEQ ID NO: 1004900 - protein, 6 aa, Mycobacterium
DPEKAL

SEQ ID NO: 1004901 - protein, 9 aa, Mycobacterium
DPEKHSLGP

SEQ ID NO: 1004902 - protein, 4 aa, Mycobacterium
DPEL

SEQ ID NO: 1004903 - protein, 11 aa, Mycobacterium
DPELGERAASA

SEQ ID NO: 1004904 - protein, 16 aa, Mycobacterium
DPEPIDGSARKPGARA

SEQ ID NO: 1004905 - protein, 12 aa, Mycobacterium
DPEPPEQARPEI

SEQ ID NO: 1004906 - protein, 7 aa, Mycobacterium
DPERARE

SEQ ID NO: 1004907 - protein, 5 aa, Mycobacterium
DPERG

SEQ ID NO: 1004908 - protein, 9 aa, Mycobacterium
DPERGGGVE

SEQ ID NO: 1004909 - protein, 11 aa, Mycobacterium
DPESDRPRDTV

SEQ ID NO: 1004910 - protein, 15 aa, Mycobacterium
DPESRNDEDSAASMP

SEQ ID NO: 1004911 - protein, 9 aa, Mycobacterium
DPETGQQCP

SEQ ID NO: 1004912 - protein, 8 aa, Mycobacterium
DPETGRQD

SEQ ID NO: 1004913 - protein, 5 aa, Mycobacterium
DPETN

SEQ ID NO: 1004914 - protein, 6 aa, Mycobacterium
DPETVT

SEQ ID NO: 1004915 - protein, 4 aa, Mycobacterium
DPFD

SEQ ID NO: 1004916 - protein, 4 aa, Mycobacterium
DPFE

SEQ ID NO: 1004917 - protein, 13 aa, Mycobacterium
DPFGSGSSQTSGV

SEQ ID NO: 1004918 - protein, 7 aa, Mycobacterium
DPGAAAH

SEQ ID NO: 1004919 - protein, 6 aa, Mycobacterium
DPGAAE

SEQ ID NO: 1004920 - protein, 10 aa, Mycobacterium
DPGAAEALDP

SEQ ID NO: 1004921 - protein, 19 aa, Mycobacterium
DPGAGNLAERSGRSSPSSI

SEQ ID NO: 1004922 - protein, 6 aa, Mycobacterium
DPGAPI

SEQ ID NO: 1004923 - protein, 10 aa, Mycobacterium
DPGAQSPRES

SEQ ID NO: 1004924 - protein, 8 aa, Mycobacterium
DPGAQVGP

SEQ ID NO: 1004925 - protein, 17 aa, Mycobacterium
DPGARRPGEINHRDGGR

SEQ ID NO: 1004926 - protein, 10 aa, Mycobacterium
DPGARSPRPA

SEQ ID NO: 1004927 - protein, 6 aa, Mycobacterium
DPGAVT

SEQ ID NO: 1004928 - protein, 9 aa, Mycobacterium
DPGDESPVA

SEQ ID NO: 1004929 - protein, 6 aa, Mycobacterium
DPGDGV

SEQ ID NO: 1004930 - protein, 4 aa, Mycobacterium
DPGE

SEQ ID NO: 1004931 - protein, 9 aa, Mycobacterium
DPGEGIQAK

SEQ ID NO: 1004932 - protein, 7 aa, Mycobacterium
DPGEIHP

SEQ ID NO: 1004933 - protein, 8 aa, Mycobacterium
DPGEPVES

SEQ ID NO: 1004934 - protein, 4 aa, Mycobacterium
DPGF

SEQ ID NO: 1004935 - protein, 9 aa, Mycobacterium
DPGGLPAVG

SEQ ID NO: 1004936 - protein, 14 aa, Mycobacterium
DPGGPVPANFGPEP

SEQ ID NO: 1004937 - protein, 12 aa, Mycobacterium
DPGGWNSVDDAP

SEQ ID NO: 1004938 - protein, 4 aa, Mycobacterium
DPGL

SEQ ID NO: 1004939 - protein, 12 aa, Mycobacterium
DPGNEYAANTVQ

SEQ ID NO: 1004940 - protein, 4 aa, Mycobacterium
DPGP

SEQ ID NO: 1004941 - protein, 8 aa, Mycobacterium
DPGPADDE

SEQ ID NO: 1004942 - protein, 7 aa, Mycobacterium
DPGPADW

SEQ ID NO: 1004943 - protein, 5 aa, Mycobacterium
DPGPM

SEQ ID NO: 1004944 - protein, 7 aa, Mycobacterium
DPGQLSE

SEQ ID NO: 1004945 - protein, 16 aa, Mycobacterium
DPGQPGGHTSIKATPY

SEQ ID NO: 1004946 - protein, 10 aa, Mycobacterium
DPGRAEVGQQ

SEQ ID NO: 1004947 - protein, 8 aa, Mycobacterium
DPGRRAEV

SEQ ID NO: 1004948 - protein, 13 aa, Mycobacterium
DPGSAPEPQADPS

SEQ ID NO: 1004949 - protein, 17 aa, Mycobacterium
DPGSGQGPAAESDSGSD

SEQ ID NO: 1004950 - protein, 6 aa, Mycobacterium
DPGSID

SEQ ID NO: 1004951 - protein, 7 aa, Mycobacterium
DPGSRGA

SEQ ID NO: 1004952 - protein, 15 aa, Mycobacterium
DPGSVAEPPTVQAKA

SEQ ID NO: 1004953 - protein, 9 aa, Mycobacterium
DPGTDADRL

SEQ ID NO: 1004954 - protein, 5 aa, Mycobacterium
DPGTG

SEQ ID NO: 1004955 - protein, 7 aa, Mycobacterium
DPGTMNP

SEQ ID NO: 1004956 - protein, 4 aa, Mycobacterium
DPGV

SEQ ID NO: 1004957 - protein, 5 aa, Mycobacterium
DPGYA

SEQ ID NO: 1004958 - protein, 8 aa, Mycobacterium
DPHATPRH

SEQ ID NO: 1004959 - protein, 6 aa, Mycobacterium
DPHDPA

SEQ ID NO: 1004960 - protein, 13 aa, Mycobacterium
DPHGPLDRTHPTR

SEQ ID NO: 1004961 - protein, 6 aa, Mycobacterium
DPHGQR

SEQ ID NO: 1004962 - protein, 5 aa, Mycobacterium
DPHNA

SEQ ID NO: 1004963 - protein, 8 aa, Mycobacterium
DPHRGPRA

SEQ ID NO: 1004964 - protein, 6 aa, Mycobacterium
DPHSTL

SEQ ID NO: 1004965 - protein, 12 aa, Mycobacterium
DPIETDNRWTDP

SEQ ID NO: 1004966 - protein, 5 aa, Mycobacterium
DPIGP

SEQ ID NO: 1004967 - protein, 28 aa, Mycobacterium
DPIPERQGCRADEAGCSPAVKQGESEFF

SEQ ID NO: 1004968 - protein, 8 aa, Mycobacterium
DPIPGNDA

SEQ ID NO: 1004969 - protein, 10 aa, Mycobacterium
DPIPPDQEAL

SEQ ID NO: 1004970 - protein, 6 aa, Mycobacterium
DPITPA

SEQ ID NO: 1004971 - protein, 8 aa, Mycobacterium
DPKALEPA

SEQ ID NO: 1004972 - protein, 9 aa, Mycobacterium
DPKDAGEFD

SEQ ID NO: 1004973 - protein, 4 aa, Mycobacterium
DPKG

SEQ ID NO: 1004974 - protein, 5 aa, Mycobacterium
DPKIT

SEQ ID NO: 1004975 - protein, 6 aa, Mycobacterium
DPKRAV

SEQ ID NO: 1004976 - protein, 10 aa, Mycobacterium
DPLDSDALGQ

SEQ ID NO: 1004977 - protein, 5 aa, Mycobacterium
DPLGG

SEQ ID NO: 1004978 - protein, 6 aa, Mycobacterium
DPLGPY

SEQ ID NO: 1004979 - protein, 8 aa, Mycobacterium
DPLKPPHQ

SEQ ID NO: 1004980 - protein, 10 aa, Mycobacterium
DPLPATPRRN

SEQ ID NO: 1004981 - protein, 15 aa, Mycobacterium
DPLSGSRREFVSPRE

SEQ ID NO: 1004982 - protein, 6 aa, Mycobacterium
DPLTAT

SEQ ID NO: 1004983 - protein, 15 aa, Mycobacterium
DPLTATLSGRPAPSI

SEQ ID NO: 1004984 - protein, 7 aa, Mycobacterium
DPMDSEQ

SEQ ID NO: 1004985 - protein, 6 aa, Mycobacterium
DPMTTR

SEQ ID NO: 1004986 - protein, 4 aa, Mycobacterium
DPNC

SEQ ID NO: 1004987 - protein, 5 aa, Mycobacterium
DPNCG

SEQ ID NO: 1004988 - protein, 15 aa, Mycobacterium
DPNGIAGGGAGRLSA

SEQ ID NO: 1004989 - protein, 7 aa, Mycobacterium
DPNHELP

SEQ ID NO: 1004990 - protein, 10 aa, Mycobacterium
DPNNPNGGVA

SEQ ID NO: 1004991 - protein, 11 aa, Mycobacterium
DPNNPNQPPYS

SEQ ID NO: 1004992 - protein, 12 aa, Mycobacterium
DPNPPGPESDYR

SEQ ID NO: 1004993 - protein, 25 aa, Mycobacterium
DPNYEPAAADSIGARARARGVSPME

SEQ ID NO: 1004994 - protein, 4 aa, Mycobacterium
DPPA

SEQ ID NO: 1004995 - protein, 8 aa, Mycobacterium
DPPAADST

SEQ ID NO: 1004996 - protein, 5 aa, Mycobacterium
DPPDH

SEQ ID NO: 1004997 - protein, 6 aa, Mycobacterium
DPPEFA

SEQ ID NO: 1004998 - protein, 5 aa, Mycobacterium
DPPNQ

SEQ ID NO: 1004999 - protein, 6 aa, Mycobacterium
DPPPEL

SEQ ID NO: 1005000 - protein, 7 aa, Mycobacterium
DPPPLPL

SEQ ID NO: 1005001 - protein, 48 aa, Mycobacterium
DPPPPRPTPPPPPTRSPPHPTTSPTSSTPPAAPAPPKASASPTTTSPN

SEQ ID NO: 1005002 - protein, 8 aa, Mycobacterium
DPPPRSGL

SEQ ID NO: 1005003 - protein, 10 aa, Mycobacterium
DPPPSLTRTR

SEQ ID NO: 1005004 - protein, 10 aa, Mycobacterium
DPPPVQTPHP

SEQ ID NO: 1005005 - protein, 4 aa, Mycobacterium
DPPR

SEQ ID NO: 1005006 - protein, 6 aa, Mycobacterium
DPPRAG

SEQ ID NO: 1005007 - protein, 7 aa, Mycobacterium
DPPRARR

SEQ ID NO: 1005008 - protein, 6 aa, Mycobacterium
DPPREV

SEQ ID NO: 1005009 - protein, 9 aa, Mycobacterium
DPPRSGAGR

SEQ ID NO: 1005010 - protein, 10 aa, Mycobacterium
DPPSELPKAS

SEQ ID NO: 1005011 - protein, 7 aa, Mycobacterium
DPPTGAD

SEQ ID NO: 1005012 - protein, 8 aa, Mycobacterium
DPPTLTTD

SEQ ID NO: 1005013 - protein, 6 aa, Mycobacterium
DPPTSL

SEQ ID NO: 1005014 - protein, 9 aa, Mycobacterium
DPPVTPEEP

SEQ ID NO: 1005015 - protein, 11 aa, Mycobacterium
DPQAALDPSGD

SEQ ID NO: 1005016 - protein, 8 aa, Mycobacterium
DPQAARSA

SEQ ID NO: 1005017 - protein, 7 aa, Mycobacterium
DPQAEPS

SEQ ID NO: 1005018 - protein, 9 aa, Mycobacterium
DPQAPKRQA

SEQ ID NO: 1005019 - protein, 10 aa, Mycobacterium
DPQDSAGQSA

SEQ ID NO: 1005020 - protein, 17 aa, Mycobacterium
DPQFGPDSSAQHRRSGA

SEQ ID NO: 1005021 - protein, 11 aa, Mycobacterium
DPQGNASTALG

SEQ ID NO: 1005022 - protein, 8 aa, Mycobacterium
DPQGQAIA

SEQ ID NO: 1005023 - protein, 8 aa, Mycobacterium
DPQHPDGP

SEQ ID NO: 1005024 - protein, 8 aa, Mycobacterium
DPQIRTSQ

SEQ ID NO: 1005025 - protein, 4 aa, Mycobacterium
DPQP

SEQ ID NO: 1005026 - protein, 9 aa, Mycobacterium
DPQPGTGFA

SEQ ID NO: 1005027 - protein, 9 aa, Mycobacterium
DPQPPFDSG

SEQ ID NO: 1005028 - protein, 4 aa, Mycobacterium
DPQR

SEQ ID NO: 1005029 - protein, 5 aa, Mycobacterium
DPQRF

SEQ ID NO: 1005030 - protein, 8 aa, Mycobacterium
DPQRLQQD

SEQ ID NO: 1005031 - protein, 9 aa, Mycobacterium
DPQRRKVGD

SEQ ID NO: 1005032 - protein, 7 aa, Mycobacterium
DPQRTAE

SEQ ID NO: 1005033 - protein, 10 aa, Mycobacterium
DPQTLDDDHR

SEQ ID NO: 1005034 - protein, 4 aa, Mycobacterium
DPQV

SEQ ID NO: 1005035 - protein, 11 aa, Mycobacterium
DPRAESAMESE

SEQ ID NO: 1005036 - protein, 9 aa, Mycobacterium
DPRATAAAI

SEQ ID NO: 1005037 - protein, 23 aa, Mycobacterium
DPRATERKKYGLKKARKAPQYSK

SEQ ID NO: 1005038 - protein, 16 aa, Mycobacterium
DPRDIGERSLNDADTV

SEQ ID NO: 1005039 - protein, 10 aa, Mycobacterium
DPRDIGERTL

SEQ ID NO: 1005040 - protein, 5 aa, Mycobacterium
DPRET

SEQ ID NO: 1005041 - protein, 7 aa, Mycobacterium
DPRETRD

SEQ ID NO: 1005042 - protein, 8 aa, Mycobacterium
DPRGEAAT

SEQ ID NO: 1005043 - protein, 7 aa, Mycobacterium
DPRGLGD

SEQ ID NO: 1005044 - protein, 8 aa, Mycobacterium
DPRKADQM

SEQ ID NO: 1005045 - protein, 5 aa, Mycobacterium
DPRLP

SEQ ID NO: 1005046 - protein, 5 aa, Mycobacterium
DPRLT

SEQ ID NO: 1005047 - protein, 7 aa, Mycobacterium
DPRLTSK

SEQ ID NO: 1005048 - protein, 12 aa, Mycobacterium
DPRNDYPPPDPE

SEQ ID NO: 1005049 - protein, 6 aa, Mycobacterium
DPRPDG

SEQ ID NO: 1005050 - protein, 27 aa, Mycobacterium
DPRPHDSTAVRNHESAYGLDGPRVSTR

SEQ ID NO: 1005051 - protein, 6 aa, Mycobacterium
DPRRDG

SEQ ID NO: 1005052 - protein, 5 aa, Mycobacterium
DPRRR

SEQ ID NO: 1005053 - protein, 5 aa, Mycobacterium
DPRSG

SEQ ID NO: 1005054 - protein, 18 aa, Mycobacterium
DPRSRAYADRRTSEGLSK

SEQ ID NO: 1005055 - protein, 7 aa, Mycobacterium
DPRTDLT

SEQ ID NO: 1005056 - protein, 8 aa, Mycobacterium
DPRTGASV

SEQ ID NO: 1005057 - protein, 7 aa, Mycobacterium
DPRTVNS

SEQ ID NO: 1005058 - protein, 9 aa, Mycobacterium
DPRTVPPEE

SEQ ID NO: 1005059 - protein, 6 aa, Mycobacterium
DPRVNP

SEQ ID NO: 1005060 - protein, 13 aa, Mycobacterium
DPSAFTDSRRPQY

SEQ ID NO: 1005061 - protein, 9 aa, Mycobacterium
DPSAGDPVV

SEQ ID NO: 1005062 - protein, 8 aa, Mycobacterium
DPSAQRHR

SEQ ID NO: 1005063 - protein, 5 aa, Mycobacterium
DPSAT

SEQ ID NO: 1005064 - protein, 17 aa, Mycobacterium
DPSAWNPNQSSNPDNVA

SEQ ID NO: 1005065 - protein, 10 aa, Mycobacterium
DPSEEGLADY

SEQ ID NO: 1005066 - protein, 8 aa, Mycobacterium
DPSEGTGP

SEQ ID NO: 1005067 - protein, 7 aa, Mycobacterium
DPSFSEK

SEQ ID NO: 1005068 - protein, 10 aa, Mycobacterium
DPSGAARGTL

SEQ ID NO: 1005069 - protein, 6 aa, Mycobacterium
DPSGNP

SEQ ID NO: 1005070 - protein, 5 aa, Mycobacterium
DPSIL

SEQ ID NO: 1005071 - protein, 21 aa, Mycobacterium
DPSIPTDESGTRHRSAERAAI

SEQ ID NO: 1005072 - protein, 12 aa, Mycobacterium
DPSKTAASRDKH

SEQ ID NO: 1005073 - protein, 6 aa, Mycobacterium
DPSLPT

SEQ ID NO: 1005074 - protein, 21 aa, Mycobacterium
DPSLTVTRDGSRDAVSNARPV

SEQ ID NO: 1005075 - protein, 5 aa, Mycobacterium
DPSMG

SEQ ID NO: 1005076 - protein, 6 aa, Mycobacterium
DPSPAI

SEQ ID NO: 1005077 - protein, 4 aa, Mycobacterium
DPSQ

SEQ ID NO: 1005078 - protein, 6 aa, Mycobacterium
DPSQGM

SEQ ID NO: 1005079 - protein, 7 aa, Mycobacterium
DPSRDID

SEQ ID NO: 1005080 - protein, 12 aa, Mycobacterium
DPSSATTLGKET

SEQ ID NO: 1005081 - protein, 11 aa, Mycobacterium
DPSSTRTGGSI

SEQ ID NO: 1005082 - protein, 9 aa, Mycobacterium
DPSTAPGAR

SEQ ID NO: 1005083 - protein, 8 aa, Mycobacterium
DPSTDAQG

SEQ ID NO: 1005084 - protein, 4 aa, Mycobacterium
DPSV

SEQ ID NO: 1005085 - protein, 5 aa, Mycobacterium
DPTAA

SEQ ID NO: 1005086 - protein, 7 aa, Mycobacterium
DPTAGAA

SEQ ID NO: 1005087 - protein, 6 aa, Mycobacterium
DPTAPS

SEQ ID NO: 1005088 - protein, 5 aa, Mycobacterium
DPTAY

SEQ ID NO: 1005089 - protein, 6 aa, Mycobacterium
DPTDAA

SEQ ID NO: 1005090 - protein, 11 aa, Mycobacterium
DPTDEQIREGL

SEQ ID NO: 1005091 - protein, 5 aa, Mycobacterium
DPTDR

SEQ ID NO: 1005092 - protein, 5 aa, Mycobacterium
DPTEL

SEQ ID NO: 1005093 - protein, 8 aa, Mycobacterium
DPTELSEE

SEQ ID NO: 1005094 - protein, 8 aa, Mycobacterium
DPTEPNRY

SEQ ID NO: 1005095 - protein, 4 aa, Mycobacterium
DPTF

SEQ ID NO: 1005096 - protein, 11 aa, Mycobacterium
DPTGKTVVPDP

SEQ ID NO: 1005097 - protein, 5 aa, Mycobacterium
DPTGY

SEQ ID NO: 1005098 - protein, 4 aa, Mycobacterium
DPTL

SEQ ID NO: 1005099 - protein, 10 aa, Mycobacterium
DPTLAPESAA

SEQ ID NO: 1005100 - protein, 6 aa, Mycobacterium
DPTLEP

SEQ ID NO: 1005101 - protein, 7 aa, Mycobacterium
DPTLRDE

SEQ ID NO: 1005102 - protein, 6 aa, Mycobacterium
DPTNFA

SEQ ID NO: 1005103 - protein, 5 aa, Mycobacterium
DPTNL

SEQ ID NO: 1005104 - protein, 4 aa, Mycobacterium
DPTQ

SEQ ID NO: 1005105 - protein, 4 aa, Mycobacterium
DPTR

SEQ ID NO: 1005106 - protein, 12 aa, Mycobacterium
DPTRQGDPDPLN

SEQ ID NO: 1005107 - protein, 9 aa, Mycobacterium
DPTSSKPPY

SEQ ID NO: 1005108 - protein, 5 aa, Mycobacterium
DPTSY

SEQ ID NO: 1005109 - protein, 8 aa, Mycobacterium
DPTTIGHR

SEQ ID NO: 1005110 - protein, 17 aa, Mycobacterium
DPTTRRAEFDPDSNGAR

SEQ ID NO: 1005111 - protein, 4 aa, Mycobacterium
DPTV

SEQ ID NO: 1005112 - protein, 12 aa, Mycobacterium
DPTVKGGTSNPW

SEQ ID NO: 1005113 - protein, 5 aa, Mycobacterium
DPTVS

SEQ ID NO: 1005114 - protein, 9 aa, Mycobacterium
DPVAEANRR

SEQ ID NO: 1005115 - protein, 8 aa, Mycobacterium
DPVAPKHQ

SEQ ID NO: 1005116 - protein, 9 aa, Mycobacterium
DPVEVTGSS

SEQ ID NO: 1005117 - protein, 6 aa, Mycobacterium
DPVGAR

SEQ ID NO: 1005118 - protein, 6 aa, Mycobacterium
DPVGDA

SEQ ID NO: 1005119 - protein, 6 aa, Mycobacterium
DPVPDL

SEQ ID NO: 1005120 - protein, 6 aa, Mycobacterium
DPVPDS

SEQ ID NO: 1005121 - protein, 6 aa, Mycobacterium
DPVQST

SEQ ID NO: 1005122 - protein, 11 aa, Mycobacterium
DPVQTERDDDT

SEQ ID NO: 1005123 - protein, 11 aa, Mycobacterium
DPVSRGPHATK

SEQ ID NO: 1005124 - protein, 4 aa, Mycobacterium
DPVT

SEQ ID NO: 1005125 - protein, 6 aa, Mycobacterium
DPWSGM

SEQ ID NO: 1005126 - protein, 9 aa, Mycobacterium
DPYADEPRL

SEQ ID NO: 1005127 - protein, 11 aa, Mycobacterium
DPYERADITSN

SEQ ID NO: 1005128 - protein, 4 aa, Mycobacterium
DPYQ

SEQ ID NO: 1005129 - protein, 4 aa, Mycobacterium
DQAA

SEQ ID NO: 1005130 - protein, 5 aa, Mycobacterium
DQAAA

SEQ ID NO: 1005131 - protein, 9 aa, Mycobacterium
DQAAAHPTA

SEQ ID NO: 1005132 - protein, 6 aa, Mycobacterium
DQADGP

SEQ ID NO: 1005133 - protein, 6 aa, Mycobacterium
DQAEPG

SEQ ID NO: 1005134 - protein, 17 aa, Mycobacterium
DQAGVGDDLGDTDGFGN

SEQ ID NO: 1005135 - protein, 5 aa, Mycobacterium
DQAHS

SEQ ID NO: 1005136 - protein, 6 aa, Mycobacterium
DQAIDY

SEQ ID NO: 1005137 - protein, 5 aa, Mycobacterium
DQAKA

SEQ ID NO: 1005138 - protein, 7 aa, Mycobacterium
DQAQPAR

SEQ ID NO: 1005139 - protein, 5 aa, Mycobacterium
DQAQR

SEQ ID NO: 1005140 - protein, 24 aa, Mycobacterium
DQAQTRSPSDPGYEPTAPPALTTP

SEQ ID NO: 1005141 - protein, 8 aa, Mycobacterium
DQARDNLD

SEQ ID NO: 1005142 - protein, 18 aa, Mycobacterium
DQATAAGDAAKAVEYDNA

SEQ ID NO: 1005143 - protein, 4 aa, Mycobacterium
DQAV

SEQ ID NO: 1005144 - protein, 14 aa, Mycobacterium
DQDDLDGQIRRTEG

SEQ ID NO: 1005145 - protein, 5 aa, Mycobacterium
DQDEV

SEQ ID NO: 1005146 - protein, 6 aa, Mycobacterium
DQDLAS

SEQ ID NO: 1005147 - protein, 13 aa, Mycobacterium
DQDPAVSSDYSHN

SEQ ID NO: 1005148 - protein, 7 aa, Mycobacterium
DQDSRLP

SEQ ID NO: 1005149 - protein, 13 aa, Mycobacterium
DQENPSDPPSALN

SEQ ID NO: 1005150 - protein, 5 aa, Mycobacterium
DQEPD

SEQ ID NO: 1005151 - protein, 12 aa, Mycobacterium
DQERDAARETIR

SEQ ID NO: 1005152 - protein, 11 aa, Mycobacterium
DQERGLSAGEK

SEQ ID NO: 1005153 - protein, 6 aa, Mycobacterium
DQESGE

SEQ ID NO: 1005154 - protein, 7 aa, Mycobacterium
DQFESEP

SEQ ID NO: 1005155 - protein, 6 aa, Mycobacterium
DQGEVD

SEQ ID NO: 1005156 - protein, 11 aa, Mycobacterium
DQGHPGGSRPY

SEQ ID NO: 1005157 - protein, 21 aa, Mycobacterium
DQGRWTGDSSAGLRSQRRGRG

SEQ ID NO: 1005158 - protein, 7 aa, Mycobacterium
DQGSRAL

SEQ ID NO: 1005159 - protein, 14 aa, Mycobacterium
DQGTRKVRDHPDFP

SEQ ID NO: 1005160 - protein, 7 aa, Mycobacterium
DQGTTST

SEQ ID NO: 1005161 - protein, 5 aa, Mycobacterium
DQGTV

SEQ ID NO: 1005162 - protein, 12 aa, Mycobacterium
DQHDVYTRRTGI

SEQ ID NO: 1005163 - protein, 20 aa, Mycobacterium
DQHGQYRGRGTHRGAAGRRD

SEQ ID NO: 1005164 - protein, 4 aa, Mycobacterium
DQID

SEQ ID NO: 1005165 - protein, 4 aa, Mycobacterium
DQIG

SEQ ID NO: 1005166 - protein, 12 aa, Mycobacterium
DQIGTGRKRFEE

SEQ ID NO: 1005167 - protein, 5 aa, Mycobacterium
DQIPG

SEQ ID NO: 1005168 - protein, 38 aa, Mycobacterium
DQKALPEPKGASTRAASDGAAQTTATAVRTSTKDRDGA

SEQ ID NO: 1005169 - protein, 5 aa, Mycobacterium
DQLAD

SEQ ID NO: 1005170 - protein, 27 aa, Mycobacterium
DQLAPGERCAATSNRNFEGRQGKGGRT

SEQ ID NO: 1005171 - protein, 17 aa, Mycobacterium
DQLDRSAASVAAQPTQT

SEQ ID NO: 1005172 - protein, 5 aa, Mycobacterium
DQLGP

SEQ ID NO: 1005173 - protein, 9 aa, Mycobacterium
DQLNSEGRP

SEQ ID NO: 1005174 - protein, 8 aa, Mycobacterium
DQLPERTY

SEQ ID NO: 1005175 - protein, 8 aa, Mycobacterium
DQLPSTHP

SEQ ID NO: 1005176 - protein, 11 aa, Mycobacterium
DQLRAKAPAGI

SEQ ID NO: 1005177 - protein, 7 aa, Mycobacterium
DQLSGEQ

SEQ ID NO: 1005178 - protein, 12 aa, Mycobacterium
DQLTAAKGRLGD

SEQ ID NO: 1005179 - protein, 7 aa, Mycobacterium
DQMTPPA

SEQ ID NO: 1005180 - protein, 4 aa, Mycobacterium
DQNL

SEQ ID NO: 1005181 - protein, 15 aa, Mycobacterium
DQNPIYADDPAARAV

SEQ ID NO: 1005182 - protein, 8 aa, Mycobacterium
DQNQQPVT

SEQ ID NO: 1005183 - protein, 5 aa, Mycobacterium
DQNRR

SEQ ID NO: 1005184 - protein, 7 aa, Mycobacterium
DQPAQQA

SEQ ID NO: 1005185 - protein, 7 aa, Mycobacterium
DQPARRP

SEQ ID NO: 1005186 - protein, 5 aa, Mycobacterium
DQPDN

SEQ ID NO: 1005187 - protein, 11 aa, Mycobacterium
DQPDTAIDDEL

SEQ ID NO: 1005188 - protein, 7 aa, Mycobacterium
DQPEHQW

SEQ ID NO: 1005189 - protein, 6 aa, Mycobacterium
DQPGVT

SEQ ID NO: 1005190 - protein, 5 aa, Mycobacterium
DQPLT

SEQ ID NO: 1005191 - protein, 11 aa, Mycobacterium
DQPPQTNEVGR

SEQ ID NO: 1005192 - protein, 6 aa, Mycobacterium
DQPQRD

SEQ ID NO: 1005193 - protein, 6 aa, Mycobacterium
DQPQRV

SEQ ID NO: 1005194 - protein, 4 aa, Mycobacterium
DQPW

SEQ ID NO: 1005195 - protein, 5 aa, Mycobacterium
DQPWS

SEQ ID NO: 1005196 - protein, 15 aa, Mycobacterium
DQQELHKAWEAPTYN

SEQ ID NO: 1005197 - protein, 5 aa, Mycobacterium
DQQHP

SEQ ID NO: 1005198 - protein, 28 aa, Mycobacterium
DQQPETSDATEASEGGEGTVTAPAHDPL

SEQ ID NO: 1005199 - protein, 8 aa, Mycobacterium
DQQRASAV

SEQ ID NO: 1005200 - protein, 9 aa, Mycobacterium
DQQRATTTA

SEQ ID NO: 1005201 - protein, 11 aa, Mycobacterium
DQQTESDAARD

SEQ ID NO: 1005202 - protein, 16 aa, Mycobacterium
DQQTQRGLQFVVAAKP

SEQ ID NO: 1005203 - protein, 14 aa, Mycobacterium
DQRGYGGSSRPEAI

SEQ ID NO: 1005204 - protein, 6 aa, Mycobacterium
DQRHAG

SEQ ID NO: 1005205 - protein, 5 aa, Mycobacterium
DQRPG

SEQ ID NO: 1005206 - protein, 13 aa, Mycobacterium
DQRPGTKKCGHQG

SEQ ID NO: 1005207 - protein, 6 aa, Mycobacterium
DQRRPE

SEQ ID NO: 1005208 - protein, 5 aa, Mycobacterium
DQRTA

SEQ ID NO: 1005209 - protein, 5 aa, Mycobacterium
DQRTV

SEQ ID NO: 1005210 - protein, 6 aa, Mycobacterium
DQSDVR

SEQ ID NO: 1005211 - protein, 5 aa, Mycobacterium
DQSEP

SEQ ID NO: 1005212 - protein, 6 aa, Mycobacterium
DQSERM

SEQ ID NO: 1005213 - protein, 5 aa, Mycobacterium
DQSGP

SEQ ID NO: 1005214 - protein, 8 aa, Mycobacterium
DQSKYASG

SEQ ID NO: 1005215 - protein, 43 aa, Mycobacterium
DQSNKIPPDSPHGGGLDTETPAQTNTSNGTVRRRYQPIPVSVE

SEQ ID NO: 1005216 - protein, 8 aa, Mycobacterium
DQSPGKSA

SEQ ID NO: 1005217 - protein, 11 aa, Mycobacterium
DQSPQRRGSPA

SEQ ID NO: 1005218 - protein, 16 aa, Mycobacterium
DQSSPATSVYDRERAQ

SEQ ID NO: 1005219 - protein, 5 aa, Mycobacterium
DQTAR

SEQ ID NO: 1005220 - protein, 4 aa, Mycobacterium
DQTH

SEQ ID NO: 1005221 - protein, 5 aa, Mycobacterium
DQTQV

SEQ ID NO: 1005222 - protein, 10 aa, Mycobacterium
DQTRAQRVTS

SEQ ID NO: 1005223 - protein, 4 aa, Mycobacterium
DQVA

SEQ ID NO: 1005224 - protein, 4 aa, Mycobacterium
DQVN

SEQ ID NO: 1005225 - protein, 4 aa, Mycobacterium
DQVP

SEQ ID NO: 1005226 - protein, 6 aa, Mycobacterium
DQVPAG

SEQ ID NO: 1005227 - protein, 4 aa, Mycobacterium
DQVT

SEQ ID NO: 1005228 - protein, 26 aa, Mycobacterium
DQYYSPDFGQATGAAVPLDDYGYSDY

SEQ ID NO: 1005229 - protein, 8 aa, Mycobacterium
DRAAAEAL

SEQ ID NO: 1005230 - protein, 11 aa, Mycobacterium
DRAARMGDAGR

SEQ ID NO: 1005231 - protein, 9 aa, Mycobacterium
DRAATDPLE

SEQ ID NO: 1005232 - protein, 10 aa, Mycobacterium
DRADDKPPYR

SEQ ID NO: 1005233 - protein, 27 aa, Mycobacterium
DRAERLATRNKDGRNLQHPRAAAPKVS

SEQ ID NO: 1005234 - protein, 10 aa, Mycobacterium
DRAETELGDT

SEQ ID NO: 1005235 - protein, 7 aa, Mycobacterium
DRAGAVE

SEQ ID NO: 1005236 - protein, 17 aa, Mycobacterium
DRAGSFPGQLSGGQQQR

SEQ ID NO: 1005237 - protein, 4 aa, Mycobacterium
DRAH

SEQ ID NO: 1005238 - protein, 9 aa, Mycobacterium
DRAKPAVPF

SEQ ID NO: 1005239 - protein, 6 aa, Mycobacterium
DRAPRY

SEQ ID NO: 1005240 - protein, 8 aa, Mycobacterium
DRAPVTGA

SEQ ID NO: 1005241 - protein, 4 aa, Mycobacterium
DRAQ

SEQ ID NO: 1005242 - protein, 7 aa, Mycobacterium
DRAQREL

SEQ ID NO: 1005243 - protein, 8 aa, Mycobacterium
DRAQTAKR

SEQ ID NO: 1005244 - protein, 5 aa, Mycobacterium
DRART

SEQ ID NO: 1005245 - protein, 13 aa, Mycobacterium
DRARTRPPGSATV

SEQ ID NO: 1005246 - protein, 6 aa, Mycobacterium
DRARTT

SEQ ID NO: 1005247 - protein, 7 aa, Mycobacterium
DRASGRF

SEQ ID NO: 1005248 - protein, 17 aa, Mycobacterium
DRASSDVLRQAAATCPT

SEQ ID NO: 1005249 - protein, 6 aa, Mycobacterium
DRASVG

SEQ ID NO: 1005250 - protein, 4 aa, Mycobacterium
DRAT

SEQ ID NO: 1005251 - protein, 7 aa, Mycobacterium
DRATADA

SEQ ID NO: 1005252 - protein, 7 aa, Mycobacterium
DRATAQA

SEQ ID NO: 1005253 - protein, 7 aa, Mycobacterium
DRATDPV

SEQ ID NO: 1005254 - protein, 6 aa, Mycobacterium
DRAVTT

SEQ ID NO: 1005255 - protein, 13 aa, Mycobacterium
DRCASARAENPHA

SEQ ID NO: 1005256 - protein, 10 aa, Mycobacterium
DRCGGPGLAG

SEQ ID NO: 1005257 - protein, 9 aa, Mycobacterium
DRDAASREV

SEQ ID NO: 1005258 - protein, 5 aa, Mycobacterium
DRDAL

SEQ ID NO: 1005259 - protein, 5 aa, Mycobacterium
DRDAM

SEQ ID NO: 1005260 - protein, 8 aa, Mycobacterium
DRDDPPLT

SEQ ID NO: 1005261 - protein, 9 aa, Mycobacterium
DRDDPRPQL

SEQ ID NO: 1005262 - protein, 9 aa, Mycobacterium
DRDEQRSTQ

SEQ ID NO: 1005263 - protein, 6 aa, Mycobacterium
DRDEQS

SEQ ID NO: 1005264 - protein, 7 aa, Mycobacterium
DRDGAGL

SEQ ID NO: 1005265 - protein, 7 aa, Mycobacterium
DRDGDKI

SEQ ID NO: 1005266 - protein, 5 aa, Mycobacterium
DRDGH

SEQ ID NO: 1005267 - protein, 8 aa, Mycobacterium
DRDIEAGT

SEQ ID NO: 1005268 - protein, 13 aa, Mycobacterium
DRDIEQERSAGNV

SEQ ID NO: 1005269 - protein, 11 aa, Mycobacterium
DRDKAQAKGSK

SEQ ID NO: 1005270 - protein, 7 aa, Mycobacterium
DRDLGHE

SEQ ID NO: 1005271 - protein, 5 aa, Mycobacterium
DRDPH

SEQ ID NO: 1005272 - protein, 4 aa, Mycobacterium
DRDQ

SEQ ID NO: 1005273 - protein, 5 aa, Mycobacterium
DRDRM

SEQ ID NO: 1005274 - protein, 6 aa, Mycobacterium
DRDRPT

SEQ ID NO: 1005275 - protein, 7 aa, Mycobacterium
DRDRRLP

SEQ ID NO: 1005276 - protein, 4 aa, Mycobacterium
DRDS

SEQ ID NO: 1005277 - protein, 19 aa, Mycobacterium
DRDSGQRARDEIAAASGAD

SEQ ID NO: 1005278 - protein, 20 aa, Mycobacterium
DRDVTASGRGQPGCRGPATS

SEQ ID NO: 1005279 - protein, 18 aa, Mycobacterium
DREADRQFDHDGRGAPKV

SEQ ID NO: 1005280 - protein, 14 aa, Mycobacterium
DREDQPYKESYGMA

SEQ ID NO: 1005281 - protein, 14 aa, Mycobacterium
DREEAATALRAADN

SEQ ID NO: 1005282 - protein, 7 aa, Mycobacterium
DREFRET

SEQ ID NO: 1005283 - protein, 5 aa, Mycobacterium
DREGA

SEQ ID NO: 1005284 - protein, 7 aa, Mycobacterium
DREGREP

SEQ ID NO: 1005285 - protein, 8 aa, Mycobacterium
DREGRPRS

SEQ ID NO: 1005286 - protein, 10 aa, Mycobacterium
DREPRKAAIA

SEQ ID NO: 1005287 - protein, 7 aa, Mycobacterium
DREPTRA

SEQ ID NO: 1005288 - protein, 4 aa, Mycobacterium
DRER

SEQ ID NO: 1005289 - protein, 4 aa, Mycobacterium
DRES

SEQ ID NO: 1005290 - protein, 9 aa, Mycobacterium
DRESELPSR

SEQ ID NO: 1005291 - protein, 12 aa, Mycobacterium
DRFRPDPAARAE

SEQ ID NO: 1005292 - protein, 4 aa, Mycobacterium
DRFT

SEQ ID NO: 1005293 - protein, 4 aa, Mycobacterium
DRGA

SEQ ID NO: 1005294 - protein, 8 aa, Mycobacterium
DRGAGAGA

SEQ ID NO: 1005295 - protein, 9 aa, Mycobacterium
DRGATSLTE

SEQ ID NO: 1005296 - protein, 4 aa, Mycobacterium
DRGC

SEQ ID NO: 1005297 - protein, 7 aa, Mycobacterium
DRGDRSV

SEQ ID NO: 1005298 - protein, 11 aa, Mycobacterium
DRGEAHPDVDP

SEQ ID NO: 1005299 - protein, 6 aa, Mycobacterium
DRGEIT

SEQ ID NO: 1005300 - protein, 7 aa, Mycobacterium
DRGETAR

SEQ ID NO: 1005301 - protein, 11 aa, Mycobacterium
DRGGPTYTKDT

SEQ ID NO: 1005302 - protein, 7 aa, Mycobacterium
DRGHGTV

SEQ ID NO: 1005303 - protein, 5 aa, Mycobacterium
DRGHT

SEQ ID NO: 1005304 - protein, 8 aa, Mycobacterium
DRGISNDD

SEQ ID NO: 1005305 - protein, 7 aa, Mycobacterium
DRGMNRD

SEQ ID NO: 1005306 - protein, 22 aa, Mycobacterium
DRGQSGPGRAGRTRGGAGWSAG

SEQ ID NO: 1005307 - protein, 7 aa, Mycobacterium
DRGRGFE

SEQ ID NO: 1005308 - protein, 7 aa, Mycobacterium
DRGRPEL

SEQ ID NO: 1005309 - protein, 7 aa, Mycobacterium
DRGRTGV

SEQ ID NO: 1005310 - protein, 6 aa, Mycobacterium
DRGSSV

SEQ ID NO: 1005311 - protein, 14 aa, Mycobacterium
DRGTQLQRARAGEI

SEQ ID NO: 1005312 - protein, 5 aa, Mycobacterium
DRGYT

SEQ ID NO: 1005313 - protein, 6 aa, Mycobacterium
DRHAHR

SEQ ID NO: 1005314 - protein, 6 aa, Mycobacterium
DRHERD

SEQ ID NO: 1005315 - protein, 10 aa, Mycobacterium
DRHGKTRGFP

SEQ ID NO: 1005316 - protein, 13 aa, Mycobacterium
DRHGPADDRRYTY

SEQ ID NO: 1005317 - protein, 5 aa, Mycobacterium
DRHGR

SEQ ID NO: 1005318 - protein, 20 aa, Mycobacterium
DRHLTTSQPSPDYPCEGRPD

SEQ ID NO: 1005319 - protein, 24 aa, Mycobacterium
DRHRTGRNNTYGAAGYSFLSSNAP

SEQ ID NO: 1005320 - protein, 4 aa, Mycobacterium
DRID

SEQ ID NO: 1005321 - protein, 8 aa, Mycobacterium
DRIPGTAA

SEQ ID NO: 1005322 - protein, 6 aa, Mycobacterium
DRKDGA

SEQ ID NO: 1005323 - protein, 11 aa, Mycobacterium
DRKHAAKNPKA

SEQ ID NO: 1005324 - protein, 9 aa, Mycobacterium
DRKKALSDT

SEQ ID NO: 1005325 - protein, 8 aa, Mycobacterium
DRKPGRIA

SEQ ID NO: 1005326 - protein, 5 aa, Mycobacterium
DRLGN

SEQ ID NO: 1005327 - protein, 4 aa, Mycobacterium
DRLS

SEQ ID NO: 1005328 - protein, 12 aa, Mycobacterium
DRLSAADRETFT

SEQ ID NO: 1005329 - protein, 20 aa, Mycobacterium
DRMTGGSAAQRAARQAQAQA

SEQ ID NO: 1005330 - protein, 12 aa, Mycobacterium
DRNAAGRSRGNK

SEQ ID NO: 1005331 - protein, 6 aa, Mycobacterium
DRNFSE

SEQ ID NO: 1005332 - protein, 10 aa, Mycobacterium
DRNGEVPWTA

SEQ ID NO: 1005333 - protein, 6 aa, Mycobacterium
DRNHEE

SEQ ID NO: 1005334 - protein, 7 aa, Mycobacterium
DRNKEQR

SEQ ID NO: 1005335 - protein, 4 aa, Mycobacterium
DRNP

SEQ ID NO: 1005336 - protein, 6 aa, Mycobacterium
DRNPLH

SEQ ID NO: 1005337 - protein, 23 aa, Mycobacterium
DRNPSPESLDEAQAKIKKALSEL

SEQ ID NO: 1005338 - protein, 11 aa, Mycobacterium
DRNPTGSIKDR

SEQ ID NO: 1005339 - protein, 5 aa, Mycobacterium
DRNQE

SEQ ID NO: 1005340 - protein, 5 aa, Mycobacterium
DRPAP

SEQ ID NO: 1005341 - protein, 9 aa, Mycobacterium
DRPASQRFT

SEQ ID NO: 1005342 - protein, 4 aa, Mycobacterium
DRPD

SEQ ID NO: 1005343 - protein, 6 aa, Mycobacterium
DRPDIQ

SEQ ID NO: 1005344 - protein, 8 aa, Mycobacterium
DRPEHTWT

SEQ ID NO: 1005345 - protein, 8 aa, Mycobacterium
DRPEQRWP

SEQ ID NO: 1005346 - protein, 9 aa, Mycobacterium
DRPESLNSL

SEQ ID NO: 1005347 - protein, 7 aa, Mycobacterium
DRPEVSA

SEQ ID NO: 1005348 - protein, 7 aa, Mycobacterium
DRPFTTT

SEQ ID NO: 1005349 - protein, 8 aa, Mycobacterium
DRPGGKGH

SEQ ID NO: 1005350 - protein, 5 aa, Mycobacterium
DRPGH

SEQ ID NO: 1005351 - protein, 7 aa, Mycobacterium
DRPGKAA

SEQ ID NO: 1005352 - protein, 5 aa, Mycobacterium
DRPGT

SEQ ID NO: 1005353 - protein, 4 aa, Mycobacterium
DRPH

SEQ ID NO: 1005354 - protein, 12 aa, Mycobacterium
DRPISKSDAIEG

SEQ ID NO: 1005355 - protein, 7 aa, Mycobacterium
DRPKESY

SEQ ID NO: 1005356 - protein, 8 aa, Mycobacterium
DRPNRGRR

SEQ ID NO: 1005357 - protein, 8 aa, Mycobacterium
DRPPAAAT

SEQ ID NO: 1005358 - protein, 9 aa, Mycobacterium
DRPPAPDRV

SEQ ID NO: 1005359 - protein, 7 aa, Mycobacterium
DRPPDHH

SEQ ID NO: 1005360 - protein, 6 aa, Mycobacterium
DRPPLS

SEQ ID NO: 1005361 - protein, 5 aa, Mycobacterium
DRPPM

SEQ ID NO: 1005362 - protein, 6 aa, Mycobacterium
DRPPPD

SEQ ID NO: 1005363 - protein, 6 aa, Mycobacterium
DRPSPH

SEQ ID NO: 1005364 - protein, 4 aa, Mycobacterium
DRPT

SEQ ID NO: 1005365 - protein, 20 aa, Mycobacterium
DRPTASRSEFRATPAFDGEA

SEQ ID NO: 1005366 - protein, 12 aa, Mycobacterium
DRPYDTAEHRRA

SEQ ID NO: 1005367 - protein, 22 aa, Mycobacterium
DRQAHAELGGTHADTPRAVLAR

SEQ ID NO: 1005368 - protein, 7 aa, Mycobacterium
DRQELQS

SEQ ID NO: 1005369 - protein, 10 aa, Mycobacterium
DRQGAERARD

SEQ ID NO: 1005370 - protein, 9 aa, Mycobacterium
DRQKNGTFE

SEQ ID NO: 1005371 - protein, 4 aa, Mycobacterium
DRQR

SEQ ID NO: 1005372 - protein, 8 aa, Mycobacterium
DRQRPGTE

SEQ ID NO: 1005373 - protein, 7 aa, Mycobacterium
DRRAAEA

SEQ ID NO: 1005374 - protein, 15 aa, Mycobacterium
DRRAEQIRAGGPDIL

SEQ ID NO: 1005375 - protein, 5 aa, Mycobacterium
DRRAG

SEQ ID NO: 1005376 - protein, 8 aa, Mycobacterium
DRRARKGE

SEQ ID NO: 1005377 - protein, 8 aa, Mycobacterium
DRRDDGYH

SEQ ID NO: 1005378 - protein, 7 aa, Mycobacterium
DRRDTNC

SEQ ID NO: 1005379 - protein, 4 aa, Mycobacterium
DRRE

SEQ ID NO: 1005380 - protein, 6 aa, Mycobacterium
DRRGND

SEQ ID NO: 1005381 - protein, 12 aa, Mycobacterium
DRRGPGDTSPSL

SEQ ID NO: 1005382 - protein, 7 aa, Mycobacterium
DRRNGSI

SEQ ID NO: 1005383 - protein, 10 aa, Mycobacterium
DRRPDLPSGK

SEQ ID NO: 1005384 - protein, 13 aa, Mycobacterium
DRRPGGLRPQRPG

SEQ ID NO: 1005385 - protein, 13 aa, Mycobacterium
DRRPHNSAVRHSN

SEQ ID NO: 1005386 - protein, 6 aa, Mycobacterium
DRRPKI

SEQ ID NO: 1005387 - protein, 5 aa, Mycobacterium
DRRQP

SEQ ID NO: 1005388 - protein, 5 aa, Mycobacterium
DRRRG

SEQ ID NO: 1005389 - protein, 7 aa, Mycobacterium
DRRRGNP

SEQ ID NO: 1005390 - protein, 15 aa, Mycobacterium
DRRRGRARSMGGPER

SEQ ID NO: 1005391 - protein, 19 aa, Mycobacterium
DRRRRGERSGDGSDAELRE

SEQ ID NO: 1005392 - protein, 18 aa, Mycobacterium
DRRSARKRNALAARSRKR

SEQ ID NO: 1005393 - protein, 7 aa, Mycobacterium
DRRSRAA

SEQ ID NO: 1005394 - protein, 8 aa, Mycobacterium
DRRSTQGN

SEQ ID NO: 1005395 - protein, 6 aa, Mycobacterium
DRRTEL

SEQ ID NO: 1005396 - protein, 6 aa, Mycobacterium
DRRTHG

SEQ ID NO: 1005397 - protein, 5 aa, Mycobacterium
DRRTT

SEQ ID NO: 1005398 - protein, 6 aa, Mycobacterium
DRRYTA

SEQ ID NO: 1005399 - protein, 30 aa, Mycobacterium; identical to SEQ ID NO: 456777

SEQ ID NO: 1005400 - protein, 43 aa, Mycobacterium
DRSAKPPSDGPPGGGLSSESAPENGSANADAKTRYQAIPITLQ

SEQ ID NO: 1005401 - protein, 12 aa, Mycobacterium
DRSASALGGSGW

SEQ ID NO: 1005402 - protein, 6 aa, Mycobacterium
DRSAVD

SEQ ID NO: 1005403 - protein, 4 aa, Mycobacterium
DRSD

SEQ ID NO: 1005404 - protein, 8 aa, Mycobacterium
DRSDRGPG

SEQ ID NO: 1005405 - protein, 5 aa, Mycobacterium
DRSEV

SEQ ID NO: 1005406 - protein, 11 aa, Mycobacterium
DRSGKHPPNAR

SEQ ID NO: 1005407 - protein, 7 aa, Mycobacterium
DRSKQQA

SEQ ID NO: 1005408 - protein, 23 aa, Mycobacterium
DRSPSDAAGDLTGCQRPECAADP

SEQ ID NO: 1005409 - protein, 7 aa, Mycobacterium
DRSPSDQ

SEQ ID NO: 1005410 - protein, 8 aa, Mycobacterium
DRSRQDPR

SEQ ID NO: 1005411 - protein, 6 aa, Mycobacterium
DRTADP

SEQ ID NO: 1005412 - protein, 8 aa, Mycobacterium
DRTGALSP

SEQ ID NO: 1005413 - protein, 7 aa, Mycobacterium
DRTGLGQ

SEQ ID NO: 1005414 - protein, 10 aa, Mycobacterium
DRTGSGPNGH

SEQ ID NO: 1005415 - protein, 144 aa, Mycobacterium
DRTNGTPAAAEPTPDSGEQKSSASTEAPAVNEATKDAPQQEQNASSGDTVRRERRRSSRDSETSSRDGADSAGESPDKRGKRAAGGDADNNQKAPEKAQEDAKIDGGAAESGGDQGAGQQGSGGQQSRGEDDGEGRQGRRGRRF

SEQ ID NO: 1005416 - protein, 6 aa, Mycobacterium
DRTPAL

SEQ ID NO: 1005417 - protein, 6 aa, Mycobacterium
DRTPDA

SEQ ID NO: 1005418 - protein, 5 aa, Mycobacterium
DRTPR

SEQ ID NO: 1005419 - protein, 7 aa, Mycobacterium
DRTQDGI

SEQ ID NO: 1005420 - protein, 12 aa, Mycobacterium
DRTRAKGASQWG

SEQ ID NO: 1005421 - protein, 24 aa, Mycobacterium
DRTSRTGKLETNRVRPVTTLSTVA

SEQ ID NO: 1005422 - protein, 6 aa, Mycobacterium
DRTTTT

SEQ ID NO: 1005423 - protein, 11 aa, Mycobacterium
DRTYTAPHGGE

SEQ ID NO: 1005424 - protein, 5 aa, Mycobacterium
DRVAR

SEQ ID NO: 1005425 - protein, 4 aa, Mycobacterium
DRVD

SEQ ID NO: 1005426 - protein, 5 aa, Mycobacterium
DRVDT

SEQ ID NO: 1005427 - protein, 8 aa, Mycobacterium
DRVGARPG

SEQ ID NO: 1005428 - protein, 6 aa, Mycobacterium
DRVGGR

SEQ ID NO: 1005429 - protein, 7 aa, Mycobacterium
DRVGGRV

SEQ ID NO: 1005430 - protein, 6 aa, Mycobacterium
DRVPDA

SEQ ID NO: 1005431 - protein, 8 aa, Mycobacterium
DRVPNSGY

SEQ ID NO: 1005432 - protein, 4 aa, Mycobacterium
DRVT

SEQ ID NO: 1005433 - protein, 9 aa, Mycobacterium
DRYASGAAR

SEQ ID NO: 1005434 - protein, 33 aa, Mycobacterium; identical to SEQ ID NO: 899853

SEQ ID NO: 1005435 - protein, 5 aa, Mycobacterium
DRYPN

SEQ ID NO: 1005436 - protein, 5 aa, Mycobacterium
DRYPT

SEQ ID NO: 1005437 - protein, 8 aa, Mycobacterium
DRYTPTPA

SEQ ID NO: 1005438 - protein, 7 aa, Mycobacterium
DSAADAN

SEQ ID NO: 1005439 - protein, 8 aa, Mycobacterium
DSAAEELS

SEQ ID NO: 1005440 - protein, 9 aa, Mycobacterium
DSAAEPPAT

SEQ ID NO: 1005441 - protein, 7 aa, Mycobacterium
DSAAGDI

SEQ ID NO: 1005442 - protein, 14 aa, Mycobacterium
DSAARGKQLNAGQA

SEQ ID NO: 1005443 - protein, 9 aa, Mycobacterium
DSAASSNDG

SEQ ID NO: 1005444 - protein, 5 aa, Mycobacterium
DSADI

SEQ ID NO: 1005445 - protein, 6 aa, Mycobacterium
DSAEGL

SEQ ID NO: 1005446 - protein, 11 aa, Mycobacterium
DSAGARIQDTA

SEQ ID NO: 1005447 - protein, 5 aa, Mycobacterium
DSAGE

SEQ ID NO: 1005448 - protein, 5 aa, Mycobacterium
DSAGG

SEQ ID NO: 1005449 - protein, 9 aa, Mycobacterium
DSAGGPVLS

SEQ ID NO: 1005450 - protein, 6 aa, Mycobacterium
DSAGGY

SEQ ID NO: 1005451 - protein, 13 aa, Mycobacterium
DSAGNISKRQSAT

SEQ ID NO: 1005452 - protein, 9 aa, Mycobacterium
DSAGTDMES

SEQ ID NO: 1005453 - protein, 13 aa, Mycobacterium
DSAKGADLAETPY

SEQ ID NO: 1005454 - protein, 8 aa, Mycobacterium
DSAKLTDL

SEQ ID NO: 1005455 - protein, 4 aa, Mycobacterium
DSAR

SEQ ID NO: 1005456 - protein, 7 aa, Mycobacterium
DSARAGI

SEQ ID NO: 1005457 - protein, 7 aa, Mycobacterium
DSARDRL

SEQ ID NO: 1005458 - protein, 5 aa, Mycobacterium
DSARQ

SEQ ID NO: 1005459 - protein, 6 aa, Mycobacterium
DSASAA

SEQ ID NO: 1005460 - protein, 8 aa, Mycobacterium
DSATARRL

SEQ ID NO: 1005461 - protein, 9 aa, Mycobacterium
DSATDGDTV

SEQ ID NO: 1005462 - protein, 11 aa, Mycobacterium
DSATGETQKFD

SEQ ID NO: 1005463 - protein, 4 aa, Mycobacterium
DSDA

SEQ ID NO: 1005464 - protein, 9 aa, Mycobacterium
DSDAPGGAG

SEQ ID NO: 1005465 - protein, 6 aa, Mycobacterium
DSDAYT

SEQ ID NO: 1005466 - protein, 12 aa, Mycobacterium
DSDEERAIERES

SEQ ID NO: 1005467 - protein, 15 aa, Mycobacterium
DSDGNGGGHHRGRRD

SEQ ID NO: 1005468 - protein, 37 aa, Mycobacterium; identical to SEQ ID NO: 457300

SEQ ID NO: 1005469 - protein, 5 aa, Mycobacterium
DSDPF

SEQ ID NO: 1005470 - protein, 7 aa, Mycobacterium
DSDRAGL

SEQ ID NO: 1005471 - protein, 14 aa, Mycobacterium
DSDREGHYAAPDHQ

SEQ ID NO: 1005472 - protein, 4 aa, Mycobacterium
DSDS

SEQ ID NO: 1005473 - protein, 6 aa, Mycobacterium
DSDSFD

SEQ ID NO: 1005474 - protein, 16 aa, Mycobacterium
DSDTEQSGKLPGTDLR

SEQ ID NO: 1005475 - protein, 10 aa, Mycobacterium
DSDVAGPAEL

SEQ ID NO: 1005476 - protein, 5 aa, Mycobacterium
DSDYG

SEQ ID NO: 1005477 - protein, 24 aa, Mycobacterium
DSEADWGPYAAPTAPENAPNILYL

SEQ ID NO: 1005478 - protein, 5 aa, Mycobacterium
DSEDG

SEQ ID NO: 1005479 - protein, 5 aa, Mycobacterium
DSEGC

SEQ ID NO: 1005480 - protein, 8 aa, Mycobacterium
DSEGDGTA

SEQ ID NO: 1005481 - protein, 8 aa, Mycobacterium
DSEHSAAR

SEQ ID NO: 1005482 - protein, 4 aa, Mycobacterium
DSEI

SEQ ID NO: 1005483 - protein, 9 aa, Mycobacterium
DSELPDGSI

SEQ ID NO: 1005484 - protein, 9 aa, Mycobacterium
DSEPGRGTA

SEQ ID NO: 1005485 - protein, 7 aa, Mycobacterium
DSEQLPA

SEQ ID NO: 1005486 - protein, 7 aa, Mycobacterium
DSEQRKG

SEQ ID NO: 1005487 - protein, 9 aa, Mycobacterium
DSETPPGKL

SEQ ID NO: 1005488 - protein, 4 aa, Mycobacterium
DSEY

SEQ ID NO: 1005489 - protein, 9 aa, Mycobacterium
DSFGAARSA

SEQ ID NO: 1005490 - protein, 11 aa, Mycobacterium
DSFSDGGRYCD

SEQ ID NO: 1005491 - protein, 6 aa, Mycobacterium
DSGAAE

SEQ ID NO: 1005492 - protein, 26 aa, Mycobacterium
DSGAGGSGGPNGGTDPGGTGGNGGRA

SEQ ID NO: 1005493 - protein, 7 aa, Mycobacterium
DSGARSL

SEQ ID NO: 1005494 - protein, 6 aa, Mycobacterium
DSGDTA

SEQ ID NO: 1005495 - protein, 7 aa, Mycobacterium
DSGEATS

SEQ ID NO: 1005496 - protein, 8 aa, Mycobacterium
DSGEDRQA

SEQ ID NO: 1005497 - protein, 7 aa, Mycobacterium
DSGEETA

SEQ ID NO: 1005498 - protein, 7 aa, Mycobacterium
DSGEGPR

SEQ ID NO: 1005499 - protein, 5 aa, Mycobacterium
DSGEP

SEQ ID NO: 1005500 - protein, 17 aa, Mycobacterium
DSGEQITDSEPDDCDVR

SEQ ID NO: 1005501 - protein, 4 aa, Mycobacterium
DSGF

SEQ ID NO: 1005502 - protein, 12 aa, Mycobacterium
DSGFDVQADGHG

SEQ ID NO: 1005503 - protein, 7 aa, Mycobacterium
DSGGERA

SEQ ID NO: 1005504 - protein, 15 aa, Mycobacterium
DSGGKVSAARKPVVG

SEQ ID NO: 1005505 - protein, 6 aa, Mycobacterium
DSGGTL

SEQ ID NO: 1005506 - protein, 7 aa, Mycobacterium
DSGGVPI

SEQ ID NO: 1005507 - protein, 5 aa, Mycobacterium
DSGHN

SEQ ID NO: 1005508 - protein, 17 aa, Mycobacterium
DSGITEADRHQLRSALL

SEQ ID NO: 1005509 - protein, 6 aa, Mycobacterium
DSGKAH

SEQ ID NO: 1005510 - protein, 7 aa, Mycobacterium
DSGLAGQ

SEQ ID NO: 1005511 - protein, 10 aa, Mycobacterium
DSGPGNPDGF

SEQ ID NO: 1005512 - protein, 5 aa, Mycobacterium
DSGRH

SEQ ID NO: 1005513 - protein, 16 aa, Mycobacterium
DSGYADERDPAARTAR

SEQ ID NO: 1005514 - protein, 14 aa, Mycobacterium
DSHEVTRAGEPISL

SEQ ID NO: 1005515 - protein, 11 aa, Mycobacterium
DSHPCSAGAAR

SEQ ID NO: 1005516 - protein, 16 aa, Mycobacterium
DSHVTGPAGPGHSTPG

SEQ ID NO: 1005517 - protein, 6 aa, Mycobacterium
DSIARK

SEQ ID NO: 1005518 - protein, 12 aa, Mycobacterium
DSIGKPDNEGMS

SEQ ID NO: 1005519 - protein, 11 aa, Mycobacterium
DSKATNPHAAE

SEQ ID NO: 1005520 - protein, 11 aa, Mycobacterium
DSKFSRPNDRR

SEQ ID NO: 1005521 - protein, 14 aa, Mycobacterium
DSKKPAVSPKTWSG

SEQ ID NO: 1005522 - protein, 6 aa, Mycobacterium
DSKSMP

SEQ ID NO: 1005523 - protein, 9 aa, Mycobacterium
DSLAAAEKP

SEQ ID NO: 1005524 - protein, 7 aa, Mycobacterium
DSLDERR

SEQ ID NO: 1005525 - protein, 8 aa, Mycobacterium
DSLDSEYA

SEQ ID NO: 1005526 - protein, 11 aa, Mycobacterium
DSLQDSGGDSI

SEQ ID NO: 1005527 - protein, 5 aa, Mycobacterium
DSLRA

SEQ ID NO: 1005528 - protein, 14 aa, Mycobacterium
DSLRSAAADAVSAG

SEQ ID NO: 1005529 - protein, 6 aa, Mycobacterium
DSLSNG

SEQ ID NO: 1005530 - protein, 20 aa, Mycobacterium
DSNGSEPSRGFLQRRIAECQ

SEQ ID NO: 1005531 - protein, 6 aa, Mycobacterium
DSNKTQ

SEQ ID NO: 1005532 - protein, 7 aa, Mycobacterium
DSNTADG

SEQ ID NO: 1005533 - protein, 9 aa, Mycobacterium
DSNTSTVSS

SEQ ID NO: 1005534 - protein, 7 aa, Mycobacterium
DSPAALG

SEQ ID NO: 1005535 - protein, 17 aa, Mycobacterium
DSPDALAAADPSDFADD

SEQ ID NO: 1005536 - protein, 5 aa, Mycobacterium
DSPDF

SEQ ID NO: 1005537 - protein, 6 aa, Mycobacterium
DSPDGP

SEQ ID NO: 1005538 - protein, 7 aa, Mycobacterium
DSPDPDR

SEQ ID NO: 1005539 - protein, 16 aa, Mycobacterium
DSPELAKRSQRLTTGA

SEQ ID NO: 1005540 - protein, 10 aa, Mycobacterium
DSPFGPPPGV

SEQ ID NO: 1005541 - protein, 7 aa, Mycobacterium
DSPGGPQ

SEQ ID NO: 1005542 - protein, 6 aa, Mycobacterium
DSPGIG

SEQ ID NO: 1005543 - protein, 7 aa, Mycobacterium
DSPGITV

SEQ ID NO: 1005544 - protein, 8 aa, Mycobacterium
DSPGNTDR

SEQ ID NO: 1005545 - protein, 9 aa, Mycobacterium
DSPLDGQAA

SEQ ID NO: 1005546 - protein, 5 aa, Mycobacterium
DSPLN

SEQ ID NO: 1005547 - protein, 11 aa, Mycobacterium
DSPLPRDGSSP

SEQ ID NO: 1005548 - protein, 6 aa, Mycobacterium
DSPNSA

SEQ ID NO: 1005549 - protein, 16 aa, Mycobacterium
DSPPGSPGINSAGSGV

SEQ ID NO: 1005550 - protein, 7 aa, Mycobacterium
DSPPTGR

SEQ ID NO: 1005551 - protein, 6 aa, Mycobacterium
DSPRPW

SEQ ID NO: 1005552 - protein, 6 aa, Mycobacterium
DSPSGP

SEQ ID NO: 1005553 - protein, 9 aa, Mycobacterium
DSPSKAAGY

SEQ ID NO: 1005554 - protein, 18 aa, Mycobacterium
DSPVKSDSRLARKRTTVG

SEQ ID NO: 1005555 - protein, 10 aa, Mycobacterium
DSPYQRPKHP

SEQ ID NO: 1005556 - protein, 8 aa, Mycobacterium
DSQDPSKV

SEQ ID NO: 1005557 - protein, 7 aa, Mycobacterium
DSQDSFG

SEQ ID NO: 1005558 - protein, 6 aa, Mycobacterium
DSQDVP

SEQ ID NO: 1005559 - protein, 6 aa, Mycobacterium
DSQESS

SEQ ID NO: 1005560 - protein, 4 aa, Mycobacterium
DSQG

SEQ ID NO: 1005561 - protein, 6 aa, Mycobacterium
DSQRGN

SEQ ID NO: 1005562 - protein, 7 aa, Mycobacterium
DSQSGEQ

SEQ ID NO: 1005563 - protein, 15 aa, Mycobacterium
DSRAAALRDTAPAPV

SEQ ID NO: 1005564 - protein, 5 aa, Mycobacterium
DSRAR

SEQ ID NO: 1005565 - protein, 16 aa, Mycobacterium
DSRDAAGSGRDRHANL

SEQ ID NO: 1005566 - protein, 8 aa, Mycobacterium
DSRGDTVH

SEQ ID NO: 1005567 - protein, 7 aa, Mycobacterium
DSRHGSA

SEQ ID NO: 1005568 - protein, 6 aa, Mycobacterium
DSRPLD

SEQ ID NO: 1005569 - protein, 5 aa, Mycobacterium
DSRQQ

SEQ ID NO: 1005570 - protein, 13 aa, Mycobacterium
DSRRPDGAHGDTS

SEQ ID NO: 1005571 - protein, 9 aa, Mycobacterium
DSRRSFSTT

SEQ ID NO: 1005572 - protein, 7 aa, Mycobacterium
DSRTNGS

SEQ ID NO: 1005573 - protein, 5 aa, Mycobacterium
DSRTV

SEQ ID NO: 1005574 - protein, 13 aa, Mycobacterium
DSRWRPARGVSKV

SEQ ID NO: 1005575 - protein, 14 aa, Mycobacterium
DSSDALTGSGGPVT

SEQ ID NO: 1005576 - protein, 8 aa, Mycobacterium
DSSDSPVP

SEQ ID NO: 1005577 - protein, 7 aa, Mycobacterium
DSSETLN

SEQ ID NO: 1005578 - protein, 9 aa, Mycobacterium
DSSIGGKDH

SEQ ID NO: 1005579 - protein, 7 aa, Mycobacterium
DSSIPEA

SEQ ID NO: 1005580 - protein, 6 aa, Mycobacterium
DSSPAL

SEQ ID NO: 1005581 - protein, 7 aa, Mycobacterium
DSSPRSS

SEQ ID NO: 1005582 - protein, 7 aa, Mycobacterium
DSSTPVA

SEQ ID NO: 1005583 - protein, 10 aa, Mycobacterium
DSSVAPATVR

SEQ ID NO: 1005584 - protein, 25 aa, Mycobacterium
DSSVSLGPEVTSSDDDTLRLACVRI

SEQ ID NO: 1005585 - protein, 7 aa, Mycobacterium
DSSYNGV

SEQ ID NO: 1005586 - protein, 7 aa, Mycobacterium
DSTAALR

SEQ ID NO: 1005587 - protein, 7 aa, Mycobacterium
DSTALYP

SEQ ID NO: 1005588 - protein, 13 aa, Mycobacterium
DSTEKYKLPADDR

SEQ ID NO: 1005589 - protein, 8 aa, Mycobacterium
DSTGADYA

SEQ ID NO: 1005590 - protein, 8 aa, Mycobacterium
DSTGAEPI

SEQ ID NO: 1005591 - protein, 14 aa, Mycobacterium
DSTGASLAYSGDTG

SEQ ID NO: 1005592 - protein, 10 aa, Mycobacterium
DSTGLPDTPL

SEQ ID NO: 1005593 - protein, 14 aa, Mycobacterium
DSTGPQLSADHPGV

SEQ ID NO: 1005594 - protein, 8 aa, Mycobacterium
DSTLADKN

SEQ ID NO: 1005595 - protein, 5 aa, Mycobacterium
DSTLG

SEQ ID NO: 1005596 - protein, 7 aa, Mycobacterium
DSTPPPW

SEQ ID NO: 1005597 - protein, 12 aa, Mycobacterium
DSTSVGPGPGNM

SEQ ID NO: 1005598 - protein, 9 aa, Mycobacterium
DSTTLSESA

SEQ ID NO: 1005599 - protein, 7 aa, Mycobacterium
DSTVPDA

SEQ ID NO: 1005600 - protein, 5 aa, Mycobacterium
DSVCS

SEQ ID NO: 1005601 - protein, 16 aa, Mycobacterium
DSVNSFDSSSSSDSLY

SEQ ID NO: 1005602 - protein, 16 aa, Mycobacterium
DSVNSFHSSSSSDSLY

SEQ ID NO: 1005603 - protein, 4 aa, Mycobacterium
DSVQ

SEQ ID NO: 1005604 - protein, 11 aa, Mycobacterium
DSVRDCGGDSI

SEQ ID NO: 1005605 - protein, 10 aa, Mycobacterium
DSVRSAADAL

SEQ ID NO: 1005606 - protein, 6 aa, Mycobacterium
DSVSER

SEQ ID NO: 1005607 - protein, 6 aa, Mycobacterium
DSVSRG

SEQ ID NO: 1005608 - protein, 15 aa, Mycobacterium
DSVTKSKFDNKYGTR

SEQ ID NO: 1005609 - protein, 6 aa, Mycobacterium
DSYADD

SEQ ID NO: 1005610 - protein, 6 aa, Mycobacterium
DSYLTP

SEQ ID NO: 1005611 - protein, 7 aa, Mycobacterium
DTAAGAG

SEQ ID NO: 1005612 - protein, 6 aa, Mycobacterium
DTADGW

SEQ ID NO: 1005613 - protein, 4 aa, Mycobacterium
DTAE

SEQ ID NO: 1005614 - protein, 6 aa, Mycobacterium
DTAEEA

SEQ ID NO: 1005615 - protein, 12 aa, Mycobacterium
DTAEQFSDQDPF

SEQ ID NO: 1005616 - protein, 4 aa, Mycobacterium
DTAG

SEQ ID NO: 1005617 - protein, 7 aa, Mycobacterium
DTAGGNS

SEQ ID NO: 1005618 - protein, 13 aa, Mycobacterium
DTAGTAPPPLTRE

SEQ ID NO: 1005619 - protein, 8 aa, Mycobacterium
DTAGVSAA

SEQ ID NO: 1005620 - protein, 23 aa, Mycobacterium
DTAHEARVEGAADPLDAQGAGDQ

SEQ ID NO: 1005621 - protein, 8 aa, Mycobacterium
DTAKAGDN

SEQ ID NO: 1005622 - protein, 11 aa, Mycobacterium
DTAKEKPQEGT

SEQ ID NO: 1005623 - protein, 6 aa, Mycobacterium
DTANPT

SEQ ID NO: 1005624 - protein, 8 aa, Mycobacterium
DTAPNAGH

SEQ ID NO: 1005625 - protein, 5 aa, Mycobacterium
DTAQA

SEQ ID NO: 1005626 - protein, 4 aa, Mycobacterium
DTAR

SEQ ID NO: 1005627 - protein, 10 aa, Mycobacterium
DTARRNARRC

SEQ ID NO: 1005628 - protein, 35 aa, Mycobacterium
DTARRTAISTADSLRAEQKAASKSVGGASPEERPA

SEQ ID NO: 1005629 - protein, 8 aa, Mycobacterium
DTASRVDR

SEQ ID NO: 1005630 - protein, 6 aa, Mycobacterium
DTASTQ

SEQ ID NO: 1005631 - protein, 4 aa, Mycobacterium
DTAT

SEQ ID NO: 1005632 - protein, 12 aa, Mycobacterium
DTATRSSVRPRE

SEQ ID NO: 1005633 - protein, 4 aa, Mycobacterium
DTCP

SEQ ID NO: 1005634 - protein, 10 aa, Mycobacterium
DTCTECPDGT

SEQ ID NO: 1005635 - protein, 6 aa, Mycobacterium
DTDDCD

SEQ ID NO: 1005636 - protein, 15 aa, Mycobacterium
DTDDGSARRSNWPER

SEQ ID NO: 1005637 - protein, 8 aa, Mycobacterium
DTDEGPDA

SEQ ID NO: 1005638 - protein, 8 aa, Mycobacterium
DTDGNGVA

SEQ ID NO: 1005639 - protein, 7 aa, Mycobacterium
DTDHGTI

SEQ ID NO: 1005640 - protein, 18 aa, Mycobacterium
DTDLSNPPAGMAPGRAEN

SEQ ID NO: 1005641 - protein, 15 aa, Mycobacterium
DTDNDKDIEKFDPGL

SEQ ID NO: 1005642 - protein, 9 aa, Mycobacterium
DTDPASPLQ

SEQ ID NO: 1005643 - protein, 44 aa, Mycobacterium
DTDPEPEPEPEAEEPAAEAGDAAAAAAPAAAPAAPSGGPRPDDI

SEQ ID NO: 1005644 - protein, 5 aa, Mycobacterium
DTDRD

SEQ ID NO: 1005645 - protein, 10 aa, Mycobacterium
DTDRDGNTRS

SEQ ID NO: 1005646 - protein, 7 aa, Mycobacterium
DTDRGGK

SEQ ID NO: 1005647 - protein, 7 aa, Mycobacterium
DTDSHPK

SEQ ID NO: 1005648 - protein, 7 aa, Mycobacterium
DTDTTNT

SEQ ID NO: 1005649 - protein, 6 aa, Mycobacterium
DTDVVE

SEQ ID NO: 1005650 - protein, 6 aa, Mycobacterium
DTEAAV

SEQ ID NO: 1005651 - protein, 8 aa, Mycobacterium
DTEAEQEL

SEQ ID NO: 1005652 - protein, 5 aa, Mycobacterium
DTEAQ

SEQ ID NO: 1005653 - protein, 4 aa, Mycobacterium
DTEE

SEQ ID NO: 1005654 - protein, 7 aa, Mycobacterium
DTEGRGV

SEQ ID NO: 1005655 - protein, 7 aa, Mycobacterium
DTEHPDE

SEQ ID NO: 1005656 - protein, 6 aa, Mycobacterium
DTEHTQ

SEQ ID NO: 1005657 - protein, 10 aa, Mycobacterium
DTEKAAANAP

SEQ ID NO: 1005658 - protein, 9 aa, Mycobacterium
DTEPATRER

SEQ ID NO: 1005659 - protein, 10 aa, Mycobacterium
DTEPSFAPGA

SEQ ID NO: 1005660 - protein, 7 aa, Mycobacterium
DTEPYRK

SEQ ID NO: 1005661 - protein, 14 aa, Mycobacterium
DTEQAQSKDSAESK

SEQ ID NO: 1005662 - protein, 9 aa, Mycobacterium
DTERGTGGN

SEQ ID NO: 1005663 - protein, 5 aa, Mycobacterium
DTERQ

SEQ ID NO: 1005664 - protein, 10 aa, Mycobacterium
DTERQRAQGR

SEQ ID NO: 1005665 - protein, 12 aa, Mycobacterium
DTETADGHAERL

SEQ ID NO: 1005666 - protein, 16 aa, Mycobacterium
DTETEAREREKTELAE

SEQ ID NO: 1005667 - protein, 7 aa, Mycobacterium
DTETFPG

SEQ ID NO: 1005668 - protein, 15 aa, Mycobacterium
DTEWSKSGKHTGRTD

SEQ ID NO: 1005669 - protein, 5 aa, Mycobacterium
DTEYR

SEQ ID NO: 1005670 - protein, 19 aa, Mycobacterium
DTFSSDGEGEGARKKLPSV

SEQ ID NO: 1005671 - protein, 24 aa, Mycobacterium
DTGAAGQTGKPPTVSDGADEPIVT

SEQ ID NO: 1005672 - protein, 14 aa, Mycobacterium
DTGADLAKTNVNGG

SEQ ID NO: 1005673 - protein, 12 aa, Mycobacterium
DTGAGSPPAGRS

SEQ ID NO: 1005674 - protein, 7 aa, Mycobacterium
DTGAHEE

SEQ ID NO: 1005675 - protein, 13 aa, Mycobacterium
DTGANLTNPIAAV

SEQ ID NO: 1005676 - protein, 5 aa, Mycobacterium
DTGAR

SEQ ID NO: 1005677 - protein, 5 aa, Mycobacterium
DTGDT

SEQ ID NO: 1005678 - protein, 8 aa, Mycobacterium
DTGETPTI

SEQ ID NO: 1005679 - protein, 4 aa, Mycobacterium
DTGG

SEQ ID NO: 1005680 - protein, 7 aa, Mycobacterium
DTGGDVD

SEQ ID NO: 1005681 - protein, 5 aa, Mycobacterium
DTGGF

SEQ ID NO: 1005682 - protein, 9 aa, Mycobacterium
DTGGKTPLA

SEQ ID NO: 1005683 - protein, 9 aa, Mycobacterium
DTGHGGDPH

SEQ ID NO: 1005684 - protein, 8 aa, Mycobacterium
DTGIQDAP

SEQ ID NO: 1005685 - protein, 5 aa, Mycobacterium
DTGLS

SEQ ID NO: 1005686 - protein, 11 aa, Mycobacterium
DTGLYKDSDRL

SEQ ID NO: 1005687 - protein, 8 aa, Mycobacterium
DTGNESIG

SEQ ID NO: 1005688 - protein, 4 aa, Mycobacterium
DTGP

SEQ ID NO: 1005689 - protein, 5 aa, Mycobacterium
DTGPL

SEQ ID NO: 1005690 - protein, 8 aa, Mycobacterium
DTGPLTKQ

SEQ ID NO: 1005691 - protein, 5 aa, Mycobacterium
DTGQP

SEQ ID NO: 1005692 - protein, 5 aa, Mycobacterium
DTGRF

SEQ ID NO: 1005693 - protein, 8 aa, Mycobacterium
DTGRSPAD

SEQ ID NO: 1005694 - protein, 10 aa, Mycobacterium
DTGSAERSLR

SEQ ID NO: 1005695 - protein, 7 aa, Mycobacterium
DTGSGDV

SEQ ID NO: 1005696 - protein, 21 aa, Mycobacterium
DTGVGEPALAPIKPGDVDGRS

SEQ ID NO: 1005697 - protein, 8 aa, Mycobacterium
DTGVPRPG

SEQ ID NO: 1005698 - protein, 5 aa, Mycobacterium
DTGVS

SEQ ID NO: 1005699 - protein, 7 aa, Mycobacterium
DTHSPRQ

SEQ ID NO: 1005700 - protein, 4 aa, Mycobacterium
DTHY

SEQ ID NO: 1005701 - protein, 10 aa, Mycobacterium
DTIATGGSIT

SEQ ID NO: 1005702 - protein, 7 aa, Mycobacterium
DTIGPER

SEQ ID NO: 1005703 - protein, 7 aa, Mycobacterium
DTIRNGY

SEQ ID NO: 1005704 - protein, 7 aa, Mycobacterium
DTKGDLP

SEQ ID NO: 1005705 - protein, 7 aa, Mycobacterium
DTKHTGD

SEQ ID NO: 1005706 - protein, 8 aa, Mycobacterium
DTLAPGHG

SEQ ID NO: 1005707 - protein, 5 aa, Mycobacterium
DTLDE

SEQ ID NO: 1005708 - protein, 9 aa, Mycobacterium
DTLPDNEAA

SEQ ID NO: 1005709 - protein, 6 aa, Mycobacterium
DTLPEG

SEQ ID NO: 1005710 - protein, 6 aa, Mycobacterium
DTLPKT

SEQ ID NO: 1005711 - protein, 5 aa, Mycobacterium
DTLRG

SEQ ID NO: 1005712 - protein, 4 aa, Mycobacterium
DTNA

SEQ ID NO: 1005713 - protein, 6 aa, Mycobacterium
DTNGTV

SEQ ID NO: 1005714 - protein, 4 aa, Mycobacterium
DTNL

SEQ ID NO: 1005715 - protein, 7 aa, Mycobacterium
DTNPASA

SEQ ID NO: 1005716 - protein, 7 aa, Mycobacterium
DTNRSRQ

SEQ ID NO: 1005717 - protein, 7 aa, Mycobacterium
DTNTGIA

SEQ ID NO: 1005718 - protein, 10 aa, Mycobacterium
DTPAAPSVSF

SEQ ID NO: 1005719 - protein, 10 aa, Mycobacterium
DTPAGPPDST

SEQ ID NO: 1005720 - protein, 13 aa, Mycobacterium
DTPDQAGEKARQI

SEQ ID NO: 1005721 - protein, 6 aa, Mycobacterium
DTPELL

SEQ ID NO: 1005722 - protein, 6 aa, Mycobacterium
DTPGFT

SEQ ID NO: 1005723 - protein, 7 aa, Mycobacterium
DTPGGSA

SEQ ID NO: 1005724 - protein, 8 aa, Mycobacterium
DTPGGSTV

SEQ ID NO: 1005725 - protein, 15 aa, Mycobacterium
DTPGTSSLNRDTSER

SEQ ID NO: 1005726 - protein, 9 aa, Mycobacterium
DTPHTRPVP

SEQ ID NO: 1005727 - protein, 15 aa, Mycobacterium
DTPKPQIREEASRRG

SEQ ID NO: 1005728 - protein, 6 aa, Mycobacterium
DTPLGA

SEQ ID NO: 1005729 - protein, 4 aa, Mycobacterium
DTPP

SEQ ID NO: 1005730 - protein, 11 aa, Mycobacterium
DTPPLGKTGPV

SEQ ID NO: 1005731 - protein, 6 aa, Mycobacterium
DTPPVA

SEQ ID NO: 1005732 - protein, 9 aa, Mycobacterium
DTPRPGDPR

SEQ ID NO: 1005733 - protein, 9 aa, Mycobacterium
DTPSERAEN

SEQ ID NO: 1005734 - protein, 6 aa, Mycobacterium
DTPTPL

SEQ ID NO: 1005735 - protein, 5 aa, Mycobacterium
DTPVP

SEQ ID NO: 1005736 - protein, 7 aa, Mycobacterium
DTQCAQD

SEQ ID NO: 1005737 - protein, 6 aa, Mycobacterium
DTQLGE

SEQ ID NO: 1005738 - protein, 4 aa, Mycobacterium
DTQR

SEQ ID NO: 1005739 - protein, 6 aa, Mycobacterium
DTQTGK

SEQ ID NO: 1005740 - protein, 13 aa, Mycobacterium
DTQTRTPIPVDTR

SEQ ID NO: 1005741 - protein, 14 aa, Mycobacterium
DTRDDSSLAADTDR

SEQ ID NO: 1005742 - protein, 9 aa, Mycobacterium
DTRDFDDAD

SEQ ID NO: 1005743 - protein, 6 aa, Mycobacterium
DTRGQQ

SEQ ID NO: 1005744 - protein, 10 aa, Mycobacterium
DTRHNSSDDG

SEQ ID NO: 1005745 - protein, 4 aa, Mycobacterium
DTRL

SEQ ID NO: 1005746 - protein, 5 aa, Mycobacterium
DTRQP

SEQ ID NO: 1005747 - protein, 22 aa, Mycobacterium
DTRRGSIGPEARTRLAEAGRRL

SEQ ID NO: 1005748 - protein, 6 aa, Mycobacterium
DTRSED

SEQ ID NO: 1005749 - protein, 7 aa, Mycobacterium
DTSDDRM

SEQ ID NO: 1005750 - protein, 5 aa, Mycobacterium
DTSDQ

SEQ ID NO: 1005751 - protein, 8 aa, Mycobacterium
DTSGSTQV

SEQ ID NO: 1005752 - protein, 15 aa, Mycobacterium
DTSISTTISGTLDPP

SEQ ID NO: 1005753 - protein, 6 aa, Mycobacterium
DTSPTV

SEQ ID NO: 1005754 - protein, 6 aa, Mycobacterium
DTSRCG

SEQ ID NO: 1005755 - protein, 6 aa, Mycobacterium
DTSRSR

SEQ ID NO: 1005756 - protein, 6 aa, Mycobacterium
DTSSGV

SEQ ID NO: 1005757 - protein, 6 aa, Mycobacterium
DTSSQL

SEQ ID NO: 1005758 - protein, 9 aa, Mycobacterium
DTSTSTATT

SEQ ID NO: 1005759 - protein, 9 aa, Mycobacterium
DTSTTGNSA

SEQ ID NO: 1005760 - protein, 7 aa, Mycobacterium
DTTAEDL

SEQ ID NO: 1005761 - protein, 22 aa, Mycobacterium
DTTDRPAHVTQDDLSNSYSLEV

SEQ ID NO: 1005762 - protein, 12 aa, Mycobacterium
DTTDVASDRYPP

SEQ ID NO: 1005763 - protein, 11 aa, Mycobacterium
DTTFDNRTRGQ

SEQ ID NO: 1005764 - protein, 14 aa, Mycobacterium
DTTFYDSPATERPV

SEQ ID NO: 1005765 - protein, 7 aa, Mycobacterium
DTTGGYR

SEQ ID NO: 1005766 - protein, 4 aa, Mycobacterium
DTTL

SEQ ID NO: 1005767 - protein, 7 aa, Mycobacterium
DTTPPDY

SEQ ID NO: 1005768 - protein, 4 aa, Mycobacterium
DTTR

SEQ ID NO: 1005769 - protein, 4 aa, Mycobacterium
DTTS

SEQ ID NO: 1005770 - protein, 5 aa, Mycobacterium
DTTST

SEQ ID NO: 1005771 - protein, 7 aa, Mycobacterium
DTTSTAT

SEQ ID NO: 1005772 - protein, 13 aa, Mycobacterium
DTTTGDTLSDPNN

SEQ ID NO: 1005773 - protein, 5 aa, Mycobacterium
DTTTQ

SEQ ID NO: 1005774 - protein, 7 aa, Mycobacterium
DTTTSTG

SEQ ID NO: 1005775 - protein, 7 aa, Mycobacterium
DTTTTTG

SEQ ID NO: 1005776 - protein, 4 aa, Mycobacterium
DTTV

SEQ ID NO: 1005777 - protein, 8 aa, Mycobacterium
DTVEPTSW

SEQ ID NO: 1005778 - protein, 7 aa, Mycobacterium
DTVGHER

SEQ ID NO: 1005779 - protein, 7 aa, Mycobacterium
DTVHGGW

SEQ ID NO: 1005780 - protein, 6 aa, Mycobacterium
DTVKDR

SEQ ID NO: 1005781 - protein, 7 aa, Mycobacterium
DTVSGEW

SEQ ID NO: 1005782 - protein, 16 aa, Mycobacterium
DTVSVPGRSLILLRKT

SEQ ID NO: 1005783 - protein, 4 aa, Mycobacterium
DTYI

SEQ ID NO: 1005784 - protein, 7 aa, Mycobacterium
DTYSGGM

SEQ ID NO: 1005785 - protein, 6 aa, Mycobacterium
DVAAGA

SEQ ID NO: 1005786 - protein, 6 aa, Mycobacterium
DVADDD

SEQ ID NO: 1005787 - protein, 13 aa, Mycobacterium
DVADTPRPPLAER

SEQ ID NO: 1005788 - protein, 7 aa, Mycobacterium
DVAESED

SEQ ID NO: 1005789 - protein, 8 aa, Mycobacterium
DVAGGSGK

SEQ ID NO: 1005790 - protein, 6 aa, Mycobacterium
DVAGHG

SEQ ID NO: 1005791 - protein, 5 aa, Mycobacterium
DVAGI

SEQ ID NO: 1005792 - protein, 21 aa, Mycobacterium
DVAGIGSSVGAANTAAVGATT

SEQ ID NO: 1005793 - protein, 7 aa, Mycobacterium
DVASGDN

SEQ ID NO: 1005794 - protein, 8 aa, Mycobacterium
DVATANPA

SEQ ID NO: 1005795 - protein, 11 aa, Mycobacterium
DVATGEAGRPV

SEQ ID NO: 1005796 - protein, 16 aa, Mycobacterium
DVATGSIDVSEANRSR

SEQ ID NO: 1005797 - protein, 7 aa, Mycobacterium
DVATGVT

SEQ ID NO: 1005798 - protein, 12 aa, Mycobacterium
DVDAARAARHVG

SEQ ID NO: 1005799 - protein, 9 aa, Mycobacterium
DVDASAARK

SEQ ID NO: 1005800 - protein, 9 aa, Mycobacterium
DVDDPYPIS

SEQ ID NO: 1005801 - protein, 7 aa, Mycobacterium
DVDERDR

SEQ ID NO: 1005802 - protein, 11 aa, Mycobacterium
DVDESTQAEQL

SEQ ID NO: 1005803 - protein, 4 aa, Mycobacterium
DVDG

SEQ ID NO: 1005804 - protein, 5 aa, Mycobacterium
DVDPD

SEQ ID NO: 1005805 - protein, 5 aa, Mycobacterium
DVDPR

SEQ ID NO: 1005806 - protein, 12 aa, Mycobacterium
DVDSAESDEARA

SEQ ID NO: 1005807 - protein, 8 aa, Mycobacterium
DVDSPRLD

SEQ ID NO: 1005808 - protein, 6 aa, Mycobacterium
DVFESK

SEQ ID NO: 1005809 - protein, 8 aa, Mycobacterium
DVGAPPSV

SEQ ID NO: 1005810 - protein, 9 aa, Mycobacterium
DVGATERHG

SEQ ID NO: 1005811 - protein, 13 aa, Mycobacterium
DVGATQKVGTEDV

SEQ ID NO: 1005812 - protein, 7 aa, Mycobacterium
DVGDHRL

SEQ ID NO: 1005813 - protein, 13 aa, Mycobacterium
DVGEPAVKEAGAD

SEQ ID NO: 1005814 - protein, 8 aa, Mycobacterium
DVGGSGLR

SEQ ID NO: 1005815 - protein, 7 aa, Mycobacterium
DVGQSRI

SEQ ID NO: 1005816 - protein, 9 aa, Mycobacterium
DVGSEGAAY

SEQ ID NO: 1005817 - protein, 7 aa, Mycobacterium
DVGSNRV

SEQ ID NO: 1005818 - protein, 13 aa, Mycobacterium
DVGSPPRLAEPGP

SEQ ID NO: 1005819 - protein, 7 aa, Mycobacterium
DVGSSED

SEQ ID NO: 1005820 - protein, 9 aa, Mycobacterium
DVGTRDRAE

SEQ ID NO: 1005821 - protein, 5 aa, Mycobacterium
DVHAN

SEQ ID NO: 1005822 - protein, 10 aa, Mycobacterium
DVHGQDGRLD

SEQ ID NO: 1005823 - protein, 8 aa, Mycobacterium
DVNDPQPG

SEQ ID NO: 1005824 - protein, 6 aa, Mycobacterium
DVNGTM

SEQ ID NO: 1005825 - protein, 25 aa, Mycobacterium
DVNTGVGATTDSGLATSGFGNTGEV

SEQ ID NO: 1005826 - protein, 7 aa, Mycobacterium
DVPADQD

SEQ ID NO: 1005827 - protein, 76 aa, Mycobacterium
DVPAPADLPPAPEDLPPAPEDLAPPAPADLPPAPEDLPPAPQDLPPAPEDVAAPAPADLPPAPADLPPAPEDLAPP

SEQ ID NO: 1005828 - protein, 6 aa, Mycobacterium
DVPASE

SEQ ID NO: 1005829 - protein, 6 aa, Mycobacterium
DVPDND

SEQ ID NO: 1005830 - protein, 6 aa, Mycobacterium
DVPEDV

SEQ ID NO: 1005831 - protein, 7 aa, Mycobacterium
DVPENEH

SEQ ID NO: 1005832 - protein, 4 aa, Mycobacterium
DVPG

SEQ ID NO: 1005833 - protein, 8 aa, Mycobacterium
DVPGTGDV

SEQ ID NO: 1005834 - protein, 10 aa, Mycobacterium
DVPLGPASMP

SEQ ID NO: 1005835 - protein, 7 aa, Mycobacterium
DVPMAGE

SEQ ID NO: 1005836 - protein, 6 aa, Mycobacterium
DVPPGA

SEQ ID NO: 1005837 - protein, 13 aa, Mycobacterium
DVPPSVSAGGPLA

SEQ ID NO: 1005838 - protein, 12 aa, Mycobacterium
DVPRPNEAPAAS

SEQ ID NO: 1005839 - protein, 9 aa, Mycobacterium
DVPTATSVR

SEQ ID NO: 1005840 - protein, 10 aa, Mycobacterium
DVPTEQSRRF

SEQ ID NO: 1005841 - protein, 8 aa, Mycobacterium
DVPTGQPA

SEQ ID NO: 1005842 - protein, 8 aa, Mycobacterium
DVRAGGGA

SEQ ID NO: 1005843 - protein, 6 aa, Mycobacterium
DVRANT

SEQ ID NO: 1005844 - protein, 9 aa, Mycobacterium
DVRKPGSDR

SEQ ID NO: 1005845 - protein, 8 aa, Mycobacterium
DVRSGDQV

SEQ ID NO: 1005846 - protein, 18 aa, Mycobacterium
DVSARDQQKSDGQWTRAK

SEQ ID NO: 1005847 - protein, 8 aa, Mycobacterium
DVSDGGGN

SEQ ID NO: 1005848 - protein, 9 aa, Mycobacterium
DVSDPDDPC

SEQ ID NO: 1005849 - protein, 13 aa, Mycobacterium
DVSGDGDAATIGA

SEQ ID NO: 1005850 - protein, 9 aa, Mycobacterium
DVSGGASGI

SEQ ID NO: 1005851 - protein, 8 aa, Mycobacterium
DVSNDAQV

SEQ ID NO: 1005852 - protein, 8 aa, Mycobacterium
DVSPDGTQ

SEQ ID NO: 1005853 - protein, 5 aa, Mycobacterium
DVSPG

SEQ ID NO: 1005854 - protein, 4 aa, Mycobacterium
DVST

SEQ ID NO: 1005855 - protein, 4 aa, Mycobacterium
DVTA

SEQ ID NO: 1005856 - protein, 8 aa, Mycobacterium
DVTAEEAE

SEQ ID NO: 1005857 - protein, 7 aa, Mycobacterium
DVTAGAG

SEQ ID NO: 1005858 - protein, 5 aa, Mycobacterium
DVTAN

SEQ ID NO: 1005859 - protein, 4 aa, Mycobacterium
DVTD

SEQ ID NO: 1005860 - protein, 12 aa, Mycobacterium
DVTDGLEKAAAR

SEQ ID NO: 1005861 - protein, 15 aa, Mycobacterium
DVTDSLAPPLPPVPD

SEQ ID NO: 1005862 - protein, 4 aa, Mycobacterium
DVTE

SEQ ID NO: 1005863 - protein, 12 aa, Mycobacterium
DVTGGAAASGGF

SEQ ID NO: 1005864 - protein, 7 aa, Mycobacterium
DVTGRRP

SEQ ID NO: 1005865 - protein, 10 aa, Mycobacterium
DVTGRSVTGT

SEQ ID NO: 1005866 - protein, 13 aa, Mycobacterium
DVTGTSKGKGFAG

SEQ ID NO: 1005867 - protein, 4 aa, Mycobacterium
DVTN

SEQ ID NO: 1005868 - protein, 15 aa, Mycobacterium
DVTNQPQGNGQAVGN

SEQ ID NO: 1005869 - protein, 18 aa, Mycobacterium
DVTPEERRRIAETGFYAY

SEQ ID NO: 1005870 - protein, 17 aa, Mycobacterium
DVTPQPHNGVRPPKRRR

SEQ ID NO: 1005871 - protein, 9 aa, Mycobacterium
DVTRRNPDE

SEQ ID NO: 1005872 - protein, 7 aa, Mycobacterium
DVTSGDD

SEQ ID NO: 1005873 - protein, 4 aa, Mycobacterium
DWAE

SEQ ID NO: 1005874 - protein, 8 aa, Mycobacterium
DWARRNPQ

SEQ ID NO: 1005875 - protein, 9 aa, Mycobacterium
DWDPSQTTL

SEQ ID NO: 1005876 - protein, 4 aa, Mycobacterium
DWED

SEQ ID NO: 1005877 - protein, 9 aa, Mycobacterium
DWEGAPTRL

SEQ ID NO: 1005878 - protein, 9 aa, Mycobacterium
DWGSPKIPE

SEQ ID NO: 1005879 - protein, 8 aa, Mycobacterium
DWPASPLP

SEQ ID NO: 1005880 - protein, 12 aa, Mycobacterium
DWPDTGHPRRAG

SEQ ID NO: 1005881 - protein, 8 aa, Mycobacterium
DWTPSYQR

SEQ ID NO: 1005882 - protein, 6 aa, Mycobacterium
DWTTPE

SEQ ID NO: 1005883 - protein, 10 aa, Mycobacterium
DYANKQGSPN

SEQ ID NO: 1005884 - protein, 5 aa, Mycobacterium
DYANS

SEQ ID NO: 1005885 - protein, 7 aa, Mycobacterium
DYAQKPA

SEQ ID NO: 1005886 - protein, 8 aa, Mycobacterium
DYARGGSA

SEQ ID NO: 1005887 - protein, 10 aa, Mycobacterium
DYARGGSASQ

SEQ ID NO: 1005888 - protein, 12 aa, Mycobacterium
DYATGSSQVAPL

SEQ ID NO: 1005889 - protein, 4 aa, Mycobacterium
DYDD

SEQ ID NO: 1005890 - protein, 4 aa, Mycobacterium
DYDG

SEQ ID NO: 1005891 - protein, 16 aa, Mycobacterium
DYDKYREDAGPNDHTV

SEQ ID NO: 1005892 - protein, 11 aa, Mycobacterium
DYDQVSNNLGG

SEQ ID NO: 1005893 - protein, 6 aa, Mycobacterium
DYEEGG

SEQ ID NO: 1005894 - protein, 5 aa, Mycobacterium
DYETS

SEQ ID NO: 1005895 - protein, 4 aa, Mycobacterium
DYFE

SEQ ID NO: 1005896 - protein, 4 aa, Mycobacterium
DYGG

SEQ ID NO: 1005897 - protein, 6 aa, Mycobacterium
DYGQAA

SEQ ID NO: 1005898 - protein, 6 aa, Mycobacterium
DYGQLS

SEQ ID NO: 1005899 - protein, 10 aa, Mycobacterium
DYGSGDAEDP

SEQ ID NO: 1005900 - protein, 7 aa, Mycobacterium
DYGSSVG

SEQ ID NO: 1005901 - protein, 6 aa, Mycobacterium
DYLPPY

SEQ ID NO: 1005902 - protein, 4 aa, Mycobacterium
DYNP

SEQ ID NO: 1005903 - protein, 9 aa, Mycobacterium
DYNQRSQRQ

SEQ ID NO: 1005904 - protein, 13 aa, Mycobacterium
DYPAPPPRETLDA

SEQ ID NO: 1005905 - protein, 14 aa, Mycobacterium
DYPATGKRTLQDNG

SEQ ID NO: 1005906 - protein, 7 aa, Mycobacterium
DYPDRDA

SEQ ID NO: 1005907 - protein, 10 aa, Mycobacterium
DYPDVSPPRG

SEQ ID NO: 1005908 - protein, 7 aa, Mycobacterium
DYPGTDH

SEQ ID NO: 1005909 - protein, 8 aa, Mycobacterium
DYPHPEGL

SEQ ID NO: 1005910 - protein, 8 aa, Mycobacterium
DYPPDDQL

SEQ ID NO: 1005911 - protein, 12 aa, Mycobacterium
DYPPGEAAAARS

SEQ ID NO: 1005912 - protein, 13 aa, Mycobacterium
DYPRTVGKAGQNV

SEQ ID NO: 1005913 - protein, 7 aa, Mycobacterium
DYPTPTQ

SEQ ID NO: 1005914 - protein, 4 aa, Mycobacterium
DYQE

SEQ ID NO: 1005915 - protein, 8 aa, Mycobacterium
DYQPGQSG

SEQ ID NO: 1005916 - protein, 18 aa, Mycobacterium
DYRDGGDTGEVTWLSRGV

SEQ ID NO: 1005917 - protein, 5 aa, Mycobacterium
DYRGA

SEQ ID NO: 1005918 - protein, 11 aa, Mycobacterium
DYRHAGSASAV

SEQ ID NO: 1005919 - protein, 10 aa, Mycobacterium
DYSEEGTVDK

SEQ ID NO: 1005920 - protein, 4 aa, Mycobacterium
DYSG

SEQ ID NO: 1005921 - protein, 14 aa, Mycobacterium
DYSGASGYTSARPQ

SEQ ID NO: 1005922 - protein, 10 aa, Mycobacterium
DYSLGGEQSG

SEQ ID NO: 1005923 - protein, 5 aa, Mycobacterium
DYSQG

SEQ ID NO: 1005924 - protein, 12 aa, Mycobacterium
DYSRRGRSDHPH

SEQ ID NO: 1005925 - protein, 11 aa, Mycobacterium
DYSRRKHTEAG

SEQ ID NO: 1005926 - protein, 4 aa, Mycobacterium
DYSS

SEQ ID NO: 1005927 - protein, 9 aa, Mycobacterium
DYTDPAEAR

SEQ ID NO: 1005928 - protein, 8 aa, Mycobacterium
DYTREPGV

SEQ ID NO: 1005929 - protein, 14 aa, Mycobacterium
EAAAAAAKAGEGPV

SEQ ID NO: 1005930 - protein, 5 aa, Mycobacterium
EAAAD

SEQ ID NO: 1005931 - protein, 14 aa, Mycobacterium
EAAAEQQVKGQQAA

SEQ ID NO: 1005932 - protein, 12 aa, Mycobacterium
EAAAGRGLTGGG

SEQ ID NO: 1005933 - protein, 10 aa, Mycobacterium
EAADDPRFGE

SEQ ID NO: 1005934 - protein, 11 aa, Mycobacterium
EAADGVRSLPG

SEQ ID NO: 1005935 - protein, 7 aa, Mycobacterium
EAADPGE

SEQ ID NO: 1005936 - protein, 4 aa, Mycobacterium
EAAE

SEQ ID NO: 1005937 - protein, 5 aa, Mycobacterium
EAAEG

SEQ ID NO: 1005938 - protein, 7 aa, Mycobacterium
EAAEKAK

SEQ ID NO: 1005939 - protein, 15 aa, Mycobacterium
EAAELGDRPLTPADV

SEQ ID NO: 1005940 - protein, 9 aa, Mycobacterium
EAAGAPTVS

SEQ ID NO: 1005941 - protein, 12 aa, Mycobacterium
EAAGASRRTAVD

SEQ ID NO: 1005942 - protein, 11 aa, Mycobacterium
EAAGASSLQSL

SEQ ID NO: 1005943 - protein, 7 aa, Mycobacterium
EAAGGRA

SEQ ID NO: 1005944 - protein, 8 aa, Mycobacterium
EAAGMPPG

SEQ ID NO: 1005945 - protein, 6 aa, Mycobacterium
EAAGRS

SEQ ID NO: 1005946 - protein, 8 aa, Mycobacterium
EAAKARRF

SEQ ID NO: 1005947 - protein, 7 aa, Mycobacterium
EAAKPGS

SEQ ID NO: 1005948 - protein, 17 aa, Mycobacterium
EAANGPRGRQGSPSRVA

SEQ ID NO: 1005949 - protein, 15 aa, Mycobacterium
EAANGTGAISYEPTN

SEQ ID NO: 1005950 - protein, 7 aa, Mycobacterium
EAANVTP

SEQ ID NO: 1005951 - protein, 9 aa, Mycobacterium
EAAPDRPPW

SEQ ID NO: 1005952 - protein, 9 aa, Mycobacterium
EAAPPAAGR

SEQ ID NO: 1005953 - protein, 9 aa, Mycobacterium
EAAPTAGLM

SEQ ID NO: 1005954 - protein, 10 aa, Mycobacterium
EAAQAAGSQV

SEQ ID NO: 1005955 - protein, 9 aa, Mycobacterium
EAAQAGPIA

SEQ ID NO: 1005956 - protein, 10 aa, Mycobacterium
EAAQDMGVTT

SEQ ID NO: 1005957 - protein, 12 aa, Mycobacterium
EAAQGAPQSHRS

SEQ ID NO: 1005958 - protein, 8 aa, Mycobacterium
EAAQQTFE

SEQ ID NO: 1005959 - protein, 10 aa, Mycobacterium
EAAQRGRQAY

SEQ ID NO: 1005960 - protein, 9 aa, Mycobacterium
EAAQSTPQR

SEQ ID NO: 1005961 - protein, 12 aa, Mycobacterium
EAARDEGLGGEV

SEQ ID NO: 1005962 - protein, 7 aa, Mycobacterium
EAARDNL

SEQ ID NO: 1005963 - protein, 5 aa, Mycobacterium
EAARQ

SEQ ID NO: 1005964 - protein, 13 aa, Mycobacterium
EAARREAQSAFGD

SEQ ID NO: 1005965 - protein, 13 aa, Mycobacterium
EAARRYERSVDPA

SEQ ID NO: 1005966 - protein, 6 aa, Mycobacterium
EAARSR

SEQ ID NO: 1005967 - protein, 21 aa, Mycobacterium
EAASAARAALSGASEEAFGTG

SEQ ID NO: 1005968 - protein, 6 aa, Mycobacterium
EAASDI

SEQ ID NO: 1005969 - protein, 9 aa, Mycobacterium
EAASTSPLQ

SEQ ID NO: 1005970 - protein, 8 aa, Mycobacterium
EAATEAVE

SEQ ID NO: 1005971 - protein, 10 aa, Mycobacterium
EAATKKRRGE

SEQ ID NO: 1005972 - protein, 6 aa, Mycobacterium
EAATNT

SEQ ID NO: 1005973 - protein, 13 aa, Mycobacterium
EAAYDGEFVKFGP

SEQ ID NO: 1005974 - protein, 7 aa, Mycobacterium
EADAAYD

SEQ ID NO: 1005975 - protein, 8 aa, Mycobacterium
EADALGAD

SEQ ID NO: 1005976 - protein, 12 aa, Mycobacterium
EADAPLDPAATA

SEQ ID NO: 1005977 - protein, 10 aa, Mycobacterium
EADATDSEDQ

SEQ ID NO: 1005978 - protein, 9 aa, Mycobacterium
EADDPHGTN

SEQ ID NO: 1005979 - protein, 8 aa, Mycobacterium
EADDQSRA

SEQ ID NO: 1005980 - protein, 34 aa, Mycobacterium; identical to SEQ ID NO: 900409

SEQ ID NO: 1005981 - protein, 9 aa, Mycobacterium
EADEQRSGF

SEQ ID NO: 1005982 - protein, 6 aa, Mycobacterium
EADEVQ

SEQ ID NO: 1005983 - protein, 7 aa, Mycobacterium
EADGRRP

SEQ ID NO: 1005984 - protein, 7 aa, Mycobacterium
EADGTIT

SEQ ID NO: 1005985 - protein, 7 aa, Mycobacterium
EADGVAM

SEQ ID NO: 1005986 - protein, 4 aa, Mycobacterium
EADP

SEQ ID NO: 1005987 - protein, 16 aa, Mycobacterium
EADPAAATIIVIPALD

SEQ ID NO: 1005988 - protein, 7 aa, Mycobacterium
EADPAQR

SEQ ID NO: 1005989 - protein, 6 aa, Mycobacterium
EADPGQ

SEQ ID NO: 1005990 - protein, 22 aa, Mycobacterium
EADPPPAQEYTPMSASGLAPDA

SEQ ID NO: 1005991 - protein, 7 aa, Mycobacterium
EADPQLA

SEQ ID NO: 1005992 - protein, 7 aa, Mycobacterium
EADPQPW

SEQ ID NO: 1005993 - protein, 9 aa, Mycobacterium
EADQSLGEQ

SEQ ID NO: 1005994 - protein, 4 aa, Mycobacterium
EADR

SEQ ID NO: 1005995 - protein, 7 aa, Mycobacterium
EADRATV

SEQ ID NO: 1005996 - protein, 7 aa, Mycobacterium
EADRERV

SEQ ID NO: 1005997 - protein, 8 aa, Mycobacterium
EADRPQLA

SEQ ID NO: 1005998 - protein, 7 aa, Mycobacterium
EADRQSR

SEQ ID NO: 1005999 - protein, 5 aa, Mycobacterium
EADSG

SEQ ID NO: 1006000 - protein, 4 aa, Mycobacterium
EADT

SEQ ID NO: 1006001 - protein, 8 aa, Mycobacterium
EAEARGAV

SEQ ID NO: 1006002 - protein, 8 aa, Mycobacterium
EAEASPSR

SEQ ID NO: 1006003 - protein, 8 aa, Mycobacterium
EAEDTRKR

SEQ ID NO: 1006004 - protein, 4 aa, Mycobacterium
EAEE

SEQ ID NO: 1006005 - protein, 7 aa, Mycobacterium
EAEGADS

SEQ ID NO: 1006006 - protein, 21 aa, Mycobacterium
EAEGAKADARRKVRDSGEREM

SEQ ID NO: 1006007 - protein, 8 aa, Mycobacterium
EAEGSPSR

SEQ ID NO: 1006008 - protein, 4 aa, Mycobacterium
EAEH

SEQ ID NO: 1006009 - protein, 10 aa, Mycobacterium
EAEKPSRVGE

SEQ ID NO: 1006010 - protein, 5 aa, Mycobacterium
EAEKR

SEQ ID NO: 1006011 - protein, 7 aa, Mycobacterium
EAEKTRK

SEQ ID NO: 1006012 - protein, 4 aa, Mycobacterium
EAEP

SEQ ID NO: 1006013 - protein, 6 aa, Mycobacterium
EAEPDR

SEQ ID NO: 1006014 - protein, 6 aa, Mycobacterium
EAEPIV

SEQ ID NO: 1006015 - protein, 13 aa, Mycobacterium
EAEQEQLQSYITQ

SEQ ID NO: 1006016 - protein, 6 aa, Mycobacterium
EAEQRL

SEQ ID NO: 1006017 - protein, 7 aa, Mycobacterium
EAERDGV

SEQ ID NO: 1006018 - protein, 7 aa, Mycobacterium
EAEREEL

SEQ ID NO: 1006019 - protein, 5 aa, Mycobacterium
EAERR

SEQ ID NO: 1006020 - protein, 7 aa, Mycobacterium
EAERTRR

SEQ ID NO: 1006021 - protein, 19 aa, Mycobacterium
EAEYSKADYPGQTRTKTRR

SEQ ID NO: 1006022 - protein, 7 aa, Mycobacterium
EAFERTA

SEQ ID NO: 1006023 - protein, 10 aa, Mycobacterium
EAGARKVEKA

SEQ ID NO: 1006024 - protein, 7 aa, Mycobacterium
EAGATIG

SEQ ID NO: 1006025 - protein, 6 aa, Mycobacterium
EAGAVT

SEQ ID NO: 1006026 - protein, 10 aa, Mycobacterium
EAGDAESAQR

SEQ ID NO: 1006027 - protein, 6 aa, Mycobacterium
EAGDGD

SEQ ID NO: 1006028 - protein, 8 aa, Mycobacterium
EAGDGQEA

SEQ ID NO: 1006029 - protein, 9 aa, Mycobacterium
EAGDLDGQK

SEQ ID NO: 1006030 - protein, 8 aa, Mycobacterium
EAGDTPTL

SEQ ID NO: 1006031 - protein, 9 aa, Mycobacterium
EAGEDTDDL

SEQ ID NO: 1006032 - protein, 14 aa, Mycobacterium
EAGEKGGGDDEYDE

SEQ ID NO: 1006033 - protein, 10 aa, Mycobacterium
EAGEPSDRER

SEQ ID NO: 1006034 - protein, 9 aa, Mycobacterium
EAGERATGL

SEQ ID NO: 1006035 - protein, 17 aa, Mycobacterium
EAGGPGDDPPVEFDDAC

SEQ ID NO: 1006036 - protein, 6 aa, Mycobacterium
EAGHRS

SEQ ID NO: 1006037 - protein, 8 aa, Mycobacterium
EAGKPGAI

SEQ ID NO: 1006038 - protein, 6 aa, Mycobacterium
EAGLPD

SEQ ID NO: 1006039 - protein, 6 aa, Mycobacterium
EAGNGD

SEQ ID NO: 1006040 - protein, 6 aa, Mycobacterium
EAGNTT

SEQ ID NO: 1006041 - protein, 9 aa, Mycobacterium
EAGPAFQGT

SEQ ID NO: 1006042 - protein, 8 aa, Mycobacterium
EAGPDGYD

SEQ ID NO: 1006043 - protein, 9 aa, Mycobacterium
EAGPGSAPM

SEQ ID NO: 1006044 - protein, 7 aa, Mycobacterium
EAGPISE

SEQ ID NO: 1006045 - protein, 7 aa, Mycobacterium
EAGPPEQ

SEQ ID NO: 1006046 - protein, 6 aa, Mycobacterium
EAGPRV

SEQ ID NO: 1006047 - protein, 6 aa, Mycobacterium
EAGQDF

SEQ ID NO: 1006048 - protein, 16 aa, Mycobacterium
EAGQNHAHHIGAAGAD

SEQ ID NO: 1006049 - protein, 8 aa, Mycobacterium
EAGRAMAD

SEQ ID NO: 1006050 - protein, 7 aa, Mycobacterium
EAGRRGA

SEQ ID NO: 1006051 - protein, 9 aa, Mycobacterium
EAGRRGLIG

SEQ ID NO: 1006052 - protein, 16 aa, Mycobacterium
EAGRSDPSEPRRDPEE

SEQ ID NO: 1006053 - protein, 4 aa, Mycobacterium
EAGS

SEQ ID NO: 1006054 - protein, 5 aa, Mycobacterium
EAGSM

SEQ ID NO: 1006055 - protein, 8 aa, Mycobacterium
EAGSSNKA

SEQ ID NO: 1006056 - protein, 7 aa, Mycobacterium
EAGSVSE

SEQ ID NO: 1006057 - protein, 10 aa, Mycobacterium
EAGSYGKDTR

SEQ ID NO: 1006058 - protein, 4 aa, Mycobacterium
EAGT

SEQ ID NO: 1006059 - protein, 7 aa, Mycobacterium
EAGTSSV

SEQ ID NO: 1006060 - protein, 4 aa, Mycobacterium
EAGV

SEQ ID NO: 1006061 - protein, 10 aa, Mycobacterium
EAGVAPPQRT

SEQ ID NO: 1006062 - protein, 6 aa, Mycobacterium
EAGVTE

SEQ ID NO: 1006063 - protein, 20 aa, Mycobacterium
EAHAAEDHKRREEADVRNQA

SEQ ID NO: 1006064 - protein, 7 aa, Mycobacterium
EAHNAQN

SEQ ID NO: 1006065 - protein, 8 aa, Mycobacterium
EAHTAGRL

SEQ ID NO: 1006066 - protein, 14 aa, Mycobacterium
EAIAAGANQYPPGM

SEQ ID NO: 1006067 - protein, 11 aa, Mycobacterium
EAIAGRTTYRQ

SEQ ID NO: 1006068 - protein, 18 aa, Mycobacterium
EAIDKTRAAIGDLERIRD

SEQ ID NO: 1006069 - protein, 13 aa, Mycobacterium
EAKEGIETTETGE

SEQ ID NO: 1006070 - protein, 11 aa, Mycobacterium
EAKGRNGVPHP

SEQ ID NO: 1006071 - protein, 5 aa, Mycobacterium
EAKNA

SEQ ID NO: 1006072 - protein, 10 aa, Mycobacterium
EAKNDAASEE

SEQ ID NO: 1006073 - protein, 14 aa, Mycobacterium
EAKPGSQGMDGKAA

SEQ ID NO: 1006074 - protein, 6 aa, Mycobacterium
EAKSDF

SEQ ID NO: 1006075 - protein, 11 aa, Mycobacterium
EALAASSADEV

SEQ ID NO: 1006076 - protein, 5 aa, Mycobacterium
EALDD

SEQ ID NO: 1006077 - protein, 8 aa, Mycobacterium
EALPAGKA

SEQ ID NO: 1006078 - protein, 7 aa, Mycobacterium
EALPGEV

SEQ ID NO: 1006079 - protein, 8 aa, Mycobacterium
EALPGPLT

SEQ ID NO: 1006080 - protein, 7 aa, Mycobacterium
EALPQDA

SEQ ID NO: 1006081 - protein, 4 aa, Mycobacterium
EANA

SEQ ID NO: 1006082 - protein, 15 aa, Mycobacterium
EANAATGSGQDGGAG

SEQ ID NO: 1006083 - protein, 6 aa, Mycobacterium
EANDRG

SEQ ID NO: 1006084 - protein, 4 aa, Mycobacterium
EANG

SEQ ID NO: 1006085 - protein, 7 aa, Mycobacterium
EANGGPR

SEQ ID NO: 1006086 - protein, 11 aa, Mycobacterium
EANKEKAIEVT

SEQ ID NO: 1006087 - protein, 5 aa, Mycobacterium
EANPE

SEQ ID NO: 1006088 - protein, 10 aa, Mycobacterium
EANPERMGRD

SEQ ID NO: 1006089 - protein, 7 aa, Mycobacterium
EANPRTC

SEQ ID NO: 1006090 - protein, 5 aa, Mycobacterium
EANQY

SEQ ID NO: 1006091 - protein, 7 aa, Mycobacterium
EANSARL

SEQ ID NO: 1006092 - protein, 6 aa, Mycobacterium
EAPAGG

SEQ ID NO: 1006093 - protein, 10 aa, Mycobacterium
EAPAQPSGGR

SEQ ID NO: 1006094 - protein, 7 aa, Mycobacterium
EAPDETN

SEQ ID NO: 1006095 - protein, 14 aa, Mycobacterium
EAPDPEPPEETDEQ

SEQ ID NO: 1006096 - protein, 12 aa, Mycobacterium
EAPEDPGAQSEV

SEQ ID NO: 1006097 - protein, 4 aa, Mycobacterium
EAPG

SEQ ID NO: 1006098 - protein, 10 aa, Mycobacterium
EAPGAPDPLR

SEQ ID NO: 1006099 - protein, 7 aa, Mycobacterium
EAPGGAH

SEQ ID NO: 1006100 - protein, 9 aa, Mycobacterium
EAPGGEAAR

SEQ ID NO: 1006101 - protein, 10 aa, Mycobacterium
EAPGGIDSPA

SEQ ID NO: 1006102 - protein, 10 aa, Mycobacterium
EAPGPAGEDG

SEQ ID NO: 1006103 - protein, 7 aa, Mycobacterium
EAPHAGA

SEQ ID NO: 1006104 - protein, 19 aa, Mycobacterium
EAPKTAGLPGTEGQHRTDF

SEQ ID NO: 1006105 - protein, 8 aa, Mycobacterium
EAPLTGAS

SEQ ID NO: 1006106 - protein, 9 aa, Mycobacterium
EAPPAPQPL

SEQ ID NO: 1006107 - protein, 6 aa, Mycobacterium
EAPPDG

SEQ ID NO: 1006108 - protein, 11 aa, Mycobacterium
EAPPPPENTPV

SEQ ID NO: 1006109 - protein, 7 aa, Mycobacterium
EAPPQTL

SEQ ID NO: 1006110 - protein, 7 aa, Mycobacterium
EAPQAPF

SEQ ID NO: 1006111 - protein, 8 aa, Mycobacterium
EAPQEGTP

SEQ ID NO: 1006112 - protein, 10 aa, Mycobacterium
EAPQPGRPAI

SEQ ID NO: 1006113 - protein, 18 aa, Mycobacterium
EAPRASHEWARDKREDLI

SEQ ID NO: 1006114 - protein, 5 aa, Mycobacterium
EAPRG

SEQ ID NO: 1006115 - protein, 8 aa, Mycobacterium
EAPTRANA

SEQ ID NO: 1006116 - protein, 6 aa, Mycobacterium
EAPTTA

SEQ ID NO: 1006117 - protein, 4 aa, Mycobacterium
EAQA

SEQ ID NO: 1006118 - protein, 7 aa, Mycobacterium
EAQERYA

SEQ ID NO: 1006119 - protein, 7 aa, Mycobacterium
EAQGEAV

SEQ ID NO: 1006120 - protein, 4 aa, Mycobacterium
EAQK

SEQ ID NO: 1006121 - protein, 16 aa, Mycobacterium
EAQNETNRERNRNAGL

SEQ ID NO: 1006122 - protein, 4 aa, Mycobacterium
EAQQ

SEQ ID NO: 1006123 - protein, 8 aa, Mycobacterium
EAQQQSKG

SEQ ID NO: 1006124 - protein, 9 aa, Mycobacterium
EAQRDTSTS

SEQ ID NO: 1006125 - protein, 10 aa, Mycobacterium
EAQRTHQALT

SEQ ID NO: 1006126 - protein, 8 aa, Mycobacterium
EAQTMDPQ

SEQ ID NO: 1006127 - protein, 5 aa, Mycobacterium
EARAA

SEQ ID NO: 1006128 - protein, 13 aa, Mycobacterium
EARASAEVHPSRR

SEQ ID NO: 1006129 - protein, 4 aa, Mycobacterium
EARE

SEQ ID NO: 1006130 - protein, 5 aa, Mycobacterium
EAREE

SEQ ID NO: 1006131 - protein, 5 aa, Mycobacterium
EARGR

SEQ ID NO: 1006132 - protein, 7 aa, Mycobacterium
EARKEEA

SEQ ID NO: 1006133 - protein, 28 aa, Mycobacterium
EARPGEDWTGQQRFSGDNPFGMGEGTQA

SEQ ID NO: 1006134 - protein, 11 aa, Mycobacterium
EARPPADAEAT

SEQ ID NO: 1006135 - protein, 9 aa, Mycobacterium
EARPPGKKV

SEQ ID NO: 1006136 - protein, 10 aa, Mycobacterium
EARTECPAGT

SEQ ID NO: 1006137 - protein, 5 aa, Mycobacterium
EASAP

SEQ ID NO: 1006138 - protein, 10 aa, Mycobacterium
EASETTRTGP

SEQ ID NO: 1006139 - protein, 7 aa, Mycobacterium
EASHHEG

SEQ ID NO: 1006140 - protein, 8 aa, Mycobacterium
EASPEYQG

SEQ ID NO: 1006141 - protein, 6 aa, Mycobacterium
EASRRG

SEQ ID NO: 1006142 - protein, 7 aa, Mycobacterium
EASRRGA

SEQ ID NO: 1006143 - protein, 7 aa, Mycobacterium
EASRRHT

SEQ ID NO: 1006144 - protein, 9 aa, Mycobacterium
EASSSRAGL

SEQ ID NO: 1006145 - protein, 8 aa, Mycobacterium
EASTGGDE

SEQ ID NO: 1006146 - protein, 13 aa, Mycobacterium
EASVTGSEQVNGV

SEQ ID NO: 1006147 - protein, 4 aa, Mycobacterium
EASY

SEQ ID NO: 1006148 - protein, 5 aa, Mycobacterium
EASYA

SEQ ID NO: 1006149 - protein, 6 aa, Mycobacterium
EATAAF

SEQ ID NO: 1006150 - protein, 15 aa, Mycobacterium
EATADEDRLPSRGEL

SEQ ID NO: 1006151 - protein, 16 aa, Mycobacterium
EATAKDINDNHRNSRY

SEQ ID NO: 1006152 - protein, 5 aa, Mycobacterium
EATAL

SEQ ID NO: 1006153 - protein, 11 aa, Mycobacterium
EATARAAARGG

SEQ ID NO: 1006154 - protein, 11 aa, Mycobacterium
EATARQARTVR

SEQ ID NO: 1006155 - protein, 6 aa, Mycobacterium
EATASL

SEQ ID NO: 1006156 - protein, 7 aa, Mycobacterium
EATATGA

SEQ ID NO: 1006157 - protein, 10 aa, Mycobacterium
EATDDEVNAE

SEQ ID NO: 1006158 - protein, 6 aa, Mycobacterium
EATDDR

SEQ ID NO: 1006159 - protein, 16 aa, Mycobacterium
EATDSSGNITKRGADK

SEQ ID NO: 1006160 - protein, 14 aa, Mycobacterium
EATEAAAKQLGGGE

SEQ ID NO: 1006161 - protein, 8 aa, Mycobacterium
EATEESGI

SEQ ID NO: 1006162 - protein, 5 aa, Mycobacterium
EATEF

SEQ ID NO: 1006163 - protein, 4 aa, Mycobacterium
EATG

SEQ ID NO: 1006164 - protein, 16 aa, Mycobacterium
EATGDADSTDTLIGAQ

SEQ ID NO: 1006165 - protein, 8 aa, Mycobacterium
EATGDRGK

SEQ ID NO: 1006166 - protein, 6 aa, Mycobacterium
EATGGK

SEQ ID NO: 1006167 - protein, 6 aa, Mycobacterium
EATGGM

SEQ ID NO: 1006168 - protein, 6 aa, Mycobacterium
EATGRG

SEQ ID NO: 1006169 - protein, 10 aa, Mycobacterium
EATGRRPSAS

SEQ ID NO: 1006170 - protein, 5 aa, Mycobacterium
EATIS

SEQ ID NO: 1006171 - protein, 5 aa, Mycobacterium
EATPQ

SEQ ID NO: 1006172 - protein, 6 aa, Mycobacterium
EATPRF

SEQ ID NO: 1006173 - protein, 6 aa, Mycobacterium
EATPRV

SEQ ID NO: 1006174 - protein, 8 aa, Mycobacterium
EATQATLS

SEQ ID NO: 1006175 - protein, 8 aa, Mycobacterium
EATQDQRE

SEQ ID NO: 1006176 - protein, 4 aa, Mycobacterium
EATR

SEQ ID NO: 1006177 - protein, 9 aa, Mycobacterium
EATSTDQGW

SEQ ID NO: 1006178 - protein, 5 aa, Mycobacterium
EAVDP

SEQ ID NO: 1006179 - protein, 6 aa, Mycobacterium
EAVEGE

SEQ ID NO: 1006180 - protein, 7 aa, Mycobacterium
EAVEGRD

SEQ ID NO: 1006181 - protein, 5 aa, Mycobacterium
EAVGG

SEQ ID NO: 1006182 - protein, 9 aa, Mycobacterium
EAVRDGRPT

SEQ ID NO: 1006183 - protein, 5 aa, Mycobacterium
EAVTE

SEQ ID NO: 1006184 - protein, 12 aa, Mycobacterium
EAYARKQSAYGS

SEQ ID NO: 1006185 - protein, 8 aa, Mycobacterium
EAYGGSPV

SEQ ID NO: 1006186 - protein, 4 aa, Mycobacterium
EAYQ

SEQ ID NO: 1006187 - protein, 7 aa, Mycobacterium
ECNPRSA

SEQ ID NO: 1006188 - protein, 56 aa, Mycobacterium
ECPGGAGAQVRGDPVVPPARSNHRRNGGCGAARRRRGRDRAELRRTAGDSLARSDH

SEQ ID NO: 1006189 - protein, 13 aa, Mycobacterium
ECPPDTAATAPVG

SEQ ID NO: 1006190 - protein, 8 aa, Mycobacterium
ECPPPTST

SEQ ID NO: 1006191 - protein, 9 aa, Mycobacterium
ECPRGPRIS

SEQ ID NO: 1006192 - protein, 17 aa, Mycobacterium
ECQGKPAVAELPEAGDS

SEQ ID NO: 1006193 - protein, 5 aa, Mycobacterium
ECRGR

SEQ ID NO: 1006194 - protein, 4 aa, Mycobacterium
ECSD

SEQ ID NO: 1006195 - protein, 6 aa, Mycobacterium
ECTGAA

SEQ ID NO: 1006196 - protein, 8 aa, Mycobacterium
ECTPETRQ

SEQ ID NO: 1006197 - protein, 7 aa, Mycobacterium
ECTSGGA

SEQ ID NO: 1006198 - protein, 4 aa, Mycobacterium
EDAA

SEQ ID NO: 1006199 - protein, 5 aa, Mycobacterium
EDAAD

SEQ ID NO: 1006200 - protein, 11 aa, Mycobacterium
EDAARKGNSSL

SEQ ID NO: 1006201 - protein, 7 aa, Mycobacterium
EDADRDA

SEQ ID NO: 1006202 - protein, 15 aa, Mycobacterium
EDADRLAGTDGDYHQ

SEQ ID NO: 1006203 - protein, 18 aa, Mycobacterium
EDAEIAKGDTITSPQFTK

SEQ ID NO: 1006204 - protein, 11 aa, Mycobacterium
EDAETADPSGL

SEQ ID NO: 1006205 - protein, 6 aa, Mycobacterium
EDAGAD

SEQ ID NO: 1006206 - protein, 9 aa, Mycobacterium
EDAGAGRTR

SEQ ID NO: 1006207 - protein, 10 aa, Mycobacterium
EDAGGQGGTL

SEQ ID NO: 1006208 - protein, 15 aa, Mycobacterium
EDAPDEIAAAIIARF

SEQ ID NO: 1006209 - protein, 11 aa, Mycobacterium
EDAPDQGKGYH

SEQ ID NO: 1006210 - protein, 7 aa, Mycobacterium
EDARARV

SEQ ID NO: 1006211 - protein, 12 aa, Mycobacterium
EDARQRHGRANS

SEQ ID NO: 1006212 - protein, 13 aa, Mycobacterium
EDARRAAEERAQR

SEQ ID NO: 1006213 - protein, 5 aa, Mycobacterium
EDARV

SEQ ID NO: 1006214 - protein, 10 aa, Mycobacterium
EDASAPDRAA

SEQ ID NO: 1006215 - protein, 10 aa, Mycobacterium
EDASAYDDGH

SEQ ID NO: 1006216 - protein, 6 aa, Mycobacterium
EDASKD

SEQ ID NO: 1006217 - protein, 4 aa, Mycobacterium
EDAT

SEQ ID NO: 1006218 - protein, 9 aa, Mycobacterium
EDAVRASRN

SEQ ID NO: 1006219 - protein, 9 aa, Mycobacterium
EDDAETPHV

SEQ ID NO: 1006220 - protein, 5 aa, Mycobacterium
EDDGA

SEQ ID NO: 1006221 - protein, 7 aa, Mycobacterium
EDDGESA

SEQ ID NO: 1006222 - protein, 23 aa, Mycobacterium
EDDPNVTDKKLPGNPTRSYRTRE

SEQ ID NO: 1006223 - protein, 10 aa, Mycobacterium
EDDQKPEAAN

SEQ ID NO: 1006224 - protein, 5 aa, Mycobacterium
EDEAR

SEQ ID NO: 1006225 - protein, 15 aa, Mycobacterium
EDEGIRANTTADSLA

SEQ ID NO: 1006226 - protein, 6 aa, Mycobacterium
EDEGPD

SEQ ID NO: 1006227 - protein, 7 aa, Mycobacterium
EDEGRKV

SEQ ID NO: 1006228 - protein, 5 aa, Mycobacterium
EDENE

SEQ ID NO: 1006229 - protein, 4 aa, Mycobacterium
EDEP

SEQ ID NO: 1006230 - protein, 6 aa, Mycobacterium
EDEPGL

SEQ ID NO: 1006231 - protein, 6 aa, Mycobacterium
EDEPVQ

SEQ ID NO: 1006232 - protein, 10 aa, Mycobacterium
EDESEREQAR

SEQ ID NO: 1006233 - protein, 16 aa, Mycobacterium
EDEVAARSDTTGGTDI

SEQ ID NO: 1006234 - protein, 6 aa, Mycobacterium
EDEVST

SEQ ID NO: 1006235 - protein, 5 aa, Mycobacterium
EDEWE

SEQ ID NO: 1006236 - protein, 4 aa, Mycobacterium
EDFA

SEQ ID NO: 1006237 - protein, 8 aa, Mycobacterium
EDFDPRDS

SEQ ID NO: 1006238 - protein, 8 aa, Mycobacterium
EDFPDPDE

SEQ ID NO: 1006239 - protein, 10 aa, Mycobacterium
EDGAESDALD

SEQ ID NO: 1006240 - protein, 11 aa, Mycobacterium
EDGDPADPMTD

SEQ ID NO: 1006241 - protein, 6 aa, Mycobacterium
EDGEAT

SEQ ID NO: 1006242 - protein, 6 aa, Mycobacterium
EDGEGP

SEQ ID NO: 1006243 - protein, 4 aa, Mycobacterium
EDGG

SEQ ID NO: 1006244 - protein, 6 aa, Mycobacterium
EDGGRS

SEQ ID NO: 1006245 - protein, 12 aa, Mycobacterium
EDGKPVPQGEPG

SEQ ID NO: 1006246 - protein, 8 aa, Mycobacterium
EDGMQTTD

SEQ ID NO: 1006247 - protein, 8 aa, Mycobacterium
EDGPRGKF

SEQ ID NO: 1006248 - protein, 8 aa, Mycobacterium
EDGQTIES

SEQ ID NO: 1006249 - protein, 11 aa, Mycobacterium
EDGQYEEPGLR

SEQ ID NO: 1006250 - protein, 4 aa, Mycobacterium
EDGR

SEQ ID NO: 1006251 - protein, 5 aa, Mycobacterium
EDGRD

SEQ ID NO: 1006252 - protein, 5 aa, Mycobacterium
EDGRE

SEQ ID NO: 1006253 - protein, 7 aa, Mycobacterium
EDGREGD

SEQ ID NO: 1006254 - protein, 5 aa, Mycobacterium
EDGRS

SEQ ID NO: 1006255 - protein, 7 aa, Mycobacterium
EDGRTHG

SEQ ID NO: 1006256 - protein, 8 aa, Mycobacterium
EDGSERVL

SEQ ID NO: 1006257 - protein, 15 aa, Mycobacterium
EDGSPVRGVTGGTGR

SEQ ID NO: 1006258 - protein, 6 aa, Mycobacterium
EDGTYD

SEQ ID NO: 1006259 - protein, 8 aa, Mycobacterium
EDHGGAGG

SEQ ID NO: 1006260 - protein, 6 aa, Mycobacterium
EDHQER

SEQ ID NO: 1006261 - protein, 13 aa, Mycobacterium
EDIPASGKMTGRP

SEQ ID NO: 1006262 - protein, 7 aa, Mycobacterium
EDKGVRD

SEQ ID NO: 1006263 - protein, 4 aa, Mycobacterium
EDKI

SEQ ID NO: 1006264 - protein, 10 aa, Mycobacterium
EDKTAPRERF

SEQ ID NO: 1006265 - protein, 5 aa, Mycobacterium
EDLAE

SEQ ID NO: 1006266 - protein, 5 aa, Mycobacterium
EDLET

SEQ ID NO: 1006267 - protein, 8 aa, Mycobacterium
EDLGEPIR

SEQ ID NO: 1006268 - protein, 15 aa, Mycobacterium
EDLPAHGEAVRRRFE

SEQ ID NO: 1006269 - protein, 6 aa, Mycobacterium
EDLPFE

SEQ ID NO: 1006270 - protein, 4 aa, Mycobacterium
EDNP

SEQ ID NO: 1006271 - protein, 12 aa, Mycobacterium
EDPAQGWQPQAG

SEQ ID NO: 1006272 - protein, 8 aa, Mycobacterium
EDPDGGAT

SEQ ID NO: 1006273 - protein, 5 aa, Mycobacterium
EDPDK

SEQ ID NO: 1006274 - protein, 15 aa, Mycobacterium
EDPDRGGLRDTPARV

SEQ ID NO: 1006275 - protein, 7 aa, Mycobacterium
EDPDVDQ

SEQ ID NO: 1006276 - protein, 5 aa, Mycobacterium
EDPEI

SEQ ID NO: 1006277 - protein, 11 aa, Mycobacterium
EDPEYRAGGYR

SEQ ID NO: 1006278 - protein, 10 aa, Mycobacterium
EDPFGTPNFT

SEQ ID NO: 1006279 - protein, 4 aa, Mycobacterium
EDPG

SEQ ID NO: 1006280 - protein, 5 aa, Mycobacterium
EDPGR

SEQ ID NO: 1006281 - protein, 8 aa, Mycobacterium
EDPGSQAY

SEQ ID NO: 1006282 - protein, 4 aa, Mycobacterium
EDPH

SEQ ID NO: 1006283 - protein, 6 aa, Mycobacterium
EDPHGW

SEQ ID NO: 1006284 - protein, 8 aa, Mycobacterium
EDPMRDRG

SEQ ID NO: 1006285 - protein, 6 aa, Mycobacterium
EDPPAL

SEQ ID NO: 1006286 - protein, 5 aa, Mycobacterium
EDPPD

SEQ ID NO: 1006287 - protein, 5 aa, Mycobacterium
EDPPI

SEQ ID NO: 1006288 - protein, 9 aa, Mycobacterium
EDPPPESVP

SEQ ID NO: 1006289 - protein, 4 aa, Mycobacterium
EDPR

SEQ ID NO: 1006290 - protein, 7 aa, Mycobacterium
EDPRRGA

SEQ ID NO: 1006291 - protein, 9 aa, Mycobacterium
EDPSPGVDG

SEQ ID NO: 1006292 - protein, 4 aa, Mycobacterium
EDPT

SEQ ID NO: 1006293 - protein, 14 aa, Mycobacterium
EDPVPSDKHLTSSA

SEQ ID NO: 1006294 - protein, 6 aa, Mycobacterium
EDPVSG

SEQ ID NO: 1006295 - protein, 6 aa, Mycobacterium
EDPWAD

SEQ ID NO: 1006296 - protein, 4 aa, Mycobacterium
EDPY

SEQ ID NO: 1006297 - protein, 15 aa, Mycobacterium
EDPYAAADRLLAPPP

SEQ ID NO: 1006298 - protein, 5 aa, Mycobacterium
EDQAA

SEQ ID NO: 1006299 - protein, 5 aa, Mycobacterium
EDQDE

SEQ ID NO: 1006300 - protein, 6 aa, Mycobacterium
EDQPDA

SEQ ID NO: 1006301 - protein, 8 aa, Mycobacterium
EDQSRSAL

SEQ ID NO: 1006302 - protein, 7 aa, Mycobacterium
EDRADKG

SEQ ID NO: 1006303 - protein, 7 aa, Mycobacterium
EDRARKG

SEQ ID NO: 1006304 - protein, 7 aa, Mycobacterium
EDRENEG

SEQ ID NO: 1006305 - protein, 5 aa, Mycobacterium
EDRES

SEQ ID NO: 1006306 - protein, 4 aa, Mycobacterium
EDRG

SEQ ID NO: 1006307 - protein, 12 aa, Mycobacterium
EDRHRPHTRNGA

SEQ ID NO: 1006308 - protein, 6 aa, Mycobacterium
EDRPAA

SEQ ID NO: 1006309 - protein, 12 aa, Mycobacterium
EDRQRPHTRNGA

SEQ ID NO: 1006310 - protein, 6 aa, Mycobacterium
EDRSAR

SEQ ID NO: 1006311 - protein, 9 aa, Mycobacterium
EDSAPSDAE

SEQ ID NO: 1006312 - protein, 5 aa, Mycobacterium
EDSAQ

SEQ ID NO: 1006313 - protein, 11 aa, Mycobacterium
EDSDEAELGAD

SEQ ID NO: 1006314 - protein, 7 aa, Mycobacterium
EDSNEPV

SEQ ID NO: 1006315 - protein, 5 aa, Mycobacterium
EDSPA

SEQ ID NO: 1006316 - protein, 8 aa, Mycobacterium
EDSPDAIG

SEQ ID NO: 1006317 - protein, 4 aa, Mycobacterium
EDSR

SEQ ID NO: 1006318 - protein, 8 aa, Mycobacterium
EDSRPLRG

SEQ ID NO: 1006319 - protein, 12 aa, Mycobacterium
EDSRPTTHTSPT

SEQ ID NO: 1006320 - protein, 10 aa, Mycobacterium
EDSSSRRPFR

SEQ ID NO: 1006321 - protein, 7 aa, Mycobacterium
EDSTKAV

SEQ ID NO: 1006322 - protein, 10 aa, Mycobacterium
EDSVAGDREL

SEQ ID NO: 1006323 - protein, 14 aa, Mycobacterium
EDSVRAAGSPEIPS

SEQ ID NO: 1006324 - protein, 12 aa, Mycobacterium
EDTAGSAGDDLE

SEQ ID NO: 1006325 - protein, 8 aa, Mycobacterium
EDTDDEIR

SEQ ID NO: 1006326 - protein, 9 aa, Mycobacterium
EDTGELTPT

SEQ ID NO: 1006327 - protein, 7 aa, Mycobacterium
EDTGRCQ

SEQ ID NO: 1006328 - protein, 5 aa, Mycobacterium
EDTGY

SEQ ID NO: 1006329 - protein, 9 aa, Mycobacterium
EDTVGASAQ

SEQ ID NO: 1006330 - protein, 5 aa, Mycobacterium
EDTVR

SEQ ID NO: 1006331 - protein, 5 aa, Mycobacterium
EDVER

SEQ ID NO: 1006332 - protein, 4 aa, Mycobacterium
EDVG

SEQ ID NO: 1006333 - protein, 11 aa, Mycobacterium
EDVGNGDGPEC

SEQ ID NO: 1006334 - protein, 15 aa, Mycobacterium
EDVSSEIRTEEVTQA

SEQ ID NO: 1006335 - protein, 16 aa, Mycobacterium
EDYDRVPADDPNPEQI

SEQ ID NO: 1006336 - protein, 5 aa, Mycobacterium
EDYDT

SEQ ID NO: 1006337 - protein, 7 aa, Mycobacterium
EEAAGAG

SEQ ID NO: 1006338 - protein, 5 aa, Mycobacterium
EEADA

SEQ ID NO: 1006339 - protein, 7 aa, Mycobacterium
EEADTSV

SEQ ID NO: 1006340 - protein, 4 aa, Mycobacterium
EEAE

SEQ ID NO: 1006341 - protein, 15 aa, Mycobacterium
EEAEAENEARYGGPL

SEQ ID NO: 1006342 - protein, 13 aa, Mycobacterium
EEAGSGDFGADGW

SEQ ID NO: 1006343 - protein, 4 aa, Mycobacterium
EEAH

SEQ ID NO: 1006344 - protein, 5 aa, Mycobacterium
EEALR

SEQ ID NO: 1006345 - protein, 13 aa, Mycobacterium
EEAMGRARKPDVY

SEQ ID NO: 1006346 - protein, 10 aa, Mycobacterium
EEANSGSINV

SEQ ID NO: 1006347 - protein, 16 aa, Mycobacterium
EEAPQSRAHDGVNLVR

SEQ ID NO: 1006348 - protein, 10 aa, Mycobacterium
EEARAKEDHS

SEQ ID NO: 1006349 - protein, 5 aa, Mycobacterium
EECRG

SEQ ID NO: 1006350 - protein, 8 aa, Mycobacterium
EEDLGKES

SEQ ID NO: 1006351 - protein, 9 aa, Mycobacterium
EEDLSGAEE

SEQ ID NO: 1006352 - protein, 5 aa, Mycobacterium
EEDPV

SEQ ID NO: 1006353 - protein, 5 aa, Mycobacterium
EEDRP

SEQ ID NO: 1006354 - protein, 4 aa, Mycobacterium
EEDS

SEQ ID NO: 1006355 - protein, 8 aa, Mycobacterium
EEDSRGRT

SEQ ID NO: 1006356 - protein, 4 aa, Mycobacterium
EEDV

SEQ ID NO: 1006357 - protein, 16 aa, Mycobacterium
EEEADSSGMFQPANAP

SEQ ID NO: 1006358 - protein, 16 aa, Mycobacterium
EEEGAAAGEALTEADA

SEQ ID NO: 1006359 - protein, 5 aa, Mycobacterium
EEEGI

SEQ ID NO: 1006360 - protein, 6 aa, Mycobacterium
EEEKAL

SEQ ID NO: 1006361 - protein, 4 aa, Mycobacterium
EEEL

SEQ ID NO: 1006362 - protein, 8 aa, Mycobacterium
EEEPDGAL

SEQ ID NO: 1006363 - protein, 14 aa, Mycobacterium
EEEPELPDYPKSDR

SEQ ID NO: 1006364 - protein, 7 aa, Mycobacterium
EEEQDQL

SEQ ID NO: 1006365 - protein, 8 aa, Mycobacterium
EEERGESL

SEQ ID NO: 1006366 - protein, 5 aa, Mycobacterium
EEETI

SEQ ID NO: 1006367 - protein, 4 aa, Mycobacterium
EEFG

SEQ ID NO: 1006368 - protein, 5 aa, Mycobacterium
EEFGE

SEQ ID NO: 1006369 - protein, 6 aa, Mycobacterium
EEGASI

SEQ ID NO: 1006370 - protein, 5 aa, Mycobacterium
EEGEV

SEQ ID NO: 1006371 - protein, 9 aa, Mycobacterium
EEGGQLTEK

SEQ ID NO: 1006372 - protein, 12 aa, Mycobacterium
EEGKALAEEIGD

SEQ ID NO: 1006373 - protein, 27 aa, Mycobacterium
EEGKAPFANPRNSAAGSLRQKDPAVTA

SEQ ID NO: 1006374 - protein, 12 aa, Mycobacterium
EEGNEVKPGSGV

SEQ ID NO: 1006375 - protein, 7 aa, Mycobacterium
EEGPDGN

SEQ ID NO: 1006376 - protein, 4 aa, Mycobacterium
EEGQ

SEQ ID NO: 1006377 - protein, 10 aa, Mycobacterium
EEGSLAPAGR

SEQ ID NO: 1006378 - protein, 4 aa, Mycobacterium
EEGY

SEQ ID NO: 1006379 - protein, 10 aa, Mycobacterium
EEHGGGGGSI

SEQ ID NO: 1006380 - protein, 13 aa, Mycobacterium
EEIGAEIGSAAAA

SEQ ID NO: 1006381 - protein, 10 aa, Mycobacterium
EEIREEVDND

SEQ ID NO: 1006382 - protein, 106 aa, Mycobacterium
EEKAAKKAKAQLAKASAKETPAKKAPAKKAAAKKETPAKKAPAKKAPAKKAPAKKATAKKAPANKAPAKKVPESAAAKAATRATDTELSAPKPVGEASNPTEIAPE

SEQ ID NO: 1006383 - protein, 10 aa, Mycobacterium
EEKAKNPGDD

SEQ ID NO: 1006384 - protein, 6 aa, Mycobacterium
EEKANR

SEQ ID NO: 1006385 - protein, 8 aa, Mycobacterium
EEKESYRS

SEQ ID NO: 1006386 - protein, 11 aa, Mycobacterium
EEKPATPKSHY

SEQ ID NO: 1006387 - protein, 8 aa, Mycobacterium
EELGGGDL

SEQ ID NO: 1006388 - protein, 12 aa, Mycobacterium
EELPDEPEPGTV

SEQ ID NO: 1006389 - protein, 15 aa, Mycobacterium
EELSDSTDWAPTSAE

SEQ ID NO: 1006390 - protein, 10 aa, Mycobacterium
EENGTPVTPA

SEQ ID NO: 1006391 - protein, 5 aa, Mycobacterium
EENNI

SEQ ID NO: 1006392 - protein, 8 aa, Mycobacterium
EENSNLQR

SEQ ID NO: 1006393 - protein, 7 aa, Mycobacterium
EEPDAPV

SEQ ID NO: 1006394 - protein, 8 aa, Mycobacterium
EEPDGPVP

SEQ ID NO: 1006395 - protein, 6 aa, Mycobacterium
EEPDGT

SEQ ID NO: 1006396 - protein, 11 aa, Mycobacterium
EEPDSGTVKVG

SEQ ID NO: 1006397 - protein, 6 aa, Mycobacterium
EEPGDL

SEQ ID NO: 1006398 - protein, 8 aa, Mycobacterium
EEPGGDSP

SEQ ID NO: 1006399 - protein, 10 aa, Mycobacterium
EEPGLGNGGL

SEQ ID NO: 1006400 - protein, 4 aa, Mycobacterium
EEPN

SEQ ID NO: 1006401 - protein, 6 aa, Mycobacterium
EEPPAS

SEQ ID NO: 1006402 - protein, 6 aa, Mycobacterium
EEPRPI

SEQ ID NO: 1006403 - protein, 17 aa, Mycobacterium
EEPSGPQSQAGPAGGRG

SEQ ID NO: 1006404 - protein, 7 aa, Mycobacterium
EEPSVPE

SEQ ID NO: 1006405 - protein, 16 aa, Mycobacterium
EEQATAKQAEVFSTRY

SEQ ID NO: 1006406 - protein, 9 aa, Mycobacterium
EEQGKLTDE

SEQ ID NO: 1006407 - protein, 11 aa, Mycobacterium
EEQGVPPEKLA

SEQ ID NO: 1006408 - protein, 5 aa, Mycobacterium
EEQHP

SEQ ID NO: 1006409 - protein, 5 aa, Mycobacterium
EEQLQ

SEQ ID NO: 1006410 - protein, 6 aa, Mycobacterium
EEQRGA

SEQ ID NO: 1006411 - protein, 12 aa, Mycobacterium
EERAEKVEKQFQ

SEQ ID NO: 1006412 - protein, 6 aa, Mycobacterium
EERARR

SEQ ID NO: 1006413 - protein, 18 aa, Mycobacterium
EERCGGDDAIRPEFGSPP

SEQ ID NO: 1006414 - protein, 10 aa, Mycobacterium
EERNAADATT

SEQ ID NO: 1006415 - protein, 6 aa, Mycobacterium
EERRDE

SEQ ID NO: 1006416 - protein, 7 aa, Mycobacterium
EERSGAR

SEQ ID NO: 1006417 - protein, 13 aa, Mycobacterium
EERVDDGTGSDTP

SEQ ID NO: 1006418 - protein, 13 aa, Mycobacterium
EESADPAIDADSD

SEQ ID NO: 1006419 - protein, 6 aa, Mycobacterium
EESDDV

SEQ ID NO: 1006420 - protein, 9 aa, Mycobacterium
EESETPQAV

SEQ ID NO: 1006421 - protein, 4 aa, Mycobacterium
EESG

SEQ ID NO: 1006422 - protein, 10 aa, Mycobacterium
EESGDQLTED

SEQ ID NO: 1006423 - protein, 5 aa, Mycobacterium
EESGV

SEQ ID NO: 1006424 - protein, 6 aa, Mycobacterium
EESIRR

SEQ ID NO: 1006425 - protein, 5 aa, Mycobacterium
EESLA

SEQ ID NO: 1006426 - protein, 4 aa, Mycobacterium
EESM

SEQ ID NO: 1006427 - protein, 8 aa, Mycobacterium
EESMDPEA

SEQ ID NO: 1006428 - protein, 7 aa, Mycobacterium
EESQKAT

SEQ ID NO: 1006429 - protein, 8 aa, Mycobacterium
EESSTLGT

SEQ ID NO: 1006430 - protein, 13 aa, Mycobacterium
EESTTEGVREVPG

SEQ ID NO: 1006431 - protein, 4 aa, Mycobacterium
EESV

SEQ ID NO: 1006432 - protein, 7 aa, Mycobacterium
EESVGKT

SEQ ID NO: 1006433 - protein, 4 aa, Mycobacterium
EETD

SEQ ID NO: 1006434 - protein, 6 aa, Mycobacterium
EETGIR

SEQ ID NO: 1006435 - protein, 17 aa, Mycobacterium
EETGLDLDPDSPDLEGT

SEQ ID NO: 1006436 - protein, 14 aa, Mycobacterium
EETKKLSKRDPQSN

SEQ ID NO: 1006437 - protein, 8 aa, Mycobacterium
EETPQIET

SEQ ID NO: 1006438 - protein, 9 aa, Mycobacterium
EETSAGRYS

SEQ ID NO: 1006439 - protein, 5 aa, Mycobacterium
EETTL

SEQ ID NO: 1006440 - protein, 12 aa, Mycobacterium
EEVGGGARSSEA

SEQ ID NO: 1006441 - protein, 13 aa, Mycobacterium
EEVTSDGRSDRGN

SEQ ID NO: 1006442 - protein, 6 aa, Mycobacterium
EEYAGP

SEQ ID NO: 1006443 - protein, 5 aa, Mycobacterium
EEYEA

SEQ ID NO: 1006444 - protein, 9 aa, Mycobacterium
EEYGGGGAG

SEQ ID NO: 1006445 - protein, 11 aa, Mycobacterium
EEYGGGGNPDF

SEQ ID NO: 1006446 - protein, 10 aa, Mycobacterium
EFEARRREQQ

SEQ ID NO: 1006447 - protein, 7 aa, Mycobacterium
EFEGERP

SEQ ID NO: 1006448 - protein, 5 aa, Mycobacterium
EFESE

SEQ ID NO: 1006449 - protein, 8 aa, Mycobacterium
EFGGTDVD

SEQ ID NO: 1006450 - protein, 5 aa, Mycobacterium
EFPAK

SEQ ID NO: 1006451 - protein, 6 aa, Mycobacterium
EFPDPD

SEQ ID NO: 1006452 - protein, 9 aa, Mycobacterium
EFPKTTKAG

SEQ ID NO: 1006453 - protein, 6 aa, Mycobacterium
EFPQQP

SEQ ID NO: 1006454 - protein, 9 aa, Mycobacterium
EFQSRSAEL

SEQ ID NO: 1006455 - protein, 4 aa, Mycobacterium
EFRT

SEQ ID NO: 1006456 - protein, 8 aa, Mycobacterium
EFSGAEAV

SEQ ID NO: 1006457 - protein, 10 aa, Mycobacterium
EFSKESGRSE

SEQ ID NO: 1006458 - protein, 7 aa, Mycobacterium
EFSNGTS

SEQ ID NO: 1006459 - protein, 13 aa, Mycobacterium
EFSRASRTTTAEP

SEQ ID NO: 1006460 - protein, 8 aa, Mycobacterium
EFTDTAGL

SEQ ID NO: 1006461 - protein, 30 aa, Mycobacterium; identical to SEQ ID NO: 464392

SEQ ID NO: 1006462 - protein, 9 aa, Mycobacterium
EFTTPDPSY

SEQ ID NO: 1006463 - protein, 20 aa, Mycobacterium
EFTTPTGTSYRSGAPPRVQT

SEQ ID NO: 1006464 - protein, 4 aa, Mycobacterium
EGAA

SEQ ID NO: 1006465 - protein, 11 aa, Mycobacterium
EGADKLPTDKR

SEQ ID NO: 1006466 - protein, 4 aa, Mycobacterium
EGAE

SEQ ID NO: 1006467 - protein, 16 aa, Mycobacterium
EGAESSVLDGDSGSET

SEQ ID NO: 1006468 - protein, 17 aa, Mycobacterium
EGAGAAGMTTAGESAVA

SEQ ID NO: 1006469 - protein, 10 aa, Mycobacterium
EGAGGNGGHG

SEQ ID NO: 1006470 - protein, 9 aa, Mycobacterium
EGAGSPAEI

SEQ ID NO: 1006471 - protein, 9 aa, Mycobacterium
EGAKGKAKE

SEQ ID NO: 1006472 - protein, 13 aa, Mycobacterium
EGALPPPRKKSRR

SEQ ID NO: 1006473 - protein, 8 aa, Mycobacterium
EGAMETDA

SEQ ID NO: 1006474 - protein, 5 aa, Mycobacterium
EGANS

SEQ ID NO: 1006475 - protein, 9 aa, Mycobacterium
EGAPAPAAV

SEQ ID NO: 1006476 - protein, 5 aa, Mycobacterium
EGAPD

SEQ ID NO: 1006477 - protein, 8 aa, Mycobacterium
EGAPGQQE

SEQ ID NO: 1006478 - protein, 10 aa, Mycobacterium
EGAPPTPQSD

SEQ ID NO: 1006479 - protein, 10 aa, Mycobacterium
EGAPRPAVGP

SEQ ID NO: 1006480 - protein, 7 aa, Mycobacterium
EGAPVER

SEQ ID NO: 1006481 - protein, 7 aa, Mycobacterium
EGAQSGA

SEQ ID NO: 1006482 - protein, 16 aa, Mycobacterium
EGARRESGWGAQRGMA

SEQ ID NO: 1006483 - protein, 69 aa, Mycobacterium
EGATATAGTTIPAGTTGATGTTGAEQRSGVSADSADSAGVTQSQPTSSAGPASTEESRGPTSPAIAPDE

SEQ ID NO: 1006484 - protein, 9 aa, Mycobacterium
EGATPQRRR

SEQ ID NO: 1006485 - protein, 7 aa, Mycobacterium
EGATVSA

SEQ ID NO: 1006486 - protein, 4 aa, Mycobacterium
EGAV

SEQ ID NO: 1006487 - protein, 4 aa, Mycobacterium
EGDD

SEQ ID NO: 1006488 - protein, 7 aa, Mycobacterium
EGDDTEP

SEQ ID NO: 1006489 - protein, 7 aa, Mycobacterium
EGDDTVR

SEQ ID NO: 1006490 - protein, 5 aa, Mycobacterium
EGDDV

SEQ ID NO: 1006491 - protein, 11 aa, Mycobacterium
EGDGAEATSGK

SEQ ID NO: 1006492 - protein, 8 aa, Mycobacterium
EGDGEGSL

SEQ ID NO: 1006493 - protein, 5 aa, Mycobacterium
EGDGV

SEQ ID NO: 1006494 - protein, 5 aa, Mycobacterium
EGDID

SEQ ID NO: 1006495 - protein, 7 aa, Mycobacterium
EGDIPTG

SEQ ID NO: 1006496 - protein, 10 aa, Mycobacterium
EGDLDPDTIT

SEQ ID NO: 1006497 - protein, 10 aa, Mycobacterium
EGDPASTEGI

SEQ ID NO: 1006498 - protein, 6 aa, Mycobacterium
EGDPSA

SEQ ID NO: 1006499 - protein, 8 aa, Mycobacterium
EGDQGLTQ

SEQ ID NO: 1006500 - protein, 4 aa, Mycobacterium
EGDR

SEQ ID NO: 1006501 - protein, 8 aa, Mycobacterium
EGDSGEHA

SEQ ID NO: 1006502 - protein, 13 aa, Mycobacterium
EGDTAALEESGKT

SEQ ID NO: 1006503 - protein, 6 aa, Mycobacterium
EGDTVE

SEQ ID NO: 1006504 - protein, 5 aa, Mycobacterium
EGDVP

SEQ ID NO: 1006505 - protein, 5 aa, Mycobacterium
EGDYR

SEQ ID NO: 1006506 - protein, 8 aa, Mycobacterium
EGDYSRPY

SEQ ID NO: 1006507 - protein, 8 aa, Mycobacterium
EGEAWQSD

SEQ ID NO: 1006508 - protein, 6 aa, Mycobacterium
EGEDDR

SEQ ID NO: 1006509 - protein, 20 aa, Mycobacterium
EGEDPTHPGTAEPPFPPPTR

SEQ ID NO: 1006510 - protein, 7 aa, Mycobacterium
EGEGFDS

SEQ ID NO: 1006511 - protein, 8 aa, Mycobacterium
EGEKDDAP

SEQ ID NO: 1006512 - protein, 5 aa, Mycobacterium
EGELE

SEQ ID NO: 1006513 - protein, 10 aa, Mycobacterium
EGELPDPGPI

SEQ ID NO: 1006514 - protein, 6 aa, Mycobacterium
EGELPQ

SEQ ID NO: 1006515 - protein, 6 aa, Mycobacterium
EGEPGD

SEQ ID NO: 1006516 - protein, 10 aa, Mycobacterium
EGERLTDRQS

SEQ ID NO: 1006517 - protein, 5 aa, Mycobacterium
EGESL

SEQ ID NO: 1006518 - protein, 19 aa, Mycobacterium
EGEVRTSLNDAEAKSNSSV

SEQ ID NO: 1006519 - protein, 8 aa, Mycobacterium
EGFGRPDG

SEQ ID NO: 1006520 - protein, 4 aa, Mycobacterium
EGFR

SEQ ID NO: 1006521 - protein, 7 aa, Mycobacterium
EGFRDDG

SEQ ID NO: 1006522 - protein, 4 aa, Mycobacterium
EGFS

SEQ ID NO: 1006523 - protein, 11 aa, Mycobacterium
EGFSKTSTTET

SEQ ID NO: 1006524 - protein, 10 aa, Mycobacterium
EGGAPDDPAR

SEQ ID NO: 1006525 - protein, 11 aa, Mycobacterium
EGGCDAAQAPD

SEQ ID NO: 1006526 - protein, 16 aa, Mycobacterium
EGGERRGTDDEQPEVG

SEQ ID NO: 1006527 - protein, 6 aa, Mycobacterium
EGGERV

SEQ ID NO: 1006528 - protein, 9 aa, Mycobacterium
EGGGCTESV

SEQ ID NO: 1006529 - protein, 13 aa, Mycobacterium
EGGGQANATVLEL

SEQ ID NO: 1006530 - protein, 8 aa, Mycobacterium
EGGGRQVA

SEQ ID NO: 1006531 - protein, 13 aa, Mycobacterium
EGGGTANVTIIER

SEQ ID NO: 1006532 - protein, 6 aa, Mycobacterium
EGGHAD

SEQ ID NO: 1006533 - protein, 7 aa, Mycobacterium
EGGHSRR

SEQ ID NO: 1006534 - protein, 8 aa, Mycobacterium
EGGIAPEE

SEQ ID NO: 1006535 - protein, 13 aa, Mycobacterium
EGGKRSTSVSSES

SEQ ID NO: 1006536 - protein, 35 aa, Mycobacterium
EGGLAGDGGDGGDTTAVGGNGGTGGVGGNGGNASS

SEQ ID NO: 1006537 - protein, 10 aa, Mycobacterium
EGGPSRHHAR

SEQ ID NO: 1006538 - protein, 5 aa, Mycobacterium
EGGPT

SEQ ID NO: 1006539 - protein, 13 aa, Mycobacterium
EGGQGGAADNEQL

SEQ ID NO: 1006540 - protein, 5 aa, Mycobacterium
EGGQS

SEQ ID NO: 1006541 - protein, 5 aa, Mycobacterium
EGGRP

SEQ ID NO: 1006542 - protein, 32 aa, Mycobacterium
EGGRPGRSRPPAGDDPGSPADQAGDRSSSSTR

SEQ ID NO: 1006543 - protein, 5 aa, Mycobacterium
EGGRV

SEQ ID NO: 1006544 - protein, 7 aa, Mycobacterium
EGGSGLA

SEQ ID NO: 1006545 - protein, 8 aa, Mycobacterium
EGGTAGTV

SEQ ID NO: 1006546 - protein, 6 aa, Mycobacterium
EGGTVG

SEQ ID NO: 1006547 - protein, 8 aa, Mycobacterium
EGGVPDDG

SEQ ID NO: 1006548 - protein, 5 aa, Mycobacterium
EGGYT

SEQ ID NO: 1006549 - protein, 6 aa, Mycobacterium
EGHDPA

SEQ ID NO: 1006550 - protein, 7 aa, Mycobacterium
EGHLTGP

SEQ ID NO: 1006551 - protein, 9 aa, Mycobacterium
EGHQNSERR

SEQ ID NO: 1006552 - protein, 34 aa, Mycobacterium
EGIEELGRSGVGVGESGLSYASGDAAAALTYGLF

SEQ ID NO: 1006553 - protein, 16 aa, Mycobacterium
EGIERNSDVRGYTSQV

SEQ ID NO: 1006554 - protein, 5 aa, Mycobacterium
EGIGA

SEQ ID NO: 1006555 - protein, 4 aa, Mycobacterium
EGIP

SEQ ID NO: 1006556 - protein, 7 aa, Mycobacterium
EGIPTDG

SEQ ID NO: 1006557 - protein, 4 aa, Mycobacterium
EGIQ

SEQ ID NO: 1006558 - protein, 9 aa, Mycobacterium
EGIRRGTPM

SEQ ID NO: 1006559 - protein, 17 aa, Mycobacterium
EGISDADAEAAGKGVKQ

SEQ ID NO: 1006560 - protein, 14 aa, Mycobacterium
EGKAAEKARNPRES

SEQ ID NO: 1006561 - protein, 9 aa, Mycobacterium
EGKAPRELP

SEQ ID NO: 1006562 - protein, 8 aa, Mycobacterium
EGKGSGHE

SEQ ID NO: 1006563 - protein, 5 aa, Mycobacterium
EGKQP

SEQ ID NO: 1006564 - protein, 7 aa, Mycobacterium
EGKRSYA

SEQ ID NO: 1006565 - protein, 9 aa, Mycobacterium
EGKSVGESA

SEQ ID NO: 1006566 - protein, 7 aa, Mycobacterium
EGKSVRS

SEQ ID NO: 1006567 - protein, 23 aa, Mycobacterium
EGLAPNPDATSTSLPGARGADVD

SEQ ID NO: 1006568 - protein, 5 aa, Mycobacterium
EGLPA

SEQ ID NO: 1006569 - protein, 14 aa, Mycobacterium
EGLPGQPEEPAPPS

SEQ ID NO: 1006570 - protein, 7 aa, Mycobacterium
EGLPPGE

SEQ ID NO: 1006571 - protein, 4 aa, Mycobacterium
EGLR

SEQ ID NO: 1006572 - protein, 5 aa, Mycobacterium
EGNAK

SEQ ID NO: 1006573 - protein, 8 aa, Mycobacterium
EGNPPDPA

SEQ ID NO: 1006574 - protein, 20 aa, Mycobacterium
EGNRALDAGDHDAALQSASS

SEQ ID NO: 1006575 - protein, 5 aa, Mycobacterium
EGNRV

SEQ ID NO: 1006576 - protein, 7 aa, Mycobacterium
EGNSGQL

SEQ ID NO: 1006577 - protein, 7 aa, Mycobacterium
EGPAFSA

SEQ ID NO: 1006578 - protein, 6 aa, Mycobacterium
EGPAHG

SEQ ID NO: 1006579 - protein, 9 aa, Mycobacterium
EGPATPAQI

SEQ ID NO: 1006580 - protein, 4 aa, Mycobacterium
EGPD

SEQ ID NO: 1006581 - protein, 13 aa, Mycobacterium
EGPDGEPVGTTRR

SEQ ID NO: 1006582 - protein, 5 aa, Mycobacterium
EGPDT

SEQ ID NO: 1006583 - protein, 7 aa, Mycobacterium
EGPDYSA

SEQ ID NO: 1006584 - protein, 18 aa, Mycobacterium
EGPEVDGPYGPYRQSQRT

SEQ ID NO: 1006585 - protein, 8 aa, Mycobacterium
EGPEVETE

SEQ ID NO: 1006586 - protein, 10 aa, Mycobacterium
EGPGITDDTR

SEQ ID NO: 1006587 - protein, 6 aa, Mycobacterium
EGPGLT

SEQ ID NO: 1006588 - protein, 4 aa, Mycobacterium
EGPI

SEQ ID NO: 1006589 - protein, 10 aa, Mycobacterium
EGPLNRATAT

SEQ ID NO: 1006590 - protein, 17 aa, Mycobacterium
EGPLRPGEGPLRPGEGP

SEQ ID NO: 1006591 - protein, 16 aa, Mycobacterium
EGPPWAGRRAQGARAC

SEQ ID NO: 1006592 - protein, 4 aa, Mycobacterium
EGPR

SEQ ID NO: 1006593 - protein, 7 aa, Mycobacterium
EGPRGLY

SEQ ID NO: 1006594 - protein, 8 aa, Mycobacterium
EGPSADPE

SEQ ID NO: 1006595 - protein, 8 aa, Mycobacterium
EGPTDDPD

SEQ ID NO: 1006596 - protein, 7 aa, Mycobacterium
EGPVDPR

SEQ ID NO: 1006597 - protein, 7 aa, Mycobacterium
EGQAAVK

SEQ ID NO: 1006598 - protein, 6 aa, Mycobacterium
EGQAIE

SEQ ID NO: 1006599 - protein, 10 aa, Mycobacterium
EGQGRPGDDD

SEQ ID NO: 1006600 - protein, 5 aa, Mycobacterium
EGQKT

SEQ ID NO: 1006601 - protein, 7 aa, Mycobacterium
EGQPDPA

SEQ ID NO: 1006602 - protein, 7 aa, Mycobacterium
EGQRPKA

SEQ ID NO: 1006603 - protein, 4 aa, Mycobacterium
EGRA

SEQ ID NO: 1006604 - protein, 12 aa, Mycobacterium
EGRAADPELRGP

SEQ ID NO: 1006605 - protein, 13 aa, Mycobacterium
EGRDPRAAALATV

SEQ ID NO: 1006606 - protein, 10 aa, Mycobacterium
EGRDTSTMPR

SEQ ID NO: 1006607 - protein, 8 aa, Mycobacterium
EGRFDEQS

SEQ ID NO: 1006608 - protein, 9 aa, Mycobacterium
EGRGEPRDD

SEQ ID NO: 1006609 - protein, 5 aa, Mycobacterium
EGRGV

SEQ ID NO: 1006610 - protein, 4 aa, Mycobacterium
EGRN

SEQ ID NO: 1006611 - protein, 5 aa, Mycobacterium
EGRNR

SEQ ID NO: 1006612 - protein, 9 aa, Mycobacterium
EGRNTASKN

SEQ ID NO: 1006613 - protein, 4 aa, Mycobacterium
EGRP

SEQ ID NO: 1006614 - protein, 17 aa, Mycobacterium
EGRPPVTRGGAKPGSSV

SEQ ID NO: 1006615 - protein, 10 aa, Mycobacterium
EGRQLRSTDG

SEQ ID NO: 1006616 - protein, 12 aa, Mycobacterium
EGRRGQPRLRPP

SEQ ID NO: 1006617 - protein, 8 aa, Mycobacterium
EGRRQPHV

SEQ ID NO: 1006618 - protein, 10 aa, Mycobacterium
EGRSLGDPET

SEQ ID NO: 1006619 - protein, 7 aa, Mycobacterium
EGRSTAT

SEQ ID NO: 1006620 - protein, 13 aa, Mycobacterium
EGRTVYREPATQS

SEQ ID NO: 1006621 - protein, 7 aa, Mycobacterium
EGRVAEP

SEQ ID NO: 1006622 - protein, 8 aa, Mycobacterium
EGRVAPEQ

SEQ ID NO: 1006623 - protein, 7 aa, Mycobacterium
EGSADPH

SEQ ID NO: 1006624 - protein, 4 aa, Mycobacterium
EGSD

SEQ ID NO: 1006625 - protein, 9 aa, Mycobacterium
EGSGLSKDE

SEQ ID NO: 1006626 - protein, 7 aa, Mycobacterium
EGSKTGA

SEQ ID NO: 1006627 - protein, 4 aa, Mycobacterium
EGSL

SEQ ID NO: 1006628 - protein, 5 aa, Mycobacterium
EGSPF

SEQ ID NO: 1006629 - protein, 7 aa, Mycobacterium
EGTAEPS

SEQ ID NO: 1006630 - protein, 5 aa, Mycobacterium
EGTAL

SEQ ID NO: 1006631 - protein, 9 aa, Mycobacterium
EGTARQDRA

SEQ ID NO: 1006632 - protein, 8 aa, Mycobacterium
EGTAVTPA

SEQ ID NO: 1006633 - protein, 4 aa, Mycobacterium
EGTD

SEQ ID NO: 1006634 - protein, 6 aa, Mycobacterium
EGTGAT

SEQ ID NO: 1006635 - protein, 6 aa, Mycobacterium
EGTGLT

SEQ ID NO: 1006636 - protein, 5 aa, Mycobacterium
EGTGT

SEQ ID NO: 1006637 - protein, 5 aa, Mycobacterium
EGTLP

SEQ ID NO: 1006638 - protein, 9 aa, Mycobacterium
EGTNSTEDY

SEQ ID NO: 1006639 - protein, 5 aa, Mycobacterium
EGTPE

SEQ ID NO: 1006640 - protein, 7 aa, Mycobacterium
EGTPPGL

SEQ ID NO: 1006641 - protein, 6 aa, Mycobacterium
EGTPVT

SEQ ID NO: 1006642 - protein, 4 aa, Mycobacterium
EGTQ

SEQ ID NO: 1006643 - protein, 7 aa, Mycobacterium
EGTREAA

SEQ ID NO: 1006644 - protein, 14 aa, Mycobacterium
EGTRLDTTEVGPFK

SEQ ID NO: 1006645 - protein, 16 aa, Mycobacterium
EGTRLDTTEVGPFKKG

SEQ ID NO: 1006646 - protein, 6 aa, Mycobacterium
EGTRTI

SEQ ID NO: 1006647 - protein, 4 aa, Mycobacterium
EGTT

SEQ ID NO: 1006648 - protein, 15 aa, Mycobacterium
EGTTMGSRIDEQLHG

SEQ ID NO: 1006649 - protein, 5 aa, Mycobacterium
EGTTV

SEQ ID NO: 1006650 - protein, 4 aa, Mycobacterium
EGVA

SEQ ID NO: 1006651 - protein, 7 aa, Mycobacterium
EGVAQTA

SEQ ID NO: 1006652 - protein, 9 aa, Mycobacterium
EGVDEPTKS

SEQ ID NO: 1006653 - protein, 6 aa, Mycobacterium
EGVEEL

SEQ ID NO: 1006654 - protein, 6 aa, Mycobacterium
EGVEQS

SEQ ID NO: 1006655 - protein, 7 aa, Mycobacterium
EGVGPAA

SEQ ID NO: 1006656 - protein, 8 aa, Mycobacterium
EGVPDDIP

SEQ ID NO: 1006657 - protein, 6 aa, Mycobacterium
EGVPGV

SEQ ID NO: 1006658 - protein, 6 aa, Mycobacterium
EGVPTP

SEQ ID NO: 1006659 - protein, 11 aa, Mycobacterium
EGVRRTGGSNV

SEQ ID NO: 1006660 - protein, 5 aa, Mycobacterium
EGVSG

SEQ ID NO: 1006661 - protein, 13 aa, Mycobacterium
EGWRTTETWPPPG

SEQ ID NO: 1006662 - protein, 8 aa, Mycobacterium
EGYPGAGH

SEQ ID NO: 1006663 - protein, 8 aa, Mycobacterium
EGYPTPTD

SEQ ID NO: 1006664 - protein, 6 aa, Mycobacterium
EHAARN

SEQ ID NO: 1006665 - protein, 10 aa, Mycobacterium
EHAESKDHHP

SEQ ID NO: 1006666 - protein, 9 aa, Mycobacterium
EHAGPGVPR

SEQ ID NO: 1006667 - protein, 8 aa, Mycobacterium
EHAKARGA

SEQ ID NO: 1006668 - protein, 10 aa, Mycobacterium
EHAKARGAKP

SEQ ID NO: 1006669 - protein, 15 aa, Mycobacterium
EHARTDWDNDGVPRR

SEQ ID NO: 1006670 - protein, 7 aa, Mycobacterium
EHDAERA

SEQ ID NO: 1006671 - protein, 7 aa, Mycobacterium
EHDPGPL

SEQ ID NO: 1006672 - protein, 7 aa, Mycobacterium
EHDSSHE

SEQ ID NO: 1006673 - protein, 17 aa, Mycobacterium
EHELGTKGPGQDGPGRE

SEQ ID NO: 1006674 - protein, 7 aa, Mycobacterium
EHGAEGK

SEQ ID NO: 1006675 - protein, 20 aa, Mycobacterium
EHGAQRVEGRDGHGVNDNAM

SEQ ID NO: 1006676 - protein, 7 aa, Mycobacterium
EHGATPY

SEQ ID NO: 1006677 - protein, 8 aa, Mycobacterium
EHGDDGSR

SEQ ID NO: 1006678 - protein, 8 aa, Mycobacterium
EHGDPLAG

SEQ ID NO: 1006679 - protein, 5 aa, Mycobacterium
EHGGH

SEQ ID NO: 1006680 - protein, 6 aa, Mycobacterium
EHGGLS

SEQ ID NO: 1006681 - protein, 14 aa, Mycobacterium
EHGKTVPDARGDIQ

SEQ ID NO: 1006682 - protein, 8 aa, Mycobacterium
EHGNEPVA

SEQ ID NO: 1006683 - protein, 6 aa, Mycobacterium
EHGPDA

SEQ ID NO: 1006684 - protein, 4 aa, Mycobacterium
EHGQ

SEQ ID NO: 1006685 - protein, 8 aa, Mycobacterium
EHGSEPDL

SEQ ID NO: 1006686 - protein, 4 aa, Mycobacterium
EHGV

SEQ ID NO: 1006687 - protein, 5 aa, Mycobacterium
EHGYP

SEQ ID NO: 1006688 - protein, 9 aa, Mycobacterium
EHHDPTKGS

SEQ ID NO: 1006689 - protein, 4 aa, Mycobacterium
EHKL

SEQ ID NO: 1006690 - protein, 9 aa, Mycobacterium
EHLEPSERP

SEQ ID NO: 1006691 - protein, 11 aa, Mycobacterium
EHNPAEGSHVE

SEQ ID NO: 1006692 - protein, 7 aa, Mycobacterium
EHPDGRR

SEQ ID NO: 1006693 - protein, 6 aa, Mycobacterium
EHPDQR

SEQ ID NO: 1006694 - protein, 6 aa, Mycobacterium
EHPDSG

SEQ ID NO: 1006695 - protein, 12 aa, Mycobacterium
EHPDTGGLEPGH

SEQ ID NO: 1006696 - protein, 4 aa, Mycobacterium
EHPG

SEQ ID NO: 1006697 - protein, 5 aa, Mycobacterium
EHPLS

SEQ ID NO: 1006698 - protein, 7 aa, Mycobacterium
EHPRGDA

SEQ ID NO: 1006699 - protein, 6 aa, Mycobacterium
EHPSSD

SEQ ID NO: 1006700 - protein, 6 aa, Mycobacterium
EHPSTA

SEQ ID NO: 1006701 - protein, 5 aa, Mycobacterium
EHPTR

SEQ ID NO: 1006702 - protein, 6 aa, Mycobacterium
EHPYPA

SEQ ID NO: 1006703 - protein, 7 aa, Mycobacterium
EHPYPTP

SEQ ID NO: 1006704 - protein, 5 aa, Mycobacterium
EHPYR

SEQ ID NO: 1006705 - protein, 9 aa, Mycobacterium
EHQGEPLPA

SEQ ID NO: 1006706 - protein, 6 aa, Mycobacterium
EHQGKR

SEQ ID NO: 1006707 - protein, 6 aa, Mycobacterium
EHQPHG

SEQ ID NO: 1006708 - protein, 15 aa, Mycobacterium
EHQRKQLERDSEGVE

SEQ ID NO: 1006709 - protein, 10 aa, Mycobacterium
EHQTATAQAG

SEQ ID NO: 1006710 - protein, 6 aa, Mycobacterium
EHRADP

SEQ ID NO: 1006711 - protein, 6 aa, Mycobacterium
EHRDSA

SEQ ID NO: 1006712 - protein, 11 aa, Mycobacterium
EHRPGRTITDT

SEQ ID NO: 1006713 - protein, 5 aa, Mycobacterium
EHRQF

SEQ ID NO: 1006714 - protein, 7 aa, Mycobacterium
EHRQPRV

SEQ ID NO: 1006715 - protein, 13 aa, Mycobacterium
EHRSTVSPYLVKQ

SEQ ID NO: 1006716 - protein, 16 aa, Mycobacterium
EHSADSALSDAKHAQE

SEQ ID NO: 1006717 - protein, 8 aa, Mycobacterium
EHSGGSDL

SEQ ID NO: 1006718 - protein, 6 aa, Mycobacterium
EHSGPQ

SEQ ID NO: 1006719 - protein, 11 aa, Mycobacterium
EHTGNTSAASI

SEQ ID NO: 1006720 - protein, 5 aa, Mycobacterium
EHTGR

SEQ ID NO: 1006721 - protein, 6 aa, Mycobacterium
EHTVAE

SEQ ID NO: 1006722 - protein, 9 aa, Mycobacterium
EIADGLTRR

SEQ ID NO: 1006723 - protein, 8 aa, Mycobacterium
EIAGAPSD

SEQ ID NO: 1006724 - protein, 12 aa, Mycobacterium
EIAGARAAAEAG

SEQ ID NO: 1006725 - protein, 5 aa, Mycobacterium
EIAGP

SEQ ID NO: 1006726 - protein, 12 aa, Mycobacterium
EIAPPDATTPAT

SEQ ID NO: 1006727 - protein, 5 aa, Mycobacterium
EIASA

SEQ ID NO: 1006728 - protein, 10 aa, Mycobacterium
EIDHDEQAQL

SEQ ID NO: 1006729 - protein, 16 aa, Mycobacterium
EIDPRNPDQYHSDGRD

SEQ ID NO: 1006730 - protein, 10 aa, Mycobacterium
EIDRDTERAH

SEQ ID NO: 1006731 - protein, 6 aa, Mycobacterium
EIDTDT

SEQ ID NO: 1006732 - protein, 5 aa, Mycobacterium
EIENR

SEQ ID NO: 1006733 - protein, 12 aa, Mycobacterium
EIEPGTPAPQAR

SEQ ID NO: 1006734 - protein, 12 aa, Mycobacterium
EIEPQEPEAEAV

SEQ ID NO: 1006735 - protein, 5 aa, Mycobacterium
EIGGG

SEQ ID NO: 1006736 - protein, 12 aa, Mycobacterium
EIGGPRASNEYP

SEQ ID NO: 1006737 - protein, 5 aa, Mycobacterium
EIGKS

SEQ ID NO: 1006738 - protein, 10 aa, Mycobacterium
EIGNEKASSY

SEQ ID NO: 1006739 - protein, 5 aa, Mycobacterium
EIGPS

SEQ ID NO: 1006740 - protein, 10 aa, Mycobacterium
EIGPSPAEAD

SEQ ID NO: 1006741 - protein, 14 aa, Mycobacterium
EIGRNISDEKTDGN

SEQ ID NO: 1006742 - protein, 11 aa, Mycobacterium
EIGRTQQGNNN

SEQ ID NO: 1006743 - protein, 9 aa, Mycobacterium
EIGSGSVPQ

SEQ ID NO: 1006744 - protein, 11 aa, Mycobacterium
EIKNGQRKQVN

SEQ ID NO: 1006745 - protein, 18 aa, Mycobacterium
EIPAAANRDWTGTTRTSW

SEQ ID NO: 1006746 - protein, 8 aa, Mycobacterium
EIPAAKAS

SEQ ID NO: 1006747 - protein, 9 aa, Mycobacterium
EIPADRPAL

SEQ ID NO: 1006748 - protein, 5 aa, Mycobacterium
EIPDT

SEQ ID NO: 1006749 - protein, 8 aa, Mycobacterium
EIPEPGTP

SEQ ID NO: 1006750 - protein, 6 aa, Mycobacterium
EIPPDR

SEQ ID NO: 1006751 - protein, 15 aa, Mycobacterium
EIPSFAPPKELQPGE

SEQ ID NO: 1006752 - protein, 7 aa, Mycobacterium
EIQPGVT

SEQ ID NO: 1006753 - protein, 9 aa, Mycobacterium
EIREEVDND

SEQ ID NO: 1006754 - protein, 7 aa, Mycobacterium
EIRTTNP

SEQ ID NO: 1006755 - protein, 12 aa, Mycobacterium
EISSDTAQSEGL

SEQ ID NO: 1006756 - protein, 6 aa, Mycobacterium
EISSTG

SEQ ID NO: 1006757 - protein, 11 aa, Mycobacterium
EITGQSGRLTP

SEQ ID NO: 1006758 - protein, 12 aa, Mycobacterium
EIYGGTKSAWDY

SEQ ID NO: 1006759 - protein, 9 aa, Mycobacterium
EKAAGPRRL

SEQ ID NO: 1006760 - protein, 7 aa, Mycobacterium
EKAAPNA

SEQ ID NO: 1006761 - protein, 9 aa, Mycobacterium
EKADAAVAA

SEQ ID NO: 1006762 - protein, 6 aa, Mycobacterium
EKADRT

SEQ ID NO: 1006763 - protein, 12 aa, Mycobacterium
EKAGAAINATPR

SEQ ID NO: 1006764 - protein, 8 aa, Mycobacterium
EKAGTEPI

SEQ ID NO: 1006765 - protein, 7 aa, Mycobacterium
EKAIASA

SEQ ID NO: 1006766 - protein, 8 aa, Mycobacterium
EKAKPRKI

SEQ ID NO: 1006767 - protein, 4 aa, Mycobacterium
EKAN

SEQ ID NO: 1006768 - protein, 4 aa, Mycobacterium
EKAP

SEQ ID NO: 1006769 - protein, 8 aa, Mycobacterium
EKAPSGGI

SEQ ID NO: 1006770 - protein, 6 aa, Mycobacterium
EKAQEL

SEQ ID NO: 1006771 - protein, 14 aa, Mycobacterium
EKAQSGSTEQDKTN

SEQ ID NO: 1006772 - protein, 5 aa, Mycobacterium
EKAVR

SEQ ID NO: 1006773 - protein, 5 aa, Mycobacterium
EKAYE

SEQ ID NO: 1006774 - protein, 10 aa, Mycobacterium
EKCPQKPTAL

SEQ ID NO: 1006775 - protein, 4 aa, Mycobacterium
EKDL

SEQ ID NO: 1006776 - protein, 6 aa, Mycobacterium
EKDPDT

SEQ ID NO: 1006777 - protein, 14 aa, Mycobacterium
EKDPTLAYGPGRGA

SEQ ID NO: 1006778 - protein, 8 aa, Mycobacterium
EKDRHNAA

SEQ ID NO: 1006779 - protein, 16 aa, Mycobacterium
EKDSRDGAEDGSPDGV

SEQ ID NO: 1006780 - protein, 9 aa, Mycobacterium
EKDSSINDD

SEQ ID NO: 1006781 - protein, 14 aa, Mycobacterium
EKEARNNKERKPVH

SEQ ID NO: 1006782 - protein, 13 aa, Mycobacterium
EKEPQGLPESKSF

SEQ ID NO: 1006783 - protein, 4 aa, Mycobacterium
EKET

SEQ ID NO: 1006784 - protein, 5 aa, Mycobacterium
EKFPN

SEQ ID NO: 1006785 - protein, 5 aa, Mycobacterium
EKGAD

SEQ ID NO: 1006786 - protein, 10 aa, Mycobacterium
EKGAPGAAGI

SEQ ID NO: 1006787 - protein, 6 aa, Mycobacterium
EKGGDD

SEQ ID NO: 1006788 - protein, 12 aa, Mycobacterium
EKGKKADKRAGS

SEQ ID NO: 1006789 - protein, 7 aa, Mycobacterium
EKGNVPA

SEQ ID NO: 1006790 - protein, 6 aa, Mycobacterium
EKGPDV

SEQ ID NO: 1006791 - protein, 5 aa, Mycobacterium
EKGPR

SEQ ID NO: 1006792 - protein, 10 aa, Mycobacterium
EKGQADNLER

SEQ ID NO: 1006793 - protein, 7 aa, Mycobacterium
EKGTADV

SEQ ID NO: 1006794 - protein, 5 aa, Mycobacterium
EKGTD

SEQ ID NO: 1006795 - protein, 6 aa, Mycobacterium
EKHGPP

SEQ ID NO: 1006796 - protein, 9 aa, Mycobacterium
EKHGSAAVT

SEQ ID NO: 1006797 - protein, 39 aa, Mycobacterium; identical to SEQ ID NO: 466598

SEQ ID NO: 1006798 - protein, 11 aa, Mycobacterium
EKKPKDAETKQ

SEQ ID NO: 1006799 - protein, 8 aa, Mycobacterium
EKKSAVSE

SEQ ID NO: 1006800 - protein, 15 aa, Mycobacterium
EKLAEAKQSHSGRAA

SEQ ID NO: 1006801 - protein, 10 aa, Mycobacterium
EKLAQQQLDG

SEQ ID NO: 1006802 - protein, 13 aa, Mycobacterium
EKLSGSTDERDRP

SEQ ID NO: 1006803 - protein, 7 aa, Mycobacterium
EKLSNEQ

SEQ ID NO: 1006804 - protein, 10 aa, Mycobacterium
EKLTEDDARV

SEQ ID NO: 1006805 - protein, 6 aa, Mycobacterium
EKMSKS

SEQ ID NO: 1006806 - protein, 8 aa, Mycobacterium
EKNHAHST

SEQ ID NO: 1006807 - protein, 6 aa, Mycobacterium
EKNNEI

SEQ ID NO: 1006808 - protein, 15 aa, Mycobacterium
EKNRPDRVDQHGNSR

SEQ ID NO: 1006809 - protein, 6 aa, Mycobacterium
EKNRQL

SEQ ID NO: 1006810 - protein, 7 aa, Mycobacterium
EKNSHTS

SEQ ID NO: 1006811 - protein, 15 aa, Mycobacterium
EKPGGHGDRAGAAGA

SEQ ID NO: 1006812 - protein, 10 aa, Mycobacterium
EKPGRDPRPA

SEQ ID NO: 1006813 - protein, 9 aa, Mycobacterium
EKPGRNPRQ

SEQ ID NO: 1006814 - protein, 10 aa, Mycobacterium
EKPKTQDAPS

SEQ ID NO: 1006815 - protein, 7 aa, Mycobacterium
EKPLGPG

SEQ ID NO: 1006816 - protein, 8 aa, Mycobacterium
EKPTEESV

SEQ ID NO: 1006817 - protein, 5 aa, Mycobacterium
EKPTT

SEQ ID NO: 1006818 - protein, 6 aa, Mycobacterium
EKPVKT

SEQ ID NO: 1006819 - protein, 11 aa, Mycobacterium
EKQKEGKKRMK

SEQ ID NO: 1006820 - protein, 18 aa, Mycobacterium
EKQKSVSARFGSKESDKF

SEQ ID NO: 1006821 - protein, 7 aa, Mycobacterium
EKQRARV

SEQ ID NO: 1006822 - protein, 5 aa, Mycobacterium
EKQVS

SEQ ID NO: 1006823 - protein, 10 aa, Mycobacterium
EKRGQAEPID

SEQ ID NO: 1006824 - protein, 8 aa, Mycobacterium
EKSASDLG

SEQ ID NO: 1006825 - protein, 10 aa, Mycobacterium
EKSDRPGRNQ

SEQ ID NO: 1006826 - protein, 6 aa, Mycobacterium
EKSDSL

SEQ ID NO: 1006827 - protein, 14 aa, Mycobacterium
EKSGSNGKSQFAAT

SEQ ID NO: 1006828 - protein, 15 aa, Mycobacterium
EKSGSNGKSQFAATP

SEQ ID NO: 1006829 - protein, 9 aa, Mycobacterium
EKSTTATPH

SEQ ID NO: 1006830 - protein, 7 aa, Mycobacterium
EKSVVDG

SEQ ID NO: 1006831 - protein, 13 aa, Mycobacterium
EKTKAPSVTAGPT

SEQ ID NO: 1006832 - protein, 9 aa, Mycobacterium
EKTYGTTDL

SEQ ID NO: 1006833 - protein, 7 aa, Mycobacterium
EKVDPDK

SEQ ID NO: 1006834 - protein, 8 aa, Mycobacterium
ELAAAEPG

SEQ ID NO: 1006835 - protein, 5 aa, Mycobacterium
ELAAG

SEQ ID NO: 1006836 - protein, 5 aa, Mycobacterium
ELAED

SEQ ID NO: 1006837 - protein, 8 aa, Mycobacterium
ELAGPGQQ

SEQ ID NO: 1006838 - protein, 5 aa, Mycobacterium
ELAGQ

SEQ ID NO: 1006839 - protein, 5 aa, Mycobacterium
ELAKN

SEQ ID NO: 1006840 - protein, 10 aa, Mycobacterium
ELAPESTEGI

SEQ ID NO: 1006841 - protein, 7 aa, Mycobacterium
ELAPGPA

SEQ ID NO: 1006842 - protein, 5 aa, Mycobacterium
ELAPR

SEQ ID NO: 1006843 - protein, 14 aa, Mycobacterium
ELAQRDRPQTGKER

SEQ ID NO: 1006844 - protein, 8 aa, Mycobacterium
ELAQSSVQ

SEQ ID NO: 1006845 - protein, 8 aa, Mycobacterium
ELASPVGD

SEQ ID NO: 1006846 - protein, 7 aa, Mycobacterium
ELATAQA

SEQ ID NO: 1006847 - protein, 5 aa, Mycobacterium
ELDDE

SEQ ID NO: 1006848 - protein, 8 aa, Mycobacterium
ELDEPGAR

SEQ ID NO: 1006849 - protein, 11 aa, Mycobacterium
ELDGSGTVRDN

SEQ ID NO: 1006850 - protein, 9 aa, Mycobacterium
ELDTGQQDR

SEQ ID NO: 1006851 - protein, 15 aa, Mycobacterium
ELDTPIANPPSDPVK

SEQ ID NO: 1006852 - protein, 10 aa, Mycobacterium
ELEDESELPA

SEQ ID NO: 1006853 - protein, 7 aa, Mycobacterium
ELEEDPP

SEQ ID NO: 1006854 - protein, 5 aa, Mycobacterium
ELEQN

SEQ ID NO: 1006855 - protein, 9 aa, Mycobacterium
ELERGRSDA

SEQ ID NO: 1006856 - protein, 6 aa, Mycobacterium
ELERTG

SEQ ID NO: 1006857 - protein, 9 aa, Mycobacterium
ELESAAPEL

SEQ ID NO: 1006858 - protein, 11 aa, Mycobacterium
ELESSTDPQEL

SEQ ID NO: 1006859 - protein, 5 aa, Mycobacterium
ELGAA

SEQ ID NO: 1006860 - protein, 6 aa, Mycobacterium
ELGADG

SEQ ID NO: 1006861 - protein, 8 aa, Mycobacterium
ELGADPGR

SEQ ID NO: 1006862 - protein, 6 aa, Mycobacterium
ELGAGE

SEQ ID NO: 1006863 - protein, 13 aa, Mycobacterium
ELGDAGDVPTGRA

SEQ ID NO: 1006864 - protein, 7 aa, Mycobacterium
ELGDEDA

SEQ ID NO: 1006865 - protein, 5 aa, Mycobacterium
ELGDG

SEQ ID NO: 1006866 - protein, 14 aa, Mycobacterium
ELGEAGTNAHHGSG

SEQ ID NO: 1006867 - protein, 7 aa, Mycobacterium
ELGEEPE

SEQ ID NO: 1006868 - protein, 17 aa, Mycobacterium
ELGEGDPDGAGDPEDYR

SEQ ID NO: 1006869 - protein, 5 aa, Mycobacterium
ELGES

SEQ ID NO: 1006870 - protein, 12 aa, Mycobacterium
ELGGADSQARYG

SEQ ID NO: 1006871 - protein, 12 aa, Mycobacterium
ELGGAEAALGAP

SEQ ID NO: 1006872 - protein, 9 aa, Mycobacterium
ELGGDPNRI

SEQ ID NO: 1006873 - protein, 5 aa, Mycobacterium
ELGGI

SEQ ID NO: 1006874 - protein, 6 aa, Mycobacterium
ELGGPA

SEQ ID NO: 1006875 - protein, 8 aa, Mycobacterium
ELGGPDAP

SEQ ID NO: 1006876 - protein, 8 aa, Mycobacterium
ELGGSNPS

SEQ ID NO: 1006877 - protein, 8 aa, Mycobacterium
ELGKTPPG

SEQ ID NO: 1006878 - protein, 10 aa, Mycobacterium
ELGNEHERRT

SEQ ID NO: 1006879 - protein, 5 aa, Mycobacterium
ELGNP

SEQ ID NO: 1006880 - protein, 7 aa, Mycobacterium
ELGPEGK

SEQ ID NO: 1006881 - protein, 5 aa, Mycobacterium
ELGPP

SEQ ID NO: 1006882 - protein, 10 aa, Mycobacterium
ELGPSSAGQI

SEQ ID NO: 1006883 - protein, 10 aa, Mycobacterium
ELGPYGSSRT

SEQ ID NO: 1006884 - protein, 27 aa, Mycobacterium
ELGQRGSAAPVDSSADAGGFEQFNRGN

SEQ ID NO: 1006885 - protein, 7 aa, Mycobacterium
ELGRAPA

SEQ ID NO: 1006886 - protein, 13 aa, Mycobacterium
ELGRDPDGVRAEA

SEQ ID NO: 1006887 - protein, 16 aa, Mycobacterium
ELGREKSAFAAAVTSH

SEQ ID NO: 1006888 - protein, 14 aa, Mycobacterium
ELGRTQYGNNNGYC

SEQ ID NO: 1006889 - protein, 7 aa, Mycobacterium
ELGTRGQ

SEQ ID NO: 1006890 - protein, 4 aa, Mycobacterium
ELHG

SEQ ID NO: 1006891 - protein, 25 aa, Mycobacterium
ELKSVGAQSTRSFRRNRAPSRSSKT

SEQ ID NO: 1006892 - protein, 4 aa, Mycobacterium
ELNE

SEQ ID NO: 1006893 - protein, 4 aa, Mycobacterium
ELPA

SEQ ID NO: 1006894 - protein, 15 aa, Mycobacterium
ELPAGAGDGRELPGG

SEQ ID NO: 1006895 - protein, 6 aa, Mycobacterium
ELPDKV

SEQ ID NO: 1006896 - protein, 6 aa, Mycobacterium
ELPDTP

SEQ ID NO: 1006897 - protein, 19 aa, Mycobacterium
ELPEGASTQNLSLDGQGRV

SEQ ID NO: 1006898 - protein, 6 aa, Mycobacterium
ELPGDP

SEQ ID NO: 1006899 - protein, 6 aa, Mycobacterium
ELPGGA

SEQ ID NO: 1006900 - protein, 6 aa, Mycobacterium
ELPGGS

SEQ ID NO: 1006901 - protein, 8 aa, Mycobacterium
ELPGSADT

SEQ ID NO: 1006902 - protein, 5 aa, Mycobacterium
ELPPG

SEQ ID NO: 1006903 - protein, 8 aa, Mycobacterium
ELPPGQAG

SEQ ID NO: 1006904 - protein, 9 aa, Mycobacterium
ELPPPGGVA

SEQ ID NO: 1006905 - protein, 7 aa, Mycobacterium
ELPPPIG

SEQ ID NO: 1006906 - protein, 12 aa, Mycobacterium
ELPQTSPLMRDA

SEQ ID NO: 1006907 - protein, 6 aa, Mycobacterium
ELPRKD

SEQ ID NO: 1006908 - protein, 6 aa, Mycobacterium
ELPSNT

SEQ ID NO: 1006909 - protein, 10 aa, Mycobacterium
ELPTAEGQQA

SEQ ID NO: 1006910 - protein, 9 aa, Mycobacterium
ELQAQQNTE

SEQ ID NO: 1006911 - protein, 6 aa, Mycobacterium
ELQDKG

SEQ ID NO: 1006912 - protein, 16 aa, Mycobacterium
ELQQETEAAVRTRSDL

SEQ ID NO: 1006913 - protein, 5 aa, Mycobacterium
ELQQS

SEQ ID NO: 1006914 - protein, 6 aa, Mycobacterium
ELRAPM

SEQ ID NO: 1006915 - protein, 17 aa, Mycobacterium
ELREAGVSDKTLADPSY

SEQ ID NO: 1006916 - protein, 4 aa, Mycobacterium
ELRG

SEQ ID NO: 1006917 - protein, 8 aa, Mycobacterium
ELRTEAGQ

SEQ ID NO: 1006918 - protein, 9 aa, Mycobacterium
ELRYNDDGS

SEQ ID NO: 1006919 - protein, 6 aa, Mycobacterium
ELSAAR

SEQ ID NO: 1006920 - protein, 5 aa, Mycobacterium
ELSDG

SEQ ID NO: 1006921 - protein, 5 aa, Mycobacterium
ELSES

SEQ ID NO: 1006922 - protein, 6 aa, Mycobacterium
ELSGSS

SEQ ID NO: 1006923 - protein, 5 aa, Mycobacterium
ELSPA

SEQ ID NO: 1006924 - protein, 12 aa, Mycobacterium
ELSSPRDDPNYD

SEQ ID NO: 1006925 - protein, 5 aa, Mycobacterium
ELSTA

SEQ ID NO: 1006926 - protein, 10 aa, Mycobacterium
ELSTDDSPSF

SEQ ID NO: 1006927 - protein, 8 aa, Mycobacterium
ELSTESDQ

SEQ ID NO: 1006928 - protein, 6 aa, Mycobacterium
ELTAGH

SEQ ID NO: 1006929 - protein, 5 aa, Mycobacterium
ELTDA

SEQ ID NO: 1006930 - protein, 4 aa, Mycobacterium
ELTE

SEQ ID NO: 1006931 - protein, 23 aa, Mycobacterium
ELTEHQSGTVGEHRHEMRGCRFG

SEQ ID NO: 1006932 - protein, 6 aa, Mycobacterium
ELTERH

SEQ ID NO: 1006933 - protein, 12 aa, Mycobacterium
ELTESGTSATSR

SEQ ID NO: 1006934 - protein, 7 aa, Mycobacterium
ELTNGRG

SEQ ID NO: 1006935 - protein, 6 aa, Mycobacterium
ELTREQ

SEQ ID NO: 1006936 - protein, 9 aa, Mycobacterium
ELTSGATHS

SEQ ID NO: 1006937 - protein, 12 aa, Mycobacterium
ELTTQDAAAAAG

SEQ ID NO: 1006938 - protein, 7 aa, Mycobacterium
ELTTQSQ

SEQ ID NO: 1006939 - protein, 13 aa, Mycobacterium
ELVPPGTPLQPGQ

SEQ ID NO: 1006940 - protein, 8 aa, Mycobacterium
ELVPSGQA

SEQ ID NO: 1006941 - protein, 13 aa, Mycobacterium
ELYDSGARMPSTY

SEQ ID NO: 1006942 - protein, 8 aa, Mycobacterium
EMDPAEAR

SEQ ID NO: 1006943 - protein, 15 aa, Mycobacterium
EMGEGPVQAARSGAG

SEQ ID NO: 1006944 - protein, 12 aa, Mycobacterium
EMGPVSRAAATE

SEQ ID NO: 1006945 - protein, 13 aa, Mycobacterium
EMMPSTPRTSIPS

SEQ ID NO: 1006946 - protein, 6 aa, Mycobacterium
EMPDGD

SEQ ID NO: 1006947 - protein, 43 aa, Mycobacterium; identical to SEQ ID NO: 256432

SEQ ID NO: 1006948 - protein, 4 aa, Mycobacterium
EMTP

SEQ ID NO: 1006949 - protein, 9 aa, Mycobacterium
EMTSDDDEL

SEQ ID NO: 1006950 - protein, 7 aa, Mycobacterium
EMYPGTD

SEQ ID NO: 1006951 - protein, 8 aa, Mycobacterium
ENADGYQQ

SEQ ID NO: 1006952 - protein, 4 aa, Mycobacterium
ENAE

SEQ ID NO: 1006953 - protein, 6 aa, Mycobacterium
ENAEDA

SEQ ID NO: 1006954 - protein, 13 aa, Mycobacterium
ENAGDRSAEGSGI

SEQ ID NO: 1006955 - protein, 7 aa, Mycobacterium
ENATGRT

SEQ ID NO: 1006956 - protein, 4 aa, Mycobacterium
ENDA

SEQ ID NO: 1006957 - protein, 7 aa, Mycobacterium
ENDGPID

SEQ ID NO: 1006958 - protein, 10 aa, Mycobacterium
ENDPVATDPD

SEQ ID NO: 1006959 - protein, 7 aa, Mycobacterium
ENDQRPI

SEQ ID NO: 1006960 - protein, 4 aa, Mycobacterium
ENDS

SEQ ID NO: 1006961 - protein, 4 aa, Mycobacterium
ENDY

SEQ ID NO: 1006962 - protein, 6 aa, Mycobacterium
ENEDAI

SEQ ID NO: 1006963 - protein, 14 aa, Mycobacterium
ENEDLPNTTNPDDW

SEQ ID NO: 1006964 - protein, 7 aa, Mycobacterium
ENEEAEG

SEQ ID NO: 1006965 - protein, 5 aa, Mycobacterium
ENEIE

SEQ ID NO: 1006966 - protein, 7 aa, Mycobacterium
ENEYEDV

SEQ ID NO: 1006967 - protein, 5 aa, Mycobacterium
ENGLP

SEQ ID NO: 1006968 - protein, 4 aa, Mycobacterium
ENGQ

SEQ ID NO: 1006969 - protein, 5 aa, Mycobacterium
ENGRK

SEQ ID NO: 1006970 - protein, 4 aa, Mycobacterium
ENGV

SEQ ID NO: 1006971 - protein, 7 aa, Mycobacterium
ENGVGTV

SEQ ID NO: 1006972 - protein, 4 aa, Mycobacterium
ENGW

SEQ ID NO: 1006973 - protein, 19 aa, Mycobacterium
ENHTAPAEPADQLVTVGDL

SEQ ID NO: 1006974 - protein, 6 aa, Mycobacterium
ENIAPA

SEQ ID NO: 1006975 - protein, 9 aa, Mycobacterium
ENIPEPGIP

SEQ ID NO: 1006976 - protein, 7 aa, Mycobacterium
ENIPSEG

SEQ ID NO: 1006977 - protein, 7 aa, Mycobacterium
ENISPKE

SEQ ID NO: 1006978 - protein, 7 aa, Mycobacterium
ENLGTAP

SEQ ID NO: 1006979 - protein, 5 aa, Mycobacterium
ENLPF

SEQ ID NO: 1006980 - protein, 7 aa, Mycobacterium
ENLSGRE

SEQ ID NO: 1006981 - protein, 7 aa, Mycobacterium
ENLTAQR

SEQ ID NO: 1006982 - protein, 6 aa, Mycobacterium
ENLTSR

SEQ ID NO: 1006983 - protein, 8 aa, Mycobacterium
ENPAGPRP

SEQ ID NO: 1006984 - protein, 7 aa, Mycobacterium
ENPANPA

SEQ ID NO: 1006985 - protein, 8 aa, Mycobacterium
ENPAQRPL

SEQ ID NO: 1006986 - protein, 17 aa, Mycobacterium
ENPDGADEFIKNTLGDF

SEQ ID NO: 1006987 - protein, 6 aa, Mycobacterium
ENPDLA

SEQ ID NO: 1006988 - protein, 8 aa, Mycobacterium
ENPDTGWD

SEQ ID NO: 1006989 - protein, 7 aa, Mycobacterium
ENPGLAD

SEQ ID NO: 1006990 - protein, 7 aa, Mycobacterium
ENPGPWK

SEQ ID NO: 1006991 - protein, 6 aa, Mycobacterium
ENPHQQ

SEQ ID NO: 1006992 - protein, 4 aa, Mycobacterium
ENPL

SEQ ID NO: 1006993 - protein, 11 aa, Mycobacterium
ENPNAAEGERE

SEQ ID NO: 1006994 - protein, 6 aa, Mycobacterium
ENPNGN

SEQ ID NO: 1006995 - protein, 8 aa, Mycobacterium
ENPPTDTR

SEQ ID NO: 1006996 - protein, 6 aa, Mycobacterium
ENPQAL

SEQ ID NO: 1006997 - protein, 6 aa, Mycobacterium
ENPSVQ

SEQ ID NO: 1006998 - protein, 5 aa, Mycobacterium
ENPSW

SEQ ID NO: 1006999 - protein, 6 aa, Mycobacterium
ENPTQT

SEQ ID NO: 1007000 - protein, 28 aa, Mycobacterium
ENPVAPAQRSAAAKTKAARHQDANGATL

SEQ ID NO: 1007001 - protein, 5 aa, Mycobacterium
ENQAA

SEQ ID NO: 1007002 - protein, 12 aa, Mycobacterium
ENQAPSPDRATG

SEQ ID NO: 1007003 - protein, 18 aa, Mycobacterium
ENQPRPAPLDAVRALETQ

SEQ ID NO: 1007004 - protein, 7 aa, Mycobacterium
ENRAEQL

SEQ ID NO: 1007005 - protein, 8 aa, Mycobacterium
ENRGSPRA

SEQ ID NO: 1007006 - protein, 10 aa, Mycobacterium
ENRPRFEREQ

SEQ ID NO: 1007007 - protein, 11 aa, Mycobacterium
ENRQKAREERN

SEQ ID NO: 1007008 - protein, 6 aa, Mycobacterium
ENRQSF

SEQ ID NO: 1007009 - protein, 4 aa, Mycobacterium
ENRS

SEQ ID NO: 1007010 - protein, 5 aa, Mycobacterium
ENRSL

SEQ ID NO: 1007011 - protein, 11 aa, Mycobacterium
ENRSPAKAAQR

SEQ ID NO: 1007012 - protein, 4 aa, Mycobacterium
ENRY

SEQ ID NO: 1007013 - protein, 4 aa, Mycobacterium
ENSA

SEQ ID NO: 1007014 - protein, 8 aa, Mycobacterium
ENSALGDD

SEQ ID NO: 1007015 - protein, 7 aa, Mycobacterium
ENSEPFT

SEQ ID NO: 1007016 - protein, 9 aa, Mycobacterium
ENSTAAPPL

SEQ ID NO: 1007017 - protein, 10 aa, Mycobacterium
ENTEADPGDH

SEQ ID NO: 1007018 - protein, 4 aa, Mycobacterium
ENTG

SEQ ID NO: 1007019 - protein, 7 aa, Mycobacterium
ENTGAGF

SEQ ID NO: 1007020 - protein, 7 aa, Mycobacterium
ENTGKPI

SEQ ID NO: 1007021 - protein, 4 aa, Mycobacterium
ENTY

SEQ ID NO: 1007022 - protein, 9 aa, Mycobacterium
ENTYTDQTT

SEQ ID NO: 1007023 - protein, 9 aa, Mycobacterium
ENVAESLTR

SEQ ID NO: 1007024 - protein, 6 aa, Mycobacterium
ENVASI

SEQ ID NO: 1007025 - protein, 4 aa, Mycobacterium
ENVT

SEQ ID NO: 1007026 - protein, 4 aa, Mycobacterium
ENYD

SEQ ID NO: 1007027 - protein, 4 aa, Mycobacterium
EPAA

SEQ ID NO: 1007028 - protein, 15 aa, Mycobacterium
EPAAPAATGAPTCGE

SEQ ID NO: 1007029 - protein, 6 aa, Mycobacterium
EPAAVR

SEQ ID NO: 1007030 - protein, 5 aa, Mycobacterium
EPAEA

SEQ ID NO: 1007031 - protein, 9 aa, Mycobacterium
EPAEMEPEE

SEQ ID NO: 1007032 - protein, 9 aa, Mycobacterium
EPAEPHEHD

SEQ ID NO: 1007033 - protein, 5 aa, Mycobacterium
EPAGA

SEQ ID NO: 1007034 - protein, 7 aa, Mycobacterium
EPAGAEA

SEQ ID NO: 1007035 - protein, 7 aa, Mycobacterium
EPAGVGE

SEQ ID NO: 1007036 - protein, 37 aa, Mycobacterium
EPAKPAKQAKPAKPPKQTPPAPAEQPASSRRGKPAIP

SEQ ID NO: 1007037 - protein, 18 aa, Mycobacterium
EPAMPPEPAVQAPPDTSL

SEQ ID NO: 1007038 - protein, 10 aa, Mycobacterium
EPAPAPDMDA

SEQ ID NO: 1007039 - protein, 8 aa, Mycobacterium
EPAPSDGL

SEQ ID NO: 1007040 - protein, 5 aa, Mycobacterium
EPAQA

SEQ ID NO: 1007041 - protein, 45 aa, Mycobacterium
EPASRTVERCRPSSHAPARPRLARTGGPARGEQPAATATDAMSAP

SEQ ID NO: 1007042 - protein, 4 aa, Mycobacterium
EPAT

SEQ ID NO: 1007043 - protein, 5 aa, Mycobacterium
EPATI

SEQ ID NO: 1007044 - protein, 12 aa, Mycobacterium
EPCAPEGHRIEG

SEQ ID NO: 1007045 - protein, 4 aa, Mycobacterium
EPCT

SEQ ID NO: 1007046 - protein, 4 aa, Mycobacterium
EPDA

SEQ ID NO: 1007047 - protein, 21 aa, Mycobacterium
EPDAGSDVGAGRAKAIEQPDG

SEQ ID NO: 1007048 - protein, 21 aa, Mycobacterium
EPDAGSDVGAGRTKAVEQADG

SEQ ID NO: 1007049 - protein, 7 aa, Mycobacterium
EPDAPES

SEQ ID NO: 1007050 - protein, 9 aa, Mycobacterium
EPDDFADPD

SEQ ID NO: 1007051 - protein, 8 aa, Mycobacterium
EPDGEGVL

SEQ ID NO: 1007052 - protein, 5 aa, Mycobacterium
EPDGH

SEQ ID NO: 1007053 - protein, 6 aa, Mycobacterium
EPDGTS

SEQ ID NO: 1007054 - protein, 4 aa, Mycobacterium
EPDI

SEQ ID NO: 1007055 - protein, 7 aa, Mycobacterium
EPDNGRQ

SEQ ID NO: 1007056 - protein, 8 aa, Mycobacterium
EPDPDDVA

SEQ ID NO: 1007057 - protein, 6 aa, Mycobacterium
EPDPEL

SEQ ID NO: 1007058 - protein, 5 aa, Mycobacterium
EPDPI

SEQ ID NO: 1007059 - protein, 8 aa, Mycobacterium
EPDPNEMH

SEQ ID NO: 1007060 - protein, 7 aa, Mycobacterium
EPDPTTQ

SEQ ID NO: 1007061 - protein, 6 aa, Mycobacterium
EPDQAI

SEQ ID NO: 1007062 - protein, 9 aa, Mycobacterium
EPDSGLDPV

SEQ ID NO: 1007063 - protein, 20 aa, Mycobacterium
EPDVGSDPAAMKTRARRDGS

SEQ ID NO: 1007064 - protein, 6 aa, Mycobacterium
EPDVNN

SEQ ID NO: 1007065 - protein, 4 aa, Mycobacterium
EPDY

SEQ ID NO: 1007066 - protein, 8 aa, Mycobacterium
EPDYEESA

SEQ ID NO: 1007067 - protein, 5 aa, Mycobacterium
EPDYP

SEQ ID NO: 1007068 - protein, 19 aa, Mycobacterium
EPEAGSDAASVKTRATRVD

SEQ ID NO: 1007069 - protein, 20 aa, Mycobacterium
EPEAGSNSHKITTTARRDGS

SEQ ID NO: 1007070 - protein, 8 aa, Mycobacterium
EPEARPEL

SEQ ID NO: 1007071 - protein, 6 aa, Mycobacterium
EPEDES

SEQ ID NO: 1007072 - protein, 6 aa, Mycobacterium
EPEEVG

SEQ ID NO: 1007073 - protein, 7 aa, Mycobacterium
EPEGAGT

SEQ ID NO: 1007074 - protein, 5 aa, Mycobacterium
EPEHQ

SEQ ID NO: 1007075 - protein, 13 aa, Mycobacterium
EPEHYESGPAAPL

SEQ ID NO: 1007076 - protein, 4 aa, Mycobacterium
EPEI

SEQ ID NO: 1007077 - protein, 8 aa, Mycobacterium
EPEITPSD

SEQ ID NO: 1007078 - protein, 4 aa, Mycobacterium
EPEK

SEQ ID NO: 1007079 - protein, 5 aa, Mycobacterium
EPELT

SEQ ID NO: 1007080 - protein, 15 aa, Mycobacterium
EPENGRYDDVSPSTG

SEQ ID NO: 1007081 - protein, 9 aa, Mycobacterium
EPENSASAR

SEQ ID NO: 1007082 - protein, 24 aa, Mycobacterium
EPEPEPAKPAAPVASAATNEEQAM

SEQ ID NO: 1007083 - protein, 6 aa, Mycobacterium
EPEPGL

SEQ ID NO: 1007084 - protein, 18 aa, Mycobacterium
EPERMSGGGLHPGPGAPR

SEQ ID NO: 1007085 - protein, 7 aa, Mycobacterium
EPETDLD

SEQ ID NO: 1007086 - protein, 5 aa, Mycobacterium
EPEVD

SEQ ID NO: 1007087 - protein, 6 aa, Mycobacterium
EPEVGA

SEQ ID NO: 1007088 - protein, 5 aa, Mycobacterium
EPEVQ

SEQ ID NO: 1007089 - protein, 11 aa, Mycobacterium
EPEVSSSNPRM

SEQ ID NO: 1007090 - protein, 12 aa, Mycobacterium
EPEWGGPTQADR

SEQ ID NO: 1007091 - protein, 4 aa, Mycobacterium
EPFA

SEQ ID NO: 1007092 - protein, 10 aa, Mycobacterium
EPFGDDERGV

SEQ ID NO: 1007093 - protein, 6 aa, Mycobacterium
EPFTDS

SEQ ID NO: 1007094 - protein, 5 aa, Mycobacterium
EPGAA

SEQ ID NO: 1007095 - protein, 9 aa, Mycobacterium
EPGAAAGIP

SEQ ID NO: 1007096 - protein, 13 aa, Mycobacterium
EPGAAANLVAGQW

SEQ ID NO: 1007097 - protein, 17 aa, Mycobacterium
EPGAAGSGGSRGRGDIS

SEQ ID NO: 1007098 - protein, 14 aa, Mycobacterium
EPGAGSDASALSAR

SEQ ID NO: 1007099 - protein, 8 aa, Mycobacterium
EPGAGSDL

SEQ ID NO: 1007100 - protein, 9 aa, Mycobacterium
EPGAGSDLA

SEQ ID NO: 1007101 - protein, 16 aa, Mycobacterium
EPGAGSDLAAAAGLRR

SEQ ID NO: 1007102 - protein, 19 aa, Mycobacterium
EPGAGSDLAGLSTKATRVD

SEQ ID NO: 1007103 - protein, 10 aa, Mycobacterium
EPGAGSDLAS

SEQ ID NO: 1007104 - protein, 8 aa, Mycobacterium
EPGASEEQ

SEQ ID NO: 1007105 - protein, 6 aa, Mycobacterium
EPGDPL

SEQ ID NO: 1007106 - protein, 7 aa, Mycobacterium
EPGELGG

SEQ ID NO: 1007107 - protein, 8 aa, Mycobacterium
EPGEPNAE

SEQ ID NO: 1007108 - protein, 8 aa, Mycobacterium
EPGETAGF

SEQ ID NO: 1007109 - protein, 48 aa, Mycobacterium
EPGGGQGDTTTPVPTTQSEQEPNPTESGPDNEGHDERDVDADSDDLDE

SEQ ID NO: 1007110 - protein, 9 aa, Mycobacterium
EPGGPAGSA

SEQ ID NO: 1007111 - protein, 5 aa, Mycobacterium
EPGKA

SEQ ID NO: 1007112 - protein, 4 aa, Mycobacterium
EPGL

SEQ ID NO: 1007113 - protein, 5 aa, Mycobacterium
EPGLA

SEQ ID NO: 1007114 - protein, 14 aa, Mycobacterium
EPGLQDEPPANTGR

SEQ ID NO: 1007115 - protein, 22 aa, Mycobacterium
EPGLQGDRSSAGTKPATLETGA

SEQ ID NO: 1007116 - protein, 7 aa, Mycobacterium
EPGLTAA

SEQ ID NO: 1007117 - protein, 4 aa, Mycobacterium
EPGP

SEQ ID NO: 1007118 - protein, 5 aa, Mycobacterium
EPGPE

SEQ ID NO: 1007119 - protein, 14 aa, Mycobacterium
EPGPSTSANNRRSG

SEQ ID NO: 1007120 - protein, 7 aa, Mycobacterium
EPGQARD

SEQ ID NO: 1007121 - protein, 5 aa, Mycobacterium
EPGQS

SEQ ID NO: 1007122 - protein, 9 aa, Mycobacterium
EPGRDPVQV

SEQ ID NO: 1007123 - protein, 21 aa, Mycobacterium
EPGREYAEDIETGSAAAALGG

SEQ ID NO: 1007124 - protein, 5 aa, Mycobacterium
EPGRP

SEQ ID NO: 1007125 - protein, 5 aa, Mycobacterium
EPGRR

SEQ ID NO: 1007126 - protein, 8 aa, Mycobacterium
EPGRVRPT

SEQ ID NO: 1007127 - protein, 6 aa, Mycobacterium
EPGTDH

SEQ ID NO: 1007128 - protein, 14 aa, Mycobacterium
EPGTDSDPATKVNP

SEQ ID NO: 1007129 - protein, 6 aa, Mycobacterium
EPGTEG

SEQ ID NO: 1007130 - protein, 13 aa, Mycobacterium
EPGTPPGSIGKGV

SEQ ID NO: 1007131 - protein, 5 aa, Mycobacterium
EPHDG

SEQ ID NO: 1007132 - protein, 21 aa, Mycobacterium
EPHGAAETAGAEEGVDSNGAP

SEQ ID NO: 1007133 - protein, 5 aa, Mycobacterium
EPHST

SEQ ID NO: 1007134 - protein, 4 aa, Mycobacterium
EPID

SEQ ID NO: 1007135 - protein, 6 aa, Mycobacterium
EPIGSK

SEQ ID NO: 1007136 - protein, 5 aa, Mycobacterium
EPIPE

SEQ ID NO: 1007137 - protein, 7 aa, Mycobacterium
EPITASD

SEQ ID NO: 1007138 - protein, 5 aa, Mycobacterium
EPKET

SEQ ID NO: 1007139 - protein, 4 aa, Mycobacterium
EPKN

SEQ ID NO: 1007140 - protein, 5 aa, Mycobacterium
EPKQT

SEQ ID NO: 1007141 - protein, 17 aa, Mycobacterium
EPKRSGRQSASAPPLRE

SEQ ID NO: 1007142 - protein, 6 aa, Mycobacterium
EPKTEK

SEQ ID NO: 1007143 - protein, 5 aa, Mycobacterium
EPLDT

SEQ ID NO: 1007144 - protein, 5 aa, Mycobacterium
EPLEE

SEQ ID NO: 1007145 - protein, 4 aa, Mycobacterium
EPLP

SEQ ID NO: 1007146 - protein, 10 aa, Mycobacterium
EPLPPRSAQA

SEQ ID NO: 1007147 - protein, 12 aa, Mycobacterium
EPLPRADPEAPH

SEQ ID NO: 1007148 - protein, 6 aa, Mycobacterium
EPLPVK

SEQ ID NO: 1007149 - protein, 8 aa, Mycobacterium
EPLQERSE

SEQ ID NO: 1007150 - protein, 73 aa, Mycobacterium
EPLTETPQSNPEDDQSPDPTQPAGLADHGRDHPQLGDSDDAAAPAQPLEASTQVELPDQSVRTAGSSALATAG

SEQ ID NO: 1007151 - protein, 6 aa, Mycobacterium
EPLTGG

SEQ ID NO: 1007152 - protein, 8 aa, Mycobacterium
EPLTPGGV

SEQ ID NO: 1007153 - protein, 6 aa, Mycobacterium
EPLTQD

SEQ ID NO: 1007154 - protein, 5 aa, Mycobacterium
EPLYR

SEQ ID NO: 1007155 - protein, 14 aa, Mycobacterium
EPMPESAAARVKTH

SEQ ID NO: 1007156 - protein, 15 aa, Mycobacterium
EPMTGAELAIALEKL

SEQ ID NO: 1007157 - protein, 8 aa, Mycobacterium
EPNAAAAA

SEQ ID NO: 1007158 - protein, 9 aa, Mycobacterium
EPNADGSTL

SEQ ID NO: 1007159 - protein, 5 aa, Mycobacterium
EPNEG

SEQ ID NO: 1007160 - protein, 5 aa, Mycobacterium
EPNGG

SEQ ID NO: 1007161 - protein, 16 aa, Mycobacterium
EPNPAPLGAAPATRAG

SEQ ID NO: 1007162 - protein, 18 aa, Mycobacterium
EPNSAHPIHPSTSGPTLD

SEQ ID NO: 1007163 - protein, 12 aa, Mycobacterium
EPNTSDSGTELA

SEQ ID NO: 1007164 - protein, 4 aa, Mycobacterium
EPPA

SEQ ID NO: 1007165 - protein, 9 aa, Mycobacterium
EPPAGDPGR

SEQ ID NO: 1007166 - protein, 6 aa, Mycobacterium
EPPAGL

SEQ ID NO: 1007167 - protein, 9 aa, Mycobacterium
EPPATAQEI

SEQ ID NO: 1007168 - protein, 7 aa, Mycobacterium
EPPDTFT

SEQ ID NO: 1007169 - protein, 7 aa, Mycobacterium
EPPEGAG

SEQ ID NO: 1007170 - protein, 13 aa, Mycobacterium
EPPEGAGPDFVRN

SEQ ID NO: 1007171 - protein, 4 aa, Mycobacterium
EPPG

SEQ ID NO: 1007172 - protein, 13 aa, Mycobacterium
EPPHGSPRNTAEV

SEQ ID NO: 1007173 - protein, 13 aa, Mycobacterium
EPPPNPLDTATAG

SEQ ID NO: 1007174 - protein, 5 aa, Mycobacterium
EPPPV

SEQ ID NO: 1007175 - protein, 9 aa, Mycobacterium
EPPQGDDTR

SEQ ID NO: 1007176 - protein, 4 aa, Mycobacterium
EPPR

SEQ ID NO: 1007177 - protein, 9 aa, Mycobacterium
EPPRPPISD

SEQ ID NO: 1007178 - protein, 19 aa, Mycobacterium
EPPSLLGDDSAPNPSETTL

SEQ ID NO: 1007179 - protein, 21 aa, Mycobacterium
EPPSPTRPGRASALTDSSTRD

SEQ ID NO: 1007180 - protein, 19 aa, Mycobacterium
EPPTPAPARDQASAEPGMA

SEQ ID NO: 1007181 - protein, 4 aa, Mycobacterium
EPPV

SEQ ID NO: 1007182 - protein, 9 aa, Mycobacterium
EPQGGADPR

SEQ ID NO: 1007183 - protein, 11 aa, Mycobacterium
EPQGVTPGQYS

SEQ ID NO: 1007184 - protein, 6 aa, Mycobacterium
EPQHFT

SEQ ID NO: 1007185 - protein, 5 aa, Mycobacterium
EPQQP

SEQ ID NO: 1007186 - protein, 7 aa, Mycobacterium
EPQRSPQ

SEQ ID NO: 1007187 - protein, 7 aa, Mycobacterium
EPQSAAE

SEQ ID NO: 1007188 - protein, 9 aa, Mycobacterium
EPQSAGACG

SEQ ID NO: 1007189 - protein, 6 aa, Mycobacterium
EPRGPQ

SEQ ID NO: 1007190 - protein, 4 aa, Mycobacterium
EPRI

SEQ ID NO: 1007191 - protein, 9 aa, Mycobacterium
EPRKGDNAP

SEQ ID NO: 1007192 - protein, 5 aa, Mycobacterium
EPRPT

SEQ ID NO: 1007193 - protein, 4 aa, Mycobacterium
EPRR

SEQ ID NO: 1007194 - protein, 11 aa, Mycobacterium
EPRRGSSPATR

SEQ ID NO: 1007195 - protein, 5 aa, Mycobacterium
EPRSS

SEQ ID NO: 1007196 - protein, 6 aa, Mycobacterium
EPSAAS

SEQ ID NO: 1007197 - protein, 6 aa, Mycobacterium
EPSAPL

SEQ ID NO: 1007198 - protein, 8 aa, Mycobacterium
EPSETSQV

SEQ ID NO: 1007199 - protein, 4 aa, Mycobacterium
EPSG

SEQ ID NO: 1007200 - protein, 6 aa, Mycobacterium
EPSGFR

SEQ ID NO: 1007201 - protein, 6 aa, Mycobacterium
EPSGPI

SEQ ID NO: 1007202 - protein, 11 aa, Mycobacterium
EPSHPNSANDI

SEQ ID NO: 1007203 - protein, 6 aa, Mycobacterium
EPSHPP

SEQ ID NO: 1007204 - protein, 17 aa, Mycobacterium
EPSSGAVTVNGTDVSTV

SEQ ID NO: 1007205 - protein, 9 aa, Mycobacterium
EPSSPLQPY

SEQ ID NO: 1007206 - protein, 5 aa, Mycobacterium
EPSTN

SEQ ID NO: 1007207 - protein, 4 aa, Mycobacterium
EPSV

SEQ ID NO: 1007208 - protein, 5 aa, Mycobacterium
EPSWT

SEQ ID NO: 1007209 - protein, 4 aa, Mycobacterium
EPTA

SEQ ID NO: 1007210 - protein, 9 aa, Mycobacterium
EPTADGQTM

SEQ ID NO: 1007211 - protein, 8 aa, Mycobacterium
EPTAGQRE

SEQ ID NO: 1007212 - protein, 4 aa, Mycobacterium
EPTE

SEQ ID NO: 1007213 - protein, 6 aa, Mycobacterium
EPTETA

SEQ ID NO: 1007214 - protein, 15 aa, Mycobacterium
EPTGAATGHLATEGA

SEQ ID NO: 1007215 - protein, 14 aa, Mycobacterium
EPTGRDGITPGREL

SEQ ID NO: 1007216 - protein, 8 aa, Mycobacterium
EPTGTRPD

SEQ ID NO: 1007217 - protein, 4 aa, Mycobacterium
EPTN

SEQ ID NO: 1007218 - protein, 7 aa, Mycobacterium
EPTPEEQ

SEQ ID NO: 1007219 - protein, 8 aa, Mycobacterium
EPTPEQPA

SEQ ID NO: 1007220 - protein, 25 aa, Mycobacterium
EPTPRLTPADGTALDSAAPDGLEGE

SEQ ID NO: 1007221 - protein, 20 aa, Mycobacterium
EPTPRSSVAAAANSSGATDK

SEQ ID NO: 1007222 - protein, 8 aa, Mycobacterium
EPTQALTG

SEQ ID NO: 1007223 - protein, 4 aa, Mycobacterium
EPTR

SEQ ID NO: 1007224 - protein, 4 aa, Mycobacterium
EPTS

SEQ ID NO: 1007225 - protein, 5 aa, Mycobacterium
EPTSI

SEQ ID NO: 1007226 - protein, 4 aa, Mycobacterium
EPTT

SEQ ID NO: 1007227 - protein, 7 aa, Mycobacterium
EPTTAAG

SEQ ID NO: 1007228 - protein, 8 aa, Mycobacterium
EPTTVGNE

SEQ ID NO: 1007229 - protein, 11 aa, Mycobacterium
EPTYEDGVGDR

SEQ ID NO: 1007230 - protein, 4 aa, Mycobacterium
EPVA

SEQ ID NO: 1007231 - protein, 6 aa, Mycobacterium
EPVAPS

SEQ ID NO: 1007232 - protein, 6 aa, Mycobacterium
EPVDAA

SEQ ID NO: 1007233 - protein, 43 aa, Mycobacterium
EPVPPAPPAPLYPESPPEPPAPPVGSTPYVPPPDPSPPPISLE

SEQ ID NO: 1007234 - protein, 36 aa, Mycobacterium
EPVPPPAPGRLPPLTPGEMATPRLPAPPPQPPIRGG

SEQ ID NO: 1007235 - protein, 5 aa, Mycobacterium
EPVRD

SEQ ID NO: 1007236 - protein, 8 aa, Mycobacterium
EPVREDTT

SEQ ID NO: 1007237 - protein, 9 aa, Mycobacterium
EPVSSKGAT

SEQ ID NO: 1007238 - protein, 31 aa, Mycobacterium
EPVTASAARATGAAGAAAAAAERRDGRGSVT

SEQ ID NO: 1007239 - protein, 12 aa, Mycobacterium
EPVTGPGQPPNG

SEQ ID NO: 1007240 - protein, 9 aa, Mycobacterium
EPVVPQPGG

SEQ ID NO: 1007241 - protein, 5 aa, Mycobacterium
EPWDT

SEQ ID NO: 1007242 - protein, 5 aa, Mycobacterium
EPWRG

SEQ ID NO: 1007243 - protein, 6 aa, Mycobacterium
EPYATR

SEQ ID NO: 1007244 - protein, 7 aa, Mycobacterium
EPYHPDP

SEQ ID NO: 1007245 - protein, 9 aa, Mycobacterium
EQAAAAGHS

SEQ ID NO: 1007246 - protein, 5 aa, Mycobacterium
EQAAK

SEQ ID NO: 1007247 - protein, 10 aa, Mycobacterium
EQAAQAPGDY

SEQ ID NO: 1007248 - protein, 7 aa, Mycobacterium
EQADRDD

SEQ ID NO: 1007249 - protein, 8 aa, Mycobacterium
EQAEPPVR

SEQ ID NO: 1007250 - protein, 14 aa, Mycobacterium
EQAEQAAAKIGAGE

SEQ ID NO: 1007251 - protein, 10 aa, Mycobacterium
EQAERDPVAA

SEQ ID NO: 1007252 - protein, 8 aa, Mycobacterium
EQAESNNE

SEQ ID NO: 1007253 - protein, 7 aa, Mycobacterium
EQAGAAR

SEQ ID NO: 1007254 - protein, 14 aa, Mycobacterium
EQAGDKFDESKQRY

SEQ ID NO: 1007255 - protein, 6 aa, Mycobacterium
EQAGPD

SEQ ID NO: 1007256 - protein, 7 aa, Mycobacterium
EQAGSGY

SEQ ID NO: 1007257 - protein, 8 aa, Mycobacterium
EQAHGAGA

SEQ ID NO: 1007258 - protein, 12 aa, Mycobacterium
EQAKPWAQRTPD

SEQ ID NO: 1007259 - protein, 12 aa, Mycobacterium
EQALANPAINAG

SEQ ID NO: 1007260 - protein, 6 aa, Mycobacterium
EQAQPD

SEQ ID NO: 1007261 - protein, 9 aa, Mycobacterium
EQARIAEGA

SEQ ID NO: 1007262 - protein, 9 aa, Mycobacterium
EQASLQDSN

SEQ ID NO: 1007263 - protein, 10 aa, Mycobacterium
EQASRGTDSG

SEQ ID NO: 1007264 - protein, 15 aa, Mycobacterium
EQATAERAHQRAAQR

SEQ ID NO: 1007265 - protein, 4 aa, Mycobacterium
EQCP

SEQ ID NO: 1007266 - protein, 15 aa, Mycobacterium
EQDAAHDFGGIVDNG

SEQ ID NO: 1007267 - protein, 5 aa, Mycobacterium
EQDET

SEQ ID NO: 1007268 - protein, 10 aa, Mycobacterium
EQDGDPGYKA

SEQ ID NO: 1007269 - protein, 8 aa, Mycobacterium
EQDLESGV

SEQ ID NO: 1007270 - protein, 7 aa, Mycobacterium
EQDYPGP

SEQ ID NO: 1007271 - protein, 5 aa, Mycobacterium
EQEAA

SEQ ID NO: 1007272 - protein, 7 aa, Mycobacterium
EQEAHEP

SEQ ID NO: 1007273 - protein, 9 aa, Mycobacterium
EQEERRISG

SEQ ID NO: 1007274 - protein, 4 aa, Mycobacterium
EQEG

SEQ ID NO: 1007275 - protein, 6 aa, Mycobacterium
EQERGI

SEQ ID NO: 1007276 - protein, 6 aa, Mycobacterium
EQFARQ

SEQ ID NO: 1007277 - protein, 8 aa, Mycobacterium
EQGDSNAP

SEQ ID NO: 1007278 - protein, 4 aa, Mycobacterium
EQGF

SEQ ID NO: 1007279 - protein, 10 aa, Mycobacterium
EQGGCPFDPR

SEQ ID NO: 1007280 - protein, 5 aa, Mycobacterium
EQGGL

SEQ ID NO: 1007281 - protein, 5 aa, Mycobacterium
EQGHP

SEQ ID NO: 1007282 - protein, 8 aa, Mycobacterium
EQGHQRQK

SEQ ID NO: 1007283 - protein, 4 aa, Mycobacterium
EQGL

SEQ ID NO: 1007284 - protein, 18 aa, Mycobacterium
EQGLGDAVKDNDSRFPPG

SEQ ID NO: 1007285 - protein, 9 aa, Mycobacterium
EQGNSQEVF

SEQ ID NO: 1007286 - protein, 15 aa, Mycobacterium
EQGREAADKIETPPW

SEQ ID NO: 1007287 - protein, 12 aa, Mycobacterium
EQGRTRYRTVLA

SEQ ID NO: 1007288 - protein, 5 aa, Mycobacterium
EQGSA

SEQ ID NO: 1007289 - protein, 4 aa, Mycobacterium
EQGT

SEQ ID NO: 1007290 - protein, 14 aa, Mycobacterium
EQGTKGPQAVGVSA

SEQ ID NO: 1007291 - protein, 7 aa, Mycobacterium
EQHAGAR

SEQ ID NO: 1007292 - protein, 6 aa, Mycobacterium
EQHERT

SEQ ID NO: 1007293 - protein, 13 aa, Mycobacterium
EQHPLATKDSDGR

SEQ ID NO: 1007294 - protein, 6 aa, Mycobacterium
EQIDPR

SEQ ID NO: 1007295 - protein, 27 aa, Mycobacterium
EQITDAAPVEQPGGEAPQSEPADGSPM

SEQ ID NO: 1007296 - protein, 9 aa, Mycobacterium
EQKANAQSV

SEQ ID NO: 1007297 - protein, 6 aa, Mycobacterium
EQKEPV

SEQ ID NO: 1007298 - protein, 9 aa, Mycobacterium
EQKKAHPNI

SEQ ID NO: 1007299 - protein, 8 aa, Mycobacterium
EQKQPTSE

SEQ ID NO: 1007300 - protein, 6 aa, Mycobacterium
EQKRPG

SEQ ID NO: 1007301 - protein, 10 aa, Mycobacterium
EQLADSDPGV

SEQ ID NO: 1007302 - protein, 9 aa, Mycobacterium
EQLGAGKPI

SEQ ID NO: 1007303 - protein, 6 aa, Mycobacterium
EQLPGS

SEQ ID NO: 1007304 - protein, 4 aa, Mycobacterium
EQLS

SEQ ID NO: 1007305 - protein, 9 aa, Mycobacterium
EQLTGEPSY

SEQ ID NO: 1007306 - protein, 7 aa, Mycobacterium
EQNCSTS

SEQ ID NO: 1007307 - protein, 7 aa, Mycobacterium
EQNEPAE

SEQ ID NO: 1007308 - protein, 4 aa, Mycobacterium
EQNQ

SEQ ID NO: 1007309 - protein, 10 aa, Mycobacterium
EQNRPRFERE

SEQ ID NO: 1007310 - protein, 19 aa, Mycobacterium
EQPAEEGQAEEDQQAPDAV

SEQ ID NO: 1007311 - protein, 6 aa, Mycobacterium
EQPDLN

SEQ ID NO: 1007312 - protein, 8 aa, Mycobacterium
EQPEPTST

SEQ ID NO: 1007313 - protein, 6 aa, Mycobacterium
EQPQPV

SEQ ID NO: 1007314 - protein, 7 aa, Mycobacterium
EQPTGGS

SEQ ID NO: 1007315 - protein, 25 aa, Mycobacterium
EQQAAKAAAAGKTKETEQAKANAEQ

SEQ ID NO: 1007316 - protein, 18 aa, Mycobacterium
EQQADDHADIAQNPRTSA

SEQ ID NO: 1007317 - protein, 10 aa, Mycobacterium
EQQARDEGYD

SEQ ID NO: 1007318 - protein, 4 aa, Mycobacterium
EQQR

SEQ ID NO: 1007319 - protein, 17 aa, Mycobacterium
EQQWASGDCRRDEVRES

SEQ ID NO: 1007320 - protein, 10 aa, Mycobacterium
EQRDAPSLRG

SEQ ID NO: 1007321 - protein, 16 aa, Mycobacterium
EQREAEGGSKVPEDTL

SEQ ID NO: 1007322 - protein, 9 aa, Mycobacterium
EQRGRIDES

SEQ ID NO: 1007323 - protein, 6 aa, Mycobacterium
EQRKDT

SEQ ID NO: 1007324 - protein, 6 aa, Mycobacterium
EQRLGA

SEQ ID NO: 1007325 - protein, 12 aa, Mycobacterium
EQRNTSRGWFSR

SEQ ID NO: 1007326 - protein, 9 aa, Mycobacterium
EQRPPGANA

SEQ ID NO: 1007327 - protein, 6 aa, Mycobacterium
EQRVPD

SEQ ID NO: 1007328 - protein, 9 aa, Mycobacterium
EQSAAGGAG

SEQ ID NO: 1007329 - protein, 14 aa, Mycobacterium
EQSALRAAAAGGRY

SEQ ID NO: 1007330 - protein, 8 aa, Mycobacterium
EQSLASAD

SEQ ID NO: 1007331 - protein, 7 aa, Mycobacterium
EQSRGVA

SEQ ID NO: 1007332 - protein, 7 aa, Mycobacterium
EQSRPEL

SEQ ID NO: 1007333 - protein, 8 aa, Mycobacterium
EQSRPLSE

SEQ ID NO: 1007334 - protein, 8 aa, Mycobacterium
EQSRPTSV

SEQ ID NO: 1007335 - protein, 15 aa, Mycobacterium
EQSSEAQPALRRQQA

SEQ ID NO: 1007336 - protein, 7 aa, Mycobacterium
EQSTPYE

SEQ ID NO: 1007337 - protein, 5 aa, Mycobacterium
EQSVE

SEQ ID NO: 1007338 - protein, 4 aa, Mycobacterium
EQSY

SEQ ID NO: 1007339 - protein, 25 aa, Mycobacterium
EQTAADGTGTLEPPGGPQTPELLSL

SEQ ID NO: 1007340 - protein, 19 aa, Mycobacterium
EQTDAAAGALPGLAQPAAK

SEQ ID NO: 1007341 - protein, 6 aa, Mycobacterium
EQTDPQ

SEQ ID NO: 1007342 - protein, 17 aa, Mycobacterium
EQTEARPADDVHAAHVS

SEQ ID NO: 1007343 - protein, 12 aa, Mycobacterium
EQTGGFEGRSKK

SEQ ID NO: 1007344 - protein, 14 aa, Mycobacterium
EQTMPKLKAAIAAL

SEQ ID NO: 1007345 - protein, 8 aa, Mycobacterium
EQTPAGPA

SEQ ID NO: 1007346 - protein, 6 aa, Mycobacterium
EQTQAG

SEQ ID NO: 1007347 - protein, 4 aa, Mycobacterium
EQTR

SEQ ID NO: 1007348 - protein, 5 aa, Mycobacterium
EQTSR

SEQ ID NO: 1007349 - protein, 7 aa, Mycobacterium
EQTVTRS

SEQ ID NO: 1007350 - protein, 11 aa, Mycobacterium
EQVATASGSDI

SEQ ID NO: 1007351 - protein, 9 aa, Mycobacterium
EQVGDTDEF

SEQ ID NO: 1007352 - protein, 4 aa, Mycobacterium
EQVQ

SEQ ID NO: 1007353 - protein, 5 aa, Mycobacterium
EQVQA

SEQ ID NO: 1007354 - protein, 9 aa, Mycobacterium
EQVSAQAGR

SEQ ID NO: 1007355 - protein, 9 aa, Mycobacterium
EQWDDGNNT

SEQ ID NO: 1007356 - protein, 5 aa, Mycobacterium
EQYGK

SEQ ID NO: 1007357 - protein, 10 aa, Mycobacterium
EQYKKTKAIP

SEQ ID NO: 1007358 - protein, 4 aa, Mycobacterium
ERAA

SEQ ID NO: 1007359 - protein, 18 aa, Mycobacterium
ERAAADNSDLPLSDGDRL

SEQ ID NO: 1007360 - protein, 7 aa, Mycobacterium
ERAAASG

SEQ ID NO: 1007361 - protein, 5 aa, Mycobacterium
ERAAE

SEQ ID NO: 1007362 - protein, 7 aa, Mycobacterium
ERAAELG

SEQ ID NO: 1007363 - protein, 6 aa, Mycobacterium
ERAAQL

SEQ ID NO: 1007364 - protein, 4 aa, Mycobacterium
ERAC

SEQ ID NO: 1007365 - protein, 5 aa, Mycobacterium
ERAEN

SEQ ID NO: 1007366 - protein, 8 aa, Mycobacterium
ERAERTGG

SEQ ID NO: 1007367 - protein, 7 aa, Mycobacterium
ERAGADA

SEQ ID NO: 1007368 - protein, 8 aa, Mycobacterium
ERAGESKA

SEQ ID NO: 1007369 - protein, 7 aa, Mycobacterium
ERAGSTP

SEQ ID NO: 1007370 - protein, 8 aa, Mycobacterium
ERAGTRNP

SEQ ID NO: 1007371 - protein, 8 aa, Mycobacterium
ERAGTTKS

SEQ ID NO: 1007372 - protein, 6 aa, Mycobacterium
ERAGVS

SEQ ID NO: 1007373 - protein, 10 aa, Mycobacterium
ERAHDTAAPQ

SEQ ID NO: 1007374 - protein, 9 aa, Mycobacterium
ERAKGAAGV

SEQ ID NO: 1007375 - protein, 6 aa, Mycobacterium
ERAKNG

SEQ ID NO: 1007376 - protein, 14 aa, Mycobacterium
ERANLDGDDGVERA

SEQ ID NO: 1007377 - protein, 8 aa, Mycobacterium
ERAPGDKA

SEQ ID NO: 1007378 - protein, 7 aa, Mycobacterium
ERAPGQK

SEQ ID NO: 1007379 - protein, 9 aa, Mycobacterium
ERAPNPAQA

SEQ ID NO: 1007380 - protein, 8 aa, Mycobacterium
ERAQREAR

SEQ ID NO: 1007381 - protein, 6 aa, Mycobacterium
ERARKH

SEQ ID NO: 1007382 - protein, 21 aa, Mycobacterium
ERARKRGYDGVTARSSSEGGP

SEQ ID NO: 1007383 - protein, 7 aa, Mycobacterium
ERARQAG

SEQ ID NO: 1007384 - protein, 5 aa, Mycobacterium
ERARS

SEQ ID NO: 1007385 - protein, 10 aa, Mycobacterium
ERASARVQDL

SEQ ID NO: 1007386 - protein, 11 aa, Mycobacterium
ERASDQSPDSG

SEQ ID NO: 1007387 - protein, 5 aa, Mycobacterium
ERASE

SEQ ID NO: 1007388 - protein, 7 aa, Mycobacterium
ERASGFR

SEQ ID NO: 1007389 - protein, 20 aa, Mycobacterium
ERASNGLANPATLADPDRLR

SEQ ID NO: 1007390 - protein, 7 aa, Mycobacterium
ERASRRA

SEQ ID NO: 1007391 - protein, 8 aa, Mycobacterium
ERAVTDDR

SEQ ID NO: 1007392 - protein, 7 aa, Mycobacterium
ERAVTDQ

SEQ ID NO: 1007393 - protein, 5 aa, Mycobacterium
ERAYG

SEQ ID NO: 1007394 - protein, 8 aa, Mycobacterium
ERDAERQV

SEQ ID NO: 1007395 - protein, 6 aa, Mycobacterium
ERDDPD

SEQ ID NO: 1007396 - protein, 7 aa, Mycobacterium
ERDDPQR

SEQ ID NO: 1007397 - protein, 8 aa, Mycobacterium
ERDGDKDL

SEQ ID NO: 1007398 - protein, 7 aa, Mycobacterium
ERDPGNA

SEQ ID NO: 1007399 - protein, 11 aa, Mycobacterium
ERDRLTPISQT

SEQ ID NO: 1007400 - protein, 12 aa, Mycobacterium
EREDDAQRASTR

SEQ ID NO: 1007401 - protein, 6 aa, Mycobacterium
EREDRE

SEQ ID NO: 1007402 - protein, 11 aa, Mycobacterium
EREERRAEKIT

SEQ ID NO: 1007403 - protein, 9 aa, Mycobacterium
EREGGEGSV

SEQ ID NO: 1007404 - protein, 5 aa, Mycobacterium
EREPA

SEQ ID NO: 1007405 - protein, 8 aa, Mycobacterium
EREPAAGD

SEQ ID NO: 1007406 - protein, 7 aa, Mycobacterium
EREPSTL

SEQ ID NO: 1007407 - protein, 14 aa, Mycobacterium
EREQLRESRRRSYD

SEQ ID NO: 1007408 - protein, 12 aa, Mycobacterium
ERERDPQRASKR

SEQ ID NO: 1007409 - protein, 5 aa, Mycobacterium
ERESA

SEQ ID NO: 1007410 - protein, 8 aa, Mycobacterium
ERESQGEE

SEQ ID NO: 1007411 - protein, 15 aa, Mycobacterium
ERETAARSARGPLVG

SEQ ID NO: 1007412 - protein, 7 aa, Mycobacterium
ERFPRGE

SEQ ID NO: 1007413 - protein, 4 aa, Mycobacterium
ERFS

SEQ ID NO: 1007414 - protein, 9 aa, Mycobacterium
ERGAGGEVQ

SEQ ID NO: 1007415 - protein, 5 aa, Mycobacterium
ERGAR

SEQ ID NO: 1007416 - protein, 8 aa, Mycobacterium
ERGDIGQP

SEQ ID NO: 1007417 - protein, 14 aa, Mycobacterium
ERGDLRAEGHGNSV

SEQ ID NO: 1007418 - protein, 7 aa, Mycobacterium
ERGDQRR

SEQ ID NO: 1007419 - protein, 4 aa, Mycobacterium
ERGE

SEQ ID NO: 1007420 - protein, 10 aa, Mycobacterium
ERGEGTTKED

SEQ ID NO: 1007421 - protein, 10 aa, Mycobacterium
ERGERPAVPG

SEQ ID NO: 1007422 - protein, 11 aa, Mycobacterium
ERGGERVNGAV

SEQ ID NO: 1007423 - protein, 5 aa, Mycobacterium
ERGGG

SEQ ID NO: 1007424 - protein, 5 aa, Mycobacterium
ERGHR

SEQ ID NO: 1007425 - protein, 4 aa, Mycobacterium
ERGL

SEQ ID NO: 1007426 - protein, 7 aa, Mycobacterium
ERGNPDY

SEQ ID NO: 1007427 - protein, 9 aa, Mycobacterium
ERGPADLPD

SEQ ID NO: 1007428 - protein, 10 aa, Mycobacterium
ERGQAREDYE

SEQ ID NO: 1007429 - protein, 9 aa, Mycobacterium
ERGQGGTIT

SEQ ID NO: 1007430 - protein, 9 aa, Mycobacterium
ERGQSTPSI

SEQ ID NO: 1007431 - protein, 27 aa, Mycobacterium
ERGRELASTAAEKGAPLAEAARRRGER

SEQ ID NO: 1007432 - protein, 6 aa, Mycobacterium
ERGRGD

SEQ ID NO: 1007433 - protein, 10 aa, Mycobacterium
ERGRKEPSSE

SEQ ID NO: 1007434 - protein, 14 aa, Mycobacterium
ERGRRGDRDDALPT

SEQ ID NO: 1007435 - protein, 6 aa, Mycobacterium
ERGRSA

SEQ ID NO: 1007436 - protein, 7 aa, Mycobacterium
ERGRSGQ

SEQ ID NO: 1007437 - protein, 11 aa, Mycobacterium
ERGRTTQEKGD

SEQ ID NO: 1007438 - protein, 7 aa, Mycobacterium
ERGRVSA

SEQ ID NO: 1007439 - protein, 9 aa, Mycobacterium
ERGSAEATV

SEQ ID NO: 1007440 - protein, 5 aa, Mycobacterium
ERGSG

SEQ ID NO: 1007441 - protein, 10 aa, Mycobacterium
ERGSSTAPAD

SEQ ID NO: 1007442 - protein, 8 aa, Mycobacterium
ERGTNGQH

SEQ ID NO: 1007443 - protein, 8 aa, Mycobacterium
ERGTPVGV

SEQ ID NO: 1007444 - protein, 8 aa, Mycobacterium
ERGTTTTP

SEQ ID NO: 1007445 - protein, 4 aa, Mycobacterium
ERGV

SEQ ID NO: 1007446 - protein, 10 aa, Mycobacterium
ERGVSPRDRN

SEQ ID NO: 1007447 - protein, 17 aa, Mycobacterium
ERGVSSGKVTERERDRA

SEQ ID NO: 1007448 - protein, 6 aa, Mycobacterium
ERGYDT

SEQ ID NO: 1007449 - protein, 5 aa, Mycobacterium
ERHGG

SEQ ID NO: 1007450 - protein, 6 aa, Mycobacterium
ERHGGS

SEQ ID NO: 1007451 - protein, 18 aa, Mycobacterium
ERHHTATGHAGHKPTPEI

SEQ ID NO: 1007452 - protein, 6 aa, Mycobacterium
ERHPYG

SEQ ID NO: 1007453 - protein, 5 aa, Mycobacterium
ERHRA

SEQ ID NO: 1007454 - protein, 6 aa, Mycobacterium
ERHRPN

SEQ ID NO: 1007455 - protein, 10 aa, Mycobacterium
ERHSQKNERP

SEQ ID NO: 1007456 - protein, 9 aa, Mycobacterium
ERKAGDGPC

SEQ ID NO: 1007457 - protein, 7 aa, Mycobacterium
ERKARNE

SEQ ID NO: 1007458 - protein, 7 aa, Mycobacterium
ERKRPQI

SEQ ID NO: 1007459 - protein, 11 aa, Mycobacterium
ERKRTATRQRI

SEQ ID NO: 1007460 - protein, 6 aa, Mycobacterium
ERLEEG

SEQ ID NO: 1007461 - protein, 5 aa, Mycobacterium
ERLEV

SEQ ID NO: 1007462 - protein, 6 aa, Mycobacterium
ERLGTR

SEQ ID NO: 1007463 - protein, 8 aa, Mycobacterium
ERLRESKE

SEQ ID NO: 1007464 - protein, 8 aa, Mycobacterium
ERNDNGPF

SEQ ID NO: 1007465 - protein, 4 aa, Mycobacterium
ERNL

SEQ ID NO: 1007466 - protein, 10 aa, Mycobacterium
ERNRRQRKSC

SEQ ID NO: 1007467 - protein, 13 aa, Mycobacterium
ERNSEAANAAATT

SEQ ID NO: 1007468 - protein, 7 aa, Mycobacterium
ERNSPGS

SEQ ID NO: 1007469 - protein, 10 aa, Mycobacterium
ERPASSGESL

SEQ ID NO: 1007470 - protein, 6 aa, Mycobacterium
ERPATG

SEQ ID NO: 1007471 - protein, 9 aa, Mycobacterium
ERPAVDPNR

SEQ ID NO: 1007472 - protein, 4 aa, Mycobacterium
ERPD

SEQ ID NO: 1007473 - protein, 6 aa, Mycobacterium
ERPDEV

SEQ ID NO: 1007474 - protein, 14 aa, Mycobacterium
ERPDPLSGLTDQER

SEQ ID NO: 1007475 - protein, 7 aa, Mycobacterium
ERPDSGG

SEQ ID NO: 1007476 - protein, 8 aa, Mycobacterium
ERPGQDRA

SEQ ID NO: 1007477 - protein, 13 aa, Mycobacterium
ERPGRPLGASTAE

SEQ ID NO: 1007478 - protein, 6 aa, Mycobacterium
ERPGTD

SEQ ID NO: 1007479 - protein, 4 aa, Mycobacterium
ERPN

SEQ ID NO: 1007480 - protein, 19 aa, Mycobacterium
ERPRRRRAAGRPAGPPIHL

SEQ ID NO: 1007481 - protein, 9 aa, Mycobacterium
ERPRTNEPP

SEQ ID NO: 1007482 - protein, 5 aa, Mycobacterium
ERPSE

SEQ ID NO: 1007483 - protein, 5 aa, Mycobacterium
ERPSL

SEQ ID NO: 1007484 - protein, 9 aa, Mycobacterium
ERPTNPKYY

SEQ ID NO: 1007485 - protein, 4 aa, Mycobacterium
ERPV

SEQ ID NO: 1007486 - protein, 7 aa, Mycobacterium
ERPVTTA

SEQ ID NO: 1007487 - protein, 7 aa, Mycobacterium
ERPYTTP

SEQ ID NO: 1007488 - protein, 4 aa, Mycobacterium
ERQA

SEQ ID NO: 1007489 - protein, 7 aa, Mycobacterium
ERQAQIT

SEQ ID NO: 1007490 - protein, 23 aa, Mycobacterium
ERQARKQLSEADYRTATNEGRRL

SEQ ID NO: 1007491 - protein, 13 aa, Mycobacterium
ERQDGNPIRILVQ

SEQ ID NO: 1007492 - protein, 7 aa, Mycobacterium
ERQGDGT

SEQ ID NO: 1007493 - protein, 8 aa, Mycobacterium
ERQGRSVP

SEQ ID NO: 1007494 - protein, 5 aa, Mycobacterium
ERQPE

SEQ ID NO: 1007495 - protein, 8 aa, Mycobacterium
ERQRQRAD

SEQ ID NO: 1007496 - protein, 11 aa, Mycobacterium
ERQRRSSARRR

SEQ ID NO: 1007497 - protein, 7 aa, Mycobacterium
ERQRTHG

SEQ ID NO: 1007498 - protein, 8 aa, Mycobacterium
ERRAKDTI

SEQ ID NO: 1007499 - protein, 8 aa, Mycobacterium
ERRAPEAV

SEQ ID NO: 1007500 - protein, 7 aa, Mycobacterium
ERRDGAP

SEQ ID NO: 1007501 - protein, 30 aa, Mycobacterium; identical to SEQ ID NO: 471246

SEQ ID NO: 1007502 - protein, 18 aa, Mycobacterium
ERREALSSVQGEYGTGNV

SEQ ID NO: 1007503 - protein, 7 aa, Mycobacterium
ERRGEYL

SEQ ID NO: 1007504 - protein, 10 aa, Mycobacterium
ERRGRPIDDE

SEQ ID NO: 1007505 - protein, 7 aa, Mycobacterium
ERRHGGH

SEQ ID NO: 1007506 - protein, 6 aa, Mycobacterium
ERRNAR

SEQ ID NO: 1007507 - protein, 5 aa, Mycobacterium
ERRPI

SEQ ID NO: 1007508 - protein, 6 aa, Mycobacterium
ERRQLG

SEQ ID NO: 1007509 - protein, 10 aa, Mycobacterium
ERRQRKQPPL

SEQ ID NO: 1007510 - protein, 10 aa, Mycobacterium
ERRRELSGGR

SEQ ID NO: 1007511 - protein, 6 aa, Mycobacterium
ERRRGE

SEQ ID NO: 1007512 - protein, 13 aa, Mycobacterium
ERRRNRQARQPRT

SEQ ID NO: 1007513 - protein, 8 aa, Mycobacterium
ERRRPDGS

SEQ ID NO: 1007514 - protein, 17 aa, Mycobacterium
ERRRRRTGVDSGRNSHS

SEQ ID NO: 1007515 - protein, 4 aa, Mycobacterium
ERRT

SEQ ID NO: 1007516 - protein, 7 aa, Mycobacterium
ERRTRES

SEQ ID NO: 1007517 - protein, 5 aa, Mycobacterium
ERRTT

SEQ ID NO: 1007518 - protein, 9 aa, Mycobacterium
ERRTYHNED

SEQ ID NO: 1007519 - protein, 5 aa, Mycobacterium
ERSAE

SEQ ID NO: 1007520 - protein, 8 aa, Mycobacterium
ERSEDDQR

SEQ ID NO: 1007521 - protein, 11 aa, Mycobacterium
ERSGATRTNIK

SEQ ID NO: 1007522 - protein, 21 aa, Mycobacterium
ERSGLGDASQLRQNRSDTGRL

SEQ ID NO: 1007523 - protein, 6 aa, Mycobacterium
ERSGQR

SEQ ID NO: 1007524 - protein, 5 aa, Mycobacterium
ERSNA

SEQ ID NO: 1007525 - protein, 4 aa, Mycobacterium
ERSP

SEQ ID NO: 1007526 - protein, 12 aa, Mycobacterium
ERSPRAAAAHDR

SEQ ID NO: 1007527 - protein, 5 aa, Mycobacterium
ERSRF

SEQ ID NO: 1007528 - protein, 19 aa, Mycobacterium
ERSVDHGGYVERASEWAAC

SEQ ID NO: 1007529 - protein, 9 aa, Mycobacterium
ERTAGTDVG

SEQ ID NO: 1007530 - protein, 17 aa, Mycobacterium
ERTAISAGSALSTKASV

SEQ ID NO: 1007531 - protein, 4 aa, Mycobacterium
ERTD

SEQ ID NO: 1007532 - protein, 7 aa, Mycobacterium
ERTDQST

SEQ ID NO: 1007533 - protein, 10 aa, Mycobacterium
ERTEDGFGQG

SEQ ID NO: 1007534 - protein, 19 aa, Mycobacterium
ERTESRGGHTRDDHPGMDP

SEQ ID NO: 1007535 - protein, 4 aa, Mycobacterium
ERTG

SEQ ID NO: 1007536 - protein, 11 aa, Mycobacterium
ERTGAPYASTM

SEQ ID NO: 1007537 - protein, 6 aa, Mycobacterium
ERTGEA

SEQ ID NO: 1007538 - protein, 9 aa, Mycobacterium
ERTGIAGVG

SEQ ID NO: 1007539 - protein, 4 aa, Mycobacterium
ERTK

SEQ ID NO: 1007540 - protein, 4 aa, Mycobacterium
ERTN

SEQ ID NO: 1007541 - protein, 11 aa, Mycobacterium
ERTNDDTRANA

SEQ ID NO: 1007542 - protein, 17 aa, Mycobacterium
ERTNQSQRADSHARGGA

SEQ ID NO: 1007543 - protein, 5 aa, Mycobacterium
ERTPQ

SEQ ID NO: 1007544 - protein, 5 aa, Mycobacterium
ERTPV

SEQ ID NO: 1007545 - protein, 9 aa, Mycobacterium
ERTQRYAPH

SEQ ID NO: 1007546 - protein, 7 aa, Mycobacterium
ERTRAPY

SEQ ID NO: 1007547 - protein, 7 aa, Mycobacterium
ERTRPTV

SEQ ID NO: 1007548 - protein, 14 aa, Mycobacterium
ERTSRQDETDIKPA

SEQ ID NO: 1007549 - protein, 6 aa, Mycobacterium
ERTTGD

SEQ ID NO: 1007550 - protein, 6 aa, Mycobacterium
ERTTKT

SEQ ID NO: 1007551 - protein, 4 aa, Mycobacterium
ERVA

SEQ ID NO: 1007552 - protein, 6 aa, Mycobacterium
ERVQGA

SEQ ID NO: 1007553 - protein, 6 aa, Mycobacterium
ERVQPA

SEQ ID NO: 1007554 - protein, 6 aa, Mycobacterium
ERVRPE

SEQ ID NO: 1007555 - protein, 5 aa, Mycobacterium
ERVTE

SEQ ID NO: 1007556 - protein, 7 aa, Mycobacterium
ERVTPDE

SEQ ID NO: 1007557 - protein, 7 aa, Mycobacterium
ERYEKGQ

SEQ ID NO: 1007558 - protein, 12 aa, Mycobacterium
ERYEPADSSTVD

SEQ ID NO: 1007559 - protein, 5 aa, Mycobacterium
ERYER

SEQ ID NO: 1007560 - protein, 5 aa, Mycobacterium
ERYGE

SEQ ID NO: 1007561 - protein, 7 aa, Mycobacterium
ERYPGDA

SEQ ID NO: 1007562 - protein, 6 aa, Mycobacterium
ERYQAA

SEQ ID NO: 1007563 - protein, 10 aa, Mycobacterium
ERYTGGGPEA

SEQ ID NO: 1007564 - protein, 8 aa, Mycobacterium
ESAATGAS

SEQ ID NO: 1007565 - protein, 5 aa, Mycobacterium
ESADA

SEQ ID NO: 1007566 - protein, 12 aa, Mycobacterium
ESADQPATPAIE

SEQ ID NO: 1007567 - protein, 7 aa, Mycobacterium
ESAELSS

SEQ ID NO: 1007568 - protein, 5 aa, Mycobacterium
ESAEQ

SEQ ID NO: 1007569 - protein, 6 aa, Mycobacterium
ESAFPP

SEQ ID NO: 1007570 - protein, 5 aa, Mycobacterium
ESAGA

SEQ ID NO: 1007571 - protein, 8 aa, Mycobacterium
ESAGSLTL

SEQ ID NO: 1007572 - protein, 10 aa, Mycobacterium
ESAHETITAD

SEQ ID NO: 1007573 - protein, 5 aa, Mycobacterium
ESAHP

SEQ ID NO: 1007574 - protein, 5 aa, Mycobacterium
ESALP

SEQ ID NO: 1007575 - protein, 10 aa, Mycobacterium
ESANSSTLQT

SEQ ID NO: 1007576 - protein, 9 aa, Mycobacterium
ESAQPRHRL

SEQ ID NO: 1007577 - protein, 7 aa, Mycobacterium
ESARHDG

SEQ ID NO: 1007578 - protein, 66 aa, Mycobacterium
ESARNQLREGASTEPPVAPRDIADPNAGEPGSQPQPPMAGRPDAVDAARAAARAPAPAVPESDDQR

SEQ ID NO: 1007579 - protein, 5 aa, Mycobacterium
ESCGG

SEQ ID NO: 1007580 - protein, 9 aa, Mycobacterium
ESDAANRGA

SEQ ID NO: 1007581 - protein, 4 aa, Mycobacterium
ESDG

SEQ ID NO: 1007582 - protein, 6 aa, Mycobacterium
ESDGPP

SEQ ID NO: 1007583 - protein, 8 aa, Mycobacterium
ESDGYGQA

SEQ ID NO: 1007584 - protein, 11 aa, Mycobacterium
ESDLESAEGRV

SEQ ID NO: 1007585 - protein, 10 aa, Mycobacterium
ESDLETDRPL

SEQ ID NO: 1007586 - protein, 6 aa, Mycobacterium
ESDLGA

SEQ ID NO: 1007587 - protein, 4 aa, Mycobacterium
ESDP

SEQ ID NO: 1007588 - protein, 6 aa, Mycobacterium
ESDPAR

SEQ ID NO: 1007589 - protein, 12 aa, Mycobacterium
ESDPLNNYYIAR

SEQ ID NO: 1007590 - protein, 15 aa, Mycobacterium
ESDPYSPPLQRDPIS

SEQ ID NO: 1007591 - protein, 23 aa, Mycobacterium
ESDQIGVRDANDANLRTRPGTPM

SEQ ID NO: 1007592 - protein, 6 aa, Mycobacterium
ESDQRE

SEQ ID NO: 1007593 - protein, 6 aa, Mycobacterium
ESDVGG

SEQ ID NO: 1007594 - protein, 6 aa, Mycobacterium
ESEDES

SEQ ID NO: 1007595 - protein, 5 aa, Mycobacterium
ESEDR

SEQ ID NO: 1007596 - protein, 5 aa, Mycobacterium
ESEDV

SEQ ID NO: 1007597 - protein, 11 aa, Mycobacterium
ESEGDDDPGAS

SEQ ID NO: 1007598 - protein, 28 aa, Mycobacterium
ESEPGLGGGGAGELGTGGGGGGGGTIST

SEQ ID NO: 1007599 - protein, 17 aa, Mycobacterium
ESEPGRSTIDTDNALGD

SEQ ID NO: 1007600 - protein, 14 aa, Mycobacterium
ESEPYAGSVTRAGE

SEQ ID NO: 1007601 - protein, 4 aa, Mycobacterium
ESEQ

SEQ ID NO: 1007602 - protein, 7 aa, Mycobacterium
ESERHPV

SEQ ID NO: 1007603 - protein, 7 aa, Mycobacterium
ESESLRD

SEQ ID NO: 1007604 - protein, 6 aa, Mycobacterium
ESEVTA

SEQ ID NO: 1007605 - protein, 6 aa, Mycobacterium
ESFAEK

SEQ ID NO: 1007606 - protein, 4 aa, Mycobacterium
ESFG

SEQ ID NO: 1007607 - protein, 4 aa, Mycobacterium
ESGA

SEQ ID NO: 1007608 - protein, 14 aa, Mycobacterium
ESGALAGVTLHNIE

SEQ ID NO: 1007609 - protein, 8 aa, Mycobacterium
ESGAPIST

SEQ ID NO: 1007610 - protein, 8 aa, Mycobacterium
ESGARADR

SEQ ID NO: 1007611 - protein, 9 aa, Mycobacterium
ESGDAGTYL

SEQ ID NO: 1007612 - protein, 8 aa, Mycobacterium
ESGDLTPS

SEQ ID NO: 1007613 - protein, 9 aa, Mycobacterium
ESGDRAEWA

SEQ ID NO: 1007614 - protein, 6 aa, Mycobacterium
ESGDYD

SEQ ID NO: 1007615 - protein, 4 aa, Mycobacterium
ESGE

SEQ ID NO: 1007616 - protein, 9 aa, Mycobacterium
ESGEEGREQ

SEQ ID NO: 1007617 - protein, 6 aa, Mycobacterium
ESGELD

SEQ ID NO: 1007618 - protein, 8 aa, Mycobacterium
ESGERAQW

SEQ ID NO: 1007619 - protein, 15 aa, Mycobacterium
ESGFDANNSRVAEAA

SEQ ID NO: 1007620 - protein, 15 aa, Mycobacterium
ESGGAGSDGGIGGSG

SEQ ID NO: 1007621 - protein, 11 aa, Mycobacterium
ESGGGSGTANI

SEQ ID NO: 1007622 - protein, 6 aa, Mycobacterium
ESGGLG

SEQ ID NO: 1007623 - protein, 6 aa, Mycobacterium
ESGITV

SEQ ID NO: 1007624 - protein, 6 aa, Mycobacterium
ESGKMT

SEQ ID NO: 1007625 - protein, 4 aa, Mycobacterium
ESGL

SEQ ID NO: 1007626 - protein, 13 aa, Mycobacterium
ESGLGTRSGGAEG

SEQ ID NO: 1007627 - protein, 7 aa, Mycobacterium
ESGPTSV

SEQ ID NO: 1007628 - protein, 6 aa, Mycobacterium
ESGQLD

SEQ ID NO: 1007629 - protein, 8 aa, Mycobacterium
ESGRNRDE

SEQ ID NO: 1007630 - protein, 8 aa, Mycobacterium
ESGSLEQD

SEQ ID NO: 1007631 - protein, 9 aa, Mycobacterium
ESGTGENFN

SEQ ID NO: 1007632 - protein, 9 aa, Mycobacterium
ESGTTRPID

SEQ ID NO: 1007633 - protein, 6 aa, Mycobacterium
ESGVAN

SEQ ID NO: 1007634 - protein, 5 aa, Mycobacterium
ESGVP

SEQ ID NO: 1007635 - protein, 11 aa, Mycobacterium
ESGVPTFRDDK

SEQ ID NO: 1007636 - protein, 7 aa, Mycobacterium
ESGVTRI

SEQ ID NO: 1007637 - protein, 4 aa, Mycobacterium
ESHD

SEQ ID NO: 1007638 - protein, 7 aa, Mycobacterium
ESHDRLK

SEQ ID NO: 1007639 - protein, 9 aa, Mycobacterium
ESHNGTYRG

SEQ ID NO: 1007640 - protein, 10 aa, Mycobacterium
ESHPAPGRTA

SEQ ID NO: 1007641 - protein, 10 aa, Mycobacterium
ESIGENQVTG

SEQ ID NO: 1007642 - protein, 7 aa, Mycobacterium
ESIGPGD

SEQ ID NO: 1007643 - protein, 11 aa, Mycobacterium
ESIPDPVRETD

SEQ ID NO: 1007644 - protein, 7 aa, Mycobacterium
ESKANEV

SEQ ID NO: 1007645 - protein, 4 aa, Mycobacterium
ESLA

SEQ ID NO: 1007646 - protein, 9 aa, Mycobacterium
ESLHPVGEG

SEQ ID NO: 1007647 - protein, 4 aa, Mycobacterium
ESMG

SEQ ID NO: 1007648 - protein, 18 aa, Mycobacterium
ESMGQGRVTRAEGAPDTV

SEQ ID NO: 1007649 - protein, 34 aa, Mycobacterium; identical to SEQ ID NO: 34018

SEQ ID NO: 1007650 - protein, 20 aa, Mycobacterium
ESMSRTPMGSSLANGGRPYS

SEQ ID NO: 1007651 - protein, 9 aa, Mycobacterium
ESNAATYSR

SEQ ID NO: 1007652 - protein, 7 aa, Mycobacterium
ESNAESN

SEQ ID NO: 1007653 - protein, 19 aa, Mycobacterium
ESNGKSTRADGTAVTTDTG

SEQ ID NO: 1007654 - protein, 10 aa, Mycobacterium
ESNLHTDGYD

SEQ ID NO: 1007655 - protein, 19 aa, Mycobacterium
ESPAPTSGRPRKTPAQAES

SEQ ID NO: 1007656 - protein, 9 aa, Mycobacterium
ESPATASFN

SEQ ID NO: 1007657 - protein, 6 aa, Mycobacterium
ESPDRL

SEQ ID NO: 1007658 - protein, 6 aa, Mycobacterium
ESPEAA

SEQ ID NO: 1007659 - protein, 9 aa, Mycobacterium
ESPGVQRPS

SEQ ID NO: 1007660 - protein, 5 aa, Mycobacterium
ESPHD

SEQ ID NO: 1007661 - protein, 5 aa, Mycobacterium
ESPLP

SEQ ID NO: 1007662 - protein, 7 aa, Mycobacterium
ESPPDRL

SEQ ID NO: 1007663 - protein, 13 aa, Mycobacterium
ESPPPASPRWEPD

SEQ ID NO: 1007664 - protein, 6 aa, Mycobacterium
ESPRGE

SEQ ID NO: 1007665 - protein, 5 aa, Mycobacterium
ESPRP

SEQ ID NO: 1007666 - protein, 4 aa, Mycobacterium
ESPS

SEQ ID NO: 1007667 - protein, 5 aa, Mycobacterium
ESPSL

SEQ ID NO: 1007668 - protein, 6 aa, Mycobacterium
ESPTAA

SEQ ID NO: 1007669 - protein, 8 aa, Mycobacterium
ESQARGTP

SEQ ID NO: 1007670 - protein, 4 aa, Mycobacterium
ESQD

SEQ ID NO: 1007671 - protein, 5 aa, Mycobacterium
ESQGD

SEQ ID NO: 1007672 - protein, 20 aa, Mycobacterium
ESQGQTSARIPARGAGPGGP

SEQ ID NO: 1007673 - protein, 12 aa, Mycobacterium
ESQIGATDGAGV

SEQ ID NO: 1007674 - protein, 8 aa, Mycobacterium
ESQPGYGA

SEQ ID NO: 1007675 - protein, 8 aa, Mycobacterium
ESQSPEFS

SEQ ID NO: 1007676 - protein, 10 aa, Mycobacterium
ESRAQREGRR

SEQ ID NO: 1007677 - protein, 5 aa, Mycobacterium
ESRGS

SEQ ID NO: 1007678 - protein, 8 aa, Mycobacterium
ESRIGPTR

SEQ ID NO: 1007679 - protein, 10 aa, Mycobacterium
ESRKRGEAAE

SEQ ID NO: 1007680 - protein, 9 aa, Mycobacterium
ESRPTRTGL

SEQ ID NO: 1007681 - protein, 6 aa, Mycobacterium
ESRSGI

SEQ ID NO: 1007682 - protein, 4 aa, Mycobacterium
ESRY

SEQ ID NO: 1007683 - protein, 6 aa, Mycobacterium
ESSEEC

SEQ ID NO: 1007684 - protein, 8 aa, Mycobacterium
ESSEGSVQ

SEQ ID NO: 1007685 - protein, 7 aa, Mycobacterium
ESSNLSQ

SEQ ID NO: 1007686 - protein, 7 aa, Mycobacterium
ESSNRDA

SEQ ID NO: 1007687 - protein, 8 aa, Mycobacterium
ESSPKAVL

SEQ ID NO: 1007688 - protein, 7 aa, Mycobacterium
ESSPTLN

SEQ ID NO: 1007689 - protein, 12 aa, Mycobacterium
ESSSVDQRSGVS

SEQ ID NO: 1007690 - protein, 8 aa, Mycobacterium
ESSYGPNS

SEQ ID NO: 1007691 - protein, 5 aa, Mycobacterium
ESTAA

SEQ ID NO: 1007692 - protein, 10 aa, Mycobacterium
ESTGADRRAA

SEQ ID NO: 1007693 - protein, 7 aa, Mycobacterium
ESTGDLS

SEQ ID NO: 1007694 - protein, 7 aa, Mycobacterium
ESTGFPG

SEQ ID NO: 1007695 - protein, 7 aa, Mycobacterium
ESTGNGN

SEQ ID NO: 1007696 - protein, 13 aa, Mycobacterium
ESTLPPKSASLQV

SEQ ID NO: 1007697 - protein, 11 aa, Mycobacterium
ESTRDAVGNAG

SEQ ID NO: 1007698 - protein, 20 aa, Mycobacterium
ESTRGVGNSFGNNRQEGPDQ

SEQ ID NO: 1007699 - protein, 8 aa, Mycobacterium
ESTSGQRA

SEQ ID NO: 1007700 - protein, 7 aa, Mycobacterium
ESTSGTL

SEQ ID NO: 1007701 - protein, 10 aa, Mycobacterium
ESTSSPVPTV

SEQ ID NO: 1007702 - protein, 15 aa, Mycobacterium
ESTSWPGVTRPTSIG

SEQ ID NO: 1007703 - protein, 6 aa, Mycobacterium
ESTTTS

SEQ ID NO: 1007704 - protein, 5 aa, Mycobacterium
ESTVG

SEQ ID NO: 1007705 - protein, 6 aa, Mycobacterium
ESTVTD

SEQ ID NO: 1007706 - protein, 22 aa, Mycobacterium
ESVADGDRVARRRQGGPLVLDP

SEQ ID NO: 1007707 - protein, 12 aa, Mycobacterium
ESVNDQPTLNSR

SEQ ID NO: 1007708 - protein, 4 aa, Mycobacterium
ESVQ

SEQ ID NO: 1007709 - protein, 6 aa, Mycobacterium
ESVREA

SEQ ID NO: 1007710 - protein, 7 aa, Mycobacterium
ESVSSGP

SEQ ID NO: 1007711 - protein, 8 aa, Mycobacterium
ESVSSQSE

SEQ ID NO: 1007712 - protein, 7 aa, Mycobacterium
ESVTEGT

SEQ ID NO: 1007713 - protein, 6 aa, Mycobacterium
ESVTPG

SEQ ID NO: 1007714 - protein, 4 aa, Mycobacterium
ESWP

SEQ ID NO: 1007715 - protein, 7 aa, Mycobacterium
ESWSGGA

SEQ ID NO: 1007716 - protein, 8 aa, Mycobacterium
ESYEETEP

SEQ ID NO: 1007717 - protein, 6 aa, Mycobacterium
ESYRSE

SEQ ID NO: 1007718 - protein, 9 aa, Mycobacterium
ESYSTGGAR

SEQ ID NO: 1007719 - protein, 4 aa, Mycobacterium
ETAA

SEQ ID NO: 1007720 - protein, 5 aa, Mycobacterium
ETAAA

SEQ ID NO: 1007721 - protein, 23 aa, Mycobacterium
ETAADVGADTAKAIAASREGSQV

SEQ ID NO: 1007722 - protein, 6 aa, Mycobacterium
ETAAGF

SEQ ID NO: 1007723 - protein, 8 aa, Mycobacterium
ETAAGSPI

SEQ ID NO: 1007724 - protein, 19 aa, Mycobacterium
ETAAPTAQYAYPMEPGLRR

SEQ ID NO: 1007725 - protein, 15 aa, Mycobacterium
ETAATLGTGGISAGM

SEQ ID NO: 1007726 - protein, 8 aa, Mycobacterium
ETACDTNS

SEQ ID NO: 1007727 - protein, 16 aa, Mycobacterium
ETADAGEPVCDSGGSD

SEQ ID NO: 1007728 - protein, 7 aa, Mycobacterium
ETAEQTA

SEQ ID NO: 1007729 - protein, 4 aa, Mycobacterium
ETAG

SEQ ID NO: 1007730 - protein, 8 aa, Mycobacterium
ETAGAPVA

SEQ ID NO: 1007731 - protein, 9 aa, Mycobacterium
ETAGDPERL

SEQ ID NO: 1007732 - protein, 8 aa, Mycobacterium
ETAGDRPI

SEQ ID NO: 1007733 - protein, 14 aa, Mycobacterium
ETAGDVDNHDRTGV

SEQ ID NO: 1007734 - protein, 7 aa, Mycobacterium
ETAGTDI

SEQ ID NO: 1007735 - protein, 5 aa, Mycobacterium
ETALD

SEQ ID NO: 1007736 - protein, 5 aa, Mycobacterium
ETAPI

SEQ ID NO: 1007737 - protein, 6 aa, Mycobacterium
ETAPRR

SEQ ID NO: 1007738 - protein, 10 aa, Mycobacterium
ETARGGGNEI

SEQ ID NO: 1007739 - protein, 10 aa, Mycobacterium
ETARRRDDGN

SEQ ID NO: 1007740 - protein, 6 aa, Mycobacterium
ETASSK

SEQ ID NO: 1007741 - protein, 5 aa, Mycobacterium
ETATV

SEQ ID NO: 1007742 - protein, 10 aa, Mycobacterium
ETAVRQSDYG

SEQ ID NO: 1007743 - protein, 8 aa, Mycobacterium
ETCPSSDG

SEQ ID NO: 1007744 - protein, 8 aa, Mycobacterium
ETDDDFAQ

SEQ ID NO: 1007745 - protein, 8 aa, Mycobacterium
ETDDDGNV

SEQ ID NO: 1007746 - protein, 10 aa, Mycobacterium
ETDDESTADI

SEQ ID NO: 1007747 - protein, 12 aa, Mycobacterium
ETDDGLSGEEGT

SEQ ID NO: 1007748 - protein, 5 aa, Mycobacterium
ETDEM

SEQ ID NO: 1007749 - protein, 4 aa, Mycobacterium
ETDG

SEQ ID NO: 1007750 - protein, 9 aa, Mycobacterium
ETDGGESSL

SEQ ID NO: 1007751 - protein, 8 aa, Mycobacterium
ETDGQGGG

SEQ ID NO: 1007752 - protein, 7 aa, Mycobacterium
ETDKDLR

SEQ ID NO: 1007753 - protein, 14 aa, Mycobacterium
ETDLAGAAASVGRG

SEQ ID NO: 1007754 - protein, 26 aa, Mycobacterium
ETDPARDESAPVPSRSGARTRAAGGY

SEQ ID NO: 1007755 - protein, 6 aa, Mycobacterium
ETDPCR

SEQ ID NO: 1007756 - protein, 10 aa, Mycobacterium
ETDPIDPPVP

SEQ ID NO: 1007757 - protein, 7 aa, Mycobacterium
ETDPWGG

SEQ ID NO: 1007758 - protein, 10 aa, Mycobacterium
ETDTGSPEAQ

SEQ ID NO: 1007759 - protein, 8 aa, Mycobacterium
ETDWSTNR

SEQ ID NO: 1007760 - protein, 4 aa, Mycobacterium
ETDY

SEQ ID NO: 1007761 - protein, 6 aa, Mycobacterium
ETEAEQ

SEQ ID NO: 1007762 - protein, 6 aa, Mycobacterium
ETEAGP

SEQ ID NO: 1007763 - protein, 6 aa, Mycobacterium
ETEAQY

SEQ ID NO: 1007764 - protein, 20 aa, Mycobacterium
ETEAVNAAERAAGTLPGARP

SEQ ID NO: 1007765 - protein, 18 aa, Mycobacterium
ETEETDGAGDGVAETGAD

SEQ ID NO: 1007766 - protein, 6 aa, Mycobacterium
ETEMPA

SEQ ID NO: 1007767 - protein, 6 aa, Mycobacterium
ETEPAA

SEQ ID NO: 1007768 - protein, 25 aa, Mycobacterium
ETEQKWGETAEWKESQRRTKSYGKD

SEQ ID NO: 1007769 - protein, 6 aa, Mycobacterium
ETERPT

SEQ ID NO: 1007770 - protein, 8 aa, Mycobacterium
ETESGPFR

SEQ ID NO: 1007771 - protein, 13 aa, Mycobacterium
ETETAKWRDPTGT

SEQ ID NO: 1007772 - protein, 5 aa, Mycobacterium
ETETG

SEQ ID NO: 1007773 - protein, 4 aa, Mycobacterium
ETFE

SEQ ID NO: 1007774 - protein, 8 aa, Mycobacterium
ETFEADGR

SEQ ID NO: 1007775 - protein, 5 aa, Mycobacterium
ETFEE

SEQ ID NO: 1007776 - protein, 7 aa, Mycobacterium
ETFGGGR

SEQ ID NO: 1007777 - protein, 5 aa, Mycobacterium
ETGAD

SEQ ID NO: 1007778 - protein, 10 aa, Mycobacterium
ETGAGQHGVA

SEQ ID NO: 1007779 - protein, 5 aa, Mycobacterium
ETGAI

SEQ ID NO: 1007780 - protein, 6 aa, Mycobacterium
ETGDDN

SEQ ID NO: 1007781 - protein, 4 aa, Mycobacterium
ETGE

SEQ ID NO: 1007782 - protein, 5 aa, Mycobacterium
ETGEL

SEQ ID NO: 1007783 - protein, 10 aa, Mycobacterium
ETGEPQSGAE

SEQ ID NO: 1007784 - protein, 21 aa, Mycobacterium
ETGHGSDVQSLETTATYDADT

SEQ ID NO: 1007785 - protein, 10 aa, Mycobacterium
ETGKGTREDI

SEQ ID NO: 1007786 - protein, 9 aa, Mycobacterium
ETGKTYEDA

SEQ ID NO: 1007787 - protein, 39 aa, Mycobacterium; identical to SEQ ID NO: 473178

SEQ ID NO: 1007788 - protein, 5 aa, Mycobacterium
ETGNR

SEQ ID NO: 1007789 - protein, 4 aa, Mycobacterium
ETGP

SEQ ID NO: 1007790 - protein, 18 aa, Mycobacterium
ETGPRLQSRCRSSARSER

SEQ ID NO: 1007791 - protein, 6 aa, Mycobacterium
ETGPRT

SEQ ID NO: 1007792 - protein, 6 aa, Mycobacterium
ETGQPG

SEQ ID NO: 1007793 - protein, 8 aa, Mycobacterium
ETGRDPAA

SEQ ID NO: 1007794 - protein, 14 aa, Mycobacterium
ETGRRILDQSGFAK

SEQ ID NO: 1007795 - protein, 11 aa, Mycobacterium
ETGSGPGAGNA

SEQ ID NO: 1007796 - protein, 10 aa, Mycobacterium
ETGSKTLKDA

SEQ ID NO: 1007797 - protein, 8 aa, Mycobacterium
ETGSTGDT

SEQ ID NO: 1007798 - protein, 10 aa, Mycobacterium
ETGSVPSPSQ

SEQ ID NO: 1007799 - protein, 8 aa, Mycobacterium
ETGTPVTW

SEQ ID NO: 1007800 - protein, 11 aa, Mycobacterium
ETGVDQSKSAG

SEQ ID NO: 1007801 - protein, 4 aa, Mycobacterium
ETIP

SEQ ID NO: 1007802 - protein, 5 aa, Mycobacterium
ETIPT

SEQ ID NO: 1007803 - protein, 19 aa, Mycobacterium
ETKPNEVDEDELRAAVGKY

SEQ ID NO: 1007804 - protein, 6 aa, Mycobacterium
ETKPPI

SEQ ID NO: 1007805 - protein, 15 aa, Mycobacterium
ETKQSLSALKDTPNE

SEQ ID NO: 1007806 - protein, 7 aa, Mycobacterium
ETKVSDL

SEQ ID NO: 1007807 - protein, 7 aa, Mycobacterium
ETLREQA

SEQ ID NO: 1007808 - protein, 6 aa, Mycobacterium
ETLSGP

SEQ ID NO: 1007809 - protein, 10 aa, Mycobacterium
ETLTQAPASL

SEQ ID NO: 1007810 - protein, 4 aa, Mycobacterium
ETMT

SEQ ID NO: 1007811 - protein, 9 aa, Mycobacterium
ETNATTTRT

SEQ ID NO: 1007812 - protein, 4 aa, Mycobacterium
ETNQ

SEQ ID NO: 1007813 - protein, 4 aa, Mycobacterium
ETNS

SEQ ID NO: 1007814 - protein, 7 aa, Mycobacterium
ETNVSEQ

SEQ ID NO: 1007815 - protein, 9 aa, Mycobacterium
ETPDVTAGP

SEQ ID NO: 1007816 - protein, 6 aa, Mycobacterium
ETPEEV

SEQ ID NO: 1007817 - protein, 5 aa, Mycobacterium
ETPEY

SEQ ID NO: 1007818 - protein, 14 aa, Mycobacterium
ETPGLSADSATAAR

SEQ ID NO: 1007819 - protein, 5 aa, Mycobacterium
ETPID

SEQ ID NO: 1007820 - protein, 8 aa, Mycobacterium
ETPTSGDV

SEQ ID NO: 1007821 - protein, 6 aa, Mycobacterium
ETQPGG

SEQ ID NO: 1007822 - protein, 19 aa, Mycobacterium
ETQRDNVAQQPLAHKASGD

SEQ ID NO: 1007823 - protein, 8 aa, Mycobacterium
ETQRGGRQ

SEQ ID NO: 1007824 - protein, 5 aa, Mycobacterium
ETQSR

SEQ ID NO: 1007825 - protein, 6 aa, Mycobacterium
ETRAER

SEQ ID NO: 1007826 - protein, 5 aa, Mycobacterium
ETRAR

SEQ ID NO: 1007827 - protein, 6 aa, Mycobacterium
ETRDGH

SEQ ID NO: 1007828 - protein, 14 aa, Mycobacterium
ETRDPDSSAHNPAW

SEQ ID NO: 1007829 - protein, 5 aa, Mycobacterium
ETRGA

SEQ ID NO: 1007830 - protein, 4 aa, Mycobacterium
ETRI

SEQ ID NO: 1007831 - protein, 15 aa, Mycobacterium
ETRKPPLQESPISSF

SEQ ID NO: 1007832 - protein, 7 aa, Mycobacterium
ETRKRRR

SEQ ID NO: 1007833 - protein, 6 aa, Mycobacterium
ETRPRE

SEQ ID NO: 1007834 - protein, 5 aa, Mycobacterium
ETSDD

SEQ ID NO: 1007835 - protein, 4 aa, Mycobacterium
ETSL

SEQ ID NO: 1007836 - protein, 30 aa, Mycobacterium
ETSLRAAQSAIEATAAPVKVETDTPRGPAG

SEQ ID NO: 1007837 - protein, 17 aa, Mycobacterium
ETSPVATQTRSNDSLQR

SEQ ID NO: 1007838 - protein, 9 aa, Mycobacterium
ETSPYDAGL

SEQ ID NO: 1007839 - protein, 8 aa, Mycobacterium
ETSQPSRL

SEQ ID NO: 1007840 - protein, 4 aa, Mycobacterium
ETSR

SEQ ID NO: 1007841 - protein, 8 aa, Mycobacterium
ETSSDGGW

SEQ ID NO: 1007842 - protein, 4 aa, Mycobacterium
ETST

SEQ ID NO: 1007843 - protein, 5 aa, Mycobacterium
ETSTP

SEQ ID NO: 1007844 - protein, 9 aa, Mycobacterium
ETSVAGEPI

SEQ ID NO: 1007845 - protein, 12 aa, Mycobacterium
ETSYGPDGIGTA

SEQ ID NO: 1007846 - protein, 4 aa, Mycobacterium
ETTA

SEQ ID NO: 1007847 - protein, 10 aa, Mycobacterium
ETTAAHPNSR

SEQ ID NO: 1007848 - protein, 12 aa, Mycobacterium
ETTADDDHLSAE

SEQ ID NO: 1007849 - protein, 6 aa, Mycobacterium
ETTADL

SEQ ID NO: 1007850 - protein, 5 aa, Mycobacterium
ETTAT

SEQ ID NO: 1007851 - protein, 11 aa, Mycobacterium
ETTATRDGDSW

SEQ ID NO: 1007852 - protein, 9 aa, Mycobacterium
ETTGEQIGP

SEQ ID NO: 1007853 - protein, 17 aa, Mycobacterium
ETTGNGPAGDIAAQTRD

SEQ ID NO: 1007854 - protein, 10 aa, Mycobacterium
ETTGQAHSDR

SEQ ID NO: 1007855 - protein, 4 aa, Mycobacterium
ETTH

SEQ ID NO: 1007856 - protein, 6 aa, Mycobacterium
ETTPPG

SEQ ID NO: 1007857 - protein, 10 aa, Mycobacterium
ETTPWPTDEN

SEQ ID NO: 1007858 - protein, 7 aa, Mycobacterium
ETTQSKI

SEQ ID NO: 1007859 - protein, 10 aa, Mycobacterium
ETTSDLGGYR

SEQ ID NO: 1007860 - protein, 7 aa, Mycobacterium
ETTTDEM

SEQ ID NO: 1007861 - protein, 7 aa, Mycobacterium
ETTYRSS

SEQ ID NO: 1007862 - protein, 8 aa, Mycobacterium
ETTYSPLP

SEQ ID NO: 1007863 - protein, 5 aa, Mycobacterium
ETTYV

SEQ ID NO: 1007864 - protein, 13 aa, Mycobacterium
ETVATSPAFRGAA

SEQ ID NO: 1007865 - protein, 4 aa, Mycobacterium
ETVE

SEQ ID NO: 1007866 - protein, 5 aa, Mycobacterium
ETVEE

SEQ ID NO: 1007867 - protein, 4 aa, Mycobacterium
ETVP

SEQ ID NO: 1007868 - protein, 10 aa, Mycobacterium
ETVPPPEQRG

SEQ ID NO: 1007869 - protein, 4 aa, Mycobacterium
ETVQ

SEQ ID NO: 1007870 - protein, 21 aa, Mycobacterium
ETVQPSADDGLVAPDSPEAQD

SEQ ID NO: 1007871 - protein, 12 aa, Mycobacterium
ETVRAGRGGTMG

SEQ ID NO: 1007872 - protein, 11 aa, Mycobacterium
ETVSANPTIAN

SEQ ID NO: 1007873 - protein, 5 aa, Mycobacterium
ETVTE

SEQ ID NO: 1007874 - protein, 5 aa, Mycobacterium
ETVTT

SEQ ID NO: 1007875 - protein, 4 aa, Mycobacterium
ETYG

SEQ ID NO: 1007876 - protein, 10 aa, Mycobacterium
EVADGGALRE

SEQ ID NO: 1007877 - protein, 10 aa, Mycobacterium
EVAESGGVSG

SEQ ID NO: 1007878 - protein, 6 aa, Mycobacterium
EVANAQ

SEQ ID NO: 1007879 - protein, 5 aa, Mycobacterium
EVAPE

SEQ ID NO: 1007880 - protein, 5 aa, Mycobacterium
EVARD

SEQ ID NO: 1007881 - protein, 8 aa, Mycobacterium
EVDAANEH

SEQ ID NO: 1007882 - protein, 9 aa, Mycobacterium
EVDGERLSD

SEQ ID NO: 1007883 - protein, 8 aa, Mycobacterium
EVDGWSEG

SEQ ID NO: 1007884 - protein, 9 aa, Mycobacterium
EVDHADPER

SEQ ID NO: 1007885 - protein, 5 aa, Mycobacterium
EVDSG

SEQ ID NO: 1007886 - protein, 10 aa, Mycobacterium
EVEASPEAEA

SEQ ID NO: 1007887 - protein, 8 aa, Mycobacterium
EVEESPRQ

SEQ ID NO: 1007888 - protein, 4 aa, Mycobacterium
EVEN

SEQ ID NO: 1007889 - protein, 5 aa, Mycobacterium
EVEPE

SEQ ID NO: 1007890 - protein, 5 aa, Mycobacterium
EVEPR

SEQ ID NO: 1007891 - protein, 4 aa, Mycobacterium
EVGA

SEQ ID NO: 1007892 - protein, 4 aa, Mycobacterium
EVGE

SEQ ID NO: 1007893 - protein, 8 aa, Mycobacterium
EVGEAPGR

SEQ ID NO: 1007894 - protein, 12 aa, Mycobacterium
EVGEDRVDPAPV

SEQ ID NO: 1007895 - protein, 5 aa, Mycobacterium
EVGEP

SEQ ID NO: 1007896 - protein, 16 aa, Mycobacterium
EVGGSPAGLGARDTLR

SEQ ID NO: 1007897 - protein, 15 aa, Mycobacterium
EVGHAKREYHESASP

SEQ ID NO: 1007898 - protein, 11 aa, Mycobacterium
EVGPTGGGVGP

SEQ ID NO: 1007899 - protein, 6 aa, Mycobacterium
EVGQPT

SEQ ID NO: 1007900 - protein, 6 aa, Mycobacterium
EVGRGA

SEQ ID NO: 1007901 - protein, 7 aa, Mycobacterium
EVGSGKT

SEQ ID NO: 1007902 - protein, 14 aa, Mycobacterium
EVGSRVDSPTGTGR

SEQ ID NO: 1007903 - protein, 13 aa, Mycobacterium
EVGSTSDHGAQSN

SEQ ID NO: 1007904 - protein, 9 aa, Mycobacterium
EVGTDGAGW

SEQ ID NO: 1007905 - protein, 6 aa, Mycobacterium
EVKPTQ

SEQ ID NO: 1007906 - protein, 6 aa, Mycobacterium
EVKTSG

SEQ ID NO: 1007907 - protein, 8 aa, Mycobacterium
EVNGTDRA

SEQ ID NO: 1007908 - protein, 10 aa, Mycobacterium
EVNPANGGVA

SEQ ID NO: 1007909 - protein, 19 aa, Mycobacterium
EVNQAARRKPRDEQRPYEN

SEQ ID NO: 1007910 - protein, 7 aa, Mycobacterium
EVPAGHG

SEQ ID NO: 1007911 - protein, 9 aa, Mycobacterium
EVPAQLGTK

SEQ ID NO: 1007912 - protein, 8 aa, Mycobacterium
EVPDDPWG

SEQ ID NO: 1007913 - protein, 5 aa, Mycobacterium
EVPEA

SEQ ID NO: 1007914 - protein, 6 aa, Mycobacterium
EVPGGR

SEQ ID NO: 1007915 - protein, 11 aa, Mycobacterium
EVPKTTSGKIQ

SEQ ID NO: 1007916 - protein, 5 aa, Mycobacterium
EVPPD

SEQ ID NO: 1007917 - protein, 10 aa, Mycobacterium
EVPPQTASRV

SEQ ID NO: 1007918 - protein, 8 aa, Mycobacterium
EVPPSSRH

SEQ ID NO: 1007919 - protein, 4 aa, Mycobacterium
EVPT

SEQ ID NO: 1007920 - protein, 8 aa, Mycobacterium
EVPTGGAS

SEQ ID NO: 1007921 - protein, 13 aa, Mycobacterium
EVQGGGNITPLSK

SEQ ID NO: 1007922 - protein, 6 aa, Mycobacterium
EVQGQD

SEQ ID NO: 1007923 - protein, 7 aa, Mycobacterium
EVRDSSE

SEQ ID NO: 1007924 - protein, 13 aa, Mycobacterium
EVREGDPAPDGAG

SEQ ID NO: 1007925 - protein, 8 aa, Mycobacterium
EVREKEAQ

SEQ ID NO: 1007926 - protein, 11 aa, Mycobacterium
EVRGDDSREAK

SEQ ID NO: 1007927 - protein, 9 aa, Mycobacterium
EVSADAAQR

SEQ ID NO: 1007928 - protein, 13 aa, Mycobacterium
EVSAGTQVQVWDL

SEQ ID NO: 1007929 - protein, 7 aa, Mycobacterium
EVSAQRR

SEQ ID NO: 1007930 - protein, 12 aa, Mycobacterium
EVSAQTGLASGE

SEQ ID NO: 1007931 - protein, 16 aa, Mycobacterium
EVSDEPDDPKYGPVGK

SEQ ID NO: 1007932 - protein, 14 aa, Mycobacterium
EVSEAQPWQQGGQT

SEQ ID NO: 1007933 - protein, 11 aa, Mycobacterium
EVSEEKKTALG

SEQ ID NO: 1007934 - protein, 6 aa, Mycobacterium
EVSEQL

SEQ ID NO: 1007935 - protein, 10 aa, Mycobacterium
EVSKAANALT

SEQ ID NO: 1007936 - protein, 5 aa, Mycobacterium
EVSPA

SEQ ID NO: 1007937 - protein, 5 aa, Mycobacterium
EVSPE

SEQ ID NO: 1007938 - protein, 6 aa, Mycobacterium
EVSPNY

SEQ ID NO: 1007939 - protein, 9 aa, Mycobacterium
EVSQSQSAA

SEQ ID NO: 1007940 - protein, 12 aa, Mycobacterium
EVSTIGSSLQTA

SEQ ID NO: 1007941 - protein, 10 aa, Mycobacterium
EVTDDEGKPV

SEQ ID NO: 1007942 - protein, 12 aa, Mycobacterium
EVTEDGSPQGAR

SEQ ID NO: 1007943 - protein, 6 aa, Mycobacterium
EVTGDR

SEQ ID NO: 1007944 - protein, 7 aa, Mycobacterium
EVTGGRS

SEQ ID NO: 1007945 - protein, 5 aa, Mycobacterium
EVTPG

SEQ ID NO: 1007946 - protein, 8 aa, Mycobacterium
EVTPPQKW

SEQ ID NO: 1007947 - protein, 8 aa, Mycobacterium
EVTRGGRR

SEQ ID NO: 1007948 - protein, 47 aa, Mycobacterium
EVTRGTEATSTTRTARAADPTGATIAEQPPTGSAVTADTAVTANTAA

SEQ ID NO: 1007949 - protein, 9 aa, Mycobacterium
EVTTGRAAA

SEQ ID NO: 1007950 - protein, 19 aa, Mycobacterium
EVTTYGSGGHGAPAGSDAE

SEQ ID NO: 1007951 - protein, 10 aa, Mycobacterium
EVVGSGDGAV

SEQ ID NO: 1007952 - protein, 8 aa, Mycobacterium
EWAETSDG

SEQ ID NO: 1007953 - protein, 5 aa, Mycobacterium
EWATN

SEQ ID NO: 1007954 - protein, 10 aa, Mycobacterium
EWDEREETPW

SEQ ID NO: 1007955 - protein, 7 aa, Mycobacterium
EWDGGDK

SEQ ID NO: 1007956 - protein, 9 aa, Mycobacterium
EWESPSGRR

SEQ ID NO: 1007957 - protein, 34 aa, Mycobacterium
EWPESTKQLRTRTDIGEQSRNKIAGLNAQRFYEL

SEQ ID NO: 1007958 - protein, 13 aa, Mycobacterium
EWPTPARRALPSA

SEQ ID NO: 1007959 - protein, 5 aa, Mycobacterium
EWRSG

SEQ ID NO: 1007960 - protein, 7 aa, Mycobacterium
EWSPAGQ

SEQ ID NO: 1007961 - protein, 11 aa, Mycobacterium
EWSPESESSQE

SEQ ID NO: 1007962 - protein, 11 aa, Mycobacterium
EWTPDDRLRQS

SEQ ID NO: 1007963 - protein, 4 aa, Mycobacterium
EYAA

SEQ ID NO: 1007964 - protein, 7 aa, Mycobacterium
EYAAAAG

SEQ ID NO: 1007965 - protein, 4 aa, Mycobacterium
EYAR

SEQ ID NO: 1007966 - protein, 9 aa, Mycobacterium
EYATGSPEV

SEQ ID NO: 1007967 - protein, 5 aa, Mycobacterium
EYDER

SEQ ID NO: 1007968 - protein, 10 aa, Mycobacterium
EYDETPEHQA

SEQ ID NO: 1007969 - protein, 12 aa, Mycobacterium
EYDRRGWGSGGA

SEQ ID NO: 1007970 - protein, 7 aa, Mycobacterium
EYDRSGP

SEQ ID NO: 1007971 - protein, 11 aa, Mycobacterium
EYEPGEPRGTD

SEQ ID NO: 1007972 - protein, 10 aa, Mycobacterium
EYERAAGRQR

SEQ ID NO: 1007973 - protein, 6 aa, Mycobacterium
EYGGMG

SEQ ID NO: 1007974 - protein, 8 aa, Mycobacterium
EYGRAEQP

SEQ ID NO: 1007975 - protein, 5 aa, Mycobacterium
EYNGS

SEQ ID NO: 1007976 - protein, 5 aa, Mycobacterium
EYNPA

SEQ ID NO: 1007977 - protein, 15 aa, Mycobacterium
EYNTDGTVRKPGQDY

SEQ ID NO: 1007978 - protein, 12 aa, Mycobacterium
EYPDTAPEHARS

SEQ ID NO: 1007979 - protein, 6 aa, Mycobacterium
EYPGPY

SEQ ID NO: 1007980 - protein, 4 aa, Mycobacterium
EYPS

SEQ ID NO: 1007981 - protein, 12 aa, Mycobacterium
EYPTSPPVQRRR

SEQ ID NO: 1007982 - protein, 18 aa, Mycobacterium
EYQKKTDRQIPVFVLTPV

SEQ ID NO: 1007983 - protein, 6 aa, Mycobacterium
EYSPTD

SEQ ID NO: 1007984 - protein, 7 aa, Mycobacterium
EYSSRAG

SEQ ID NO: 1007985 - protein, 10 aa, Mycobacterium
EYTDDNVPVS

SEQ ID NO: 1007986 - protein, 10 aa, Mycobacterium
EYTEGAGPGI

SEQ ID NO: 1007987 - protein, 14 aa, Mycobacterium
EYTSAQRGLSGEDL

SEQ ID NO: 1007988 - protein, 7 aa, Mycobacterium
FAAEPGH

SEQ ID NO: 1007989 - protein, 19 aa, Mycobacterium
FAAPTDDPIPARSDAAAVT

SEQ ID NO: 1007990 - protein, 5 aa, Mycobacterium
FAATG

SEQ ID NO: 1007991 - protein, 8 aa, Mycobacterium
FADAGSDG

SEQ ID NO: 1007992 - protein, 9 aa, Mycobacterium
FADGPEAVD

SEQ ID NO: 1007993 - protein, 9 aa, Mycobacterium
FADGSLSRK

SEQ ID NO: 1007994 - protein, 10 aa, Mycobacterium
FAEAAQRTSR

SEQ ID NO: 1007995 - protein, 9 aa, Mycobacterium
FAEDSPEAY

SEQ ID NO: 1007996 - protein, 9 aa, Mycobacterium
FAEKPPPEA

SEQ ID NO: 1007997 - protein, 9 aa, Mycobacterium
FAEQRGHPK

SEQ ID NO: 1007998 - protein, 9 aa, Mycobacterium
FAGDEDKPA

SEQ ID NO: 1007999 - protein, 6 aa, Mycobacterium
FAGERP

SEQ ID NO: 1008000 - protein, 17 aa, Mycobacterium
FAGGGGDGGAGAVGGTG

SEQ ID NO: 1008001 - protein, 10 aa, Mycobacterium
FAGGSPGAFQ

SEQ ID NO: 1008002 - protein, 14 aa, Mycobacterium
FAGNQSGLTGGSQR

SEQ ID NO: 1008003 - protein, 4 aa, Mycobacterium
FAGQ

SEQ ID NO: 1008004 - protein, 46 aa, Mycobacterium
FAGRGGGTGLSAGAPKLKPASFGGAGAASMRPPIGPDSISSQLGGR

SEQ ID NO: 1008005 - protein, 8 aa, Mycobacterium
FAGRTRSA

SEQ ID NO: 1008006 - protein, 16 aa, Mycobacterium
FAGSEGGGDRAHTHDH

SEQ ID NO: 1008007 - protein, 14 aa, Mycobacterium
FAGSGGFGGAGGDA

SEQ ID NO: 1008008 - protein, 7 aa, Mycobacterium
FAKGAAS

SEQ ID NO: 1008009 - protein, 8 aa, Mycobacterium
FANAGSGN

SEQ ID NO: 1008010 - protein, 17 aa, Mycobacterium
FANDGQGGEDPADGGRY

SEQ ID NO: 1008011 - protein, 4 aa, Mycobacterium
FANP

SEQ ID NO: 1008012 - protein, 11 aa, Mycobacterium
FAPAAEDSTGA

SEQ ID NO: 1008013 - protein, 10 aa, Mycobacterium
FAPASDTPGL

SEQ ID NO: 1008014 - protein, 4 aa, Mycobacterium
FAPL

SEQ ID NO: 1008015 - protein, 6 aa, Mycobacterium
FAPPDG

SEQ ID NO: 1008016 - protein, 5 aa, Mycobacterium
FAPTA

SEQ ID NO: 1008017 - protein, 10 aa, Mycobacterium
FAPTAATDHR

SEQ ID NO: 1008018 - protein, 7 aa, Mycobacterium
FAPTPEQ

SEQ ID NO: 1008019 - protein, 12 aa, Mycobacterium
FAQDGVGGLRGG

SEQ ID NO: 1008020 - protein, 12 aa, Mycobacterium
FARNRTKENRDF

SEQ ID NO: 1008021 - protein, 11 aa, Mycobacterium
FARPGARRSRA

SEQ ID NO: 1008022 - protein, 4 aa, Mycobacterium
FASA

SEQ ID NO: 1008023 - protein, 14 aa, Mycobacterium
FASGAGSEGGHATP

SEQ ID NO: 1008024 - protein, 7 aa, Mycobacterium
FASQDEA

SEQ ID NO: 1008025 - protein, 7 aa, Mycobacterium
FASRDGT

SEQ ID NO: 1008026 - protein, 20 aa, Mycobacterium
FASSGLAKPPEADANPAVPP

SEQ ID NO: 1008027 - protein, 11 aa, Mycobacterium
FASSTGESVVP

SEQ ID NO: 1008028 - protein, 17 aa, Mycobacterium
FATEGVSEAAQAGRKRL

SEQ ID NO: 1008029 - protein, 4 aa, Mycobacterium
FDAA

SEQ ID NO: 1008030 - protein, 11 aa, Mycobacterium
FDAPASSSPLH

SEQ ID NO: 1008031 - protein, 11 aa, Mycobacterium
FDASKPTAWSA

SEQ ID NO: 1008032 - protein, 10 aa, Mycobacterium
FDDDDEDDIT

SEQ ID NO: 1008033 - protein, 6 aa, Mycobacterium
FDDDEA

SEQ ID NO: 1008034 - protein, 12 aa, Mycobacterium
FDDQGAKYDGDG

SEQ ID NO: 1008035 - protein, 11 aa, Mycobacterium
FDEAPETGATF

SEQ ID NO: 1008036 - protein, 5 aa, Mycobacterium
FDEDA

SEQ ID NO: 1008037 - protein, 8 aa, Mycobacterium
FDESTAAS

SEQ ID NO: 1008038 - protein, 13 aa, Mycobacterium
FDESTAKSSGDRL

SEQ ID NO: 1008039 - protein, 6 aa, Mycobacterium
FDETRQ

SEQ ID NO: 1008040 - protein, 6 aa, Mycobacterium
FDGDGM

SEQ ID NO: 1008041 - protein, 9 aa, Mycobacterium
FDGEQNLAG

SEQ ID NO: 1008042 - protein, 8 aa, Mycobacterium
FDGGDGQR

SEQ ID NO: 1008043 - protein, 11 aa, Mycobacterium
FDGGGEDTGAF

SEQ ID NO: 1008044 - protein, 46 aa, Mycobacterium; identical to SEQ ID NO: 901848

SEQ ID NO: 1008045 - protein, 8 aa, Mycobacterium
FDGRPQAT

SEQ ID NO: 1008046 - protein, 10 aa, Mycobacterium
FDGRSGEPFP

SEQ ID NO: 1008047 - protein, 21 aa, Mycobacterium
FDGSGDPEETLQQTEARQAES

SEQ ID NO: 1008048 - protein, 7 aa, Mycobacterium
FDGSGID

SEQ ID NO: 1008049 - protein, 9 aa, Mycobacterium
FDKDGTGLD

SEQ ID NO: 1008050 - protein, 5 aa, Mycobacterium
FDNAD

SEQ ID NO: 1008051 - protein, 16 aa, Mycobacterium
FDNGPWPSTPPKERAT

SEQ ID NO: 1008052 - protein, 7 aa, Mycobacterium
FDPADDK

SEQ ID NO: 1008053 - protein, 6 aa, Mycobacterium
FDPATG

SEQ ID NO: 1008054 - protein, 4 aa, Mycobacterium
FDPD

SEQ ID NO: 1008055 - protein, 4 aa, Mycobacterium
FDPE

SEQ ID NO: 1008056 - protein, 5 aa, Mycobacterium
FDPEA

SEQ ID NO: 1008057 - protein, 7 aa, Mycobacterium
FDPQAKG

SEQ ID NO: 1008058 - protein, 4 aa, Mycobacterium
FDPR

SEQ ID NO: 1008059 - protein, 7 aa, Mycobacterium
FDPRPPM

SEQ ID NO: 1008060 - protein, 9 aa, Mycobacterium
FDPTRGSYL

SEQ ID NO: 1008061 - protein, 10 aa, Mycobacterium
FDPVGKPGAL

SEQ ID NO: 1008062 - protein, 10 aa, Mycobacterium
FDQAPAATAI

SEQ ID NO: 1008063 - protein, 7 aa, Mycobacterium
FDRNDKR

SEQ ID NO: 1008064 - protein, 4 aa, Mycobacterium
FDRP

SEQ ID NO: 1008065 - protein, 11 aa, Mycobacterium
FDRPPSDHTSA

SEQ ID NO: 1008066 - protein, 11 aa, Mycobacterium
FDSDDPDVAEE

SEQ ID NO: 1008067 - protein, 8 aa, Mycobacterium
FDSIDKSD

SEQ ID NO: 1008068 - protein, 8 aa, Mycobacterium
FDSRDDQL

SEQ ID NO: 1008069 - protein, 6 aa, Mycobacterium
FDSRPD

SEQ ID NO: 1008070 - protein, 8 aa, Mycobacterium
FDSTDGGW

SEQ ID NO: 1008071 - protein, 22 aa, Mycobacterium
FDTASTAATARGRVKATSQRKI

SEQ ID NO: 1008072 - protein, 7 aa, Mycobacterium
FDTEQTG

SEQ ID NO: 1008073 - protein, 10 aa, Mycobacterium
FDTGARGSLR

SEQ ID NO: 1008074 - protein, 6 aa, Mycobacterium
FDTTTA

SEQ ID NO: 1008075 - protein, 4 aa, Mycobacterium
FEDD

SEQ ID NO: 1008076 - protein, 8 aa, Mycobacterium
FEDETGTV

SEQ ID NO: 1008077 - protein, 11 aa, Mycobacterium
FEEAPEVANAG

SEQ ID NO: 1008078 - protein, 19 aa, Mycobacterium
FEESKQRQLDREARTGKRV

SEQ ID NO: 1008079 - protein, 8 aa, Mycobacterium
FEETTTHY

SEQ ID NO: 1008080 - protein, 4 aa, Mycobacterium
FEGA

SEQ ID NO: 1008081 - protein, 5 aa, Mycobacterium
FEGDP

SEQ ID NO: 1008082 - protein, 5 aa, Mycobacterium
FEGNA

SEQ ID NO: 1008083 - protein, 16 aa, Mycobacterium
FEGPDGTREYMWVDVV

SEQ ID NO: 1008084 - protein, 14 aa, Mycobacterium
FEGPTDGTAPENPY

SEQ ID NO: 1008085 - protein, 17 aa, Mycobacterium
FEGTTARIREKQKAGDF

SEQ ID NO: 1008086 - protein, 11 aa, Mycobacterium
FEHSTPDLSGR

SEQ ID NO: 1008087 - protein, 8 aa, Mycobacterium
FENDDTAA

SEQ ID NO: 1008088 - protein, 7 aa, Mycobacterium
FEPDPDF

SEQ ID NO: 1008089 - protein, 10 aa, Mycobacterium
FEPGQEEPTR

SEQ ID NO: 1008090 - protein, 9 aa, Mycobacterium
FEPGQPSAW

SEQ ID NO: 1008091 - protein, 21 aa, Mycobacterium
FEPKNSKSRSLRTHSQTSGWS

SEQ ID NO: 1008092 - protein, 9 aa, Mycobacterium
FEPSKTRRH

SEQ ID NO: 1008093 - protein, 10 aa, Mycobacterium
FEQDPNGDWR

SEQ ID NO: 1008094 - protein, 8 aa, Mycobacterium
FEQEPMDG

SEQ ID NO: 1008095 - protein, 6 aa, Mycobacterium
FEQRPD

SEQ ID NO: 1008096 - protein, 8 aa, Mycobacterium
FERSGPER

SEQ ID NO: 1008097 - protein, 6 aa, Mycobacterium
FESDDG

SEQ ID NO: 1008098 - protein, 6 aa, Mycobacterium
FESQIG

SEQ ID NO: 1008099 - protein, 12 aa, Mycobacterium
FETARRRGSRAH

SEQ ID NO: 1008100 - protein, 8 aa, Mycobacterium
FETDKGKW

SEQ ID NO: 1008101 - protein, 5 aa, Mycobacterium
FETEG

SEQ ID NO: 1008102 - protein, 7 aa, Mycobacterium
FETNEDG

SEQ ID NO: 1008103 - protein, 11 aa, Mycobacterium
FETSNTPGYSG

SEQ ID NO: 1008104 - protein, 5 aa, Mycobacterium
FEVPE

SEQ ID NO: 1008105 - protein, 4 aa, Mycobacterium
FGAA

SEQ ID NO: 1008106 - protein, 7 aa, Mycobacterium
FGADEAA

SEQ ID NO: 1008107 - protein, 8 aa, Mycobacterium
FGAEGEDF

SEQ ID NO: 1008108 - protein, 55 aa, Mycobacterium
FGANGGAGGTGGTGGTGTSQGGDGGSGGDGGDGGDASGGLSSAGDGGNGGAGGFG

SEQ ID NO: 1008109 - protein, 11 aa, Mycobacterium
FGAPATSPGTV

SEQ ID NO: 1008110 - protein, 10 aa, Mycobacterium
FGDGALKDKP

SEQ ID NO: 1008111 - protein, 32 aa, Mycobacterium
FGDGGAGGAGGTGGSGADGGDAGTGGAGGRGG

SEQ ID NO: 1008112 - protein, 26 aa, Mycobacterium
FGDGGDGGDCAESNGGIGSGGRGGSA

SEQ ID NO: 1008113 - protein, 12 aa, Mycobacterium
FGDGMPGPNGFT

SEQ ID NO: 1008114 - protein, 10 aa, Mycobacterium
FGEANGPMGF

SEQ ID NO: 1008115 - protein, 7 aa, Mycobacterium
FGEGEGR

SEQ ID NO: 1008116 - protein, 14 aa, Mycobacterium
FGEPPQLGGAATAE

SEQ ID NO: 1008117 - protein, 6 aa, Mycobacterium
FGGAAS

SEQ ID NO: 1008118 - protein, 11 aa, Mycobacterium
FGGAGGQGGQG

SEQ ID NO: 1008119 - protein, 9 aa, Mycobacterium
FGGAPPIAT

SEQ ID NO: 1008120 - protein, 34 aa, Mycobacterium
FGGDGGAGGDAGHGGTGGDGGNGGQGASGGRGGL

SEQ ID NO: 1008121 - protein, 6 aa, Mycobacterium
FGGDPA

SEQ ID NO: 1008122 - protein, 7 aa, Mycobacterium
FGGDPDN

SEQ ID NO: 1008123 - protein, 10 aa, Mycobacterium
FGGEESAGAS

SEQ ID NO: 1008124 - protein, 5 aa, Mycobacterium
FGGGA

SEQ ID NO: 1008125 - protein, 5 aa, Mycobacterium
FGGGD

SEQ ID NO: 1008126 - protein, 7 aa, Mycobacterium
FGGGGRG

SEQ ID NO: 1008127 - protein, 9 aa, Mycobacterium
FGGGTPEVV

SEQ ID NO: 1008128 - protein, 4 aa, Mycobacterium
FGGH

SEQ ID NO: 1008129 - protein, 4 aa, Mycobacterium
FGGN

SEQ ID NO: 1008130 - protein, 12 aa, Mycobacterium
FGGNGPHGTRPG

SEQ ID NO: 1008131 - protein, 29 aa, Mycobacterium
FGGPGGAGGTGGVGTGGDGGNGGAGGNAG

SEQ ID NO: 1008132 - protein, 6 aa, Mycobacterium
FGGPGV

SEQ ID NO: 1008133 - protein, 7 aa, Mycobacterium
FGGPIET

SEQ ID NO: 1008134 - protein, 8 aa, Mycobacterium
FGGPPGAG

SEQ ID NO: 1008135 - protein, 11 aa, Mycobacterium
FGGPTVTNDGV

SEQ ID NO: 1008136 - protein, 8 aa, Mycobacterium
FGGQTREL

SEQ ID NO: 1008137 - protein, 18 aa, Mycobacterium
FGGSGGNGGSAGDGGAGG

SEQ ID NO: 1008138 - protein, 6 aa, Mycobacterium
FGGSGR

SEQ ID NO: 1008139 - protein, 33 aa, Mycobacterium
FGGTGGAGGAGGQSTNALADSVGGNGGQGGDGR

SEQ ID NO: 1008140 - protein, 12 aa, Mycobacterium
FGGTPRYPASEV

SEQ ID NO: 1008141 - protein, 14 aa, Mycobacterium
FGGYKQSGIGREGH

SEQ ID NO: 1008142 - protein, 8 aa, Mycobacterium
FGKAPSAN

SEQ ID NO: 1008143 - protein, 16 aa, Mycobacterium
FGKGNSDSLPDTKNPL

SEQ ID NO: 1008144 - protein, 6 aa, Mycobacterium
FGKNSQ

SEQ ID NO: 1008145 - protein, 7 aa, Mycobacterium
FGKPDGY

SEQ ID NO: 1008146 - protein, 5 aa, Mycobacterium
FGLPE

SEQ ID NO: 1008147 - protein, 16 aa, Mycobacterium
FGNAGSTNTGGFNGNN

SEQ ID NO: 1008148 - protein, 78 aa, Mycobacterium
FGNGGAGGAGGDRVAGSQGNGGDGGDGGHGGTYFGSGGAGGHGGYDDSGSGGQGGHGGDGGAAGTIGNGGDGGTGGDA

SEQ ID NO: 1008149 - protein, 68 aa, Mycobacterium
FGNGGAGGLGGAGGVSGDHSGGNGGEGGNGGDAQFAGHGGAGGPGGTGGGGTADDGVAGSNGSPGLFF

SEQ ID NO: 1008150 - protein, 9 aa, Mycobacterium
FGNNGNNNI

SEQ ID NO: 1008151 - protein, 6 aa, Mycobacterium
FGNPTA

SEQ ID NO: 1008152 - protein, 9 aa, Mycobacterium
FGNQGSGNI

SEQ ID NO: 1008153 - protein, 20 aa, Mycobacterium
FGNSNSQVSADASGAGGNLG

SEQ ID NO: 1008154 - protein, 12 aa, Mycobacterium
FGNTATDGFRSG

SEQ ID NO: 1008155 - protein, 15 aa, Mycobacterium
FGNTGNPLTSSNPGI

SEQ ID NO: 1008156 - protein, 9 aa, Mycobacterium
FGNTGSASI

SEQ ID NO: 1008157 - protein, 10 aa, Mycobacterium
FGNTGSNNFG

SEQ ID NO: 1008158 - protein, 38 aa, Mycobacterium
FGNTGSNNIGFGNTGNNNIGFGNTGDNNRGIGLTGTGQ

SEQ ID NO: 1008159 - protein, 4 aa, Mycobacterium
FGPA

SEQ ID NO: 1008160 - protein, 8 aa, Mycobacterium
FGPAGAAA

SEQ ID NO: 1008161 - protein, 12 aa, Mycobacterium
FGPDSMTESGYP

SEQ ID NO: 1008162 - protein, 7 aa, Mycobacterium
FGPGFGP

SEQ ID NO: 1008163 - protein, 5 aa, Mycobacterium
FGPGG

SEQ ID NO: 1008164 - protein, 9 aa, Mycobacterium
FGPGPAQRR

SEQ ID NO: 1008165 - protein, 11 aa, Mycobacterium
FGPGPGPLSEA

SEQ ID NO: 1008166 - protein, 9 aa, Mycobacterium
FGPNTPRFR

SEQ ID NO: 1008167 - protein, 9 aa, Mycobacterium
FGPPAGDPA

SEQ ID NO: 1008168 - protein, 10 aa, Mycobacterium
FGPSGSGKST

SEQ ID NO: 1008169 - protein, 8 aa, Mycobacterium
FGPSTRTR

SEQ ID NO: 1008170 - protein, 6 aa, Mycobacterium
FGQAGT

SEQ ID NO: 1008171 - protein, 34 aa, Mycobacterium
FGQGGAGGNGGQGGGENFASTAGAGGPAGTGGHG

SEQ ID NO: 1008172 - protein, 14 aa, Mycobacterium
FGRGGATDYQQNLA

SEQ ID NO: 1008173 - protein, 7 aa, Mycobacterium
FGRGSNR

SEQ ID NO: 1008174 - protein, 7 aa, Mycobacterium
FGRPSTG

SEQ ID NO: 1008175 - protein, 9 aa, Mycobacterium
FGRRRDERV

SEQ ID NO: 1008176 - protein, 6 aa, Mycobacterium
FGRSRG

SEQ ID NO: 1008177 - protein, 12 aa, Mycobacterium
FGRTSRIREPDG

SEQ ID NO: 1008178 - protein, 10 aa, Mycobacterium
FGSDGGGSIR

SEQ ID NO: 1008179 - protein, 9 aa, Mycobacterium
FGSDQDTYR

SEQ ID NO: 1008180 - protein, 20 aa, Mycobacterium
FGSGGAGGSGGVGGLNAGAQ

SEQ ID NO: 1008181 - protein, 37 aa, Mycobacterium
FGSGGSGGAGGEGGAFGDGNAGGSGSGGHGGNGGNGG

SEQ ID NO: 1008182 - protein, 8 aa, Mycobacterium
FGSGTGHA

SEQ ID NO: 1008183 - protein, 4 aa, Mycobacterium
FGSP

SEQ ID NO: 1008184 - protein, 7 aa, Mycobacterium
FGSSGLR

SEQ ID NO: 1008185 - protein, 4 aa, Mycobacterium
FGSY

SEQ ID NO: 1008186 - protein, 10 aa, Mycobacterium
FGTAEESNRR

SEQ ID NO: 1008187 - protein, 14 aa, Mycobacterium
FGTAPNPGGGLPYT

SEQ ID NO: 1008188 - protein, 8 aa, Mycobacterium
FGTDPDVA

SEQ ID NO: 1008189 - protein, 11 aa, Mycobacterium
FGTGESSSIGE

SEQ ID NO: 1008190 - protein, 6 aa, Mycobacterium
FGVSGT

SEQ ID NO: 1008191 - protein, 14 aa, Mycobacterium
FHAPESTTAWPTGE

SEQ ID NO: 1008192 - protein, 5 aa, Mycobacterium
FHQPR

SEQ ID NO: 1008193 - protein, 4 aa, Mycobacterium
FKGP

SEQ ID NO: 1008194 - protein, 4 aa, Mycobacterium
FKPG

SEQ ID NO: 1008195 - protein, 11 aa, Mycobacterium
FKSGTSEPPLQ

SEQ ID NO: 1008196 - protein, 9 aa, Mycobacterium
FKTSQGKYV

SEQ ID NO: 1008197 - protein, 19 aa, Mycobacterium
FNASGDNTAAGSSAGRRTV

SEQ ID NO: 1008198 - protein, 5 aa, Mycobacterium
FNEPG

SEQ ID NO: 1008199 - protein, 6 aa, Mycobacterium
FNGEGK

SEQ ID NO: 1008200 - protein, 4 aa, Mycobacterium
FNGP

SEQ ID NO: 1008201 - protein, 12 aa, Mycobacterium
FNGQAAPTKYPA

SEQ ID NO: 1008202 - protein, 9 aa, Mycobacterium
FNPAGSIKD

SEQ ID NO: 1008203 - protein, 15 aa, Mycobacterium
FNPDNPDAFAETGGW

SEQ ID NO: 1008204 - protein, 12 aa, Mycobacterium
FNPDRTKLPIPQ

SEQ ID NO: 1008205 - protein, 11 aa, Mycobacterium
FNPDRYRDTYQ

SEQ ID NO: 1008206 - protein, 8 aa, Mycobacterium
FNPECAPA

SEQ ID NO: 1008207 - protein, 9 aa, Mycobacterium
FNPGGMKDR

SEQ ID NO: 1008208 - protein, 19 aa, Mycobacterium
FNPGPSNTGALNTGTANTG

SEQ ID NO: 1008209 - protein, 8 aa, Mycobacterium
FNQNTEGI

SEQ ID NO: 1008210 - protein, 7 aa, Mycobacterium
FNSDSTF

SEQ ID NO: 1008211 - protein, 25 aa, Mycobacterium
FNSGVGSSGTLNTGWGNSGSTNTGY

SEQ ID NO: 1008212 - protein, 11 aa, Mycobacterium
FNSSAAGGKKI

SEQ ID NO: 1008213 - protein, 5 aa, Mycobacterium
FNTGI

SEQ ID NO: 1008214 - protein, 9 aa, Mycobacterium
FPASDPGQL

SEQ ID NO: 1008215 - protein, 20 aa, Mycobacterium
FPASPASVATLSGGTSTEGT

SEQ ID NO: 1008216 - protein, 11 aa, Mycobacterium
FPDAAEDVKQS

SEQ ID NO: 1008217 - protein, 11 aa, Mycobacterium
FPDDEPLDHTG

SEQ ID NO: 1008218 - protein, 12 aa, Mycobacterium
FPDGSNSQPSYL

SEQ ID NO: 1008219 - protein, 6 aa, Mycobacterium
FPDSHR

SEQ ID NO: 1008220 - protein, 6 aa, Mycobacterium
FPEGTR

SEQ ID NO: 1008221 - protein, 11 aa, Mycobacterium
FPEPGSAVEQG

SEQ ID NO: 1008222 - protein, 16 aa, Mycobacterium
FPETTLADPPPGSDLK

SEQ ID NO: 1008223 - protein, 8 aa, Mycobacterium
FPGDENRV

SEQ ID NO: 1008224 - protein, 12 aa, Mycobacterium
FPGESPQGSGVV

SEQ ID NO: 1008225 - protein, 6 aa, Mycobacterium
FPGGEG

SEQ ID NO: 1008226 - protein, 8 aa, Mycobacterium
FPGGPPPR

SEQ ID NO: 1008227 - protein, 6 aa, Mycobacterium
FPGPAL

SEQ ID NO: 1008228 - protein, 33 aa, Mycobacterium; identical to SEQ ID NO: 476070

SEQ ID NO: 1008229 - protein, 9 aa, Mycobacterium
FPGQGGGFH

SEQ ID NO: 1008230 - protein, 8 aa, Mycobacterium
FPGQQGGP

SEQ ID NO: 1008231 - protein, 9 aa, Mycobacterium
FPHQGTEGP

SEQ ID NO: 1008232 - protein, 21 aa, Mycobacterium
FPKTDTKVGAQEGSETTQGGF

SEQ ID NO: 1008233 - protein, 11 aa, Mycobacterium
FPNHEANPLDP

SEQ ID NO: 1008234 - protein, 29 aa, Mycobacterium
FPPAEDESPSDSAEPAAGPAKSPLPPMPI

SEQ ID NO: 1008235 - protein, 12 aa, Mycobacterium
FPPASVTGTPKL

SEQ ID NO: 1008236 - protein, 12 aa, Mycobacterium
FPPGLSSPGGLG

SEQ ID NO: 1008237 - protein, 5 aa, Mycobacterium
FPPNT

SEQ ID NO: 1008238 - protein, 7 aa, Mycobacterium
FPPPQQS

SEQ ID NO: 1008239 - protein, 37 aa, Mycobacterium; identical to SEQ ID NO: 476145

SEQ ID NO: 1008240 - protein, 18 aa, Mycobacterium
FPQLPQAPDDYPTFPDTS

SEQ ID NO: 1008241 - protein, 22 aa, Mycobacterium
FPQTPGAAAQSDNAAEAAVEQP

SEQ ID NO: 1008242 - protein, 7 aa, Mycobacterium
FPQVQPR

SEQ ID NO: 1008243 - protein, 8 aa, Mycobacterium
FPRPDDPL

SEQ ID NO: 1008244 - protein, 12 aa, Mycobacterium
FPRPSDAEEART

SEQ ID NO: 1008245 - protein, 24 aa, Mycobacterium
FPRRDPHGDPIPSSDGQVPTPPAR

SEQ ID NO: 1008246 - protein, 8 aa, Mycobacterium
FPSGPVSA

SEQ ID NO: 1008247 - protein, 6 aa, Mycobacterium
FPTASQ

SEQ ID NO: 1008248 - protein, 12 aa, Mycobacterium
FPTDDPDDAEAL

SEQ ID NO: 1008249 - protein, 8 aa, Mycobacterium
FPTDRGWD

SEQ ID NO: 1008250 - protein, 21 aa, Mycobacterium
FPTEPPGAPLPPLAGGTSPRA

SEQ ID NO: 1008251 - protein, 5 aa, Mycobacterium
FPTGP

SEQ ID NO: 1008252 - protein, 9 aa, Mycobacterium
FPTPDDPNH

SEQ ID NO: 1008253 - protein, 5 aa, Mycobacterium
FPTPE

SEQ ID NO: 1008254 - protein, 5 aa, Mycobacterium
FPTQA

SEQ ID NO: 1008255 - protein, 9 aa, Mycobacterium
FQDDGSAGI

SEQ ID NO: 1008256 - protein, 9 aa, Mycobacterium
FQDPPDSAL

SEQ ID NO: 1008257 - protein, 5 aa, Mycobacterium
FQETT

SEQ ID NO: 1008258 - protein, 10 aa, Mycobacterium
FQGPPGRAPI

SEQ ID NO: 1008259 - protein, 4 aa, Mycobacterium
FQPE

SEQ ID NO: 1008260 - protein, 9 aa, Mycobacterium
FQPRQHAQP

SEQ ID NO: 1008261 - protein, 9 aa, Mycobacterium
FQSEPDADA

SEQ ID NO: 1008262 - protein, 11 aa, Mycobacterium
FQTRSTKQGGR

SEQ ID NO: 1008263 - protein, 10 aa, Mycobacterium
FRDEASRSKL

SEQ ID NO: 1008264 - protein, 32 aa, Mycobacterium; identical to SEQ ID NO: 476339

SEQ ID NO: 1008265 - protein, 19 aa, Mycobacterium
FRKDGTVTAGSSSQISDGA

SEQ ID NO: 1008266 - protein, 5 aa, Mycobacterium
FRPDE

SEQ ID NO: 1008267 - protein, 17 aa, Mycobacterium
FRPDHSHAKSARSVAET

SEQ ID NO: 1008268 - protein, 7 aa, Mycobacterium
FRPGKVP

SEQ ID NO: 1008269 - protein, 6 aa, Mycobacterium
FRPGNE

SEQ ID NO: 1008270 - protein, 6 aa, Mycobacterium
FRPGRA

SEQ ID NO: 1008271 - protein, 23 aa, Mycobacterium
FRPGSRSSKNRRRRRLHNRCRSP

SEQ ID NO: 1008272 - protein, 8 aa, Mycobacterium
FRPPMPPG

SEQ ID NO: 1008273 - protein, 4 aa, Mycobacterium
FRPT

SEQ ID NO: 1008274 - protein, 9 aa, Mycobacterium
FRRSRRDAL

SEQ ID NO: 1008275 - protein, 19 aa, Mycobacterium
FRRSSSTTSGAHPSAQRSA

SEQ ID NO: 1008276 - protein, 12 aa, Mycobacterium
FSAASDEALGDI

SEQ ID NO: 1008277 - protein, 12 aa, Mycobacterium
FSAGSSGAAVTA

SEQ ID NO: 1008278 - protein, 10 aa, Mycobacterium
FSAPDDDDTE

SEQ ID NO: 1008279 - protein, 10 aa, Mycobacterium
FSAPPTPFNG

SEQ ID NO: 1008280 - protein, 15 aa, Mycobacterium
FSATGLPSVADDSGL

SEQ ID NO: 1008281 - protein, 5 aa, Mycobacterium
FSEGG

SEQ ID NO: 1008282 - protein, 11 aa, Mycobacterium
FSEQPKYENAA

SEQ ID NO: 1008283 - protein, 8 aa, Mycobacterium
FSGEGAGS

SEQ ID NO: 1008284 - protein, 11 aa, Mycobacterium
FSGGGNVKEMA

SEQ ID NO: 1008285 - protein, 9 aa, Mycobacterium
FSGRPSHRA

SEQ ID NO: 1008286 - protein, 6 aa, Mycobacterium
FSGSNG

SEQ ID NO: 1008287 - protein, 9 aa, Mycobacterium
FSGTSPDGH

SEQ ID NO: 1008288 - protein, 6 aa, Mycobacterium
FSPASR

SEQ ID NO: 1008289 - protein, 7 aa, Mycobacterium
FSPDSGS

SEQ ID NO: 1008290 - protein, 10 aa, Mycobacterium
FSPGQNHQGD

SEQ ID NO: 1008291 - protein, 15 aa, Mycobacterium
FSPGRTDASQENTDV

SEQ ID NO: 1008292 - protein, 21 aa, Mycobacterium
FSPGYPATAGTAGLRESAGAA

SEQ ID NO: 1008293 - protein, 4 aa, Mycobacterium
FSPL

SEQ ID NO: 1008294 - protein, 5 aa, Mycobacterium
FSPRR

SEQ ID NO: 1008295 - protein, 4 aa, Mycobacterium
FSPT

SEQ ID NO: 1008296 - protein, 4 aa, Mycobacterium
FSQG

SEQ ID NO: 1008297 - protein, 4 aa, Mycobacterium
FSQY

SEQ ID NO: 1008298 - protein, 6 aa, Mycobacterium
FSRNGP

SEQ ID NO: 1008299 - protein, 8 aa, Mycobacterium
FSRPEPHY

SEQ ID NO: 1008300 - protein, 4 aa, Mycobacterium
FSSA

SEQ ID NO: 1008301 - protein, 9 aa, Mycobacterium
FSSAPTDHA

SEQ ID NO: 1008302 - protein, 6 aa, Mycobacterium
FSSEAA

SEQ ID NO: 1008303 - protein, 9 aa, Mycobacterium
FSTAADSNA

SEQ ID NO: 1008304 - protein, 6 aa, Mycobacterium
FSTEQS

SEQ ID NO: 1008305 - protein, 18 aa, Mycobacterium
FSTGETGRVGSPKRREIG

SEQ ID NO: 1008306 - protein, 9 aa, Mycobacterium
FSTTSEGIG

SEQ ID NO: 1008307 - protein, 5 aa, Mycobacterium
FSVPP

SEQ ID NO: 1008308 - protein, 29 aa, Mycobacterium
FTAPGRPPVPGAAPRAKSSRAAVGKPGWP

SEQ ID NO: 1008309 - protein, 4 aa, Mycobacterium
FTDD

SEQ ID NO: 1008310 - protein, 5 aa, Mycobacterium
FTDPD

SEQ ID NO: 1008311 - protein, 7 aa, Mycobacterium
FTDPGER

SEQ ID NO: 1008312 - protein, 7 aa, Mycobacterium
FTEPAAA

SEQ ID NO: 1008313 - protein, 10 aa, Mycobacterium
FTESGEPAGI

SEQ ID NO: 1008314 - protein, 6 aa, Mycobacterium
FTGAGG

SEQ ID NO: 1008315 - protein, 4 aa, Mycobacterium
FTGD

SEQ ID NO: 1008316 - protein, 10 aa, Mycobacterium
FTGEDGATYE

SEQ ID NO: 1008317 - protein, 8 aa, Mycobacterium
FTGEGAKM

SEQ ID NO: 1008318 - protein, 13 aa, Mycobacterium
FTGNPGPTPPTLG

SEQ ID NO: 1008319 - protein, 4 aa, Mycobacterium
FTGR

SEQ ID NO: 1008320 - protein, 5 aa, Mycobacterium
FTGYT

SEQ ID NO: 1008321 - protein, 18 aa, Mycobacterium
FTKTTSKGVETIGGARRG

SEQ ID NO: 1008322 - protein, 13 aa, Mycobacterium
FTNSPIKDGEHAN

SEQ ID NO: 1008323 - protein, 7 aa, Mycobacterium
FTPARPD

SEQ ID NO: 1008324 - protein, 4 aa, Mycobacterium
FTPE

SEQ ID NO: 1008325 - protein, 7 aa, Mycobacterium
FTPEATA

SEQ ID NO: 1008326 - protein, 13 aa, Mycobacterium
FTPEATKEADDNL

SEQ ID NO: 1008327 - protein, 18 aa, Mycobacterium
FTPGERRDASDKSSSAAR

SEQ ID NO: 1008328 - protein, 6 aa, Mycobacterium
FTPGPG

SEQ ID NO: 1008329 - protein, 35 aa, Mycobacterium; identical to SEQ ID NO: 476907

SEQ ID NO: 1008330 - protein, 4 aa, Mycobacterium
FTPQ

SEQ ID NO: 1008331 - protein, 9 aa, Mycobacterium
FTPQETESL

SEQ ID NO: 1008332 - protein, 8 aa, Mycobacterium
FTPQPEQF

SEQ ID NO: 1008333 - protein, 9 aa, Mycobacterium
FTPTPPDRI

SEQ ID NO: 1008334 - protein, 17 aa, Mycobacterium
FTPTQAEEARAWVSAES

SEQ ID NO: 1008335 - protein, 8 aa, Mycobacterium
FTQDGAPQ

SEQ ID NO: 1008336 - protein, 6 aa, Mycobacterium
FTRSNW

SEQ ID NO: 1008337 - protein, 11 aa, Mycobacterium
FTSDTSREEVG

SEQ ID NO: 1008338 - protein, 10 aa, Mycobacterium
FTSGENRLDS

SEQ ID NO: 1008339 - protein, 5 aa, Mycobacterium
FTSSG

SEQ ID NO: 1008340 - protein, 9 aa, Mycobacterium
FTTTTRAGN

SEQ ID NO: 1008341 - protein, 6 aa, Mycobacterium
FVGTAQ

SEQ ID NO: 1008342 - protein, 5 aa, Mycobacterium
FYPEE

SEQ ID NO: 1008343 - protein, 4 aa, Mycobacterium
GAAA

SEQ ID NO: 1008344 - protein, 7 aa, Mycobacterium
GAAAAAL

SEQ ID NO: 1008345 - protein, 13 aa, Mycobacterium
GAAADTRRAAERN

SEQ ID NO: 1008346 - protein, 8 aa, Mycobacterium
GAAAEPLG

SEQ ID NO: 1008347 - protein, 6 aa, Mycobacterium
GAAAET

SEQ ID NO: 1008348 - protein, 14 aa, Mycobacterium
GAAAGAGATGAHCC

SEQ ID NO: 1008349 - protein, 15 aa, Mycobacterium
GAAAGTYRAAPGELS

SEQ ID NO: 1008350 - protein, 17 aa, Mycobacterium
GAAASYSGAEAANASPL

SEQ ID NO: 1008351 - protein, 7 aa, Mycobacterium
GAAAVSS

SEQ ID NO: 1008352 - protein, 9 aa, Mycobacterium
GAAAYTAAE

SEQ ID NO: 1008353 - protein, 12 aa, Mycobacterium
GAADADADVRDV

SEQ ID NO: 1008354 - protein, 12 aa, Mycobacterium
GAADGTGFSEGG

SEQ ID NO: 1008355 - protein, 8 aa, Mycobacterium
GAADPGAR

SEQ ID NO: 1008356 - protein, 10 aa, Mycobacterium
GAADRDQERY

SEQ ID NO: 1008357 - protein, 13 aa, Mycobacterium
GAADSEDGPAWSD

SEQ ID NO: 1008358 - protein, 18 aa, Mycobacterium
GAAEDSFRKEHGGTGNVG

SEQ ID NO: 1008359 - protein, 7 aa, Mycobacterium
GAAEGAI

SEQ ID NO: 1008360 - protein, 9 aa, Mycobacterium
GAAEGDGAV

SEQ ID NO: 1008361 - protein, 5 aa, Mycobacterium
GAAEL

SEQ ID NO: 1008362 - protein, 10 aa, Mycobacterium
GAAELEGASA

SEQ ID NO: 1008363 - protein, 10 aa, Mycobacterium
GAAEMEGASA

SEQ ID NO: 1008364 - protein, 14 aa, Mycobacterium
GAAEPLSDAGPTGW

SEQ ID NO: 1008365 - protein, 15 aa, Mycobacterium
GAAFSEAASAATTKL

SEQ ID NO: 1008366 - protein, 14 aa, Mycobacterium
GAAGAPGQDGGDGG

SEQ ID NO: 1008367 - protein, 9 aa, Mycobacterium
GAAGDEPGF

SEQ ID NO: 1008368 - protein, 25 aa, Mycobacterium
GAAGDGGNGGFGAGGRGGSGGAGGD

SEQ ID NO: 1008369 - protein, 7 aa, Mycobacterium
GAAGGQG

SEQ ID NO: 1008370 - protein, 16 aa, Mycobacterium
GAAGHAGRVGGQARLA

SEQ ID NO: 1008371 - protein, 6 aa, Mycobacterium
GAAGLG

SEQ ID NO: 1008372 - protein, 7 aa, Mycobacterium
GAAGPVR

SEQ ID NO: 1008373 - protein, 15 aa, Mycobacterium
GAAGQSGGAGGSAGL

SEQ ID NO: 1008374 - protein, 7 aa, Mycobacterium
GAAGSEA

SEQ ID NO: 1008375 - protein, 9 aa, Mycobacterium
GAAGSGSQR

SEQ ID NO: 1008376 - protein, 11 aa, Mycobacterium
GAAGTGTPLPA

SEQ ID NO: 1008377 - protein, 18 aa, Mycobacterium
GAAGTTIPAGTANPAGTA

SEQ ID NO: 1008378 - protein, 5 aa, Mycobacterium
GAAGV

SEQ ID NO: 1008379 - protein, 13 aa, Mycobacterium
GAAITQGTVLAEI

SEQ ID NO: 1008380 - protein, 9 aa, Mycobacterium
GAAKAGKAM

SEQ ID NO: 1008381 - protein, 10 aa, Mycobacterium
GAAKDNETKR

SEQ ID NO: 1008382 - protein, 22 aa, Mycobacterium
GAAKKTAKAASTAAVAEAGGLE

SEQ ID NO: 1008383 - protein, 7 aa, Mycobacterium
GAAKPAI

SEQ ID NO: 1008384 - protein, 7 aa, Mycobacterium
GAAKPGD

SEQ ID NO: 1008385 - protein, 14 aa, Mycobacterium
GAAKSDFEMIEVSR

SEQ ID NO: 1008386 - protein, 10 aa, Mycobacterium
GAALGAGETR

SEQ ID NO: 1008387 - protein, 4 aa, Mycobacterium
GAAM

SEQ ID NO: 1008388 - protein, 14 aa, Mycobacterium
GAANAAAAPPTTGI

SEQ ID NO: 1008389 - protein, 13 aa, Mycobacterium
GAANEADGGPNLG

SEQ ID NO: 1008390 - protein, 7 aa, Mycobacterium
GAANPGE

SEQ ID NO: 1008391 - protein, 8 aa, Mycobacterium
GAANQPLA

SEQ ID NO: 1008392 - protein, 8 aa, Mycobacterium
GAANTGNY

SEQ ID NO: 1008393 - protein, 17 aa, Mycobacterium
GAAPAGGAAEAAEEQSE

SEQ ID NO: 1008394 - protein, 24 aa, Mycobacterium
GAAPAVPDDGAGSTPRAAQIGVGG

SEQ ID NO: 1008395 - protein, 6 aa, Mycobacterium
GAAPDR

SEQ ID NO: 1008396 - protein, 10 aa, Mycobacterium
GAAPESKPAV

SEQ ID NO: 1008397 - protein, 24 aa, Mycobacterium
GAAPGGDGGKGGDAQLVGTGGNGG

SEQ ID NO: 1008398 - protein, 9 aa, Mycobacterium
GAAPGSRFP

SEQ ID NO: 1008399 - protein, 9 aa, Mycobacterium
GAAPPESIA

SEQ ID NO: 1008400 - protein, 10 aa, Mycobacterium
GAAPPRPPAG

SEQ ID NO: 1008401 - protein, 15 aa, Mycobacterium
GAAPSGAISGAPNPY

SEQ ID NO: 1008402 - protein, 8 aa, Mycobacterium
GAAPTADR

SEQ ID NO: 1008403 - protein, 9 aa, Mycobacterium
GAAPTEGTY

SEQ ID NO: 1008404 - protein, 4 aa, Mycobacterium
GAAQ

SEQ ID NO: 1008405 - protein, 7 aa, Mycobacterium
GAAQPHR

SEQ ID NO: 1008406 - protein, 13 aa, Mycobacterium
GAAQPKASTPASP

SEQ ID NO: 1008407 - protein, 17 aa, Mycobacterium
GAAQTYARAEATGAAPL

SEQ ID NO: 1008408 - protein, 8 aa, Mycobacterium
GAARAERA

SEQ ID NO: 1008409 - protein, 5 aa, Mycobacterium
GAARD

SEQ ID NO: 1008410 - protein, 6 aa, Mycobacterium
GAARHG

SEQ ID NO: 1008411 - protein, 9 aa, Mycobacterium
GAARPDGPV

SEQ ID NO: 1008412 - protein, 5 aa, Mycobacterium
GAARR

SEQ ID NO: 1008413 - protein, 10 aa, Mycobacterium
GAARRRTPAR

SEQ ID NO: 1008414 - protein, 6 aa, Mycobacterium
GAARTQ

SEQ ID NO: 1008415 - protein, 4 aa, Mycobacterium
GAAS

SEQ ID NO: 1008416 - protein, 5 aa, Mycobacterium
GAASA

SEQ ID NO: 1008417 - protein, 8 aa, Mycobacterium
GAASAARI

SEQ ID NO: 1008418 - protein, 14 aa, Mycobacterium
GAASAFAASEATNA

SEQ ID NO: 1008419 - protein, 20 aa, Mycobacterium
GAASAYASAEVANASPLQIL

SEQ ID NO: 1008420 - protein, 9 aa, Mycobacterium
GAASGYDDG

SEQ ID NO: 1008421 - protein, 8 aa, Mycobacterium
GAASPRES

SEQ ID NO: 1008422 - protein, 5 aa, Mycobacterium
GAASY

SEQ ID NO: 1008423 - protein, 17 aa, Mycobacterium
GAASYATAEAANASPLQ

SEQ ID NO: 1008424 - protein, 11 aa, Mycobacterium
GAATARRVGTD

SEQ ID NO: 1008425 - protein, 8 aa, Mycobacterium
GAATDQTY

SEQ ID NO: 1008426 - protein, 7 aa, Mycobacterium
GAATEED

SEQ ID NO: 1008427 - protein, 7 aa, Mycobacterium
GAATEVE

SEQ ID NO: 1008428 - protein, 7 aa, Mycobacterium
GAATGGV

SEQ ID NO: 1008429 - protein, 9 aa, Mycobacterium
GAATQTTAV

SEQ ID NO: 1008430 - protein, 8 aa, Mycobacterium
GAATTTQA

SEQ ID NO: 1008431 - protein, 6 aa, Mycobacterium
GAAVTR

SEQ ID NO: 1008432 - protein, 7 aa, Mycobacterium
GAAYGGN

SEQ ID NO: 1008433 - protein, 8 aa, Mycobacterium
GAAYSAES

SEQ ID NO: 1008434 - protein, 5 aa, Mycobacterium
GADAE

SEQ ID NO: 1008435 - protein, 8 aa, Mycobacterium
GADAGAGG

SEQ ID NO: 1008436 - protein, 8 aa, Mycobacterium
GADAGEID

SEQ ID NO: 1008437 - protein, 9 aa, Mycobacterium
GADAPDADL

SEQ ID NO: 1008438 - protein, 14 aa, Mycobacterium
GADATEAGTAGQAG

SEQ ID NO: 1008439 - protein, 15 aa, Mycobacterium
GADATTPGANGGNGG

SEQ ID NO: 1008440 - protein, 13 aa, Mycobacterium
GADAYASSEVANA

SEQ ID NO: 1008441 - protein, 9 aa, Mycobacterium
GADDDEISL

SEQ ID NO: 1008442 - protein, 10 aa, Mycobacterium
GADDVGRAEE

SEQ ID NO: 1008443 - protein, 7 aa, Mycobacterium
GADEADA

SEQ ID NO: 1008444 - protein, 10 aa, Mycobacterium
GADEATRKAA

SEQ ID NO: 1008445 - protein, 9 aa, Mycobacterium
GADEDQLSA

SEQ ID NO: 1008446 - protein, 6 aa, Mycobacterium
GADEMS

SEQ ID NO: 1008447 - protein, 7 aa, Mycobacterium
GADEPGR

SEQ ID NO: 1008448 - protein, 7 aa, Mycobacterium
GADEVST

SEQ ID NO: 1008449 - protein, 5 aa, Mycobacterium
GADFD

SEQ ID NO: 1008450 - protein, 8 aa, Mycobacterium
GADGEQVE

SEQ ID NO: 1008451 - protein, 6 aa, Mycobacterium
GADGID

SEQ ID NO: 1008452 - protein, 6 aa, Mycobacterium
GADGLT

SEQ ID NO: 1008453 - protein, 11 aa, Mycobacterium
GADGPPGSYQD

SEQ ID NO: 1008454 - protein, 6 aa, Mycobacterium
GADGRA

SEQ ID NO: 1008455 - protein, 19 aa, Mycobacterium
GADGRPDPSSHSVGKGDQH

SEQ ID NO: 1008456 - protein, 51 aa, Mycobacterium; identical to SEQ ID NO: 477554

SEQ ID NO: 1008457 - protein, 19 aa, Mycobacterium
GADGTQGGPQLTSPPTDPI

SEQ ID NO: 1008458 - protein, 5 aa, Mycobacterium
GADHE

SEQ ID NO: 1008459 - protein, 9 aa, Mycobacterium
GADIEGAPS

SEQ ID NO: 1008460 - protein, 4 aa, Mycobacterium
GADL

SEQ ID NO: 1008461 - protein, 13 aa, Mycobacterium
GADLPYRADLRQS

SEQ ID NO: 1008462 - protein, 7 aa, Mycobacterium
GADLQRA

SEQ ID NO: 1008463 - protein, 16 aa, Mycobacterium
GADNTDEQRFSPGERY

SEQ ID NO: 1008464 - protein, 6 aa, Mycobacterium
GADPAQ

SEQ ID NO: 1008465 - protein, 5 aa, Mycobacterium
GADPE

SEQ ID NO: 1008466 - protein, 8 aa, Mycobacterium
GADPGGVS

SEQ ID NO: 1008467 - protein, 8 aa, Mycobacterium
GADPMDPR

SEQ ID NO: 1008468 - protein, 11 aa, Mycobacterium
GADPQDPTATR

SEQ ID NO: 1008469 - protein, 8 aa, Mycobacterium
GADPTGEA

SEQ ID NO: 1008470 - protein, 4 aa, Mycobacterium
GADQ

SEQ ID NO: 1008471 - protein, 11 aa, Mycobacterium
GADQAPASVHP

SEQ ID NO: 1008472 - protein, 6 aa, Mycobacterium
GADQVS

SEQ ID NO: 1008473 - protein, 6 aa, Mycobacterium
GADRDG

SEQ ID NO: 1008474 - protein, 9 aa, Mycobacterium
GADSAPADV

SEQ ID NO: 1008475 - protein, 7 aa, Mycobacterium
GADSGDI

SEQ ID NO: 1008476 - protein, 8 aa, Mycobacterium
GADSPYET

SEQ ID NO: 1008477 - protein, 7 aa, Mycobacterium
GADSSRG

SEQ ID NO: 1008478 - protein, 10 aa, Mycobacterium
GADSYGWAES

SEQ ID NO: 1008479 - protein, 4 aa, Mycobacterium
GADT

SEQ ID NO: 1008480 - protein, 14 aa, Mycobacterium
GADTAAASVPGAVG

SEQ ID NO: 1008481 - protein, 9 aa, Mycobacterium
GADTDPTVN

SEQ ID NO: 1008482 - protein, 13 aa, Mycobacterium
GADTERTRVLLST

SEQ ID NO: 1008483 - protein, 5 aa, Mycobacterium
GADTP

SEQ ID NO: 1008484 - protein, 6 aa, Mycobacterium
GADTSA

SEQ ID NO: 1008485 - protein, 9 aa, Mycobacterium
GAEADPDAA

SEQ ID NO: 1008486 - protein, 8 aa, Mycobacterium
GAEAGDEF

SEQ ID NO: 1008487 - protein, 13 aa, Mycobacterium
GAEAGRPLASSNR

SEQ ID NO: 1008488 - protein, 8 aa, Mycobacterium
GAEAVESG

SEQ ID NO: 1008489 - protein, 4 aa, Mycobacterium
GAED

SEQ ID NO: 1008490 - protein, 7 aa, Mycobacterium
GAEDPKL

SEQ ID NO: 1008491 - protein, 8 aa, Mycobacterium
GAEDVNDL

SEQ ID NO: 1008492 - protein, 6 aa, Mycobacterium
GAEEAE

SEQ ID NO: 1008493 - protein, 5 aa, Mycobacterium
GAEGD

SEQ ID NO: 1008494 - protein, 8 aa, Mycobacterium
GAEHADAA

SEQ ID NO: 1008495 - protein, 16 aa, Mycobacterium
GAEHPTGTFPETEKAA

SEQ ID NO: 1008496 - protein, 7 aa, Mycobacterium
GAEIPDG

SEQ ID NO: 1008497 - protein, 6 aa, Mycobacterium
GAEIRG

SEQ ID NO: 1008498 - protein, 7 aa, Mycobacterium
GAELTKR

SEQ ID NO: 1008499 - protein, 5 aa, Mycobacterium
GAENR

SEQ ID NO: 1008500 - protein, 7 aa, Mycobacterium
GAENSGF

SEQ ID NO: 1008501 - protein, 13 aa, Mycobacterium
GAEPIGSMGTDTP

SEQ ID NO: 1008502 - protein, 14 aa, Mycobacterium
GAEPQDAFRFARTL

SEQ ID NO: 1008503 - protein, 6 aa, Mycobacterium
GAEPQH

SEQ ID NO: 1008504 - protein, 8 aa, Mycobacterium
GAEPRATR

SEQ ID NO: 1008505 - protein, 7 aa, Mycobacterium
GAEPVRA

SEQ ID NO: 1008506 - protein, 5 aa, Mycobacterium
GAEQI

SEQ ID NO: 1008507 - protein, 12 aa, Mycobacterium
GAEQTRTPTDGE

SEQ ID NO: 1008508 - protein, 18 aa, Mycobacterium
GAERADAAEVEHNPRSAP

SEQ ID NO: 1008509 - protein, 8 aa, Mycobacterium
GAERAHDI

SEQ ID NO: 1008510 - protein, 22 aa, Mycobacterium
GAERGIGDQRVQSGAVEKHGDR

SEQ ID NO: 1008511 - protein, 5 aa, Mycobacterium
GAERP

SEQ ID NO: 1008512 - protein, 6 aa, Mycobacterium
GAERQK

SEQ ID NO: 1008513 - protein, 9 aa, Mycobacterium
GAESANANQ

SEQ ID NO: 1008514 - protein, 5 aa, Mycobacterium
GAESS

SEQ ID NO: 1008515 - protein, 5 aa, Mycobacterium
GAETL

SEQ ID NO: 1008516 - protein, 9 aa, Mycobacterium
GAETTRNAV

SEQ ID NO: 1008517 - protein, 11 aa, Mycobacterium
GAFGGDGGNAR

SEQ ID NO: 1008518 - protein, 9 aa, Mycobacterium
GAGAALDAG

SEQ ID NO: 1008519 - protein, 10 aa, Mycobacterium
GAGADSESAA

SEQ ID NO: 1008520 - protein, 7 aa, Mycobacterium
GAGADTV

SEQ ID NO: 1008521 - protein, 7 aa, Mycobacterium
GAGAEAA

SEQ ID NO: 1008522 - protein, 9 aa, Mycobacterium
GAGAEPGDP

SEQ ID NO: 1008523 - protein, 16 aa, Mycobacterium
GAGAGAGAGAGAGAVS

SEQ ID NO: 1008524 - protein, 14 aa, Mycobacterium
GAGAGAGAGAGAVS

SEQ ID NO: 1008525 - protein, 10 aa, Mycobacterium
GAGAGAYAEA

SEQ ID NO: 1008526 - protein, 10 aa, Mycobacterium
GAGAGAYAGA

SEQ ID NO: 1008527 - protein, 6 aa, Mycobacterium
GAGAGG

SEQ ID NO: 1008528 - protein, 9 aa, Mycobacterium
GAGAGLGGV

SEQ ID NO: 1008529 - protein, 9 aa, Mycobacterium
GAGAGNAPV

SEQ ID NO: 1008530 - protein, 12 aa, Mycobacterium
GAGAISLPLLIS

SEQ ID NO: 1008531 - protein, 12 aa, Mycobacterium
GAGAPDAYKRAG

SEQ ID NO: 1008532 - protein, 11 aa, Mycobacterium
GAGAPKGSCDT

SEQ ID NO: 1008533 - protein, 7 aa, Mycobacterium
GAGARIQ

SEQ ID NO: 1008534 - protein, 8 aa, Mycobacterium
GAGASAYR

SEQ ID NO: 1008535 - protein, 15 aa, Mycobacterium
GAGASFADADAGGRA

SEQ ID NO: 1008536 - protein, 10 aa, Mycobacterium
GAGATPPAKA

SEQ ID NO: 1008537 - protein, 6 aa, Mycobacterium
GAGDAT

SEQ ID NO: 1008538 - protein, 7 aa, Mycobacterium
GAGDEAI

SEQ ID NO: 1008539 - protein, 18 aa, Mycobacterium
GAGDERRHAGLSALERAL

SEQ ID NO: 1008540 - protein, 12 aa, Mycobacterium
GAGDERTQRANY

SEQ ID NO: 1008541 - protein, 7 aa, Mycobacterium
GAGDKSF

SEQ ID NO: 1008542 - protein, 23 aa, Mycobacterium
GAGDQRGEQQRQGDRSGHDGRLP

SEQ ID NO: 1008543 - protein, 6 aa, Mycobacterium
GAGDRA

SEQ ID NO: 1008544 - protein, 6 aa, Mycobacterium
GAGDSL

SEQ ID NO: 1008545 - protein, 5 aa, Mycobacterium
GAGDV

SEQ ID NO: 1008546 - protein, 4 aa, Mycobacterium
GAGE

SEQ ID NO: 1008547 - protein, 6 aa, Mycobacterium
GAGEAV

SEQ ID NO: 1008548 - protein, 8 aa, Mycobacterium
GAGEAYPA

SEQ ID NO: 1008549 - protein, 5 aa, Mycobacterium
GAGED

SEQ ID NO: 1008550 - protein, 9 aa, Mycobacterium
GAGERASNP

SEQ ID NO: 1008551 - protein, 9 aa, Mycobacterium
GAGESQNLA

SEQ ID NO: 1008552 - protein, 5 aa, Mycobacterium
GAGGA

SEQ ID NO: 1008553 - protein, 21 aa, Mycobacterium
GAGGAGDNGDGGAGDNGGDGG

SEQ ID NO: 1008554 - protein, 10 aa, Mycobacterium
GAGGAGEDGG

SEQ ID NO: 1008555 - protein, 29 aa, Mycobacterium
GAGGAGGAGGAGGSSTGGAGGTGGAGGAG

SEQ ID NO: 1008556 - protein, 13 aa, Mycobacterium
GAGGAGGAGWANS

SEQ ID NO: 1008557 - protein, 17 aa, Mycobacterium
GAGGAGGALGAGGTGGI

SEQ ID NO: 1008558 - protein, 17 aa, Mycobacterium
GAGGAGGDGGGGGKSGW

SEQ ID NO: 1008559 - protein, 149 aa, Mycobacterium
GAGGAGGDGLDGGPGAMGLTGGTGGHGGDNTSSVTRPGVGGAGGTGGTGGTGGTGGTGGAGGTGGTGGTGGTGGTGGTGGAGGAGGLFGQSGAAGAGGTAGAGGAGGTGGTGGVGGTGGTGAGGGGRTGGVGGDGVTGATGASGQPGAS

SEQ ID NO: 1008560 - protein, 24 aa, Mycobacterium
GAGGAGGTGTTSGGVGGTGGAGGV

SEQ ID NO: 1008561 - protein, 21 aa, Mycobacterium
GAGGAYAAAEAANASPLQAAE

SEQ ID NO: 1008562 - protein, 9 aa, Mycobacterium
GAGGDGGSV

SEQ ID NO: 1008563 - protein, 10 aa, Mycobacterium
GAGGDGGVGG

SEQ ID NO: 1008564 - protein, 79 aa, Mycobacterium
GAGGDGIARGDAAGGDGGNGGFGGGGTIRGNGGNGGNGDNGDNGSNGSNGGNGGKGGNGGNGGKGGKGGKGGNAGNGTV

SEQ ID NO: 1008565 - protein, 13 aa, Mycobacterium
GAGGDNPADGPLT

SEQ ID NO: 1008566 - protein, 38 aa, Mycobacterium
GAGGDPGTGGGQGSDGNRGADGLGGPAFDGARGADGNP

SEQ ID NO: 1008567 - protein, 23 aa, Mycobacterium
GAGGEGGNSATTAGVGGAGGAGG

SEQ ID NO: 1008568 - protein, 16 aa, Mycobacterium
GAGGGDGGAGGNAGTL

SEQ ID NO: 1008569 - protein, 57 aa, Mycobacterium
GAGGGDGGAGGYGLTGAGGAGGAGGNSGLLSGPGGSGGTGGAGAVADGAVGGAGGSA

SEQ ID NO: 1008570 - protein, 57 aa, Mycobacterium
GAGGGDGGIGGMGQHNGGAGGTGGSAGVLGGPGGAGGTGGYGGVTGGGGGSGGDAGG

SEQ ID NO: 1008571 - protein, 11 aa, Mycobacterium
GAGGGNPARTY

SEQ ID NO: 1008572 - protein, 72 aa, Mycobacterium
GAGGGTGGSGGDGTTEAGRGGDGGNGGSAGLIGNGGAGAVAGGGGTGPISRGSGDPGAGGSGGLLFGRPGPS

SEQ ID NO: 1008573 - protein, 5 aa, Mycobacterium
GAGGH

SEQ ID NO: 1008574 - protein, 215 aa, Mycobacterium
GAGGHGGGGGMGGTGGTGAAAAAGINAAAGGTGGDGGAAGAGGAAGAGGFGGSAGSYGNGGGGGNGGTGGAGANAVAGTGDNGSDGAAGGQGGSGGNSGAGGTNGSGGNGGLGGAGGDGGSGTADTGGGAGNGGSGGKGGTGGVSGVAGSGGAGGTGGEGGGGGTGGKGGAAGTGANATAGTDRYGGYAADGGGGGGGGYGGKQHPGDRRGWRRG

SEQ ID NO: 1008575 - protein, 5 aa, Mycobacterium
GAGGI

SEQ ID NO: 1008576 - protein, 39 aa, Mycobacterium
GAGGNGGAGGAGGNGGDISPLAGGNAGNGGVGGSGGDAG

SEQ ID NO: 1008577 - protein, 9 aa, Mycobacterium
GAGGNGGAL

SEQ ID NO: 1008578 - protein, 14 aa, Mycobacterium
GAGGNGGDGGNGGG

SEQ ID NO: 1008579 - protein, 18 aa, Mycobacterium
GAGGNGGNGGAGQAAAGD

SEQ ID NO: 1008580 - protein, 7 aa, Mycobacterium
GAGGNRD

SEQ ID NO: 1008581 - protein, 18 aa, Mycobacterium
GAGGPGGTGGVVGAGGAA

SEQ ID NO: 1008582 - protein, 7 aa, Mycobacterium
GAGGPPF

SEQ ID NO: 1008583 - protein, 39 aa, Mycobacterium; identical to SEQ ID NO: 478155

SEQ ID NO: 1008584 - protein, 85 aa, Mycobacterium
GAGGSGGAGGNGADGISGGIGESGGDGGSAGNGGAGGSGGAGGAGGAAGDGGAGGVGGAGGNGGAGGLSQAAGFSDGIQGGRWSR

SEQ ID NO: 1008585 - protein, 110 aa, Mycobacterium
GAGGSGGGGGDSVGLQSGAGGGGAGGDGGLLNGTGGAGGAGGDGGSALSGGTGGNGGAGGAGGDAELTGDGGSGGAGGDGGSPGGTGAAGGAGGDGGQRGGSPGAPGAAG

SEQ ID NO: 1008586 - protein, 10 aa, Mycobacterium
GAGGSGGTGG

SEQ ID NO: 1008587 - protein, 22 aa, Mycobacterium
GAGGTGGAGGLGAAGGAGGNGG

SEQ ID NO: 1008588 - protein, 27 aa, Mycobacterium
GAGGTGGAGGTGTSGGGGMGGAGGQAG

SEQ ID NO: 1008589 - protein, 8 aa, Mycobacterium
GAGGTGGM

SEQ ID NO: 1008590 - protein, 5 aa, Mycobacterium
GAGGV

SEQ ID NO: 1008591 - protein, 6 aa, Mycobacterium
GAGGVA

SEQ ID NO: 1008592 - protein, 11 aa, Mycobacterium
GAGGVGASAGL

SEQ ID NO: 1008593 - protein, 130 aa, Mycobacterium
GAGGVGGDGGNGTNGVGGAGGHGGMGGNAGSSDAANGAVGSRGGDGGDGGKGGQGTTGGDGGNGGSAGKGGTGGAAAQTNDAGDGGDGGASSTSTGGAPGGVGGDGDDGDPPTGQTGGGGTGGGGGAPGV

SEQ ID NO: 1008594 - protein, 30 aa, Mycobacterium; identical to SEQ ID NO: 397100

SEQ ID NO: 1008595 - protein, 62 aa, Mycobacterium
GAGHDGHIGGGAGGTGGAGGNGTSADGVGHGGNGGIGGNGNSASNGGGDGGNGGAGGTGGHG

SEQ ID NO: 1008596 - protein, 7 aa, Mycobacterium
GAGHGDG

SEQ ID NO: 1008597 - protein, 6 aa, Mycobacterium
GAGIDA

SEQ ID NO: 1008598 - protein, 6 aa, Mycobacterium
GAGISR

SEQ ID NO: 1008599 - protein, 5 aa, Mycobacterium
GAGKT

SEQ ID NO: 1008600 - protein, 6 aa, Mycobacterium
GAGKTS

SEQ ID NO: 1008601 - protein, 8 aa, Mycobacterium
GAGLEERE

SEQ ID NO: 1008602 - protein, 8 aa, Mycobacterium
GAGLGPAD

SEQ ID NO: 1008603 - protein, 6 aa, Mycobacterium
GAGLPV

SEQ ID NO: 1008604 - protein, 12 aa, Mycobacterium
GAGLSAQASAAL

SEQ ID NO: 1008605 - protein, 15 aa, Mycobacterium
GAGLSGDLSAGLPSV

SEQ ID NO: 1008606 - protein, 8 aa, Mycobacterium
GAGLSGQA

SEQ ID NO: 1008607 - protein, 7 aa, Mycobacterium
GAGLTDN

SEQ ID NO: 1008608 - protein, 8 aa, Mycobacterium
GAGNETTT

SEQ ID NO: 1008609 - protein, 7 aa, Mycobacterium
GAGNIGN

SEQ ID NO: 1008610 - protein, 11 aa, Mycobacterium
GAGNRAGDGFD

SEQ ID NO: 1008611 - protein, 4 aa, Mycobacterium
GAGP

SEQ ID NO: 1008612 - protein, 6 aa, Mycobacterium
GAGPGQ

SEQ ID NO: 1008613 - protein, 5 aa, Mycobacterium
GAGPR

SEQ ID NO: 1008614 - protein, 7 aa, Mycobacterium
GAGPRKD

SEQ ID NO: 1008615 - protein, 9 aa, Mycobacterium
GAGPRSATE

SEQ ID NO: 1008616 - protein, 7 aa, Mycobacterium
GAGPSSL

SEQ ID NO: 1008617 - protein, 7 aa, Mycobacterium
GAGQGSP

SEQ ID NO: 1008618 - protein, 6 aa, Mycobacterium
GAGQID

SEQ ID NO: 1008619 - protein, 9 aa, Mycobacterium
GAGQMPARQ

SEQ ID NO: 1008620 - protein, 9 aa, Mycobacterium
GAGQQHGPA

SEQ ID NO: 1008621 - protein, 4 aa, Mycobacterium
GAGR

SEQ ID NO: 1008622 - protein, 5 aa, Mycobacterium
GAGRD

SEQ ID NO: 1008623 - protein, 11 aa, Mycobacterium
GAGRGGRDSAL

SEQ ID NO: 1008624 - protein, 5 aa, Mycobacterium
GAGRI

SEQ ID NO: 1008625 - protein, 17 aa, Mycobacterium
GAGRKADSSDESGLRPR

SEQ ID NO: 1008626 - protein, 9 aa, Mycobacterium
GAGRRYGKP

SEQ ID NO: 1008627 - protein, 10 aa, Mycobacterium
GAGSAPGPKA

SEQ ID NO: 1008628 - protein, 9 aa, Mycobacterium
GAGSDNTVT

SEQ ID NO: 1008629 - protein, 10 aa, Mycobacterium
GAGSDNTVTL

SEQ ID NO: 1008630 - protein, 9 aa, Mycobacterium
GAGSGIGRG

SEQ ID NO: 1008631 - protein, 10 aa, Mycobacterium
GAGSNALGAN

SEQ ID NO: 1008632 - protein, 11 aa, Mycobacterium
GAGSNDVGDLD

SEQ ID NO: 1008633 - protein, 14 aa, Mycobacterium
GAGSPDQDSWPEDA

SEQ ID NO: 1008634 - protein, 7 aa, Mycobacterium
GAGSSVA

SEQ ID NO: 1008635 - protein, 16 aa, Mycobacterium
GAGSYAAAEAANASPL

SEQ ID NO: 1008636 - protein, 17 aa, Mycobacterium
GAGSYAAAEAANTTPLQ

SEQ ID NO: 1008637 - protein, 8 aa, Mycobacterium
GAGTESRA

SEQ ID NO: 1008638 - protein, 5 aa, Mycobacterium
GAGTF

SEQ ID NO: 1008639 - protein, 6 aa, Mycobacterium
GAGTGV

SEQ ID NO: 1008640 - protein, 5 aa, Mycobacterium
GAGTN

SEQ ID NO: 1008641 - protein, 6 aa, Mycobacterium
GAGTRW

SEQ ID NO: 1008642 - protein, 8 aa, Mycobacterium
GAGTTGLG

SEQ ID NO: 1008643 - protein, 16 aa, Mycobacterium
GAGTYASAEAANAAPF

SEQ ID NO: 1008644 - protein, 6 aa, Mycobacterium
GAGVDP

SEQ ID NO: 1008645 - protein, 9 aa, Mycobacterium
GAGYPPPAI

SEQ ID NO: 1008646 - protein, 8 aa, Mycobacterium
GAHADTGV

SEQ ID NO: 1008647 - protein, 7 aa, Mycobacterium
GAHGGTV

SEQ ID NO: 1008648 - protein, 14 aa, Mycobacterium
GAHKYSPDVSPKQM

SEQ ID NO: 1008649 - protein, 4 aa, Mycobacterium
GAHP

SEQ ID NO: 1008650 - protein, 8 aa, Mycobacterium
GAHTDPHT

SEQ ID NO: 1008651 - protein, 6 aa, Mycobacterium
GAIGRR

SEQ ID NO: 1008652 - protein, 4 aa, Mycobacterium
GAIP

SEQ ID NO: 1008653 - protein, 13 aa, Mycobacterium
GAIPNAGRSEVAA

SEQ ID NO: 1008654 - protein, 8 aa, Mycobacterium
GAIQTTPS

SEQ ID NO: 1008655 - protein, 20 aa, Mycobacterium
GAISGLPNAGLDAANAAPTV

SEQ ID NO: 1008656 - protein, 7 aa, Mycobacterium
GAITGPA

SEQ ID NO: 1008657 - protein, 14 aa, Mycobacterium
GAKADGRDTIDGQT

SEQ ID NO: 1008658 - protein, 13 aa, Mycobacterium
GAKAKATKQTINT

SEQ ID NO: 1008659 - protein, 8 aa, Mycobacterium
GAKAPKLI

SEQ ID NO: 1008660 - protein, 14 aa, Mycobacterium
GAKARQAKSKARLQ

SEQ ID NO: 1008661 - protein, 4 aa, Mycobacterium
GAKG

SEQ ID NO: 1008662 - protein, 19 aa, Mycobacterium
GAKHTGKTAAARPVPPPRV

SEQ ID NO: 1008663 - protein, 15 aa, Mycobacterium
GAKIDSKGRPLPGAG

SEQ ID NO: 1008664 - protein, 6 aa, Mycobacterium
GAKLPS

SEQ ID NO: 1008665 - protein, 4 aa, Mycobacterium
GAKN

SEQ ID NO: 1008666 - protein, 8 aa, Mycobacterium
GAKPLSEN

SEQ ID NO: 1008667 - protein, 10 aa, Mycobacterium
GAKPPKGQGF

SEQ ID NO: 1008668 - protein, 10 aa, Mycobacterium
GAKPTAERRT

SEQ ID NO: 1008669 - protein, 10 aa, Mycobacterium
GAKPVGADTG

SEQ ID NO: 1008670 - protein, 8 aa, Mycobacterium
GAKPVSGS

SEQ ID NO: 1008671 - protein, 12 aa, Mycobacterium
GAKQQDKPAAQV

SEQ ID NO: 1008672 - protein, 9 aa, Mycobacterium
GAKSVPAQK

SEQ ID NO: 1008673 - protein, 4 aa, Mycobacterium
GAKT

SEQ ID NO: 1008674 - protein, 9 aa, Mycobacterium
GAKTLRGGK

SEQ ID NO: 1008675 - protein, 7 aa, Mycobacterium
GAKVGSA

SEQ ID NO: 1008676 - protein, 10 aa, Mycobacterium
GALAAPGGEG

SEQ ID NO: 1008677 - protein, 7 aa, Mycobacterium
GALAGQG

SEQ ID NO: 1008678 - protein, 11 aa, Mycobacterium
GALAPAAMPNP

SEQ ID NO: 1008679 - protein, 18 aa, Mycobacterium
GALDQTARDRNIRRRSRE

SEQ ID NO: 1008680 - protein, 7 aa, Mycobacterium
GALGDTA

SEQ ID NO: 1008681 - protein, 7 aa, Mycobacterium
GALGERA

SEQ ID NO: 1008682 - protein, 8 aa, Mycobacterium
GALGGGAA

SEQ ID NO: 1008683 - protein, 65 aa, Mycobacterium
GALGGHGGAGGVGGVGATGGAGGLGATGAEGVTGGNLHGGDGGSGGKGGVGGAGGDGGAGGKAQV

SEQ ID NO: 1008684 - protein, 8 aa, Mycobacterium
GALGPRSA

SEQ ID NO: 1008685 - protein, 5 aa, Mycobacterium
GALHN

SEQ ID NO: 1008686 - protein, 6 aa, Mycobacterium
GALPAA

SEQ ID NO: 1008687 - protein, 6 aa, Mycobacterium
GALPET

SEQ ID NO: 1008688 - protein, 8 aa, Mycobacterium
GALPGQNA

SEQ ID NO: 1008689 - protein, 9 aa, Mycobacterium
GALPPGTRL

SEQ ID NO: 1008690 - protein, 9 aa, Mycobacterium
GALPPPEPA

SEQ ID NO: 1008691 - protein, 7 aa, Mycobacterium
GALPRGA

SEQ ID NO: 1008692 - protein, 16 aa, Mycobacterium
GALTDQTARQDAAEQA

SEQ ID NO: 1008693 - protein, 9 aa, Mycobacterium
GALTERGEV

SEQ ID NO: 1008694 - protein, 10 aa, Mycobacterium
GAMGGSASEE

SEQ ID NO: 1008695 - protein, 4 aa, Mycobacterium
GAMS

SEQ ID NO: 1008696 - protein, 8 aa, Mycobacterium
GAMSQSGY

SEQ ID NO: 1008697 - protein, 4 aa, Mycobacterium
GANA

SEQ ID NO: 1008698 - protein, 11 aa, Mycobacterium
GANAGPDRSAI

SEQ ID NO: 1008699 - protein, 8 aa, Mycobacterium
GANDAVTK

SEQ ID NO: 1008700 - protein, 10 aa, Mycobacterium
GANDGGGSIR

SEQ ID NO: 1008701 - protein, 7 aa, Mycobacterium
GANDLGG

SEQ ID NO: 1008702 - protein, 11 aa, Mycobacterium
GANDPARSGFE

SEQ ID NO: 1008703 - protein, 17 aa, Mycobacterium
GANEYSQAEAANATFTA

SEQ ID NO: 1008704 - protein, 11 aa, Mycobacterium
GANFQTPPSVQ

SEQ ID NO: 1008705 - protein, 17 aa, Mycobacterium
GANFSGGLDESKPDGFD

SEQ ID NO: 1008706 - protein, 9 aa, Mycobacterium
GANGAGKST

SEQ ID NO: 1008707 - protein, 9 aa, Mycobacterium
GANGAVKSS

SEQ ID NO: 1008708 - protein, 11 aa, Mycobacterium
GANGGAAGNVP

SEQ ID NO: 1008709 - protein, 8 aa, Mycobacterium
GANGGAIR

SEQ ID NO: 1008710 - protein, 10 aa, Mycobacterium
GANGSGKSNL

SEQ ID NO: 1008711 - protein, 6 aa, Mycobacterium
GANINS

SEQ ID NO: 1008712 - protein, 4 aa, Mycobacterium
GANN

SEQ ID NO: 1008713 - protein, 6 aa, Mycobacterium
GANQTM

SEQ ID NO: 1008714 - protein, 8 aa, Mycobacterium
GANREQAL

SEQ ID NO: 1008715 - protein, 7 aa, Mycobacterium
GANRGLG

SEQ ID NO: 1008716 - protein, 21 aa, Mycobacterium
GANRTAAELSPAEKDAVSHRG

SEQ ID NO: 1008717 - protein, 7 aa, Mycobacterium
GANSDSM

SEQ ID NO: 1008718 - protein, 11 aa, Mycobacterium
GANVTPEEGKA

SEQ ID NO: 1008719 - protein, 4 aa, Mycobacterium
GANW

SEQ ID NO: 1008720 - protein, 17 aa, Mycobacterium
GAPAALADSVRNGDTQV

SEQ ID NO: 1008721 - protein, 13 aa, Mycobacterium
GAPAAPAGPAVTH

SEQ ID NO: 1008722 - protein, 8 aa, Mycobacterium
GAPADEDR

SEQ ID NO: 1008723 - protein, 11 aa, Mycobacterium
GAPAGVTPNPL

SEQ ID NO: 1008724 - protein, 17 aa, Mycobacterium
GAPATLADSVRNGDTQL

SEQ ID NO: 1008725 - protein, 4 aa, Mycobacterium
GAPD

SEQ ID NO: 1008726 - protein, 6 aa, Mycobacterium
GAPDDR

SEQ ID NO: 1008727 - protein, 5 aa, Mycobacterium
GAPDG

SEQ ID NO: 1008728 - protein, 10 aa, Mycobacterium
GAPDTQRGVA

SEQ ID NO: 1008729 - protein, 4 aa, Mycobacterium
GAPE

SEQ ID NO: 1008730 - protein, 5 aa, Mycobacterium
GAPEA

SEQ ID NO: 1008731 - protein, 9 aa, Mycobacterium
GAPEGTVAA

SEQ ID NO: 1008732 - protein, 29 aa, Mycobacterium
GAPENSGSEQSKAHSEGRASRFREETRAE

SEQ ID NO: 1008733 - protein, 7 aa, Mycobacterium
GAPESAR

SEQ ID NO: 1008734 - protein, 9 aa, Mycobacterium
GAPETKVAG

SEQ ID NO: 1008735 - protein, 7 aa, Mycobacterium
GAPFSGA

SEQ ID NO: 1008736 - protein, 9 aa, Mycobacterium
GAPGAGEVD

SEQ ID NO: 1008737 - protein, 7 aa, Mycobacterium
GAPGATL

SEQ ID NO: 1008738 - protein, 6 aa, Mycobacterium
GAPGDG

SEQ ID NO: 1008739 - protein, 7 aa, Mycobacterium
GAPGQGE

SEQ ID NO: 1008740 - protein, 11 aa, Mycobacterium
GAPGQGSYAAA

SEQ ID NO: 1008741 - protein, 6 aa, Mycobacterium
GAPHND

SEQ ID NO: 1008742 - protein, 10 aa, Mycobacterium
GAPLEDGQAD

SEQ ID NO: 1008743 - protein, 6 aa, Mycobacterium
GAPLPT

SEQ ID NO: 1008744 - protein, 4 aa, Mycobacterium
GAPM

SEQ ID NO: 1008745 - protein, 7 aa, Mycobacterium
GAPNDGW

SEQ ID NO: 1008746 - protein, 5 aa, Mycobacterium
GAPNG

SEQ ID NO: 1008747 - protein, 13 aa, Mycobacterium
GAPPLPSTGEGYR

SEQ ID NO: 1008748 - protein, 19 aa, Mycobacterium
GAPPSLSERDAAAGSLDEV

SEQ ID NO: 1008749 - protein, 14 aa, Mycobacterium
GAPPTSCARQTSRN

SEQ ID NO: 1008750 - protein, 10 aa, Mycobacterium
GAPQAYPPDA

SEQ ID NO: 1008751 - protein, 5 aa, Mycobacterium
GAPQG

SEQ ID NO: 1008752 - protein, 6 aa, Mycobacterium
GAPQLP

SEQ ID NO: 1008753 - protein, 7 aa, Mycobacterium
GAPQRRP

SEQ ID NO: 1008754 - protein, 7 aa, Mycobacterium
GAPQRTA

SEQ ID NO: 1008755 - protein, 7 aa, Mycobacterium
GAPQVNA

SEQ ID NO: 1008756 - protein, 6 aa, Mycobacterium
GAPRED

SEQ ID NO: 1008757 - protein, 5 aa, Mycobacterium
GAPRH

SEQ ID NO: 1008758 - protein, 6 aa, Mycobacterium
GAPRPL

SEQ ID NO: 1008759 - protein, 30 aa, Mycobacterium
GAPRSDLATARSTYGHDTHAPRHRPPPRPS

SEQ ID NO: 1008760 - protein, 22 aa, Mycobacterium
GAPSATPSETTDSTRNLAASTV

SEQ ID NO: 1008761 - protein, 6 aa, Mycobacterium
GAPSGA

SEQ ID NO: 1008762 - protein, 4 aa, Mycobacterium
GAPT

SEQ ID NO: 1008763 - protein, 7 aa, Mycobacterium
GAPTALT

SEQ ID NO: 1008764 - protein, 14 aa, Mycobacterium
GAPTDTRPLDDRED

SEQ ID NO: 1008765 - protein, 7 aa, Mycobacterium
GAPTEQE

SEQ ID NO: 1008766 - protein, 9 aa, Mycobacterium
GAPTITNDG

SEQ ID NO: 1008767 - protein, 9 aa, Mycobacterium
GAPTPASFT

SEQ ID NO: 1008768 - protein, 9 aa, Mycobacterium
GAPTPTETE

SEQ ID NO: 1008769 - protein, 12 aa, Mycobacterium
GAPTTGRDDPDA

SEQ ID NO: 1008770 - protein, 4 aa, Mycobacterium
GAPV

SEQ ID NO: 1008771 - protein, 6 aa, Mycobacterium
GAPWEN

SEQ ID NO: 1008772 - protein, 9 aa, Mycobacterium
GAQAGPRSP

SEQ ID NO: 1008773 - protein, 8 aa, Mycobacterium
GAQANAEE

SEQ ID NO: 1008774 - protein, 8 aa, Mycobacterium
GAQATTGA

SEQ ID NO: 1008775 - protein, 17 aa, Mycobacterium
GAQAYAGAESANASPLR

SEQ ID NO: 1008776 - protein, 7 aa, Mycobacterium
GAQEAEL

SEQ ID NO: 1008777 - protein, 20 aa, Mycobacterium
GAQESAAVPPMGSGEGNPSW

SEQ ID NO: 1008778 - protein, 5 aa, Mycobacterium
GAQGA

SEQ ID NO: 1008779 - protein, 8 aa, Mycobacterium
GAQGASVR

SEQ ID NO: 1008780 - protein, 6 aa, Mycobacterium
GAQGQR

SEQ ID NO: 1008781 - protein, 7 aa, Mycobacterium
GAQGVAE

SEQ ID NO: 1008782 - protein, 6 aa, Mycobacterium
GAQHAR

SEQ ID NO: 1008783 - protein, 7 aa, Mycobacterium
GAQKYPV

SEQ ID NO: 1008784 - protein, 4 aa, Mycobacterium
GAQL

SEQ ID NO: 1008785 - protein, 4 aa, Mycobacterium
GAQM

SEQ ID NO: 1008786 - protein, 6 aa, Mycobacterium
GAQNPT

SEQ ID NO: 1008787 - protein, 4 aa, Mycobacterium
GAQP

SEQ ID NO: 1008788 - protein, 7 aa, Mycobacterium
GAQPGDI

SEQ ID NO: 1008789 - protein, 8 aa, Mycobacterium
GAQPHPYR

SEQ ID NO: 1008790 - protein, 22 aa, Mycobacterium
GAQPPPNRRPATAVARTRLPWQ

SEQ ID NO: 1008791 - protein, 12 aa, Mycobacterium
GAQQRAQSLGGL

SEQ ID NO: 1008792 - protein, 7 aa, Mycobacterium
GAQRPEL

SEQ ID NO: 1008793 - protein, 7 aa, Mycobacterium
GAQSNHV

SEQ ID NO: 1008794 - protein, 11 aa, Mycobacterium
GAQTGSYSEPT

SEQ ID NO: 1008795 - protein, 6 aa, Mycobacterium
GAQTRE

SEQ ID NO: 1008796 - protein, 23 aa, Mycobacterium
GAQTSPADFGYTADGLPDPAASK

SEQ ID NO: 1008797 - protein, 10 aa, Mycobacterium
GARADGHDHA

SEQ ID NO: 1008798 - protein, 8 aa, Mycobacterium
GARADKGL

SEQ ID NO: 1008799 - protein, 8 aa, Mycobacterium
GARADSVP

SEQ ID NO: 1008800 - protein, 7 aa, Mycobacterium
GARAQAR

SEQ ID NO: 1008801 - protein, 15 aa, Mycobacterium
GARDEPLRAADTDRI

SEQ ID NO: 1008802 - protein, 6 aa, Mycobacterium
GARDGQ

SEQ ID NO: 1008803 - protein, 8 aa, Mycobacterium
GARDGRTV

SEQ ID NO: 1008804 - protein, 4 aa, Mycobacterium
GARE

SEQ ID NO: 1008805 - protein, 7 aa, Mycobacterium
GAREDLP

SEQ ID NO: 1008806 - protein, 11 aa, Mycobacterium
GAREGTLAPGQ

SEQ ID NO: 1008807 - protein, 11 aa, Mycobacterium
GARFRGDRGAL

SEQ ID NO: 1008808 - protein, 7 aa, Mycobacterium
GARGAAR

SEQ ID NO: 1008809 - protein, 4 aa, Mycobacterium
GARH

SEQ ID NO: 1008810 - protein, 18 aa, Mycobacterium
GARKGLADTALRTADSGY

SEQ ID NO: 1008811 - protein, 7 aa, Mycobacterium
GARLDSD

SEQ ID NO: 1008812 - protein, 5 aa, Mycobacterium
GARLR

SEQ ID NO: 1008813 - protein, 5 aa, Mycobacterium
GARNS

SEQ ID NO: 1008814 - protein, 9 aa, Mycobacterium
GARNSDFEA

SEQ ID NO: 1008815 - protein, 11 aa, Mycobacterium
GARNSSIGEDE

SEQ ID NO: 1008816 - protein, 5 aa, Mycobacterium
GARPG

SEQ ID NO: 1008817 - protein, 6 aa, Mycobacterium
GARPGS

SEQ ID NO: 1008818 - protein, 15 aa, Mycobacterium
GARPRRRGGPDGRDA

SEQ ID NO: 1008819 - protein, 5 aa, Mycobacterium
GARPS

SEQ ID NO: 1008820 - protein, 12 aa, Mycobacterium
GARQTKSQGTAA

SEQ ID NO: 1008821 - protein, 9 aa, Mycobacterium
GARQVPGRH

SEQ ID NO: 1008822 - protein, 14 aa, Mycobacterium
GARRGGAVSGIGGH

SEQ ID NO: 1008823 - protein, 10 aa, Mycobacterium
GARRKPRSVE

SEQ ID NO: 1008824 - protein, 33 aa, Mycobacterium
GARRSTGPECGGDRQASADAKADGVRAAGASVF

SEQ ID NO: 1008825 - protein, 7 aa, Mycobacterium
GARSQAL

SEQ ID NO: 1008826 - protein, 8 aa, Mycobacterium
GARSRGVT

SEQ ID NO: 1008827 - protein, 8 aa, Mycobacterium
GARTGAKG

SEQ ID NO: 1008828 - protein, 6 aa, Mycobacterium
GARTSI

SEQ ID NO: 1008829 - protein, 5 aa, Mycobacterium
GARVG

SEQ ID NO: 1008830 - protein, 5 aa, Mycobacterium
GARVT

SEQ ID NO: 1008831 - protein, 14 aa, Mycobacterium
GARYRPQPAARTAA

SEQ ID NO: 1008832 - protein, 11 aa, Mycobacterium
GASAAAASLTP

SEQ ID NO: 1008833 - protein, 7 aa, Mycobacterium
GASADRM

SEQ ID NO: 1008834 - protein, 16 aa, Mycobacterium
GASAEQAAAKIGSGAV

SEQ ID NO: 1008835 - protein, 8 aa, Mycobacterium
GASAGAAV

SEQ ID NO: 1008836 - protein, 13 aa, Mycobacterium
GASAPAGVLDAGQ

SEQ ID NO: 1008837 - protein, 5 aa, Mycobacterium
GASAV

SEQ ID NO: 1008838 - protein, 17 aa, Mycobacterium
GASAYTGAEAANASPLQ

SEQ ID NO: 1008839 - protein, 8 aa, Mycobacterium
GASDPTVV

SEQ ID NO: 1008840 - protein, 14 aa, Mycobacterium
GASFPYRKDPEDKN

SEQ ID NO: 1008841 - protein, 10 aa, Mycobacterium
GASGARPEHT

SEQ ID NO: 1008842 - protein, 10 aa, Mycobacterium
GASGGTPRQR

SEQ ID NO: 1008843 - protein, 8 aa, Mycobacterium
GASGGVGS

SEQ ID NO: 1008844 - protein, 6 aa, Mycobacterium
GASGKP

SEQ ID NO: 1008845 - protein, 6 aa, Mycobacterium
GASGMG

SEQ ID NO: 1008846 - protein, 11 aa, Mycobacterium
GASGPRSSWRA

SEQ ID NO: 1008847 - protein, 10 aa, Mycobacterium
GASGSGKSSL

SEQ ID NO: 1008848 - protein, 16 aa, Mycobacterium
GASGSYASAEAANVTP

SEQ ID NO: 1008849 - protein, 9 aa, Mycobacterium
GASGTSPTF

SEQ ID NO: 1008850 - protein, 8 aa, Mycobacterium
GASGYAGG

SEQ ID NO: 1008851 - protein, 8 aa, Mycobacterium
GASKGSIA

SEQ ID NO: 1008852 - protein, 4 aa, Mycobacterium
GASL

SEQ ID NO: 1008853 - protein, 7 aa, Mycobacterium
GASLAGN

SEQ ID NO: 1008854 - protein, 8 aa, Mycobacterium
GASLDGEQ

SEQ ID NO: 1008855 - protein, 5 aa, Mycobacterium
GASLS

SEQ ID NO: 1008856 - protein, 12 aa, Mycobacterium
GASMEGTNTGSF

SEQ ID NO: 1008857 - protein, 9 aa, Mycobacterium
GASNEQVTE

SEQ ID NO: 1008858 - protein, 9 aa, Mycobacterium
GASPAIGSV

SEQ ID NO: 1008859 - protein, 9 aa, Mycobacterium
GASPGIGAA

SEQ ID NO: 1008860 - protein, 9 aa, Mycobacterium
GASPGSDLA

SEQ ID NO: 1008861 - protein, 7 aa, Mycobacterium
GASPRAE

SEQ ID NO: 1008862 - protein, 11 aa, Mycobacterium
GASPYKRARER

SEQ ID NO: 1008863 - protein, 8 aa, Mycobacterium
GASQNIGE

SEQ ID NO: 1008864 - protein, 9 aa, Mycobacterium
GASQSEALA

SEQ ID NO: 1008865 - protein, 25 aa, Mycobacterium
GASRGDPGPFTNGNGPELANGDSLS

SEQ ID NO: 1008866 - protein, 7 aa, Mycobacterium
GASRGLG

SEQ ID NO: 1008867 - protein, 5 aa, Mycobacterium
GASRP

SEQ ID NO: 1008868 - protein, 4 aa, Mycobacterium
GASS

SEQ ID NO: 1008869 - protein, 7 aa, Mycobacterium
GASSATR

SEQ ID NO: 1008870 - protein, 8 aa, Mycobacterium
GASSGIGE

SEQ ID NO: 1008871 - protein, 6 aa, Mycobacterium
GASSVA

SEQ ID NO: 1008872 - protein, 13 aa, Mycobacterium
GASSVRLVNQTGY

SEQ ID NO: 1008873 - protein, 4 aa, Mycobacterium
GAST

SEQ ID NO: 1008874 - protein, 10 aa, Mycobacterium
GASTEKVAQV

SEQ ID NO: 1008875 - protein, 8 aa, Mycobacterium
GASTGIGK

SEQ ID NO: 1008876 - protein, 8 aa, Mycobacterium
GASTPEEL

SEQ ID NO: 1008877 - protein, 4 aa, Mycobacterium
GASV

SEQ ID NO: 1008878 - protein, 15 aa, Mycobacterium
GASVSAVAGGRPVET

SEQ ID NO: 1008879 - protein, 12 aa, Mycobacterium
GASYTRDGESFT

SEQ ID NO: 1008880 - protein, 5 aa, Mycobacterium
GATAA

SEQ ID NO: 1008881 - protein, 14 aa, Mycobacterium
GATAEVNDAVRGAG

SEQ ID NO: 1008882 - protein, 9 aa, Mycobacterium
GATALANDA

SEQ ID NO: 1008883 - protein, 7 aa, Mycobacterium
GATAPRV

SEQ ID NO: 1008884 - protein, 8 aa, Mycobacterium
GATAQEAI

SEQ ID NO: 1008885 - protein, 10 aa, Mycobacterium
GATARDGASS

SEQ ID NO: 1008886 - protein, 10 aa, Mycobacterium
GATASLAPSA

SEQ ID NO: 1008887 - protein, 8 aa, Mycobacterium
GATDPEIE

SEQ ID NO: 1008888 - protein, 10 aa, Mycobacterium
GATDTAPRFT

SEQ ID NO: 1008889 - protein, 4 aa, Mycobacterium
GATE

SEQ ID NO: 1008890 - protein, 8 aa, Mycobacterium
GATEQKDM

SEQ ID NO: 1008891 - protein, 8 aa, Mycobacterium
GATEYAAA

SEQ ID NO: 1008892 - protein, 12 aa, Mycobacterium
GATFSDAAARDA

SEQ ID NO: 1008893 - protein, 8 aa, Mycobacterium
GATGAFRS

SEQ ID NO: 1008894 - protein, 10 aa, Mycobacterium
GATGHRLDDP

SEQ ID NO: 1008895 - protein, 9 aa, Mycobacterium
GATGLKPTW

SEQ ID NO: 1008896 - protein, 6 aa, Mycobacterium
GATGLP

SEQ ID NO: 1008897 - protein, 9 aa, Mycobacterium
GATGNFTQT

SEQ ID NO: 1008898 - protein, 8 aa, Mycobacterium
GATGPSDR

SEQ ID NO: 1008899 - protein, 15 aa, Mycobacterium
GATGSGAGEEQGVQD

SEQ ID NO: 1008900 - protein, 8 aa, Mycobacterium
GATGSRLV

SEQ ID NO: 1008901 - protein, 8 aa, Mycobacterium
GATGSSPD

SEQ ID NO: 1008902 - protein, 10 aa, Mycobacterium
GATGTGKTKT

SEQ ID NO: 1008903 - protein, 7 aa, Mycobacterium
GATGVRG

SEQ ID NO: 1008904 - protein, 5 aa, Mycobacterium
GATHA

SEQ ID NO: 1008905 - protein, 6 aa, Mycobacterium
GATHAP

SEQ ID NO: 1008906 - protein, 9 aa, Mycobacterium
GATKTRERE

SEQ ID NO: 1008907 - protein, 12 aa, Mycobacterium
GATLDSTIGRTM

SEQ ID NO: 1008908 - protein, 5 aa, Mycobacterium
GATNA

SEQ ID NO: 1008909 - protein, 15 aa, Mycobacterium
GATNDPSFTTDHAEQ

SEQ ID NO: 1008910 - protein, 8 aa, Mycobacterium
GATPALTE

SEQ ID NO: 1008911 - protein, 13 aa, Mycobacterium
GATPATSPTTASK

SEQ ID NO: 1008912 - protein, 7 aa, Mycobacterium
GATPLCQ

SEQ ID NO: 1008913 - protein, 6 aa, Mycobacterium
GATPQW

SEQ ID NO: 1008914 - protein, 5 aa, Mycobacterium
GATPS

SEQ ID NO: 1008915 - protein, 8 aa, Mycobacterium
GATPSQRY

SEQ ID NO: 1008916 - protein, 8 aa, Mycobacterium
GATQAPKG

SEQ ID NO: 1008917 - protein, 11 aa, Mycobacterium
GATRSSGVSVV

SEQ ID NO: 1008918 - protein, 8 aa, Mycobacterium
GATSGHTQ

SEQ ID NO: 1008919 - protein, 7 aa, Mycobacterium
GATSGPV

SEQ ID NO: 1008920 - protein, 7 aa, Mycobacterium
GATSGRR

SEQ ID NO: 1008921 - protein, 6 aa, Mycobacterium
GATSPP

SEQ ID NO: 1008922 - protein, 5 aa, Mycobacterium
GATTA

SEQ ID NO: 1008923 - protein, 5 aa, Mycobacterium
GATTF

SEQ ID NO: 1008924 - protein, 7 aa, Mycobacterium
GATTIGG

SEQ ID NO: 1008925 - protein, 9 aa, Mycobacterium
GATTPDART

SEQ ID NO: 1008926 - protein, 9 aa, Mycobacterium
GATVEDPHE

SEQ ID NO: 1008927 - protein, 7 aa, Mycobacterium
GATVNAT

SEQ ID NO: 1008928 - protein, 9 aa, Mycobacterium
GATVTQTDD

SEQ ID NO: 1008929 - protein, 10 aa, Mycobacterium
GATYDGAGTN

SEQ ID NO: 1008930 - protein, 8 aa, Mycobacterium
GAVAGQDS

SEQ ID NO: 1008931 - protein, 6 aa, Mycobacterium
GAVDAK

SEQ ID NO: 1008932 - protein, 9 aa, Mycobacterium
GAVGCPTGA

SEQ ID NO: 1008933 - protein, 10 aa, Mycobacterium
GAVGPAGHPI

SEQ ID NO: 1008934 - protein, 9 aa, Mycobacterium
GAVGPPSAQ

SEQ ID NO: 1008935 - protein, 5 aa, Mycobacterium
GAVHG

SEQ ID NO: 1008936 - protein, 6 aa, Mycobacterium
GAVKSS

SEQ ID NO: 1008937 - protein, 53 aa, Mycobacterium; identical to SEQ ID NO: 480007

SEQ ID NO: 1008938 - protein, 6 aa, Mycobacterium
GAVPAE

SEQ ID NO: 1008939 - protein, 7 aa, Mycobacterium
GAVPALP

SEQ ID NO: 1008940 - protein, 15 aa, Mycobacterium
GAVRSRRRDAARHLS

SEQ ID NO: 1008941 - protein, 27 aa, Mycobacterium
GAVSGRGAPIVSNDGDIAGAERFDQGK

SEQ ID NO: 1008942 - protein, 7 aa, Mycobacterium
GAVSPGA

SEQ ID NO: 1008943 - protein, 5 aa, Mycobacterium
GAVTG

SEQ ID NO: 1008944 - protein, 7 aa, Mycobacterium
GAVTGKT

SEQ ID NO: 1008945 - protein, 6 aa, Mycobacterium
GAWDDP

SEQ ID NO: 1008946 - protein, 7 aa, Mycobacterium
GAYPSTL

SEQ ID NO: 1008947 - protein, 7 aa, Mycobacterium
GAYSEPT

SEQ ID NO: 1008948 - protein, 4 aa, Mycobacterium
GAYT

SEQ ID NO: 1008949 - protein, 5 aa, Mycobacterium
GAYTS

SEQ ID NO: 1008950 - protein, 5 aa, Mycobacterium
GCANP

SEQ ID NO: 1008951 - protein, 4 aa, Mycobacterium
GCDQ

SEQ ID NO: 1008952 - protein, 6 aa, Mycobacterium
GCEPTE

SEQ ID NO: 1008953 - protein, 31 aa, Mycobacterium
GCGEQSGQAPEGSVGRRQPVSGPLRRGCWCF

SEQ ID NO: 1008954 - protein, 8 aa, Mycobacterium
GCGGAPVG

SEQ ID NO: 1008955 - protein, 11 aa, Mycobacterium
GCGGPAAPDIS

SEQ ID NO: 1008956 - protein, 6 aa, Mycobacterium
GCGGQI

SEQ ID NO: 1008957 - protein, 6 aa, Mycobacterium
GCHGGP

SEQ ID NO: 1008958 - protein, 7 aa, Mycobacterium
GCPESSV

SEQ ID NO: 1008959 - protein, 18 aa, Mycobacterium
GCPPTPDQVVAALRSVTG

SEQ ID NO: 1008960 - protein, 24 aa, Mycobacterium
GCRSGGARPLRKRRRPPGRMDDRI

SEQ ID NO: 1008961 - protein, 4 aa, Mycobacterium
GCSR

SEQ ID NO: 1008962 - protein, 10 aa, Mycobacterium
GDAAAAAQGW

SEQ ID NO: 1008963 - protein, 8 aa, Mycobacterium
GDAAATDA

SEQ ID NO: 1008964 - protein, 5 aa, Mycobacterium
GDAAL

SEQ ID NO: 1008965 - protein, 12 aa, Mycobacterium
GDAAQPPSATDL

SEQ ID NO: 1008966 - protein, 6 aa, Mycobacterium
GDADSE

SEQ ID NO: 1008967 - protein, 7 aa, Mycobacterium
GDAEPAL

SEQ ID NO: 1008968 - protein, 7 aa, Mycobacterium
GDAEPDI

SEQ ID NO: 1008969 - protein, 4 aa, Mycobacterium
GDAG

SEQ ID NO: 1008970 - protein, 45 aa, Mycobacterium
GDAGDGGDAGTGGEGGDGGTGGSGAMSGQTGDQGAGGTPGTGGAS

SEQ ID NO: 1008971 - protein, 13 aa, Mycobacterium
GDAGQRQVPRRPE

SEQ ID NO: 1008972 - protein, 7 aa, Mycobacterium
GDAKDVG

SEQ ID NO: 1008973 - protein, 10 aa, Mycobacterium
GDALTASSDL

SEQ ID NO: 1008974 - protein, 33 aa, Mycobacterium; identical to SEQ ID NO: 480320

SEQ ID NO: 1008975 - protein, 14 aa, Mycobacterium
GDANLSGHTYPDQS

SEQ ID NO: 1008976 - protein, 7 aa, Mycobacterium
GDAPEDV

SEQ ID NO: 1008977 - protein, 10 aa, Mycobacterium
GDAPGSKYDK

SEQ ID NO: 1008978 - protein, 13 aa, Mycobacterium
GDAPPDGSRRLDT

SEQ ID NO: 1008979 - protein, 6 aa, Mycobacterium
GDAQEP

SEQ ID NO: 1008980 - protein, 9 aa, Mycobacterium
GDAQQRADA

SEQ ID NO: 1008981 - protein, 5 aa, Mycobacterium
GDARE

SEQ ID NO: 1008982 - protein, 6 aa, Mycobacterium
GDARGA

SEQ ID NO: 1008983 - protein, 7 aa, Mycobacterium
GDARPIP

SEQ ID NO: 1008984 - protein, 11 aa, Mycobacterium
GDASAWAGVGT

SEQ ID NO: 1008985 - protein, 15 aa, Mycobacterium
GDASGAAGATGGGRV

SEQ ID NO: 1008986 - protein, 5 aa, Mycobacterium
GDATA

SEQ ID NO: 1008987 - protein, 16 aa, Mycobacterium
GDATMTAGNSTPLTDG

SEQ ID NO: 1008988 - protein, 6 aa, Mycobacterium
GDATRL

SEQ ID NO: 1008989 - protein, 8 aa, Mycobacterium
GDAVTGAT

SEQ ID NO: 1008990 - protein, 11 aa, Mycobacterium
GDCGCRADPKS

SEQ ID NO: 1008991 - protein, 14 aa, Mycobacterium
GDCGPDSPMARSTK

SEQ ID NO: 1008992 - protein, 4 aa, Mycobacterium
GDCY

SEQ ID NO: 1008993 - protein, 5 aa, Mycobacterium
GDDAL

SEQ ID NO: 1008994 - protein, 6 aa, Mycobacterium
GDDDPD

SEQ ID NO: 1008995 - protein, 4 aa, Mycobacterium
GDDE

SEQ ID NO: 1008996 - protein, 7 aa, Mycobacterium
GDDEATL

SEQ ID NO: 1008997 - protein, 9 aa, Mycobacterium
GDDGQQIED

SEQ ID NO: 1008998 - protein, 5 aa, Mycobacterium
GDDGR

SEQ ID NO: 1008999 - protein, 7 aa, Mycobacterium
GDDHRRR

SEQ ID NO: 1009000 - protein, 7 aa, Mycobacterium
GDDPAAY

SEQ ID NO: 1009001 - protein, 8 aa, Mycobacterium
GDDPDRDF

SEQ ID NO: 1009002 - protein, 5 aa, Mycobacterium
GDDPE

SEQ ID NO: 1009003 - protein, 8 aa, Mycobacterium
GDDPLKRK

SEQ ID NO: 1009004 - protein, 6 aa, Mycobacterium
GDDPLY

SEQ ID NO: 1009005 - protein, 8 aa, Mycobacterium
GDDPPRVH

SEQ ID NO: 1009006 - protein, 5 aa, Mycobacterium
GDDPY

SEQ ID NO: 1009007 - protein, 5 aa, Mycobacterium
GDDQA

SEQ ID NO: 1009008 - protein, 6 aa, Mycobacterium
GDDQPR

SEQ ID NO: 1009009 - protein, 6 aa, Mycobacterium
GDDRTS

SEQ ID NO: 1009010 - protein, 7 aa, Mycobacterium
GDDSTSA

SEQ ID NO: 1009011 - protein, 7 aa, Mycobacterium
GDDTTAR

SEQ ID NO: 1009012 - protein, 8 aa, Mycobacterium
GDDVGTPT

SEQ ID NO: 1009013 - protein, 6 aa, Mycobacterium
GDDVHR

SEQ ID NO: 1009014 - protein, 9 aa, Mycobacterium
GDDVQPGDV

SEQ ID NO: 1009015 - protein, 13 aa, Mycobacterium
GDEDELRDEAGEL

SEQ ID NO: 1009016 - protein, 9 aa, Mycobacterium
GDEEKPAGQ

SEQ ID NO: 1009017 - protein, 9 aa, Mycobacterium
GDEELADGR

SEQ ID NO: 1009018 - protein, 11 aa, Mycobacterium
GDEGKGKATDL

SEQ ID NO: 1009019 - protein, 5 aa, Mycobacterium
GDEHP

SEQ ID NO: 1009020 - protein, 19 aa, Mycobacterium
GDEKKFPGEISGGMRKRAG

SEQ ID NO: 1009021 - protein, 7 aa, Mycobacterium
GDELQAA

SEQ ID NO: 1009022 - protein, 14 aa, Mycobacterium
GDELSEQARANPDA

SEQ ID NO: 1009023 - protein, 5 aa, Mycobacterium
GDEPA

SEQ ID NO: 1009024 - protein, 24 aa, Mycobacterium
GDEPVPQADPGQPWPGQLPAPSPA

SEQ ID NO: 1009025 - protein, 6 aa, Mycobacterium
GDEQLN

SEQ ID NO: 1009026 - protein, 8 aa, Mycobacterium
GDEQRADA

SEQ ID NO: 1009027 - protein, 7 aa, Mycobacterium
GDEQTHE

SEQ ID NO: 1009028 - protein, 5 aa, Mycobacterium
GDERA

SEQ ID NO: 1009029 - protein, 8 aa, Mycobacterium
GDESNGEL

SEQ ID NO: 1009030 - protein, 8 aa, Mycobacterium
GDETCRPQ

SEQ ID NO: 1009031 - protein, 12 aa, Mycobacterium
GDETKAVAGLFS

SEQ ID NO: 1009032 - protein, 5 aa, Mycobacterium
GDEVS

SEQ ID NO: 1009033 - protein, 12 aa, Mycobacterium
GDFAGESRRLGE

SEQ ID NO: 1009034 - protein, 4 aa, Mycobacterium
GDFD

SEQ ID NO: 1009035 - protein, 11 aa, Mycobacterium
GDFDDDDRPAR

SEQ ID NO: 1009036 - protein, 6 aa, Mycobacterium
GDFPES

SEQ ID NO: 1009037 - protein, 5 aa, Mycobacterium
GDGAA

SEQ ID NO: 1009038 - protein, 6 aa, Mycobacterium
GDGADI

SEQ ID NO: 1009039 - protein, 11 aa, Mycobacterium
GDGAEPTSRRP

SEQ ID NO: 1009040 - protein, 9 aa, Mycobacterium
GDGAYTGAG

SEQ ID NO: 1009041 - protein, 13 aa, Mycobacterium
GDGCLSENLDFVT

SEQ ID NO: 1009042 - protein, 7 aa, Mycobacterium
GDGDRAA

SEQ ID NO: 1009043 - protein, 5 aa, Mycobacterium
GDGER

SEQ ID NO: 1009044 - protein, 9 aa, Mycobacterium
GDGFADQPR

SEQ ID NO: 1009045 - protein, 32 aa, Mycobacterium
GDGGAGGAGGGGTVAAGAAGGSGGNGGAGGIG

SEQ ID NO: 1009046 - protein, 15 aa, Mycobacterium
GDGGAGGNGSATYDY

SEQ ID NO: 1009047 - protein, 37 aa, Mycobacterium
GDGGGGGAGGAGYSASGLPPAGIGAPGGAGGAGGSGG

SEQ ID NO: 1009048 - protein, 29 aa, Mycobacterium
GDGGHGGAGGVSFDPAGGDGGNGGQGGNA

SEQ ID NO: 1009049 - protein, 26 aa, Mycobacterium
GDGGLGGDGGIGLAGTGGNGGNGGDA

SEQ ID NO: 1009050 - protein, 26 aa, Mycobacterium
GDGGNGGSGGSGVDPGAGGAAGNGGR

SEQ ID NO: 1009051 - protein, 10 aa, Mycobacterium
GDGGPATGRG

SEQ ID NO: 1009052 - protein, 56 aa, Mycobacterium
GDGGTGSNGGLATAGGAGGDGGAGGKAALIGSGGNGGAGGSGTVDPGGNGGRGGDA

SEQ ID NO: 1009053 - protein, 7 aa, Mycobacterium
GDGLGGS

SEQ ID NO: 1009054 - protein, 8 aa, Mycobacterium
GDGLGGSS

SEQ ID NO: 1009055 - protein, 6 aa, Mycobacterium
GDGLQG

SEQ ID NO: 1009056 - protein, 5 aa, Mycobacterium
GDGLR

SEQ ID NO: 1009057 - protein, 8 aa, Mycobacterium
GDGLTRPA

SEQ ID NO: 1009058 - protein, 6 aa, Mycobacterium
GDGMRD

SEQ ID NO: 1009059 - protein, 16 aa, Mycobacterium
GDGNIGAFSSGTNSVF

SEQ ID NO: 1009060 - protein, 14 aa, Mycobacterium
GDGNIGGGNYGNNN

SEQ ID NO: 1009061 - protein, 7 aa, Mycobacterium
GDGNTGI

SEQ ID NO: 1009062 - protein, 9 aa, Mycobacterium
GDGNVGAAN

SEQ ID NO: 1009063 - protein, 24 aa, Mycobacterium
GDGNWGIGNSGDTNTGIGNSGSFN

SEQ ID NO: 1009064 - protein, 14 aa, Mycobacterium
GDGPLDDEPPVAPT

SEQ ID NO: 1009065 - protein, 20 aa, Mycobacterium
GDGPPVAEPAEHASSVASSM

SEQ ID NO: 1009066 - protein, 6 aa, Mycobacterium
GDGPQL

SEQ ID NO: 1009067 - protein, 8 aa, Mycobacterium
GDGPVRPG

SEQ ID NO: 1009068 - protein, 9 aa, Mycobacterium
GDGPVTDRG

SEQ ID NO: 1009069 - protein, 16 aa, Mycobacterium
GDGQRSYADVVGATAN

SEQ ID NO: 1009070 - protein, 13 aa, Mycobacterium
GDGRSADSIERRV

SEQ ID NO: 1009071 - protein, 7 aa, Mycobacterium
GDGRYTD

SEQ ID NO: 1009072 - protein, 4 aa, Mycobacterium
GDGS

SEQ ID NO: 1009073 - protein, 19 aa, Mycobacterium
GDGSARTGRGYAGQNGPAA

SEQ ID NO: 1009074 - protein, 5 aa, Mycobacterium
GDGST

SEQ ID NO: 1009075 - protein, 17 aa, Mycobacterium
GDGSTISGRISIGGEVK

SEQ ID NO: 1009076 - protein, 16 aa, Mycobacterium
GDGTAGAPGQNGGDGG

SEQ ID NO: 1009077 - protein, 6 aa, Mycobacterium
GDGTDA

SEQ ID NO: 1009078 - protein, 18 aa, Mycobacterium
GDGTDGAPGTGQDGGDGG

SEQ ID NO: 1009079 - protein, 5 aa, Mycobacterium
GDGTN

SEQ ID NO: 1009080 - protein, 19 aa, Mycobacterium
GDGTPDNGDRLAASGAKFD

SEQ ID NO: 1009081 - protein, 7 aa, Mycobacterium
GDGTPQT

SEQ ID NO: 1009082 - protein, 6 aa, Mycobacterium
GDGTVS

SEQ ID NO: 1009083 - protein, 4 aa, Mycobacterium
GDGV

SEQ ID NO: 1009084 - protein, 9 aa, Mycobacterium
GDGYTECTS

SEQ ID NO: 1009085 - protein, 5 aa, Mycobacterium
GDHGA

SEQ ID NO: 1009086 - protein, 8 aa, Mycobacterium
GDHGTEIA

SEQ ID NO: 1009087 - protein, 10 aa, Mycobacterium
GDHHRSDRQQ

SEQ ID NO: 1009088 - protein, 6 aa, Mycobacterium
GDHTDG

SEQ ID NO: 1009089 - protein, 14 aa, Mycobacterium
GDIANSPQTVATGS

SEQ ID NO: 1009090 - protein, 8 aa, Mycobacterium
GDIDTDAM

SEQ ID NO: 1009091 - protein, 5 aa, Mycobacterium
GDIED

SEQ ID NO: 1009092 - protein, 14 aa, Mycobacterium
GDIEEGVTSEASSL

SEQ ID NO: 1009093 - protein, 11 aa, Mycobacterium
GDISQAAYTGD

SEQ ID NO: 1009094 - protein, 4 aa, Mycobacterium
GDIT

SEQ ID NO: 1009095 - protein, 12 aa, Mycobacterium
GDKAHPASRGYT

SEQ ID NO: 1009096 - protein, 9 aa, Mycobacterium
GDKDGAAKV

SEQ ID NO: 1009097 - protein, 9 aa, Mycobacterium
GDKGEADLG

SEQ ID NO: 1009098 - protein, 8 aa, Mycobacterium
GDKGQPCW

SEQ ID NO: 1009099 - protein, 4 aa, Mycobacterium
GDKK

SEQ ID NO: 1009100 - protein, 30 aa, Mycobacterium
GDKKGLGAKRTLAERSATQTAVATAEAALG

SEQ ID NO: 1009101 - protein, 8 aa, Mycobacterium
GDKPPLPF

SEQ ID NO: 1009102 - protein, 10 aa, Mycobacterium
GDKTNNDSYI

SEQ ID NO: 1009103 - protein, 9 aa, Mycobacterium
GDKTPVSVA

SEQ ID NO: 1009104 - protein, 6 aa, Mycobacterium
GDKTSL

SEQ ID NO: 1009105 - protein, 8 aa, Mycobacterium
GDKTYRDF

SEQ ID NO: 1009106 - protein, 4 aa, Mycobacterium
GDKV

SEQ ID NO: 1009107 - protein, 23 aa, Mycobacterium
GDLAGIGSSVAAANAAAAGPTTA

SEQ ID NO: 1009108 - protein, 18 aa, Mycobacterium
GDLAKGHPHAQERDNALS

SEQ ID NO: 1009109 - protein, 21 aa, Mycobacterium
GDLAKPNTDLRKKAAAAVGAS

SEQ ID NO: 1009110 - protein, 31 aa, Mycobacterium; identical to SEQ ID NO: 902848

SEQ ID NO: 1009111 - protein, 7 aa, Mycobacterium
GDLEREK

SEQ ID NO: 1009112 - protein, 8 aa, Mycobacterium
GDLESNAK

SEQ ID NO: 1009113 - protein, 4 aa, Mycobacterium
GDLG

SEQ ID NO: 1009114 - protein, 9 aa, Mycobacterium
GDLGASAAR

SEQ ID NO: 1009115 - protein, 9 aa, Mycobacterium
GDLGDTDSL

SEQ ID NO: 1009116 - protein, 11 aa, Mycobacterium
GDLRADSDTDA

SEQ ID NO: 1009117 - protein, 14 aa, Mycobacterium
GDLSEDVTKDDKTF

SEQ ID NO: 1009118 - protein, 17 aa, Mycobacterium
GDLSGDSVPTGGDDPHK

SEQ ID NO: 1009119 - protein, 30 aa, Mycobacterium
GDLSGLSRAGQTDDKLAARAEETGDAWTPT

SEQ ID NO: 1009120 - protein, 13 aa, Mycobacterium
GDLTEPSPAQVAQ

SEQ ID NO: 1009121 - protein, 5 aa, Mycobacterium
GDLTG

SEQ ID NO: 1009122 - protein, 4 aa, Mycobacterium
GDLV

SEQ ID NO: 1009123 - protein, 7 aa, Mycobacterium
GDNETAR

SEQ ID NO: 1009124 - protein, 7 aa, Mycobacterium
GDNGLSR

SEQ ID NO: 1009125 - protein, 8 aa, Mycobacterium
GDNGSGMH

SEQ ID NO: 1009126 - protein, 9 aa, Mycobacterium
GDNLAHPKA

SEQ ID NO: 1009127 - protein, 4 aa, Mycobacterium
GDNN

SEQ ID NO: 1009128 - protein, 10 aa, Mycobacterium
GDNNGVKATS

SEQ ID NO: 1009129 - protein, 8 aa, Mycobacterium
GDNPDSGV

SEQ ID NO: 1009130 - protein, 5 aa, Mycobacterium
GDNQI

SEQ ID NO: 1009131 - protein, 6 aa, Mycobacterium
GDNQVG

SEQ ID NO: 1009132 - protein, 4 aa, Mycobacterium
GDNS

SEQ ID NO: 1009133 - protein, 5 aa, Mycobacterium
GDNVP

SEQ ID NO: 1009134 - protein, 4 aa, Mycobacterium
GDPA

SEQ ID NO: 1009135 - protein, 9 aa, Mycobacterium
GDPAATAAL

SEQ ID NO: 1009136 - protein, 11 aa, Mycobacterium
GDPADEKTDVG

SEQ ID NO: 1009137 - protein, 8 aa, Mycobacterium
GDPADRRR

SEQ ID NO: 1009138 - protein, 6 aa, Mycobacterium
GDPAEQ

SEQ ID NO: 1009139 - protein, 8 aa, Mycobacterium
GDPALPSA

SEQ ID NO: 1009140 - protein, 7 aa, Mycobacterium
GDPAPEF

SEQ ID NO: 1009141 - protein, 10 aa, Mycobacterium
GDPAPTQELN

SEQ ID NO: 1009142 - protein, 16 aa, Mycobacterium
GDPAQRRAGYSPNPDD

SEQ ID NO: 1009143 - protein, 5 aa, Mycobacterium
GDPAR

SEQ ID NO: 1009144 - protein, 9 aa, Mycobacterium
GDPATPPHW

SEQ ID NO: 1009145 - protein, 16 aa, Mycobacterium
GDPAYGYDTGPANVPT

SEQ ID NO: 1009146 - protein, 13 aa, Mycobacterium
GDPAYGYSTSPPI

SEQ ID NO: 1009147 - protein, 6 aa, Mycobacterium
GDPDAF

SEQ ID NO: 1009148 - protein, 7 aa, Mycobacterium
GDPDEDF

SEQ ID NO: 1009149 - protein, 8 aa, Mycobacterium
GDPDRPGM

SEQ ID NO: 1009150 - protein, 9 aa, Mycobacterium
GDPDRPLTA

SEQ ID NO: 1009151 - protein, 7 aa, Mycobacterium
GDPEDGY

SEQ ID NO: 1009152 - protein, 6 aa, Mycobacterium
GDPEPA

SEQ ID NO: 1009153 - protein, 6 aa, Mycobacterium
GDPETQ

SEQ ID NO: 1009154 - protein, 4 aa, Mycobacterium
GDPG

SEQ ID NO: 1009155 - protein, 7 aa, Mycobacterium
GDPGAAL

SEQ ID NO: 1009156 - protein, 11 aa, Mycobacterium
GDPGAASANRI

SEQ ID NO: 1009157 - protein, 5 aa, Mycobacterium
GDPGG

SEQ ID NO: 1009158 - protein, 6 aa, Mycobacterium
GDPGRF

SEQ ID NO: 1009159 - protein, 9 aa, Mycobacterium
GDPGSVSAN

SEQ ID NO: 1009160 - protein, 4 aa, Mycobacterium
GDPI

SEQ ID NO: 1009161 - protein, 15 aa, Mycobacterium
GDPLDGATASGASSI

SEQ ID NO: 1009162 - protein, 16 aa, Mycobacterium
GDPLEGAGAAANGFSG

SEQ ID NO: 1009163 - protein, 6 aa, Mycobacterium
GDPLGQ

SEQ ID NO: 1009164 - protein, 9 aa, Mycobacterium
GDPLPSHGR

SEQ ID NO: 1009165 - protein, 6 aa, Mycobacterium
GDPLQD

SEQ ID NO: 1009166 - protein, 6 aa, Mycobacterium
GDPNGV

SEQ ID NO: 1009167 - protein, 5 aa, Mycobacterium
GDPNQ

SEQ ID NO: 1009168 - protein, 17 aa, Mycobacterium
GDPNYGYSTGPANVPTP

SEQ ID NO: 1009169 - protein, 4 aa, Mycobacterium
GDPP

SEQ ID NO: 1009170 - protein, 6 aa, Mycobacterium
GDPPAI

SEQ ID NO: 1009171 - protein, 4 aa, Mycobacterium
GDPQ

SEQ ID NO: 1009172 - protein, 18 aa, Mycobacterium
GDPQRAEAAAQVFIARLR

SEQ ID NO: 1009173 - protein, 8 aa, Mycobacterium
GDPQRPGR

SEQ ID NO: 1009174 - protein, 4 aa, Mycobacterium
GDPR

SEQ ID NO: 1009175 - protein, 7 aa, Mycobacterium
GDPRFSD

SEQ ID NO: 1009176 - protein, 7 aa, Mycobacterium
GDPRPPL

SEQ ID NO: 1009177 - protein, 19 aa, Mycobacterium
GDPSDGLPGVPGVGEKTAA

SEQ ID NO: 1009178 - protein, 11 aa, Mycobacterium
GDPSGHEGMGD

SEQ ID NO: 1009179 - protein, 16 aa, Mycobacterium
GDPSQKGDDVSGSGSY

SEQ ID NO: 1009180 - protein, 8 aa, Mycobacterium
GDPSVPSG

SEQ ID NO: 1009181 - protein, 13 aa, Mycobacterium
GDPTGTGRGGPGY

SEQ ID NO: 1009182 - protein, 9 aa, Mycobacterium
GDPTLPNPN

SEQ ID NO: 1009183 - protein, 5 aa, Mycobacterium
GDPTM

SEQ ID NO: 1009184 - protein, 10 aa, Mycobacterium
GDPTTATAVE

SEQ ID NO: 1009185 - protein, 13 aa, Mycobacterium
GDPVCSGGNDAAA

SEQ ID NO: 1009186 - protein, 10 aa, Mycobacterium
GDPVGGWPEP

SEQ ID NO: 1009187 - protein, 5 aa, Mycobacterium
GDPVK

SEQ ID NO: 1009188 - protein, 5 aa, Mycobacterium
GDPVP

SEQ ID NO: 1009189 - protein, 18 aa, Mycobacterium
GDPVPPVDTYASGRPADQ

SEQ ID NO: 1009190 - protein, 9 aa, Mycobacterium
GDPWTPTSR

SEQ ID NO: 1009191 - protein, 6 aa, Mycobacterium
GDQAAI

SEQ ID NO: 1009192 - protein, 5 aa, Mycobacterium
GDQAV

SEQ ID NO: 1009193 - protein, 7 aa, Mycobacterium
GDQDAAR

SEQ ID NO: 1009194 - protein, 7 aa, Mycobacterium
GDQIGKG

SEQ ID NO: 1009195 - protein, 13 aa, Mycobacterium
GDQIYSEDGSQVD

SEQ ID NO: 1009196 - protein, 11 aa, Mycobacterium
GDQPERTGRTG

SEQ ID NO: 1009197 - protein, 5 aa, Mycobacterium
GDQPV

SEQ ID NO: 1009198 - protein, 5 aa, Mycobacterium
GDQQW

SEQ ID NO: 1009199 - protein, 4 aa, Mycobacterium
GDQR

SEQ ID NO: 1009200 - protein, 22 aa, Mycobacterium
GDQRIRGRSGYQYASGDTADTV

SEQ ID NO: 1009201 - protein, 6 aa, Mycobacterium
GDQVTK

SEQ ID NO: 1009202 - protein, 4 aa, Mycobacterium
GDRA

SEQ ID NO: 1009203 - protein, 11 aa, Mycobacterium
GDRAAQTGQQI

SEQ ID NO: 1009204 - protein, 11 aa, Mycobacterium
GDRAGDPAVRD

SEQ ID NO: 1009205 - protein, 14 aa, Mycobacterium
GDRDGRAAVQSPIQ

SEQ ID NO: 1009206 - protein, 7 aa, Mycobacterium
GDRETLR

SEQ ID NO: 1009207 - protein, 4 aa, Mycobacterium
GDRG

SEQ ID NO: 1009208 - protein, 10 aa, Mycobacterium
GDRGAASELA

SEQ ID NO: 1009209 - protein, 12 aa, Mycobacterium
GDRGAGAVAART

SEQ ID NO: 1009210 - protein, 5 aa, Mycobacterium
GDRGG

SEQ ID NO: 1009211 - protein, 6 aa, Mycobacterium
GDRGLK

SEQ ID NO: 1009212 - protein, 4 aa, Mycobacterium
GDRH

SEQ ID NO: 1009213 - protein, 5 aa, Mycobacterium
GDRIA

SEQ ID NO: 1009214 - protein, 4 aa, Mycobacterium
GDRL

SEQ ID NO: 1009215 - protein, 6 aa, Mycobacterium
GDRNGG

SEQ ID NO: 1009216 - protein, 9 aa, Mycobacterium
GDRNPPVFD

SEQ ID NO: 1009217 - protein, 5 aa, Mycobacterium
GDRPD

SEQ ID NO: 1009218 - protein, 8 aa, Mycobacterium
GDRPGSSI

SEQ ID NO: 1009219 - protein, 8 aa, Mycobacterium
GDRPLTLP

SEQ ID NO: 1009220 - protein, 7 aa, Mycobacterium
GDRPPRV

SEQ ID NO: 1009221 - protein, 4 aa, Mycobacterium
GDRR

SEQ ID NO: 1009222 - protein, 6 aa, Mycobacterium
GDRRDE

SEQ ID NO: 1009223 - protein, 13 aa, Mycobacterium
GDRRQRDRSQSGH

SEQ ID NO: 1009224 - protein, 8 aa, Mycobacterium
GDRSGAKL

SEQ ID NO: 1009225 - protein, 7 aa, Mycobacterium
GDRSGDQ

SEQ ID NO: 1009226 - protein, 11 aa, Mycobacterium
GDRSQDYPELD

SEQ ID NO: 1009227 - protein, 4 aa, Mycobacterium
GDRV

SEQ ID NO: 1009228 - protein, 8 aa, Mycobacterium
GDRVPDGC

SEQ ID NO: 1009229 - protein, 6 aa, Mycobacterium
GDRVTH

SEQ ID NO: 1009230 - protein, 4 aa, Mycobacterium
GDSA

SEQ ID NO: 1009231 - protein, 5 aa, Mycobacterium
GDSAG

SEQ ID NO: 1009232 - protein, 8 aa, Mycobacterium
GDSAGGNI

SEQ ID NO: 1009233 - protein, 8 aa, Mycobacterium
GDSAGGNL

SEQ ID NO: 1009234 - protein, 9 aa, Mycobacterium
GDSASSPAW

SEQ ID NO: 1009235 - protein, 6 aa, Mycobacterium
GDSDER

SEQ ID NO: 1009236 - protein, 6 aa, Mycobacterium
GDSDTV

SEQ ID NO: 1009237 - protein, 9 aa, Mycobacterium
GDSEGQPRQ

SEQ ID NO: 1009238 - protein, 7 aa, Mycobacterium
GDSEPDR

SEQ ID NO: 1009239 - protein, 9 aa, Mycobacterium
GDSEQGRAF

SEQ ID NO: 1009240 - protein, 12 aa, Mycobacterium
GDSGGAGGAGGA

SEQ ID NO: 1009241 - protein, 12 aa, Mycobacterium
GDSGLWPQTSPM

SEQ ID NO: 1009242 - protein, 5 aa, Mycobacterium
GDSHP

SEQ ID NO: 1009243 - protein, 4 aa, Mycobacterium
GDSI

SEQ ID NO: 1009244 - protein, 6 aa, Mycobacterium
GDSLQT

SEQ ID NO: 1009245 - protein, 5 aa, Mycobacterium
GDSMT

SEQ ID NO: 1009246 - protein, 5 aa, Mycobacterium
GDSPD

SEQ ID NO: 1009247 - protein, 22 aa, Mycobacterium
GDSPEQSAEHPERGASRGLAHD

SEQ ID NO: 1009248 - protein, 8 aa, Mycobacterium
GDSPETAA

SEQ ID NO: 1009249 - protein, 7 aa, Mycobacterium
GDSPGAM

SEQ ID NO: 1009250 - protein, 10 aa, Mycobacterium
GDSPKPPPQR

SEQ ID NO: 1009251 - protein, 4 aa, Mycobacterium
GDST

SEQ ID NO: 1009252 - protein, 8 aa, Mycobacterium
GDSTDHAD

SEQ ID NO: 1009253 - protein, 5 aa, Mycobacterium
GDSVT

SEQ ID NO: 1009254 - protein, 5 aa, Mycobacterium
GDTAL

SEQ ID NO: 1009255 - protein, 8 aa, Mycobacterium
GDTAPKAA

SEQ ID NO: 1009256 - protein, 6 aa, Mycobacterium
GDTATA

SEQ ID NO: 1009257 - protein, 19 aa, Mycobacterium
GDTATAAQLSDNPNEAREA

SEQ ID NO: 1009258 - protein, 4 aa, Mycobacterium
GDTG

SEQ ID NO: 1009259 - protein, 8 aa, Mycobacterium
GDTNTETG

SEQ ID NO: 1009260 - protein, 4 aa, Mycobacterium
GDTP

SEQ ID NO: 1009261 - protein, 7 aa, Mycobacterium
GDTPADK

SEQ ID NO: 1009262 - protein, 7 aa, Mycobacterium
GDTPHEN

SEQ ID NO: 1009263 - protein, 5 aa, Mycobacterium
GDTPL

SEQ ID NO: 1009264 - protein, 7 aa, Mycobacterium
GDTPLPV

SEQ ID NO: 1009265 - protein, 6 aa, Mycobacterium
GDTQTA

SEQ ID NO: 1009266 - protein, 6 aa, Mycobacterium
GDTSAQ

SEQ ID NO: 1009267 - protein, 6 aa, Mycobacterium
GDTTDD

SEQ ID NO: 1009268 - protein, 8 aa, Mycobacterium
GDTTPGRV

SEQ ID NO: 1009269 - protein, 4 aa, Mycobacterium
GDTV

SEQ ID NO: 1009270 - protein, 7 aa, Mycobacterium
GDTVTAG

SEQ ID NO: 1009271 - protein, 12 aa, Mycobacterium
GDTVTSSPIKGT

SEQ ID NO: 1009272 - protein, 23 aa, Mycobacterium
GDTVTTARKGATEALTGYREPKP

SEQ ID NO: 1009273 - protein, 4 aa, Mycobacterium
GDVA

SEQ ID NO: 1009274 - protein, 13 aa, Mycobacterium
GDVAAKAGALAES

SEQ ID NO: 1009275 - protein, 6 aa, Mycobacterium
GDVAPG

SEQ ID NO: 1009276 - protein, 6 aa, Mycobacterium
GDVEKL

SEQ ID NO: 1009277 - protein, 8 aa, Mycobacterium
GDVGDTSE

SEQ ID NO: 1009278 - protein, 10 aa, Mycobacterium
GDVGRRLPSG

SEQ ID NO: 1009279 - protein, 27 aa, Mycobacterium
GDVNTDIGSTADTGDTNSGFNNTGSNV

SEQ ID NO: 1009280 - protein, 16 aa, Mycobacterium
GDVNTGSGNSGHTNTG

SEQ ID NO: 1009281 - protein, 7 aa, Mycobacterium
GDVPAGR

SEQ ID NO: 1009282 - protein, 10 aa, Mycobacterium
GDVPLRPTTT

SEQ ID NO: 1009283 - protein, 16 aa, Mycobacterium
GDVPPAANRPDGTDAD

SEQ ID NO: 1009284 - protein, 15 aa, Mycobacterium
GDVSRGGVDMTDPGA

SEQ ID NO: 1009285 - protein, 5 aa, Mycobacterium
GDYDL

SEQ ID NO: 1009286 - protein, 16 aa, Mycobacterium
GDYERAPVAQPAPDAV

SEQ ID NO: 1009287 - protein, 7 aa, Mycobacterium
GDYESTM

SEQ ID NO: 1009288 - protein, 5 aa, Mycobacterium
GDYGT

SEQ ID NO: 1009289 - protein, 14 aa, Mycobacterium
GDYNTGLANAGNYN

SEQ ID NO: 1009290 - protein, 15 aa, Mycobacterium
GDYNTGLANTGDVNT

SEQ ID NO: 1009291 - protein, 6 aa, Mycobacterium
GEAAAA

SEQ ID NO: 1009292 - protein, 6 aa, Mycobacterium
GEAAAY

SEQ ID NO: 1009293 - protein, 7 aa, Mycobacterium
GEAARDA

SEQ ID NO: 1009294 - protein, 6 aa, Mycobacterium
GEAARG

SEQ ID NO: 1009295 - protein, 13 aa, Mycobacterium
GEAARSEAQSAAG

SEQ ID NO: 1009296 - protein, 15 aa, Mycobacterium
GEAATAADGPPDPVH

SEQ ID NO: 1009297 - protein, 7 aa, Mycobacterium
GEAATAV

SEQ ID NO: 1009298 - protein, 8 aa, Mycobacterium
GEADDGAA

SEQ ID NO: 1009299 - protein, 7 aa, Mycobacterium
GEADGSI

SEQ ID NO: 1009300 - protein, 6 aa, Mycobacterium
GEADPA

SEQ ID NO: 1009301 - protein, 7 aa, Mycobacterium
GEADPRS

SEQ ID NO: 1009302 - protein, 9 aa, Mycobacterium
GEAEATGEI

SEQ ID NO: 1009303 - protein, 7 aa, Mycobacterium
GEAEQTH

SEQ ID NO: 1009304 - protein, 19 aa, Mycobacterium
GEAESTAASQPGVRPQSRR

SEQ ID NO: 1009305 - protein, 9 aa, Mycobacterium
GEAGAEPMT

SEQ ID NO: 1009306 - protein, 10 aa, Mycobacterium
GEAGDRQIDN

SEQ ID NO: 1009307 - protein, 6 aa, Mycobacterium
GEAGFG

SEQ ID NO: 1009308 - protein, 7 aa, Mycobacterium
GEAGPFV

SEQ ID NO: 1009309 - protein, 25 aa, Mycobacterium
GEAGPGPSYLDPGSGGPQNDFTNRN

SEQ ID NO: 1009310 - protein, 10 aa, Mycobacterium
GEAGQSFETP

SEQ ID NO: 1009311 - protein, 6 aa, Mycobacterium
GEAKEF

SEQ ID NO: 1009312 - protein, 9 aa, Mycobacterium
GEAKNTYGT

SEQ ID NO: 1009313 - protein, 9 aa, Mycobacterium
GEAKQAITA

SEQ ID NO: 1009314 - protein, 6 aa, Mycobacterium
GEAKSE

SEQ ID NO: 1009315 - protein, 4 aa, Mycobacterium
GEAL

SEQ ID NO: 1009316 - protein, 7 aa, Mycobacterium
GEALGRP

SEQ ID NO: 1009317 - protein, 13 aa, Mycobacterium
GEANTGGADKSSI

SEQ ID NO: 1009318 - protein, 5 aa, Mycobacterium
GEAPE

SEQ ID NO: 1009319 - protein, 7 aa, Mycobacterium
GEAPGEI

SEQ ID NO: 1009320 - protein, 14 aa, Mycobacterium
GEAPTAASWGAANR

SEQ ID NO: 1009321 - protein, 8 aa, Mycobacterium
GEASPSEL

SEQ ID NO: 1009322 - protein, 9 aa, Mycobacterium
GEATPTGGM

SEQ ID NO: 1009323 - protein, 11 aa, Mycobacterium
GEAYPAPPRIR

SEQ ID NO: 1009324 - protein, 4 aa, Mycobacterium
GEDA

SEQ ID NO: 1009325 - protein, 7 aa, Mycobacterium
GEDAGRG

SEQ ID NO: 1009326 - protein, 9 aa, Mycobacterium
GEDAQLPHH

SEQ ID NO: 1009327 - protein, 7 aa, Mycobacterium
GEDGKPV

SEQ ID NO: 1009328 - protein, 8 aa, Mycobacterium
GEDGPEGI

SEQ ID NO: 1009329 - protein, 7 aa, Mycobacterium
GEDGQDD

SEQ ID NO: 1009330 - protein, 6 aa, Mycobacterium
GEDGTG

SEQ ID NO: 1009331 - protein, 4 aa, Mycobacterium
GEDL

SEQ ID NO: 1009332 - protein, 8 aa, Mycobacterium
GEDLGDPE

SEQ ID NO: 1009333 - protein, 9 aa, Mycobacterium
GEDLGSGAD

SEQ ID NO: 1009334 - protein, 13 aa, Mycobacterium
GEDPLDASGVHPE

SEQ ID NO: 1009335 - protein, 12 aa, Mycobacterium
GEDQATDADYSE

SEQ ID NO: 1009336 - protein, 9 aa, Mycobacterium
GEDQHQDTG

SEQ ID NO: 1009337 - protein, 4 aa, Mycobacterium
GEDR

SEQ ID NO: 1009338 - protein, 8 aa, Mycobacterium
GEDREGAE

SEQ ID NO: 1009339 - protein, 15 aa, Mycobacterium
GEDSERLTGATGLST

SEQ ID NO: 1009340 - protein, 7 aa, Mycobacterium
GEDSPYE

SEQ ID NO: 1009341 - protein, 5 aa, Mycobacterium
GEDTA

SEQ ID NO: 1009342 - protein, 5 aa, Mycobacterium
GEDTV

SEQ ID NO: 1009343 - protein, 6 aa, Mycobacterium
GEDTYE

SEQ ID NO: 1009344 - protein, 7 aa, Mycobacterium
GEEASTV

SEQ ID NO: 1009345 - protein, 6 aa, Mycobacterium
GEEDRL

SEQ ID NO: 1009346 - protein, 10 aa, Mycobacterium
GEEESGSPSL

SEQ ID NO: 1009347 - protein, 4 aa, Mycobacterium
GEEH

SEQ ID NO: 1009348 - protein, 7 aa, Mycobacterium
GEEHRQR

SEQ ID NO: 1009349 - protein, 4 aa, Mycobacterium
GEEI

SEQ ID NO: 1009350 - protein, 8 aa, Mycobacterium
GEELTEAE

SEQ ID NO: 1009351 - protein, 5 aa, Mycobacterium
GEERL

SEQ ID NO: 1009352 - protein, 8 aa, Mycobacterium
GEESAGQI

SEQ ID NO: 1009353 - protein, 5 aa, Mycobacterium
GEEYP

SEQ ID NO: 1009354 - protein, 6 aa, Mycobacterium
GEFDTG

SEQ ID NO: 1009355 - protein, 9 aa, Mycobacterium
GEFSSQPSA

SEQ ID NO: 1009356 - protein, 10 aa, Mycobacterium
GEGAGSGPHT

SEQ ID NO: 1009357 - protein, 18 aa, Mycobacterium
GEGAPGRRSRARNGSGSV

SEQ ID NO: 1009358 - protein, 5 aa, Mycobacterium
GEGCR

SEQ ID NO: 1009359 - protein, 9 aa, Mycobacterium
GEGDDAEAR

SEQ ID NO: 1009360 - protein, 7 aa, Mycobacterium
GEGDREG

SEQ ID NO: 1009361 - protein, 4 aa, Mycobacterium
GEGE

SEQ ID NO: 1009362 - protein, 14 aa, Mycobacterium
GEGEDLQTNNEQSV

SEQ ID NO: 1009363 - protein, 12 aa, Mycobacterium
GEGEGRGPHGDY

SEQ ID NO: 1009364 - protein, 5 aa, Mycobacterium
GEGGL

SEQ ID NO: 1009365 - protein, 6 aa, Mycobacterium
GEGGNL

SEQ ID NO: 1009366 - protein, 9 aa, Mycobacterium
GEGGRSSGI

SEQ ID NO: 1009367 - protein, 12 aa, Mycobacterium
GEGGVKGLSGPE

SEQ ID NO: 1009368 - protein, 6 aa, Mycobacterium
GEGGYQ

SEQ ID NO: 1009369 - protein, 4 aa, Mycobacterium
GEGI

SEQ ID NO: 1009370 - protein, 8 aa, Mycobacterium
GEGKTLAG

SEQ ID NO: 1009371 - protein, 13 aa, Mycobacterium
GEGLAGQPNFPDA

SEQ ID NO: 1009372 - protein, 5 aa, Mycobacterium
GEGLN

SEQ ID NO: 1009373 - protein, 6 aa, Mycobacterium
GEGNNL

SEQ ID NO: 1009374 - protein, 16 aa, Mycobacterium
GEGNSTADTAAPGSPW

SEQ ID NO: 1009375 - protein, 18 aa, Mycobacterium
GEGNTNVHAEAGPGGANI

SEQ ID NO: 1009376 - protein, 7 aa, Mycobacterium
GEGPSEA

SEQ ID NO: 1009377 - protein, 12 aa, Mycobacterium
GEGQDSKAQGAC

SEQ ID NO: 1009378 - protein, 11 aa, Mycobacterium
GEGRAGEYPTI

SEQ ID NO: 1009379 - protein, 5 aa, Mycobacterium
GEGRL

SEQ ID NO: 1009380 - protein, 7 aa, Mycobacterium
GEGRPDR

SEQ ID NO: 1009381 - protein, 8 aa, Mycobacterium
GEGRSRDD

SEQ ID NO: 1009382 - protein, 11 aa, Mycobacterium
GEGSAASGPRI

SEQ ID NO: 1009383 - protein, 6 aa, Mycobacterium
GEGTRA

SEQ ID NO: 1009384 - protein, 6 aa, Mycobacterium
GEGTTE

SEQ ID NO: 1009385 - protein, 4 aa, Mycobacterium
GEGV

SEQ ID NO: 1009386 - protein, 9 aa, Mycobacterium
GEGVAAKSL

SEQ ID NO: 1009387 - protein, 9 aa, Mycobacterium
GEGVTDHQV

SEQ ID NO: 1009388 - protein, 7 aa, Mycobacterium
GEHAARA

SEQ ID NO: 1009389 - protein, 4 aa, Mycobacterium
GEHD

SEQ ID NO: 1009390 - protein, 6 aa, Mycobacterium
GEHDGR

SEQ ID NO: 1009391 - protein, 5 aa, Mycobacterium
GEHGD

SEQ ID NO: 1009392 - protein, 6 aa, Mycobacterium
GEHPDW

SEQ ID NO: 1009393 - protein, 8 aa, Mycobacterium
GEHPGPAN

SEQ ID NO: 1009394 - protein, 6 aa, Mycobacterium
GEHQLE

SEQ ID NO: 1009395 - protein, 5 aa, Mycobacterium
GEHSD

SEQ ID NO: 1009396 - protein, 16 aa, Mycobacterium
GEIAGAGHASATGRFD

SEQ ID NO: 1009397 - protein, 4 aa, Mycobacterium
GEIE

SEQ ID NO: 1009398 - protein, 8 aa, Mycobacterium
GEIEAADN

SEQ ID NO: 1009399 - protein, 8 aa, Mycobacterium
GEIGPATV

SEQ ID NO: 1009400 - protein, 5 aa, Mycobacterium
GEIPT

SEQ ID NO: 1009401 - protein, 5 aa, Mycobacterium
GEISS

SEQ ID NO: 1009402 - protein, 15 aa, Mycobacterium
GEITGGKLATPVTAA

SEQ ID NO: 1009403 - protein, 9 aa, Mycobacterium
GEKHGGVKP

SEQ ID NO: 1009404 - protein, 11 aa, Mycobacterium
GELAAEGRSDA

SEQ ID NO: 1009405 - protein, 6 aa, Mycobacterium
GELDGR

SEQ ID NO: 1009406 - protein, 10 aa, Mycobacterium
GELDNPGAMT

SEQ ID NO: 1009407 - protein, 10 aa, Mycobacterium
GELDQGEVGL

SEQ ID NO: 1009408 - protein, 10 aa, Mycobacterium
GELGEQRHRA

SEQ ID NO: 1009409 - protein, 6 aa, Mycobacterium
GELGER

SEQ ID NO: 1009410 - protein, 13 aa, Mycobacterium
GELGPVSPSGSGR

SEQ ID NO: 1009411 - protein, 8 aa, Mycobacterium
GELGQHNG

SEQ ID NO: 1009412 - protein, 8 aa, Mycobacterium
GELGRSAA

SEQ ID NO: 1009413 - protein, 12 aa, Mycobacterium
GELGSAADSFAS

SEQ ID NO: 1009414 - protein, 7 aa, Mycobacterium
GELPPVD

SEQ ID NO: 1009415 - protein, 4 aa, Mycobacterium
GELS

SEQ ID NO: 1009416 - protein, 17 aa, Mycobacterium
GELSESGPPAPARSDGL

SEQ ID NO: 1009417 - protein, 4 aa, Mycobacterium
GELT

SEQ ID NO: 1009418 - protein, 8 aa, Mycobacterium
GELTGSGR

SEQ ID NO: 1009419 - protein, 7 aa, Mycobacterium
GELTRQA

SEQ ID NO: 1009420 - protein, 11 aa, Mycobacterium
GELTSGEGSYA

SEQ ID NO: 1009421 - protein, 8 aa, Mycobacterium
GENGDGAL

SEQ ID NO: 1009422 - protein, 4 aa, Mycobacterium
GENI

SEQ ID NO: 1009423 - protein, 8 aa, Mycobacterium
GENISPRE

SEQ ID NO: 1009424 - protein, 4 aa, Mycobacterium
GENP

SEQ ID NO: 1009425 - protein, 7 aa, Mycobacterium
GENPKVG

SEQ ID NO: 1009426 - protein, 5 aa, Mycobacterium
GENPR

SEQ ID NO: 1009427 - protein, 4 aa, Mycobacterium
GENQ

SEQ ID NO: 1009428 - protein, 10 aa, Mycobacterium
GENSTARVGG

SEQ ID NO: 1009429 - protein, 27 aa, Mycobacterium
GENTYDAEGKEVTLNPGANGVRVDPGG

SEQ ID NO: 1009430 - protein, 4 aa, Mycobacterium
GEPA

SEQ ID NO: 1009431 - protein, 7 aa, Mycobacterium
GEPAADD

SEQ ID NO: 1009432 - protein, 16 aa, Mycobacterium
GEPANAPEDDAATPGR

SEQ ID NO: 1009433 - protein, 6 aa, Mycobacterium
GEPATL

SEQ ID NO: 1009434 - protein, 10 aa, Mycobacterium
GEPDDGVEIG

SEQ ID NO: 1009435 - protein, 10 aa, Mycobacterium
GEPDESSEQK

SEQ ID NO: 1009436 - protein, 5 aa, Mycobacterium
GEPDI

SEQ ID NO: 1009437 - protein, 6 aa, Mycobacterium
GEPEAI

SEQ ID NO: 1009438 - protein, 4 aa, Mycobacterium
GEPF

SEQ ID NO: 1009439 - protein, 6 aa, Mycobacterium
GEPGGQ

SEQ ID NO: 1009440 - protein, 5 aa, Mycobacterium
GEPGL

SEQ ID NO: 1009441 - protein, 19 aa, Mycobacterium
GEPGRDAPKLAGDRAARIA

SEQ ID NO: 1009442 - protein, 7 aa, Mycobacterium
GEPGRET

SEQ ID NO: 1009443 - protein, 6 aa, Mycobacterium
GEPGRY

SEQ ID NO: 1009444 - protein, 7 aa, Mycobacterium
GEPGTGF

SEQ ID NO: 1009445 - protein, 7 aa, Mycobacterium
GEPGVGK

SEQ ID NO: 1009446 - protein, 12 aa, Mycobacterium
GEPGVGKTTAAK

SEQ ID NO: 1009447 - protein, 6 aa, Mycobacterium
GEPINP

SEQ ID NO: 1009448 - protein, 5 aa, Mycobacterium
GEPLG

SEQ ID NO: 1009449 - protein, 9 aa, Mycobacterium
GEPLPADST

SEQ ID NO: 1009450 - protein, 5 aa, Mycobacterium
GEPLR

SEQ ID NO: 1009451 - protein, 7 aa, Mycobacterium
GEPNPLE

SEQ ID NO: 1009452 - protein, 26 aa, Mycobacterium
GEPQPTTQTSSADTMPASIPTRVTGQ

SEQ ID NO: 1009453 - protein, 10 aa, Mycobacterium
GEPQQNPDRP

SEQ ID NO: 1009454 - protein, 6 aa, Mycobacterium
GEPRAD

SEQ ID NO: 1009455 - protein, 8 aa, Mycobacterium
GEPRNTVR

SEQ ID NO: 1009456 - protein, 6 aa, Mycobacterium
GEPRYG

SEQ ID NO: 1009457 - protein, 6 aa, Mycobacterium
GEPSWP

SEQ ID NO: 1009458 - protein, 6 aa, Mycobacterium
GEPTDA

SEQ ID NO: 1009459 - protein, 8 aa, Mycobacterium
GEPTDGIT

SEQ ID NO: 1009460 - protein, 10 aa, Mycobacterium
GEPTDPDGPV

SEQ ID NO: 1009461 - protein, 7 aa, Mycobacterium
GEPTSGY

SEQ ID NO: 1009462 - protein, 5 aa, Mycobacterium
GEPTV

SEQ ID NO: 1009463 - protein, 22 aa, Mycobacterium
GEPVANDESLAPPKRTVHQHPR

SEQ ID NO: 1009464 - protein, 11 aa, Mycobacterium
GEPVDDGALPG

SEQ ID NO: 1009465 - protein, 8 aa, Mycobacterium
GEPWSSEN

SEQ ID NO: 1009466 - protein, 8 aa, Mycobacterium
GEQAADAE

SEQ ID NO: 1009467 - protein, 41 aa, Mycobacterium
GEQARTPVPEGAATPVAQPPRVPEAPPHDGSAPAGEASSPC

SEQ ID NO: 1009468 - protein, 17 aa, Mycobacterium
GEQDSHEYGQAKTEMGQ

SEQ ID NO: 1009469 - protein, 4 aa, Mycobacterium
GEQG

SEQ ID NO: 1009470 - protein, 5 aa, Mycobacterium
GEQHP

SEQ ID NO: 1009471 - protein, 9 aa, Mycobacterium
GEQITPETT

SEQ ID NO: 1009472 - protein, 9 aa, Mycobacterium
GEQPADPGV

SEQ ID NO: 1009473 - protein, 9 aa, Mycobacterium
GEQPRADSL

SEQ ID NO: 1009474 - protein, 5 aa, Mycobacterium
GEQQA

SEQ ID NO: 1009475 - protein, 8 aa, Mycobacterium
GEQRPGSV

SEQ ID NO: 1009476 - protein, 8 aa, Mycobacterium
GEQSCTAG

SEQ ID NO: 1009477 - protein, 7 aa, Mycobacterium
GEQSNNI

SEQ ID NO: 1009478 - protein, 7 aa, Mycobacterium
GEQSQAY

SEQ ID NO: 1009479 - protein, 6 aa, Mycobacterium
GERADG

SEQ ID NO: 1009480 - protein, 28 aa, Mycobacterium
GERADGGESIAAPEDELASRRKHRDRKI

SEQ ID NO: 1009481 - protein, 6 aa, Mycobacterium
GERAEW

SEQ ID NO: 1009482 - protein, 6 aa, Mycobacterium
GERAQV

SEQ ID NO: 1009483 - protein, 5 aa, Mycobacterium
GEREQ

SEQ ID NO: 1009484 - protein, 6 aa, Mycobacterium
GERETV

SEQ ID NO: 1009485 - protein, 19 aa, Mycobacterium
GERGATRKQFPDSPEALNP

SEQ ID NO: 1009486 - protein, 6 aa, Mycobacterium
GERGYH

SEQ ID NO: 1009487 - protein, 6 aa, Mycobacterium
GERKLK

SEQ ID NO: 1009488 - protein, 5 aa, Mycobacterium
GERLP

SEQ ID NO: 1009489 - protein, 8 aa, Mycobacterium
GERPGPMQ

SEQ ID NO: 1009490 - protein, 7 aa, Mycobacterium
GERPPRV

SEQ ID NO: 1009491 - protein, 7 aa, Mycobacterium
GERPTFS

SEQ ID NO: 1009492 - protein, 7 aa, Mycobacterium
GERQGPA

SEQ ID NO: 1009493 - protein, 5 aa, Mycobacterium
GERQV

SEQ ID NO: 1009494 - protein, 9 aa, Mycobacterium
GERRRTDDG

SEQ ID NO: 1009495 - protein, 5 aa, Mycobacterium
GERSL

SEQ ID NO: 1009496 - protein, 31 aa, Mycobacterium; identical to SEQ ID NO: 483498

SEQ ID NO: 1009497 - protein, 4 aa, Mycobacterium
GERT

SEQ ID NO: 1009498 - protein, 8 aa, Mycobacterium
GERTFRST

SEQ ID NO: 1009499 - protein, 6 aa, Mycobacterium
GERTKR

SEQ ID NO: 1009500 - protein, 13 aa, Mycobacterium
GERTPNRPKATGA

SEQ ID NO: 1009501 - protein, 9 aa, Mycobacterium
GERTSQGRT

SEQ ID NO: 1009502 - protein, 11 aa, Mycobacterium
GERTTPAGAEA

SEQ ID NO: 1009503 - protein, 6 aa, Mycobacterium
GERVEA

SEQ ID NO: 1009504 - protein, 5 aa, Mycobacterium
GERVR

SEQ ID NO: 1009505 - protein, 10 aa, Mycobacterium
GESAANIGRG

SEQ ID NO: 1009506 - protein, 5 aa, Mycobacterium
GESAD

SEQ ID NO: 1009507 - protein, 15 aa, Mycobacterium
GESALGESAATLSSA

SEQ ID NO: 1009508 - protein, 10 aa, Mycobacterium
GESALNATRS

SEQ ID NO: 1009509 - protein, 8 aa, Mycobacterium
GESAQFAK

SEQ ID NO: 1009510 - protein, 11 aa, Mycobacterium
GESDDTSKLSR

SEQ ID NO: 1009511 - protein, 10 aa, Mycobacterium
GESDSGRAHA

SEQ ID NO: 1009512 - protein, 9 aa, Mycobacterium
GESFPTGRA

SEQ ID NO: 1009513 - protein, 10 aa, Mycobacterium
GESGARSVDT

SEQ ID NO: 1009514 - protein, 13 aa, Mycobacterium
GESGGAPETVQHN

SEQ ID NO: 1009515 - protein, 9 aa, Mycobacterium
GESGPHPER

SEQ ID NO: 1009516 - protein, 18 aa, Mycobacterium
GESGQPLRERRAPDSPLR

SEQ ID NO: 1009517 - protein, 10 aa, Mycobacterium
GESGSGKSTT

SEQ ID NO: 1009518 - protein, 9 aa, Mycobacterium
GESGSGKTT

SEQ ID NO: 1009519 - protein, 19 aa, Mycobacterium
GESGVGDFAPSTLDGFPDR

SEQ ID NO: 1009520 - protein, 4 aa, Mycobacterium
GESL

SEQ ID NO: 1009521 - protein, 5 aa, Mycobacterium
GESLE

SEQ ID NO: 1009522 - protein, 9 aa, Mycobacterium
GESPDPSTG

SEQ ID NO: 1009523 - protein, 8 aa, Mycobacterium
GESPLDPA

SEQ ID NO: 1009524 - protein, 12 aa, Mycobacterium
GESPPARRDPRA

SEQ ID NO: 1009525 - protein, 8 aa, Mycobacterium
GESPQWSA

SEQ ID NO: 1009526 - protein, 9 aa, Mycobacterium
GESPRATRY

SEQ ID NO: 1009527 - protein, 6 aa, Mycobacterium
GESRAD

SEQ ID NO: 1009528 - protein, 10 aa, Mycobacterium
GESRNDSSSR

SEQ ID NO: 1009529 - protein, 7 aa, Mycobacterium
GESSGYD

SEQ ID NO: 1009530 - protein, 7 aa, Mycobacterium
GESTADR

SEQ ID NO: 1009531 - protein, 4 aa, Mycobacterium
GESV

SEQ ID NO: 1009532 - protein, 6 aa, Mycobacterium
GESVAG

SEQ ID NO: 1009533 - protein, 6 aa, Mycobacterium
GESVQS

SEQ ID NO: 1009534 - protein, 6 aa, Mycobacterium
GESYKT

SEQ ID NO: 1009535 - protein, 8 aa, Mycobacterium
GETAGDFP

SEQ ID NO: 1009536 - protein, 6 aa, Mycobacterium
GETATY

SEQ ID NO: 1009537 - protein, 7 aa, Mycobacterium
GETCGTV

SEQ ID NO: 1009538 - protein, 10 aa, Mycobacterium
GETDKATYAR

SEQ ID NO: 1009539 - protein, 5 aa, Mycobacterium
GETDP

SEQ ID NO: 1009540 - protein, 5 aa, Mycobacterium
GETDT

SEQ ID NO: 1009541 - protein, 9 aa, Mycobacterium
GETEAKTNA

SEQ ID NO: 1009542 - protein, 100 aa, Mycobacterium
GETEESEETDGTDETDDFDDDSDDSDDSDEDDDTDETNDTDVDADEDEDTDDDSDEDEDTEDDDELDDDLDDELDDDDSDSDDEDSESELTEPAAGRPAA

SEQ ID NO: 1009543 - protein, 10 aa, Mycobacterium
GETEKVPSTA

SEQ ID NO: 1009544 - protein, 7 aa, Mycobacterium
GETETLS

SEQ ID NO: 1009545 - protein, 6 aa, Mycobacterium
GETGGK

SEQ ID NO: 1009546 - protein, 13 aa, Mycobacterium
GETGGNCELTEPG

SEQ ID NO: 1009547 - protein, 11 aa, Mycobacterium
GETGGSGGQGG

SEQ ID NO: 1009548 - protein, 8 aa, Mycobacterium
GETGRTDF

SEQ ID NO: 1009549 - protein, 6 aa, Mycobacterium
GETGYP

SEQ ID NO: 1009550 - protein, 11 aa, Mycobacterium
GETHARTRTGA

SEQ ID NO: 1009551 - protein, 5 aa, Mycobacterium
GETLA

SEQ ID NO: 1009552 - protein, 7 aa, Mycobacterium
GETLAGG

SEQ ID NO: 1009553 - protein, 10 aa, Mycobacterium
GETPPKSPCE

SEQ ID NO: 1009554 - protein, 8 aa, Mycobacterium
GETRSYGE

SEQ ID NO: 1009555 - protein, 16 aa, Mycobacterium
GETSEQVEEWHPLPTA

SEQ ID NO: 1009556 - protein, 5 aa, Mycobacterium
GETTA

SEQ ID NO: 1009557 - protein, 6 aa, Mycobacterium
GETTVT

SEQ ID NO: 1009558 - protein, 19 aa, Mycobacterium
GETVSAGESCGEVESTKTV

SEQ ID NO: 1009559 - protein, 8 aa, Mycobacterium
GETVSQTA

SEQ ID NO: 1009560 - protein, 7 aa, Mycobacterium
GEVAEQK

SEQ ID NO: 1009561 - protein, 9 aa, Mycobacterium
GEVDPSALP

SEQ ID NO: 1009562 - protein, 16 aa, Mycobacterium
GEVEAAAEAEEAEVGE

SEQ ID NO: 1009563 - protein, 5 aa, Mycobacterium
GEVEY

SEQ ID NO: 1009564 - protein, 4 aa, Mycobacterium
GEVG

SEQ ID NO: 1009565 - protein, 16 aa, Mycobacterium
GEVGASKMSGSNIGEG

SEQ ID NO: 1009566 - protein, 10 aa, Mycobacterium
GEVGNAEQAN

SEQ ID NO: 1009567 - protein, 13 aa, Mycobacterium
GEVGNKKVYDPRS

SEQ ID NO: 1009568 - protein, 12 aa, Mycobacterium
GEVNTGIGNSGH

SEQ ID NO: 1009569 - protein, 4 aa, Mycobacterium
GEVR

SEQ ID NO: 1009570 - protein, 7 aa, Mycobacterium
GEVRTEN

SEQ ID NO: 1009571 - protein, 7 aa, Mycobacterium
GEVSTPE

SEQ ID NO: 1009572 - protein, 11 aa, Mycobacterium
GEVTGSEPGSV

SEQ ID NO: 1009573 - protein, 5 aa, Mycobacterium
GEYDD

SEQ ID NO: 1009574 - protein, 8 aa, Mycobacterium
GEYGKTPT

SEQ ID NO: 1009575 - protein, 5 aa, Mycobacterium
GEYGP

SEQ ID NO: 1009576 - protein, 7 aa, Mycobacterium
GEYNGQQ

SEQ ID NO: 1009577 - protein, 6 aa, Mycobacterium
GEYNSY

SEQ ID NO: 1009578 - protein, 4 aa, Mycobacterium
GFAD

SEQ ID NO: 1009579 - protein, 12 aa, Mycobacterium
GFAEPKPAGRIN

SEQ ID NO: 1009580 - protein, 14 aa, Mycobacterium
GFAGADPRTGRRRG

SEQ ID NO: 1009581 - protein, 6 aa, Mycobacterium
GFAGGT

SEQ ID NO: 1009582 - protein, 5 aa, Mycobacterium
GFANT

SEQ ID NO: 1009583 - protein, 12 aa, Mycobacterium
GFATDDPTHPVP

SEQ ID NO: 1009584 - protein, 5 aa, Mycobacterium
GFATS

SEQ ID NO: 1009585 - protein, 9 aa, Mycobacterium
GFDAGQPTA

SEQ ID NO: 1009586 - protein, 8 aa, Mycobacterium
GFDAGRPT

SEQ ID NO: 1009587 - protein, 6 aa, Mycobacterium
GFDAPS

SEQ ID NO: 1009588 - protein, 27 aa, Mycobacterium
GFDDPDGSPAPLRQPDGSIVADQPDRV

SEQ ID NO: 1009589 - protein, 5 aa, Mycobacterium
GFDGT

SEQ ID NO: 1009590 - protein, 5 aa, Mycobacterium
GFDPA

SEQ ID NO: 1009591 - protein, 6 aa, Mycobacterium
GFDPAR

SEQ ID NO: 1009592 - protein, 11 aa, Mycobacterium
GFDPDDALPQD

SEQ ID NO: 1009593 - protein, 11 aa, Mycobacterium
GFDPNQPTAWS

SEQ ID NO: 1009594 - protein, 7 aa, Mycobacterium
GFDPSAR

SEQ ID NO: 1009595 - protein, 6 aa, Mycobacterium
GFDPSV

SEQ ID NO: 1009596 - protein, 7 aa, Mycobacterium
GFEPPDD

SEQ ID NO: 1009597 - protein, 4 aa, Mycobacterium
GFER

SEQ ID NO: 1009598 - protein, 5 aa, Mycobacterium
GFGAH

SEQ ID NO: 1009599 - protein, 4 aa, Mycobacterium
GFGG

SEQ ID NO: 1009600 - protein, 22 aa, Mycobacterium
GFGGMGGAGTTGGAGDVGGQGV

SEQ ID NO: 1009601 - protein, 17 aa, Mycobacterium
GFGGPDTFGGGIRTPTL

SEQ ID NO: 1009602 - protein, 5 aa, Mycobacterium
GFGGR

SEQ ID NO: 1009603 - protein, 6 aa, Mycobacterium
GFGGRR

SEQ ID NO: 1009604 - protein, 5 aa, Mycobacterium
GFGGT

SEQ ID NO: 1009605 - protein, 22 aa, Mycobacterium
GFGGVPGERPAAPEIPDREPDA

SEQ ID NO: 1009606 - protein, 13 aa, Mycobacterium
GFGNAADESSYGH

SEQ ID NO: 1009607 - protein, 10 aa, Mycobacterium
GFGNSGPALT

SEQ ID NO: 1009608 - protein, 12 aa, Mycobacterium
GFGNSGTGNSGF

SEQ ID NO: 1009609 - protein, 11 aa, Mycobacterium
GFGNSTTVPSS

SEQ ID NO: 1009610 - protein, 6 aa, Mycobacterium
GFGNTG

SEQ ID NO: 1009611 - protein, 4 aa, Mycobacterium
GFGP

SEQ ID NO: 1009612 - protein, 13 aa, Mycobacterium
GFGPDQRRSSPSF

SEQ ID NO: 1009613 - protein, 5 aa, Mycobacterium
GFGPE

SEQ ID NO: 1009614 - protein, 11 aa, Mycobacterium
GFGPGDAPFGG

SEQ ID NO: 1009615 - protein, 7 aa, Mycobacterium
GFGPPRS

SEQ ID NO: 1009616 - protein, 7 aa, Mycobacterium
GFGPQAL

SEQ ID NO: 1009617 - protein, 6 aa, Mycobacterium
GFGPTG

SEQ ID NO: 1009618 - protein, 10 aa, Mycobacterium
GFGSGTSGQQ

SEQ ID NO: 1009619 - protein, 6 aa, Mycobacterium
GFGSTE

SEQ ID NO: 1009620 - protein, 8 aa, Mycobacterium
GFGSTEGG

SEQ ID NO: 1009621 - protein, 20 aa, Mycobacterium
GFHGGSPRTGASVQGSDPRC

SEQ ID NO: 1009622 - protein, 6 aa, Mycobacterium
GFHPSQ

SEQ ID NO: 1009623 - protein, 14 aa, Mycobacterium
GFHTPAPAVGQDQP

SEQ ID NO: 1009624 - protein, 7 aa, Mycobacterium
GFKGSDY

SEQ ID NO: 1009625 - protein, 12 aa, Mycobacterium
GFKGSRKSTPFA

SEQ ID NO: 1009626 - protein, 10 aa, Mycobacterium
GFKNAEPEDV

SEQ ID NO: 1009627 - protein, 4 aa, Mycobacterium
GFNP

SEQ ID NO: 1009628 - protein, 13 aa, Mycobacterium
GFNPGSSNTGSFN

SEQ ID NO: 1009629 - protein, 16 aa, Mycobacterium
GFNPPQPTDKGGPDYG

SEQ ID NO: 1009630 - protein, 7 aa, Mycobacterium
GFPGTAT

SEQ ID NO: 1009631 - protein, 7 aa, Mycobacterium
GFPIPSQ

SEQ ID NO: 1009632 - protein, 6 aa, Mycobacterium
GFPPED

SEQ ID NO: 1009633 - protein, 11 aa, Mycobacterium
GFPSGKHASAI

SEQ ID NO: 1009634 - protein, 12 aa, Mycobacterium
GFQANEDNGYHQ

SEQ ID NO: 1009635 - protein, 9 aa, Mycobacterium
GFQTSTGVI

SEQ ID NO: 1009636 - protein, 12 aa, Mycobacterium
GFREGAVSARSA

SEQ ID NO: 1009637 - protein, 6 aa, Mycobacterium
GFSADD

SEQ ID NO: 1009638 - protein, 5 aa, Mycobacterium
GFSAQ

SEQ ID NO: 1009639 - protein, 16 aa, Mycobacterium
GFSGNHPRRSLNRGPQ

SEQ ID NO: 1009640 - protein, 12 aa, Mycobacterium
GFSGQGASHGAQ

SEQ ID NO: 1009641 - protein, 5 aa, Mycobacterium
GFSGT

SEQ ID NO: 1009642 - protein, 26 aa, Mycobacterium
GFSGTGGAAGVGAGAPGGVGGGGAAD

SEQ ID NO: 1009643 - protein, 11 aa, Mycobacterium
GFSPGQNQQGD

SEQ ID NO: 1009644 - protein, 5 aa, Mycobacterium
GFTEA

SEQ ID NO: 1009645 - protein, 11 aa, Mycobacterium
GFTEQGPLTGE

SEQ ID NO: 1009646 - protein, 12 aa, Mycobacterium
GFTTRGKDRDDA

SEQ ID NO: 1009647 - protein, 10 aa, Mycobacterium
GGAAANAAVP

SEQ ID NO: 1009648 - protein, 6 aa, Mycobacterium
GGAAAR

SEQ ID NO: 1009649 - protein, 13 aa, Mycobacterium
GGAADALPAARPY

SEQ ID NO: 1009650 - protein, 33 aa, Mycobacterium
GGAAGLLGTGGTGGAGARLAGGAGGTGGAGGAG

SEQ ID NO: 1009651 - protein, 5 aa, Mycobacterium
GGAAH

SEQ ID NO: 1009652 - protein, 15 aa, Mycobacterium
GGAAPAAAAVTTPLA

SEQ ID NO: 1009653 - protein, 19 aa, Mycobacterium
GGAAQYAAAEAANASPLQT

SEQ ID NO: 1009654 - protein, 10 aa, Mycobacterium
GGAARERAGE

SEQ ID NO: 1009655 - protein, 4 aa, Mycobacterium
GGAD

SEQ ID NO: 1009656 - protein, 10 aa, Mycobacterium
GGADGATGPL

SEQ ID NO: 1009657 - protein, 10 aa, Mycobacterium
GGADPPPSRW

SEQ ID NO: 1009658 - protein, 8 aa, Mycobacterium
GGADPSTW

SEQ ID NO: 1009659 - protein, 12 aa, Mycobacterium
GGADRPAARPDD

SEQ ID NO: 1009660 - protein, 10 aa, Mycobacterium
GGADRTESVS

SEQ ID NO: 1009661 - protein, 10 aa, Mycobacterium
GGADSGHGGI

SEQ ID NO: 1009662 - protein, 8 aa, Mycobacterium
GGAEFGSG

SEQ ID NO: 1009663 - protein, 10 aa, Mycobacterium
GGAEGPGTGV

SEQ ID NO: 1009664 - protein, 14 aa, Mycobacterium
GGAELAGPDDSQPW

SEQ ID NO: 1009665 - protein, 36 aa, Mycobacterium
GGAGAAGIAPGSNGGNGGSGGVGGAGGAGGSGGQGG

SEQ ID NO: 1009666 - protein, 12 aa, Mycobacterium
GGAGGAAGSGGW

SEQ ID NO: 1009667 - protein, 70 aa, Mycobacterium
GGAGGAGGASLLSGNGGAGGAGGIGGTGAGGAGGDGGAAGAFSGNGGAGGIGVGGGGGGGGVGGAGGNAG

SEQ ID NO: 1009668 - protein, 24 aa, Mycobacterium
GGAGGAGGFGNNTTGGIGGLGGAG

SEQ ID NO: 1009669 - protein, 9 aa, Mycobacterium
GGAGGAGGL

SEQ ID NO: 1009670 - protein, 27 aa, Mycobacterium
GGAGGAGGSGTSGIGGLGGDGGSAGAL

SEQ ID NO: 1009671 - protein, 27 aa, Mycobacterium
GGAGGAGGYDVTTQAGLTGGNGGVGGK

SEQ ID NO: 1009672 - protein, 16 aa, Mycobacterium
GGAGGAYGAAEQAGIS

SEQ ID NO: 1009673 - protein, 8 aa, Mycobacterium
GGAGGDGG

SEQ ID NO: 1009674 - protein, 69 aa, Mycobacterium
GGAGGDGGASAGGTSPGGQSAGAGGNGGSGGATGLCGTGGAGGGKGGSSGATASLGGIGGSGGAGGDGG

SEQ ID NO: 1009675 - protein, 25 aa, Mycobacterium
GGAGGDGGSATVNAVGKGGDGGNAG

SEQ ID NO: 1009676 - protein, 22 aa, Mycobacterium
GGAGGEGGAGATAGPGGGGGAG

SEQ ID NO: 1009677 - protein, 9 aa, Mycobacterium
GGAGGEPDW

SEQ ID NO: 1009678 - protein, 40 aa, Mycobacterium
GGAGGFSGAGDGGCGGAGGGHGGTGGYGAFDGGAGGVGGH

SEQ ID NO: 1009679 - protein, 12 aa, Mycobacterium
GGAGGGGGDSPS

SEQ ID NO: 1009680 - protein, 33 aa, Mycobacterium
GGAGGGGTGGNGHGRPIGSGGAGGDGGDGGTGG

SEQ ID NO: 1009681 - protein, 27 aa, Mycobacterium
GGAGGHGGSAINANAGSGGAGGAGGAG

SEQ ID NO: 1009682 - protein, 9 aa, Mycobacterium
GGAGGIGAA

SEQ ID NO: 1009683 - protein, 8 aa, Mycobacterium
GGAGGIGG

SEQ ID NO: 1009684 - protein, 20 aa, Mycobacterium
GGAGGIGGSGAAGGAGGNGG

SEQ ID NO: 1009685 - protein, 38 aa, Mycobacterium
GGAGGMGGAGADGAVGAAGTAGTSTSAGGVGGAGWDAT

SEQ ID NO: 1009686 - protein, 41 aa, Mycobacterium
GGAGGNAGGLFGSGGAGGIGGAVGTGGTVAGAGGDGGGAGW

SEQ ID NO: 1009687 - protein, 20 aa, Mycobacterium
GGAGGNGAPGGTGVGGTGGS

SEQ ID NO: 1009688 - protein, 17 aa, Mycobacterium
GGAGGNGGLGGSGGTGV

SEQ ID NO: 1009689 - protein, 12 aa, Mycobacterium
GGAGGNGGNAGL

SEQ ID NO: 1009690 - protein, 44 aa, Mycobacterium
GGAGGNGGSGGDGGHGGNSALSVPGSIGGDAGAGGTGGSAGKSG

SEQ ID NO: 1009691 - protein, 63 aa, Mycobacterium
GGAGGPGGGASLDSLNGGTGGAGGSATVHNTQNAIGGNGGDGGAAGASSPSVATGATVGAGAM

SEQ ID NO: 1009692 - protein, 22 aa, Mycobacterium
GGAGGPGGSGGLNGGAGGAGGV

SEQ ID NO: 1009693 - protein, 44 aa, Mycobacterium
GGAGGQGGGGGTGGDGGDCAGANIGGDGGAGGAGGLGGNGTDGG

SEQ ID NO: 1009694 - protein, 26 aa, Mycobacterium
GGAGGQGGLGGNTVDGGNGGNGGNAA

SEQ ID NO: 1009695 - protein, 70 aa, Mycobacterium
GGAGGQGGQANAGGSTGTGGEGGDGGDAGLIGDGGNGGNAGTDTDGTPTGDPGTGGTGGTLLGANGNAGL

SEQ ID NO: 1009696 - protein, 18 aa, Mycobacterium
GGAGGQGGTGGMAGGYDN

SEQ ID NO: 1009697 - protein, 28 aa, Mycobacterium
GGAGGQGGTGITGINGGSAGHGGSGGNA

SEQ ID NO: 1009698 - protein, 25 aa, Mycobacterium
GGAGGSGGSSDTAASGAGGNGGTAA

SEQ ID NO: 1009699 - protein, 26 aa, Mycobacterium
GGAGGSGSGGLASAGGGGSAGGNAGL

SEQ ID NO: 1009700 - protein, 10 aa, Mycobacterium
GGAGGTGGAG

SEQ ID NO: 1009701 - protein, 16 aa, Mycobacterium
GGAGGTGGTGGTGGAA

SEQ ID NO: 1009702 - protein, 8 aa, Mycobacterium
GGAGGVGG

SEQ ID NO: 1009703 - protein, 34 aa, Mycobacterium
GGAGGVGGAGGNSAGGDGGLGGDGGASGAGGAAG

SEQ ID NO: 1009704 - protein, 77 aa, Mycobacterium
GGAGGVGTAAHPTGGSGGSAGLIGTGGAGGAGYGPAAQTGATGGSGGVGGTGGSGLDGPDSGAAGGAGGSGGSGGAA

SEQ ID NO: 1009705 - protein, 5 aa, Mycobacterium
GGAGM

SEQ ID NO: 1009706 - protein, 11 aa, Mycobacterium
GGAGPARTGCT

SEQ ID NO: 1009707 - protein, 8 aa, Mycobacterium
GGAGSEQW

SEQ ID NO: 1009708 - protein, 10 aa, Mycobacterium
GGAGTTAAGL

SEQ ID NO: 1009709 - protein, 10 aa, Mycobacterium
GGAGTTAAGM

SEQ ID NO: 1009710 - protein, 14 aa, Mycobacterium
GGAGYTAAKHAQGA

SEQ ID NO: 1009711 - protein, 5 aa, Mycobacterium
GGAHG

SEQ ID NO: 1009712 - protein, 11 aa, Mycobacterium
GGAKPGSGVGY

SEQ ID NO: 1009713 - protein, 8 aa, Mycobacterium
GGAKQAAM

SEQ ID NO: 1009714 - protein, 12 aa, Mycobacterium
GGAKTAKAVSKR

SEQ ID NO: 1009715 - protein, 7 aa, Mycobacterium
GGALPAG

SEQ ID NO: 1009716 - protein, 6 aa, Mycobacterium
GGALST

SEQ ID NO: 1009717 - protein, 4 aa, Mycobacterium
GGAM

SEQ ID NO: 1009718 - protein, 6 aa, Mycobacterium
GGAMTG

SEQ ID NO: 1009719 - protein, 4 aa, Mycobacterium
GGAN

SEQ ID NO: 1009720 - protein, 8 aa, Mycobacterium
GGANAGTR

SEQ ID NO: 1009721 - protein, 5 aa, Mycobacterium
GGAND

SEQ ID NO: 1009722 - protein, 10 aa, Mycobacterium
GGANIPSVTT

SEQ ID NO: 1009723 - protein, 5 aa, Mycobacterium
GGANS

SEQ ID NO: 1009724 - protein, 6 aa, Mycobacterium
GGANTG

SEQ ID NO: 1009725 - protein, 10 aa, Mycobacterium
GGANTSTSER

SEQ ID NO: 1009726 - protein, 4 aa, Mycobacterium
GGAP

SEQ ID NO: 1009727 - protein, 12 aa, Mycobacterium
GGAPAATAVTDS

SEQ ID NO: 1009728 - protein, 12 aa, Mycobacterium
GGAPAEEEEPEG

SEQ ID NO: 1009729 - protein, 8 aa, Mycobacterium
GGAPAGHA

SEQ ID NO: 1009730 - protein, 6 aa, Mycobacterium
GGAPAL

SEQ ID NO: 1009731 - protein, 9 aa, Mycobacterium
GGAPAPTES

SEQ ID NO: 1009732 - protein, 8 aa, Mycobacterium
GGAPGASS

SEQ ID NO: 1009733 - protein, 7 aa, Mycobacterium
GGAPKNP

SEQ ID NO: 1009734 - protein, 5 aa, Mycobacterium
GGAPR

SEQ ID NO: 1009735 - protein, 25 aa, Mycobacterium
GGAPYGADTPFGGYKDSGVGRQNGV

SEQ ID NO: 1009736 - protein, 6 aa, Mycobacterium
GGAQCP

SEQ ID NO: 1009737 - protein, 5 aa, Mycobacterium
GGAQL

SEQ ID NO: 1009738 - protein, 13 aa, Mycobacterium
GGAQSAFAKTGAY

SEQ ID NO: 1009739 - protein, 4 aa, Mycobacterium
GGAR

SEQ ID NO: 1009740 - protein, 13 aa, Mycobacterium
GGARDGTGAGSAM

SEQ ID NO: 1009741 - protein, 9 aa, Mycobacterium
GGARGQGRA

SEQ ID NO: 1009742 - protein, 13 aa, Mycobacterium
GGARGRAKAFRPS

SEQ ID NO: 1009743 - protein, 5 aa, Mycobacterium
GGARN

SEQ ID NO: 1009744 - protein, 14 aa, Mycobacterium
GGARRDEEKARAKE

SEQ ID NO: 1009745 - protein, 10 aa, Mycobacterium
GGASAAAAQL

SEQ ID NO: 1009746 - protein, 11 aa, Mycobacterium
GGASAAASGLA

SEQ ID NO: 1009747 - protein, 13 aa, Mycobacterium
GGASAAASGLPSW

SEQ ID NO: 1009748 - protein, 6 aa, Mycobacterium
GGASAE

SEQ ID NO: 1009749 - protein, 5 aa, Mycobacterium
GGASG

SEQ ID NO: 1009750 - protein, 8 aa, Mycobacterium
GGASGIGR

SEQ ID NO: 1009751 - protein, 8 aa, Mycobacterium
GGASGLGL

SEQ ID NO: 1009752 - protein, 10 aa, Mycobacterium
GGASQPRRTL

SEQ ID NO: 1009753 - protein, 13 aa, Mycobacterium
GGASSAAASLPSG

SEQ ID NO: 1009754 - protein, 9 aa, Mycobacterium
GGATLDNEE

SEQ ID NO: 1009755 - protein, 5 aa, Mycobacterium
GGATM

SEQ ID NO: 1009756 - protein, 16 aa, Mycobacterium
GGATPGSFTVTRPAVP

SEQ ID NO: 1009757 - protein, 18 aa, Mycobacterium
GGATVGGTSGGLAGPGDR

SEQ ID NO: 1009758 - protein, 6 aa, Mycobacterium
GGAVNE

SEQ ID NO: 1009759 - protein, 13 aa, Mycobacterium
GGAVPEPGEFSAA

SEQ ID NO: 1009760 - protein, 8 aa, Mycobacterium
GGAVSPTL

SEQ ID NO: 1009761 - protein, 12 aa, Mycobacterium
GGAVTSPGVRSA

SEQ ID NO: 1009762 - protein, 5 aa, Mycobacterium
GGAVV

SEQ ID NO: 1009763 - protein, 26 aa, Mycobacterium
GGCDRGGYRADARRTRTRSESLGGPP

SEQ ID NO: 1009764 - protein, 7 aa, Mycobacterium
GGCGGQI

SEQ ID NO: 1009765 - protein, 5 aa, Mycobacterium
GGCPH

SEQ ID NO: 1009766 - protein, 6 aa, Mycobacterium
GGCRVT

SEQ ID NO: 1009767 - protein, 10 aa, Mycobacterium
GGCSTPPAVA

SEQ ID NO: 1009768 - protein, 7 aa, Mycobacterium
GGDADRA

SEQ ID NO: 1009769 - protein, 9 aa, Mycobacterium
GGDAEERAA

SEQ ID NO: 1009770 - protein, 9 aa, Mycobacterium
GGDAKTWGD

SEQ ID NO: 1009771 - protein, 8 aa, Mycobacterium
GGDAMPSA

SEQ ID NO: 1009772 - protein, 6 aa, Mycobacterium
GGDAPR

SEQ ID NO: 1009773 - protein, 22 aa, Mycobacterium
GGDASSLAQYGPGWEQNPTARE

SEQ ID NO: 1009774 - protein, 10 aa, Mycobacterium
GGDATGAEVQ

SEQ ID NO: 1009775 - protein, 9 aa, Mycobacterium
GGDDDRGTE

SEQ ID NO: 1009776 - protein, 9 aa, Mycobacterium
GGDDGLDPV

SEQ ID NO: 1009777 - protein, 5 aa, Mycobacterium
GGDDI

SEQ ID NO: 1009778 - protein, 13 aa, Mycobacterium
GGDEADAGGHAPD

SEQ ID NO: 1009779 - protein, 5 aa, Mycobacterium
GGDEL

SEQ ID NO: 1009780 - protein, 9 aa, Mycobacterium
GGDETLPYT

SEQ ID NO: 1009781 - protein, 10 aa, Mycobacterium
GGDGAVGGNS

SEQ ID NO: 1009782 - protein, 36 aa, Mycobacterium
GGDGGIGGAGGNATASGSVAAGLDGGAGGAGGSGGH

SEQ ID NO: 1009783 - protein, 9 aa, Mycobacterium
GGDGGLGGT

SEQ ID NO: 1009784 - protein, 47 aa, Mycobacterium
GGDGGTGGTGASAAAGANGGAGQTGLAGTDGGTGGASGEGGAGGKGG

SEQ ID NO: 1009785 - protein, 14 aa, Mycobacterium
GGDKVPRKGGPGVT

SEQ ID NO: 1009786 - protein, 8 aa, Mycobacterium
GGDNLTAT

SEQ ID NO: 1009787 - protein, 7 aa, Mycobacterium
GGDNSPA

SEQ ID NO: 1009788 - protein, 5 aa, Mycobacterium
GGDPA

SEQ ID NO: 1009789 - protein, 8 aa, Mycobacterium
GGDPGVTA

SEQ ID NO: 1009790 - protein, 11 aa, Mycobacterium
GGDPQANAAEA

SEQ ID NO: 1009791 - protein, 7 aa, Mycobacterium
GGDPTGW

SEQ ID NO: 1009792 - protein, 7 aa, Mycobacterium
GGDPVRA

SEQ ID NO: 1009793 - protein, 5 aa, Mycobacterium
GGDPW

SEQ ID NO: 1009794 - protein, 7 aa, Mycobacterium
GGDQDPY

SEQ ID NO: 1009795 - protein, 37 aa, Mycobacterium
GGDQSFEKRPYPPGQHGRARIKDSEYRQQLQEKQKAR

SEQ ID NO: 1009796 - protein, 5 aa, Mycobacterium
GGDRA

SEQ ID NO: 1009797 - protein, 13 aa, Mycobacterium
GGDRDPGKRGPMG

SEQ ID NO: 1009798 - protein, 6 aa, Mycobacterium
GGDRFT

SEQ ID NO: 1009799 - protein, 6 aa, Mycobacterium
GGDRRL

SEQ ID NO: 1009800 - protein, 7 aa, Mycobacterium
GGDSAME

SEQ ID NO: 1009801 - protein, 5 aa, Mycobacterium
GGDSL

SEQ ID NO: 1009802 - protein, 11 aa, Mycobacterium
GGDSLAETRRN

SEQ ID NO: 1009803 - protein, 9 aa, Mycobacterium
GGDTDLGRT

SEQ ID NO: 1009804 - protein, 8 aa, Mycobacterium
GGDTGADC

SEQ ID NO: 1009805 - protein, 6 aa, Mycobacterium
GGDTLD

SEQ ID NO: 1009806 - protein, 8 aa, Mycobacterium
GGDTTKDI

SEQ ID NO: 1009807 - protein, 11 aa, Mycobacterium
GGEADDAERRL

SEQ ID NO: 1009808 - protein, 9 aa, Mycobacterium
GGEAGGHCG

SEQ ID NO: 1009809 - protein, 12 aa, Mycobacterium
GGEARDLDLPED

SEQ ID NO: 1009810 - protein, 6 aa, Mycobacterium
GGECPL

SEQ ID NO: 1009811 - protein, 10 aa, Mycobacterium
GGEEDGVEAE

SEQ ID NO: 1009812 - protein, 7 aa, Mycobacterium
GGEELPV

SEQ ID NO: 1009813 - protein, 13 aa, Mycobacterium
GGEETATVYAGTG

SEQ ID NO: 1009814 - protein, 9 aa, Mycobacterium
GGEFTAGNE

SEQ ID NO: 1009815 - protein, 5 aa, Mycobacterium
GGEGA

SEQ ID NO: 1009816 - protein, 58 aa, Mycobacterium
GGEGGAGGTGGAGGTGGAGGDGLAATTAGGTGGNAGDGGEGGAGGNAGAGGAGGQGGL

SEQ ID NO: 1009817 - protein, 11 aa, Mycobacterium
GGEGGGHTGPV

SEQ ID NO: 1009818 - protein, 200 aa, Mycobacterium
GGEGGLPGTGAGTAGSIGSAGNGGEGGFGGIGGNSYYAGNAGPGGQGGQGGAGANGAPGLAGGTGGAGGFGGTGGIANGTGNGGTGGKGGTGGDGGTGGTATTADQTGGDGGDGGKGGGGGTGGKANGGDGGDGGGGGDGGDGGGGGDGGAGGAGGNGDGAVGGIGGGGGTGGTGGTGTPPGGANGGPGKTGADGLGGHT

SEQ ID NO: 1009819 - protein, 6 aa, Mycobacterium
GGEKAL

SEQ ID NO: 1009820 - protein, 5 aa, Mycobacterium
GGEKV

SEQ ID NO: 1009821 - protein, 4 aa, Mycobacterium
GGEL

SEQ ID NO: 1009822 - protein, 4 aa, Mycobacterium
GGEN

SEQ ID NO: 1009823 - protein, 7 aa, Mycobacterium
GGEPAGL

SEQ ID NO: 1009824 - protein, 7 aa, Mycobacterium
GGEPANR

SEQ ID NO: 1009825 - protein, 7 aa, Mycobacterium
GGEPTVR

SEQ ID NO: 1009826 - protein, 6 aa, Mycobacterium
GGEQDA

SEQ ID NO: 1009827 - protein, 6 aa, Mycobacterium
GGERGE

SEQ ID NO: 1009828 - protein, 10 aa, Mycobacterium
GGERKNDPDW

SEQ ID NO: 1009829 - protein, 6 aa, Mycobacterium
GGESAR

SEQ ID NO: 1009830 - protein, 14 aa, Mycobacterium
GGESPGSADGLASP

SEQ ID NO: 1009831 - protein, 15 aa, Mycobacterium
GGESSGRRRIRPGTG

SEQ ID NO: 1009832 - protein, 8 aa, Mycobacterium
GGESTASL

SEQ ID NO: 1009833 - protein, 16 aa, Mycobacterium
GGESTRPGAARVDPAV

SEQ ID NO: 1009834 - protein, 5 aa, Mycobacterium
GGEVP

SEQ ID NO: 1009835 - protein, 10 aa, Mycobacterium
GGEVPSESDI

SEQ ID NO: 1009836 - protein, 38 aa, Mycobacterium
GGFGAGSGGGGGLTEPAGAGGVGDVAPAGSAPSGDGFA

SEQ ID NO: 1009837 - protein, 49 aa, Mycobacterium
GGFGGFGGTGGQGGLFGNGGNGGSGGNGGGGARNGADAGPGALGGQGGS

SEQ ID NO: 1009838 - protein, 18 aa, Mycobacterium
GGFGTATGGDGGAGGQGA

SEQ ID NO: 1009839 - protein, 6 aa, Mycobacterium
GGFGTG

SEQ ID NO: 1009840 - protein, 13 aa, Mycobacterium
GGFTAPASRHRAS

SEQ ID NO: 1009841 - protein, 16 aa, Mycobacterium
GGFTGGPAYGSDGAEL

SEQ ID NO: 1009842 - protein, 5 aa, Mycobacterium
GGFTS

SEQ ID NO: 1009843 - protein, 8 aa, Mycobacterium
GGGAATDV

SEQ ID NO: 1009844 - protein, 9 aa, Mycobacterium
GGGADPAVR

SEQ ID NO: 1009845 - protein, 10 aa, Mycobacterium
GGGAGGAGGI

SEQ ID NO: 1009846 - protein, 21 aa, Mycobacterium
GGGAGGIGGGTGGVGGTGGDA

SEQ ID NO: 1009847 - protein, 53 aa, Mycobacterium
GGGAGGVGGLGAAGSATAAPGMGGHGGAGGTSYQLGGAAGAGGAGGQGGLGYD

SEQ ID NO: 1009848 - protein, 8 aa, Mycobacterium
GGGAPEAV

SEQ ID NO: 1009849 - protein, 12 aa, Mycobacterium
GGGAPSPEQSSQ

SEQ ID NO: 1009850 - protein, 9 aa, Mycobacterium
GGGATPAEA

SEQ ID NO: 1009851 - protein, 9 aa, Mycobacterium
GGGDGTVAA

SEQ ID NO: 1009852 - protein, 8 aa, Mycobacterium
GGGDSAAA

SEQ ID NO: 1009853 - protein, 4 aa, Mycobacterium
GGGE

SEQ ID NO: 1009854 - protein, 7 aa, Mycobacterium
GGGEAVE

SEQ ID NO: 1009855 - protein, 7 aa, Mycobacterium
GGGEKKT

SEQ ID NO: 1009856 - protein, 5 aa, Mycobacterium
GGGEM

SEQ ID NO: 1009857 - protein, 7 aa, Mycobacterium
GGGERKT

SEQ ID NO: 1009858 - protein, 6 aa, Mycobacterium
GGGEVL

SEQ ID NO: 1009859 - protein, 12 aa, Mycobacterium
GGGGAGGDGGAG

SEQ ID NO: 1009860 - protein, 7 aa, Mycobacterium
GGGGAYQ

SEQ ID NO: 1009861 - protein, 6 aa, Mycobacterium
GGGGGA

SEQ ID NO: 1009862 - protein, 48 aa, Mycobacterium
GGGGGSIPGGPTGGGGPGGGGGTIPGVGGGGGGPGGGGDCIGNICGSY

SEQ ID NO: 1009863 - protein, 31 aa, Mycobacterium
GGGGHRDPRHRASGPLSDELPAAGSGRGVPQ

SEQ ID NO: 1009864 - protein, 18 aa, Mycobacterium
GGGGPAGIGGWAPQGGVG

SEQ ID NO: 1009865 - protein, 23 aa, Mycobacterium
GGGGPGSRKRSAPAHRGHRPPRL

SEQ ID NO: 1009866 - protein, 13 aa, Mycobacterium
GGGGQGDALILRA

SEQ ID NO: 1009867 - protein, 13 aa, Mycobacterium
GGGGRPGDTDLGN

SEQ ID NO: 1009868 - protein, 13 aa, Mycobacterium
GGGGRPLAETSGR

SEQ ID NO: 1009869 - protein, 6 aa, Mycobacterium
GGGGRS

SEQ ID NO: 1009870 - protein, 9 aa, Mycobacterium
GGGGRSTRQ

SEQ ID NO: 1009871 - protein, 47 aa, Mycobacterium
GGGGVGGVGGAGAAGGSGGTGGNGGAAGSGGANGGDGGVGGAATDTF

SEQ ID NO: 1009872 - protein, 7 aa, Mycobacterium
GGGGVTD

SEQ ID NO: 1009873 - protein, 11 aa, Mycobacterium
GGGIGGTGGFG

SEQ ID NO: 1009874 - protein, 4 aa, Mycobacterium
GGGL

SEQ ID NO: 1009875 - protein, 8 aa, Mycobacterium
GGGLGRGG

SEQ ID NO: 1009876 - protein, 5 aa, Mycobacterium
GGGLN

SEQ ID NO: 1009877 - protein, 13 aa, Mycobacterium
GGGMANATIIERL

SEQ ID NO: 1009878 - protein, 14 aa, Mycobacterium
GGGMGSATVIEVAA

SEQ ID NO: 1009879 - protein, 5 aa, Mycobacterium
GGGNI

SEQ ID NO: 1009880 - protein, 43 aa, Mycobacterium
GGGPALPAGAPEGDAGAGVSAVPTGASAAEQCGGRSSGPAFAS

SEQ ID NO: 1009881 - protein, 8 aa, Mycobacterium
GGGPGDPE

SEQ ID NO: 1009882 - protein, 6 aa, Mycobacterium
GGGPGI

SEQ ID NO: 1009883 - protein, 6 aa, Mycobacterium
GGGPGY

SEQ ID NO: 1009884 - protein, 12 aa, Mycobacterium
GGGPIAGCMLLT

SEQ ID NO: 1009885 - protein, 7 aa, Mycobacterium
GGGPNGL

SEQ ID NO: 1009886 - protein, 11 aa, Mycobacterium
GGGQDDGDARA

SEQ ID NO: 1009887 - protein, 8 aa, Mycobacterium
GGGQGNHL

SEQ ID NO: 1009888 - protein, 7 aa, Mycobacterium
GGGQSTN

SEQ ID NO: 1009889 - protein, 6 aa, Mycobacterium
GGGQVT

SEQ ID NO: 1009890 - protein, 4 aa, Mycobacterium
GGGR

SEQ ID NO: 1009891 - protein, 19 aa, Mycobacterium
GGGRANPDLDLGSNAGGYV

SEQ ID NO: 1009892 - protein, 6 aa, Mycobacterium
GGGRGF

SEQ ID NO: 1009893 - protein, 9 aa, Mycobacterium
GGGRPAGRQ

SEQ ID NO: 1009894 - protein, 9 aa, Mycobacterium
GGGRTKALA

SEQ ID NO: 1009895 - protein, 5 aa, Mycobacterium
GGGSD

SEQ ID NO: 1009896 - protein, 9 aa, Mycobacterium
GGGSGIGKG

SEQ ID NO: 1009897 - protein, 5 aa, Mycobacterium
GGGSS

SEQ ID NO: 1009898 - protein, 12 aa, Mycobacterium
GGGSSGAGQQRL

SEQ ID NO: 1009899 - protein, 5 aa, Mycobacterium
GGGSV

SEQ ID NO: 1009900 - protein, 4 aa, Mycobacterium
GGGT

SEQ ID NO: 1009901 - protein, 5 aa, Mycobacterium
GGGTA

SEQ ID NO: 1009902 - protein, 5 aa, Mycobacterium
GGGTC

SEQ ID NO: 1009903 - protein, 5 aa, Mycobacterium
GGGTD

SEQ ID NO: 1009904 - protein, 29 aa, Mycobacterium
GGGTDRGVTDPRSHPASGSEPAGRTGSCA

SEQ ID NO: 1009905 - protein, 7 aa, Mycobacterium
GGGTFTP

SEQ ID NO: 1009906 - protein, 73 aa, Mycobacterium; identical to SEQ ID NO: 485454

SEQ ID NO: 1009907 - protein, 4 aa, Mycobacterium
GGGV

SEQ ID NO: 1009908 - protein, 9 aa, Mycobacterium
GGGYPAARA

SEQ ID NO: 1009909 - protein, 6 aa, Mycobacterium
GGHDSL

SEQ ID NO: 1009910 - protein, 7 aa, Mycobacterium
GGHGGIG

SEQ ID NO: 1009911 - protein, 24 aa, Mycobacterium
GGHGGNAGSGVGGAANGGNGGSVG

SEQ ID NO: 1009912 - protein, 27 aa, Mycobacterium
GGHGGSGGTAYAGSGAVGGTGGNGGAG

SEQ ID NO: 1009913 - protein, 25 aa, Mycobacterium
GGHGGTGGTSASGTGATGGSGGAGG

SEQ ID NO: 1009914 - protein, 6 aa, Mycobacterium
GGHPPT

SEQ ID NO: 1009915 - protein, 8 aa, Mycobacterium
GGHPVGAS

SEQ ID NO: 1009916 - protein, 12 aa, Mycobacterium
GGHTRDHGKAPV

SEQ ID NO: 1009917 - protein, 8 aa, Mycobacterium
GGHTRGEF

SEQ ID NO: 1009918 - protein, 8 aa, Mycobacterium
GGHTWPGS

SEQ ID NO: 1009919 - protein, 7 aa, Mycobacterium
GGIATPE

SEQ ID NO: 1009920 - protein, 4 aa, Mycobacterium
GGID

SEQ ID NO: 1009921 - protein, 7 aa, Mycobacterium
GGIDSPQ

SEQ ID NO: 1009922 - protein, 6 aa, Mycobacterium
GGIEGA

SEQ ID NO: 1009923 - protein, 4 aa, Mycobacterium
GGIG

SEQ ID NO: 1009924 - protein, 39 aa, Mycobacterium; identical to SEQ ID NO: 485557

SEQ ID NO: 1009925 - protein, 11 aa, Mycobacterium
GGIGGGGDSVH

SEQ ID NO: 1009926 - protein, 7 aa, Mycobacterium
GGIGGNH

SEQ ID NO: 1009927 - protein, 22 aa, Mycobacterium
GGIGGQGGAGALGGAGGSGGAA

SEQ ID NO: 1009928 - protein, 19 aa, Mycobacterium
GGIGGQGGAGGIGGAGGSA

SEQ ID NO: 1009929 - protein, 26 aa, Mycobacterium
GGIGGSGGQGMASGGAGGAGGASGLV

SEQ ID NO: 1009930 - protein, 25 aa, Mycobacterium
GGIGGSGTPGTVANPTGGVGGVGGA

SEQ ID NO: 1009931 - protein, 71 aa, Mycobacterium
GGIGGTEGTGGTGGIGATGGAGGTGGVGGSAGSTDGGVADANIGGDGDIAGTGGDGGTGGVGGVGGSGGAG

SEQ ID NO: 1009932 - protein, 53 aa, Mycobacterium
GGIGGVGGIGGNGGAGGTSGLIGDGGAGGAGGTGGGNAGVGGVGGVGGTGGAA

SEQ ID NO: 1009933 - protein, 16 aa, Mycobacterium
GGIGNVGGKGGAGAAG

SEQ ID NO: 1009934 - protein, 8 aa, Mycobacterium
GGIGPTAL

SEQ ID NO: 1009935 - protein, 8 aa, Mycobacterium
GGIGSGQQ

SEQ ID NO: 1009936 - protein, 8 aa, Mycobacterium
GGIGTGAI

SEQ ID NO: 1009937 - protein, 6 aa, Mycobacterium
GGIGTR

SEQ ID NO: 1009938 - protein, 8 aa, Mycobacterium
GGINSPDK

SEQ ID NO: 1009939 - protein, 4 aa, Mycobacterium
GGIQ

SEQ ID NO: 1009940 - protein, 9 aa, Mycobacterium
GGIRDDDSL

SEQ ID NO: 1009941 - protein, 8 aa, Mycobacterium
GGIRPDQD

SEQ ID NO: 1009942 - protein, 13 aa, Mycobacterium
GGIRPSKTGSSVV

SEQ ID NO: 1009943 - protein, 8 aa, Mycobacterium
GGIRTGMD

SEQ ID NO: 1009944 - protein, 7 aa, Mycobacterium
GGISGPE

SEQ ID NO: 1009945 - protein, 4 aa, Mycobacterium
GGIT

SEQ ID NO: 1009946 - protein, 13 aa, Mycobacterium
GGITADSDPGAEW

SEQ ID NO: 1009947 - protein, 6 aa, Mycobacterium
GGITET

SEQ ID NO: 1009948 - protein, 13 aa, Mycobacterium
GGKAERNQRTEEI

SEQ ID NO: 1009949 - protein, 8 aa, Mycobacterium
GGKDGKDT

SEQ ID NO: 1009950 - protein, 20 aa, Mycobacterium
GGKEAEQRAASSVKEKNDWS

SEQ ID NO: 1009951 - protein, 7 aa, Mycobacterium
GGKGGAL

SEQ ID NO: 1009952 - protein, 7 aa, Mycobacterium
GGKGPTI

SEQ ID NO: 1009953 - protein, 15 aa, Mycobacterium
GGKGYASRTPTNRRY

SEQ ID NO: 1009954 - protein, 7 aa, Mycobacterium
GGKIETG

SEQ ID NO: 1009955 - protein, 8 aa, Mycobacterium
GGKNGESS

SEQ ID NO: 1009956 - protein, 6 aa, Mycobacterium
GGKNVA

SEQ ID NO: 1009957 - protein, 7 aa, Mycobacterium
GGKPGRP

SEQ ID NO: 1009958 - protein, 13 aa, Mycobacterium
GGKPNSHDDADYD

SEQ ID NO: 1009959 - protein, 10 aa, Mycobacterium
GGKQTPRDRE

SEQ ID NO: 1009960 - protein, 4 aa, Mycobacterium
GGKR

SEQ ID NO: 1009961 - protein, 6 aa, Mycobacterium
GGKSPN

SEQ ID NO: 1009962 - protein, 13 aa, Mycobacterium
GGKVAGGETEPAA

SEQ ID NO: 1009963 - protein, 5 aa, Mycobacterium
GGLAA

SEQ ID NO: 1009964 - protein, 9 aa, Mycobacterium
GGLDPESAT

SEQ ID NO: 1009965 - protein, 5 aa, Mycobacterium
GGLDS

SEQ ID NO: 1009966 - protein, 15 aa, Mycobacterium
GGLGGAGGAGGNGGQ

SEQ ID NO: 1009967 - protein, 24 aa, Mycobacterium
GGLGGAGGFGGSGGGAGGQGGAGG

SEQ ID NO: 1009968 - protein, 6 aa, Mycobacterium
GGLGGD

SEQ ID NO: 1009969 - protein, 5 aa, Mycobacterium
GGLGS

SEQ ID NO: 1009970 - protein, 4 aa, Mycobacterium
GGLI

SEQ ID NO: 1009971 - protein, 8 aa, Mycobacterium
GGLKTNRD

SEQ ID NO: 1009972 - protein, 8 aa, Mycobacterium
GGLNPAGL

SEQ ID NO: 1009973 - protein, 8 aa, Mycobacterium
GGLPALPA

SEQ ID NO: 1009974 - protein, 8 aa, Mycobacterium
GGLPDVDN

SEQ ID NO: 1009975 - protein, 11 aa, Mycobacterium
GGLPESGLVPT

SEQ ID NO: 1009976 - protein, 5 aa, Mycobacterium
GGLPS

SEQ ID NO: 1009977 - protein, 12 aa, Mycobacterium
GGLRPGRTEREV

SEQ ID NO: 1009978 - protein, 13 aa, Mycobacterium
GGMDKNVGLELRV

SEQ ID NO: 1009979 - protein, 89 aa, Mycobacterium
GGMGGGGGNAASSGFDGGVGGQDGTGGQGGDGGTGTTDGSGAQGGQGGTGGHGGVGTNGGSGDPGDTGDLGGVPSGVTGGTGGAGGAGG

SEQ ID NO: 1009980 - protein, 9 aa, Mycobacterium
GGMPAPPPL

SEQ ID NO: 1009981 - protein, 6 aa, Mycobacterium
GGMPPM

SEQ ID NO: 1009982 - protein, 5 aa, Mycobacterium
GGMRT

SEQ ID NO: 1009983 - protein, 13 aa, Mycobacterium
GGMSEEDKQTVRE

SEQ ID NO: 1009984 - protein, 4 aa, Mycobacterium
GGMT

SEQ ID NO: 1009985 - protein, 24 aa, Mycobacterium
GGNAGNLNLGGGNTGNANLGSGNN

SEQ ID NO: 1009986 - protein, 12 aa, Mycobacterium
GGNAGPSPIDGW

SEQ ID NO: 1009987 - protein, 4 aa, Mycobacterium
GGNG

SEQ ID NO: 1009988 - protein, 6 aa, Mycobacterium
GGNGER

SEQ ID NO: 1009989 - protein, 68 aa, Mycobacterium
GGNGGAAGTGGAGGAGGAGGAGGAGGAGGTSSVSGNIGAVGGNGGDGGDGGDGGAAGAAGGAGGQGGF

SEQ ID NO: 1009990 - protein, 37 aa, Mycobacterium
GGNGGIGGAGGAGADGVNPLPADAPFSHADSGQQGHD

SEQ ID NO: 1009991 - protein, 25 aa, Mycobacterium
GGNGGIGGTGAVGGTGAVGGAGGNG

SEQ ID NO: 1009992 - protein, 130 aa, Mycobacterium
GGNGGNGGGGGAGGNGGNGAAGVSAGGAGGAGGEGNGGTAGTGGKGGDGGTASDDGVGGDGGSGGRGGDGNTRYTPRGNVGGHGGNGGTGGAAGTGGHGGNGGDGGNGGINANGAAGGAGGNGGAGGGST

SEQ ID NO: 1009993 - protein, 42 aa, Mycobacterium
GGNGGNGGMGGHGGDSGYGDQTGGRGGNGGMGGAGGAAGNGG

SEQ ID NO: 1009994 - protein, 28 aa, Mycobacterium
GGNGGTGGFSGPLSAGAGGGDGGAGGGV

SEQ ID NO: 1009995 - protein, 8 aa, Mycobacterium
GGNLGNGN

SEQ ID NO: 1009996 - protein, 7 aa, Mycobacterium
GGNNAGH

SEQ ID NO: 1009997 - protein, 5 aa, Mycobacterium
GGNPM

SEQ ID NO: 1009998 - protein, 7 aa, Mycobacterium
GGNPQYD

SEQ ID NO: 1009999 - protein, 5 aa, Mycobacterium
GGNRG

SEQ ID NO: 1010000 - protein, 14 aa, Mycobacterium
GGNTATASASGVGN

SEQ ID NO: 1010001 - protein, 7 aa, Mycobacterium
GGNTTTV

SEQ ID NO: 1010002 - protein, 5 aa, Mycobacterium
GGNVA

SEQ ID NO: 1010003 - protein, 5 aa, Mycobacterium
GGNVE

SEQ ID NO: 1010004 - protein, 6 aa, Mycobacterium
GGPAAI

SEQ ID NO: 1010005 - protein, 10 aa, Mycobacterium
GGPAAQQAAS

SEQ ID NO: 1010006 - protein, 8 aa, Mycobacterium
GGPAPRPV

SEQ ID NO: 1010007 - protein, 6 aa, Mycobacterium
GGPARN

SEQ ID NO: 1010008 - protein, 6 aa, Mycobacterium
GGPASF

SEQ ID NO: 1010009 - protein, 15 aa, Mycobacterium
GGPASVYAPGAPQLD

SEQ ID NO: 1010010 - protein, 9 aa, Mycobacterium
GGPATPVHA

SEQ ID NO: 1010011 - protein, 4 aa, Mycobacterium
GGPE

SEQ ID NO: 1010012 - protein, 6 aa, Mycobacterium
GGPEIG

SEQ ID NO: 1010013 - protein, 10 aa, Mycobacterium
GGPEPYTGAP

SEQ ID NO: 1010014 - protein, 9 aa, Mycobacterium
GGPGASSWS

SEQ ID NO: 1010015 - protein, 12 aa, Mycobacterium
GGPGGAATLSAP

SEQ ID NO: 1010016 - protein, 7 aa, Mycobacterium
GGPGGLA

SEQ ID NO: 1010017 - protein, 8 aa, Mycobacterium
GGPGIGSE

SEQ ID NO: 1010018 - protein, 5 aa, Mycobacterium
GGPGR

SEQ ID NO: 1010019 - protein, 6 aa, Mycobacterium
GGPGRT

SEQ ID NO: 1010020 - protein, 7 aa, Mycobacterium
GGPGTEV

SEQ ID NO: 1010021 - protein, 8 aa, Mycobacterium
GGPGTGKS

SEQ ID NO: 1010022 - protein, 5 aa, Mycobacterium
GGPGV

SEQ ID NO: 1010023 - protein, 7 aa, Mycobacterium
GGPIHPR

SEQ ID NO: 1010024 - protein, 4 aa, Mycobacterium
GGPK

SEQ ID NO: 1010025 - protein, 6 aa, Mycobacterium
GGPLQP

SEQ ID NO: 1010026 - protein, 4 aa, Mycobacterium
GGPN

SEQ ID NO: 1010027 - protein, 8 aa, Mycobacterium
GGPNPEGN

SEQ ID NO: 1010028 - protein, 4 aa, Mycobacterium
GGPP

SEQ ID NO: 1010029 - protein, 23 aa, Mycobacterium
GGPPQPPGPPEAESEAPRHSRHA

SEQ ID NO: 1010030 - protein, 10 aa, Mycobacterium
GGPPSPETAL

SEQ ID NO: 1010031 - protein, 9 aa, Mycobacterium
GGPPSSDHV

SEQ ID NO: 1010032 - protein, 4 aa, Mycobacterium
GGPQ

SEQ ID NO: 1010033 - protein, 8 aa, Mycobacterium
GGPQDPTL

SEQ ID NO: 1010034 - protein, 5 aa, Mycobacterium
GGPQI

SEQ ID NO: 1010035 - protein, 6 aa, Mycobacterium
GGPQPV

SEQ ID NO: 1010036 - protein, 6 aa, Mycobacterium
GGPQTY

SEQ ID NO: 1010037 - protein, 4 aa, Mycobacterium
GGPR

SEQ ID NO: 1010038 - protein, 5 aa, Mycobacterium
GGPRL

SEQ ID NO: 1010039 - protein, 4 aa, Mycobacterium
GGPS

SEQ ID NO: 1010040 - protein, 9 aa, Mycobacterium
GGPSGQAGA

SEQ ID NO: 1010041 - protein, 15 aa, Mycobacterium
GGPSGSGLASPDGLA

SEQ ID NO: 1010042 - protein, 8 aa, Mycobacterium
GGPSRLRG

SEQ ID NO: 1010043 - protein, 5 aa, Mycobacterium
GGPTG

SEQ ID NO: 1010044 - protein, 4 aa, Mycobacterium
GGPV

SEQ ID NO: 1010045 - protein, 9 aa, Mycobacterium
GGPVGSGKT

SEQ ID NO: 1010046 - protein, 8 aa, Mycobacterium
GGPVPIPE

SEQ ID NO: 1010047 - protein, 12 aa, Mycobacterium
GGPVSNNKGISL

SEQ ID NO: 1010048 - protein, 10 aa, Mycobacterium
GGPVVGPPPF

SEQ ID NO: 1010049 - protein, 4 aa, Mycobacterium
GGPY

SEQ ID NO: 1010050 - protein, 18 aa, Mycobacterium
GGQAAASLDSVTTPAGGQ

SEQ ID NO: 1010051 - protein, 6 aa, Mycobacterium
GGQAGN

SEQ ID NO: 1010052 - protein, 8 aa, Mycobacterium
GGQAGTPL

SEQ ID NO: 1010053 - protein, 26 aa, Mycobacterium
GGQAPALSRLGGSDWTNTKTKARKAV

SEQ ID NO: 1010054 - protein, 7 aa, Mycobacterium
GGQASGR

SEQ ID NO: 1010055 - protein, 5 aa, Mycobacterium
GGQDL

SEQ ID NO: 1010056 - protein, 8 aa, Mycobacterium
GGQEPTAT

SEQ ID NO: 1010057 - protein, 15 aa, Mycobacterium
GGQERDIRSGTPDVA

SEQ ID NO: 1010058 - protein, 4 aa, Mycobacterium
GGQG

SEQ ID NO: 1010059 - protein, 48 aa, Mycobacterium; identical to SEQ ID NO: 486196

SEQ ID NO: 1010060 - protein, 33 aa, Mycobacterium
GGQGGGGGFGGLGGTGAGGAPSDKGINGEPGNP

SEQ ID NO: 1010061 - protein, 7 aa, Mycobacterium
GGQITQE

SEQ ID NO: 1010062 - protein, 21 aa, Mycobacterium
GGQLTTHHPGEQQIGGVPEQP

SEQ ID NO: 1010063 - protein, 8 aa, Mycobacterium
GGQPGQGF

SEQ ID NO: 1010064 - protein, 6 aa, Mycobacterium
GGQPMD

SEQ ID NO: 1010065 - protein, 6 aa, Mycobacterium
GGQPVD

SEQ ID NO: 1010066 - protein, 6 aa, Mycobacterium
GGQTAL

SEQ ID NO: 1010067 - protein, 10 aa, Mycobacterium
GGQTGPTPAD

SEQ ID NO: 1010068 - protein, 13 aa, Mycobacterium
GGQTGQNGTDSKA

SEQ ID NO: 1010069 - protein, 8 aa, Mycobacterium
GGQTSAES

SEQ ID NO: 1010070 - protein, 9 aa, Mycobacterium
GGRAPKPGE

SEQ ID NO: 1010071 - protein, 4 aa, Mycobacterium
GGRE

SEQ ID NO: 1010072 - protein, 17 aa, Mycobacterium
GGREAKPYDVLLGHPET

SEQ ID NO: 1010073 - protein, 5 aa, Mycobacterium
GGREH

SEQ ID NO: 1010074 - protein, 6 aa, Mycobacterium
GGREKC

SEQ ID NO: 1010075 - protein, 9 aa, Mycobacterium
GGRGDLDPD

SEQ ID NO: 1010076 - protein, 13 aa, Mycobacterium
GGRGIRVDVVDTD

SEQ ID NO: 1010077 - protein, 7 aa, Mycobacterium
GGRGLST

SEQ ID NO: 1010078 - protein, 8 aa, Mycobacterium
GGRGPTER

SEQ ID NO: 1010079 - protein, 6 aa, Mycobacterium
GGRGSG

SEQ ID NO: 1010080 - protein, 11 aa, Mycobacterium
GGRGSRIGRPI

SEQ ID NO: 1010081 - protein, 10 aa, Mycobacterium
GGRGVGSAEN

SEQ ID NO: 1010082 - protein, 4 aa, Mycobacterium
GGRH

SEQ ID NO: 1010083 - protein, 15 aa, Mycobacterium
GGRHPTASSAMLNSL

SEQ ID NO: 1010084 - protein, 17 aa, Mycobacterium
GGRINTDALDNSAGVDC

SEQ ID NO: 1010085 - protein, 11 aa, Mycobacterium
GGRKAAERQAD

SEQ ID NO: 1010086 - protein, 7 aa, Mycobacterium
GGRLGDG

SEQ ID NO: 1010087 - protein, 5 aa, Mycobacterium
GGRLT

SEQ ID NO: 1010088 - protein, 6 aa, Mycobacterium
GGRNLA

SEQ ID NO: 1010089 - protein, 7 aa, Mycobacterium
GGRPAYT

SEQ ID NO: 1010090 - protein, 19 aa, Mycobacterium
GGRPKSPARSQDIEFGGDK

SEQ ID NO: 1010091 - protein, 14 aa, Mycobacterium
GGRPLADDTARSQV

SEQ ID NO: 1010092 - protein, 11 aa, Mycobacterium
GGRPLTSNPGL

SEQ ID NO: 1010093 - protein, 6 aa, Mycobacterium
GGRPVR

SEQ ID NO: 1010094 - protein, 7 aa, Mycobacterium
GGRQASA

SEQ ID NO: 1010095 - protein, 5 aa, Mycobacterium
GGRQE

SEQ ID NO: 1010096 - protein, 8 aa, Mycobacterium
GGRQKTHY

SEQ ID NO: 1010097 - protein, 8 aa, Mycobacterium
GGRQPGGV

SEQ ID NO: 1010098 - protein, 8 aa, Mycobacterium
GGRRARHH

SEQ ID NO: 1010099 - protein, 5 aa, Mycobacterium
GGRRE

SEQ ID NO: 1010100 - protein, 12 aa, Mycobacterium
GGRRGCDPAGPV

SEQ ID NO: 1010101 - protein, 6 aa, Mycobacterium
GGRRST

SEQ ID NO: 1010102 - protein, 4 aa, Mycobacterium
GGRS

SEQ ID NO: 1010103 - protein, 12 aa, Mycobacterium
GGRSAKSSMCGL

SEQ ID NO: 1010104 - protein, 15 aa, Mycobacterium
GGRSNSGEGGEDVGR

SEQ ID NO: 1010105 - protein, 7 aa, Mycobacterium
GGRSSAR

SEQ ID NO: 1010106 - protein, 11 aa, Mycobacterium
GGRTESYIDER

SEQ ID NO: 1010107 - protein, 10 aa, Mycobacterium
GGRTRTGKLR

SEQ ID NO: 1010108 - protein, 14 aa, Mycobacterium
GGRTVGAGRVVKII

SEQ ID NO: 1010109 - protein, 10 aa, Mycobacterium
GGRVDPGENA

SEQ ID NO: 1010110 - protein, 4 aa, Mycobacterium
GGSA

SEQ ID NO: 1010111 - protein, 5 aa, Mycobacterium
GGSAA

SEQ ID NO: 1010112 - protein, 27 aa, Mycobacterium
GGSAGAGLSRASGLSATAANNSSIGTN

SEQ ID NO: 1010113 - protein, 7 aa, Mycobacterium
GGSAGAH

SEQ ID NO: 1010114 - protein, 8 aa, Mycobacterium
GGSAGGHL

SEQ ID NO: 1010115 - protein, 16 aa, Mycobacterium
GGSAIANGATAVTAGT

SEQ ID NO: 1010116 - protein, 10 aa, Mycobacterium
GGSAPSLAEA

SEQ ID NO: 1010117 - protein, 10 aa, Mycobacterium
GGSASRGPIG

SEQ ID NO: 1010118 - protein, 5 aa, Mycobacterium
GGSDQ

SEQ ID NO: 1010119 - protein, 4 aa, Mycobacterium
GGSE

SEQ ID NO: 1010120 - protein, 7 aa, Mycobacterium
GGSEARP

SEQ ID NO: 1010121 - protein, 11 aa, Mycobacterium
GGSEEDETAWR

SEQ ID NO: 1010122 - protein, 8 aa, Mycobacterium
GGSEGVGA

SEQ ID NO: 1010123 - protein, 10 aa, Mycobacterium
GGSELSYGSD

SEQ ID NO: 1010124 - protein, 9 aa, Mycobacterium
GGSENIGPI

SEQ ID NO: 1010125 - protein, 7 aa, Mycobacterium
GGSETID

SEQ ID NO: 1010126 - protein, 10 aa, Mycobacterium
GGSGAGKTTL

SEQ ID NO: 1010127 - protein, 6 aa, Mycobacterium
GGSGEW

SEQ ID NO: 1010128 - protein, 5 aa, Mycobacterium
GGSGG

SEQ ID NO: 1010129 - protein, 7 aa, Mycobacterium
GGSGGAG

SEQ ID NO: 1010130 - protein, 10 aa, Mycobacterium
GGSGGAGGDG

SEQ ID NO: 1010131 - protein, 24 aa, Mycobacterium
GGSGGGDPAAGTYPQEMLVDWVRV

SEQ ID NO: 1010132 - protein, 8 aa, Mycobacterium
GGSGGSPV

SEQ ID NO: 1010133 - protein, 53 aa, Mycobacterium
GGSGGVGQKGGNGGSAGLWGNGGNGGLGGEGVQGGPGHPGQAGGNGGNGGNAG

SEQ ID NO: 1010134 - protein, 6 aa, Mycobacterium
GGSGIK

SEQ ID NO: 1010135 - protein, 10 aa, Mycobacterium
GGSGRTSTET

SEQ ID NO: 1010136 - protein, 134 aa, Mycobacterium
GGSGSRGADGVTGPNPNGGGGGDDGAGGAGGQGGNGGLAGHAQAAGYSDGVQGVGGVGGKGGAGGLAGDGGTGAAGTFANGGNGIGGTGGDGGDNGARGAGGTGGSGSTTGTDGASGTTTTSGGNGGNGGRGAD

SEQ ID NO: 1010137 - protein, 8 aa, Mycobacterium
GGSGTSIT

SEQ ID NO: 1010138 - protein, 11 aa, Mycobacterium
GGSGTSPAARL

SEQ ID NO: 1010139 - protein, 14 aa, Mycobacterium
GGSIPPVEVPGGPS

SEQ ID NO: 1010140 - protein, 6 aa, Mycobacterium
GGSNDL

SEQ ID NO: 1010141 - protein, 10 aa, Mycobacterium
GGSPESSRYA

SEQ ID NO: 1010142 - protein, 9 aa, Mycobacterium
GGSPGASTA

SEQ ID NO: 1010143 - protein, 5 aa, Mycobacterium
GGSPL

SEQ ID NO: 1010144 - protein, 8 aa, Mycobacterium
GGSPREIA

SEQ ID NO: 1010145 - protein, 7 aa, Mycobacterium
GGSPTDV

SEQ ID NO: 1010146 - protein, 7 aa, Mycobacterium
GGSQPAV

SEQ ID NO: 1010147 - protein, 6 aa, Mycobacterium
GGSQTV

SEQ ID NO: 1010148 - protein, 6 aa, Mycobacterium
GGSQVT

SEQ ID NO: 1010149 - protein, 9 aa, Mycobacterium
GGSRAGNAE

SEQ ID NO: 1010150 - protein, 9 aa, Mycobacterium
GGSRKAAVS

SEQ ID NO: 1010151 - protein, 27 aa, Mycobacterium
GGSRSRRASRRTDSARRVGHGTNLVFV

SEQ ID NO: 1010152 - protein, 6 aa, Mycobacterium
GGSSEY

SEQ ID NO: 1010153 - protein, 9 aa, Mycobacterium
GGSSGIGEA

SEQ ID NO: 1010154 - protein, 4 aa, Mycobacterium
GGST

SEQ ID NO: 1010155 - protein, 8 aa, Mycobacterium
GGSTNEVQ

SEQ ID NO: 1010156 - protein, 12 aa, Mycobacterium
GGSVGTFDRPTP

SEQ ID NO: 1010157 - protein, 9 aa, Mycobacterium
GGSYAEPAL

SEQ ID NO: 1010158 - protein, 15 aa, Mycobacterium
GGSYAETEAANAVAA

SEQ ID NO: 1010159 - protein, 8 aa, Mycobacterium
GGSYKAAA

SEQ ID NO: 1010160 - protein, 9 aa, Mycobacterium
GGTAAAGDI

SEQ ID NO: 1010161 - protein, 15 aa, Mycobacterium
GGTAELSTDQGEGTE

SEQ ID NO: 1010162 - protein, 7 aa, Mycobacterium
GGTAGPG

SEQ ID NO: 1010163 - protein, 10 aa, Mycobacterium
GGTAPSAETL

SEQ ID NO: 1010164 - protein, 30 aa, Mycobacterium
GGTAPTPAEAARLDADEAAARAAGRAPHQS

SEQ ID NO: 1010165 - protein, 6 aa, Mycobacterium
GGTASP

SEQ ID NO: 1010166 - protein, 13 aa, Mycobacterium
GGTAVQQQAGVRD

SEQ ID NO: 1010167 - protein, 7 aa, Mycobacterium
GGTDAKA

SEQ ID NO: 1010168 - protein, 10 aa, Mycobacterium
GGTDPAGPLT

SEQ ID NO: 1010169 - protein, 11 aa, Mycobacterium
GGTDTDGAEGA

SEQ ID NO: 1010170 - protein, 8 aa, Mycobacterium
GGTDVDGH

SEQ ID NO: 1010171 - protein, 6 aa, Mycobacterium
GGTEDE

SEQ ID NO: 1010172 - protein, 15 aa, Mycobacterium
GGTEIVDGNGAKIKG

SEQ ID NO: 1010173 - protein, 8 aa, Mycobacterium
GGTESDNL

SEQ ID NO: 1010174 - protein, 4 aa, Mycobacterium
GGTF

SEQ ID NO: 1010175 - protein, 17 aa, Mycobacterium
GGTGDSGDGIGAGETAA

SEQ ID NO: 1010176 - protein, 6 aa, Mycobacterium
GGTGDW

SEQ ID NO: 1010177 - protein, 56 aa, Mycobacterium
GGTGGAGGAGGAGSDGIIPSNGGLGGNGGNGGNGGQAFGDGVGGAGGIGGKGGNAA

SEQ ID NO: 1010178 - protein, 10 aa, Mycobacterium
GGTGGAGGLT

SEQ ID NO: 1010179 - protein, 33 aa, Mycobacterium
GGTGGMGGLGGNGGAATTAGTNGGAGGDGGLGG

SEQ ID NO: 1010180 - protein, 8 aa, Mycobacterium
GGTGGNGG

SEQ ID NO: 1010181 - protein, 31 aa, Mycobacterium
GGTGGTGGDAVAGLPGVNGGNGGNGPAGGAA

SEQ ID NO: 1010182 - protein, 12 aa, Mycobacterium
GGTGGTGGNGPD

SEQ ID NO: 1010183 - protein, 15 aa, Mycobacterium
GGTGISPTDSTPEQT

SEQ ID NO: 1010184 - protein, 14 aa, Mycobacterium
GGTGMARPGAVSRA

SEQ ID NO: 1010185 - protein, 17 aa, Mycobacterium
GGTGPAEGSKSTTVTPG

SEQ ID NO: 1010186 - protein, 12 aa, Mycobacterium
GGTGQLESTVSD

SEQ ID NO: 1010187 - protein, 25 aa, Mycobacterium
GGTGSCDAGGGRYGNAGGGSIALRS

SEQ ID NO: 1010188 - protein, 14 aa, Mycobacterium
GGTGTDVGKRHPTL

SEQ ID NO: 1010189 - protein, 6 aa, Mycobacterium
GGTHAA

SEQ ID NO: 1010190 - protein, 7 aa, Mycobacterium
GGTHDNW

SEQ ID NO: 1010191 - protein, 6 aa, Mycobacterium
GGTHDP

SEQ ID NO: 1010192 - protein, 23 aa, Mycobacterium
GGTISTSTGTDGVRRPSRNGAQL

SEQ ID NO: 1010193 - protein, 9 aa, Mycobacterium
GGTLSSGSR

SEQ ID NO: 1010194 - protein, 13 aa, Mycobacterium
GGTLSTWQAERLI

SEQ ID NO: 1010195 - protein, 5 aa, Mycobacterium
GGTMP

SEQ ID NO: 1010196 - protein, 7 aa, Mycobacterium
GGTNEVQ

SEQ ID NO: 1010197 - protein, 9 aa, Mycobacterium
GGTNGKTSV

SEQ ID NO: 1010198 - protein, 6 aa, Mycobacterium
GGTNTG

SEQ ID NO: 1010199 - protein, 15 aa, Mycobacterium
GGTNVTGALDPNRGQ

SEQ ID NO: 1010200 - protein, 11 aa, Mycobacterium
GGTPDSALTGP

SEQ ID NO: 1010201 - protein, 8 aa, Mycobacterium
GGTPEEFA

SEQ ID NO: 1010202 - protein, 6 aa, Mycobacterium
GGTPEG

SEQ ID NO: 1010203 - protein, 6 aa, Mycobacterium
GGTPES

SEQ ID NO: 1010204 - protein, 5 aa, Mycobacterium
GGTPG

SEQ ID NO: 1010205 - protein, 7 aa, Mycobacterium
GGTPLRS

SEQ ID NO: 1010206 - protein, 9 aa, Mycobacterium
GGTPRQVEN

SEQ ID NO: 1010207 - protein, 8 aa, Mycobacterium
GGTPSLLG

SEQ ID NO: 1010208 - protein, 27 aa, Mycobacterium
GGTQSTGGDGGGGGGGDAGVGGAGGAL

SEQ ID NO: 1010209 - protein, 4 aa, Mycobacterium
GGTR

SEQ ID NO: 1010210 - protein, 5 aa, Mycobacterium
GGTRE

SEQ ID NO: 1010211 - protein, 5 aa, Mycobacterium
GGTRL

SEQ ID NO: 1010212 - protein, 6 aa, Mycobacterium
GGTSEI

SEQ ID NO: 1010213 - protein, 8 aa, Mycobacterium
GGTSLEAA

SEQ ID NO: 1010214 - protein, 5 aa, Mycobacterium
GGTTE

SEQ ID NO: 1010215 - protein, 8 aa, Mycobacterium
GGTTGTPK

SEQ ID NO: 1010216 - protein, 12 aa, Mycobacterium
GGTVGRGGGPSY

SEQ ID NO: 1010217 - protein, 7 aa, Mycobacterium
GGVAEKG

SEQ ID NO: 1010218 - protein, 7 aa, Mycobacterium
GGVAPSI

SEQ ID NO: 1010219 - protein, 8 aa, Mycobacterium
GGVATDDA

SEQ ID NO: 1010220 - protein, 13 aa, Mycobacterium
GGVDDRDRNADLG

SEQ ID NO: 1010221 - protein, 7 aa, Mycobacterium
GGVDNPE

SEQ ID NO: 1010222 - protein, 5 aa, Mycobacterium
GGVDS

SEQ ID NO: 1010223 - protein, 8 aa, Mycobacterium
GGVDSPDR

SEQ ID NO: 1010224 - protein, 8 aa, Mycobacterium
GGVDSPEG

SEQ ID NO: 1010225 - protein, 6 aa, Mycobacterium
GGVEAA

SEQ ID NO: 1010226 - protein, 14 aa, Mycobacterium
GGVETGQALTSNPG

SEQ ID NO: 1010227 - protein, 6 aa, Mycobacterium
GGVGGA

SEQ ID NO: 1010228 - protein, 103 aa, Mycobacterium
GGVGGAGGAASTAGGSGGLGGGGGAGGDGTAGAAGVNPTTMPAGNGTPGFTGRDTGGPGGPGADSTEYGQTGGTGGTGGYGRVEGGDGGVGGSGGAGGGGGHG

SEQ ID NO: 1010229 - protein, 18 aa, Mycobacterium
GGVGGAGGAGADAVGPPF

SEQ ID NO: 1010230 - protein, 24 aa, Mycobacterium
GGVGGAGGSSSSAGGAGGVGGAGG

SEQ ID NO: 1010231 - protein, 15 aa, Mycobacterium
GGVGGGGGAGGGAGV

SEQ ID NO: 1010232 - protein, 39 aa, Mycobacterium; identical to SEQ ID NO: 486991

SEQ ID NO: 1010233 - protein, 7 aa, Mycobacterium
GGVGKTS

SEQ ID NO: 1010234 - protein, 10 aa, Mycobacterium
GGVGKTTITA

SEQ ID NO: 1010235 - protein, 10 aa, Mycobacterium
GGVGKTTTAA

SEQ ID NO: 1010236 - protein, 7 aa, Mycobacterium
GGVGTAS

SEQ ID NO: 1010237 - protein, 4 aa, Mycobacterium
GGVP

SEQ ID NO: 1010238 - protein, 13 aa, Mycobacterium
GGVPAYGNQRTEW

SEQ ID NO: 1010239 - protein, 11 aa, Mycobacterium
GGVPDGPWPDA

SEQ ID NO: 1010240 - protein, 5 aa, Mycobacterium
GGVPG

SEQ ID NO: 1010241 - protein, 4 aa, Mycobacterium
GGVR

SEQ ID NO: 1010242 - protein, 7 aa, Mycobacterium
GGVSAGA

SEQ ID NO: 1010243 - protein, 8 aa, Mycobacterium
GGVSGGTV

SEQ ID NO: 1010244 - protein, 6 aa, Mycobacterium
GGVSSL

SEQ ID NO: 1010245 - protein, 8 aa, Mycobacterium
GGVTGSAA

SEQ ID NO: 1010246 - protein, 5 aa, Mycobacterium
GGVTK

SEQ ID NO: 1010247 - protein, 7 aa, Mycobacterium
GGVTQGV

SEQ ID NO: 1010248 - protein, 9 aa, Mycobacterium
GGVTSAYDP

SEQ ID NO: 1010249 - protein, 21 aa, Mycobacterium
GGVVADSNGPYEYNEARNKAR

SEQ ID NO: 1010250 - protein, 9 aa, Mycobacterium
GGWEPDAKG

SEQ ID NO: 1010251 - protein, 5 aa, Mycobacterium
GGWPE

SEQ ID NO: 1010252 - protein, 7 aa, Mycobacterium
GGWPEAD

SEQ ID NO: 1010253 - protein, 9 aa, Mycobacterium
GGWQTTTGM

SEQ ID NO: 1010254 - protein, 5 aa, Mycobacterium
GGYAE

SEQ ID NO: 1010255 - protein, 5 aa, Mycobacterium
GGYDP

SEQ ID NO: 1010256 - protein, 7 aa, Mycobacterium
GGYGGDS

SEQ ID NO: 1010257 - protein, 5 aa, Mycobacterium
GGYQQ

SEQ ID NO: 1010258 - protein, 5 aa, Mycobacterium
GGYRI

SEQ ID NO: 1010259 - protein, 8 aa, Mycobacterium
GHAAPGTL

SEQ ID NO: 1010260 - protein, 8 aa, Mycobacterium
GHADAGNQ

SEQ ID NO: 1010261 - protein, 4 aa, Mycobacterium
GHAE

SEQ ID NO: 1010262 - protein, 12 aa, Mycobacterium
GHAGGEHGVFDV

SEQ ID NO: 1010263 - protein, 8 aa, Mycobacterium
GHAGSPAE

SEQ ID NO: 1010264 - protein, 11 aa, Mycobacterium
GHAQRPGDPTL

SEQ ID NO: 1010265 - protein, 6 aa, Mycobacterium
GHDEPG

SEQ ID NO: 1010266 - protein, 12 aa, Mycobacterium
GHDGESSPGFAA

SEQ ID NO: 1010267 - protein, 6 aa, Mycobacterium
GHDPRR

SEQ ID NO: 1010268 - protein, 9 aa, Mycobacterium
GHDPSDQES

SEQ ID NO: 1010269 - protein, 5 aa, Mycobacterium
GHDRG

SEQ ID NO: 1010270 - protein, 11 aa, Mycobacterium
GHDSKAQSFSG

SEQ ID NO: 1010271 - protein, 11 aa, Mycobacterium
GHDTTSATISG

SEQ ID NO: 1010272 - protein, 5 aa, Mycobacterium
GHEEE

SEQ ID NO: 1010273 - protein, 6 aa, Mycobacterium
GHEGSG

SEQ ID NO: 1010274 - protein, 9 aa, Mycobacterium
GHEHGADGI

SEQ ID NO: 1010275 - protein, 11 aa, Mycobacterium
GHEIGGPTSEL

SEQ ID NO: 1010276 - protein, 22 aa, Mycobacterium
GHEPDETADHAPVTASPPEIDQ

SEQ ID NO: 1010277 - protein, 6 aa, Mycobacterium
GHEPDN

SEQ ID NO: 1010278 - protein, 6 aa, Mycobacterium
GHEPRY

SEQ ID NO: 1010279 - protein, 6 aa, Mycobacterium
GHGAQL

SEQ ID NO: 1010280 - protein, 12 aa, Mycobacterium
GHGESDWSPHGD

SEQ ID NO: 1010281 - protein, 16 aa, Mycobacterium
GHGESLPERTEAPGYR

SEQ ID NO: 1010282 - protein, 216 aa, Mycobacterium
GHGGAGGNGGNGGIGGENASNRGATGGAGGVGGIGGAGSLSIRGGGYGGLGGNGGTGGAGGAGANETYGGSGGSGGAAGNGGVGGLNGVGGNGGVGGHGGNGQFNGGNGGKGGVGGTAGAGTTAGNGGHGGTGGTGGDGQTAAGVGGSGGTGGNGGRGGTGGAGGTGVTGGDGGRGGSGGAGGDGAGTCAGNGGNGGLGGAGGNGGHGGTSTLNEQ

SEQ ID NO: 1010283 - protein, 9 aa, Mycobacterium
GHGGDGGNA

SEQ ID NO: 1010284 - protein, 11 aa, Mycobacterium
GHGNSTSIGAE

SEQ ID NO: 1010285 - protein, 4 aa, Mycobacterium
GHGQ

SEQ ID NO: 1010286 - protein, 5 aa, Mycobacterium
GHGRA

SEQ ID NO: 1010287 - protein, 12 aa, Mycobacterium
GHGRSGIPRRGG

SEQ ID NO: 1010288 - protein, 25 aa, Mycobacterium
GHGSAGGSSLNLAGGDGGDGGQGGF

SEQ ID NO: 1010289 - protein, 6 aa, Mycobacterium
GHGTGT

SEQ ID NO: 1010290 - protein, 12 aa, Mycobacterium
GHGTGTTLGDPI

SEQ ID NO: 1010291 - protein, 10 aa, Mycobacterium
GHHDPASMTP

SEQ ID NO: 1010292 - protein, 12 aa, Mycobacterium
GHKISVRGDDKE

SEQ ID NO: 1010293 - protein, 17 aa, Mycobacterium
GHLPGDDGHSAAAKDGF

SEQ ID NO: 1010294 - protein, 6 aa, Mycobacterium
GHNADR

SEQ ID NO: 1010295 - protein, 13 aa, Mycobacterium
GHNEGDDPSMTNP

SEQ ID NO: 1010296 - protein, 5 aa, Mycobacterium
GHPAA

SEQ ID NO: 1010297 - protein, 7 aa, Mycobacterium
GHPAGDV

SEQ ID NO: 1010298 - protein, 12 aa, Mycobacterium
GHPDPSSGTIDA

SEQ ID NO: 1010299 - protein, 7 aa, Mycobacterium
GHPLGAT

SEQ ID NO: 1010300 - protein, 5 aa, Mycobacterium
GHPPP

SEQ ID NO: 1010301 - protein, 5 aa, Mycobacterium
GHPPS

SEQ ID NO: 1010302 - protein, 18 aa, Mycobacterium
GHPRIGARADNASSAREQ

SEQ ID NO: 1010303 - protein, 5 aa, Mycobacterium
GHQAR

SEQ ID NO: 1010304 - protein, 4 aa, Mycobacterium
GHQL

SEQ ID NO: 1010305 - protein, 8 aa, Mycobacterium
GHQPRTEA

SEQ ID NO: 1010306 - protein, 12 aa, Mycobacterium
GHQWPGSRSKPV

SEQ ID NO: 1010307 - protein, 5 aa, Mycobacterium
GHRGR

SEQ ID NO: 1010308 - protein, 7 aa, Mycobacterium
GHRRERL

SEQ ID NO: 1010309 - protein, 4 aa, Mycobacterium
GHSD

SEQ ID NO: 1010310 - protein, 9 aa, Mycobacterium
GHSDAAGSD

SEQ ID NO: 1010311 - protein, 5 aa, Mycobacterium
GHSEP

SEQ ID NO: 1010312 - protein, 58 aa, Mycobacterium
GHSGGDGGRGGLGGNGGHGGVGGGHTAGNGFNDGTTGAGGVGGVGGTGGVGGTGGDGL

SEQ ID NO: 1010313 - protein, 9 aa, Mycobacterium
GHSGGSPHT

SEQ ID NO: 1010314 - protein, 6 aa, Mycobacterium
GHSPAQ

SEQ ID NO: 1010315 - protein, 5 aa, Mycobacterium
GHSPG

SEQ ID NO: 1010316 - protein, 13 aa, Mycobacterium
GHSQTTQTGETAM

SEQ ID NO: 1010317 - protein, 7 aa, Mycobacterium
GHSSSGV

SEQ ID NO: 1010318 - protein, 10 aa, Mycobacterium
GHSTGRDPAT

SEQ ID NO: 1010319 - protein, 8 aa, Mycobacterium
GHSTPTVT

SEQ ID NO: 1010320 - protein, 11 aa, Mycobacterium
GHTETDDGRGI

SEQ ID NO: 1010321 - protein, 5 aa, Mycobacterium
GHTHA

SEQ ID NO: 1010322 - protein, 6 aa, Mycobacterium
GHTNTG

SEQ ID NO: 1010323 - protein, 14 aa, Mycobacterium
GHTNTGLANPTDYN

SEQ ID NO: 1010324 - protein, 13 aa, Mycobacterium
GHTPETPQQAEED

SEQ ID NO: 1010325 - protein, 12 aa, Mycobacterium
GHTPSAEVPTNR

SEQ ID NO: 1010326 - protein, 6 aa, Mycobacterium
GHTQKG

SEQ ID NO: 1010327 - protein, 8 aa, Mycobacterium
GHTRGDDL

SEQ ID NO: 1010328 - protein, 4 aa, Mycobacterium
GHVG

SEQ ID NO: 1010329 - protein, 10 aa, Mycobacterium
GHYAASPQGL

SEQ ID NO: 1010330 - protein, 6 aa, Mycobacterium
GHYSGA

SEQ ID NO: 1010331 - protein, 7 aa, Mycobacterium
GIADTGV

SEQ ID NO: 1010332 - protein, 4 aa, Mycobacterium
GIAP

SEQ ID NO: 1010333 - protein, 5 aa, Mycobacterium
GIAPG

SEQ ID NO: 1010334 - protein, 12 aa, Mycobacterium
GIASDGSEVIGE

SEQ ID NO: 1010335 - protein, 7 aa, Mycobacterium
GIASRRA

SEQ ID NO: 1010336 - protein, 4 aa, Mycobacterium
GIDA

SEQ ID NO: 1010337 - protein, 5 aa, Mycobacterium
GIDAS

SEQ ID NO: 1010338 - protein, 6 aa, Mycobacterium
GIDGPT

SEQ ID NO: 1010339 - protein, 12 aa, Mycobacterium
GIDGVGGHRPGQ

SEQ ID NO: 1010340 - protein, 6 aa, Mycobacterium
GIDPGA

SEQ ID NO: 1010341 - protein, 13 aa, Mycobacterium
GIDPTPAFEGTDV

SEQ ID NO: 1010342 - protein, 5 aa, Mycobacterium
GIDRS

SEQ ID NO: 1010343 - protein, 5 aa, Mycobacterium
GIDTE

SEQ ID NO: 1010344 - protein, 4 aa, Mycobacterium
GIEA

SEQ ID NO: 1010345 - protein, 8 aa, Mycobacterium
GIEASDDP

SEQ ID NO: 1010346 - protein, 12 aa, Mycobacterium
GIEPGGLRGSAT

SEQ ID NO: 1010347 - protein, 12 aa, Mycobacterium
GIEPSEVTPEKS

SEQ ID NO: 1010348 - protein, 4 aa, Mycobacterium
GIEV

SEQ ID NO: 1010349 - protein, 13 aa, Mycobacterium
GIGATENAEGFTT

SEQ ID NO: 1010350 - protein, 41 aa, Mycobacterium
GIGEGGKLGDAGSGGNPPNGDTGSGGSGGAGGSGGAGGDPS

SEQ ID NO: 1010351 - protein, 4 aa, Mycobacterium
GIGG

SEQ ID NO: 1010352 - protein, 6 aa, Mycobacterium
GIGGAS

SEQ ID NO: 1010353 - protein, 8 aa, Mycobacterium
GIGGDGGD

SEQ ID NO: 1010354 - protein, 19 aa, Mycobacterium
GIGGDGGGGGDGGAGGNGG

SEQ ID NO: 1010355 - protein, 45 aa, Mycobacterium
GIGGHGGAGGSLFGDGGDGGSAGFQSTAGDGGNAGLVGNGGNGGW

SEQ ID NO: 1010356 - protein, 10 aa, Mycobacterium
GIGGQGGTAM

SEQ ID NO: 1010357 - protein, 35 aa, Mycobacterium
GIGGQGGTGGEAGGGTGIHAGNGGTGGNGGGGGWL

SEQ ID NO: 1010358 - protein, 23 aa, Mycobacterium
GIGGTGAAGAGMGGMGGNGGSGS

SEQ ID NO: 1010359 - protein, 43 aa, Mycobacterium
GIGGTGGAGATGSSGGAGGVGFGSGGTGGFGGAGAAGGTGGDG

SEQ ID NO: 1010360 - protein, 8 aa, Mycobacterium
GIGKRGAE

SEQ ID NO: 1010361 - protein, 6 aa, Mycobacterium
GIGKTR

SEQ ID NO: 1010362 - protein, 22 aa, Mycobacterium
GIGNSGALNTGIGNSGLNAGSG

SEQ ID NO: 1010363 - protein, 7 aa, Mycobacterium
GIGNTGA

SEQ ID NO: 1010364 - protein, 9 aa, Mycobacterium
GIGNTGNNN

SEQ ID NO: 1010365 - protein, 7 aa, Mycobacterium
GIGPAEL

SEQ ID NO: 1010366 - protein, 5 aa, Mycobacterium
GIGPG

SEQ ID NO: 1010367 - protein, 5 aa, Mycobacterium
GIGQQ

SEQ ID NO: 1010368 - protein, 20 aa, Mycobacterium
GIGSDNPNKVVTTDFKIVAE

SEQ ID NO: 1010369 - protein, 11 aa, Mycobacterium
GIGSSTPHQYG

SEQ ID NO: 1010370 - protein, 6 aa, Mycobacterium
GIGTAA

SEQ ID NO: 1010371 - protein, 6 aa, Mycobacterium
GIGTGG

SEQ ID NO: 1010372 - protein, 9 aa, Mycobacterium
GIGTPERAA

SEQ ID NO: 1010373 - protein, 7 aa, Mycobacterium
GIKDTSD

SEQ ID NO: 1010374 - protein, 5 aa, Mycobacterium
GIKNE

SEQ ID NO: 1010375 - protein, 8 aa, Mycobacterium
GINNDEAR

SEQ ID NO: 1010376 - protein, 9 aa, Mycobacterium
GIPAGDTSW

SEQ ID NO: 1010377 - protein, 4 aa, Mycobacterium
GIPE

SEQ ID NO: 1010378 - protein, 6 aa, Mycobacterium
GIPEDA

SEQ ID NO: 1010379 - protein, 7 aa, Mycobacterium
GIPEEQA

SEQ ID NO: 1010380 - protein, 7 aa, Mycobacterium
GIPGPRK

SEQ ID NO: 1010381 - protein, 6 aa, Mycobacterium
GIPGQD

SEQ ID NO: 1010382 - protein, 7 aa, Mycobacterium
GIPGSTA

SEQ ID NO: 1010383 - protein, 4 aa, Mycobacterium
GIPP

SEQ ID NO: 1010384 - protein, 13 aa, Mycobacterium
GIPPSSLRRSQTG

SEQ ID NO: 1010385 - protein, 7 aa, Mycobacterium
GIPSPAD

SEQ ID NO: 1010386 - protein, 11 aa, Mycobacterium
GIPTESLAGTR

SEQ ID NO: 1010387 - protein, 7 aa, Mycobacterium
GIPTPGF

SEQ ID NO: 1010388 - protein, 9 aa, Mycobacterium
GIPTPGLPF

SEQ ID NO: 1010389 - protein, 14 aa, Mycobacterium
GIRATADAAEALAG

SEQ ID NO: 1010390 - protein, 11 aa, Mycobacterium
GIRERGGAPVE

SEQ ID NO: 1010391 - protein, 5 aa, Mycobacterium
GIRKN

SEQ ID NO: 1010392 - protein, 6 aa, Mycobacterium
GIRPGD

SEQ ID NO: 1010393 - protein, 13 aa, Mycobacterium
GISDAYKTGRGSI

SEQ ID NO: 1010394 - protein, 4 aa, Mycobacterium
GISG

SEQ ID NO: 1010395 - protein, 18 aa, Mycobacterium
GISGEHERRDGRDRPGTM

SEQ ID NO: 1010396 - protein, 8 aa, Mycobacterium
GISKDGRQ

SEQ ID NO: 1010397 - protein, 5 aa, Mycobacterium
GISMP

SEQ ID NO: 1010398 - protein, 14 aa, Mycobacterium
GISPSSASLRNPFP

SEQ ID NO: 1010399 - protein, 5 aa, Mycobacterium
GISRD

SEQ ID NO: 1010400 - protein, 25 aa, Mycobacterium
GISSPPVAVPPAEPGPPTPRRDEPL

SEQ ID NO: 1010401 - protein, 7 aa, Mycobacterium
GITAPAG

SEQ ID NO: 1010402 - protein, 15 aa, Mycobacterium
GITDENGDEPPRTAD

SEQ ID NO: 1010403 - protein, 8 aa, Mycobacterium
GITDPAGL

SEQ ID NO: 1010404 - protein, 26 aa, Mycobacterium
GITGGDHQAGGVAGSSGAVADPLARR

SEQ ID NO: 1010405 - protein, 7 aa, Mycobacterium
GITGRDA

SEQ ID NO: 1010406 - protein, 12 aa, Mycobacterium
GITGSDGPAHNG

SEQ ID NO: 1010407 - protein, 11 aa, Mycobacterium
GITGSDGPSHN

SEQ ID NO: 1010408 - protein, 4 aa, Mycobacterium
GITP

SEQ ID NO: 1010409 - protein, 8 aa, Mycobacterium
GITPAERT

SEQ ID NO: 1010410 - protein, 6 aa, Mycobacterium
GITRSG

SEQ ID NO: 1010411 - protein, 26 aa, Mycobacterium
GITTETGTHLDTTRDDGIAHPDPEES

SEQ ID NO: 1010412 - protein, 9 aa, Mycobacterium
GIVEDADGN

SEQ ID NO: 1010413 - protein, 5 aa, Mycobacterium
GKAAA

SEQ ID NO: 1010414 - protein, 14 aa, Mycobacterium
GKAATTTAVAGGST

SEQ ID NO: 1010415 - protein, 6 aa, Mycobacterium
GKADQL

SEQ ID NO: 1010416 - protein, 6 aa, Mycobacterium
GKAEPV

SEQ ID NO: 1010417 - protein, 9 aa, Mycobacterium
GKAFSAPPA

SEQ ID NO: 1010418 - protein, 9 aa, Mycobacterium
GKAFSSGGS

SEQ ID NO: 1010419 - protein, 12 aa, Mycobacterium
GKAGGSIGRNSS

SEQ ID NO: 1010420 - protein, 18 aa, Mycobacterium
GKAGGVKYAATPDDAYEH

SEQ ID NO: 1010421 - protein, 19 aa, Mycobacterium
GKAGGVKYAATPEEAYQQA

SEQ ID NO: 1010422 - protein, 8 aa, Mycobacterium
GKAGQKRW

SEQ ID NO: 1010423 - protein, 8 aa, Mycobacterium
GKAGRQAV

SEQ ID NO: 1010424 - protein, 12 aa, Mycobacterium
GKAGSETEYGSA

SEQ ID NO: 1010425 - protein, 9 aa, Mycobacterium
GKAGTGKSA

SEQ ID NO: 1010426 - protein, 11 aa, Mycobacterium
GKAHGLGDPSG

SEQ ID NO: 1010427 - protein, 4 aa, Mycobacterium
GKAK

SEQ ID NO: 1010428 - protein, 9 aa, Mycobacterium
GKAKEVPAA

SEQ ID NO: 1010429 - protein, 5 aa, Mycobacterium
GKAQA

SEQ ID NO: 1010430 - protein, 15 aa, Mycobacterium
GKAQGGMASSRSQLG

SEQ ID NO: 1010431 - protein, 9 aa, Mycobacterium
GKAQPGQVA

SEQ ID NO: 1010432 - protein, 5 aa, Mycobacterium
GKASV

SEQ ID NO: 1010433 - protein, 7 aa, Mycobacterium
GKATPEA

SEQ ID NO: 1010434 - protein, 6 aa, Mycobacterium
GKATWS

SEQ ID NO: 1010435 - protein, 8 aa, Mycobacterium
GKCDADRG

SEQ ID NO: 1010436 - protein, 13 aa, Mycobacterium
GKCGSCSAEINGK

SEQ ID NO: 1010437 - protein, 5 aa, Mycobacterium
GKCTA

SEQ ID NO: 1010438 - protein, 6 aa, Mycobacterium
GKDEDE

SEQ ID NO: 1010439 - protein, 7 aa, Mycobacterium
GKDGKLG

SEQ ID NO: 1010440 - protein, 7 aa, Mycobacterium
GKDGNAG

SEQ ID NO: 1010441 - protein, 9 aa, Mycobacterium
GKDKGAKGK

SEQ ID NO: 1010442 - protein, 10 aa, Mycobacterium
GKDLDAKQQQ

SEQ ID NO: 1010443 - protein, 5 aa, Mycobacterium
GKDRQ

SEQ ID NO: 1010444 - protein, 9 aa, Mycobacterium
GKDSPDFGT

SEQ ID NO: 1010445 - protein, 4 aa, Mycobacterium
GKDT

SEQ ID NO: 1010446 - protein, 24 aa, Mycobacterium
GKDVDPAAYGQQAHPATDEPAPIR

SEQ ID NO: 1010447 - protein, 7 aa, Mycobacterium
GKDWSRR

SEQ ID NO: 1010448 - protein, 8 aa, Mycobacterium
GKEAHESW

SEQ ID NO: 1010449 - protein, 9 aa, Mycobacterium
GKEIDRSPA

SEQ ID NO: 1010450 - protein, 6 aa, Mycobacterium
GKELEG

SEQ ID NO: 1010451 - protein, 13 aa, Mycobacterium
GKFGGENSGYNVS

SEQ ID NO: 1010452 - protein, 4 aa, Mycobacterium
GKFR

SEQ ID NO: 1010453 - protein, 7 aa, Mycobacterium
GKFTDTT

SEQ ID NO: 1010454 - protein, 11 aa, Mycobacterium
GKFTSDESRTL

SEQ ID NO: 1010455 - protein, 33 aa, Mycobacterium
GKGAAGGDGGDGGLYGNGGKGGDGGDGGTGQGG

SEQ ID NO: 1010456 - protein, 5 aa, Mycobacterium
GKGAD

SEQ ID NO: 1010457 - protein, 14 aa, Mycobacterium
GKGAEISVEPRDVP

SEQ ID NO: 1010458 - protein, 15 aa, Mycobacterium
GKGCAEAMKGQGARV

SEQ ID NO: 1010459 - protein, 6 aa, Mycobacterium
GKGDGG

SEQ ID NO: 1010460 - protein, 4 aa, Mycobacterium
GKGE

SEQ ID NO: 1010461 - protein, 6 aa, Mycobacterium
GKGEYG

SEQ ID NO: 1010462 - protein, 11 aa, Mycobacterium
GKGGAGGPGGL

SEQ ID NO: 1010463 - protein, 7 aa, Mycobacterium
GKGGKQR

SEQ ID NO: 1010464 - protein, 8 aa, Mycobacterium
GKGGKTRI

SEQ ID NO: 1010465 - protein, 10 aa, Mycobacterium
GKGGTGKSTI

SEQ ID NO: 1010466 - protein, 9 aa, Mycobacterium
GKGGYGGSA

SEQ ID NO: 1010467 - protein, 6 aa, Mycobacterium
GKGKRI

SEQ ID NO: 1010468 - protein, 8 aa, Mycobacterium
GKGPTEAK

SEQ ID NO: 1010469 - protein, 9 aa, Mycobacterium
GKGRGADHS

SEQ ID NO: 1010470 - protein, 8 aa, Mycobacterium
GKGSDAAT

SEQ ID NO: 1010471 - protein, 8 aa, Mycobacterium
GKGSTEGA

SEQ ID NO: 1010472 - protein, 7 aa, Mycobacterium
GKGTEEA

SEQ ID NO: 1010473 - protein, 9 aa, Mycobacterium
GKGTQAQKL

SEQ ID NO: 1010474 - protein, 4 aa, Mycobacterium
GKGV

SEQ ID NO: 1010475 - protein, 5 aa, Mycobacterium
GKHGE

SEQ ID NO: 1010476 - protein, 6 aa, Mycobacterium
GKHSDC

SEQ ID NO: 1010477 - protein, 14 aa, Mycobacterium
GKIDIGSGSAGGQQ

SEQ ID NO: 1010478 - protein, 4 aa, Mycobacterium
GKIG

SEQ ID NO: 1010479 - protein, 7 aa, Mycobacterium
GKIRSRR

SEQ ID NO: 1010480 - protein, 8 aa, Mycobacterium
GKISQRNF

SEQ ID NO: 1010481 - protein, 5 aa, Mycobacterium
GKKET

SEQ ID NO: 1010482 - protein, 6 aa, Mycobacterium
GKKGAF

SEQ ID NO: 1010483 - protein, 12 aa, Mycobacterium
GKKGSPDQLAPG

SEQ ID NO: 1010484 - protein, 8 aa, Mycobacterium
GKKREDGV

SEQ ID NO: 1010485 - protein, 9 aa, Mycobacterium
GKLAPSAAR

SEQ ID NO: 1010486 - protein, 8 aa, Mycobacterium
GKLDNTPE

SEQ ID NO: 1010487 - protein, 6 aa, Mycobacterium
GKLGDP

SEQ ID NO: 1010488 - protein, 8 aa, Mycobacterium
GKLSDPRP

SEQ ID NO: 1010489 - protein, 13 aa, Mycobacterium
GKNFSAGHDLGSE

SEQ ID NO: 1010490 - protein, 4 aa, Mycobacterium
GKPA

SEQ ID NO: 1010491 - protein, 14 aa, Mycobacterium
GKPAGKAVEPSADP

SEQ ID NO: 1010492 - protein, 13 aa, Mycobacterium
GKPAPNSSMAHPG

SEQ ID NO: 1010493 - protein, 13 aa, Mycobacterium
GKPATRRHEANGG

SEQ ID NO: 1010494 - protein, 6 aa, Mycobacterium
GKPEDI

SEQ ID NO: 1010495 - protein, 6 aa, Mycobacterium
GKPELT

SEQ ID NO: 1010496 - protein, 9 aa, Mycobacterium
GKPETVDDA

SEQ ID NO: 1010497 - protein, 7 aa, Mycobacterium
GKPGEDG

SEQ ID NO: 1010498 - protein, 7 aa, Mycobacterium
GKPGKAV

SEQ ID NO: 1010499 - protein, 5 aa, Mycobacterium
GKPGR

SEQ ID NO: 1010500 - protein, 5 aa, Mycobacterium
GKPHA

SEQ ID NO: 1010501 - protein, 8 aa, Mycobacterium
GKPHDPAV

SEQ ID NO: 1010502 - protein, 54 aa, Mycobacterium
GKPIATPGAGPTEPSFPTRRPTTSPPTSTSPSQPTSPASPTSPAGAIPLPPDDN

SEQ ID NO: 1010503 - protein, 7 aa, Mycobacterium
GKPITPA

SEQ ID NO: 1010504 - protein, 10 aa, Mycobacterium
GKPNAVTPAH

SEQ ID NO: 1010505 - protein, 9 aa, Mycobacterium
GKPPENDVT

SEQ ID NO: 1010506 - protein, 8 aa, Mycobacterium
GKPRPGNY

SEQ ID NO: 1010507 - protein, 13 aa, Mycobacterium
GKPTDQLPGPGRQ

SEQ ID NO: 1010508 - protein, 8 aa, Mycobacterium
GKPTDTPM

SEQ ID NO: 1010509 - protein, 7 aa, Mycobacterium
GKQGGKK

SEQ ID NO: 1010510 - protein, 6 aa, Mycobacterium
GKQGRF

SEQ ID NO: 1010511 - protein, 8 aa, Mycobacterium
GKQGTKGR

SEQ ID NO: 1010512 - protein, 17 aa, Mycobacterium
GKQPPVNPEPARPSSDY

SEQ ID NO: 1010513 - protein, 8 aa, Mycobacterium
GKQTGAEG

SEQ ID NO: 1010514 - protein, 17 aa, Mycobacterium
GKQVNTARSEVQRDYDE

SEQ ID NO: 1010515 - protein, 5 aa, Mycobacterium
GKRAP

SEQ ID NO: 1010516 - protein, 12 aa, Mycobacterium
GKRESKSRPGEG

SEQ ID NO: 1010517 - protein, 5 aa, Mycobacterium
GKRKG

SEQ ID NO: 1010518 - protein, 8 aa, Mycobacterium
GKRTLSEG

SEQ ID NO: 1010519 - protein, 8 aa, Mycobacterium
GKRTVERV

SEQ ID NO: 1010520 - protein, 5 aa, Mycobacterium
GKSAS

SEQ ID NO: 1010521 - protein, 15 aa, Mycobacterium
GKSDQPYGVPSPRFE

SEQ ID NO: 1010522 - protein, 10 aa, Mycobacterium
GKSDRPGRNQ

SEQ ID NO: 1010523 - protein, 7 aa, Mycobacterium
GKSGCST

SEQ ID NO: 1010524 - protein, 8 aa, Mycobacterium
GKSGFVSD

SEQ ID NO: 1010525 - protein, 6 aa, Mycobacterium
GKSKGS

SEQ ID NO: 1010526 - protein, 4 aa, Mycobacterium
GKSP

SEQ ID NO: 1010527 - protein, 6 aa, Mycobacterium
GKSPAA

SEQ ID NO: 1010528 - protein, 9 aa, Mycobacterium
GKSPSRKNP

SEQ ID NO: 1010529 - protein, 8 aa, Mycobacterium
GKSRWAEE

SEQ ID NO: 1010530 - protein, 4 aa, Mycobacterium
GKSS

SEQ ID NO: 1010531 - protein, 19 aa, Mycobacterium
GKSSSASRAIDTESNLGQY

SEQ ID NO: 1010532 - protein, 5 aa, Mycobacterium
GKSTL

SEQ ID NO: 1010533 - protein, 5 aa, Mycobacterium
GKTAG

SEQ ID NO: 1010534 - protein, 9 aa, Mycobacterium
GKTAQRVAA

SEQ ID NO: 1010535 - protein, 8 aa, Mycobacterium
GKTASGEV

SEQ ID NO: 1010536 - protein, 7 aa, Mycobacterium
GKTGGDT

SEQ ID NO: 1010537 - protein, 9 aa, Mycobacterium
GKTGSEALG

SEQ ID NO: 1010538 - protein, 24 aa, Mycobacterium
GKTHGAGDADLVGPEPEAAPIEQQ

SEQ ID NO: 1010539 - protein, 8 aa, Mycobacterium
GKTIPPDA

SEQ ID NO: 1010540 - protein, 7 aa, Mycobacterium
GKTPQRV

SEQ ID NO: 1010541 - protein, 5 aa, Mycobacterium
GKTQA

SEQ ID NO: 1010542 - protein, 10 aa, Mycobacterium
GKTRDPGGDG

SEQ ID NO: 1010543 - protein, 4 aa, Mycobacterium
GKTT

SEQ ID NO: 1010544 - protein, 7 aa, Mycobacterium
GKTTAMR

SEQ ID NO: 1010545 - protein, 5 aa, Mycobacterium
GKTTF

SEQ ID NO: 1010546 - protein, 6 aa, Mycobacterium
GKTTLT

SEQ ID NO: 1010547 - protein, 20 aa, Mycobacterium
GKVDSGSQVINSTKGKKERL

SEQ ID NO: 1010548 - protein, 10 aa, Mycobacterium
GKVRAAHTPA

SEQ ID NO: 1010549 - protein, 11 aa, Mycobacterium
GKVRGRGGLSR

SEQ ID NO: 1010550 - protein, 9 aa, Mycobacterium
GKVRTDERK

SEQ ID NO: 1010551 - protein, 5 aa, Mycobacterium
GKVSY

SEQ ID NO: 1010552 - protein, 7 aa, Mycobacterium
GKYGTTV

SEQ ID NO: 1010553 - protein, 10 aa, Mycobacterium
GKYPPPPGAS

SEQ ID NO: 1010554 - protein, 7 aa, Mycobacterium
GKYPSTE

SEQ ID NO: 1010555 - protein, 4 aa, Mycobacterium
GKYT

SEQ ID NO: 1010556 - protein, 4 aa, Mycobacterium
GLAA

SEQ ID NO: 1010557 - protein, 6 aa, Mycobacterium
GLAADG

SEQ ID NO: 1010558 - protein, 14 aa, Mycobacterium
GLAAEQSSDQPRIC

SEQ ID NO: 1010559 - protein, 8 aa, Mycobacterium
GLAAETAN

SEQ ID NO: 1010560 - protein, 6 aa, Mycobacterium
GLADKI

SEQ ID NO: 1010561 - protein, 7 aa, Mycobacterium
GLADTSA

SEQ ID NO: 1010562 - protein, 4 aa, Mycobacterium
GLAG

SEQ ID NO: 1010563 - protein, 12 aa, Mycobacterium
GLAGAQRSATGQ

SEQ ID NO: 1010564 - protein, 7 aa, Mycobacterium
GLAGPAA

SEQ ID NO: 1010565 - protein, 25 aa, Mycobacterium
GLAGQGGSGGTSGTGGPGGPGGSAQ

SEQ ID NO: 1010566 - protein, 7 aa, Mycobacterium
GLAKPDG

SEQ ID NO: 1010567 - protein, 8 aa, Mycobacterium
GLANYGNS

SEQ ID NO: 1010568 - protein, 6 aa, Mycobacterium
GLAPAA

SEQ ID NO: 1010569 - protein, 14 aa, Mycobacterium
GLAPAADHRKKMSN

SEQ ID NO: 1010570 - protein, 22 aa, Mycobacterium
GLAPDGRSKAYAGAADGVGWSE

SEQ ID NO: 1010571 - protein, 7 aa, Mycobacterium
GLAPERD

SEQ ID NO: 1010572 - protein, 6 aa, Mycobacterium
GLAPSS

SEQ ID NO: 1010573 - protein, 6 aa, Mycobacterium
GLAPST

SEQ ID NO: 1010574 - protein, 14 aa, Mycobacterium
GLAQPSGVSPAADS

SEQ ID NO: 1010575 - protein, 9 aa, Mycobacterium
GLARPQGDR

SEQ ID NO: 1010576 - protein, 10 aa, Mycobacterium
GLASGNSYHE

SEQ ID NO: 1010577 - protein, 17 aa, Mycobacterium
GLASPAAASPIDAIPGS

SEQ ID NO: 1010578 - protein, 5 aa, Mycobacterium
GLASQ

SEQ ID NO: 1010579 - protein, 9 aa, Mycobacterium
GLASTTSMD

SEQ ID NO: 1010580 - protein, 9 aa, Mycobacterium
GLATATKSA

SEQ ID NO: 1010581 - protein, 7 aa, Mycobacterium
GLATDGI

SEQ ID NO: 1010582 - protein, 7 aa, Mycobacterium
GLDDETM

SEQ ID NO: 1010583 - protein, 5 aa, Mycobacterium
GLDGI

SEQ ID NO: 1010584 - protein, 6 aa, Mycobacterium
GLDGYS

SEQ ID NO: 1010585 - protein, 5 aa, Mycobacterium
GLDND

SEQ ID NO: 1010586 - protein, 5 aa, Mycobacterium
GLDPA

SEQ ID NO: 1010587 - protein, 6 aa, Mycobacterium
GLDPDE

SEQ ID NO: 1010588 - protein, 5 aa, Mycobacterium
GLDPL

SEQ ID NO: 1010589 - protein, 9 aa, Mycobacterium
GLDPTDPAQ

SEQ ID NO: 1010590 - protein, 6 aa, Mycobacterium
GLDQDA

SEQ ID NO: 1010591 - protein, 6 aa, Mycobacterium
GLDRPV

SEQ ID NO: 1010592 - protein, 13 aa, Mycobacterium
GLDSGPVSLRSGE

SEQ ID NO: 1010593 - protein, 7 aa, Mycobacterium
GLEDDPE

SEQ ID NO: 1010594 - protein, 8 aa, Mycobacterium
GLEEPQAR

SEQ ID NO: 1010595 - protein, 5 aa, Mycobacterium
GLEGE

SEQ ID NO: 1010596 - protein, 7 aa, Mycobacterium
GLEPADP

SEQ ID NO: 1010597 - protein, 10 aa, Mycobacterium
GLEPDQAADA

SEQ ID NO: 1010598 - protein, 6 aa, Mycobacterium
GLERPR

SEQ ID NO: 1010599 - protein, 5 aa, Mycobacterium
GLETR

SEQ ID NO: 1010600 - protein, 6 aa, Mycobacterium
GLGDRG

SEQ ID NO: 1010601 - protein, 6 aa, Mycobacterium
GLGEGP

SEQ ID NO: 1010602 - protein, 5 aa, Mycobacterium
GLGEN

SEQ ID NO: 1010603 - protein, 6 aa, Mycobacterium
GLGEQE

SEQ ID NO: 1010604 - protein, 9 aa, Mycobacterium
GLGEQSGFG

SEQ ID NO: 1010605 - protein, 7 aa, Mycobacterium
GLGESDN

SEQ ID NO: 1010606 - protein, 4 aa, Mycobacterium
GLGG

SEQ ID NO: 1010607 - protein, 5 aa, Mycobacterium
GLGGA

SEQ ID NO: 1010608 - protein, 25 aa, Mycobacterium
GLGGAGGAGVSASGGAGGAGGAGGA

SEQ ID NO: 1010609 - protein, 7 aa, Mycobacterium
GLGGEGG

SEQ ID NO: 1010610 - protein, 7 aa, Mycobacterium
GLGGGLP

SEQ ID NO: 1010611 - protein, 15 aa, Mycobacterium
GLGGKGGSGGLGPHA

SEQ ID NO: 1010612 - protein, 11 aa, Mycobacterium
GLGGPGREHEA

SEQ ID NO: 1010613 - protein, 37 aa, Mycobacterium
GLGGQGGDGGDATGSTNASGTGGTAGSAGNGGDGGHS

SEQ ID NO: 1010614 - protein, 30 aa, Mycobacterium
GLGGSGGAALPNQQSGNGGGGGHGGAGGAA

SEQ ID NO: 1010615 - protein, 5 aa, Mycobacterium
GLGGT

SEQ ID NO: 1010616 - protein, 6 aa, Mycobacterium
GLGGTN

SEQ ID NO: 1010617 - protein, 4 aa, Mycobacterium
GLGH

SEQ ID NO: 1010618 - protein, 10 aa, Mycobacterium
GLGKPDKKAV

SEQ ID NO: 1010619 - protein, 4 aa, Mycobacterium
GLGN

SEQ ID NO: 1010620 - protein, 16 aa, Mycobacterium
GLGNPGRGRLAQRPAR

SEQ ID NO: 1010621 - protein, 12 aa, Mycobacterium
GLGPDAPEQPKA

SEQ ID NO: 1010622 - protein, 12 aa, Mycobacterium
GLGQDGFDEGNA

SEQ ID NO: 1010623 - protein, 6 aa, Mycobacterium
GLGQQE

SEQ ID NO: 1010624 - protein, 6 aa, Mycobacterium
GLGRTA

SEQ ID NO: 1010625 - protein, 16 aa, Mycobacterium
GLGSAARNSAGFGAPR

SEQ ID NO: 1010626 - protein, 6 aa, Mycobacterium
GLGSCD

SEQ ID NO: 1010627 - protein, 5 aa, Mycobacterium
GLGSP

SEQ ID NO: 1010628 - protein, 6 aa, Mycobacterium
GLGSQT

SEQ ID NO: 1010629 - protein, 7 aa, Mycobacterium
GLGTADE

SEQ ID NO: 1010630 - protein, 9 aa, Mycobacterium
GLGTDEPGA

SEQ ID NO: 1010631 - protein, 8 aa, Mycobacterium
GLGTPDDL

SEQ ID NO: 1010632 - protein, 9 aa, Mycobacterium
GLGVPQPGG

SEQ ID NO: 1010633 - protein, 4 aa, Mycobacterium
GLHR

SEQ ID NO: 1010634 - protein, 7 aa, Mycobacterium
GLHSNGY

SEQ ID NO: 1010635 - protein, 8 aa, Mycobacterium
GLKESHPH

SEQ ID NO: 1010636 - protein, 7 aa, Mycobacterium
GLKPTDI

SEQ ID NO: 1010637 - protein, 10 aa, Mycobacterium
GLLPSTGVGA

SEQ ID NO: 1010638 - protein, 11 aa, Mycobacterium
GLNAAGGAERG

SEQ ID NO: 1010639 - protein, 4 aa, Mycobacterium
GLNE

SEQ ID NO: 1010640 - protein, 5 aa, Mycobacterium
GLNGA

SEQ ID NO: 1010641 - protein, 12 aa, Mycobacterium
GLNPTGSFKDRG

SEQ ID NO: 1010642 - protein, 6 aa, Mycobacterium
GLNSDD

SEQ ID NO: 1010643 - protein, 10 aa, Mycobacterium
GLNSGTGNAG

SEQ ID NO: 1010644 - protein, 19 aa, Mycobacterium
GLPADPATDEALGATTRPD

SEQ ID NO: 1010645 - protein, 17 aa, Mycobacterium
GLPADSEEAMNAAEQHR

SEQ ID NO: 1010646 - protein, 12 aa, Mycobacterium
GLPAPRYGTATT

SEQ ID NO: 1010647 - protein, 8 aa, Mycobacterium
GLPAPTST

SEQ ID NO: 1010648 - protein, 7 aa, Mycobacterium
GLPASAK

SEQ ID NO: 1010649 - protein, 8 aa, Mycobacterium
GLPDDDPV

SEQ ID NO: 1010650 - protein, 5 aa, Mycobacterium
GLPDE

SEQ ID NO: 1010651 - protein, 8 aa, Mycobacterium
GLPDNKVG

SEQ ID NO: 1010652 - protein, 10 aa, Mycobacterium
GLPDRKDVKD

SEQ ID NO: 1010653 - protein, 12 aa, Mycobacterium
GLPDSATGTPEQ

SEQ ID NO: 1010654 - protein, 13 aa, Mycobacterium
GLPGDGSDWNHSV

SEQ ID NO: 1010655 - protein, 8 aa, Mycobacterium
GLPGPTGR

SEQ ID NO: 1010656 - protein, 6 aa, Mycobacterium
GLPGPV

SEQ ID NO: 1010657 - protein, 12 aa, Mycobacterium
GLPGQASSYGTS

SEQ ID NO: 1010658 - protein, 6 aa, Mycobacterium
GLPGQR

SEQ ID NO: 1010659 - protein, 8 aa, Mycobacterium
GLPGSPWH

SEQ ID NO: 1010660 - protein, 17 aa, Mycobacterium
GLPHPEDDRLDVAGPSG

SEQ ID NO: 1010661 - protein, 5 aa, Mycobacterium
GLPKG

SEQ ID NO: 1010662 - protein, 12 aa, Mycobacterium
GLPKGDPPPPLP

SEQ ID NO: 1010663 - protein, 10 aa, Mycobacterium
GLPLGSTDMG

SEQ ID NO: 1010664 - protein, 15 aa, Mycobacterium
GLPPAGVVDLGSRSR

SEQ ID NO: 1010665 - protein, 24 aa, Mycobacterium
GLPPAPQPLSDDQVAQRAATVRGA

SEQ ID NO: 1010666 - protein, 19 aa, Mycobacterium
GLPPASESVPQRVAEQGSL

SEQ ID NO: 1010667 - protein, 12 aa, Mycobacterium
GLPPDSLSGTRT

SEQ ID NO: 1010668 - protein, 8 aa, Mycobacterium
GLPPRPGV

SEQ ID NO: 1010669 - protein, 5 aa, Mycobacterium
GLPQL

SEQ ID NO: 1010670 - protein, 8 aa, Mycobacterium
GLPQRQPD

SEQ ID NO: 1010671 - protein, 7 aa, Mycobacterium
GLPSATA

SEQ ID NO: 1010672 - protein, 18 aa, Mycobacterium
GLPSGRLGDKPADPDTFT

SEQ ID NO: 1010673 - protein, 11 aa, Mycobacterium
GLPSKPSGWRK

SEQ ID NO: 1010674 - protein, 15 aa, Mycobacterium
GLPTGRGGKFTASEI

SEQ ID NO: 1010675 - protein, 18 aa, Mycobacterium
GLQARAGAGRGDGKPVVE

SEQ ID NO: 1010676 - protein, 4 aa, Mycobacterium
GLQE

SEQ ID NO: 1010677 - protein, 7 aa, Mycobacterium
GLQEARG

SEQ ID NO: 1010678 - protein, 7 aa, Mycobacterium
GLQPASP

SEQ ID NO: 1010679 - protein, 12 aa, Mycobacterium
GLQPDPESAGLA

SEQ ID NO: 1010680 - protein, 7 aa, Mycobacterium
GLQPYQP

SEQ ID NO: 1010681 - protein, 5 aa, Mycobacterium
GLRGA

SEQ ID NO: 1010682 - protein, 6 aa, Mycobacterium
GLRGGG

SEQ ID NO: 1010683 - protein, 18 aa, Mycobacterium
GLRGKGRLTDADIDATTR

SEQ ID NO: 1010684 - protein, 8 aa, Mycobacterium
GLRKPSAD

SEQ ID NO: 1010685 - protein, 13 aa, Mycobacterium
GLRPDKNPSEVVR

SEQ ID NO: 1010686 - protein, 5 aa, Mycobacterium
GLRPE

SEQ ID NO: 1010687 - protein, 15 aa, Mycobacterium
GLRPGSIADANDAAQ

SEQ ID NO: 1010688 - protein, 8 aa, Mycobacterium
GLRPISRN

SEQ ID NO: 1010689 - protein, 6 aa, Mycobacterium
GLRQGE

SEQ ID NO: 1010690 - protein, 9 aa, Mycobacterium
GLRRGDAVT

SEQ ID NO: 1010691 - protein, 10 aa, Mycobacterium
GLRRTEGHKM

SEQ ID NO: 1010692 - protein, 38 aa, Mycobacterium
GLRSSDEANAAQADQRAALRRTDEQARNHPDGAQGLNP

SEQ ID NO: 1010693 - protein, 8 aa, Mycobacterium
GLRTGPDG

SEQ ID NO: 1010694 - protein, 10 aa, Mycobacterium
GLSADQDDQR

SEQ ID NO: 1010695 - protein, 15 aa, Mycobacterium
GLSDEHAAASSTAHA

SEQ ID NO: 1010696 - protein, 9 aa, Mycobacterium
GLSEEEKER

SEQ ID NO: 1010697 - protein, 18 aa, Mycobacterium
GLSEPEQVSAPPQASRAK

SEQ ID NO: 1010698 - protein, 10 aa, Mycobacterium
GLSESDQEAA

SEQ ID NO: 1010699 - protein, 4 aa, Mycobacterium
GLSG

SEQ ID NO: 1010700 - protein, 5 aa, Mycobacterium
GLSGG

SEQ ID NO: 1010701 - protein, 8 aa, Mycobacterium
GLSGKTRS

SEQ ID NO: 1010702 - protein, 5 aa, Mycobacterium
GLSGT

SEQ ID NO: 1010703 - protein, 10 aa, Mycobacterium
GLSHSPPVPT

SEQ ID NO: 1010704 - protein, 5 aa, Mycobacterium
GLSKD

SEQ ID NO: 1010705 - protein, 6 aa, Mycobacterium
GLSNEE

SEQ ID NO: 1010706 - protein, 8 aa, Mycobacterium
GLSPEDAF

SEQ ID NO: 1010707 - protein, 9 aa, Mycobacterium
GLSPSQDEI

SEQ ID NO: 1010708 - protein, 10 aa, Mycobacterium
GLSPTQASAQ

SEQ ID NO: 1010709 - protein, 12 aa, Mycobacterium
GLSPYGPQTGEP

SEQ ID NO: 1010710 - protein, 22 aa, Mycobacterium
GLSQGDVVESGANADIKPGNNL

SEQ ID NO: 1010711 - protein, 9 aa, Mycobacterium
GLSSSARAE

SEQ ID NO: 1010712 - protein, 4 aa, Mycobacterium
GLTE

SEQ ID NO: 1010713 - protein, 18 aa, Mycobacterium
GLTEANSAEFEPGTPDPV

SEQ ID NO: 1010714 - protein, 5 aa, Mycobacterium
GLTGD

SEQ ID NO: 1010715 - protein, 11 aa, Mycobacterium
GLTGNSWRGPA

SEQ ID NO: 1010716 - protein, 5 aa, Mycobacterium
GLTHP

SEQ ID NO: 1010717 - protein, 13 aa, Mycobacterium
GLTKDELISKLRN

SEQ ID NO: 1010718 - protein, 5 aa, Mycobacterium
GLTKN

SEQ ID NO: 1010719 - protein, 7 aa, Mycobacterium
GLTPADV

SEQ ID NO: 1010720 - protein, 6 aa, Mycobacterium
GLTPEQ

SEQ ID NO: 1010721 - protein, 5 aa, Mycobacterium
GLTPG

SEQ ID NO: 1010722 - protein, 5 aa, Mycobacterium
GLTPR

SEQ ID NO: 1010723 - protein, 17 aa, Mycobacterium
GLTPSGRQRLVRAISED

SEQ ID NO: 1010724 - protein, 6 aa, Mycobacterium
GLTQPE

SEQ ID NO: 1010725 - protein, 5 aa, Mycobacterium
GLTQT

SEQ ID NO: 1010726 - protein, 9 aa, Mycobacterium
GLTSPEPAT

SEQ ID NO: 1010727 - protein, 5 aa, Mycobacterium
GLTTG

SEQ ID NO: 1010728 - protein, 4 aa, Mycobacterium
GLYE

SEQ ID NO: 1010729 - protein, 6 aa, Mycobacterium
GLYGRS

SEQ ID NO: 1010730 - protein, 8 aa, Mycobacterium
GMADQSRT

SEQ ID NO: 1010731 - protein, 21 aa, Mycobacterium
GMAEKSAEFADHGNRVYLPIT

SEQ ID NO: 1010732 - protein, 9 aa, Mycobacterium
GMAGGSADA

SEQ ID NO: 1010733 - protein, 7 aa, Mycobacterium
GMAQDGG

SEQ ID NO: 1010734 - protein, 8 aa, Mycobacterium
GMCNPEDE

SEQ ID NO: 1010735 - protein, 6 aa, Mycobacterium
GMEKTQ

SEQ ID NO: 1010736 - protein, 9 aa, Mycobacterium
GMGAGAGNV

SEQ ID NO: 1010737 - protein, 5 aa, Mycobacterium
GMGDT

SEQ ID NO: 1010738 - protein, 4 aa, Mycobacterium
GMGG

SEQ ID NO: 1010739 - protein, 7 aa, Mycobacterium
GMGGSQR

SEQ ID NO: 1010740 - protein, 4 aa, Mycobacterium
GMGQ

SEQ ID NO: 1010741 - protein, 6 aa, Mycobacterium
GMGREG

SEQ ID NO: 1010742 - protein, 5 aa, Mycobacterium
GMGTQ

SEQ ID NO: 1010743 - protein, 7 aa, Mycobacterium
GMKSGQQ

SEQ ID NO: 1010744 - protein, 13 aa, Mycobacterium
GMLPGSRSERAGV

SEQ ID NO: 1010745 - protein, 13 aa, Mycobacterium
GMPAAPGHVLAGG

SEQ ID NO: 1010746 - protein, 8 aa, Mycobacterium
GMPNTNPI

SEQ ID NO: 1010747 - protein, 4 aa, Mycobacterium
GMQL

SEQ ID NO: 1010748 - protein, 4 aa, Mycobacterium
GMQP

SEQ ID NO: 1010749 - protein, 7 aa, Mycobacterium
GMSEDDA

SEQ ID NO: 1010750 - protein, 9 aa, Mycobacterium
GMSSDRPLA

SEQ ID NO: 1010751 - protein, 5 aa, Mycobacterium
GMTPP

SEQ ID NO: 1010752 - protein, 7 aa, Mycobacterium
GMTPTAP

SEQ ID NO: 1010753 - protein, 13 aa, Mycobacterium
GMTTGASQTKTTV

SEQ ID NO: 1010754 - protein, 14 aa, Mycobacterium
GMTTGMPTPDGKPQ

SEQ ID NO: 1010755 - protein, 11 aa, Mycobacterium
GMYGDESPGAG

SEQ ID NO: 1010756 - protein, 12 aa, Mycobacterium
GNAADHELQSDD

SEQ ID NO: 1010757 - protein, 10 aa, Mycobacterium
GNAASLGPLS

SEQ ID NO: 1010758 - protein, 6 aa, Mycobacterium
GNADAE

SEQ ID NO: 1010759 - protein, 8 aa, Mycobacterium
GNADPTEL

SEQ ID NO: 1010760 - protein, 7 aa, Mycobacterium
GNAENAG

SEQ ID NO: 1010761 - protein, 12 aa, Mycobacterium
GNAGAGGAGGPG

SEQ ID NO: 1010762 - protein, 7 aa, Mycobacterium
GNAGKAG

SEQ ID NO: 1010763 - protein, 5 aa, Mycobacterium
GNAGN

SEQ ID NO: 1010764 - protein, 21 aa, Mycobacterium
GNAGNGGAGGDGWTNGDGGDV

SEQ ID NO: 1010765 - protein, 13 aa, Mycobacterium
GNAGSGNAGFGNS

SEQ ID NO: 1010766 - protein, 9 aa, Mycobacterium
GNAKSPDIG

SEQ ID NO: 1010767 - protein, 8 aa, Mycobacterium
GNAMTDDT

SEQ ID NO: 1010768 - protein, 12 aa, Mycobacterium
GNANTGSLNTGS

SEQ ID NO: 1010769 - protein, 18 aa, Mycobacterium
GNAPSDAPDAEKIPVSTD

SEQ ID NO: 1010770 - protein, 7 aa, Mycobacterium
GNARPAQ

SEQ ID NO: 1010771 - protein, 9 aa, Mycobacterium
GNASGTVGF

SEQ ID NO: 1010772 - protein, 20 aa, Mycobacterium
GNASSLHTTGRAARRRLEES

SEQ ID NO: 1010773 - protein, 5 aa, Mycobacterium
GNATQ

SEQ ID NO: 1010774 - protein, 4 aa, Mycobacterium
GNCL

SEQ ID NO: 1010775 - protein, 65 aa, Mycobacterium
GNDAASKARTCANRTAGATANSGASLTTHASPTAEATADRTTSTTADRTTGLATNTGTNTDASLS

SEQ ID NO: 1010776 - protein, 8 aa, Mycobacterium
GNDAEQVA

SEQ ID NO: 1010777 - protein, 12 aa, Mycobacterium
GNDEAALGDGVD

SEQ ID NO: 1010778 - protein, 8 aa, Mycobacterium
GNDEERRL

SEQ ID NO: 1010779 - protein, 6 aa, Mycobacterium
GNDGLN

SEQ ID NO: 1010780 - protein, 7 aa, Mycobacterium
GNDGNPY

SEQ ID NO: 1010781 - protein, 5 aa, Mycobacterium
GNDQV

SEQ ID NO: 1010782 - protein, 4 aa, Mycobacterium
GNDR

SEQ ID NO: 1010783 - protein, 35 aa, Mycobacterium; identical to SEQ ID NO: 904187

SEQ ID NO: 1010784 - protein, 7 aa, Mycobacterium
GNDRRGI

SEQ ID NO: 1010785 - protein, 6 aa, Mycobacterium
GNDTES

SEQ ID NO: 1010786 - protein, 7 aa, Mycobacterium
GNDTGGG

SEQ ID NO: 1010787 - protein, 9 aa, Mycobacterium
GNDTTRQTI

SEQ ID NO: 1010788 - protein, 6 aa, Mycobacterium
GNDTVT

SEQ ID NO: 1010789 - protein, 16 aa, Mycobacterium
GNEATTARTVSAPTSH

SEQ ID NO: 1010790 - protein, 8 aa, Mycobacterium
GNEDGSHD

SEQ ID NO: 1010791 - protein, 6 aa, Mycobacterium
GNEDGV

SEQ ID NO: 1010792 - protein, 11 aa, Mycobacterium
GNENNVTASAF

SEQ ID NO: 1010793 - protein, 13 aa, Mycobacterium
GNEPTPQFGPSAR

SEQ ID NO: 1010794 - protein, 16 aa, Mycobacterium
GNESHRAGGHAQEGAD

SEQ ID NO: 1010795 - protein, 7 aa, Mycobacterium
GNESPAE

SEQ ID NO: 1010796 - protein, 11 aa, Mycobacterium
GNESTDGVGGA

SEQ ID NO: 1010797 - protein, 9 aa, Mycobacterium
GNETTRNSI

SEQ ID NO: 1010798 - protein, 10 aa, Mycobacterium
GNETTRNSIT

SEQ ID NO: 1010799 - protein, 6 aa, Mycobacterium
GNFGGG

SEQ ID NO: 1010800 - protein, 7 aa, Mycobacterium
GNFNEPD

SEQ ID NO: 1010801 - protein, 6 aa, Mycobacterium
GNFPTT

SEQ ID NO: 1010802 - protein, 18 aa, Mycobacterium
GNGADGAAGTGENGGDGG

SEQ ID NO: 1010803 - protein, 18 aa, Mycobacterium
GNGADGAAGTGQNGGDGG

SEQ ID NO: 1010804 - protein, 17 aa, Mycobacterium
GNGADGAAPGQSGDDGG

SEQ ID NO: 1010805 - protein, 20 aa, Mycobacterium
GNGADGATVGRIGTPGGAGG

SEQ ID NO: 1010806 - protein, 49 aa, Mycobacterium
GNGADGGPGQAGGGGGSAGLLGNGGSGGNGGPGIPGGPGPTGGNGDNGG

SEQ ID NO: 1010807 - protein, 18 aa, Mycobacterium
GNGANGAAGTGAAGGDGG

SEQ ID NO: 1010808 - protein, 18 aa, Mycobacterium
GNGANGAAGTGANGGDGG

SEQ ID NO: 1010809 - protein, 18 aa, Mycobacterium
GNGANGAPGTGANGGDGG

SEQ ID NO: 1010810 - protein, 9 aa, Mycobacterium
GNGANGGAA

SEQ ID NO: 1010811 - protein, 18 aa, Mycobacterium
GNGANGVDGTGAAGGDGG

SEQ ID NO: 1010812 - protein, 18 aa, Mycobacterium
GNGAPGATGSGASGSPGG

SEQ ID NO: 1010813 - protein, 17 aa, Mycobacterium
GNGASGAPGTGANGAAG

SEQ ID NO: 1010814 - protein, 25 aa, Mycobacterium
GNGAVGGAGGIGTTDGGAGGQGGNA

SEQ ID NO: 1010815 - protein, 6 aa, Mycobacterium
GNGAVV

SEQ ID NO: 1010816 - protein, 18 aa, Mycobacterium
GNGDAANAVLGGCRIYLE

SEQ ID NO: 1010817 - protein, 18 aa, Mycobacterium
GNGDDGVAGTGQSGGDGG

SEQ ID NO: 1010818 - protein, 48 aa, Mycobacterium
GNGFNGAGGAGGDGGTGGAGGTGAPAPFGSGGAYGGTGGHGGTGGSGV

SEQ ID NO: 1010819 - protein, 10 aa, Mycobacterium
GNGGAAGNGG

SEQ ID NO: 1010820 - protein, 6 aa, Mycobacterium
GNGGAG

SEQ ID NO: 1010821 - protein, 29 aa, Mycobacterium
GNGGAGGAGGAAGGGLGNGGNGGNGGEAA

SEQ ID NO: 1010822 - protein, 26 aa, Mycobacterium
GNGGAGGAGGINAAGNGGSGGVGGRG

SEQ ID NO: 1010823 - protein, 25 aa, Mycobacterium
GNGGAGGAGGQSQLASGGTGGSGGM

SEQ ID NO: 1010824 - protein, 22 aa, Mycobacterium
GNGGAGGAGGTGQTQGGAGGAG

SEQ ID NO: 1010825 - protein, 44 aa, Mycobacterium
GNGGAGGAGNTNQVSGYSGNDGNGGNGGSGAAGQAGGAGGAAGL

SEQ ID NO: 1010826 - protein, 11 aa, Mycobacterium
GNGGAGGDAGV

SEQ ID NO: 1010827 - protein, 58 aa, Mycobacterium
GNGGAGGDGANGAAGGAGGDGGMLSGNGGNGGAGGDLNDPAVPTGSQVGGRGGNAGLI

SEQ ID NO: 1010828 - protein, 14 aa, Mycobacterium
GNGGAGGDGGFGGT

SEQ ID NO: 1010829 - protein, 25 aa, Mycobacterium
GNGGAGGDSTQGTGGRGGAGGAGGA

SEQ ID NO: 1010830 - protein, 29 aa, Mycobacterium
GNGGAGGDVGTSGSSRNFGDGGNGGDAQL

SEQ ID NO: 1010831 - protein, 22 aa, Mycobacterium
GNGGAGGHGGAGGAGGIGGNGG

SEQ ID NO: 1010832 - protein, 31 aa, Mycobacterium
GNGGAGGNGSTGGVGLAGGDGGAGGAGGAGG

SEQ ID NO: 1010833 - protein, 24 aa, Mycobacterium
GNGGAGGPAKPSSNQAAGGNGGAG

SEQ ID NO: 1010834 - protein, 28 aa, Mycobacterium
GNGGAGGSAGVSPTGVFPSNGGSGGNAQ

SEQ ID NO: 1010835 - protein, 39 aa, Mycobacterium
GNGGAGGSGQFGVGASSAGGLGGNGGRVIGDGGDGGVGG

SEQ ID NO: 1010836 - protein, 19 aa, Mycobacterium
GNGGAGGTGGNGGSGGLGG

SEQ ID NO: 1010837 - protein, 13 aa, Mycobacterium
GNGGAGGVGGAAY

SEQ ID NO: 1010838 - protein, 27 aa, Mycobacterium
GNGGAGGVGGVGRNANAGGSGGSGGNA

SEQ ID NO: 1010839 - protein, 11 aa, Mycobacterium
GNGGDGGATGI

SEQ ID NO: 1010840 - protein, 33 aa, Mycobacterium
GNGGDGGPGIFGGTGGTGGQGGTLAGVPGAAGP

SEQ ID NO: 1010841 - protein, 24 aa, Mycobacterium
GNGGDGGVEAGGPGTTGGDGGNGG

SEQ ID NO: 1010842 - protein, 33 aa, Mycobacterium
GNGGGGGTGGAGFVGPSSAGDGGNGGGGGRAGL

SEQ ID NO: 1010843 - protein, 11 aa, Mycobacterium
GNGGGGGYEGS

SEQ ID NO: 1010844 - protein, 24 aa, Mycobacterium
GNGGGGTGGFGLPPATGGFGGRGG

SEQ ID NO: 1010845 - protein, 9 aa, Mycobacterium
GNGGHGGHA

SEQ ID NO: 1010846 - protein, 21 aa, Mycobacterium
GNGGMGGAGGAGAAGGAGGTG

SEQ ID NO: 1010847 - protein, 20 aa, Mycobacterium
GNGGMGGAGLRGGDGGTGGL

SEQ ID NO: 1010848 - protein, 24 aa, Mycobacterium
GNGGNGAAGTNPGVAGGAGGAAGL

SEQ ID NO: 1010849 - protein, 143 aa, Mycobacterium
GNGGNGGAGGAGYAADGPAGPAIGNGGDGGHGGAGGFYGNGGAGGAGGNSAPGGGTGGNGGTGGDSGAMGSSGGRGGDGGVGTNGGAGGGGGNATSYGTANATGGAGGDGGTGSTGNGGSGGDGGNGGTGHGGGGGPGGTAIN

SEQ ID NO: 1010850 - protein, 24 aa, Mycobacterium
GNGGNGGIGGAGPTPGGNGIGGTS

SEQ ID NO: 1010851 - protein, 26 aa, Mycobacterium
GNGGNGGNAGSGGTSGFEGVAGQGGA

SEQ ID NO: 1010852 - protein, 27 aa, Mycobacterium
GNGGNGGNGGNGGVGSTDGDGGQGGAA

SEQ ID NO: 1010853 - protein, 22 aa, Mycobacterium
GNGGNGGNGGVGQAGGAGGAAG

SEQ ID NO: 1010854 - protein, 23 aa, Mycobacterium
GNGGNGGNGLSGQAGGAGGAAGL

SEQ ID NO: 1010855 - protein, 23 aa, Mycobacterium
GNGGNGGSGGLAQAGGNGGAAGL

SEQ ID NO: 1010856 - protein, 20 aa, Mycobacterium
GNGGNGGTGVLGGNGGDARG

SEQ ID NO: 1010857 - protein, 34 aa, Mycobacterium; identical to SEQ ID NO: 490524

SEQ ID NO: 1010858 - protein, 8 aa, Mycobacterium
GNGGNNTG

SEQ ID NO: 1010859 - protein, 33 aa, Mycobacterium
GNGGNSGDVGLSGAGTPGLPGNGGLLIDTIGNT

SEQ ID NO: 1010860 - protein, 48 aa, Mycobacterium
GNGGSGGNGGIGQAGGAGGDAGLIGNGGSGGIGGPDSTGLPGGAGGAG

SEQ ID NO: 1010861 - protein, 55 aa, Mycobacterium
GNGGTGGAGGFGPTGGAGGAGGAGGTLSGSGGDGGIGGYGAGGDGGGARGAGGDA

SEQ ID NO: 1010862 - protein, 38 aa, Mycobacterium; identical to SEQ ID NO: 490542

SEQ ID NO: 1010863 - protein, 21 aa, Mycobacterium
GNGGTGGTGGEGAAGGLGGQG

SEQ ID NO: 1010864 - protein, 62 aa, Mycobacterium
GNGGVGGNGGFSGPITAGGAGGTGGTGGSAGLPGDGGAGGAGGASGFAGGGTGGIGGTGGLP

SEQ ID NO: 1010865 - protein, 53 aa, Mycobacterium
GNGGVGGTGGNSLGTGGGTGGAGGQSGVFGDGGAGGTGGDSVNIAGTGGAGGA

SEQ ID NO: 1010866 - protein, 8 aa, Mycobacterium
GNGLGTEM

SEQ ID NO: 1010867 - protein, 12 aa, Mycobacterium
GNGLKDPDTALK

SEQ ID NO: 1010868 - protein, 9 aa, Mycobacterium
GNGLPQNTT

SEQ ID NO: 1010869 - protein, 6 aa, Mycobacterium
GNGLRR

SEQ ID NO: 1010870 - protein, 4 aa, Mycobacterium
GNGN

SEQ ID NO: 1010871 - protein, 8 aa, Mycobacterium
GNGPSFCS

SEQ ID NO: 1010872 - protein, 10 aa, Mycobacterium
GNGPSPKDGG

SEQ ID NO: 1010873 - protein, 13 aa, Mycobacterium
GNGRDGAAQVEAR

SEQ ID NO: 1010874 - protein, 18 aa, Mycobacterium
GNGSNGTPGTGAPGGDGG

SEQ ID NO: 1010875 - protein, 16 aa, Mycobacterium
GNGSNGTYPGQDGRDG

SEQ ID NO: 1010876 - protein, 5 aa, Mycobacterium
GNGTC

SEQ ID NO: 1010877 - protein, 18 aa, Mycobacterium
GNGTDGAAGTGANGGDGG

SEQ ID NO: 1010878 - protein, 17 aa, Mycobacterium
GNGTDGLAGTGAAGGAG

SEQ ID NO: 1010879 - protein, 16 aa, Mycobacterium
GNGTDGTAANPDGGAG

SEQ ID NO: 1010880 - protein, 17 aa, Mycobacterium
GNGTNGTAADPNGGRAG

SEQ ID NO: 1010881 - protein, 15 aa, Mycobacterium
GNGTNGTAANPNGGV

SEQ ID NO: 1010882 - protein, 17 aa, Mycobacterium
GNGTPGAAGSGAAGTAG

SEQ ID NO: 1010883 - protein, 18 aa, Mycobacterium
GNGTPGAAGSGTDGTPGG

SEQ ID NO: 1010884 - protein, 18 aa, Mycobacterium
GNGTPGDAGSGTDGTPGG

SEQ ID NO: 1010885 - protein, 15 aa, Mycobacterium
GNGTPSAELGGDRAP

SEQ ID NO: 1010886 - protein, 18 aa, Mycobacterium
GNGTSGALGTGQAGGDGG

SEQ ID NO: 1010887 - protein, 5 aa, Mycobacterium
GNGWR

SEQ ID NO: 1010888 - protein, 9 aa, Mycobacterium
GNHQTPNGT

SEQ ID NO: 1010889 - protein, 5 aa, Mycobacterium
GNIEA

SEQ ID NO: 1010890 - protein, 5 aa, Mycobacterium
GNIEV

SEQ ID NO: 1010891 - protein, 12 aa, Mycobacterium
GNIGNTNFGSGN

SEQ ID NO: 1010892 - protein, 4 aa, Mycobacterium
GNIP

SEQ ID NO: 1010893 - protein, 10 aa, Mycobacterium
GNIPKGEYGA

SEQ ID NO: 1010894 - protein, 8 aa, Mycobacterium
GNIYEKDG

SEQ ID NO: 1010895 - protein, 9 aa, Mycobacterium
GNKARQQLS

SEQ ID NO: 1010896 - protein, 6 aa, Mycobacterium
GNKQRW

SEQ ID NO: 1010897 - protein, 13 aa, Mycobacterium
GNKSRAVTAAREA

SEQ ID NO: 1010898 - protein, 7 aa, Mycobacterium
GNLGSTN

SEQ ID NO: 1010899 - protein, 7 aa, Mycobacterium
GNLTEDD

SEQ ID NO: 1010900 - protein, 10 aa, Mycobacterium
GNLTTPSEFQ

SEQ ID NO: 1010901 - protein, 4 aa, Mycobacterium
GNMD

SEQ ID NO: 1010902 - protein, 7 aa, Mycobacterium
GNNDVSR

SEQ ID NO: 1010903 - protein, 5 aa, Mycobacterium
GNNNF

SEQ ID NO: 1010904 - protein, 8 aa, Mycobacterium
GNNNPTVT

SEQ ID NO: 1010905 - protein, 19 aa, Mycobacterium
GNNNSAIANATGVGGTLGT

SEQ ID NO: 1010906 - protein, 7 aa, Mycobacterium
GNNNTDV

SEQ ID NO: 1010907 - protein, 6 aa, Mycobacterium
GNNPVR

SEQ ID NO: 1010908 - protein, 4 aa, Mycobacterium
GNNS

SEQ ID NO: 1010909 - protein, 5 aa, Mycobacterium
GNNSS

SEQ ID NO: 1010910 - protein, 19 aa, Mycobacterium
GNPAGAGGGLEAAARTARY

SEQ ID NO: 1010911 - protein, 19 aa, Mycobacterium
GNPAKPLSNQEMAESPPLE

SEQ ID NO: 1010912 - protein, 16 aa, Mycobacterium
GNPANSESHYRGTGPE

SEQ ID NO: 1010913 - protein, 6 aa, Mycobacterium
GNPATG

SEQ ID NO: 1010914 - protein, 6 aa, Mycobacterium
GNPDEV

SEQ ID NO: 1010915 - protein, 7 aa, Mycobacterium
GNPDQKI

SEQ ID NO: 1010916 - protein, 8 aa, Mycobacterium
GNPDTAAN

SEQ ID NO: 1010917 - protein, 7 aa, Mycobacterium
GNPDYAR

SEQ ID NO: 1010918 - protein, 7 aa, Mycobacterium
GNPGDGW

SEQ ID NO: 1010919 - protein, 12 aa, Mycobacterium
GNPPADNSELTA

SEQ ID NO: 1010920 - protein, 9 aa, Mycobacterium
GNPPEFGGR

SEQ ID NO: 1010921 - protein, 8 aa, Mycobacterium
GNPRTSRD

SEQ ID NO: 1010922 - protein, 4 aa, Mycobacterium
GNPS

SEQ ID NO: 1010923 - protein, 4 aa, Mycobacterium
GNPT

SEQ ID NO: 1010924 - protein, 9 aa, Mycobacterium
GNPTLGTVS

SEQ ID NO: 1010925 - protein, 5 aa, Mycobacterium
GNPTT

SEQ ID NO: 1010926 - protein, 7 aa, Mycobacterium
GNPTTDV

SEQ ID NO: 1010927 - protein, 6 aa, Mycobacterium
GNPYGA

SEQ ID NO: 1010928 - protein, 6 aa, Mycobacterium
GNQAPL

SEQ ID NO: 1010929 - protein, 8 aa, Mycobacterium
GNQDDARS

SEQ ID NO: 1010930 - protein, 7 aa, Mycobacterium
GNQEGIS

SEQ ID NO: 1010931 - protein, 11 aa, Mycobacterium
GNQHDAEDLTQ

SEQ ID NO: 1010932 - protein, 25 aa, Mycobacterium
GNQRTAGDQSRREGGKVFGSGSRST

SEQ ID NO: 1010933 - protein, 15 aa, Mycobacterium
GNRAASSLAGGADTL

SEQ ID NO: 1010934 - protein, 7 aa, Mycobacterium
GNRCHDG

SEQ ID NO: 1010935 - protein, 6 aa, Mycobacterium
GNRDDV

SEQ ID NO: 1010936 - protein, 23 aa, Mycobacterium
GNRDGSDGLAAGCSATNDRDRGV

SEQ ID NO: 1010937 - protein, 9 aa, Mycobacterium
GNRNFEGRI

SEQ ID NO: 1010938 - protein, 6 aa, Mycobacterium
GNRPSQ

SEQ ID NO: 1010939 - protein, 9 aa, Mycobacterium
GNRQPEAEE

SEQ ID NO: 1010940 - protein, 5 aa, Mycobacterium
GNRRR

SEQ ID NO: 1010941 - protein, 13 aa, Mycobacterium
GNRSSAPATTDSD

SEQ ID NO: 1010942 - protein, 5 aa, Mycobacterium
GNRSY

SEQ ID NO: 1010943 - protein, 6 aa, Mycobacterium
GNRTAA

SEQ ID NO: 1010944 - protein, 4 aa, Mycobacterium
GNSA

SEQ ID NO: 1010945 - protein, 7 aa, Mycobacterium
GNSAPRV

SEQ ID NO: 1010946 - protein, 17 aa, Mycobacterium
GNSAPVSCSDSSNSAAA

SEQ ID NO: 1010947 - protein, 6 aa, Mycobacterium
GNSDAA

SEQ ID NO: 1010948 - protein, 7 aa, Mycobacterium
GNSDATV

SEQ ID NO: 1010949 - protein, 8 aa, Mycobacterium
GNSGAGDV

SEQ ID NO: 1010950 - protein, 26 aa, Mycobacterium
GNSGDGGAGGAGANLDGGNGGLGGNA

SEQ ID NO: 1010951 - protein, 22 aa, Mycobacterium
GNSGSFNAGSFNSSTSNLGSFN

SEQ ID NO: 1010952 - protein, 14 aa, Mycobacterium
GNSGTGNVGFGNSD

SEQ ID NO: 1010953 - protein, 10 aa, Mycobacterium
GNSIEGGTSE

SEQ ID NO: 1010954 - protein, 23 aa, Mycobacterium
GNSLGTVNSADSAATGDTTSGVV

SEQ ID NO: 1010955 - protein, 6 aa, Mycobacterium
GNSNGD

SEQ ID NO: 1010956 - protein, 5 aa, Mycobacterium
GNSNT

SEQ ID NO: 1010957 - protein, 12 aa, Mycobacterium
GNSSPDAIDPDR

SEQ ID NO: 1010958 - protein, 10 aa, Mycobacterium
GNSSQISDGS

SEQ ID NO: 1010959 - protein, 6 aa, Mycobacterium
GNSTPA

SEQ ID NO: 1010960 - protein, 5 aa, Mycobacterium
GNSYL

SEQ ID NO: 1010961 - protein, 15 aa, Mycobacterium
GNTCPAGRDTAGHPP

SEQ ID NO: 1010962 - protein, 35 aa, Mycobacterium
GNTDSNVDSGDVGTQNLGSGNTGNTNRAAATPATA

SEQ ID NO: 1010963 - protein, 7 aa, Mycobacterium
GNTGNFD

SEQ ID NO: 1010964 - protein, 8 aa, Mycobacterium
GNTGNGNI

SEQ ID NO: 1010965 - protein, 9 aa, Mycobacterium
GNTGSNNFG

SEQ ID NO: 1010966 - protein, 13 aa, Mycobacterium
GNTGVADSLPGIA

SEQ ID NO: 1010967 - protein, 19 aa, Mycobacterium
GNTIGQASYAAAAQGSGVV

SEQ ID NO: 1010968 - protein, 5 aa, Mycobacterium
GNTQT

SEQ ID NO: 1010969 - protein, 15 aa, Mycobacterium
GNTSSEHTGHPCAGS

SEQ ID NO: 1010970 - protein, 14 aa, Mycobacterium
GNTTLQTVSDQQRD

SEQ ID NO: 1010971 - protein, 6 aa, Mycobacterium
GNTYDT

SEQ ID NO: 1010972 - protein, 7 aa, Mycobacterium
GNTYRNP

SEQ ID NO: 1010973 - protein, 6 aa, Mycobacterium
GNTYYR

SEQ ID NO: 1010974 - protein, 4 aa, Mycobacterium
GNVE

SEQ ID NO: 1010975 - protein, 4 aa, Mycobacterium
GNVG

SEQ ID NO: 1010976 - protein, 8 aa, Mycobacterium
GNVGSKER

SEQ ID NO: 1010977 - protein, 10 aa, Mycobacterium
GNVPKTASGK

SEQ ID NO: 1010978 - protein, 5 aa, Mycobacterium
GNVPR

SEQ ID NO: 1010979 - protein, 7 aa, Mycobacterium
GNVRGPY

SEQ ID NO: 1010980 - protein, 10 aa, Mycobacterium
GNVRNSGVER

SEQ ID NO: 1010981 - protein, 7 aa, Mycobacterium
GNVSGPD

SEQ ID NO: 1010982 - protein, 15 aa, Mycobacterium
GNVSPEHGIGSRKRP

SEQ ID NO: 1010983 - protein, 7 aa, Mycobacterium
GNVTGPD

SEQ ID NO: 1010984 - protein, 6 aa, Mycobacterium
GPAAAI

SEQ ID NO: 1010985 - protein, 5 aa, Mycobacterium
GPAAG

SEQ ID NO: 1010986 - protein, 16 aa, Mycobacterium
GPAAPADGCTATVEPG

SEQ ID NO: 1010987 - protein, 8 aa, Mycobacterium
GPAATPAD

SEQ ID NO: 1010988 - protein, 10 aa, Mycobacterium
GPADDPDGIV

SEQ ID NO: 1010989 - protein, 12 aa, Mycobacterium
GPADDPRVTDDG

SEQ ID NO: 1010990 - protein, 8 aa, Mycobacterium
GPADGSSN

SEQ ID NO: 1010991 - protein, 8 aa, Mycobacterium
GPADHAGP

SEQ ID NO: 1010992 - protein, 38 aa, Mycobacterium
GPAEGGDDRDLPGPDDGEAAHQEEQDRRPKGAEGHDLA

SEQ ID NO: 1010993 - protein, 10 aa, Mycobacterium
GPAEIPAPPE

SEQ ID NO: 1010994 - protein, 6 aa, Mycobacterium
GPAEQA

SEQ ID NO: 1010995 - protein, 5 aa, Mycobacterium
GPAGE

SEQ ID NO: 1010996 - protein, 6 aa, Mycobacterium
GPAGIA

SEQ ID NO: 1010997 - protein, 32 aa, Mycobacterium
GPAGPAGTGITSSSADAAEPGAAAGAAGATGP

SEQ ID NO: 1010998 - protein, 5 aa, Mycobacterium
GPAGT

SEQ ID NO: 1010999 - protein, 14 aa, Mycobacterium
GPAGTGKSSVSRGL

SEQ ID NO: 1011000 - protein, 5 aa, Mycobacterium
GPAGV

SEQ ID NO: 1011001 - protein, 9 aa, Mycobacterium
GPAGVGKTE

SEQ ID NO: 1011002 - protein, 5 aa, Mycobacterium
GPAGY

SEQ ID NO: 1011003 - protein, 8 aa, Mycobacterium
GPAIAGGT

SEQ ID NO: 1011004 - protein, 20 aa, Mycobacterium
GPALERRARATARATVPAST

SEQ ID NO: 1011005 - protein, 4 aa, Mycobacterium
GPAM

SEQ ID NO: 1011006 - protein, 16 aa, Mycobacterium
GPANEEPPERPTPGPL

SEQ ID NO: 1011007 - protein, 8 aa, Mycobacterium
GPAPAAPV

SEQ ID NO: 1011008 - protein, 12 aa, Mycobacterium
GPAPAPPRPRYV

SEQ ID NO: 1011009 - protein, 15 aa, Mycobacterium
GPAPDRDPAPTEPRR

SEQ ID NO: 1011010 - protein, 6 aa, Mycobacterium
GPAPGT

SEQ ID NO: 1011011 - protein, 39 aa, Mycobacterium
GPAPIPPEPPPPPPPGATTGTPGTATGSSGGTSAIADSR

SEQ ID NO: 1011012 - protein, 5 aa, Mycobacterium
GPAPL

SEQ ID NO: 1011013 - protein, 7 aa, Mycobacterium
GPAPLGG

SEQ ID NO: 1011014 - protein, 11 aa, Mycobacterium
GPAPQLGADTS

SEQ ID NO: 1011015 - protein, 5 aa, Mycobacterium
GPAPR

SEQ ID NO: 1011016 - protein, 13 aa, Mycobacterium
GPAPTAPTENPIQ

SEQ ID NO: 1011017 - protein, 7 aa, Mycobacterium
GPAPTSV

SEQ ID NO: 1011018 - protein, 10 aa, Mycobacterium
GPAPTTTSIP

SEQ ID NO: 1011019 - protein, 4 aa, Mycobacterium
GPAQ

SEQ ID NO: 1011020 - protein, 9 aa, Mycobacterium
GPAQPRPAA

SEQ ID NO: 1011021 - protein, 4 aa, Mycobacterium
GPAR

SEQ ID NO: 1011022 - protein, 10 aa, Mycobacterium
GPASASMAAA

SEQ ID NO: 1011023 - protein, 7 aa, Mycobacterium
GPASESM

SEQ ID NO: 1011024 - protein, 12 aa, Mycobacterium
GPASESSIGSDT

SEQ ID NO: 1011025 - protein, 6 aa, Mycobacterium
GPASYT

SEQ ID NO: 1011026 - protein, 13 aa, Mycobacterium
GPATRSHAAKTIS

SEQ ID NO: 1011027 - protein, 4 aa, Mycobacterium
GPAV

SEQ ID NO: 1011028 - protein, 5 aa, Mycobacterium
GPAVR

SEQ ID NO: 1011029 - protein, 22 aa, Mycobacterium
GPAYNTGSAWGYTPKGATGVPT

SEQ ID NO: 1011030 - protein, 6 aa, Mycobacterium
GPAYQA

SEQ ID NO: 1011031 - protein, 8 aa, Mycobacterium
GPCGPSSE

SEQ ID NO: 1011032 - protein, 4 aa, Mycobacterium
GPDA

SEQ ID NO: 1011033 - protein, 8 aa, Mycobacterium
GPDALQTR

SEQ ID NO: 1011034 - protein, 8 aa, Mycobacterium
GPDAPTGF

SEQ ID NO: 1011035 - protein, 10 aa, Mycobacterium
GPDDCAAGNP

SEQ ID NO: 1011036 - protein, 6 aa, Mycobacterium
GPDDEI

SEQ ID NO: 1011037 - protein, 13 aa, Mycobacterium
GPDETPPQGWEQD

SEQ ID NO: 1011038 - protein, 4 aa, Mycobacterium
GPDG

SEQ ID NO: 1011039 - protein, 6 aa, Mycobacterium
GPDGAL

SEQ ID NO: 1011040 - protein, 48 aa, Mycobacterium
GPDGGGHTPTTNGKALAGATADAVAPAARLPGDQARAASRRARTAQKR

SEQ ID NO: 1011041 - protein, 10 aa, Mycobacterium
GPDGKRQPAH

SEQ ID NO: 1011042 - protein, 6 aa, Mycobacterium
GPDGSG

SEQ ID NO: 1011043 - protein, 6 aa, Mycobacterium
GPDLGG

SEQ ID NO: 1011044 - protein, 4 aa, Mycobacterium
GPDP

SEQ ID NO: 1011045 - protein, 12 aa, Mycobacterium
GPDPAEYVGGSP

SEQ ID NO: 1011046 - protein, 11 aa, Mycobacterium
GPDPAVNSQSL

SEQ ID NO: 1011047 - protein, 8 aa, Mycobacterium
GPDPGHSF

SEQ ID NO: 1011048 - protein, 13 aa, Mycobacterium
GPDPLRKDADPSW

SEQ ID NO: 1011049 - protein, 6 aa, Mycobacterium
GPDPSV

SEQ ID NO: 1011050 - protein, 8 aa, Mycobacterium
GPDPVDEG

SEQ ID NO: 1011051 - protein, 48 aa, Mycobacterium
GPDQQEPAGPIIEEPEDDPIEDGGDANGLVERPDNEAGPIIEELADDG

SEQ ID NO: 1011052 - protein, 7 aa, Mycobacterium
GPDRAAE

SEQ ID NO: 1011053 - protein, 4 aa, Mycobacterium
GPDT

SEQ ID NO: 1011054 - protein, 5 aa, Mycobacterium
GPDTA

SEQ ID NO: 1011055 - protein, 8 aa, Mycobacterium
GPDTEPLQ

SEQ ID NO: 1011056 - protein, 5 aa, Mycobacterium
GPDTG

SEQ ID NO: 1011057 - protein, 8 aa, Mycobacterium
GPDTPAGK

SEQ ID NO: 1011058 - protein, 7 aa, Mycobacterium
GPDTTSY

SEQ ID NO: 1011059 - protein, 22 aa, Mycobacterium
GPDVGQNHEQTERLAAEVIPRL

SEQ ID NO: 1011060 - protein, 9 aa, Mycobacterium
GPDVPTLSQ

SEQ ID NO: 1011061 - protein, 8 aa, Mycobacterium
GPEAPAAV

SEQ ID NO: 1011062 - protein, 12 aa, Mycobacterium
GPEATDAAIEAR

SEQ ID NO: 1011063 - protein, 4 aa, Mycobacterium
GPED

SEQ ID NO: 1011064 - protein, 8 aa, Mycobacterium
GPEGAQRA

SEQ ID NO: 1011065 - protein, 22 aa, Mycobacterium
GPEGGGVDKHPYPTFDSQRGAQ

SEQ ID NO: 1011066 - protein, 8 aa, Mycobacterium
GPEGPEQV

SEQ ID NO: 1011067 - protein, 6 aa, Mycobacterium
GPEGYR

SEQ ID NO: 1011068 - protein, 5 aa, Mycobacterium
GPEHG

SEQ ID NO: 1011069 - protein, 5 aa, Mycobacterium
GPELT

SEQ ID NO: 1011070 - protein, 10 aa, Mycobacterium
GPEPDNPDQL

SEQ ID NO: 1011071 - protein, 4 aa, Mycobacterium
GPEQ

SEQ ID NO: 1011072 - protein, 17 aa, Mycobacterium
GPEQPSPMADLPSGAKF

SEQ ID NO: 1011073 - protein, 5 aa, Mycobacterium
GPEQT

SEQ ID NO: 1011074 - protein, 4 aa, Mycobacterium
GPER

SEQ ID NO: 1011075 - protein, 5 aa, Mycobacterium
GPERG

SEQ ID NO: 1011076 - protein, 12 aa, Mycobacterium
GPESADGRVPTD

SEQ ID NO: 1011077 - protein, 8 aa, Mycobacterium
GPESEADR

SEQ ID NO: 1011078 - protein, 9 aa, Mycobacterium
GPESSGKTT

SEQ ID NO: 1011079 - protein, 14 aa, Mycobacterium
GPETRPPAGSSAGW

SEQ ID NO: 1011080 - protein, 8 aa, Mycobacterium
GPEVETEQ

SEQ ID NO: 1011081 - protein, 9 aa, Mycobacterium
GPFAEGAEV

SEQ ID NO: 1011082 - protein, 4 aa, Mycobacterium
GPFD

SEQ ID NO: 1011083 - protein, 7 aa, Mycobacterium
GPFPAAD

SEQ ID NO: 1011084 - protein, 4 aa, Mycobacterium
GPGA

SEQ ID NO: 1011085 - protein, 6 aa, Mycobacterium
GPGAEV

SEQ ID NO: 1011086 - protein, 10 aa, Mycobacterium
GPGAGEHGGS

SEQ ID NO: 1011087 - protein, 13 aa, Mycobacterium
GPGATAADAGGIA

SEQ ID NO: 1011088 - protein, 9 aa, Mycobacterium
GPGATGRSF

SEQ ID NO: 1011089 - protein, 9 aa, Mycobacterium
GPGDAGVRT

SEQ ID NO: 1011090 - protein, 6 aa, Mycobacterium
GPGDGY

SEQ ID NO: 1011091 - protein, 6 aa, Mycobacterium
GPGDPE

SEQ ID NO: 1011092 - protein, 9 aa, Mycobacterium
GPGEAREAD

SEQ ID NO: 1011093 - protein, 7 aa, Mycobacterium
GPGERTG

SEQ ID NO: 1011094 - protein, 5 aa, Mycobacterium
GPGFT

SEQ ID NO: 1011095 - protein, 4 aa, Mycobacterium
GPGG

SEQ ID NO: 1011096 - protein, 6 aa, Mycobacterium
GPGGAL

SEQ ID NO: 1011097 - protein, 22 aa, Mycobacterium
GPGGARGGGRRGGPGRGRRGDV

SEQ ID NO: 1011098 - protein, 5 aa, Mycobacterium
GPGGD

SEQ ID NO: 1011099 - protein, 27 aa, Mycobacterium
GPGGGGGGGGNGTGTTTTGGTGGIGGH

SEQ ID NO: 1011100 - protein, 21 aa, Mycobacterium
GPGGHSAPPAHEAPSGGPDGL

SEQ ID NO: 1011101 - protein, 7 aa, Mycobacterium
GPGGKTA

SEQ ID NO: 1011102 - protein, 5 aa, Mycobacterium
GPGGM

SEQ ID NO: 1011103 - protein, 15 aa, Mycobacterium
GPGGQKAAIASAKLG

SEQ ID NO: 1011104 - protein, 8 aa, Mycobacterium
GPGHGGPG

SEQ ID NO: 1011105 - protein, 20 aa, Mycobacterium
GPGHPHTAQQPVPFEIKQVA

SEQ ID NO: 1011106 - protein, 8 aa, Mycobacterium
GPGHSDLP

SEQ ID NO: 1011107 - protein, 5 aa, Mycobacterium
GPGLA

SEQ ID NO: 1011108 - protein, 8 aa, Mycobacterium
GPGLRPVG

SEQ ID NO: 1011109 - protein, 4 aa, Mycobacterium
GPGN

SEQ ID NO: 1011110 - protein, 5 aa, Mycobacterium
GPGNF

SEQ ID NO: 1011111 - protein, 4 aa, Mycobacterium
GPGP

SEQ ID NO: 1011112 - protein, 6 aa, Mycobacterium
GPGPAA

SEQ ID NO: 1011113 - protein, 8 aa, Mycobacterium
GPGPVPGQ

SEQ ID NO: 1011114 - protein, 17 aa, Mycobacterium
GPGRDQTIVRRDILQER

SEQ ID NO: 1011115 - protein, 8 aa, Mycobacterium
GPGSEVPL

SEQ ID NO: 1011116 - protein, 9 aa, Mycobacterium
GPGSGRETA

SEQ ID NO: 1011117 - protein, 15 aa, Mycobacterium
GPGSTCARDDGSGPA

SEQ ID NO: 1011118 - protein, 4 aa, Mycobacterium
GPGT

SEQ ID NO: 1011119 - protein, 19 aa, Mycobacterium
GPGTAARPRAALHTGCPST

SEQ ID NO: 1011120 - protein, 10 aa, Mycobacterium
GPGTGNGGED

SEQ ID NO: 1011121 - protein, 7 aa, Mycobacterium
GPGTTAR

SEQ ID NO: 1011122 - protein, 6 aa, Mycobacterium
GPGVQT

SEQ ID NO: 1011123 - protein, 26 aa, Mycobacterium
GPGVSGPERSHDDQDCRGCAAITKPR

SEQ ID NO: 1011124 - protein, 13 aa, Mycobacterium
GPGVTRAAPGDRV

SEQ ID NO: 1011125 - protein, 7 aa, Mycobacterium
GPGWPRS

SEQ ID NO: 1011126 - protein, 12 aa, Mycobacterium
GPGYPDAPAGRD

SEQ ID NO: 1011127 - protein, 11 aa, Mycobacterium
GPHTDQTLDGA

SEQ ID NO: 1011128 - protein, 5 aa, Mycobacterium
GPIEG

SEQ ID NO: 1011129 - protein, 6 aa, Mycobacterium
GPITAD

SEQ ID NO: 1011130 - protein, 8 aa, Mycobacterium
GPKALRSN

SEQ ID NO: 1011131 - protein, 6 aa, Mycobacterium
GPKDEI

SEQ ID NO: 1011132 - protein, 6 aa, Mycobacterium
GPKEAR

SEQ ID NO: 1011133 - protein, 7 aa, Mycobacterium
GPKEHAS

SEQ ID NO: 1011134 - protein, 8 aa, Mycobacterium
GPKGGPGM

SEQ ID NO: 1011135 - protein, 6 aa, Mycobacterium
GPKNQT

SEQ ID NO: 1011136 - protein, 6 aa, Mycobacterium
GPKPAE

SEQ ID NO: 1011137 - protein, 6 aa, Mycobacterium
GPKPPQ

SEQ ID NO: 1011138 - protein, 13 aa, Mycobacterium
GPKQGDDDGGTGG

SEQ ID NO: 1011139 - protein, 4 aa, Mycobacterium
GPKR

SEQ ID NO: 1011140 - protein, 12 aa, Mycobacterium
GPKTLRSAAPWA

SEQ ID NO: 1011141 - protein, 4 aa, Mycobacterium
GPLA

SEQ ID NO: 1011142 - protein, 9 aa, Mycobacterium
GPLDGGPAV

SEQ ID NO: 1011143 - protein, 16 aa, Mycobacterium
GPLGAKSMAESPYNPM

SEQ ID NO: 1011144 - protein, 11 aa, Mycobacterium
GPLPATGRGLR

SEQ ID NO: 1011145 - protein, 9 aa, Mycobacterium
GPLSGDPYR

SEQ ID NO: 1011146 - protein, 12 aa, Mycobacterium
GPLSTDSDNDAV

SEQ ID NO: 1011147 - protein, 4 aa, Mycobacterium
GPLT

SEQ ID NO: 1011148 - protein, 5 aa, Mycobacterium
GPLTH

SEQ ID NO: 1011149 - protein, 9 aa, Mycobacterium
GPLTPETAQ

SEQ ID NO: 1011150 - protein, 4 aa, Mycobacterium
GPMG

SEQ ID NO: 1011151 - protein, 4 aa, Mycobacterium
GPND

SEQ ID NO: 1011152 - protein, 9 aa, Mycobacterium
GPNGAGKSS

SEQ ID NO: 1011153 - protein, 10 aa, Mycobacterium
GPNGAGKTTT

SEQ ID NO: 1011154 - protein, 6 aa, Mycobacterium
GPNGDL

SEQ ID NO: 1011155 - protein, 15 aa, Mycobacterium
GPNGGGTGEQQGVQD

SEQ ID NO: 1011156 - protein, 8 aa, Mycobacterium
GPNGPVPE

SEQ ID NO: 1011157 - protein, 8 aa, Mycobacterium
GPNGVGKT

SEQ ID NO: 1011158 - protein, 7 aa, Mycobacterium
GPNHGVS

SEQ ID NO: 1011159 - protein, 7 aa, Mycobacterium
GPNPRAA

SEQ ID NO: 1011160 - protein, 7 aa, Mycobacterium
GPNRIGQ

SEQ ID NO: 1011161 - protein, 9 aa, Mycobacterium
GPNRPGPGG

SEQ ID NO: 1011162 - protein, 5 aa, Mycobacterium
GPNRY

SEQ ID NO: 1011163 - protein, 11 aa, Mycobacterium
GPNTGTPITSV

SEQ ID NO: 1011164 - protein, 5 aa, Mycobacterium
GPNYN

SEQ ID NO: 1011165 - protein, 11 aa, Mycobacterium
GPPARTSKPKF

SEQ ID NO: 1011166 - protein, 14 aa, Mycobacterium
GPPDDSVNGDAAGR

SEQ ID NO: 1011167 - protein, 5 aa, Mycobacterium
GPPFP

SEQ ID NO: 1011168 - protein, 4 aa, Mycobacterium
GPPG

SEQ ID NO: 1011169 - protein, 7 aa, Mycobacterium
GPPGALD

SEQ ID NO: 1011170 - protein, 8 aa, Mycobacterium
GPPGERFA

SEQ ID NO: 1011171 - protein, 8 aa, Mycobacterium
GPPGRRTD

SEQ ID NO: 1011172 - protein, 9 aa, Mycobacterium
GPPGSGKTT

SEQ ID NO: 1011173 - protein, 5 aa, Mycobacterium
GPPGT

SEQ ID NO: 1011174 - protein, 9 aa, Mycobacterium
GPPGTAETV

SEQ ID NO: 1011175 - protein, 11 aa, Mycobacterium
GPPGTGKTSVA

SEQ ID NO: 1011176 - protein, 9 aa, Mycobacterium
GPPGTGKTT

SEQ ID NO: 1011177 - protein, 6 aa, Mycobacterium
GPPGVG

SEQ ID NO: 1011178 - protein, 14 aa, Mycobacterium
GPPGVGKTSLGESV

SEQ ID NO: 1011179 - protein, 9 aa, Mycobacterium
GPPHEGGPG

SEQ ID NO: 1011180 - protein, 9 aa, Mycobacterium
GPPPEEPNQ

SEQ ID NO: 1011181 - protein, 8 aa, Mycobacterium
GPPPGSPR

SEQ ID NO: 1011182 - protein, 48 aa, Mycobacterium
GPPPPGPGGGGGPKANAQRNSAAPAVPIAPTSRPSRPEPTSIPVEKRR

SEQ ID NO: 1011183 - protein, 6 aa, Mycobacterium
GPPPQS

SEQ ID NO: 1011184 - protein, 8 aa, Mycobacterium
GPPPSPIE

SEQ ID NO: 1011185 - protein, 4 aa, Mycobacterium
GPPQ

SEQ ID NO: 1011186 - protein, 10 aa, Mycobacterium
GPPQTPQTLS

SEQ ID NO: 1011187 - protein, 6 aa, Mycobacterium
GPPREL

SEQ ID NO: 1011188 - protein, 8 aa, Mycobacterium
GPPSRSGR

SEQ ID NO: 1011189 - protein, 50 aa, Mycobacterium
GPPSYRTSSIRSRGLSRPGALRSASPHGGASHRRSDGSHSVAGLAAASGL

SEQ ID NO: 1011190 - protein, 5 aa, Mycobacterium
GPPTC

SEQ ID NO: 1011191 - protein, 22 aa, Mycobacterium
GPPVVKESTGEDISKEDLGGPD

SEQ ID NO: 1011192 - protein, 7 aa, Mycobacterium
GPQATSR

SEQ ID NO: 1011193 - protein, 8 aa, Mycobacterium
GPQIPERS

SEQ ID NO: 1011194 - protein, 6 aa, Mycobacterium
GPQPAD

SEQ ID NO: 1011195 - protein, 5 aa, Mycobacterium
GPQPL

SEQ ID NO: 1011196 - protein, 7 aa, Mycobacterium
GPQTTQV

SEQ ID NO: 1011197 - protein, 24 aa, Mycobacterium
GPQVGASVSPGAVAAAAGPDTDTA

SEQ ID NO: 1011198 - protein, 8 aa, Mycobacterium
GPRADAAR

SEQ ID NO: 1011199 - protein, 11 aa, Mycobacterium
GPRGPERLPAD

SEQ ID NO: 1011200 - protein, 8 aa, Mycobacterium
GPRGPVGA

SEQ ID NO: 1011201 - protein, 11 aa, Mycobacterium
GPRHNAPATPG

SEQ ID NO: 1011202 - protein, 17 aa, Mycobacterium
GPRHTRGTPPNVVETDP

SEQ ID NO: 1011203 - protein, 5 aa, Mycobacterium
GPRKM

SEQ ID NO: 1011204 - protein, 4 aa, Mycobacterium
GPRL

SEQ ID NO: 1011205 - protein, 4 aa, Mycobacterium
GPRN

SEQ ID NO: 1011206 - protein, 6 aa, Mycobacterium
GPRNDL

SEQ ID NO: 1011207 - protein, 9 aa, Mycobacterium
GPRNPYPGR

SEQ ID NO: 1011208 - protein, 5 aa, Mycobacterium
GPRPD

SEQ ID NO: 1011209 - protein, 6 aa, Mycobacterium
GPRPEM

SEQ ID NO: 1011210 - protein, 4 aa, Mycobacterium
GPRR

SEQ ID NO: 1011211 - protein, 9 aa, Mycobacterium
GPRRPGGDH

SEQ ID NO: 1011212 - protein, 6 aa, Mycobacterium
GPRRYG

SEQ ID NO: 1011213 - protein, 4 aa, Mycobacterium
GPRS

SEQ ID NO: 1011214 - protein, 5 aa, Mycobacterium
GPRSD

SEQ ID NO: 1011215 - protein, 11 aa, Mycobacterium
GPRSRATGDRC

SEQ ID NO: 1011216 - protein, 5 aa, Mycobacterium
GPRST

SEQ ID NO: 1011217 - protein, 12 aa, Mycobacterium
GPRTYSEQRGHP

SEQ ID NO: 1011218 - protein, 17 aa, Mycobacterium
GPRWPDVSGNSQATGTR

SEQ ID NO: 1011219 - protein, 9 aa, Mycobacterium
GPSAGHGAP

SEQ ID NO: 1011220 - protein, 8 aa, Mycobacterium
GPSDTWSR

SEQ ID NO: 1011221 - protein, 7 aa, Mycobacterium
GPSGATT

SEQ ID NO: 1011222 - protein, 9 aa, Mycobacterium
GPSGGGKTT

SEQ ID NO: 1011223 - protein, 11 aa, Mycobacterium
GPSGKRPGAIA

SEQ ID NO: 1011224 - protein, 6 aa, Mycobacterium
GPSGNY

SEQ ID NO: 1011225 - protein, 8 aa, Mycobacterium
GPSGSPLR

SEQ ID NO: 1011226 - protein, 6 aa, Mycobacterium
GPSGWG

SEQ ID NO: 1011227 - protein, 8 aa, Mycobacterium
GPSGYGEE

SEQ ID NO: 1011228 - protein, 12 aa, Mycobacterium
GPSITPRPPQGH

SEQ ID NO: 1011229 - protein, 11 aa, Mycobacterium
GPSKDAQGARR

SEQ ID NO: 1011230 - protein, 8 aa, Mycobacterium
GPSLSGTH

SEQ ID NO: 1011231 - protein, 10 aa, Mycobacterium
GPSPDELSSG

SEQ ID NO: 1011232 - protein, 8 aa, Mycobacterium
GPSPGGLR

SEQ ID NO: 1011233 - protein, 11 aa, Mycobacterium
GPSPGTPPGPW

SEQ ID NO: 1011234 - protein, 6 aa, Mycobacterium
GPSPWT

SEQ ID NO: 1011235 - protein, 11 aa, Mycobacterium
GPSSSHTVGPM

SEQ ID NO: 1011236 - protein, 17 aa, Mycobacterium
GPSTRWAPSSSAPGRSS

SEQ ID NO: 1011237 - protein, 4 aa, Mycobacterium
GPSV

SEQ ID NO: 1011238 - protein, 10 aa, Mycobacterium
GPSYTRPPSW

SEQ ID NO: 1011239 - protein, 6 aa, Mycobacterium
GPTAAR

SEQ ID NO: 1011240 - protein, 19 aa, Mycobacterium
GPTAGGYTAAAADGTSGGV

SEQ ID NO: 1011241 - protein, 6 aa, Mycobacterium
GPTARY

SEQ ID NO: 1011242 - protein, 4 aa, Mycobacterium
GPTD

SEQ ID NO: 1011243 - protein, 8 aa, Mycobacterium
GPTDIAGA

SEQ ID NO: 1011244 - protein, 6 aa, Mycobacterium
GPTETA

SEQ ID NO: 1011245 - protein, 6 aa, Mycobacterium
GPTETT

SEQ ID NO: 1011246 - protein, 6 aa, Mycobacterium
GPTGAT

SEQ ID NO: 1011247 - protein, 7 aa, Mycobacterium
GPTGGLG

SEQ ID NO: 1011248 - protein, 17 aa, Mycobacterium
GPTGVIGTNKKDSQDTV

SEQ ID NO: 1011249 - protein, 18 aa, Mycobacterium
GPTGVIGTNKKDSQDTVD

SEQ ID NO: 1011250 - protein, 5 aa, Mycobacterium
GPTLA

SEQ ID NO: 1011251 - protein, 5 aa, Mycobacterium
GPTLD

SEQ ID NO: 1011252 - protein, 8 aa, Mycobacterium
GPTLPDGM

SEQ ID NO: 1011253 - protein, 13 aa, Mycobacterium
GPTLRRRGDKQRQ

SEQ ID NO: 1011254 - protein, 7 aa, Mycobacterium
GPTPAAR

SEQ ID NO: 1011255 - protein, 6 aa, Mycobacterium
GPTPDA

SEQ ID NO: 1011256 - protein, 11 aa, Mycobacterium
GPTPRRATAAE

SEQ ID NO: 1011257 - protein, 7 aa, Mycobacterium
GPTPSEV

SEQ ID NO: 1011258 - protein, 7 aa, Mycobacterium
GPTPTAD

SEQ ID NO: 1011259 - protein, 5 aa, Mycobacterium
GPTQA

SEQ ID NO: 1011260 - protein, 7 aa, Mycobacterium
GPTRAYG

SEQ ID NO: 1011261 - protein, 24 aa, Mycobacterium
GPTRNPWDTSRTPGGSSGGSAAAV

SEQ ID NO: 1011262 - protein, 5 aa, Mycobacterium
GPTRQ

SEQ ID NO: 1011263 - protein, 5 aa, Mycobacterium
GPTSK

SEQ ID NO: 1011264 - protein, 5 aa, Mycobacterium
GPTSV

SEQ ID NO: 1011265 - protein, 8 aa, Mycobacterium
GPTTASSR

SEQ ID NO: 1011266 - protein, 9 aa, Mycobacterium
GPTTGRASA

SEQ ID NO: 1011267 - protein, 10 aa, Mycobacterium
GPTVESAPDV

SEQ ID NO: 1011268 - protein, 5 aa, Mycobacterium
GPVAA

SEQ ID NO: 1011269 - protein, 5 aa, Mycobacterium
GPVAG

SEQ ID NO: 1011270 - protein, 11 aa, Mycobacterium
GPVAGQDPTPF

SEQ ID NO: 1011271 - protein, 4 aa, Mycobacterium
GPVD

SEQ ID NO: 1011272 - protein, 12 aa, Mycobacterium
GPVDTSRPEPAI

SEQ ID NO: 1011273 - protein, 8 aa, Mycobacterium
GPVGRRGC

SEQ ID NO: 1011274 - protein, 16 aa, Mycobacterium
GPVGTASVLAQGSGVV

SEQ ID NO: 1011275 - protein, 12 aa, Mycobacterium
GPVPASRPAGDV

SEQ ID NO: 1011276 - protein, 6 aa, Mycobacterium
GPVPEQ

SEQ ID NO: 1011277 - protein, 18 aa, Mycobacterium
GPVPGKAGKAHRQTAGQH

SEQ ID NO: 1011278 - protein, 18 aa, Mycobacterium
GPVPKAPLGRSNNYPRSV

SEQ ID NO: 1011279 - protein, 14 aa, Mycobacterium
GPVRTDLPDASEAS

SEQ ID NO: 1011280 - protein, 11 aa, Mycobacterium
GPVSGSARTAE

SEQ ID NO: 1011281 - protein, 9 aa, Mycobacterium
GPVTDPDGI

SEQ ID NO: 1011282 - protein, 20 aa, Mycobacterium
GPVTGSVAPAVGAPAGPLPA

SEQ ID NO: 1011283 - protein, 10 aa, Mycobacterium
GPVTTPRSET

SEQ ID NO: 1011284 - protein, 4 aa, Mycobacterium
GPWI

SEQ ID NO: 1011285 - protein, 10 aa, Mycobacterium
GPWREGEGPW

SEQ ID NO: 1011286 - protein, 5 aa, Mycobacterium
GPWVG

SEQ ID NO: 1011287 - protein, 4 aa, Mycobacterium
GPYA

SEQ ID NO: 1011288 - protein, 11 aa, Mycobacterium
GPYDPGERSRP

SEQ ID NO: 1011289 - protein, 6 aa, Mycobacterium
GPYLTR

SEQ ID NO: 1011290 - protein, 4 aa, Mycobacterium
GPYP

SEQ ID NO: 1011291 - protein, 4 aa, Mycobacterium
GPYQ

SEQ ID NO: 1011292 - protein, 8 aa, Mycobacterium
GPYRESNL

SEQ ID NO: 1011293 - protein, 6 aa, Mycobacterium
GPYTAT

SEQ ID NO: 1011294 - protein, 6 aa, Mycobacterium
GQAAET

SEQ ID NO: 1011295 - protein, 19 aa, Mycobacterium
GQAAPGDDLAEPAAEAGED

SEQ ID NO: 1011296 - protein, 6 aa, Mycobacterium
GQAAYN

SEQ ID NO: 1011297 - protein, 12 aa, Mycobacterium
GQAAYSASKGGV

SEQ ID NO: 1011298 - protein, 5 aa, Mycobacterium
GQADE

SEQ ID NO: 1011299 - protein, 8 aa, Mycobacterium
GQAPPELR

SEQ ID NO: 1011300 - protein, 11 aa, Mycobacterium
GQAPPLGGEGA

SEQ ID NO: 1011301 - protein, 6 aa, Mycobacterium
GQAQNG

SEQ ID NO: 1011302 - protein, 9 aa, Mycobacterium
GQARIAKRE

SEQ ID NO: 1011303 - protein, 5 aa, Mycobacterium
GQARS

SEQ ID NO: 1011304 - protein, 10 aa, Mycobacterium
GQATGRQVEN

SEQ ID NO: 1011305 - protein, 4 aa, Mycobacterium
GQAV

SEQ ID NO: 1011306 - protein, 4 aa, Mycobacterium
GQAY

SEQ ID NO: 1011307 - protein, 7 aa, Mycobacterium
GQCPDGV

SEQ ID NO: 1011308 - protein, 5 aa, Mycobacterium
GQDAA

SEQ ID NO: 1011309 - protein, 10 aa, Mycobacterium
GQDARGAEEE

SEQ ID NO: 1011310 - protein, 5 aa, Mycobacterium
GQDDV

SEQ ID NO: 1011311 - protein, 8 aa, Mycobacterium
GQDEIPTD

SEQ ID NO: 1011312 - protein, 5 aa, Mycobacterium
GQDGE

SEQ ID NO: 1011313 - protein, 11 aa, Mycobacterium
GQDGPLAPTAG

SEQ ID NO: 1011314 - protein, 9 aa, Mycobacterium
GQDGSYSEE

SEQ ID NO: 1011315 - protein, 5 aa, Mycobacterium
GQDGY

SEQ ID NO: 1011316 - protein, 16 aa, Mycobacterium
GQDLSQHDSGAYTGDI

SEQ ID NO: 1011317 - protein, 9 aa, Mycobacterium
GQDNPQDRG

SEQ ID NO: 1011318 - protein, 10 aa, Mycobacterium
GQDRTGPGKE

SEQ ID NO: 1011319 - protein, 10 aa, Mycobacterium
GQDTRRGTFS

SEQ ID NO: 1011320 - protein, 7 aa, Mycobacterium
GQDVPVG

SEQ ID NO: 1011321 - protein, 8 aa, Mycobacterium
GQEAAQVG

SEQ ID NO: 1011322 - protein, 14 aa, Mycobacterium
GQEAASSPEADLTP

SEQ ID NO: 1011323 - protein, 5 aa, Mycobacterium
GQEDL

SEQ ID NO: 1011324 - protein, 5 aa, Mycobacterium
GQEGE

SEQ ID NO: 1011325 - protein, 8 aa, Mycobacterium
GQEKDDAE

SEQ ID NO: 1011326 - protein, 7 aa, Mycobacterium
GQENQGW

SEQ ID NO: 1011327 - protein, 8 aa, Mycobacterium
GQERDAMR

SEQ ID NO: 1011328 - protein, 7 aa, Mycobacterium
GQESMTK

SEQ ID NO: 1011329 - protein, 15 aa, Mycobacterium
GQESSPTGDRPATGV

SEQ ID NO: 1011330 - protein, 9 aa, Mycobacterium
GQETTAKQL

SEQ ID NO: 1011331 - protein, 9 aa, Mycobacterium
GQFDPTTMG

SEQ ID NO: 1011332 - protein, 26 aa, Mycobacterium
GQFRRGHPAPLKDAADEAVSQPDSPV

SEQ ID NO: 1011333 - protein, 17 aa, Mycobacterium
GQGAVGDRSAAQQPTAR

SEQ ID NO: 1011334 - protein, 144 aa, Mycobacterium
GQGDGGAGGAGGVAGDGGKGADAAAFSGGAGGNGGHGGDNGAGGAGGTGGAGSTVGAHGADGFSPITGGNGGGGGNGASGPAASAGGAGGAGGDGGLYGNGGAGGDGGDGVVGGQGADATAAGASGENGGDGGAGGMGGVGGMG

SEQ ID NO: 1011335 - protein, 8 aa, Mycobacterium
GQGDTDDV

SEQ ID NO: 1011336 - protein, 14 aa, Mycobacterium
GQGEAGLRGAPSGD

SEQ ID NO: 1011337 - protein, 9 aa, Mycobacterium
GQGEAPKLI

SEQ ID NO: 1011338 - protein, 4 aa, Mycobacterium
GQGG

SEQ ID NO: 1011339 - protein, 17 aa, Mycobacterium
GQGGAGGNGGQGGGDDF

SEQ ID NO: 1011340 - protein, 8 aa, Mycobacterium
GQGGLTRN

SEQ ID NO: 1011341 - protein, 9 aa, Mycobacterium
GQGGQRPGM

SEQ ID NO: 1011342 - protein, 19 aa, Mycobacterium
GQGGSLPDRVQQGLAAIVI

SEQ ID NO: 1011343 - protein, 5 aa, Mycobacterium
GQGGV

SEQ ID NO: 1011344 - protein, 8 aa, Mycobacterium
GQGGVSAG

SEQ ID NO: 1011345 - protein, 5 aa, Mycobacterium
GQGPG

SEQ ID NO: 1011346 - protein, 5 aa, Mycobacterium
GQGPQ

SEQ ID NO: 1011347 - protein, 6 aa, Mycobacterium
GQGQYL

SEQ ID NO: 1011348 - protein, 8 aa, Mycobacterium
GQGRGSVR

SEQ ID NO: 1011349 - protein, 8 aa, Mycobacterium
GQGRQYNY

SEQ ID NO: 1011350 - protein, 4 aa, Mycobacterium
GQGS

SEQ ID NO: 1011351 - protein, 14 aa, Mycobacterium
GQGSHLGTGGMASK

SEQ ID NO: 1011352 - protein, 5 aa, Mycobacterium
GQGSQ

SEQ ID NO: 1011353 - protein, 9 aa, Mycobacterium
GQGSSRPPR

SEQ ID NO: 1011354 - protein, 4 aa, Mycobacterium
GQGV

SEQ ID NO: 1011355 - protein, 5 aa, Mycobacterium
GQHAG

SEQ ID NO: 1011356 - protein, 12 aa, Mycobacterium
GQHAGDHKSRFG

SEQ ID NO: 1011357 - protein, 6 aa, Mycobacterium
GQHDLT

SEQ ID NO: 1011358 - protein, 6 aa, Mycobacterium
GQHGED

SEQ ID NO: 1011359 - protein, 11 aa, Mycobacterium
GQHPDGQRTLA

SEQ ID NO: 1011360 - protein, 10 aa, Mycobacterium
GQHRGGQRAR

SEQ ID NO: 1011361 - protein, 8 aa, Mycobacterium
GQHTNDRE

SEQ ID NO: 1011362 - protein, 5 aa, Mycobacterium
GQIEA

SEQ ID NO: 1011363 - protein, 4 aa, Mycobacterium
GQIP

SEQ ID NO: 1011364 - protein, 7 aa, Mycobacterium
GQIQQNS

SEQ ID NO: 1011365 - protein, 6 aa, Mycobacterium
GQISGE

SEQ ID NO: 1011366 - protein, 6 aa, Mycobacterium
GQISPA

SEQ ID NO: 1011367 - protein, 9 aa, Mycobacterium
GQKAPELAA

SEQ ID NO: 1011368 - protein, 8 aa, Mycobacterium
GQKCSAAS

SEQ ID NO: 1011369 - protein, 16 aa, Mycobacterium
GQKGGSWRTTGCSSPL

SEQ ID NO: 1011370 - protein, 7 aa, Mycobacterium
GQKHKVP

SEQ ID NO: 1011371 - protein, 5 aa, Mycobacterium
GQKVA

SEQ ID NO: 1011372 - protein, 13 aa, Mycobacterium
GQLANATKTVPQL

SEQ ID NO: 1011373 - protein, 8 aa, Mycobacterium
GQLDPEYN

SEQ ID NO: 1011374 - protein, 10 aa, Mycobacterium
GQLGGADNAT

SEQ ID NO: 1011375 - protein, 9 aa, Mycobacterium
GQLGGTSHR

SEQ ID NO: 1011376 - protein, 6 aa, Mycobacterium
GQLKAD

SEQ ID NO: 1011377 - protein, 6 aa, Mycobacterium
GQLPAQ

SEQ ID NO: 1011378 - protein, 8 aa, Mycobacterium
GQLPDGQR

SEQ ID NO: 1011379 - protein, 21 aa, Mycobacterium
GQLPPPPEALETDDTVNPTVS

SEQ ID NO: 1011380 - protein, 13 aa, Mycobacterium
GQLPSASADVTAA

SEQ ID NO: 1011381 - protein, 5 aa, Mycobacterium
GQLRG

SEQ ID NO: 1011382 - protein, 6 aa, Mycobacterium
GQLRSG

SEQ ID NO: 1011383 - protein, 8 aa, Mycobacterium
GQMAPADG

SEQ ID NO: 1011384 - protein, 6 aa, Mycobacterium
GQMGSG

SEQ ID NO: 1011385 - protein, 6 aa, Mycobacterium
GQNAHT

SEQ ID NO: 1011386 - protein, 4 aa, Mycobacterium
GQNR

SEQ ID NO: 1011387 - protein, 6 aa, Mycobacterium
GQNSAA

SEQ ID NO: 1011388 - protein, 7 aa, Mycobacterium
GQNTPTI

SEQ ID NO: 1011389 - protein, 4 aa, Mycobacterium
GQPA

SEQ ID NO: 1011390 - protein, 6 aa, Mycobacterium
GQPAPD

SEQ ID NO: 1011391 - protein, 7 aa, Mycobacterium
GQPAREV

SEQ ID NO: 1011392 - protein, 30 aa, Mycobacterium
GQPASGGGIGTGGGTSTGSGTGTSTGGATV

SEQ ID NO: 1011393 - protein, 6 aa, Mycobacterium
GQPASS

SEQ ID NO: 1011394 - protein, 20 aa, Mycobacterium
GQPAWSGKPEVAAAAEARAV

SEQ ID NO: 1011395 - protein, 4 aa, Mycobacterium
GQPC

SEQ ID NO: 1011396 - protein, 4 aa, Mycobacterium
GQPE

SEQ ID NO: 1011397 - protein, 6 aa, Mycobacterium
GQPELT

SEQ ID NO: 1011398 - protein, 4 aa, Mycobacterium
GQPG

SEQ ID NO: 1011399 - protein, 11 aa, Mycobacterium
GQPGPNASAEE

SEQ ID NO: 1011400 - protein, 16 aa, Mycobacterium
GQPIDGRGDIKAETRR

SEQ ID NO: 1011401 - protein, 6 aa, Mycobacterium
GQPLPP

SEQ ID NO: 1011402 - protein, 6 aa, Mycobacterium
GQPLTP

SEQ ID NO: 1011403 - protein, 7 aa, Mycobacterium
GQPPAGG

SEQ ID NO: 1011404 - protein, 12 aa, Mycobacterium
GQPRATGDPHQL

SEQ ID NO: 1011405 - protein, 6 aa, Mycobacterium
GQPRHI

SEQ ID NO: 1011406 - protein, 5 aa, Mycobacterium
GQPRQ

SEQ ID NO: 1011407 - protein, 6 aa, Mycobacterium
GQPTDD

SEQ ID NO: 1011408 - protein, 12 aa, Mycobacterium
GQPVDDPDIPAK

SEQ ID NO: 1011409 - protein, 13 aa, Mycobacterium
GQPVEQALRAEKH

SEQ ID NO: 1011410 - protein, 5 aa, Mycobacterium
GQPVH

SEQ ID NO: 1011411 - protein, 5 aa, Mycobacterium
GQPVR

SEQ ID NO: 1011412 - protein, 15 aa, Mycobacterium
GQPWQKGRRVSPAED

SEQ ID NO: 1011413 - protein, 6 aa, Mycobacterium
GQPYTA

SEQ ID NO: 1011414 - protein, 6 aa, Mycobacterium
GQQAMD

SEQ ID NO: 1011415 - protein, 5 aa, Mycobacterium
GQQDS

SEQ ID NO: 1011416 - protein, 10 aa, Mycobacterium
GQQGDGSAKL

SEQ ID NO: 1011417 - protein, 9 aa, Mycobacterium
GQQPQQGSL

SEQ ID NO: 1011418 - protein, 22 aa, Mycobacterium
GQQRATQRHESCAAPSEGPDGA

SEQ ID NO: 1011419 - protein, 5 aa, Mycobacterium
GQQTL

SEQ ID NO: 1011420 - protein, 8 aa, Mycobacterium
GQQTRAAL

SEQ ID NO: 1011421 - protein, 10 aa, Mycobacterium
GQRGAPTRQQ

SEQ ID NO: 1011422 - protein, 14 aa, Mycobacterium
GQRGEPIVGPDRPG

SEQ ID NO: 1011423 - protein, 21 aa, Mycobacterium
GQRGGKQSDTPLRKDGHMPEN

SEQ ID NO: 1011424 - protein, 20 aa, Mycobacterium
GQRGPDGRGPGGGNTDDQDG

SEQ ID NO: 1011425 - protein, 7 aa, Mycobacterium
GQRHGTD

SEQ ID NO: 1011426 - protein, 7 aa, Mycobacterium
GQRKPLA

SEQ ID NO: 1011427 - protein, 22 aa, Mycobacterium
GQRNGYSAGSEAANPGQAGSRH

SEQ ID NO: 1011428 - protein, 4 aa, Mycobacterium
GQRR

SEQ ID NO: 1011429 - protein, 5 aa, Mycobacterium
GQRRV

SEQ ID NO: 1011430 - protein, 4 aa, Mycobacterium
GQRS

SEQ ID NO: 1011431 - protein, 10 aa, Mycobacterium
GQRSDGGTSR

SEQ ID NO: 1011432 - protein, 10 aa, Mycobacterium
GQRSPTDQGA

SEQ ID NO: 1011433 - protein, 10 aa, Mycobacterium
GQSAAEQEAT

SEQ ID NO: 1011434 - protein, 9 aa, Mycobacterium
GQSAAPTSL

SEQ ID NO: 1011435 - protein, 8 aa, Mycobacterium
GQSADEVE

SEQ ID NO: 1011436 - protein, 8 aa, Mycobacterium
GQSDRVGN

SEQ ID NO: 1011437 - protein, 5 aa, Mycobacterium
GQSEA

SEQ ID NO: 1011438 - protein, 8 aa, Mycobacterium
GQSEVPSR

SEQ ID NO: 1011439 - protein, 6 aa, Mycobacterium
GQSGYF

SEQ ID NO: 1011440 - protein, 4 aa, Mycobacterium
GQSI

SEQ ID NO: 1011441 - protein, 6 aa, Mycobacterium
GQSIPA

SEQ ID NO: 1011442 - protein, 6 aa, Mycobacterium
GQSKAT

SEQ ID NO: 1011443 - protein, 5 aa, Mycobacterium
GQSLA

SEQ ID NO: 1011444 - protein, 9 aa, Mycobacterium
GQSLNPNSK

SEQ ID NO: 1011445 - protein, 12 aa, Mycobacterium
GQSLSDAKSALG

SEQ ID NO: 1011446 - protein, 10 aa, Mycobacterium
GQSPEFGGRN

SEQ ID NO: 1011447 - protein, 4 aa, Mycobacterium
GQSQ

SEQ ID NO: 1011448 - protein, 17 aa, Mycobacterium
GQSRERMRKRGGGPGAA

SEQ ID NO: 1011449 - protein, 10 aa, Mycobacterium
GQSRRAARKA

SEQ ID NO: 1011450 - protein, 5 aa, Mycobacterium
GQSSS

SEQ ID NO: 1011451 - protein, 11 aa, Mycobacterium
GQSTHDRDQVS

SEQ ID NO: 1011452 - protein, 7 aa, Mycobacterium
GQSYETL

SEQ ID NO: 1011453 - protein, 12 aa, Mycobacterium
GQTADGLGADGR

SEQ ID NO: 1011454 - protein, 4 aa, Mycobacterium
GQTE

SEQ ID NO: 1011455 - protein, 7 aa, Mycobacterium
GQTERGL

SEQ ID NO: 1011456 - protein, 4 aa, Mycobacterium
GQTH

SEQ ID NO: 1011457 - protein, 16 aa, Mycobacterium
GQTITTSPIGSAGSGL

SEQ ID NO: 1011458 - protein, 8 aa, Mycobacterium
GQTPGTRM

SEQ ID NO: 1011459 - protein, 5 aa, Mycobacterium
GQTPL

SEQ ID NO: 1011460 - protein, 7 aa, Mycobacterium
GQTPLGV

SEQ ID NO: 1011461 - protein, 16 aa, Mycobacterium
GQTPRPELPGYGAPVG

SEQ ID NO: 1011462 - protein, 7 aa, Mycobacterium
GQTPSLG

SEQ ID NO: 1011463 - protein, 16 aa, Mycobacterium
GQTPSPESVPGRRGQL

SEQ ID NO: 1011464 - protein, 8 aa, Mycobacterium
GQTPSTGE

SEQ ID NO: 1011465 - protein, 10 aa, Mycobacterium
GQTPSTKSAK

SEQ ID NO: 1011466 - protein, 8 aa, Mycobacterium
GQTRSELT

SEQ ID NO: 1011467 - protein, 6 aa, Mycobacterium
GQTSTD

SEQ ID NO: 1011468 - protein, 6 aa, Mycobacterium
GQTTPG

SEQ ID NO: 1011469 - protein, 16 aa, Mycobacterium
GQTTSTEDAEGEPLAS

SEQ ID NO: 1011470 - protein, 20 aa, Mycobacterium
GQTTTGRPAFAGSDARRLEG

SEQ ID NO: 1011471 - protein, 9 aa, Mycobacterium
GQTYVTTPG

SEQ ID NO: 1011472 - protein, 5 aa, Mycobacterium
GQVEE

SEQ ID NO: 1011473 - protein, 9 aa, Mycobacterium
GQVKAKGPI

SEQ ID NO: 1011474 - protein, 8 aa, Mycobacterium
GQVPDGED

SEQ ID NO: 1011475 - protein, 9 aa, Mycobacterium
GQVPGAQIG

SEQ ID NO: 1011476 - protein, 4 aa, Mycobacterium
GQVR

SEQ ID NO: 1011477 - protein, 14 aa, Mycobacterium
GQVSSGAPLPPDQV

SEQ ID NO: 1011478 - protein, 11 aa, Mycobacterium
GQVTSYGPPAS

SEQ ID NO: 1011479 - protein, 7 aa, Mycobacterium
GQWDPGK

SEQ ID NO: 1011480 - protein, 7 aa, Mycobacterium
GQYPPSD

SEQ ID NO: 1011481 - protein, 20 aa, Mycobacterium
GQYSPTSEVGKVTKSTPMGS

SEQ ID NO: 1011482 - protein, 7 aa, Mycobacterium
GRAAAAG

SEQ ID NO: 1011483 - protein, 5 aa, Mycobacterium
GRAAE

SEQ ID NO: 1011484 - protein, 9 aa, Mycobacterium
GRAAPPDTT

SEQ ID NO: 1011485 - protein, 9 aa, Mycobacterium
GRADRIGDQ

SEQ ID NO: 1011486 - protein, 9 aa, Mycobacterium
GRADVSGLG

SEQ ID NO: 1011487 - protein, 8 aa, Mycobacterium
GRAEADDT

SEQ ID NO: 1011488 - protein, 15 aa, Mycobacterium
GRAEAGSPSATRDHA

SEQ ID NO: 1011489 - protein, 20 aa, Mycobacterium
GRAEERSVRERLGGSDAAVS

SEQ ID NO: 1011490 - protein, 5 aa, Mycobacterium
GRAEP

SEQ ID NO: 1011491 - protein, 8 aa, Mycobacterium
GRAFSAGG

SEQ ID NO: 1011492 - protein, 4 aa, Mycobacterium
GRAG

SEQ ID NO: 1011493 - protein, 8 aa, Mycobacterium
GRAGGHHS

SEQ ID NO: 1011494 - protein, 22 aa, Mycobacterium
GRAGIASTIEPADGQAPDGTNL

SEQ ID NO: 1011495 - protein, 17 aa, Mycobacterium
GRAGRAAAAHAAAAGRA

SEQ ID NO: 1011496 - protein, 8 aa, Mycobacterium
GRAGSGGK

SEQ ID NO: 1011497 - protein, 7 aa, Mycobacterium
GRAGSPK

SEQ ID NO: 1011498 - protein, 9 aa, Mycobacterium
GRAKRTGSP

SEQ ID NO: 1011499 - protein, 8 aa, Mycobacterium
GRALRDDG

SEQ ID NO: 1011500 - protein, 4 aa, Mycobacterium
GRAP

SEQ ID NO: 1011501 - protein, 25 aa, Mycobacterium
GRAPGPSRSGADATIPVSVAPAGHV

SEQ ID NO: 1011502 - protein, 11 aa, Mycobacterium
GRAPGSDPVTS

SEQ ID NO: 1011503 - protein, 9 aa, Mycobacterium
GRAPRTDDI

SEQ ID NO: 1011504 - protein, 16 aa, Mycobacterium
GRAPSGAAAPRAAGGN

SEQ ID NO: 1011505 - protein, 4 aa, Mycobacterium
GRAR

SEQ ID NO: 1011506 - protein, 14 aa, Mycobacterium
GRARGDTSNGFPGD

SEQ ID NO: 1011507 - protein, 12 aa, Mycobacterium
GRARSYGRDPDQ

SEQ ID NO: 1011508 - protein, 5 aa, Mycobacterium
GRART

SEQ ID NO: 1011509 - protein, 8 aa, Mycobacterium
GRASKALS

SEQ ID NO: 1011510 - protein, 5 aa, Mycobacterium
GRASV

SEQ ID NO: 1011511 - protein, 13 aa, Mycobacterium
GRATAGPDPLGRS

SEQ ID NO: 1011512 - protein, 7 aa, Mycobacterium
GRATCPP

SEQ ID NO: 1011513 - protein, 4 aa, Mycobacterium
GRCD

SEQ ID NO: 1011514 - protein, 9 aa, Mycobacterium
GRDAAVPTP

SEQ ID NO: 1011515 - protein, 16 aa, Mycobacterium
GRDAPLGSPGGADTVE

SEQ ID NO: 1011516 - protein, 5 aa, Mycobacterium
GRDAR

SEQ ID NO: 1011517 - protein, 7 aa, Mycobacterium
GRDDGGL

SEQ ID NO: 1011518 - protein, 11 aa, Mycobacterium
GRDDPDNVANA

SEQ ID NO: 1011519 - protein, 13 aa, Mycobacterium
GRDDVAEHVVFLD

SEQ ID NO: 1011520 - protein, 5 aa, Mycobacterium
GRDEA

SEQ ID NO: 1011521 - protein, 11 aa, Mycobacterium
GRDEATETARR

SEQ ID NO: 1011522 - protein, 19 aa, Mycobacterium
GRDGAAQLDAGQAFSDAGL

SEQ ID NO: 1011523 - protein, 15 aa, Mycobacterium
GRDGSVCDSSYERGA

SEQ ID NO: 1011524 - protein, 5 aa, Mycobacterium
GRDHR

SEQ ID NO: 1011525 - protein, 6 aa, Mycobacterium
GRDPAP

SEQ ID NO: 1011526 - protein, 10 aa, Mycobacterium
GRDPGAQSSV

SEQ ID NO: 1011527 - protein, 12 aa, Mycobacterium
GRDPQRQRARQI

SEQ ID NO: 1011528 - protein, 44 aa, Mycobacterium
GRDQPLSVPPPAAPPPRPTTPAATPPNPDSPELRGAAAEAAKRL

SEQ ID NO: 1011529 - protein, 8 aa, Mycobacterium
GRDQSATR

SEQ ID NO: 1011530 - protein, 5 aa, Mycobacterium
GRDRT

SEQ ID NO: 1011531 - protein, 6 aa, Mycobacterium
GRDTAA

SEQ ID NO: 1011532 - protein, 11 aa, Mycobacterium
GRDTADIGDRE

SEQ ID NO: 1011533 - protein, 5 aa, Mycobacterium
GRDTR

SEQ ID NO: 1011534 - protein, 5 aa, Mycobacterium
GRDYA

SEQ ID NO: 1011535 - protein, 11 aa, Mycobacterium
GREAARPGLTN

SEQ ID NO: 1011536 - protein, 13 aa, Mycobacterium
GREARARTRMKEG

SEQ ID NO: 1011537 - protein, 8 aa, Mycobacterium
GREARSRG

SEQ ID NO: 1011538 - protein, 16 aa, Mycobacterium
GREATDEELAAESGIP

SEQ ID NO: 1011539 - protein, 7 aa, Mycobacterium
GREDGGL

SEQ ID NO: 1011540 - protein, 10 aa, Mycobacterium
GREDKSPLGG

SEQ ID NO: 1011541 - protein, 8 aa, Mycobacterium
GREEAEAE

SEQ ID NO: 1011542 - protein, 6 aa, Mycobacterium
GREGEL

SEQ ID NO: 1011543 - protein, 4 aa, Mycobacterium
GREN

SEQ ID NO: 1011544 - protein, 11 aa, Mycobacterium
GRENDPQTGDD

SEQ ID NO: 1011545 - protein, 5 aa, Mycobacterium
GRENP

SEQ ID NO: 1011546 - protein, 11 aa, Mycobacterium
GREPDAVRDAT

SEQ ID NO: 1011547 - protein, 5 aa, Mycobacterium
GREPE

SEQ ID NO: 1011548 - protein, 6 aa, Mycobacterium
GREQTL

SEQ ID NO: 1011549 - protein, 8 aa, Mycobacterium
GRERASDD

SEQ ID NO: 1011550 - protein, 8 aa, Mycobacterium
GRESAEQT

SEQ ID NO: 1011551 - protein, 7 aa, Mycobacterium
GRESEDA

SEQ ID NO: 1011552 - protein, 10 aa, Mycobacterium
GRESGSAPTA

SEQ ID NO: 1011553 - protein, 5 aa, Mycobacterium
GRESL

SEQ ID NO: 1011554 - protein, 30 aa, Mycobacterium
GRESLGGRPFGDGTPPGPPVAGERVPAGHG

SEQ ID NO: 1011555 - protein, 8 aa, Mycobacterium
GRETFGEP

SEQ ID NO: 1011556 - protein, 8 aa, Mycobacterium
GRFPDSEL

SEQ ID NO: 1011557 - protein, 4 aa, Mycobacterium
GRGA

SEQ ID NO: 1011558 - protein, 9 aa, Mycobacterium
GRGADGANT

SEQ ID NO: 1011559 - protein, 11 aa, Mycobacterium
GRGAKLSRLTE

SEQ ID NO: 1011560 - protein, 22 aa, Mycobacterium
GRGAQEGRTALSAPGGGTRVGE

SEQ ID NO: 1011561 - protein, 4 aa, Mycobacterium
GRGD

SEQ ID NO: 1011562 - protein, 11 aa, Mycobacterium
GRGDDTTMSPD

SEQ ID NO: 1011563 - protein, 12 aa, Mycobacterium
GRGDKEGGDAAA

SEQ ID NO: 1011564 - protein, 6 aa, Mycobacterium
GRGDRG

SEQ ID NO: 1011565 - protein, 9 aa, Mycobacterium
GRGDRRRAT

SEQ ID NO: 1011566 - protein, 33 aa, Mycobacterium
GRGDRSGRDRKITTRPRGHRPGEKSWGHRGAHL

SEQ ID NO: 1011567 - protein, 4 aa, Mycobacterium
GRGE

SEQ ID NO: 1011568 - protein, 5 aa, Mycobacterium
GRGEE

SEQ ID NO: 1011569 - protein, 17 aa, Mycobacterium
GRGEQLASAGAPWPTYE

SEQ ID NO: 1011570 - protein, 6 aa, Mycobacterium
GRGFNA

SEQ ID NO: 1011571 - protein, 22 aa, Mycobacterium
GRGGASPNPIQSRPSVVPRTGI

SEQ ID NO: 1011572 - protein, 13 aa, Mycobacterium
GRGGGLLTLRSEP

SEQ ID NO: 1011573 - protein, 17 aa, Mycobacterium
GRGGNGGAGGAGGPVES

SEQ ID NO: 1011574 - protein, 6 aa, Mycobacterium
GRGGQV

SEQ ID NO: 1011575 - protein, 9 aa, Mycobacterium
GRGGRTATA

SEQ ID NO: 1011576 - protein, 13 aa, Mycobacterium
GRGHGPVSPLFRL

SEQ ID NO: 1011577 - protein, 10 aa, Mycobacterium
GRGKTGSGKT

SEQ ID NO: 1011578 - protein, 4 aa, Mycobacterium
GRGL

SEQ ID NO: 1011579 - protein, 12 aa, Mycobacterium
GRGPGGVRPPNN

SEQ ID NO: 1011580 - protein, 4 aa, Mycobacterium
GRGQ

SEQ ID NO: 1011581 - protein, 9 aa, Mycobacterium
GRGRADDTD

SEQ ID NO: 1011582 - protein, 8 aa, Mycobacterium
GRGREAGQ

SEQ ID NO: 1011583 - protein, 5 aa, Mycobacterium
GRGRG

SEQ ID NO: 1011584 - protein, 6 aa, Mycobacterium
GRGRGG

SEQ ID NO: 1011585 - protein, 10 aa, Mycobacterium
GRGRHTSTQS

SEQ ID NO: 1011586 - protein, 6 aa, Mycobacterium
GRGRNH

SEQ ID NO: 1011587 - protein, 8 aa, Mycobacterium
GRGRPAKR

SEQ ID NO: 1011588 - protein, 9 aa, Mycobacterium
GRGRPEESP

SEQ ID NO: 1011589 - protein, 5 aa, Mycobacterium
GRGRR

SEQ ID NO: 1011590 - protein, 8 aa, Mycobacterium
GRGSAANS

SEQ ID NO: 1011591 - protein, 13 aa, Mycobacterium
GRGSEDEPGDVPP

SEQ ID NO: 1011592 - protein, 16 aa, Mycobacterium
GRGSPQGLAASKALTT

SEQ ID NO: 1011593 - protein, 13 aa, Mycobacterium
GRGTDVARSRRGG

SEQ ID NO: 1011594 - protein, 8 aa, Mycobacterium
GRGTETPD

SEQ ID NO: 1011595 - protein, 5 aa, Mycobacterium
GRGTP

SEQ ID NO: 1011596 - protein, 22 aa, Mycobacterium
GRGYETAESLAARGERAAPVEQ

SEQ ID NO: 1011597 - protein, 15 aa, Mycobacterium
GRHDPSGFSDWLTVA

SEQ ID NO: 1011598 - protein, 6 aa, Mycobacterium
GRHNAA

SEQ ID NO: 1011599 - protein, 4 aa, Mycobacterium
GRHP

SEQ ID NO: 1011600 - protein, 6 aa, Mycobacterium
GRHPER

SEQ ID NO: 1011601 - protein, 7 aa, Mycobacterium
GRHPGGE

SEQ ID NO: 1011602 - protein, 20 aa, Mycobacterium
GRHSNIGYDAPKDLAQTKSK

SEQ ID NO: 1011603 - protein, 9 aa, Mycobacterium
GRIASTKGD

SEQ ID NO: 1011604 - protein, 22 aa, Mycobacterium
GRIDKTAAELADERKAVTELGL

SEQ ID NO: 1011605 - protein, 5 aa, Mycobacterium
GRIEP

SEQ ID NO: 1011606 - protein, 6 aa, Mycobacterium
GRIPAD

SEQ ID NO: 1011607 - protein, 7 aa, Mycobacterium
GRIPERE

SEQ ID NO: 1011608 - protein, 8 aa, Mycobacterium
GRIRTAEG

SEQ ID NO: 1011609 - protein, 12 aa, Mycobacterium
GRISGSTDSQVV

SEQ ID NO: 1011610 - protein, 6 aa, Mycobacterium
GRITGP

SEQ ID NO: 1011611 - protein, 7 aa, Mycobacterium
GRKGGLI

SEQ ID NO: 1011612 - protein, 6 aa, Mycobacterium
GRKPEH

SEQ ID NO: 1011613 - protein, 8 aa, Mycobacterium
GRKPGTRV

SEQ ID NO: 1011614 - protein, 6 aa, Mycobacterium
GRKPSR

SEQ ID NO: 1011615 - protein, 13 aa, Mycobacterium
GRKQDAAIKKGLT

SEQ ID NO: 1011616 - protein, 5 aa, Mycobacterium
GRKSA

SEQ ID NO: 1011617 - protein, 11 aa, Mycobacterium
GRKSGQPRHTA

SEQ ID NO: 1011618 - protein, 6 aa, Mycobacterium
GRKSGR

SEQ ID NO: 1011619 - protein, 14 aa, Mycobacterium
GRKTGLPRSTPATP

SEQ ID NO: 1011620 - protein, 4 aa, Mycobacterium
GRLD

SEQ ID NO: 1011621 - protein, 11 aa, Mycobacterium
GRLDSSEGDVG

SEQ ID NO: 1011622 - protein, 10 aa, Mycobacterium
GRLEGKSSLG

SEQ ID NO: 1011623 - protein, 11 aa, Mycobacterium
GRLNPERITES

SEQ ID NO: 1011624 - protein, 4 aa, Mycobacterium
GRLP

SEQ ID NO: 1011625 - protein, 8 aa, Mycobacterium
GRLPETGT

SEQ ID NO: 1011626 - protein, 7 aa, Mycobacterium
GRLSGTK

SEQ ID NO: 1011627 - protein, 5 aa, Mycobacterium
GRLSS

SEQ ID NO: 1011628 - protein, 13 aa, Mycobacterium
GRLTDADIEATTR

SEQ ID NO: 1011629 - protein, 7 aa, Mycobacterium
GRNATTV

SEQ ID NO: 1011630 - protein, 6 aa, Mycobacterium
GRNEAP

SEQ ID NO: 1011631 - protein, 8 aa, Mycobacterium
GRNGESPL

SEQ ID NO: 1011632 - protein, 12 aa, Mycobacterium
GRNGGSAVSSRY

SEQ ID NO: 1011633 - protein, 4 aa, Mycobacterium
GRNH

SEQ ID NO: 1011634 - protein, 8 aa, Mycobacterium
GRNPRGAD

SEQ ID NO: 1011635 - protein, 7 aa, Mycobacterium
GRNPTGV

SEQ ID NO: 1011636 - protein, 5 aa, Mycobacterium
GRNQP

SEQ ID NO: 1011637 - protein, 7 aa, Mycobacterium
GRNQRRN

SEQ ID NO: 1011638 - protein, 8 aa, Mycobacterium
GRNQSGKA

SEQ ID NO: 1011639 - protein, 7 aa, Mycobacterium
GRNSEYA

SEQ ID NO: 1011640 - protein, 11 aa, Mycobacterium
GRNSFEGRRTQ

SEQ ID NO: 1011641 - protein, 4 aa, Mycobacterium
GRNV

SEQ ID NO: 1011642 - protein, 5 aa, Mycobacterium
GRNVT

SEQ ID NO: 1011643 - protein, 8 aa, Mycobacterium
GRPAAGDG

SEQ ID NO: 1011644 - protein, 8 aa, Mycobacterium
GRPADGAP

SEQ ID NO: 1011645 - protein, 6 aa, Mycobacterium
GRPAEA

SEQ ID NO: 1011646 - protein, 7 aa, Mycobacterium
GRPAEPE

SEQ ID NO: 1011647 - protein, 16 aa, Mycobacterium
GRPAGAPVRRRIAKNE

SEQ ID NO: 1011648 - protein, 21 aa, Mycobacterium
GRPANEDTFAEAGRRAAQACE

SEQ ID NO: 1011649 - protein, 12 aa, Mycobacterium
GRPAPGRGSAQS

SEQ ID NO: 1011650 - protein, 6 aa, Mycobacterium
GRPAQI

SEQ ID NO: 1011651 - protein, 8 aa, Mycobacterium
GRPAQING

SEQ ID NO: 1011652 - protein, 13 aa, Mycobacterium
GRPATRKRWPNGV

SEQ ID NO: 1011653 - protein, 5 aa, Mycobacterium
GRPDD

SEQ ID NO: 1011654 - protein, 9 aa, Mycobacterium
GRPDTADRL

SEQ ID NO: 1011655 - protein, 13 aa, Mycobacterium
GRPDVDDLGTAYG

SEQ ID NO: 1011656 - protein, 4 aa, Mycobacterium
GRPE

SEQ ID NO: 1011657 - protein, 5 aa, Mycobacterium
GRPEE

SEQ ID NO: 1011658 - protein, 15 aa, Mycobacterium
GRPEELTDAADGEFE

SEQ ID NO: 1011659 - protein, 5 aa, Mycobacterium
GRPET

SEQ ID NO: 1011660 - protein, 9 aa, Mycobacterium
GRPETDDSA

SEQ ID NO: 1011661 - protein, 11 aa, Mycobacterium
GRPETDDSASA

SEQ ID NO: 1011662 - protein, 9 aa, Mycobacterium
GRPETEDAE

SEQ ID NO: 1011663 - protein, 5 aa, Mycobacterium
GRPGM

SEQ ID NO: 1011664 - protein, 11 aa, Mycobacterium
GRPGSTPTGPL

SEQ ID NO: 1011665 - protein, 4 aa, Mycobacterium
GRPH

SEQ ID NO: 1011666 - protein, 6 aa, Mycobacterium
GRPHGL

SEQ ID NO: 1011667 - protein, 12 aa, Mycobacterium
GRPKDGPDPKLS

SEQ ID NO: 1011668 - protein, 11 aa, Mycobacterium
GRPKGEAVEGT

SEQ ID NO: 1011669 - protein, 4 aa, Mycobacterium
GRPL

SEQ ID NO: 1011670 - protein, 6 aa, Mycobacterium
GRPLGE

SEQ ID NO: 1011671 - protein, 7 aa, Mycobacterium
GRPLSGV

SEQ ID NO: 1011672 - protein, 25 aa, Mycobacterium
GRPLSTAAVSRPATSYTAVAPDNSI

SEQ ID NO: 1011673 - protein, 4 aa, Mycobacterium
GRPM

SEQ ID NO: 1011674 - protein, 12 aa, Mycobacterium
GRPNGDDVDPEH

SEQ ID NO: 1011675 - protein, 13 aa, Mycobacterium
GRPPGDAPTTAAQ

SEQ ID NO: 1011676 - protein, 10 aa, Mycobacterium
GRPPGRKDPA

SEQ ID NO: 1011677 - protein, 6 aa, Mycobacterium
GRPPGT

SEQ ID NO: 1011678 - protein, 10 aa, Mycobacterium
GRPPLGTDGG

SEQ ID NO: 1011679 - protein, 22 aa, Mycobacterium
GRPQIGNDANGAAGTGANGGAA

SEQ ID NO: 1011680 - protein, 8 aa, Mycobacterium
GRPQPGET

SEQ ID NO: 1011681 - protein, 17 aa, Mycobacterium
GRPRAAKSTSRPAKLSR

SEQ ID NO: 1011682 - protein, 10 aa, Mycobacterium
GRPRRPARPT

SEQ ID NO: 1011683 - protein, 6 aa, Mycobacterium
GRPSAG

SEQ ID NO: 1011684 - protein, 7 aa, Mycobacterium
GRPSELA

SEQ ID NO: 1011685 - protein, 8 aa, Mycobacterium
GRPSERWG

SEQ ID NO: 1011686 - protein, 10 aa, Mycobacterium
GRPSSGITAP

SEQ ID NO: 1011687 - protein, 5 aa, Mycobacterium
GRPST

SEQ ID NO: 1011688 - protein, 7 aa, Mycobacterium
GRPSTYT

SEQ ID NO: 1011689 - protein, 6 aa, Mycobacterium
GRPTAA

SEQ ID NO: 1011690 - protein, 10 aa, Mycobacterium
GRPTGTSNTR

SEQ ID NO: 1011691 - protein, 4 aa, Mycobacterium
GRPV

SEQ ID NO: 1011692 - protein, 5 aa, Mycobacterium
GRPVG

SEQ ID NO: 1011693 - protein, 9 aa, Mycobacterium
GRPVPAAHP

SEQ ID NO: 1011694 - protein, 13 aa, Mycobacterium
GRPVPGQSSGDLT

SEQ ID NO: 1011695 - protein, 6 aa, Mycobacterium
GRPVTG

SEQ ID NO: 1011696 - protein, 15 aa, Mycobacterium
GRPYAASAPRIGSPR

SEQ ID NO: 1011697 - protein, 17 aa, Mycobacterium
GRPYEDVEKELALAFSR

SEQ ID NO: 1011698 - protein, 11 aa, Mycobacterium
GRQDRAAEPSC

SEQ ID NO: 1011699 - protein, 69 aa, Mycobacterium
GRQGNGGAGGHGGSGNQGGYGGLSGDESSRAAQGATGNDGNGGNGGKGANGNAALGANRNGGNGGIGGT

SEQ ID NO: 1011700 - protein, 8 aa, Mycobacterium
GRQGQTDH

SEQ ID NO: 1011701 - protein, 8 aa, Mycobacterium
GRQLAGAR

SEQ ID NO: 1011702 - protein, 9 aa, Mycobacterium
GRQPAAEFP

SEQ ID NO: 1011703 - protein, 6 aa, Mycobacterium
GRQPTG

SEQ ID NO: 1011704 - protein, 4 aa, Mycobacterium
GRQR

SEQ ID NO: 1011705 - protein, 22 aa, Mycobacterium
GRQRRPLPTGLAASGSDPTAPL

SEQ ID NO: 1011706 - protein, 17 aa, Mycobacterium
GRQRSGGGGSLSESVPM

SEQ ID NO: 1011707 - protein, 20 aa, Mycobacterium
GRQSGLDPGLTGCSSMCSAS

SEQ ID NO: 1011708 - protein, 7 aa, Mycobacterium
GRREAGL

SEQ ID NO: 1011709 - protein, 8 aa, Mycobacterium
GRREIRPA

SEQ ID NO: 1011710 - protein, 6 aa, Mycobacterium
GRREPI

SEQ ID NO: 1011711 - protein, 7 aa, Mycobacterium
GRRFPRP

SEQ ID NO: 1011712 - protein, 5 aa, Mycobacterium
GRRGA

SEQ ID NO: 1011713 - protein, 12 aa, Mycobacterium
GRRGAAGTLASN

SEQ ID NO: 1011714 - protein, 7 aa, Mycobacterium
GRRGAQV

SEQ ID NO: 1011715 - protein, 8 aa, Mycobacterium
GRRGGSAM

SEQ ID NO: 1011716 - protein, 7 aa, Mycobacterium
GRRGLAG

SEQ ID NO: 1011717 - protein, 14 aa, Mycobacterium
GRRGPNRDLPAYDD

SEQ ID NO: 1011718 - protein, 10 aa, Mycobacterium
GRRGPTGAGR

SEQ ID NO: 1011719 - protein, 6 aa, Mycobacterium
GRRGQE

SEQ ID NO: 1011720 - protein, 8 aa, Mycobacterium
GRRGVGRN

SEQ ID NO: 1011721 - protein, 5 aa, Mycobacterium
GRRNA

SEQ ID NO: 1011722 - protein, 6 aa, Mycobacterium
GRRNAA

SEQ ID NO: 1011723 - protein, 11 aa, Mycobacterium
GRRNPAVTAQA

SEQ ID NO: 1011724 - protein, 7 aa, Mycobacterium
GRRPGAR

SEQ ID NO: 1011725 - protein, 22 aa, Mycobacterium
GRRPGDSVVPDRATPAKITDED

SEQ ID NO: 1011726 - protein, 22 aa, Mycobacterium
GRRPLTSGQLGERMGLSAGLRR

SEQ ID NO: 1011727 - protein, 10 aa, Mycobacterium
GRRPPGPDDQ

SEQ ID NO: 1011728 - protein, 24 aa, Mycobacterium
GRRPPVATRGTDSTDVTARADLPA

SEQ ID NO: 1011729 - protein, 21 aa, Mycobacterium
GRRPTPGTAAYGAAKAGFESL

SEQ ID NO: 1011730 - protein, 6 aa, Mycobacterium
GRRRPI

SEQ ID NO: 1011731 - protein, 10 aa, Mycobacterium
GRRSGLATEG

SEQ ID NO: 1011732 - protein, 10 aa, Mycobacterium
GRRSGRPEWA

SEQ ID NO: 1011733 - protein, 11 aa, Mycobacterium
GRRSGRSGRRM

SEQ ID NO: 1011734 - protein, 10 aa, Mycobacterium
GRRSNYGAER

SEQ ID NO: 1011735 - protein, 6 aa, Mycobacterium
GRRTAR

SEQ ID NO: 1011736 - protein, 5 aa, Mycobacterium
GRRTI

SEQ ID NO: 1011737 - protein, 5 aa, Mycobacterium
GRRVH

SEQ ID NO: 1011738 - protein, 4 aa, Mycobacterium
GRSA

SEQ ID NO: 1011739 - protein, 12 aa, Mycobacterium
GRSAAAELMRQL

SEQ ID NO: 1011740 - protein, 5 aa, Mycobacterium
GRSAE

SEQ ID NO: 1011741 - protein, 6 aa, Mycobacterium
GRSAEQ

SEQ ID NO: 1011742 - protein, 4 aa, Mycobacterium
GRSC

SEQ ID NO: 1011743 - protein, 10 aa, Mycobacterium
GRSDQRLGQT

SEQ ID NO: 1011744 - protein, 9 aa, Mycobacterium
GRSDSPDLS

SEQ ID NO: 1011745 - protein, 4 aa, Mycobacterium
GRSE

SEQ ID NO: 1011746 - protein, 14 aa, Mycobacterium
GRSEATHVCAPAEA

SEQ ID NO: 1011747 - protein, 8 aa, Mycobacterium
GRSEEGCA

SEQ ID NO: 1011748 - protein, 18 aa, Mycobacterium
GRSEGVDLDDKGRQQASG

SEQ ID NO: 1011749 - protein, 9 aa, Mycobacterium
GRSEPSDDV

SEQ ID NO: 1011750 - protein, 10 aa, Mycobacterium
GRSEPSDEQR

SEQ ID NO: 1011751 - protein, 10 aa, Mycobacterium
GRSESDRHDE

SEQ ID NO: 1011752 - protein, 4 aa, Mycobacterium
GRSG

SEQ ID NO: 1011753 - protein, 12 aa, Mycobacterium
GRSGAADRRSHT

SEQ ID NO: 1011754 - protein, 11 aa, Mycobacterium
GRSGALSDRGT

SEQ ID NO: 1011755 - protein, 7 aa, Mycobacterium
GRSGTAA

SEQ ID NO: 1011756 - protein, 6 aa, Mycobacterium
GRSGVS

SEQ ID NO: 1011757 - protein, 12 aa, Mycobacterium
GRSHRPGQTPHF

SEQ ID NO: 1011758 - protein, 5 aa, Mycobacterium
GRSIR

SEQ ID NO: 1011759 - protein, 6 aa, Mycobacterium
GRSIRR

SEQ ID NO: 1011760 - protein, 5 aa, Mycobacterium
GRSLT

SEQ ID NO: 1011761 - protein, 7 aa, Mycobacterium
GRSPQEW

SEQ ID NO: 1011762 - protein, 9 aa, Mycobacterium
GRSQAGGLG

SEQ ID NO: 1011763 - protein, 5 aa, Mycobacterium
GRSQM

SEQ ID NO: 1011764 - protein, 4 aa, Mycobacterium
GRSR

SEQ ID NO: 1011765 - protein, 14 aa, Mycobacterium
GRSRPAAEGVRARL

SEQ ID NO: 1011766 - protein, 4 aa, Mycobacterium
GRSS

SEQ ID NO: 1011767 - protein, 5 aa, Mycobacterium
GRSSV

SEQ ID NO: 1011768 - protein, 4 aa, Mycobacterium
GRST

SEQ ID NO: 1011769 - protein, 11 aa, Mycobacterium
GRSTADATDQI

SEQ ID NO: 1011770 - protein, 7 aa, Mycobacterium
GRSTGPE

SEQ ID NO: 1011771 - protein, 8 aa, Mycobacterium
GRSTVEDA

SEQ ID NO: 1011772 - protein, 4 aa, Mycobacterium
GRSV

SEQ ID NO: 1011773 - protein, 5 aa, Mycobacterium
GRSVG

SEQ ID NO: 1011774 - protein, 12 aa, Mycobacterium
GRSVPAKSLSNF

SEQ ID NO: 1011775 - protein, 23 aa, Mycobacterium
GRSVTEKNAGVRAAAASGFEQAS

SEQ ID NO: 1011776 - protein, 4 aa, Mycobacterium
GRTA

SEQ ID NO: 1011777 - protein, 7 aa, Mycobacterium
GRTATGI

SEQ ID NO: 1011778 - protein, 4 aa, Mycobacterium
GRTD

SEQ ID NO: 1011779 - protein, 19 aa, Mycobacterium
GRTDTRHYYTPEDSSYETT

SEQ ID NO: 1011780 - protein, 7 aa, Mycobacterium
GRTEETF

SEQ ID NO: 1011781 - protein, 11 aa, Mycobacterium
GRTEIAEATRD

SEQ ID NO: 1011782 - protein, 8 aa, Mycobacterium
GRTEQEHL

SEQ ID NO: 1011783 - protein, 11 aa, Mycobacterium
GRTESPSAADV

SEQ ID NO: 1011784 - protein, 8 aa, Mycobacterium
GRTETAQY

SEQ ID NO: 1011785 - protein, 6 aa, Mycobacterium
GRTFGT

SEQ ID NO: 1011786 - protein, 5 aa, Mycobacterium
GRTFR

SEQ ID NO: 1011787 - protein, 6 aa, Mycobacterium
GRTNPD

SEQ ID NO: 1011788 - protein, 7 aa, Mycobacterium
GRTNQQI

SEQ ID NO: 1011789 - protein, 8 aa, Mycobacterium
GRTNRAEL

SEQ ID NO: 1011790 - protein, 5 aa, Mycobacterium
GRTPE

SEQ ID NO: 1011791 - protein, 6 aa, Mycobacterium
GRTPTD

SEQ ID NO: 1011792 - protein, 5 aa, Mycobacterium
GRTQT

SEQ ID NO: 1011793 - protein, 12 aa, Mycobacterium
GRTRANLASHGD

SEQ ID NO: 1011794 - protein, 6 aa, Mycobacterium
GRTSGV

SEQ ID NO: 1011795 - protein, 19 aa, Mycobacterium
GRTTAAAELQDSNAATPEL

SEQ ID NO: 1011796 - protein, 8 aa, Mycobacterium
GRTTGTSL

SEQ ID NO: 1011797 - protein, 6 aa, Mycobacterium
GRTVEG

SEQ ID NO: 1011798 - protein, 14 aa, Mycobacterium
GRTVPATDHSGRET

SEQ ID NO: 1011799 - protein, 5 aa, Mycobacterium
GRTVT

SEQ ID NO: 1011800 - protein, 9 aa, Mycobacterium
GRTYPYEGN

SEQ ID NO: 1011801 - protein, 8 aa, Mycobacterium
GRVDPRSD

SEQ ID NO: 1011802 - protein, 9 aa, Mycobacterium
GRVPDPALP

SEQ ID NO: 1011803 - protein, 9 aa, Mycobacterium
GRVPGPDGR

SEQ ID NO: 1011804 - protein, 7 aa, Mycobacterium
GRVQEPT

SEQ ID NO: 1011805 - protein, 14 aa, Mycobacterium
GRVQQAEHQPEGTR

SEQ ID NO: 1011806 - protein, 9 aa, Mycobacterium
GRVSAGGAT

SEQ ID NO: 1011807 - protein, 11 aa, Mycobacterium
GRVSDSGEGRW

SEQ ID NO: 1011808 - protein, 11 aa, Mycobacterium
GRVTAGGRHYP

SEQ ID NO: 1011809 - protein, 6 aa, Mycobacterium
GRWATE

SEQ ID NO: 1011810 - protein, 12 aa, Mycobacterium
GRWDTTPDPAVT

SEQ ID NO: 1011811 - protein, 21 aa, Mycobacterium
GRYGATLPGDRRARAHDCRGS

SEQ ID NO: 1011812 - protein, 4 aa, Mycobacterium
GRYT

SEQ ID NO: 1011813 - protein, 4 aa, Mycobacterium
GSAA

SEQ ID NO: 1011814 - protein, 6 aa, Mycobacterium
GSAAAA

SEQ ID NO: 1011815 - protein, 14 aa, Mycobacterium
GSAAEVNTARADGM

SEQ ID NO: 1011816 - protein, 6 aa, Mycobacterium
GSAAGE

SEQ ID NO: 1011817 - protein, 10 aa, Mycobacterium
GSAAPPQEVT

SEQ ID NO: 1011818 - protein, 10 aa, Mycobacterium
GSAAPRGPAV

SEQ ID NO: 1011819 - protein, 9 aa, Mycobacterium
GSAAQEDQY

SEQ ID NO: 1011820 - protein, 13 aa, Mycobacterium
GSACGDARAAAPV

SEQ ID NO: 1011821 - protein, 21 aa, Mycobacterium
GSADAAAGYDKTMAKAKDANL

SEQ ID NO: 1011822 - protein, 12 aa, Mycobacterium
GSADAAGTRPWR

SEQ ID NO: 1011823 - protein, 14 aa, Mycobacterium
GSADQGWIFDASSL

SEQ ID NO: 1011824 - protein, 16 aa, Mycobacterium
GSADRPDGGQAGPRCG

SEQ ID NO: 1011825 - protein, 10 aa, Mycobacterium
GSADRRIQSA

SEQ ID NO: 1011826 - protein, 6 aa, Mycobacterium
GSAEEL

SEQ ID NO: 1011827 - protein, 16 aa, Mycobacterium
GSAEPYSLDNERPAHP

SEQ ID NO: 1011828 - protein, 7 aa, Mycobacterium
GSAGEAI

SEQ ID NO: 1011829 - protein, 5 aa, Mycobacterium
GSAGG

SEQ ID NO: 1011830 - protein, 19 aa, Mycobacterium
GSAGHTAGGLAAPSAAAEA

SEQ ID NO: 1011831 - protein, 7 aa, Mycobacterium
GSAGNSF

SEQ ID NO: 1011832 - protein, 13 aa, Mycobacterium
GSAGREDPTAPIS

SEQ ID NO: 1011833 - protein, 34 aa, Mycobacterium; identical to SEQ ID NO: 495684

SEQ ID NO: 1011834 - protein, 11 aa, Mycobacterium
GSAGSAGSACA

SEQ ID NO: 1011835 - protein, 9 aa, Mycobacterium
GSAGSETAL

SEQ ID NO: 1011836 - protein, 27 aa, Mycobacterium
GSAGSKSRFSGDDTQRPLDKKGRAQAE

SEQ ID NO: 1011837 - protein, 12 aa, Mycobacterium
GSALATGNGGIG

SEQ ID NO: 1011838 - protein, 13 aa, Mycobacterium
GSAMGARTTCPAR

SEQ ID NO: 1011839 - protein, 7 aa, Mycobacterium
GSANRDA

SEQ ID NO: 1011840 - protein, 10 aa, Mycobacterium
GSAPAGAGLG

SEQ ID NO: 1011841 - protein, 10 aa, Mycobacterium
GSAPPPAAGV

SEQ ID NO: 1011842 - protein, 7 aa, Mycobacterium
GSAPTTI

SEQ ID NO: 1011843 - protein, 4 aa, Mycobacterium
GSAQ

SEQ ID NO: 1011844 - protein, 6 aa, Mycobacterium
GSARSP

SEQ ID NO: 1011845 - protein, 10 aa, Mycobacterium
GSASPTSTRP

SEQ ID NO: 1011846 - protein, 8 aa, Mycobacterium
GSASTDPV

SEQ ID NO: 1011847 - protein, 4 aa, Mycobacterium
GSAT

SEQ ID NO: 1011848 - protein, 15 aa, Mycobacterium
GSATHDVDATGRQID

SEQ ID NO: 1011849 - protein, 15 aa, Mycobacterium
GSATHGARHTADAIE

SEQ ID NO: 1011850 - protein, 6 aa, Mycobacterium
GSAVPE

SEQ ID NO: 1011851 - protein, 6 aa, Mycobacterium
GSAYGL

SEQ ID NO: 1011852 - protein, 37 aa, Mycobacterium
GSAYPGQNGSGGATGGAPSGINGGSGGNGGQGGFGGG

SEQ ID NO: 1011853 - protein, 4 aa, Mycobacterium
GSCN

SEQ ID NO: 1011854 - protein, 6 aa, Mycobacterium
GSCNRE

SEQ ID NO: 1011855 - protein, 12 aa, Mycobacterium
GSCSPPRRARGR

SEQ ID NO: 1011856 - protein, 7 aa, Mycobacterium
GSCSTND

SEQ ID NO: 1011857 - protein, 6 aa, Mycobacterium
GSDAAL

SEQ ID NO: 1011858 - protein, 6 aa, Mycobacterium
GSDAAQ

SEQ ID NO: 1011859 - protein, 8 aa, Mycobacterium
GSDAPSAL

SEQ ID NO: 1011860 - protein, 21 aa, Mycobacterium
GSDARNAGGASAQQPGITTGA

SEQ ID NO: 1011861 - protein, 17 aa, Mycobacterium
GSDDSEFKRGSTSEDQL

SEQ ID NO: 1011862 - protein, 7 aa, Mycobacterium
GSDEASV

SEQ ID NO: 1011863 - protein, 5 aa, Mycobacterium
GSDED

SEQ ID NO: 1011864 - protein, 8 aa, Mycobacterium
GSDEEAPL

SEQ ID NO: 1011865 - protein, 6 aa, Mycobacterium
GSDEEF

SEQ ID NO: 1011866 - protein, 9 aa, Mycobacterium
GSDEGGHDA

SEQ ID NO: 1011867 - protein, 7 aa, Mycobacterium
GSDEGLT

SEQ ID NO: 1011868 - protein, 7 aa, Mycobacterium
GSDEVST

SEQ ID NO: 1011869 - protein, 10 aa, Mycobacterium
GSDGAELDPE

SEQ ID NO: 1011870 - protein, 10 aa, Mycobacterium
GSDGEQAAAI

SEQ ID NO: 1011871 - protein, 166 aa, Mycobacterium
GSDGGIGTGGNGGLGGNGGAGGHGGINTGTRGTASASGGTGGNGGAGGNGGAPGAANAIGGQGGQGGIGGNGGNGGNGGTASSSNTGPTPSAGTGGGGTGGGGGGGGGGGGGGASASGAVGGTGGGGGGGGAGAAAGTGAVGGGGGGAAPPAAPVAPPEMEAREAT

SEQ ID NO: 1011872 - protein, 5 aa, Mycobacterium
GSDGI

SEQ ID NO: 1011873 - protein, 5 aa, Mycobacterium
GSDGS

SEQ ID NO: 1011874 - protein, 11 aa, Mycobacterium
GSDHSDDRHSC

SEQ ID NO: 1011875 - protein, 7 aa, Mycobacterium
GSDKPDL

SEQ ID NO: 1011876 - protein, 6 aa, Mycobacterium
GSDLQR

SEQ ID NO: 1011877 - protein, 10 aa, Mycobacterium
GSDPATSVAN

SEQ ID NO: 1011878 - protein, 8 aa, Mycobacterium
GSDPEFRA

SEQ ID NO: 1011879 - protein, 8 aa, Mycobacterium
GSDPKGAV

SEQ ID NO: 1011880 - protein, 8 aa, Mycobacterium
GSDPNPLA

SEQ ID NO: 1011881 - protein, 10 aa, Mycobacterium
GSDPPDDPYE

SEQ ID NO: 1011882 - protein, 8 aa, Mycobacterium
GSDRVSAA

SEQ ID NO: 1011883 - protein, 8 aa, Mycobacterium
GSDSGADA

SEQ ID NO: 1011884 - protein, 10 aa, Mycobacterium
GSDSGGGAGI

SEQ ID NO: 1011885 - protein, 11 aa, Mycobacterium
GSDSGGGAGIQ

SEQ ID NO: 1011886 - protein, 4 aa, Mycobacterium
GSDT

SEQ ID NO: 1011887 - protein, 15 aa, Mycobacterium
GSDTAADVSPIGTPL

SEQ ID NO: 1011888 - protein, 8 aa, Mycobacterium
GSDTAARA

SEQ ID NO: 1011889 - protein, 6 aa, Mycobacterium
GSDVQA

SEQ ID NO: 1011890 - protein, 13 aa, Mycobacterium
GSDWPGAAEDRDT

SEQ ID NO: 1011891 - protein, 5 aa, Mycobacterium
GSDYP

SEQ ID NO: 1011892 - protein, 6 aa, Mycobacterium
GSEAGD

SEQ ID NO: 1011893 - protein, 7 aa, Mycobacterium
GSEDGYL

SEQ ID NO: 1011894 - protein, 14 aa, Mycobacterium
GSEFSQDADPRYAN

SEQ ID NO: 1011895 - protein, 14 aa, Mycobacterium
GSEGAEDSPSGQPR

SEQ ID NO: 1011896 - protein, 6 aa, Mycobacterium
GSEGDF

SEQ ID NO: 1011897 - protein, 31 aa, Mycobacterium; identical to SEQ ID NO: 496038

SEQ ID NO: 1011898 - protein, 8 aa, Mycobacterium
GSEKSPGF

SEQ ID NO: 1011899 - protein, 6 aa, Mycobacterium
GSEKTA

SEQ ID NO: 1011900 - protein, 10 aa, Mycobacterium
GSELTDSQVG

SEQ ID NO: 1011901 - protein, 7 aa, Mycobacterium
GSEMADE

SEQ ID NO: 1011902 - protein, 18 aa, Mycobacterium
GSENSGAFRSHTPPVQRG

SEQ ID NO: 1011903 - protein, 4 aa, Mycobacterium
GSEP

SEQ ID NO: 1011904 - protein, 5 aa, Mycobacterium
GSEPL

SEQ ID NO: 1011905 - protein, 17 aa, Mycobacterium
GSEQTAAAEGKVGNVRR

SEQ ID NO: 1011906 - protein, 6 aa, Mycobacterium
GSERPL

SEQ ID NO: 1011907 - protein, 5 aa, Mycobacterium
GSETT

SEQ ID NO: 1011908 - protein, 7 aa, Mycobacterium
GSEVSGK

SEQ ID NO: 1011909 - protein, 41 aa, Mycobacterium
GSFTPTPVGYGGNGGNGVNGGTGGTGGSGGTLIGTDGTNGS

SEQ ID NO: 1011910 - protein, 16 aa, Mycobacterium
GSGAGGVGSGGVAFIE

SEQ ID NO: 1011911 - protein, 7 aa, Mycobacterium
GSGAGLP

SEQ ID NO: 1011912 - protein, 12 aa, Mycobacterium
GSGARPGTSPKV

SEQ ID NO: 1011913 - protein, 7 aa, Mycobacterium
GSGATHA

SEQ ID NO: 1011914 - protein, 26 aa, Mycobacterium
GSGDGSDSRDGAPHRNGGTHERPAVD

SEQ ID NO: 1011915 - protein, 4 aa, Mycobacterium
GSGE

SEQ ID NO: 1011916 - protein, 7 aa, Mycobacterium
GSGEKRT

SEQ ID NO: 1011917 - protein, 9 aa, Mycobacterium
GSGEPGPVI

SEQ ID NO: 1011918 - protein, 5 aa, Mycobacterium
GSGFG

SEQ ID NO: 1011919 - protein, 4 aa, Mycobacterium
GSGG

SEQ ID NO: 1011920 - protein, 11 aa, Mycobacterium
GSGGAGGIGGA

SEQ ID NO: 1011921 - protein, 14 aa, Mycobacterium
GSGGAGGQGGTGLA

SEQ ID NO: 1011922 - protein, 12 aa, Mycobacterium
GSGGAGGTGGTA

SEQ ID NO: 1011923 - protein, 54 aa, Mycobacterium
GSGGGGGAGGDGGVGGTGAQGAPGTQSFSAGTGGNGGDGGSGGVAGAGGSGGFL

SEQ ID NO: 1011924 - protein, 24 aa, Mycobacterium
GSGGGGNGGSGYSGIGGTGGTGGN

SEQ ID NO: 1011925 - protein, 7 aa, Mycobacterium
GSGGHNS

SEQ ID NO: 1011926 - protein, 21 aa, Mycobacterium
GSGGPGTATGTTVTTSSAEAA

SEQ ID NO: 1011927 - protein, 16 aa, Mycobacterium
GSGGSAGREDPTAPIS

SEQ ID NO: 1011928 - protein, 14 aa, Mycobacterium
GSGGSGGIGGTGGH

SEQ ID NO: 1011929 - protein, 53 aa, Mycobacterium
GSGGTGGDGGGGGSASGSGTGGSGGTGGVGGIGGDGKLGGFGGDGGDGGDGGF

SEQ ID NO: 1011930 - protein, 55 aa, Mycobacterium
GSGGTGGHGAAGAVAGGDGGCGGTGGGLAGSGGTGGNGAVGTVSGVGGDGGNAAG

SEQ ID NO: 1011931 - protein, 15 aa, Mycobacterium
GSGGTGGQGGGGGDG

SEQ ID NO: 1011932 - protein, 16 aa, Mycobacterium
GSGHAGGRGSARADHL

SEQ ID NO: 1011933 - protein, 5 aa, Mycobacterium
GSGHS

SEQ ID NO: 1011934 - protein, 14 aa, Mycobacterium
GSGIEPTDPRVSPL

SEQ ID NO: 1011935 - protein, 5 aa, Mycobacterium
GSGIT

SEQ ID NO: 1011936 - protein, 4 aa, Mycobacterium
GSGK

SEQ ID NO: 1011937 - protein, 5 aa, Mycobacterium
GSGKA

SEQ ID NO: 1011938 - protein, 6 aa, Mycobacterium
GSGKLT

SEQ ID NO: 1011939 - protein, 9 aa, Mycobacterium
GSGKSTIGR

SEQ ID NO: 1011940 - protein, 9 aa, Mycobacterium
GSGKTITGT

SEQ ID NO: 1011941 - protein, 7 aa, Mycobacterium
GSGNAGA

SEQ ID NO: 1011942 - protein, 8 aa, Mycobacterium
GSGNESAN

SEQ ID NO: 1011943 - protein, 7 aa, Mycobacterium
GSGNFEI

SEQ ID NO: 1011944 - protein, 6 aa, Mycobacterium
GSGNFG

SEQ ID NO: 1011945 - protein, 17 aa, Mycobacterium
GSGNGNSGNGDSTTPLS

SEQ ID NO: 1011946 - protein, 6 aa, Mycobacterium
GSGNGV

SEQ ID NO: 1011947 - protein, 59 aa, Mycobacterium; identical to SEQ ID NO: 905106

SEQ ID NO: 1011948 - protein, 10 aa, Mycobacterium
GSGNKGDTNF

SEQ ID NO: 1011949 - protein, 14 aa, Mycobacterium
GSGNLGDANPGSGN

SEQ ID NO: 1011950 - protein, 29 aa, Mycobacterium
GSGNLGSGNFGSGNFGSSNIGASNLGSNN

SEQ ID NO: 1011951 - protein, 6 aa, Mycobacterium
GSGNTG

SEQ ID NO: 1011952 - protein, 20 aa, Mycobacterium
GSGNVGNANNGIGNLGSGNL

SEQ ID NO: 1011953 - protein, 4 aa, Mycobacterium
GSGP

SEQ ID NO: 1011954 - protein, 9 aa, Mycobacterium
GSGPAGLAA

SEQ ID NO: 1011955 - protein, 6 aa, Mycobacterium
GSGPGD

SEQ ID NO: 1011956 - protein, 8 aa, Mycobacterium
GSGPKALE

SEQ ID NO: 1011957 - protein, 6 aa, Mycobacterium
GSGPQA

SEQ ID NO: 1011958 - protein, 5 aa, Mycobacterium
GSGPR

SEQ ID NO: 1011959 - protein, 6 aa, Mycobacterium
GSGPSG

SEQ ID NO: 1011960 - protein, 5 aa, Mycobacterium
GSGPV

SEQ ID NO: 1011961 - protein, 16 aa, Mycobacterium
GSGQIKTGAPARSERV

SEQ ID NO: 1011962 - protein, 17 aa, Mycobacterium
GSGQPDNGNAGAAGAGG

SEQ ID NO: 1011963 - protein, 4 aa, Mycobacterium
GSGR

SEQ ID NO: 1011964 - protein, 19 aa, Mycobacterium
GSGRLRRPRHPRQARSHRR

SEQ ID NO: 1011965 - protein, 14 aa, Mycobacterium
GSGRRLASTTKETL

SEQ ID NO: 1011966 - protein, 12 aa, Mycobacterium
GSGRTPFARGGD

SEQ ID NO: 1011967 - protein, 13 aa, Mycobacterium
GSGRWPDRPLGSV

SEQ ID NO: 1011968 - protein, 6 aa, Mycobacterium
GSGSAS

SEQ ID NO: 1011969 - protein, 9 aa, Mycobacterium
GSGSGASAF

SEQ ID NO: 1011970 - protein, 7 aa, Mycobacterium
GSGSGSI

SEQ ID NO: 1011971 - protein, 9 aa, Mycobacterium
GSGSLKSEI

SEQ ID NO: 1011972 - protein, 11 aa, Mycobacterium
GSGSSRHSPRN

SEQ ID NO: 1011973 - protein, 7 aa, Mycobacterium
GSGSTGV

SEQ ID NO: 1011974 - protein, 6 aa, Mycobacterium
GSGSTV

SEQ ID NO: 1011975 - protein, 6 aa, Mycobacterium
GSGTED

SEQ ID NO: 1011976 - protein, 26 aa, Mycobacterium
GSGTGEFAHSPDTDRPATEPGLGADD

SEQ ID NO: 1011977 - protein, 16 aa, Mycobacterium
GSGTGTGGEAKWGGYA

SEQ ID NO: 1011978 - protein, 8 aa, Mycobacterium
GSGTSEKT

SEQ ID NO: 1011979 - protein, 6 aa, Mycobacterium
GSGVDG

SEQ ID NO: 1011980 - protein, 10 aa, Mycobacterium
GSGVQPPVAT

SEQ ID NO: 1011981 - protein, 8 aa, Mycobacterium
GSHGTSPI

SEQ ID NO: 1011982 - protein, 5 aa, Mycobacterium
GSHPS

SEQ ID NO: 1011983 - protein, 9 aa, Mycobacterium
GSHQDAINK

SEQ ID NO: 1011984 - protein, 17 aa, Mycobacterium
GSHRPDLALADRECQDH

SEQ ID NO: 1011985 - protein, 10 aa, Mycobacterium
GSIADGKKEI

SEQ ID NO: 1011986 - protein, 7 aa, Mycobacterium
GSIAPEE

SEQ ID NO: 1011987 - protein, 12 aa, Mycobacterium
GSIDGARSASAT

SEQ ID NO: 1011988 - protein, 9 aa, Mycobacterium
GSIGDAEAA

SEQ ID NO: 1011989 - protein, 16 aa, Mycobacterium
GSIKSGITDATGGYIP

SEQ ID NO: 1011990 - protein, 12 aa, Mycobacterium
GSIPTTTSGKVR

SEQ ID NO: 1011991 - protein, 7 aa, Mycobacterium
GSISTDD

SEQ ID NO: 1011992 - protein, 7 aa, Mycobacterium
GSITAAP

SEQ ID NO: 1011993 - protein, 7 aa, Mycobacterium
GSKEARI

SEQ ID NO: 1011994 - protein, 9 aa, Mycobacterium
GSKTPGHPE

SEQ ID NO: 1011995 - protein, 12 aa, Mycobacterium
GSKVGSSSLPEG

SEQ ID NO: 1011996 - protein, 12 aa, Mycobacterium
GSLAAGPALSGR

SEQ ID NO: 1011997 - protein, 7 aa, Mycobacterium
GSLAGTA

SEQ ID NO: 1011998 - protein, 8 aa, Mycobacterium
GSLANTAG

SEQ ID NO: 1011999 - protein, 9 aa, Mycobacterium
GSLASQSAE

SEQ ID NO: 1012000 - protein, 7 aa, Mycobacterium
GSLDPVQ

SEQ ID NO: 1012001 - protein, 8 aa, Mycobacterium
GSLDQEPE

SEQ ID NO: 1012002 - protein, 11 aa, Mycobacterium
GSLEPTDEAAA

SEQ ID NO: 1012003 - protein, 6 aa, Mycobacterium
GSLGGG

SEQ ID NO: 1012004 - protein, 5 aa, Mycobacterium
GSLGH

SEQ ID NO: 1012005 - protein, 14 aa, Mycobacterium
GSLGSGSPEPATDL

SEQ ID NO: 1012006 - protein, 8 aa, Mycobacterium
GSLSRRGV

SEQ ID NO: 1012007 - protein, 6 aa, Mycobacterium
GSMAAR

SEQ ID NO: 1012008 - protein, 6 aa, Mycobacterium
GSMGGA

SEQ ID NO: 1012009 - protein, 13 aa, Mycobacterium
GSMSSKTNGEDRI

SEQ ID NO: 1012010 - protein, 10 aa, Mycobacterium
GSNGSGKSTL

SEQ ID NO: 1012011 - protein, 4 aa, Mycobacterium
GSNM

SEQ ID NO: 1012012 - protein, 15 aa, Mycobacterium
GSNNIGGANSGGNNL

SEQ ID NO: 1012013 - protein, 5 aa, Mycobacterium
GSNNQ

SEQ ID NO: 1012014 - protein, 8 aa, Mycobacterium
GSNPTERT

SEQ ID NO: 1012015 - protein, 8 aa, Mycobacterium
GSNTSTLP

SEQ ID NO: 1012016 - protein, 16 aa, Mycobacterium
GSNVGAASSAAAGPTA

SEQ ID NO: 1012017 - protein, 9 aa, Mycobacterium
GSPADPATL

SEQ ID NO: 1012018 - protein, 6 aa, Mycobacterium
GSPAEL

SEQ ID NO: 1012019 - protein, 7 aa, Mycobacterium
GSPAFTA

SEQ ID NO: 1012020 - protein, 7 aa, Mycobacterium
GSPAGEL

SEQ ID NO: 1012021 - protein, 6 aa, Mycobacterium
GSPAKV

SEQ ID NO: 1012022 - protein, 7 aa, Mycobacterium
GSPAQAA

SEQ ID NO: 1012023 - protein, 6 aa, Mycobacterium
GSPASY

SEQ ID NO: 1012024 - protein, 10 aa, Mycobacterium
GSPDDSGARA

SEQ ID NO: 1012025 - protein, 7 aa, Mycobacterium
GSPDPQL

SEQ ID NO: 1012026 - protein, 9 aa, Mycobacterium
GSPEEAAEQ

SEQ ID NO: 1012027 - protein, 9 aa, Mycobacterium
GSPFQSAAQ

SEQ ID NO: 1012028 - protein, 8 aa, Mycobacterium
GSPGAQGR

SEQ ID NO: 1012029 - protein, 16 aa, Mycobacterium
GSPGFRGDPAGPPISI

SEQ ID NO: 1012030 - protein, 6 aa, Mycobacterium
GSPGHY

SEQ ID NO: 1012031 - protein, 10 aa, Mycobacterium
GSPGSSERVY

SEQ ID NO: 1012032 - protein, 5 aa, Mycobacterium
GSPHS

SEQ ID NO: 1012033 - protein, 18 aa, Mycobacterium
GSPITDTDTALPMVELRL

SEQ ID NO: 1012034 - protein, 6 aa, Mycobacterium
GSPITI

SEQ ID NO: 1012035 - protein, 9 aa, Mycobacterium
GSPKQVANT

SEQ ID NO: 1012036 - protein, 4 aa, Mycobacterium
GSPL

SEQ ID NO: 1012037 - protein, 9 aa, Mycobacterium
GSPLAGDSL

SEQ ID NO: 1012038 - protein, 20 aa, Mycobacterium
GSPMGRTRDAAPGAAPDRPV

SEQ ID NO: 1012039 - protein, 7 aa, Mycobacterium
GSPNRGM

SEQ ID NO: 1012040 - protein, 10 aa, Mycobacterium
GSPNRRRARA

SEQ ID NO: 1012041 - protein, 6 aa, Mycobacterium
GSPPAE

SEQ ID NO: 1012042 - protein, 9 aa, Mycobacterium
GSPPAGDLP

SEQ ID NO: 1012043 - protein, 7 aa, Mycobacterium
GSPPPWA

SEQ ID NO: 1012044 - protein, 9 aa, Mycobacterium
GSPQLPGNT

SEQ ID NO: 1012045 - protein, 9 aa, Mycobacterium
GSPRIGPRR

SEQ ID NO: 1012046 - protein, 12 aa, Mycobacterium
GSPSQARKHANA

SEQ ID NO: 1012047 - protein, 7 aa, Mycobacterium
GSPSRPL

SEQ ID NO: 1012048 - protein, 7 aa, Mycobacterium
GSPTRAP

SEQ ID NO: 1012049 - protein, 24 aa, Mycobacterium
GSPVRPGTGWPGDPASSQTPVAAE

SEQ ID NO: 1012050 - protein, 4 aa, Mycobacterium
GSPW

SEQ ID NO: 1012051 - protein, 5 aa, Mycobacterium
GSPWA

SEQ ID NO: 1012052 - protein, 15 aa, Mycobacterium
GSPYETLRAEVVMET

SEQ ID NO: 1012053 - protein, 6 aa, Mycobacterium
GSQGHA

SEQ ID NO: 1012054 - protein, 5 aa, Mycobacterium
GSQGT

SEQ ID NO: 1012055 - protein, 4 aa, Mycobacterium
GSQI

SEQ ID NO: 1012056 - protein, 4 aa, Mycobacterium
GSQK

SEQ ID NO: 1012057 - protein, 15 aa, Mycobacterium
GSQPSDQSVTFDVDR

SEQ ID NO: 1012058 - protein, 7 aa, Mycobacterium
GSQQAYE

SEQ ID NO: 1012059 - protein, 7 aa, Mycobacterium
GSQRGAD

SEQ ID NO: 1012060 - protein, 11 aa, Mycobacterium
GSQVAKPDLPG

SEQ ID NO: 1012061 - protein, 6 aa, Mycobacterium
GSQVTK

SEQ ID NO: 1012062 - protein, 4 aa, Mycobacterium
GSQW

SEQ ID NO: 1012063 - protein, 9 aa, Mycobacterium
GSRAEGDDL

SEQ ID NO: 1012064 - protein, 6 aa, Mycobacterium
GSRAFS

SEQ ID NO: 1012065 - protein, 9 aa, Mycobacterium
GSRAGGLHS

SEQ ID NO: 1012066 - protein, 5 aa, Mycobacterium
GSRAI

SEQ ID NO: 1012067 - protein, 8 aa, Mycobacterium
GSRAQTDL

SEQ ID NO: 1012068 - protein, 7 aa, Mycobacterium
GSRASEF

SEQ ID NO: 1012069 - protein, 7 aa, Mycobacterium
GSRASTH

SEQ ID NO: 1012070 - protein, 9 aa, Mycobacterium
GSRDAAESV

SEQ ID NO: 1012071 - protein, 9 aa, Mycobacterium
GSREETVGQ

SEQ ID NO: 1012072 - protein, 5 aa, Mycobacterium
GSRGG

SEQ ID NO: 1012073 - protein, 6 aa, Mycobacterium
GSRGLG

SEQ ID NO: 1012074 - protein, 13 aa, Mycobacterium
GSRGPDAKPYSAL

SEQ ID NO: 1012075 - protein, 10 aa, Mycobacterium
GSRGPRESKY

SEQ ID NO: 1012076 - protein, 6 aa, Mycobacterium
GSRISE

SEQ ID NO: 1012077 - protein, 8 aa, Mycobacterium
GSRKQLAA

SEQ ID NO: 1012078 - protein, 12 aa, Mycobacterium
GSRLAKNPRRAK

SEQ ID NO: 1012079 - protein, 6 aa, Mycobacterium
GSRLAS

SEQ ID NO: 1012080 - protein, 6 aa, Mycobacterium
GSRLDR

SEQ ID NO: 1012081 - protein, 8 aa, Mycobacterium
GSRLDTAE

SEQ ID NO: 1012082 - protein, 9 aa, Mycobacterium
GSRPEAQET

SEQ ID NO: 1012083 - protein, 9 aa, Mycobacterium
GSRPTLPDL

SEQ ID NO: 1012084 - protein, 13 aa, Mycobacterium
GSRPTSRKPTASI

SEQ ID NO: 1012085 - protein, 15 aa, Mycobacterium
GSRPVQPSAEQPVVL

SEQ ID NO: 1012086 - protein, 9 aa, Mycobacterium
GSRQTHDDR

SEQ ID NO: 1012087 - protein, 5 aa, Mycobacterium
GSRQV

SEQ ID NO: 1012088 - protein, 5 aa, Mycobacterium
GSRRK

SEQ ID NO: 1012089 - protein, 7 aa, Mycobacterium
GSRRRGA

SEQ ID NO: 1012090 - protein, 7 aa, Mycobacterium
GSRRTGI

SEQ ID NO: 1012091 - protein, 10 aa, Mycobacterium
GSRSPDSGNA

SEQ ID NO: 1012092 - protein, 15 aa, Mycobacterium
GSRSRADTFGPDGGE

SEQ ID NO: 1012093 - protein, 9 aa, Mycobacterium
GSRTANAGP

SEQ ID NO: 1012094 - protein, 11 aa, Mycobacterium
GSRTGVPREGG

SEQ ID NO: 1012095 - protein, 9 aa, Mycobacterium
GSRTKEPDD

SEQ ID NO: 1012096 - protein, 7 aa, Mycobacterium
GSRTSQF

SEQ ID NO: 1012097 - protein, 4 aa, Mycobacterium
GSRY

SEQ ID NO: 1012098 - protein, 4 aa, Mycobacterium
GSSA

SEQ ID NO: 1012099 - protein, 13 aa, Mycobacterium
GSSAAAAPAAVSQ

SEQ ID NO: 1012100 - protein, 13 aa, Mycobacterium
GSSALPTVSVPPG

SEQ ID NO: 1012101 - protein, 7 aa, Mycobacterium
GSSDRDI

SEQ ID NO: 1012102 - protein, 6 aa, Mycobacterium
GSSDRL

SEQ ID NO: 1012103 - protein, 6 aa, Mycobacterium
GSSEKA

SEQ ID NO: 1012104 - protein, 15 aa, Mycobacterium
GSSELATQLTQGATA

SEQ ID NO: 1012105 - protein, 7 aa, Mycobacterium
GSSFKAA

SEQ ID NO: 1012106 - protein, 6 aa, Mycobacterium
GSSGAL

SEQ ID NO: 1012107 - protein, 10 aa, Mycobacterium
GSSGKTSTKD

SEQ ID NO: 1012108 - protein, 5 aa, Mycobacterium
GSSGL

SEQ ID NO: 1012109 - protein, 8 aa, Mycobacterium
GSSGPQGA

SEQ ID NO: 1012110 - protein, 17 aa, Mycobacterium
GSSGSSPSTTDDAPADV

SEQ ID NO: 1012111 - protein, 6 aa, Mycobacterium
GSSGTL

SEQ ID NO: 1012112 - protein, 17 aa, Mycobacterium
GSSHGYDVTDPTTVSAE

SEQ ID NO: 1012113 - protein, 10 aa, Mycobacterium
GSSHTPESLE

SEQ ID NO: 1012114 - protein, 4 aa, Mycobacterium
GSSI

SEQ ID NO: 1012115 - protein, 12 aa, Mycobacterium
GSSLDTPAGQQQ

SEQ ID NO: 1012116 - protein, 8 aa, Mycobacterium
GSSLPQTS

SEQ ID NO: 1012117 - protein, 4 aa, Mycobacterium
GSSM

SEQ ID NO: 1012118 - protein, 5 aa, Mycobacterium
GSSMT

SEQ ID NO: 1012119 - protein, 7 aa, Mycobacterium
GSSNLGD

SEQ ID NO: 1012120 - protein, 6 aa, Mycobacterium
GSSPEA

SEQ ID NO: 1012121 - protein, 7 aa, Mycobacterium
GSSPRPY

SEQ ID NO: 1012122 - protein, 5 aa, Mycobacterium
GSSQR

SEQ ID NO: 1012123 - protein, 5 aa, Mycobacterium
GSSRA

SEQ ID NO: 1012124 - protein, 7 aa, Mycobacterium
GSSRRYA

SEQ ID NO: 1012125 - protein, 15 aa, Mycobacterium
GSSTENSAYGPTRNP

SEQ ID NO: 1012126 - protein, 9 aa, Mycobacterium
GSSTPAKDY

SEQ ID NO: 1012127 - protein, 7 aa, Mycobacterium
GSSTYPG

SEQ ID NO: 1012128 - protein, 4 aa, Mycobacterium
GSSV

SEQ ID NO: 1012129 - protein, 16 aa, Mycobacterium
GSSVNTANAMATTQTT

SEQ ID NO: 1012130 - protein, 5 aa, Mycobacterium
GSSWT

SEQ ID NO: 1012131 - protein, 5 aa, Mycobacterium
GSSYH

SEQ ID NO: 1012132 - protein, 6 aa, Mycobacterium
GSSYNT

SEQ ID NO: 1012133 - protein, 9 aa, Mycobacterium
GSTATGRSV

SEQ ID NO: 1012134 - protein, 6 aa, Mycobacterium
GSTAVG

SEQ ID NO: 1012135 - protein, 5 aa, Mycobacterium
GSTDF

SEQ ID NO: 1012136 - protein, 12 aa, Mycobacterium
GSTDRPSTGDSV

SEQ ID NO: 1012137 - protein, 5 aa, Mycobacterium
GSTGE

SEQ ID NO: 1012138 - protein, 13 aa, Mycobacterium
GSTGEPKGVAGTN

SEQ ID NO: 1012139 - protein, 149 aa, Mycobacterium
GSTGGLGGTGGTGGTGGLGGQAQAGGFQDGVDGAGGAGGQGGIGGTGGTGGAGGTGSYATGFGTGGTGGTGGTAGQGGSGGGGGLSGDGSSIGATGASGGAGTGGTGGVGGDGGDSNSGKGGQGGLGGAGGTGATGGTGGSGGYGGDSY

SEQ ID NO: 1012140 - protein, 8 aa, Mycobacterium
GSTGLPKG

SEQ ID NO: 1012141 - protein, 6 aa, Mycobacterium
GSTGLT

SEQ ID NO: 1012142 - protein, 8 aa, Mycobacterium
GSTGRPKP

SEQ ID NO: 1012143 - protein, 6 aa, Mycobacterium
GSTGVG

SEQ ID NO: 1012144 - protein, 17 aa, Mycobacterium
GSTHTARPAACSQEQSY

SEQ ID NO: 1012145 - protein, 16 aa, Mycobacterium
GSTIGAANGAAAATTR

SEQ ID NO: 1012146 - protein, 17 aa, Mycobacterium
GSTINTANAAASALTTS

SEQ ID NO: 1012147 - protein, 19 aa, Mycobacterium
GSTISAANAAASASTTAVA

SEQ ID NO: 1012148 - protein, 9 aa, Mycobacterium
GSTISQANA

SEQ ID NO: 1012149 - protein, 7 aa, Mycobacterium
GSTISTA

SEQ ID NO: 1012150 - protein, 17 aa, Mycobacterium
GSTISTANTAAAAPTTT

SEQ ID NO: 1012151 - protein, 17 aa, Mycobacterium
GSTLGEAGAAAATPTTA

SEQ ID NO: 1012152 - protein, 6 aa, Mycobacterium
GSTLGG

SEQ ID NO: 1012153 - protein, 18 aa, Mycobacterium
GSTLSSQNAAAAAPTTGV

SEQ ID NO: 1012154 - protein, 4 aa, Mycobacterium
GSTP

SEQ ID NO: 1012155 - protein, 11 aa, Mycobacterium
GSTPDNSSPTN

SEQ ID NO: 1012156 - protein, 9 aa, Mycobacterium
GSTPTATGK

SEQ ID NO: 1012157 - protein, 15 aa, Mycobacterium
GSTPVGVTTSGTFSP

SEQ ID NO: 1012158 - protein, 7 aa, Mycobacterium
GSTQEFT

SEQ ID NO: 1012159 - protein, 8 aa, Mycobacterium
GSTQSVSA

SEQ ID NO: 1012160 - protein, 6 aa, Mycobacterium
GSTRGN

SEQ ID NO: 1012161 - protein, 6 aa, Mycobacterium
GSTRRR

SEQ ID NO: 1012162 - protein, 8 aa, Mycobacterium
GSTRSINA

SEQ ID NO: 1012163 - protein, 12 aa, Mycobacterium
GSTSGSGVSPPA

SEQ ID NO: 1012164 - protein, 57 aa, Mycobacterium
GSTTIGGGNGGDGHTGLTGGDGGAGGKGGALAGHGGDGGVGGTGGTGGSGGTGTSGI

SEQ ID NO: 1012165 - protein, 5 aa, Mycobacterium
GSTVA

SEQ ID NO: 1012166 - protein, 5 aa, Mycobacterium
GSTVE

SEQ ID NO: 1012167 - protein, 4 aa, Mycobacterium
GSTW

SEQ ID NO: 1012168 - protein, 7 aa, Mycobacterium
GSVARTA

SEQ ID NO: 1012169 - protein, 13 aa, Mycobacterium
GSVATNAEGANMD

SEQ ID NO: 1012170 - protein, 25 aa, Mycobacterium
GSVDGCASSTVTSAPTPYLSTFLLV

SEQ ID NO: 1012171 - protein, 7 aa, Mycobacterium
GSVDKSL

SEQ ID NO: 1012172 - protein, 72 aa, Mycobacterium
GSVDPADGGDRSGADAVDDVGDENPSESRKPDAATETGASDEKSDDGEAPEAADGSPPGAPAGDGAERSAMP

SEQ ID NO: 1012173 - protein, 9 aa, Mycobacterium
GSVGGSTGV

SEQ ID NO: 1012174 - protein, 6 aa, Mycobacterium
GSVHRS

SEQ ID NO: 1012175 - protein, 5 aa, Mycobacterium
GSVNT

SEQ ID NO: 1012176 - protein, 6 aa, Mycobacterium
GSVQQR

SEQ ID NO: 1012177 - protein, 4 aa, Mycobacterium
GSVR

SEQ ID NO: 1012178 - protein, 8 aa, Mycobacterium
GSVSDKGG

SEQ ID NO: 1012179 - protein, 18 aa, Mycobacterium
GSVSKEQRAQVEEDLKRG

SEQ ID NO: 1012180 - protein, 7 aa, Mycobacterium
GSVSPSA

SEQ ID NO: 1012181 - protein, 5 aa, Mycobacterium
GSVTS

SEQ ID NO: 1012182 - protein, 15 aa, Mycobacterium
GSVYTQAEAAGAATL

SEQ ID NO: 1012183 - protein, 9 aa, Mycobacterium
GSWDGPTAE

SEQ ID NO: 1012184 - protein, 8 aa, Mycobacterium
GSWGPEAA

SEQ ID NO: 1012185 - protein, 6 aa, Mycobacterium
GSWGTT

SEQ ID NO: 1012186 - protein, 4 aa, Mycobacterium
GSWI

SEQ ID NO: 1012187 - protein, 17 aa, Mycobacterium
GSWPSGTTVHANPDGTA

SEQ ID NO: 1012188 - protein, 13 aa, Mycobacterium
GSWSNDSVSCPRS

SEQ ID NO: 1012189 - protein, 14 aa, Mycobacterium
GSYAATEAANTVAV

SEQ ID NO: 1012190 - protein, 11 aa, Mycobacterium
GSYESGPSAAL

SEQ ID NO: 1012191 - protein, 12 aa, Mycobacterium
GSYGEEEGSRPP

SEQ ID NO: 1012192 - protein, 9 aa, Mycobacterium
GSYPQTTAI

SEQ ID NO: 1012193 - protein, 5 aa, Mycobacterium
GSYPR

SEQ ID NO: 1012194 - protein, 4 aa, Mycobacterium
GTAA

SEQ ID NO: 1012195 - protein, 43 aa, Mycobacterium; identical to SEQ ID NO: 497541

SEQ ID NO: 1012196 - protein, 10 aa, Mycobacterium
GTAADNQASL

SEQ ID NO: 1012197 - protein, 8 aa, Mycobacterium
GTAAETRS

SEQ ID NO: 1012198 - protein, 85 aa, Mycobacterium
GTAAGGHAGADGTTAGEIGGVGGRGGGAWAQSPTGTPNVTGGAGGAGGAAGDGAFGGGPYHTGQGGVGGDGGNGGNGGAGGAGGL

SEQ ID NO: 1012199 - protein, 10 aa, Mycobacterium
GTAAGGRDGQ

SEQ ID NO: 1012200 - protein, 10 aa, Mycobacterium
GTAANPVTTT

SEQ ID NO: 1012201 - protein, 8 aa, Mycobacterium
GTAAQAGL

SEQ ID NO: 1012202 - protein, 7 aa, Mycobacterium
GTAARSQ

SEQ ID NO: 1012203 - protein, 10 aa, Mycobacterium
GTAASTSGAM

SEQ ID NO: 1012204 - protein, 7 aa, Mycobacterium
GTAATAR

SEQ ID NO: 1012205 - protein, 7 aa, Mycobacterium
GTAAYGM

SEQ ID NO: 1012206 - protein, 4 aa, Mycobacterium
GTAD

SEQ ID NO: 1012207 - protein, 9 aa, Mycobacterium
GTADGSGDL

SEQ ID NO: 1012208 - protein, 9 aa, Mycobacterium
GTADRRQVD

SEQ ID NO: 1012209 - protein, 5 aa, Mycobacterium
GTAED

SEQ ID NO: 1012210 - protein, 13 aa, Mycobacterium
GTAEEIAEDTDPT

SEQ ID NO: 1012211 - protein, 5 aa, Mycobacterium
GTAEG

SEQ ID NO: 1012212 - protein, 9 aa, Mycobacterium
GTAELRRPD

SEQ ID NO: 1012213 - protein, 7 aa, Mycobacterium
GTAEQKQ

SEQ ID NO: 1012214 - protein, 5 aa, Mycobacterium
GTAER

SEQ ID NO: 1012215 - protein, 28 aa, Mycobacterium
GTAGAGGSGGLGAAGAGGAGGQGGTGGL

SEQ ID NO: 1012216 - protein, 9 aa, Mycobacterium
GTAGEAPEH

SEQ ID NO: 1012217 - protein, 6 aa, Mycobacterium
GTAGNI

SEQ ID NO: 1012218 - protein, 7 aa, Mycobacterium
GTAGQRC

SEQ ID NO: 1012219 - protein, 10 aa, Mycobacterium
GTAGSATTQL

SEQ ID NO: 1012220 - protein, 7 aa, Mycobacterium
GTAGYNA

SEQ ID NO: 1012221 - protein, 7 aa, Mycobacterium
GTAIGPD

SEQ ID NO: 1012222 - protein, 10 aa, Mycobacterium
GTAIPEGNDG

SEQ ID NO: 1012223 - protein, 6 aa, Mycobacterium
GTAKEI

SEQ ID NO: 1012224 - protein, 10 aa, Mycobacterium
GTAKGPAGQN

SEQ ID NO: 1012225 - protein, 9 aa, Mycobacterium
GTANGTPVT

SEQ ID NO: 1012226 - protein, 6 aa, Mycobacterium
GTANWG

SEQ ID NO: 1012227 - protein, 12 aa, Mycobacterium
GTAPGQAGGAGG

SEQ ID NO: 1012228 - protein, 6 aa, Mycobacterium
GTAPIS

SEQ ID NO: 1012229 - protein, 12 aa, Mycobacterium
GTAPTAEGPDAI

SEQ ID NO: 1012230 - protein, 8 aa, Mycobacterium
GTAPTGPL

SEQ ID NO: 1012231 - protein, 6 aa, Mycobacterium
GTAQDA

SEQ ID NO: 1012232 - protein, 16 aa, Mycobacterium
GTARRDDGAIVSSGGR

SEQ ID NO: 1012233 - protein, 18 aa, Mycobacterium
GTASAMPPGTDSAQRSWG

SEQ ID NO: 1012234 - protein, 6 aa, Mycobacterium
GTASPL

SEQ ID NO: 1012235 - protein, 12 aa, Mycobacterium
GTASTASLDRKD

SEQ ID NO: 1012236 - protein, 6 aa, Mycobacterium
GTATFG

SEQ ID NO: 1012237 - protein, 8 aa, Mycobacterium
GTATPEAY

SEQ ID NO: 1012238 - protein, 11 aa, Mycobacterium
GTATPQATAPA

SEQ ID NO: 1012239 - protein, 4 aa, Mycobacterium
GTAV

SEQ ID NO: 1012240 - protein, 14 aa, Mycobacterium
GTAVGTGLNAPEGF

SEQ ID NO: 1012241 - protein, 5 aa, Mycobacterium
GTAVS

SEQ ID NO: 1012242 - protein, 4 aa, Mycobacterium
GTAW

SEQ ID NO: 1012243 - protein, 14 aa, Mycobacterium
GTDAAIGDTDELAG

SEQ ID NO: 1012244 - protein, 8 aa, Mycobacterium
GTDAASGK

SEQ ID NO: 1012245 - protein, 9 aa, Mycobacterium
GTDAGGTIQ

SEQ ID NO: 1012246 - protein, 16 aa, Mycobacterium
GTDEPTLTGRQVQPAT

SEQ ID NO: 1012247 - protein, 5 aa, Mycobacterium
GTDEQ

SEQ ID NO: 1012248 - protein, 7 aa, Mycobacterium
GTDEQKQ

SEQ ID NO: 1012249 - protein, 7 aa, Mycobacterium
GTDEQRK

SEQ ID NO: 1012250 - protein, 9 aa, Mycobacterium
GTDFRPAKR

SEQ ID NO: 1012251 - protein, 6 aa, Mycobacterium
GTDGRQ

SEQ ID NO: 1012252 - protein, 7 aa, Mycobacterium
GTDGSDA

SEQ ID NO: 1012253 - protein, 19 aa, Mycobacterium
GTDPASGEEITAQNGRYGP

SEQ ID NO: 1012254 - protein, 9 aa, Mycobacterium
GTDPDQATW

SEQ ID NO: 1012255 - protein, 6 aa, Mycobacterium
GTDSHT

SEQ ID NO: 1012256 - protein, 5 aa, Mycobacterium
GTDTA

SEQ ID NO: 1012257 - protein, 6 aa, Mycobacterium
GTDTDW

SEQ ID NO: 1012258 - protein, 5 aa, Mycobacterium
GTDVP

SEQ ID NO: 1012259 - protein, 6 aa, Mycobacterium
GTDVPH

SEQ ID NO: 1012260 - protein, 5 aa, Mycobacterium
GTEAE

SEQ ID NO: 1012261 - protein, 12 aa, Mycobacterium
GTEAGRAAARAG

SEQ ID NO: 1012262 - protein, 7 aa, Mycobacterium
GTEANEA

SEQ ID NO: 1012263 - protein, 5 aa, Mycobacterium
GTEAV

SEQ ID NO: 1012264 - protein, 7 aa, Mycobacterium
GTEAVGE

SEQ ID NO: 1012265 - protein, 17 aa, Mycobacterium
GTEDPGTTSSGAPIVTV

SEQ ID NO: 1012266 - protein, 9 aa, Mycobacterium
GTEEDGTPD

SEQ ID NO: 1012267 - protein, 7 aa, Mycobacterium
GTEEQKQ

SEQ ID NO: 1012268 - protein, 4 aa, Mycobacterium
GTEG

SEQ ID NO: 1012269 - protein, 12 aa, Mycobacterium
GTEGPYTGNGGA

SEQ ID NO: 1012270 - protein, 4 aa, Mycobacterium
GTEI

SEQ ID NO: 1012271 - protein, 8 aa, Mycobacterium
GTENPGGA

SEQ ID NO: 1012272 - protein, 5 aa, Mycobacterium
GTEPA

SEQ ID NO: 1012273 - protein, 7 aa, Mycobacterium
GTEPGSI

SEQ ID NO: 1012274 - protein, 7 aa, Mycobacterium
GTEPPAE

SEQ ID NO: 1012275 - protein, 11 aa, Mycobacterium
GTEPYTTDHAP

SEQ ID NO: 1012276 - protein, 14 aa, Mycobacterium
GTERAEALRRYHDI

SEQ ID NO: 1012277 - protein, 5 aa, Mycobacterium
GTERI

SEQ ID NO: 1012278 - protein, 6 aa, Mycobacterium
GTESNL

SEQ ID NO: 1012279 - protein, 28 aa, Mycobacterium
GTETGGRRAGTGAHNNENLSQRAKWSSE

SEQ ID NO: 1012280 - protein, 14 aa, Mycobacterium
GTEVDAARGIGGSD

SEQ ID NO: 1012281 - protein, 8 aa, Mycobacterium
GTFGSAGQ

SEQ ID NO: 1012282 - protein, 11 aa, Mycobacterium
GTGADLAAARA

SEQ ID NO: 1012283 - protein, 19 aa, Mycobacterium
GTGAPVPAGRRSDRRPAQT

SEQ ID NO: 1012284 - protein, 5 aa, Mycobacterium
GTGDQ

SEQ ID NO: 1012285 - protein, 10 aa, Mycobacterium
GTGDSIGSDA

SEQ ID NO: 1012286 - protein, 4 aa, Mycobacterium
GTGE

SEQ ID NO: 1012287 - protein, 11 aa, Mycobacterium
GTGEPPGIGGI

SEQ ID NO: 1012288 - protein, 5 aa, Mycobacterium
GTGFP

SEQ ID NO: 1012289 - protein, 4 aa, Mycobacterium
GTGG

SEQ ID NO: 1012290 - protein, 11 aa, Mycobacterium
GTGGAGGAAGL

SEQ ID NO: 1012291 - protein, 28 aa, Mycobacterium
GTGGAGGAGGAGAAGGNGGVGGAGGRGG

SEQ ID NO: 1012292 - protein, 15 aa, Mycobacterium
GTGGAGGAGGAGGVN

SEQ ID NO: 1012293 - protein, 32 aa, Mycobacterium
GTGGAGGAGGGGGTAVGGSLTANGGAGGAGGL

SEQ ID NO: 1012294 - protein, 26 aa, Mycobacterium
GTGGAGGAGGRTFNGDGGNGGAGGAG

SEQ ID NO: 1012295 - protein, 26 aa, Mycobacterium
GTGGAGGAGGSGVAGAGGVGGAGGNA

SEQ ID NO: 1012296 - protein, 27 aa, Mycobacterium
GTGGAGGAGLAGSSAATMAGGAGGRGG

SEQ ID NO: 1012297 - protein, 66 aa, Mycobacterium
GTGGAGGTGGDNSLGLTGQGGQGGDAGAGGASGYGIGNGGAGGAAGDGGGAGSLGTGGNGGSGGRA

SEQ ID NO: 1012298 - protein, 25 aa, Mycobacterium
GTGGAGGTGGFGSTSGAAGGTGGDG

SEQ ID NO: 1012299 - protein, 6 aa, Mycobacterium
GTGGAN

SEQ ID NO: 1012300 - protein, 7 aa, Mycobacterium
GTGGDGH

SEQ ID NO: 1012301 - protein, 8 aa, Mycobacterium
GTGGDGVN

SEQ ID NO: 1012302 - protein, 22 aa, Mycobacterium
GTGGGGGIGGSGGEGGAGGMGG

SEQ ID NO: 1012303 - protein, 8 aa, Mycobacterium
GTGGHSSR

SEQ ID NO: 1012304 - protein, 5 aa, Mycobacterium
GTGGL

SEQ ID NO: 1012305 - protein, 56 aa, Mycobacterium
GTGGLGGAGGVGGQDGGAGGDGGNAPLLGRGGAGGVGGASDGFGNGGAGGDGGVGG

SEQ ID NO: 1012306 - protein, 20 aa, Mycobacterium
GTGGNGGAGGIGAAGGMGGA

SEQ ID NO: 1012307 - protein, 37 aa, Mycobacterium
GTGGNGGAGGTAAPGGTDGTAGAAGKGGVLFGTDGAT

SEQ ID NO: 1012308 - protein, 15 aa, Mycobacterium
GTGGNGGATSTNGAL

SEQ ID NO: 1012309 - protein, 30 aa, Mycobacterium; identical to SEQ ID NO: 498214

SEQ ID NO: 1012310 - protein, 14 aa, Mycobacterium
GTGGQDLSVEQAEQ

SEQ ID NO: 1012311 - protein, 7 aa, Mycobacterium
GTGGQSL

SEQ ID NO: 1012312 - protein, 48 aa, Mycobacterium
GTGGSGGAGPAGIGGGLTGGAGGAGGAGGYSSTADGGVGGAGGAGGLW

SEQ ID NO: 1012313 - protein, 130 aa, Mycobacterium
GTGGSGSQSATTGTSTSGVTSGSVASGSAAGSVSSGATAGTVSAGATTGSVASGATAGTVSAGATDGAVTSGTTASSSDGTTVSAGGVAATDPGSDGGVAVSGSGSGSGVAVGGTDTPGTSAPAPVTPRA

SEQ ID NO: 1012314 - protein, 29 aa, Mycobacterium
GTGGSSGGLGGLPASTGQLPGTQAAGLGG

SEQ ID NO: 1012315 - protein, 14 aa, Mycobacterium
GTGGTGGDGGIGGH

SEQ ID NO: 1012316 - protein, 32 aa, Mycobacterium
GTGGTRGTGGTGGAANPFGAAGGSGGSGGAGG

SEQ ID NO: 1012317 - protein, 4 aa, Mycobacterium
GTGI

SEQ ID NO: 1012318 - protein, 5 aa, Mycobacterium
GTGKT

SEQ ID NO: 1012319 - protein, 5 aa, Mycobacterium
GTGKV

SEQ ID NO: 1012320 - protein, 4 aa, Mycobacterium
GTGN

SEQ ID NO: 1012321 - protein, 6 aa, Mycobacterium
GTGNAE

SEQ ID NO: 1012322 - protein, 37 aa, Mycobacterium
GTGNFGIGNSGTGNWGIGNSGNSYNTGIGNSGDANTG

SEQ ID NO: 1012323 - protein, 5 aa, Mycobacterium
GTGPE

SEQ ID NO: 1012324 - protein, 6 aa, Mycobacterium
GTGPFT

SEQ ID NO: 1012325 - protein, 10 aa, Mycobacterium
GTGPGDRDEP

SEQ ID NO: 1012326 - protein, 8 aa, Mycobacterium
GTGPGKTT

SEQ ID NO: 1012327 - protein, 12 aa, Mycobacterium
GTGPGRAPGAMP

SEQ ID NO: 1012328 - protein, 4 aa, Mycobacterium
GTGQ

SEQ ID NO: 1012329 - protein, 8 aa, Mycobacterium
GTGQTGAT

SEQ ID NO: 1012330 - protein, 7 aa, Mycobacterium
GTGQTKY

SEQ ID NO: 1012331 - protein, 28 aa, Mycobacterium
GTGRGFSSGAGMSAQDMGRKTSTSSLTE

SEQ ID NO: 1012332 - protein, 8 aa, Mycobacterium
GTGRHGGY

SEQ ID NO: 1012333 - protein, 6 aa, Mycobacterium
GTGRSR

SEQ ID NO: 1012334 - protein, 19 aa, Mycobacterium
GTGRTIDGYPSLKADGSTA

SEQ ID NO: 1012335 - protein, 17 aa, Mycobacterium
GTGRVGRPGTEAAAGAT

SEQ ID NO: 1012336 - protein, 4 aa, Mycobacterium
GTGS

SEQ ID NO: 1012337 - protein, 16 aa, Mycobacterium
GTGSASHVTAYVCCPS

SEQ ID NO: 1012338 - protein, 5 aa, Mycobacterium
GTGSL

SEQ ID NO: 1012339 - protein, 6 aa, Mycobacterium
GTGSNT

SEQ ID NO: 1012340 - protein, 18 aa, Mycobacterium
GTGTDSIESVEHPDGATS

SEQ ID NO: 1012341 - protein, 10 aa, Mycobacterium
GTGTGGRRPL

SEQ ID NO: 1012342 - protein, 12 aa, Mycobacterium
GTGTLTARPGAQ

SEQ ID NO: 1012343 - protein, 9 aa, Mycobacterium
GTGTPLGDP

SEQ ID NO: 1012344 - protein, 10 aa, Mycobacterium
GTGTPVGDPI

SEQ ID NO: 1012345 - protein, 12 aa, Mycobacterium
GTGTSESGERDR

SEQ ID NO: 1012346 - protein, 15 aa, Mycobacterium
GTGVTPRDVTPEATR

SEQ ID NO: 1012347 - protein, 9 aa, Mycobacterium
GTGYGDAAT

SEQ ID NO: 1012348 - protein, 6 aa, Mycobacterium
GTHADR

SEQ ID NO: 1012349 - protein, 9 aa, Mycobacterium
GTHAPTGEF

SEQ ID NO: 1012350 - protein, 6 aa, Mycobacterium
GTHPGA

SEQ ID NO: 1012351 - protein, 4 aa, Mycobacterium
GTHT

SEQ ID NO: 1012352 - protein, 4 aa, Mycobacterium
GTID

SEQ ID NO: 1012353 - protein, 6 aa, Mycobacterium
GTIDET

SEQ ID NO: 1012354 - protein, 10 aa, Mycobacterium
GTIDSDHSSP

SEQ ID NO: 1012355 - protein, 7 aa, Mycobacterium
GTIPGTA

SEQ ID NO: 1012356 - protein, 20 aa, Mycobacterium
GTIPKTPSGKLRRSNSLTLV

SEQ ID NO: 1012357 - protein, 7 aa, Mycobacterium
GTIPPGR

SEQ ID NO: 1012358 - protein, 7 aa, Mycobacterium
GTIPSKT

SEQ ID NO: 1012359 - protein, 4 aa, Mycobacterium
GTIQ

SEQ ID NO: 1012360 - protein, 4 aa, Mycobacterium
GTIR

SEQ ID NO: 1012361 - protein, 6 aa, Mycobacterium
GTIRSA

SEQ ID NO: 1012362 - protein, 6 aa, Mycobacterium
GTKAEA

SEQ ID NO: 1012363 - protein, 15 aa, Mycobacterium
GTKEDIKEAQDNGGS

SEQ ID NO: 1012364 - protein, 8 aa, Mycobacterium
GTKGKRYA

SEQ ID NO: 1012365 - protein, 6 aa, Mycobacterium
GTKGLT

SEQ ID NO: 1012366 - protein, 8 aa, Mycobacterium
GTKKAEAM

SEQ ID NO: 1012367 - protein, 9 aa, Mycobacterium
GTKQKASRI

SEQ ID NO: 1012368 - protein, 9 aa, Mycobacterium
GTKRRAEAR

SEQ ID NO: 1012369 - protein, 20 aa, Mycobacterium
GTKSMPGADRLASEANRRRR

SEQ ID NO: 1012370 - protein, 9 aa, Mycobacterium
GTLDSGTAG

SEQ ID NO: 1012371 - protein, 11 aa, Mycobacterium
GTLHTSRGDMN

SEQ ID NO: 1012372 - protein, 4 aa, Mycobacterium
GTLP

SEQ ID NO: 1012373 - protein, 7 aa, Mycobacterium
GTLPEAA

SEQ ID NO: 1012374 - protein, 5 aa, Mycobacterium
GTLPG

SEQ ID NO: 1012375 - protein, 5 aa, Mycobacterium
GTLPI

SEQ ID NO: 1012376 - protein, 8 aa, Mycobacterium
GTLPPGQL

SEQ ID NO: 1012377 - protein, 20 aa, Mycobacterium
GTLPTSLKGAPLGNQSGSAQ

SEQ ID NO: 1012378 - protein, 5 aa, Mycobacterium
GTLRG

SEQ ID NO: 1012379 - protein, 7 aa, Mycobacterium
GTLSGNP

SEQ ID NO: 1012380 - protein, 8 aa, Mycobacterium
GTLSQAGD

SEQ ID NO: 1012381 - protein, 6 aa, Mycobacterium
GTNAQA

SEQ ID NO: 1012382 - protein, 7 aa, Mycobacterium
GTNAVNG

SEQ ID NO: 1012383 - protein, 7 aa, Mycobacterium
GTNCENL

SEQ ID NO: 1012384 - protein, 4 aa, Mycobacterium
GTNE

SEQ ID NO: 1012385 - protein, 6 aa, Mycobacterium
GTNEIQ

SEQ ID NO: 1012386 - protein, 13 aa, Mycobacterium
GTNFSRGQRGSYA

SEQ ID NO: 1012387 - protein, 52 aa, Mycobacterium; identical to SEQ ID NO: 498573

SEQ ID NO: 1012388 - protein, 11 aa, Mycobacterium
GTNGKSTTTRM

SEQ ID NO: 1012389 - protein, 4 aa, Mycobacterium
GTNQ

SEQ ID NO: 1012390 - protein, 10 aa, Mycobacterium
GTNRAAAPGA

SEQ ID NO: 1012391 - protein, 21 aa, Mycobacterium
GTNSASFASGNVRSGTAGITQ

SEQ ID NO: 1012392 - protein, 12 aa, Mycobacterium
GTNTLAQATSPY

SEQ ID NO: 1012393 - protein, 14 aa, Mycobacterium
GTNTSPLAGKVSGH

SEQ ID NO: 1012394 - protein, 11 aa, Mycobacterium
GTNWKSNPNAM

SEQ ID NO: 1012395 - protein, 4 aa, Mycobacterium
GTPA

SEQ ID NO: 1012396 - protein, 9 aa, Mycobacterium
GTPAADTYE

SEQ ID NO: 1012397 - protein, 11 aa, Mycobacterium
GTPADRNGIAT

SEQ ID NO: 1012398 - protein, 6 aa, Mycobacterium
GTPADV

SEQ ID NO: 1012399 - protein, 6 aa, Mycobacterium
GTPAES

SEQ ID NO: 1012400 - protein, 14 aa, Mycobacterium
GTPAGVGPIEDGDT

SEQ ID NO: 1012401 - protein, 19 aa, Mycobacterium
GTPAPGPAPDGMRVPPSAD

SEQ ID NO: 1012402 - protein, 8 aa, Mycobacterium
GTPAQKTR

SEQ ID NO: 1012403 - protein, 6 aa, Mycobacterium
GTPAWR

SEQ ID NO: 1012404 - protein, 10 aa, Mycobacterium
GTPCTPRSVA

SEQ ID NO: 1012405 - protein, 4 aa, Mycobacterium
GTPD

SEQ ID NO: 1012406 - protein, 16 aa, Mycobacterium
GTPDAETAAVTEGKRV

SEQ ID NO: 1012407 - protein, 5 aa, Mycobacterium
GTPDL

SEQ ID NO: 1012408 - protein, 27 aa, Mycobacterium
GTPDPVPEGDAAEQSIPAGYDEEPGLD

SEQ ID NO: 1012409 - protein, 6 aa, Mycobacterium
GTPDQI

SEQ ID NO: 1012410 - protein, 8 aa, Mycobacterium
GTPDQKDR

SEQ ID NO: 1012411 - protein, 5 aa, Mycobacterium
GTPED

SEQ ID NO: 1012412 - protein, 10 aa, Mycobacterium
GTPEEQQQQW

SEQ ID NO: 1012413 - protein, 13 aa, Mycobacterium
GTPEFADRQRRTL

SEQ ID NO: 1012414 - protein, 16 aa, Mycobacterium
GTPEMRERRPEDRPDA

SEQ ID NO: 1012415 - protein, 8 aa, Mycobacterium
GTPEPRHD

SEQ ID NO: 1012416 - protein, 5 aa, Mycobacterium
GTPEQ

SEQ ID NO: 1012417 - protein, 7 aa, Mycobacterium
GTPEQKR

SEQ ID NO: 1012418 - protein, 4 aa, Mycobacterium
GTPF

SEQ ID NO: 1012419 - protein, 7 aa, Mycobacterium
GTPFPAT

SEQ ID NO: 1012420 - protein, 10 aa, Mycobacterium
GTPFRSDDSP

SEQ ID NO: 1012421 - protein, 4 aa, Mycobacterium
GTPG

SEQ ID NO: 1012422 - protein, 9 aa, Mycobacterium
GTPGETDDD

SEQ ID NO: 1012423 - protein, 5 aa, Mycobacterium
GTPGF

SEQ ID NO: 1012424 - protein, 5 aa, Mycobacterium
GTPHC

SEQ ID NO: 1012425 - protein, 5 aa, Mycobacterium
GTPHQ

SEQ ID NO: 1012426 - protein, 5 aa, Mycobacterium
GTPIR

SEQ ID NO: 1012427 - protein, 4 aa, Mycobacterium
GTPK

SEQ ID NO: 1012428 - protein, 6 aa, Mycobacterium
GTPNAG

SEQ ID NO: 1012429 - protein, 9 aa, Mycobacterium
GTPNTPDEH

SEQ ID NO: 1012430 - protein, 6 aa, Mycobacterium
GTPPAA

SEQ ID NO: 1012431 - protein, 7 aa, Mycobacterium
GTPPNRR

SEQ ID NO: 1012432 - protein, 7 aa, Mycobacterium
GTPPPTW

SEQ ID NO: 1012433 - protein, 8 aa, Mycobacterium
GTPPYQTQ

SEQ ID NO: 1012434 - protein, 9 aa, Mycobacterium
GTPRGADER

SEQ ID NO: 1012435 - protein, 9 aa, Mycobacterium
GTPRLPDER

SEQ ID NO: 1012436 - protein, 8 aa, Mycobacterium
GTPRPVSE

SEQ ID NO: 1012437 - protein, 5 aa, Mycobacterium
GTPSQ

SEQ ID NO: 1012438 - protein, 7 aa, Mycobacterium
GTPTERA

SEQ ID NO: 1012439 - protein, 7 aa, Mycobacterium
GTPTGEH

SEQ ID NO: 1012440 - protein, 4 aa, Mycobacterium
GTPV

SEQ ID NO: 1012441 - protein, 5 aa, Mycobacterium
GTPVD

SEQ ID NO: 1012442 - protein, 11 aa, Mycobacterium
GTPVPPEPAEV

SEQ ID NO: 1012443 - protein, 7 aa, Mycobacterium
GTQEGGA

SEQ ID NO: 1012444 - protein, 24 aa, Mycobacterium
GTQHRRSCAREPQPRTAYRDGPGV

SEQ ID NO: 1012445 - protein, 4 aa, Mycobacterium
GTQL

SEQ ID NO: 1012446 - protein, 13 aa, Mycobacterium
GTQPCDSAAGPRL

SEQ ID NO: 1012447 - protein, 10 aa, Mycobacterium
GTQPSGGDHA

SEQ ID NO: 1012448 - protein, 12 aa, Mycobacterium
GTQQGISDAAAD

SEQ ID NO: 1012449 - protein, 12 aa, Mycobacterium
GTQQTMPSPGRP

SEQ ID NO: 1012450 - protein, 12 aa, Mycobacterium
GTRAGATAASPA

SEQ ID NO: 1012451 - protein, 9 aa, Mycobacterium
GTRANRPAV

SEQ ID NO: 1012452 - protein, 4 aa, Mycobacterium
GTRD

SEQ ID NO: 1012453 - protein, 10 aa, Mycobacterium
GTRDQDLPDE

SEQ ID NO: 1012454 - protein, 4 aa, Mycobacterium
GTRE

SEQ ID NO: 1012455 - protein, 12 aa, Mycobacterium
GTREFSTRGRDD

SEQ ID NO: 1012456 - protein, 12 aa, Mycobacterium
GTREGSSVRGGA

SEQ ID NO: 1012457 - protein, 12 aa, Mycobacterium
GTREQTSAVPAN

SEQ ID NO: 1012458 - protein, 10 aa, Mycobacterium
GTRGEPTAQD

SEQ ID NO: 1012459 - protein, 9 aa, Mycobacterium
GTRIPTGAT

SEQ ID NO: 1012460 - protein, 6 aa, Mycobacterium
GTRNVP

SEQ ID NO: 1012461 - protein, 11 aa, Mycobacterium
GTRPARPSEVE

SEQ ID NO: 1012462 - protein, 8 aa, Mycobacterium
GTRRGQEL

SEQ ID NO: 1012463 - protein, 10 aa, Mycobacterium
GTRSGKGKFT

SEQ ID NO: 1012464 - protein, 7 aa, Mycobacterium
GTRSKAD

SEQ ID NO: 1012465 - protein, 10 aa, Mycobacterium
GTRSPRSDAE

SEQ ID NO: 1012466 - protein, 10 aa, Mycobacterium
GTRTQVGYGP

SEQ ID NO: 1012467 - protein, 8 aa, Mycobacterium
GTSAEKFT

SEQ ID NO: 1012468 - protein, 12 aa, Mycobacterium
GTSAESPTVGPT

SEQ ID NO: 1012469 - protein, 8 aa, Mycobacterium
GTSAGGSL

SEQ ID NO: 1012470 - protein, 6 aa, Mycobacterium
GTSARP

SEQ ID NO: 1012471 - protein, 8 aa, Mycobacterium
GTSDISKP

SEQ ID NO: 1012472 - protein, 4 aa, Mycobacterium
GTSE

SEQ ID NO: 1012473 - protein, 5 aa, Mycobacterium
GTSEI

SEQ ID NO: 1012474 - protein, 30 aa, Mycobacterium
GTSGGGAESVAGGVERPGRSAGDGHRCHRR

SEQ ID NO: 1012475 - protein, 10 aa, Mycobacterium
GTSGGLRTDE

SEQ ID NO: 1012476 - protein, 11 aa, Mycobacterium
GTSGMKSALNG

SEQ ID NO: 1012477 - protein, 9 aa, Mycobacterium
GTSGNPKAV

SEQ ID NO: 1012478 - protein, 7 aa, Mycobacterium
GTSGPQV

SEQ ID NO: 1012479 - protein, 5 aa, Mycobacterium
GTSHG

SEQ ID NO: 1012480 - protein, 18 aa, Mycobacterium
GTSLGAANAAVAASTTSV

SEQ ID NO: 1012481 - protein, 9 aa, Mycobacterium
GTSNDEIQA

SEQ ID NO: 1012482 - protein, 8 aa, Mycobacterium
GTSPGGLP

SEQ ID NO: 1012483 - protein, 5 aa, Mycobacterium
GTSPN

SEQ ID NO: 1012484 - protein, 7 aa, Mycobacterium
GTSPRGD

SEQ ID NO: 1012485 - protein, 7 aa, Mycobacterium
GTSRANP

SEQ ID NO: 1012486 - protein, 6 aa, Mycobacterium
GTSRGL

SEQ ID NO: 1012487 - protein, 12 aa, Mycobacterium
GTSSGGSGSVGG

SEQ ID NO: 1012488 - protein, 9 aa, Mycobacterium
GTSSTRIRE

SEQ ID NO: 1012489 - protein, 8 aa, Mycobacterium
GTSTESDI

SEQ ID NO: 1012490 - protein, 14 aa, Mycobacterium
GTSTPPIHSVRPPR

SEQ ID NO: 1012491 - protein, 4 aa, Mycobacterium
GTSY

SEQ ID NO: 1012492 - protein, 4 aa, Mycobacterium
GTTA

SEQ ID NO: 1012493 - protein, 7 aa, Mycobacterium
GTTAASY

SEQ ID NO: 1012494 - protein, 5 aa, Mycobacterium
GTTAI

SEQ ID NO: 1012495 - protein, 7 aa, Mycobacterium
GTTAPQF

SEQ ID NO: 1012496 - protein, 12 aa, Mycobacterium
GTTATTEEITDT

SEQ ID NO: 1012497 - protein, 9 aa, Mycobacterium
GTTDDGGTA

SEQ ID NO: 1012498 - protein, 6 aa, Mycobacterium
GTTDYG

SEQ ID NO: 1012499 - protein, 5 aa, Mycobacterium
GTTEE

SEQ ID NO: 1012500 - protein, 5 aa, Mycobacterium
GTTFA

SEQ ID NO: 1012501 - protein, 7 aa, Mycobacterium
GTTGEPK

SEQ ID NO: 1012502 - protein, 6 aa, Mycobacterium
GTTGFP

SEQ ID NO: 1012503 - protein, 5 aa, Mycobacterium
GTTGL

SEQ ID NO: 1012504 - protein, 8 aa, Mycobacterium
GTTGLPKG

SEQ ID NO: 1012505 - protein, 6 aa, Mycobacterium
GTTGMP

SEQ ID NO: 1012506 - protein, 6 aa, Mycobacterium
GTTGMT

SEQ ID NO: 1012507 - protein, 8 aa, Mycobacterium
GTTGNPKG

SEQ ID NO: 1012508 - protein, 7 aa, Mycobacterium
GTTGRPK

SEQ ID NO: 1012509 - protein, 9 aa, Mycobacterium
GTTGRPKGV

SEQ ID NO: 1012510 - protein, 6 aa, Mycobacterium
GTTGSL

SEQ ID NO: 1012511 - protein, 19 aa, Mycobacterium
GTTGTPKGAKHSGGSGGIG

SEQ ID NO: 1012512 - protein, 6 aa, Mycobacterium
GTTGYS

SEQ ID NO: 1012513 - protein, 8 aa, Mycobacterium
GTTHRPSS

SEQ ID NO: 1012514 - protein, 6 aa, Mycobacterium
GTTPAA

SEQ ID NO: 1012515 - protein, 7 aa, Mycobacterium
GTTPAQH

SEQ ID NO: 1012516 - protein, 7 aa, Mycobacterium
GTTPPFG

SEQ ID NO: 1012517 - protein, 7 aa, Mycobacterium
GTTQMGT

SEQ ID NO: 1012518 - protein, 5 aa, Mycobacterium
GTTSL

SEQ ID NO: 1012519 - protein, 9 aa, Mycobacterium
GTTSQPKAV

SEQ ID NO: 1012520 - protein, 9 aa, Mycobacterium
GTTSSPGRC

SEQ ID NO: 1012521 - protein, 6 aa, Mycobacterium
GTTTRG

SEQ ID NO: 1012522 - protein, 6 aa, Mycobacterium
GTTVDP

SEQ ID NO: 1012523 - protein, 11 aa, Mycobacterium
GTVAGRPNDGC

SEQ ID NO: 1012524 - protein, 5 aa, Mycobacterium
GTVDA

SEQ ID NO: 1012525 - protein, 10 aa, Mycobacterium
GTVDDASGHV

SEQ ID NO: 1012526 - protein, 9 aa, Mycobacterium
GTVDREGVT

SEQ ID NO: 1012527 - protein, 24 aa, Mycobacterium
GTVETAGRRGTRVRDRPASTPRSS

SEQ ID NO: 1012528 - protein, 5 aa, Mycobacterium
GTVFG

SEQ ID NO: 1012529 - protein, 6 aa, Mycobacterium
GTVGRQ

SEQ ID NO: 1012530 - protein, 11 aa, Mycobacterium
GTVKSRCARGR

SEQ ID NO: 1012531 - protein, 7 aa, Mycobacterium
GTVPDSP

SEQ ID NO: 1012532 - protein, 18 aa, Mycobacterium
GTVPQASGRGLGHTGGTL

SEQ ID NO: 1012533 - protein, 13 aa, Mycobacterium
GTVRPAGAVPSLT

SEQ ID NO: 1012534 - protein, 13 aa, Mycobacterium
GTVSEHNATRNAA

SEQ ID NO: 1012535 - protein, 9 aa, Mycobacterium
GTVTATTSV

SEQ ID NO: 1012536 - protein, 6 aa, Mycobacterium
GTVTSG

SEQ ID NO: 1012537 - protein, 7 aa, Mycobacterium
GTVTSTL

SEQ ID NO: 1012538 - protein, 14 aa, Mycobacterium
GTVTTITSSRSPMV

SEQ ID NO: 1012539 - protein, 5 aa, Mycobacterium
GTVYG

SEQ ID NO: 1012540 - protein, 7 aa, Mycobacterium
GTWRTDS

SEQ ID NO: 1012541 - protein, 5 aa, Mycobacterium
GTWTP

SEQ ID NO: 1012542 - protein, 26 aa, Mycobacterium
GTYEPGYYSDSTRTYSIGDPSPDVAQ

SEQ ID NO: 1012543 - protein, 7 aa, Mycobacterium
GTYGTSG

SEQ ID NO: 1012544 - protein, 10 aa, Mycobacterium
GTYRTEGPAN

SEQ ID NO: 1012545 - protein, 4 aa, Mycobacterium
GTYT

SEQ ID NO: 1012546 - protein, 17 aa, Mycobacterium
GVAATQSTGASAAAPSL

SEQ ID NO: 1012547 - protein, 14 aa, Mycobacterium
GVADAELNGDPART

SEQ ID NO: 1012548 - protein, 6 aa, Mycobacterium
GVADAS

SEQ ID NO: 1012549 - protein, 5 aa, Mycobacterium
GVADP

SEQ ID NO: 1012550 - protein, 12 aa, Mycobacterium
GVADTGDTVTPR

SEQ ID NO: 1012551 - protein, 9 aa, Mycobacterium
GVAENSVKR

SEQ ID NO: 1012552 - protein, 5 aa, Mycobacterium
GVAGG

SEQ ID NO: 1012553 - protein, 9 aa, Mycobacterium
GVAGGAPPR

SEQ ID NO: 1012554 - protein, 7 aa, Mycobacterium
GVAGGTW

SEQ ID NO: 1012555 - protein, 6 aa, Mycobacterium
GVAGTG

SEQ ID NO: 1012556 - protein, 7 aa, Mycobacterium
GVANEAE

SEQ ID NO: 1012557 - protein, 6 aa, Mycobacterium
GVANEI

SEQ ID NO: 1012558 - protein, 7 aa, Mycobacterium
GVANNGL

SEQ ID NO: 1012559 - protein, 7 aa, Mycobacterium
GVAPDQL

SEQ ID NO: 1012560 - protein, 14 aa, Mycobacterium
GVAQTQTRIALRSQ

SEQ ID NO: 1012561 - protein, 4 aa, Mycobacterium
GVAR

SEQ ID NO: 1012562 - protein, 7 aa, Mycobacterium
GVARPGT

SEQ ID NO: 1012563 - protein, 14 aa, Mycobacterium
GVARSGVSAYPPQL

SEQ ID NO: 1012564 - protein, 5 aa, Mycobacterium
GVASG

SEQ ID NO: 1012565 - protein, 4 aa, Mycobacterium
GVAT

SEQ ID NO: 1012566 - protein, 9 aa, Mycobacterium
GVATGGKAY

SEQ ID NO: 1012567 - protein, 18 aa, Mycobacterium
GVATSAGGAGGAGGNAAD

SEQ ID NO: 1012568 - protein, 17 aa, Mycobacterium
GVDDAPEATDSAQERPS

SEQ ID NO: 1012569 - protein, 7 aa, Mycobacterium
GVDEVPD

SEQ ID NO: 1012570 - protein, 23 aa, Mycobacterium
GVDGLGGSSTGGVGGQGGTGGRA

SEQ ID NO: 1012571 - protein, 8 aa, Mycobacterium
GVDGTGAG

SEQ ID NO: 1012572 - protein, 6 aa, Mycobacterium
GVDGTV

SEQ ID NO: 1012573 - protein, 10 aa, Mycobacterium
GVDHASASLN

SEQ ID NO: 1012574 - protein, 8 aa, Mycobacterium
GVDNPATV

SEQ ID NO: 1012575 - protein, 4 aa, Mycobacterium
GVDP

SEQ ID NO: 1012576 - protein, 7 aa, Mycobacterium
GVDPADK

SEQ ID NO: 1012577 - protein, 6 aa, Mycobacterium
GVDPES

SEQ ID NO: 1012578 - protein, 13 aa, Mycobacterium
GVDPKNLDSISTA

SEQ ID NO: 1012579 - protein, 18 aa, Mycobacterium
GVDPRSVAAASRVRSASS

SEQ ID NO: 1012580 - protein, 4 aa, Mycobacterium
GVDR

SEQ ID NO: 1012581 - protein, 5 aa, Mycobacterium
GVDSA

SEQ ID NO: 1012582 - protein, 10 aa, Mycobacterium
GVDSGREDHG

SEQ ID NO: 1012583 - protein, 4 aa, Mycobacterium
GVDT

SEQ ID NO: 1012584 - protein, 9 aa, Mycobacterium
GVDTEREHD

SEQ ID NO: 1012585 - protein, 8 aa, Mycobacterium
GVEAADGD

SEQ ID NO: 1012586 - protein, 5 aa, Mycobacterium
GVEAG

SEQ ID NO: 1012587 - protein, 5 aa, Mycobacterium
GVEAR

SEQ ID NO: 1012588 - protein, 6 aa, Mycobacterium
GVEEAR

SEQ ID NO: 1012589 - protein, 5 aa, Mycobacterium
GVEEG

SEQ ID NO: 1012590 - protein, 7 aa, Mycobacterium
GVEEGAA

SEQ ID NO: 1012591 - protein, 8 aa, Mycobacterium
GVEGGPSL

SEQ ID NO: 1012592 - protein, 8 aa, Mycobacterium
GVEGGRGY

SEQ ID NO: 1012593 - protein, 7 aa, Mycobacterium
GVEGTDI

SEQ ID NO: 1012594 - protein, 4 aa, Mycobacterium
GVEH

SEQ ID NO: 1012595 - protein, 8 aa, Mycobacterium
GVEHADSA

SEQ ID NO: 1012596 - protein, 4 aa, Mycobacterium
GVEK

SEQ ID NO: 1012597 - protein, 9 aa, Mycobacterium
GVELTGPGG

SEQ ID NO: 1012598 - protein, 7 aa, Mycobacterium
GVENNAT

SEQ ID NO: 1012599 - protein, 16 aa, Mycobacterium
GVEPPPVADPETRPPI

SEQ ID NO: 1012600 - protein, 8 aa, Mycobacterium
GVERANTA

SEQ ID NO: 1012601 - protein, 11 aa, Mycobacterium
GVERSTTDEAV

SEQ ID NO: 1012602 - protein, 4 aa, Mycobacterium
GVEV

SEQ ID NO: 1012603 - protein, 6 aa, Mycobacterium
GVGAAD

SEQ ID NO: 1012604 - protein, 5 aa, Mycobacterium
GVGAY

SEQ ID NO: 1012605 - protein, 7 aa, Mycobacterium
GVGDRSL

SEQ ID NO: 1012606 - protein, 4 aa, Mycobacterium
GVGE

SEQ ID NO: 1012607 - protein, 5 aa, Mycobacterium
GVGED

SEQ ID NO: 1012608 - protein, 10 aa, Mycobacterium
GVGEDITGGL

SEQ ID NO: 1012609 - protein, 6 aa, Mycobacterium
GVGESG

SEQ ID NO: 1012610 - protein, 13 aa, Mycobacterium
GVGETRSCGTGTV

SEQ ID NO: 1012611 - protein, 13 aa, Mycobacterium
GVGGAGGAGTAGA

SEQ ID NO: 1012612 - protein, 21 aa, Mycobacterium
GVGGAGGSGGLGGATEDGVGG

SEQ ID NO: 1012613 - protein, 10 aa, Mycobacterium
GVGGAGGTGG

SEQ ID NO: 1012614 - protein, 23 aa, Mycobacterium
GVGGAGGVGGAGGGAGGVGGAGG

SEQ ID NO: 1012615 - protein, 23 aa, Mycobacterium
GVGGAGGYGSSDGGAGGAGGNGG

SEQ ID NO: 1012616 - protein, 16 aa, Mycobacterium
GVGGDVDSIVEAFLAS

SEQ ID NO: 1012617 - protein, 7 aa, Mycobacterium
GVGGGSL

SEQ ID NO: 1012618 - protein, 6 aa, Mycobacterium
GVGGIG

SEQ ID NO: 1012619 - protein, 12 aa, Mycobacterium
GVGGNGGTGGIG

SEQ ID NO: 1012620 - protein, 12 aa, Mycobacterium
GVGGSGGTGGAG

SEQ ID NO: 1012621 - protein, 5 aa, Mycobacterium
GVGGT

SEQ ID NO: 1012622 - protein, 21 aa, Mycobacterium
GVGHDPSARYQDRAGPPTDRV

SEQ ID NO: 1012623 - protein, 5 aa, Mycobacterium
GVGKT

SEQ ID NO: 1012624 - protein, 9 aa, Mycobacterium
GVGKTTTAA

SEQ ID NO: 1012625 - protein, 8 aa, Mycobacterium
GVGNAGAN

SEQ ID NO: 1012626 - protein, 6 aa, Mycobacterium
GVGNDQ

SEQ ID NO: 1012627 - protein, 13 aa, Mycobacterium
GVGNGGSGGVGGA

SEQ ID NO: 1012628 - protein, 6 aa, Mycobacterium
GVGPGS

SEQ ID NO: 1012629 - protein, 22 aa, Mycobacterium
GVGPNAGGPGISSPTTALPGQL

SEQ ID NO: 1012630 - protein, 7 aa, Mycobacterium
GVGPTIA

SEQ ID NO: 1012631 - protein, 6 aa, Mycobacterium
GVGRKT

SEQ ID NO: 1012632 - protein, 30 aa, Mycobacterium
GVGSHGSGTASTGAAGTNVEHSTAPPPTEI

SEQ ID NO: 1012633 - protein, 6 aa, Mycobacterium
GVHARS

SEQ ID NO: 1012634 - protein, 19 aa, Mycobacterium
GVHSESEGVEPARRVVVLR

SEQ ID NO: 1012635 - protein, 20 aa, Mycobacterium
GVIPEPAPVDNPPGLGARDE

SEQ ID NO: 1012636 - protein, 5 aa, Mycobacterium
GVKED

SEQ ID NO: 1012637 - protein, 10 aa, Mycobacterium
GVKGTSGMRK

SEQ ID NO: 1012638 - protein, 25 aa, Mycobacterium
GVKKQDSAHQHPIAGAARRAAASAH

SEQ ID NO: 1012639 - protein, 16 aa, Mycobacterium
GVKPATASAGGDDDSW

SEQ ID NO: 1012640 - protein, 5 aa, Mycobacterium
GVKRQ

SEQ ID NO: 1012641 - protein, 8 aa, Mycobacterium
GVKSSAPD

SEQ ID NO: 1012642 - protein, 9 aa, Mycobacterium
GVKSTGGGG

SEQ ID NO: 1012643 - protein, 4 aa, Mycobacterium
GVMP

SEQ ID NO: 1012644 - protein, 7 aa, Mycobacterium
GVNDGIE

SEQ ID NO: 1012645 - protein, 15 aa, Mycobacterium
GVNGGSPGHGGNGGN

SEQ ID NO: 1012646 - protein, 7 aa, Mycobacterium
GVNKDDK

SEQ ID NO: 1012647 - protein, 9 aa, Mycobacterium
GVNPDDLRP

SEQ ID NO: 1012648 - protein, 9 aa, Mycobacterium
GVNPTNDGT

SEQ ID NO: 1012649 - protein, 4 aa, Mycobacterium
GVPA

SEQ ID NO: 1012650 - protein, 11 aa, Mycobacterium
GVPAGKSDRLT

SEQ ID NO: 1012651 - protein, 10 aa, Mycobacterium
GVPAGPGSVD

SEQ ID NO: 1012652 - protein, 6 aa, Mycobacterium
GVPAPV

SEQ ID NO: 1012653 - protein, 8 aa, Mycobacterium
GVPDESYQ

SEQ ID NO: 1012654 - protein, 8 aa, Mycobacterium
GVPDPGAH

SEQ ID NO: 1012655 - protein, 4 aa, Mycobacterium
GVPE

SEQ ID NO: 1012656 - protein, 8 aa, Mycobacterium
GVPGEELP

SEQ ID NO: 1012657 - protein, 13 aa, Mycobacterium
GVPGGQLQATAER

SEQ ID NO: 1012658 - protein, 16 aa, Mycobacterium
GVPGKGGQLSQASATT

SEQ ID NO: 1012659 - protein, 7 aa, Mycobacterium
GVPGPDR

SEQ ID NO: 1012660 - protein, 17 aa, Mycobacterium
GVPGRRRAGSRGGQRNQ

SEQ ID NO: 1012661 - protein, 5 aa, Mycobacterium
GVPND

SEQ ID NO: 1012662 - protein, 9 aa, Mycobacterium
GVPPPDGSR

SEQ ID NO: 1012663 - protein, 4 aa, Mycobacterium
GVPR

SEQ ID NO: 1012664 - protein, 7 aa, Mycobacterium
GVPRPET

SEQ ID NO: 1012665 - protein, 6 aa, Mycobacterium
GVPSQD

SEQ ID NO: 1012666 - protein, 16 aa, Mycobacterium
GVPSQVKSADPIPART

SEQ ID NO: 1012667 - protein, 6 aa, Mycobacterium
GVPTGQ

SEQ ID NO: 1012668 - protein, 8 aa, Mycobacterium
GVPTPGLP

SEQ ID NO: 1012669 - protein, 9 aa, Mycobacterium
GVPTSSPER

SEQ ID NO: 1012670 - protein, 13 aa, Mycobacterium
GVQAEQAATQAKL

SEQ ID NO: 1012671 - protein, 5 aa, Mycobacterium
GVQDG

SEQ ID NO: 1012672 - protein, 10 aa, Mycobacterium
GVQGDNRTYG

SEQ ID NO: 1012673 - protein, 5 aa, Mycobacterium
GVQGM

SEQ ID NO: 1012674 - protein, 18 aa, Mycobacterium
GVQKTGNRTDIRMLDRPH

SEQ ID NO: 1012675 - protein, 8 aa, Mycobacterium
GVQPTQYE

SEQ ID NO: 1012676 - protein, 7 aa, Mycobacterium
GVRADTD

SEQ ID NO: 1012677 - protein, 8 aa, Mycobacterium
GVRAKNQR

SEQ ID NO: 1012678 - protein, 18 aa, Mycobacterium
GVRDGKTGTLVPGAPASY

SEQ ID NO: 1012679 - protein, 7 aa, Mycobacterium
GVRGGGR

SEQ ID NO: 1012680 - protein, 6 aa, Mycobacterium
GVRPEG

SEQ ID NO: 1012681 - protein, 12 aa, Mycobacterium
GVRRTRSKFGSR

SEQ ID NO: 1012682 - protein, 11 aa, Mycobacterium
GVRSASLNGQE

SEQ ID NO: 1012683 - protein, 13 aa, Mycobacterium
GVRSDRSRNHKGS

SEQ ID NO: 1012684 - protein, 6 aa, Mycobacterium
GVRSGE

SEQ ID NO: 1012685 - protein, 7 aa, Mycobacterium
GVRSKTC

SEQ ID NO: 1012686 - protein, 6 aa, Mycobacterium
GVSDDD

SEQ ID NO: 1012687 - protein, 4 aa, Mycobacterium
GVSG

SEQ ID NO: 1012688 - protein, 5 aa, Mycobacterium
GVSGG

SEQ ID NO: 1012689 - protein, 13 aa, Mycobacterium
GVSGGAGGAGGAA

SEQ ID NO: 1012690 - protein, 6 aa, Mycobacterium
GVSGGT

SEQ ID NO: 1012691 - protein, 7 aa, Mycobacterium
GVSGLSP

SEQ ID NO: 1012692 - protein, 11 aa, Mycobacterium
GVSGNASARAP

SEQ ID NO: 1012693 - protein, 5 aa, Mycobacterium
GVSGT

SEQ ID NO: 1012694 - protein, 4 aa, Mycobacterium
GVSH

SEQ ID NO: 1012695 - protein, 10 aa, Mycobacterium
GVSHGPEGSL

SEQ ID NO: 1012696 - protein, 21 aa, Mycobacterium
GVSQDSKDVTTLGRGGSDTTA

SEQ ID NO: 1012697 - protein, 5 aa, Mycobacterium
GVSQP

SEQ ID NO: 1012698 - protein, 5 aa, Mycobacterium
GVSRA

SEQ ID NO: 1012699 - protein, 7 aa, Mycobacterium
GVSRSTV

SEQ ID NO: 1012700 - protein, 9 aa, Mycobacterium
GVSTPSNQD

SEQ ID NO: 1012701 - protein, 4 aa, Mycobacterium
GVSV

SEQ ID NO: 1012702 - protein, 16 aa, Mycobacterium
GVTAPGSSAESGPLDT

SEQ ID NO: 1012703 - protein, 10 aa, Mycobacterium
GVTDPEGKRK

SEQ ID NO: 1012704 - protein, 4 aa, Mycobacterium
GVTG

SEQ ID NO: 1012705 - protein, 15 aa, Mycobacterium
GVTGARDAVSNAAPD

SEQ ID NO: 1012706 - protein, 16 aa, Mycobacterium
GVTGVTDATPDLSDED

SEQ ID NO: 1012707 - protein, 8 aa, Mycobacterium
GVTKQAAQ

SEQ ID NO: 1012708 - protein, 8 aa, Mycobacterium
GVTPAQAR

SEQ ID NO: 1012709 - protein, 11 aa, Mycobacterium
GVTPDNPAQFT

SEQ ID NO: 1012710 - protein, 11 aa, Mycobacterium
GVTPPSSSVTS

SEQ ID NO: 1012711 - protein, 4 aa, Mycobacterium
GVTS

SEQ ID NO: 1012712 - protein, 6 aa, Mycobacterium
GVTSGR

SEQ ID NO: 1012713 - protein, 5 aa, Mycobacterium
GVTSS

SEQ ID NO: 1012714 - protein, 10 aa, Mycobacterium
GVVDQDGQRI

SEQ ID NO: 1012715 - protein, 11 aa, Mycobacterium
GWANTGNVNTG

SEQ ID NO: 1012716 - protein, 4 aa, Mycobacterium
GWAP

SEQ ID NO: 1012717 - protein, 8 aa, Mycobacterium
GWDQTPTV

SEQ ID NO: 1012718 - protein, 7 aa, Mycobacterium
GWGGGSD

SEQ ID NO: 1012719 - protein, 5 aa, Mycobacterium
GWNPQ

SEQ ID NO: 1012720 - protein, 10 aa, Mycobacterium
GWNSPRPAPA

SEQ ID NO: 1012721 - protein, 13 aa, Mycobacterium
GWPDPTGVRATSD

SEQ ID NO: 1012722 - protein, 22 aa, Mycobacterium
GWPPKTQRCASSRTRRPTRSCS

SEQ ID NO: 1012723 - protein, 9 aa, Mycobacterium
GWQAPDPRL

SEQ ID NO: 1012724 - protein, 15 aa, Mycobacterium
GWQGAASAAMASAAA

SEQ ID NO: 1012725 - protein, 12 aa, Mycobacterium
GWSARPEAGARE

SEQ ID NO: 1012726 - protein, 10 aa, Mycobacterium
GWSDTAAATT

SEQ ID NO: 1012727 - protein, 5 aa, Mycobacterium
GWSEQ

SEQ ID NO: 1012728 - protein, 13 aa, Mycobacterium
GWSGDPSPAALRG

SEQ ID NO: 1012729 - protein, 12 aa, Mycobacterium
GWSGHGGAGGRG

SEQ ID NO: 1012730 - protein, 9 aa, Mycobacterium
GWSGQDPTI

SEQ ID NO: 1012731 - protein, 4 aa, Mycobacterium
GWSP

SEQ ID NO: 1012732 - protein, 4 aa, Mycobacterium
GWTL

SEQ ID NO: 1012733 - protein, 4 aa, Mycobacterium
GWTT

SEQ ID NO: 1012734 - protein, 10 aa, Mycobacterium
GWVGPSSEAM

SEQ ID NO: 1012735 - protein, 8 aa, Mycobacterium
GYAGLSDT

SEQ ID NO: 1012736 - protein, 6 aa, Mycobacterium
GYAGPP

SEQ ID NO: 1012737 - protein, 10 aa, Mycobacterium
GYAGTRVPRV

SEQ ID NO: 1012738 - protein, 5 aa, Mycobacterium
GYAQT

SEQ ID NO: 1012739 - protein, 4 aa, Mycobacterium
GYDK

SEQ ID NO: 1012740 - protein, 19 aa, Mycobacterium
GYDKSWADGRGAAPADRRH

SEQ ID NO: 1012741 - protein, 6 aa, Mycobacterium
GYDPDA

SEQ ID NO: 1012742 - protein, 6 aa, Mycobacterium
GYDSAI

SEQ ID NO: 1012743 - protein, 16 aa, Mycobacterium
GYEHPGDPRQPDNTHR

SEQ ID NO: 1012744 - protein, 10 aa, Mycobacterium
GYEPQTAQTY

SEQ ID NO: 1012745 - protein, 9 aa, Mycobacterium
GYESPTGIQ

SEQ ID NO: 1012746 - protein, 4 aa, Mycobacterium
GYEY

SEQ ID NO: 1012747 - protein, 8 aa, Mycobacterium
GYGAEADR

SEQ ID NO: 1012748 - protein, 8 aa, Mycobacterium
GYGASGDR

SEQ ID NO: 1012749 - protein, 29 aa, Mycobacterium
GYGGTVTARRGRETRQAAAAQSGSDVSQA

SEQ ID NO: 1012750 - protein, 10 aa, Mycobacterium
GYGHPTSQGT

SEQ ID NO: 1012751 - protein, 23 aa, Mycobacterium
GYGQTGPDAHKAGYASVAEAASG

SEQ ID NO: 1012752 - protein, 7 aa, Mycobacterium
GYGSTGE

SEQ ID NO: 1012753 - protein, 4 aa, Mycobacterium
GYGT

SEQ ID NO: 1012754 - protein, 10 aa, Mycobacterium
GYGTAEGPQL

SEQ ID NO: 1012755 - protein, 4 aa, Mycobacterium
GYHD

SEQ ID NO: 1012756 - protein, 13 aa, Mycobacterium
GYHQTSLGGGTKL

SEQ ID NO: 1012757 - protein, 6 aa, Mycobacterium
GYHRRE

SEQ ID NO: 1012758 - protein, 8 aa, Mycobacterium
GYKARNPF

SEQ ID NO: 1012759 - protein, 14 aa, Mycobacterium
GYKIPGGTPSSPGL

SEQ ID NO: 1012760 - protein, 13 aa, Mycobacterium
GYKPNTKPHNRQI

SEQ ID NO: 1012761 - protein, 9 aa, Mycobacterium
GYKPSAAGL

SEQ ID NO: 1012762 - protein, 10 aa, Mycobacterium
GYKQSGIGRE

SEQ ID NO: 1012763 - protein, 6 aa, Mycobacterium
GYPADV

SEQ ID NO: 1012764 - protein, 10 aa, Mycobacterium
GYPAGLDDTP

SEQ ID NO: 1012765 - protein, 8 aa, Mycobacterium
GYPDVNTS

SEQ ID NO: 1012766 - protein, 7 aa, Mycobacterium
GYPGDRN

SEQ ID NO: 1012767 - protein, 25 aa, Mycobacterium
GYPMQRKGSSAVTGSLDSASASEIG

SEQ ID NO: 1012768 - protein, 5 aa, Mycobacterium
GYPNA

SEQ ID NO: 1012769 - protein, 14 aa, Mycobacterium
GYPPAEQLASDGGW

SEQ ID NO: 1012770 - protein, 12 aa, Mycobacterium
GYPPATGPARRV

SEQ ID NO: 1012771 - protein, 11 aa, Mycobacterium
GYPPPGSRGRM

SEQ ID NO: 1012772 - protein, 7 aa, Mycobacterium
GYPRPGK

SEQ ID NO: 1012773 - protein, 5 aa, Mycobacterium
GYPVG

SEQ ID NO: 1012774 - protein, 8 aa, Mycobacterium
GYQAVGSG

SEQ ID NO: 1012775 - protein, 8 aa, Mycobacterium
GYQSLSAQ

SEQ ID NO: 1012776 - protein, 11 aa, Mycobacterium
GYRPDPATGAV

SEQ ID NO: 1012777 - protein, 8 aa, Mycobacterium
GYRPETPA

SEQ ID NO: 1012778 - protein, 7 aa, Mycobacterium
GYRTPAE

SEQ ID NO: 1012779 - protein, 9 aa, Mycobacterium
GYSALGGRQ

SEQ ID NO: 1012780 - protein, 5 aa, Mycobacterium
GYSEL

SEQ ID NO: 1012781 - protein, 19 aa, Mycobacterium
GYSGGDVANATYRNHGTHA

SEQ ID NO: 1012782 - protein, 15 aa, Mycobacterium
GYSGVTDDIDPGGKA

SEQ ID NO: 1012783 - protein, 8 aa, Mycobacterium
GYSPHSFR

SEQ ID NO: 1012784 - protein, 4 aa, Mycobacterium
GYSQ

SEQ ID NO: 1012785 - protein, 7 aa, Mycobacterium
GYSQGAA

SEQ ID NO: 1012786 - protein, 5 aa, Mycobacterium
GYSTA

SEQ ID NO: 1012787 - protein, 5 aa, Mycobacterium
GYSTE

SEQ ID NO: 1012788 - protein, 4 aa, Mycobacterium
GYSV

SEQ ID NO: 1012789 - protein, 11 aa, Mycobacterium
GYTDPAASEKK

SEQ ID NO: 1012790 - protein, 7 aa, Mycobacterium
GYTEDDK

SEQ ID NO: 1012791 - protein, 6 aa, Mycobacterium
GYTGEH

SEQ ID NO: 1012792 - protein, 6 aa, Mycobacterium
GYTGEV

SEQ ID NO: 1012793 - protein, 7 aa, Mycobacterium
GYTGSPT

SEQ ID NO: 1012794 - protein, 4 aa, Mycobacterium
GYTP

SEQ ID NO: 1012795 - protein, 16 aa, Mycobacterium
GYTPDQAARESGQQAY

SEQ ID NO: 1012796 - protein, 10 aa, Mycobacterium
GYTPEFPGRE

SEQ ID NO: 1012797 - protein, 4 aa, Mycobacterium
GYTR

SEQ ID NO: 1012798 - protein, 14 aa, Mycobacterium
GYTSPGRVKETAED

SEQ ID NO: 1012799 - protein, 6 aa, Mycobacterium
GYTSSL

SEQ ID NO: 1012800 - protein, 5 aa, Mycobacterium
GYTST

SEQ ID NO: 1012801 - protein, 5 aa, Mycobacterium
GYTYG

SEQ ID NO: 1012802 - protein, 21 aa, Mycobacterium
HAAAAARARQDTLTKPRGALG

SEQ ID NO: 1012803 - protein, 8 aa, Mycobacterium
HAADPARY

SEQ ID NO: 1012804 - protein, 15 aa, Mycobacterium
HAADQRAMASADAQR

SEQ ID NO: 1012805 - protein, 4 aa, Mycobacterium
HAAG

SEQ ID NO: 1012806 - protein, 4 aa, Mycobacterium
HAAL

SEQ ID NO: 1012807 - protein, 6 aa, Mycobacterium
HAANNG

SEQ ID NO: 1012808 - protein, 13 aa, Mycobacterium
HAARARYDSFPRS

SEQ ID NO: 1012809 - protein, 6 aa, Mycobacterium
HAARNP

SEQ ID NO: 1012810 - protein, 8 aa, Mycobacterium
HAARTSAD

SEQ ID NO: 1012811 - protein, 9 aa, Mycobacterium
HAASPEQQQ

SEQ ID NO: 1012812 - protein, 21 aa, Mycobacterium
HAASSAGSSPPTVARSCPPHT

SEQ ID NO: 1012813 - protein, 12 aa, Mycobacterium
HADDAESNRIRT

SEQ ID NO: 1012814 - protein, 5 aa, Mycobacterium
HADDD

SEQ ID NO: 1012815 - protein, 13 aa, Mycobacterium
HADGDRGPSATSV

SEQ ID NO: 1012816 - protein, 6 aa, Mycobacterium
HADGSE

SEQ ID NO: 1012817 - protein, 6 aa, Mycobacterium
HADKPT

SEQ ID NO: 1012818 - protein, 9 aa, Mycobacterium
HADPATQAD

SEQ ID NO: 1012819 - protein, 10 aa, Mycobacterium
HADPQTAAGL

SEQ ID NO: 1012820 - protein, 12 aa, Mycobacterium
HADTRAGKYSKG

SEQ ID NO: 1012821 - protein, 5 aa, Mycobacterium
HAEGD

SEQ ID NO: 1012822 - protein, 6 aa, Mycobacterium
HAEPGT

SEQ ID NO: 1012823 - protein, 6 aa, Mycobacterium
HAETRV

SEQ ID NO: 1012824 - protein, 7 aa, Mycobacterium
HAGETGG

SEQ ID NO: 1012825 - protein, 10 aa, Mycobacterium
HAGGDPNGFG

SEQ ID NO: 1012826 - protein, 12 aa, Mycobacterium
HAGGSGLWGLIT

SEQ ID NO: 1012827 - protein, 7 aa, Mycobacterium
HAGHRES

SEQ ID NO: 1012828 - protein, 8 aa, Mycobacterium
HAGISAPA

SEQ ID NO: 1012829 - protein, 7 aa, Mycobacterium
HAGLSGP

SEQ ID NO: 1012830 - protein, 13 aa, Mycobacterium
HAGQQPDSATNAR

SEQ ID NO: 1012831 - protein, 40 aa, Mycobacterium
HAGSDGAQGAHVGAPGDPGNPPDPGSGAGKNAVDAAAGRD

SEQ ID NO: 1012832 - protein, 10 aa, Mycobacterium
HAHGSRGHGA

SEQ ID NO: 1012833 - protein, 10 aa, Mycobacterium
HAKASADTGL

SEQ ID NO: 1012834 - protein, 10 aa, Mycobacterium
HAKPSPAHRV

SEQ ID NO: 1012835 - protein, 7 aa, Mycobacterium
HAKQGDR

SEQ ID NO: 1012836 - protein, 8 aa, Mycobacterium
HALPGETD

SEQ ID NO: 1012837 - protein, 6 aa, Mycobacterium
HANEDG

SEQ ID NO: 1012838 - protein, 6 aa, Mycobacterium
HANREG

SEQ ID NO: 1012839 - protein, 4 aa, Mycobacterium
HAPE

SEQ ID NO: 1012840 - protein, 6 aa, Mycobacterium
HAPHAE

SEQ ID NO: 1012841 - protein, 5 aa, Mycobacterium
HAPKT

SEQ ID NO: 1012842 - protein, 7 aa, Mycobacterium
HAPPVTA

SEQ ID NO: 1012843 - protein, 6 aa, Mycobacterium
HAPQES

SEQ ID NO: 1012844 - protein, 6 aa, Mycobacterium
HAPTQA

SEQ ID NO: 1012845 - protein, 16 aa, Mycobacterium
HAQDQGYGTELNPDHT

SEQ ID NO: 1012846 - protein, 8 aa, Mycobacterium
HAQGHPVS

SEQ ID NO: 1012847 - protein, 14 aa, Mycobacterium
HAQRSPEAAPPYTV

SEQ ID NO: 1012848 - protein, 7 aa, Mycobacterium
HARDGGP

SEQ ID NO: 1012849 - protein, 10 aa, Mycobacterium
HARGQDTQQD

SEQ ID NO: 1012850 - protein, 15 aa, Mycobacterium
HARGTNMLTVLFQNQ

SEQ ID NO: 1012851 - protein, 6 aa, Mycobacterium
HARLSS

SEQ ID NO: 1012852 - protein, 13 aa, Mycobacterium
HARPVAGASVKSG

SEQ ID NO: 1012853 - protein, 8 aa, Mycobacterium
HARSTGPY

SEQ ID NO: 1012854 - protein, 7 aa, Mycobacterium
HASAAEE

SEQ ID NO: 1012855 - protein, 6 aa, Mycobacterium
HASAAK

SEQ ID NO: 1012856 - protein, 7 aa, Mycobacterium
HASASPV

SEQ ID NO: 1012857 - protein, 9 aa, Mycobacterium
HASGDVRDG

SEQ ID NO: 1012858 - protein, 16 aa, Mycobacterium
HASGDYPKLDDPSEAG

SEQ ID NO: 1012859 - protein, 7 aa, Mycobacterium
HASPAAV

SEQ ID NO: 1012860 - protein, 11 aa, Mycobacterium
HASTAGSQLEV

SEQ ID NO: 1012861 - protein, 4 aa, Mycobacterium
HATA

SEQ ID NO: 1012862 - protein, 9 aa, Mycobacterium
HATAPSGGV

SEQ ID NO: 1012863 - protein, 7 aa, Mycobacterium
HATDDPR

SEQ ID NO: 1012864 - protein, 7 aa, Mycobacterium
HATDPTP

SEQ ID NO: 1012865 - protein, 11 aa, Mycobacterium
HATESNPTAAS

SEQ ID NO: 1012866 - protein, 5 aa, Mycobacterium
HATEY

SEQ ID NO: 1012867 - protein, 16 aa, Mycobacterium
HATGTQVGDVAEGRAI

SEQ ID NO: 1012868 - protein, 5 aa, Mycobacterium
HATPE

SEQ ID NO: 1012869 - protein, 9 aa, Mycobacterium
HATPTTSEF

SEQ ID NO: 1012870 - protein, 8 aa, Mycobacterium
HAYGGGSQ

SEQ ID NO: 1012871 - protein, 16 aa, Mycobacterium
HCGSPRPPSTTGCRWV

SEQ ID NO: 1012872 - protein, 16 aa, Mycobacterium
HCTASGYSAIGSRLSA

SEQ ID NO: 1012873 - protein, 10 aa, Mycobacterium
HDAGPANDAA

SEQ ID NO: 1012874 - protein, 8 aa, Mycobacterium
HDAGPENI

SEQ ID NO: 1012875 - protein, 12 aa, Mycobacterium
HDAKDSTSLETE

SEQ ID NO: 1012876 - protein, 10 aa, Mycobacterium
HDAPKVARRS

SEQ ID NO: 1012877 - protein, 7 aa, Mycobacterium
HDAPPAT

SEQ ID NO: 1012878 - protein, 5 aa, Mycobacterium
HDDDT

SEQ ID NO: 1012879 - protein, 6 aa, Mycobacterium
HDDGDA

SEQ ID NO: 1012880 - protein, 8 aa, Mycobacterium
HDDGPRPT

SEQ ID NO: 1012881 - protein, 10 aa, Mycobacterium
HDDKAARTAM

SEQ ID NO: 1012882 - protein, 7 aa, Mycobacterium
HDDPAGP

SEQ ID NO: 1012883 - protein, 12 aa, Mycobacterium
HDDQPQYRTRKH

SEQ ID NO: 1012884 - protein, 4 aa, Mycobacterium
HDER

SEQ ID NO: 1012885 - protein, 7 aa, Mycobacterium
HDFGTGA

SEQ ID NO: 1012886 - protein, 6 aa, Mycobacterium
HDGANG

SEQ ID NO: 1012887 - protein, 17 aa, Mycobacterium
HDGDDDALRQANDTDYG

SEQ ID NO: 1012888 - protein, 7 aa, Mycobacterium
HDGDPEL

SEQ ID NO: 1012889 - protein, 6 aa, Mycobacterium
HDGDTV

SEQ ID NO: 1012890 - protein, 4 aa, Mycobacterium
HDGG

SEQ ID NO: 1012891 - protein, 11 aa, Mycobacterium
HDGGPSAARTA

SEQ ID NO: 1012892 - protein, 5 aa, Mycobacterium
HDGGR

SEQ ID NO: 1012893 - protein, 11 aa, Mycobacterium
HDGGTGATPLT

SEQ ID NO: 1012894 - protein, 8 aa, Mycobacterium
HDGKPPVG

SEQ ID NO: 1012895 - protein, 8 aa, Mycobacterium
HDGPESVR

SEQ ID NO: 1012896 - protein, 6 aa, Mycobacterium
HDGPTT

SEQ ID NO: 1012897 - protein, 7 aa, Mycobacterium
HDGRPQL

SEQ ID NO: 1012898 - protein, 7 aa, Mycobacterium
HDGSAEV

SEQ ID NO: 1012899 - protein, 8 aa, Mycobacterium
HDGTPGRI

SEQ ID NO: 1012900 - protein, 15 aa, Mycobacterium
HDHGAPSYAAGRPRT

SEQ ID NO: 1012901 - protein, 8 aa, Mycobacterium
HDKRKSAE

SEQ ID NO: 1012902 - protein, 5 aa, Mycobacterium
HDLAP

SEQ ID NO: 1012903 - protein, 13 aa, Mycobacterium
HDLGDGAYSATTD

SEQ ID NO: 1012904 - protein, 22 aa, Mycobacterium
HDLGSADDVRERAPGPDQHPTY

SEQ ID NO: 1012905 - protein, 8 aa, Mycobacterium
HDLPPTAG

SEQ ID NO: 1012906 - protein, 5 aa, Mycobacterium
HDLTT

SEQ ID NO: 1012907 - protein, 11 aa, Mycobacterium
HDNKSTSFAGG

SEQ ID NO: 1012908 - protein, 6 aa, Mycobacterium
HDNTQL

SEQ ID NO: 1012909 - protein, 4 aa, Mycobacterium
HDPA

SEQ ID NO: 1012910 - protein, 5 aa, Mycobacterium
HDPAS

SEQ ID NO: 1012911 - protein, 6 aa, Mycobacterium
HDPDKL

SEQ ID NO: 1012912 - protein, 6 aa, Mycobacterium
HDPDTL

SEQ ID NO: 1012913 - protein, 10 aa, Mycobacterium
HDPKSTMAKG

SEQ ID NO: 1012914 - protein, 7 aa, Mycobacterium
HDPLRDD

SEQ ID NO: 1012915 - protein, 10 aa, Mycobacterium
HDPLRDDGAR

SEQ ID NO: 1012916 - protein, 8 aa, Mycobacterium
HDPSDTTW

SEQ ID NO: 1012917 - protein, 5 aa, Mycobacterium
HDPST

SEQ ID NO: 1012918 - protein, 4 aa, Mycobacterium
HDPV

SEQ ID NO: 1012919 - protein, 4 aa, Mycobacterium
HDQR

SEQ ID NO: 1012920 - protein, 10 aa, Mycobacterium
HDRLGPQSGR

SEQ ID NO: 1012921 - protein, 6 aa, Mycobacterium
HDRPAT

SEQ ID NO: 1012922 - protein, 4 aa, Mycobacterium
HDRR

SEQ ID NO: 1012923 - protein, 6 aa, Mycobacterium
HDRSEA

SEQ ID NO: 1012924 - protein, 4 aa, Mycobacterium
HDRT

SEQ ID NO: 1012925 - protein, 5 aa, Mycobacterium
HDSRV

SEQ ID NO: 1012926 - protein, 10 aa, Mycobacterium
HDTAEKPQEA

SEQ ID NO: 1012927 - protein, 4 aa, Mycobacterium
HDTE

SEQ ID NO: 1012928 - protein, 7 aa, Mycobacterium
HDTLDND

SEQ ID NO: 1012929 - protein, 8 aa, Mycobacterium
HDTLTTRT

SEQ ID NO: 1012930 - protein, 8 aa, Mycobacterium
HDTPGGQL

SEQ ID NO: 1012931 - protein, 9 aa, Mycobacterium
HDVGRGRDG

SEQ ID NO: 1012932 - protein, 8 aa, Mycobacterium
HEAAAQRR

SEQ ID NO: 1012933 - protein, 16 aa, Mycobacterium
HEAAGAAVRTAEERSV

SEQ ID NO: 1012934 - protein, 5 aa, Mycobacterium
HEARE

SEQ ID NO: 1012935 - protein, 7 aa, Mycobacterium
HEDDPRV

SEQ ID NO: 1012936 - protein, 10 aa, Mycobacterium
HEDDPSRYAT

SEQ ID NO: 1012937 - protein, 13 aa, Mycobacterium
HEDPPGRARQTNG

SEQ ID NO: 1012938 - protein, 8 aa, Mycobacterium
HEEAPEEI

SEQ ID NO: 1012939 - protein, 7 aa, Mycobacterium
HEEARLP

SEQ ID NO: 1012940 - protein, 10 aa, Mycobacterium
HEENKKAFAG

SEQ ID NO: 1012941 - protein, 7 aa, Mycobacterium
HEEPDRC

SEQ ID NO: 1012942 - protein, 5 aa, Mycobacterium
HEGAG

SEQ ID NO: 1012943 - protein, 12 aa, Mycobacterium
HEGDGGQDAKPV

SEQ ID NO: 1012944 - protein, 14 aa, Mycobacterium
HEGDTAAAVAILET

SEQ ID NO: 1012945 - protein, 6 aa, Mycobacterium
HEGESD

SEQ ID NO: 1012946 - protein, 5 aa, Mycobacterium
HEGGS

SEQ ID NO: 1012947 - protein, 8 aa, Mycobacterium
HEGPSAAQ

SEQ ID NO: 1012948 - protein, 7 aa, Mycobacterium
HEGRSGA

SEQ ID NO: 1012949 - protein, 12 aa, Mycobacterium
HEKFGEPDLGGS

SEQ ID NO: 1012950 - protein, 13 aa, Mycobacterium
HEKQSSDSSGDRY

SEQ ID NO: 1012951 - protein, 4 aa, Mycobacterium
HENE

SEQ ID NO: 1012952 - protein, 5 aa, Mycobacterium
HENTE

SEQ ID NO: 1012953 - protein, 8 aa, Mycobacterium
HEPADPDH

SEQ ID NO: 1012954 - protein, 5 aa, Mycobacterium
HEPDI

SEQ ID NO: 1012955 - protein, 6 aa, Mycobacterium
HEPDSG

SEQ ID NO: 1012956 - protein, 9 aa, Mycobacterium
HEPGERRGQ

SEQ ID NO: 1012957 - protein, 11 aa, Mycobacterium
HERGAAGFDDP

SEQ ID NO: 1012958 - protein, 9 aa, Mycobacterium
HESEPRQRD

SEQ ID NO: 1012959 - protein, 11 aa, Mycobacterium
HESGVKADRLT

SEQ ID NO: 1012960 - protein, 8 aa, Mycobacterium
HESNEALA

SEQ ID NO: 1012961 - protein, 5 aa, Mycobacterium
HESNQ

SEQ ID NO: 1012962 - protein, 4 aa, Mycobacterium
HESP

SEQ ID NO: 1012963 - protein, 10 aa, Mycobacterium
HESTQNAKEM

SEQ ID NO: 1012964 - protein, 5 aa, Mycobacterium
HETPE

SEQ ID NO: 1012965 - protein, 5 aa, Mycobacterium
HETRA

SEQ ID NO: 1012966 - protein, 5 aa, Mycobacterium
HETSQ

SEQ ID NO: 1012967 - protein, 6 aa, Mycobacterium
HETTAA

SEQ ID NO: 1012968 - protein, 7 aa, Mycobacterium
HETTAST

SEQ ID NO: 1012969 - protein, 10 aa, Mycobacterium
HEVGTGGQAE

SEQ ID NO: 1012970 - protein, 16 aa, Mycobacterium
HFPDPNGFSGPRAQRL

SEQ ID NO: 1012971 - protein, 7 aa, Mycobacterium
HFPTEQS

SEQ ID NO: 1012972 - protein, 13 aa, Mycobacterium
HFSETGTELTPPR

SEQ ID NO: 1012973 - protein, 9 aa, Mycobacterium
HFTPTDPLT

SEQ ID NO: 1012974 - protein, 9 aa, Mycobacterium
HGAADGSLP

SEQ ID NO: 1012975 - protein, 13 aa, Mycobacterium
HGAADWSKRPLPS

SEQ ID NO: 1012976 - protein, 9 aa, Mycobacterium
HGAAVPDPI

SEQ ID NO: 1012977 - protein, 6 aa, Mycobacterium
HGAGQP

SEQ ID NO: 1012978 - protein, 7 aa, Mycobacterium
HGAGSIS

SEQ ID NO: 1012979 - protein, 14 aa, Mycobacterium
HGALDSDGADLSES

SEQ ID NO: 1012980 - protein, 4 aa, Mycobacterium
HGAP

SEQ ID NO: 1012981 - protein, 13 aa, Mycobacterium
HGAPPNGATARRS

SEQ ID NO: 1012982 - protein, 7 aa, Mycobacterium
HGAQTGS

SEQ ID NO: 1012983 - protein, 5 aa, Mycobacterium
HGAQY

SEQ ID NO: 1012984 - protein, 10 aa, Mycobacterium
HGASSKEARS

SEQ ID NO: 1012985 - protein, 5 aa, Mycobacterium
HGATP

SEQ ID NO: 1012986 - protein, 11 aa, Mycobacterium
HGDDGDKARRL

SEQ ID NO: 1012987 - protein, 7 aa, Mycobacterium
HGDDRRT

SEQ ID NO: 1012988 - protein, 8 aa, Mycobacterium
HGDDTTYA

SEQ ID NO: 1012989 - protein, 7 aa, Mycobacterium
HGDEQLN

SEQ ID NO: 1012990 - protein, 9 aa, Mycobacterium
HGDKNGDGF

SEQ ID NO: 1012991 - protein, 5 aa, Mycobacterium
HGDNF

SEQ ID NO: 1012992 - protein, 11 aa, Mycobacterium
HGDPAPGESTV

SEQ ID NO: 1012993 - protein, 9 aa, Mycobacterium
HGDQAATPG

SEQ ID NO: 1012994 - protein, 4 aa, Mycobacterium
HGDR

SEQ ID NO: 1012995 - protein, 4 aa, Mycobacterium
HGDS

SEQ ID NO: 1012996 - protein, 13 aa, Mycobacterium
HGDSRQVRTDPNA

SEQ ID NO: 1012997 - protein, 10 aa, Mycobacterium
HGDTDQTPFG

SEQ ID NO: 1012998 - protein, 6 aa, Mycobacterium
HGDTNA

SEQ ID NO: 1012999 - protein, 6 aa, Mycobacterium
HGEALG

SEQ ID NO: 1013000 - protein, 13 aa, Mycobacterium
HGEDVEEALPSRP

SEQ ID NO: 1013001 - protein, 8 aa, Mycobacterium
HGEPNAEA

SEQ ID NO: 1013002 - protein, 10 aa, Mycobacterium
HGETDTENQR

SEQ ID NO: 1013003 - protein, 7 aa, Mycobacterium
HGETTSA

SEQ ID NO: 1013004 - protein, 14 aa, Mycobacterium
HGEVPRGRRIARPR

SEQ ID NO: 1013005 - protein, 8 aa, Mycobacterium
HGGAAAEF

SEQ ID NO: 1013006 - protein, 5 aa, Mycobacterium
HGGAG

SEQ ID NO: 1013007 - protein, 11 aa, Mycobacterium
HGGASAAAAQL

SEQ ID NO: 1013008 - protein, 7 aa, Mycobacterium
HGGDDPA

SEQ ID NO: 1013009 - protein, 6 aa, Mycobacterium
HGGDDQ

SEQ ID NO: 1013010 - protein, 15 aa, Mycobacterium
HGGDGGNAGDVGAGS

SEQ ID NO: 1013011 - protein, 6 aa, Mycobacterium
HGGDGV

SEQ ID NO: 1013012 - protein, 16 aa, Mycobacterium
HGGGEPPPYLAASSAN

SEQ ID NO: 1013013 - protein, 22 aa, Mycobacterium
HGGHGHSSPKDKRDQTGQESLY

SEQ ID NO: 1013014 - protein, 5 aa, Mycobacterium
HGGIE

SEQ ID NO: 1013015 - protein, 4 aa, Mycobacterium
HGGP

SEQ ID NO: 1013016 - protein, 9 aa, Mycobacterium
HGGPLSSAA

SEQ ID NO: 1013017 - protein, 11 aa, Mycobacterium
HGGRQANGGLP

SEQ ID NO: 1013018 - protein, 11 aa, Mycobacterium
HGGRQLDRAPA

SEQ ID NO: 1013019 - protein, 6 aa, Mycobacterium
HGGSAA

SEQ ID NO: 1013020 - protein, 4 aa, Mycobacterium
HGGT

SEQ ID NO: 1013021 - protein, 100 aa, Mycobacterium
HGGTGGDGGTSGWSGSGGNGRNGGDGGTTGIARGDNGGDGGNGGNGGTSFGVGGAGGAGGTGNINGGVGGNGGTGGFAAGTGGAGGNGDNIGGDGGNGGD

SEQ ID NO: 1013022 - protein, 9 aa, Mycobacterium
HGGTNPRDL

SEQ ID NO: 1013023 - protein, 5 aa, Mycobacterium
HGGTQ

SEQ ID NO: 1013024 - protein, 5 aa, Mycobacterium
HGHQD

SEQ ID NO: 1013025 - protein, 14 aa, Mycobacterium
HGISDASPAALAAD

SEQ ID NO: 1013026 - protein, 4 aa, Mycobacterium
HGKQ

SEQ ID NO: 1013027 - protein, 8 aa, Mycobacterium
HGKSQSLT

SEQ ID NO: 1013028 - protein, 6 aa, Mycobacterium
HGLPTG

SEQ ID NO: 1013029 - protein, 19 aa, Mycobacterium
HGLRQKQRATSSSFRRCQA

SEQ ID NO: 1013030 - protein, 5 aa, Mycobacterium
HGLSE

SEQ ID NO: 1013031 - protein, 12 aa, Mycobacterium
HGLSNRERSYEA

SEQ ID NO: 1013032 - protein, 5 aa, Mycobacterium
HGLTS

SEQ ID NO: 1013033 - protein, 13 aa, Mycobacterium
HGMGRASQAVTGT

SEQ ID NO: 1013034 - protein, 6 aa, Mycobacterium
HGNKEA

SEQ ID NO: 1013035 - protein, 12 aa, Mycobacterium
HGNPVPHDGETV

SEQ ID NO: 1013036 - protein, 4 aa, Mycobacterium
HGNT

SEQ ID NO: 1013037 - protein, 4 aa, Mycobacterium
HGPA

SEQ ID NO: 1013038 - protein, 8 aa, Mycobacterium
HGPAPVAD

SEQ ID NO: 1013039 - protein, 4 aa, Mycobacterium
HGPD

SEQ ID NO: 1013040 - protein, 11 aa, Mycobacterium
HGPESEQVEEE

SEQ ID NO: 1013041 - protein, 14 aa, Mycobacterium
HGPEVDKGAKWDPA

SEQ ID NO: 1013042 - protein, 5 aa, Mycobacterium
HGPIG

SEQ ID NO: 1013043 - protein, 15 aa, Mycobacterium
HGPKPRDYSQRTPKK

SEQ ID NO: 1013044 - protein, 9 aa, Mycobacterium
HGPQAGKGH

SEQ ID NO: 1013045 - protein, 14 aa, Mycobacterium
HGPTPRVTANHRGG

SEQ ID NO: 1013046 - protein, 8 aa, Mycobacterium
HGPTTPTF

SEQ ID NO: 1013047 - protein, 6 aa, Mycobacterium
HGQHGE

SEQ ID NO: 1013048 - protein, 10 aa, Mycobacterium
HGQPRTNSYH

SEQ ID NO: 1013049 - protein, 12 aa, Mycobacterium
HGQVDSSELETR

SEQ ID NO: 1013050 - protein, 5 aa, Mycobacterium
HGRDP

SEQ ID NO: 1013051 - protein, 6 aa, Mycobacterium
HGRGGI

SEQ ID NO: 1013052 - protein, 6 aa, Mycobacterium
HGRNAS

SEQ ID NO: 1013053 - protein, 5 aa, Mycobacterium
HGRPA

SEQ ID NO: 1013054 - protein, 6 aa, Mycobacterium
HGRPPY

SEQ ID NO: 1013055 - protein, 11 aa, Mycobacterium
HGRSDKPRADY

SEQ ID NO: 1013056 - protein, 15 aa, Mycobacterium
HGRTELAEAAAKQAE

SEQ ID NO: 1013057 - protein, 4 aa, Mycobacterium
HGRW

SEQ ID NO: 1013058 - protein, 6 aa, Mycobacterium
HGRWPQ

SEQ ID NO: 1013059 - protein, 5 aa, Mycobacterium
HGSDA

SEQ ID NO: 1013060 - protein, 11 aa, Mycobacterium
HGSGCDAGKTV

SEQ ID NO: 1013061 - protein, 7 aa, Mycobacterium
HGSGDSE

SEQ ID NO: 1013062 - protein, 9 aa, Mycobacterium
HGSPKTKEF

SEQ ID NO: 1013063 - protein, 8 aa, Mycobacterium
HGSVSTIG

SEQ ID NO: 1013064 - protein, 9 aa, Mycobacterium
HGTASGTLT

SEQ ID NO: 1013065 - protein, 10 aa, Mycobacterium
HGTATPAGDP

SEQ ID NO: 1013066 - protein, 15 aa, Mycobacterium
HGTATPIGDSAEANA

SEQ ID NO: 1013067 - protein, 4 aa, Mycobacterium
HGTG

SEQ ID NO: 1013068 - protein, 5 aa, Mycobacterium
HGTGT

SEQ ID NO: 1013069 - protein, 9 aa, Mycobacterium
HGTGTQLGD

SEQ ID NO: 1013070 - protein, 15 aa, Mycobacterium
HGTGTRIGDTTEAQA

SEQ ID NO: 1013071 - protein, 12 aa, Mycobacterium
HGTGTRLGDPIE

SEQ ID NO: 1013072 - protein, 14 aa, Mycobacterium
HGTSPRQWRALPPR

SEQ ID NO: 1013073 - protein, 9 aa, Mycobacterium
HGTSRAQAG

SEQ ID NO: 1013074 - protein, 5 aa, Mycobacterium
HGTTP

SEQ ID NO: 1013075 - protein, 119 aa, Mycobacterium
HGTTPGANGQYGGDGGEGGRGGVGGAAAAGQAGSQGDGGNGGDGGDGGTPGNGGSGADGANSAIGVSAGDGGYGGAGGNAGAGGLGGEGGAGSTSGASGLDGSQAAGGDGGNGGFGGTG

SEQ ID NO: 1013076 - protein, 15 aa, Mycobacterium
HGVDPAVRGRVSDER

SEQ ID NO: 1013077 - protein, 6 aa, Mycobacterium
HGVGPE

SEQ ID NO: 1013078 - protein, 4 aa, Mycobacterium
HGVP

SEQ ID NO: 1013079 - protein, 8 aa, Mycobacterium
HGVPPGRR

SEQ ID NO: 1013080 - protein, 5 aa, Mycobacterium
HGVPT

SEQ ID NO: 1013081 - protein, 12 aa, Mycobacterium
HGVSDSVARAGG

SEQ ID NO: 1013082 - protein, 9 aa, Mycobacterium
HGWTASGEK

SEQ ID NO: 1013083 - protein, 10 aa, Mycobacterium
HGYSTDVSDG

SEQ ID NO: 1013084 - protein, 58 aa, Mycobacterium
HHAGAGDTATAHAAPDPAHSPDSAHPADPGNRFPAGAAGAADTSGASGAGSSRVRPSH

SEQ ID NO: 1013085 - protein, 4 aa, Mycobacterium
HHDG

SEQ ID NO: 1013086 - protein, 7 aa, Mycobacterium
HHDGDPL

SEQ ID NO: 1013087 - protein, 15 aa, Mycobacterium
HHDRPRRVRKPGEPL

SEQ ID NO: 1013088 - protein, 15 aa, Mycobacterium
HHEAEADAAVAAIAS

SEQ ID NO: 1013089 - protein, 6 aa, Mycobacterium
HHEAGA

SEQ ID NO: 1013090 - protein, 7 aa, Mycobacterium
HHEQTSE

SEQ ID NO: 1013091 - protein, 4 aa, Mycobacterium
HHGG

SEQ ID NO: 1013092 - protein, 5 aa, Mycobacterium
HHGGK

SEQ ID NO: 1013093 - protein, 11 aa, Mycobacterium
HHGQGKLDARA

SEQ ID NO: 1013094 - protein, 8 aa, Mycobacterium
HHHGDSET

SEQ ID NO: 1013095 - protein, 4 aa, Mycobacterium
HHKG

SEQ ID NO: 1013096 - protein, 5 aa, Mycobacterium
HHNPH

SEQ ID NO: 1013097 - protein, 5 aa, Mycobacterium
HHPGS

SEQ ID NO: 1013098 - protein, 8 aa, Mycobacterium
HHPLPKPH

SEQ ID NO: 1013099 - protein, 6 aa, Mycobacterium
HHPPPT

SEQ ID NO: 1013100 - protein, 17 aa, Mycobacterium
HHRRRTRAGTAPARDSR

SEQ ID NO: 1013101 - protein, 13 aa, Mycobacterium
HHRSDGGLQAVTD

SEQ ID NO: 1013102 - protein, 17 aa, Mycobacterium
HHSGSRKAKFPAPRAFR

SEQ ID NO: 1013103 - protein, 16 aa, Mycobacterium
HHTAGGDESSAALPHR

SEQ ID NO: 1013104 - protein, 4 aa, Mycobacterium
HIET

SEQ ID NO: 1013105 - protein, 7 aa, Mycobacterium
HIGDSRS

SEQ ID NO: 1013106 - protein, 7 aa, Mycobacterium
HIGDSRT

SEQ ID NO: 1013107 - protein, 20 aa, Mycobacterium
HIGGGNAGNAGNGGTGGSGG

SEQ ID NO: 1013108 - protein, 4 aa, Mycobacterium
HIGP

SEQ ID NO: 1013109 - protein, 9 aa, Mycobacterium
HIPDGGAEG

SEQ ID NO: 1013110 - protein, 11 aa, Mycobacterium
HIPGGSGTASR

SEQ ID NO: 1013111 - protein, 5 aa, Mycobacterium
HIPTA

SEQ ID NO: 1013112 - protein, 7 aa, Mycobacterium
HISDSRS

SEQ ID NO: 1013113 - protein, 8 aa, Mycobacterium
HITDDGPM

SEQ ID NO: 1013114 - protein, 13 aa, Mycobacterium
HKAGGKTTPIGTV

SEQ ID NO: 1013115 - protein, 10 aa, Mycobacterium
HKATRNGEQI

SEQ ID NO: 1013116 - protein, 25 aa, Mycobacterium
HKGQTEVTTGQLADPVNGQPRSAAL

SEQ ID NO: 1013117 - protein, 7 aa, Mycobacterium
HKHSPDE

SEQ ID NO: 1013118 - protein, 8 aa, Mycobacterium
HKITGTRK

SEQ ID NO: 1013119 - protein, 10 aa, Mycobacterium
HKLAGNGWQT

SEQ ID NO: 1013120 - protein, 6 aa, Mycobacterium
HKLSDD

SEQ ID NO: 1013121 - protein, 8 aa, Mycobacterium
HKLSSGAA

SEQ ID NO: 1013122 - protein, 10 aa, Mycobacterium
HKPATAGWKG

SEQ ID NO: 1013123 - protein, 7 aa, Mycobacterium
HKPNGSH

SEQ ID NO: 1013124 - protein, 20 aa, Mycobacterium
HKPRGPSATPWVRADQATVT

SEQ ID NO: 1013125 - protein, 11 aa, Mycobacterium
HKQGRHDDAAE

SEQ ID NO: 1013126 - protein, 14 aa, Mycobacterium
HKSGFPRSTPVTPM

SEQ ID NO: 1013127 - protein, 7 aa, Mycobacterium
HKTTKMG

SEQ ID NO: 1013128 - protein, 6 aa, Mycobacterium
HKVGPG

SEQ ID NO: 1013129 - protein, 6 aa, Mycobacterium
HKYGGT

SEQ ID NO: 1013130 - protein, 8 aa, Mycobacterium
HKYKDSRE

SEQ ID NO: 1013131 - protein, 12 aa, Mycobacterium
HLDSTRAVSPLR

SEQ ID NO: 1013132 - protein, 7 aa, Mycobacterium
HLGDRNK

SEQ ID NO: 1013133 - protein, 9 aa, Mycobacterium
HLGGTPPAV

SEQ ID NO: 1013134 - protein, 7 aa, Mycobacterium
HLGKGDS

SEQ ID NO: 1013135 - protein, 6 aa, Mycobacterium
HLPGGD

SEQ ID NO: 1013136 - protein, 9 aa, Mycobacterium
HLPNPDGPP

SEQ ID NO: 1013137 - protein, 9 aa, Mycobacterium
HLPPDSAVP

SEQ ID NO: 1013138 - protein, 6 aa, Mycobacterium
HLRPRS

SEQ ID NO: 1013139 - protein, 6 aa, Mycobacterium
HLRSGA

SEQ ID NO: 1013140 - protein, 11 aa, Mycobacterium
HMEGTAPYSRE

SEQ ID NO: 1013141 - protein, 4 aa, Mycobacterium
HNAG

SEQ ID NO: 1013142 - protein, 17 aa, Mycobacterium
HNAGPTGAGLASSASGF

SEQ ID NO: 1013143 - protein, 15 aa, Mycobacterium
HNAGSSINELIWKKQ

SEQ ID NO: 1013144 - protein, 5 aa, Mycobacterium
HNDDG

SEQ ID NO: 1013145 - protein, 7 aa, Mycobacterium
HNDDGGE

SEQ ID NO: 1013146 - protein, 8 aa, Mycobacterium
HNDRGTAV

SEQ ID NO: 1013147 - protein, 8 aa, Mycobacterium
HNEGNKDL

SEQ ID NO: 1013148 - protein, 5 aa, Mycobacterium
HNETR

SEQ ID NO: 1013149 - protein, 10 aa, Mycobacterium
HNGASHQDPG

SEQ ID NO: 1013150 - protein, 4 aa, Mycobacterium
HNGL

SEQ ID NO: 1013151 - protein, 6 aa, Mycobacterium
HNGQPT

SEQ ID NO: 1013152 - protein, 5 aa, Mycobacterium
HNHES

SEQ ID NO: 1013153 - protein, 7 aa, Mycobacterium
HNHPESE

SEQ ID NO: 1013154 - protein, 5 aa, Mycobacterium
HNHPS

SEQ ID NO: 1013155 - protein, 6 aa, Mycobacterium
HNPAAY

SEQ ID NO: 1013156 - protein, 8 aa, Mycobacterium
HNPAGAAA

SEQ ID NO: 1013157 - protein, 7 aa, Mycobacterium
HNPATSP

SEQ ID NO: 1013158 - protein, 7 aa, Mycobacterium
HNPDDDS

SEQ ID NO: 1013159 - protein, 7 aa, Mycobacterium
HNPMPDN

SEQ ID NO: 1013160 - protein, 8 aa, Mycobacterium
HNPTGAAH

SEQ ID NO: 1013161 - protein, 8 aa, Mycobacterium
HNPVTDNG

SEQ ID NO: 1013162 - protein, 4 aa, Mycobacterium
HNQA

SEQ ID NO: 1013163 - protein, 6 aa, Mycobacterium
HNQEQP

SEQ ID NO: 1013164 - protein, 12 aa, Mycobacterium
HNRAYSDGDRDG

SEQ ID NO: 1013165 - protein, 6 aa, Mycobacterium
HNTARA

SEQ ID NO: 1013166 - protein, 6 aa, Mycobacterium
HNTPGM

SEQ ID NO: 1013167 - protein, 14 aa, Mycobacterium
HPAALGSAGKAVSP

SEQ ID NO: 1013168 - protein, 8 aa, Mycobacterium
HPAASASD

SEQ ID NO: 1013169 - protein, 8 aa, Mycobacterium
HPADGGGD

SEQ ID NO: 1013170 - protein, 7 aa, Mycobacterium
HPAGSKA

SEQ ID NO: 1013171 - protein, 11 aa, Mycobacterium
HPAIADSEGVV

SEQ ID NO: 1013172 - protein, 9 aa, Mycobacterium
HPAPPGAPT

SEQ ID NO: 1013173 - protein, 15 aa, Mycobacterium
HPAPPPEGTEPILTS

SEQ ID NO: 1013174 - protein, 10 aa, Mycobacterium
HPAPQTYQEA

SEQ ID NO: 1013175 - protein, 12 aa, Mycobacterium
HPAQRGGISGIP

SEQ ID NO: 1013176 - protein, 14 aa, Mycobacterium
HPATDSLTESSSRE

SEQ ID NO: 1013177 - protein, 9 aa, Mycobacterium
HPDARKPKR

SEQ ID NO: 1013178 - protein, 6 aa, Mycobacterium
HPDDER

SEQ ID NO: 1013179 - protein, 5 aa, Mycobacterium
HPDDK

SEQ ID NO: 1013180 - protein, 6 aa, Mycobacterium
HPDDRA

SEQ ID NO: 1013181 - protein, 9 aa, Mycobacterium
HPDDTRLGP

SEQ ID NO: 1013182 - protein, 5 aa, Mycobacterium
HPDGG

SEQ ID NO: 1013183 - protein, 5 aa, Mycobacterium
HPDGT

SEQ ID NO: 1013184 - protein, 4 aa, Mycobacterium
HPDI

SEQ ID NO: 1013185 - protein, 9 aa, Mycobacterium
HPDPLSGGL

SEQ ID NO: 1013186 - protein, 9 aa, Mycobacterium
HPDPLTPGH

SEQ ID NO: 1013187 - protein, 10 aa, Mycobacterium
HPEATAELAG

SEQ ID NO: 1013188 - protein, 11 aa, Mycobacterium
HPEDEAGSFDA

SEQ ID NO: 1013189 - protein, 9 aa, Mycobacterium
HPEGLGPNL

SEQ ID NO: 1013190 - protein, 12 aa, Mycobacterium
HPEHTQEYQKPY

SEQ ID NO: 1013191 - protein, 19 aa, Mycobacterium
HPEKSGDAGAAVLSNWVEN

SEQ ID NO: 1013192 - protein, 4 aa, Mycobacterium
HPEL

SEQ ID NO: 1013193 - protein, 6 aa, Mycobacterium
HPENEQ

SEQ ID NO: 1013194 - protein, 5 aa, Mycobacterium
HPEPE

SEQ ID NO: 1013195 - protein, 12 aa, Mycobacterium
HPEQSKLSPHLQ

SEQ ID NO: 1013196 - protein, 6 aa, Mycobacterium
HPEQST

SEQ ID NO: 1013197 - protein, 21 aa, Mycobacterium
HPETPEYIAPGETSGQPVSYP

SEQ ID NO: 1013198 - protein, 7 aa, Mycobacterium
HPETPGG

SEQ ID NO: 1013199 - protein, 15 aa, Mycobacterium
HPGAGAGDPGQPPSQ

SEQ ID NO: 1013200 - protein, 5 aa, Mycobacterium
HPGAT

SEQ ID NO: 1013201 - protein, 5 aa, Mycobacterium
HPGCP

SEQ ID NO: 1013202 - protein, 7 aa, Mycobacterium
HPGDSPH

SEQ ID NO: 1013203 - protein, 7 aa, Mycobacterium
HPGEPAG

SEQ ID NO: 1013204 - protein, 16 aa, Mycobacterium
HPGEPGGHTTRGAGAD

SEQ ID NO: 1013205 - protein, 4 aa, Mycobacterium
HPGG

SEQ ID NO: 1013206 - protein, 5 aa, Mycobacterium
HPGGG

SEQ ID NO: 1013207 - protein, 8 aa, Mycobacterium
HPGIGTSQ

SEQ ID NO: 1013208 - protein, 15 aa, Mycobacterium
HPGLGPLPKDALGGG

SEQ ID NO: 1013209 - protein, 5 aa, Mycobacterium
HPGLP

SEQ ID NO: 1013210 - protein, 7 aa, Mycobacterium
HPGPATV

SEQ ID NO: 1013211 - protein, 20 aa, Mycobacterium
HPGPDQASSPIDDPSDSLTC

SEQ ID NO: 1013212 - protein, 10 aa, Mycobacterium
HPGSVGKPMQ

SEQ ID NO: 1013213 - protein, 9 aa, Mycobacterium
HPGSVGRGF

SEQ ID NO: 1013214 - protein, 5 aa, Mycobacterium
HPGTF

SEQ ID NO: 1013215 - protein, 5 aa, Mycobacterium
HPGTR

SEQ ID NO: 1013216 - protein, 5 aa, Mycobacterium
HPGVQ

SEQ ID NO: 1013217 - protein, 12 aa, Mycobacterium
HPHAGGGQPGCS

SEQ ID NO: 1013218 - protein, 6 aa, Mycobacterium
HPHGDA

SEQ ID NO: 1013219 - protein, 35 aa, Mycobacterium; identical to SEQ ID NO: 503763

SEQ ID NO: 1013220 - protein, 8 aa, Mycobacterium
HPHPGGTG

SEQ ID NO: 1013221 - protein, 5 aa, Mycobacterium
HPHTG

SEQ ID NO: 1013222 - protein, 6 aa, Mycobacterium
HPITGG

SEQ ID NO: 1013223 - protein, 6 aa, Mycobacterium
HPKTGQ

SEQ ID NO: 1013224 - protein, 9 aa, Mycobacterium
HPKVDGKTG

SEQ ID NO: 1013225 - protein, 4 aa, Mycobacterium
HPLA

SEQ ID NO: 1013226 - protein, 6 aa, Mycobacterium
HPLPTE

SEQ ID NO: 1013227 - protein, 14 aa, Mycobacterium
HPMTGTAQSGWGAG

SEQ ID NO: 1013228 - protein, 4 aa, Mycobacterium
HPNA

SEQ ID NO: 1013229 - protein, 5 aa, Mycobacterium
HPNDD

SEQ ID NO: 1013230 - protein, 14 aa, Mycobacterium
HPNDPLGAGAGLRR

SEQ ID NO: 1013231 - protein, 6 aa, Mycobacterium
HPNGAD

SEQ ID NO: 1013232 - protein, 5 aa, Mycobacterium
HPPAA

SEQ ID NO: 1013233 - protein, 9 aa, Mycobacterium
HPPAGPGVR

SEQ ID NO: 1013234 - protein, 15 aa, Mycobacterium
HPPAPTVRPARTNAE

SEQ ID NO: 1013235 - protein, 8 aa, Mycobacterium
HPPATSVP

SEQ ID NO: 1013236 - protein, 4 aa, Mycobacterium
HPPD

SEQ ID NO: 1013237 - protein, 7 aa, Mycobacterium
HPPDGLD

SEQ ID NO: 1013238 - protein, 6 aa, Mycobacterium
HPPELG

SEQ ID NO: 1013239 - protein, 10 aa, Mycobacterium
HPPKNRSSHQ

SEQ ID NO: 1013240 - protein, 8 aa, Mycobacterium
HPPNPKAT

SEQ ID NO: 1013241 - protein, 4 aa, Mycobacterium
HPPR

SEQ ID NO: 1013242 - protein, 11 aa, Mycobacterium
HPPYGHNGERA

SEQ ID NO: 1013243 - protein, 7 aa, Mycobacterium
HPQPGAE

SEQ ID NO: 1013244 - protein, 6 aa, Mycobacterium
HPQSAT

SEQ ID NO: 1013245 - protein, 4 aa, Mycobacterium
HPRA

SEQ ID NO: 1013246 - protein, 5 aa, Mycobacterium
HPRLG

SEQ ID NO: 1013247 - protein, 4 aa, Mycobacterium
HPRP

SEQ ID NO: 1013248 - protein, 13 aa, Mycobacterium
HPRPALPGAPQRL

SEQ ID NO: 1013249 - protein, 8 aa, Mycobacterium
HPRRDTTM

SEQ ID NO: 1013250 - protein, 5 aa, Mycobacterium
HPRRP

SEQ ID NO: 1013251 - protein, 20 aa, Mycobacterium
HPRSDFPTQHPYPGWPIANP

SEQ ID NO: 1013252 - protein, 4 aa, Mycobacterium
HPSA

SEQ ID NO: 1013253 - protein, 5 aa, Mycobacterium
HPSAT

SEQ ID NO: 1013254 - protein, 6 aa, Mycobacterium
HPSDEI

SEQ ID NO: 1013255 - protein, 12 aa, Mycobacterium
HPSGDGSACATR

SEQ ID NO: 1013256 - protein, 8 aa, Mycobacterium
HPSGVDPP

SEQ ID NO: 1013257 - protein, 4 aa, Mycobacterium
HPSH

SEQ ID NO: 1013258 - protein, 8 aa, Mycobacterium
HPSKNPMR

SEQ ID NO: 1013259 - protein, 5 aa, Mycobacterium
HPSPV

SEQ ID NO: 1013260 - protein, 6 aa, Mycobacterium
HPSPVP

SEQ ID NO: 1013261 - protein, 10 aa, Mycobacterium
HPSQASPLGA

SEQ ID NO: 1013262 - protein, 9 aa, Mycobacterium
HPSSQQRAA

SEQ ID NO: 1013263 - protein, 6 aa, Mycobacterium
HPTDVT

SEQ ID NO: 1013264 - protein, 4 aa, Mycobacterium
HPTE

SEQ ID NO: 1013265 - protein, 5 aa, Mycobacterium
HPTFA

SEQ ID NO: 1013266 - protein, 5 aa, Mycobacterium
HPTLG

SEQ ID NO: 1013267 - protein, 6 aa, Mycobacterium
HPTLGR

SEQ ID NO: 1013268 - protein, 4 aa, Mycobacterium
HPTM

SEQ ID NO: 1013269 - protein, 5 aa, Mycobacterium
HPTPE

SEQ ID NO: 1013270 - protein, 4 aa, Mycobacterium
HPTR

SEQ ID NO: 1013271 - protein, 4 aa, Mycobacterium
HPTV

SEQ ID NO: 1013272 - protein, 8 aa, Mycobacterium
HPVADSPV

SEQ ID NO: 1013273 - protein, 26 aa, Mycobacterium
HPVPGSVAGPASPAPAAADGGAQGPV

SEQ ID NO: 1013274 - protein, 14 aa, Mycobacterium
HPVQPPHSHHGPPV

SEQ ID NO: 1013275 - protein, 7 aa, Mycobacterium
HPVSGGA

SEQ ID NO: 1013276 - protein, 5 aa, Mycobacterium
HPYEE

SEQ ID NO: 1013277 - protein, 6 aa, Mycobacterium
HPYPHK

SEQ ID NO: 1013278 - protein, 5 aa, Mycobacterium
HQAAT

SEQ ID NO: 1013279 - protein, 6 aa, Mycobacterium
HQDDAV

SEQ ID NO: 1013280 - protein, 7 aa, Mycobacterium
HQDGTPD

SEQ ID NO: 1013281 - protein, 6 aa, Mycobacterium
HQDGVT

SEQ ID NO: 1013282 - protein, 10 aa, Mycobacterium
HQDRRPEITS

SEQ ID NO: 1013283 - protein, 8 aa, Mycobacterium
HQDSAGEA

SEQ ID NO: 1013284 - protein, 10 aa, Mycobacterium
HQDSHGGGGL

SEQ ID NO: 1013285 - protein, 4 aa, Mycobacterium
HQEI

SEQ ID NO: 1013286 - protein, 4 aa, Mycobacterium
HQEV

SEQ ID NO: 1013287 - protein, 9 aa, Mycobacterium
HQGESAASF

SEQ ID NO: 1013288 - protein, 11 aa, Mycobacterium
HQGESRAGYNG

SEQ ID NO: 1013289 - protein, 5 aa, Mycobacterium
HQLPE

SEQ ID NO: 1013290 - protein, 8 aa, Mycobacterium
HQLPPRPV

SEQ ID NO: 1013291 - protein, 14 aa, Mycobacterium
HQNGELTSEWAAIS

SEQ ID NO: 1013292 - protein, 30 aa, Mycobacterium; identical to SEQ ID NO: 504132

SEQ ID NO: 1013293 - protein, 27 aa, Mycobacterium
HQNPANIGGQRDGWAPRGVYVNNFVFV

SEQ ID NO: 1013294 - protein, 5 aa, Mycobacterium
HQPAK

SEQ ID NO: 1013295 - protein, 15 aa, Mycobacterium
HQPATPAADQNRGDA

SEQ ID NO: 1013296 - protein, 17 aa, Mycobacterium
HQPDRTQFRQPHPARLP

SEQ ID NO: 1013297 - protein, 5 aa, Mycobacterium
HQPEL

SEQ ID NO: 1013298 - protein, 8 aa, Mycobacterium
HQPGGDAK

SEQ ID NO: 1013299 - protein, 9 aa, Mycobacterium
HQPGTSTNI

SEQ ID NO: 1013300 - protein, 4 aa, Mycobacterium
HQPP

SEQ ID NO: 1013301 - protein, 18 aa, Mycobacterium
HQPTPREDSSAAADRDIE

SEQ ID NO: 1013302 - protein, 6 aa, Mycobacterium
HQQAST

SEQ ID NO: 1013303 - protein, 11 aa, Mycobacterium
HQQPDGSARVP

SEQ ID NO: 1013304 - protein, 11 aa, Mycobacterium
HQQRSAGSPQQ

SEQ ID NO: 1013305 - protein, 12 aa, Mycobacterium
HQRAAAGHLPDP

SEQ ID NO: 1013306 - protein, 9 aa, Mycobacterium
HQRPRRQPN

SEQ ID NO: 1013307 - protein, 7 aa, Mycobacterium
HQRTADE

SEQ ID NO: 1013308 - protein, 7 aa, Mycobacterium
HQSDTQT

SEQ ID NO: 1013309 - protein, 8 aa, Mycobacterium
HQSQPIAS

SEQ ID NO: 1013310 - protein, 4 aa, Mycobacterium
HQTS

SEQ ID NO: 1013311 - protein, 10 aa, Mycobacterium
HQVGDSASID

SEQ ID NO: 1013312 - protein, 5 aa, Mycobacterium
HQVGE

SEQ ID NO: 1013313 - protein, 5 aa, Mycobacterium
HQVRP

SEQ ID NO: 1013314 - protein, 5 aa, Mycobacterium
HQYNP

SEQ ID NO: 1013315 - protein, 4 aa, Mycobacterium
HRAG

SEQ ID NO: 1013316 - protein, 5 aa, Mycobacterium
HRAGA

SEQ ID NO: 1013317 - protein, 7 aa, Mycobacterium
HRAGQDP

SEQ ID NO: 1013318 - protein, 9 aa, Mycobacterium
HRAGSGQPL

SEQ ID NO: 1013319 - protein, 8 aa, Mycobacterium
HRATDDAM

SEQ ID NO: 1013320 - protein, 8 aa, Mycobacterium
HRDAQTTQ

SEQ ID NO: 1013321 - protein, 16 aa, Mycobacterium
HRDEHAQEAGEANRRT

SEQ ID NO: 1013322 - protein, 15 aa, Mycobacterium
HRDEPFGDYGRRASS

SEQ ID NO: 1013323 - protein, 7 aa, Mycobacterium
HRDGQQR

SEQ ID NO: 1013324 - protein, 8 aa, Mycobacterium
HRDKLGGT

SEQ ID NO: 1013325 - protein, 7 aa, Mycobacterium
HRDMDPA

SEQ ID NO: 1013326 - protein, 19 aa, Mycobacterium
HRDPAEYDRPEEFDPDRGP

SEQ ID NO: 1013327 - protein, 11 aa, Mycobacterium
HRDREQARELT

SEQ ID NO: 1013328 - protein, 8 aa, Mycobacterium
HRDRRPGH

SEQ ID NO: 1013329 - protein, 9 aa, Mycobacterium
HRDRTNDQV

SEQ ID NO: 1013330 - protein, 5 aa, Mycobacterium
HRDSG

SEQ ID NO: 1013331 - protein, 8 aa, Mycobacterium
HRDTTRQR

SEQ ID NO: 1013332 - protein, 4 aa, Mycobacterium
HREE

SEQ ID NO: 1013333 - protein, 7 aa, Mycobacterium
HREPGPA

SEQ ID NO: 1013334 - protein, 7 aa, Mycobacterium
HREQGLP

SEQ ID NO: 1013335 - protein, 18 aa, Mycobacterium
HREQSAAATRSPGPTGAA

SEQ ID NO: 1013336 - protein, 4 aa, Mycobacterium
HRGA

SEQ ID NO: 1013337 - protein, 5 aa, Mycobacterium
HRGAA

SEQ ID NO: 1013338 - protein, 12 aa, Mycobacterium
HRGDAATRRLSQ

SEQ ID NO: 1013339 - protein, 5 aa, Mycobacterium
HRGDG

SEQ ID NO: 1013340 - protein, 9 aa, Mycobacterium
HRGRDGGYE

SEQ ID NO: 1013341 - protein, 14 aa, Mycobacterium
HRGRTGAGRACRRP

SEQ ID NO: 1013342 - protein, 9 aa, Mycobacterium
HRGSGAPEG

SEQ ID NO: 1013343 - protein, 6 aa, Mycobacterium
HRGSPV

SEQ ID NO: 1013344 - protein, 8 aa, Mycobacterium
HRGTGARG

SEQ ID NO: 1013345 - protein, 5 aa, Mycobacterium
HRGTV

SEQ ID NO: 1013346 - protein, 9 aa, Mycobacterium
HRHRTGRTA

SEQ ID NO: 1013347 - protein, 5 aa, Mycobacterium
HRKGD

SEQ ID NO: 1013348 - protein, 5 aa, Mycobacterium
HRKPY

SEQ ID NO: 1013349 - protein, 7 aa, Mycobacterium
HRMGDGE

SEQ ID NO: 1013350 - protein, 10 aa, Mycobacterium
HRNTVQTART

SEQ ID NO: 1013351 - protein, 5 aa, Mycobacterium
HRPDH

SEQ ID NO: 1013352 - protein, 14 aa, Mycobacterium
HRPDRRRWWGGGII

SEQ ID NO: 1013353 - protein, 7 aa, Mycobacterium
HRPENAG

SEQ ID NO: 1013354 - protein, 5 aa, Mycobacterium
HRPKQ

SEQ ID NO: 1013355 - protein, 4 aa, Mycobacterium
HRPL

SEQ ID NO: 1013356 - protein, 7 aa, Mycobacterium
HRPLPGR

SEQ ID NO: 1013357 - protein, 6 aa, Mycobacterium
HRPPGQ

SEQ ID NO: 1013358 - protein, 5 aa, Mycobacterium
HRPQV

SEQ ID NO: 1013359 - protein, 5 aa, Mycobacterium
HRQAP

SEQ ID NO: 1013360 - protein, 15 aa, Mycobacterium
HRQKRPARFTDRTEG

SEQ ID NO: 1013361 - protein, 7 aa, Mycobacterium
HRQPRTI

SEQ ID NO: 1013362 - protein, 10 aa, Mycobacterium
HRQQRRRGRF

SEQ ID NO: 1013363 - protein, 9 aa, Mycobacterium
HRQRPATAQ

SEQ ID NO: 1013364 - protein, 6 aa, Mycobacterium
HRQRRD

SEQ ID NO: 1013365 - protein, 12 aa, Mycobacterium
HRRAGGRAAEPL

SEQ ID NO: 1013366 - protein, 4 aa, Mycobacterium
HRRD

SEQ ID NO: 1013367 - protein, 9 aa, Mycobacterium
HRRDDAAAY

SEQ ID NO: 1013368 - protein, 13 aa, Mycobacterium
HRRPGSIGGCATP

SEQ ID NO: 1013369 - protein, 4 aa, Mycobacterium
HRRR

SEQ ID NO: 1013370 - protein, 5 aa, Mycobacterium
HRRTP

SEQ ID NO: 1013371 - protein, 15 aa, Mycobacterium
HRSAPSAKVHRLDTS

SEQ ID NO: 1013372 - protein, 24 aa, Mycobacterium
HRSQRRTLARTAARTSLDTSATSI

SEQ ID NO: 1013373 - protein, 6 aa, Mycobacterium
HRSRQG

SEQ ID NO: 1013374 - protein, 8 aa, Mycobacterium
HRSTEPGH

SEQ ID NO: 1013375 - protein, 24 aa, Mycobacterium
HRSTRGAPATEAGLAASGAPAAEA

SEQ ID NO: 1013376 - protein, 41 aa, Mycobacterium
HRTDPRCPSAPSPPDPPVPPVPPSPTTPPLPPAPPAAPSCP

SEQ ID NO: 1013377 - protein, 17 aa, Mycobacterium
HRTNSGSFAGTDEAKTV

SEQ ID NO: 1013378 - protein, 14 aa, Mycobacterium
HRTPWKADAPPPFD

SEQ ID NO: 1013379 - protein, 8 aa, Mycobacterium
HRTQSGKM

SEQ ID NO: 1013380 - protein, 5 aa, Mycobacterium
HRTTE

SEQ ID NO: 1013381 - protein, 6 aa, Mycobacterium
HRVPGD

SEQ ID NO: 1013382 - protein, 8 aa, Mycobacterium
HRVPPDAQ

SEQ ID NO: 1013383 - protein, 13 aa, Mycobacterium
HSAGQDARQDNHV

SEQ ID NO: 1013384 - protein, 8 aa, Mycobacterium
HSAGSEII

SEQ ID NO: 1013385 - protein, 12 aa, Mycobacterium
HSAPERARERAR

SEQ ID NO: 1013386 - protein, 5 aa, Mycobacterium
HSATD

SEQ ID NO: 1013387 - protein, 6 aa, Mycobacterium
HSATPY

SEQ ID NO: 1013388 - protein, 7 aa, Mycobacterium
HSATSSA

SEQ ID NO: 1013389 - protein, 13 aa, Mycobacterium
HSCPEQAIVITDE

SEQ ID NO: 1013390 - protein, 22 aa, Mycobacterium
HSDNPAAITEDVPARGSPEHYY

SEQ ID NO: 1013391 - protein, 10 aa, Mycobacterium
HSDPKRGEQL

SEQ ID NO: 1013392 - protein, 11 aa, Mycobacterium
HSDRSGEPFEP

SEQ ID NO: 1013393 - protein, 4 aa, Mycobacterium
HSDS

SEQ ID NO: 1013394 - protein, 8 aa, Mycobacterium
HSDVDGGE

SEQ ID NO: 1013395 - protein, 5 aa, Mycobacterium
HSDVE

SEQ ID NO: 1013396 - protein, 6 aa, Mycobacterium
HSDVEQ

SEQ ID NO: 1013397 - protein, 6 aa, Mycobacterium
HSEDHR

SEQ ID NO: 1013398 - protein, 18 aa, Mycobacterium
HSEEAIGRAPAAGPDEVE

SEQ ID NO: 1013399 - protein, 4 aa, Mycobacterium
HSEK

SEQ ID NO: 1013400 - protein, 6 aa, Mycobacterium
HSENAA

SEQ ID NO: 1013401 - protein, 10 aa, Mycobacterium
HSEPDDEPTR

SEQ ID NO: 1013402 - protein, 5 aa, Mycobacterium
HSGAG

SEQ ID NO: 1013403 - protein, 6 aa, Mycobacterium
HSGDPY

SEQ ID NO: 1013404 - protein, 6 aa, Mycobacterium
HSGEEA

SEQ ID NO: 1013405 - protein, 10 aa, Mycobacterium
HSGESGAADH

SEQ ID NO: 1013406 - protein, 11 aa, Mycobacterium
HSGESRDYLPA

SEQ ID NO: 1013407 - protein, 9 aa, Mycobacterium
HSGGPSADE

SEQ ID NO: 1013408 - protein, 54 aa, Mycobacterium; identical to SEQ ID NO: 504806

SEQ ID NO: 1013409 - protein, 7 aa, Mycobacterium
HSGLSDR

SEQ ID NO: 1013410 - protein, 7 aa, Mycobacterium
HSGNDEI

SEQ ID NO: 1013411 - protein, 59 aa, Mycobacterium; identical to SEQ ID NO: 504817

SEQ ID NO: 1013412 - protein, 7 aa, Mycobacterium
HSGPARA

SEQ ID NO: 1013413 - protein, 32 aa, Mycobacterium
HSGQPSTNNHHAPERRRLGSEPMRPMINSRAT

SEQ ID NO: 1013414 - protein, 10 aa, Mycobacterium
HSHRRTSRRW

SEQ ID NO: 1013415 - protein, 9 aa, Mycobacterium
HSKAAAASV

SEQ ID NO: 1013416 - protein, 8 aa, Mycobacterium
HSKHSGTE

SEQ ID NO: 1013417 - protein, 13 aa, Mycobacterium
HSMGTAKPGDFGL

SEQ ID NO: 1013418 - protein, 13 aa, Mycobacterium
HSNAGDNSGGEQE

SEQ ID NO: 1013419 - protein, 6 aa, Mycobacterium
HSNETV

SEQ ID NO: 1013420 - protein, 9 aa, Mycobacterium
HSNGGPPQC

SEQ ID NO: 1013421 - protein, 5 aa, Mycobacterium
HSNGR

SEQ ID NO: 1013422 - protein, 6 aa, Mycobacterium
HSNNPE

SEQ ID NO: 1013423 - protein, 7 aa, Mycobacterium
HSPDDPL

SEQ ID NO: 1013424 - protein, 9 aa, Mycobacterium
HSPDRPPDL

SEQ ID NO: 1013425 - protein, 12 aa, Mycobacterium
HSPGRASAAARE

SEQ ID NO: 1013426 - protein, 5 aa, Mycobacterium
HSPHS

SEQ ID NO: 1013427 - protein, 5 aa, Mycobacterium
HSPLG

SEQ ID NO: 1013428 - protein, 10 aa, Mycobacterium
HSPPLRPKSV

SEQ ID NO: 1013429 - protein, 10 aa, Mycobacterium
HSPVPNGGNV

SEQ ID NO: 1013430 - protein, 6 aa, Mycobacterium
HSQGEV

SEQ ID NO: 1013431 - protein, 5 aa, Mycobacterium
HSRGV

SEQ ID NO: 1013432 - protein, 6 aa, Mycobacterium
HSRSPQ

SEQ ID NO: 1013433 - protein, 30 aa, Mycobacterium
HSSDQSHGRGVGSAPDPGEQRQPGLHPHRA

SEQ ID NO: 1013434 - protein, 4 aa, Mycobacterium
HSSR

SEQ ID NO: 1013435 - protein, 9 aa, Mycobacterium
HSSSHGPPV

SEQ ID NO: 1013436 - protein, 11 aa, Mycobacterium
HSSSSEGDGRL

SEQ ID NO: 1013437 - protein, 11 aa, Mycobacterium
HSSTRESGATV

SEQ ID NO: 1013438 - protein, 9 aa, Mycobacterium
HSTAPEDGT

SEQ ID NO: 1013439 - protein, 15 aa, Mycobacterium
HSTGEEFDASYNRGD

SEQ ID NO: 1013440 - protein, 8 aa, Mycobacterium
HSTGGVGD

SEQ ID NO: 1013441 - protein, 6 aa, Mycobacterium
HSTGNA

SEQ ID NO: 1013442 - protein, 5 aa, Mycobacterium
HSTPG

SEQ ID NO: 1013443 - protein, 33 aa, Mycobacterium
HSTQYRPHPTHPAINTTKDERPARQTPGSPLGS

SEQ ID NO: 1013444 - protein, 5 aa, Mycobacterium
HSVNN

SEQ ID NO: 1013445 - protein, 15 aa, Mycobacterium
HSVPDSADPTAVERG

SEQ ID NO: 1013446 - protein, 8 aa, Mycobacterium
HSYGGRQT

SEQ ID NO: 1013447 - protein, 9 aa, Mycobacterium
HSYRGPSAR

SEQ ID NO: 1013448 - protein, 4 aa, Mycobacterium
HTAA

SEQ ID NO: 1013449 - protein, 10 aa, Mycobacterium
HTAATTDEAV

SEQ ID NO: 1013450 - protein, 7 aa, Mycobacterium
HTAEEAA

SEQ ID NO: 1013451 - protein, 10 aa, Mycobacterium
HTAGSAVSAR

SEQ ID NO: 1013452 - protein, 13 aa, Mycobacterium
HTAGTSSQISDGA

SEQ ID NO: 1013453 - protein, 8 aa, Mycobacterium
HTDEDTPL

SEQ ID NO: 1013454 - protein, 6 aa, Mycobacterium
HTDPSW

SEQ ID NO: 1013455 - protein, 11 aa, Mycobacterium
HTDTRSDGEGL

SEQ ID NO: 1013456 - protein, 12 aa, Mycobacterium
HTEAGPGEPGTV

SEQ ID NO: 1013457 - protein, 5 aa, Mycobacterium
HTEPV

SEQ ID NO: 1013458 - protein, 6 aa, Mycobacterium
HTEYDT

SEQ ID NO: 1013459 - protein, 7 aa, Mycobacterium
HTGAADA

SEQ ID NO: 1013460 - protein, 5 aa, Mycobacterium
HTGDG

SEQ ID NO: 1013461 - protein, 6 aa, Mycobacterium
HTGEST

SEQ ID NO: 1013462 - protein, 10 aa, Mycobacterium
HTGGNSSGIV

SEQ ID NO: 1013463 - protein, 5 aa, Mycobacterium
HTGLT

SEQ ID NO: 1013464 - protein, 14 aa, Mycobacterium
HTGPLRPSETGRPI

SEQ ID NO: 1013465 - protein, 7 aa, Mycobacterium
HTGQRRL

SEQ ID NO: 1013466 - protein, 5 aa, Mycobacterium
HTGRD

SEQ ID NO: 1013467 - protein, 7 aa, Mycobacterium
HTGRRPV

SEQ ID NO: 1013468 - protein, 6 aa, Mycobacterium
HTGSDP

SEQ ID NO: 1013469 - protein, 6 aa, Mycobacterium
HTGSPL

SEQ ID NO: 1013470 - protein, 5 aa, Mycobacterium
HTHGR

SEQ ID NO: 1013471 - protein, 6 aa, Mycobacterium
HTHTSV

SEQ ID NO: 1013472 - protein, 8 aa, Mycobacterium
HTKASAAL

SEQ ID NO: 1013473 - protein, 9 aa, Mycobacterium
HTKKKESEI

SEQ ID NO: 1013474 - protein, 10 aa, Mycobacterium
HTKPESVGQA

SEQ ID NO: 1013475 - protein, 5 aa, Mycobacterium
HTPDA

SEQ ID NO: 1013476 - protein, 4 aa, Mycobacterium
HTPF

SEQ ID NO: 1013477 - protein, 7 aa, Mycobacterium
HTPFTST

SEQ ID NO: 1013478 - protein, 6 aa, Mycobacterium
HTPGGY

SEQ ID NO: 1013479 - protein, 6 aa, Mycobacterium
HTPPAA

SEQ ID NO: 1013480 - protein, 5 aa, Mycobacterium
HTPPG

SEQ ID NO: 1013481 - protein, 8 aa, Mycobacterium
HTPPGYGP

SEQ ID NO: 1013482 - protein, 9 aa, Mycobacterium
HTRAGTSVS

SEQ ID NO: 1013483 - protein, 7 aa, Mycobacterium
HTRDESF

SEQ ID NO: 1013484 - protein, 10 aa, Mycobacterium
HTREEAQEQV

SEQ ID NO: 1013485 - protein, 4 aa, Mycobacterium
HTRG

SEQ ID NO: 1013486 - protein, 11 aa, Mycobacterium
HTRGLSEDEAQ

SEQ ID NO: 1013487 - protein, 6 aa, Mycobacterium
HTRHGG

SEQ ID NO: 1013488 - protein, 7 aa, Mycobacterium
HTRPEDV

SEQ ID NO: 1013489 - protein, 5 aa, Mycobacterium
HTRPT

SEQ ID NO: 1013490 - protein, 7 aa, Mycobacterium
HTSAAEE

SEQ ID NO: 1013491 - protein, 9 aa, Mycobacterium
HTSASGTTI

SEQ ID NO: 1013492 - protein, 6 aa, Mycobacterium
HTSDDP

SEQ ID NO: 1013493 - protein, 6 aa, Mycobacterium
HTSEGW

SEQ ID NO: 1013494 - protein, 5 aa, Mycobacterium
HTSPV

SEQ ID NO: 1013495 - protein, 5 aa, Mycobacterium
HTSRR

SEQ ID NO: 1013496 - protein, 8 aa, Mycobacterium
HTSSGTSA

SEQ ID NO: 1013497 - protein, 9 aa, Mycobacterium
HTSTAGTDA

SEQ ID NO: 1013498 - protein, 9 aa, Mycobacterium
HTSTPEGQV

SEQ ID NO: 1013499 - protein, 5 aa, Mycobacterium
HTSVN

SEQ ID NO: 1013500 - protein, 15 aa, Mycobacterium
HTTADDPGRYRSQEE

SEQ ID NO: 1013501 - protein, 9 aa, Mycobacterium
HTTGEGAVS

SEQ ID NO: 1013502 - protein, 10 aa, Mycobacterium
HTTGTGRAAV

SEQ ID NO: 1013503 - protein, 8 aa, Mycobacterium
HTTNPTPM

SEQ ID NO: 1013504 - protein, 15 aa, Mycobacterium
HTVTATDGKARPPAR

SEQ ID NO: 1013505 - protein, 11 aa, Mycobacterium
HTVTPSPHHPI

SEQ ID NO: 1013506 - protein, 15 aa, Mycobacterium
HTWTPDDAGKRYSTY

SEQ ID NO: 1013507 - protein, 10 aa, Mycobacterium
HVDADTEEAA

SEQ ID NO: 1013508 - protein, 11 aa, Mycobacterium
HVEGGRRRRTR

SEQ ID NO: 1013509 - protein, 12 aa, Mycobacterium
HVEPPPAAPDRP

SEQ ID NO: 1013510 - protein, 8 aa, Mycobacterium
HVNEGQGD

SEQ ID NO: 1013511 - protein, 8 aa, Mycobacterium
HVPTSSGV

SEQ ID NO: 1013512 - protein, 9 aa, Mycobacterium
HVSSDGEPL

SEQ ID NO: 1013513 - protein, 8 aa, Mycobacterium
HVTAGSAV

SEQ ID NO: 1013514 - protein, 16 aa, Mycobacterium
HYEQQEQTSQKILGSD

SEQ ID NO: 1013515 - protein, 12 aa, Mycobacterium
HYGGSTARSGGG

SEQ ID NO: 1013516 - protein, 5 aa, Mycobacterium
HYGPT

SEQ ID NO: 1013517 - protein, 10 aa, Mycobacterium
HYGRANARVQ

SEQ ID NO: 1013518 - protein, 11 aa, Mycobacterium
HYGSPDKDPAV

SEQ ID NO: 1013519 - protein, 5 aa, Mycobacterium
HYPQD

SEQ ID NO: 1013520 - protein, 16 aa, Mycobacterium
HYPQDLEETAEGAHPA

SEQ ID NO: 1013521 - protein, 10 aa, Mycobacterium
HYRPPGDAAA

SEQ ID NO: 1013522 - protein, 31 aa, Mycobacterium
IAADDADRRAHAADAAAKFPANEADAAQQFQ

SEQ ID NO: 1013523 - protein, 14 aa, Mycobacterium
IAADPGANRGAGLS

SEQ ID NO: 1013524 - protein, 17 aa, Mycobacterium
IAAETAGNHADERREQM

SEQ ID NO: 1013525 - protein, 11 aa, Mycobacterium
IAAGAEDDPDV

SEQ ID NO: 1013526 - protein, 8 aa, Mycobacterium
IAAGGGQP

SEQ ID NO: 1013527 - protein, 7 aa, Mycobacterium
IAAGSSE

SEQ ID NO: 1013528 - protein, 19 aa, Mycobacterium
IAAGTARSTGTAGPAVGAG

SEQ ID NO: 1013529 - protein, 7 aa, Mycobacterium
IAATEAE

SEQ ID NO: 1013530 - protein, 6 aa, Mycobacterium
IADDSG

SEQ ID NO: 1013531 - protein, 9 aa, Mycobacterium
IADGQHDDQ

SEQ ID NO: 1013532 - protein, 5 aa, Mycobacterium
IADGT

SEQ ID NO: 1013533 - protein, 8 aa, Mycobacterium
IADKTPEC

SEQ ID NO: 1013534 - protein, 4 aa, Mycobacterium
IADP

SEQ ID NO: 1013535 - protein, 7 aa, Mycobacterium
IADPNDV

SEQ ID NO: 1013536 - protein, 6 aa, Mycobacterium
IADSAG

SEQ ID NO: 1013537 - protein, 7 aa, Mycobacterium
IAEAEGA

SEQ ID NO: 1013538 - protein, 6 aa, Mycobacterium
IAEAGG

SEQ ID NO: 1013539 - protein, 5 aa, Mycobacterium
IAEAT

SEQ ID NO: 1013540 - protein, 11 aa, Mycobacterium
IAEGDVDRARR

SEQ ID NO: 1013541 - protein, 18 aa, Mycobacterium
IAEGKADGARLSTAVKER

SEQ ID NO: 1013542 - protein, 14 aa, Mycobacterium
IAEKDREQSRGGLT

SEQ ID NO: 1013543 - protein, 10 aa, Mycobacterium
IAEPDQGTSF

SEQ ID NO: 1013544 - protein, 8 aa, Mycobacterium
IAEPGTAE

SEQ ID NO: 1013545 - protein, 8 aa, Mycobacterium
IAERGGPV

SEQ ID NO: 1013546 - protein, 11 aa, Mycobacterium
IAESGGPELAD

SEQ ID NO: 1013547 - protein, 11 aa, Mycobacterium
IAGADQPDAPG

SEQ ID NO: 1013548 - protein, 5 aa, Mycobacterium
IAGDS

SEQ ID NO: 1013549 - protein, 8 aa, Mycobacterium
IAGGTVQG

SEQ ID NO: 1013550 - protein, 14 aa, Mycobacterium
IAGNRGQTNYGATK

SEQ ID NO: 1013551 - protein, 10 aa, Mycobacterium
IAGPASPAAN

SEQ ID NO: 1013552 - protein, 13 aa, Mycobacterium
IAGPGGGTEQKPV

SEQ ID NO: 1013553 - protein, 9 aa, Mycobacterium
IAGPKRPQD

SEQ ID NO: 1013554 - protein, 10 aa, Mycobacterium
IAGPNSDGDD

SEQ ID NO: 1013555 - protein, 8 aa, Mycobacterium
IAGPPGAG

SEQ ID NO: 1013556 - protein, 19 aa, Mycobacterium
IAGQPDRLTAGRETRFAET

SEQ ID NO: 1013557 - protein, 5 aa, Mycobacterium
IAGRG

SEQ ID NO: 1013558 - protein, 5 aa, Mycobacterium
IAGRP

SEQ ID NO: 1013559 - protein, 11 aa, Mycobacterium
IAGRSTTAHRN

SEQ ID NO: 1013560 - protein, 4 aa, Mycobacterium
IAKK

SEQ ID NO: 1013561 - protein, 7 aa, Mycobacterium
IANPRER

SEQ ID NO: 1013562 - protein, 9 aa, Mycobacterium
IAPAGPSAV

SEQ ID NO: 1013563 - protein, 5 aa, Mycobacterium
IAPAK

SEQ ID NO: 1013564 - protein, 5 aa, Mycobacterium
IAPDE

SEQ ID NO: 1013565 - protein, 6 aa, Mycobacterium
IAPGAA

SEQ ID NO: 1013566 - protein, 10 aa, Mycobacterium
IAPGNRQPLP

SEQ ID NO: 1013567 - protein, 7 aa, Mycobacterium
IAPGPTI

SEQ ID NO: 1013568 - protein, 4 aa, Mycobacterium
IAPH

SEQ ID NO: 1013569 - protein, 9 aa, Mycobacterium
IAPPDPDGK

SEQ ID NO: 1013570 - protein, 12 aa, Mycobacterium
IAPPFNATQPMP

SEQ ID NO: 1013571 - protein, 8 aa, Mycobacterium
IAPQSTST

SEQ ID NO: 1013572 - protein, 4 aa, Mycobacterium
IAPT

SEQ ID NO: 1013573 - protein, 5 aa, Mycobacterium
IAQNA

SEQ ID NO: 1013574 - protein, 11 aa, Mycobacterium
IAQPKAGATTA

SEQ ID NO: 1013575 - protein, 10 aa, Mycobacterium
IAQSRAAGDG

SEQ ID NO: 1013576 - protein, 14 aa, Mycobacterium
IARGNAEGRPRNKF

SEQ ID NO: 1013577 - protein, 8 aa, Mycobacterium
IASAATYH

SEQ ID NO: 1013578 - protein, 6 aa, Mycobacterium
IASAKA

SEQ ID NO: 1013579 - protein, 9 aa, Mycobacterium
IASGPGQLQ

SEQ ID NO: 1013580 - protein, 6 aa, Mycobacterium
IASPGT

SEQ ID NO: 1013581 - protein, 14 aa, Mycobacterium
IASPPPEPLVSPEG

SEQ ID NO: 1013582 - protein, 11 aa, Mycobacterium
IASRPQGYTKK

SEQ ID NO: 1013583 - protein, 6 aa, Mycobacterium
IASTGG

SEQ ID NO: 1013584 - protein, 9 aa, Mycobacterium
IATAEPTAT

SEQ ID NO: 1013585 - protein, 14 aa, Mycobacterium
IATASHPDAGPDQH

SEQ ID NO: 1013586 - protein, 8 aa, Mycobacterium
IATDGELA

SEQ ID NO: 1013587 - protein, 8 aa, Mycobacterium
IATDPRAQ

SEQ ID NO: 1013588 - protein, 10 aa, Mycobacterium
IATETGNPVT

SEQ ID NO: 1013589 - protein, 15 aa, Mycobacterium
IATGPNPQPNEPSLT

SEQ ID NO: 1013590 - protein, 8 aa, Mycobacterium
IATNADNP

SEQ ID NO: 1013591 - protein, 9 aa, Mycobacterium
IDADSGEAL

SEQ ID NO: 1013592 - protein, 8 aa, Mycobacterium
IDAGPTNN

SEQ ID NO: 1013593 - protein, 4 aa, Mycobacterium
IDAP

SEQ ID NO: 1013594 - protein, 17 aa, Mycobacterium
IDAPTAARLGKPYPQEF

SEQ ID NO: 1013595 - protein, 5 aa, Mycobacterium
IDASS

SEQ ID NO: 1013596 - protein, 7 aa, Mycobacterium
IDATDAR

SEQ ID NO: 1013597 - protein, 10 aa, Mycobacterium
IDATRPDGTP

SEQ ID NO: 1013598 - protein, 6 aa, Mycobacterium
IDDDER

SEQ ID NO: 1013599 - protein, 5 aa, Mycobacterium
IDDEG

SEQ ID NO: 1013600 - protein, 9 aa, Mycobacterium
IDDPAASPL

SEQ ID NO: 1013601 - protein, 7 aa, Mycobacterium
IDDPKLS

SEQ ID NO: 1013602 - protein, 6 aa, Mycobacterium
IDDPRD

SEQ ID NO: 1013603 - protein, 4 aa, Mycobacterium
IDDS

SEQ ID NO: 1013604 - protein, 6 aa, Mycobacterium
IDDTRP

SEQ ID NO: 1013605 - protein, 19 aa, Mycobacterium
IDDVERGSQDSDWDPVKAA

SEQ ID NO: 1013606 - protein, 4 aa, Mycobacterium
IDEA

SEQ ID NO: 1013607 - protein, 15 aa, Mycobacterium
IDEASGAASDGFAPN

SEQ ID NO: 1013608 - protein, 4 aa, Mycobacterium
IDEE

SEQ ID NO: 1013609 - protein, 11 aa, Mycobacterium
IDEGSIPGPRI

SEQ ID NO: 1013610 - protein, 5 aa, Mycobacterium
IDEQG

SEQ ID NO: 1013611 - protein, 20 aa, Mycobacterium
IDESDESDKAENGARPSATA

SEQ ID NO: 1013612 - protein, 22 aa, Mycobacterium
IDETEDPQKGGQNSRPSETADG

SEQ ID NO: 1013613 - protein, 22 aa, Mycobacterium
IDETEDPQKGGQNSRPSETAEG

SEQ ID NO: 1013614 - protein, 9 aa, Mycobacterium
IDGADPAAE

SEQ ID NO: 1013615 - protein, 8 aa, Mycobacterium
IDGAQSYR

SEQ ID NO: 1013616 - protein, 8 aa, Mycobacterium
IDGEKLDD

SEQ ID NO: 1013617 - protein, 8 aa, Mycobacterium
IDGEPLSD

SEQ ID NO: 1013618 - protein, 7 aa, Mycobacterium
IDGGGHS

SEQ ID NO: 1013619 - protein, 14 aa, Mycobacterium
IDGGLSDPHNGGRS

SEQ ID NO: 1013620 - protein, 16 aa, Mycobacterium
IDGKEAEISGSGNGPL

SEQ ID NO: 1013621 - protein, 14 aa, Mycobacterium
IDGKPFSGESLAGK

SEQ ID NO: 1013622 - protein, 8 aa, Mycobacterium
IDGPARRA

SEQ ID NO: 1013623 - protein, 8 aa, Mycobacterium
IDGPRDAQ

SEQ ID NO: 1013624 - protein, 8 aa, Mycobacterium
IDGPRPEQ

SEQ ID NO: 1013625 - protein, 9 aa, Mycobacterium
IDGSLAPTL

SEQ ID NO: 1013626 - protein, 14 aa, Mycobacterium
IDGSSSAISETVPA

SEQ ID NO: 1013627 - protein, 9 aa, Mycobacterium
IDHKATAEQ

SEQ ID NO: 1013628 - protein, 12 aa, Mycobacterium
IDKEGADPAKIR

SEQ ID NO: 1013629 - protein, 7 aa, Mycobacterium
IDKSTDK

SEQ ID NO: 1013630 - protein, 6 aa, Mycobacterium
IDNGRE

SEQ ID NO: 1013631 - protein, 11 aa, Mycobacterium
IDPADAAAIGE

SEQ ID NO: 1013632 - protein, 9 aa, Mycobacterium
IDPADEQAV

SEQ ID NO: 1013633 - protein, 9 aa, Mycobacterium
IDPAHTRSR

SEQ ID NO: 1013634 - protein, 9 aa, Mycobacterium
IDPAREPIP

SEQ ID NO: 1013635 - protein, 17 aa, Mycobacterium
IDPATGQATKLAGPGWT

SEQ ID NO: 1013636 - protein, 4 aa, Mycobacterium
IDPD

SEQ ID NO: 1013637 - protein, 7 aa, Mycobacterium
IDPDETS

SEQ ID NO: 1013638 - protein, 10 aa, Mycobacterium
IDPDGANGGP

SEQ ID NO: 1013639 - protein, 8 aa, Mycobacterium
IDPDGSTL

SEQ ID NO: 1013640 - protein, 13 aa, Mycobacterium
IDPDNAADYQANA

SEQ ID NO: 1013641 - protein, 6 aa, Mycobacterium
IDPDRA

SEQ ID NO: 1013642 - protein, 4 aa, Mycobacterium
IDPE

SEQ ID NO: 1013643 - protein, 8 aa, Mycobacterium
IDPEETSE

SEQ ID NO: 1013644 - protein, 6 aa, Mycobacterium
IDPEPD

SEQ ID NO: 1013645 - protein, 9 aa, Mycobacterium
IDPERTADK

SEQ ID NO: 1013646 - protein, 7 aa, Mycobacterium
IDPGGAQ

SEQ ID NO: 1013647 - protein, 6 aa, Mycobacterium
IDPGKV

SEQ ID NO: 1013648 - protein, 7 aa, Mycobacterium
IDPGPHA

SEQ ID NO: 1013649 - protein, 7 aa, Mycobacterium
IDPGPTL

SEQ ID NO: 1013650 - protein, 7 aa, Mycobacterium
IDPGQRY

SEQ ID NO: 1013651 - protein, 13 aa, Mycobacterium
IDPGSGGAGAVHG

SEQ ID NO: 1013652 - protein, 15 aa, Mycobacterium
IDPLGTKVSAGGMPD

SEQ ID NO: 1013653 - protein, 9 aa, Mycobacterium
IDPPPSIQA

SEQ ID NO: 1013654 - protein, 5 aa, Mycobacterium
IDPQR

SEQ ID NO: 1013655 - protein, 6 aa, Mycobacterium
IDPQRD

SEQ ID NO: 1013656 - protein, 7 aa, Mycobacterium
IDPRDTR

SEQ ID NO: 1013657 - protein, 11 aa, Mycobacterium
IDPTDKRGQWE

SEQ ID NO: 1013658 - protein, 7 aa, Mycobacterium
IDPTMPS

SEQ ID NO: 1013659 - protein, 28 aa, Mycobacterium
IDQAEEELAERATPTTIPRRPRSSDDVG

SEQ ID NO: 1013660 - protein, 15 aa, Mycobacterium
IDQKSTNRNPRSTVG

SEQ ID NO: 1013661 - protein, 4 aa, Mycobacterium
IDRA

SEQ ID NO: 1013662 - protein, 4 aa, Mycobacterium
IDRN

SEQ ID NO: 1013663 - protein, 12 aa, Mycobacterium
IDRSDSEWDREK

SEQ ID NO: 1013664 - protein, 11 aa, Mycobacterium
IDRSPGEPRPL

SEQ ID NO: 1013665 - protein, 5 aa, Mycobacterium
IDRSQ

SEQ ID NO: 1013666 - protein, 9 aa, Mycobacterium
IDSAGTDNA

SEQ ID NO: 1013667 - protein, 8 aa, Mycobacterium
IDSARGDA

SEQ ID NO: 1013668 - protein, 19 aa, Mycobacterium
IDSASAPNIPDGAGDPVQT

SEQ ID NO: 1013669 - protein, 6 aa, Mycobacterium
IDSEPS

SEQ ID NO: 1013670 - protein, 6 aa, Mycobacterium
IDSGGE

SEQ ID NO: 1013671 - protein, 15 aa, Mycobacterium
IDSGSGSEDDDARAI

SEQ ID NO: 1013672 - protein, 12 aa, Mycobacterium
IDSGYGTRLIPT

SEQ ID NO: 1013673 - protein, 13 aa, Mycobacterium
IDSRPSPQGSGVV

SEQ ID NO: 1013674 - protein, 17 aa, Mycobacterium
IDTEGRCTEARSDLDSA

SEQ ID NO: 1013675 - protein, 8 aa, Mycobacterium
IDTGDAPL

SEQ ID NO: 1013676 - protein, 6 aa, Mycobacterium
IDTGDK

SEQ ID NO: 1013677 - protein, 5 aa, Mycobacterium
IDTGP

SEQ ID NO: 1013678 - protein, 4 aa, Mycobacterium
IDTP

SEQ ID NO: 1013679 - protein, 13 aa, Mycobacterium
IDTPDEMSPYAPR

SEQ ID NO: 1013680 - protein, 6 aa, Mycobacterium
IDTPEA

SEQ ID NO: 1013681 - protein, 5 aa, Mycobacterium
IDTQA

SEQ ID NO: 1013682 - protein, 9 aa, Mycobacterium
IDTTAAATI

SEQ ID NO: 1013683 - protein, 12 aa, Mycobacterium
IDTTQPDGRAAQ

SEQ ID NO: 1013684 - protein, 6 aa, Mycobacterium
IDTVPT

SEQ ID NO: 1013685 - protein, 7 aa, Mycobacterium
IDVTPTG

SEQ ID NO: 1013686 - protein, 12 aa, Mycobacterium
IDYESAEAGFQS

SEQ ID NO: 1013687 - protein, 7 aa, Mycobacterium
IEAADDG

SEQ ID NO: 1013688 - protein, 15 aa, Mycobacterium
IEAAEGAAAATAGLA

SEQ ID NO: 1013689 - protein, 8 aa, Mycobacterium
IEADPANP

SEQ ID NO: 1013690 - protein, 8 aa, Mycobacterium
IEADSDRD

SEQ ID NO: 1013691 - protein, 13 aa, Mycobacterium
IEAEPADGAGEQV

SEQ ID NO: 1013692 - protein, 10 aa, Mycobacterium
IEAQPGGPHS

SEQ ID NO: 1013693 - protein, 5 aa, Mycobacterium
IEATA

SEQ ID NO: 1013694 - protein, 12 aa, Mycobacterium
IEATAAAAAAEL

SEQ ID NO: 1013695 - protein, 16 aa, Mycobacterium
IECSTGSACTAGVAQP

SEQ ID NO: 1013696 - protein, 8 aa, Mycobacterium
IEDADEDS

SEQ ID NO: 1013697 - protein, 10 aa, Mycobacterium
IEDAQSSEAL

SEQ ID NO: 1013698 - protein, 9 aa, Mycobacterium
IEDRPQNHD

SEQ ID NO: 1013699 - protein, 6 aa, Mycobacterium
IEDSRT

SEQ ID NO: 1013700 - protein, 9 aa, Mycobacterium
IEDSSKEPE

SEQ ID NO: 1013701 - protein, 4 aa, Mycobacterium
IEEG

SEQ ID NO: 1013702 - protein, 5 aa, Mycobacterium
IEERA

SEQ ID NO: 1013703 - protein, 4 aa, Mycobacterium
IEES

SEQ ID NO: 1013704 - protein, 10 aa, Mycobacterium
IEESRGERDA

SEQ ID NO: 1013705 - protein, 4 aa, Mycobacterium
IEEV

SEQ ID NO: 1013706 - protein, 10 aa, Mycobacterium
IEGAGSPTMT

SEQ ID NO: 1013707 - protein, 22 aa, Mycobacterium
IEGIRSSSSNPPLTLPEDPREI

SEQ ID NO: 1013708 - protein, 10 aa, Mycobacterium
IEGVADPSNL

SEQ ID NO: 1013709 - protein, 14 aa, Mycobacterium
IEIPTSRRSIDSRR

SEQ ID NO: 1013710 - protein, 14 aa, Mycobacterium
IEKEDESFCPPGSI

SEQ ID NO: 1013711 - protein, 7 aa, Mycobacterium
IELPPGT

SEQ ID NO: 1013712 - protein, 11 aa, Mycobacterium
IELSSSQSTSI

SEQ ID NO: 1013713 - protein, 13 aa, Mycobacterium
IENSDSDYDREKL

SEQ ID NO: 1013714 - protein, 6 aa, Mycobacterium
IEPARD

SEQ ID NO: 1013715 - protein, 5 aa, Mycobacterium
IEPGS

SEQ ID NO: 1013716 - protein, 8 aa, Mycobacterium
IEPLPPKR

SEQ ID NO: 1013717 - protein, 7 aa, Mycobacterium
IEPNSLG

SEQ ID NO: 1013718 - protein, 12 aa, Mycobacterium
IEPPGGEISRTV

SEQ ID NO: 1013719 - protein, 4 aa, Mycobacterium
IEPQ

SEQ ID NO: 1013720 - protein, 6 aa, Mycobacterium
IEPRTG

SEQ ID NO: 1013721 - protein, 9 aa, Mycobacterium
IEPTDLPRG

SEQ ID NO: 1013722 - protein, 7 aa, Mycobacterium
IEPTKGR

SEQ ID NO: 1013723 - protein, 8 aa, Mycobacterium
IEPTLPTA

SEQ ID NO: 1013724 - protein, 8 aa, Mycobacterium
IEPTNREP

SEQ ID NO: 1013725 - protein, 4 aa, Mycobacterium
IEQA

SEQ ID NO: 1013726 - protein, 6 aa, Mycobacterium
IEQGDE

SEQ ID NO: 1013727 - protein, 9 aa, Mycobacterium
IEQQTADAA

SEQ ID NO: 1013728 - protein, 7 aa, Mycobacterium
IEQTSAH

SEQ ID NO: 1013729 - protein, 15 aa, Mycobacterium
IEQVGSPTEVYDAPT

SEQ ID NO: 1013730 - protein, 5 aa, Mycobacterium
IERAA

SEQ ID NO: 1013731 - protein, 7 aa, Mycobacterium
IERGGKQ

SEQ ID NO: 1013732 - protein, 4 aa, Mycobacterium
IERQ

SEQ ID NO: 1013733 - protein, 21 aa, Mycobacterium
IERQGPDGSSERVRYWCPACQ

SEQ ID NO: 1013734 - protein, 9 aa, Mycobacterium
IERRTEDWS

SEQ ID NO: 1013735 - protein, 7 aa, Mycobacterium
IERSGRS

SEQ ID NO: 1013736 - protein, 8 aa, Mycobacterium
IERYGSSE

SEQ ID NO: 1013737 - protein, 16 aa, Mycobacterium
IESDDGQVLSSRTNAR

SEQ ID NO: 1013738 - protein, 7 aa, Mycobacterium
IESEKHR

SEQ ID NO: 1013739 - protein, 6 aa, Mycobacterium
IETAED

SEQ ID NO: 1013740 - protein, 9 aa, Mycobacterium
IETHDESSF

SEQ ID NO: 1013741 - protein, 8 aa, Mycobacterium
IETPPAMP

SEQ ID NO: 1013742 - protein, 18 aa, Mycobacterium
IEVTDTADGPQWLLGGDG

SEQ ID NO: 1013743 - protein, 13 aa, Mycobacterium
IGADGDAQSYAEP

SEQ ID NO: 1013744 - protein, 6 aa, Mycobacterium
IGADPA

SEQ ID NO: 1013745 - protein, 6 aa, Mycobacterium
IGAERD

SEQ ID NO: 1013746 - protein, 10 aa, Mycobacterium
IGAGQNGLAD

SEQ ID NO: 1013747 - protein, 19 aa, Mycobacterium
IGAPDSSAHAAATDGRVGA

SEQ ID NO: 1013748 - protein, 12 aa, Mycobacterium
IGAPYSEPGAVA

SEQ ID NO: 1013749 - protein, 8 aa, Mycobacterium
IGARRGAL

SEQ ID NO: 1013750 - protein, 12 aa, Mycobacterium
IGASKKDGQRAK

SEQ ID NO: 1013751 - protein, 8 aa, Mycobacterium
IGATGPRR

SEQ ID NO: 1013752 - protein, 7 aa, Mycobacterium
IGATTEA

SEQ ID NO: 1013753 - protein, 11 aa, Mycobacterium
IGDDGERQAAE

SEQ ID NO: 1013754 - protein, 9 aa, Mycobacterium
IGDDQEVPD

SEQ ID NO: 1013755 - protein, 31 aa, Mycobacterium
IGDGGAGGAGGNGGDGTGAGGLGGNGASADW

SEQ ID NO: 1013756 - protein, 30 aa, Mycobacterium
IGDGGDGGRGAPGGAGGMGGSLFGQDGSNG

SEQ ID NO: 1013757 - protein, 33 aa, Mycobacterium
IGDGGDGGRGDSGGTGGAGGTGGSLAGHDGSDG

SEQ ID NO: 1013758 - protein, 35 aa, Mycobacterium
IGDGGNGGAGGSGTPDGSGGAGGTAGRLAGAAGTH

SEQ ID NO: 1013759 - protein, 28 aa, Mycobacterium
IGDGGSGGAGGDGGSGDAGDGGAGGDAR

SEQ ID NO: 1013760 - protein, 27 aa, Mycobacterium
IGDGGTGGNGGLLSGDGGAGGVGGTGG

SEQ ID NO: 1013761 - protein, 30 aa, Mycobacterium
IGDGRYSNDPTNPLGTHNPDGGDCGTVAVR

SEQ ID NO: 1013762 - protein, 16 aa, Mycobacterium
IGDNNGLTANAPGLGA

SEQ ID NO: 1013763 - protein, 11 aa, Mycobacterium
IGDNTRPDAIR

SEQ ID NO: 1013764 - protein, 5 aa, Mycobacterium
IGEAE

SEQ ID NO: 1013765 - protein, 9 aa, Mycobacterium
IGEPGNAGT

SEQ ID NO: 1013766 - protein, 7 aa, Mycobacterium
IGEQTQH

SEQ ID NO: 1013767 - protein, 4 aa, Mycobacterium
IGER

SEQ ID NO: 1013768 - protein, 6 aa, Mycobacterium
IGETEQ

SEQ ID NO: 1013769 - protein, 26 aa, Mycobacterium
IGGAGGAGGTGATAGGDGGVGGEGSG

SEQ ID NO: 1013770 - protein, 6 aa, Mycobacterium
IGGASD

SEQ ID NO: 1013771 - protein, 6 aa, Mycobacterium
IGGDDA

SEQ ID NO: 1013772 - protein, 5 aa, Mycobacterium
IGGDG

SEQ ID NO: 1013773 - protein, 8 aa, Mycobacterium
IGGDRPPF

SEQ ID NO: 1013774 - protein, 11 aa, Mycobacterium
IGGDTSGIDEA

SEQ ID NO: 1013775 - protein, 8 aa, Mycobacterium
IGGESRAK

SEQ ID NO: 1013776 - protein, 5 aa, Mycobacterium
IGGGF

SEQ ID NO: 1013777 - protein, 26 aa, Mycobacterium
IGGGGAGGAGGEGATTGGDGGAGGTG

SEQ ID NO: 1013778 - protein, 6 aa, Mycobacterium
IGGGGI

SEQ ID NO: 1013779 - protein, 8 aa, Mycobacterium
IGGGPTEM

SEQ ID NO: 1013780 - protein, 5 aa, Mycobacterium
IGGNA

SEQ ID NO: 1013781 - protein, 4 aa, Mycobacterium
IGGP

SEQ ID NO: 1013782 - protein, 7 aa, Mycobacterium
IGGPATD

SEQ ID NO: 1013783 - protein, 6 aa, Mycobacterium
IGGPAV

SEQ ID NO: 1013784 - protein, 45 aa, Mycobacterium
IGGPTPASPEPPAAPPEPTAPAEPPQPPEAAAQPPQAVEEQPHAT

SEQ ID NO: 1013785 - protein, 5 aa, Mycobacterium
IGGQE

SEQ ID NO: 1013786 - protein, 6 aa, Mycobacterium
IGGQED

SEQ ID NO: 1013787 - protein, 6 aa, Mycobacterium
IGGQET

SEQ ID NO: 1013788 - protein, 9 aa, Mycobacterium
IGGSDGSGG

SEQ ID NO: 1013789 - protein, 16 aa, Mycobacterium
IGGSSQNFTVGPPALN

SEQ ID NO: 1013790 - protein, 7 aa, Mycobacterium
IGGTNNK

SEQ ID NO: 1013791 - protein, 5 aa, Mycobacterium
IGGYE

SEQ ID NO: 1013792 - protein, 4 aa, Mycobacterium
IGHP

SEQ ID NO: 1013793 - protein, 5 aa, Mycobacterium
IGHTG

SEQ ID NO: 1013794 - protein, 9 aa, Mycobacterium
IGINDGSAA

SEQ ID NO: 1013795 - protein, 6 aa, Mycobacterium
IGLGSS

SEQ ID NO: 1013796 - protein, 5 aa, Mycobacterium
IGLPD

SEQ ID NO: 1013797 - protein, 11 aa, Mycobacterium
IGLPGKGASAY

SEQ ID NO: 1013798 - protein, 14 aa, Mycobacterium
IGLTPKTEKAILDA

SEQ ID NO: 1013799 - protein, 48 aa, Mycobacterium
IGNAGDFNTGTFNAGDANTGNANSGSYNTGGFNSGNYDTGWANTGDVD

SEQ ID NO: 1013800 - protein, 11 aa, Mycobacterium
IGNDLSTPVPE

SEQ ID NO: 1013801 - protein, 8 aa, Mycobacterium
IGNGDGRL

SEQ ID NO: 1013802 - protein, 23 aa, Mycobacterium
IGNGGAGGAGGAAAAGGSGGQGG

SEQ ID NO: 1013803 - protein, 26 aa, Mycobacterium
IGNGGAGGAGGAGATGGAGGTGGAGG

SEQ ID NO: 1013804 - protein, 29 aa, Mycobacterium
IGNGGAGGAGGAPGPNGGFSGGNGGNGGD

SEQ ID NO: 1013805 - protein, 27 aa, Mycobacterium
IGNGGAGGAGGASTSGVGGAGGAGGAG

SEQ ID NO: 1013806 - protein, 14 aa, Mycobacterium
IGNGGAGGAGGQGL

SEQ ID NO: 1013807 - protein, 22 aa, Mycobacterium
IGNGGAGGDGGGVSGNGGNGGN

SEQ ID NO: 1013808 - protein, 21 aa, Mycobacterium
IGNGGAGGGGGARAAGGYGGH

SEQ ID NO: 1013809 - protein, 13 aa, Mycobacterium
IGNGGAGGNGGAG

SEQ ID NO: 1013810 - protein, 23 aa, Mycobacterium
IGNGGAGGSGWAGGAGGAGGNGG

SEQ ID NO: 1013811 - protein, 11 aa, Mycobacterium
IGNGGAGGTGG

SEQ ID NO: 1013812 - protein, 27 aa, Mycobacterium
IGNGGDGGAAGTSVGQSASGGNGGNAR

SEQ ID NO: 1013813 - protein, 28 aa, Mycobacterium
IGNGGNGGAGGAGSNGLAGGSGGAGGSA

SEQ ID NO: 1013814 - protein, 26 aa, Mycobacterium
IGNGGNGGIGGPGTTGMSGGAGGAGG

SEQ ID NO: 1013815 - protein, 33 aa, Mycobacterium; identical to SEQ ID NO: 507266

SEQ ID NO: 1013816 - protein, 35 aa, Mycobacterium
IGNGGSGGAGGADFAGTSGGMGGATGGDGGQGGNA

SEQ ID NO: 1013817 - protein, 57 aa, Mycobacterium
IGNGGSGGAGGSGGLGAHAGAGGNGGSLYGNDGSGGAGGTGASGAGGNGGGGGAAGM

SEQ ID NO: 1013818 - protein, 7 aa, Mycobacterium
IGNGVGD

SEQ ID NO: 1013819 - protein, 5 aa, Mycobacterium
IGNNQ

SEQ ID NO: 1013820 - protein, 6 aa, Mycobacterium
IGNRGD

SEQ ID NO: 1013821 - protein, 20 aa, Mycobacterium
IGNSGNYNTGVGNTGAANTG

SEQ ID NO: 1013822 - protein, 18 aa, Mycobacterium
IGNSGTANSGIANSGSTN

SEQ ID NO: 1013823 - protein, 8 aa, Mycobacterium
IGNSGTNN

SEQ ID NO: 1013824 - protein, 7 aa, Mycobacterium
IGNTTPA

SEQ ID NO: 1013825 - protein, 6 aa, Mycobacterium
IGPAAP

SEQ ID NO: 1013826 - protein, 4 aa, Mycobacterium
IGPD

SEQ ID NO: 1013827 - protein, 5 aa, Mycobacterium
IGPDQ

SEQ ID NO: 1013828 - protein, 7 aa, Mycobacterium
IGPDTDI

SEQ ID NO: 1013829 - protein, 7 aa, Mycobacterium
IGPDTTL

SEQ ID NO: 1013830 - protein, 8 aa, Mycobacterium
IGPEPGSA

SEQ ID NO: 1013831 - protein, 4 aa, Mycobacterium
IGPG

SEQ ID NO: 1013832 - protein, 10 aa, Mycobacterium
IGPGAQPGTI

SEQ ID NO: 1013833 - protein, 10 aa, Mycobacterium
IGPGKGNAMG

SEQ ID NO: 1013834 - protein, 5 aa, Mycobacterium
IGPGL

SEQ ID NO: 1013835 - protein, 6 aa, Mycobacterium
IGPGSV

SEQ ID NO: 1013836 - protein, 5 aa, Mycobacterium
IGPIS

SEQ ID NO: 1013837 - protein, 5 aa, Mycobacterium
IGPKG

SEQ ID NO: 1013838 - protein, 13 aa, Mycobacterium
IGPMTSARTGIPT

SEQ ID NO: 1013839 - protein, 5 aa, Mycobacterium
IGPPI

SEQ ID NO: 1013840 - protein, 15 aa, Mycobacterium
IGPPRQLPADSPEGQ

SEQ ID NO: 1013841 - protein, 5 aa, Mycobacterium
IGPRA

SEQ ID NO: 1013842 - protein, 17 aa, Mycobacterium
IGPSAFDPEGKGHRGRA

SEQ ID NO: 1013843 - protein, 10 aa, Mycobacterium
IGPSGSGKST

SEQ ID NO: 1013844 - protein, 26 aa, Mycobacterium
IGPSPPSPAGPTGSRSPVNRPTPWTS

SEQ ID NO: 1013845 - protein, 9 aa, Mycobacterium
IGPTAQPNI

SEQ ID NO: 1013846 - protein, 10 aa, Mycobacterium
IGQNRPGPRG

SEQ ID NO: 1013847 - protein, 4 aa, Mycobacterium
IGQQ

SEQ ID NO: 1013848 - protein, 5 aa, Mycobacterium
IGQTP

SEQ ID NO: 1013849 - protein, 6 aa, Mycobacterium
IGRATD

SEQ ID NO: 1013850 - protein, 8 aa, Mycobacterium
IGRDPKEI

SEQ ID NO: 1013851 - protein, 9 aa, Mycobacterium
IGREATEPM

SEQ ID NO: 1013852 - protein, 7 aa, Mycobacterium
IGREGDG

SEQ ID NO: 1013853 - protein, 4 aa, Mycobacterium
IGRG

SEQ ID NO: 1013854 - protein, 5 aa, Mycobacterium
IGRGA

SEQ ID NO: 1013855 - protein, 6 aa, Mycobacterium
IGRGEH

SEQ ID NO: 1013856 - protein, 9 aa, Mycobacterium
IGRKPRGSY

SEQ ID NO: 1013857 - protein, 11 aa, Mycobacterium
IGRKTGQARRV

SEQ ID NO: 1013858 - protein, 16 aa, Mycobacterium
IGRPARQRTTTYASLA

SEQ ID NO: 1013859 - protein, 12 aa, Mycobacterium
IGRPASGDRTRD

SEQ ID NO: 1013860 - protein, 5 aa, Mycobacterium
IGRPR

SEQ ID NO: 1013861 - protein, 10 aa, Mycobacterium
IGRRSPDGRE

SEQ ID NO: 1013862 - protein, 15 aa, Mycobacterium
IGRSAPAIAGHQADS

SEQ ID NO: 1013863 - protein, 4 aa, Mycobacterium
IGRT

SEQ ID NO: 1013864 - protein, 4 aa, Mycobacterium
IGSA

SEQ ID NO: 1013865 - protein, 9 aa, Mycobacterium
IGSADDHTG

SEQ ID NO: 1013866 - protein, 5 aa, Mycobacterium
IGSDA

SEQ ID NO: 1013867 - protein, 10 aa, Mycobacterium
IGSDGAGSIR

SEQ ID NO: 1013868 - protein, 11 aa, Mycobacterium
IGSDPDPRALQ

SEQ ID NO: 1013869 - protein, 13 aa, Mycobacterium
IGSDTGGSIRQPA

SEQ ID NO: 1013870 - protein, 7 aa, Mycobacterium
IGSESDR

SEQ ID NO: 1013871 - protein, 11 aa, Mycobacterium
IGSGAERVNPA

SEQ ID NO: 1013872 - protein, 49 aa, Mycobacterium; identical to SEQ ID NO: 507510

SEQ ID NO: 1013873 - protein, 21 aa, Mycobacterium
IGSGGSGGTGGLGAAGGAGGS

SEQ ID NO: 1013874 - protein, 10 aa, Mycobacterium
IGSGLSSSAA

SEQ ID NO: 1013875 - protein, 8 aa, Mycobacterium
IGSGSTAT

SEQ ID NO: 1013876 - protein, 7 aa, Mycobacterium
IGSGTVP

SEQ ID NO: 1013877 - protein, 10 aa, Mycobacterium
IGSKRSTERM

SEQ ID NO: 1013878 - protein, 6 aa, Mycobacterium
IGSPKG

SEQ ID NO: 1013879 - protein, 10 aa, Mycobacterium
IGSPLSGAQD

SEQ ID NO: 1013880 - protein, 11 aa, Mycobacterium
IGSPRRQKYTA

SEQ ID NO: 1013881 - protein, 6 aa, Mycobacterium
IGSPYG

SEQ ID NO: 1013882 - protein, 8 aa, Mycobacterium
IGSSAQDA

SEQ ID NO: 1013883 - protein, 4 aa, Mycobacterium
IGSY

SEQ ID NO: 1013884 - protein, 7 aa, Mycobacterium
IGTASDA

SEQ ID NO: 1013885 - protein, 9 aa, Mycobacterium
IGTATPGRV

SEQ ID NO: 1013886 - protein, 4 aa, Mycobacterium
IGTD

SEQ ID NO: 1013887 - protein, 13 aa, Mycobacterium
IGTGGAATNPKYK

SEQ ID NO: 1013888 - protein, 27 aa, Mycobacterium
IGTGGAGGAGGSSSTVNGGLGGTGGAG

SEQ ID NO: 1013889 - protein, 22 aa, Mycobacterium
IGTGGAGGKGAPSMPGGLGGRG

SEQ ID NO: 1013890 - protein, 41 aa, Mycobacterium
IGTGGTGGAGAGSASDDGGGGSGGAGGRLSSAGGAGGDGGF

SEQ ID NO: 1013891 - protein, 22 aa, Mycobacterium
IGTGGTGGAGGTGAAGGTGGAG

SEQ ID NO: 1013892 - protein, 12 aa, Mycobacterium
IGTGKSGKATVS

SEQ ID NO: 1013893 - protein, 10 aa, Mycobacterium
IGTPANVSGV

SEQ ID NO: 1013894 - protein, 10 aa, Mycobacterium
IGTPASGVDG

SEQ ID NO: 1013895 - protein, 28 aa, Mycobacterium
IGTSGAEIGGAFGGEKQTGGGRESGSDA

SEQ ID NO: 1013896 - protein, 6 aa, Mycobacterium
IGTSPF

SEQ ID NO: 1013897 - protein, 4 aa, Mycobacterium
IGTT

SEQ ID NO: 1013898 - protein, 7 aa, Mycobacterium
IGTTAAP

SEQ ID NO: 1013899 - protein, 10 aa, Mycobacterium
IGTTAPSEEL

SEQ ID NO: 1013900 - protein, 4 aa, Mycobacterium
IGWP

SEQ ID NO: 1013901 - protein, 7 aa, Mycobacterium
IHDQGGT

SEQ ID NO: 1013902 - protein, 6 aa, Mycobacterium
IHPGGI

SEQ ID NO: 1013903 - protein, 16 aa, Mycobacterium
IHPTGADPMTYASTGR

SEQ ID NO: 1013904 - protein, 8 aa, Mycobacterium
IHPTPDTH

SEQ ID NO: 1013905 - protein, 6 aa, Mycobacterium
IHSGDS

SEQ ID NO: 1013906 - protein, 6 aa, Mycobacterium
IHTSGE

SEQ ID NO: 1013907 - protein, 6 aa, Mycobacterium
IIGRGQ

SEQ ID NO: 1013908 - protein, 17 aa, Mycobacterium
IKAAPPPPRMAGGDHSV

SEQ ID NO: 1013909 - protein, 7 aa, Mycobacterium
IKASGAR

SEQ ID NO: 1013910 - protein, 7 aa, Mycobacterium
IKDGRPV

SEQ ID NO: 1013911 - protein, 6 aa, Mycobacterium
IKDSLS

SEQ ID NO: 1013912 - protein, 12 aa, Mycobacterium
IKEAEDALRDYQ

SEQ ID NO: 1013913 - protein, 7 aa, Mycobacterium
IKGDGKV

SEQ ID NO: 1013914 - protein, 6 aa, Mycobacterium
IKGSDT

SEQ ID NO: 1013915 - protein, 8 aa, Mycobacterium
IKGSPTTE

SEQ ID NO: 1013916 - protein, 6 aa, Mycobacterium
IKPDAT

SEQ ID NO: 1013917 - protein, 4 aa, Mycobacterium
IKPG

SEQ ID NO: 1013918 - protein, 11 aa, Mycobacterium
IKPQARTLATD

SEQ ID NO: 1013919 - protein, 7 aa, Mycobacterium
IKQASGR

SEQ ID NO: 1013920 - protein, 13 aa, Mycobacterium
IKQGISGDDAKKI

SEQ ID NO: 1013921 - protein, 23 aa, Mycobacterium
IKSSGDRQHGGEPGAAGRHHQIQ

SEQ ID NO: 1013922 - protein, 8 aa, Mycobacterium
IKTDEEEV

SEQ ID NO: 1013923 - protein, 7 aa, Mycobacterium
IKTNPTA

SEQ ID NO: 1013924 - protein, 7 aa, Mycobacterium
ILDSGGR

SEQ ID NO: 1013925 - protein, 19 aa, Mycobacterium
ILKPGASSLTSLPPPPSPP

SEQ ID NO: 1013926 - protein, 6 aa, Mycobacterium
ILPGGQ

SEQ ID NO: 1013927 - protein, 8 aa, Mycobacterium
ILTPGPAT

SEQ ID NO: 1013928 - protein, 6 aa, Mycobacterium
INANPA

SEQ ID NO: 1013929 - protein, 10 aa, Mycobacterium
INASEQATNF

SEQ ID NO: 1013930 - protein, 8 aa, Mycobacterium
INDGSGVR

SEQ ID NO: 1013931 - protein, 4 aa, Mycobacterium
INDP

SEQ ID NO: 1013932 - protein, 9 aa, Mycobacterium
INGDETEPT

SEQ ID NO: 1013933 - protein, 8 aa, Mycobacterium
INGDPAGG

SEQ ID NO: 1013934 - protein, 4 aa, Mycobacterium
INGP

SEQ ID NO: 1013935 - protein, 6 aa, Mycobacterium
INGPRG

SEQ ID NO: 1013936 - protein, 5 aa, Mycobacterium
INGPS

SEQ ID NO: 1013937 - protein, 5 aa, Mycobacterium
INGSG

SEQ ID NO: 1013938 - protein, 9 aa, Mycobacterium
INPDGSTWA

SEQ ID NO: 1013939 - protein, 12 aa, Mycobacterium
INPGPASYRPAS

SEQ ID NO: 1013940 - protein, 24 aa, Mycobacterium
INPPPPPAPPPEPAPVEPPPPEPG

SEQ ID NO: 1013941 - protein, 10 aa, Mycobacterium
INQDGRSNGL

SEQ ID NO: 1013942 - protein, 6 aa, Mycobacterium
INQDSG

SEQ ID NO: 1013943 - protein, 10 aa, Mycobacterium
INRNSATLDE

SEQ ID NO: 1013944 - protein, 7 aa, Mycobacterium
INRYPDN

SEQ ID NO: 1013945 - protein, 22 aa, Mycobacterium
INSGAADKLERDAKKAIDEFGA

SEQ ID NO: 1013946 - protein, 12 aa, Mycobacterium
INSRRSLSGRAH

SEQ ID NO: 1013947 - protein, 7 aa, Mycobacterium
INTVTGN

SEQ ID NO: 1013948 - protein, 4 aa, Mycobacterium
INYE

SEQ ID NO: 1013949 - protein, 15 aa, Mycobacterium
IPAAPTSFKAKPGQR

SEQ ID NO: 1013950 - protein, 6 aa, Mycobacterium
IPAAPV

SEQ ID NO: 1013951 - protein, 17 aa, Mycobacterium
IPADASSTAFEPDPIRA

SEQ ID NO: 1013952 - protein, 6 aa, Mycobacterium
IPADEP

SEQ ID NO: 1013953 - protein, 10 aa, Mycobacterium
IPADVSDAAG

SEQ ID NO: 1013954 - protein, 12 aa, Mycobacterium
IPAGDPDKGQLR

SEQ ID NO: 1013955 - protein, 5 aa, Mycobacterium
IPAGR

SEQ ID NO: 1013956 - protein, 6 aa, Mycobacterium
IPAGSG

SEQ ID NO: 1013957 - protein, 15 aa, Mycobacterium
IPAGSGSGGGAGGAG

SEQ ID NO: 1013958 - protein, 10 aa, Mycobacterium
IPANRPGRAV

SEQ ID NO: 1013959 - protein, 20 aa, Mycobacterium
IPANTPAATTGSMPSAVPSA

SEQ ID NO: 1013960 - protein, 5 aa, Mycobacterium
IPAPE

SEQ ID NO: 1013961 - protein, 10 aa, Mycobacterium
IPASSGKTHR

SEQ ID NO: 1013962 - protein, 4 aa, Mycobacterium
IPAT

SEQ ID NO: 1013963 - protein, 5 aa, Mycobacterium
IPATQ

SEQ ID NO: 1013964 - protein, 11 aa, Mycobacterium
IPDADAALQPG

SEQ ID NO: 1013965 - protein, 6 aa, Mycobacterium
IPDAEP

SEQ ID NO: 1013966 - protein, 11 aa, Mycobacterium
IPDERSDAEPA

SEQ ID NO: 1013967 - protein, 12 aa, Mycobacterium
IPDLPQQQPRDP

SEQ ID NO: 1013968 - protein, 4 aa, Mycobacterium
IPDP

SEQ ID NO: 1013969 - protein, 7 aa, Mycobacterium
IPDPGTE

SEQ ID NO: 1013970 - protein, 18 aa, Mycobacterium
IPDPRERPTDREEAARQK

SEQ ID NO: 1013971 - protein, 9 aa, Mycobacterium
IPDRDDPAK

SEQ ID NO: 1013972 - protein, 6 aa, Mycobacterium
IPDRGG

SEQ ID NO: 1013973 - protein, 12 aa, Mycobacterium
IPDSDAADPSGL

SEQ ID NO: 1013974 - protein, 5 aa, Mycobacterium
IPDSG

SEQ ID NO: 1013975 - protein, 6 aa, Mycobacterium
IPEAEK

SEQ ID NO: 1013976 - protein, 8 aa, Mycobacterium
IPEPDGSY

SEQ ID NO: 1013977 - protein, 16 aa, Mycobacterium
IPEPEATEEAKSLAAE

SEQ ID NO: 1013978 - protein, 8 aa, Mycobacterium
IPEPGPGE

SEQ ID NO: 1013979 - protein, 15 aa, Mycobacterium
IPERQPHAKGGGAHG

SEQ ID NO: 1013980 - protein, 5 aa, Mycobacterium
IPESQ

SEQ ID NO: 1013981 - protein, 5 aa, Mycobacterium
IPGAC

SEQ ID NO: 1013982 - protein, 7 aa, Mycobacterium
IPGASRS

SEQ ID NO: 1013983 - protein, 9 aa, Mycobacterium
IPGEPPEAA

SEQ ID NO: 1013984 - protein, 10 aa, Mycobacterium
IPGGEPIPEE

SEQ ID NO: 1013985 - protein, 12 aa, Mycobacterium
IPGGNGGYGGDG

SEQ ID NO: 1013986 - protein, 8 aa, Mycobacterium
IPGKEEFN

SEQ ID NO: 1013987 - protein, 6 aa, Mycobacterium
IPGKPR

SEQ ID NO: 1013988 - protein, 6 aa, Mycobacterium
IPGLSD

SEQ ID NO: 1013989 - protein, 22 aa, Mycobacterium
IPGPGPGGYKGAGEGGAIGSAP

SEQ ID NO: 1013990 - protein, 9 aa, Mycobacterium
IPGPPIPGE

SEQ ID NO: 1013991 - protein, 5 aa, Mycobacterium
IPGPR

SEQ ID NO: 1013992 - protein, 4 aa, Mycobacterium
IPGS

SEQ ID NO: 1013993 - protein, 7 aa, Mycobacterium
IPGSPDP

SEQ ID NO: 1013994 - protein, 8 aa, Mycobacterium
IPGSPSQQ

SEQ ID NO: 1013995 - protein, 15 aa, Mycobacterium
IPGTASGAGGSGSSV

SEQ ID NO: 1013996 - protein, 8 aa, Mycobacterium
IPGVQAPG

SEQ ID NO: 1013997 - protein, 11 aa, Mycobacterium
IPGYPAQGDAI

SEQ ID NO: 1013998 - protein, 5 aa, Mycobacterium
IPHSD

SEQ ID NO: 1013999 - protein, 7 aa, Mycobacterium
IPKGFRA

SEQ ID NO: 1014000 - protein, 6 aa, Mycobacterium
IPKPTV

SEQ ID NO: 1014001 - protein, 5 aa, Mycobacterium
IPLED

SEQ ID NO: 1014002 - protein, 12 aa, Mycobacterium
IPLEGRKGNLLS

SEQ ID NO: 1014003 - protein, 4 aa, Mycobacterium
IPNQ

SEQ ID NO: 1014004 - protein, 7 aa, Mycobacterium
IPNTSGL

SEQ ID NO: 1014005 - protein, 27 aa, Mycobacterium
IPPAPPACPVPATPSTPLPIDGRPNNA

SEQ ID NO: 1014006 - protein, 15 aa, Mycobacterium
IPPAPPAPPAPPLPA

SEQ ID NO: 1014007 - protein, 8 aa, Mycobacterium
IPPAPRGV

SEQ ID NO: 1014008 - protein, 6 aa, Mycobacterium
IPPNGQ

SEQ ID NO: 1014009 - protein, 5 aa, Mycobacterium
IPPNR

SEQ ID NO: 1014010 - protein, 16 aa, Mycobacterium
IPPPGTPVSDPIDPAR

SEQ ID NO: 1014011 - protein, 12 aa, Mycobacterium
IPPPTRAGAELA

SEQ ID NO: 1014012 - protein, 18 aa, Mycobacterium
IPPQAAPAVQGGTSGLRR

SEQ ID NO: 1014013 - protein, 7 aa, Mycobacterium
IPPQADA

SEQ ID NO: 1014014 - protein, 5 aa, Mycobacterium
IPPQQ

SEQ ID NO: 1014015 - protein, 7 aa, Mycobacterium
IPPTGSR

SEQ ID NO: 1014016 - protein, 8 aa, Mycobacterium
IPPTTTGE

SEQ ID NO: 1014017 - protein, 8 aa, Mycobacterium
IPPTVSPP

SEQ ID NO: 1014018 - protein, 5 aa, Mycobacterium
IPPVP

SEQ ID NO: 1014019 - protein, 9 aa, Mycobacterium
IPQGDDGKP

SEQ ID NO: 1014020 - protein, 5 aa, Mycobacterium
IPQGP

SEQ ID NO: 1014021 - protein, 11 aa, Mycobacterium
IPRDGGVGAPR

SEQ ID NO: 1014022 - protein, 7 aa, Mycobacterium
IPREGGI

SEQ ID NO: 1014023 - protein, 11 aa, Mycobacterium
IPRKPNGKVDG

SEQ ID NO: 1014024 - protein, 10 aa, Mycobacterium
IPRRGGEARP

SEQ ID NO: 1014025 - protein, 11 aa, Mycobacterium
IPRTTSGKLAR

SEQ ID NO: 1014026 - protein, 5 aa, Mycobacterium
IPSAN

SEQ ID NO: 1014027 - protein, 11 aa, Mycobacterium
IPSATAESKAM

SEQ ID NO: 1014028 - protein, 20 aa, Mycobacterium
IPSLGGGGLGGAGLGDLGSA

SEQ ID NO: 1014029 - protein, 9 aa, Mycobacterium
IPTASAPPV

SEQ ID NO: 1014030 - protein, 6 aa, Mycobacterium
IPTASR

SEQ ID NO: 1014031 - protein, 4 aa, Mycobacterium
IPTD

SEQ ID NO: 1014032 - protein, 5 aa, Mycobacterium
IPTGG

SEQ ID NO: 1014033 - protein, 35 aa, Mycobacterium
IPTLPPPAAKKRSRRSTAGDRDEPTPPDAQTAATG

SEQ ID NO: 1014034 - protein, 9 aa, Mycobacterium
IPTPGHTSG

SEQ ID NO: 1014035 - protein, 5 aa, Mycobacterium
IPTPL

SEQ ID NO: 1014036 - protein, 6 aa, Mycobacterium
IPTPRA

SEQ ID NO: 1014037 - protein, 5 aa, Mycobacterium
IPTTA

SEQ ID NO: 1014038 - protein, 6 aa, Mycobacterium
IPVPGP

SEQ ID NO: 1014039 - protein, 12 aa, Mycobacterium
IPVTTSGKVRRS

SEQ ID NO: 1014040 - protein, 6 aa, Mycobacterium
IPYAGD

SEQ ID NO: 1014041 - protein, 11 aa, Mycobacterium
IPYGGGSSVVG

SEQ ID NO: 1014042 - protein, 5 aa, Mycobacterium
IQAGG

SEQ ID NO: 1014043 - protein, 10 aa, Mycobacterium
IQAGSGKDKC

SEQ ID NO: 1014044 - protein, 9 aa, Mycobacterium
IQATPDGNT

SEQ ID NO: 1014045 - protein, 9 aa, Mycobacterium
IQDAAPEMD

SEQ ID NO: 1014046 - protein, 8 aa, Mycobacterium
IQDGTKLG

SEQ ID NO: 1014047 - protein, 9 aa, Mycobacterium
IQDKGEGKN

SEQ ID NO: 1014048 - protein, 7 aa, Mycobacterium
IQDPRVT

SEQ ID NO: 1014049 - protein, 13 aa, Mycobacterium
IQEAREACGGTGY

SEQ ID NO: 1014050 - protein, 9 aa, Mycobacterium
IQGEGGDRH

SEQ ID NO: 1014051 - protein, 15 aa, Mycobacterium
IQGEPDASSFPSGGL

SEQ ID NO: 1014052 - protein, 4 aa, Mycobacterium
IQGK

SEQ ID NO: 1014053 - protein, 8 aa, Mycobacterium
IQPDEERT

SEQ ID NO: 1014054 - protein, 13 aa, Mycobacterium
IQPDSGRVKRGKT

SEQ ID NO: 1014055 - protein, 10 aa, Mycobacterium
IQPNGQVTNE

SEQ ID NO: 1014056 - protein, 5 aa, Mycobacterium
IQPQG

SEQ ID NO: 1014057 - protein, 6 aa, Mycobacterium
IQPRPT

SEQ ID NO: 1014058 - protein, 8 aa, Mycobacterium
IQRPDGIR

SEQ ID NO: 1014059 - protein, 5 aa, Mycobacterium
IQRQN

SEQ ID NO: 1014060 - protein, 6 aa, Mycobacterium
IQRQQQ

SEQ ID NO: 1014061 - protein, 4 aa, Mycobacterium
IQST

SEQ ID NO: 1014062 - protein, 4 aa, Mycobacterium
IQTA

SEQ ID NO: 1014063 - protein, 18 aa, Mycobacterium
IQTPTTGQEPDEPNQPSS

SEQ ID NO: 1014064 - protein, 7 aa, Mycobacterium
IQTQRGQ

SEQ ID NO: 1014065 - protein, 8 aa, Mycobacterium
IRAAAPKK

SEQ ID NO: 1014066 - protein, 13 aa, Mycobacterium
IRAQGGVSRMSDP

SEQ ID NO: 1014067 - protein, 8 aa, Mycobacterium
IRDSEPDW

SEQ ID NO: 1014068 - protein, 9 aa, Mycobacterium
IRDSGQKDL

SEQ ID NO: 1014069 - protein, 12 aa, Mycobacterium
IREATDVAQTHP

SEQ ID NO: 1014070 - protein, 4 aa, Mycobacterium
IREG

SEQ ID NO: 1014071 - protein, 14 aa, Mycobacterium
IRESTQRRKERQKV

SEQ ID NO: 1014072 - protein, 16 aa, Mycobacterium
IRGAGTSDGAGALMSD

SEQ ID NO: 1014073 - protein, 10 aa, Mycobacterium
IRGESENLAP

SEQ ID NO: 1014074 - protein, 7 aa, Mycobacterium
IRGGDAD

SEQ ID NO: 1014075 - protein, 5 aa, Mycobacterium
IRGRD

SEQ ID NO: 1014076 - protein, 13 aa, Mycobacterium
IRGSTASSSGPSL

SEQ ID NO: 1014077 - protein, 4 aa, Mycobacterium
IRHP

SEQ ID NO: 1014078 - protein, 4 aa, Mycobacterium
IRHR

SEQ ID NO: 1014079 - protein, 7 aa, Mycobacterium
IRKAEDP

SEQ ID NO: 1014080 - protein, 12 aa, Mycobacterium
IRKDPNDAQKVA

SEQ ID NO: 1014081 - protein, 10 aa, Mycobacterium
IRKDTDRDKI

SEQ ID NO: 1014082 - protein, 7 aa, Mycobacterium
IRKRGSV

SEQ ID NO: 1014083 - protein, 7 aa, Mycobacterium
IRNGHSQ

SEQ ID NO: 1014084 - protein, 11 aa, Mycobacterium
IRNTDAGKRRP

SEQ ID NO: 1014085 - protein, 4 aa, Mycobacterium
IRPA

SEQ ID NO: 1014086 - protein, 13 aa, Mycobacterium
IRPAGETFATPDA

SEQ ID NO: 1014087 - protein, 27 aa, Mycobacterium
IRPGANRCGKRVTQAQAPRAERPTGRR

SEQ ID NO: 1014088 - protein, 15 aa, Mycobacterium
IRPKSLRDRLARDQP

SEQ ID NO: 1014089 - protein, 8 aa, Mycobacterium
IRPPQEAP

SEQ ID NO: 1014090 - protein, 6 aa, Mycobacterium
IRPPQR

SEQ ID NO: 1014091 - protein, 12 aa, Mycobacterium
IRPPSTSSVSSW

SEQ ID NO: 1014092 - protein, 6 aa, Mycobacterium
IRPSTI

SEQ ID NO: 1014093 - protein, 5 aa, Mycobacterium
IRPSY

SEQ ID NO: 1014094 - protein, 9 aa, Mycobacterium
IRPTDTAGD

SEQ ID NO: 1014095 - protein, 8 aa, Mycobacterium
IRQGDRGD

SEQ ID NO: 1014096 - protein, 5 aa, Mycobacterium
IRQQR

SEQ ID NO: 1014097 - protein, 11 aa, Mycobacterium
IRQRPRPLSDS

SEQ ID NO: 1014098 - protein, 4 aa, Mycobacterium
IRQS

SEQ ID NO: 1014099 - protein, 23 aa, Mycobacterium
IRRGRGSYALSPGRVDRKGLETR

SEQ ID NO: 1014100 - protein, 6 aa, Mycobacterium
IRRGSD

SEQ ID NO: 1014101 - protein, 4 aa, Mycobacterium
IRSG

SEQ ID NO: 1014102 - protein, 5 aa, Mycobacterium
IRSGA

SEQ ID NO: 1014103 - protein, 21 aa, Mycobacterium
IRSGRGSRPRTKTRPEHADAE

SEQ ID NO: 1014104 - protein, 12 aa, Mycobacterium
IRSGRSKHARSR

SEQ ID NO: 1014105 - protein, 5 aa, Mycobacterium
IRSRS

SEQ ID NO: 1014106 - protein, 9 aa, Mycobacterium
IRSTGEKHT

SEQ ID NO: 1014107 - protein, 5 aa, Mycobacterium
IRTGT

SEQ ID NO: 1014108 - protein, 22 aa, Mycobacterium
ISADPDEAVSYGEGDTGNPPQF

SEQ ID NO: 1014109 - protein, 6 aa, Mycobacterium
ISADPT

SEQ ID NO: 1014110 - protein, 5 aa, Mycobacterium
ISAEP

SEQ ID NO: 1014111 - protein, 7 aa, Mycobacterium
ISAEQAA

SEQ ID NO: 1014112 - protein, 7 aa, Mycobacterium
ISAETTE

SEQ ID NO: 1014113 - protein, 5 aa, Mycobacterium
ISAGD

SEQ ID NO: 1014114 - protein, 29 aa, Mycobacterium
ISAGGAGGNGGTGLSGFGGAGGAGGNAGL

SEQ ID NO: 1014115 - protein, 11 aa, Mycobacterium
ISAGRHPDADW

SEQ ID NO: 1014116 - protein, 11 aa, Mycobacterium
ISAGSTAATAL

SEQ ID NO: 1014117 - protein, 6 aa, Mycobacterium
ISATDD

SEQ ID NO: 1014118 - protein, 9 aa, Mycobacterium
ISDDPQRVA

SEQ ID NO: 1014119 - protein, 12 aa, Mycobacterium
ISDGMSGGPTIE

SEQ ID NO: 1014120 - protein, 10 aa, Mycobacterium
ISDPQLPGRA

SEQ ID NO: 1014121 - protein, 6 aa, Mycobacterium
ISDPRN

SEQ ID NO: 1014122 - protein, 9 aa, Mycobacterium
ISDQPTQRV

SEQ ID NO: 1014123 - protein, 5 aa, Mycobacterium
ISEED

SEQ ID NO: 1014124 - protein, 19 aa, Mycobacterium
ISEGGGVYSREQKSIPVSD

SEQ ID NO: 1014125 - protein, 8 aa, Mycobacterium
ISEQDASG

SEQ ID NO: 1014126 - protein, 11 aa, Mycobacterium
ISEREPAPRRR

SEQ ID NO: 1014127 - protein, 7 aa, Mycobacterium
ISESVRP

SEQ ID NO: 1014128 - protein, 11 aa, Mycobacterium
ISGDGKRSTTR

SEQ ID NO: 1014129 - protein, 5 aa, Mycobacterium
ISGDQ

SEQ ID NO: 1014130 - protein, 8 aa, Mycobacterium
ISGKKGER

SEQ ID NO: 1014131 - protein, 12 aa, Mycobacterium
ISGLNTGQLSES

SEQ ID NO: 1014132 - protein, 8 aa, Mycobacterium
ISGNKGDS

SEQ ID NO: 1014133 - protein, 10 aa, Mycobacterium
ISGNVSADAV

SEQ ID NO: 1014134 - protein, 7 aa, Mycobacterium
ISGRPGG

SEQ ID NO: 1014135 - protein, 6 aa, Mycobacterium
ISGRTG

SEQ ID NO: 1014136 - protein, 13 aa, Mycobacterium
ISGSPNALQAAGH

SEQ ID NO: 1014137 - protein, 9 aa, Mycobacterium
ISGSSGPVI

SEQ ID NO: 1014138 - protein, 4 aa, Mycobacterium
ISGT

SEQ ID NO: 1014139 - protein, 8 aa, Mycobacterium
ISGTDRRG

SEQ ID NO: 1014140 - protein, 8 aa, Mycobacterium
ISGTESLT

SEQ ID NO: 1014141 - protein, 62 aa, Mycobacterium
ISGTGDVGGQGGVGGFGEGGAGGDGGGAGLIGNGGSGGTGGNAVGNSGVGGHGGAGGRGGRL

SEQ ID NO: 1014142 - protein, 4 aa, Mycobacterium
ISGV

SEQ ID NO: 1014143 - protein, 4 aa, Mycobacterium
ISHS

SEQ ID NO: 1014144 - protein, 7 aa, Mycobacterium
ISKAGGR

SEQ ID NO: 1014145 - protein, 7 aa, Mycobacterium
ISKDGEQ

SEQ ID NO: 1014146 - protein, 6 aa, Mycobacterium
ISNDPN

SEQ ID NO: 1014147 - protein, 10 aa, Mycobacterium
ISNEATTDCT

SEQ ID NO: 1014148 - protein, 23 aa, Mycobacterium
ISNGGSGGNGGIGAAGGAGGSGG

SEQ ID NO: 1014149 - protein, 7 aa, Mycobacterium
ISNGQSG

SEQ ID NO: 1014150 - protein, 9 aa, Mycobacterium
ISNSGDTAL

SEQ ID NO: 1014151 - protein, 9 aa, Mycobacterium
ISPDATDPL

SEQ ID NO: 1014152 - protein, 6 aa, Mycobacterium
ISPDGS

SEQ ID NO: 1014153 - protein, 8 aa, Mycobacterium
ISPDGTTA

SEQ ID NO: 1014154 - protein, 8 aa, Mycobacterium
ISPDSYPT

SEQ ID NO: 1014155 - protein, 5 aa, Mycobacterium
ISPEG

SEQ ID NO: 1014156 - protein, 8 aa, Mycobacterium
ISPEGLPA

SEQ ID NO: 1014157 - protein, 9 aa, Mycobacterium
ISPGGVGLT

SEQ ID NO: 1014158 - protein, 6 aa, Mycobacterium
ISPGQR

SEQ ID NO: 1014159 - protein, 10 aa, Mycobacterium
ISPPSTALDA

SEQ ID NO: 1014160 - protein, 6 aa, Mycobacterium
ISPRGC

SEQ ID NO: 1014161 - protein, 4 aa, Mycobacterium
ISPV

SEQ ID NO: 1014162 - protein, 4 aa, Mycobacterium
ISQA

SEQ ID NO: 1014163 - protein, 7 aa, Mycobacterium
ISQAATS

SEQ ID NO: 1014164 - protein, 4 aa, Mycobacterium
ISQE

SEQ ID NO: 1014165 - protein, 4 aa, Mycobacterium
ISQG

SEQ ID NO: 1014166 - protein, 6 aa, Mycobacterium
ISQQTT

SEQ ID NO: 1014167 - protein, 20 aa, Mycobacterium
ISRAGGPDIQRESNEKAPIG

SEQ ID NO: 1014168 - protein, 5 aa, Mycobacterium
ISREG

SEQ ID NO: 1014169 - protein, 5 aa, Mycobacterium
ISRKA

SEQ ID NO: 1014170 - protein, 10 aa, Mycobacterium
ISRNSGRREK

SEQ ID NO: 1014171 - protein, 7 aa, Mycobacterium
ISRPERL

SEQ ID NO: 1014172 - protein, 9 aa, Mycobacterium
ISRQGGRAA

SEQ ID NO: 1014173 - protein, 12 aa, Mycobacterium
ISRRRTSTGSWC

SEQ ID NO: 1014174 - protein, 6 aa, Mycobacterium
ISRTDG

SEQ ID NO: 1014175 - protein, 4 aa, Mycobacterium
ISSE

SEQ ID NO: 1014176 - protein, 5 aa, Mycobacterium
ISSGE

SEQ ID NO: 1014177 - protein, 10 aa, Mycobacterium
ISSGHPDRLA

SEQ ID NO: 1014178 - protein, 13 aa, Mycobacterium
ISSPKQLDSIAGP

SEQ ID NO: 1014179 - protein, 13 aa, Mycobacterium
ISSPSDPTANPIL

SEQ ID NO: 1014180 - protein, 7 aa, Mycobacterium
ISTEDAK

SEQ ID NO: 1014181 - protein, 8 aa, Mycobacterium
ISTGGGAS

SEQ ID NO: 1014182 - protein, 5 aa, Mycobacterium
ISTPA

SEQ ID NO: 1014183 - protein, 30 aa, Mycobacterium
ISTPPQTAPSLPDVAQSAPPNHQISPATTG

SEQ ID NO: 1014184 - protein, 36 aa, Mycobacterium
ISTSSAGPAVPPAPPPIKTPPRPPAPPWPTTPPVAP

SEQ ID NO: 1014185 - protein, 4 aa, Mycobacterium
ISVP

SEQ ID NO: 1014186 - protein, 13 aa, Mycobacterium
ISYAGQDAKTGQT

SEQ ID NO: 1014187 - protein, 13 aa, Mycobacterium
ITAAGNGGGATPA

SEQ ID NO: 1014188 - protein, 6 aa, Mycobacterium
ITAEAG

SEQ ID NO: 1014189 - protein, 26 aa, Mycobacterium
ITAGPTAATAGLDATDHAESTRTRMQ

SEQ ID NO: 1014190 - protein, 11 aa, Mycobacterium
ITAPNARGERV

SEQ ID NO: 1014191 - protein, 10 aa, Mycobacterium
ITAPNDGTVE

SEQ ID NO: 1014192 - protein, 4 aa, Mycobacterium
ITAT

SEQ ID NO: 1014193 - protein, 10 aa, Mycobacterium
ITDAQSVDEA

SEQ ID NO: 1014194 - protein, 12 aa, Mycobacterium
ITDASGRTLSGQ

SEQ ID NO: 1014195 - protein, 8 aa, Mycobacterium
ITDDDQVS

SEQ ID NO: 1014196 - protein, 4 aa, Mycobacterium
ITDE

SEQ ID NO: 1014197 - protein, 12 aa, Mycobacterium
ITDEGGRRPPSH

SEQ ID NO: 1014198 - protein, 8 aa, Mycobacterium
ITDGRRTE

SEQ ID NO: 1014199 - protein, 4 aa, Mycobacterium
ITDI

SEQ ID NO: 1014200 - protein, 7 aa, Mycobacterium
ITDNPEA

SEQ ID NO: 1014201 - protein, 5 aa, Mycobacterium
ITDNQ

SEQ ID NO: 1014202 - protein, 9 aa, Mycobacterium
ITDVNGGGQ

SEQ ID NO: 1014203 - protein, 4 aa, Mycobacterium
ITEE

SEQ ID NO: 1014204 - protein, 7 aa, Mycobacterium
ITEETRA

SEQ ID NO: 1014205 - protein, 17 aa, Mycobacterium
ITEPDTSGSLGAPTQHR

SEQ ID NO: 1014206 - protein, 5 aa, Mycobacterium
ITERQ

SEQ ID NO: 1014207 - protein, 8 aa, Mycobacterium
ITERRGSL

SEQ ID NO: 1014208 - protein, 4 aa, Mycobacterium
ITET

SEQ ID NO: 1014209 - protein, 14 aa, Mycobacterium
ITGEDGEPTPQRAN

SEQ ID NO: 1014210 - protein, 6 aa, Mycobacterium
ITGEPL

SEQ ID NO: 1014211 - protein, 9 aa, Mycobacterium
ITGERTKGG

SEQ ID NO: 1014212 - protein, 11 aa, Mycobacterium
ITGERTKGGFY

SEQ ID NO: 1014213 - protein, 5 aa, Mycobacterium
ITGHG

SEQ ID NO: 1014214 - protein, 53 aa, Mycobacterium
ITGNPGDPRYPYREPPPAPPPGGPPTGPPAVAPPGLASTPGPVQVPGPQPGGA

SEQ ID NO: 1014215 - protein, 4 aa, Mycobacterium
ITGP

SEQ ID NO: 1014216 - protein, 5 aa, Mycobacterium
ITGPA

SEQ ID NO: 1014217 - protein, 15 aa, Mycobacterium
ITGPETYQEPARPPN

SEQ ID NO: 1014218 - protein, 9 aa, Mycobacterium
ITGPGKGAV

SEQ ID NO: 1014219 - protein, 9 aa, Mycobacterium
ITGSEQDRL

SEQ ID NO: 1014220 - protein, 12 aa, Mycobacterium
ITGSGAALSAPM

SEQ ID NO: 1014221 - protein, 12 aa, Mycobacterium
ITGTDTGAANDH

SEQ ID NO: 1014222 - protein, 11 aa, Mycobacterium
ITHPSAANAEA

SEQ ID NO: 1014223 - protein, 13 aa, Mycobacterium
ITHQGRKSGKPYK

SEQ ID NO: 1014224 - protein, 6 aa, Mycobacterium
ITKNNP

SEQ ID NO: 1014225 - protein, 23 aa, Mycobacterium
ITNGSSSSVGNPQAAPTTGPAAP

SEQ ID NO: 1014226 - protein, 8 aa, Mycobacterium
ITNSGTDI

SEQ ID NO: 1014227 - protein, 7 aa, Mycobacterium
ITPAGRA

SEQ ID NO: 1014228 - protein, 7 aa, Mycobacterium
ITPDDDE

SEQ ID NO: 1014229 - protein, 6 aa, Mycobacterium
ITPDEA

SEQ ID NO: 1014230 - protein, 6 aa, Mycobacterium
ITPEQY

SEQ ID NO: 1014231 - protein, 7 aa, Mycobacterium
ITPGPDA

SEQ ID NO: 1014232 - protein, 9 aa, Mycobacterium
ITPGSGEKR

SEQ ID NO: 1014233 - protein, 9 aa, Mycobacterium
ITPNGDGDW

SEQ ID NO: 1014234 - protein, 14 aa, Mycobacterium
ITPTSVATDDGTDH

SEQ ID NO: 1014235 - protein, 8 aa, Mycobacterium
ITQDDNGV

SEQ ID NO: 1014236 - protein, 5 aa, Mycobacterium
ITQGG

SEQ ID NO: 1014237 - protein, 7 aa, Mycobacterium
ITQGKGS

SEQ ID NO: 1014238 - protein, 5 aa, Mycobacterium
ITRDA

SEQ ID NO: 1014239 - protein, 21 aa, Mycobacterium
ITRGAGDKTISENVAHPEVIE

SEQ ID NO: 1014240 - protein, 7 aa, Mycobacterium
ITRGDAE

SEQ ID NO: 1014241 - protein, 6 aa, Mycobacterium
ITRPGL

SEQ ID NO: 1014242 - protein, 12 aa, Mycobacterium
ITSEKQLGTYSD

SEQ ID NO: 1014243 - protein, 8 aa, Mycobacterium
ITSGDRAA

SEQ ID NO: 1014244 - protein, 7 aa, Mycobacterium
ITSPENT

SEQ ID NO: 1014245 - protein, 6 aa, Mycobacterium
ITSPID

SEQ ID NO: 1014246 - protein, 10 aa, Mycobacterium
ITSTRGRSIT

SEQ ID NO: 1014247 - protein, 9 aa, Mycobacterium
ITTDDADNA

SEQ ID NO: 1014248 - protein, 6 aa, Mycobacterium
ITTDPD

SEQ ID NO: 1014249 - protein, 7 aa, Mycobacterium
ITTGPGG

SEQ ID NO: 1014250 - protein, 5 aa, Mycobacterium
ITTPA

SEQ ID NO: 1014251 - protein, 12 aa, Mycobacterium
ITYSNPDQAIGS

SEQ ID NO: 1014252 - protein, 7 aa, Mycobacterium
IVEKTSE

SEQ ID NO: 1014253 - protein, 6 aa, Mycobacterium
IVPPDR

SEQ ID NO: 1014254 - protein, 4 aa, Mycobacterium
IYDA

SEQ ID NO: 1014255 - protein, 4 aa, Mycobacterium
IYEA

SEQ ID NO: 1014256 - protein, 8 aa, Mycobacterium
IYGGSNEI

SEQ ID NO: 1014257 - protein, 12 aa, Mycobacterium
IYNGSGVGNFGG

SEQ ID NO: 1014258 - protein, 5 aa, Mycobacterium
IYPNT

SEQ ID NO: 1014259 - protein, 6 aa, Mycobacterium
IYSESR

SEQ ID NO: 1014260 - protein, 7 aa, Mycobacterium
KAAAADA

SEQ ID NO: 1014261 - protein, 8 aa, Mycobacterium
KAAAANPP

SEQ ID NO: 1014262 - protein, 11 aa, Mycobacterium
KAAAAQDSGAF

SEQ ID NO: 1014263 - protein, 8 aa, Mycobacterium
KAAADAGV

SEQ ID NO: 1014264 - protein, 7 aa, Mycobacterium
KAAADAH

SEQ ID NO: 1014265 - protein, 7 aa, Mycobacterium
KAAAGEI

SEQ ID NO: 1014266 - protein, 10 aa, Mycobacterium
KAADNAGRPV

SEQ ID NO: 1014267 - protein, 9 aa, Mycobacterium
KAAEAGKDV

SEQ ID NO: 1014268 - protein, 13 aa, Mycobacterium
KAAEATQSETETA

SEQ ID NO: 1014269 - protein, 14 aa, Mycobacterium
KAAFTGAAADQVEQ

SEQ ID NO: 1014270 - protein, 4 aa, Mycobacterium
KAAG

SEQ ID NO: 1014271 - protein, 17 aa, Mycobacterium
KAAGPSKPRAGRDPVNQ

SEQ ID NO: 1014272 - protein, 6 aa, Mycobacterium
KAAGVD

SEQ ID NO: 1014273 - protein, 6 aa, Mycobacterium
KAAKPI

SEQ ID NO: 1014274 - protein, 7 aa, Mycobacterium
KAALKDS

SEQ ID NO: 1014275 - protein, 11 aa, Mycobacterium
KAANAQKVEET

SEQ ID NO: 1014276 - protein, 10 aa, Mycobacterium
KAAPAGAGGT

SEQ ID NO: 1014277 - protein, 6 aa, Mycobacterium
KAAPGY

SEQ ID NO: 1014278 - protein, 16 aa, Mycobacterium
KAAPPSAKSADANMNR

SEQ ID NO: 1014279 - protein, 22 aa, Mycobacterium
KAAPSPLDVPSDPGLPVVKGQV

SEQ ID NO: 1014280 - protein, 5 aa, Mycobacterium
KAAQE

SEQ ID NO: 1014281 - protein, 5 aa, Mycobacterium
KAARK

SEQ ID NO: 1014282 - protein, 6 aa, Mycobacterium
KAASDA

SEQ ID NO: 1014283 - protein, 8 aa, Mycobacterium
KAASESAE

SEQ ID NO: 1014284 - protein, 8 aa, Mycobacterium
KAATAEEI

SEQ ID NO: 1014285 - protein, 9 aa, Mycobacterium
KAATDDLSG

SEQ ID NO: 1014286 - protein, 15 aa, Mycobacterium
KAATGSLTAAATGAV

SEQ ID NO: 1014287 - protein, 7 aa, Mycobacterium
KAATSAR

SEQ ID NO: 1014288 - protein, 5 aa, Mycobacterium
KAAVE

SEQ ID NO: 1014289 - protein, 10 aa, Mycobacterium
KADANGGEAD

SEQ ID NO: 1014290 - protein, 13 aa, Mycobacterium
KADAPSGTATRTA

SEQ ID NO: 1014291 - protein, 8 aa, Mycobacterium
KADELRQA

SEQ ID NO: 1014292 - protein, 5 aa, Mycobacterium
KADEV

SEQ ID NO: 1014293 - protein, 13 aa, Mycobacterium
KADGIASAEVAGP

SEQ ID NO: 1014294 - protein, 5 aa, Mycobacterium
KADGV

SEQ ID NO: 1014295 - protein, 13 aa, Mycobacterium
KADPEKVNPNGGA

SEQ ID NO: 1014296 - protein, 12 aa, Mycobacterium
KADQPRANHPDM

SEQ ID NO: 1014297 - protein, 7 aa, Mycobacterium
KADRSTD

SEQ ID NO: 1014298 - protein, 4 aa, Mycobacterium
KADS

SEQ ID NO: 1014299 - protein, 4 aa, Mycobacterium
KADT

SEQ ID NO: 1014300 - protein, 21 aa, Mycobacterium
KAEADSLNAQISGSSANIAPL

SEQ ID NO: 1014301 - protein, 6 aa, Mycobacterium
KAEAHE

SEQ ID NO: 1014302 - protein, 6 aa, Mycobacterium
KAEFDG

SEQ ID NO: 1014303 - protein, 15 aa, Mycobacterium
KAEHESKAWMRNMEL

SEQ ID NO: 1014304 - protein, 4 aa, Mycobacterium
KAEL

SEQ ID NO: 1014305 - protein, 4 aa, Mycobacterium
KAEP

SEQ ID NO: 1014306 - protein, 9 aa, Mycobacterium
KAEPDDSTL

SEQ ID NO: 1014307 - protein, 16 aa, Mycobacterium
KAEQVATTLTGQQASV

SEQ ID NO: 1014308 - protein, 8 aa, Mycobacterium
KAERAQGL

SEQ ID NO: 1014309 - protein, 11 aa, Mycobacterium
KAERDSDAVQS

SEQ ID NO: 1014310 - protein, 11 aa, Mycobacterium
KAETSTPSAAP

SEQ ID NO: 1014311 - protein, 25 aa, Mycobacterium
KAEVDKAQAQAAQAGPLAEAQSQRE

SEQ ID NO: 1014312 - protein, 10 aa, Mycobacterium
KAEVEIPSPY

SEQ ID NO: 1014313 - protein, 14 aa, Mycobacterium
KAEVEPTEQPGLRR

SEQ ID NO: 1014314 - protein, 6 aa, Mycobacterium
KAFGEP

SEQ ID NO: 1014315 - protein, 5 aa, Mycobacterium
KAGAA

SEQ ID NO: 1014316 - protein, 20 aa, Mycobacterium
KAGASERTPVSAGARDSSTL

SEQ ID NO: 1014317 - protein, 14 aa, Mycobacterium
KAGDHTLTAADPSS

SEQ ID NO: 1014318 - protein, 10 aa, Mycobacterium
KAGDLSANGR

SEQ ID NO: 1014319 - protein, 8 aa, Mycobacterium
KAGEGVVN

SEQ ID NO: 1014320 - protein, 19 aa, Mycobacterium
KAGESEATKWESSGEGTYT

SEQ ID NO: 1014321 - protein, 6 aa, Mycobacterium
KAGETA

SEQ ID NO: 1014322 - protein, 8 aa, Mycobacterium
KAGGLPGD

SEQ ID NO: 1014323 - protein, 8 aa, Mycobacterium
KAGGPNLD

SEQ ID NO: 1014324 - protein, 6 aa, Mycobacterium
KAGGRV

SEQ ID NO: 1014325 - protein, 9 aa, Mycobacterium
KAGKAHPSF

SEQ ID NO: 1014326 - protein, 14 aa, Mycobacterium
KAGKKINKEDGIQR

SEQ ID NO: 1014327 - protein, 6 aa, Mycobacterium
KAGLGE

SEQ ID NO: 1014328 - protein, 5 aa, Mycobacterium
KAGLI

SEQ ID NO: 1014329 - protein, 5 aa, Mycobacterium
KAGLN

SEQ ID NO: 1014330 - protein, 5 aa, Mycobacterium
KAGLP

SEQ ID NO: 1014331 - protein, 7 aa, Mycobacterium
KAGNPNI

SEQ ID NO: 1014332 - protein, 7 aa, Mycobacterium
KAGPARV

SEQ ID NO: 1014333 - protein, 5 aa, Mycobacterium
KAGPL

SEQ ID NO: 1014334 - protein, 18 aa, Mycobacterium
KAGPSNATGSETLPSGTE

SEQ ID NO: 1014335 - protein, 9 aa, Mycobacterium
KAGQRGERV

SEQ ID NO: 1014336 - protein, 6 aa, Mycobacterium
KAGSKN

SEQ ID NO: 1014337 - protein, 10 aa, Mycobacterium
KAGVEPDGLQ

SEQ ID NO: 1014338 - protein, 5 aa, Mycobacterium
KAHGQ

SEQ ID NO: 1014339 - protein, 5 aa, Mycobacterium
KAHRG

SEQ ID NO: 1014340 - protein, 4 aa, Mycobacterium
KAIN

SEQ ID NO: 1014341 - protein, 7 aa, Mycobacterium
KAIPGDG

SEQ ID NO: 1014342 - protein, 4 aa, Mycobacterium
KAKA

SEQ ID NO: 1014343 - protein, 6 aa, Mycobacterium
KAKAAP

SEQ ID NO: 1014344 - protein, 16 aa, Mycobacterium
KAKDADKLEDLERENA

SEQ ID NO: 1014345 - protein, 8 aa, Mycobacterium
KAKDKRED

SEQ ID NO: 1014346 - protein, 8 aa, Mycobacterium
KAKEVPAA

SEQ ID NO: 1014347 - protein, 16 aa, Mycobacterium
KAKKKKKKSAGAGRHK

SEQ ID NO: 1014348 - protein, 28 aa, Mycobacterium
KAKKSSVPNENIERARKRGAGEEAGGAD

SEQ ID NO: 1014349 - protein, 9 aa, Mycobacterium
KAKPGRSVD

SEQ ID NO: 1014350 - protein, 7 aa, Mycobacterium
KAKRELG

SEQ ID NO: 1014351 - protein, 4 aa, Mycobacterium
KAKS

SEQ ID NO: 1014352 - protein, 6 aa, Mycobacterium
KAKSLG

SEQ ID NO: 1014353 - protein, 8 aa, Mycobacterium
KAKSQKAV

SEQ ID NO: 1014354 - protein, 4 aa, Mycobacterium
KALG

SEQ ID NO: 1014355 - protein, 4 aa, Mycobacterium
KALT

SEQ ID NO: 1014356 - protein, 4 aa, Mycobacterium
KAMP

SEQ ID NO: 1014357 - protein, 28 aa, Mycobacterium
KANARPDTLSGGGSNNALRSRVPSRWPR

SEQ ID NO: 1014358 - protein, 7 aa, Mycobacterium
KANPGGL

SEQ ID NO: 1014359 - protein, 22 aa, Mycobacterium
KAPAFSLPDANGNKVSLSDYKG

SEQ ID NO: 1014360 - protein, 7 aa, Mycobacterium
KAPAQGA

SEQ ID NO: 1014361 - protein, 8 aa, Mycobacterium
KAPDALSL

SEQ ID NO: 1014362 - protein, 8 aa, Mycobacterium
KAPDPPQR

SEQ ID NO: 1014363 - protein, 4 aa, Mycobacterium
KAPE

SEQ ID NO: 1014364 - protein, 4 aa, Mycobacterium
KAPF

SEQ ID NO: 1014365 - protein, 6 aa, Mycobacterium
KAPPEL

SEQ ID NO: 1014366 - protein, 8 aa, Mycobacterium
KAPPHPDL

SEQ ID NO: 1014367 - protein, 67 aa, Mycobacterium
KAPSSSGGSPSPTPNPNPDPSPTPDPTPTPTPDPTPTPTPEPTPAPAPEPAPEPTPVEPAPVTVLPT

SEQ ID NO: 1014368 - protein, 5 aa, Mycobacterium
KAPSV

SEQ ID NO: 1014369 - protein, 9 aa, Mycobacterium
KAPTGSNAQ

SEQ ID NO: 1014370 - protein, 4 aa, Mycobacterium
KAQA

SEQ ID NO: 1014371 - protein, 10 aa, Mycobacterium
KAQKQARRWS

SEQ ID NO: 1014372 - protein, 40 aa, Mycobacterium
KAREEMSTEATADDEESTEGAIPALPSPPRGYTPAPPPHW

SEQ ID NO: 1014373 - protein, 8 aa, Mycobacterium
KAREVRGA

SEQ ID NO: 1014374 - protein, 38 aa, Mycobacterium; identical to SEQ ID NO: 510623

SEQ ID NO: 1014375 - protein, 8 aa, Mycobacterium
KARQSGAA

SEQ ID NO: 1014376 - protein, 7 aa, Mycobacterium
KASAGEC

SEQ ID NO: 1014377 - protein, 9 aa, Mycobacterium
KASARGVAT

SEQ ID NO: 1014378 - protein, 9 aa, Mycobacterium
KASDAAENV

SEQ ID NO: 1014379 - protein, 9 aa, Mycobacterium
KASDETKSV

SEQ ID NO: 1014380 - protein, 13 aa, Mycobacterium
KASDEWKIAVLRA

SEQ ID NO: 1014381 - protein, 10 aa, Mycobacterium
KASGGIRTAT

SEQ ID NO: 1014382 - protein, 8 aa, Mycobacterium
KASGRDLS

SEQ ID NO: 1014383 - protein, 9 aa, Mycobacterium
KASKGTTTY

SEQ ID NO: 1014384 - protein, 16 aa, Mycobacterium
KASPIRGAGDTEGRRQ

SEQ ID NO: 1014385 - protein, 10 aa, Mycobacterium
KASPQFSDRR

SEQ ID NO: 1014386 - protein, 10 aa, Mycobacterium
KASSGGERES

SEQ ID NO: 1014387 - protein, 11 aa, Mycobacterium
KASSSSAEGHQ

SEQ ID NO: 1014388 - protein, 10 aa, Mycobacterium
KASSSSTSRI

SEQ ID NO: 1014389 - protein, 5 aa, Mycobacterium
KASSV

SEQ ID NO: 1014390 - protein, 6 aa, Mycobacterium
KASYDA

SEQ ID NO: 1014391 - protein, 7 aa, Mycobacterium
KATAAAR

SEQ ID NO: 1014392 - protein, 6 aa, Mycobacterium
KATAEA

SEQ ID NO: 1014393 - protein, 7 aa, Mycobacterium
KATFAGD

SEQ ID NO: 1014394 - protein, 6 aa, Mycobacterium
KATGVR

SEQ ID NO: 1014395 - protein, 4 aa, Mycobacterium
KATL

SEQ ID NO: 1014396 - protein, 5 aa, Mycobacterium
KATPE

SEQ ID NO: 1014397 - protein, 7 aa, Mycobacterium
KATRDAD

SEQ ID NO: 1014398 - protein, 8 aa, Mycobacterium
KATVEGRP

SEQ ID NO: 1014399 - protein, 10 aa, Mycobacterium
KAVAESHPDG

SEQ ID NO: 1014400 - protein, 6 aa, Mycobacterium
KAVAPV

SEQ ID NO: 1014401 - protein, 7 aa, Mycobacterium
KAVPIPY

SEQ ID NO: 1014402 - protein, 8 aa, Mycobacterium
KAVRDNRM

SEQ ID NO: 1014403 - protein, 7 aa, Mycobacterium
KAVRGDG

SEQ ID NO: 1014404 - protein, 7 aa, Mycobacterium
KAVTDRP

SEQ ID NO: 1014405 - protein, 4 aa, Mycobacterium
KAYA

SEQ ID NO: 1014406 - protein, 7 aa, Mycobacterium
KAYADAG

SEQ ID NO: 1014407 - protein, 7 aa, Mycobacterium
KAYDTGD

SEQ ID NO: 1014408 - protein, 47 aa, Mycobacterium
KAYEDVDGQAAAALRNGGKGSVSPAALAANPAADPPTLADTQGSGVV

SEQ ID NO: 1014409 - protein, 12 aa, Mycobacterium
KAYGGQGLPDGS

SEQ ID NO: 1014410 - protein, 21 aa, Mycobacterium
KCGGPGAPCRYGGTPAPEPGP

SEQ ID NO: 1014411 - protein, 7 aa, Mycobacterium
KCSDTQF

SEQ ID NO: 1014412 - protein, 39 aa, Mycobacterium
KCSPSTPTSAGKSTRTGHCSPAPSTRRCASNRRDPMSRA

SEQ ID NO: 1014413 - protein, 7 aa, Mycobacterium
KCSTSRK

SEQ ID NO: 1014414 - protein, 9 aa, Mycobacterium
KDAEARAGA

SEQ ID NO: 1014415 - protein, 24 aa, Mycobacterium
KDAEGDQGSADPAGPDGSVASNAH

SEQ ID NO: 1014416 - protein, 4 aa, Mycobacterium
KDAP

SEQ ID NO: 1014417 - protein, 8 aa, Mycobacterium
KDAPPLPA

SEQ ID NO: 1014418 - protein, 5 aa, Mycobacterium
KDARA

SEQ ID NO: 1014419 - protein, 9 aa, Mycobacterium
KDARAYASA

SEQ ID NO: 1014420 - protein, 9 aa, Mycobacterium
KDATSPEKL

SEQ ID NO: 1014421 - protein, 17 aa, Mycobacterium
KDDGQPQIPVENPATGE

SEQ ID NO: 1014422 - protein, 8 aa, Mycobacterium
KDDLKSTV

SEQ ID NO: 1014423 - protein, 7 aa, Mycobacterium
KDDRRPV

SEQ ID NO: 1014424 - protein, 4 aa, Mycobacterium
KDDY

SEQ ID NO: 1014425 - protein, 6 aa, Mycobacterium
KDEEAP

SEQ ID NO: 1014426 - protein, 6 aa, Mycobacterium
KDEKHV

SEQ ID NO: 1014427 - protein, 12 aa, Mycobacterium
KDELPDLGEFNP

SEQ ID NO: 1014428 - protein, 8 aa, Mycobacterium
KDERPGRK

SEQ ID NO: 1014429 - protein, 8 aa, Mycobacterium
KDEYPATA

SEQ ID NO: 1014430 - protein, 9 aa, Mycobacterium
KDGAIAGPR

SEQ ID NO: 1014431 - protein, 12 aa, Mycobacterium
KDGDKGFQPNTE

SEQ ID NO: 1014432 - protein, 23 aa, Mycobacterium
KDGEAGEDEVARAEKDLDKSTHQ

SEQ ID NO: 1014433 - protein, 7 aa, Mycobacterium
KDGGTVD

SEQ ID NO: 1014434 - protein, 6 aa, Mycobacterium
KDGGVL

SEQ ID NO: 1014435 - protein, 9 aa, Mycobacterium
KDGPEREAA

SEQ ID NO: 1014436 - protein, 5 aa, Mycobacterium
KDGRD

SEQ ID NO: 1014437 - protein, 8 aa, Mycobacterium
KDGRPKPV

SEQ ID NO: 1014438 - protein, 7 aa, Mycobacterium
KDGSGGR

SEQ ID NO: 1014439 - protein, 11 aa, Mycobacterium
KDGTNAVGNRT

SEQ ID NO: 1014440 - protein, 7 aa, Mycobacterium
KDHGLTP

SEQ ID NO: 1014441 - protein, 8 aa, Mycobacterium
KDHPRRGF

SEQ ID NO: 1014442 - protein, 11 aa, Mycobacterium
KDKGTGKENTI

SEQ ID NO: 1014443 - protein, 16 aa, Mycobacterium
KDMEPNDPMEPEVTFV

SEQ ID NO: 1014444 - protein, 7 aa, Mycobacterium
KDNEGNP

SEQ ID NO: 1014445 - protein, 6 aa, Mycobacterium
KDNGRI

SEQ ID NO: 1014446 - protein, 13 aa, Mycobacterium
KDNPSNPSPPEAH

SEQ ID NO: 1014447 - protein, 9 aa, Mycobacterium
KDNTAGTDE

SEQ ID NO: 1014448 - protein, 6 aa, Mycobacterium
KDPAIS

SEQ ID NO: 1014449 - protein, 5 aa, Mycobacterium
KDPAR

SEQ ID NO: 1014450 - protein, 8 aa, Mycobacterium
KDPATPKI

SEQ ID NO: 1014451 - protein, 6 aa, Mycobacterium
KDPDEI

SEQ ID NO: 1014452 - protein, 6 aa, Mycobacterium
KDPETG

SEQ ID NO: 1014453 - protein, 5 aa, Mycobacterium
KDPEV

SEQ ID NO: 1014454 - protein, 12 aa, Mycobacterium
KDPHLSAADRNA

SEQ ID NO: 1014455 - protein, 4 aa, Mycobacterium
KDPR

SEQ ID NO: 1014456 - protein, 6 aa, Mycobacterium
KDPRMK

SEQ ID NO: 1014457 - protein, 4 aa, Mycobacterium
KDPS

SEQ ID NO: 1014458 - protein, 12 aa, Mycobacterium
KDPVGHKGARLT

SEQ ID NO: 1014459 - protein, 9 aa, Mycobacterium
KDQDGNPVL

SEQ ID NO: 1014460 - protein, 7 aa, Mycobacterium
KDQEEEV

SEQ ID NO: 1014461 - protein, 5 aa, Mycobacterium
KDREL

SEQ ID NO: 1014462 - protein, 5 aa, Mycobacterium
KDRER

SEQ ID NO: 1014463 - protein, 9 aa, Mycobacterium
KDRKQFGKS

SEQ ID NO: 1014464 - protein, 9 aa, Mycobacterium
KDRNPKWSP

SEQ ID NO: 1014465 - protein, 17 aa, Mycobacterium
KDRREGADTVVLLARGV

SEQ ID NO: 1014466 - protein, 6 aa, Mycobacterium
KDRRPS

SEQ ID NO: 1014467 - protein, 8 aa, Mycobacterium
KDRRQSLA

SEQ ID NO: 1014468 - protein, 4 aa, Mycobacterium
KDRT

SEQ ID NO: 1014469 - protein, 16 aa, Mycobacterium
KDSGLRGRGGAGFSTG

SEQ ID NO: 1014470 - protein, 13 aa, Mycobacterium
KDSPPSFDPSEVA

SEQ ID NO: 1014471 - protein, 5 aa, Mycobacterium
KDSSA

SEQ ID NO: 1014472 - protein, 14 aa, Mycobacterium
KDSVRGTYSNHSPR

SEQ ID NO: 1014473 - protein, 7 aa, Mycobacterium
KDTANAE

SEQ ID NO: 1014474 - protein, 11 aa, Mycobacterium
KDTDPSDKAAH

SEQ ID NO: 1014475 - protein, 10 aa, Mycobacterium
KDTGVQDASD

SEQ ID NO: 1014476 - protein, 7 aa, Mycobacterium
KDTTGSD

SEQ ID NO: 1014477 - protein, 9 aa, Mycobacterium
KDVIKSGGE

SEQ ID NO: 1014478 - protein, 8 aa, Mycobacterium
KDVNGAPA

SEQ ID NO: 1014479 - protein, 6 aa, Mycobacterium
KDVPVG

SEQ ID NO: 1014480 - protein, 14 aa, Mycobacterium
KDVTQLNNGKTSRW

SEQ ID NO: 1014481 - protein, 9 aa, Mycobacterium
KDWKGRTPN

SEQ ID NO: 1014482 - protein, 6 aa, Mycobacterium
KDWTES

SEQ ID NO: 1014483 - protein, 7 aa, Mycobacterium
KDWTPTQ

SEQ ID NO: 1014484 - protein, 20 aa, Mycobacterium
KEAAEEAKAKLEAAGASVSV

SEQ ID NO: 1014485 - protein, 6 aa, Mycobacterium
KEAEEL

SEQ ID NO: 1014486 - protein, 15 aa, Mycobacterium
KEAFGTQKRQRGMDR

SEQ ID NO: 1014487 - protein, 7 aa, Mycobacterium
KEAGADF

SEQ ID NO: 1014488 - protein, 6 aa, Mycobacterium
KEAIRG

SEQ ID NO: 1014489 - protein, 6 aa, Mycobacterium
KEAPDR

SEQ ID NO: 1014490 - protein, 6 aa, Mycobacterium
KEAPVN

SEQ ID NO: 1014491 - protein, 12 aa, Mycobacterium
KEATGSLDDGQL

SEQ ID NO: 1014492 - protein, 8 aa, Mycobacterium
KEDAVAEG

SEQ ID NO: 1014493 - protein, 8 aa, Mycobacterium
KEDDTVEV

SEQ ID NO: 1014494 - protein, 4 aa, Mycobacterium
KEDQ

SEQ ID NO: 1014495 - protein, 20 aa, Mycobacterium
KEEGAKVITGGERAELGGDL

SEQ ID NO: 1014496 - protein, 14 aa, Mycobacterium
KEEGARVVTGGERC

SEQ ID NO: 1014497 - protein, 7 aa, Mycobacterium
KEERLSE

SEQ ID NO: 1014498 - protein, 10 aa, Mycobacterium
KEGDADRGGN

SEQ ID NO: 1014499 - protein, 6 aa, Mycobacterium
KEGEEK

SEQ ID NO: 1014500 - protein, 10 aa, Mycobacterium
KEGSDEQQTR

SEQ ID NO: 1014501 - protein, 15 aa, Mycobacterium
KEGSKSRAKVEEQGI

SEQ ID NO: 1014502 - protein, 9 aa, Mycobacterium
KEGSTEPDG

SEQ ID NO: 1014503 - protein, 9 aa, Mycobacterium
KEGVEPQSE

SEQ ID NO: 1014504 - protein, 9 aa, Mycobacterium
KEHPAKPMS

SEQ ID NO: 1014505 - protein, 9 aa, Mycobacterium
KEKDEAVKG

SEQ ID NO: 1014506 - protein, 10 aa, Mycobacterium
KELEEAGGQA

SEQ ID NO: 1014507 - protein, 7 aa, Mycobacterium
KELQNDP

SEQ ID NO: 1014508 - protein, 9 aa, Mycobacterium
KELREQNGR

SEQ ID NO: 1014509 - protein, 8 aa, Mycobacterium
KENAEHSI

SEQ ID NO: 1014510 - protein, 5 aa, Mycobacterium
KENPR

SEQ ID NO: 1014511 - protein, 33 aa, Mycobacterium
KEPASGPTGGVSTTAGAPSGTTATAGPTVAPTQ

SEQ ID NO: 1014512 - protein, 6 aa, Mycobacterium
KEPMEV

SEQ ID NO: 1014513 - protein, 5 aa, Mycobacterium
KEQHR

SEQ ID NO: 1014514 - protein, 16 aa, Mycobacterium
KERAHNAGAKNVEERP

SEQ ID NO: 1014515 - protein, 8 aa, Mycobacterium
KERGSGER

SEQ ID NO: 1014516 - protein, 4 aa, Mycobacterium
KERK

SEQ ID NO: 1014517 - protein, 7 aa, Mycobacterium
KERREGD

SEQ ID NO: 1014518 - protein, 6 aa, Mycobacterium
KERRFQ

SEQ ID NO: 1014519 - protein, 7 aa, Mycobacterium
KERTQFG

SEQ ID NO: 1014520 - protein, 4 aa, Mycobacterium
KERV

SEQ ID NO: 1014521 - protein, 7 aa, Mycobacterium
KESAASD

SEQ ID NO: 1014522 - protein, 8 aa, Mycobacterium
KESRPDTK

SEQ ID NO: 1014523 - protein, 23 aa, Mycobacterium
KETGKPGKYKAISRSTAYHGTPH

SEQ ID NO: 1014524 - protein, 4 aa, Mycobacterium
KEVI

SEQ ID NO: 1014525 - protein, 7 aa, Mycobacterium
KEVSRRS

SEQ ID NO: 1014526 - protein, 11 aa, Mycobacterium
KEYGGGGYSPV

SEQ ID NO: 1014527 - protein, 11 aa, Mycobacterium
KEYGGQDRSPM

SEQ ID NO: 1014528 - protein, 6 aa, Mycobacterium
KEYQDL

SEQ ID NO: 1014529 - protein, 7 aa, Mycobacterium
KFADGSE

SEQ ID NO: 1014530 - protein, 5 aa, Mycobacterium
KFAGE

SEQ ID NO: 1014531 - protein, 7 aa, Mycobacterium
KFPGAKD

SEQ ID NO: 1014532 - protein, 7 aa, Mycobacterium
KFPGAND

SEQ ID NO: 1014533 - protein, 5 aa, Mycobacterium
KFPTS

SEQ ID NO: 1014534 - protein, 5 aa, Mycobacterium
KFSEE

SEQ ID NO: 1014535 - protein, 4 aa, Mycobacterium
KFTG

SEQ ID NO: 1014536 - protein, 12 aa, Mycobacterium
KGAAQDARPIGG

SEQ ID NO: 1014537 - protein, 12 aa, Mycobacterium
KGAATSSKGKGT

SEQ ID NO: 1014538 - protein, 9 aa, Mycobacterium
KGAGGGDGG

SEQ ID NO: 1014539 - protein, 9 aa, Mycobacterium
KGAPMPAPK

SEQ ID NO: 1014540 - protein, 15 aa, Mycobacterium
KGAPSDREIGSNFAA

SEQ ID NO: 1014541 - protein, 9 aa, Mycobacterium
KGAQPQAAK

SEQ ID NO: 1014542 - protein, 8 aa, Mycobacterium
KGARLDPA

SEQ ID NO: 1014543 - protein, 10 aa, Mycobacterium
KGDAAKTATT

SEQ ID NO: 1014544 - protein, 7 aa, Mycobacterium
KGDGVGK

SEQ ID NO: 1014545 - protein, 4 aa, Mycobacterium
KGDL

SEQ ID NO: 1014546 - protein, 5 aa, Mycobacterium
KGDNR

SEQ ID NO: 1014547 - protein, 15 aa, Mycobacterium
KGDPTLDAGELLKAS

SEQ ID NO: 1014548 - protein, 4 aa, Mycobacterium
KGDS

SEQ ID NO: 1014549 - protein, 9 aa, Mycobacterium
KGDVDSSTV

SEQ ID NO: 1014550 - protein, 8 aa, Mycobacterium
KGDVGEDI

SEQ ID NO: 1014551 - protein, 4 aa, Mycobacterium
KGEA

SEQ ID NO: 1014552 - protein, 6 aa, Mycobacterium
KGEAKD

SEQ ID NO: 1014553 - protein, 8 aa, Mycobacterium
KGFPPSTL

SEQ ID NO: 1014554 - protein, 7 aa, Mycobacterium
KGFTSGL

SEQ ID NO: 1014555 - protein, 11 aa, Mycobacterium
KGGAGKTTTTV

SEQ ID NO: 1014556 - protein, 22 aa, Mycobacterium
KGGDGAPGGPGQPGGNGGAAGL

SEQ ID NO: 1014557 - protein, 13 aa, Mycobacterium
KGGDHQVPNARKT

SEQ ID NO: 1014558 - protein, 7 aa, Mycobacterium
KGGDYLA

SEQ ID NO: 1014559 - protein, 6 aa, Mycobacterium
KGGEQL

SEQ ID NO: 1014560 - protein, 9 aa, Mycobacterium
KGGGFAGPR

SEQ ID NO: 1014561 - protein, 14 aa, Mycobacterium
KGGGSVKCCTLEVH

SEQ ID NO: 1014562 - protein, 10 aa, Mycobacterium
KGGKDFAGPS

SEQ ID NO: 1014563 - protein, 17 aa, Mycobacterium
KGGKEGPRATLVGQHPR

SEQ ID NO: 1014564 - protein, 10 aa, Mycobacterium
KGGKSEELKA

SEQ ID NO: 1014565 - protein, 4 aa, Mycobacterium
KGGQ

SEQ ID NO: 1014566 - protein, 4 aa, Mycobacterium
KGGR

SEQ ID NO: 1014567 - protein, 5 aa, Mycobacterium
KGGSN

SEQ ID NO: 1014568 - protein, 9 aa, Mycobacterium
KGGTGKSTI

SEQ ID NO: 1014569 - protein, 15 aa, Mycobacterium
KGHETGQRGGAEVRP

SEQ ID NO: 1014570 - protein, 4 aa, Mycobacterium
KGHP

SEQ ID NO: 1014571 - protein, 65 aa, Mycobacterium
KGIEDESPALTYSGPSEDGSAQVQRNGGGAAKTPAGVPAGRSRRERREAARRQGRGAKPPKSVKK

SEQ ID NO: 1014572 - protein, 14 aa, Mycobacterium
KGIGESATVGSPPA

SEQ ID NO: 1014573 - protein, 7 aa, Mycobacterium
KGITHEQ

SEQ ID NO: 1014574 - protein, 5 aa, Mycobacterium
KGITS

SEQ ID NO: 1014575 - protein, 7 aa, Mycobacterium
KGKLTAR

SEQ ID NO: 1014576 - protein, 8 aa, Mycobacterium
KGKNAAEV

SEQ ID NO: 1014577 - protein, 6 aa, Mycobacterium
KGKRFN

SEQ ID NO: 1014578 - protein, 8 aa, Mycobacterium
KGKRSATI

SEQ ID NO: 1014579 - protein, 14 aa, Mycobacterium
KGKRTFQPNNRRRA

SEQ ID NO: 1014580 - protein, 6 aa, Mycobacterium
KGLGGE

SEQ ID NO: 1014581 - protein, 24 aa, Mycobacterium
KGLPLKPDATSTSLPGARGADVDG

SEQ ID NO: 1014582 - protein, 8 aa, Mycobacterium
KGLPTDDP

SEQ ID NO: 1014583 - protein, 7 aa, Mycobacterium
KGLSTHE

SEQ ID NO: 1014584 - protein, 6 aa, Mycobacterium
KGMTDL

SEQ ID NO: 1014585 - protein, 14 aa, Mycobacterium
KGNAAAKDHTAAVG

SEQ ID NO: 1014586 - protein, 31 aa, Mycobacterium
KGNGGAGGADGIGGTGGIGGDGSRGDTPLGP

SEQ ID NO: 1014587 - protein, 16 aa, Mycobacterium
KGNKQRTAPFGQPAAE

SEQ ID NO: 1014588 - protein, 4 aa, Mycobacterium
KGNL

SEQ ID NO: 1014589 - protein, 8 aa, Mycobacterium
KGNTVNPD

SEQ ID NO: 1014590 - protein, 5 aa, Mycobacterium
KGPAE

SEQ ID NO: 1014591 - protein, 19 aa, Mycobacterium
KGPDQQKPAGVLSGGERNR

SEQ ID NO: 1014592 - protein, 8 aa, Mycobacterium
KGPEVSNT

SEQ ID NO: 1014593 - protein, 8 aa, Mycobacterium
KGPGATSI

SEQ ID NO: 1014594 - protein, 7 aa, Mycobacterium
KGPMGTA

SEQ ID NO: 1014595 - protein, 13 aa, Mycobacterium
KGPPAAGDRETPA

SEQ ID NO: 1014596 - protein, 4 aa, Mycobacterium
KGQD

SEQ ID NO: 1014597 - protein, 6 aa, Mycobacterium
KGQGNV

SEQ ID NO: 1014598 - protein, 6 aa, Mycobacterium
KGQSFL

SEQ ID NO: 1014599 - protein, 33 aa, Mycobacterium; identical to SEQ ID NO: 512204

SEQ ID NO: 1014600 - protein, 8 aa, Mycobacterium
KGQVGAGG

SEQ ID NO: 1014601 - protein, 6 aa, Mycobacterium
KGRPEV

SEQ ID NO: 1014602 - protein, 13 aa, Mycobacterium
KGRYPDRKTARRV

SEQ ID NO: 1014603 - protein, 11 aa, Mycobacterium
KGSAESQLSYT

SEQ ID NO: 1014604 - protein, 9 aa, Mycobacterium
KGSDAQLRA

SEQ ID NO: 1014605 - protein, 10 aa, Mycobacterium
KGSGDTSGYG

SEQ ID NO: 1014606 - protein, 6 aa, Mycobacterium
KGSGPG

SEQ ID NO: 1014607 - protein, 9 aa, Mycobacterium
KGSGQQEVA

SEQ ID NO: 1014608 - protein, 5 aa, Mycobacterium
KGSKA

SEQ ID NO: 1014609 - protein, 7 aa, Mycobacterium
KGSLGGN

SEQ ID NO: 1014610 - protein, 12 aa, Mycobacterium
KGSLRGQGSGVV

SEQ ID NO: 1014611 - protein, 7 aa, Mycobacterium
KGSTVNR

SEQ ID NO: 1014612 - protein, 8 aa, Mycobacterium
KGTAGAAV

SEQ ID NO: 1014613 - protein, 5 aa, Mycobacterium
KGTDR

SEQ ID NO: 1014614 - protein, 5 aa, Mycobacterium
KGTFR

SEQ ID NO: 1014615 - protein, 5 aa, Mycobacterium
KGTGI

SEQ ID NO: 1014616 - protein, 9 aa, Mycobacterium
KGTIGDGSR

SEQ ID NO: 1014617 - protein, 7 aa, Mycobacterium
KGTMTAA

SEQ ID NO: 1014618 - protein, 7 aa, Mycobacterium
KGTPGLS

SEQ ID NO: 1014619 - protein, 5 aa, Mycobacterium
KGTRL

SEQ ID NO: 1014620 - protein, 11 aa, Mycobacterium
KGTSLSTHTPD

SEQ ID NO: 1014621 - protein, 8 aa, Mycobacterium
KGTVESGL

SEQ ID NO: 1014622 - protein, 16 aa, Mycobacterium
KGVAAKGGWGPGQDGD

SEQ ID NO: 1014623 - protein, 7 aa, Mycobacterium
KGVPEGQ

SEQ ID NO: 1014624 - protein, 6 aa, Mycobacterium
KGVSQM

SEQ ID NO: 1014625 - protein, 27 aa, Mycobacterium
KGYSATGIDGSATAIERARDNAAKAGV

SEQ ID NO: 1014626 - protein, 6 aa, Mycobacterium
KGYSDN

SEQ ID NO: 1014627 - protein, 11 aa, Mycobacterium
KGYSQGDPYGN

SEQ ID NO: 1014628 - protein, 7 aa, Mycobacterium
KGYSTRA

SEQ ID NO: 1014629 - protein, 13 aa, Mycobacterium
KGYTAETVPAEGE

SEQ ID NO: 1014630 - protein, 4 aa, Mycobacterium
KGYV

SEQ ID NO: 1014631 - protein, 17 aa, Mycobacterium
KHAHDKRQDLARRDAQR

SEQ ID NO: 1014632 - protein, 6 aa, Mycobacterium
KHDAAS

SEQ ID NO: 1014633 - protein, 13 aa, Mycobacterium
KHGAQPSESVESD

SEQ ID NO: 1014634 - protein, 7 aa, Mycobacterium
KHGDEAV

SEQ ID NO: 1014635 - protein, 10 aa, Mycobacterium
KHGLDSEEAI

SEQ ID NO: 1014636 - protein, 8 aa, Mycobacterium
KHGQGSPF

SEQ ID NO: 1014637 - protein, 7 aa, Mycobacterium
KHGREPG

SEQ ID NO: 1014638 - protein, 14 aa, Mycobacterium
KHKPPGYRPPEGAV

SEQ ID NO: 1014639 - protein, 8 aa, Mycobacterium
KHLEPGQA

SEQ ID NO: 1014640 - protein, 5 aa, Mycobacterium
KHPDL

SEQ ID NO: 1014641 - protein, 7 aa, Mycobacterium
KHPENVP

SEQ ID NO: 1014642 - protein, 4 aa, Mycobacterium
KHPG

SEQ ID NO: 1014643 - protein, 14 aa, Mycobacterium
KHPGTGGLVSPDTV

SEQ ID NO: 1014644 - protein, 9 aa, Mycobacterium
KHPRGRAGW

SEQ ID NO: 1014645 - protein, 6 aa, Mycobacterium
KHQDTA

SEQ ID NO: 1014646 - protein, 16 aa, Mycobacterium
KHRGHATELGEAAAAA

SEQ ID NO: 1014647 - protein, 6 aa, Mycobacterium
KHRPRT

SEQ ID NO: 1014648 - protein, 13 aa, Mycobacterium
KHSEARDLQNERS

SEQ ID NO: 1014649 - protein, 5 aa, Mycobacterium
KHSEV

SEQ ID NO: 1014650 - protein, 6 aa, Mycobacterium
KHTDTA

SEQ ID NO: 1014651 - protein, 11 aa, Mycobacterium
KHYQGDDTDLK

SEQ ID NO: 1014652 - protein, 7 aa, Mycobacterium
KIADDGE

SEQ ID NO: 1014653 - protein, 5 aa, Mycobacterium
KIAES

SEQ ID NO: 1014654 - protein, 12 aa, Mycobacterium
KIAKDRGIGGPV

SEQ ID NO: 1014655 - protein, 6 aa, Mycobacterium
KIANNE

SEQ ID NO: 1014656 - protein, 9 aa, Mycobacterium
KIDEDSDVD

SEQ ID NO: 1014657 - protein, 5 aa, Mycobacterium
KIDGD

SEQ ID NO: 1014658 - protein, 13 aa, Mycobacterium
KIDPPAQAKPPEQ

SEQ ID NO: 1014659 - protein, 9 aa, Mycobacterium
KIGTTGRGI

SEQ ID NO: 1014660 - protein, 7 aa, Mycobacterium
KIPATEP

SEQ ID NO: 1014661 - protein, 6 aa, Mycobacterium
KIPDED

SEQ ID NO: 1014662 - protein, 8 aa, Mycobacterium
KIPSGPMA

SEQ ID NO: 1014663 - protein, 7 aa, Mycobacterium
KIPTERT

SEQ ID NO: 1014664 - protein, 7 aa, Mycobacterium
KIRDDPR

SEQ ID NO: 1014665 - protein, 6 aa, Mycobacterium
KIREGE

SEQ ID NO: 1014666 - protein, 6 aa, Mycobacterium
KISAAG

SEQ ID NO: 1014667 - protein, 7 aa, Mycobacterium
KISDEGL

SEQ ID NO: 1014668 - protein, 6 aa, Mycobacterium
KITPRE

SEQ ID NO: 1014669 - protein, 28 aa, Mycobacterium
KKAAAKGAGEDKKGNVDDALKMHSGSKP

SEQ ID NO: 1014670 - protein, 8 aa, Mycobacterium
KKAAGSVD

SEQ ID NO: 1014671 - protein, 9 aa, Mycobacterium
KKAAKNGDL

SEQ ID NO: 1014672 - protein, 8 aa, Mycobacterium
KKAHPNIK

SEQ ID NO: 1014673 - protein, 7 aa, Mycobacterium
KKARSGQ

SEQ ID NO: 1014674 - protein, 7 aa, Mycobacterium
KKDGADW

SEQ ID NO: 1014675 - protein, 12 aa, Mycobacterium
KKENHLRQNRPN

SEQ ID NO: 1014676 - protein, 4 aa, Mycobacterium
KKEP

SEQ ID NO: 1014677 - protein, 6 aa, Mycobacterium
KKGGAD

SEQ ID NO: 1014678 - protein, 10 aa, Mycobacterium
KKGGLDQTRT

SEQ ID NO: 1014679 - protein, 17 aa, Mycobacterium
KKGQKTRRREKKNVPHG

SEQ ID NO: 1014680 - protein, 8 aa, Mycobacterium
KKHESRQV

SEQ ID NO: 1014681 - protein, 14 aa, Mycobacterium
KKKDPDTSKNVDDH

SEQ ID NO: 1014682 - protein, 33 aa, Mycobacterium
KKKKKKKKKKNSPMSSKSIRSNPTDTSYEPKTG

SEQ ID NO: 1014683 - protein, 28 aa, Mycobacterium
KKKVARAKRAPTEKTAVTEESSAAQLAP

SEQ ID NO: 1014684 - protein, 19 aa, Mycobacterium
KKLQEQQAESVPDDVPAEQ

SEQ ID NO: 1014685 - protein, 8 aa, Mycobacterium
KKLSAPVG

SEQ ID NO: 1014686 - protein, 10 aa, Mycobacterium
KKNRRNDPDR

SEQ ID NO: 1014687 - protein, 6 aa, Mycobacterium
KKNVAK

SEQ ID NO: 1014688 - protein, 7 aa, Mycobacterium
KKPADTK

SEQ ID NO: 1014689 - protein, 5 aa, Mycobacterium
KKPGI

SEQ ID NO: 1014690 - protein, 6 aa, Mycobacterium
KKPSTA

SEQ ID NO: 1014691 - protein, 13 aa, Mycobacterium
KKQAQESVAAEAT

SEQ ID NO: 1014692 - protein, 12 aa, Mycobacterium
KKQMKAAAKAAK

SEQ ID NO: 1014693 - protein, 9 aa, Mycobacterium
KKQTGGSGQ

SEQ ID NO: 1014694 - protein, 7 aa, Mycobacterium
KKRGWSG

SEQ ID NO: 1014695 - protein, 6 aa, Mycobacterium
KKRRSV

SEQ ID NO: 1014696 - protein, 20 aa, Mycobacterium
KKRYKASTTTRNLRTLDKVL

SEQ ID NO: 1014697 - protein, 9 aa, Mycobacterium
KKSARGEYE

SEQ ID NO: 1014698 - protein, 5 aa, Mycobacterium
KKSLA

SEQ ID NO: 1014699 - protein, 15 aa, Mycobacterium
KKSSTGAASDAHREP

SEQ ID NO: 1014700 - protein, 15 aa, Mycobacterium
KKTGRPRNPTPEFSD

SEQ ID NO: 1014701 - protein, 15 aa, Mycobacterium
KKTPESFPGGDPVEE

SEQ ID NO: 1014702 - protein, 8 aa, Mycobacterium
KKYTTPEI

SEQ ID NO: 1014703 - protein, 7 aa, Mycobacterium
KLADGRQ

SEQ ID NO: 1014704 - protein, 12 aa, Mycobacterium
KLAERQGEKSYA

SEQ ID NO: 1014705 - protein, 5 aa, Mycobacterium
KLAGG

SEQ ID NO: 1014706 - protein, 7 aa, Mycobacterium
KLAGSGA

SEQ ID NO: 1014707 - protein, 8 aa, Mycobacterium
KLASGDVN

SEQ ID NO: 1014708 - protein, 9 aa, Mycobacterium
KLASKQRGI

SEQ ID NO: 1014709 - protein, 12 aa, Mycobacterium
KLASPSEGIPEG

SEQ ID NO: 1014710 - protein, 9 aa, Mycobacterium
KLATPDTSV

SEQ ID NO: 1014711 - protein, 5 aa, Mycobacterium
KLDDH

SEQ ID NO: 1014712 - protein, 11 aa, Mycobacterium
KLDQPDSRTVA

SEQ ID NO: 1014713 - protein, 17 aa, Mycobacterium
KLENGSKAIYNPHYEIQ

SEQ ID NO: 1014714 - protein, 4 aa, Mycobacterium
KLGE

SEQ ID NO: 1014715 - protein, 7 aa, Mycobacterium
KLGGDDS

SEQ ID NO: 1014716 - protein, 5 aa, Mycobacterium
KLGNR

SEQ ID NO: 1014717 - protein, 9 aa, Mycobacterium
KLGQESQAL

SEQ ID NO: 1014718 - protein, 12 aa, Mycobacterium
KLGTPSVDPPLE

SEQ ID NO: 1014719 - protein, 11 aa, Mycobacterium
KLGTRSVASGE

SEQ ID NO: 1014720 - protein, 4 aa, Mycobacterium
KLNG

SEQ ID NO: 1014721 - protein, 6 aa, Mycobacterium
KLPDDP

SEQ ID NO: 1014722 - protein, 5 aa, Mycobacterium
KLPEG

SEQ ID NO: 1014723 - protein, 15 aa, Mycobacterium
KLPHPAPLPADRRPG

SEQ ID NO: 1014724 - protein, 13 aa, Mycobacterium
KLPMETDEDGQIV

SEQ ID NO: 1014725 - protein, 5 aa, Mycobacterium
KLPPV

SEQ ID NO: 1014726 - protein, 7 aa, Mycobacterium
KLPQDRT

SEQ ID NO: 1014727 - protein, 8 aa, Mycobacterium
KLPSAVDE

SEQ ID NO: 1014728 - protein, 6 aa, Mycobacterium
KLPSTM

SEQ ID NO: 1014729 - protein, 13 aa, Mycobacterium
KLPTPTSQDDEVP

SEQ ID NO: 1014730 - protein, 7 aa, Mycobacterium
KLRGKKV

SEQ ID NO: 1014731 - protein, 10 aa, Mycobacterium
KLRGSIPANQ

SEQ ID NO: 1014732 - protein, 4 aa, Mycobacterium
KLRK

SEQ ID NO: 1014733 - protein, 6 aa, Mycobacterium
KLRPKI

SEQ ID NO: 1014734 - protein, 8 aa, Mycobacterium
KLRSEAID

SEQ ID NO: 1014735 - protein, 6 aa, Mycobacterium
KLSAGM

SEQ ID NO: 1014736 - protein, 4 aa, Mycobacterium
KLSE

SEQ ID NO: 1014737 - protein, 6 aa, Mycobacterium
KLSEEQ

SEQ ID NO: 1014738 - protein, 11 aa, Mycobacterium
KLSGGQRKRAS

SEQ ID NO: 1014739 - protein, 6 aa, Mycobacterium
KLSNKL

SEQ ID NO: 1014740 - protein, 18 aa, Mycobacterium
KLSPDQVSATELAGEPIT

SEQ ID NO: 1014741 - protein, 9 aa, Mycobacterium
KLSPKGTGA

SEQ ID NO: 1014742 - protein, 9 aa, Mycobacterium
KLSPTVDMT

SEQ ID NO: 1014743 - protein, 7 aa, Mycobacterium
KLTDAPR

SEQ ID NO: 1014744 - protein, 7 aa, Mycobacterium
KLTDDDW

SEQ ID NO: 1014745 - protein, 5 aa, Mycobacterium
KLTGQ

SEQ ID NO: 1014746 - protein, 7 aa, Mycobacterium
KLTSGAG

SEQ ID NO: 1014747 - protein, 7 aa, Mycobacterium
KLTTEGV

SEQ ID NO: 1014748 - protein, 4 aa, Mycobacterium
KMAE

SEQ ID NO: 1014749 - protein, 4 aa, Mycobacterium
KMEK

SEQ ID NO: 1014750 - protein, 10 aa, Mycobacterium
KMEQPSARQP

SEQ ID NO: 1014751 - protein, 9 aa, Mycobacterium
KMPQGDSAV

SEQ ID NO: 1014752 - protein, 9 aa, Mycobacterium
KMRDSAVAG

SEQ ID NO: 1014753 - protein, 7 aa, Mycobacterium
KNAAGVS

SEQ ID NO: 1014754 - protein, 8 aa, Mycobacterium
KNAEPSDI

SEQ ID NO: 1014755 - protein, 6 aa, Mycobacterium
KNAGAQ

SEQ ID NO: 1014756 - protein, 8 aa, Mycobacterium
KNAGPGGT

SEQ ID NO: 1014757 - protein, 6 aa, Mycobacterium
KNAPRG

SEQ ID NO: 1014758 - protein, 8 aa, Mycobacterium
KNAQEAHE

SEQ ID NO: 1014759 - protein, 19 aa, Mycobacterium
KNASRGRQTVSSCNSVGEG

SEQ ID NO: 1014760 - protein, 6 aa, Mycobacterium
KNDAGK

SEQ ID NO: 1014761 - protein, 4 aa, Mycobacterium
KNDI

SEQ ID NO: 1014762 - protein, 5 aa, Mycobacterium
KNELR

SEQ ID NO: 1014763 - protein, 6 aa, Mycobacterium
KNFSGH

SEQ ID NO: 1014764 - protein, 9 aa, Mycobacterium
KNFSGNGDN

SEQ ID NO: 1014765 - protein, 6 aa, Mycobacterium
KNGKNV

SEQ ID NO: 1014766 - protein, 5 aa, Mycobacterium
KNGMP

SEQ ID NO: 1014767 - protein, 6 aa, Mycobacterium
KNGPYL

SEQ ID NO: 1014768 - protein, 6 aa, Mycobacterium
KNGRHS

SEQ ID NO: 1014769 - protein, 6 aa, Mycobacterium
KNGSYS

SEQ ID NO: 1014770 - protein, 9 aa, Mycobacterium
KNISAGQVE

SEQ ID NO: 1014771 - protein, 6 aa, Mycobacterium
KNKGVQ

SEQ ID NO: 1014772 - protein, 5 aa, Mycobacterium
KNKKS

SEQ ID NO: 1014773 - protein, 8 aa, Mycobacterium
KNKLERSL

SEQ ID NO: 1014774 - protein, 16 aa, Mycobacterium
KNPAPAPAEPVYPNYA

SEQ ID NO: 1014775 - protein, 5 aa, Mycobacterium
KNPDW

SEQ ID NO: 1014776 - protein, 10 aa, Mycobacterium
KNPEEAQRRE

SEQ ID NO: 1014777 - protein, 6 aa, Mycobacterium
KNPGQD

SEQ ID NO: 1014778 - protein, 15 aa, Mycobacterium
KNPPAGSFSPGGHDA

SEQ ID NO: 1014779 - protein, 9 aa, Mycobacterium
KNQTYNTPA

SEQ ID NO: 1014780 - protein, 6 aa, Mycobacterium
KNREAG

SEQ ID NO: 1014781 - protein, 8 aa, Mycobacterium
KNRRNDPD

SEQ ID NO: 1014782 - protein, 8 aa, Mycobacterium
KNSDESKL

SEQ ID NO: 1014783 - protein, 8 aa, Mycobacterium
KNSGGAMT

SEQ ID NO: 1014784 - protein, 14 aa, Mycobacterium
KNSGIGRENGPEGV

SEQ ID NO: 1014785 - protein, 15 aa, Mycobacterium
KNSITPRDALASAGK

SEQ ID NO: 1014786 - protein, 16 aa, Mycobacterium
KNSRHGLQNPNARYRK

SEQ ID NO: 1014787 - protein, 10 aa, Mycobacterium
KNSTIGAGTK

SEQ ID NO: 1014788 - protein, 9 aa, Mycobacterium
KNVPTARSE

SEQ ID NO: 1014789 - protein, 8 aa, Mycobacterium
KNYDGSWT

SEQ ID NO: 1014790 - protein, 13 aa, Mycobacterium
KPAAGADPRSGRW

SEQ ID NO: 1014791 - protein, 4 aa, Mycobacterium
KPAD

SEQ ID NO: 1014792 - protein, 12 aa, Mycobacterium
KPADGMFQERRR

SEQ ID NO: 1014793 - protein, 13 aa, Mycobacterium
KPAEGVPGTERTP

SEQ ID NO: 1014794 - protein, 24 aa, Mycobacterium
KPAHASADRIDGKRLGEQFGLVVD

SEQ ID NO: 1014795 - protein, 10 aa, Mycobacterium
KPAKDDKAEE

SEQ ID NO: 1014796 - protein, 7 aa, Mycobacterium
KPALVSG

SEQ ID NO: 1014797 - protein, 8 aa, Mycobacterium
KPAPEAFS

SEQ ID NO: 1014798 - protein, 8 aa, Mycobacterium
KPAPETPL

SEQ ID NO: 1014799 - protein, 11 aa, Mycobacterium
KPAPPAPPLPI

SEQ ID NO: 1014800 - protein, 7 aa, Mycobacterium
KPAPPFV

SEQ ID NO: 1014801 - protein, 8 aa, Mycobacterium
KPAPSVSQ

SEQ ID NO: 1014802 - protein, 10 aa, Mycobacterium
KPARGGSSIG

SEQ ID NO: 1014803 - protein, 8 aa, Mycobacterium
KPDDFQDK

SEQ ID NO: 1014804 - protein, 6 aa, Mycobacterium
KPDKMR

SEQ ID NO: 1014805 - protein, 6 aa, Mycobacterium
KPDPAA

SEQ ID NO: 1014806 - protein, 6 aa, Mycobacterium
KPDPLA

SEQ ID NO: 1014807 - protein, 5 aa, Mycobacterium
KPDTE

SEQ ID NO: 1014808 - protein, 13 aa, Mycobacterium
KPDWQGALTPENT

SEQ ID NO: 1014809 - protein, 9 aa, Mycobacterium
KPEADGGFS

SEQ ID NO: 1014810 - protein, 5 aa, Mycobacterium
KPEAI

SEQ ID NO: 1014811 - protein, 6 aa, Mycobacterium
KPEDRA

SEQ ID NO: 1014812 - protein, 10 aa, Mycobacterium
KPEESERTFG

SEQ ID NO: 1014813 - protein, 6 aa, Mycobacterium
KPELDR

SEQ ID NO: 1014814 - protein, 6 aa, Mycobacterium
KPEQEE

SEQ ID NO: 1014815 - protein, 6 aa, Mycobacterium
KPERQR

SEQ ID NO: 1014816 - protein, 10 aa, Mycobacterium
KPERVGSRNP

SEQ ID NO: 1014817 - protein, 6 aa, Mycobacterium
KPESVD

SEQ ID NO: 1014818 - protein, 6 aa, Mycobacterium
KPFGGG

SEQ ID NO: 1014819 - protein, 6 aa, Mycobacterium
KPFKKE

SEQ ID NO: 1014820 - protein, 4 aa, Mycobacterium
KPFT

SEQ ID NO: 1014821 - protein, 11 aa, Mycobacterium
KPGADLADRET

SEQ ID NO: 1014822 - protein, 9 aa, Mycobacterium
KPGAGSLSV

SEQ ID NO: 1014823 - protein, 9 aa, Mycobacterium
KPGAPARLD

SEQ ID NO: 1014824 - protein, 4 aa, Mycobacterium
KPGC

SEQ ID NO: 1014825 - protein, 6 aa, Mycobacterium
KPGDIT

SEQ ID NO: 1014826 - protein, 12 aa, Mycobacterium
KPGDKVKKGQEI

SEQ ID NO: 1014827 - protein, 8 aa, Mycobacterium
KPGDVATA

SEQ ID NO: 1014828 - protein, 10 aa, Mycobacterium
KPGEPLPGDA

SEQ ID NO: 1014829 - protein, 9 aa, Mycobacterium
KPGETDPMT

SEQ ID NO: 1014830 - protein, 6 aa, Mycobacterium
KPGLER

SEQ ID NO: 1014831 - protein, 7 aa, Mycobacterium
KPGLRQA

SEQ ID NO: 1014832 - protein, 7 aa, Mycobacterium
KPGRPAI

SEQ ID NO: 1014833 - protein, 17 aa, Mycobacterium
KPGSLSSSYDDRTQPMD

SEQ ID NO: 1014834 - protein, 10 aa, Mycobacterium
KPGSRDDATE

SEQ ID NO: 1014835 - protein, 4 aa, Mycobacterium
KPGV

SEQ ID NO: 1014836 - protein, 13 aa, Mycobacterium
KPGVGNDEGDGDE

SEQ ID NO: 1014837 - protein, 21 aa, Mycobacterium
KPGYTGPSPGKAAAAAATTRC

SEQ ID NO: 1014838 - protein, 28 aa, Mycobacterium
KPHRESLDDPLDGDPATKTQDEQGDLEK

SEQ ID NO: 1014839 - protein, 7 aa, Mycobacterium
KPIDDQT

SEQ ID NO: 1014840 - protein, 7 aa, Mycobacterium
KPIDSQS

SEQ ID NO: 1014841 - protein, 11 aa, Mycobacterium
KPIEDAGREVQ

SEQ ID NO: 1014842 - protein, 7 aa, Mycobacterium
KPIPTGK

SEQ ID NO: 1014843 - protein, 8 aa, Mycobacterium
KPISENAN

SEQ ID NO: 1014844 - protein, 9 aa, Mycobacterium
KPKGMDEKM

SEQ ID NO: 1014845 - protein, 13 aa, Mycobacterium
KPKRRTKAQIARE

SEQ ID NO: 1014846 - protein, 7 aa, Mycobacterium
KPLAGPG

SEQ ID NO: 1014847 - protein, 8 aa, Mycobacterium
KPLDGSAE

SEQ ID NO: 1014848 - protein, 11 aa, Mycobacterium
KPLDQTAATPG

SEQ ID NO: 1014849 - protein, 10 aa, Mycobacterium
KPLGKDEAVA

SEQ ID NO: 1014850 - protein, 7 aa, Mycobacterium
KPLPLSP

SEQ ID NO: 1014851 - protein, 5 aa, Mycobacterium
KPMAA

SEQ ID NO: 1014852 - protein, 6 aa, Mycobacterium
KPPAFE

SEQ ID NO: 1014853 - protein, 6 aa, Mycobacterium
KPPHPE

SEQ ID NO: 1014854 - protein, 12 aa, Mycobacterium
KPPLFGTEPDAR

SEQ ID NO: 1014855 - protein, 5 aa, Mycobacterium
KPPLP

SEQ ID NO: 1014856 - protein, 8 aa, Mycobacterium
KPPRVRVT

SEQ ID NO: 1014857 - protein, 4 aa, Mycobacterium
KPQA

SEQ ID NO: 1014858 - protein, 6 aa, Mycobacterium
KPQADV

SEQ ID NO: 1014859 - protein, 6 aa, Mycobacterium
KPQPGY

SEQ ID NO: 1014860 - protein, 8 aa, Mycobacterium
KPQSQASI

SEQ ID NO: 1014861 - protein, 6 aa, Mycobacterium
KPRKII

SEQ ID NO: 1014862 - protein, 8 aa, Mycobacterium
KPRPPQFR

SEQ ID NO: 1014863 - protein, 8 aa, Mycobacterium
KPRPVPTP

SEQ ID NO: 1014864 - protein, 6 aa, Mycobacterium
KPRQER

SEQ ID NO: 1014865 - protein, 7 aa, Mycobacterium
KPRSTPG

SEQ ID NO: 1014866 - protein, 8 aa, Mycobacterium
KPRTGPPE

SEQ ID NO: 1014867 - protein, 30 aa, Mycobacterium
KPSAATPRGTTGTSSSPVGTASTGSATSKW

SEQ ID NO: 1014868 - protein, 8 aa, Mycobacterium
KPSAPDVS

SEQ ID NO: 1014869 - protein, 9 aa, Mycobacterium
KPSASKGRY

SEQ ID NO: 1014870 - protein, 6 aa, Mycobacterium
KPSEFT

SEQ ID NO: 1014871 - protein, 7 aa, Mycobacterium
KPSGMTS

SEQ ID NO: 1014872 - protein, 7 aa, Mycobacterium
KPSQGRI

SEQ ID NO: 1014873 - protein, 12 aa, Mycobacterium
KPSQLSGGQRQR

SEQ ID NO: 1014874 - protein, 7 aa, Mycobacterium
KPTKADV

SEQ ID NO: 1014875 - protein, 8 aa, Mycobacterium
KPTKPGSY

SEQ ID NO: 1014876 - protein, 7 aa, Mycobacterium
KPTPLGG

SEQ ID NO: 1014877 - protein, 4 aa, Mycobacterium
KPTQ

SEQ ID NO: 1014878 - protein, 5 aa, Mycobacterium
KPTVS

SEQ ID NO: 1014879 - protein, 7 aa, Mycobacterium
KPTYGTV

SEQ ID NO: 1014880 - protein, 6 aa, Mycobacterium
KPVAGQ

SEQ ID NO: 1014881 - protein, 6 aa, Mycobacterium
KPVEEL

SEQ ID NO: 1014882 - protein, 11 aa, Mycobacterium
KPVGRRGEAGL

SEQ ID NO: 1014883 - protein, 4 aa, Mycobacterium
KPVP

SEQ ID NO: 1014884 - protein, 13 aa, Mycobacterium
KPVPVPKPSGPDV

SEQ ID NO: 1014885 - protein, 8 aa, Mycobacterium
KPVTPART

SEQ ID NO: 1014886 - protein, 5 aa, Mycobacterium
KPYDE

SEQ ID NO: 1014887 - protein, 9 aa, Mycobacterium
KPYPTPQSR

SEQ ID NO: 1014888 - protein, 6 aa, Mycobacterium
KPYRAA

SEQ ID NO: 1014889 - protein, 6 aa, Mycobacterium
KPYSYT

SEQ ID NO: 1014890 - protein, 8 aa, Mycobacterium
KQADGGRA

SEQ ID NO: 1014891 - protein, 9 aa, Mycobacterium
KQAEEATDK

SEQ ID NO: 1014892 - protein, 12 aa, Mycobacterium
KQAIGRATNNVA

SEQ ID NO: 1014893 - protein, 10 aa, Mycobacterium
KQALKERKTI

SEQ ID NO: 1014894 - protein, 5 aa, Mycobacterium
KQANL

SEQ ID NO: 1014895 - protein, 6 aa, Mycobacterium
KQANQV

SEQ ID NO: 1014896 - protein, 10 aa, Mycobacterium
KQAQGQKQSQ

SEQ ID NO: 1014897 - protein, 6 aa, Mycobacterium
KQFGKP

SEQ ID NO: 1014898 - protein, 12 aa, Mycobacterium
KQGAQPEPADPA

SEQ ID NO: 1014899 - protein, 10 aa, Mycobacterium
KQGHGEPNPT

SEQ ID NO: 1014900 - protein, 5 aa, Mycobacterium
KQGIN

SEQ ID NO: 1014901 - protein, 4 aa, Mycobacterium
KQGV

SEQ ID NO: 1014902 - protein, 5 aa, Mycobacterium
KQHAR

SEQ ID NO: 1014903 - protein, 18 aa, Mycobacterium
KQHGDRAQRESLVVVVPA

SEQ ID NO: 1014904 - protein, 7 aa, Mycobacterium
KQKVGQI

SEQ ID NO: 1014905 - protein, 4 aa, Mycobacterium
KQKW

SEQ ID NO: 1014906 - protein, 17 aa, Mycobacterium
KQLAEKKAERKGSAQPV

SEQ ID NO: 1014907 - protein, 13 aa, Mycobacterium
KQLPQYPQLHPGQ

SEQ ID NO: 1014908 - protein, 9 aa, Mycobacterium
KQMKADREK

SEQ ID NO: 1014909 - protein, 9 aa, Mycobacterium
KQNAGDPEY

SEQ ID NO: 1014910 - protein, 8 aa, Mycobacterium
KQNAPAFR

SEQ ID NO: 1014911 - protein, 4 aa, Mycobacterium
KQPA

SEQ ID NO: 1014912 - protein, 9 aa, Mycobacterium
KQPGEARDQ

SEQ ID NO: 1014913 - protein, 16 aa, Mycobacterium
KQPKTAPLAGNSIATD

SEQ ID NO: 1014914 - protein, 6 aa, Mycobacterium
KQPSGD

SEQ ID NO: 1014915 - protein, 11 aa, Mycobacterium
KQQKTRERRIR

SEQ ID NO: 1014916 - protein, 8 aa, Mycobacterium
KQQRPATK

SEQ ID NO: 1014917 - protein, 4 aa, Mycobacterium
KQRK

SEQ ID NO: 1014918 - protein, 11 aa, Mycobacterium
KQRKGSVQSPK

SEQ ID NO: 1014919 - protein, 11 aa, Mycobacterium
KQRNSKADHAA

SEQ ID NO: 1014920 - protein, 4 aa, Mycobacterium
KQRR

SEQ ID NO: 1014921 - protein, 6 aa, Mycobacterium
KQSESN

SEQ ID NO: 1014922 - protein, 14 aa, Mycobacterium
KQSGVGRELGPDTL

SEQ ID NO: 1014923 - protein, 14 aa, Mycobacterium
KQSLTLAPDSQRYR

SEQ ID NO: 1014924 - protein, 16 aa, Mycobacterium
KQTDADVGSFDGGYGS

SEQ ID NO: 1014925 - protein, 10 aa, Mycobacterium
KQTGKQLGAT

SEQ ID NO: 1014926 - protein, 4 aa, Mycobacterium
KQTT

SEQ ID NO: 1014927 - protein, 12 aa, Mycobacterium
KQVSGAAGDYGS

SEQ ID NO: 1014928 - protein, 8 aa, Mycobacterium
KRAAAAQR

SEQ ID NO: 1014929 - protein, 8 aa, Mycobacterium
KRAAPTDD

SEQ ID NO: 1014930 - protein, 7 aa, Mycobacterium
KRAARAG

SEQ ID NO: 1014931 - protein, 4 aa, Mycobacterium
KRAE

SEQ ID NO: 1014932 - protein, 9 aa, Mycobacterium
KRAGTSKPA

SEQ ID NO: 1014933 - protein, 13 aa, Mycobacterium
KRAIKQGTELAAR

SEQ ID NO: 1014934 - protein, 12 aa, Mycobacterium
KRAPDWSSFPRY

SEQ ID NO: 1014935 - protein, 16 aa, Mycobacterium
KRAQAEGYCPGDDPQL

SEQ ID NO: 1014936 - protein, 6 aa, Mycobacterium
KRATAQ

SEQ ID NO: 1014937 - protein, 7 aa, Mycobacterium
KRATEGY

SEQ ID NO: 1014938 - protein, 23 aa, Mycobacterium
KRDMSKKLSASNQAWKSSCSSSP

SEQ ID NO: 1014939 - protein, 16 aa, Mycobacterium
KRDSEATSNASQRAGE

SEQ ID NO: 1014940 - protein, 5 aa, Mycobacterium
KRDTV

SEQ ID NO: 1014941 - protein, 12 aa, Mycobacterium
KRDVRGLDTSGL

SEQ ID NO: 1014942 - protein, 6 aa, Mycobacterium
KRELDR

SEQ ID NO: 1014943 - protein, 9 aa, Mycobacterium
KRELGDTST

SEQ ID NO: 1014944 - protein, 12 aa, Mycobacterium
KREQESGQVASR

SEQ ID NO: 1014945 - protein, 11 aa, Mycobacterium
KRESKSRPSQG

SEQ ID NO: 1014946 - protein, 11 aa, Mycobacterium
KRETSKDDGER

SEQ ID NO: 1014947 - protein, 10 aa, Mycobacterium
KRFRRTGTGK

SEQ ID NO: 1014948 - protein, 8 aa, Mycobacterium
KRGDIGST

SEQ ID NO: 1014949 - protein, 8 aa, Mycobacterium
KRGERQPL

SEQ ID NO: 1014950 - protein, 6 aa, Mycobacterium
KRGERT

SEQ ID NO: 1014951 - protein, 7 aa, Mycobacterium
KRGGGAI

SEQ ID NO: 1014952 - protein, 7 aa, Mycobacterium
KRGGRIR

SEQ ID NO: 1014953 - protein, 15 aa, Mycobacterium
KRGIQDETGVKPPWA

SEQ ID NO: 1014954 - protein, 6 aa, Mycobacterium
KRGPGI

SEQ ID NO: 1014955 - protein, 6 aa, Mycobacterium
KRGRPS

SEQ ID NO: 1014956 - protein, 5 aa, Mycobacterium
KRGRR

SEQ ID NO: 1014957 - protein, 12 aa, Mycobacterium
KRGTDSRSLATE

SEQ ID NO: 1014958 - protein, 8 aa, Mycobacterium
KRGVRKSY

SEQ ID NO: 1014959 - protein, 10 aa, Mycobacterium
KRHGRPPRER

SEQ ID NO: 1014960 - protein, 13 aa, Mycobacterium
KRHKQGRRTAREN

SEQ ID NO: 1014961 - protein, 8 aa, Mycobacterium
KRHSTRDD

SEQ ID NO: 1014962 - protein, 6 aa, Mycobacterium
KRKNER

SEQ ID NO: 1014963 - protein, 6 aa, Mycobacterium
KRKPYA

SEQ ID NO: 1014964 - protein, 10 aa, Mycobacterium
KRLGDNRKRE

SEQ ID NO: 1014965 - protein, 7 aa, Mycobacterium
KRLGRDH

SEQ ID NO: 1014966 - protein, 9 aa, Mycobacterium
KRLGSDKGM

SEQ ID NO: 1014967 - protein, 5 aa, Mycobacterium
KRNAD

SEQ ID NO: 1014968 - protein, 5 aa, Mycobacterium
KRNLP

SEQ ID NO: 1014969 - protein, 7 aa, Mycobacterium
KRNPDLD

SEQ ID NO: 1014970 - protein, 7 aa, Mycobacterium
KRNRGGK

SEQ ID NO: 1014971 - protein, 6 aa, Mycobacterium
KRPAGF

SEQ ID NO: 1014972 - protein, 6 aa, Mycobacterium
KRPEVR

SEQ ID NO: 1014973 - protein, 6 aa, Mycobacterium
KRPGDV

SEQ ID NO: 1014974 - protein, 14 aa, Mycobacterium
KRPGTPAAELDGQL

SEQ ID NO: 1014975 - protein, 4 aa, Mycobacterium
KRPK

SEQ ID NO: 1014976 - protein, 9 aa, Mycobacterium
KRPKAEIRD

SEQ ID NO: 1014977 - protein, 9 aa, Mycobacterium
KRPPEEGRA

SEQ ID NO: 1014978 - protein, 13 aa, Mycobacterium
KRPPQFPSLTSSE

SEQ ID NO: 1014979 - protein, 36 aa, Mycobacterium
KRPRKSAAEVAGPDVSAAPDSKAGPDSKAGSNSKDS

SEQ ID NO: 1014980 - protein, 14 aa, Mycobacterium
KRPRLGVDTDERTI

SEQ ID NO: 1014981 - protein, 7 aa, Mycobacterium
KRPSIRD

SEQ ID NO: 1014982 - protein, 4 aa, Mycobacterium
KRQP

SEQ ID NO: 1014983 - protein, 14 aa, Mycobacterium
KRQRRERGSINPDD

SEQ ID NO: 1014984 - protein, 5 aa, Mycobacterium
KRRAD

SEQ ID NO: 1014985 - protein, 4 aa, Mycobacterium
KRRD

SEQ ID NO: 1014986 - protein, 11 aa, Mycobacterium
KRRDEPPNLEL

SEQ ID NO: 1014987 - protein, 11 aa, Mycobacterium
KRRDTSVDPPQ

SEQ ID NO: 1014988 - protein, 5 aa, Mycobacterium
KRRQP

SEQ ID NO: 1014989 - protein, 6 aa, Mycobacterium
KRRSEV

SEQ ID NO: 1014990 - protein, 7 aa, Mycobacterium
KRRTPRA

SEQ ID NO: 1014991 - protein, 17 aa, Mycobacterium
KRRVAKSTGDKSHPANL

SEQ ID NO: 1014992 - protein, 7 aa, Mycobacterium
KRSGAEV

SEQ ID NO: 1014993 - protein, 6 aa, Mycobacterium
KRSIDA

SEQ ID NO: 1014994 - protein, 10 aa, Mycobacterium
KRSPAGKPDY

SEQ ID NO: 1014995 - protein, 9 aa, Mycobacterium
KRSPDLSHT

SEQ ID NO: 1014996 - protein, 18 aa, Mycobacterium
KRSTDADTSASADGTSLN

SEQ ID NO: 1014997 - protein, 13 aa, Mycobacterium
KRTAQKVADELNE

SEQ ID NO: 1014998 - protein, 6 aa, Mycobacterium
KRTESS

SEQ ID NO: 1014999 - protein, 5 aa, Mycobacterium
KRTGK

SEQ ID NO: 1015000 - protein, 6 aa, Mycobacterium
KRTHQS

SEQ ID NO: 1015001 - protein, 7 aa, Mycobacterium
KRTPRMA

SEQ ID NO: 1015002 - protein, 5 aa, Mycobacterium
KRTSD

SEQ ID NO: 1015003 - protein, 6 aa, Mycobacterium
KRVDTA

SEQ ID NO: 1015004 - protein, 6 aa, Mycobacterium
KRVHTS

SEQ ID NO: 1015005 - protein, 9 aa, Mycobacterium
KRVKDKEHS

SEQ ID NO: 1015006 - protein, 7 aa, Mycobacterium
KRWQSSH

SEQ ID NO: 1015007 - protein, 44 aa, Mycobacterium
KSAAHDAAQAQTTSGPTSMAGATAAATTGAVTGDSAKRSAEQQR

SEQ ID NO: 1015008 - protein, 6 aa, Mycobacterium
KSAAMG

SEQ ID NO: 1015009 - protein, 6 aa, Mycobacterium
KSADEI

SEQ ID NO: 1015010 - protein, 9 aa, Mycobacterium
KSADPIPTR

SEQ ID NO: 1015011 - protein, 17 aa, Mycobacterium
KSAERPAPMVGVSNSRG

SEQ ID NO: 1015012 - protein, 6 aa, Mycobacterium
KSAGGL

SEQ ID NO: 1015013 - protein, 5 aa, Mycobacterium
KSAIT

SEQ ID NO: 1015014 - protein, 7 aa, Mycobacterium
KSAPPQA

SEQ ID NO: 1015015 - protein, 4 aa, Mycobacterium
KSAS

SEQ ID NO: 1015016 - protein, 5 aa, Mycobacterium
KSASL

SEQ ID NO: 1015017 - protein, 11 aa, Mycobacterium
KSATDLGGLPG

SEQ ID NO: 1015018 - protein, 6 aa, Mycobacterium
KSATGL

SEQ ID NO: 1015019 - protein, 5 aa, Mycobacterium
KSAVM

SEQ ID NO: 1015020 - protein, 13 aa, Mycobacterium
KSAVVNPAATPAV

SEQ ID NO: 1015021 - protein, 6 aa, Mycobacterium
KSAYES

SEQ ID NO: 1015022 - protein, 7 aa, Mycobacterium
KSDEHPE

SEQ ID NO: 1015023 - protein, 6 aa, Mycobacterium
KSDLAA

SEQ ID NO: 1015024 - protein, 7 aa, Mycobacterium
KSDPVDD

SEQ ID NO: 1015025 - protein, 8 aa, Mycobacterium
KSDSGQAA

SEQ ID NO: 1015026 - protein, 9 aa, Mycobacterium
KSDTEARAR

SEQ ID NO: 1015027 - protein, 6 aa, Mycobacterium
KSEPYC

SEQ ID NO: 1015028 - protein, 19 aa, Mycobacterium
KSFAPRGRTGGREWLTAIT

SEQ ID NO: 1015029 - protein, 5 aa, Mycobacterium
KSGAA

SEQ ID NO: 1015030 - protein, 11 aa, Mycobacterium
KSGASARGQAA

SEQ ID NO: 1015031 - protein, 7 aa, Mycobacterium
KSGATLG

SEQ ID NO: 1015032 - protein, 16 aa, Mycobacterium
KSGEAAAEGVAGAAGM

SEQ ID NO: 1015033 - protein, 4 aa, Mycobacterium
KSGF

SEQ ID NO: 1015034 - protein, 12 aa, Mycobacterium
KSGGAGVSGREQ

SEQ ID NO: 1015035 - protein, 6 aa, Mycobacterium
KSGGDV

SEQ ID NO: 1015036 - protein, 7 aa, Mycobacterium
KSGQTRC

SEQ ID NO: 1015037 - protein, 17 aa, Mycobacterium
KSGRWRAEKATASSPVA

SEQ ID NO: 1015038 - protein, 6 aa, Mycobacterium
KSGSDY

SEQ ID NO: 1015039 - protein, 5 aa, Mycobacterium
KSGTV

SEQ ID NO: 1015040 - protein, 4 aa, Mycobacterium
KSGW

SEQ ID NO: 1015041 - protein, 11 aa, Mycobacterium
KSHPADDGGKA

SEQ ID NO: 1015042 - protein, 8 aa, Mycobacterium
KSHPGGGD

SEQ ID NO: 1015043 - protein, 7 aa, Mycobacterium
KSHPTGD

SEQ ID NO: 1015044 - protein, 6 aa, Mycobacterium
KSHSVT

SEQ ID NO: 1015045 - protein, 10 aa, Mycobacterium
KSHTSAEQVG

SEQ ID NO: 1015046 - protein, 4 aa, Mycobacterium
KSID

SEQ ID NO: 1015047 - protein, 6 aa, Mycobacterium
KSIPLS

SEQ ID NO: 1015048 - protein, 6 aa, Mycobacterium
KSKAAH

SEQ ID NO: 1015049 - protein, 7 aa, Mycobacterium
KSKGRAA

SEQ ID NO: 1015050 - protein, 6 aa, Mycobacterium
KSLADG

SEQ ID NO: 1015051 - protein, 7 aa, Mycobacterium
KSLADGA

SEQ ID NO: 1015052 - protein, 10 aa, Mycobacterium
KSLKNSISPD

SEQ ID NO: 1015053 - protein, 7 aa, Mycobacterium
KSLKSVG

SEQ ID NO: 1015054 - protein, 11 aa, Mycobacterium
KSLLDQEGRDD

SEQ ID NO: 1015055 - protein, 8 aa, Mycobacterium
KSLTLDPQ

SEQ ID NO: 1015056 - protein, 11 aa, Mycobacterium
KSNAGHSQAAS

SEQ ID NO: 1015057 - protein, 14 aa, Mycobacterium
KSNKIDDPVTDITE

SEQ ID NO: 1015058 - protein, 9 aa, Mycobacterium
KSNLGNSEA

SEQ ID NO: 1015059 - protein, 6 aa, Mycobacterium
KSPAGA

SEQ ID NO: 1015060 - protein, 7 aa, Mycobacterium
KSPAGHS

SEQ ID NO: 1015061 - protein, 5 aa, Mycobacterium
KSPSF

SEQ ID NO: 1015062 - protein, 8 aa, Mycobacterium
KSPTAPYL

SEQ ID NO: 1015063 - protein, 9 aa, Mycobacterium
KSQGSQADD

SEQ ID NO: 1015064 - protein, 6 aa, Mycobacterium
KSQPQA

SEQ ID NO: 1015065 - protein, 6 aa, Mycobacterium
KSQTAA

SEQ ID NO: 1015066 - protein, 6 aa, Mycobacterium
KSQVGA

SEQ ID NO: 1015067 - protein, 11 aa, Mycobacterium
KSRARGNTPEE

SEQ ID NO: 1015068 - protein, 9 aa, Mycobacterium
KSRARQRAQ

SEQ ID NO: 1015069 - protein, 6 aa, Mycobacterium
KSRATF

SEQ ID NO: 1015070 - protein, 13 aa, Mycobacterium
KSRFTQGSSLADK

SEQ ID NO: 1015071 - protein, 5 aa, Mycobacterium
KSRGV

SEQ ID NO: 1015072 - protein, 7 aa, Mycobacterium
KSRNEIE

SEQ ID NO: 1015073 - protein, 6 aa, Mycobacterium
KSRPYL

SEQ ID NO: 1015074 - protein, 7 aa, Mycobacterium
KSRQPKS

SEQ ID NO: 1015075 - protein, 8 aa, Mycobacterium
KSRQRPGS

SEQ ID NO: 1015076 - protein, 4 aa, Mycobacterium
KSRR

SEQ ID NO: 1015077 - protein, 5 aa, Mycobacterium
KSRSL

SEQ ID NO: 1015078 - protein, 10 aa, Mycobacterium
KSRYGDDSGM

SEQ ID NO: 1015079 - protein, 5 aa, Mycobacterium
KSSAG

SEQ ID NO: 1015080 - protein, 8 aa, Mycobacterium
KSSGTLST

SEQ ID NO: 1015081 - protein, 28 aa, Mycobacterium
KSSKRTRRLDGRTTVAANDTKRVKSLLN

SEQ ID NO: 1015082 - protein, 6 aa, Mycobacterium
KSSPTC

SEQ ID NO: 1015083 - protein, 5 aa, Mycobacterium
KSTAA

SEQ ID NO: 1015084 - protein, 8 aa, Mycobacterium
KSTDDVGP

SEQ ID NO: 1015085 - protein, 5 aa, Mycobacterium
KSTDL

SEQ ID NO: 1015086 - protein, 7 aa, Mycobacterium
KSTGISP

SEQ ID NO: 1015087 - protein, 4 aa, Mycobacterium
KSTI

SEQ ID NO: 1015088 - protein, 8 aa, Mycobacterium
KSTPERPV

SEQ ID NO: 1015089 - protein, 7 aa, Mycobacterium
KSVAGRS

SEQ ID NO: 1015090 - protein, 13 aa, Mycobacterium
KSVDGKPPVVTRS

SEQ ID NO: 1015091 - protein, 5 aa, Mycobacterium
KSVGQ

SEQ ID NO: 1015092 - protein, 11 aa, Mycobacterium
KSVNGTPISGD

SEQ ID NO: 1015093 - protein, 7 aa, Mycobacterium
KSVPEQE

SEQ ID NO: 1015094 - protein, 17 aa, Mycobacterium
KSVTNPDGTGVRGKDGV

SEQ ID NO: 1015095 - protein, 14 aa, Mycobacterium
KSVTTFGPYSPGQA

SEQ ID NO: 1015096 - protein, 12 aa, Mycobacterium
KSVVTADGTRHG

SEQ ID NO: 1015097 - protein, 6 aa, Mycobacterium
KSWQES

SEQ ID NO: 1015098 - protein, 5 aa, Mycobacterium
KSYAA

SEQ ID NO: 1015099 - protein, 7 aa, Mycobacterium
KSYGKGS

SEQ ID NO: 1015100 - protein, 14 aa, Mycobacterium
KSYPPETASAPDSL

SEQ ID NO: 1015101 - protein, 7 aa, Mycobacterium
KSYQPTL

SEQ ID NO: 1015102 - protein, 9 aa, Mycobacterium
KSYRETGGG

SEQ ID NO: 1015103 - protein, 11 aa, Mycobacterium
KSYVGTDEQVE

SEQ ID NO: 1015104 - protein, 8 aa, Mycobacterium
KTAADSGK

SEQ ID NO: 1015105 - protein, 7 aa, Mycobacterium
KTAAKLQ

SEQ ID NO: 1015106 - protein, 32 aa, Mycobacterium
KTACSASSPRTKPSTSPRRKRPKTPSVRAGRP

SEQ ID NO: 1015107 - protein, 10 aa, Mycobacterium
KTADDPDTFS

SEQ ID NO: 1015108 - protein, 5 aa, Mycobacterium
KTADQ

SEQ ID NO: 1015109 - protein, 5 aa, Mycobacterium
KTADW

SEQ ID NO: 1015110 - protein, 8 aa, Mycobacterium
KTAEERLD

SEQ ID NO: 1015111 - protein, 11 aa, Mycobacterium
KTAEHAETPEF

SEQ ID NO: 1015112 - protein, 7 aa, Mycobacterium
KTAEQRL

SEQ ID NO: 1015113 - protein, 4 aa, Mycobacterium
KTAG

SEQ ID NO: 1015114 - protein, 6 aa, Mycobacterium
KTANHS

SEQ ID NO: 1015115 - protein, 7 aa, Mycobacterium
KTANPGV

SEQ ID NO: 1015116 - protein, 7 aa, Mycobacterium
KTANTYS

SEQ ID NO: 1015117 - protein, 4 aa, Mycobacterium
KTAP

SEQ ID NO: 1015118 - protein, 6 aa, Mycobacterium
KTCRPN

SEQ ID NO: 1015119 - protein, 7 aa, Mycobacterium
KTDATQR

SEQ ID NO: 1015120 - protein, 11 aa, Mycobacterium
KTDKASGIVND

SEQ ID NO: 1015121 - protein, 7 aa, Mycobacterium
KTDRYAR

SEQ ID NO: 1015122 - protein, 8 aa, Mycobacterium
KTEAEGEP

SEQ ID NO: 1015123 - protein, 10 aa, Mycobacterium
KTEHLGDRSP

SEQ ID NO: 1015124 - protein, 13 aa, Mycobacterium
KTEPTGGNARPVA

SEQ ID NO: 1015125 - protein, 14 aa, Mycobacterium
KTEREADSSGRTRA

SEQ ID NO: 1015126 - protein, 13 aa, Mycobacterium
KTESGSPIPSYDA

SEQ ID NO: 1015127 - protein, 6 aa, Mycobacterium
KTGATG

SEQ ID NO: 1015128 - protein, 4 aa, Mycobacterium
KTGE

SEQ ID NO: 1015129 - protein, 11 aa, Mycobacterium
KTGEAEFPGGS

SEQ ID NO: 1015130 - protein, 7 aa, Mycobacterium
KTGHTTF

SEQ ID NO: 1015131 - protein, 7 aa, Mycobacterium
KTGQPGH

SEQ ID NO: 1015132 - protein, 7 aa, Mycobacterium
KTGSPYA

SEQ ID NO: 1015133 - protein, 5 aa, Mycobacterium
KTGVR

SEQ ID NO: 1015134 - protein, 13 aa, Mycobacterium
KTIPADASYEPKW

SEQ ID NO: 1015135 - protein, 5 aa, Mycobacterium
KTKNN

SEQ ID NO: 1015136 - protein, 16 aa, Mycobacterium
KTKTTPADQAVDDYRA

SEQ ID NO: 1015137 - protein, 8 aa, Mycobacterium
KTLNDDAA

SEQ ID NO: 1015138 - protein, 7 aa, Mycobacterium
KTLNRQK

SEQ ID NO: 1015139 - protein, 7 aa, Mycobacterium
KTLPTER

SEQ ID NO: 1015140 - protein, 7 aa, Mycobacterium
KTLSDPN

SEQ ID NO: 1015141 - protein, 6 aa, Mycobacterium
KTLSGS

SEQ ID NO: 1015142 - protein, 8 aa, Mycobacterium
KTNGGPKF

SEQ ID NO: 1015143 - protein, 6 aa, Mycobacterium
KTNGRI

SEQ ID NO: 1015144 - protein, 8 aa, Mycobacterium
KTNTPRNF

SEQ ID NO: 1015145 - protein, 7 aa, Mycobacterium
KTPAPHG

SEQ ID NO: 1015146 - protein, 7 aa, Mycobacterium
KTPDGGL

SEQ ID NO: 1015147 - protein, 6 aa, Mycobacterium
KTPEGY

SEQ ID NO: 1015148 - protein, 5 aa, Mycobacterium
KTPEQ

SEQ ID NO: 1015149 - protein, 7 aa, Mycobacterium
KTPETAG

SEQ ID NO: 1015150 - protein, 39 aa, Mycobacterium
KTPEVRTTTSAVNSNEPNAADPPPAAAEPPSSPSPADPC

SEQ ID NO: 1015151 - protein, 10 aa, Mycobacterium
KTPGDPGALY

SEQ ID NO: 1015152 - protein, 7 aa, Mycobacterium
KTPKAEI

SEQ ID NO: 1015153 - protein, 16 aa, Mycobacterium
KTPLNPGAKERSATVQ

SEQ ID NO: 1015154 - protein, 5 aa, Mycobacterium
KTPPC

SEQ ID NO: 1015155 - protein, 5 aa, Mycobacterium
KTPPF

SEQ ID NO: 1015156 - protein, 31 aa, Mycobacterium; identical to SEQ ID NO: 515802

SEQ ID NO: 1015157 - protein, 8 aa, Mycobacterium
KTPYGQPK

SEQ ID NO: 1015158 - protein, 5 aa, Mycobacterium
KTPYH

SEQ ID NO: 1015159 - protein, 13 aa, Mycobacterium
KTQPPLVLDDLVA

SEQ ID NO: 1015160 - protein, 5 aa, Mycobacterium
KTQQS

SEQ ID NO: 1015161 - protein, 12 aa, Mycobacterium
KTQSADSGPRAI

SEQ ID NO: 1015162 - protein, 10 aa, Mycobacterium
KTRDDEDSYT

SEQ ID NO: 1015163 - protein, 5 aa, Mycobacterium
KTRGA

SEQ ID NO: 1015164 - protein, 7 aa, Mycobacterium
KTRQRLP

SEQ ID NO: 1015165 - protein, 6 aa, Mycobacterium
KTRRGL

SEQ ID NO: 1015166 - protein, 8 aa, Mycobacterium
KTRRPRPA

SEQ ID NO: 1015167 - protein, 7 aa, Mycobacterium
KTRRPSV

SEQ ID NO: 1015168 - protein, 10 aa, Mycobacterium
KTSAKRPKRR

SEQ ID NO: 1015169 - protein, 7 aa, Mycobacterium
KTSATTW

SEQ ID NO: 1015170 - protein, 5 aa, Mycobacterium
KTSIE

SEQ ID NO: 1015171 - protein, 7 aa, Mycobacterium
KTSPTVA

SEQ ID NO: 1015172 - protein, 8 aa, Mycobacterium
KTSSAPAA

SEQ ID NO: 1015173 - protein, 7 aa, Mycobacterium
KTSSEWD

SEQ ID NO: 1015174 - protein, 25 aa, Mycobacterium
KTSSGNPAIYSAPTGLASGSTTTLQ

SEQ ID NO: 1015175 - protein, 11 aa, Mycobacterium
KTSSSASEPDR

SEQ ID NO: 1015176 - protein, 9 aa, Mycobacterium
KTTAEQRAG

SEQ ID NO: 1015177 - protein, 12 aa, Mycobacterium
KTTEPKARALRP

SEQ ID NO: 1015178 - protein, 5 aa, Mycobacterium
KTTQL

SEQ ID NO: 1015179 - protein, 6 aa, Mycobacterium
KTTSVN

SEQ ID NO: 1015180 - protein, 5 aa, Mycobacterium
KTTVA

SEQ ID NO: 1015181 - protein, 8 aa, Mycobacterium
KTVAPGPL

SEQ ID NO: 1015182 - protein, 5 aa, Mycobacterium
KTVPG

SEQ ID NO: 1015183 - protein, 8 aa, Mycobacterium
KTWATNGG

SEQ ID NO: 1015184 - protein, 7 aa, Mycobacterium
KTWQPGD

SEQ ID NO: 1015185 - protein, 6 aa, Mycobacterium
KTWSTS

SEQ ID NO: 1015186 - protein, 5 aa, Mycobacterium
KTYNA

SEQ ID NO: 1015187 - protein, 4 aa, Mycobacterium
KVAA

SEQ ID NO: 1015188 - protein, 10 aa, Mycobacterium
KVAAGGAARL

SEQ ID NO: 1015189 - protein, 4 aa, Mycobacterium
KVAP

SEQ ID NO: 1015190 - protein, 18 aa, Mycobacterium
KVASRYPAQLSGGEQQRV

SEQ ID NO: 1015191 - protein, 10 aa, Mycobacterium
KVDAKQPGDY

SEQ ID NO: 1015192 - protein, 7 aa, Mycobacterium
KVDPDNP

SEQ ID NO: 1015193 - protein, 5 aa, Mycobacterium
KVDRR

SEQ ID NO: 1015194 - protein, 12 aa, Mycobacterium
KVDSDKAEADAA

SEQ ID NO: 1015195 - protein, 12 aa, Mycobacterium
KVDTHQLKKCFD

SEQ ID NO: 1015196 - protein, 8 aa, Mycobacterium
KVEDGRTD

SEQ ID NO: 1015197 - protein, 8 aa, Mycobacterium
KVENDRSV

SEQ ID NO: 1015198 - protein, 14 aa, Mycobacterium
KVGEAPKQSGIALP

SEQ ID NO: 1015199 - protein, 5 aa, Mycobacterium
KVGEE

SEQ ID NO: 1015200 - protein, 13 aa, Mycobacterium
KVGGRNEHASGYE

SEQ ID NO: 1015201 - protein, 5 aa, Mycobacterium
KVGNE

SEQ ID NO: 1015202 - protein, 10 aa, Mycobacterium
KVGNGHPGTA

SEQ ID NO: 1015203 - protein, 16 aa, Mycobacterium
KVGPAGSAATAPAVNG

SEQ ID NO: 1015204 - protein, 8 aa, Mycobacterium
KVGQASGH

SEQ ID NO: 1015205 - protein, 4 aa, Mycobacterium
KVGR

SEQ ID NO: 1015206 - protein, 10 aa, Mycobacterium
KVGRAEPNRR

SEQ ID NO: 1015207 - protein, 8 aa, Mycobacterium
KVGSAGRA

SEQ ID NO: 1015208 - protein, 16 aa, Mycobacterium
KVGSDDDHAAAAADGW

SEQ ID NO: 1015209 - protein, 5 aa, Mycobacterium
KVGTV

SEQ ID NO: 1015210 - protein, 18 aa, Mycobacterium
KVNKPVTGQYTAAGVNPR

SEQ ID NO: 1015211 - protein, 11 aa, Mycobacterium
KVPARAGNDAD

SEQ ID NO: 1015212 - protein, 4 aa, Mycobacterium
KVPG

SEQ ID NO: 1015213 - protein, 5 aa, Mycobacterium
KVPGR

SEQ ID NO: 1015214 - protein, 7 aa, Mycobacterium
KVPGSAM

SEQ ID NO: 1015215 - protein, 7 aa, Mycobacterium
KVPKDQV

SEQ ID NO: 1015216 - protein, 5 aa, Mycobacterium
KVPPG

SEQ ID NO: 1015217 - protein, 9 aa, Mycobacterium
KVPPSGSPG

SEQ ID NO: 1015218 - protein, 9 aa, Mycobacterium
KVPSEEVPA

SEQ ID NO: 1015219 - protein, 13 aa, Mycobacterium
KVPVGSSPTPSGW

SEQ ID NO: 1015220 - protein, 12 aa, Mycobacterium
KVRARHARCIRS

SEQ ID NO: 1015221 - protein, 21 aa, Mycobacterium
KVREAGESNWSDPQAQARAEQ

SEQ ID NO: 1015222 - protein, 5 aa, Mycobacterium
KVRGN

SEQ ID NO: 1015223 - protein, 17 aa, Mycobacterium
KVRNPGATREFRIVRGR

SEQ ID NO: 1015224 - protein, 20 aa, Mycobacterium
KVRPAGLSATGGGEFGSGAG

SEQ ID NO: 1015225 - protein, 6 aa, Mycobacterium
KVRTRA

SEQ ID NO: 1015226 - protein, 7 aa, Mycobacterium
KVSDDDM

SEQ ID NO: 1015227 - protein, 4 aa, Mycobacterium
KVSR

SEQ ID NO: 1015228 - protein, 6 aa, Mycobacterium
KVTGTA

SEQ ID NO: 1015229 - protein, 15 aa, Mycobacterium
KVTSPGWGAARKSWL

SEQ ID NO: 1015230 - protein, 5 aa, Mycobacterium
KWGQD

SEQ ID NO: 1015231 - protein, 6 aa, Mycobacterium
KWGSSG

SEQ ID NO: 1015232 - protein, 9 aa, Mycobacterium
KWQGPAATA

SEQ ID NO: 1015233 - protein, 5 aa, Mycobacterium
KYAAK

SEQ ID NO: 1015234 - protein, 8 aa, Mycobacterium
KYAEDTGT

SEQ ID NO: 1015235 - protein, 6 aa, Mycobacterium
KYDDPE

SEQ ID NO: 1015236 - protein, 5 aa, Mycobacterium
KYDGR

SEQ ID NO: 1015237 - protein, 9 aa, Mycobacterium
KYEKDGSAR

SEQ ID NO: 1015238 - protein, 14 aa, Mycobacterium
KYEPAVGSEGQVGP

SEQ ID NO: 1015239 - protein, 6 aa, Mycobacterium
KYGDGE

SEQ ID NO: 1015240 - protein, 6 aa, Mycobacterium
KYGSEI

SEQ ID NO: 1015241 - protein, 5 aa, Mycobacterium
KYPPL

SEQ ID NO: 1015242 - protein, 4 aa, Mycobacterium
KYPT

SEQ ID NO: 1015243 - protein, 7 aa, Mycobacterium
KYQQARR

SEQ ID NO: 1015244 - protein, 11 aa, Mycobacterium
KYQVTSGSITL

SEQ ID NO: 1015245 - protein, 4 aa, Mycobacterium
KYRD

SEQ ID NO: 1015246 - protein, 5 aa, Mycobacterium
KYRDT

SEQ ID NO: 1015247 - protein, 12 aa, Mycobacterium
KYRERGADLPPL

SEQ ID NO: 1015248 - protein, 10 aa, Mycobacterium
KYSHDDPDGV

SEQ ID NO: 1015249 - protein, 8 aa, Mycobacterium
LAAAGSRL

SEQ ID NO: 1015250 - protein, 11 aa, Mycobacterium
LAAAGSSGEQI

SEQ ID NO: 1015251 - protein, 14 aa, Mycobacterium
LAAANGAAAGPTTV

SEQ ID NO: 1015252 - protein, 8 aa, Mycobacterium
LAAASSVS

SEQ ID NO: 1015253 - protein, 6 aa, Mycobacterium
LAAAST

SEQ ID NO: 1015254 - protein, 6 aa, Mycobacterium
LAAATG

SEQ ID NO: 1015255 - protein, 24 aa, Mycobacterium
LAAATTDRLRRQKQANRVRDDVPN

SEQ ID NO: 1015256 - protein, 5 aa, Mycobacterium
LAADA

SEQ ID NO: 1015257 - protein, 18 aa, Mycobacterium
LAADGGLGRPRADAGIGP

SEQ ID NO: 1015258 - protein, 12 aa, Mycobacterium
LAADGKTKEDFG

SEQ ID NO: 1015259 - protein, 6 aa, Mycobacterium
LAADGV

SEQ ID NO: 1015260 - protein, 12 aa, Mycobacterium
LAADPGPATIDE

SEQ ID NO: 1015261 - protein, 18 aa, Mycobacterium
LAAEGGAHQSIKTPSIGL

SEQ ID NO: 1015262 - protein, 11 aa, Mycobacterium
LAAEGHDVRSR

SEQ ID NO: 1015263 - protein, 6 aa, Mycobacterium
LAAEGT

SEQ ID NO: 1015264 - protein, 7 aa, Mycobacterium
LAAENGV

SEQ ID NO: 1015265 - protein, 6 aa, Mycobacterium
LAAERG

SEQ ID NO: 1015266 - protein, 11 aa, Mycobacterium
LAAESDSVDKA

SEQ ID NO: 1015267 - protein, 10 aa, Mycobacterium
LAAGADDVSA

SEQ ID NO: 1015268 - protein, 8 aa, Mycobacterium
LAAGASTA

SEQ ID NO: 1015269 - protein, 7 aa, Mycobacterium
LAAGGGG

SEQ ID NO: 1015270 - protein, 12 aa, Mycobacterium
LAAGPGEPDGKE

SEQ ID NO: 1015271 - protein, 5 aa, Mycobacterium
LAAGQ

SEQ ID NO: 1015272 - protein, 6 aa, Mycobacterium
LAAKQG

SEQ ID NO: 1015273 - protein, 7 aa, Mycobacterium
LAAKTAA

SEQ ID NO: 1015274 - protein, 10 aa, Mycobacterium
LAANGTPEQL

SEQ ID NO: 1015275 - protein, 17 aa, Mycobacterium
LAANQDSAQGETDSGAS

SEQ ID NO: 1015276 - protein, 5 aa, Mycobacterium
LAAPA

SEQ ID NO: 1015277 - protein, 11 aa, Mycobacterium
LAAPAPSTARD

SEQ ID NO: 1015278 - protein, 16 aa, Mycobacterium
LAAPDDAHAQPRPDSG

SEQ ID NO: 1015279 - protein, 9 aa, Mycobacterium
LAAPDTNTA

SEQ ID NO: 1015280 - protein, 7 aa, Mycobacterium
LAASPSA

SEQ ID NO: 1015281 - protein, 9 aa, Mycobacterium
LAASSDGKY

SEQ ID NO: 1015282 - protein, 9 aa, Mycobacterium
LAATDDEIV

SEQ ID NO: 1015283 - protein, 15 aa, Mycobacterium
LAATDSSGYLDPGYP

SEQ ID NO: 1015284 - protein, 7 aa, Mycobacterium
LAATPQP

SEQ ID NO: 1015285 - protein, 4 aa, Mycobacterium
LADA

SEQ ID NO: 1015286 - protein, 9 aa, Mycobacterium
LADAGGDTV

SEQ ID NO: 1015287 - protein, 6 aa, Mycobacterium
LADDNR

SEQ ID NO: 1015288 - protein, 5 aa, Mycobacterium
LADDQ

SEQ ID NO: 1015289 - protein, 8 aa, Mycobacterium
LADEGTSV

SEQ ID NO: 1015290 - protein, 17 aa, Mycobacterium
LADGDAGWDASAPVQLP

SEQ ID NO: 1015291 - protein, 9 aa, Mycobacterium
LADGGDPNL

SEQ ID NO: 1015292 - protein, 9 aa, Mycobacterium
LADGPLPTH

SEQ ID NO: 1015293 - protein, 12 aa, Mycobacterium
LADNKTPQQPHR

SEQ ID NO: 1015294 - protein, 10 aa, Mycobacterium
LADNTDPERM

SEQ ID NO: 1015295 - protein, 6 aa, Mycobacterium
LADPDH

SEQ ID NO: 1015296 - protein, 8 aa, Mycobacterium
LADPPPQV

SEQ ID NO: 1015297 - protein, 9 aa, Mycobacterium
LADPTALPT

SEQ ID NO: 1015298 - protein, 4 aa, Mycobacterium
LADR

SEQ ID NO: 1015299 - protein, 14 aa, Mycobacterium
LADRGAVASPQTRD

SEQ ID NO: 1015300 - protein, 6 aa, Mycobacterium
LADRGQ

SEQ ID NO: 1015301 - protein, 12 aa, Mycobacterium
LADRPPMSVLRP

SEQ ID NO: 1015302 - protein, 11 aa, Mycobacterium
LADRSDPKAAN

SEQ ID NO: 1015303 - protein, 8 aa, Mycobacterium
LADSAGDG

SEQ ID NO: 1015304 - protein, 7 aa, Mycobacterium
LADSDGQ

SEQ ID NO: 1015305 - protein, 5 aa, Mycobacterium
LADTA

SEQ ID NO: 1015306 - protein, 7 aa, Mycobacterium
LADTNTE

SEQ ID NO: 1015307 - protein, 15 aa, Mycobacterium
LADTPEKVRAEGIRP

SEQ ID NO: 1015308 - protein, 4 aa, Mycobacterium
LAEA

SEQ ID NO: 1015309 - protein, 6 aa, Mycobacterium
LAEAQA

SEQ ID NO: 1015310 - protein, 9 aa, Mycobacterium
LAEARTAAL

SEQ ID NO: 1015311 - protein, 7 aa, Mycobacterium
LAEEPAV

SEQ ID NO: 1015312 - protein, 10 aa, Mycobacterium
LAEETGDAAK

SEQ ID NO: 1015313 - protein, 6 aa, Mycobacterium
LAEGAG

SEQ ID NO: 1015314 - protein, 13 aa, Mycobacterium
LAEGGGHVEEVSD

SEQ ID NO: 1015315 - protein, 7 aa, Mycobacterium
LAEGGGQ

SEQ ID NO: 1015316 - protein, 8 aa, Mycobacterium
LAEGLSAT

SEQ ID NO: 1015317 - protein, 6 aa, Mycobacterium
LAEGPV

SEQ ID NO: 1015318 - protein, 7 aa, Mycobacterium
LAEGSSI

SEQ ID NO: 1015319 - protein, 10 aa, Mycobacterium
LAEKNRKYEE

SEQ ID NO: 1015320 - protein, 4 aa, Mycobacterium
LAEN

SEQ ID NO: 1015321 - protein, 9 aa, Mycobacterium
LAEPADSRA

SEQ ID NO: 1015322 - protein, 10 aa, Mycobacterium
LAEPATTHGQ

SEQ ID NO: 1015323 - protein, 6 aa, Mycobacterium
LAEPER

SEQ ID NO: 1015324 - protein, 8 aa, Mycobacterium
LAEPERPL

SEQ ID NO: 1015325 - protein, 4 aa, Mycobacterium
LAEQ

SEQ ID NO: 1015326 - protein, 5 aa, Mycobacterium
LAEQV

SEQ ID NO: 1015327 - protein, 4 aa, Mycobacterium
LAER

SEQ ID NO: 1015328 - protein, 6 aa, Mycobacterium
LAERGR

SEQ ID NO: 1015329 - protein, 8 aa, Mycobacterium
LAESAEAL

SEQ ID NO: 1015330 - protein, 9 aa, Mycobacterium
LAESDGDFD

SEQ ID NO: 1015331 - protein, 9 aa, Mycobacterium
LAESPMESE

SEQ ID NO: 1015332 - protein, 8 aa, Mycobacterium
LAESRNEA

SEQ ID NO: 1015333 - protein, 9 aa, Mycobacterium
LAETKPDVA

SEQ ID NO: 1015334 - protein, 8 aa, Mycobacterium
LAETPAPD

SEQ ID NO: 1015335 - protein, 8 aa, Mycobacterium
LAEYDQSD

SEQ ID NO: 1015336 - protein, 4 aa, Mycobacterium
LAGA

SEQ ID NO: 1015337 - protein, 11 aa, Mycobacterium
LAGASYTDATG

SEQ ID NO: 1015338 - protein, 9 aa, Mycobacterium
LAGATTAGG

SEQ ID NO: 1015339 - protein, 7 aa, Mycobacterium
LAGDEVS

SEQ ID NO: 1015340 - protein, 10 aa, Mycobacterium
LAGDKAAAAR

SEQ ID NO: 1015341 - protein, 11 aa, Mycobacterium
LAGDQGAAGRV

SEQ ID NO: 1015342 - protein, 8 aa, Mycobacterium
LAGEDFGS

SEQ ID NO: 1015343 - protein, 11 aa, Mycobacterium
LAGEERAPAPA

SEQ ID NO: 1015344 - protein, 6 aa, Mycobacterium
LAGEGA

SEQ ID NO: 1015345 - protein, 7 aa, Mycobacterium
LAGEPAD

SEQ ID NO: 1015346 - protein, 6 aa, Mycobacterium
LAGERL

SEQ ID NO: 1015347 - protein, 5 aa, Mycobacterium
LAGET

SEQ ID NO: 1015348 - protein, 8 aa, Mycobacterium
LAGGGPKY

SEQ ID NO: 1015349 - protein, 5 aa, Mycobacterium
LAGGN

SEQ ID NO: 1015350 - protein, 8 aa, Mycobacterium
LAGGSSTS

SEQ ID NO: 1015351 - protein, 11 aa, Mycobacterium
LAGKSKDEVNA

SEQ ID NO: 1015352 - protein, 6 aa, Mycobacterium
LAGPRR

SEQ ID NO: 1015353 - protein, 8 aa, Mycobacterium
LAGPYAST

SEQ ID NO: 1015354 - protein, 10 aa, Mycobacterium
LAGQQDSGEA

SEQ ID NO: 1015355 - protein, 18 aa, Mycobacterium
LAGRAPAKPVGQLTGEDH

SEQ ID NO: 1015356 - protein, 7 aa, Mycobacterium
LAGRDGE

SEQ ID NO: 1015357 - protein, 15 aa, Mycobacterium
LAGRPRFVTAVKRLV

SEQ ID NO: 1015358 - protein, 7 aa, Mycobacterium
LAGSDSF

SEQ ID NO: 1015359 - protein, 8 aa, Mycobacterium
LAGSTIKR

SEQ ID NO: 1015360 - protein, 16 aa, Mycobacterium
LAGTRALGRGAAHDRL

SEQ ID NO: 1015361 - protein, 11 aa, Mycobacterium
LAGTTTPTAAQ

SEQ ID NO: 1015362 - protein, 6 aa, Mycobacterium
LAGVSG

SEQ ID NO: 1015363 - protein, 9 aa, Mycobacterium
LAGYTDGTN

SEQ ID NO: 1015364 - protein, 22 aa, Mycobacterium
LAHKPTPQTKPGLTAERATNIK

SEQ ID NO: 1015365 - protein, 50 aa, Mycobacterium
LAHKPTPQTKPSLTTHASSTTEATADRTASATADRTTGLATNTGASLTTQ

SEQ ID NO: 1015366 - protein, 80 aa, Mycobacterium
LAHKSTAQTKLTSAAEPAAETKPSLTTQPAAESKSEPTTDSGLTAKAHSQTRLRADPKAQTGASLTGKSPLKTGSDAQAG

SEQ ID NO: 1015367 - protein, 8 aa, Mycobacterium
LAHTTGGL

SEQ ID NO: 1015368 - protein, 13 aa, Mycobacterium
LAKETSSTKQDAT

SEQ ID NO: 1015369 - protein, 10 aa, Mycobacterium
LAKGGAGNRD

SEQ ID NO: 1015370 - protein, 4 aa, Mycobacterium
LAKN

SEQ ID NO: 1015371 - protein, 6 aa, Mycobacterium
LAKPGA

SEQ ID NO: 1015372 - protein, 6 aa, Mycobacterium
LAKPTM

SEQ ID NO: 1015373 - protein, 6 aa, Mycobacterium
LAKTKP

SEQ ID NO: 1015374 - protein, 7 aa, Mycobacterium
LAKTSER

SEQ ID NO: 1015375 - protein, 7 aa, Mycobacterium
LALPGGP

SEQ ID NO: 1015376 - protein, 31 aa, Mycobacterium; identical to SEQ ID NO: 517191

SEQ ID NO: 1015377 - protein, 7 aa, Mycobacterium
LANDDTV

SEQ ID NO: 1015378 - protein, 8 aa, Mycobacterium
LANGATAE

SEQ ID NO: 1015379 - protein, 11 aa, Mycobacterium
LANGGTNPITG

SEQ ID NO: 1015380 - protein, 9 aa, Mycobacterium
LANNGSEVF

SEQ ID NO: 1015381 - protein, 9 aa, Mycobacterium
LANPSFGDD

SEQ ID NO: 1015382 - protein, 8 aa, Mycobacterium
LANPTISS

SEQ ID NO: 1015383 - protein, 5 aa, Mycobacterium
LANSA

SEQ ID NO: 1015384 - protein, 24 aa, Mycobacterium
LANSAGDGFADVPAERGALPGQPN

SEQ ID NO: 1015385 - protein, 10 aa, Mycobacterium
LANTGSTNWG

SEQ ID NO: 1015386 - protein, 4 aa, Mycobacterium
LAPA

SEQ ID NO: 1015387 - protein, 10 aa, Mycobacterium
LAPAAGDEIS

SEQ ID NO: 1015388 - protein, 8 aa, Mycobacterium
LAPAATRG

SEQ ID NO: 1015389 - protein, 6 aa, Mycobacterium
LAPADA

SEQ ID NO: 1015390 - protein, 8 aa, Mycobacterium
LAPAEAAA

SEQ ID NO: 1015391 - protein, 11 aa, Mycobacterium
LAPDAAPSGQH

SEQ ID NO: 1015392 - protein, 18 aa, Mycobacterium
LAPDDAERATPSNRDEVG

SEQ ID NO: 1015393 - protein, 5 aa, Mycobacterium
LAPDF

SEQ ID NO: 1015394 - protein, 7 aa, Mycobacterium
LAPDPGI

SEQ ID NO: 1015395 - protein, 8 aa, Mycobacterium
LAPEDSVS

SEQ ID NO: 1015396 - protein, 8 aa, Mycobacterium
LAPEEARD

SEQ ID NO: 1015397 - protein, 6 aa, Mycobacterium
LAPEGA

SEQ ID NO: 1015398 - protein, 6 aa, Mycobacterium
LAPENR

SEQ ID NO: 1015399 - protein, 6 aa, Mycobacterium
LAPEPN

SEQ ID NO: 1015400 - protein, 22 aa, Mycobacterium
LAPGAGSRPLRSTNARPEGARE

SEQ ID NO: 1015401 - protein, 8 aa, Mycobacterium
LAPGPHET

SEQ ID NO: 1015402 - protein, 6 aa, Mycobacterium
LAPGTP

SEQ ID NO: 1015403 - protein, 9 aa, Mycobacterium
LAPKGTESR

SEQ ID NO: 1015404 - protein, 6 aa, Mycobacterium
LAPKPG

SEQ ID NO: 1015405 - protein, 10 aa, Mycobacterium
LAPPADESLK

SEQ ID NO: 1015406 - protein, 5 aa, Mycobacterium
LAPPD

SEQ ID NO: 1015407 - protein, 15 aa, Mycobacterium
LAPPDWSPDSPSTSV

SEQ ID NO: 1015408 - protein, 8 aa, Mycobacterium
LAPPPADD

SEQ ID NO: 1015409 - protein, 8 aa, Mycobacterium
LAPPPETL

SEQ ID NO: 1015410 - protein, 5 aa, Mycobacterium
LAPPR

SEQ ID NO: 1015411 - protein, 7 aa, Mycobacterium
LAPPSVR

SEQ ID NO: 1015412 - protein, 7 aa, Mycobacterium
LAPPTAR

SEQ ID NO: 1015413 - protein, 9 aa, Mycobacterium
LAPQHEAAQ

SEQ ID NO: 1015414 - protein, 7 aa, Mycobacterium
LAPRNPL

SEQ ID NO: 1015415 - protein, 14 aa, Mycobacterium
LAPRRGQSFDSGVG

SEQ ID NO: 1015416 - protein, 15 aa, Mycobacterium
LAPSDASELKARADA

SEQ ID NO: 1015417 - protein, 9 aa, Mycobacterium
LAPSDDSNV

SEQ ID NO: 1015418 - protein, 6 aa, Mycobacterium
LAPTAP

SEQ ID NO: 1015419 - protein, 15 aa, Mycobacterium
LAPTESVEPVPQRQP

SEQ ID NO: 1015420 - protein, 7 aa, Mycobacterium
LAPTGQA

SEQ ID NO: 1015421 - protein, 8 aa, Mycobacterium
LAQASTVG

SEQ ID NO: 1015422 - protein, 9 aa, Mycobacterium
LAQEKTGEA

SEQ ID NO: 1015423 - protein, 7 aa, Mycobacterium
LAQGAQN

SEQ ID NO: 1015424 - protein, 12 aa, Mycobacterium
LAQHGDQRRATT

SEQ ID NO: 1015425 - protein, 5 aa, Mycobacterium
LAQPG

SEQ ID NO: 1015426 - protein, 5 aa, Mycobacterium
LAQRA

SEQ ID NO: 1015427 - protein, 13 aa, Mycobacterium
LAQTASLDGPIPR

SEQ ID NO: 1015428 - protein, 5 aa, Mycobacterium
LAREG

SEQ ID NO: 1015429 - protein, 18 aa, Mycobacterium
LAREPRRGPRLPVQNIRS

SEQ ID NO: 1015430 - protein, 10 aa, Mycobacterium
LARGDAQCSY

SEQ ID NO: 1015431 - protein, 13 aa, Mycobacterium
LARGGEPDRASDV

SEQ ID NO: 1015432 - protein, 8 aa, Mycobacterium
LARGTEAA

SEQ ID NO: 1015433 - protein, 8 aa, Mycobacterium
LARNESRG

SEQ ID NO: 1015434 - protein, 5 aa, Mycobacterium
LARPE

SEQ ID NO: 1015435 - protein, 15 aa, Mycobacterium
LARPGPPSSDYTRRQ

SEQ ID NO: 1015436 - protein, 8 aa, Mycobacterium
LARPGTDI

SEQ ID NO: 1015437 - protein, 8 aa, Mycobacterium
LARQTPCS

SEQ ID NO: 1015438 - protein, 7 aa, Mycobacterium
LARRSTK

SEQ ID NO: 1015439 - protein, 8 aa, Mycobacterium
LARSGAPA

SEQ ID NO: 1015440 - protein, 17 aa, Mycobacterium
LARSGKPMVTTDPDTLA

SEQ ID NO: 1015441 - protein, 4 aa, Mycobacterium
LART

SEQ ID NO: 1015442 - protein, 14 aa, Mycobacterium
LASAARGQEDVPAQ

SEQ ID NO: 1015443 - protein, 9 aa, Mycobacterium
LASAEANPI

SEQ ID NO: 1015444 - protein, 5 aa, Mycobacterium
LASDP

SEQ ID NO: 1015445 - protein, 8 aa, Mycobacterium
LASDPGLG

SEQ ID NO: 1015446 - protein, 8 aa, Mycobacterium
LASDPSVE

SEQ ID NO: 1015447 - protein, 11 aa, Mycobacterium
LASEDSAARAR

SEQ ID NO: 1015448 - protein, 10 aa, Mycobacterium
LASEKKCGHL

SEQ ID NO: 1015449 - protein, 6 aa, Mycobacterium
LASGGR

SEQ ID NO: 1015450 - protein, 9 aa, Mycobacterium
LASGPAPAA

SEQ ID NO: 1015451 - protein, 13 aa, Mycobacterium
LASGTAKRDPALG

SEQ ID NO: 1015452 - protein, 10 aa, Mycobacterium
LASGTPGMKG

SEQ ID NO: 1015453 - protein, 11 aa, Mycobacterium
LASGTSSRSSK

SEQ ID NO: 1015454 - protein, 11 aa, Mycobacterium
LASHGSSTSAV

SEQ ID NO: 1015455 - protein, 8 aa, Mycobacterium
LASLPSST

SEQ ID NO: 1015456 - protein, 7 aa, Mycobacterium
LASNGPT

SEQ ID NO: 1015457 - protein, 9 aa, Mycobacterium
LASPGDERE

SEQ ID NO: 1015458 - protein, 14 aa, Mycobacterium
LASPGTGDFARDTR

SEQ ID NO: 1015459 - protein, 8 aa, Mycobacterium
LASQPEPM

SEQ ID NO: 1015460 - protein, 12 aa, Mycobacterium
LASQTDSDERLR

SEQ ID NO: 1015461 - protein, 10 aa, Mycobacterium
LASRARKAPG

SEQ ID NO: 1015462 - protein, 7 aa, Mycobacterium
LASRDEQ

SEQ ID NO: 1015463 - protein, 7 aa, Mycobacterium
LASRPEE

SEQ ID NO: 1015464 - protein, 7 aa, Mycobacterium
LASRRRG

SEQ ID NO: 1015465 - protein, 5 aa, Mycobacterium
LASSG

SEQ ID NO: 1015466 - protein, 7 aa, Mycobacterium
LASSSTI

SEQ ID NO: 1015467 - protein, 10 aa, Mycobacterium
LASSTGPGRR

SEQ ID NO: 1015468 - protein, 5 aa, Mycobacterium
LASTR

SEQ ID NO: 1015469 - protein, 14 aa, Mycobacterium
LATAATALGNNNTI

SEQ ID NO: 1015470 - protein, 12 aa, Mycobacterium
LATDPEARQRRE

SEQ ID NO: 1015471 - protein, 14 aa, Mycobacterium
LATEPAARAAGTAV

SEQ ID NO: 1015472 - protein, 4 aa, Mycobacterium
LATG

SEQ ID NO: 1015473 - protein, 8 aa, Mycobacterium
LATGAYPR

SEQ ID NO: 1015474 - protein, 13 aa, Mycobacterium
LATNDDDGEIDPA

SEQ ID NO: 1015475 - protein, 15 aa, Mycobacterium
LATNKSNNRWETTGR

SEQ ID NO: 1015476 - protein, 8 aa, Mycobacterium
LATNQSQL

SEQ ID NO: 1015477 - protein, 6 aa, Mycobacterium
LATPGQ

SEQ ID NO: 1015478 - protein, 6 aa, Mycobacterium
LATRGF

SEQ ID NO: 1015479 - protein, 20 aa, Mycobacterium
LATRTAKDMPKSTSSTYGCR

SEQ ID NO: 1015480 - protein, 6 aa, Mycobacterium
LATTGR

SEQ ID NO: 1015481 - protein, 9 aa, Mycobacterium
LATTSKEAI

SEQ ID NO: 1015482 - protein, 14 aa, Mycobacterium
LAVQGRKDAKLQKR

SEQ ID NO: 1015483 - protein, 8 aa, Mycobacterium
LDAADRGE

SEQ ID NO: 1015484 - protein, 9 aa, Mycobacterium
LDAAGDNPA

SEQ ID NO: 1015485 - protein, 8 aa, Mycobacterium
LDAAGSPL

SEQ ID NO: 1015486 - protein, 16 aa, Mycobacterium
LDAAQGTPLNNLGRHH

SEQ ID NO: 1015487 - protein, 11 aa, Mycobacterium
LDAEGNPVELE

SEQ ID NO: 1015488 - protein, 8 aa, Mycobacterium
LDAGADDY

SEQ ID NO: 1015489 - protein, 8 aa, Mycobacterium
LDAGDQAG

SEQ ID NO: 1015490 - protein, 11 aa, Mycobacterium
LDAGGEPSLGD

SEQ ID NO: 1015491 - protein, 10 aa, Mycobacterium
LDAGGNGRQY

SEQ ID NO: 1015492 - protein, 26 aa, Mycobacterium
LDAGSGPQGADGPSAGPTPSAPNPSA

SEQ ID NO: 1015493 - protein, 7 aa, Mycobacterium
LDANRNS

SEQ ID NO: 1015494 - protein, 9 aa, Mycobacterium
LDAPPGSRA

SEQ ID NO: 1015495 - protein, 11 aa, Mycobacterium
LDAQPDGQLPA

SEQ ID NO: 1015496 - protein, 8 aa, Mycobacterium
LDATQGTR

SEQ ID NO: 1015497 - protein, 12 aa, Mycobacterium
LDATSKAQLDRG

SEQ ID NO: 1015498 - protein, 7 aa, Mycobacterium
LDDAGRQ

SEQ ID NO: 1015499 - protein, 8 aa, Mycobacterium
LDDDGRRQ

SEQ ID NO: 1015500 - protein, 7 aa, Mycobacterium
LDDEQRE

SEQ ID NO: 1015501 - protein, 4 aa, Mycobacterium
LDDG

SEQ ID NO: 1015502 - protein, 8 aa, Mycobacterium
LDDGAADS

SEQ ID NO: 1015503 - protein, 7 aa, Mycobacterium
LDDKPTY

SEQ ID NO: 1015504 - protein, 4 aa, Mycobacterium
LDDN

SEQ ID NO: 1015505 - protein, 4 aa, Mycobacterium
LDDP

SEQ ID NO: 1015506 - protein, 6 aa, Mycobacterium
LDDPGL

SEQ ID NO: 1015507 - protein, 7 aa, Mycobacterium
LDDPSLD

SEQ ID NO: 1015508 - protein, 10 aa, Mycobacterium
LDDPSTHDEI

SEQ ID NO: 1015509 - protein, 8 aa, Mycobacterium
LDDQGGTA

SEQ ID NO: 1015510 - protein, 9 aa, Mycobacterium
LDDSDDPAQ

SEQ ID NO: 1015511 - protein, 12 aa, Mycobacterium
LDDSKKLTEKTR

SEQ ID NO: 1015512 - protein, 11 aa, Mycobacterium
LDDSRPRNDLP

SEQ ID NO: 1015513 - protein, 4 aa, Mycobacterium
LDDT

SEQ ID NO: 1015514 - protein, 12 aa, Mycobacterium
LDEAEASRHRLR

SEQ ID NO: 1015515 - protein, 6 aa, Mycobacterium
LDEAGY

SEQ ID NO: 1015516 - protein, 8 aa, Mycobacterium
LDEARRGL

SEQ ID NO: 1015517 - protein, 11 aa, Mycobacterium
LDEGKPDLAPP

SEQ ID NO: 1015518 - protein, 10 aa, Mycobacterium
LDEKPTASDD

SEQ ID NO: 1015519 - protein, 5 aa, Mycobacterium
LDEPS

SEQ ID NO: 1015520 - protein, 7 aa, Mycobacterium
LDEQPAS

SEQ ID NO: 1015521 - protein, 9 aa, Mycobacterium
LDERGEGPI

SEQ ID NO: 1015522 - protein, 6 aa, Mycobacterium
LDESDL

SEQ ID NO: 1015523 - protein, 20 aa, Mycobacterium
LDGAGSAAGLAATSGGDPAD

SEQ ID NO: 1015524 - protein, 9 aa, Mycobacterium
LDGAPAASV

SEQ ID NO: 1015525 - protein, 10 aa, Mycobacterium
LDGDARGGAA

SEQ ID NO: 1015526 - protein, 8 aa, Mycobacterium
LDGDDKDY

SEQ ID NO: 1015527 - protein, 7 aa, Mycobacterium
LDGDGRL

SEQ ID NO: 1015528 - protein, 9 aa, Mycobacterium
LDGEPQYKT

SEQ ID NO: 1015529 - protein, 8 aa, Mycobacterium
LDGGADDY

SEQ ID NO: 1015530 - protein, 12 aa, Mycobacterium
LDGGAGGAGGNA

SEQ ID NO: 1015531 - protein, 4 aa, Mycobacterium
LDGN

SEQ ID NO: 1015532 - protein, 4 aa, Mycobacterium
LDGP

SEQ ID NO: 1015533 - protein, 6 aa, Mycobacterium
LDGPGL

SEQ ID NO: 1015534 - protein, 6 aa, Mycobacterium
LDGPPQ

SEQ ID NO: 1015535 - protein, 41 aa, Mycobacterium
LDGPPRRHRPRRRGRGLGGHDAGSPIRADRRGRGGDRPHRH

SEQ ID NO: 1015536 - protein, 7 aa, Mycobacterium
LDGPTAA

SEQ ID NO: 1015537 - protein, 7 aa, Mycobacterium
LDGQGDD

SEQ ID NO: 1015538 - protein, 7 aa, Mycobacterium
LDGSPLR

SEQ ID NO: 1015539 - protein, 6 aa, Mycobacterium
LDGSYP

SEQ ID NO: 1015540 - protein, 4 aa, Mycobacterium
LDGT

SEQ ID NO: 1015541 - protein, 7 aa, Mycobacterium
LDGTGRA

SEQ ID NO: 1015542 - protein, 13 aa, Mycobacterium
LDGTSGVRPFCFA

SEQ ID NO: 1015543 - protein, 9 aa, Mycobacterium
LDHKTQSSE

SEQ ID NO: 1015544 - protein, 10 aa, Mycobacterium
LDHPTDPNGE

SEQ ID NO: 1015545 - protein, 5 aa, Mycobacterium
LDKDG

SEQ ID NO: 1015546 - protein, 9 aa, Mycobacterium
LDKEGITAD

SEQ ID NO: 1015547 - protein, 9 aa, Mycobacterium
LDKPPGVAE

SEQ ID NO: 1015548 - protein, 10 aa, Mycobacterium
LDNDPETERR

SEQ ID NO: 1015549 - protein, 5 aa, Mycobacterium
LDNPT

SEQ ID NO: 1015550 - protein, 14 aa, Mycobacterium
LDPAAETEVAPQID

SEQ ID NO: 1015551 - protein, 9 aa, Mycobacterium
LDPAGEKAQ

SEQ ID NO: 1015552 - protein, 7 aa, Mycobacterium
LDPAPGL

SEQ ID NO: 1015553 - protein, 7 aa, Mycobacterium
LDPAQRE

SEQ ID NO: 1015554 - protein, 12 aa, Mycobacterium
LDPASLSGSSTG

SEQ ID NO: 1015555 - protein, 6 aa, Mycobacterium
LDPATE

SEQ ID NO: 1015556 - protein, 5 aa, Mycobacterium
LDPDE

SEQ ID NO: 1015557 - protein, 8 aa, Mycobacterium
LDPDEETI

SEQ ID NO: 1015558 - protein, 5 aa, Mycobacterium
LDPDN

SEQ ID NO: 1015559 - protein, 9 aa, Mycobacterium
LDPDPGKPS

SEQ ID NO: 1015560 - protein, 8 aa, Mycobacterium
LDPDTEKL

SEQ ID NO: 1015561 - protein, 20 aa, Mycobacterium
LDPEAAAAGAAAVASQGAAK

SEQ ID NO: 1015562 - protein, 6 aa, Mycobacterium
LDPEAR

SEQ ID NO: 1015563 - protein, 5 aa, Mycobacterium
LDPEP

SEQ ID NO: 1015564 - protein, 9 aa, Mycobacterium
LDPERAAGG

SEQ ID NO: 1015565 - protein, 5 aa, Mycobacterium
LDPEY

SEQ ID NO: 1015566 - protein, 6 aa, Mycobacterium
LDPGER

SEQ ID NO: 1015567 - protein, 5 aa, Mycobacterium
LDPGS

SEQ ID NO: 1015568 - protein, 9 aa, Mycobacterium
LDPGTGPGH

SEQ ID NO: 1015569 - protein, 10 aa, Mycobacterium
LDPGTQATID

SEQ ID NO: 1015570 - protein, 10 aa, Mycobacterium
LDPKADYGPL

SEQ ID NO: 1015571 - protein, 6 aa, Mycobacterium
LDPNSS

SEQ ID NO: 1015572 - protein, 9 aa, Mycobacterium
LDPNTGQVQ

SEQ ID NO: 1015573 - protein, 5 aa, Mycobacterium
LDPPW

SEQ ID NO: 1015574 - protein, 6 aa, Mycobacterium
LDPQGQ

SEQ ID NO: 1015575 - protein, 5 aa, Mycobacterium
LDPQN

SEQ ID NO: 1015576 - protein, 5 aa, Mycobacterium
LDPQR

SEQ ID NO: 1015577 - protein, 6 aa, Mycobacterium
LDPQRP

SEQ ID NO: 1015578 - protein, 6 aa, Mycobacterium
LDPRTV

SEQ ID NO: 1015579 - protein, 5 aa, Mycobacterium
LDPSG

SEQ ID NO: 1015580 - protein, 12 aa, Mycobacterium
LDPSQPDDAPAR

SEQ ID NO: 1015581 - protein, 11 aa, Mycobacterium
LDPTGTGQKRW

SEQ ID NO: 1015582 - protein, 8 aa, Mycobacterium
LDPTRPPH

SEQ ID NO: 1015583 - protein, 11 aa, Mycobacterium
LDQPDSGNITI

SEQ ID NO: 1015584 - protein, 7 aa, Mycobacterium
LDQPDTA

SEQ ID NO: 1015585 - protein, 15 aa, Mycobacterium
LDQSRQEHSSRRDTL

SEQ ID NO: 1015586 - protein, 9 aa, Mycobacterium
LDRDGRGDV

SEQ ID NO: 1015587 - protein, 10 aa, Mycobacterium
LDRDTAETRV

SEQ ID NO: 1015588 - protein, 6 aa, Mycobacterium
LDRGGT

SEQ ID NO: 1015589 - protein, 10 aa, Mycobacterium
LDRGSGNSVE

SEQ ID NO: 1015590 - protein, 11 aa, Mycobacterium
LDRPAQGESGQ

SEQ ID NO: 1015591 - protein, 6 aa, Mycobacterium
LDRPGL

SEQ ID NO: 1015592 - protein, 22 aa, Mycobacterium
LDRPPLGSRDRSRRRRRHPSRR

SEQ ID NO: 1015593 - protein, 6 aa, Mycobacterium
LDRPQT

SEQ ID NO: 1015594 - protein, 4 aa, Mycobacterium
LDRQ

SEQ ID NO: 1015595 - protein, 9 aa, Mycobacterium
LDRSDDPTR

SEQ ID NO: 1015596 - protein, 7 aa, Mycobacterium
LDRSGGL

SEQ ID NO: 1015597 - protein, 15 aa, Mycobacterium
LDRSSRDVSAQRSSY

SEQ ID NO: 1015598 - protein, 4 aa, Mycobacterium
LDRT

SEQ ID NO: 1015599 - protein, 6 aa, Mycobacterium
LDRTKS

SEQ ID NO: 1015600 - protein, 9 aa, Mycobacterium
LDRTSTGAG

SEQ ID NO: 1015601 - protein, 7 aa, Mycobacterium
LDSATDS

SEQ ID NO: 1015602 - protein, 4 aa, Mycobacterium
LDSD

SEQ ID NO: 1015603 - protein, 12 aa, Mycobacterium
LDSDHPLPPSAQ

SEQ ID NO: 1015604 - protein, 8 aa, Mycobacterium
LDSDRSVA

SEQ ID NO: 1015605 - protein, 10 aa, Mycobacterium
LDSDSEPAAL

SEQ ID NO: 1015606 - protein, 8 aa, Mycobacterium
LDSETRQG

SEQ ID NO: 1015607 - protein, 6 aa, Mycobacterium
LDSEVG

SEQ ID NO: 1015608 - protein, 8 aa, Mycobacterium
LDSNTANQ

SEQ ID NO: 1015609 - protein, 10 aa, Mycobacterium
LDSPDESRPP

SEQ ID NO: 1015610 - protein, 7 aa, Mycobacterium
LDSPEKE

SEQ ID NO: 1015611 - protein, 7 aa, Mycobacterium
LDSPGAA

SEQ ID NO: 1015612 - protein, 12 aa, Mycobacterium
LDSPGEPTQGAA

SEQ ID NO: 1015613 - protein, 7 aa, Mycobacterium
LDSPRSF

SEQ ID NO: 1015614 - protein, 11 aa, Mycobacterium
LDSSGPGQQIS

SEQ ID NO: 1015615 - protein, 15 aa, Mycobacterium
LDSSNRQVREAAERA

SEQ ID NO: 1015616 - protein, 9 aa, Mycobacterium
LDSVDSKER

SEQ ID NO: 1015617 - protein, 11 aa, Mycobacterium
LDTDEDDRLTR

SEQ ID NO: 1015618 - protein, 8 aa, Mycobacterium
LDTDQRAT

SEQ ID NO: 1015619 - protein, 6 aa, Mycobacterium
LDTGGA

SEQ ID NO: 1015620 - protein, 9 aa, Mycobacterium
LDTGRTRRG

SEQ ID NO: 1015621 - protein, 6 aa, Mycobacterium
LDTPAS

SEQ ID NO: 1015622 - protein, 8 aa, Mycobacterium
LDTPTTAQ

SEQ ID NO: 1015623 - protein, 5 aa, Mycobacterium
LDTRA

SEQ ID NO: 1015624 - protein, 10 aa, Mycobacterium
LDTSDDAAVR

SEQ ID NO: 1015625 - protein, 8 aa, Mycobacterium
LDTTAPTA

SEQ ID NO: 1015626 - protein, 10 aa, Mycobacterium
LDTTNRDAAR

SEQ ID NO: 1015627 - protein, 7 aa, Mycobacterium
LDVDADG

SEQ ID NO: 1015628 - protein, 8 aa, Mycobacterium
LDVQGGGS

SEQ ID NO: 1015629 - protein, 6 aa, Mycobacterium
LDYPDD

SEQ ID NO: 1015630 - protein, 6 aa, Mycobacterium
LEAGAD

SEQ ID NO: 1015631 - protein, 9 aa, Mycobacterium
LEAGATMDP

SEQ ID NO: 1015632 - protein, 11 aa, Mycobacterium
LEAGGRLPSEA

SEQ ID NO: 1015633 - protein, 4 aa, Mycobacterium
LEAP

SEQ ID NO: 1015634 - protein, 4 aa, Mycobacterium
LEAQ

SEQ ID NO: 1015635 - protein, 7 aa, Mycobacterium
LEARGKT

SEQ ID NO: 1015636 - protein, 11 aa, Mycobacterium
LEASGRPDSDV

SEQ ID NO: 1015637 - protein, 6 aa, Mycobacterium
LEASSG

SEQ ID NO: 1015638 - protein, 7 aa, Mycobacterium
LEDDAGN

SEQ ID NO: 1015639 - protein, 9 aa, Mycobacterium
LEDDEAADS

SEQ ID NO: 1015640 - protein, 59 aa, Mycobacterium
LEDEDEAASDEAEGDDDSDEGDDAEYGDGAKAPAAAAPGTASDEEEIAEPSEKDKASGD

SEQ ID NO: 1015641 - protein, 4 aa, Mycobacterium
LEDG

SEQ ID NO: 1015642 - protein, 6 aa, Mycobacterium
LEDGNS

SEQ ID NO: 1015643 - protein, 11 aa, Mycobacterium
LEDGPSAGSAW

SEQ ID NO: 1015644 - protein, 8 aa, Mycobacterium
LEDPDTGL

SEQ ID NO: 1015645 - protein, 7 aa, Mycobacterium
LEDRGVD

SEQ ID NO: 1015646 - protein, 10 aa, Mycobacterium
LEDRPKDTDR

SEQ ID NO: 1015647 - protein, 8 aa, Mycobacterium
LEDSDPAV

SEQ ID NO: 1015648 - protein, 6 aa, Mycobacterium
LEDSQP

SEQ ID NO: 1015649 - protein, 8 aa, Mycobacterium
LEEASNAK

SEQ ID NO: 1015650 - protein, 5 aa, Mycobacterium
LEEDP

SEQ ID NO: 1015651 - protein, 4 aa, Mycobacterium
LEEG

SEQ ID NO: 1015652 - protein, 6 aa, Mycobacterium
LEEGGA

SEQ ID NO: 1015653 - protein, 9 aa, Mycobacterium
LEEGPDGRE

SEQ ID NO: 1015654 - protein, 4 aa, Mycobacterium
LEEN

SEQ ID NO: 1015655 - protein, 12 aa, Mycobacterium
LEGATDEDRQRV

SEQ ID NO: 1015656 - protein, 9 aa, Mycobacterium
LEGATPDGV

SEQ ID NO: 1015657 - protein, 6 aa, Mycobacterium
LEGDSE

SEQ ID NO: 1015658 - protein, 8 aa, Mycobacterium
LEGDTGAS

SEQ ID NO: 1015659 - protein, 6 aa, Mycobacterium
LEGEMG

SEQ ID NO: 1015660 - protein, 22 aa, Mycobacterium
LEGGEAFTAEEQPAELDETEDV

SEQ ID NO: 1015661 - protein, 9 aa, Mycobacterium
LEGGSRARG

SEQ ID NO: 1015662 - protein, 9 aa, Mycobacterium
LEGGSRPTH

SEQ ID NO: 1015663 - protein, 19 aa, Mycobacterium
LEGPGGTGGLTAAGQPENC

SEQ ID NO: 1015664 - protein, 8 aa, Mycobacterium
LEGREAVD

SEQ ID NO: 1015665 - protein, 8 aa, Mycobacterium
LEGTDTDV

SEQ ID NO: 1015666 - protein, 6 aa, Mycobacterium
LEGTGG

SEQ ID NO: 1015667 - protein, 8 aa, Mycobacterium
LEGTSGPV

SEQ ID NO: 1015668 - protein, 9 aa, Mycobacterium
LEKAGGEPQ

SEQ ID NO: 1015669 - protein, 13 aa, Mycobacterium
LEKDALREIAKGN

SEQ ID NO: 1015670 - protein, 13 aa, Mycobacterium
LEKDALREVAKVK

SEQ ID NO: 1015671 - protein, 8 aa, Mycobacterium
LEKPANQI

SEQ ID NO: 1015672 - protein, 11 aa, Mycobacterium
LELSSTKPTTI

SEQ ID NO: 1015673 - protein, 6 aa, Mycobacterium
LENAGS

SEQ ID NO: 1015674 - protein, 17 aa, Mycobacterium
LENGRAEVEAATSRLAT

SEQ ID NO: 1015675 - protein, 9 aa, Mycobacterium
LENPGPDDM

SEQ ID NO: 1015676 - protein, 8 aa, Mycobacterium
LENPTSEQ

SEQ ID NO: 1015677 - protein, 15 aa, Mycobacterium
LENRTARGKVVLRVR

SEQ ID NO: 1015678 - protein, 13 aa, Mycobacterium
LEPAKPQPEQITL

SEQ ID NO: 1015679 - protein, 4 aa, Mycobacterium
LEPG

SEQ ID NO: 1015680 - protein, 15 aa, Mycobacterium
LEPGGRPDAPEPGPA

SEQ ID NO: 1015681 - protein, 16 aa, Mycobacterium
LEPGPRRTASWPDVPG

SEQ ID NO: 1015682 - protein, 5 aa, Mycobacterium
LEPGS

SEQ ID NO: 1015683 - protein, 8 aa, Mycobacterium
LEPGTPDG

SEQ ID NO: 1015684 - protein, 10 aa, Mycobacterium
LEPKGDKTVV

SEQ ID NO: 1015685 - protein, 12 aa, Mycobacterium
LEPSDATDANGG

SEQ ID NO: 1015686 - protein, 6 aa, Mycobacterium
LEPSDR

SEQ ID NO: 1015687 - protein, 6 aa, Mycobacterium
LEQAES

SEQ ID NO: 1015688 - protein, 8 aa, Mycobacterium
LEQGTNKR

SEQ ID NO: 1015689 - protein, 11 aa, Mycobacterium
LEQSGPTVSQT

SEQ ID NO: 1015690 - protein, 12 aa, Mycobacterium
LEQTRPIGVSPV

SEQ ID NO: 1015691 - protein, 7 aa, Mycobacterium
LERAPTG

SEQ ID NO: 1015692 - protein, 6 aa, Mycobacterium
LERDGA

SEQ ID NO: 1015693 - protein, 10 aa, Mycobacterium
LERKTAADGV

SEQ ID NO: 1015694 - protein, 10 aa, Mycobacterium
LERNDPADLP

SEQ ID NO: 1015695 - protein, 8 aa, Mycobacterium
LERPEDQA

SEQ ID NO: 1015696 - protein, 16 aa, Mycobacterium
LERRQKSRHTRAARDA

SEQ ID NO: 1015697 - protein, 6 aa, Mycobacterium
LESAGA

SEQ ID NO: 1015698 - protein, 9 aa, Mycobacterium
LESAQNDAE

SEQ ID NO: 1015699 - protein, 9 aa, Mycobacterium
LESARPYAD

SEQ ID NO: 1015700 - protein, 9 aa, Mycobacterium
LESEPGAKV

SEQ ID NO: 1015701 - protein, 15 aa, Mycobacterium
LESNRDSRQYAGPER

SEQ ID NO: 1015702 - protein, 5 aa, Mycobacterium
LETAT

SEQ ID NO: 1015703 - protein, 20 aa, Mycobacterium
LETENPEAAANVKARLEAES

SEQ ID NO: 1015704 - protein, 5 aa, Mycobacterium
LETPA

SEQ ID NO: 1015705 - protein, 10 aa, Mycobacterium
LETQARQRER

SEQ ID NO: 1015706 - protein, 4 aa, Mycobacterium
LETR

SEQ ID NO: 1015707 - protein, 9 aa, Mycobacterium
LETSSDGGW

SEQ ID NO: 1015708 - protein, 5 aa, Mycobacterium
LEVDT

SEQ ID NO: 1015709 - protein, 5 aa, Mycobacterium
LEVEG

SEQ ID NO: 1015710 - protein, 25 aa, Mycobacterium
LFGSPGHAGIGGQTGTNGAAGGGGF

SEQ ID NO: 1015711 - protein, 10 aa, Mycobacterium
LGAAADSFSA

SEQ ID NO: 1015712 - protein, 16 aa, Mycobacterium
LGAAAEAAAGPTTGVA

SEQ ID NO: 1015713 - protein, 9 aa, Mycobacterium
LGAAGSRMY

SEQ ID NO: 1015714 - protein, 12 aa, Mycobacterium
LGAANSAALART

SEQ ID NO: 1015715 - protein, 5 aa, Mycobacterium
LGAAQ

SEQ ID NO: 1015716 - protein, 8 aa, Mycobacterium
LGADSSAK

SEQ ID NO: 1015717 - protein, 7 aa, Mycobacterium
LGAEAGL

SEQ ID NO: 1015718 - protein, 37 aa, Mycobacterium; identical to SEQ ID NO: 519470

SEQ ID NO: 1015719 - protein, 7 aa, Mycobacterium
LGAEPSA

SEQ ID NO: 1015720 - protein, 8 aa, Mycobacterium
LGAGEQGT

SEQ ID NO: 1015721 - protein, 13 aa, Mycobacterium
LGAGGISGPPVAE

SEQ ID NO: 1015722 - protein, 20 aa, Mycobacterium
LGAGGTGKGTAGTMRGSAGA

SEQ ID NO: 1015723 - protein, 9 aa, Mycobacterium
LGAKSNSLV

SEQ ID NO: 1015724 - protein, 9 aa, Mycobacterium
LGALNTQAQ

SEQ ID NO: 1015725 - protein, 7 aa, Mycobacterium
LGANPNW

SEQ ID NO: 1015726 - protein, 14 aa, Mycobacterium
LGAPGPAPDASAAA

SEQ ID NO: 1015727 - protein, 9 aa, Mycobacterium
LGAPGQANY

SEQ ID NO: 1015728 - protein, 4 aa, Mycobacterium
LGAQ

SEQ ID NO: 1015729 - protein, 54 aa, Mycobacterium
LGAQGDSAAQTGGGGNTGQAAEGASSGQAAASGGAVSPNSIAAGATNTTTGSAV

SEQ ID NO: 1015730 - protein, 10 aa, Mycobacterium
LGAQGGSNGG

SEQ ID NO: 1015731 - protein, 6 aa, Mycobacterium
LGAQPR

SEQ ID NO: 1015732 - protein, 28 aa, Mycobacterium
LGAQQGGAPPTGAETGPTVTAGERRRTR

SEQ ID NO: 1015733 - protein, 9 aa, Mycobacterium
LGAQSQDGF

SEQ ID NO: 1015734 - protein, 4 aa, Mycobacterium
LGAR

SEQ ID NO: 1015735 - protein, 5 aa, Mycobacterium
LGASG

SEQ ID NO: 1015736 - protein, 5 aa, Mycobacterium
LGATG

SEQ ID NO: 1015737 - protein, 5 aa, Mycobacterium
LGATR

SEQ ID NO: 1015738 - protein, 6 aa, Mycobacterium
LGDAGA

SEQ ID NO: 1015739 - protein, 10 aa, Mycobacterium
LGDAPPERSR

SEQ ID NO: 1015740 - protein, 26 aa, Mycobacterium
LGDATGALGPAGSMSQLARSPTPFPR

SEQ ID NO: 1015741 - protein, 11 aa, Mycobacterium
LGDDGARQRRT

SEQ ID NO: 1015742 - protein, 10 aa, Mycobacterium
LGDDKTAAEF

SEQ ID NO: 1015743 - protein, 8 aa, Mycobacterium
LGDDPELA

SEQ ID NO: 1015744 - protein, 6 aa, Mycobacterium
LGDEGD

SEQ ID NO: 1015745 - protein, 10 aa, Mycobacterium
LGDPAANAAS

SEQ ID NO: 1015746 - protein, 16 aa, Mycobacterium
LGDPALGHSQRAAGDR

SEQ ID NO: 1015747 - protein, 4 aa, Mycobacterium
LGDQ

SEQ ID NO: 1015748 - protein, 11 aa, Mycobacterium
LGDQPIQSASG

SEQ ID NO: 1015749 - protein, 6 aa, Mycobacterium
LGDRAD

SEQ ID NO: 1015750 - protein, 15 aa, Mycobacterium
LGDRQRKALLEKFGS

SEQ ID NO: 1015751 - protein, 7 aa, Mycobacterium
LGDRSPL

SEQ ID NO: 1015752 - protein, 10 aa, Mycobacterium
LGDSEGGWGD

SEQ ID NO: 1015753 - protein, 10 aa, Mycobacterium
LGDSESPDVR

SEQ ID NO: 1015754 - protein, 5 aa, Mycobacterium
LGDSL

SEQ ID NO: 1015755 - protein, 8 aa, Mycobacterium
LGDTAAPA

SEQ ID NO: 1015756 - protein, 5 aa, Mycobacterium
LGEAA

SEQ ID NO: 1015757 - protein, 10 aa, Mycobacterium
LGEDGPTHQP

SEQ ID NO: 1015758 - protein, 7 aa, Mycobacterium
LGEEAGA

SEQ ID NO: 1015759 - protein, 13 aa, Mycobacterium
LGEETELRAETDG

SEQ ID NO: 1015760 - protein, 11 aa, Mycobacterium
LGEGGYIGRED

SEQ ID NO: 1015761 - protein, 6 aa, Mycobacterium
LGEGQF

SEQ ID NO: 1015762 - protein, 11 aa, Mycobacterium
LGEHDSPGEAT

SEQ ID NO: 1015763 - protein, 5 aa, Mycobacterium
LGEKD

SEQ ID NO: 1015764 - protein, 10 aa, Mycobacterium
LGELRSRSNP

SEQ ID NO: 1015765 - protein, 14 aa, Mycobacterium
LGENNGVPTDGGLS

SEQ ID NO: 1015766 - protein, 6 aa, Mycobacterium
LGENPD

SEQ ID NO: 1015767 - protein, 4 aa, Mycobacterium
LGEP

SEQ ID NO: 1015768 - protein, 6 aa, Mycobacterium
LGEPGQ

SEQ ID NO: 1015769 - protein, 12 aa, Mycobacterium
LGEPLSAEQTAR

SEQ ID NO: 1015770 - protein, 4 aa, Mycobacterium
LGEQ

SEQ ID NO: 1015771 - protein, 8 aa, Mycobacterium
LGEQASAR

SEQ ID NO: 1015772 - protein, 11 aa, Mycobacterium
LGEQPGPPSDL

SEQ ID NO: 1015773 - protein, 4 aa, Mycobacterium
LGER

SEQ ID NO: 1015774 - protein, 9 aa, Mycobacterium
LGERTEAAI

SEQ ID NO: 1015775 - protein, 8 aa, Mycobacterium
LGESEFSR

SEQ ID NO: 1015776 - protein, 5 aa, Mycobacterium
LGEVP

SEQ ID NO: 1015777 - protein, 11 aa, Mycobacterium
LGFGNNGDNNI

SEQ ID NO: 1015778 - protein, 8 aa, Mycobacterium
LGGAAGTR

SEQ ID NO: 1015779 - protein, 7 aa, Mycobacterium
LGGAEMS

SEQ ID NO: 1015780 - protein, 39 aa, Mycobacterium
LGGAGDSPGPQADVAKTPAPTTANPAAVRADRREETAAT

SEQ ID NO: 1015781 - protein, 9 aa, Mycobacterium
LGGAGGELA

SEQ ID NO: 1015782 - protein, 7 aa, Mycobacterium
LGGARRA

SEQ ID NO: 1015783 - protein, 8 aa, Mycobacterium
LGGATETA

SEQ ID NO: 1015784 - protein, 6 aa, Mycobacterium
LGGDDF

SEQ ID NO: 1015785 - protein, 11 aa, Mycobacterium
LGGDGGSPWPS

SEQ ID NO: 1015786 - protein, 20 aa, Mycobacterium
LGGDGGTGGQLFGNMGLNGP

SEQ ID NO: 1015787 - protein, 6 aa, Mycobacterium
LGGDPA

SEQ ID NO: 1015788 - protein, 7 aa, Mycobacterium
LGGDSVS

SEQ ID NO: 1015789 - protein, 9 aa, Mycobacterium
LGGEPALGA

SEQ ID NO: 1015790 - protein, 5 aa, Mycobacterium
LGGGL

SEQ ID NO: 1015791 - protein, 13 aa, Mycobacterium
LGGGQCGCHRWAS

SEQ ID NO: 1015792 - protein, 6 aa, Mycobacterium
LGGGRH

SEQ ID NO: 1015793 - protein, 6 aa, Mycobacterium
LGGGRS

SEQ ID NO: 1015794 - protein, 7 aa, Mycobacterium
LGGGSQN

SEQ ID NO: 1015795 - protein, 9 aa, Mycobacterium
LGGGSVSGN

SEQ ID NO: 1015796 - protein, 4 aa, Mycobacterium
LGGH

SEQ ID NO: 1015797 - protein, 12 aa, Mycobacterium
LGGHPDLGTNNY

SEQ ID NO: 1015798 - protein, 4 aa, Mycobacterium
LGGK

SEQ ID NO: 1015799 - protein, 6 aa, Mycobacterium
LGGLGA

SEQ ID NO: 1015800 - protein, 79 aa, Mycobacterium
LGGNGGNGGLGNAGYGGDGGKGGDGGDTGGGVGRSGGTGGKGGASTLNGQQVAGGSGGSSKAPVGNRGSSGGTGGHPGG

SEQ ID NO: 1015801 - protein, 50 aa, Mycobacterium
LGGPGGAGGDGGTGGAANIGTGGDGGGGGTGGISRNGNGGDGGAGGSGGE

SEQ ID NO: 1015802 - protein, 9 aa, Mycobacterium
LGGPTSSEL

SEQ ID NO: 1015803 - protein, 5 aa, Mycobacterium
LGGQA

SEQ ID NO: 1015804 - protein, 7 aa, Mycobacterium
LGGRAGY

SEQ ID NO: 1015805 - protein, 11 aa, Mycobacterium
LGGSASDVQPD

SEQ ID NO: 1015806 - protein, 6 aa, Mycobacterium
LGGSSS

SEQ ID NO: 1015807 - protein, 14 aa, Mycobacterium
LGGSSSRRGDGTYR

SEQ ID NO: 1015808 - protein, 9 aa, Mycobacterium
LGGTPMPRD

SEQ ID NO: 1015809 - protein, 12 aa, Mycobacterium
LGGTPRPSSPVA

SEQ ID NO: 1015810 - protein, 6 aa, Mycobacterium
LGGTRD

SEQ ID NO: 1015811 - protein, 5 aa, Mycobacterium
LGHPR

SEQ ID NO: 1015812 - protein, 5 aa, Mycobacterium
LGHTG

SEQ ID NO: 1015813 - protein, 14 aa, Mycobacterium
LGIPGPGPDGRPRY

SEQ ID NO: 1015814 - protein, 8 aa, Mycobacterium
LGKDGGTM

SEQ ID NO: 1015815 - protein, 8 aa, Mycobacterium
LGKGRTAR

SEQ ID NO: 1015816 - protein, 17 aa, Mycobacterium
LGKPPGGSAVTVEPGGA

SEQ ID NO: 1015817 - protein, 22 aa, Mycobacterium
LGLANSGNGNLGGFNSGGGTSA

SEQ ID NO: 1015818 - protein, 4 aa, Mycobacterium
LGLS

SEQ ID NO: 1015819 - protein, 5 aa, Mycobacterium
LGNAR

SEQ ID NO: 1015820 - protein, 44 aa, Mycobacterium; identical to SEQ ID NO: 520162

SEQ ID NO: 1015821 - protein, 24 aa, Mycobacterium
LGNGGTGGAGGAGANGGAGGSAGL

SEQ ID NO: 1015822 - protein, 9 aa, Mycobacterium
LGNGKPNYR

SEQ ID NO: 1015823 - protein, 15 aa, Mycobacterium
LGNHANASSEVEYDG

SEQ ID NO: 1015824 - protein, 59 aa, Mycobacterium
LGNKGGTGNIGSGNTGSTNIGNGNTGSSNFGGGNVGSNNIGDGNLGSGNWRSGNLGNEN

SEQ ID NO: 1015825 - protein, 17 aa, Mycobacterium
LGNKGNANLGSGNTGIG

SEQ ID NO: 1015826 - protein, 6 aa, Mycobacterium
LGNPAT

SEQ ID NO: 1015827 - protein, 6 aa, Mycobacterium
LGNQGD

SEQ ID NO: 1015828 - protein, 8 aa, Mycobacterium
LGNSGDNN

SEQ ID NO: 1015829 - protein, 10 aa, Mycobacterium
LGNTGNSNAP

SEQ ID NO: 1015830 - protein, 9 aa, Mycobacterium
LGPAAARES

SEQ ID NO: 1015831 - protein, 9 aa, Mycobacterium
LGPAASPLG

SEQ ID NO: 1015832 - protein, 8 aa, Mycobacterium
LGPAATLA

SEQ ID NO: 1015833 - protein, 7 aa, Mycobacterium
LGPADDE

SEQ ID NO: 1015834 - protein, 4 aa, Mycobacterium
LGPD

SEQ ID NO: 1015835 - protein, 5 aa, Mycobacterium
LGPDA

SEQ ID NO: 1015836 - protein, 8 aa, Mycobacterium
LGPDDGWQ

SEQ ID NO: 1015837 - protein, 5 aa, Mycobacterium
LGPDL

SEQ ID NO: 1015838 - protein, 9 aa, Mycobacterium
LGPDPAATL

SEQ ID NO: 1015839 - protein, 5 aa, Mycobacterium
LGPDT

SEQ ID NO: 1015840 - protein, 4 aa, Mycobacterium
LGPE

SEQ ID NO: 1015841 - protein, 6 aa, Mycobacterium
LGPEAP

SEQ ID NO: 1015842 - protein, 15 aa, Mycobacterium
LGPEARTEQPDPPGP

SEQ ID NO: 1015843 - protein, 8 aa, Mycobacterium
LGPEGGGV

SEQ ID NO: 1015844 - protein, 5 aa, Mycobacterium
LGPEH

SEQ ID NO: 1015845 - protein, 9 aa, Mycobacterium
LGPERVKPG

SEQ ID NO: 1015846 - protein, 4 aa, Mycobacterium
LGPG

SEQ ID NO: 1015847 - protein, 7 aa, Mycobacterium
LGPGATV

SEQ ID NO: 1015848 - protein, 7 aa, Mycobacterium
LGPGDDA

SEQ ID NO: 1015849 - protein, 8 aa, Mycobacterium
LGPGDTDW

SEQ ID NO: 1015850 - protein, 5 aa, Mycobacterium
LGPGE

SEQ ID NO: 1015851 - protein, 5 aa, Mycobacterium
LGPGH

SEQ ID NO: 1015852 - protein, 5 aa, Mycobacterium
LGPHT

SEQ ID NO: 1015853 - protein, 4 aa, Mycobacterium
LGPK

SEQ ID NO: 1015854 - protein, 5 aa, Mycobacterium
LGPKG

SEQ ID NO: 1015855 - protein, 4 aa, Mycobacterium
LGPL

SEQ ID NO: 1015856 - protein, 7 aa, Mycobacterium
LGPPALP

SEQ ID NO: 1015857 - protein, 7 aa, Mycobacterium
LGPPASI

SEQ ID NO: 1015858 - protein, 10 aa, Mycobacterium
LGPPGDWAPE

SEQ ID NO: 1015859 - protein, 25 aa, Mycobacterium
LGPPPVPTSSPPTTPAGAPTKPASM

SEQ ID NO: 1015860 - protein, 22 aa, Mycobacterium
LGPPQRAPAGAGKRRDGRRQPS

SEQ ID NO: 1015861 - protein, 12 aa, Mycobacterium
LGPPTVDSKEKF

SEQ ID NO: 1015862 - protein, 8 aa, Mycobacterium
LGPQPAAA

SEQ ID NO: 1015863 - protein, 10 aa, Mycobacterium
LGPSGSGKST

SEQ ID NO: 1015864 - protein, 14 aa, Mycobacterium
LGPSLSNRGRRSVA

SEQ ID NO: 1015865 - protein, 9 aa, Mycobacterium
LGPSPGPGR

SEQ ID NO: 1015866 - protein, 6 aa, Mycobacterium
LGPTGQ

SEQ ID NO: 1015867 - protein, 7 aa, Mycobacterium
LGPTSGA

SEQ ID NO: 1015868 - protein, 23 aa, Mycobacterium
LGPTTRTASISPDVNDPGARNVS

SEQ ID NO: 1015869 - protein, 6 aa, Mycobacterium
LGPVNG

SEQ ID NO: 1015870 - protein, 9 aa, Mycobacterium
LGQARRGSR

SEQ ID NO: 1015871 - protein, 20 aa, Mycobacterium
LGQEDEPSAGGRPDDAPSAY

SEQ ID NO: 1015872 - protein, 11 aa, Mycobacterium
LGQPGTYTDFG

SEQ ID NO: 1015873 - protein, 8 aa, Mycobacterium
LGQPPSGY

SEQ ID NO: 1015874 - protein, 16 aa, Mycobacterium
LGQPRSNGCSYADSPH

SEQ ID NO: 1015875 - protein, 7 aa, Mycobacterium
LGQRAAE

SEQ ID NO: 1015876 - protein, 5 aa, Mycobacterium
LGQRP

SEQ ID NO: 1015877 - protein, 24 aa, Mycobacterium
LGQTGAEGRAGDPGNGVGVGEDDL

SEQ ID NO: 1015878 - protein, 13 aa, Mycobacterium
LGQTKASGQPRAG

SEQ ID NO: 1015879 - protein, 5 aa, Mycobacterium
LGQTR

SEQ ID NO: 1015880 - protein, 9 aa, Mycobacterium
LGRAPTATE

SEQ ID NO: 1015881 - protein, 4 aa, Mycobacterium
LGRD

SEQ ID NO: 1015882 - protein, 7 aa, Mycobacterium
LGRDDGG

SEQ ID NO: 1015883 - protein, 10 aa, Mycobacterium
LGRDPAGDGF

SEQ ID NO: 1015884 - protein, 4 aa, Mycobacterium
LGRG

SEQ ID NO: 1015885 - protein, 10 aa, Mycobacterium
LGRGPAISAE

SEQ ID NO: 1015886 - protein, 7 aa, Mycobacterium
LGRGPGN

SEQ ID NO: 1015887 - protein, 10 aa, Mycobacterium
LGRPDGLTVP

SEQ ID NO: 1015888 - protein, 9 aa, Mycobacterium
LGRPDGTSA

SEQ ID NO: 1015889 - protein, 8 aa, Mycobacterium
LGRPDPQM

SEQ ID NO: 1015890 - protein, 9 aa, Mycobacterium
LGRPGDVDE

SEQ ID NO: 1015891 - protein, 5 aa, Mycobacterium
LGRPH

SEQ ID NO: 1015892 - protein, 9 aa, Mycobacterium
LGRPNGARL

SEQ ID NO: 1015893 - protein, 8 aa, Mycobacterium
LGRPSRPT

SEQ ID NO: 1015894 - protein, 14 aa, Mycobacterium
LGRPVGARGEQTRQ

SEQ ID NO: 1015895 - protein, 7 aa, Mycobacterium
LGRPVGD

SEQ ID NO: 1015896 - protein, 10 aa, Mycobacterium
LGRQSEEGSG

SEQ ID NO: 1015897 - protein, 7 aa, Mycobacterium
LGRRRPD

SEQ ID NO: 1015898 - protein, 11 aa, Mycobacterium
LGRSRTAANIG

SEQ ID NO: 1015899 - protein, 6 aa, Mycobacterium
LGRSSG

SEQ ID NO: 1015900 - protein, 5 aa, Mycobacterium
LGRST

SEQ ID NO: 1015901 - protein, 6 aa, Mycobacterium
LGRTDN

SEQ ID NO: 1015902 - protein, 5 aa, Mycobacterium
LGRTP

SEQ ID NO: 1015903 - protein, 10 aa, Mycobacterium
LGSADPGIPP

SEQ ID NO: 1015904 - protein, 6 aa, Mycobacterium
LGSAET

SEQ ID NO: 1015905 - protein, 6 aa, Mycobacterium
LGSAPQ

SEQ ID NO: 1015906 - protein, 6 aa, Mycobacterium
LGSDGD

SEQ ID NO: 1015907 - protein, 22 aa, Mycobacterium
LGSDGDAKAVTSRRLGRPDVTG

SEQ ID NO: 1015908 - protein, 23 aa, Mycobacterium
LGSDKRDDYAPDGRRSDAYRPLS

SEQ ID NO: 1015909 - protein, 11 aa, Mycobacterium
LGSDRRQATAA

SEQ ID NO: 1015910 - protein, 10 aa, Mycobacterium
LGSDTGGSIR

SEQ ID NO: 1015911 - protein, 29 aa, Mycobacterium
LGSEGAGGAGGSSTSANGGAGGAGGAGGW

SEQ ID NO: 1015912 - protein, 10 aa, Mycobacterium
LGSETGRIHG

SEQ ID NO: 1015913 - protein, 5 aa, Mycobacterium
LGSGA

SEQ ID NO: 1015914 - protein, 9 aa, Mycobacterium
LGSGDDPDL

SEQ ID NO: 1015915 - protein, 20 aa, Mycobacterium
LGSGEGSQQNSESASRGGLG

SEQ ID NO: 1015916 - protein, 11 aa, Mycobacterium
LGSGNTGAGNL

SEQ ID NO: 1015917 - protein, 8 aa, Mycobacterium
LGSGRAEL

SEQ ID NO: 1015918 - protein, 7 aa, Mycobacterium
LGSGRRY

SEQ ID NO: 1015919 - protein, 5 aa, Mycobacterium
LGSGV

SEQ ID NO: 1015920 - protein, 15 aa, Mycobacterium
LGSPDPAETYSSSPH

SEQ ID NO: 1015921 - protein, 29 aa, Mycobacterium
LGSPGGAAKVGLTENDPDAVKSLEIRAEA

SEQ ID NO: 1015922 - protein, 18 aa, Mycobacterium
LGSPGGAAKVGMTENDPQ

SEQ ID NO: 1015923 - protein, 5 aa, Mycobacterium
LGSPK

SEQ ID NO: 1015924 - protein, 22 aa, Mycobacterium
LGSPSWAAEPRLATAAGRRTHE

SEQ ID NO: 1015925 - protein, 6 aa, Mycobacterium
LGSPTA

SEQ ID NO: 1015926 - protein, 6 aa, Mycobacterium
LGSSGA

SEQ ID NO: 1015927 - protein, 6 aa, Mycobacterium
LGSSHG

SEQ ID NO: 1015928 - protein, 8 aa, Mycobacterium
LGSSKGRI

SEQ ID NO: 1015929 - protein, 7 aa, Mycobacterium
LGSSSGL

SEQ ID NO: 1015930 - protein, 5 aa, Mycobacterium
LGSSV

SEQ ID NO: 1015931 - protein, 9 aa, Mycobacterium
LGSTIGAAN

SEQ ID NO: 1015932 - protein, 6 aa, Mycobacterium
LGSTQD

SEQ ID NO: 1015933 - protein, 11 aa, Mycobacterium
LGSTSKTAELG

SEQ ID NO: 1015934 - protein, 6 aa, Mycobacterium
LGSVDD

SEQ ID NO: 1015935 - protein, 8 aa, Mycobacterium
LGTAGDGG

SEQ ID NO: 1015936 - protein, 8 aa, Mycobacterium
LGTAGTAT

SEQ ID NO: 1015937 - protein, 11 aa, Mycobacterium
LGTATKSASRL

SEQ ID NO: 1015938 - protein, 4 aa, Mycobacterium
LGTG

SEQ ID NO: 1015939 - protein, 15 aa, Mycobacterium
LGTGAGIAGGALPPP

SEQ ID NO: 1015940 - protein, 6 aa, Mycobacterium
LGTGGK

SEQ ID NO: 1015941 - protein, 5 aa, Mycobacterium
LGTGP

SEQ ID NO: 1015942 - protein, 15 aa, Mycobacterium
LGTGQVSGTVPAGTT

SEQ ID NO: 1015943 - protein, 5 aa, Mycobacterium
LGTGT

SEQ ID NO: 1015944 - protein, 5 aa, Mycobacterium
LGTID

SEQ ID NO: 1015945 - protein, 4 aa, Mycobacterium
LGTK

SEQ ID NO: 1015946 - protein, 15 aa, Mycobacterium
LGTLPKEQRADAGKA

SEQ ID NO: 1015947 - protein, 20 aa, Mycobacterium
LGTNPRKSTKTGSGERDAEI

SEQ ID NO: 1015948 - protein, 13 aa, Mycobacterium
LGTNTDPYQRAEG

SEQ ID NO: 1015949 - protein, 5 aa, Mycobacterium
LGTPE

SEQ ID NO: 1015950 - protein, 6 aa, Mycobacterium
LGTPPA

SEQ ID NO: 1015951 - protein, 11 aa, Mycobacterium
LGTSGDDGSGI

SEQ ID NO: 1015952 - protein, 8 aa, Mycobacterium
LGTSGGKN

SEQ ID NO: 1015953 - protein, 4 aa, Mycobacterium
LGTT

SEQ ID NO: 1015954 - protein, 10 aa, Mycobacterium
LGTTDPKHPF

SEQ ID NO: 1015955 - protein, 6 aa, Mycobacterium
LGTTDQ

SEQ ID NO: 1015956 - protein, 5 aa, Mycobacterium
LGTTL

SEQ ID NO: 1015957 - protein, 14 aa, Mycobacterium
LGVGPATARVVAHH

SEQ ID NO: 1015958 - protein, 7 aa, Mycobacterium
LGVGTEA

SEQ ID NO: 1015959 - protein, 17 aa, Mycobacterium
LGVKTGEGFYTYPNSSD

SEQ ID NO: 1015960 - protein, 7 aa, Mycobacterium
LHGGDDA

SEQ ID NO: 1015961 - protein, 4 aa, Mycobacterium
LHGS

SEQ ID NO: 1015962 - protein, 5 aa, Mycobacterium
LHGSG

SEQ ID NO: 1015963 - protein, 5 aa, Mycobacterium
LHPDI

SEQ ID NO: 1015964 - protein, 4 aa, Mycobacterium
LHPS

SEQ ID NO: 1015965 - protein, 17 aa, Mycobacterium
LHPTKNSPAQRPRRTRR

SEQ ID NO: 1015966 - protein, 23 aa, Mycobacterium
LHPTRGKASQGEPLVGPEAPGWQ

SEQ ID NO: 1015967 - protein, 5 aa, Mycobacterium
LHSQA

SEQ ID NO: 1015968 - protein, 10 aa, Mycobacterium
LHTKPIDGTG

SEQ ID NO: 1015969 - protein, 6 aa, Mycobacterium
LHTNRG

SEQ ID NO: 1015970 - protein, 12 aa, Mycobacterium
LIGGSDSNEARG

SEQ ID NO: 1015971 - protein, 10 aa, Mycobacterium
LIGGSGYQNY

SEQ ID NO: 1015972 - protein, 27 aa, Mycobacterium
LIGNGGSGGIGGPGTTGLAGGAGGSGG

SEQ ID NO: 1015973 - protein, 8 aa, Mycobacterium
LKAAREGK

SEQ ID NO: 1015974 - protein, 9 aa, Mycobacterium
LKAGGADAA

SEQ ID NO: 1015975 - protein, 7 aa, Mycobacterium
LKAGKST

SEQ ID NO: 1015976 - protein, 5 aa, Mycobacterium
LKAGQ

SEQ ID NO: 1015977 - protein, 11 aa, Mycobacterium
LKAQRDSDRAA

SEQ ID NO: 1015978 - protein, 9 aa, Mycobacterium
LKARDSGRG

SEQ ID NO: 1015979 - protein, 7 aa, Mycobacterium
LKATGDS

SEQ ID NO: 1015980 - protein, 15 aa, Mycobacterium
LKDDELGRGGFTGRT

SEQ ID NO: 1015981 - protein, 17 aa, Mycobacterium
LKDTSRTELTVDDTLGI

SEQ ID NO: 1015982 - protein, 5 aa, Mycobacterium
LKEGR

SEQ ID NO: 1015983 - protein, 13 aa, Mycobacterium
LKENERLERETRD

SEQ ID NO: 1015984 - protein, 12 aa, Mycobacterium
LKGDGGSSWGNQ

SEQ ID NO: 1015985 - protein, 9 aa, Mycobacterium
LKGGTEMGQ

SEQ ID NO: 1015986 - protein, 8 aa, Mycobacterium
LKGGTSEP

SEQ ID NO: 1015987 - protein, 6 aa, Mycobacterium
LKGKQA

SEQ ID NO: 1015988 - protein, 13 aa, Mycobacterium
LKHRQTSTKVLTP

SEQ ID NO: 1015989 - protein, 9 aa, Mycobacterium
LKNQDPARY

SEQ ID NO: 1015990 - protein, 6 aa, Mycobacterium
LKPADI

SEQ ID NO: 1015991 - protein, 7 aa, Mycobacterium
LKPESSY

SEQ ID NO: 1015992 - protein, 12 aa, Mycobacterium
LKPKSRNSPESM

SEQ ID NO: 1015993 - protein, 4 aa, Mycobacterium
LKPL

SEQ ID NO: 1015994 - protein, 6 aa, Mycobacterium
LKPPEL

SEQ ID NO: 1015995 - protein, 7 aa, Mycobacterium
LKPQRGA

SEQ ID NO: 1015996 - protein, 7 aa, Mycobacterium
LKPRGPS

SEQ ID NO: 1015997 - protein, 20 aa, Mycobacterium
LKPSGAAKFGTRTETKNVNS

SEQ ID NO: 1015998 - protein, 5 aa, Mycobacterium
LKRDP

SEQ ID NO: 1015999 - protein, 8 aa, Mycobacterium
LKRGGTNL

SEQ ID NO: 1016000 - protein, 4 aa, Mycobacterium
LKSG

SEQ ID NO: 1016001 - protein, 6 aa, Mycobacterium
LKSPTF

SEQ ID NO: 1016002 - protein, 7 aa, Mycobacterium
LKSQGAE

SEQ ID NO: 1016003 - protein, 7 aa, Mycobacterium
LKSTGKA

SEQ ID NO: 1016004 - protein, 15 aa, Mycobacterium
LKVDSRDGGYLGRVN

SEQ ID NO: 1016005 - protein, 12 aa, Mycobacterium
LLGGGDGATLAD

SEQ ID NO: 1016006 - protein, 14 aa, Mycobacterium
LLGGGGKKKSDADV

SEQ ID NO: 1016007 - protein, 11 aa, Mycobacterium
LLGGSGYQNYR

SEQ ID NO: 1016008 - protein, 7 aa, Mycobacterium
LLGPDRP

SEQ ID NO: 1016009 - protein, 25 aa, Mycobacterium
LLGSGGAGGAGGSSAFGDGGAGGVG

SEQ ID NO: 1016010 - protein, 12 aa, Mycobacterium
LMGSPGQGAYAA

SEQ ID NO: 1016011 - protein, 10 aa, Mycobacterium
LNASTPGKGV

SEQ ID NO: 1016012 - protein, 11 aa, Mycobacterium
LNDDRSDPANI

SEQ ID NO: 1016013 - protein, 14 aa, Mycobacterium
LNDDTKPRKLRPGD

SEQ ID NO: 1016014 - protein, 8 aa, Mycobacterium
LNDEPAYG

SEQ ID NO: 1016015 - protein, 9 aa, Mycobacterium
LNDGGAGKL

SEQ ID NO: 1016016 - protein, 16 aa, Mycobacterium
LNDGTRLREDPMTFAG

SEQ ID NO: 1016017 - protein, 9 aa, Mycobacterium
LNDNEDKSK

SEQ ID NO: 1016018 - protein, 15 aa, Mycobacterium
LNDTKTKALKLCMAS

SEQ ID NO: 1016019 - protein, 24 aa, Mycobacterium
LNEDTVREDDNRYGYSQQKGNYAK

SEQ ID NO: 1016020 - protein, 105 aa, Mycobacterium
LNGASTATATGGIGGNGGDGGTANGSNGGNGGAGGYASTTGTGTASVGNGGRGGDGTATVATGGTGGVGGNAHAPAGSPVPGVGGKGGNPGPGGKPGPNGADGIV

SEQ ID NO: 1016021 - protein, 8 aa, Mycobacterium
LNGGSGNI

SEQ ID NO: 1016022 - protein, 8 aa, Mycobacterium
LNGHDRGA

SEQ ID NO: 1016023 - protein, 4 aa, Mycobacterium
LNGQ

SEQ ID NO: 1016024 - protein, 28 aa, Mycobacterium
LNGSGGDGGHGGAGGAGGLGTDTGVPPF

SEQ ID NO: 1016025 - protein, 4 aa, Mycobacterium
LNHG

SEQ ID NO: 1016026 - protein, 7 aa, Mycobacterium
LNHTGSH

SEQ ID NO: 1016027 - protein, 8 aa, Mycobacterium
LNLGSGNI

SEQ ID NO: 1016028 - protein, 28 aa, Mycobacterium
LNLGSGNTGGINLGSGNTGSFNPGWGNA

SEQ ID NO: 1016029 - protein, 18 aa, Mycobacterium
LNPAPAAVRTKSASLADY

SEQ ID NO: 1016030 - protein, 5 aa, Mycobacterium
LNPAQ

SEQ ID NO: 1016031 - protein, 7 aa, Mycobacterium
LNPDENS

SEQ ID NO: 1016032 - protein, 7 aa, Mycobacterium
LNPDSAD

SEQ ID NO: 1016033 - protein, 15 aa, Mycobacterium
LNPEQLANKFRMAWS

SEQ ID NO: 1016034 - protein, 5 aa, Mycobacterium
LNPER

SEQ ID NO: 1016035 - protein, 10 aa, Mycobacterium
LNPGGSSKDR

SEQ ID NO: 1016036 - protein, 5 aa, Mycobacterium
LNPGP

SEQ ID NO: 1016037 - protein, 7 aa, Mycobacterium
LNPPPIT

SEQ ID NO: 1016038 - protein, 43 aa, Mycobacterium
LNPPVPPTAYSPPPAPTPDPTPTPDPTLTPGSTSGSGTGTGGL

SEQ ID NO: 1016039 - protein, 7 aa, Mycobacterium
LNPRTRE

SEQ ID NO: 1016040 - protein, 4 aa, Mycobacterium
LNPS

SEQ ID NO: 1016041 - protein, 9 aa, Mycobacterium
LNPTGSFKD

SEQ ID NO: 1016042 - protein, 15 aa, Mycobacterium
LNPTSAATPARVSAG

SEQ ID NO: 1016043 - protein, 7 aa, Mycobacterium
LNQAAKE

SEQ ID NO: 1016044 - protein, 5 aa, Mycobacterium
LNQAE

SEQ ID NO: 1016045 - protein, 11 aa, Mycobacterium
LNQTEEAGRRR

SEQ ID NO: 1016046 - protein, 4 aa, Mycobacterium
LNRP

SEQ ID NO: 1016047 - protein, 7 aa, Mycobacterium
LNRQETG

SEQ ID NO: 1016048 - protein, 18 aa, Mycobacterium
LNRRGSAAGDRQDDPTPI

SEQ ID NO: 1016049 - protein, 10 aa, Mycobacterium
LNSGKTPKTV

SEQ ID NO: 1016050 - protein, 7 aa, Mycobacterium
LNSGSGN

SEQ ID NO: 1016051 - protein, 10 aa, Mycobacterium
LNSGTANSGV

SEQ ID NO: 1016052 - protein, 6 aa, Mycobacterium
LNSPGW

SEQ ID NO: 1016053 - protein, 10 aa, Mycobacterium
LNSRSEAAIE

SEQ ID NO: 1016054 - protein, 10 aa, Mycobacterium
LNTGVANSAN

SEQ ID NO: 1016055 - protein, 6 aa, Mycobacterium
LNTPKA

SEQ ID NO: 1016056 - protein, 6 aa, Mycobacterium
LNTPTQ

SEQ ID NO: 1016057 - protein, 8 aa, Mycobacterium
LNTYGGQL

SEQ ID NO: 1016058 - protein, 11 aa, Mycobacterium
LNVNGSSLAAG

SEQ ID NO: 1016059 - protein, 5 aa, Mycobacterium
LNVSG

SEQ ID NO: 1016060 - protein, 8 aa, Mycobacterium
LNYDNPAV

SEQ ID NO: 1016061 - protein, 5 aa, Mycobacterium
LPAAG

SEQ ID NO: 1016062 - protein, 8 aa, Mycobacterium
LPAAPADC

SEQ ID NO: 1016063 - protein, 8 aa, Mycobacterium
LPAATGYP

SEQ ID NO: 1016064 - protein, 4 aa, Mycobacterium
LPAD

SEQ ID NO: 1016065 - protein, 6 aa, Mycobacterium
LPADAG

SEQ ID NO: 1016066 - protein, 8 aa, Mycobacterium
LPADGIST

SEQ ID NO: 1016067 - protein, 7 aa, Mycobacterium
LPADGPD

SEQ ID NO: 1016068 - protein, 7 aa, Mycobacterium
LPADGTR

SEQ ID NO: 1016069 - protein, 10 aa, Mycobacterium
LPADPADTNF

SEQ ID NO: 1016070 - protein, 8 aa, Mycobacterium
LPADPGQP

SEQ ID NO: 1016071 - protein, 8 aa, Mycobacterium
LPADTANL

SEQ ID NO: 1016072 - protein, 8 aa, Mycobacterium
LPAEAEEL

SEQ ID NO: 1016073 - protein, 12 aa, Mycobacterium
LPAEPTRRGRRN

SEQ ID NO: 1016074 - protein, 9 aa, Mycobacterium
LPAERAGAA

SEQ ID NO: 1016075 - protein, 9 aa, Mycobacterium
LPAETGPAP

SEQ ID NO: 1016076 - protein, 9 aa, Mycobacterium
LPAGGVPAA

SEQ ID NO: 1016077 - protein, 5 aa, Mycobacterium
LPAGP

SEQ ID NO: 1016078 - protein, 7 aa, Mycobacterium
LPAGSPK

SEQ ID NO: 1016079 - protein, 6 aa, Mycobacterium
LPAGSS

SEQ ID NO: 1016080 - protein, 8 aa, Mycobacterium
LPAPAGRG

SEQ ID NO: 1016081 - protein, 18 aa, Mycobacterium
LPAPAPPKISPPKISPPR

SEQ ID NO: 1016082 - protein, 11 aa, Mycobacterium
LPAPGDDEQLG

SEQ ID NO: 1016083 - protein, 7 aa, Mycobacterium
LPAPHSV

SEQ ID NO: 1016084 - protein, 12 aa, Mycobacterium
LPAPIKPTAAPL

SEQ ID NO: 1016085 - protein, 8 aa, Mycobacterium
LPAPPLPT

SEQ ID NO: 1016086 - protein, 20 aa, Mycobacterium
LPAPQPSEGPVLPIAFGKAL

SEQ ID NO: 1016087 - protein, 7 aa, Mycobacterium
LPAPQTE

SEQ ID NO: 1016088 - protein, 15 aa, Mycobacterium
LPAPRAAMTCALEAL

SEQ ID NO: 1016089 - protein, 6 aa, Mycobacterium
LPAQYA

SEQ ID NO: 1016090 - protein, 5 aa, Mycobacterium
LPARR

SEQ ID NO: 1016091 - protein, 16 aa, Mycobacterium
LPASPASVASLLAGAS

SEQ ID NO: 1016092 - protein, 25 aa, Mycobacterium
LPASSRRPRSGSPTVPGEIQPPPGV

SEQ ID NO: 1016093 - protein, 11 aa, Mycobacterium
LPATAANDRLE

SEQ ID NO: 1016094 - protein, 5 aa, Mycobacterium
LPATE

SEQ ID NO: 1016095 - protein, 17 aa, Mycobacterium
LPCRTETAGRPRPPSAP

SEQ ID NO: 1016096 - protein, 4 aa, Mycobacterium
LPDA

SEQ ID NO: 1016097 - protein, 7 aa, Mycobacterium
LPDAATR

SEQ ID NO: 1016098 - protein, 5 aa, Mycobacterium
LPDAG

SEQ ID NO: 1016099 - protein, 5 aa, Mycobacterium
LPDDQ

SEQ ID NO: 1016100 - protein, 7 aa, Mycobacterium
LPDDSRQ

SEQ ID NO: 1016101 - protein, 5 aa, Mycobacterium
LPDEQ

SEQ ID NO: 1016102 - protein, 5 aa, Mycobacterium
LPDET

SEQ ID NO: 1016103 - protein, 4 aa, Mycobacterium
LPDG

SEQ ID NO: 1016104 - protein, 5 aa, Mycobacterium
LPDGA

SEQ ID NO: 1016105 - protein, 8 aa, Mycobacterium
LPDGFPDA

SEQ ID NO: 1016106 - protein, 5 aa, Mycobacterium
LPDGG

SEQ ID NO: 1016107 - protein, 6 aa, Mycobacterium
LPDGGP

SEQ ID NO: 1016108 - protein, 10 aa, Mycobacterium
LPDGPDGPRA

SEQ ID NO: 1016109 - protein, 6 aa, Mycobacterium
LPDPAE

SEQ ID NO: 1016110 - protein, 9 aa, Mycobacterium
LPDPDNNGR

SEQ ID NO: 1016111 - protein, 6 aa, Mycobacterium
LPDPEA

SEQ ID NO: 1016112 - protein, 6 aa, Mycobacterium
LPDPGV

SEQ ID NO: 1016113 - protein, 5 aa, Mycobacterium
LPDPH

SEQ ID NO: 1016114 - protein, 7 aa, Mycobacterium
LPDPPRH

SEQ ID NO: 1016115 - protein, 8 aa, Mycobacterium
LPDPSAPV

SEQ ID NO: 1016116 - protein, 12 aa, Mycobacterium
LPDQAAGMERPR

SEQ ID NO: 1016117 - protein, 4 aa, Mycobacterium
LPDR

SEQ ID NO: 1016118 - protein, 9 aa, Mycobacterium
LPDRPATRF

SEQ ID NO: 1016119 - protein, 5 aa, Mycobacterium
LPDSA

SEQ ID NO: 1016120 - protein, 8 aa, Mycobacterium
LPDSARSE

SEQ ID NO: 1016121 - protein, 9 aa, Mycobacterium
LPDSPDDDT

SEQ ID NO: 1016122 - protein, 6 aa, Mycobacterium
LPDSQR

SEQ ID NO: 1016123 - protein, 6 aa, Mycobacterium
LPDTEI

SEQ ID NO: 1016124 - protein, 6 aa, Mycobacterium
LPDTET

SEQ ID NO: 1016125 - protein, 11 aa, Mycobacterium
LPEAAGSTSGF

SEQ ID NO: 1016126 - protein, 10 aa, Mycobacterium
LPEAGHEQQI

SEQ ID NO: 1016127 - protein, 12 aa, Mycobacterium
LPEAKSQVGWDD

SEQ ID NO: 1016128 - protein, 5 aa, Mycobacterium
LPEAQ

SEQ ID NO: 1016129 - protein, 10 aa, Mycobacterium
LPEDDREPAA

SEQ ID NO: 1016130 - protein, 12 aa, Mycobacterium
LPEDVSAPSGEA

SEQ ID NO: 1016131 - protein, 26 aa, Mycobacterium
LPEEARASLGKQVPHPSRLGNPDEYG

SEQ ID NO: 1016132 - protein, 12 aa, Mycobacterium
LPEGPPPSKAFG

SEQ ID NO: 1016133 - protein, 4 aa, Mycobacterium
LPEH

SEQ ID NO: 1016134 - protein, 12 aa, Mycobacterium
LPEHAPKYPRRA

SEQ ID NO: 1016135 - protein, 7 aa, Mycobacterium
LPEPGDV

SEQ ID NO: 1016136 - protein, 5 aa, Mycobacterium
LPEPK

SEQ ID NO: 1016137 - protein, 8 aa, Mycobacterium
LPEPPLPG

SEQ ID NO: 1016138 - protein, 11 aa, Mycobacterium
LPEPTASSAFT

SEQ ID NO: 1016139 - protein, 9 aa, Mycobacterium
LPEPTSVDG

SEQ ID NO: 1016140 - protein, 5 aa, Mycobacterium
LPEQG

SEQ ID NO: 1016141 - protein, 11 aa, Mycobacterium
LPEQKRQEALA

SEQ ID NO: 1016142 - protein, 6 aa, Mycobacterium
LPEQLS

SEQ ID NO: 1016143 - protein, 8 aa, Mycobacterium
LPERGAPG

SEQ ID NO: 1016144 - protein, 11 aa, Mycobacterium
LPERNTGAGVA

SEQ ID NO: 1016145 - protein, 14 aa, Mycobacterium
LPESAGGGGGDGAD

SEQ ID NO: 1016146 - protein, 5 aa, Mycobacterium
LPESG

SEQ ID NO: 1016147 - protein, 5 aa, Mycobacterium
LPESS

SEQ ID NO: 1016148 - protein, 15 aa, Mycobacterium
LPFGTDGAVDDGGAE

SEQ ID NO: 1016149 - protein, 12 aa, Mycobacterium
LPGAADSDVGQV

SEQ ID NO: 1016150 - protein, 10 aa, Mycobacterium
LPGAASTNIE

SEQ ID NO: 1016151 - protein, 50 aa, Mycobacterium
LPGAPASPTGFTPAPSPLQPGAPAVGVGGPSIPGVSTPAASAPPLSPQSL

SEQ ID NO: 1016152 - protein, 6 aa, Mycobacterium
LPGAQR

SEQ ID NO: 1016153 - protein, 10 aa, Mycobacterium
LPGARERLRD

SEQ ID NO: 1016154 - protein, 11 aa, Mycobacterium
LPGARGADVDG

SEQ ID NO: 1016155 - protein, 4 aa, Mycobacterium
LPGD

SEQ ID NO: 1016156 - protein, 5 aa, Mycobacterium
LPGDG

SEQ ID NO: 1016157 - protein, 8 aa, Mycobacterium
LPGDPARY

SEQ ID NO: 1016158 - protein, 30 aa, Mycobacterium
LPGDSGGDPGQPEANGIATPGPRTVADQPT

SEQ ID NO: 1016159 - protein, 12 aa, Mycobacterium
LPGEPPDIPPIG

SEQ ID NO: 1016160 - protein, 7 aa, Mycobacterium
LPGETAL

SEQ ID NO: 1016161 - protein, 11 aa, Mycobacterium
LPGFSRDEAKE

SEQ ID NO: 1016162 - protein, 4 aa, Mycobacterium
LPGG

SEQ ID NO: 1016163 - protein, 6 aa, Mycobacterium
LPGGAE

SEQ ID NO: 1016164 - protein, 9 aa, Mycobacterium
LPGGESAND

SEQ ID NO: 1016165 - protein, 9 aa, Mycobacterium
LPGGNPPSM

SEQ ID NO: 1016166 - protein, 9 aa, Mycobacterium
LPGGPPDFS

SEQ ID NO: 1016167 - protein, 6 aa, Mycobacterium
LPGGQD

SEQ ID NO: 1016168 - protein, 18 aa, Mycobacterium
LPGGQDYRDPEGLDTRNY

SEQ ID NO: 1016169 - protein, 13 aa, Mycobacterium
LPGGQYRKRGQLA

SEQ ID NO: 1016170 - protein, 5 aa, Mycobacterium
LPGGS

SEQ ID NO: 1016171 - protein, 6 aa, Mycobacterium
LPGGTG

SEQ ID NO: 1016172 - protein, 5 aa, Mycobacterium
LPGHS

SEQ ID NO: 1016173 - protein, 5 aa, Mycobacterium
LPGIG

SEQ ID NO: 1016174 - protein, 8 aa, Mycobacterium
LPGKASQQ

SEQ ID NO: 1016175 - protein, 4 aa, Mycobacterium
LPGL

SEQ ID NO: 1016176 - protein, 4 aa, Mycobacterium
LPGN

SEQ ID NO: 1016177 - protein, 10 aa, Mycobacterium
LPGNDYAGDE

SEQ ID NO: 1016178 - protein, 4 aa, Mycobacterium
LPGP

SEQ ID NO: 1016179 - protein, 8 aa, Mycobacterium
LPGPAGDI

SEQ ID NO: 1016180 - protein, 7 aa, Mycobacterium
LPGPAVP

SEQ ID NO: 1016181 - protein, 9 aa, Mycobacterium
LPGPHYETP

SEQ ID NO: 1016182 - protein, 11 aa, Mycobacterium
LPGPPVSERDA

SEQ ID NO: 1016183 - protein, 13 aa, Mycobacterium
LPGPSIEASPVRY

SEQ ID NO: 1016184 - protein, 6 aa, Mycobacterium
LPGPTK

SEQ ID NO: 1016185 - protein, 6 aa, Mycobacterium
LPGPVQ

SEQ ID NO: 1016186 - protein, 6 aa, Mycobacterium
LPGQLN

SEQ ID NO: 1016187 - protein, 8 aa, Mycobacterium
LPGRASSL

SEQ ID NO: 1016188 - protein, 17 aa, Mycobacterium
LPGRDGPLGSPGGAAKI

SEQ ID NO: 1016189 - protein, 4 aa, Mycobacterium
LPGS

SEQ ID NO: 1016190 - protein, 11 aa, Mycobacterium
LPGSESDKMGP

SEQ ID NO: 1016191 - protein, 6 aa, Mycobacterium
LPGSLG

SEQ ID NO: 1016192 - protein, 4 aa, Mycobacterium
LPGT

SEQ ID NO: 1016193 - protein, 7 aa, Mycobacterium
LPGTDEL

SEQ ID NO: 1016194 - protein, 16 aa, Mycobacterium
LPGTGLSSDGKDQAQQ

SEQ ID NO: 1016195 - protein, 8 aa, Mycobacterium
LPGTGTAT

SEQ ID NO: 1016196 - protein, 6 aa, Mycobacterium
LPGTPV

SEQ ID NO: 1016197 - protein, 4 aa, Mycobacterium
LPGV

SEQ ID NO: 1016198 - protein, 4 aa, Mycobacterium
LPGW

SEQ ID NO: 1016199 - protein, 4 aa, Mycobacterium
LPHE

SEQ ID NO: 1016200 - protein, 21 aa, Mycobacterium
LPHTAKGSLDRRAVAQQFGGQ

SEQ ID NO: 1016201 - protein, 4 aa, Mycobacterium
LPKG

SEQ ID NO: 1016202 - protein, 4 aa, Mycobacterium
LPKK

SEQ ID NO: 1016203 - protein, 4 aa, Mycobacterium
LPKP

SEQ ID NO: 1016204 - protein, 32 aa, Mycobacterium
LPKPRTQTRQIPSSRLQQTRTHRNKRHHTTPL

SEQ ID NO: 1016205 - protein, 10 aa, Mycobacterium
LPKQGSRKPW

SEQ ID NO: 1016206 - protein, 6 aa, Mycobacterium
LPKRGR

SEQ ID NO: 1016207 - protein, 9 aa, Mycobacterium
LPKSWDPAA

SEQ ID NO: 1016208 - protein, 11 aa, Mycobacterium
LPLSNRSDDHL

SEQ ID NO: 1016209 - protein, 6 aa, Mycobacterium
LPMGES

SEQ ID NO: 1016210 - protein, 5 aa, Mycobacterium
LPNAS

SEQ ID NO: 1016211 - protein, 11 aa, Mycobacterium
LPNEGETAPDL

SEQ ID NO: 1016212 - protein, 4 aa, Mycobacterium
LPNG

SEQ ID NO: 1016213 - protein, 4 aa, Mycobacterium
LPNL

SEQ ID NO: 1016214 - protein, 17 aa, Mycobacterium
LPNNRDELERNYPRTAA

SEQ ID NO: 1016215 - protein, 17 aa, Mycobacterium
LPPADRASVRLTSLTVA

SEQ ID NO: 1016216 - protein, 34 aa, Mycobacterium
LPPAPEPPVPPAPPAPGSPPFPPLPPVPNPAPGF

SEQ ID NO: 1016217 - protein, 12 aa, Mycobacterium
LPPAPNRYAAVS

SEQ ID NO: 1016218 - protein, 8 aa, Mycobacterium
LPPAPPTT

SEQ ID NO: 1016219 - protein, 13 aa, Mycobacterium
LPPASETVEPPRS

SEQ ID NO: 1016220 - protein, 8 aa, Mycobacterium
LPPDPREA

SEQ ID NO: 1016221 - protein, 12 aa, Mycobacterium
LPPDTSKEDRAQ

SEQ ID NO: 1016222 - protein, 4 aa, Mycobacterium
LPPE

SEQ ID NO: 1016223 - protein, 8 aa, Mycobacterium
LPPEDEDA

SEQ ID NO: 1016224 - protein, 15 aa, Mycobacterium
LPPEEAANIPQAPTQ

SEQ ID NO: 1016225 - protein, 6 aa, Mycobacterium
LPPEGA

SEQ ID NO: 1016226 - protein, 6 aa, Mycobacterium
LPPEGR

SEQ ID NO: 1016227 - protein, 6 aa, Mycobacterium
LPPEIN

SEQ ID NO: 1016228 - protein, 9 aa, Mycobacterium
LPPEKQPAV

SEQ ID NO: 1016229 - protein, 7 aa, Mycobacterium
LPPEVNS

SEQ ID NO: 1016230 - protein, 4 aa, Mycobacterium
LPPG

SEQ ID NO: 1016231 - protein, 5 aa, Mycobacterium
LPPGA

SEQ ID NO: 1016232 - protein, 7 aa, Mycobacterium
LPPGAGE

SEQ ID NO: 1016233 - protein, 67 aa, Mycobacterium
LPPGPPTVAGPLPAAPACPPCPPSPISQPPRPPAPPFAPAPPAPPSPPLPISPAAPPAPPATPAVVC

SEQ ID NO: 1016234 - protein, 5 aa, Mycobacterium
LPPGS

SEQ ID NO: 1016235 - protein, 6 aa, Mycobacterium
LPPGSE

SEQ ID NO: 1016236 - protein, 6 aa, Mycobacterium
LPPGTE

SEQ ID NO: 1016237 - protein, 9 aa, Mycobacterium
LPPIEEPDT

SEQ ID NO: 1016238 - protein, 25 aa, Mycobacterium
LPPLPNSPELPPLPAEAAKPPPCAP

SEQ ID NO: 1016239 - protein, 7 aa, Mycobacterium
LPPLPSD

SEQ ID NO: 1016240 - protein, 4 aa, Mycobacterium
LPPN

SEQ ID NO: 1016241 - protein, 4 aa, Mycobacterium
LPPP

SEQ ID NO: 1016242 - protein, 7 aa, Mycobacterium
LPPPAAL

SEQ ID NO: 1016243 - protein, 7 aa, Mycobacterium
LPPPDAR

SEQ ID NO: 1016244 - protein, 9 aa, Mycobacterium
LPPPGGRAE

SEQ ID NO: 1016245 - protein, 15 aa, Mycobacterium
LPPPGREGAAAAEQL

SEQ ID NO: 1016246 - protein, 13 aa, Mycobacterium
LPPPPQPPGREPV

SEQ ID NO: 1016247 - protein, 14 aa, Mycobacterium
LPPQPDHAVGSSRL

SEQ ID NO: 1016248 - protein, 7 aa, Mycobacterium
LPPQSDL

SEQ ID NO: 1016249 - protein, 8 aa, Mycobacterium
LPPQTLTG

SEQ ID NO: 1016250 - protein, 57 aa, Mycobacterium; identical to SEQ ID NO: 522714

SEQ ID NO: 1016251 - protein, 12 aa, Mycobacterium
LPPSEDFESGTA

SEQ ID NO: 1016252 - protein, 9 aa, Mycobacterium
LPPSPAKAV

SEQ ID NO: 1016253 - protein, 16 aa, Mycobacterium
LPPSPDGGPRRPPQHI

SEQ ID NO: 1016254 - protein, 5 aa, Mycobacterium
LPPSQ

SEQ ID NO: 1016255 - protein, 7 aa, Mycobacterium
LPPSQSK

SEQ ID NO: 1016256 - protein, 6 aa, Mycobacterium
LPPSRS

SEQ ID NO: 1016257 - protein, 10 aa, Mycobacterium
LPPSSWGSGK

SEQ ID NO: 1016258 - protein, 9 aa, Mycobacterium
LPPSTSAQI

SEQ ID NO: 1016259 - protein, 5 aa, Mycobacterium
LPPSV

SEQ ID NO: 1016260 - protein, 5 aa, Mycobacterium
LPPTE

SEQ ID NO: 1016261 - protein, 5 aa, Mycobacterium
LPPTL

SEQ ID NO: 1016262 - protein, 33 aa, Mycobacterium; identical to SEQ ID NO: 908812

SEQ ID NO: 1016263 - protein, 4 aa, Mycobacterium
LPQE

SEQ ID NO: 1016264 - protein, 18 aa, Mycobacterium
LPQGPAYYPDGELTDEPE

SEQ ID NO: 1016265 - protein, 10 aa, Mycobacterium
LPQKPNGPDW

SEQ ID NO: 1016266 - protein, 5 aa, Mycobacterium
LPQNS

SEQ ID NO: 1016267 - protein, 9 aa, Mycobacterium
LPQPGTARD

SEQ ID NO: 1016268 - protein, 7 aa, Mycobacterium
LPQPRDH

SEQ ID NO: 1016269 - protein, 13 aa, Mycobacterium
LPQRGESRRDPAM

SEQ ID NO: 1016270 - protein, 5 aa, Mycobacterium
LPQRL

SEQ ID NO: 1016271 - protein, 7 aa, Mycobacterium
LPRDGKA

SEQ ID NO: 1016272 - protein, 8 aa, Mycobacterium
LPRDPGEL

SEQ ID NO: 1016273 - protein, 19 aa, Mycobacterium
LPRDPRSEQPWNPEPLAGN

SEQ ID NO: 1016274 - protein, 7 aa, Mycobacterium
LPRERAD

SEQ ID NO: 1016275 - protein, 7 aa, Mycobacterium
LPRGRGD

SEQ ID NO: 1016276 - protein, 8 aa, Mycobacterium
LPRGRQPI

SEQ ID NO: 1016277 - protein, 8 aa, Mycobacterium
LPRGSTGK

SEQ ID NO: 1016278 - protein, 9 aa, Mycobacterium
LPRKPSGDL

SEQ ID NO: 1016279 - protein, 6 aa, Mycobacterium
LPRKSD

SEQ ID NO: 1016280 - protein, 4 aa, Mycobacterium
LPRP

SEQ ID NO: 1016281 - protein, 9 aa, Mycobacterium
LPRPARDEL

SEQ ID NO: 1016282 - protein, 6 aa, Mycobacterium
LPRPGR

SEQ ID NO: 1016283 - protein, 12 aa, Mycobacterium
LPRPPEEDPQGT

SEQ ID NO: 1016284 - protein, 10 aa, Mycobacterium
LPRSGDQNAR

SEQ ID NO: 1016285 - protein, 16 aa, Mycobacterium
LPRSSGGKIAKGQLRD

SEQ ID NO: 1016286 - protein, 8 aa, Mycobacterium
LPRTDTGK

SEQ ID NO: 1016287 - protein, 8 aa, Mycobacterium
LPSAEPAQ

SEQ ID NO: 1016288 - protein, 43 aa, Mycobacterium
LPSATPARCSRRGRASRRPTRLSSNGPAGISPPRCRRVPSTNA

SEQ ID NO: 1016289 - protein, 6 aa, Mycobacterium
LPSDAP

SEQ ID NO: 1016290 - protein, 9 aa, Mycobacterium
LPSDEATHE

SEQ ID NO: 1016291 - protein, 8 aa, Mycobacterium
LPSDNPLV

SEQ ID NO: 1016292 - protein, 6 aa, Mycobacterium
LPSEPH

SEQ ID NO: 1016293 - protein, 5 aa, Mycobacterium
LPSGA

SEQ ID NO: 1016294 - protein, 6 aa, Mycobacterium
LPSGEY

SEQ ID NO: 1016295 - protein, 23 aa, Mycobacterium
LPSGPRRRYAAQTSDISYGPGGR

SEQ ID NO: 1016296 - protein, 5 aa, Mycobacterium
LPSGV

SEQ ID NO: 1016297 - protein, 9 aa, Mycobacterium
LPSKEAVTT

SEQ ID NO: 1016298 - protein, 12 aa, Mycobacterium
LPSNPRAGVSDE

SEQ ID NO: 1016299 - protein, 7 aa, Mycobacterium
LPSPASQ

SEQ ID NO: 1016300 - protein, 11 aa, Mycobacterium
LPSPNAMEVGP

SEQ ID NO: 1016301 - protein, 8 aa, Mycobacterium
LPSPTHER

SEQ ID NO: 1016302 - protein, 14 aa, Mycobacterium
LPSPVVPPKPSASA

SEQ ID NO: 1016303 - protein, 6 aa, Mycobacterium
LPSRES

SEQ ID NO: 1016304 - protein, 4 aa, Mycobacterium
LPSS

SEQ ID NO: 1016305 - protein, 6 aa, Mycobacterium
LPSSAR

SEQ ID NO: 1016306 - protein, 12 aa, Mycobacterium
LPSSPGVTGAAA

SEQ ID NO: 1016307 - protein, 4 aa, Mycobacterium
LPST

SEQ ID NO: 1016308 - protein, 6 aa, Mycobacterium
LPSTAA

SEQ ID NO: 1016309 - protein, 6 aa, Mycobacterium
LPSTAT

SEQ ID NO: 1016310 - protein, 6 aa, Mycobacterium
LPSTPR

SEQ ID NO: 1016311 - protein, 12 aa, Mycobacterium
LPSTRARRPFED

SEQ ID NO: 1016312 - protein, 12 aa, Mycobacterium
LPSTRQPTGARH

SEQ ID NO: 1016313 - protein, 11 aa, Mycobacterium
LPSTTSDAEIR

SEQ ID NO: 1016314 - protein, 22 aa, Mycobacterium
LPSVSNNLSRIGSAAAIDAHDP

SEQ ID NO: 1016315 - protein, 12 aa, Mycobacterium
LPSVSQQDTVCS

SEQ ID NO: 1016316 - protein, 16 aa, Mycobacterium
LPTAARAAANATPESR

SEQ ID NO: 1016317 - protein, 5 aa, Mycobacterium
LPTAP

SEQ ID NO: 1016318 - protein, 7 aa, Mycobacterium
LPTATTP

SEQ ID NO: 1016319 - protein, 8 aa, Mycobacterium
LPTATTPH

SEQ ID NO: 1016320 - protein, 5 aa, Mycobacterium
LPTDG

SEQ ID NO: 1016321 - protein, 10 aa, Mycobacterium
LPTEGHPQNH

SEQ ID NO: 1016322 - protein, 9 aa, Mycobacterium
LPTEGPTQS

SEQ ID NO: 1016323 - protein, 5 aa, Mycobacterium
LPTGF

SEQ ID NO: 1016324 - protein, 6 aa, Mycobacterium
LPTGIK

SEQ ID NO: 1016325 - protein, 11 aa, Mycobacterium
LPTGPAPNRSG

SEQ ID NO: 1016326 - protein, 9 aa, Mycobacterium
LPTGTGKTL

SEQ ID NO: 1016327 - protein, 6 aa, Mycobacterium
LPTLPQ

SEQ ID NO: 1016328 - protein, 5 aa, Mycobacterium
LPTMR

SEQ ID NO: 1016329 - protein, 6 aa, Mycobacterium
LPTNAA

SEQ ID NO: 1016330 - protein, 7 aa, Mycobacterium
LPTPGYG

SEQ ID NO: 1016331 - protein, 8 aa, Mycobacterium
LPTPPPPI

SEQ ID NO: 1016332 - protein, 9 aa, Mycobacterium
LPTPSGNTF

SEQ ID NO: 1016333 - protein, 6 aa, Mycobacterium
LPTQAD

SEQ ID NO: 1016334 - protein, 6 aa, Mycobacterium
LPTRPA

SEQ ID NO: 1016335 - protein, 6 aa, Mycobacterium
LPTRRP

SEQ ID NO: 1016336 - protein, 10 aa, Mycobacterium
LPTSGGDAAK

SEQ ID NO: 1016337 - protein, 8 aa, Mycobacterium
LPTSPAES

SEQ ID NO: 1016338 - protein, 8 aa, Mycobacterium
LPTTPVGK

SEQ ID NO: 1016339 - protein, 11 aa, Mycobacterium
LPTVEDANAQR

SEQ ID NO: 1016340 - protein, 8 aa, Mycobacterium
LPTVPRSR

SEQ ID NO: 1016341 - protein, 11 aa, Mycobacterium
LPVGNEGAGTV

SEQ ID NO: 1016342 - protein, 6 aa, Mycobacterium
LPVGPD

SEQ ID NO: 1016343 - protein, 4 aa, Mycobacterium
LPVP

SEQ ID NO: 1016344 - protein, 6 aa, Mycobacterium
LPYATT

SEQ ID NO: 1016345 - protein, 4 aa, Mycobacterium
LPYD

SEQ ID NO: 1016346 - protein, 17 aa, Mycobacterium
LPYPDAASVSSRSSVAR

SEQ ID NO: 1016347 - protein, 15 aa, Mycobacterium
LQAAQTAGQAAAAAA

SEQ ID NO: 1016348 - protein, 7 aa, Mycobacterium
LQAGQGA

SEQ ID NO: 1016349 - protein, 10 aa, Mycobacterium
LQAPGDPVTR

SEQ ID NO: 1016350 - protein, 16 aa, Mycobacterium
LQASGTAFSGAVQSGD

SEQ ID NO: 1016351 - protein, 7 aa, Mycobacterium
LQDPTGR

SEQ ID NO: 1016352 - protein, 8 aa, Mycobacterium
LQDRGPGI

SEQ ID NO: 1016353 - protein, 9 aa, Mycobacterium
LQDSGSTFD

SEQ ID NO: 1016354 - protein, 8 aa, Mycobacterium
LQEDKEPV

SEQ ID NO: 1016355 - protein, 20 aa, Mycobacterium
LQEGDDVLGPDGQPPITAQG

SEQ ID NO: 1016356 - protein, 9 aa, Mycobacterium
LQEKADEYR

SEQ ID NO: 1016357 - protein, 6 aa, Mycobacterium
LQESDS

SEQ ID NO: 1016358 - protein, 10 aa, Mycobacterium
LQGASGRKLG

SEQ ID NO: 1016359 - protein, 11 aa, Mycobacterium
LQGDAGPDEWG

SEQ ID NO: 1016360 - protein, 11 aa, Mycobacterium
LQGDPGSALPD

SEQ ID NO: 1016361 - protein, 7 aa, Mycobacterium
LQGDTSA

SEQ ID NO: 1016362 - protein, 11 aa, Mycobacterium
LQGGSGRTLDA

SEQ ID NO: 1016363 - protein, 9 aa, Mycobacterium
LQGKTRTSV

SEQ ID NO: 1016364 - protein, 10 aa, Mycobacterium
LQGSDLSESD

SEQ ID NO: 1016365 - protein, 5 aa, Mycobacterium
LQGSR

SEQ ID NO: 1016366 - protein, 10 aa, Mycobacterium
LQGTTGGERD

SEQ ID NO: 1016367 - protein, 8 aa, Mycobacterium
LQHPDASG

SEQ ID NO: 1016368 - protein, 15 aa, Mycobacterium
LQHRSNAGLTPGEPV

SEQ ID NO: 1016369 - protein, 10 aa, Mycobacterium
LQIGRSGRHI

SEQ ID NO: 1016370 - protein, 7 aa, Mycobacterium
LQKAGYG

SEQ ID NO: 1016371 - protein, 4 aa, Mycobacterium
LQNA

SEQ ID NO: 1016372 - protein, 9 aa, Mycobacterium
LQNKSNEMS

SEQ ID NO: 1016373 - protein, 13 aa, Mycobacterium
LQPARGRSRTTTA

SEQ ID NO: 1016374 - protein, 8 aa, Mycobacterium
LQPDGRPH

SEQ ID NO: 1016375 - protein, 5 aa, Mycobacterium
LQPDN

SEQ ID NO: 1016376 - protein, 15 aa, Mycobacterium
LQPDSAAVSETARAQ

SEQ ID NO: 1016377 - protein, 12 aa, Mycobacterium
LQPDSGRVTRRS

SEQ ID NO: 1016378 - protein, 10 aa, Mycobacterium
LQPDSPAGTL

SEQ ID NO: 1016379 - protein, 12 aa, Mycobacterium
LQPEQDAPAPPL

SEQ ID NO: 1016380 - protein, 10 aa, Mycobacterium
LQPGAEDLST

SEQ ID NO: 1016381 - protein, 11 aa, Mycobacterium
LQPGWQKQRQR

SEQ ID NO: 1016382 - protein, 11 aa, Mycobacterium
LQPNAGSQGEL

SEQ ID NO: 1016383 - protein, 12 aa, Mycobacterium
LQPNAGSQGEYS

SEQ ID NO: 1016384 - protein, 6 aa, Mycobacterium
LQPSDI

SEQ ID NO: 1016385 - protein, 9 aa, Mycobacterium
LQPSHNPQV

SEQ ID NO: 1016386 - protein, 10 aa, Mycobacterium
LQPTNGRGAD

SEQ ID NO: 1016387 - protein, 4 aa, Mycobacterium
LQQA

SEQ ID NO: 1016388 - protein, 11 aa, Mycobacterium
LQQAGDETDRR

SEQ ID NO: 1016389 - protein, 11 aa, Mycobacterium
LQRAQETAAPI

SEQ ID NO: 1016390 - protein, 16 aa, Mycobacterium
LQRDGDGGPWRIERPP

SEQ ID NO: 1016391 - protein, 4 aa, Mycobacterium
LQRG

SEQ ID NO: 1016392 - protein, 7 aa, Mycobacterium
LQRNPGV

SEQ ID NO: 1016393 - protein, 10 aa, Mycobacterium
LQRRDSRAPT

SEQ ID NO: 1016394 - protein, 9 aa, Mycobacterium
LQRRPNDGG

SEQ ID NO: 1016395 - protein, 9 aa, Mycobacterium
LQRSGVADE

SEQ ID NO: 1016396 - protein, 9 aa, Mycobacterium
LQRSTTGAR

SEQ ID NO: 1016397 - protein, 7 aa, Mycobacterium
LQSAAAG

SEQ ID NO: 1016398 - protein, 6 aa, Mycobacterium
LQSAKD

SEQ ID NO: 1016399 - protein, 10 aa, Mycobacterium
LQSGRPAQIS

SEQ ID NO: 1016400 - protein, 9 aa, Mycobacterium
LQSPADIGA

SEQ ID NO: 1016401 - protein, 6 aa, Mycobacterium
LQSPGF

SEQ ID NO: 1016402 - protein, 38 aa, Mycobacterium
LQSPSGAGAPASAAAAGGVAAGRGAARGTGAAAGRGGM

SEQ ID NO: 1016403 - protein, 6 aa, Mycobacterium
LQSTAA

SEQ ID NO: 1016404 - protein, 16 aa, Mycobacterium
LQSTGDHGDFGGEQAR

SEQ ID NO: 1016405 - protein, 7 aa, Mycobacterium
LQSTSQG

SEQ ID NO: 1016406 - protein, 6 aa, Mycobacterium
LQTAPW

SEQ ID NO: 1016407 - protein, 6 aa, Mycobacterium
LQTPKA

SEQ ID NO: 1016408 - protein, 6 aa, Mycobacterium
LQTPLG

SEQ ID NO: 1016409 - protein, 6 aa, Mycobacterium
LQTTAE

SEQ ID NO: 1016410 - protein, 17 aa, Mycobacterium
LQTTDSPDAEEQRELEA

SEQ ID NO: 1016411 - protein, 6 aa, Mycobacterium
LQTTRR

SEQ ID NO: 1016412 - protein, 5 aa, Mycobacterium
LQYSG

SEQ ID NO: 1016413 - protein, 8 aa, Mycobacterium
LRAAAADN

SEQ ID NO: 1016414 - protein, 6 aa, Mycobacterium
LRADGR

SEQ ID NO: 1016415 - protein, 13 aa, Mycobacterium
LRAEQKEKRDRGE

SEQ ID NO: 1016416 - protein, 17 aa, Mycobacterium
LRAPARARMRDGGDIDR

SEQ ID NO: 1016417 - protein, 10 aa, Mycobacterium
LRAPDGAEVA

SEQ ID NO: 1016418 - protein, 7 aa, Mycobacterium
LRAPESS

SEQ ID NO: 1016419 - protein, 7 aa, Mycobacterium
LRAPQTP

SEQ ID NO: 1016420 - protein, 5 aa, Mycobacterium
LRAQG

SEQ ID NO: 1016421 - protein, 4 aa, Mycobacterium
LRAR

SEQ ID NO: 1016422 - protein, 12 aa, Mycobacterium
LRASDDESVPPA

SEQ ID NO: 1016423 - protein, 8 aa, Mycobacterium
LRASPKEV

SEQ ID NO: 1016424 - protein, 11 aa, Mycobacterium
LRASRKTLSVG

SEQ ID NO: 1016425 - protein, 8 aa, Mycobacterium
LRCGDRSA

SEQ ID NO: 1016426 - protein, 7 aa, Mycobacterium
LRDAEND

SEQ ID NO: 1016427 - protein, 4 aa, Mycobacterium
LRDD

SEQ ID NO: 1016428 - protein, 18 aa, Mycobacterium
LRDDDPSSATGVSTIGSS

SEQ ID NO: 1016429 - protein, 7 aa, Mycobacterium
LRDDGRT

SEQ ID NO: 1016430 - protein, 8 aa, Mycobacterium
LRDDRSAL

SEQ ID NO: 1016431 - protein, 6 aa, Mycobacterium
LRDDSG

SEQ ID NO: 1016432 - protein, 5 aa, Mycobacterium
LRDEP

SEQ ID NO: 1016433 - protein, 6 aa, Mycobacterium
LRDGKF

SEQ ID NO: 1016434 - protein, 16 aa, Mycobacterium
LRDNGLDPVETPDEYE

SEQ ID NO: 1016435 - protein, 6 aa, Mycobacterium
LRDNQA

SEQ ID NO: 1016436 - protein, 6 aa, Mycobacterium
LRDPRQ

SEQ ID NO: 1016437 - protein, 4 aa, Mycobacterium
LRDQ

SEQ ID NO: 1016438 - protein, 14 aa, Mycobacterium
LRDQQAAADRAKAS

SEQ ID NO: 1016439 - protein, 7 aa, Mycobacterium
LRDSEPT

SEQ ID NO: 1016440 - protein, 7 aa, Mycobacterium
LRDSTAS

SEQ ID NO: 1016441 - protein, 15 aa, Mycobacterium
LRDTRDAKAPTVNER

SEQ ID NO: 1016442 - protein, 4 aa, Mycobacterium
LREA

SEQ ID NO: 1016443 - protein, 19 aa, Mycobacterium
LREAQDLPTVPGSAGPPCG

SEQ ID NO: 1016444 - protein, 9 aa, Mycobacterium
LREEPDPIT

SEQ ID NO: 1016445 - protein, 4 aa, Mycobacterium
LREG

SEQ ID NO: 1016446 - protein, 6 aa, Mycobacterium
LREGGS

SEQ ID NO: 1016447 - protein, 32 aa, Mycobacterium
LREPGPRVADAAAADADAGADSGLVQRLRLLR

SEQ ID NO: 1016448 - protein, 7 aa, Mycobacterium
LREQNTR

SEQ ID NO: 1016449 - protein, 23 aa, Mycobacterium
LRETGGDPREASVRPAGQVEGYS

SEQ ID NO: 1016450 - protein, 11 aa, Mycobacterium
LRGAEAKRARA

SEQ ID NO: 1016451 - protein, 5 aa, Mycobacterium
LRGDP

SEQ ID NO: 1016452 - protein, 23 aa, Mycobacterium
LRGEPADYPPPGGYRGGYPDEAR

SEQ ID NO: 1016453 - protein, 4 aa, Mycobacterium
LRGG

SEQ ID NO: 1016454 - protein, 6 aa, Mycobacterium
LRGKPQ

SEQ ID NO: 1016455 - protein, 7 aa, Mycobacterium
LRGQGHT

SEQ ID NO: 1016456 - protein, 36 aa, Mycobacterium
LRGRQQPGRTRREDERPDRRTAAGSGRDPQADEARD

SEQ ID NO: 1016457 - protein, 6 aa, Mycobacterium
LRGSKG

SEQ ID NO: 1016458 - protein, 4 aa, Mycobacterium
LRGT

SEQ ID NO: 1016459 - protein, 8 aa, Mycobacterium
LRGYPEDP

SEQ ID NO: 1016460 - protein, 8 aa, Mycobacterium
LRKANAQH

SEQ ID NO: 1016461 - protein, 8 aa, Mycobacterium
LRKPGPRQ

SEQ ID NO: 1016462 - protein, 6 aa, Mycobacterium
LRNADG

SEQ ID NO: 1016463 - protein, 37 aa, Mycobacterium
LRNPAFNTGESRTACTGYATSPSTKTVKGHIPETAHR

SEQ ID NO: 1016464 - protein, 12 aa, Mycobacterium
LRNPGDPVPANL

SEQ ID NO: 1016465 - protein, 7 aa, Mycobacterium
LRPAARR

SEQ ID NO: 1016466 - protein, 19 aa, Mycobacterium
LRPAPVGAYPAGASAYGAE

SEQ ID NO: 1016467 - protein, 15 aa, Mycobacterium
LRPDAANLTDPVQAA

SEQ ID NO: 1016468 - protein, 6 aa, Mycobacterium
LRPDDD

SEQ ID NO: 1016469 - protein, 10 aa, Mycobacterium
LRPDRPSPRV

SEQ ID NO: 1016470 - protein, 8 aa, Mycobacterium
LRPDRPSV

SEQ ID NO: 1016471 - protein, 9 aa, Mycobacterium
LRPEGRNGP

SEQ ID NO: 1016472 - protein, 9 aa, Mycobacterium
LRPEGRSGE

SEQ ID NO: 1016473 - protein, 25 aa, Mycobacterium
LRPGDPIVGEEGGGPADSAPAPDDA

SEQ ID NO: 1016474 - protein, 6 aa, Mycobacterium
LRPGDR

SEQ ID NO: 1016475 - protein, 17 aa, Mycobacterium
LRPGKPGEHDLEDVERP

SEQ ID NO: 1016476 - protein, 6 aa, Mycobacterium
LRPGQR

SEQ ID NO: 1016477 - protein, 12 aa, Mycobacterium
LRPKDYSEARTI

SEQ ID NO: 1016478 - protein, 5 aa, Mycobacterium
LRPPD

SEQ ID NO: 1016479 - protein, 11 aa, Mycobacterium
LRPPPSASRSW

SEQ ID NO: 1016480 - protein, 5 aa, Mycobacterium
LRPPS

SEQ ID NO: 1016481 - protein, 37 aa, Mycobacterium
LRPPTVAPPAVPSAPTGPVSGAPVASPSSSPSAGGSM

SEQ ID NO: 1016482 - protein, 9 aa, Mycobacterium
LRPREQSGD

SEQ ID NO: 1016483 - protein, 6 aa, Mycobacterium
LRPRGV

SEQ ID NO: 1016484 - protein, 5 aa, Mycobacterium
LRPRH

SEQ ID NO: 1016485 - protein, 6 aa, Mycobacterium
LRPRPE

SEQ ID NO: 1016486 - protein, 9 aa, Mycobacterium
LRPRPPVGT

SEQ ID NO: 1016487 - protein, 5 aa, Mycobacterium
LRPRR

SEQ ID NO: 1016488 - protein, 4 aa, Mycobacterium
LRQE

SEQ ID NO: 1016489 - protein, 16 aa, Mycobacterium
LRQPTGTTGPAGPAIS

SEQ ID NO: 1016490 - protein, 16 aa, Mycobacterium
LRQQAASGQPGPEGAG

SEQ ID NO: 1016491 - protein, 8 aa, Mycobacterium
LRQSGADA

SEQ ID NO: 1016492 - protein, 9 aa, Mycobacterium
LRQTTGEAE

SEQ ID NO: 1016493 - protein, 11 aa, Mycobacterium
LRRAETRHGTK

SEQ ID NO: 1016494 - protein, 6 aa, Mycobacterium
LRRAST

SEQ ID NO: 1016495 - protein, 4 aa, Mycobacterium
LRRD

SEQ ID NO: 1016496 - protein, 9 aa, Mycobacterium
LRREQSRPC

SEQ ID NO: 1016497 - protein, 13 aa, Mycobacterium
LRRGGRPAPDGAG

SEQ ID NO: 1016498 - protein, 5 aa, Mycobacterium
LRRGP

SEQ ID NO: 1016499 - protein, 7 aa, Mycobacterium
LRRGPGG

SEQ ID NO: 1016500 - protein, 8 aa, Mycobacterium
LRRPDGAK

SEQ ID NO: 1016501 - protein, 5 aa, Mycobacterium
LRRPG

SEQ ID NO: 1016502 - protein, 13 aa, Mycobacterium
LRRPTGVASPLGE

SEQ ID NO: 1016503 - protein, 8 aa, Mycobacterium
LRRSARAA

SEQ ID NO: 1016504 - protein, 4 aa, Mycobacterium
LRRT

SEQ ID NO: 1016505 - protein, 11 aa, Mycobacterium
LRRTGADDDGL

SEQ ID NO: 1016506 - protein, 12 aa, Mycobacterium
LRRTKDRRKVHY

SEQ ID NO: 1016507 - protein, 4 aa, Mycobacterium
LRSD

SEQ ID NO: 1016508 - protein, 8 aa, Mycobacterium
LRSDNEYR

SEQ ID NO: 1016509 - protein, 12 aa, Mycobacterium
LRSGDRVDRNEI

SEQ ID NO: 1016510 - protein, 8 aa, Mycobacterium
LRSNPGDD

SEQ ID NO: 1016511 - protein, 6 aa, Mycobacterium
LRSPEL

SEQ ID NO: 1016512 - protein, 7 aa, Mycobacterium
LRSSDRA

SEQ ID NO: 1016513 - protein, 6 aa, Mycobacterium
LRSSTR

SEQ ID NO: 1016514 - protein, 7 aa, Mycobacterium
LRSTAAA

SEQ ID NO: 1016515 - protein, 11 aa, Mycobacterium
LRSTATKTDGG

SEQ ID NO: 1016516 - protein, 12 aa, Mycobacterium
LRTDESGTGTEI

SEQ ID NO: 1016517 - protein, 17 aa, Mycobacterium
LRTEAGKPMKASADGMV

SEQ ID NO: 1016518 - protein, 12 aa, Mycobacterium
LRTGDPASAALA

SEQ ID NO: 1016519 - protein, 7 aa, Mycobacterium
LRTRKAG

SEQ ID NO: 1016520 - protein, 10 aa, Mycobacterium
LRTTTDNRGR

SEQ ID NO: 1016521 - protein, 9 aa, Mycobacterium
LSAADGRRL

SEQ ID NO: 1016522 - protein, 12 aa, Mycobacterium
LSAATAAGASYA

SEQ ID NO: 1016523 - protein, 6 aa, Mycobacterium
LSAATR

SEQ ID NO: 1016524 - protein, 7 aa, Mycobacterium
LSADDPI

SEQ ID NO: 1016525 - protein, 22 aa, Mycobacterium
LSAGADAYSGAEASSAATLQSL

SEQ ID NO: 1016526 - protein, 17 aa, Mycobacterium
LSAGAGAYSGAEASSAG

SEQ ID NO: 1016527 - protein, 16 aa, Mycobacterium
LSAGSSVAAVSADAGV

SEQ ID NO: 1016528 - protein, 7 aa, Mycobacterium
LSAKESH

SEQ ID NO: 1016529 - protein, 6 aa, Mycobacterium
LSAPAV

SEQ ID NO: 1016530 - protein, 8 aa, Mycobacterium
LSAPGSRL

SEQ ID NO: 1016531 - protein, 9 aa, Mycobacterium
LSAPGSTVA

SEQ ID NO: 1016532 - protein, 10 aa, Mycobacterium
LSAQLGASLS

SEQ ID NO: 1016533 - protein, 8 aa, Mycobacterium
LSAQSGVD

SEQ ID NO: 1016534 - protein, 12 aa, Mycobacterium
LSASAAADTARR

SEQ ID NO: 1016535 - protein, 17 aa, Mycobacterium
LSASKGAARRTIGEGGV

SEQ ID NO: 1016536 - protein, 8 aa, Mycobacterium
LSATANDY

SEQ ID NO: 1016537 - protein, 6 aa, Mycobacterium
LSATGS

SEQ ID NO: 1016538 - protein, 7 aa, Mycobacterium
LSATGSR

SEQ ID NO: 1016539 - protein, 10 aa, Mycobacterium
LSATRDVAAP

SEQ ID NO: 1016540 - protein, 17 aa, Mycobacterium
LSATVGTEGPVPPPPRA

SEQ ID NO: 1016541 - protein, 9 aa, Mycobacterium
LSDAEAAPM

SEQ ID NO: 1016542 - protein, 9 aa, Mycobacterium
LSDAEQQAA

SEQ ID NO: 1016543 - protein, 7 aa, Mycobacterium
LSDAETS

SEQ ID NO: 1016544 - protein, 7 aa, Mycobacterium
LSDATGD

SEQ ID NO: 1016545 - protein, 6 aa, Mycobacterium
LSDAVE

SEQ ID NO: 1016546 - protein, 8 aa, Mycobacterium
LSDDERVG

SEQ ID NO: 1016547 - protein, 10 aa, Mycobacterium
LSDDETERAV

SEQ ID NO: 1016548 - protein, 6 aa, Mycobacterium
LSDEHK

SEQ ID NO: 1016549 - protein, 4 aa, Mycobacterium
LSDG

SEQ ID NO: 1016550 - protein, 8 aa, Mycobacterium
LSDGSERE

SEQ ID NO: 1016551 - protein, 8 aa, Mycobacterium
LSDKPRQP

SEQ ID NO: 1016552 - protein, 8 aa, Mycobacterium
LSDLGRAQ

SEQ ID NO: 1016553 - protein, 7 aa, Mycobacterium
LSDNDLE

SEQ ID NO: 1016554 - protein, 4 aa, Mycobacterium
LSDP

SEQ ID NO: 1016555 - protein, 7 aa, Mycobacterium
LSDPAAE

SEQ ID NO: 1016556 - protein, 7 aa, Mycobacterium
LSDPAEQ

SEQ ID NO: 1016557 - protein, 7 aa, Mycobacterium
LSDPPSV

SEQ ID NO: 1016558 - protein, 9 aa, Mycobacterium
LSDRARNGR

SEQ ID NO: 1016559 - protein, 11 aa, Mycobacterium
LSEAGSGDPYD

SEQ ID NO: 1016560 - protein, 10 aa, Mycobacterium
LSEAGSRSEM

SEQ ID NO: 1016561 - protein, 5 aa, Mycobacterium
LSEAQ

SEQ ID NO: 1016562 - protein, 13 aa, Mycobacterium
LSEATAAAGPTTD

SEQ ID NO: 1016563 - protein, 4 aa, Mycobacterium
LSED

SEQ ID NO: 1016564 - protein, 9 aa, Mycobacterium
LSEDETERA

SEQ ID NO: 1016565 - protein, 7 aa, Mycobacterium
LSEEDKQ

SEQ ID NO: 1016566 - protein, 11 aa, Mycobacterium
LSEEGADDPVR

SEQ ID NO: 1016567 - protein, 4 aa, Mycobacterium
LSEG

SEQ ID NO: 1016568 - protein, 7 aa, Mycobacterium
LSEGAGT

SEQ ID NO: 1016569 - protein, 6 aa, Mycobacterium
LSEGGY

SEQ ID NO: 1016570 - protein, 9 aa, Mycobacterium
LSEGTIKGD

SEQ ID NO: 1016571 - protein, 6 aa, Mycobacterium
LSEPAT

SEQ ID NO: 1016572 - protein, 25 aa, Mycobacterium
LSEPDAEHNWDSDRRNAELDSDGVA

SEQ ID NO: 1016573 - protein, 8 aa, Mycobacterium
LSEQGLGD

SEQ ID NO: 1016574 - protein, 5 aa, Mycobacterium
LSEQI

SEQ ID NO: 1016575 - protein, 7 aa, Mycobacterium
LSEQRNA

SEQ ID NO: 1016576 - protein, 25 aa, Mycobacterium
LSETSPTASFNHPDRERKPGSIGTP

SEQ ID NO: 1016577 - protein, 12 aa, Mycobacterium
LSEVSDSVGVPT

SEQ ID NO: 1016578 - protein, 9 aa, Mycobacterium
LSGAGGGNF

SEQ ID NO: 1016579 - protein, 9 aa, Mycobacterium
LSGAKKRIS

SEQ ID NO: 1016580 - protein, 26 aa, Mycobacterium
LSGASPDTSDQVDDTEDSWDDEESWR

SEQ ID NO: 1016581 - protein, 10 aa, Mycobacterium
LSGDALGGQT

SEQ ID NO: 1016582 - protein, 5 aa, Mycobacterium
LSGDE

SEQ ID NO: 1016583 - protein, 12 aa, Mycobacterium
LSGDPNIAATPI

SEQ ID NO: 1016584 - protein, 8 aa, Mycobacterium
LSGDPQFT

SEQ ID NO: 1016585 - protein, 7 aa, Mycobacterium
LSGDPTL

SEQ ID NO: 1016586 - protein, 15 aa, Mycobacterium
LSGDRRTYQQEPGNM

SEQ ID NO: 1016587 - protein, 8 aa, Mycobacterium
LSGEEAER

SEQ ID NO: 1016588 - protein, 33 aa, Mycobacterium
LSGGAGGAGGAGGHGGQLYGDGGGGGAGGMGGS

SEQ ID NO: 1016589 - protein, 5 aa, Mycobacterium
LSGGE

SEQ ID NO: 1016590 - protein, 8 aa, Mycobacterium
LSGGEQQR

SEQ ID NO: 1016591 - protein, 7 aa, Mycobacterium
LSGGGTQ

SEQ ID NO: 1016592 - protein, 6 aa, Mycobacterium
LSGGNR

SEQ ID NO: 1016593 - protein, 8 aa, Mycobacterium
LSGGQQQR

SEQ ID NO: 1016594 - protein, 8 aa, Mycobacterium
LSGGQRRR

SEQ ID NO: 1016595 - protein, 5 aa, Mycobacterium
LSGPA

SEQ ID NO: 1016596 - protein, 7 aa, Mycobacterium
LSGPDVP

SEQ ID NO: 1016597 - protein, 11 aa, Mycobacterium
LSGPGAEQPWQ

SEQ ID NO: 1016598 - protein, 7 aa, Mycobacterium
LSGPGVS

SEQ ID NO: 1016599 - protein, 6 aa, Mycobacterium
LSGPPC

SEQ ID NO: 1016600 - protein, 5 aa, Mycobacterium
LSGPV

SEQ ID NO: 1016601 - protein, 17 aa, Mycobacterium
LSGQAADPFKIPAGTAS

SEQ ID NO: 1016602 - protein, 10 aa, Mycobacterium
LSGQAGSRIS

SEQ ID NO: 1016603 - protein, 7 aa, Mycobacterium
LSGQGTS

SEQ ID NO: 1016604 - protein, 12 aa, Mycobacterium
LSGRGAESERGP

SEQ ID NO: 1016605 - protein, 7 aa, Mycobacterium
LSGRPDT

SEQ ID NO: 1016606 - protein, 6 aa, Mycobacterium
LSGSER

SEQ ID NO: 1016607 - protein, 11 aa, Mycobacterium
LSGSNIGGIAE

SEQ ID NO: 1016608 - protein, 18 aa, Mycobacterium
LSGSRADEIGHWLPLIDL

SEQ ID NO: 1016609 - protein, 7 aa, Mycobacterium
LSGSSGS

SEQ ID NO: 1016610 - protein, 11 aa, Mycobacterium
LSGSSLATQSL

SEQ ID NO: 1016611 - protein, 10 aa, Mycobacterium
LSGSSSRNSM

SEQ ID NO: 1016612 - protein, 6 aa, Mycobacterium
LSGTYR

SEQ ID NO: 1016613 - protein, 5 aa, Mycobacterium
LSGYD

SEQ ID NO: 1016614 - protein, 7 aa, Mycobacterium
LSHTQGE

SEQ ID NO: 1016615 - protein, 6 aa, Mycobacterium
LSHYSD

SEQ ID NO: 1016616 - protein, 10 aa, Mycobacterium
LSKATAGLKG

SEQ ID NO: 1016617 - protein, 4 aa, Mycobacterium
LSKG

SEQ ID NO: 1016618 - protein, 6 aa, Mycobacterium
LSKQTG

SEQ ID NO: 1016619 - protein, 8 aa, Mycobacterium
LSKSQQNL

SEQ ID NO: 1016620 - protein, 9 aa, Mycobacterium
LSKTGARYS

SEQ ID NO: 1016621 - protein, 16 aa, Mycobacterium
LSKTGGEFGVTTGRRR

SEQ ID NO: 1016622 - protein, 19 aa, Mycobacterium
LSNAADDSAKITAETRDYH

SEQ ID NO: 1016623 - protein, 8 aa, Mycobacterium
LSNEQRAD

SEQ ID NO: 1016624 - protein, 7 aa, Mycobacterium
LSNGGTA

SEQ ID NO: 1016625 - protein, 20 aa, Mycobacterium
LSNQKHTDLTARYGRDKTGL

SEQ ID NO: 1016626 - protein, 18 aa, Mycobacterium
LSNSGGGVLQPRTGNRLL

SEQ ID NO: 1016627 - protein, 10 aa, Mycobacterium
LSPAAKQTLS

SEQ ID NO: 1016628 - protein, 5 aa, Mycobacterium
LSPAG

SEQ ID NO: 1016629 - protein, 5 aa, Mycobacterium
LSPAH

SEQ ID NO: 1016630 - protein, 6 aa, Mycobacterium
LSPAHS

SEQ ID NO: 1016631 - protein, 5 aa, Mycobacterium
LSPDE

SEQ ID NO: 1016632 - protein, 8 aa, Mycobacterium
LSPDGTKG

SEQ ID NO: 1016633 - protein, 5 aa, Mycobacterium
LSPDV

SEQ ID NO: 1016634 - protein, 7 aa, Mycobacterium
LSPEEGW

SEQ ID NO: 1016635 - protein, 4 aa, Mycobacterium
LSPG

SEQ ID NO: 1016636 - protein, 9 aa, Mycobacterium
LSPGPVDTS

SEQ ID NO: 1016637 - protein, 11 aa, Mycobacterium
LSPGSRLPTEQ

SEQ ID NO: 1016638 - protein, 10 aa, Mycobacterium
LSPKTARLGA

SEQ ID NO: 1016639 - protein, 5 aa, Mycobacterium
LSPND

SEQ ID NO: 1016640 - protein, 10 aa, Mycobacterium
LSPPNQPTIE

SEQ ID NO: 1016641 - protein, 17 aa, Mycobacterium
LSPPPASNVSLVGFCMH

SEQ ID NO: 1016642 - protein, 6 aa, Mycobacterium
LSPPSV

SEQ ID NO: 1016643 - protein, 8 aa, Mycobacterium
LSPQARAR

SEQ ID NO: 1016644 - protein, 6 aa, Mycobacterium
LSPQNL

SEQ ID NO: 1016645 - protein, 4 aa, Mycobacterium
LSPR

SEQ ID NO: 1016646 - protein, 9 aa, Mycobacterium
LSPRALTDH

SEQ ID NO: 1016647 - protein, 12 aa, Mycobacterium
LSPREGAAIGTA

SEQ ID NO: 1016648 - protein, 19 aa, Mycobacterium
LSPRPTPAACCGRSPTRWR

SEQ ID NO: 1016649 - protein, 5 aa, Mycobacterium
LSPTD

SEQ ID NO: 1016650 - protein, 6 aa, Mycobacterium
LSPTDI

SEQ ID NO: 1016651 - protein, 14 aa, Mycobacterium
LSPTGPTPTPDDDG

SEQ ID NO: 1016652 - protein, 6 aa, Mycobacterium
LSPTRD

SEQ ID NO: 1016653 - protein, 4 aa, Mycobacterium
LSPY

SEQ ID NO: 1016654 - protein, 4 aa, Mycobacterium
LSQA

SEQ ID NO: 1016655 - protein, 7 aa, Mycobacterium
LSQEEGV

SEQ ID NO: 1016656 - protein, 9 aa, Mycobacterium
LSQEQRDEL

SEQ ID NO: 1016657 - protein, 8 aa, Mycobacterium
LSQPARDR

SEQ ID NO: 1016658 - protein, 8 aa, Mycobacterium
LSQSESQV

SEQ ID NO: 1016659 - protein, 8 aa, Mycobacterium
LSQSPKDL

SEQ ID NO: 1016660 - protein, 8 aa, Mycobacterium
LSQSQGRT

SEQ ID NO: 1016661 - protein, 4 aa, Mycobacterium
LSRD

SEQ ID NO: 1016662 - protein, 5 aa, Mycobacterium
LSRDD

SEQ ID NO: 1016663 - protein, 14 aa, Mycobacterium
LSRDGLSGSAAPAG

SEQ ID NO: 1016664 - protein, 7 aa, Mycobacterium
LSRGESL

SEQ ID NO: 1016665 - protein, 9 aa, Mycobacterium
LSRGNDNAL

SEQ ID NO: 1016666 - protein, 14 aa, Mycobacterium
LSRPQTWRCCGTFR

SEQ ID NO: 1016667 - protein, 5 aa, Mycobacterium
LSRQI

SEQ ID NO: 1016668 - protein, 9 aa, Mycobacterium
LSRTAKPDA

SEQ ID NO: 1016669 - protein, 22 aa, Mycobacterium
LSSAAATTAAVSSASTGDGGVA

SEQ ID NO: 1016670 - protein, 16 aa, Mycobacterium
LSSAGAPGAAAVAEPP

SEQ ID NO: 1016671 - protein, 8 aa, Mycobacterium
LSSDDARE

SEQ ID NO: 1016672 - protein, 17 aa, Mycobacterium
LSSDEEKKKVGADQTEK

SEQ ID NO: 1016673 - protein, 5 aa, Mycobacterium
LSSDQ

SEQ ID NO: 1016674 - protein, 7 aa, Mycobacterium
LSSGGTR

SEQ ID NO: 1016675 - protein, 8 aa, Mycobacterium
LSSGKAPR

SEQ ID NO: 1016676 - protein, 8 aa, Mycobacterium
LSSGKEAD

SEQ ID NO: 1016677 - protein, 10 aa, Mycobacterium
LSSGLQPGDV

SEQ ID NO: 1016678 - protein, 8 aa, Mycobacterium
LSSLASGA

SEQ ID NO: 1016679 - protein, 8 aa, Mycobacterium
LSSNPIGA

SEQ ID NO: 1016680 - protein, 14 aa, Mycobacterium
LSSPQPRVVVVPRD

SEQ ID NO: 1016681 - protein, 8 aa, Mycobacterium
LSSPQSRR

SEQ ID NO: 1016682 - protein, 5 aa, Mycobacterium
LSSPS

SEQ ID NO: 1016683 - protein, 8 aa, Mycobacterium
LSSPTTAT

SEQ ID NO: 1016684 - protein, 4 aa, Mycobacterium
LSSR

SEQ ID NO: 1016685 - protein, 20 aa, Mycobacterium
LSSRGTDGPSNSDLTHREAV

SEQ ID NO: 1016686 - protein, 9 aa, Mycobacterium
LSSSAGARR

SEQ ID NO: 1016687 - protein, 5 aa, Mycobacterium
LSSSS

SEQ ID NO: 1016688 - protein, 7 aa, Mycobacterium
LSSTSAF

SEQ ID NO: 1016689 - protein, 4 aa, Mycobacterium
LSTA

SEQ ID NO: 1016690 - protein, 8 aa, Mycobacterium
LSTAAQSF

SEQ ID NO: 1016691 - protein, 6 aa, Mycobacterium
LSTAEE

SEQ ID NO: 1016692 - protein, 13 aa, Mycobacterium
LSTDDAGQTTENY

SEQ ID NO: 1016693 - protein, 8 aa, Mycobacterium
LSTDPAKA

SEQ ID NO: 1016694 - protein, 18 aa, Mycobacterium
LSTDRAAEPELGPQPDLP

SEQ ID NO: 1016695 - protein, 7 aa, Mycobacterium
LSTDTAR

SEQ ID NO: 1016696 - protein, 9 aa, Mycobacterium
LSTGLEGTG

SEQ ID NO: 1016697 - protein, 6 aa, Mycobacterium
LSTGYT

SEQ ID NO: 1016698 - protein, 6 aa, Mycobacterium
LSTPAA

SEQ ID NO: 1016699 - protein, 6 aa, Mycobacterium
LSTPDI

SEQ ID NO: 1016700 - protein, 7 aa, Mycobacterium
LSTPEAT

SEQ ID NO: 1016701 - protein, 5 aa, Mycobacterium
LSTPL

SEQ ID NO: 1016702 - protein, 8 aa, Mycobacterium
LSTPRSQV

SEQ ID NO: 1016703 - protein, 7 aa, Mycobacterium
LSTRSAA

SEQ ID NO: 1016704 - protein, 8 aa, Mycobacterium
LSTSGQLD

SEQ ID NO: 1016705 - protein, 15 aa, Mycobacterium
LSTSTGELAQAAESA

SEQ ID NO: 1016706 - protein, 9 aa, Mycobacterium
LSTTDSHSR

SEQ ID NO: 1016707 - protein, 13 aa, Mycobacterium
LTAANAAAAVPTT

SEQ ID NO: 1016708 - protein, 12 aa, Mycobacterium
LTAASGVRPAGK

SEQ ID NO: 1016709 - protein, 4 aa, Mycobacterium
LTAE

SEQ ID NO: 1016710 - protein, 8 aa, Mycobacterium
LTAEDKAA

SEQ ID NO: 1016711 - protein, 6 aa, Mycobacterium
LTAEQA

SEQ ID NO: 1016712 - protein, 7 aa, Mycobacterium
LTAESST

SEQ ID NO: 1016713 - protein, 8 aa, Mycobacterium
LTAGADDY

SEQ ID NO: 1016714 - protein, 8 aa, Mycobacterium
LTAGGDDY

SEQ ID NO: 1016715 - protein, 5 aa, Mycobacterium
LTAGT

SEQ ID NO: 1016716 - protein, 6 aa, Mycobacterium
LTAGTQ

SEQ ID NO: 1016717 - protein, 6 aa, Mycobacterium
LTAKPV

SEQ ID NO: 1016718 - protein, 4 aa, Mycobacterium
LTAP

SEQ ID NO: 1016719 - protein, 11 aa, Mycobacterium
LTARPQPADGV

SEQ ID NO: 1016720 - protein, 12 aa, Mycobacterium
LTASPSGDGPDL

SEQ ID NO: 1016721 - protein, 23 aa, Mycobacterium
LTASRSLGAPSYAVTSTGPDHHK

SEQ ID NO: 1016722 - protein, 4 aa, Mycobacterium
LTDA

SEQ ID NO: 1016723 - protein, 9 aa, Mycobacterium
LTDADGPSV

SEQ ID NO: 1016724 - protein, 5 aa, Mycobacterium
LTDDE

SEQ ID NO: 1016725 - protein, 6 aa, Mycobacterium
LTDEDA

SEQ ID NO: 1016726 - protein, 4 aa, Mycobacterium
LTDG

SEQ ID NO: 1016727 - protein, 6 aa, Mycobacterium
LTDGAG

SEQ ID NO: 1016728 - protein, 9 aa, Mycobacterium
LTDGTELTP

SEQ ID NO: 1016729 - protein, 12 aa, Mycobacterium
LTDPAADTGKKT

SEQ ID NO: 1016730 - protein, 6 aa, Mycobacterium
LTDPDT

SEQ ID NO: 1016731 - protein, 13 aa, Mycobacterium
LTDPPTGQPGIPP

SEQ ID NO: 1016732 - protein, 13 aa, Mycobacterium
LTDPSALADTAGY

SEQ ID NO: 1016733 - protein, 10 aa, Mycobacterium
LTDPSPGTSI

SEQ ID NO: 1016734 - protein, 7 aa, Mycobacterium
LTDPSSD

SEQ ID NO: 1016735 - protein, 8 aa, Mycobacterium
LTDQEAPA

SEQ ID NO: 1016736 - protein, 6 aa, Mycobacterium
LTDRDD

SEQ ID NO: 1016737 - protein, 8 aa, Mycobacterium
LTDTKGRH

SEQ ID NO: 1016738 - protein, 9 aa, Mycobacterium
LTDTPPETL

SEQ ID NO: 1016739 - protein, 6 aa, Mycobacterium
LTDTQQ

SEQ ID NO: 1016740 - protein, 5 aa, Mycobacterium
LTEDE

SEQ ID NO: 1016741 - protein, 7 aa, Mycobacterium
LTEDGAN

SEQ ID NO: 1016742 - protein, 13 aa, Mycobacterium
LTEDPEQRDVEEL

SEQ ID NO: 1016743 - protein, 10 aa, Mycobacterium
LTEDPTPRGH

SEQ ID NO: 1016744 - protein, 7 aa, Mycobacterium
LTEEAAA

SEQ ID NO: 1016745 - protein, 8 aa, Mycobacterium
LTEEATAD

SEQ ID NO: 1016746 - protein, 7 aa, Mycobacterium
LTEERRR

SEQ ID NO: 1016747 - protein, 6 aa, Mycobacterium
LTEERS

SEQ ID NO: 1016748 - protein, 4 aa, Mycobacterium
LTEG

SEQ ID NO: 1016749 - protein, 5 aa, Mycobacterium
LTEGR

SEQ ID NO: 1016750 - protein, 9 aa, Mycobacterium
LTEPGRSSA

SEQ ID NO: 1016751 - protein, 13 aa, Mycobacterium
LTEQAANLGPQSY

SEQ ID NO: 1016752 - protein, 11 aa, Mycobacterium
LTEQQAARHAE

SEQ ID NO: 1016753 - protein, 7 aa, Mycobacterium
LTESEAH

SEQ ID NO: 1016754 - protein, 6 aa, Mycobacterium
LTESGR

SEQ ID NO: 1016755 - protein, 13 aa, Mycobacterium
LTESGTSFSAARE

SEQ ID NO: 1016756 - protein, 8 aa, Mycobacterium
LTESTDGW

SEQ ID NO: 1016757 - protein, 12 aa, Mycobacterium
LTETGRAQAELA

SEQ ID NO: 1016758 - protein, 6 aa, Mycobacterium
LTETSA

SEQ ID NO: 1016759 - protein, 8 aa, Mycobacterium
LTETSAAI

SEQ ID NO: 1016760 - protein, 5 aa, Mycobacterium
LTGAG

SEQ ID NO: 1016761 - protein, 4 aa, Mycobacterium
LTGD

SEQ ID NO: 1016762 - protein, 6 aa, Mycobacterium
LTGEVR

SEQ ID NO: 1016763 - protein, 9 aa, Mycobacterium
LTGGASRTT

SEQ ID NO: 1016764 - protein, 4 aa, Mycobacterium
LTGK

SEQ ID NO: 1016765 - protein, 7 aa, Mycobacterium
LTGPDGM

SEQ ID NO: 1016766 - protein, 9 aa, Mycobacterium
LTGPETPRG

SEQ ID NO: 1016767 - protein, 5 aa, Mycobacterium
LTGPL

SEQ ID NO: 1016768 - protein, 8 aa, Mycobacterium
LTGPSDDG

SEQ ID NO: 1016769 - protein, 6 aa, Mycobacterium
LTGQGC

SEQ ID NO: 1016770 - protein, 5 aa, Mycobacterium
LTGQH

SEQ ID NO: 1016771 - protein, 14 aa, Mycobacterium
LTGQPAKQAPFEPL

SEQ ID NO: 1016772 - protein, 7 aa, Mycobacterium
LTGRAPM

SEQ ID NO: 1016773 - protein, 8 aa, Mycobacterium
LTGRGETT

SEQ ID NO: 1016774 - protein, 12 aa, Mycobacterium
LTGRRAASAGAH

SEQ ID NO: 1016775 - protein, 11 aa, Mycobacterium
LTGSAGPDGRL

SEQ ID NO: 1016776 - protein, 12 aa, Mycobacterium
LTGSLSTPSSWG

SEQ ID NO: 1016777 - protein, 9 aa, Mycobacterium
LTGSRTTAA

SEQ ID NO: 1016778 - protein, 7 aa, Mycobacterium
LTGTPGA

SEQ ID NO: 1016779 - protein, 6 aa, Mycobacterium
LTGTRP

SEQ ID NO: 1016780 - protein, 8 aa, Mycobacterium
LTGTSDTK

SEQ ID NO: 1016781 - protein, 7 aa, Mycobacterium
LTKTGSN

SEQ ID NO: 1016782 - protein, 4 aa, Mycobacterium
LTLP

SEQ ID NO: 1016783 - protein, 5 aa, Mycobacterium
LTNKQ

SEQ ID NO: 1016784 - protein, 7 aa, Mycobacterium
LTPAAQP

SEQ ID NO: 1016785 - protein, 5 aa, Mycobacterium
LTPAD

SEQ ID NO: 1016786 - protein, 7 aa, Mycobacterium
LTPAPGR

SEQ ID NO: 1016787 - protein, 7 aa, Mycobacterium
LTPDETA

SEQ ID NO: 1016788 - protein, 12 aa, Mycobacterium
LTPDGHTTNPLA

SEQ ID NO: 1016789 - protein, 5 aa, Mycobacterium
LTPEE

SEQ ID NO: 1016790 - protein, 10 aa, Mycobacterium
LTPEERMASN

SEQ ID NO: 1016791 - protein, 6 aa, Mycobacterium
LTPEQQ

SEQ ID NO: 1016792 - protein, 6 aa, Mycobacterium
LTPERV

SEQ ID NO: 1016793 - protein, 7 aa, Mycobacterium
LTPGDDV

SEQ ID NO: 1016794 - protein, 6 aa, Mycobacterium
LTPGGG

SEQ ID NO: 1016795 - protein, 5 aa, Mycobacterium
LTPGI

SEQ ID NO: 1016796 - protein, 6 aa, Mycobacterium
LTPGSR

SEQ ID NO: 1016797 - protein, 6 aa, Mycobacterium
LTPIPD

SEQ ID NO: 1016798 - protein, 9 aa, Mycobacterium
LTPNEPRFQ

SEQ ID NO: 1016799 - protein, 7 aa, Mycobacterium
LTPPELG

SEQ ID NO: 1016800 - protein, 17 aa, Mycobacterium
LTPPTRISDKENPKVPK

SEQ ID NO: 1016801 - protein, 13 aa, Mycobacterium
LTPPTTATSSGRG

SEQ ID NO: 1016802 - protein, 14 aa, Mycobacterium
LTPPVPGHPSPARF

SEQ ID NO: 1016803 - protein, 4 aa, Mycobacterium
LTPQ

SEQ ID NO: 1016804 - protein, 5 aa, Mycobacterium
LTPQE

SEQ ID NO: 1016805 - protein, 6 aa, Mycobacterium
LTPQRR

SEQ ID NO: 1016806 - protein, 10 aa, Mycobacterium
LTPRPPSTPI

SEQ ID NO: 1016807 - protein, 6 aa, Mycobacterium
LTPRQR

SEQ ID NO: 1016808 - protein, 7 aa, Mycobacterium
LTPRSSD

SEQ ID NO: 1016809 - protein, 6 aa, Mycobacterium
LTPRTV

SEQ ID NO: 1016810 - protein, 4 aa, Mycobacterium
LTPS

SEQ ID NO: 1016811 - protein, 14 aa, Mycobacterium
LTPSAQETTPIDNT

SEQ ID NO: 1016812 - protein, 14 aa, Mycobacterium
LTPSKWSDFGKASD

SEQ ID NO: 1016813 - protein, 8 aa, Mycobacterium
LTPSSAHG

SEQ ID NO: 1016814 - protein, 4 aa, Mycobacterium
LTPT

SEQ ID NO: 1016815 - protein, 5 aa, Mycobacterium
LTPTE

SEQ ID NO: 1016816 - protein, 4 aa, Mycobacterium
LTPV

SEQ ID NO: 1016817 - protein, 8 aa, Mycobacterium
LTQDPDTN

SEQ ID NO: 1016818 - protein, 12 aa, Mycobacterium
LTQHRKDNTGYT

SEQ ID NO: 1016819 - protein, 7 aa, Mycobacterium
LTQPDAT

SEQ ID NO: 1016820 - protein, 7 aa, Mycobacterium
LTQTGTH

SEQ ID NO: 1016821 - protein, 8 aa, Mycobacterium
LTQTPSAV

SEQ ID NO: 1016822 - protein, 8 aa, Mycobacterium
LTQVGGSG

SEQ ID NO: 1016823 - protein, 16 aa, Mycobacterium
LTRASTRGDGRTGEDV

SEQ ID NO: 1016824 - protein, 8 aa, Mycobacterium
LTRDPKTR

SEQ ID NO: 1016825 - protein, 26 aa, Mycobacterium
LTRGAASTRRGGGQGRERLARSTGGI

SEQ ID NO: 1016826 - protein, 8 aa, Mycobacterium
LTRGNHAD

SEQ ID NO: 1016827 - protein, 19 aa, Mycobacterium
LTRNAAKTAYEQAGVGPSD

SEQ ID NO: 1016828 - protein, 6 aa, Mycobacterium
LTRPGG

SEQ ID NO: 1016829 - protein, 5 aa, Mycobacterium
LTRPT

SEQ ID NO: 1016830 - protein, 10 aa, Mycobacterium
LTRRADDKTR

SEQ ID NO: 1016831 - protein, 6 aa, Mycobacterium
LTRRQT

SEQ ID NO: 1016832 - protein, 7 aa, Mycobacterium
LTRRSGG

SEQ ID NO: 1016833 - protein, 6 aa, Mycobacterium
LTRTPE

SEQ ID NO: 1016834 - protein, 14 aa, Mycobacterium
LTRTTRRSEEPPMP

SEQ ID NO: 1016835 - protein, 9 aa, Mycobacterium
LTSAASPAT

SEQ ID NO: 1016836 - protein, 23 aa, Mycobacterium
LTSAEEAHRLSQTSRMTGKLILE

SEQ ID NO: 1016837 - protein, 17 aa, Mycobacterium
LTSAESAENDTSGVESC

SEQ ID NO: 1016838 - protein, 5 aa, Mycobacterium
LTSAT

SEQ ID NO: 1016839 - protein, 10 aa, Mycobacterium
LTSDATRLAG

SEQ ID NO: 1016840 - protein, 13 aa, Mycobacterium
LTSDDRGVLIVPA

SEQ ID NO: 1016841 - protein, 4 aa, Mycobacterium
LTSG

SEQ ID NO: 1016842 - protein, 7 aa, Mycobacterium
LTSGNRI

SEQ ID NO: 1016843 - protein, 6 aa, Mycobacterium
LTSGQK

SEQ ID NO: 1016844 - protein, 13 aa, Mycobacterium
LTSGTGRAVTGGG

SEQ ID NO: 1016845 - protein, 6 aa, Mycobacterium
LTSNGV

SEQ ID NO: 1016846 - protein, 7 aa, Mycobacterium
LTSPEAT

SEQ ID NO: 1016847 - protein, 13 aa, Mycobacterium
LTSPTDPAPQHIT

SEQ ID NO: 1016848 - protein, 7 aa, Mycobacterium
LTSRGVE

SEQ ID NO: 1016849 - protein, 4 aa, Mycobacterium
LTST

SEQ ID NO: 1016850 - protein, 9 aa, Mycobacterium
LTSTDTSSY

SEQ ID NO: 1016851 - protein, 7 aa, Mycobacterium
LTSTSSV

SEQ ID NO: 1016852 - protein, 17 aa, Mycobacterium
LTSVSGGTAVSASTDTE

SEQ ID NO: 1016853 - protein, 11 aa, Mycobacterium
LTTEPGPPRPS

SEQ ID NO: 1016854 - protein, 11 aa, Mycobacterium
LTTEQAARAGH

SEQ ID NO: 1016855 - protein, 5 aa, Mycobacterium
LTTER

SEQ ID NO: 1016856 - protein, 4 aa, Mycobacterium
LTTG

SEQ ID NO: 1016857 - protein, 5 aa, Mycobacterium
LTTGD

SEQ ID NO: 1016858 - protein, 13 aa, Mycobacterium
LTTGLEPARALPG

SEQ ID NO: 1016859 - protein, 4 aa, Mycobacterium
LTTP

SEQ ID NO: 1016860 - protein, 9 aa, Mycobacterium
LTTPGTPFN

SEQ ID NO: 1016861 - protein, 6 aa, Mycobacterium
LTTPTQ

SEQ ID NO: 1016862 - protein, 6 aa, Mycobacterium
LTTRTE

SEQ ID NO: 1016863 - protein, 4 aa, Mycobacterium
LTTS

SEQ ID NO: 1016864 - protein, 9 aa, Mycobacterium
LTTSGSGVD

SEQ ID NO: 1016865 - protein, 13 aa, Mycobacterium
LTTTRAPQPGEHT

SEQ ID NO: 1016866 - protein, 14 aa, Mycobacterium
LTYSPDHDGRADPG

SEQ ID NO: 1016867 - protein, 4 aa, Mycobacterium
LVDG

SEQ ID NO: 1016868 - protein, 20 aa, Mycobacterium
LVDPDESSTTRLVRLHTEAD

SEQ ID NO: 1016869 - protein, 81 aa, Mycobacterium
LVGPGGDGGLGSTGGNGGNGSQPPFGSIPAGSGGDGGNGGDGGSSGFVSGQSGTDGQDGGDPSGQFGGTGGAGGSGGAGAG

SEQ ID NO: 1016870 - protein, 20 aa, Mycobacterium
LVGPGTDGAPGTGQAGGPGG

SEQ ID NO: 1016871 - protein, 7 aa, Mycobacterium
LVPEEQA

SEQ ID NO: 1016872 - protein, 10 aa, Mycobacterium
LVPGPVASTA

SEQ ID NO: 1016873 - protein, 4 aa, Mycobacterium
LVPT

SEQ ID NO: 1016874 - protein, 6 aa, Mycobacterium
LVSEDD

SEQ ID NO: 1016875 - protein, 13 aa, Mycobacterium
LVSGSDAKESRGV

SEQ ID NO: 1016876 - protein, 5 aa, Mycobacterium
MAAGT

SEQ ID NO: 1016877 - protein, 7 aa, Mycobacterium
MADARGT

SEQ ID NO: 1016878 - protein, 8 aa, Mycobacterium
MADEGRND

SEQ ID NO: 1016879 - protein, 12 aa, Mycobacterium
MADNGGAVETSS

SEQ ID NO: 1016880 - protein, 10 aa, Mycobacterium
MADSYDDQGN

SEQ ID NO: 1016881 - protein, 7 aa, Mycobacterium
MAEGRGS

SEQ ID NO: 1016882 - protein, 24 aa, Mycobacterium
MAEPAVSAAPAPKAAPAAPAAPVP

SEQ ID NO: 1016883 - protein, 6 aa, Mycobacterium
MAEPRY

SEQ ID NO: 1016884 - protein, 10 aa, Mycobacterium
MAGAGGNGGS

SEQ ID NO: 1016885 - protein, 12 aa, Mycobacterium
MAGENNTTGVSS

SEQ ID NO: 1016886 - protein, 10 aa, Mycobacterium
MAGGPGTPAL

SEQ ID NO: 1016887 - protein, 12 aa, Mycobacterium
MAGPGGNGGDAR

SEQ ID NO: 1016888 - protein, 6 aa, Mycobacterium
MAGRGT

SEQ ID NO: 1016889 - protein, 34 aa, Mycobacterium; identical to SEQ ID NO: 526752

SEQ ID NO: 1016890 - protein, 4 aa, Mycobacterium
MAPD

SEQ ID NO: 1016891 - protein, 10 aa, Mycobacterium
MAPDEARQAE

SEQ ID NO: 1016892 - protein, 7 aa, Mycobacterium
MAREDED

SEQ ID NO: 1016893 - protein, 6 aa, Mycobacterium
MARGDA

SEQ ID NO: 1016894 - protein, 7 aa, Mycobacterium
MARPQDW

SEQ ID NO: 1016895 - protein, 4 aa, Mycobacterium
MASA

SEQ ID NO: 1016896 - protein, 10 aa, Mycobacterium
MASGGATGKC

SEQ ID NO: 1016897 - protein, 13 aa, Mycobacterium
MASGPPGGGPDVA

SEQ ID NO: 1016898 - protein, 7 aa, Mycobacterium
MATGAAY

SEQ ID NO: 1016899 - protein, 13 aa, Mycobacterium
MDAENRAALTIST

SEQ ID NO: 1016900 - protein, 24 aa, Mycobacterium
MDAQEAAERAARRAQRAHPAGAPE

SEQ ID NO: 1016901 - protein, 11 aa, Mycobacterium
MDGLRRSNENL

SEQ ID NO: 1016902 - protein, 9 aa, Mycobacterium
MDPRKNPLH

SEQ ID NO: 1016903 - protein, 4 aa, Mycobacterium
MDPT

SEQ ID NO: 1016904 - protein, 7 aa, Mycobacterium
MDRGGAR

SEQ ID NO: 1016905 - protein, 8 aa, Mycobacterium
MDRGGSLQ

SEQ ID NO: 1016906 - protein, 14 aa, Mycobacterium
MEAAQQTAAPLARQ

SEQ ID NO: 1016907 - protein, 6 aa, Mycobacterium
MEATTA

SEQ ID NO: 1016908 - protein, 7 aa, Mycobacterium
MEEDTGK

SEQ ID NO: 1016909 - protein, 6 aa, Mycobacterium
MEKTGA

SEQ ID NO: 1016910 - protein, 8 aa, Mycobacterium
MENDGATA

SEQ ID NO: 1016911 - protein, 6 aa, Mycobacterium
MEPATG

SEQ ID NO: 1016912 - protein, 22 aa, Mycobacterium
MEPPARLGGPIAGGPVPPGSIP

SEQ ID NO: 1016913 - protein, 4 aa, Mycobacterium
MEPT

SEQ ID NO: 1016914 - protein, 20 aa, Mycobacterium
MERSQARASRLQRRQEASEA

SEQ ID NO: 1016915 - protein, 8 aa, Mycobacterium
MESERGYD

SEQ ID NO: 1016916 - protein, 7 aa, Mycobacterium
MESGHAY

SEQ ID NO: 1016917 - protein, 10 aa, Mycobacterium
MESPEGRQKY

SEQ ID NO: 1016918 - protein, 6 aa, Mycobacterium
METRGK

SEQ ID NO: 1016919 - protein, 4 aa, Mycobacterium
MGAD

SEQ ID NO: 1016920 - protein, 8 aa, Mycobacterium
MGADGGAM

SEQ ID NO: 1016921 - protein, 7 aa, Mycobacterium
MGAEPSE

SEQ ID NO: 1016922 - protein, 30 aa, Mycobacterium
MGAGGTGGSKEKPAEKRVTAPGVPNGQSVK

SEQ ID NO: 1016923 - protein, 8 aa, Mycobacterium
MGDAGLTG

SEQ ID NO: 1016924 - protein, 24 aa, Mycobacterium
MGDGDSGGLGDSGGSAGAAGAGGL

SEQ ID NO: 1016925 - protein, 28 aa, Mycobacterium
MGDGGAGGDGGDGSAAGGLGGDGGNADW

SEQ ID NO: 1016926 - protein, 13 aa, Mycobacterium
MGDQTGAALSRTG

SEQ ID NO: 1016927 - protein, 15 aa, Mycobacterium
MGGAGLGSSISAGLG

SEQ ID NO: 1016928 - protein, 5 aa, Mycobacterium
MGGAQ

SEQ ID NO: 1016929 - protein, 39 aa, Mycobacterium
MGGMGSASKAGLAAASGVPGGPALKPAALGGGAGAGAAM

SEQ ID NO: 1016930 - protein, 19 aa, Mycobacterium
MGGRDSSSNLDRSQPTMSI

SEQ ID NO: 1016931 - protein, 6 aa, Mycobacterium
MGKPSV

SEQ ID NO: 1016932 - protein, 10 aa, Mycobacterium
MGNNNPKDNW

SEQ ID NO: 1016933 - protein, 8 aa, Mycobacterium
MGNPQTAK

SEQ ID NO: 1016934 - protein, 5 aa, Mycobacterium
MGPEY

SEQ ID NO: 1016935 - protein, 9 aa, Mycobacterium
MGPGSLATD

SEQ ID NO: 1016936 - protein, 7 aa, Mycobacterium
MGPPADP

SEQ ID NO: 1016937 - protein, 15 aa, Mycobacterium
MGPSYPELASDSDRI

SEQ ID NO: 1016938 - protein, 4 aa, Mycobacterium
MGRA

SEQ ID NO: 1016939 - protein, 9 aa, Mycobacterium
MGRATSGVQ

SEQ ID NO: 1016940 - protein, 4 aa, Mycobacterium
MGRG

SEQ ID NO: 1016941 - protein, 40 aa, Mycobacterium
MGRKSATRKSKGAKGKAGKKGKKGGARGPTPPKVKSPFGM

SEQ ID NO: 1016942 - protein, 13 aa, Mycobacterium
MGRTEGLSDVERA

SEQ ID NO: 1016943 - protein, 10 aa, Mycobacterium
MGSASTNYYN

SEQ ID NO: 1016944 - protein, 6 aa, Mycobacterium
MGTDER

SEQ ID NO: 1016945 - protein, 34 aa, Mycobacterium
MGTGGTGGAGGWGGTDEITGGTGGGGGTGGAGGW

SEQ ID NO: 1016946 - protein, 11 aa, Mycobacterium
MGTGVGGGTSM

SEQ ID NO: 1016947 - protein, 5 aa, Mycobacterium
MGTPE

SEQ ID NO: 1016948 - protein, 7 aa, Mycobacterium
MGTPPAS

SEQ ID NO: 1016949 - protein, 9 aa, Mycobacterium
MGTQAADLA

SEQ ID NO: 1016950 - protein, 4 aa, Mycobacterium
MGVG

SEQ ID NO: 1016951 - protein, 11 aa, Mycobacterium
MGYGPAEADVA

SEQ ID NO: 1016952 - protein, 10 aa, Mycobacterium
MGYPGPDPVA

SEQ ID NO: 1016953 - protein, 14 aa, Mycobacterium
MHTRAESHETQSIV

SEQ ID NO: 1016954 - protein, 4 aa, Mycobacterium
MKAG

SEQ ID NO: 1016955 - protein, 7 aa, Mycobacterium
MKDDPEM

SEQ ID NO: 1016956 - protein, 11 aa, Mycobacterium
MKDGPKNRLRS

SEQ ID NO: 1016957 - protein, 8 aa, Mycobacterium
MKDPHNRS

SEQ ID NO: 1016958 - protein, 15 aa, Mycobacterium
MKKAPEKRHRVYQKE

SEQ ID NO: 1016959 - protein, 8 aa, Mycobacterium
MKNPADSA

SEQ ID NO: 1016960 - protein, 8 aa, Mycobacterium
MKNPERGY

SEQ ID NO: 1016961 - protein, 10 aa, Mycobacterium
MKPEAQAAKD

SEQ ID NO: 1016962 - protein, 8 aa, Mycobacterium
MKSGGAIG

SEQ ID NO: 1016963 - protein, 8 aa, Mycobacterium
MKTGDLGG

SEQ ID NO: 1016964 - protein, 9 aa, Mycobacterium
MKTGEGKTL

SEQ ID NO: 1016965 - protein, 7 aa, Mycobacterium
MNAGKNV

SEQ ID NO: 1016966 - protein, 9 aa, Mycobacterium
MNAKSTAVG

SEQ ID NO: 1016967 - protein, 8 aa, Mycobacterium
MNGNSDAT

SEQ ID NO: 1016968 - protein, 4 aa, Mycobacterium
MNGQ

SEQ ID NO: 1016969 - protein, 8 aa, Mycobacterium
MNKGQPGR

SEQ ID NO: 1016970 - protein, 4 aa, Mycobacterium
MNPG

SEQ ID NO: 1016971 - protein, 7 aa, Mycobacterium
MNPNGGL

SEQ ID NO: 1016972 - protein, 7 aa, Mycobacterium
MNPNSPW

SEQ ID NO: 1016973 - protein, 12 aa, Mycobacterium
MPAAPPPDDLPG

SEQ ID NO: 1016974 - protein, 6 aa, Mycobacterium
MPAKPA

SEQ ID NO: 1016975 - protein, 10 aa, Mycobacterium
MPAPSRTGSQ

SEQ ID NO: 1016976 - protein, 11 aa, Mycobacterium
MPASADGNGAH

SEQ ID NO: 1016977 - protein, 6 aa, Mycobacterium
MPASEA

SEQ ID NO: 1016978 - protein, 9 aa, Mycobacterium
MPASSDEAT

SEQ ID NO: 1016979 - protein, 4 aa, Mycobacterium
MPDE

SEQ ID NO: 1016980 - protein, 8 aa, Mycobacterium
MPDEPKPV

SEQ ID NO: 1016981 - protein, 4 aa, Mycobacterium
MPDG

SEQ ID NO: 1016982 - protein, 7 aa, Mycobacterium
MPDNATD

SEQ ID NO: 1016983 - protein, 22 aa, Mycobacterium
MPDPLPDHGDGPYWAPTATADR

SEQ ID NO: 1016984 - protein, 6 aa, Mycobacterium
MPDSPF

SEQ ID NO: 1016985 - protein, 5 aa, Mycobacterium
MPEGA

SEQ ID NO: 1016986 - protein, 11 aa, Mycobacterium
MPGANAPSVAE

SEQ ID NO: 1016987 - protein, 5 aa, Mycobacterium
MPGAS

SEQ ID NO: 1016988 - protein, 14 aa, Mycobacterium
MPGPDRHRPIPWPA

SEQ ID NO: 1016989 - protein, 7 aa, Mycobacterium
MPHTTPP

SEQ ID NO: 1016990 - protein, 17 aa, Mycobacterium
MPKTKRTKTGYTTDADA

SEQ ID NO: 1016991 - protein, 11 aa, Mycobacterium
MPLNDAQPRIE

SEQ ID NO: 1016992 - protein, 8 aa, Mycobacterium
MPNAKPSA

SEQ ID NO: 1016993 - protein, 4 aa, Mycobacterium
MPNW

SEQ ID NO: 1016994 - protein, 7 aa, Mycobacterium
MPPAERQ

SEQ ID NO: 1016995 - protein, 7 aa, Mycobacterium
MPPDGTL

SEQ ID NO: 1016996 - protein, 8 aa, Mycobacterium
MPPEADHN

SEQ ID NO: 1016997 - protein, 19 aa, Mycobacterium
MPPGGEDPEYAAATRAAAA

SEQ ID NO: 1016998 - protein, 6 aa, Mycobacterium
MPPGVE

SEQ ID NO: 1016999 - protein, 11 aa, Mycobacterium
MPPGVPPGQPL

SEQ ID NO: 1017000 - protein, 19 aa, Mycobacterium
MPQPGRRERIDPKRLAGRA

SEQ ID NO: 1017001 - protein, 7 aa, Mycobacterium
MPSGADG

SEQ ID NO: 1017002 - protein, 11 aa, Mycobacterium
MPSPCSENQSC

SEQ ID NO: 1017003 - protein, 20 aa, Mycobacterium
MPSRAPVGLAGRPSGLRNRR

SEQ ID NO: 1017004 - protein, 11 aa, Mycobacterium
MPTDEGGKTRL

SEQ ID NO: 1017005 - protein, 17 aa, Mycobacterium
MPTDSPLPELARARRML

SEQ ID NO: 1017006 - protein, 8 aa, Mycobacterium
MPTGRRDD

SEQ ID NO: 1017007 - protein, 11 aa, Mycobacterium
MPTKSYDNAQG

SEQ ID NO: 1017008 - protein, 4 aa, Mycobacterium
MPTR

SEQ ID NO: 1017009 - protein, 5 aa, Mycobacterium
MPVPP

SEQ ID NO: 1017010 - protein, 7 aa, Mycobacterium
MPVTSGG

SEQ ID NO: 1017011 - protein, 4 aa, Mycobacterium
MQAT

SEQ ID NO: 1017012 - protein, 10 aa, Mycobacterium
MQEQVSSSLR

SEQ ID NO: 1017013 - protein, 14 aa, Mycobacterium
MQGRGGAKSYSKDR

SEQ ID NO: 1017014 - protein, 8 aa, Mycobacterium
MQPDAPAV

SEQ ID NO: 1017015 - protein, 9 aa, Mycobacterium
MQPGADEPV

SEQ ID NO: 1017016 - protein, 4 aa, Mycobacterium
MQPQ

SEQ ID NO: 1017017 - protein, 8 aa, Mycobacterium
MQPTPPPI

SEQ ID NO: 1017018 - protein, 4 aa, Mycobacterium
MQRT

SEQ ID NO: 1017019 - protein, 6 aa, Mycobacterium
MRAPGS

SEQ ID NO: 1017020 - protein, 8 aa, Mycobacterium
MRATGSND

SEQ ID NO: 1017021 - protein, 4 aa, Mycobacterium
MRDA

SEQ ID NO: 1017022 - protein, 7 aa, Mycobacterium
MRDPAEA

SEQ ID NO: 1017023 - protein, 9 aa, Mycobacterium
MRENGDPVH

SEQ ID NO: 1017024 - protein, 10 aa, Mycobacterium
MRETRGAPEG

SEQ ID NO: 1017025 - protein, 7 aa, Mycobacterium
MRGATAP

SEQ ID NO: 1017026 - protein, 10 aa, Mycobacterium
MRGEGAPAPI

SEQ ID NO: 1017027 - protein, 5 aa, Mycobacterium
MRGPS

SEQ ID NO: 1017028 - protein, 13 aa, Mycobacterium
MRNREDPGAGPVD

SEQ ID NO: 1017029 - protein, 10 aa, Mycobacterium
MRPDQVAGNT

SEQ ID NO: 1017030 - protein, 12 aa, Mycobacterium
MRPETTKEGLGK

SEQ ID NO: 1017031 - protein, 4 aa, Mycobacterium
MRPG

SEQ ID NO: 1017032 - protein, 47 aa, Mycobacterium; identical to SEQ ID NO: 527619

SEQ ID NO: 1017033 - protein, 8 aa, Mycobacterium
MRPQTTRH

SEQ ID NO: 1017034 - protein, 5 aa, Mycobacterium
MRQPN

SEQ ID NO: 1017035 - protein, 8 aa, Mycobacterium
MRRNKKAF

SEQ ID NO: 1017036 - protein, 7 aa, Mycobacterium
MRSGSRG

SEQ ID NO: 1017037 - protein, 7 aa, Mycobacterium
MRTAGDD

SEQ ID NO: 1017038 - protein, 10 aa, Mycobacterium
MRTDDPDDTY

SEQ ID NO: 1017039 - protein, 19 aa, Mycobacterium
MRTDTQTWATTDGPPRSEL

SEQ ID NO: 1017040 - protein, 16 aa, Mycobacterium
MRTGTGLGGVRPPHRV

SEQ ID NO: 1017041 - protein, 4 aa, Mycobacterium
MSAG

SEQ ID NO: 1017042 - protein, 11 aa, Mycobacterium
MSAGDDAQAAA

SEQ ID NO: 1017043 - protein, 6 aa, Mycobacterium
MSAPNE

SEQ ID NO: 1017044 - protein, 11 aa, Mycobacterium
MSAPSSGSSKV

SEQ ID NO: 1017045 - protein, 8 aa, Mycobacterium
MSDDRGRP

SEQ ID NO: 1017046 - protein, 10 aa, Mycobacterium
MSDPDKPNIA

SEQ ID NO: 1017047 - protein, 9 aa, Mycobacterium
MSDTPDNVN

SEQ ID NO: 1017048 - protein, 39 aa, Mycobacterium
MSDTSQAKAGNSRDDESGCLGRRNRENSCGRGILEPPTS

SEQ ID NO: 1017049 - protein, 12 aa, Mycobacterium
MSEPGAGSDLAS

SEQ ID NO: 1017050 - protein, 13 aa, Mycobacterium
MSEPSAGSDLAPL

SEQ ID NO: 1017051 - protein, 7 aa, Mycobacterium
MSGESDP

SEQ ID NO: 1017052 - protein, 7 aa, Mycobacterium
MSGGHAE

SEQ ID NO: 1017053 - protein, 44 aa, Mycobacterium
MSGGTGNGGTISGGGAAGSGGASGATTAAATGSGELGGSGGVAA

SEQ ID NO: 1017054 - protein, 14 aa, Mycobacterium
MSGQPLDAQARPSV

SEQ ID NO: 1017055 - protein, 11 aa, Mycobacterium
MSGSGKGGAKY

SEQ ID NO: 1017056 - protein, 6 aa, Mycobacterium
MSGSNI

SEQ ID NO: 1017057 - protein, 8 aa, Mycobacterium
MSGTHEAN

SEQ ID NO: 1017058 - protein, 5 aa, Mycobacterium
MSGYA

SEQ ID NO: 1017059 - protein, 7 aa, Mycobacterium
MSGYAGT

SEQ ID NO: 1017060 - protein, 5 aa, Mycobacterium
MSKKK

SEQ ID NO: 1017061 - protein, 9 aa, Mycobacterium
MSKNSTAMG

SEQ ID NO: 1017062 - protein, 10 aa, Mycobacterium
MSNGSGADAG

SEQ ID NO: 1017063 - protein, 6 aa, Mycobacterium
MSPARK

SEQ ID NO: 1017064 - protein, 5 aa, Mycobacterium
MSPAS

SEQ ID NO: 1017065 - protein, 5 aa, Mycobacterium
MSPQG

SEQ ID NO: 1017066 - protein, 17 aa, Mycobacterium
MSQTESRSCTWLGASTR

SEQ ID NO: 1017067 - protein, 7 aa, Mycobacterium
MSRKDIG

SEQ ID NO: 1017068 - protein, 7 aa, Mycobacterium
MSRRTGQ

SEQ ID NO: 1017069 - protein, 4 aa, Mycobacterium
MSSE

SEQ ID NO: 1017070 - protein, 15 aa, Mycobacterium
MSTSGTPSSSTPMGA

SEQ ID NO: 1017071 - protein, 11 aa, Mycobacterium
MSTSSNERGMS

SEQ ID NO: 1017072 - protein, 12 aa, Mycobacterium
MTAGQKKQVRAE

SEQ ID NO: 1017073 - protein, 7 aa, Mycobacterium
MTAGSGA

SEQ ID NO: 1017074 - protein, 10 aa, Mycobacterium
MTAPEKVTGI

SEQ ID NO: 1017075 - protein, 16 aa, Mycobacterium
MTAPPHPRAAGATDKD

SEQ ID NO: 1017076 - protein, 6 aa, Mycobacterium
MTDDQR

SEQ ID NO: 1017077 - protein, 4 aa, Mycobacterium
MTDP

SEQ ID NO: 1017078 - protein, 6 aa, Mycobacterium
MTGGGF

SEQ ID NO: 1017079 - protein, 8 aa, Mycobacterium
MTGPSDDP

SEQ ID NO: 1017080 - protein, 12 aa, Mycobacterium
MTGQGADFAAHH

SEQ ID NO: 1017081 - protein, 8 aa, Mycobacterium
MTGTEDPE

SEQ ID NO: 1017082 - protein, 5 aa, Mycobacterium
MTNNN

SEQ ID NO: 1017083 - protein, 5 aa, Mycobacterium
MTPEA

SEQ ID NO: 1017084 - protein, 6 aa, Mycobacterium
MTPGPG

SEQ ID NO: 1017085 - protein, 12 aa, Mycobacterium
MTPPERDTTADG

SEQ ID NO: 1017086 - protein, 6 aa, Mycobacterium
MTPPIA

SEQ ID NO: 1017087 - protein, 9 aa, Mycobacterium
MTPTAKEVT

SEQ ID NO: 1017088 - protein, 5 aa, Mycobacterium
MTPTE

SEQ ID NO: 1017089 - protein, 9 aa, Mycobacterium
MTQRRDEPA

SEQ ID NO: 1017090 - protein, 12 aa, Mycobacterium
MTQTHPDIPEEL

SEQ ID NO: 1017091 - protein, 7 aa, Mycobacterium
MTSEDAA

SEQ ID NO: 1017092 - protein, 7 aa, Mycobacterium
MTSGYSP

SEQ ID NO: 1017093 - protein, 19 aa, Mycobacterium
MYGADGKLKDTKAVNPEST

SEQ ID NO: 1017094 - protein, 11 aa, Mycobacterium
MYTGPGSTPMV

SEQ ID NO: 1017095 - protein, 4 aa, Mycobacterium
NAAA

SEQ ID NO: 1017096 - protein, 9 aa, Mycobacterium
NAAAAAGEA

SEQ ID NO: 1017097 - protein, 9 aa, Mycobacterium
NAAAAIPTS

SEQ ID NO: 1017098 - protein, 9 aa, Mycobacterium
NAAAALPAT

SEQ ID NO: 1017099 - protein, 20 aa, Mycobacterium
NAAADADGPVATTGLYPPGS

SEQ ID NO: 1017100 - protein, 9 aa, Mycobacterium
NAAAGAERI

SEQ ID NO: 1017101 - protein, 7 aa, Mycobacterium
NAAARAG

SEQ ID NO: 1017102 - protein, 15 aa, Mycobacterium
NAADTSTPAVDDLDD

SEQ ID NO: 1017103 - protein, 6 aa, Mycobacterium
NAADVT

SEQ ID NO: 1017104 - protein, 15 aa, Mycobacterium
NAAEPEPDAEDVPDT

SEQ ID NO: 1017105 - protein, 7 aa, Mycobacterium
NAAEQGR

SEQ ID NO: 1017106 - protein, 6 aa, Mycobacterium
NAAGDV

SEQ ID NO: 1017107 - protein, 8 aa, Mycobacterium
NAAGEPRY

SEQ ID NO: 1017108 - protein, 5 aa, Mycobacterium
NAAGI

SEQ ID NO: 1017109 - protein, 6 aa, Mycobacterium
NAAGRA

SEQ ID NO: 1017110 - protein, 9 aa, Mycobacterium
NAAGYSDAE

SEQ ID NO: 1017111 - protein, 17 aa, Mycobacterium
NAAGYSGRLEVTAEPGA

SEQ ID NO: 1017112 - protein, 13 aa, Mycobacterium
NAAHQGANDEITP

SEQ ID NO: 1017113 - protein, 8 aa, Mycobacterium
NAAHSDPA

SEQ ID NO: 1017114 - protein, 5 aa, Mycobacterium
NAAHT

SEQ ID NO: 1017115 - protein, 12 aa, Mycobacterium
NAAKEPETEGGR

SEQ ID NO: 1017116 - protein, 11 aa, Mycobacterium
NAANAAAATQI

SEQ ID NO: 1017117 - protein, 8 aa, Mycobacterium
NAANTQLR

SEQ ID NO: 1017118 - protein, 4 aa, Mycobacterium
NAAP

SEQ ID NO: 1017119 - protein, 9 aa, Mycobacterium
NAAPDAPSL

SEQ ID NO: 1017120 - protein, 10 aa, Mycobacterium
NAAPDPEVRA

SEQ ID NO: 1017121 - protein, 20 aa, Mycobacterium
NAAPESGEPGAAVTSIAAPN

SEQ ID NO: 1017122 - protein, 5 aa, Mycobacterium
NAAPT

SEQ ID NO: 1017123 - protein, 7 aa, Mycobacterium
NAARNRV

SEQ ID NO: 1017124 - protein, 11 aa, Mycobacterium
NAARPQAAPRR

SEQ ID NO: 1017125 - protein, 6 aa, Mycobacterium
NAARRV

SEQ ID NO: 1017126 - protein, 6 aa, Mycobacterium
NAARTA

SEQ ID NO: 1017127 - protein, 9 aa, Mycobacterium
NAARTQARQ

SEQ ID NO: 1017128 - protein, 5 aa, Mycobacterium
NAASR

SEQ ID NO: 1017129 - protein, 13 aa, Mycobacterium
NAATAAAAAPTTG

SEQ ID NO: 1017130 - protein, 6 aa, Mycobacterium
NAAYSA

SEQ ID NO: 1017131 - protein, 8 aa, Mycobacterium
NACGANDG

SEQ ID NO: 1017132 - protein, 5 aa, Mycobacterium
NADAK

SEQ ID NO: 1017133 - protein, 6 aa, Mycobacterium
NADEGR

SEQ ID NO: 1017134 - protein, 13 aa, Mycobacterium
NADGGADVVNGRE

SEQ ID NO: 1017135 - protein, 9 aa, Mycobacterium
NADGSTAQM

SEQ ID NO: 1017136 - protein, 7 aa, Mycobacterium
NADGYGL

SEQ ID NO: 1017137 - protein, 4 aa, Mycobacterium
NADM

SEQ ID NO: 1017138 - protein, 6 aa, Mycobacterium
NADPDV

SEQ ID NO: 1017139 - protein, 8 aa, Mycobacterium
NADPGPIG

SEQ ID NO: 1017140 - protein, 10 aa, Mycobacterium
NADSAATASG

SEQ ID NO: 1017141 - protein, 11 aa, Mycobacterium
NADTIEQAAEA

SEQ ID NO: 1017142 - protein, 5 aa, Mycobacterium
NADYS

SEQ ID NO: 1017143 - protein, 20 aa, Mycobacterium
NAEAARRAAANSMNTTSSKL

SEQ ID NO: 1017144 - protein, 16 aa, Mycobacterium
NAEDLDAARAADTPAA

SEQ ID NO: 1017145 - protein, 20 aa, Mycobacterium
NAEENADEAVAEATDTDESS

SEQ ID NO: 1017146 - protein, 12 aa, Mycobacterium
NAEHSSTGLRSA

SEQ ID NO: 1017147 - protein, 16 aa, Mycobacterium
NAEIPGVGPSESEVGP

SEQ ID NO: 1017148 - protein, 6 aa, Mycobacterium
NAENAG

SEQ ID NO: 1017149 - protein, 12 aa, Mycobacterium
NAEQAGVTGPLP

SEQ ID NO: 1017150 - protein, 14 aa, Mycobacterium
NAERATDWRGNNNI

SEQ ID NO: 1017151 - protein, 10 aa, Mycobacterium
NAESEGERAA

SEQ ID NO: 1017152 - protein, 6 aa, Mycobacterium
NAESRS

SEQ ID NO: 1017153 - protein, 4 aa, Mycobacterium
NAET

SEQ ID NO: 1017154 - protein, 7 aa, Mycobacterium
NAEVSGP

SEQ ID NO: 1017155 - protein, 5 aa, Mycobacterium
NAEYH

SEQ ID NO: 1017156 - protein, 10 aa, Mycobacterium
NAFDKTDNRV

SEQ ID NO: 1017157 - protein, 8 aa, Mycobacterium
NAFEDPAE

SEQ ID NO: 1017158 - protein, 12 aa, Mycobacterium
NAGAGGAGGAGQ

SEQ ID NO: 1017159 - protein, 5 aa, Mycobacterium
NAGDE

SEQ ID NO: 1017160 - protein, 11 aa, Mycobacterium
NAGDGTHEHPT

SEQ ID NO: 1017161 - protein, 9 aa, Mycobacterium
NAGEGLPPL

SEQ ID NO: 1017162 - protein, 11 aa, Mycobacterium
NAGGAKELEPV

SEQ ID NO: 1017163 - protein, 7 aa, Mycobacterium
NAGGARD

SEQ ID NO: 1017164 - protein, 8 aa, Mycobacterium
NAGGAYAA

SEQ ID NO: 1017165 - protein, 16 aa, Mycobacterium
NAGGFNQGLANSGNNN

SEQ ID NO: 1017166 - protein, 6 aa, Mycobacterium
NAGGQR

SEQ ID NO: 1017167 - protein, 8 aa, Mycobacterium
NAGGSPYA

SEQ ID NO: 1017168 - protein, 10 aa, Mycobacterium
NAGHGGISGR

SEQ ID NO: 1017169 - protein, 8 aa, Mycobacterium
NAGKPTSV

SEQ ID NO: 1017170 - protein, 15 aa, Mycobacterium
NAGKSRPDGIGKTPI

SEQ ID NO: 1017171 - protein, 7 aa, Mycobacterium
NAGLREG

SEQ ID NO: 1017172 - protein, 8 aa, Mycobacterium
NAGMQPSE

SEQ ID NO: 1017173 - protein, 10 aa, Mycobacterium
NAGPADLSNP

SEQ ID NO: 1017174 - protein, 15 aa, Mycobacterium
NAGPEVDPRPSVDPE

SEQ ID NO: 1017175 - protein, 7 aa, Mycobacterium
NAGPGTA

SEQ ID NO: 1017176 - protein, 12 aa, Mycobacterium
NAGQAGADGPVQ

SEQ ID NO: 1017177 - protein, 14 aa, Mycobacterium
NAGQPITSSTLTEE

SEQ ID NO: 1017178 - protein, 7 aa, Mycobacterium
NAGRGPA

SEQ ID NO: 1017179 - protein, 29 aa, Mycobacterium
NAGSGNVGYENAGGANVGFGNSGSDNTGF

SEQ ID NO: 1017180 - protein, 16 aa, Mycobacterium
NAGSLNQGFANTGDHS

SEQ ID NO: 1017181 - protein, 255 aa, Mycobacterium
NAGTTGAGGDGGNGGNGGLAGNGGAGGNGDASNPNGGTGGNAANPGAGGAGGAGGNGSRTGAPGTTGNTPTTAAGHGGKGGDGFNPATSGQDGGSGGKGGDAGQFGNGGNGGNGAAGDAAGSGHTGGNGGAGGGGGNAGQFGEPGTGGSGGNGGKGGDGAAGGNGGTGGIGGTGGIGGDGRNGSTGAIGGNGGTGGTGGTGGTGGKSLGNLPSGDGGVGGNAGTGGNGGNATDGGAGGKGGDGAAGGTGGNAGEF

SEQ ID NO: 1017182 - protein, 57 aa, Mycobacterium; identical to SEQ ID NO: 528473

SEQ ID NO: 1017183 - protein, 4 aa, Mycobacterium
NAGY

SEQ ID NO: 1017184 - protein, 7 aa, Mycobacterium
NAHADQL

SEQ ID NO: 1017185 - protein, 8 aa, Mycobacterium
NAHVGTGA

SEQ ID NO: 1017186 - protein, 6 aa, Mycobacterium
NAIPQT

SEQ ID NO: 1017187 - protein, 7 aa, Mycobacterium
NAISGIP

SEQ ID NO: 1017188 - protein, 4 aa, Mycobacterium
NAIT

SEQ ID NO: 1017189 - protein, 7 aa, Mycobacterium
NAKAAVE

SEQ ID NO: 1017190 - protein, 9 aa, Mycobacterium
NAKDRTVAS

SEQ ID NO: 1017191 - protein, 4 aa, Mycobacterium
NAKN

SEQ ID NO: 1017192 - protein, 7 aa, Mycobacterium
NAKPDEL

SEQ ID NO: 1017193 - protein, 9 aa, Mycobacterium
NALGSDPWS

SEQ ID NO: 1017194 - protein, 6 aa, Mycobacterium
NALPGL

SEQ ID NO: 1017195 - protein, 8 aa, Mycobacterium
NALPGSIS

SEQ ID NO: 1017196 - protein, 6 aa, Mycobacterium
NALRDN

SEQ ID NO: 1017197 - protein, 6 aa, Mycobacterium
NAMPPT

SEQ ID NO: 1017198 - protein, 12 aa, Mycobacterium
NANAAAYPRPGR

SEQ ID NO: 1017199 - protein, 8 aa, Mycobacterium
NANGKLDG

SEQ ID NO: 1017200 - protein, 30 aa, Mycobacterium
NANIGNGNIGTANIGGGNSGVRNTPITPGI

SEQ ID NO: 1017201 - protein, 7 aa, Mycobacterium
NANPDCT

SEQ ID NO: 1017202 - protein, 6 aa, Mycobacterium
NANWGI

SEQ ID NO: 1017203 - protein, 13 aa, Mycobacterium
NAPAIAAAEGSYE

SEQ ID NO: 1017204 - protein, 12 aa, Mycobacterium
NAPAIAAAESSY

SEQ ID NO: 1017205 - protein, 11 aa, Mycobacterium
NAPAIATAEAQ

SEQ ID NO: 1017206 - protein, 12 aa, Mycobacterium
NAPAISATEGTY

SEQ ID NO: 1017207 - protein, 5 aa, Mycobacterium
NAPAQ

SEQ ID NO: 1017208 - protein, 6 aa, Mycobacterium
NAPAQT

SEQ ID NO: 1017209 - protein, 8 aa, Mycobacterium
NAPASTSA

SEQ ID NO: 1017210 - protein, 9 aa, Mycobacterium
NAPASTSPL

SEQ ID NO: 1017211 - protein, 5 aa, Mycobacterium
NAPAT

SEQ ID NO: 1017212 - protein, 5 aa, Mycobacterium
NAPAV

SEQ ID NO: 1017213 - protein, 9 aa, Mycobacterium
NAPEADTAA

SEQ ID NO: 1017214 - protein, 8 aa, Mycobacterium
NAPGGGAD

SEQ ID NO: 1017215 - protein, 10 aa, Mycobacterium
NAPGGGGQGD

SEQ ID NO: 1017216 - protein, 9 aa, Mycobacterium
NAPGTPTTD

SEQ ID NO: 1017217 - protein, 7 aa, Mycobacterium
NAPPPAW

SEQ ID NO: 1017218 - protein, 6 aa, Mycobacterium
NAPPPI

SEQ ID NO: 1017219 - protein, 7 aa, Mycobacterium
NAPQPGL

SEQ ID NO: 1017220 - protein, 7 aa, Mycobacterium
NAPSFEP

SEQ ID NO: 1017221 - protein, 7 aa, Mycobacterium
NAPSQAL

SEQ ID NO: 1017222 - protein, 10 aa, Mycobacterium
NAPSQALTGR

SEQ ID NO: 1017223 - protein, 4 aa, Mycobacterium
NAPT

SEQ ID NO: 1017224 - protein, 6 aa, Mycobacterium
NAPTQA

SEQ ID NO: 1017225 - protein, 6 aa, Mycobacterium
NAPTQT

SEQ ID NO: 1017226 - protein, 9 aa, Mycobacterium
NAPTSTSPI

SEQ ID NO: 1017227 - protein, 5 aa, Mycobacterium
NAPWD

SEQ ID NO: 1017228 - protein, 7 aa, Mycobacterium
NAQADRP

SEQ ID NO: 1017229 - protein, 9 aa, Mycobacterium
NAQGRGIGE

SEQ ID NO: 1017230 - protein, 10 aa, Mycobacterium
NAQGYPGRQE

SEQ ID NO: 1017231 - protein, 6 aa, Mycobacterium
NAQLEN

SEQ ID NO: 1017232 - protein, 15 aa, Mycobacterium
NAQPIAEGDPANPSH

SEQ ID NO: 1017233 - protein, 26 aa, Mycobacterium
NAQPYDSDGAPVANRIQPGKRPRSSM

SEQ ID NO: 1017234 - protein, 11 aa, Mycobacterium
NARAEPSPDDR

SEQ ID NO: 1017235 - protein, 7 aa, Mycobacterium
NARAGLA

SEQ ID NO: 1017236 - protein, 7 aa, Mycobacterium
NARDRTM

SEQ ID NO: 1017237 - protein, 5 aa, Mycobacterium
NARKR

SEQ ID NO: 1017238 - protein, 20 aa, Mycobacterium
NARQGLAGEPGSAASAFSSV

SEQ ID NO: 1017239 - protein, 6 aa, Mycobacterium
NARQPN

SEQ ID NO: 1017240 - protein, 12 aa, Mycobacterium
NARRACATSRTS

SEQ ID NO: 1017241 - protein, 12 aa, Mycobacterium
NARRNPNAQTRG

SEQ ID NO: 1017242 - protein, 6 aa, Mycobacterium
NARRRQ

SEQ ID NO: 1017243 - protein, 4 aa, Mycobacterium
NARS

SEQ ID NO: 1017244 - protein, 11 aa, Mycobacterium
NARVTGAADPL

SEQ ID NO: 1017245 - protein, 4 aa, Mycobacterium
NASA

SEQ ID NO: 1017246 - protein, 10 aa, Mycobacterium
NASDDTDYGK

SEQ ID NO: 1017247 - protein, 8 aa, Mycobacterium
NASDTHPL

SEQ ID NO: 1017248 - protein, 7 aa, Mycobacterium
NASGYGN

SEQ ID NO: 1017249 - protein, 4 aa, Mycobacterium
NASP

SEQ ID NO: 1017250 - protein, 5 aa, Mycobacterium
NASPV

SEQ ID NO: 1017251 - protein, 6 aa, Mycobacterium
NASRAA

SEQ ID NO: 1017252 - protein, 8 aa, Mycobacterium
NASRSAGE

SEQ ID NO: 1017253 - protein, 5 aa, Mycobacterium
NASTA

SEQ ID NO: 1017254 - protein, 6 aa, Mycobacterium
NATAGY

SEQ ID NO: 1017255 - protein, 12 aa, Mycobacterium
NATDGAEGTREF

SEQ ID NO: 1017256 - protein, 4 aa, Mycobacterium
NATE

SEQ ID NO: 1017257 - protein, 8 aa, Mycobacterium
NATEPVPG

SEQ ID NO: 1017258 - protein, 6 aa, Mycobacterium
NATFQS

SEQ ID NO: 1017259 - protein, 4 aa, Mycobacterium
NATG

SEQ ID NO: 1017260 - protein, 6 aa, Mycobacterium
NATGHP

SEQ ID NO: 1017261 - protein, 8 aa, Mycobacterium
NATGPENL

SEQ ID NO: 1017262 - protein, 16 aa, Mycobacterium
NATGPGAGIAGQTAQT

SEQ ID NO: 1017263 - protein, 7 aa, Mycobacterium
NATRELS

SEQ ID NO: 1017264 - protein, 6 aa, Mycobacterium
NATTIE

SEQ ID NO: 1017265 - protein, 10 aa, Mycobacterium
NAVKHDGDTE

SEQ ID NO: 1017266 - protein, 12 aa, Mycobacterium
NAVPNDPRPPMV

SEQ ID NO: 1017267 - protein, 12 aa, Mycobacterium
NAVQAGSLNRPG

SEQ ID NO: 1017268 - protein, 5 aa, Mycobacterium
NAVYP

SEQ ID NO: 1017269 - protein, 13 aa, Mycobacterium
NAYSRSARAGDPE

SEQ ID NO: 1017270 - protein, 7 aa, Mycobacterium
NCDPAKF

SEQ ID NO: 1017271 - protein, 6 aa, Mycobacterium
NCDPDE

SEQ ID NO: 1017272 - protein, 8 aa, Mycobacterium
NCDSAEDA

SEQ ID NO: 1017273 - protein, 4 aa, Mycobacterium
NCSL

SEQ ID NO: 1017274 - protein, 7 aa, Mycobacterium
NCSTGST

SEQ ID NO: 1017275 - protein, 13 aa, Mycobacterium
NDAAPSPADASAA

SEQ ID NO: 1017276 - protein, 8 aa, Mycobacterium
NDAATDQQ

SEQ ID NO: 1017277 - protein, 10 aa, Mycobacterium
NDAEHTEENV

SEQ ID NO: 1017278 - protein, 5 aa, Mycobacterium
NDAGA

SEQ ID NO: 1017279 - protein, 18 aa, Mycobacterium
NDAGVDGVGGAGGAGGAA

SEQ ID NO: 1017280 - protein, 7 aa, Mycobacterium
NDAKEGA

SEQ ID NO: 1017281 - protein, 5 aa, Mycobacterium
NDAQS

SEQ ID NO: 1017282 - protein, 13 aa, Mycobacterium
NDATALSTGDTVD

SEQ ID NO: 1017283 - protein, 7 aa, Mycobacterium
NDAVPQL

SEQ ID NO: 1017284 - protein, 17 aa, Mycobacterium
NDAVTYPQDGPDQMAAE

SEQ ID NO: 1017285 - protein, 5 aa, Mycobacterium
NDDEQ

SEQ ID NO: 1017286 - protein, 11 aa, Mycobacterium
NDDGSIEQPWP

SEQ ID NO: 1017287 - protein, 6 aa, Mycobacterium
NDDGTF

SEQ ID NO: 1017288 - protein, 5 aa, Mycobacterium
NDDLD

SEQ ID NO: 1017289 - protein, 4 aa, Mycobacterium
NDDP

SEQ ID NO: 1017290 - protein, 6 aa, Mycobacterium
NDDPSE

SEQ ID NO: 1017291 - protein, 6 aa, Mycobacterium
NDDQGI

SEQ ID NO: 1017292 - protein, 8 aa, Mycobacterium
NDDSTIGR

SEQ ID NO: 1017293 - protein, 11 aa, Mycobacterium
NDEAASAQRMS

SEQ ID NO: 1017294 - protein, 4 aa, Mycobacterium
NDED

SEQ ID NO: 1017295 - protein, 6 aa, Mycobacterium
NDEELD

SEQ ID NO: 1017296 - protein, 10 aa, Mycobacterium
NDELFPPQQA

SEQ ID NO: 1017297 - protein, 5 aa, Mycobacterium
NDENT

SEQ ID NO: 1017298 - protein, 35 aa, Mycobacterium
NDEPQRDRANRADRAPKPRGGADSKLRRDQRNPHH

SEQ ID NO: 1017299 - protein, 4 aa, Mycobacterium
NDEV

SEQ ID NO: 1017300 - protein, 7 aa, Mycobacterium
NDEYDNE

SEQ ID NO: 1017301 - protein, 5 aa, Mycobacterium
NDFGQ

SEQ ID NO: 1017302 - protein, 16 aa, Mycobacterium
NDFSPAKVTQLLLWAM

SEQ ID NO: 1017303 - protein, 5 aa, Mycobacterium
NDGAG

SEQ ID NO: 1017304 - protein, 6 aa, Mycobacterium
NDGATI

SEQ ID NO: 1017305 - protein, 9 aa, Mycobacterium
NDGEGLGGT

SEQ ID NO: 1017306 - protein, 6 aa, Mycobacterium
NDGGKA

SEQ ID NO: 1017307 - protein, 14 aa, Mycobacterium
NDGGNSLHGGTAGF

SEQ ID NO: 1017308 - protein, 8 aa, Mycobacterium
NDGGTEKV

SEQ ID NO: 1017309 - protein, 4 aa, Mycobacterium
NDGS

SEQ ID NO: 1017310 - protein, 74 aa, Mycobacterium
NDGSGDAYGGFGGTGGNGGAPGASGGDGGLGGPAVTSSGSAYAGIGGTGGNGASGASGGTGGTGGGGGNGGRGG

SEQ ID NO: 1017311 - protein, 6 aa, Mycobacterium
NDGSLP

SEQ ID NO: 1017312 - protein, 10 aa, Mycobacterium
NDGSSVADYY

SEQ ID NO: 1017313 - protein, 15 aa, Mycobacterium
NDGTPEAVFTDDGSG

SEQ ID NO: 1017314 - protein, 4 aa, Mycobacterium
NDHE

SEQ ID NO: 1017315 - protein, 5 aa, Mycobacterium
NDHGS

SEQ ID NO: 1017316 - protein, 14 aa, Mycobacterium
NDHTAGGLQTNTAP

SEQ ID NO: 1017317 - protein, 5 aa, Mycobacterium
NDIGG

SEQ ID NO: 1017318 - protein, 6 aa, Mycobacterium
NDKCEV

SEQ ID NO: 1017319 - protein, 20 aa, Mycobacterium
NDKHNEANGEDNDDGEGHNR

SEQ ID NO: 1017320 - protein, 9 aa, Mycobacterium
NDKTTATPM

SEQ ID NO: 1017321 - protein, 13 aa, Mycobacterium
NDLARGGDALTDR

SEQ ID NO: 1017322 - protein, 16 aa, Mycobacterium
NDLDSPPHTPPESSTL

SEQ ID NO: 1017323 - protein, 15 aa, Mycobacterium
NDLGGIGSTLAQANA

SEQ ID NO: 1017324 - protein, 4 aa, Mycobacterium
NDMA

SEQ ID NO: 1017325 - protein, 6 aa, Mycobacterium
NDNGGG

SEQ ID NO: 1017326 - protein, 10 aa, Mycobacterium
NDNNGKVTGY

SEQ ID NO: 1017327 - protein, 4 aa, Mycobacterium
NDNR

SEQ ID NO: 1017328 - protein, 6 aa, Mycobacterium
NDNRKD

SEQ ID NO: 1017329 - protein, 16 aa, Mycobacterium
NDNTAAEATASGVGGN

SEQ ID NO: 1017330 - protein, 8 aa, Mycobacterium
NDNTTPTI

SEQ ID NO: 1017331 - protein, 6 aa, Mycobacterium
NDPAEL

SEQ ID NO: 1017332 - protein, 6 aa, Mycobacterium
NDPAER

SEQ ID NO: 1017333 - protein, 6 aa, Mycobacterium
NDPAET

SEQ ID NO: 1017334 - protein, 5 aa, Mycobacterium
NDPAG

SEQ ID NO: 1017335 - protein, 6 aa, Mycobacterium
NDPASA

SEQ ID NO: 1017336 - protein, 7 aa, Mycobacterium
NDPDAAR

SEQ ID NO: 1017337 - protein, 4 aa, Mycobacterium
NDPE

SEQ ID NO: 1017338 - protein, 8 aa, Mycobacterium
NDPEANAA

SEQ ID NO: 1017339 - protein, 9 aa, Mycobacterium
NDPGANAER

SEQ ID NO: 1017340 - protein, 6 aa, Mycobacterium
NDPQFA

SEQ ID NO: 1017341 - protein, 4 aa, Mycobacterium
NDPR

SEQ ID NO: 1017342 - protein, 4 aa, Mycobacterium
NDPV

SEQ ID NO: 1017343 - protein, 4 aa, Mycobacterium
NDQG

SEQ ID NO: 1017344 - protein, 10 aa, Mycobacterium
NDQPGCAQAY

SEQ ID NO: 1017345 - protein, 18 aa, Mycobacterium
NDRAQNIAKAAAAAGSGD

SEQ ID NO: 1017346 - protein, 7 aa, Mycobacterium
NDRDGGD

SEQ ID NO: 1017347 - protein, 10 aa, Mycobacterium
NDRDTADGLR

SEQ ID NO: 1017348 - protein, 7 aa, Mycobacterium
NDRPTGT

SEQ ID NO: 1017349 - protein, 28 aa, Mycobacterium
NDRREEGDLRENGGYHAAREEQGQQEAR

SEQ ID NO: 1017350 - protein, 7 aa, Mycobacterium
NDRRSAI

SEQ ID NO: 1017351 - protein, 6 aa, Mycobacterium
NDSANN

SEQ ID NO: 1017352 - protein, 8 aa, Mycobacterium
NDSFNENR

SEQ ID NO: 1017353 - protein, 8 aa, Mycobacterium
NDSLTPDE

SEQ ID NO: 1017354 - protein, 8 aa, Mycobacterium
NDSPYGLS

SEQ ID NO: 1017355 - protein, 7 aa, Mycobacterium
NDSSGFF

SEQ ID NO: 1017356 - protein, 9 aa, Mycobacterium
NDTDDPVSG

SEQ ID NO: 1017357 - protein, 7 aa, Mycobacterium
NDTDRDA

SEQ ID NO: 1017358 - protein, 5 aa, Mycobacterium
NDTEY

SEQ ID NO: 1017359 - protein, 6 aa, Mycobacterium
NDTGGV

SEQ ID NO: 1017360 - protein, 6 aa, Mycobacterium
NDTRIS

SEQ ID NO: 1017361 - protein, 13 aa, Mycobacterium
NDTSTPTQRTPAI

SEQ ID NO: 1017362 - protein, 5 aa, Mycobacterium
NDTTL

SEQ ID NO: 1017363 - protein, 6 aa, Mycobacterium
NDTVAT

SEQ ID NO: 1017364 - protein, 6 aa, Mycobacterium
NDVQRE

SEQ ID NO: 1017365 - protein, 8 aa, Mycobacterium
NDVRASGA

SEQ ID NO: 1017366 - protein, 13 aa, Mycobacterium
NDYADRKNNRQAV

SEQ ID NO: 1017367 - protein, 4 aa, Mycobacterium
NDYD

SEQ ID NO: 1017368 - protein, 4 aa, Mycobacterium
NDYT

SEQ ID NO: 1017369 - protein, 11 aa, Mycobacterium
NDYVGKGLSGG

SEQ ID NO: 1017370 - protein, 8 aa, Mycobacterium
NEAATEDA

SEQ ID NO: 1017371 - protein, 5 aa, Mycobacterium
NEAED

SEQ ID NO: 1017372 - protein, 9 aa, Mycobacterium
NEAETTTAS

SEQ ID NO: 1017373 - protein, 20 aa, Mycobacterium
NEAGSVGSFTAAGTSYATHN

SEQ ID NO: 1017374 - protein, 9 aa, Mycobacterium
NEANEKDIE

SEQ ID NO: 1017375 - protein, 9 aa, Mycobacterium
NEANTQPLA

SEQ ID NO: 1017376 - protein, 6 aa, Mycobacterium
NEASTN

SEQ ID NO: 1017377 - protein, 14 aa, Mycobacterium
NEDAKRKAAAQLEQ

SEQ ID NO: 1017378 - protein, 8 aa, Mycobacterium
NEDGDRAT

SEQ ID NO: 1017379 - protein, 5 aa, Mycobacterium
NEDGR

SEQ ID NO: 1017380 - protein, 9 aa, Mycobacterium
NEDGSNITK

SEQ ID NO: 1017381 - protein, 14 aa, Mycobacterium
NEDQPPGSRDIPDN

SEQ ID NO: 1017382 - protein, 10 aa, Mycobacterium
NEDQSEDTLK

SEQ ID NO: 1017383 - protein, 6 aa, Mycobacterium
NEDVTT

SEQ ID NO: 1017384 - protein, 5 aa, Mycobacterium
NEEEK

SEQ ID NO: 1017385 - protein, 10 aa, Mycobacterium
NEENASGGRV

SEQ ID NO: 1017386 - protein, 7 aa, Mycobacterium
NEEQKSK

SEQ ID NO: 1017387 - protein, 12 aa, Mycobacterium
NEGFSGGEKKRH

SEQ ID NO: 1017388 - protein, 6 aa, Mycobacterium
NEGGLH

SEQ ID NO: 1017389 - protein, 10 aa, Mycobacterium
NEGGPRKVSP

SEQ ID NO: 1017390 - protein, 6 aa, Mycobacterium
NEGLTI

SEQ ID NO: 1017391 - protein, 11 aa, Mycobacterium
NEGSDSTHSPE

SEQ ID NO: 1017392 - protein, 9 aa, Mycobacterium
NEGSVPGGY

SEQ ID NO: 1017393 - protein, 7 aa, Mycobacterium
NEGTEGA

SEQ ID NO: 1017394 - protein, 11 aa, Mycobacterium
NEGTEPQRRPH

SEQ ID NO: 1017395 - protein, 7 aa, Mycobacterium
NEGVPGD

SEQ ID NO: 1017396 - protein, 6 aa, Mycobacterium
NEHDEA

SEQ ID NO: 1017397 - protein, 5 aa, Mycobacterium
NEHER

SEQ ID NO: 1017398 - protein, 14 aa, Mycobacterium
NEHREGASESEGLA

SEQ ID NO: 1017399 - protein, 4 aa, Mycobacterium
NEIT

SEQ ID NO: 1017400 - protein, 9 aa, Mycobacterium
NEKAPKDRD

SEQ ID NO: 1017401 - protein, 20 aa, Mycobacterium
NEKHNSANGEDNRDGERHNR

SEQ ID NO: 1017402 - protein, 8 aa, Mycobacterium
NEKSQLQN

SEQ ID NO: 1017403 - protein, 14 aa, Mycobacterium
NELNAGYAADGYGR

SEQ ID NO: 1017404 - protein, 10 aa, Mycobacterium
NELQGSQSRI

SEQ ID NO: 1017405 - protein, 8 aa, Mycobacterium
NEMSEGVQ

SEQ ID NO: 1017406 - protein, 5 aa, Mycobacterium
NEPAP

SEQ ID NO: 1017407 - protein, 8 aa, Mycobacterium
NEPAPGAW

SEQ ID NO: 1017408 - protein, 7 aa, Mycobacterium
NEPERDQ

SEQ ID NO: 1017409 - protein, 16 aa, Mycobacterium
NEPGESAASGTHEFPS

SEQ ID NO: 1017410 - protein, 5 aa, Mycobacterium
NEPGF

SEQ ID NO: 1017411 - protein, 5 aa, Mycobacterium
NEPGL

SEQ ID NO: 1017412 - protein, 5 aa, Mycobacterium
NEPGV

SEQ ID NO: 1017413 - protein, 9 aa, Mycobacterium
NEQATDEAF

SEQ ID NO: 1017414 - protein, 15 aa, Mycobacterium
NEQLQKSPANKSAYA

SEQ ID NO: 1017415 - protein, 6 aa, Mycobacterium
NEQSVR

SEQ ID NO: 1017416 - protein, 7 aa, Mycobacterium
NEQTHQP

SEQ ID NO: 1017417 - protein, 13 aa, Mycobacterium
NERATLEEAQENK

SEQ ID NO: 1017418 - protein, 4 aa, Mycobacterium
NERC

SEQ ID NO: 1017419 - protein, 7 aa, Mycobacterium
NERDAVP

SEQ ID NO: 1017420 - protein, 4 aa, Mycobacterium
NERE

SEQ ID NO: 1017421 - protein, 6 aa, Mycobacterium
NERGFS

SEQ ID NO: 1017422 - protein, 7 aa, Mycobacterium
NERSQLQ

SEQ ID NO: 1017423 - protein, 6 aa, Mycobacterium
NESDTA

SEQ ID NO: 1017424 - protein, 6 aa, Mycobacterium
NETDDI

SEQ ID NO: 1017425 - protein, 20 aa, Mycobacterium
NETGGNGQAAVTAETSEEDL

SEQ ID NO: 1017426 - protein, 5 aa, Mycobacterium
NETGL

SEQ ID NO: 1017427 - protein, 5 aa, Mycobacterium
NETQI

SEQ ID NO: 1017428 - protein, 8 aa, Mycobacterium
NETRTGDR

SEQ ID NO: 1017429 - protein, 8 aa, Mycobacterium
NETTRNTI

SEQ ID NO: 1017430 - protein, 6 aa, Mycobacterium
NETTTK

SEQ ID NO: 1017431 - protein, 11 aa, Mycobacterium
NEVPGATDRDR

SEQ ID NO: 1017432 - protein, 20 aa, Mycobacterium
NEVTAPNSEDGVAKVLERWW

SEQ ID NO: 1017433 - protein, 7 aa, Mycobacterium
NFDNDEA

SEQ ID NO: 1017434 - protein, 10 aa, Mycobacterium
NFDPTRRSGR

SEQ ID NO: 1017435 - protein, 9 aa, Mycobacterium
NFDSAEGSM

SEQ ID NO: 1017436 - protein, 5 aa, Mycobacterium
NFEAG

SEQ ID NO: 1017437 - protein, 6 aa, Mycobacterium
NFETPS

SEQ ID NO: 1017438 - protein, 8 aa, Mycobacterium
NFGGGRTK

SEQ ID NO: 1017439 - protein, 10 aa, Mycobacterium
NFKTRGGLTT

SEQ ID NO: 1017440 - protein, 12 aa, Mycobacterium
NFPDEDSRSPMD

SEQ ID NO: 1017441 - protein, 16 aa, Mycobacterium
NFPSATAPQGVSTPNG

SEQ ID NO: 1017442 - protein, 6 aa, Mycobacterium
NFSGRA

SEQ ID NO: 1017443 - protein, 36 aa, Mycobacterium
NGAAGGAGGGGGTGGAGGHGGGGGTDGGGGDGAMGG

SEQ ID NO: 1017444 - protein, 12 aa, Mycobacterium
NGAAGGVGGAGG

SEQ ID NO: 1017445 - protein, 11 aa, Mycobacterium
NGAAPGGGHGG

SEQ ID NO: 1017446 - protein, 13 aa, Mycobacterium
NGAAPIPHNNDSV

SEQ ID NO: 1017447 - protein, 14 aa, Mycobacterium
NGADGAAGTGQAGA

SEQ ID NO: 1017448 - protein, 15 aa, Mycobacterium
NGADGALGQAGGDGG

SEQ ID NO: 1017449 - protein, 14 aa, Mycobacterium
NGADGAPGADGQAG

SEQ ID NO: 1017450 - protein, 14 aa, Mycobacterium
NGADGAPGQAGADG

SEQ ID NO: 1017451 - protein, 17 aa, Mycobacterium
NGADGAPGSGANGADGG

SEQ ID NO: 1017452 - protein, 16 aa, Mycobacterium
NGADGAPGTGQTGQAG

SEQ ID NO: 1017453 - protein, 15 aa, Mycobacterium
NGADGTAANPNGGAG

SEQ ID NO: 1017454 - protein, 16 aa, Mycobacterium
NGADGTAANPNGGAGG

SEQ ID NO: 1017455 - protein, 16 aa, Mycobacterium
NGADGTAPEQAGGDGS

SEQ ID NO: 1017456 - protein, 9 aa, Mycobacterium
NGAGASQDC

SEQ ID NO: 1017457 - protein, 9 aa, Mycobacterium
NGAGKTTTI

SEQ ID NO: 1017458 - protein, 9 aa, Mycobacterium
NGAGSGSGF

SEQ ID NO: 1017459 - protein, 29 aa, Mycobacterium
NGAGSSASGSAIGGYGGMGTGGRGGLGGS

SEQ ID NO: 1017460 - protein, 30 aa, Mycobacterium; identical to SEQ ID NO: 529874

SEQ ID NO: 1017461 - protein, 17 aa, Mycobacterium
NGANAAPGSGANGGDGG

SEQ ID NO: 1017462 - protein, 16 aa, Mycobacterium
NGANATTLGGNGGDGG

SEQ ID NO: 1017463 - protein, 17 aa, Mycobacterium
NGANATTPGGAGGDGGL

SEQ ID NO: 1017464 - protein, 17 aa, Mycobacterium
NGANGAAGTGAADGDGG

SEQ ID NO: 1017465 - protein, 17 aa, Mycobacterium
NGANGAAGTGASGGDGG

SEQ ID NO: 1017466 - protein, 17 aa, Mycobacterium
NGANGADGTGAAGGDGG

SEQ ID NO: 1017467 - protein, 16 aa, Mycobacterium
NGANGADGTGQNGADG

SEQ ID NO: 1017468 - protein, 16 aa, Mycobacterium
NGANGAPGTGANGGAG

SEQ ID NO: 1017469 - protein, 16 aa, Mycobacterium
NGANGTAANPNGGDGG

SEQ ID NO: 1017470 - protein, 17 aa, Mycobacterium
NGANGTPGLGTDGAPGG

SEQ ID NO: 1017471 - protein, 17 aa, Mycobacterium
NGANGTPGTGADGAPGG

SEQ ID NO: 1017472 - protein, 19 aa, Mycobacterium
NGANGTTVNGVGTPGGDGG

SEQ ID NO: 1017473 - protein, 19 aa, Mycobacterium
NGANGYTNAQGIGTPGGAG

SEQ ID NO: 1017474 - protein, 9 aa, Mycobacterium
NGAPATTVT

SEQ ID NO: 1017475 - protein, 17 aa, Mycobacterium
NGAPGVAGVNGGAGEAG

SEQ ID NO: 1017476 - protein, 9 aa, Mycobacterium
NGARDPLRL

SEQ ID NO: 1017477 - protein, 8 aa, Mycobacterium
NGAREGLA

SEQ ID NO: 1017478 - protein, 7 aa, Mycobacterium
NGARRSY

SEQ ID NO: 1017479 - protein, 9 aa, Mycobacterium
NGASAEGTI

SEQ ID NO: 1017480 - protein, 4 aa, Mycobacterium
NGAT

SEQ ID NO: 1017481 - protein, 40 aa, Mycobacterium; identical to SEQ ID NO: 529946

SEQ ID NO: 1017482 - protein, 10 aa, Mycobacterium
NGAVSAPTPI

SEQ ID NO: 1017483 - protein, 10 aa, Mycobacterium
NGAYKPDPEA

SEQ ID NO: 1017484 - protein, 8 aa, Mycobacterium
NGAYNQDQ

SEQ ID NO: 1017485 - protein, 12 aa, Mycobacterium
NGDAPDQGWDSV

SEQ ID NO: 1017486 - protein, 5 aa, Mycobacterium
NGDEV

SEQ ID NO: 1017487 - protein, 5 aa, Mycobacterium
NGDGA

SEQ ID NO: 1017488 - protein, 13 aa, Mycobacterium
NGDGTDTGLPAEE

SEQ ID NO: 1017489 - protein, 12 aa, Mycobacterium
NGDIPQGQRERT

SEQ ID NO: 1017490 - protein, 8 aa, Mycobacterium
NGDQSDSE

SEQ ID NO: 1017491 - protein, 5 aa, Mycobacterium
NGDTG

SEQ ID NO: 1017492 - protein, 5 aa, Mycobacterium
NGDVD

SEQ ID NO: 1017493 - protein, 8 aa, Mycobacterium
NGDYVDPE

SEQ ID NO: 1017494 - protein, 5 aa, Mycobacterium
NGEGE

SEQ ID NO: 1017495 - protein, 11 aa, Mycobacterium
NGENDGTGADV

SEQ ID NO: 1017496 - protein, 8 aa, Mycobacterium
NGEPCRPP

SEQ ID NO: 1017497 - protein, 24 aa, Mycobacterium
NGEPNTDGDAGTGTTLTSPLTPQQ

SEQ ID NO: 1017498 - protein, 9 aa, Mycobacterium
NGEPYSKTH

SEQ ID NO: 1017499 - protein, 5 aa, Mycobacterium
NGERN

SEQ ID NO: 1017500 - protein, 10 aa, Mycobacterium
NGESIEDHRS

SEQ ID NO: 1017501 - protein, 12 aa, Mycobacterium
NGFNKTDTQDRV

SEQ ID NO: 1017502 - protein, 4 aa, Mycobacterium
NGFS

SEQ ID NO: 1017503 - protein, 6 aa, Mycobacterium
NGFSEK

SEQ ID NO: 1017504 - protein, 49 aa, Mycobacterium
NGGAANVGVGNGGGGNLGFGNSGTENTGSFNSGGDNGRNGGNTGSFNSG

SEQ ID NO: 1017505 - protein, 53 aa, Mycobacterium
NGGAGFNNGATAGAAGGNGGNAGLIGNGGAGGNGGAGGNGGAGAAGGTGDNGG

SEQ ID NO: 1017506 - protein, 27 aa, Mycobacterium
NGGAGGAAGVSLSGAPGTGGNGGSAQF

SEQ ID NO: 1017507 - protein, 28 aa, Mycobacterium
NGGAGGAGAAGLSGVTGGIGGNGGNGAQ

SEQ ID NO: 1017508 - protein, 15 aa, Mycobacterium
NGGAGGAGGASAIPL

SEQ ID NO: 1017509 - protein, 12 aa, Mycobacterium
NGGAGGAGGESF

SEQ ID NO: 1017510 - protein, 31 aa, Mycobacterium; identical to SEQ ID NO: 530110

SEQ ID NO: 1017511 - protein, 27 aa, Mycobacterium
NGGAGGAGGTGGDGGGTGGAGGAAGNG

SEQ ID NO: 1017512 - protein, 11 aa, Mycobacterium
NGGAGGAGGVG

SEQ ID NO: 1017513 - protein, 22 aa, Mycobacterium
NGGAGGARRAGGTGGAGGVAGS

SEQ ID NO: 1017514 - protein, 41 aa, Mycobacterium
NGGAGGDGGAGGEGGDSSGGAASAGGDGGAGGAGGAGANGG

SEQ ID NO: 1017515 - protein, 22 aa, Mycobacterium
NGGAGGDGGAGGQGAGGAGGSG

SEQ ID NO: 1017516 - protein, 18 aa, Mycobacterium
NGGAGGDGGATGTPGTTA

SEQ ID NO: 1017517 - protein, 24 aa, Mycobacterium
NGGAGGDGGIGTTGGGHAGAGGGA

SEQ ID NO: 1017518 - protein, 21 aa, Mycobacterium
NGGAGGGAPWGGADGGAGGDA

SEQ ID NO: 1017519 - protein, 22 aa, Mycobacterium
NGGAGGGGTAAHPAGGNGGAAG

SEQ ID NO: 1017520 - protein, 76 aa, Mycobacterium
NGGAGGIGGAGGVVGSSEGGVDGGVGGSGGSGGATGLLGNSGAGGTGGQGGGGGRGFDGSLGAGGAEGTGAVGGSG

SEQ ID NO: 1017521 - protein, 43 aa, Mycobacterium
NGGAGGIGGDGTGNGFGSLSGGGNGGAGAPGLSGLGGAGGRGG

SEQ ID NO: 1017522 - protein, 31 aa, Mycobacterium; identical to SEQ ID NO: 530128

SEQ ID NO: 1017523 - protein, 36 aa, Mycobacterium
NGGAGGIGGTRGSGGAGAPGGIGGGGGGGGNGTATN

SEQ ID NO: 1017524 - protein, 29 aa, Mycobacterium
NGGAGGLGGAAAGDYTAGGVGGAGGNAGL

SEQ ID NO: 1017525 - protein, 24 aa, Mycobacterium
NGGAGGMGGTGGSNANGGVGGQAG

SEQ ID NO: 1017526 - protein, 33 aa, Mycobacterium; identical to SEQ ID NO: 530133

SEQ ID NO: 1017527 - protein, 15 aa, Mycobacterium
NGGAGGNGATGGTGF

SEQ ID NO: 1017528 - protein, 11 aa, Mycobacterium
NGGAGGNGGDA

SEQ ID NO: 1017529 - protein, 21 aa, Mycobacterium
NGGAGGNGGLSGNGAAGRTGG

SEQ ID NO: 1017530 - protein, 19 aa, Mycobacterium
NGGAGGNGGQGGDAGANGF

SEQ ID NO: 1017531 - protein, 28 aa, Mycobacterium
NGGAGGPGGAGGNAGLIGNGGAGGSGAA

SEQ ID NO: 1017532 - protein, 15 aa, Mycobacterium
NGGAGGQGGAGAAAV

SEQ ID NO: 1017533 - protein, 21 aa, Mycobacterium
NGGAGGSEAPGQSGGNGGAAG

SEQ ID NO: 1017534 - protein, 44 aa, Mycobacterium
NGGAGGSGAAGGNGGAGGAAGLVGNGGAGGAGGNNAAGGSGGAG

SEQ ID NO: 1017535 - protein, 46 aa, Mycobacterium
NGGAGGSGAAGQAGGAGGAGGAAGLIGSGGAGGIGGTGAAGGKGGN

SEQ ID NO: 1017536 - protein, 22 aa, Mycobacterium
NGGAGGSGAPGLNGGAGGAAGL

SEQ ID NO: 1017537 - protein, 23 aa, Mycobacterium
NGGAGGSGATGLTGGAGGNGGAA

SEQ ID NO: 1017538 - protein, 27 aa, Mycobacterium
NGGAGGSGAVNGLGTGQAGGNGGAAGL

SEQ ID NO: 1017539 - protein, 32 aa, Mycobacterium
NGGAGGSGGKGGNGGSAIETGNDGAAGAGGHG

SEQ ID NO: 1017540 - protein, 14 aa, Mycobacterium
NGGAGGSGGNGGIG

SEQ ID NO: 1017541 - protein, 25 aa, Mycobacterium
NGGAGGSGGSTAGVHPAGDGGNSGM

SEQ ID NO: 1017542 - protein, 26 aa, Mycobacterium
NGGAGGSGTPGTASVAGGNGGNGGAG

SEQ ID NO: 1017543 - protein, 27 aa, Mycobacterium
NGGAGGSGTPPGLGSAGGTGGTGGAAG

SEQ ID NO: 1017544 - protein, 26 aa, Mycobacterium
NGGAGGTGADGFSTALGSDGGNGGTG

SEQ ID NO: 1017545 - protein, 16 aa, Mycobacterium
NGGAGGTGGFRPRRCR

SEQ ID NO: 1017546 - protein, 29 aa, Mycobacterium
NGGAGGTGYSPTTGSGAVGGDGGAGGTGG

SEQ ID NO: 1017547 - protein, 9 aa, Mycobacterium
NGGAGGVGV

SEQ ID NO: 1017548 - protein, 25 aa, Mycobacterium
NGGAGYSYTSGATAEAGGNGGAAGL

SEQ ID NO: 1017549 - protein, 6 aa, Mycobacterium
NGGAVS

SEQ ID NO: 1017550 - protein, 8 aa, Mycobacterium
NGGDERYP

SEQ ID NO: 1017551 - protein, 54 aa, Mycobacterium
NGGDGADGGNSLASLAGAGGAAGNAGLLGSGGTGGAGGQSFSGTGGKGGDGGSA

SEQ ID NO: 1017552 - protein, 71 aa, Mycobacterium
NGGDGGAGGDDGVGGTGGIGGAGGNGGVGGDGSSSGTGAGGSGGDATDGGTGGDGGSGGGFGTGGAGGTGG

SEQ ID NO: 1017553 - protein, 29 aa, Mycobacterium
NGGDGGDGGAGGTGGSAGTGGAGGNGGNA

SEQ ID NO: 1017554 - protein, 21 aa, Mycobacterium
NGGDGGDGTGGAAGGAGGSGG

SEQ ID NO: 1017555 - protein, 25 aa, Mycobacterium
NGGDGGQGGNGINGTGANGGAGGDA

SEQ ID NO: 1017556 - protein, 51 aa, Mycobacterium
NGGDGGSGAAGQVGGNGGNAGMIGTGGAGGQGGSGVSTTSAQAGGRGGSGG

SEQ ID NO: 1017557 - protein, 22 aa, Mycobacterium
NGGDGGSGASGQIGGTGGSAGL

SEQ ID NO: 1017558 - protein, 19 aa, Mycobacterium
NGGDGGTGGGTGTDGLGGT

SEQ ID NO: 1017559 - protein, 39 aa, Mycobacterium
NGGGGAGGQGGDGGHGGSPVGFDGKSGVGGDGGDGGNAR

SEQ ID NO: 1017560 - protein, 28 aa, Mycobacterium
NGGGGDGGLSVGPHSGRGAGGGGGGGGS

SEQ ID NO: 1017561 - protein, 68 aa, Mycobacterium
NGGGGGAGGIGGGGGTGAVGGTGGAGGAGGDSEFAGGNGNTGGDGGTGGTGGAGGDGGNGGAGGAGGL

SEQ ID NO: 1017562 - protein, 13 aa, Mycobacterium
NGGGGGDAGANNK

SEQ ID NO: 1017563 - protein, 51 aa, Mycobacterium
NGGHGGTGATGGSGRHSGASGDGGDGGDAQAIGDGGAGGSGGLLFGAPGAH

SEQ ID NO: 1017564 - protein, 22 aa, Mycobacterium
NGGIGGDGGVAANGGAGGQGGL

SEQ ID NO: 1017565 - protein, 6 aa, Mycobacterium
NGGKSS

SEQ ID NO: 1017566 - protein, 7 aa, Mycobacterium
NGGMTPK

SEQ ID NO: 1017567 - protein, 24 aa, Mycobacterium
NGGNAGTGGAGPSNGGNGVGGTGG

SEQ ID NO: 1017568 - protein, 22 aa, Mycobacterium
NGGNAGTGGTGLSTGSTGAGGI

SEQ ID NO: 1017569 - protein, 23 aa, Mycobacterium
NGGNAGVGGTGPAAGATGVGGTS

SEQ ID NO: 1017570 - protein, 32 aa, Mycobacterium
NGGNGAADGGGAGSAAGAGGNAGLIGNGGHGG

SEQ ID NO: 1017571 - protein, 45 aa, Mycobacterium
NGGNGAAGDFGQAGGGGGSAGLFGDGGNGGTGGAGSAGGNGGTGG

SEQ ID NO: 1017572 - protein, 24 aa, Mycobacterium
NGGNGANGGNTGAPGTLSGGGTGT

SEQ ID NO: 1017573 - protein, 33 aa, Mycobacterium
NGGNGAPGTNQGVAGGNGGSAGLIGNGGAGGHG

SEQ ID NO: 1017574 - protein, 22 aa, Mycobacterium
NGGNGAPSAVGQAGGAGGAAGL

SEQ ID NO: 1017575 - protein, 47 aa, Mycobacterium
NGGNGFAQTGNNNVAGGDGGNAGLIGNGGAGGGGGTAFAGGKGGHGG

SEQ ID NO: 1017576 - protein, 23 aa, Mycobacterium
NGGNGFSQTTAGVAGGAGGAAGL

SEQ ID NO: 1017577 - protein, 9 aa, Mycobacterium
NGGNGGAAA

SEQ ID NO: 1017578 - protein, 44 aa, Mycobacterium
NGGNGGAGAAGQAGGRGGDAGLIGSGGAGGAGGTGGAGGAGGHG

SEQ ID NO: 1017579 - protein, 24 aa, Mycobacterium
NGGNGGAGAGSDQGGTGGTGGTGG

SEQ ID NO: 1017580 - protein, 33 aa, Mycobacterium
NGGNGGAGGTGLPEGTGGTGGTGGLLFGTPGMH

SEQ ID NO: 1017581 - protein, 22 aa, Mycobacterium
NGGNGGCGAPGGNGGAGGSAGL

SEQ ID NO: 1017582 - protein, 10 aa, Mycobacterium
NGGNGGIGGA

SEQ ID NO: 1017583 - protein, 12 aa, Mycobacterium
NGGNGGMGGTAT

SEQ ID NO: 1017584 - protein, 22 aa, Mycobacterium
NGGNGGNAGSGGVGPGIAGAAG

SEQ ID NO: 1017585 - protein, 27 aa, Mycobacterium
NGGNGGNGGAVGTGGTPGGGGNGGTGG

SEQ ID NO: 1017586 - protein, 17 aa, Mycobacterium
NGGNGGNTGNGGTFQAS

SEQ ID NO: 1017587 - protein, 45 aa, Mycobacterium
NGGNGGSGAAGQAGGAGGAAGLIGTGGAGGMGGAGGGAGGMGGSG

SEQ ID NO: 1017588 - protein, 56 aa, Mycobacterium; identical to SEQ ID NO: 530272

SEQ ID NO: 1017589 - protein, 19 aa, Mycobacterium
NGGNGGSGAAGQTGGDGGV

SEQ ID NO: 1017590 - protein, 21 aa, Mycobacterium
NGGNGGSGAAGQVGGTGGAAG

SEQ ID NO: 1017591 - protein, 22 aa, Mycobacterium
NGGNGGSGAPGQAGGAGGSAGL

SEQ ID NO: 1017592 - protein, 22 aa, Mycobacterium
NGGNGGSGATGQVGGSGGAAGL

SEQ ID NO: 1017593 - protein, 51 aa, Mycobacterium
NGGNGGSGAVGGTGGAGGSAGLFGSGGAGAAGGAGAAGGVGGNGGADGSGG

SEQ ID NO: 1017594 - protein, 22 aa, Mycobacterium
NGGNGGSGGVGQNGGSGGSAGL

SEQ ID NO: 1017595 - protein, 19 aa, Mycobacterium
NGGNGGSGLAGQAGGVGGA

SEQ ID NO: 1017596 - protein, 22 aa, Mycobacterium
NGGNGGTGAAGQAGGNGGAAGL

SEQ ID NO: 1017597 - protein, 55 aa, Mycobacterium
NGGNGGTGGSGAAGGAGAMRGNGGNGGSAGTGTTAGTDGNGGNGGTGGAAGSGGM

SEQ ID NO: 1017598 - protein, 10 aa, Mycobacterium
NGGNGGYDIQ

SEQ ID NO: 1017599 - protein, 58 aa, Mycobacterium
NGGNGWNSTTGGAAGGNGGDAGLLGNGGTGGSGGAAGLVGNGGSGGSGGDGGTGGTAD

SEQ ID NO: 1017600 - protein, 22 aa, Mycobacterium
NGGNGYSETTAGVAGGAGGAAG

SEQ ID NO: 1017601 - protein, 35 aa, Mycobacterium; identical to SEQ ID NO: 530294

SEQ ID NO: 1017602 - protein, 23 aa, Mycobacterium
NGGNGYSSTTAEVAGGNGGAAGL

SEQ ID NO: 1017603 - protein, 17 aa, Mycobacterium
NGGNVGTGTPGAGGSGG

SEQ ID NO: 1017604 - protein, 6 aa, Mycobacterium
NGGPSV

SEQ ID NO: 1017605 - protein, 21 aa, Mycobacterium
NGGRGGDSTLAGVSGGGGGYA

SEQ ID NO: 1017606 - protein, 5 aa, Mycobacterium
NGGRP

SEQ ID NO: 1017607 - protein, 10 aa, Mycobacterium
NGGSAQESVV

SEQ ID NO: 1017608 - protein, 20 aa, Mycobacterium
NGGSGAPGQRGGDGGDAGLL

SEQ ID NO: 1017609 - protein, 10 aa, Mycobacterium
NGGSGGAGGW

SEQ ID NO: 1017610 - protein, 19 aa, Mycobacterium
NGGSGGARGPNAAGGPGGL

SEQ ID NO: 1017611 - protein, 36 aa, Mycobacterium
NGGSGGDGGDGGDGGDGAQGGEGGATGSVGGIGSQG

SEQ ID NO: 1017612 - protein, 39 aa, Mycobacterium; identical to SEQ ID NO: 530319

SEQ ID NO: 1017613 - protein, 23 aa, Mycobacterium
NGGSGGNSTHAGVAGGAGGNAGL

SEQ ID NO: 1017614 - protein, 32 aa, Mycobacterium
NGGSGGQGGTGLAGADGVNTSNGTAGPGAWGN

SEQ ID NO: 1017615 - protein, 22 aa, Mycobacterium
NGGSGGSGAAGQAGGAGGAAGL

SEQ ID NO: 1017616 - protein, 20 aa, Mycobacterium
NGGSGGSGAAGSVGGNGGAA

SEQ ID NO: 1017617 - protein, 10 aa, Mycobacterium
NGGSSGNSLE

SEQ ID NO: 1017618 - protein, 29 aa, Mycobacterium
NGGSTNTGDWNSGSINTGYANSGGTNTGI

SEQ ID NO: 1017619 - protein, 38 aa, Mycobacterium
NGGTAQTGGTGGAGGDLALGGQGGAGGAAGGTGGDTGL

SEQ ID NO: 1017620 - protein, 23 aa, Mycobacterium
NGGTGGAGGAGGTGGVGGQVNAE

SEQ ID NO: 1017621 - protein, 43 aa, Mycobacterium
NGGTGGQGGAGFAGGTGADNVSAGRPRGAGGTGGIGAGGGNAG

SEQ ID NO: 1017622 - protein, 25 aa, Mycobacterium
NGGTGGRGGIGTTGIGGIGGTGGDA

SEQ ID NO: 1017623 - protein, 45 aa, Mycobacterium
NGGTGGSGAPGQNGDAGGNAGLLGSGGTGGVGGAGATGGTGGTGG

SEQ ID NO: 1017624 - protein, 12 aa, Mycobacterium
NGGTGGTGGYNQ

SEQ ID NO: 1017625 - protein, 8 aa, Mycobacterium
NGGTGTVS

SEQ ID NO: 1017626 - protein, 5 aa, Mycobacterium
NGGTM

SEQ ID NO: 1017627 - protein, 20 aa, Mycobacterium
NGGTRADPQRRLSAGTGNVA

SEQ ID NO: 1017628 - protein, 14 aa, Mycobacterium
NGGTYGGVESRNRQ

SEQ ID NO: 1017629 - protein, 5 aa, Mycobacterium
NGGVE

SEQ ID NO: 1017630 - protein, 23 aa, Mycobacterium
NGGVGGAGGQGALSGGAGGAGGG

SEQ ID NO: 1017631 - protein, 67 aa, Mycobacterium
NGGVGGAGGVGAFGSGGTGGNGGAGGAVGNGGAGGDAGSSGNLSPAGDGKGGNAKLVGNGGDGGAGV

SEQ ID NO: 1017632 - protein, 26 aa, Mycobacterium
NGGVGGTGGYGAAAAGGVGGAGGRAG

SEQ ID NO: 1017633 - protein, 21 aa, Mycobacterium
NGGVGGVGGVGAGDGGAGGRA

SEQ ID NO: 1017634 - protein, 6 aa, Mycobacterium
NGGYNT

SEQ ID NO: 1017635 - protein, 5 aa, Mycobacterium
NGHNA

SEQ ID NO: 1017636 - protein, 11 aa, Mycobacterium
NGHNVSTRGRI

SEQ ID NO: 1017637 - protein, 7 aa, Mycobacterium
NGHRAGN

SEQ ID NO: 1017638 - protein, 21 aa, Mycobacterium
NGHRAPLPSAGPGGAERVAGS

SEQ ID NO: 1017639 - protein, 6 aa, Mycobacterium
NGHVES

SEQ ID NO: 1017640 - protein, 4 aa, Mycobacterium
NGIG

SEQ ID NO: 1017641 - protein, 8 aa, Mycobacterium
NGKGQKKL

SEQ ID NO: 1017642 - protein, 9 aa, Mycobacterium
NGKPDSMAD

SEQ ID NO: 1017643 - protein, 7 aa, Mycobacterium
NGKPVRE

SEQ ID NO: 1017644 - protein, 8 aa, Mycobacterium
NGKRPQAY

SEQ ID NO: 1017645 - protein, 15 aa, Mycobacterium
NGLAPAAVDDDGPSV

SEQ ID NO: 1017646 - protein, 21 aa, Mycobacterium
NGLEPSPVSPGLGRDSETGQV

SEQ ID NO: 1017647 - protein, 4 aa, Mycobacterium
NGLH

SEQ ID NO: 1017648 - protein, 11 aa, Mycobacterium
NGLRRGDAVTG

SEQ ID NO: 1017649 - protein, 6 aa, Mycobacterium
NGLSKA

SEQ ID NO: 1017650 - protein, 6 aa, Mycobacterium
NGLTED

SEQ ID NO: 1017651 - protein, 6 aa, Mycobacterium
NGNGQH

SEQ ID NO: 1017652 - protein, 19 aa, Mycobacterium
NGNIGDGNIGSNNAGFGNV

SEQ ID NO: 1017653 - protein, 4 aa, Mycobacterium
NGNK

SEQ ID NO: 1017654 - protein, 5 aa, Mycobacterium
NGNSF

SEQ ID NO: 1017655 - protein, 8 aa, Mycobacterium
NGNTPDQF

SEQ ID NO: 1017656 - protein, 28 aa, Mycobacterium
NGNVGDDNLGSGNLGSENVGSSNIGSGN

SEQ ID NO: 1017657 - protein, 5 aa, Mycobacterium
NGPAV

SEQ ID NO: 1017658 - protein, 4 aa, Mycobacterium
NGPG

SEQ ID NO: 1017659 - protein, 4 aa, Mycobacterium
NGPI

SEQ ID NO: 1017660 - protein, 5 aa, Mycobacterium
NGPIG

SEQ ID NO: 1017661 - protein, 14 aa, Mycobacterium
NGPIKGTSNFGVFR

SEQ ID NO: 1017662 - protein, 5 aa, Mycobacterium
NGPKA

SEQ ID NO: 1017663 - protein, 9 aa, Mycobacterium
NGPSDDPFG

SEQ ID NO: 1017664 - protein, 5 aa, Mycobacterium
NGPTH

SEQ ID NO: 1017665 - protein, 5 aa, Mycobacterium
NGPTQ

SEQ ID NO: 1017666 - protein, 26 aa, Mycobacterium
NGPVADTLSSVPADSPPPVLGVVGVL

SEQ ID NO: 1017667 - protein, 7 aa, Mycobacterium
NGPYPDD

SEQ ID NO: 1017668 - protein, 6 aa, Mycobacterium
NGQAGV

SEQ ID NO: 1017669 - protein, 5 aa, Mycobacterium
NGQGV

SEQ ID NO: 1017670 - protein, 6 aa, Mycobacterium
NGQPAA

SEQ ID NO: 1017671 - protein, 14 aa, Mycobacterium
NGQPGGSGGAGGDA

SEQ ID NO: 1017672 - protein, 8 aa, Mycobacterium
NGRDSAAH

SEQ ID NO: 1017673 - protein, 5 aa, Mycobacterium
NGREA

SEQ ID NO: 1017674 - protein, 13 aa, Mycobacterium
NGRERMTTPVPKR

SEQ ID NO: 1017675 - protein, 9 aa, Mycobacterium
NGRNATSNN

SEQ ID NO: 1017676 - protein, 11 aa, Mycobacterium
NGRPDGDVTPY

SEQ ID NO: 1017677 - protein, 17 aa, Mycobacterium
NGRRGRPVTGPGNRPLK

SEQ ID NO: 1017678 - protein, 4 aa, Mycobacterium
NGRS

SEQ ID NO: 1017679 - protein, 6 aa, Mycobacterium
NGRSAV

SEQ ID NO: 1017680 - protein, 9 aa, Mycobacterium
NGRSYAPTI

SEQ ID NO: 1017681 - protein, 16 aa, Mycobacterium
NGSESGPSRESEPGVT

SEQ ID NO: 1017682 - protein, 16 aa, Mycobacterium
NGSGKPTQRDGAPGVR

SEQ ID NO: 1017683 - protein, 7 aa, Mycobacterium
NGSGVSV

SEQ ID NO: 1017684 - protein, 8 aa, Mycobacterium
NGSIGAGG

SEQ ID NO: 1017685 - protein, 5 aa, Mycobacterium
NGSPA

SEQ ID NO: 1017686 - protein, 5 aa, Mycobacterium
NGSPR

SEQ ID NO: 1017687 - protein, 7 aa, Mycobacterium
NGSPRAL

SEQ ID NO: 1017688 - protein, 8 aa, Mycobacterium
NGSQIPRE

SEQ ID NO: 1017689 - protein, 8 aa, Mycobacterium
NGSQRAAG

SEQ ID NO: 1017690 - protein, 5 aa, Mycobacterium
NGSTE

SEQ ID NO: 1017691 - protein, 15 aa, Mycobacterium
NGSVSLSSQGMLSPT

SEQ ID NO: 1017692 - protein, 9 aa, Mycobacterium
NGSYADYPR

SEQ ID NO: 1017693 - protein, 5 aa, Mycobacterium
NGTAA

SEQ ID NO: 1017694 - protein, 11 aa, Mycobacterium
NGTASREPDAL

SEQ ID NO: 1017695 - protein, 8 aa, Mycobacterium
NGTGTDLE

SEQ ID NO: 1017696 - protein, 7 aa, Mycobacterium
NGTLDHD

SEQ ID NO: 1017697 - protein, 6 aa, Mycobacterium
NGTLLP

SEQ ID NO: 1017698 - protein, 8 aa, Mycobacterium
NGTPPPEV

SEQ ID NO: 1017699 - protein, 7 aa, Mycobacterium
NGTPRTK

SEQ ID NO: 1017700 - protein, 12 aa, Mycobacterium
NGTPSELGGASL

SEQ ID NO: 1017701 - protein, 8 aa, Mycobacterium
NGTQQERD

SEQ ID NO: 1017702 - protein, 17 aa, Mycobacterium
NGTSGALGTGQAGGDGG

SEQ ID NO: 1017703 - protein, 9 aa, Mycobacterium
NGTSPDEAI

SEQ ID NO: 1017704 - protein, 5 aa, Mycobacterium
NGTVS

SEQ ID NO: 1017705 - protein, 6 aa, Mycobacterium
NGVAED

SEQ ID NO: 1017706 - protein, 8 aa, Mycobacterium
NGVASGDA

SEQ ID NO: 1017707 - protein, 10 aa, Mycobacterium
NGVNGGVGSA

SEQ ID NO: 1017708 - protein, 12 aa, Mycobacterium
NGVNRGTGSAVS

SEQ ID NO: 1017709 - protein, 22 aa, Mycobacterium
NGVPTAARPGKLVRGRQPAPVP

SEQ ID NO: 1017710 - protein, 14 aa, Mycobacterium
NGVTPHDKRHRARV

SEQ ID NO: 1017711 - protein, 6 aa, Mycobacterium
NGWEIP

SEQ ID NO: 1017712 - protein, 4 aa, Mycobacterium
NGYG

SEQ ID NO: 1017713 - protein, 8 aa, Mycobacterium
NGYTGDAT

SEQ ID NO: 1017714 - protein, 6 aa, Mycobacterium
NGYTRD

SEQ ID NO: 1017715 - protein, 6 aa, Mycobacterium
NHDERN

SEQ ID NO: 1017716 - protein, 14 aa, Mycobacterium
NHEPESAEQAEQDV

SEQ ID NO: 1017717 - protein, 7 aa, Mycobacterium
NHEPRRN

SEQ ID NO: 1017718 - protein, 11 aa, Mycobacterium
NHGAAANMTGT

SEQ ID NO: 1017719 - protein, 18 aa, Mycobacterium
NHGPSNRKTFKFNHNQSG

SEQ ID NO: 1017720 - protein, 8 aa, Mycobacterium
NHHSAGSF

SEQ ID NO: 1017721 - protein, 14 aa, Mycobacterium
NHLAGPPDDPRIPD

SEQ ID NO: 1017722 - protein, 15 aa, Mycobacterium
NHPAQGGQQVFAIPL

SEQ ID NO: 1017723 - protein, 8 aa, Mycobacterium
NHPDGQAD

SEQ ID NO: 1017724 - protein, 22 aa, Mycobacterium
NHPDRNPGNKSAEDRYKAVSEA

SEQ ID NO: 1017725 - protein, 5 aa, Mycobacterium
NHPET

SEQ ID NO: 1017726 - protein, 11 aa, Mycobacterium
NHPHPSGKPVT

SEQ ID NO: 1017727 - protein, 14 aa, Mycobacterium
NHPTPTNPPATTAA

SEQ ID NO: 1017728 - protein, 7 aa, Mycobacterium
NHRGSTV

SEQ ID NO: 1017729 - protein, 7 aa, Mycobacterium
NHRGTRG

SEQ ID NO: 1017730 - protein, 4 aa, Mycobacterium
NHTG

SEQ ID NO: 1017731 - protein, 7 aa, Mycobacterium
NHTPGAV

SEQ ID NO: 1017732 - protein, 6 aa, Mycobacterium
NHTSSA

SEQ ID NO: 1017733 - protein, 5 aa, Mycobacterium
NHTTH

SEQ ID NO: 1017734 - protein, 5 aa, Mycobacterium
NHTVP

SEQ ID NO: 1017735 - protein, 6 aa, Mycobacterium
NIAGAG

SEQ ID NO: 1017736 - protein, 4 aa, Mycobacterium
NIAN

SEQ ID NO: 1017737 - protein, 5 aa, Mycobacterium
NIDDA

SEQ ID NO: 1017738 - protein, 10 aa, Mycobacterium
NIEDQSSDRV

SEQ ID NO: 1017739 - protein, 8 aa, Mycobacterium
NIENQSSG

SEQ ID NO: 1017740 - protein, 5 aa, Mycobacterium
NIGDT

SEQ ID NO: 1017741 - protein, 7 aa, Mycobacterium
NIGESDE

SEQ ID NO: 1017742 - protein, 9 aa, Mycobacterium
NIGGGNNGN

SEQ ID NO: 1017743 - protein, 5 aa, Mycobacterium
NIGGY

SEQ ID NO: 1017744 - protein, 12 aa, Mycobacterium
NIGHSESAAGTV

SEQ ID NO: 1017745 - protein, 10 aa, Mycobacterium
NIGHTQAAAG

SEQ ID NO: 1017746 - protein, 11 aa, Mycobacterium
NIGHTSAAAGV

SEQ ID NO: 1017747 - protein, 5 aa, Mycobacterium
NIGSG

SEQ ID NO: 1017748 - protein, 17 aa, Mycobacterium
NISGNDALDALAQPAVF

SEQ ID NO: 1017749 - protein, 13 aa, Mycobacterium
NITDDQARACAAT

SEQ ID NO: 1017750 - protein, 8 aa, Mycobacterium
NITGAGPV

SEQ ID NO: 1017751 - protein, 6 aa, Mycobacterium
NITSGG

SEQ ID NO: 1017752 - protein, 7 aa, Mycobacterium
NKAPGGV

SEQ ID NO: 1017753 - protein, 9 aa, Mycobacterium
NKDSPAAAR

SEQ ID NO: 1017754 - protein, 11 aa, Mycobacterium
NKESPVETASA

SEQ ID NO: 1017755 - protein, 18 aa, Mycobacterium
NKGDGNIGFGNGGPANLS

SEQ ID NO: 1017756 - protein, 7 aa, Mycobacterium
NKHARTE

SEQ ID NO: 1017757 - protein, 9 aa, Mycobacterium
NKHKPSPVD

SEQ ID NO: 1017758 - protein, 24 aa, Mycobacterium
NKIATESPSASATTGAANGQRTVS

SEQ ID NO: 1017759 - protein, 21 aa, Mycobacterium
NKIPNSKEASISKAKAGRMAS

SEQ ID NO: 1017760 - protein, 16 aa, Mycobacterium
NKKGGTLDLGDSRGRE

SEQ ID NO: 1017761 - protein, 6 aa, Mycobacterium
NKPAEL

SEQ ID NO: 1017762 - protein, 10 aa, Mycobacterium
NKPDDTAQTF

SEQ ID NO: 1017763 - protein, 8 aa, Mycobacterium
NKPPTNPV

SEQ ID NO: 1017764 - protein, 8 aa, Mycobacterium
NKPSNADV

SEQ ID NO: 1017765 - protein, 18 aa, Mycobacterium
NKPYGSRPSKVYPNDKLP

SEQ ID NO: 1017766 - protein, 13 aa, Mycobacterium
NKPYTDSLPQMPE

SEQ ID NO: 1017767 - protein, 6 aa, Mycobacterium
NKQEDA

SEQ ID NO: 1017768 - protein, 4 aa, Mycobacterium
NKQH

SEQ ID NO: 1017769 - protein, 6 aa, Mycobacterium
NKQIDV

SEQ ID NO: 1017770 - protein, 5 aa, Mycobacterium
NKRSV

SEQ ID NO: 1017771 - protein, 8 aa, Mycobacterium
NKRYQEAS

SEQ ID NO: 1017772 - protein, 7 aa, Mycobacterium
NKSNDFE

SEQ ID NO: 1017773 - protein, 7 aa, Mycobacterium
NKSSSAR

SEQ ID NO: 1017774 - protein, 8 aa, Mycobacterium
NKTEPYSG

SEQ ID NO: 1017775 - protein, 6 aa, Mycobacterium
NKTPID

SEQ ID NO: 1017776 - protein, 6 aa, Mycobacterium
NKVPGA

SEQ ID NO: 1017777 - protein, 7 aa, Mycobacterium
NKVPGGG

SEQ ID NO: 1017778 - protein, 6 aa, Mycobacterium
NKVPNA

SEQ ID NO: 1017779 - protein, 8 aa, Mycobacterium
NLGEAAGT

SEQ ID NO: 1017780 - protein, 11 aa, Mycobacterium
NLGFGNSGTGN

SEQ ID NO: 1017781 - protein, 11 aa, Mycobacterium
NLGGGNNGSFN

SEQ ID NO: 1017782 - protein, 8 aa, Mycobacterium
NLGHTEAA

SEQ ID NO: 1017783 - protein, 5 aa, Mycobacterium
NLGNS

SEQ ID NO: 1017784 - protein, 8 aa, Mycobacterium
NLGPGEQA

SEQ ID NO: 1017785 - protein, 16 aa, Mycobacterium
NLGSGNVGFGNTGNNN

SEQ ID NO: 1017786 - protein, 7 aa, Mycobacterium
NLGTERH

SEQ ID NO: 1017787 - protein, 20 aa, Mycobacterium
NLKPSDGRFGCGPSKVRPAQ

SEQ ID NO: 1017788 - protein, 8 aa, Mycobacterium
NLNGTATA

SEQ ID NO: 1017789 - protein, 12 aa, Mycobacterium
NLNPSQAHGSGD

SEQ ID NO: 1017790 - protein, 6 aa, Mycobacterium
NLNTGA

SEQ ID NO: 1017791 - protein, 5 aa, Mycobacterium
NLPAP

SEQ ID NO: 1017792 - protein, 7 aa, Mycobacterium
NLPETTS

SEQ ID NO: 1017793 - protein, 4 aa, Mycobacterium
NLPG

SEQ ID NO: 1017794 - protein, 6 aa, Mycobacterium
NLPPAT

SEQ ID NO: 1017795 - protein, 4 aa, Mycobacterium
NLPS

SEQ ID NO: 1017796 - protein, 10 aa, Mycobacterium
NLPSRPPEFD

SEQ ID NO: 1017797 - protein, 11 aa, Mycobacterium
NLPSRRADGQL

SEQ ID NO: 1017798 - protein, 9 aa, Mycobacterium
NLPSSFSSV

SEQ ID NO: 1017799 - protein, 4 aa, Mycobacterium
NLQQ

SEQ ID NO: 1017800 - protein, 7 aa, Mycobacterium
NLQRDAD

SEQ ID NO: 1017801 - protein, 6 aa, Mycobacterium
NLQSEE

SEQ ID NO: 1017802 - protein, 8 aa, Mycobacterium
NLQSQGNE

SEQ ID NO: 1017803 - protein, 6 aa, Mycobacterium
NLRKGA

SEQ ID NO: 1017804 - protein, 7 aa, Mycobacterium
NLRPGDR

SEQ ID NO: 1017805 - protein, 9 aa, Mycobacterium
NLRPNSSVE

SEQ ID NO: 1017806 - protein, 5 aa, Mycobacterium
NLSEE

SEQ ID NO: 1017807 - protein, 11 aa, Mycobacterium
NLSEPQYNTMR

SEQ ID NO: 1017808 - protein, 7 aa, Mycobacterium
NLSETST

SEQ ID NO: 1017809 - protein, 10 aa, Mycobacterium
NLTDAERDGL

SEQ ID NO: 1017810 - protein, 8 aa, Mycobacterium
NLTEPESG

SEQ ID NO: 1017811 - protein, 13 aa, Mycobacterium
NLTGNRATAVEGK

SEQ ID NO: 1017812 - protein, 5 aa, Mycobacterium
NLTPA

SEQ ID NO: 1017813 - protein, 8 aa, Mycobacterium
NLTPGPRA

SEQ ID NO: 1017814 - protein, 7 aa, Mycobacterium
NMARSGD

SEQ ID NO: 1017815 - protein, 21 aa, Mycobacterium
NMDAPPPSEDFGRQPPQDLAA

SEQ ID NO: 1017816 - protein, 8 aa, Mycobacterium
NMENNSLD

SEQ ID NO: 1017817 - protein, 5 aa, Mycobacterium
NMGDG

SEQ ID NO: 1017818 - protein, 11 aa, Mycobacterium
NMGHTSAAAGV

SEQ ID NO: 1017819 - protein, 8 aa, Mycobacterium
NMNKSGPA

SEQ ID NO: 1017820 - protein, 12 aa, Mycobacterium
NMPSATAQRPGD

SEQ ID NO: 1017821 - protein, 10 aa, Mycobacterium
NMQEGEKRSL

SEQ ID NO: 1017822 - protein, 6 aa, Mycobacterium
NNAAAP

SEQ ID NO: 1017823 - protein, 5 aa, Mycobacterium
NNADN

SEQ ID NO: 1017824 - protein, 7 aa, Mycobacterium
NNADTLA

SEQ ID NO: 1017825 - protein, 25 aa, Mycobacterium
NNANRYDSYQRRTSRPIPIFALTPA

SEQ ID NO: 1017826 - protein, 5 aa, Mycobacterium
NNDAD

SEQ ID NO: 1017827 - protein, 7 aa, Mycobacterium
NNDGTYD

SEQ ID NO: 1017828 - protein, 7 aa, Mycobacterium
NNDNGRQ

SEQ ID NO: 1017829 - protein, 10 aa, Mycobacterium
NNDYTSSVAR

SEQ ID NO: 1017830 - protein, 10 aa, Mycobacterium
NNEERPFSRD

SEQ ID NO: 1017831 - protein, 7 aa, Mycobacterium
NNFGSGN

SEQ ID NO: 1017832 - protein, 22 aa, Mycobacterium
NNGANRNFPSTCATTPREYLAR

SEQ ID NO: 1017833 - protein, 7 aa, Mycobacterium
NNGGNDN

SEQ ID NO: 1017834 - protein, 8 aa, Mycobacterium
NNGLTASE

SEQ ID NO: 1017835 - protein, 13 aa, Mycobacterium
NNGPAGTGSPVNA

SEQ ID NO: 1017836 - protein, 28 aa, Mycobacterium
NNGSQGSVSDHSAGARGYGTGHGFNGAT

SEQ ID NO: 1017837 - protein, 7 aa, Mycobacterium
NNGTGNF

SEQ ID NO: 1017838 - protein, 4 aa, Mycobacterium
NNGV

SEQ ID NO: 1017839 - protein, 17 aa, Mycobacterium
NNKSPSRKTGELDNRGS

SEQ ID NO: 1017840 - protein, 7 aa, Mycobacterium
NNKVRIP

SEQ ID NO: 1017841 - protein, 7 aa, Mycobacterium
NNLHGRG

SEQ ID NO: 1017842 - protein, 6 aa, Mycobacterium
NNNTAD

SEQ ID NO: 1017843 - protein, 19 aa, Mycobacterium
NNPSRSAIRQGRADATTVV

SEQ ID NO: 1017844 - protein, 9 aa, Mycobacterium
NNPSTVSGG

SEQ ID NO: 1017845 - protein, 9 aa, Mycobacterium
NNPTRRNAY

SEQ ID NO: 1017846 - protein, 16 aa, Mycobacterium
NNPTTFSAENDKMGPE

SEQ ID NO: 1017847 - protein, 10 aa, Mycobacterium
NNQAGASAGI

SEQ ID NO: 1017848 - protein, 41 aa, Mycobacterium
NNQAGNGGNGANGSGPGGAGGAGGEGGASTAGGAATGGARA

SEQ ID NO: 1017849 - protein, 13 aa, Mycobacterium
NNQPPRPPAPPAA

SEQ ID NO: 1017850 - protein, 8 aa, Mycobacterium
NNRETGEA

SEQ ID NO: 1017851 - protein, 10 aa, Mycobacterium
NNRGKKSVSV

SEQ ID NO: 1017852 - protein, 4 aa, Mycobacterium
NNRL

SEQ ID NO: 1017853 - protein, 9 aa, Mycobacterium
NNSARTPSA

SEQ ID NO: 1017854 - protein, 11 aa, Mycobacterium
NNSASSVSSAL

SEQ ID NO: 1017855 - protein, 4 aa, Mycobacterium
NNSG

SEQ ID NO: 1017856 - protein, 7 aa, Mycobacterium
NNSSRSL

SEQ ID NO: 1017857 - protein, 9 aa, Mycobacterium
NNSTDDTAA

SEQ ID NO: 1017858 - protein, 5 aa, Mycobacterium
NNSTQ

SEQ ID NO: 1017859 - protein, 13 aa, Mycobacterium
NNTASASGLGAGN

SEQ ID NO: 1017860 - protein, 8 aa, Mycobacterium
NNTGSAKT

SEQ ID NO: 1017861 - protein, 8 aa, Mycobacterium
NNTISASS

SEQ ID NO: 1017862 - protein, 4 aa, Mycobacterium
NNTP

SEQ ID NO: 1017863 - protein, 5 aa, Mycobacterium
NNTPF

SEQ ID NO: 1017864 - protein, 5 aa, Mycobacterium
NNTPV

SEQ ID NO: 1017865 - protein, 5 aa, Mycobacterium
NNTRE

SEQ ID NO: 1017866 - protein, 10 aa, Mycobacterium
NNTSNASSFG

SEQ ID NO: 1017867 - protein, 9 aa, Mycobacterium
NNTSTASAL

SEQ ID NO: 1017868 - protein, 7 aa, Mycobacterium
NNVEEGR

SEQ ID NO: 1017869 - protein, 8 aa, Mycobacterium
NNVPSGAF

SEQ ID NO: 1017870 - protein, 8 aa, Mycobacterium
NPAAGYSN

SEQ ID NO: 1017871 - protein, 16 aa, Mycobacterium
NPAALGDGIRAGQRVG

SEQ ID NO: 1017872 - protein, 8 aa, Mycobacterium
NPAASQGS

SEQ ID NO: 1017873 - protein, 9 aa, Mycobacterium
NPAATRRSA

SEQ ID NO: 1017874 - protein, 4 aa, Mycobacterium
NPAD

SEQ ID NO: 1017875 - protein, 6 aa, Mycobacterium
NPADDV

SEQ ID NO: 1017876 - protein, 6 aa, Mycobacterium
NPAPFG

SEQ ID NO: 1017877 - protein, 16 aa, Mycobacterium
NPAPSDDQSLTIGPDG

SEQ ID NO: 1017878 - protein, 15 aa, Mycobacterium
NPARIGQAALLKPHL

SEQ ID NO: 1017879 - protein, 13 aa, Mycobacterium
NPASHQEDSFSPE

SEQ ID NO: 1017880 - protein, 5 aa, Mycobacterium
NPASL

SEQ ID NO: 1017881 - protein, 11 aa, Mycobacterium
NPATDSPQATA

SEQ ID NO: 1017882 - protein, 9 aa, Mycobacterium
NPATGEAAR

SEQ ID NO: 1017883 - protein, 7 aa, Mycobacterium
NPATGQP

SEQ ID NO: 1017884 - protein, 9 aa, Mycobacterium
NPATLGDPA

SEQ ID NO: 1017885 - protein, 8 aa, Mycobacterium
NPATPNGG

SEQ ID NO: 1017886 - protein, 8 aa, Mycobacterium
NPATSGVD

SEQ ID NO: 1017887 - protein, 8 aa, Mycobacterium
NPAVGSAH

SEQ ID NO: 1017888 - protein, 5 aa, Mycobacterium
NPDAG

SEQ ID NO: 1017889 - protein, 5 aa, Mycobacterium
NPDAR

SEQ ID NO: 1017890 - protein, 5 aa, Mycobacterium
NPDAV

SEQ ID NO: 1017891 - protein, 4 aa, Mycobacterium
NPDD

SEQ ID NO: 1017892 - protein, 9 aa, Mycobacterium
NPDEDLSTG

SEQ ID NO: 1017893 - protein, 7 aa, Mycobacterium
NPDEDSR

SEQ ID NO: 1017894 - protein, 9 aa, Mycobacterium
NPDGKSRRE

SEQ ID NO: 1017895 - protein, 18 aa, Mycobacterium
NPDHRDDIAATGATPVQA

SEQ ID NO: 1017896 - protein, 7 aa, Mycobacterium
NPDKLAG

SEQ ID NO: 1017897 - protein, 8 aa, Mycobacterium
NPDPDVPG

SEQ ID NO: 1017898 - protein, 7 aa, Mycobacterium
NPDPEIH

SEQ ID NO: 1017899 - protein, 4 aa, Mycobacterium
NPDS

SEQ ID NO: 1017900 - protein, 5 aa, Mycobacterium
NPDSF

SEQ ID NO: 1017901 - protein, 4 aa, Mycobacterium
NPDV

SEQ ID NO: 1017902 - protein, 12 aa, Mycobacterium
NPDVRSTSELTG

SEQ ID NO: 1017903 - protein, 8 aa, Mycobacterium
NPEATAEA

SEQ ID NO: 1017904 - protein, 8 aa, Mycobacterium
NPEEGELR

SEQ ID NO: 1017905 - protein, 4 aa, Mycobacterium
NPEF

SEQ ID NO: 1017906 - protein, 5 aa, Mycobacterium
NPEFD

SEQ ID NO: 1017907 - protein, 8 aa, Mycobacterium
NPEKGNAA

SEQ ID NO: 1017908 - protein, 8 aa, Mycobacterium
NPEPASGL

SEQ ID NO: 1017909 - protein, 4 aa, Mycobacterium
NPEQ

SEQ ID NO: 1017910 - protein, 6 aa, Mycobacterium
NPESHR

SEQ ID NO: 1017911 - protein, 13 aa, Mycobacterium
NPESTQEATEPAV

SEQ ID NO: 1017912 - protein, 4 aa, Mycobacterium
NPEV

SEQ ID NO: 1017913 - protein, 8 aa, Mycobacterium
NPEWQAPD

SEQ ID NO: 1017914 - protein, 4 aa, Mycobacterium
NPGA

SEQ ID NO: 1017915 - protein, 9 aa, Mycobacterium
NPGADLPTE

SEQ ID NO: 1017916 - protein, 8 aa, Mycobacterium
NPGAGGTL

SEQ ID NO: 1017917 - protein, 6 aa, Mycobacterium
NPGARA

SEQ ID NO: 1017918 - protein, 8 aa, Mycobacterium
NPGDGEQR

SEQ ID NO: 1017919 - protein, 9 aa, Mycobacterium
NPGENYART

SEQ ID NO: 1017920 - protein, 8 aa, Mycobacterium
NPGFDPGN

SEQ ID NO: 1017921 - protein, 10 aa, Mycobacterium
NPGGDPGPTH

SEQ ID NO: 1017922 - protein, 9 aa, Mycobacterium
NPGGPGISG

SEQ ID NO: 1017923 - protein, 6 aa, Mycobacterium
NPGHDV

SEQ ID NO: 1017924 - protein, 13 aa, Mycobacterium
NPGKDDDGNPIDY

SEQ ID NO: 1017925 - protein, 11 aa, Mycobacterium
NPGKRTSGTGP

SEQ ID NO: 1017926 - protein, 5 aa, Mycobacterium
NPGLA

SEQ ID NO: 1017927 - protein, 4 aa, Mycobacterium
NPGN

SEQ ID NO: 1017928 - protein, 5 aa, Mycobacterium
NPGQH

SEQ ID NO: 1017929 - protein, 11 aa, Mycobacterium
NPGSPTDRRRA

SEQ ID NO: 1017930 - protein, 5 aa, Mycobacterium
NPGTS

SEQ ID NO: 1017931 - protein, 9 aa, Mycobacterium
NPGTSLNET

SEQ ID NO: 1017932 - protein, 15 aa, Mycobacterium
NPHGEPDITGPDGRA

SEQ ID NO: 1017933 - protein, 7 aa, Mycobacterium
NPHTKPP

SEQ ID NO: 1017934 - protein, 13 aa, Mycobacterium
NPIEHEGTYPLPE

SEQ ID NO: 1017935 - protein, 6 aa, Mycobacterium
NPIEQE

SEQ ID NO: 1017936 - protein, 10 aa, Mycobacterium
NPIPPTDLPD

SEQ ID NO: 1017937 - protein, 6 aa, Mycobacterium
NPITNV

SEQ ID NO: 1017938 - protein, 7 aa, Mycobacterium
NPITPEE

SEQ ID NO: 1017939 - protein, 12 aa, Mycobacterium
NPKIEGNETVDG

SEQ ID NO: 1017940 - protein, 13 aa, Mycobacterium
NPKPAAQAAAPAV

SEQ ID NO: 1017941 - protein, 7 aa, Mycobacterium
NPKPRVR

SEQ ID NO: 1017942 - protein, 8 aa, Mycobacterium
NPKPVRDR

SEQ ID NO: 1017943 - protein, 5 aa, Mycobacterium
NPKTN

SEQ ID NO: 1017944 - protein, 8 aa, Mycobacterium
NPLESDEL

SEQ ID NO: 1017945 - protein, 7 aa, Mycobacterium
NPLPGGR

SEQ ID NO: 1017946 - protein, 4 aa, Mycobacterium
NPLR

SEQ ID NO: 1017947 - protein, 17 aa, Mycobacterium
NPLSDDTLSTLSLPGVF

SEQ ID NO: 1017948 - protein, 6 aa, Mycobacterium
NPLSDS

SEQ ID NO: 1017949 - protein, 25 aa, Mycobacterium
NPPAELAEGARRAAASCPAMAIKIE

SEQ ID NO: 1017950 - protein, 6 aa, Mycobacterium
NPPDRP

SEQ ID NO: 1017951 - protein, 9 aa, Mycobacterium
NPPDVSGLG

SEQ ID NO: 1017952 - protein, 5 aa, Mycobacterium
NPPFS

SEQ ID NO: 1017953 - protein, 30 aa, Mycobacterium
NPPGPVNPTPASRAWRTNSRATSNSSTSRL

SEQ ID NO: 1017954 - protein, 4 aa, Mycobacterium
NPPL

SEQ ID NO: 1017955 - protein, 7 aa, Mycobacterium
NPPRALS

SEQ ID NO: 1017956 - protein, 8 aa, Mycobacterium
NPPRNRPA

SEQ ID NO: 1017957 - protein, 15 aa, Mycobacterium
NPPSMQRGDINDPKL

SEQ ID NO: 1017958 - protein, 5 aa, Mycobacterium
NPPVD

SEQ ID NO: 1017959 - protein, 5 aa, Mycobacterium
NPPYY

SEQ ID NO: 1017960 - protein, 17 aa, Mycobacterium
NPQAPDVEVSVRHREQR

SEQ ID NO: 1017961 - protein, 7 aa, Mycobacterium
NPQARTY

SEQ ID NO: 1017962 - protein, 6 aa, Mycobacterium
NPQGTV

SEQ ID NO: 1017963 - protein, 6 aa, Mycobacterium
NPQHEY

SEQ ID NO: 1017964 - protein, 7 aa, Mycobacterium
NPQPETR

SEQ ID NO: 1017965 - protein, 6 aa, Mycobacterium
NPQRTQ

SEQ ID NO: 1017966 - protein, 5 aa, Mycobacterium
NPRAD

SEQ ID NO: 1017967 - protein, 7 aa, Mycobacterium
NPRASRT

SEQ ID NO: 1017968 - protein, 11 aa, Mycobacterium
NPRHGASGPGW

SEQ ID NO: 1017969 - protein, 9 aa, Mycobacterium
NPRSDVSYT

SEQ ID NO: 1017970 - protein, 8 aa, Mycobacterium
NPRTGDRT

SEQ ID NO: 1017971 - protein, 7 aa, Mycobacterium
NPSEAKT

SEQ ID NO: 1017972 - protein, 8 aa, Mycobacterium
NPSGPAAV

SEQ ID NO: 1017973 - protein, 8 aa, Mycobacterium
NPSGTRKD

SEQ ID NO: 1017974 - protein, 5 aa, Mycobacterium
NPSHD

SEQ ID NO: 1017975 - protein, 5 aa, Mycobacterium
NPSLA

SEQ ID NO: 1017976 - protein, 6 aa, Mycobacterium
NPSPEE

SEQ ID NO: 1017977 - protein, 11 aa, Mycobacterium
NPSPPPPTAYG

SEQ ID NO: 1017978 - protein, 12 aa, Mycobacterium
NPSRGDERTRAD

SEQ ID NO: 1017979 - protein, 4 aa, Mycobacterium
NPST

SEQ ID NO: 1017980 - protein, 6 aa, Mycobacterium
NPSTGE

SEQ ID NO: 1017981 - protein, 11 aa, Mycobacterium
NPSVPDDDMTP

SEQ ID NO: 1017982 - protein, 10 aa, Mycobacterium
NPTAAGGTEP

SEQ ID NO: 1017983 - protein, 12 aa, Mycobacterium
NPTGIVPKGPDL

SEQ ID NO: 1017984 - protein, 5 aa, Mycobacterium
NPTGV

SEQ ID NO: 1017985 - protein, 8 aa, Mycobacterium
NPTNPTSV

SEQ ID NO: 1017986 - protein, 17 aa, Mycobacterium
NPTPGSDWDASPKPVER

SEQ ID NO: 1017987 - protein, 4 aa, Mycobacterium
NPTR

SEQ ID NO: 1017988 - protein, 6 aa, Mycobacterium
NPTRGS

SEQ ID NO: 1017989 - protein, 5 aa, Mycobacterium
NPTSL

SEQ ID NO: 1017990 - protein, 5 aa, Mycobacterium
NPTSS

SEQ ID NO: 1017991 - protein, 14 aa, Mycobacterium
NPTVDAGIQDSTRF

SEQ ID NO: 1017992 - protein, 5 aa, Mycobacterium
NPTVN

SEQ ID NO: 1017993 - protein, 5 aa, Mycobacterium
NPVRV

SEQ ID NO: 1017994 - protein, 9 aa, Mycobacterium
NPYPEGSTA

SEQ ID NO: 1017995 - protein, 11 aa, Mycobacterium
NPYSAAKAIGT

SEQ ID NO: 1017996 - protein, 17 aa, Mycobacterium
NQAANKKSALARALNKL

SEQ ID NO: 1017997 - protein, 6 aa, Mycobacterium
NQADRD

SEQ ID NO: 1017998 - protein, 13 aa, Mycobacterium
NQAGVKGTSGMRK

SEQ ID NO: 1017999 - protein, 9 aa, Mycobacterium
NQASGGTVN

SEQ ID NO: 1018000 - protein, 6 aa, Mycobacterium
NQDNAY

SEQ ID NO: 1018001 - protein, 8 aa, Mycobacterium
NQDPRADY

SEQ ID NO: 1018002 - protein, 7 aa, Mycobacterium
NQDSDPH

SEQ ID NO: 1018003 - protein, 5 aa, Mycobacterium
NQDWH

SEQ ID NO: 1018004 - protein, 5 aa, Mycobacterium
NQGAA

SEQ ID NO: 1018005 - protein, 6 aa, Mycobacterium
NQGAGI

SEQ ID NO: 1018006 - protein, 24 aa, Mycobacterium
NQGDIDKQSITGATATATHGTGAR

SEQ ID NO: 1018007 - protein, 10 aa, Mycobacterium
NQGRTADDPM

SEQ ID NO: 1018008 - protein, 10 aa, Mycobacterium
NQGSEDVHRP

SEQ ID NO: 1018009 - protein, 4 aa, Mycobacterium
NQGV

SEQ ID NO: 1018010 - protein, 5 aa, Mycobacterium
NQHAR

SEQ ID NO: 1018011 - protein, 7 aa, Mycobacterium
NQHGPTS

SEQ ID NO: 1018012 - protein, 4 aa, Mycobacterium
NQLE

SEQ ID NO: 1018013 - protein, 5 aa, Mycobacterium
NQNHG

SEQ ID NO: 1018014 - protein, 7 aa, Mycobacterium
NQPDVAE

SEQ ID NO: 1018015 - protein, 6 aa, Mycobacterium
NQPGRS

SEQ ID NO: 1018016 - protein, 8 aa, Mycobacterium
NQPKLAEA

SEQ ID NO: 1018017 - protein, 13 aa, Mycobacterium
NQPSAAIESPGGD

SEQ ID NO: 1018018 - protein, 20 aa, Mycobacterium
NQPSIPRTEAQRRSRLEGTT

SEQ ID NO: 1018019 - protein, 5 aa, Mycobacterium
NQRET

SEQ ID NO: 1018020 - protein, 10 aa, Mycobacterium
NQRNGGYTVN

SEQ ID NO: 1018021 - protein, 8 aa, Mycobacterium
NQRRPSQE

SEQ ID NO: 1018022 - protein, 6 aa, Mycobacterium
NQRSDD

SEQ ID NO: 1018023 - protein, 10 aa, Mycobacterium
NQRSRPSFPE

SEQ ID NO: 1018024 - protein, 10 aa, Mycobacterium
NQSGPAAANG

SEQ ID NO: 1018025 - protein, 9 aa, Mycobacterium
NQSGREDLA

SEQ ID NO: 1018026 - protein, 13 aa, Mycobacterium
NQSPYPPGGPIPR

SEQ ID NO: 1018027 - protein, 6 aa, Mycobacterium
NQSTAL

SEQ ID NO: 1018028 - protein, 24 aa, Mycobacterium
NQTDKEWRTAADGPHKRSRASDLA

SEQ ID NO: 1018029 - protein, 7 aa, Mycobacterium
NQTGSTA

SEQ ID NO: 1018030 - protein, 9 aa, Mycobacterium
NQTPESARE

SEQ ID NO: 1018031 - protein, 5 aa, Mycobacterium
NQVPA

SEQ ID NO: 1018032 - protein, 5 aa, Mycobacterium
NQVSR

SEQ ID NO: 1018033 - protein, 6 aa, Mycobacterium
NQYTRG

SEQ ID NO: 1018034 - protein, 12 aa, Mycobacterium
NRAAASAIDPPS

SEQ ID NO: 1018035 - protein, 7 aa, Mycobacterium
NRAAGSL

SEQ ID NO: 1018036 - protein, 10 aa, Mycobacterium
NRAASPSTAR

SEQ ID NO: 1018037 - protein, 10 aa, Mycobacterium
NRAEGKKHPW

SEQ ID NO: 1018038 - protein, 14 aa, Mycobacterium
NRAEPDLKSGRGGL

SEQ ID NO: 1018039 - protein, 10 aa, Mycobacterium
NRAGAGGGTG

SEQ ID NO: 1018040 - protein, 7 aa, Mycobacterium
NRAGPLT

SEQ ID NO: 1018041 - protein, 5 aa, Mycobacterium
NRAGV

SEQ ID NO: 1018042 - protein, 15 aa, Mycobacterium
NRAMSESSTGAGLGP

SEQ ID NO: 1018043 - protein, 8 aa, Mycobacterium
NRANPIEG

SEQ ID NO: 1018044 - protein, 7 aa, Mycobacterium
NRAPAKV

SEQ ID NO: 1018045 - protein, 6 aa, Mycobacterium
NRAPGV

SEQ ID NO: 1018046 - protein, 4 aa, Mycobacterium
NRAQ

SEQ ID NO: 1018047 - protein, 8 aa, Mycobacterium
NRAQANDK

SEQ ID NO: 1018048 - protein, 17 aa, Mycobacterium
NRARDRLRRESARPAKE

SEQ ID NO: 1018049 - protein, 16 aa, Mycobacterium
NRATERYGPSCAGAPP

SEQ ID NO: 1018050 - protein, 9 aa, Mycobacterium
NRCDDEAAA

SEQ ID NO: 1018051 - protein, 5 aa, Mycobacterium
NRDAT

SEQ ID NO: 1018052 - protein, 13 aa, Mycobacterium
NRDDPGDDSGNVT

SEQ ID NO: 1018053 - protein, 7 aa, Mycobacterium
NRDEEKF

SEQ ID NO: 1018054 - protein, 10 aa, Mycobacterium
NRDGEHTTTD

SEQ ID NO: 1018055 - protein, 6 aa, Mycobacterium
NRDGVS

SEQ ID NO: 1018056 - protein, 10 aa, Mycobacterium
NRDHRQFRPD

SEQ ID NO: 1018057 - protein, 5 aa, Mycobacterium
NRDKR

SEQ ID NO: 1018058 - protein, 13 aa, Mycobacterium
NRDPLGLGAPSRL

SEQ ID NO: 1018059 - protein, 6 aa, Mycobacterium
NRDPVQ

SEQ ID NO: 1018060 - protein, 5 aa, Mycobacterium
NRDSH

SEQ ID NO: 1018061 - protein, 10 aa, Mycobacterium
NRDTAASGRP

SEQ ID NO: 1018062 - protein, 12 aa, Mycobacterium
NREAQRGRLKPA

SEQ ID NO: 1018063 - protein, 5 aa, Mycobacterium
NREDM

SEQ ID NO: 1018064 - protein, 8 aa, Mycobacterium
NREDPPYQ

SEQ ID NO: 1018065 - protein, 4 aa, Mycobacterium
NREE

SEQ ID NO: 1018066 - protein, 5 aa, Mycobacterium
NREEM

SEQ ID NO: 1018067 - protein, 13 aa, Mycobacterium
NREGKADAKTRQG

SEQ ID NO: 1018068 - protein, 9 aa, Mycobacterium
NREGLPEQY

SEQ ID NO: 1018069 - protein, 8 aa, Mycobacterium
NREGQPAF

SEQ ID NO: 1018070 - protein, 18 aa, Mycobacterium
NRENGAHPINDSPQVQGL

SEQ ID NO: 1018071 - protein, 7 aa, Mycobacterium
NREQPIP

SEQ ID NO: 1018072 - protein, 4 aa, Mycobacterium
NRER

SEQ ID NO: 1018073 - protein, 10 aa, Mycobacterium
NRGAPTPGFG

SEQ ID NO: 1018074 - protein, 7 aa, Mycobacterium
NRGGPPR

SEQ ID NO: 1018075 - protein, 10 aa, Mycobacterium
NRGIRPESKF

SEQ ID NO: 1018076 - protein, 4 aa, Mycobacterium
NRGN

SEQ ID NO: 1018077 - protein, 13 aa, Mycobacterium
NRGPEQRTDKKPM

SEQ ID NO: 1018078 - protein, 6 aa, Mycobacterium
NRGPVD

SEQ ID NO: 1018079 - protein, 10 aa, Mycobacterium
NRGQDAADTI

SEQ ID NO: 1018080 - protein, 8 aa, Mycobacterium
NRGTDALI

SEQ ID NO: 1018081 - protein, 7 aa, Mycobacterium
NRGTTTD

SEQ ID NO: 1018082 - protein, 5 aa, Mycobacterium
NRHRG

SEQ ID NO: 1018083 - protein, 9 aa, Mycobacterium
NRIGQERVG

SEQ ID NO: 1018084 - protein, 4 aa, Mycobacterium
NRKN

SEQ ID NO: 1018085 - protein, 8 aa, Mycobacterium
NRLDPQSR

SEQ ID NO: 1018086 - protein, 7 aa, Mycobacterium
NRLGRRG

SEQ ID NO: 1018087 - protein, 6 aa, Mycobacterium
NRLPEA

SEQ ID NO: 1018088 - protein, 4 aa, Mycobacterium
NRLQ

SEQ ID NO: 1018089 - protein, 8 aa, Mycobacterium
NRNGGRRW

SEQ ID NO: 1018090 - protein, 8 aa, Mycobacterium
NRNRAASE

SEQ ID NO: 1018091 - protein, 6 aa, Mycobacterium
NRNRAS

SEQ ID NO: 1018092 - protein, 12 aa, Mycobacterium
NRPDTGSDAEYS

SEQ ID NO: 1018093 - protein, 8 aa, Mycobacterium
NRPEGLGE

SEQ ID NO: 1018094 - protein, 8 aa, Mycobacterium
NRPEKGNA

SEQ ID NO: 1018095 - protein, 5 aa, Mycobacterium
NRPGA

SEQ ID NO: 1018096 - protein, 4 aa, Mycobacterium
NRPK

SEQ ID NO: 1018097 - protein, 27 aa, Mycobacterium
NRPNRASPRCGAGRGAPTTVRTRGARL

SEQ ID NO: 1018098 - protein, 7 aa, Mycobacterium
NRPPTPH

SEQ ID NO: 1018099 - protein, 14 aa, Mycobacterium
NRPRHTLEDRSPAK

SEQ ID NO: 1018100 - protein, 7 aa, Mycobacterium
NRQAAQR

SEQ ID NO: 1018101 - protein, 21 aa, Mycobacterium
NRQPETGQSQGPIRRLLGRIG

SEQ ID NO: 1018102 - protein, 8 aa, Mycobacterium
NRQPLPED

SEQ ID NO: 1018103 - protein, 4 aa, Mycobacterium
NRQV

SEQ ID NO: 1018104 - protein, 10 aa, Mycobacterium
NRRGRDKARD

SEQ ID NO: 1018105 - protein, 7 aa, Mycobacterium
NRRGRDV

SEQ ID NO: 1018106 - protein, 6 aa, Mycobacterium
NRRHHR

SEQ ID NO: 1018107 - protein, 4 aa, Mycobacterium
NRRR

SEQ ID NO: 1018108 - protein, 5 aa, Mycobacterium
NRRRA

SEQ ID NO: 1018109 - protein, 8 aa, Mycobacterium
NRRTAANY

SEQ ID NO: 1018110 - protein, 5 aa, Mycobacterium
NRSRD

SEQ ID NO: 1018111 - protein, 9 aa, Mycobacterium
NRSSGKQGY

SEQ ID NO: 1018112 - protein, 6 aa, Mycobacterium
NRTAQG

SEQ ID NO: 1018113 - protein, 5 aa, Mycobacterium
NRTDQ

SEQ ID NO: 1018114 - protein, 7 aa, Mycobacterium
NRTEALE

SEQ ID NO: 1018115 - protein, 4 aa, Mycobacterium
NRTG

SEQ ID NO: 1018116 - protein, 9 aa, Mycobacterium
NRTHSADSR

SEQ ID NO: 1018117 - protein, 13 aa, Mycobacterium
NRTPNRGPGAEGA

SEQ ID NO: 1018118 - protein, 22 aa, Mycobacterium
NRTPPAFTATHENENDPSAADM

SEQ ID NO: 1018119 - protein, 5 aa, Mycobacterium
NRYPD

SEQ ID NO: 1018120 - protein, 8 aa, Mycobacterium
NSAAPSVA

SEQ ID NO: 1018121 - protein, 10 aa, Mycobacterium
NSAATNEADP

SEQ ID NO: 1018122 - protein, 15 aa, Mycobacterium
NSAGKPGLSVGPGNA

SEQ ID NO: 1018123 - protein, 5 aa, Mycobacterium
NSAGY

SEQ ID NO: 1018124 - protein, 6 aa, Mycobacterium
NSAPSH

SEQ ID NO: 1018125 - protein, 9 aa, Mycobacterium
NSARTPAGR

SEQ ID NO: 1018126 - protein, 9 aa, Mycobacterium
NSATKAGVK

SEQ ID NO: 1018127 - protein, 4 aa, Mycobacterium
NSAV

SEQ ID NO: 1018128 - protein, 8 aa, Mycobacterium
NSAVAKGA

SEQ ID NO: 1018129 - protein, 5 aa, Mycobacterium
NSCEL

SEQ ID NO: 1018130 - protein, 4 aa, Mycobacterium
NSDD

SEQ ID NO: 1018131 - protein, 5 aa, Mycobacterium
NSDGE

SEQ ID NO: 1018132 - protein, 5 aa, Mycobacterium
NSDGR

SEQ ID NO: 1018133 - protein, 24 aa, Mycobacterium
NSDGSKGPVRDAAGNPIADQVDSI

SEQ ID NO: 1018134 - protein, 4 aa, Mycobacterium
NSDL

SEQ ID NO: 1018135 - protein, 8 aa, Mycobacterium
NSDPDVND

SEQ ID NO: 1018136 - protein, 8 aa, Mycobacterium
NSDRSASP

SEQ ID NO: 1018137 - protein, 4 aa, Mycobacterium
NSEH

SEQ ID NO: 1018138 - protein, 8 aa, Mycobacterium
NSERIRGA

SEQ ID NO: 1018139 - protein, 12 aa, Mycobacterium
NSFEAQAARDGL

SEQ ID NO: 1018140 - protein, 7 aa, Mycobacterium
NSFGVQD

SEQ ID NO: 1018141 - protein, 10 aa, Mycobacterium
NSFPGEPPYV

SEQ ID NO: 1018142 - protein, 16 aa, Mycobacterium
NSGAHNTGAFNAGGYN

SEQ ID NO: 1018143 - protein, 10 aa, Mycobacterium
NSGAIDTGFG

SEQ ID NO: 1018144 - protein, 5 aa, Mycobacterium
NSGAS

SEQ ID NO: 1018145 - protein, 12 aa, Mycobacterium
NSGDGSSSGFGN

SEQ ID NO: 1018146 - protein, 6 aa, Mycobacterium
NSGDNG

SEQ ID NO: 1018147 - protein, 8 aa, Mycobacterium
NSGDTNTG

SEQ ID NO: 1018148 - protein, 9 aa, Mycobacterium
NSGDTSTGL

SEQ ID NO: 1018149 - protein, 7 aa, Mycobacterium
NSGGGSL

SEQ ID NO: 1018150 - protein, 17 aa, Mycobacterium
NSGGKTAEDAAHQNAGL

SEQ ID NO: 1018151 - protein, 8 aa, Mycobacterium
NSGHENTG

SEQ ID NO: 1018152 - protein, 14 aa, Mycobacterium
NSGINPGSTAGAEG

SEQ ID NO: 1018153 - protein, 7 aa, Mycobacterium
NSGLRNY

SEQ ID NO: 1018154 - protein, 9 aa, Mycobacterium
NSGNGSTGL

SEQ ID NO: 1018155 - protein, 18 aa, Mycobacterium
NSGNYNTGFANSGDVNTG

SEQ ID NO: 1018156 - protein, 7 aa, Mycobacterium
NSGPGTF

SEQ ID NO: 1018157 - protein, 9 aa, Mycobacterium
NSGPLPEEI

SEQ ID NO: 1018158 - protein, 10 aa, Mycobacterium
NSGPVDDPPW

SEQ ID NO: 1018159 - protein, 5 aa, Mycobacterium
NSGRG

SEQ ID NO: 1018160 - protein, 8 aa, Mycobacterium
NSGSKPPF

SEQ ID NO: 1018161 - protein, 18 aa, Mycobacterium
NSGSLNTGIGNTGSTNTG

SEQ ID NO: 1018162 - protein, 6 aa, Mycobacterium
NSGTDN

SEQ ID NO: 1018163 - protein, 6 aa, Mycobacterium
NSGTGN

SEQ ID NO: 1018164 - protein, 8 aa, Mycobacterium
NSGTGNFG

SEQ ID NO: 1018165 - protein, 6 aa, Mycobacterium
NSGTNA

SEQ ID NO: 1018166 - protein, 10 aa, Mycobacterium
NSGTNNTGIF

SEQ ID NO: 1018167 - protein, 9 aa, Mycobacterium
NSGTSLPDT

SEQ ID NO: 1018168 - protein, 4 aa, Mycobacterium
NSGV

SEQ ID NO: 1018169 - protein, 4 aa, Mycobacterium
NSKV

SEQ ID NO: 1018170 - protein, 13 aa, Mycobacterium
NSLHRTKADESYQ

SEQ ID NO: 1018171 - protein, 8 aa, Mycobacterium
NSLPSGIA

SEQ ID NO: 1018172 - protein, 4 aa, Mycobacterium
NSLR

SEQ ID NO: 1018173 - protein, 6 aa, Mycobacterium
NSLTAT

SEQ ID NO: 1018174 - protein, 5 aa, Mycobacterium
NSMSS

SEQ ID NO: 1018175 - protein, 26 aa, Mycobacterium
NSPAEIANDDAGAARRYKRSADLTGR

SEQ ID NO: 1018176 - protein, 10 aa, Mycobacterium
NSPAIAATEA

SEQ ID NO: 1018177 - protein, 12 aa, Mycobacterium
NSPDCEWKDRRS

SEQ ID NO: 1018178 - protein, 10 aa, Mycobacterium
NSPDEVGPPE

SEQ ID NO: 1018179 - protein, 7 aa, Mycobacterium
NSPEDRQ

SEQ ID NO: 1018180 - protein, 4 aa, Mycobacterium
NSPG

SEQ ID NO: 1018181 - protein, 7 aa, Mycobacterium
NSPGAAA

SEQ ID NO: 1018182 - protein, 12 aa, Mycobacterium
NSPGAVAPHGQA

SEQ ID NO: 1018183 - protein, 7 aa, Mycobacterium
NSPGSAV

SEQ ID NO: 1018184 - protein, 10 aa, Mycobacterium
NSPNESAETV

SEQ ID NO: 1018185 - protein, 6 aa, Mycobacterium
NSPRTY

SEQ ID NO: 1018186 - protein, 8 aa, Mycobacterium
NSQARQGI

SEQ ID NO: 1018187 - protein, 5 aa, Mycobacterium
NSQLR

SEQ ID NO: 1018188 - protein, 5 aa, Mycobacterium
NSQTM

SEQ ID NO: 1018189 - protein, 6 aa, Mycobacterium
NSQYGL

SEQ ID NO: 1018190 - protein, 7 aa, Mycobacterium
NSRGADK

SEQ ID NO: 1018191 - protein, 7 aa, Mycobacterium
NSRIDQR

SEQ ID NO: 1018192 - protein, 11 aa, Mycobacterium
NSRPERRDPPT

SEQ ID NO: 1018193 - protein, 12 aa, Mycobacterium
NSRPTRAEASDV

SEQ ID NO: 1018194 - protein, 6 aa, Mycobacterium
NSRRGQ

SEQ ID NO: 1018195 - protein, 6 aa, Mycobacterium
NSRVRA

SEQ ID NO: 1018196 - protein, 19 aa, Mycobacterium
NSSAGGYSSGVGNSGGGGY

SEQ ID NO: 1018197 - protein, 6 aa, Mycobacterium
NSSATG

SEQ ID NO: 1018198 - protein, 9 aa, Mycobacterium
NSSDPQRIG

SEQ ID NO: 1018199 - protein, 11 aa, Mycobacterium
NSSDTETTSEI

SEQ ID NO: 1018200 - protein, 19 aa, Mycobacterium
NSSGLTNPAPIKAPTPTPS

SEQ ID NO: 1018201 - protein, 14 aa, Mycobacterium
NSSPEPLPVQPSPD

SEQ ID NO: 1018202 - protein, 7 aa, Mycobacterium
NSSSFPS

SEQ ID NO: 1018203 - protein, 9 aa, Mycobacterium
NSTAGGAYV

SEQ ID NO: 1018204 - protein, 6 aa, Mycobacterium
NSTETV

SEQ ID NO: 1018205 - protein, 13 aa, Mycobacterium
NSTNGTTVNNAPV

SEQ ID NO: 1018206 - protein, 4 aa, Mycobacterium
NSTQ

SEQ ID NO: 1018207 - protein, 12 aa, Mycobacterium
NSTTLSNRDGVS

SEQ ID NO: 1018208 - protein, 5 aa, Mycobacterium
NSTWG

SEQ ID NO: 1018209 - protein, 6 aa, Mycobacterium
NSVDKV

SEQ ID NO: 1018210 - protein, 7 aa, Mycobacterium
NSVDPTV

SEQ ID NO: 1018211 - protein, 5 aa, Mycobacterium
NSVGP

SEQ ID NO: 1018212 - protein, 5 aa, Mycobacterium
NSVGT

SEQ ID NO: 1018213 - protein, 8 aa, Mycobacterium
NSVTPPGQ

SEQ ID NO: 1018214 - protein, 7 aa, Mycobacterium
NSYRAKS

SEQ ID NO: 1018215 - protein, 6 aa, Mycobacterium
NTAADQ

SEQ ID NO: 1018216 - protein, 7 aa, Mycobacterium
NTAADQL

SEQ ID NO: 1018217 - protein, 8 aa, Mycobacterium
NTAEGGIA

SEQ ID NO: 1018218 - protein, 8 aa, Mycobacterium
NTAGPGRF

SEQ ID NO: 1018219 - protein, 5 aa, Mycobacterium
NTAHA

SEQ ID NO: 1018220 - protein, 4 aa, Mycobacterium
NTAL

SEQ ID NO: 1018221 - protein, 6 aa, Mycobacterium
NTAQTN

SEQ ID NO: 1018222 - protein, 9 aa, Mycobacterium
NTARASKAT

SEQ ID NO: 1018223 - protein, 6 aa, Mycobacterium
NTATFA

SEQ ID NO: 1018224 - protein, 8 aa, Mycobacterium
NTDAPRNR

SEQ ID NO: 1018225 - protein, 5 aa, Mycobacterium
NTDGA

SEQ ID NO: 1018226 - protein, 9 aa, Mycobacterium
NTDGEAAEH

SEQ ID NO: 1018227 - protein, 6 aa, Mycobacterium
NTDPTF

SEQ ID NO: 1018228 - protein, 6 aa, Mycobacterium
NTDPYG

SEQ ID NO: 1018229 - protein, 10 aa, Mycobacterium
NTDSAGNSYG

SEQ ID NO: 1018230 - protein, 6 aa, Mycobacterium
NTDTGQ

SEQ ID NO: 1018231 - protein, 10 aa, Mycobacterium
NTEADDKGRN

SEQ ID NO: 1018232 - protein, 18 aa, Mycobacterium
NTEGQDPESLADAIGRLW

SEQ ID NO: 1018233 - protein, 9 aa, Mycobacterium
NTESAGSRP

SEQ ID NO: 1018234 - protein, 5 aa, Mycobacterium
NTEVS

SEQ ID NO: 1018235 - protein, 9 aa, Mycobacterium
NTGAGPYLE

SEQ ID NO: 1018236 - protein, 5 aa, Mycobacterium
NTGAP

SEQ ID NO: 1018237 - protein, 9 aa, Mycobacterium
NTGATQWSD

SEQ ID NO: 1018238 - protein, 10 aa, Mycobacterium
NTGDRSGADV

SEQ ID NO: 1018239 - protein, 9 aa, Mycobacterium
NTGFGNGGN

SEQ ID NO: 1018240 - protein, 4 aa, Mycobacterium
NTGG

SEQ ID NO: 1018241 - protein, 10 aa, Mycobacterium
NTGGFNSGSM

SEQ ID NO: 1018242 - protein, 11 aa, Mycobacterium
NTGGKPKAVKC

SEQ ID NO: 1018243 - protein, 33 aa, Mycobacterium
NTGIGNVGSYNTGGFNPGDANTGGFNTGSYNTG

SEQ ID NO: 1018244 - protein, 5 aa, Mycobacterium
NTGLG

SEQ ID NO: 1018245 - protein, 10 aa, Mycobacterium
NTGLGNSGQW

SEQ ID NO: 1018246 - protein, 7 aa, Mycobacterium
NTGNNNI

SEQ ID NO: 1018247 - protein, 9 aa, Mycobacterium
NTGRAAPRD

SEQ ID NO: 1018248 - protein, 6 aa, Mycobacterium
NTGSGN

SEQ ID NO: 1018249 - protein, 7 aa, Mycobacterium
NTGSGNI

SEQ ID NO: 1018250 - protein, 16 aa, Mycobacterium
NTGSGNIGIGNSGSNN

SEQ ID NO: 1018251 - protein, 19 aa, Mycobacterium
NTGSGTASGFGNTGGNNSG

SEQ ID NO: 1018252 - protein, 7 aa, Mycobacterium
NTGSNNI

SEQ ID NO: 1018253 - protein, 32 aa, Mycobacterium
NTGSNNIGIGNTGDGNIGFGNTGNDNTGIGLN

SEQ ID NO: 1018254 - protein, 4 aa, Mycobacterium
NTGT

SEQ ID NO: 1018255 - protein, 9 aa, Mycobacterium
NTGTDNSGF

SEQ ID NO: 1018256 - protein, 5 aa, Mycobacterium
NTGVG

SEQ ID NO: 1018257 - protein, 20 aa, Mycobacterium
NTGVPTTDQPQKGKDFTSDQ

SEQ ID NO: 1018258 - protein, 39 aa, Mycobacterium
NTGYSGGNGGNGGAGGTGDLAESGGAGGQGGNGGTGSNI

SEQ ID NO: 1018259 - protein, 12 aa, Mycobacterium
NTKGKPEDPAAA

SEQ ID NO: 1018260 - protein, 5 aa, Mycobacterium
NTKPV

SEQ ID NO: 1018261 - protein, 6 aa, Mycobacterium
NTLSSY

SEQ ID NO: 1018262 - protein, 5 aa, Mycobacterium
NTLTA

SEQ ID NO: 1018263 - protein, 18 aa, Mycobacterium
NTLTPSAPGGYDPTGAPA

SEQ ID NO: 1018264 - protein, 14 aa, Mycobacterium
NTMSGTGLQRLRLQ

SEQ ID NO: 1018265 - protein, 10 aa, Mycobacterium
NTNGDNPTTR

SEQ ID NO: 1018266 - protein, 6 aa, Mycobacterium
NTNVGS

SEQ ID NO: 1018267 - protein, 4 aa, Mycobacterium
NTPA

SEQ ID NO: 1018268 - protein, 8 aa, Mycobacterium
NTPAGDQG

SEQ ID NO: 1018269 - protein, 12 aa, Mycobacterium
NTPAIATTEAEY

SEQ ID NO: 1018270 - protein, 4 aa, Mycobacterium
NTPD

SEQ ID NO: 1018271 - protein, 4 aa, Mycobacterium
NTPE

SEQ ID NO: 1018272 - protein, 9 aa, Mycobacterium
NTPEGGRPL

SEQ ID NO: 1018273 - protein, 22 aa, Mycobacterium
NTPKPCTEPPYSGGQDRANDLN

SEQ ID NO: 1018274 - protein, 9 aa, Mycobacterium
NTPKSRERV

SEQ ID NO: 1018275 - protein, 6 aa, Mycobacterium
NTPLPT

SEQ ID NO: 1018276 - protein, 9 aa, Mycobacterium
NTPNSAGRY

SEQ ID NO: 1018277 - protein, 9 aa, Mycobacterium
NTPPGREEL

SEQ ID NO: 1018278 - protein, 12 aa, Mycobacterium
NTPPPPMSVKAC

SEQ ID NO: 1018279 - protein, 12 aa, Mycobacterium
NTPQSEHPAFPP

SEQ ID NO: 1018280 - protein, 6 aa, Mycobacterium
NTQAAN

SEQ ID NO: 1018281 - protein, 6 aa, Mycobacterium
NTQETL

SEQ ID NO: 1018282 - protein, 8 aa, Mycobacterium
NTQPPSIT

SEQ ID NO: 1018283 - protein, 4 aa, Mycobacterium
NTQR

SEQ ID NO: 1018284 - protein, 6 aa, Mycobacterium
NTQRRG

SEQ ID NO: 1018285 - protein, 7 aa, Mycobacterium
NTRPRKT

SEQ ID NO: 1018286 - protein, 9 aa, Mycobacterium
NTRRPPRTS

SEQ ID NO: 1018287 - protein, 8 aa, Mycobacterium
NTRSCPGQ

SEQ ID NO: 1018288 - protein, 6 aa, Mycobacterium
NTRSYG

SEQ ID NO: 1018289 - protein, 17 aa, Mycobacterium
NTSANSYASAEANAAKT

SEQ ID NO: 1018290 - protein, 7 aa, Mycobacterium
NTSAPVM

SEQ ID NO: 1018291 - protein, 6 aa, Mycobacterium
NTSDLA

SEQ ID NO: 1018292 - protein, 5 aa, Mycobacterium
NTSED

SEQ ID NO: 1018293 - protein, 7 aa, Mycobacterium
NTSEEEF

SEQ ID NO: 1018294 - protein, 7 aa, Mycobacterium
NTSGALQ

SEQ ID NO: 1018295 - protein, 21 aa, Mycobacterium
NTSKGEAAAQQMTGPNAGPVE

SEQ ID NO: 1018296 - protein, 10 aa, Mycobacterium
NTSLASGSAP

SEQ ID NO: 1018297 - protein, 6 aa, Mycobacterium
NTSPGY

SEQ ID NO: 1018298 - protein, 8 aa, Mycobacterium
NTSSAYAK

SEQ ID NO: 1018299 - protein, 23 aa, Mycobacterium
NTSSGAGLQGSVGQANYSAAKAG

SEQ ID NO: 1018300 - protein, 7 aa, Mycobacterium
NTSSNLN

SEQ ID NO: 1018301 - protein, 4 aa, Mycobacterium
NTTD

SEQ ID NO: 1018302 - protein, 8 aa, Mycobacterium
NTTDSATV

SEQ ID NO: 1018303 - protein, 4 aa, Mycobacterium
NTTF

SEQ ID NO: 1018304 - protein, 9 aa, Mycobacterium
NTTGSFTTP

SEQ ID NO: 1018305 - protein, 4 aa, Mycobacterium
NTTI

SEQ ID NO: 1018306 - protein, 5 aa, Mycobacterium
NTTRR

SEQ ID NO: 1018307 - protein, 7 aa, Mycobacterium
NTTVSRD

SEQ ID NO: 1018308 - protein, 11 aa, Mycobacterium
NTVAKGHSSAI

SEQ ID NO: 1018309 - protein, 6 aa, Mycobacterium
NTVDGG

SEQ ID NO: 1018310 - protein, 9 aa, Mycobacterium
NTVTPTGVG

SEQ ID NO: 1018311 - protein, 5 aa, Mycobacterium
NTYGG

SEQ ID NO: 1018312 - protein, 12 aa, Mycobacterium
NTYPQAQGTGVV

SEQ ID NO: 1018313 - protein, 6 aa, Mycobacterium
NVADNG

SEQ ID NO: 1018314 - protein, 11 aa, Mycobacterium
NVAGGKPPAAV

SEQ ID NO: 1018315 - protein, 15 aa, Mycobacterium
NVARTGDRQAGPGRA

SEQ ID NO: 1018316 - protein, 7 aa, Mycobacterium
NVATTQV

SEQ ID NO: 1018317 - protein, 5 aa, Mycobacterium
NVDEV

SEQ ID NO: 1018318 - protein, 12 aa, Mycobacterium
NVDGKGASYGSH

SEQ ID NO: 1018319 - protein, 7 aa, Mycobacterium
NVEDPAQ

SEQ ID NO: 1018320 - protein, 12 aa, Mycobacterium
NVGAGNSGDGNL

SEQ ID NO: 1018321 - protein, 8 aa, Mycobacterium
NVGKPQVA

SEQ ID NO: 1018322 - protein, 8 aa, Mycobacterium
NVGLGNAG

SEQ ID NO: 1018323 - protein, 6 aa, Mycobacterium
NVGNNN

SEQ ID NO: 1018324 - protein, 6 aa, Mycobacterium
NVGPNQ

SEQ ID NO: 1018325 - protein, 5 aa, Mycobacterium
NVGQG

SEQ ID NO: 1018326 - protein, 6 aa, Mycobacterium
NVLPSR

SEQ ID NO: 1018327 - protein, 4 aa, Mycobacterium
NVNG

SEQ ID NO: 1018328 - protein, 24 aa, Mycobacterium
NVNTGIGNATDAGEVGLTATDSSG

SEQ ID NO: 1018329 - protein, 19 aa, Mycobacterium
NVPAPVADRRPLPPRHPHQ

SEQ ID NO: 1018330 - protein, 7 aa, Mycobacterium
NVPERGG

SEQ ID NO: 1018331 - protein, 7 aa, Mycobacterium
NVPGLNA

SEQ ID NO: 1018332 - protein, 8 aa, Mycobacterium
NVPGPKET

SEQ ID NO: 1018333 - protein, 4 aa, Mycobacterium
NVPQ

SEQ ID NO: 1018334 - protein, 6 aa, Mycobacterium
NVQGKP

SEQ ID NO: 1018335 - protein, 11 aa, Mycobacterium
NVREGEAGGIT

SEQ ID NO: 1018336 - protein, 7 aa, Mycobacterium
NVRGPYK

SEQ ID NO: 1018337 - protein, 14 aa, Mycobacterium
NVRPSLRADPDLTR

SEQ ID NO: 1018338 - protein, 6 aa, Mycobacterium
NVRSAP

SEQ ID NO: 1018339 - protein, 35 aa, Mycobacterium
NVSTGIGNPGNYNTASFSTGSFNTAGLNPGDYNTG

SEQ ID NO: 1018340 - protein, 4 aa, Mycobacterium
NVSV

SEQ ID NO: 1018341 - protein, 18 aa, Mycobacterium
NVTDQASEIADTMAAKVP

SEQ ID NO: 1018342 - protein, 17 aa, Mycobacterium
NVTPEAGPGYGDAVAAP

SEQ ID NO: 1018343 - protein, 6 aa, Mycobacterium
NVTRED

SEQ ID NO: 1018344 - protein, 8 aa, Mycobacterium
NVTSPPSC

SEQ ID NO: 1018345 - protein, 8 aa, Mycobacterium
NVVGSSPG

SEQ ID NO: 1018346 - protein, 10 aa, Mycobacterium
NWETGDPKKQ

SEQ ID NO: 1018347 - protein, 9 aa, Mycobacterium
NWGRASAEV

SEQ ID NO: 1018348 - protein, 5 aa, Mycobacterium
NWRDD

SEQ ID NO: 1018349 - protein, 4 aa, Mycobacterium
NYAA

SEQ ID NO: 1018350 - protein, 7 aa, Mycobacterium
NYASPER

SEQ ID NO: 1018351 - protein, 17 aa, Mycobacterium
NYDGPGYTVQGSVNASD

SEQ ID NO: 1018352 - protein, 14 aa, Mycobacterium
NYEATKDLPAATGD

SEQ ID NO: 1018353 - protein, 5 aa, Mycobacterium
NYGEL

SEQ ID NO: 1018354 - protein, 8 aa, Mycobacterium
NYGPGDPN

SEQ ID NO: 1018355 - protein, 6 aa, Mycobacterium
NYGPTI

SEQ ID NO: 1018356 - protein, 8 aa, Mycobacterium
NYGVPDNE

SEQ ID NO: 1018357 - protein, 13 aa, Mycobacterium
NYPEAWGDEEKRV

SEQ ID NO: 1018358 - protein, 4 aa, Mycobacterium
NYPG

SEQ ID NO: 1018359 - protein, 7 aa, Mycobacterium
NYPGRPR

SEQ ID NO: 1018360 - protein, 4 aa, Mycobacterium
NYPP

SEQ ID NO: 1018361 - protein, 6 aa, Mycobacterium
NYPPEV

SEQ ID NO: 1018362 - protein, 12 aa, Mycobacterium
NYSATWESCLCG

SEQ ID NO: 1018363 - protein, 5 aa, Mycobacterium
NYSDN

SEQ ID NO: 1018364 - protein, 4 aa, Mycobacterium
NYSG

SEQ ID NO: 1018365 - protein, 45 aa, Mycobacterium; identical to SEQ ID NO: 910719

SEQ ID NO: 1018366 - protein, 7 aa, Mycobacterium
PAAAARS

SEQ ID NO: 1018367 - protein, 15 aa, Mycobacterium
PAAAARYAANPAQAI

SEQ ID NO: 1018368 - protein, 20 aa, Mycobacterium
PAAADESDAVRAKSTPTDPV

SEQ ID NO: 1018369 - protein, 54 aa, Mycobacterium
PAAAPAKPAPAPAPAKPAAGPPAAGNGSPAAAPSAKPAAAPAKAPAPPPAEGDE

SEQ ID NO: 1018370 - protein, 17 aa, Mycobacterium
PAAASPDDAAVEAAAER

SEQ ID NO: 1018371 - protein, 5 aa, Mycobacterium
PAAAT

SEQ ID NO: 1018372 - protein, 14 aa, Mycobacterium
PAAATSELDQRKNA

SEQ ID NO: 1018373 - protein, 14 aa, Mycobacterium
PAAAVDRAAPPRAV

SEQ ID NO: 1018374 - protein, 5 aa, Mycobacterium
PAADG

SEQ ID NO: 1018375 - protein, 9 aa, Mycobacterium
PAADPDRYA

SEQ ID NO: 1018376 - protein, 6 aa, Mycobacterium
PAAEEV

SEQ ID NO: 1018377 - protein, 18 aa, Mycobacterium
PAAGEASSIITPRHPDCA

SEQ ID NO: 1018378 - protein, 5 aa, Mycobacterium
PAAGV

SEQ ID NO: 1018379 - protein, 8 aa, Mycobacterium
PAAGVESG

SEQ ID NO: 1018380 - protein, 7 aa, Mycobacterium
PAAHDSE

SEQ ID NO: 1018381 - protein, 6 aa, Mycobacterium
PAAHVG

SEQ ID NO: 1018382 - protein, 4 aa, Mycobacterium
PAAK

SEQ ID NO: 1018383 - protein, 6 aa, Mycobacterium
PAALSP

SEQ ID NO: 1018384 - protein, 6 aa, Mycobacterium
PAANPD

SEQ ID NO: 1018385 - protein, 8 aa, Mycobacterium
PAAPAGAP

SEQ ID NO: 1018386 - protein, 11 aa, Mycobacterium
PAAPDYRKPAP

SEQ ID NO: 1018387 - protein, 6 aa, Mycobacterium
PAAPPL

SEQ ID NO: 1018388 - protein, 20 aa, Mycobacterium
PAAPVAPGAPVAMAATRPAV

SEQ ID NO: 1018389 - protein, 9 aa, Mycobacterium
PAAQGRGLG

SEQ ID NO: 1018390 - protein, 5 aa, Mycobacterium
PAARG

SEQ ID NO: 1018391 - protein, 5 aa, Mycobacterium
PAARH

SEQ ID NO: 1018392 - protein, 8 aa, Mycobacterium
PAARPMNG

SEQ ID NO: 1018393 - protein, 11 aa, Mycobacterium
PAARRAQAQAA

SEQ ID NO: 1018394 - protein, 13 aa, Mycobacterium
PAARRNAQSIGEK

SEQ ID NO: 1018395 - protein, 11 aa, Mycobacterium
PAARRPQPIDT

SEQ ID NO: 1018396 - protein, 7 aa, Mycobacterium
PAARTRM

SEQ ID NO: 1018397 - protein, 9 aa, Mycobacterium
PAASGRNYE

SEQ ID NO: 1018398 - protein, 9 aa, Mycobacterium
PAASPDPRA

SEQ ID NO: 1018399 - protein, 29 aa, Mycobacterium
PAASPRVGNRSVSAAVAPTVSKNGVDLDH

SEQ ID NO: 1018400 - protein, 10 aa, Mycobacterium
PAASYRPGEA

SEQ ID NO: 1018401 - protein, 7 aa, Mycobacterium
PAATGAE

SEQ ID NO: 1018402 - protein, 8 aa, Mycobacterium
PAATGETP

SEQ ID NO: 1018403 - protein, 7 aa, Mycobacterium
PAATKAD

SEQ ID NO: 1018404 - protein, 6 aa, Mycobacterium
PAATPW

SEQ ID NO: 1018405 - protein, 17 aa, Mycobacterium
PAATRTTGTASPAAAAQ

SEQ ID NO: 1018406 - protein, 4 aa, Mycobacterium
PAAV

SEQ ID NO: 1018407 - protein, 5 aa, Mycobacterium
PAAVA

SEQ ID NO: 1018408 - protein, 8 aa, Mycobacterium
PAAVPSGV

SEQ ID NO: 1018409 - protein, 4 aa, Mycobacterium
PAAY

SEQ ID NO: 1018410 - protein, 7 aa, Mycobacterium
PACADDL

SEQ ID NO: 1018411 - protein, 23 aa, Mycobacterium
PACTAADAAGAAVPAEAQQPSTV

SEQ ID NO: 1018412 - protein, 12 aa, Mycobacterium
PADAAQRVTGPA

SEQ ID NO: 1018413 - protein, 8 aa, Mycobacterium
PADANETA

SEQ ID NO: 1018414 - protein, 10 aa, Mycobacterium
PADANVSEMP

SEQ ID NO: 1018415 - protein, 6 aa, Mycobacterium
PADAPG

SEQ ID NO: 1018416 - protein, 8 aa, Mycobacterium
PADARDYG

SEQ ID NO: 1018417 - protein, 7 aa, Mycobacterium
PADARTD

SEQ ID NO: 1018418 - protein, 8 aa, Mycobacterium
PADASALD

SEQ ID NO: 1018419 - protein, 10 aa, Mycobacterium
PADATATASM

SEQ ID NO: 1018420 - protein, 10 aa, Mycobacterium
PADATNPVAA

SEQ ID NO: 1018421 - protein, 32 aa, Mycobacterium
PADAYKSAPSITKPMGPPSPGQPQWNPQRATS

SEQ ID NO: 1018422 - protein, 13 aa, Mycobacterium
PADCSTLSGPACE

SEQ ID NO: 1018423 - protein, 20 aa, Mycobacterium
PADDRSGSGRRCKWSPSTAA

SEQ ID NO: 1018424 - protein, 10 aa, Mycobacterium
PADDTARHDE

SEQ ID NO: 1018425 - protein, 8 aa, Mycobacterium
PADEHRRA

SEQ ID NO: 1018426 - protein, 6 aa, Mycobacterium
PADEKN

SEQ ID NO: 1018427 - protein, 8 aa, Mycobacterium
PADGPIGD

SEQ ID NO: 1018428 - protein, 5 aa, Mycobacterium
PADGR

SEQ ID NO: 1018429 - protein, 4 aa, Mycobacterium
PADI

SEQ ID NO: 1018430 - protein, 6 aa, Mycobacterium
PADLEQ

SEQ ID NO: 1018431 - protein, 4 aa, Mycobacterium
PADN

SEQ ID NO: 1018432 - protein, 7 aa, Mycobacterium
PADPADP

SEQ ID NO: 1018433 - protein, 12 aa, Mycobacterium
PADPDAKPRPLA

SEQ ID NO: 1018434 - protein, 9 aa, Mycobacterium
PADPHRRPS

SEQ ID NO: 1018435 - protein, 10 aa, Mycobacterium
PADPPATRQA

SEQ ID NO: 1018436 - protein, 9 aa, Mycobacterium
PADPQDPAT

SEQ ID NO: 1018437 - protein, 8 aa, Mycobacterium
PADQRDPA

SEQ ID NO: 1018438 - protein, 9 aa, Mycobacterium
PADQSDRRT

SEQ ID NO: 1018439 - protein, 5 aa, Mycobacterium
PADQV

SEQ ID NO: 1018440 - protein, 8 aa, Mycobacterium
PADQVPDA

SEQ ID NO: 1018441 - protein, 4 aa, Mycobacterium
PADR

SEQ ID NO: 1018442 - protein, 8 aa, Mycobacterium
PADRQQLS

SEQ ID NO: 1018443 - protein, 7 aa, Mycobacterium
PADRRDY

SEQ ID NO: 1018444 - protein, 7 aa, Mycobacterium
PADSPGV

SEQ ID NO: 1018445 - protein, 14 aa, Mycobacterium
PADTRTVSVEERRR

SEQ ID NO: 1018446 - protein, 8 aa, Mycobacterium
PADVAREG

SEQ ID NO: 1018447 - protein, 4 aa, Mycobacterium
PADY

SEQ ID NO: 1018448 - protein, 7 aa, Mycobacterium
PAEAEAE

SEQ ID NO: 1018449 - protein, 5 aa, Mycobacterium
PAEAG

SEQ ID NO: 1018450 - protein, 16 aa, Mycobacterium
PAEDATASGDVAVGSG

SEQ ID NO: 1018451 - protein, 10 aa, Mycobacterium
PAEEAAEADV

SEQ ID NO: 1018452 - protein, 9 aa, Mycobacterium
PAEGGSNTA

SEQ ID NO: 1018453 - protein, 9 aa, Mycobacterium
PAEGRPARK

SEQ ID NO: 1018454 - protein, 7 aa, Mycobacterium
PAEGTAA

SEQ ID NO: 1018455 - protein, 4 aa, Mycobacterium
PAEH

SEQ ID NO: 1018456 - protein, 8 aa, Mycobacterium
PAEHTDSG

SEQ ID NO: 1018457 - protein, 4 aa, Mycobacterium
PAEI

SEQ ID NO: 1018458 - protein, 12 aa, Mycobacterium
PAEIGKNRNADV

SEQ ID NO: 1018459 - protein, 4 aa, Mycobacterium
PAEL

SEQ ID NO: 1018460 - protein, 16 aa, Mycobacterium
PAEPAPDPLAPPPGPL

SEQ ID NO: 1018461 - protein, 7 aa, Mycobacterium
PAEPDAE

SEQ ID NO: 1018462 - protein, 5 aa, Mycobacterium
PAESE

SEQ ID NO: 1018463 - protein, 12 aa, Mycobacterium
PAESLTGTTGLG

SEQ ID NO: 1018464 - protein, 11 aa, Mycobacterium
PAETAAPDRRR

SEQ ID NO: 1018465 - protein, 5 aa, Mycobacterium
PAETE

SEQ ID NO: 1018466 - protein, 24 aa, Mycobacterium
PAETPAAPALPAPPLPPVPPSPPS

SEQ ID NO: 1018467 - protein, 8 aa, Mycobacterium
PAEVRTKT

SEQ ID NO: 1018468 - protein, 7 aa, Mycobacterium
PAEYSGY

SEQ ID NO: 1018469 - protein, 18 aa, Mycobacterium
PAFGSDSAAVSTTATLDG

SEQ ID NO: 1018470 - protein, 6 aa, Mycobacterium
PAFPRA

SEQ ID NO: 1018471 - protein, 5 aa, Mycobacterium
PAFTA

SEQ ID NO: 1018472 - protein, 30 aa, Mycobacterium
PAGAGATSAPAPEAPAAPRATTSARAGAKE

SEQ ID NO: 1018473 - protein, 8 aa, Mycobacterium
PAGAGPKL

SEQ ID NO: 1018474 - protein, 11 aa, Mycobacterium
PAGAGVDPVTA

SEQ ID NO: 1018475 - protein, 11 aa, Mycobacterium
PAGALDSPRAD

SEQ ID NO: 1018476 - protein, 12 aa, Mycobacterium
PAGAPAPALGEH

SEQ ID NO: 1018477 - protein, 8 aa, Mycobacterium
PAGAPELT

SEQ ID NO: 1018478 - protein, 7 aa, Mycobacterium
PAGARTT

SEQ ID NO: 1018479 - protein, 15 aa, Mycobacterium
PAGATEGATNREIET

SEQ ID NO: 1018480 - protein, 21 aa, Mycobacterium
PAGEAVPDEPPAGEAVPDEPH

SEQ ID NO: 1018481 - protein, 9 aa, Mycobacterium
PAGEEISGT

SEQ ID NO: 1018482 - protein, 7 aa, Mycobacterium
PAGFSNG

SEQ ID NO: 1018483 - protein, 9 aa, Mycobacterium
PAGGDARTE

SEQ ID NO: 1018484 - protein, 8 aa, Mycobacterium
PAGGDYDP

SEQ ID NO: 1018485 - protein, 5 aa, Mycobacterium
PAGGP

SEQ ID NO: 1018486 - protein, 7 aa, Mycobacterium
PAGGTLR

SEQ ID NO: 1018487 - protein, 6 aa, Mycobacterium
PAGGYQ

SEQ ID NO: 1018488 - protein, 8 aa, Mycobacterium
PAGHGINN

SEQ ID NO: 1018489 - protein, 8 aa, Mycobacterium
PAGHPDAG

SEQ ID NO: 1018490 - protein, 4 aa, Mycobacterium
PAGI

SEQ ID NO: 1018491 - protein, 6 aa, Mycobacterium
PAGIGK

SEQ ID NO: 1018492 - protein, 7 aa, Mycobacterium
PAGIGKT

SEQ ID NO: 1018493 - protein, 9 aa, Mycobacterium
PAGLPAPKV

SEQ ID NO: 1018494 - protein, 4 aa, Mycobacterium
PAGP

SEQ ID NO: 1018495 - protein, 5 aa, Mycobacterium
PAGPE

SEQ ID NO: 1018496 - protein, 7 aa, Mycobacterium
PAGPGPY

SEQ ID NO: 1018497 - protein, 12 aa, Mycobacterium
PAGPNQRDSGPN

SEQ ID NO: 1018498 - protein, 7 aa, Mycobacterium
PAGPQGH

SEQ ID NO: 1018499 - protein, 10 aa, Mycobacterium
PAGQGTGLGK

SEQ ID NO: 1018500 - protein, 13 aa, Mycobacterium
PAGQRDNAPSTTQ

SEQ ID NO: 1018501 - protein, 4 aa, Mycobacterium
PAGR

SEQ ID NO: 1018502 - protein, 19 aa, Mycobacterium
PAGRKLNASQIEWSAYAEK

SEQ ID NO: 1018503 - protein, 6 aa, Mycobacterium
PAGRRQ

SEQ ID NO: 1018504 - protein, 5 aa, Mycobacterium
PAGRT

SEQ ID NO: 1018505 - protein, 15 aa, Mycobacterium
PAGSDYRNTAPKVSP

SEQ ID NO: 1018506 - protein, 5 aa, Mycobacterium
PAGSF

SEQ ID NO: 1018507 - protein, 6 aa, Mycobacterium
PAGSGP

SEQ ID NO: 1018508 - protein, 18 aa, Mycobacterium
PAGSPDGRAAGHRGCGRR

SEQ ID NO: 1018509 - protein, 9 aa, Mycobacterium
PAGSQSDEL

SEQ ID NO: 1018510 - protein, 13 aa, Mycobacterium
PAGSTDKFGRGLT

SEQ ID NO: 1018511 - protein, 9 aa, Mycobacterium
PAGSTTPPL

SEQ ID NO: 1018512 - protein, 10 aa, Mycobacterium
PAGSTTPSEL

SEQ ID NO: 1018513 - protein, 8 aa, Mycobacterium
PAGSTTPV

SEQ ID NO: 1018514 - protein, 5 aa, Mycobacterium
PAGTA

SEQ ID NO: 1018515 - protein, 7 aa, Mycobacterium
PAGTDIT

SEQ ID NO: 1018516 - protein, 35 aa, Mycobacterium
PAGTGGTGGNGGIGGTGGTASGAGATGGNGAMGGM

SEQ ID NO: 1018517 - protein, 7 aa, Mycobacterium
PAGTGKT

SEQ ID NO: 1018518 - protein, 6 aa, Mycobacterium
PAGTLT

SEQ ID NO: 1018519 - protein, 21 aa, Mycobacterium
PAGTTAAAAIGEAGLPRRGAP

SEQ ID NO: 1018520 - protein, 14 aa, Mycobacterium
PAGVGAPPLSEADA

SEQ ID NO: 1018521 - protein, 10 aa, Mycobacterium
PAGVQTAENL

SEQ ID NO: 1018522 - protein, 5 aa, Mycobacterium
PAGYT

SEQ ID NO: 1018523 - protein, 6 aa, Mycobacterium
PAHAAT

SEQ ID NO: 1018524 - protein, 5 aa, Mycobacterium
PAHAD

SEQ ID NO: 1018525 - protein, 4 aa, Mycobacterium
PAHE

SEQ ID NO: 1018526 - protein, 7 aa, Mycobacterium
PAHGADA

SEQ ID NO: 1018527 - protein, 7 aa, Mycobacterium
PAHPPGH

SEQ ID NO: 1018528 - protein, 5 aa, Mycobacterium
PAHSD

SEQ ID NO: 1018529 - protein, 6 aa, Mycobacterium
PAHTAA

SEQ ID NO: 1018530 - protein, 6 aa, Mycobacterium
PAIADD

SEQ ID NO: 1018531 - protein, 13 aa, Mycobacterium
PAIAGQPAPSELA

SEQ ID NO: 1018532 - protein, 4 aa, Mycobacterium
PAIP

SEQ ID NO: 1018533 - protein, 18 aa, Mycobacterium
PAITGKPSGDDLRERKAT

SEQ ID NO: 1018534 - protein, 21 aa, Mycobacterium
PAKAEDSVTEQATVLRRKIQD

SEQ ID NO: 1018535 - protein, 5 aa, Mycobacterium
PAKAR

SEQ ID NO: 1018536 - protein, 11 aa, Mycobacterium
PAKPPSAQTDA

SEQ ID NO: 1018537 - protein, 6 aa, Mycobacterium
PAKPVA

SEQ ID NO: 1018538 - protein, 6 aa, Mycobacterium
PAKQVN

SEQ ID NO: 1018539 - protein, 30 aa, Mycobacterium
PAKSARPWAPPTGPTSSPTWAPTPTKPTAV

SEQ ID NO: 1018540 - protein, 8 aa, Mycobacterium
PAKSGVGG

SEQ ID NO: 1018541 - protein, 4 aa, Mycobacterium
PALA

SEQ ID NO: 1018542 - protein, 5 aa, Mycobacterium
PALAA

SEQ ID NO: 1018543 - protein, 7 aa, Mycobacterium
PALATGK

SEQ ID NO: 1018544 - protein, 8 aa, Mycobacterium
PALGPSRE

SEQ ID NO: 1018545 - protein, 8 aa, Mycobacterium
PALPRNRG

SEQ ID NO: 1018546 - protein, 4 aa, Mycobacterium
PALR

SEQ ID NO: 1018547 - protein, 11 aa, Mycobacterium
PALTGPQAQLG

SEQ ID NO: 1018548 - protein, 13 aa, Mycobacterium
PALTSEDLRTSAG

SEQ ID NO: 1018549 - protein, 17 aa, Mycobacterium
PAMTGKPSGDDLRSGKR

SEQ ID NO: 1018550 - protein, 18 aa, Mycobacterium
PANELPTAQDSYSHNTSP

SEQ ID NO: 1018551 - protein, 4 aa, Mycobacterium
PANG

SEQ ID NO: 1018552 - protein, 10 aa, Mycobacterium
PANRDQKARL

SEQ ID NO: 1018553 - protein, 10 aa, Mycobacterium
PANSEPRTGL

SEQ ID NO: 1018554 - protein, 7 aa, Mycobacterium
PANSRVP

SEQ ID NO: 1018555 - protein, 17 aa, Mycobacterium
PANVSRRAKVDVLIVHT

SEQ ID NO: 1018556 - protein, 12 aa, Mycobacterium
PAPAAATSRGGM

SEQ ID NO: 1018557 - protein, 13 aa, Mycobacterium
PAPAQDAEPDGLP

SEQ ID NO: 1018558 - protein, 5 aa, Mycobacterium
PAPAR

SEQ ID NO: 1018559 - protein, 15 aa, Mycobacterium
PAPARRIGGHPAKRT

SEQ ID NO: 1018560 - protein, 7 aa, Mycobacterium
PAPATLR

SEQ ID NO: 1018561 - protein, 4 aa, Mycobacterium
PAPD

SEQ ID NO: 1018562 - protein, 10 aa, Mycobacterium
PAPDGSGYTS

SEQ ID NO: 1018563 - protein, 5 aa, Mycobacterium
PAPDL

SEQ ID NO: 1018564 - protein, 8 aa, Mycobacterium
PAPDRNEV

SEQ ID NO: 1018565 - protein, 5 aa, Mycobacterium
PAPDT

SEQ ID NO: 1018566 - protein, 6 aa, Mycobacterium
PAPDTP

SEQ ID NO: 1018567 - protein, 8 aa, Mycobacterium
PAPDTPFN

SEQ ID NO: 1018568 - protein, 9 aa, Mycobacterium
PAPEDPPAV

SEQ ID NO: 1018569 - protein, 15 aa, Mycobacterium
PAPELASTASVGGYP

SEQ ID NO: 1018570 - protein, 9 aa, Mycobacterium
PAPEPVGGE

SEQ ID NO: 1018571 - protein, 10 aa, Mycobacterium
PAPGDDRQLA

SEQ ID NO: 1018572 - protein, 10 aa, Mycobacterium
PAPGDGRTFS

SEQ ID NO: 1018573 - protein, 7 aa, Mycobacterium
PAPGDHK

SEQ ID NO: 1018574 - protein, 6 aa, Mycobacterium
PAPGPV

SEQ ID NO: 1018575 - protein, 7 aa, Mycobacterium
PAPGSYA

SEQ ID NO: 1018576 - protein, 9 aa, Mycobacterium
PAPHSRTPI

SEQ ID NO: 1018577 - protein, 4 aa, Mycobacterium
PAPI

SEQ ID NO: 1018578 - protein, 9 aa, Mycobacterium
PAPISGAHP

SEQ ID NO: 1018579 - protein, 17 aa, Mycobacterium
PAPKRRSFTSGSCSPWR

SEQ ID NO: 1018580 - protein, 4 aa, Mycobacterium
PAPL

SEQ ID NO: 1018581 - protein, 17 aa, Mycobacterium
PAPLAQTAGTAAIDSAD

SEQ ID NO: 1018582 - protein, 12 aa, Mycobacterium
PAPLPPAGSARA

SEQ ID NO: 1018583 - protein, 6 aa, Mycobacterium
PAPLRT

SEQ ID NO: 1018584 - protein, 8 aa, Mycobacterium
PAPNLPGE

SEQ ID NO: 1018585 - protein, 11 aa, Mycobacterium
PAPPAHHRRDR

SEQ ID NO: 1018586 - protein, 16 aa, Mycobacterium
PAPPAPAAPPLPPSPP

SEQ ID NO: 1018587 - protein, 18 aa, Mycobacterium
PAPPAPPLPHKSPPAAPF

SEQ ID NO: 1018588 - protein, 10 aa, Mycobacterium
PAPPKPSLPA

SEQ ID NO: 1018589 - protein, 7 aa, Mycobacterium
PAPPMTA

SEQ ID NO: 1018590 - protein, 17 aa, Mycobacterium
PAPPRPPFPPSPPEPAE

SEQ ID NO: 1018591 - protein, 12 aa, Mycobacterium
PAPPSVPESPPG

SEQ ID NO: 1018592 - protein, 13 aa, Mycobacterium
PAPPVPPSPPSPK

SEQ ID NO: 1018593 - protein, 19 aa, Mycobacterium
PAPPVPPTPPSPACPPASP

SEQ ID NO: 1018594 - protein, 9 aa, Mycobacterium
PAPQATTAA

SEQ ID NO: 1018595 - protein, 19 aa, Mycobacterium
PAPQSTDTTHNTPPPPHPT

SEQ ID NO: 1018596 - protein, 19 aa, Mycobacterium
PAPRPDSSSLPYPAVGTGR

SEQ ID NO: 1018597 - protein, 18 aa, Mycobacterium
PAPRTPESVAGWDRVLTT

SEQ ID NO: 1018598 - protein, 8 aa, Mycobacterium
PAPTPRRG

SEQ ID NO: 1018599 - protein, 5 aa, Mycobacterium
PAPTR

SEQ ID NO: 1018600 - protein, 8 aa, Mycobacterium
PAPTTAER

SEQ ID NO: 1018601 - protein, 4 aa, Mycobacterium
PAPV

SEQ ID NO: 1018602 - protein, 31 aa, Mycobacterium
PAPVGRTAAPGADVDDEPRWSAAESKPKPVH

SEQ ID NO: 1018603 - protein, 5 aa, Mycobacterium
PAPVP

SEQ ID NO: 1018604 - protein, 10 aa, Mycobacterium
PAPYADDSKD

SEQ ID NO: 1018605 - protein, 9 aa, Mycobacterium
PAQAKRQIA

SEQ ID NO: 1018606 - protein, 9 aa, Mycobacterium
PAQAPTTRG

SEQ ID NO: 1018607 - protein, 4 aa, Mycobacterium
PAQG

SEQ ID NO: 1018608 - protein, 27 aa, Mycobacterium
PAQGGAVTTQDAAPAASPEAQARTAGC

SEQ ID NO: 1018609 - protein, 6 aa, Mycobacterium
PAQGRL

SEQ ID NO: 1018610 - protein, 22 aa, Mycobacterium
PAQPEPSAPHQAPAPGAGQEPI

SEQ ID NO: 1018611 - protein, 4 aa, Mycobacterium
PAQR

SEQ ID NO: 1018612 - protein, 9 aa, Mycobacterium
PAQRQDELT

SEQ ID NO: 1018613 - protein, 4 aa, Mycobacterium
PAQS

SEQ ID NO: 1018614 - protein, 18 aa, Mycobacterium
PAQSAAGSRFATEGLPDV

SEQ ID NO: 1018615 - protein, 10 aa, Mycobacterium
PAQVAANRTQ

SEQ ID NO: 1018616 - protein, 12 aa, Mycobacterium
PAQVQAAPEQPR

SEQ ID NO: 1018617 - protein, 18 aa, Mycobacterium
PAQVSTAKIKKTADSPPV

SEQ ID NO: 1018618 - protein, 4 aa, Mycobacterium
PAQY

SEQ ID NO: 1018619 - protein, 8 aa, Mycobacterium
PARAPGLA

SEQ ID NO: 1018620 - protein, 10 aa, Mycobacterium
PARARKPQRR

SEQ ID NO: 1018621 - protein, 7 aa, Mycobacterium
PARDDYD

SEQ ID NO: 1018622 - protein, 8 aa, Mycobacterium
PARDEGGR

SEQ ID NO: 1018623 - protein, 5 aa, Mycobacterium
PARDL

SEQ ID NO: 1018624 - protein, 6 aa, Mycobacterium
PAREAK

SEQ ID NO: 1018625 - protein, 8 aa, Mycobacterium
PARGTVGE

SEQ ID NO: 1018626 - protein, 4 aa, Mycobacterium
PARL

SEQ ID NO: 1018627 - protein, 5 aa, Mycobacterium
PARLG

SEQ ID NO: 1018628 - protein, 23 aa, Mycobacterium
PARNPWNPQHTPGGSSGGSGAAV

SEQ ID NO: 1018629 - protein, 6 aa, Mycobacterium
PARPGL

SEQ ID NO: 1018630 - protein, 5 aa, Mycobacterium
PARRL

SEQ ID NO: 1018631 - protein, 19 aa, Mycobacterium
PARSLDQQAQDVIDLLELR

SEQ ID NO: 1018632 - protein, 14 aa, Mycobacterium
PARSSRSGESILTT

SEQ ID NO: 1018633 - protein, 4 aa, Mycobacterium
PARV

SEQ ID NO: 1018634 - protein, 24 aa, Mycobacterium
PARVTGRNVASEAKAPYDPQRADR

SEQ ID NO: 1018635 - protein, 4 aa, Mycobacterium
PASA

SEQ ID NO: 1018636 - protein, 18 aa, Mycobacterium
PASAEDRIVSGPGDQGPF

SEQ ID NO: 1018637 - protein, 5 aa, Mycobacterium
PASAR

SEQ ID NO: 1018638 - protein, 5 aa, Mycobacterium
PASAS

SEQ ID NO: 1018639 - protein, 25 aa, Mycobacterium
PASAVDPAHADGRATRATSETMNSE

SEQ ID NO: 1018640 - protein, 9 aa, Mycobacterium
PASDNWDTG

SEQ ID NO: 1018641 - protein, 8 aa, Mycobacterium
PASDRNRF

SEQ ID NO: 1018642 - protein, 4 aa, Mycobacterium
PASF

SEQ ID NO: 1018643 - protein, 9 aa, Mycobacterium
PASGPGTIA

SEQ ID NO: 1018644 - protein, 10 aa, Mycobacterium
PASGSGTGAQ

SEQ ID NO: 1018645 - protein, 7 aa, Mycobacterium
PASKTRA

SEQ ID NO: 1018646 - protein, 9 aa, Mycobacterium
PASLSTSSL

SEQ ID NO: 1018647 - protein, 7 aa, Mycobacterium
PASMPAQ

SEQ ID NO: 1018648 - protein, 7 aa, Mycobacterium
PASMPTR

SEQ ID NO: 1018649 - protein, 7 aa, Mycobacterium
PASPGPH

SEQ ID NO: 1018650 - protein, 12 aa, Mycobacterium
PASPGWPSTSAN

SEQ ID NO: 1018651 - protein, 7 aa, Mycobacterium
PASPHAA

SEQ ID NO: 1018652 - protein, 13 aa, Mycobacterium
PASPKGVATGEGG

SEQ ID NO: 1018653 - protein, 8 aa, Mycobacterium
PASPPLPP

SEQ ID NO: 1018654 - protein, 14 aa, Mycobacterium
PASPSDVLGEPGDG

SEQ ID NO: 1018655 - protein, 12 aa, Mycobacterium
PASQGSGTVAVR

SEQ ID NO: 1018656 - protein, 14 aa, Mycobacterium
PASRETPYPGGDEL

SEQ ID NO: 1018657 - protein, 12 aa, Mycobacterium
PASRPSTAAPTK

SEQ ID NO: 1018658 - protein, 25 aa, Mycobacterium
PASRRSRQRHDPATSIPLTAQTGPA

SEQ ID NO: 1018659 - protein, 12 aa, Mycobacterium
PASSDFSSSDFP

SEQ ID NO: 1018660 - protein, 4 aa, Mycobacterium
PAST

SEQ ID NO: 1018661 - protein, 7 aa, Mycobacterium
PASTPDA

SEQ ID NO: 1018662 - protein, 5 aa, Mycobacterium
PASVA

SEQ ID NO: 1018663 - protein, 11 aa, Mycobacterium
PASVAEDFTRP

SEQ ID NO: 1018664 - protein, 14 aa, Mycobacterium
PASVGAQGNTNVTN

SEQ ID NO: 1018665 - protein, 7 aa, Mycobacterium
PATADQL

SEQ ID NO: 1018666 - protein, 14 aa, Mycobacterium
PATARATAAATTPE

SEQ ID NO: 1018667 - protein, 7 aa, Mycobacterium
PATASFN

SEQ ID NO: 1018668 - protein, 7 aa, Mycobacterium
PATDPAV

SEQ ID NO: 1018669 - protein, 10 aa, Mycobacterium
PATDVPTAAE

SEQ ID NO: 1018670 - protein, 4 aa, Mycobacterium
PATF

SEQ ID NO: 1018671 - protein, 5 aa, Mycobacterium
PATGA

SEQ ID NO: 1018672 - protein, 6 aa, Mycobacterium
PATGAG

SEQ ID NO: 1018673 - protein, 11 aa, Mycobacterium
PATGDSGSRTC

SEQ ID NO: 1018674 - protein, 5 aa, Mycobacterium
PATGR

SEQ ID NO: 1018675 - protein, 15 aa, Mycobacterium
PATGSFDPSGTSAIG

SEQ ID NO: 1018676 - protein, 9 aa, Mycobacterium
PATGTTKSD

SEQ ID NO: 1018677 - protein, 4 aa, Mycobacterium
PATH

SEQ ID NO: 1018678 - protein, 6 aa, Mycobacterium
PATIGG

SEQ ID NO: 1018679 - protein, 4 aa, Mycobacterium
PATL

SEQ ID NO: 1018680 - protein, 7 aa, Mycobacterium
PATLPES

SEQ ID NO: 1018681 - protein, 6 aa, Mycobacterium
PATLPK

SEQ ID NO: 1018682 - protein, 4 aa, Mycobacterium
PATP

SEQ ID NO: 1018683 - protein, 11 aa, Mycobacterium
PATPADKTDTR

SEQ ID NO: 1018684 - protein, 7 aa, Mycobacterium
PATPTTA

SEQ ID NO: 1018685 - protein, 7 aa, Mycobacterium
PATQETI

SEQ ID NO: 1018686 - protein, 8 aa, Mycobacterium
PATRSSEL

SEQ ID NO: 1018687 - protein, 6 aa, Mycobacterium
PATSAV

SEQ ID NO: 1018688 - protein, 7 aa, Mycobacterium
PATWTEP

SEQ ID NO: 1018689 - protein, 4 aa, Mycobacterium
PAVA

SEQ ID NO: 1018690 - protein, 6 aa, Mycobacterium
PAVAAA

SEQ ID NO: 1018691 - protein, 18 aa, Mycobacterium
PAVAARPSTGLPAPAADD

SEQ ID NO: 1018692 - protein, 7 aa, Mycobacterium
PAVASGA

SEQ ID NO: 1018693 - protein, 14 aa, Mycobacterium
PAVASSDARNIETT

SEQ ID NO: 1018694 - protein, 11 aa, Mycobacterium
PAVASSDATNV

SEQ ID NO: 1018695 - protein, 8 aa, Mycobacterium
PAVCPGTE

SEQ ID NO: 1018696 - protein, 6 aa, Mycobacterium
PAVGEN

SEQ ID NO: 1018697 - protein, 7 aa, Mycobacterium
PAVGRRG

SEQ ID NO: 1018698 - protein, 4 aa, Mycobacterium
PAVP

SEQ ID NO: 1018699 - protein, 7 aa, Mycobacterium
PAVSAKK

SEQ ID NO: 1018700 - protein, 4 aa, Mycobacterium
PAVT

SEQ ID NO: 1018701 - protein, 18 aa, Mycobacterium
PAVTAGAAGLTRSGGVSA

SEQ ID NO: 1018702 - protein, 5 aa, Mycobacterium
PAYDD

SEQ ID NO: 1018703 - protein, 6 aa, Mycobacterium
PAYPDE

SEQ ID NO: 1018704 - protein, 8 aa, Mycobacterium
PAYQGRGI

SEQ ID NO: 1018705 - protein, 10 aa, Mycobacterium
PAYRGGPTLR

SEQ ID NO: 1018706 - protein, 8 aa, Mycobacterium
PCAPADPQ

SEQ ID NO: 1018707 - protein, 7 aa, Mycobacterium
PCAREGD

SEQ ID NO: 1018708 - protein, 6 aa, Mycobacterium
PCPASR

SEQ ID NO: 1018709 - protein, 6 aa, Mycobacterium
PCPEPS

SEQ ID NO: 1018710 - protein, 8 aa, Mycobacterium
PCRRSRRS

SEQ ID NO: 1018711 - protein, 6 aa, Mycobacterium
PCTGTG

SEQ ID NO: 1018712 - protein, 23 aa, Mycobacterium
PCTRGRRRDGTGIFSPPVGPLCG

SEQ ID NO: 1018713 - protein, 8 aa, Mycobacterium
PDAAADAE

SEQ ID NO: 1018714 - protein, 10 aa, Mycobacterium
PDAADTTTDP

SEQ ID NO: 1018715 - protein, 5 aa, Mycobacterium
PDAAL

SEQ ID NO: 1018716 - protein, 6 aa, Mycobacterium
PDAAPK

SEQ ID NO: 1018717 - protein, 8 aa, Mycobacterium
PDAARSLG

SEQ ID NO: 1018718 - protein, 19 aa, Mycobacterium
PDAASGTPIAATQAASTAE

SEQ ID NO: 1018719 - protein, 4 aa, Mycobacterium
PDAD

SEQ ID NO: 1018720 - protein, 7 aa, Mycobacterium
PDADGEK

SEQ ID NO: 1018721 - protein, 8 aa, Mycobacterium
PDAEAGKE

SEQ ID NO: 1018722 - protein, 10 aa, Mycobacterium
PDAEPGTSPF

SEQ ID NO: 1018723 - protein, 7 aa, Mycobacterium
PDAESAV

SEQ ID NO: 1018724 - protein, 4 aa, Mycobacterium
PDAF

SEQ ID NO: 1018725 - protein, 4 aa, Mycobacterium
PDAG

SEQ ID NO: 1018726 - protein, 6 aa, Mycobacterium
PDAGHS

SEQ ID NO: 1018727 - protein, 7 aa, Mycobacterium
PDAGHSF

SEQ ID NO: 1018728 - protein, 11 aa, Mycobacterium
PDAGKPGHPPF

SEQ ID NO: 1018729 - protein, 7 aa, Mycobacterium
PDAGLDA

SEQ ID NO: 1018730 - protein, 5 aa, Mycobacterium
PDAGP

SEQ ID NO: 1018731 - protein, 24 aa, Mycobacterium
PDAGPELEKPPTGTAIGNASSDAG

SEQ ID NO: 1018732 - protein, 5 aa, Mycobacterium
PDAGS

SEQ ID NO: 1018733 - protein, 7 aa, Mycobacterium
PDAHRES

SEQ ID NO: 1018734 - protein, 16 aa, Mycobacterium
PDAKDFGNAAPLPADP

SEQ ID NO: 1018735 - protein, 27 aa, Mycobacterium
PDALPVGGAQAAGIASPQWAQSSAPRY

SEQ ID NO: 1018736 - protein, 9 aa, Mycobacterium
PDAMGESTA

SEQ ID NO: 1018737 - protein, 10 aa, Mycobacterium
PDANQDVETR

SEQ ID NO: 1018738 - protein, 5 aa, Mycobacterium
PDAPE

SEQ ID NO: 1018739 - protein, 7 aa, Mycobacterium
PDAPIRT

SEQ ID NO: 1018740 - protein, 8 aa, Mycobacterium
PDAPKHKG

SEQ ID NO: 1018741 - protein, 5 aa, Mycobacterium
PDAPP

SEQ ID NO: 1018742 - protein, 16 aa, Mycobacterium
PDAPPVTPRGACDPRA

SEQ ID NO: 1018743 - protein, 6 aa, Mycobacterium
PDAPTL

SEQ ID NO: 1018744 - protein, 6 aa, Mycobacterium
PDAQGP

SEQ ID NO: 1018745 - protein, 6 aa, Mycobacterium
PDARAV

SEQ ID NO: 1018746 - protein, 7 aa, Mycobacterium
PDARTAD

SEQ ID NO: 1018747 - protein, 10 aa, Mycobacterium
PDASDKELAA

SEQ ID NO: 1018748 - protein, 10 aa, Mycobacterium
PDASDPRPAV

SEQ ID NO: 1018749 - protein, 6 aa, Mycobacterium
PDASGI

SEQ ID NO: 1018750 - protein, 11 aa, Mycobacterium
PDASGNVGNRA

SEQ ID NO: 1018751 - protein, 8 aa, Mycobacterium
PDATNSAI

SEQ ID NO: 1018752 - protein, 4 aa, Mycobacterium
PDAV

SEQ ID NO: 1018753 - protein, 5 aa, Mycobacterium
PDAVE

SEQ ID NO: 1018754 - protein, 9 aa, Mycobacterium
PDAVPTDPT

SEQ ID NO: 1018755 - protein, 6 aa, Mycobacterium
PDAYPG

SEQ ID NO: 1018756 - protein, 9 aa, Mycobacterium
PDCGTGFGT

SEQ ID NO: 1018757 - protein, 19 aa, Mycobacterium
PDCSDLNGPHERMRDGAQE

SEQ ID NO: 1018758 - protein, 4 aa, Mycobacterium
PDDA

SEQ ID NO: 1018759 - protein, 14 aa, Mycobacterium
PDDANSEPSPPLGK

SEQ ID NO: 1018760 - protein, 13 aa, Mycobacterium
PDDARRAKDGGVD

SEQ ID NO: 1018761 - protein, 10 aa, Mycobacterium
PDDDNKRKFR

SEQ ID NO: 1018762 - protein, 27 aa, Mycobacterium
PDDDSDGDLDAESPEISEISESHTAKE

SEQ ID NO: 1018763 - protein, 5 aa, Mycobacterium
PDDEA

SEQ ID NO: 1018764 - protein, 8 aa, Mycobacterium
PDDELGSN

SEQ ID NO: 1018765 - protein, 10 aa, Mycobacterium
PDDESLSNGA

SEQ ID NO: 1018766 - protein, 6 aa, Mycobacterium
PDDGGV

SEQ ID NO: 1018767 - protein, 6 aa, Mycobacterium
PDDGTK

SEQ ID NO: 1018768 - protein, 15 aa, Mycobacterium
PDDHRAAQSAAAAGL

SEQ ID NO: 1018769 - protein, 4 aa, Mycobacterium
PDDI

SEQ ID NO: 1018770 - protein, 4 aa, Mycobacterium
PDDL

SEQ ID NO: 1018771 - protein, 15 aa, Mycobacterium
PDDLGSGRQSPPVPS

SEQ ID NO: 1018772 - protein, 7 aa, Mycobacterium
PDDLPDS

SEQ ID NO: 1018773 - protein, 6 aa, Mycobacterium
PDDPHQ

SEQ ID NO: 1018774 - protein, 8 aa, Mycobacterium
PDDPPGRR

SEQ ID NO: 1018775 - protein, 8 aa, Mycobacterium
PDDRTGER

SEQ ID NO: 1018776 - protein, 6 aa, Mycobacterium
PDDSTA

SEQ ID NO: 1018777 - protein, 7 aa, Mycobacterium
PDDTTVG

SEQ ID NO: 1018778 - protein, 10 aa, Mycobacterium
PDDVPEEIST

SEQ ID NO: 1018779 - protein, 4 aa, Mycobacterium
PDDY

SEQ ID NO: 1018780 - protein, 15 aa, Mycobacterium
PDEAAALGDELKGVT

SEQ ID NO: 1018781 - protein, 4 aa, Mycobacterium
PDEC

SEQ ID NO: 1018782 - protein, 4 aa, Mycobacterium
PDEG

SEQ ID NO: 1018783 - protein, 5 aa, Mycobacterium
PDEGF

SEQ ID NO: 1018784 - protein, 9 aa, Mycobacterium
PDEGGGDDV

SEQ ID NO: 1018785 - protein, 19 aa, Mycobacterium
PDEHPAAKPFKDALSSDGI

SEQ ID NO: 1018786 - protein, 6 aa, Mycobacterium
PDEHTP

SEQ ID NO: 1018787 - protein, 4 aa, Mycobacterium
PDEI

SEQ ID NO: 1018788 - protein, 7 aa, Mycobacterium
PDEKQMQ

SEQ ID NO: 1018789 - protein, 21 aa, Mycobacterium
PDELPPPPEDPGPVDDLEISN

SEQ ID NO: 1018790 - protein, 5 aa, Mycobacterium
PDEND

SEQ ID NO: 1018791 - protein, 7 aa, Mycobacterium
PDENHEG

SEQ ID NO: 1018792 - protein, 8 aa, Mycobacterium
PDEPGAAV

SEQ ID NO: 1018793 - protein, 18 aa, Mycobacterium
PDEPRAGAGECTLQDRDG

SEQ ID NO: 1018794 - protein, 7 aa, Mycobacterium
PDEQLDN

SEQ ID NO: 1018795 - protein, 6 aa, Mycobacterium
PDEQRA

SEQ ID NO: 1018796 - protein, 8 aa, Mycobacterium
PDETASNR

SEQ ID NO: 1018797 - protein, 7 aa, Mycobacterium
PDEVPPQ

SEQ ID NO: 1018798 - protein, 7 aa, Mycobacterium
PDFAEGA

SEQ ID NO: 1018799 - protein, 10 aa, Mycobacterium
PDFGTGSSRE

SEQ ID NO: 1018800 - protein, 7 aa, Mycobacterium
PDFTPTD

SEQ ID NO: 1018801 - protein, 6 aa, Mycobacterium
PDGAEP

SEQ ID NO: 1018802 - protein, 5 aa, Mycobacterium
PDGDG

SEQ ID NO: 1018803 - protein, 6 aa, Mycobacterium
PDGDPQ

SEQ ID NO: 1018804 - protein, 9 aa, Mycobacterium
PDGELPDNL

SEQ ID NO: 1018805 - protein, 5 aa, Mycobacterium
PDGFT

SEQ ID NO: 1018806 - protein, 6 aa, Mycobacterium
PDGGAS

SEQ ID NO: 1018807 - protein, 10 aa, Mycobacterium
PDGGDGSRSV

SEQ ID NO: 1018808 - protein, 7 aa, Mycobacterium
PDGGTYD

SEQ ID NO: 1018809 - protein, 7 aa, Mycobacterium
PDGGVPQ

SEQ ID NO: 1018810 - protein, 7 aa, Mycobacterium
PDGHTED

SEQ ID NO: 1018811 - protein, 17 aa, Mycobacterium
PDGISGSAAEVYAALQK

SEQ ID NO: 1018812 - protein, 7 aa, Mycobacterium
PDGKTQV

SEQ ID NO: 1018813 - protein, 7 aa, Mycobacterium
PDGLSDP

SEQ ID NO: 1018814 - protein, 5 aa, Mycobacterium
PDGMD

SEQ ID NO: 1018815 - protein, 6 aa, Mycobacterium
PDGNSY

SEQ ID NO: 1018816 - protein, 10 aa, Mycobacterium
PDGPAAGNGA

SEQ ID NO: 1018817 - protein, 12 aa, Mycobacterium
PDGPDLRVQPGD

SEQ ID NO: 1018818 - protein, 6 aa, Mycobacterium
PDGPGQ

SEQ ID NO: 1018819 - protein, 23 aa, Mycobacterium
PDGQHHGTKSLKSIADASQAISG

SEQ ID NO: 1018820 - protein, 16 aa, Mycobacterium
PDGQWTASPQEGRTVR

SEQ ID NO: 1018821 - protein, 15 aa, Mycobacterium
PDGRHSDEDRARRRG

SEQ ID NO: 1018822 - protein, 11 aa, Mycobacterium
PDGSALDDTEV

SEQ ID NO: 1018823 - protein, 12 aa, Mycobacterium
PDGSDDPRIPPE

SEQ ID NO: 1018824 - protein, 5 aa, Mycobacterium
PDGSE

SEQ ID NO: 1018825 - protein, 10 aa, Mycobacterium
PDGSPSWADP

SEQ ID NO: 1018826 - protein, 6 aa, Mycobacterium
PDGSRQ

SEQ ID NO: 1018827 - protein, 8 aa, Mycobacterium
PDGSTVET

SEQ ID NO: 1018828 - protein, 16 aa, Mycobacterium
PDGTKTPGKTVPDPYF

SEQ ID NO: 1018829 - protein, 10 aa, Mycobacterium
PDGTPGARKD

SEQ ID NO: 1018830 - protein, 18 aa, Mycobacterium
PDGTPKAVGTRLTNPAYA

SEQ ID NO: 1018831 - protein, 7 aa, Mycobacterium
PDGVANY

SEQ ID NO: 1018832 - protein, 7 aa, Mycobacterium
PDGVDPA

SEQ ID NO: 1018833 - protein, 9 aa, Mycobacterium
PDGVGKSTL

SEQ ID NO: 1018834 - protein, 5 aa, Mycobacterium
PDHDT

SEQ ID NO: 1018835 - protein, 5 aa, Mycobacterium
PDHPR

SEQ ID NO: 1018836 - protein, 4 aa, Mycobacterium
PDHT

SEQ ID NO: 1018837 - protein, 4 aa, Mycobacterium
PDIE

SEQ ID NO: 1018838 - protein, 5 aa, Mycobacterium
PDIGA

SEQ ID NO: 1018839 - protein, 9 aa, Mycobacterium
PDIQHGSPP

SEQ ID NO: 1018840 - protein, 11 aa, Mycobacterium
PDIQQQVRDNP

SEQ ID NO: 1018841 - protein, 13 aa, Mycobacterium
PDKFSGSPLRDLV

SEQ ID NO: 1018842 - protein, 9 aa, Mycobacterium
PDKSTTDVS

SEQ ID NO: 1018843 - protein, 11 aa, Mycobacterium
PDKVGADAGEL

SEQ ID NO: 1018844 - protein, 8 aa, Mycobacterium
PDKVYSGG

SEQ ID NO: 1018845 - protein, 11 aa, Mycobacterium
PDLAPPGKHAA

SEQ ID NO: 1018846 - protein, 7 aa, Mycobacterium
PDLETAP

SEQ ID NO: 1018847 - protein, 15 aa, Mycobacterium
PDLGKAVEEGVRANS

SEQ ID NO: 1018848 - protein, 5 aa, Mycobacterium
PDLTA

SEQ ID NO: 1018849 - protein, 7 aa, Mycobacterium
PDLTPGP

SEQ ID NO: 1018850 - protein, 5 aa, Mycobacterium
PDLTT

SEQ ID NO: 1018851 - protein, 13 aa, Mycobacterium
PDMSTSPDYPSTP

SEQ ID NO: 1018852 - protein, 8 aa, Mycobacterium
PDNEDSHG

SEQ ID NO: 1018853 - protein, 8 aa, Mycobacterium
PDNPDSIV

SEQ ID NO: 1018854 - protein, 5 aa, Mycobacterium
PDNPE

SEQ ID NO: 1018855 - protein, 8 aa, Mycobacterium
PDNPPYDE

SEQ ID NO: 1018856 - protein, 7 aa, Mycobacterium
PDNTEVS

SEQ ID NO: 1018857 - protein, 18 aa, Mycobacterium
PDNVATPADWRPGDPVVT

SEQ ID NO: 1018858 - protein, 11 aa, Mycobacterium
PDNVQGAAGPF

SEQ ID NO: 1018859 - protein, 12 aa, Mycobacterium
PDPAAMDPDQPF

SEQ ID NO: 1018860 - protein, 11 aa, Mycobacterium
PDPAPRGSAPA

SEQ ID NO: 1018861 - protein, 8 aa, Mycobacterium
PDPDAAMG

SEQ ID NO: 1018862 - protein, 7 aa, Mycobacterium
PDPDFAG

SEQ ID NO: 1018863 - protein, 8 aa, Mycobacterium
PDPDGDEV

SEQ ID NO: 1018864 - protein, 21 aa, Mycobacterium
PDPDPHGAVTPPGRPEGRPWT

SEQ ID NO: 1018865 - protein, 12 aa, Mycobacterium
PDPDRKAQKRRE

SEQ ID NO: 1018866 - protein, 6 aa, Mycobacterium
PDPDVV

SEQ ID NO: 1018867 - protein, 5 aa, Mycobacterium
PDPFT

SEQ ID NO: 1018868 - protein, 4 aa, Mycobacterium
PDPG

SEQ ID NO: 1018869 - protein, 8 aa, Mycobacterium
PDPGTDPV

SEQ ID NO: 1018870 - protein, 5 aa, Mycobacterium
PDPGV

SEQ ID NO: 1018871 - protein, 9 aa, Mycobacterium
PDPHGAGQR

SEQ ID NO: 1018872 - protein, 8 aa, Mycobacterium
PDPHTRDL

SEQ ID NO: 1018873 - protein, 13 aa, Mycobacterium
PDPINPQKSGEAF

SEQ ID NO: 1018874 - protein, 16 aa, Mycobacterium
PDPNPAHSSASNRRSA

SEQ ID NO: 1018875 - protein, 10 aa, Mycobacterium
PDPPAGGQES

SEQ ID NO: 1018876 - protein, 7 aa, Mycobacterium
PDPPAVA

SEQ ID NO: 1018877 - protein, 29 aa, Mycobacterium
PDPPPDQRERHPRNERKERPERRRSGGAF

SEQ ID NO: 1018878 - protein, 8 aa, Mycobacterium
PDPPYGQG

SEQ ID NO: 1018879 - protein, 7 aa, Mycobacterium
PDPQRGQ

SEQ ID NO: 1018880 - protein, 7 aa, Mycobacterium
PDPQYAP

SEQ ID NO: 1018881 - protein, 5 aa, Mycobacterium
PDPRL

SEQ ID NO: 1018882 - protein, 7 aa, Mycobacterium
PDPRPDA

SEQ ID NO: 1018883 - protein, 9 aa, Mycobacterium
PDPRRPQRT

SEQ ID NO: 1018884 - protein, 6 aa, Mycobacterium
PDPRRR

SEQ ID NO: 1018885 - protein, 7 aa, Mycobacterium
PDPRYGQ

SEQ ID NO: 1018886 - protein, 8 aa, Mycobacterium
PDPTEGVK

SEQ ID NO: 1018887 - protein, 10 aa, Mycobacterium
PDPTTPEAQK

SEQ ID NO: 1018888 - protein, 8 aa, Mycobacterium
PDPVPAPG

SEQ ID NO: 1018889 - protein, 5 aa, Mycobacterium
PDPVY

SEQ ID NO: 1018890 - protein, 6 aa, Mycobacterium
PDPYLT

SEQ ID NO: 1018891 - protein, 7 aa, Mycobacterium
PDQAARA

SEQ ID NO: 1018892 - protein, 10 aa, Mycobacterium
PDQDDPASFG

SEQ ID NO: 1018893 - protein, 5 aa, Mycobacterium
PDQLA

SEQ ID NO: 1018894 - protein, 6 aa, Mycobacterium
PDQLAS

SEQ ID NO: 1018895 - protein, 5 aa, Mycobacterium
PDQLE

SEQ ID NO: 1018896 - protein, 7 aa, Mycobacterium
PDQPGRV

SEQ ID NO: 1018897 - protein, 5 aa, Mycobacterium
PDQPI

SEQ ID NO: 1018898 - protein, 7 aa, Mycobacterium
PDQRAEF

SEQ ID NO: 1018899 - protein, 7 aa, Mycobacterium
PDQRPPV

SEQ ID NO: 1018900 - protein, 4 aa, Mycobacterium
PDQV

SEQ ID NO: 1018901 - protein, 5 aa, Mycobacterium
PDQVA

SEQ ID NO: 1018902 - protein, 4 aa, Mycobacterium
PDRA

SEQ ID NO: 1018903 - protein, 5 aa, Mycobacterium
PDRAD

SEQ ID NO: 1018904 - protein, 6 aa, Mycobacterium
PDRAPL

SEQ ID NO: 1018905 - protein, 6 aa, Mycobacterium
PDRART

SEQ ID NO: 1018906 - protein, 6 aa, Mycobacterium
PDRESA

SEQ ID NO: 1018907 - protein, 5 aa, Mycobacterium
PDRGP

SEQ ID NO: 1018908 - protein, 8 aa, Mycobacterium
PDRGPERA

SEQ ID NO: 1018909 - protein, 13 aa, Mycobacterium
PDRGTPSFATPIS

SEQ ID NO: 1018910 - protein, 5 aa, Mycobacterium
PDRIS

SEQ ID NO: 1018911 - protein, 6 aa, Mycobacterium
PDRKRR

SEQ ID NO: 1018912 - protein, 13 aa, Mycobacterium
PDRNAGFSTANPG

SEQ ID NO: 1018913 - protein, 24 aa, Mycobacterium
PDRPADKAYKARRNDGGKPRRKRL

SEQ ID NO: 1018914 - protein, 7 aa, Mycobacterium
PDRPEDE

SEQ ID NO: 1018915 - protein, 5 aa, Mycobacterium
PDRPT

SEQ ID NO: 1018916 - protein, 6 aa, Mycobacterium
PDRPYS

SEQ ID NO: 1018917 - protein, 6 aa, Mycobacterium
PDRQRH

SEQ ID NO: 1018918 - protein, 6 aa, Mycobacterium
PDRQRP

SEQ ID NO: 1018919 - protein, 9 aa, Mycobacterium
PDRRGQRHA

SEQ ID NO: 1018920 - protein, 8 aa, Mycobacterium
PDRRRGER

SEQ ID NO: 1018921 - protein, 9 aa, Mycobacterium
PDRSPGARI

SEQ ID NO: 1018922 - protein, 6 aa, Mycobacterium
PDRSVP

SEQ ID NO: 1018923 - protein, 7 aa, Mycobacterium
PDRTGRI

SEQ ID NO: 1018924 - protein, 16 aa, Mycobacterium
PDRTLTEDDASAARDA

SEQ ID NO: 1018925 - protein, 16 aa, Mycobacterium
PDRVPGISSPGAIPGI

SEQ ID NO: 1018926 - protein, 8 aa, Mycobacterium
PDRVTRDA

SEQ ID NO: 1018927 - protein, 16 aa, Mycobacterium
PDRYDGVAGAHRIDLN

SEQ ID NO: 1018928 - protein, 4 aa, Mycobacterium
PDSA

SEQ ID NO: 1018929 - protein, 7 aa, Mycobacterium
PDSAGLD

SEQ ID NO: 1018930 - protein, 5 aa, Mycobacterium
PDSAQ

SEQ ID NO: 1018931 - protein, 6 aa, Mycobacterium
PDSAVG

SEQ ID NO: 1018932 - protein, 6 aa, Mycobacterium
PDSDAR

SEQ ID NO: 1018933 - protein, 8 aa, Mycobacterium
PDSDKPAN

SEQ ID NO: 1018934 - protein, 9 aa, Mycobacterium
PDSEAHASI

SEQ ID NO: 1018935 - protein, 8 aa, Mycobacterium
PDSESSKS

SEQ ID NO: 1018936 - protein, 26 aa, Mycobacterium
PDSGMSRATGDIERIGEKSSSVPDHD

SEQ ID NO: 1018937 - protein, 6 aa, Mycobacterium
PDSGRV

SEQ ID NO: 1018938 - protein, 13 aa, Mycobacterium
PDSGSKPAAPYAK

SEQ ID NO: 1018939 - protein, 5 aa, Mycobacterium
PDSPE

SEQ ID NO: 1018940 - protein, 13 aa, Mycobacterium
PDSPLPVDAGTRA

SEQ ID NO: 1018941 - protein, 8 aa, Mycobacterium
PDSPNQPY

SEQ ID NO: 1018942 - protein, 13 aa, Mycobacterium
PDSPPTDELASAE

SEQ ID NO: 1018943 - protein, 6 aa, Mycobacterium
PDSPSV

SEQ ID NO: 1018944 - protein, 11 aa, Mycobacterium
PDSRHSSVTNR

SEQ ID NO: 1018945 - protein, 8 aa, Mycobacterium
PDSSGNPY

SEQ ID NO: 1018946 - protein, 15 aa, Mycobacterium
PDSTTEATTEEGEVS

SEQ ID NO: 1018947 - protein, 8 aa, Mycobacterium
PDSVSATN

SEQ ID NO: 1018948 - protein, 10 aa, Mycobacterium
PDTAEARTNV

SEQ ID NO: 1018949 - protein, 5 aa, Mycobacterium
PDTDF

SEQ ID NO: 1018950 - protein, 5 aa, Mycobacterium
PDTDY

SEQ ID NO: 1018951 - protein, 10 aa, Mycobacterium
PDTGELGPRN

SEQ ID NO: 1018952 - protein, 11 aa, Mycobacterium
PDTGTELRDGE

SEQ ID NO: 1018953 - protein, 4 aa, Mycobacterium
PDTL

SEQ ID NO: 1018954 - protein, 7 aa, Mycobacterium
PDTLGGR

SEQ ID NO: 1018955 - protein, 7 aa, Mycobacterium
PDTPEVR

SEQ ID NO: 1018956 - protein, 6 aa, Mycobacterium
PDTPFR

SEQ ID NO: 1018957 - protein, 5 aa, Mycobacterium
PDTPN

SEQ ID NO: 1018958 - protein, 17 aa, Mycobacterium
PDTRPDQGQGGAGAATL

SEQ ID NO: 1018959 - protein, 5 aa, Mycobacterium
PDTRR

SEQ ID NO: 1018960 - protein, 5 aa, Mycobacterium
PDTSA

SEQ ID NO: 1018961 - protein, 7 aa, Mycobacterium
PDTSAAL

SEQ ID NO: 1018962 - protein, 6 aa, Mycobacterium
PDVAQD

SEQ ID NO: 1018963 - protein, 4 aa, Mycobacterium
PDVD

SEQ ID NO: 1018964 - protein, 4 aa, Mycobacterium
PDVG

SEQ ID NO: 1018965 - protein, 24 aa, Mycobacterium
PDVGSDPARLASTATPIDDGQAYE

SEQ ID NO: 1018966 - protein, 12 aa, Mycobacterium
PDVNPDEAAQAK

SEQ ID NO: 1018967 - protein, 5 aa, Mycobacterium
PDVPE

SEQ ID NO: 1018968 - protein, 15 aa, Mycobacterium
PDVPGGEAGAEGLPP

SEQ ID NO: 1018969 - protein, 5 aa, Mycobacterium
PDVQE

SEQ ID NO: 1018970 - protein, 4 aa, Mycobacterium
PDVT

SEQ ID NO: 1018971 - protein, 10 aa, Mycobacterium
PDVYEQPNRF

SEQ ID NO: 1018972 - protein, 13 aa, Mycobacterium
PDWPQPASGGGSY

SEQ ID NO: 1018973 - protein, 9 aa, Mycobacterium
PDYANLPRK

SEQ ID NO: 1018974 - protein, 4 aa, Mycobacterium
PDYQ

SEQ ID NO: 1018975 - protein, 4 aa, Mycobacterium
PDYR

SEQ ID NO: 1018976 - protein, 9 aa, Mycobacterium
PDYSSSWPP

SEQ ID NO: 1018977 - protein, 7 aa, Mycobacterium
PEAAEQA

SEQ ID NO: 1018978 - protein, 5 aa, Mycobacterium
PEAAS

SEQ ID NO: 1018979 - protein, 8 aa, Mycobacterium
PEAASDDW

SEQ ID NO: 1018980 - protein, 5 aa, Mycobacterium
PEADL

SEQ ID NO: 1018981 - protein, 40 aa, Mycobacterium; identical to SEQ ID NO: 537964

SEQ ID NO: 1018982 - protein, 5 aa, Mycobacterium
PEAED

SEQ ID NO: 1018983 - protein, 10 aa, Mycobacterium
PEAELRRGRR

SEQ ID NO: 1018984 - protein, 11 aa, Mycobacterium
PEAERRYNDEI

SEQ ID NO: 1018985 - protein, 5 aa, Mycobacterium
PEAGE

SEQ ID NO: 1018986 - protein, 5 aa, Mycobacterium
PEAGH

SEQ ID NO: 1018987 - protein, 9 aa, Mycobacterium
PEAIDPDKA

SEQ ID NO: 1018988 - protein, 6 aa, Mycobacterium
PEAIGP

SEQ ID NO: 1018989 - protein, 12 aa, Mycobacterium
PEAISSEAKERR

SEQ ID NO: 1018990 - protein, 11 aa, Mycobacterium
PEAKPAATGLE

SEQ ID NO: 1018991 - protein, 9 aa, Mycobacterium
PEAPGDRNA

SEQ ID NO: 1018992 - protein, 22 aa, Mycobacterium
PEAPLAATTNRQQLKVDEKAKD

SEQ ID NO: 1018993 - protein, 7 aa, Mycobacterium
PEAPTHR

SEQ ID NO: 1018994 - protein, 4 aa, Mycobacterium
PEAQ

SEQ ID NO: 1018995 - protein, 5 aa, Mycobacterium
PEAQW

SEQ ID NO: 1018996 - protein, 12 aa, Mycobacterium
PEAQWTDNAPIA

SEQ ID NO: 1018997 - protein, 5 aa, Mycobacterium
PEARQ

SEQ ID NO: 1018998 - protein, 5 aa, Mycobacterium
PEASA

SEQ ID NO: 1018999 - protein, 29 aa, Mycobacterium
PEASGAPEVPEVPPKDPGPAGVRAQTATA

SEQ ID NO: 1019000 - protein, 6 aa, Mycobacterium
PEATAA

SEQ ID NO: 1019001 - protein, 8 aa, Mycobacterium
PEATEEAL

SEQ ID NO: 1019002 - protein, 5 aa, Mycobacterium
PEATR

SEQ ID NO: 1019003 - protein, 5 aa, Mycobacterium
PEAVG

SEQ ID NO: 1019004 - protein, 8 aa, Mycobacterium
PEDAEDEL

SEQ ID NO: 1019005 - protein, 8 aa, Mycobacterium
PEDAGAQI

SEQ ID NO: 1019006 - protein, 8 aa, Mycobacterium
PEDAPAGQ

SEQ ID NO: 1019007 - protein, 4 aa, Mycobacterium
PEDG

SEQ ID NO: 1019008 - protein, 8 aa, Mycobacterium
PEDGDAQP

SEQ ID NO: 1019009 - protein, 9 aa, Mycobacterium
PEDGGGIPW

SEQ ID NO: 1019010 - protein, 10 aa, Mycobacterium
PEDGIAPGTR

SEQ ID NO: 1019011 - protein, 8 aa, Mycobacterium
PEDLRARN

SEQ ID NO: 1019012 - protein, 8 aa, Mycobacterium
PEDPDGTE

SEQ ID NO: 1019013 - protein, 7 aa, Mycobacterium
PEDPNAH

SEQ ID NO: 1019014 - protein, 7 aa, Mycobacterium
PEDRPAL

SEQ ID NO: 1019015 - protein, 5 aa, Mycobacterium
PEDSA

SEQ ID NO: 1019016 - protein, 6 aa, Mycobacterium
PEDTPL

SEQ ID NO: 1019017 - protein, 11 aa, Mycobacterium
PEEDQEAARDF

SEQ ID NO: 1019018 - protein, 7 aa, Mycobacterium
PEEEHNR

SEQ ID NO: 1019019 - protein, 19 aa, Mycobacterium
PEELESGNNVAAYQGSGVV

SEQ ID NO: 1019020 - protein, 7 aa, Mycobacterium
PEELRPN

SEQ ID NO: 1019021 - protein, 4 aa, Mycobacterium
PEEP

SEQ ID NO: 1019022 - protein, 11 aa, Mycobacterium
PEERDEIPSAM

SEQ ID NO: 1019023 - protein, 6 aa, Mycobacterium
PEERRT

SEQ ID NO: 1019024 - protein, 6 aa, Mycobacterium
PEEVAA

SEQ ID NO: 1019025 - protein, 5 aa, Mycobacterium
PEGAG

SEQ ID NO: 1019026 - protein, 10 aa, Mycobacterium
PEGAPDTTRG

SEQ ID NO: 1019027 - protein, 9 aa, Mycobacterium
PEGASASID

SEQ ID NO: 1019028 - protein, 4 aa, Mycobacterium
PEGF

SEQ ID NO: 1019029 - protein, 4 aa, Mycobacterium
PEGG

SEQ ID NO: 1019030 - protein, 10 aa, Mycobacterium
PEGGAGGGTV

SEQ ID NO: 1019031 - protein, 5 aa, Mycobacterium
PEGGQ

SEQ ID NO: 1019032 - protein, 5 aa, Mycobacterium
PEGLS

SEQ ID NO: 1019033 - protein, 4 aa, Mycobacterium
PEGP

SEQ ID NO: 1019034 - protein, 12 aa, Mycobacterium
PEGPEGKPDPVA

SEQ ID NO: 1019035 - protein, 6 aa, Mycobacterium
PEGPQR

SEQ ID NO: 1019036 - protein, 5 aa, Mycobacterium
PEGQC

SEQ ID NO: 1019037 - protein, 15 aa, Mycobacterium
PEGQRADGENTESDR

SEQ ID NO: 1019038 - protein, 9 aa, Mycobacterium
PEGSDDELA

SEQ ID NO: 1019039 - protein, 12 aa, Mycobacterium
PEGSEGALPADV

SEQ ID NO: 1019040 - protein, 8 aa, Mycobacterium
PEGSTQSM

SEQ ID NO: 1019041 - protein, 8 aa, Mycobacterium
PEGSWTDT

SEQ ID NO: 1019042 - protein, 16 aa, Mycobacterium
PEGVPPAARRPEPTLP

SEQ ID NO: 1019043 - protein, 14 aa, Mycobacterium
PEHAPAFARRGGHT

SEQ ID NO: 1019044 - protein, 5 aa, Mycobacterium
PEHGE

SEQ ID NO: 1019045 - protein, 14 aa, Mycobacterium
PEHGKGTVAVRGGA

SEQ ID NO: 1019046 - protein, 6 aa, Mycobacterium
PEHPYP

SEQ ID NO: 1019047 - protein, 8 aa, Mycobacterium
PEHPYPAG

SEQ ID NO: 1019048 - protein, 4 aa, Mycobacterium
PEHQ

SEQ ID NO: 1019049 - protein, 5 aa, Mycobacterium
PEHQP

SEQ ID NO: 1019050 - protein, 8 aa, Mycobacterium
PEHRAPAA

SEQ ID NO: 1019051 - protein, 14 aa, Mycobacterium
PEHSELSPRLVGTA

SEQ ID NO: 1019052 - protein, 4 aa, Mycobacterium
PEHT

SEQ ID NO: 1019053 - protein, 6 aa, Mycobacterium
PEHTEK

SEQ ID NO: 1019054 - protein, 4 aa, Mycobacterium
PEHV

SEQ ID NO: 1019055 - protein, 4 aa, Mycobacterium
PEIS

SEQ ID NO: 1019056 - protein, 6 aa, Mycobacterium
PEITDD

SEQ ID NO: 1019057 - protein, 4 aa, Mycobacterium
PEKA

SEQ ID NO: 1019058 - protein, 10 aa, Mycobacterium
PEKGGSTREA

SEQ ID NO: 1019059 - protein, 6 aa, Mycobacterium
PEKPGL

SEQ ID NO: 1019060 - protein, 7 aa, Mycobacterium
PEKRSRE

SEQ ID NO: 1019061 - protein, 10 aa, Mycobacterium
PEKVADHTGV

SEQ ID NO: 1019062 - protein, 11 aa, Mycobacterium
PELAGEDGVRS

SEQ ID NO: 1019063 - protein, 10 aa, Mycobacterium
PELAPDAPTA

SEQ ID NO: 1019064 - protein, 11 aa, Mycobacterium
PELARRGRGTP

SEQ ID NO: 1019065 - protein, 8 aa, Mycobacterium
PELGGQGF

SEQ ID NO: 1019066 - protein, 16 aa, Mycobacterium
PELHSRPDEARKAGRR

SEQ ID NO: 1019067 - protein, 4 aa, Mycobacterium
PELP

SEQ ID NO: 1019068 - protein, 6 aa, Mycobacterium
PELPAT

SEQ ID NO: 1019069 - protein, 5 aa, Mycobacterium
PELPP

SEQ ID NO: 1019070 - protein, 6 aa, Mycobacterium
PELTPQ

SEQ ID NO: 1019071 - protein, 9 aa, Mycobacterium
PEMSGQRAA

SEQ ID NO: 1019072 - protein, 6 aa, Mycobacterium
PENEPV

SEQ ID NO: 1019073 - protein, 6 aa, Mycobacterium
PENGST

SEQ ID NO: 1019074 - protein, 5 aa, Mycobacterium
PENKA

SEQ ID NO: 1019075 - protein, 9 aa, Mycobacterium
PENPADTFG

SEQ ID NO: 1019076 - protein, 9 aa, Mycobacterium
PENPDSTGV

SEQ ID NO: 1019077 - protein, 11 aa, Mycobacterium
PENPPAVPPAT

SEQ ID NO: 1019078 - protein, 5 aa, Mycobacterium
PENPS

SEQ ID NO: 1019079 - protein, 7 aa, Mycobacterium
PENPSNV

SEQ ID NO: 1019080 - protein, 7 aa, Mycobacterium
PENRERD

SEQ ID NO: 1019081 - protein, 7 aa, Mycobacterium
PENSPHR

SEQ ID NO: 1019082 - protein, 4 aa, Mycobacterium
PENV

SEQ ID NO: 1019083 - protein, 6 aa, Mycobacterium
PEPARA

SEQ ID NO: 1019084 - protein, 10 aa, Mycobacterium
PEPDAPPSWI

SEQ ID NO: 1019085 - protein, 9 aa, Mycobacterium
PEPESGKST

SEQ ID NO: 1019086 - protein, 4 aa, Mycobacterium
PEPF

SEQ ID NO: 1019087 - protein, 6 aa, Mycobacterium
PEPGQT

SEQ ID NO: 1019088 - protein, 4 aa, Mycobacterium
PEPH

SEQ ID NO: 1019089 - protein, 14 aa, Mycobacterium
PEPHGAGNANSGFR

SEQ ID NO: 1019090 - protein, 5 aa, Mycobacterium
PEPHR

SEQ ID NO: 1019091 - protein, 4 aa, Mycobacterium
PEPI

SEQ ID NO: 1019092 - protein, 9 aa, Mycobacterium
PEPLPGQPL

SEQ ID NO: 1019093 - protein, 5 aa, Mycobacterium
PEPLS

SEQ ID NO: 1019094 - protein, 15 aa, Mycobacterium
PEPMGSRVPADPETV

SEQ ID NO: 1019095 - protein, 6 aa, Mycobacterium
PEPNPG

SEQ ID NO: 1019096 - protein, 29 aa, Mycobacterium
PEPPAPEAGTEAPAKKSKKATAPKPRSGS

SEQ ID NO: 1019097 - protein, 13 aa, Mycobacterium
PEPPDDVTPIGPG

SEQ ID NO: 1019098 - protein, 7 aa, Mycobacterium
PEPPFDA

SEQ ID NO: 1019099 - protein, 19 aa, Mycobacterium
PEPPLPADSSSQDCDPTAS

SEQ ID NO: 1019100 - protein, 8 aa, Mycobacterium
PEPQRDPV

SEQ ID NO: 1019101 - protein, 10 aa, Mycobacterium
PEPRPPQEET

SEQ ID NO: 1019102 - protein, 6 aa, Mycobacterium
PEPSSE

SEQ ID NO: 1019103 - protein, 6 aa, Mycobacterium
PEPTGL

SEQ ID NO: 1019104 - protein, 8 aa, Mycobacterium
PEPTPLSR

SEQ ID NO: 1019105 - protein, 4 aa, Mycobacterium
PEPV

SEQ ID NO: 1019106 - protein, 6 aa, Mycobacterium
PEPYSG

SEQ ID NO: 1019107 - protein, 31 aa, Mycobacterium
PEQARAARRGALARRQGRPGPHRRPGAQRGR

SEQ ID NO: 1019108 - protein, 8 aa, Mycobacterium
PEQDRAQF

SEQ ID NO: 1019109 - protein, 7 aa, Mycobacterium
PEQDRGR

SEQ ID NO: 1019110 - protein, 7 aa, Mycobacterium
PEQGGWT

SEQ ID NO: 1019111 - protein, 4 aa, Mycobacterium
PEQL

SEQ ID NO: 1019112 - protein, 16 aa, Mycobacterium
PEQLRPTGLGAATQLD

SEQ ID NO: 1019113 - protein, 7 aa, Mycobacterium
PEQLTGA

SEQ ID NO: 1019114 - protein, 14 aa, Mycobacterium
PEQRHLGIKDSLEL

SEQ ID NO: 1019115 - protein, 12 aa, Mycobacterium
PEQRSTMPGNTT

SEQ ID NO: 1019116 - protein, 4 aa, Mycobacterium
PERA

SEQ ID NO: 1019117 - protein, 7 aa, Mycobacterium
PERATGP

SEQ ID NO: 1019118 - protein, 12 aa, Mycobacterium
PERAVAPGTPEW

SEQ ID NO: 1019119 - protein, 5 aa, Mycobacterium
PERCD

SEQ ID NO: 1019120 - protein, 10 aa, Mycobacterium
PERDDDVENP

SEQ ID NO: 1019121 - protein, 9 aa, Mycobacterium
PERDGPPDI

SEQ ID NO: 1019122 - protein, 9 aa, Mycobacterium
PERDVARPH

SEQ ID NO: 1019123 - protein, 4 aa, Mycobacterium
PERE

SEQ ID NO: 1019124 - protein, 11 aa, Mycobacterium
PERERAAKRLG

SEQ ID NO: 1019125 - protein, 9 aa, Mycobacterium
PERPSAPDI

SEQ ID NO: 1019126 - protein, 17 aa, Mycobacterium
PERPTKAKTLTLPGPDA

SEQ ID NO: 1019127 - protein, 9 aa, Mycobacterium
PERQSSEEL

SEQ ID NO: 1019128 - protein, 11 aa, Mycobacterium
PERRVSDGQQQ

SEQ ID NO: 1019129 - protein, 9 aa, Mycobacterium
PERSEAGPI

SEQ ID NO: 1019130 - protein, 8 aa, Mycobacterium
PERSEGDA

SEQ ID NO: 1019131 - protein, 8 aa, Mycobacterium
PERSEGDL

SEQ ID NO: 1019132 - protein, 10 aa, Mycobacterium
PESAGGDGAT

SEQ ID NO: 1019133 - protein, 5 aa, Mycobacterium
PESAH

SEQ ID NO: 1019134 - protein, 11 aa, Mycobacterium
PESEHPHGLPD

SEQ ID NO: 1019135 - protein, 10 aa, Mycobacterium
PESGEFDPDA

SEQ ID NO: 1019136 - protein, 10 aa, Mycobacterium
PESGKPFQHN

SEQ ID NO: 1019137 - protein, 6 aa, Mycobacterium
PESGPL

SEQ ID NO: 1019138 - protein, 20 aa, Mycobacterium
PESGTPAAVGYAQESGIPYG

SEQ ID NO: 1019139 - protein, 4 aa, Mycobacterium
PESQ

SEQ ID NO: 1019140 - protein, 7 aa, Mycobacterium
PESRSAA

SEQ ID NO: 1019141 - protein, 9 aa, Mycobacterium
PESVEAGGN

SEQ ID NO: 1019142 - protein, 5 aa, Mycobacterium
PESVP

SEQ ID NO: 1019143 - protein, 5 aa, Mycobacterium
PESYT

SEQ ID NO: 1019144 - protein, 8 aa, Mycobacterium
PESYTGTE

SEQ ID NO: 1019145 - protein, 7 aa, Mycobacterium
PETGERT

SEQ ID NO: 1019146 - protein, 11 aa, Mycobacterium
PETGHPVGPDR

SEQ ID NO: 1019147 - protein, 5 aa, Mycobacterium
PETGL

SEQ ID NO: 1019148 - protein, 27 aa, Mycobacterium
PETIEARKDPWDPDSAPTRAQTEAARH

SEQ ID NO: 1019149 - protein, 8 aa, Mycobacterium
PETPPTLG

SEQ ID NO: 1019150 - protein, 7 aa, Mycobacterium
PETPQSA

SEQ ID NO: 1019151 - protein, 7 aa, Mycobacterium
PETQAVE

SEQ ID NO: 1019152 - protein, 5 aa, Mycobacterium
PETRT

SEQ ID NO: 1019153 - protein, 5 aa, Mycobacterium
PETSL

SEQ ID NO: 1019154 - protein, 13 aa, Mycobacterium
PETSQTDPTGVGD

SEQ ID NO: 1019155 - protein, 5 aa, Mycobacterium
PETTR

SEQ ID NO: 1019156 - protein, 5 aa, Mycobacterium
PETVP

SEQ ID NO: 1019157 - protein, 4 aa, Mycobacterium
PEVA

SEQ ID NO: 1019158 - protein, 15 aa, Mycobacterium
PEVAESVSAGGGPRR

SEQ ID NO: 1019159 - protein, 13 aa, Mycobacterium
PEVETGEISPQTC

SEQ ID NO: 1019160 - protein, 4 aa, Mycobacterium
PEVG

SEQ ID NO: 1019161 - protein, 8 aa, Mycobacterium
PEVGGQGF

SEQ ID NO: 1019162 - protein, 4 aa, Mycobacterium
PEVN

SEQ ID NO: 1019163 - protein, 11 aa, Mycobacterium
PEVPPQPGKGE

SEQ ID NO: 1019164 - protein, 4 aa, Mycobacterium
PEVR

SEQ ID NO: 1019165 - protein, 4 aa, Mycobacterium
PEVS

SEQ ID NO: 1019166 - protein, 11 aa, Mycobacterium
PEVSSQSGTEL

SEQ ID NO: 1019167 - protein, 4 aa, Mycobacterium
PEWS

SEQ ID NO: 1019168 - protein, 4 aa, Mycobacterium
PEYA

SEQ ID NO: 1019169 - protein, 5 aa, Mycobacterium
PEYRD

SEQ ID NO: 1019170 - protein, 7 aa, Mycobacterium
PEYRNRD

SEQ ID NO: 1019171 - protein, 11 aa, Mycobacterium
PEYSAPECTDP

SEQ ID NO: 1019172 - protein, 14 aa, Mycobacterium
PFAGEGAPVAGEGV

SEQ ID NO: 1019173 - protein, 11 aa, Mycobacterium
PFANDANDLPL

SEQ ID NO: 1019174 - protein, 4 aa, Mycobacterium
PFAT

SEQ ID NO: 1019175 - protein, 5 aa, Mycobacterium
PFDKD

SEQ ID NO: 1019176 - protein, 12 aa, Mycobacterium
PFDSARTNYDPA

SEQ ID NO: 1019177 - protein, 11 aa, Mycobacterium
PFEPTERDGRL

SEQ ID NO: 1019178 - protein, 9 aa, Mycobacterium
PFGGNTTQV

SEQ ID NO: 1019179 - protein, 12 aa, Mycobacterium
PFGGYKQSGIGR

SEQ ID NO: 1019180 - protein, 10 aa, Mycobacterium
PFGREGDQGV

SEQ ID NO: 1019181 - protein, 10 aa, Mycobacterium
PFGSGDPWAP

SEQ ID NO: 1019182 - protein, 9 aa, Mycobacterium
PFLPPPAPR

SEQ ID NO: 1019183 - protein, 10 aa, Mycobacterium
PFNTSGQPAI

SEQ ID NO: 1019184 - protein, 5 aa, Mycobacterium
PFPTE

SEQ ID NO: 1019185 - protein, 7 aa, Mycobacterium
PFSSGEK

SEQ ID NO: 1019186 - protein, 34 aa, Mycobacterium
PFSSPHQTTNPAGLGAQSAAVAHSTANVAADSGN

SEQ ID NO: 1019187 - protein, 4 aa, Mycobacterium
PFTG

SEQ ID NO: 1019188 - protein, 9 aa, Mycobacterium
PFTGGSGEL

SEQ ID NO: 1019189 - protein, 6 aa, Mycobacterium
PFTPQN

SEQ ID NO: 1019190 - protein, 11 aa, Mycobacterium
PFTSPPPITDP

SEQ ID NO: 1019191 - protein, 4 aa, Mycobacterium
PGAA

SEQ ID NO: 1019192 - protein, 5 aa, Mycobacterium
PGAAA

SEQ ID NO: 1019193 - protein, 9 aa, Mycobacterium
PGAADAERP

SEQ ID NO: 1019194 - protein, 7 aa, Mycobacterium
PGAADQI

SEQ ID NO: 1019195 - protein, 7 aa, Mycobacterium
PGAAPKL

SEQ ID NO: 1019196 - protein, 10 aa, Mycobacterium
PGAAPRTSTY

SEQ ID NO: 1019197 - protein, 9 aa, Mycobacterium
PGAATLSTT

SEQ ID NO: 1019198 - protein, 10 aa, Mycobacterium
PGADATLTTT

SEQ ID NO: 1019199 - protein, 8 aa, Mycobacterium
PGADCTED

SEQ ID NO: 1019200 - protein, 10 aa, Mycobacterium
PGADFGPGGA

SEQ ID NO: 1019201 - protein, 9 aa, Mycobacterium
PGAEGFSEN

SEQ ID NO: 1019202 - protein, 7 aa, Mycobacterium
PGAEGMA

SEQ ID NO: 1019203 - protein, 8 aa, Mycobacterium
PGAEPMRT

SEQ ID NO: 1019204 - protein, 10 aa, Mycobacterium
PGAEQEKNGI

SEQ ID NO: 1019205 - protein, 13 aa, Mycobacterium
PGAGAAAPASDLS

SEQ ID NO: 1019206 - protein, 52 aa, Mycobacterium
PGAGADADTAGAPAAVDRGTAALNHTSPGHHPASGHHRGTAGNHPAAGHHRG

SEQ ID NO: 1019207 - protein, 7 aa, Mycobacterium
PGAGAGE

SEQ ID NO: 1019208 - protein, 7 aa, Mycobacterium
PGAGGAV

SEQ ID NO: 1019209 - protein, 5 aa, Mycobacterium
PGAGK

SEQ ID NO: 1019210 - protein, 11 aa, Mycobacterium
PGAGPGRGAGD

SEQ ID NO: 1019211 - protein, 14 aa, Mycobacterium
PGAGVDRPILNAPV

SEQ ID NO: 1019212 - protein, 8 aa, Mycobacterium
PGAKRDIA

SEQ ID NO: 1019213 - protein, 9 aa, Mycobacterium
PGAKTVTAL

SEQ ID NO: 1019214 - protein, 4 aa, Mycobacterium
PGAL

SEQ ID NO: 1019215 - protein, 6 aa, Mycobacterium
PGAMTS

SEQ ID NO: 1019216 - protein, 4 aa, Mycobacterium
PGAP

SEQ ID NO: 1019217 - protein, 7 aa, Mycobacterium
PGAPAAG

SEQ ID NO: 1019218 - protein, 11 aa, Mycobacterium
PGAPAGHDNPD

SEQ ID NO: 1019219 - protein, 11 aa, Mycobacterium
PGAPPSPAGLD

SEQ ID NO: 1019220 - protein, 15 aa, Mycobacterium
PGAPRIEPGGDEAPV

SEQ ID NO: 1019221 - protein, 15 aa, Mycobacterium
PGAPSASLPMRGRPN

SEQ ID NO: 1019222 - protein, 10 aa, Mycobacterium
PGAPVPTGRK

SEQ ID NO: 1019223 - protein, 10 aa, Mycobacterium
PGARRQIPTE

SEQ ID NO: 1019224 - protein, 6 aa, Mycobacterium
PGARTA

SEQ ID NO: 1019225 - protein, 9 aa, Mycobacterium
PGASDTARF

SEQ ID NO: 1019226 - protein, 7 aa, Mycobacterium
PGASGRI

SEQ ID NO: 1019227 - protein, 9 aa, Mycobacterium
PGASQGRGL

SEQ ID NO: 1019228 - protein, 6 aa, Mycobacterium
PGASSV

SEQ ID NO: 1019229 - protein, 4 aa, Mycobacterium
PGAT

SEQ ID NO: 1019230 - protein, 5 aa, Mycobacterium
PGAVE

SEQ ID NO: 1019231 - protein, 5 aa, Mycobacterium
PGAVT

SEQ ID NO: 1019232 - protein, 9 aa, Mycobacterium
PGCDRPAAD

SEQ ID NO: 1019233 - protein, 9 aa, Mycobacterium
PGCDRPATQ

SEQ ID NO: 1019234 - protein, 5 aa, Mycobacterium
PGDAQ

SEQ ID NO: 1019235 - protein, 6 aa, Mycobacterium
PGDCGR

SEQ ID NO: 1019236 - protein, 4 aa, Mycobacterium
PGDD

SEQ ID NO: 1019237 - protein, 8 aa, Mycobacterium
PGDDDPAA

SEQ ID NO: 1019238 - protein, 5 aa, Mycobacterium
PGDEA

SEQ ID NO: 1019239 - protein, 7 aa, Mycobacterium
PGDGAEA

SEQ ID NO: 1019240 - protein, 9 aa, Mycobacterium
PGDGGEPEV

SEQ ID NO: 1019241 - protein, 8 aa, Mycobacterium
PGDGPIGD

SEQ ID NO: 1019242 - protein, 6 aa, Mycobacterium
PGDGRI

SEQ ID NO: 1019243 - protein, 17 aa, Mycobacterium
PGDGSNVNAPGASEDPY

SEQ ID NO: 1019244 - protein, 4 aa, Mycobacterium
PGDI

SEQ ID NO: 1019245 - protein, 13 aa, Mycobacterium
PGDIEANPRQPRQ

SEQ ID NO: 1019246 - protein, 19 aa, Mycobacterium
PGDLAKAAEGDVDADSVRS

SEQ ID NO: 1019247 - protein, 14 aa, Mycobacterium
PGDLGTKGGIRTDV

SEQ ID NO: 1019248 - protein, 5 aa, Mycobacterium
PGDPA

SEQ ID NO: 1019249 - protein, 10 aa, Mycobacterium
PGDPSSPLPI

SEQ ID NO: 1019250 - protein, 9 aa, Mycobacterium
PGDREIDEK

SEQ ID NO: 1019251 - protein, 9 aa, Mycobacterium
PGDRQQART

SEQ ID NO: 1019252 - protein, 8 aa, Mycobacterium
PGDSERTV

SEQ ID NO: 1019253 - protein, 4 aa, Mycobacterium
PGDV

SEQ ID NO: 1019254 - protein, 5 aa, Mycobacterium
PGDVD

SEQ ID NO: 1019255 - protein, 8 aa, Mycobacterium
PGEAAAAR

SEQ ID NO: 1019256 - protein, 10 aa, Mycobacterium
PGEDDGDQAA

SEQ ID NO: 1019257 - protein, 6 aa, Mycobacterium
PGEEYD

SEQ ID NO: 1019258 - protein, 4 aa, Mycobacterium
PGEG

SEQ ID NO: 1019259 - protein, 8 aa, Mycobacterium
PGEGFAPS

SEQ ID NO: 1019260 - protein, 7 aa, Mycobacterium
PGEGFGE

SEQ ID NO: 1019261 - protein, 7 aa, Mycobacterium
PGEGHNL

SEQ ID NO: 1019262 - protein, 10 aa, Mycobacterium
PGEGPEAGAR

SEQ ID NO: 1019263 - protein, 5 aa, Mycobacterium
PGEGV

SEQ ID NO: 1019264 - protein, 12 aa, Mycobacterium
PGEHGSTFGGNP

SEQ ID NO: 1019265 - protein, 16 aa, Mycobacterium
PGEHRADKTLAWKDLE

SEQ ID NO: 1019266 - protein, 9 aa, Mycobacterium
PGEKGTTGE

SEQ ID NO: 1019267 - protein, 8 aa, Mycobacterium
PGELEPGV

SEQ ID NO: 1019268 - protein, 7 aa, Mycobacterium
PGELGDH

SEQ ID NO: 1019269 - protein, 5 aa, Mycobacterium
PGENA

SEQ ID NO: 1019270 - protein, 34 aa, Mycobacterium
PGENNIGIGNTGNGNFGLGNTGDGNIGGGNTGIG

SEQ ID NO: 1019271 - protein, 5 aa, Mycobacterium
PGEPW

SEQ ID NO: 1019272 - protein, 6 aa, Mycobacterium
PGEPWR

SEQ ID NO: 1019273 - protein, 16 aa, Mycobacterium
PGEQDEMAHEPTDEPL

SEQ ID NO: 1019274 - protein, 5 aa, Mycobacterium
PGERR

SEQ ID NO: 1019275 - protein, 5 aa, Mycobacterium
PGERV

SEQ ID NO: 1019276 - protein, 15 aa, Mycobacterium
PGESEISGTYHGKGE

SEQ ID NO: 1019277 - protein, 6 aa, Mycobacterium
PGETEA

SEQ ID NO: 1019278 - protein, 8 aa, Mycobacterium
PGETEQDF

SEQ ID NO: 1019279 - protein, 5 aa, Mycobacterium
PGETK

SEQ ID NO: 1019280 - protein, 4 aa, Mycobacterium
PGEV

SEQ ID NO: 1019281 - protein, 4 aa, Mycobacterium
PGEW

SEQ ID NO: 1019282 - protein, 6 aa, Mycobacterium
PGFGEQ

SEQ ID NO: 1019283 - protein, 14 aa, Mycobacterium
PGFGNTTTSSSSGF

SEQ ID NO: 1019284 - protein, 6 aa, Mycobacterium
PGFHGQ

SEQ ID NO: 1019285 - protein, 8 aa, Mycobacterium
PGFQPSTP

SEQ ID NO: 1019286 - protein, 7 aa, Mycobacterium
PGGAAPI

SEQ ID NO: 1019287 - protein, 29 aa, Mycobacterium
PGGAGGDGGAGFSGADGGAGGNGGAGGGG

SEQ ID NO: 1019288 - protein, 10 aa, Mycobacterium
PGGALTAQQV

SEQ ID NO: 1019289 - protein, 4 aa, Mycobacterium
PGGC

SEQ ID NO: 1019290 - protein, 5 aa, Mycobacterium
PGGCT

SEQ ID NO: 1019291 - protein, 4 aa, Mycobacterium
PGGD

SEQ ID NO: 1019292 - protein, 5 aa, Mycobacterium
PGGDE

SEQ ID NO: 1019293 - protein, 7 aa, Mycobacterium
PGGDPAV

SEQ ID NO: 1019294 - protein, 6 aa, Mycobacterium
PGGDPT

SEQ ID NO: 1019295 - protein, 5 aa, Mycobacterium
PGGEG

SEQ ID NO: 1019296 - protein, 7 aa, Mycobacterium
PGGESGF

SEQ ID NO: 1019297 - protein, 7 aa, Mycobacterium
PGGESTT

SEQ ID NO: 1019298 - protein, 7 aa, Mycobacterium
PGGETTD

SEQ ID NO: 1019299 - protein, 4 aa, Mycobacterium
PGGF

SEQ ID NO: 1019300 - protein, 4 aa, Mycobacterium
PGGG

SEQ ID NO: 1019301 - protein, 7 aa, Mycobacterium
PGGGGMG

SEQ ID NO: 1019302 - protein, 8 aa, Mycobacterium
PGGGGTQR

SEQ ID NO: 1019303 - protein, 11 aa, Mycobacterium
PGGGGVDAARD

SEQ ID NO: 1019304 - protein, 7 aa, Mycobacterium
PGGGGVT

SEQ ID NO: 1019305 - protein, 12 aa, Mycobacterium
PGGGSRQPLTTA

SEQ ID NO: 1019306 - protein, 12 aa, Mycobacterium
PGGGTAPSTDTY

SEQ ID NO: 1019307 - protein, 14 aa, Mycobacterium
PGGHKLDDATENRI

SEQ ID NO: 1019308 - protein, 5 aa, Mycobacterium
PGGIE

SEQ ID NO: 1019309 - protein, 8 aa, Mycobacterium
PGGIESPD

SEQ ID NO: 1019310 - protein, 7 aa, Mycobacterium
PGGKSEL

SEQ ID NO: 1019311 - protein, 5 aa, Mycobacterium
PGGLG

SEQ ID NO: 1019312 - protein, 8 aa, Mycobacterium
PGGPGASA

SEQ ID NO: 1019313 - protein, 8 aa, Mycobacterium
PGGQGDDV

SEQ ID NO: 1019314 - protein, 70 aa, Mycobacterium
PGGQTGGDGSTGGTGGTGGAGGSGGAMAGKGGDGGTGGDGGDGGTGTTGAGRGGTGGAGGGGGKPTRSFS

SEQ ID NO: 1019315 - protein, 4 aa, Mycobacterium
PGGS

SEQ ID NO: 1019316 - protein, 5 aa, Mycobacterium
PGGSA

SEQ ID NO: 1019317 - protein, 9 aa, Mycobacterium
PGGSAPGQA

SEQ ID NO: 1019318 - protein, 16 aa, Mycobacterium
PGGSGGTVVHTTSWWH

SEQ ID NO: 1019319 - protein, 8 aa, Mycobacterium
PGGSLTGS

SEQ ID NO: 1019320 - protein, 6 aa, Mycobacterium
PGGSPL

SEQ ID NO: 1019321 - protein, 9 aa, Mycobacterium
PGGSSTPLL

SEQ ID NO: 1019322 - protein, 17 aa, Mycobacterium
PGGSVRDEEVTAAAAKA

SEQ ID NO: 1019323 - protein, 4 aa, Mycobacterium
PGGT

SEQ ID NO: 1019324 - protein, 8 aa, Mycobacterium
PGHGDDTA

SEQ ID NO: 1019325 - protein, 7 aa, Mycobacterium
PGHGKTD

SEQ ID NO: 1019326 - protein, 5 aa, Mycobacterium
PGHGP

SEQ ID NO: 1019327 - protein, 6 aa, Mycobacterium
PGHGPR

SEQ ID NO: 1019328 - protein, 7 aa, Mycobacterium
PGHPECG

SEQ ID NO: 1019329 - protein, 4 aa, Mycobacterium
PGHT

SEQ ID NO: 1019330 - protein, 8 aa, Mycobacterium
PGIDSGRT

SEQ ID NO: 1019331 - protein, 7 aa, Mycobacterium
PGIGATS

SEQ ID NO: 1019332 - protein, 7 aa, Mycobacterium
PGIGKSR

SEQ ID NO: 1019333 - protein, 9 aa, Mycobacterium
PGIGPKSAQ

SEQ ID NO: 1019334 - protein, 8 aa, Mycobacterium
PGIGPKTA

SEQ ID NO: 1019335 - protein, 7 aa, Mycobacterium
PGINPAE

SEQ ID NO: 1019336 - protein, 4 aa, Mycobacterium
PGIP

SEQ ID NO: 1019337 - protein, 5 aa, Mycobacterium
PGIPT

SEQ ID NO: 1019338 - protein, 4 aa, Mycobacterium
PGIT

SEQ ID NO: 1019339 - protein, 4 aa, Mycobacterium
PGKA

SEQ ID NO: 1019340 - protein, 7 aa, Mycobacterium
PGKAAAV

SEQ ID NO: 1019341 - protein, 7 aa, Mycobacterium
PGKGFAS

SEQ ID NO: 1019342 - protein, 19 aa, Mycobacterium
PGKLTAQSGGHQADAAHPG

SEQ ID NO: 1019343 - protein, 23 aa, Mycobacterium
PGKSAAAGAAQRDQDPLTPAARD

SEQ ID NO: 1019344 - protein, 11 aa, Mycobacterium
PGLADAGQKIS

SEQ ID NO: 1019345 - protein, 6 aa, Mycobacterium
PGLAEA

SEQ ID NO: 1019346 - protein, 10 aa, Mycobacterium
PGLARRDDRG

SEQ ID NO: 1019347 - protein, 4 aa, Mycobacterium
PGLD

SEQ ID NO: 1019348 - protein, 6 aa, Mycobacterium
PGLDAA

SEQ ID NO: 1019349 - protein, 12 aa, Mycobacterium
PGLDSAERDEVA

SEQ ID NO: 1019350 - protein, 9 aa, Mycobacterium
PGLESPTIA

SEQ ID NO: 1019351 - protein, 9 aa, Mycobacterium
PGLGVRPAK

SEQ ID NO: 1019352 - protein, 6 aa, Mycobacterium
PGLPEP

SEQ ID NO: 1019353 - protein, 21 aa, Mycobacterium
PGLPGQLAGSATAAAAANGWP

SEQ ID NO: 1019354 - protein, 13 aa, Mycobacterium
PGLPPAGDPTELN

SEQ ID NO: 1019355 - protein, 17 aa, Mycobacterium
PGLPQGDPVSAAPYGSA

SEQ ID NO: 1019356 - protein, 10 aa, Mycobacterium
PGLPTQPLQG

SEQ ID NO: 1019357 - protein, 12 aa, Mycobacterium
PGLQEPTSKGGK

SEQ ID NO: 1019358 - protein, 11 aa, Mycobacterium
PGLQTNPNSLA

SEQ ID NO: 1019359 - protein, 17 aa, Mycobacterium
PGLQTQRQQLRAELDRI

SEQ ID NO: 1019360 - protein, 4 aa, Mycobacterium
PGLS

SEQ ID NO: 1019361 - protein, 11 aa, Mycobacterium
PGLSSDDRAAI

SEQ ID NO: 1019362 - protein, 4 aa, Mycobacterium
PGLT

SEQ ID NO: 1019363 - protein, 5 aa, Mycobacterium
PGLTP

SEQ ID NO: 1019364 - protein, 5 aa, Mycobacterium
PGMPQ

SEQ ID NO: 1019365 - protein, 5 aa, Mycobacterium
PGMPT

SEQ ID NO: 1019366 - protein, 4 aa, Mycobacterium
PGMQ

SEQ ID NO: 1019367 - protein, 4 aa, Mycobacterium
PGMS

SEQ ID NO: 1019368 - protein, 15 aa, Mycobacterium
PGNAEQLKDNEPKRV

SEQ ID NO: 1019369 - protein, 10 aa, Mycobacterium
PGNAGTARLA

SEQ ID NO: 1019370 - protein, 7 aa, Mycobacterium
PGNARIS

SEQ ID NO: 1019371 - protein, 18 aa, Mycobacterium
PGNEQAAATVPAAFGNSK

SEQ ID NO: 1019372 - protein, 4 aa, Mycobacterium
PGNG

SEQ ID NO: 1019373 - protein, 10 aa, Mycobacterium
PGNGDDTHAV

SEQ ID NO: 1019374 - protein, 4 aa, Mycobacterium
PGNI

SEQ ID NO: 1019375 - protein, 5 aa, Mycobacterium
PGNIP

SEQ ID NO: 1019376 - protein, 8 aa, Mycobacterium
PGNPAVAA

SEQ ID NO: 1019377 - protein, 5 aa, Mycobacterium
PGNPV

SEQ ID NO: 1019378 - protein, 4 aa, Mycobacterium
PGNR

SEQ ID NO: 1019379 - protein, 8 aa, Mycobacterium
PGNRPSTS

SEQ ID NO: 1019380 - protein, 12 aa, Mycobacterium
PGNRSDIRERST

SEQ ID NO: 1019381 - protein, 4 aa, Mycobacterium
PGPA

SEQ ID NO: 1019382 - protein, 6 aa, Mycobacterium
PGPAAY

SEQ ID NO: 1019383 - protein, 10 aa, Mycobacterium
PGPATSSASA

SEQ ID NO: 1019384 - protein, 9 aa, Mycobacterium
PGPDLPYDE

SEQ ID NO: 1019385 - protein, 12 aa, Mycobacterium
PGPEDGTEPVPI

SEQ ID NO: 1019386 - protein, 5 aa, Mycobacterium
PGPEG

SEQ ID NO: 1019387 - protein, 10 aa, Mycobacterium
PGPEGDASAG

SEQ ID NO: 1019388 - protein, 18 aa, Mycobacterium
PGPEGDPYVSDPAPTKRE

SEQ ID NO: 1019389 - protein, 8 aa, Mycobacterium
PGPETEVG

SEQ ID NO: 1019390 - protein, 4 aa, Mycobacterium
PGPF

SEQ ID NO: 1019391 - protein, 5 aa, Mycobacterium
PGPFT

SEQ ID NO: 1019392 - protein, 5 aa, Mycobacterium
PGPGA

SEQ ID NO: 1019393 - protein, 5 aa, Mycobacterium
PGPGL

SEQ ID NO: 1019394 - protein, 10 aa, Mycobacterium
PGPGSEPGES

SEQ ID NO: 1019395 - protein, 15 aa, Mycobacterium
PGPIDTEATRTVTPG

SEQ ID NO: 1019396 - protein, 7 aa, Mycobacterium
PGPIQGG

SEQ ID NO: 1019397 - protein, 4 aa, Mycobacterium
PGPL

SEQ ID NO: 1019398 - protein, 10 aa, Mycobacterium
PGPLDVAEGD

SEQ ID NO: 1019399 - protein, 8 aa, Mycobacterium
PGPMQGGL

SEQ ID NO: 1019400 - protein, 9 aa, Mycobacterium
PGPNAAVKA

SEQ ID NO: 1019401 - protein, 7 aa, Mycobacterium
PGPNGPQ

SEQ ID NO: 1019402 - protein, 6 aa, Mycobacterium
PGPPGR

SEQ ID NO: 1019403 - protein, 18 aa, Mycobacterium
PGPPGSVSKTTSGKVQHS

SEQ ID NO: 1019404 - protein, 14 aa, Mycobacterium
PGPPPPRTGTDRTS

SEQ ID NO: 1019405 - protein, 6 aa, Mycobacterium
PGPPTI

SEQ ID NO: 1019406 - protein, 4 aa, Mycobacterium
PGPR

SEQ ID NO: 1019407 - protein, 5 aa, Mycobacterium
PGPRD

SEQ ID NO: 1019408 - protein, 5 aa, Mycobacterium
PGPRL

SEQ ID NO: 1019409 - protein, 5 aa, Mycobacterium
PGPSG

SEQ ID NO: 1019410 - protein, 8 aa, Mycobacterium
PGPSSASI

SEQ ID NO: 1019411 - protein, 9 aa, Mycobacterium
PGPSTQPNV

SEQ ID NO: 1019412 - protein, 4 aa, Mycobacterium
PGPT

SEQ ID NO: 1019413 - protein, 7 aa, Mycobacterium
PGPVSAE

SEQ ID NO: 1019414 - protein, 15 aa, Mycobacterium
PGPYPGYSTVKPRSC

SEQ ID NO: 1019415 - protein, 10 aa, Mycobacterium
PGQAATVPDI

SEQ ID NO: 1019416 - protein, 5 aa, Mycobacterium
PGQAG

SEQ ID NO: 1019417 - protein, 11 aa, Mycobacterium
PGQGDRPSRTK

SEQ ID NO: 1019418 - protein, 6 aa, Mycobacterium
PGQPAR

SEQ ID NO: 1019419 - protein, 6 aa, Mycobacterium
PGQQGG

SEQ ID NO: 1019420 - protein, 5 aa, Mycobacterium
PGQRI

SEQ ID NO: 1019421 - protein, 18 aa, Mycobacterium
PGQRSPAATVSTRAVRQG

SEQ ID NO: 1019422 - protein, 4 aa, Mycobacterium
PGQS

SEQ ID NO: 1019423 - protein, 4 aa, Mycobacterium
PGRA

SEQ ID NO: 1019424 - protein, 11 aa, Mycobacterium
PGRAAKGPFGT

SEQ ID NO: 1019425 - protein, 5 aa, Mycobacterium
PGRAT

SEQ ID NO: 1019426 - protein, 9 aa, Mycobacterium
PGRDGRVTG

SEQ ID NO: 1019427 - protein, 4 aa, Mycobacterium
PGRE

SEQ ID NO: 1019428 - protein, 7 aa, Mycobacterium
PGREGFP

SEQ ID NO: 1019429 - protein, 6 aa, Mycobacterium
PGREPA

SEQ ID NO: 1019430 - protein, 6 aa, Mycobacterium
PGRESV

SEQ ID NO: 1019431 - protein, 5 aa, Mycobacterium
PGRGA

SEQ ID NO: 1019432 - protein, 6 aa, Mycobacterium
PGRGAD

SEQ ID NO: 1019433 - protein, 8 aa, Mycobacterium
PGRGEPKR

SEQ ID NO: 1019434 - protein, 7 aa, Mycobacterium
PGRGGGF

SEQ ID NO: 1019435 - protein, 9 aa, Mycobacterium
PGRGGSDRG

SEQ ID NO: 1019436 - protein, 9 aa, Mycobacterium
PGRGTEPTA

SEQ ID NO: 1019437 - protein, 12 aa, Mycobacterium
PGRKADTDAAAR

SEQ ID NO: 1019438 - protein, 4 aa, Mycobacterium
PGRP

SEQ ID NO: 1019439 - protein, 11 aa, Mycobacterium
PGRPAPLHPNE

SEQ ID NO: 1019440 - protein, 7 aa, Mycobacterium
PGRPAPR

SEQ ID NO: 1019441 - protein, 6 aa, Mycobacterium
PGRRAR

SEQ ID NO: 1019442 - protein, 5 aa, Mycobacterium
PGRRT

SEQ ID NO: 1019443 - protein, 12 aa, Mycobacterium
PGRSWPAKSERA

SEQ ID NO: 1019444 - protein, 13 aa, Mycobacterium
PGRTGRGIPIPPG

SEQ ID NO: 1019445 - protein, 6 aa, Mycobacterium
PGRTKT

SEQ ID NO: 1019446 - protein, 8 aa, Mycobacterium
PGRTVTEA

SEQ ID NO: 1019447 - protein, 4 aa, Mycobacterium
PGRV

SEQ ID NO: 1019448 - protein, 12 aa, Mycobacterium
PGRWDEDGEKRI

SEQ ID NO: 1019449 - protein, 5 aa, Mycobacterium
PGSAA

SEQ ID NO: 1019450 - protein, 22 aa, Mycobacterium
PGSAAPPATDRRRDGFARQSGQ

SEQ ID NO: 1019451 - protein, 5 aa, Mycobacterium
PGSDA

SEQ ID NO: 1019452 - protein, 7 aa, Mycobacterium
PGSDAPE

SEQ ID NO: 1019453 - protein, 18 aa, Mycobacterium
PGSDDSVDAHASDTLAAG

SEQ ID NO: 1019454 - protein, 6 aa, Mycobacterium
PGSDHR

SEQ ID NO: 1019455 - protein, 7 aa, Mycobacterium
PGSENAL

SEQ ID NO: 1019456 - protein, 15 aa, Mycobacterium
PGSHDREYSRYEMAR

SEQ ID NO: 1019457 - protein, 7 aa, Mycobacterium
PGSIKPN

SEQ ID NO: 1019458 - protein, 39 aa, Mycobacterium; identical to SEQ ID NO: 540517

SEQ ID NO: 1019459 - protein, 11 aa, Mycobacterium
PGSLGAPRPRF

SEQ ID NO: 1019460 - protein, 10 aa, Mycobacterium
PGSNHTKAAG

SEQ ID NO: 1019461 - protein, 10 aa, Mycobacterium
PGSNPFGPDM

SEQ ID NO: 1019462 - protein, 11 aa, Mycobacterium
PGSPFGEHRPN

SEQ ID NO: 1019463 - protein, 9 aa, Mycobacterium
PGSPGGVRD

SEQ ID NO: 1019464 - protein, 5 aa, Mycobacterium
PGSRF

SEQ ID NO: 1019465 - protein, 13 aa, Mycobacterium
PGSRIATGALGSR

SEQ ID NO: 1019466 - protein, 11 aa, Mycobacterium
PGTANGPSRIG

SEQ ID NO: 1019467 - protein, 5 aa, Mycobacterium
PGTAR

SEQ ID NO: 1019468 - protein, 9 aa, Mycobacterium
PGTATPGWA

SEQ ID NO: 1019469 - protein, 6 aa, Mycobacterium
PGTDID

SEQ ID NO: 1019470 - protein, 7 aa, Mycobacterium
PGTEAPA

SEQ ID NO: 1019471 - protein, 9 aa, Mycobacterium
PGTEAPPRC

SEQ ID NO: 1019472 - protein, 4 aa, Mycobacterium
PGTG

SEQ ID NO: 1019473 - protein, 12 aa, Mycobacterium
PGTGDAVQAAKA

SEQ ID NO: 1019474 - protein, 7 aa, Mycobacterium
PGTGLSP

SEQ ID NO: 1019475 - protein, 17 aa, Mycobacterium
PGTGNTGIANAGDYNTG

SEQ ID NO: 1019476 - protein, 7 aa, Mycobacterium
PGTGQEY

SEQ ID NO: 1019477 - protein, 8 aa, Mycobacterium
PGTGSDDD

SEQ ID NO: 1019478 - protein, 6 aa, Mycobacterium
PGTGTA

SEQ ID NO: 1019479 - protein, 17 aa, Mycobacterium
PGTGTGAAAAAEERSRR

SEQ ID NO: 1019480 - protein, 5 aa, Mycobacterium
PGTIG

SEQ ID NO: 1019481 - protein, 11 aa, Mycobacterium
PGTKGLTQGQK

SEQ ID NO: 1019482 - protein, 4 aa, Mycobacterium
PGTL

SEQ ID NO: 1019483 - protein, 7 aa, Mycobacterium
PGTLPEP

SEQ ID NO: 1019484 - protein, 21 aa, Mycobacterium
PGTLPQAVPGSPIAYTTHQLE

SEQ ID NO: 1019485 - protein, 5 aa, Mycobacterium
PGTMN

SEQ ID NO: 1019486 - protein, 7 aa, Mycobacterium
PGTNAQV

SEQ ID NO: 1019487 - protein, 5 aa, Mycobacterium
PGTPA

SEQ ID NO: 1019488 - protein, 6 aa, Mycobacterium
PGTPAG

SEQ ID NO: 1019489 - protein, 6 aa, Mycobacterium
PGTPGL

SEQ ID NO: 1019490 - protein, 6 aa, Mycobacterium
PGTQAR

SEQ ID NO: 1019491 - protein, 4 aa, Mycobacterium
PGTS

SEQ ID NO: 1019492 - protein, 10 aa, Mycobacterium
PGTTGVHSSG

SEQ ID NO: 1019493 - protein, 6 aa, Mycobacterium
PGTTRT

SEQ ID NO: 1019494 - protein, 9 aa, Mycobacterium
PGTVQAGDT

SEQ ID NO: 1019495 - protein, 17 aa, Mycobacterium
PGVDGYPYRQRPTPIPT

SEQ ID NO: 1019496 - protein, 5 aa, Mycobacterium
PGVDK

SEQ ID NO: 1019497 - protein, 5 aa, Mycobacterium
PGVDL

SEQ ID NO: 1019498 - protein, 4 aa, Mycobacterium
PGVE

SEQ ID NO: 1019499 - protein, 9 aa, Mycobacterium
PGVEKTNYD

SEQ ID NO: 1019500 - protein, 7 aa, Mycobacterium
PGVGKST

SEQ ID NO: 1019501 - protein, 11 aa, Mycobacterium
PGVGSRTAPDL

SEQ ID NO: 1019502 - protein, 12 aa, Mycobacterium
PGVGSTTRGTLP

SEQ ID NO: 1019503 - protein, 5 aa, Mycobacterium
PGVKP

SEQ ID NO: 1019504 - protein, 21 aa, Mycobacterium
PGVQAAPRTPGRDGEVAEAEK

SEQ ID NO: 1019505 - protein, 5 aa, Mycobacterium
PGVQQ

SEQ ID NO: 1019506 - protein, 7 aa, Mycobacterium
PGVQTPD

SEQ ID NO: 1019507 - protein, 7 aa, Mycobacterium
PGVRNYD

SEQ ID NO: 1019508 - protein, 11 aa, Mycobacterium
PGVRPRRGHQR

SEQ ID NO: 1019509 - protein, 12 aa, Mycobacterium
PGVSPDDVREAT

SEQ ID NO: 1019510 - protein, 9 aa, Mycobacterium
PGVSPSGLD

SEQ ID NO: 1019511 - protein, 7 aa, Mycobacterium
PGVVDPA

SEQ ID NO: 1019512 - protein, 7 aa, Mycobacterium
PGWAPCS

SEQ ID NO: 1019513 - protein, 5 aa, Mycobacterium
PGWGS

SEQ ID NO: 1019514 - protein, 19 aa, Mycobacterium
PGWKPQTPANQETGRLAKS

SEQ ID NO: 1019515 - protein, 7 aa, Mycobacterium
PGWRGRS

SEQ ID NO: 1019516 - protein, 11 aa, Mycobacterium
PGYARDQGSPT

SEQ ID NO: 1019517 - protein, 7 aa, Mycobacterium
PGYDPAR

SEQ ID NO: 1019518 - protein, 10 aa, Mycobacterium
PGYDPSTYDR

SEQ ID NO: 1019519 - protein, 9 aa, Mycobacterium
PGYEEQRAA

SEQ ID NO: 1019520 - protein, 4 aa, Mycobacterium
PGYH

SEQ ID NO: 1019521 - protein, 9 aa, Mycobacterium
PGYKSSLAG

SEQ ID NO: 1019522 - protein, 4 aa, Mycobacterium
PGYL

SEQ ID NO: 1019523 - protein, 18 aa, Mycobacterium
PGYQGESGESGEQPRPTT

SEQ ID NO: 1019524 - protein, 6 aa, Mycobacterium
PGYTSA

SEQ ID NO: 1019525 - protein, 9 aa, Mycobacterium
PHAASDALG

SEQ ID NO: 1019526 - protein, 15 aa, Mycobacterium
PHAGGGGGGGQPGCS

SEQ ID NO: 1019527 - protein, 9 aa, Mycobacterium
PHAKAAEVA

SEQ ID NO: 1019528 - protein, 10 aa, Mycobacterium
PHAPDTHSPL

SEQ ID NO: 1019529 - protein, 7 aa, Mycobacterium
PHASEGV

SEQ ID NO: 1019530 - protein, 11 aa, Mycobacterium
PHCRRTKKKQT

SEQ ID NO: 1019531 - protein, 4 aa, Mycobacterium
PHDA

SEQ ID NO: 1019532 - protein, 7 aa, Mycobacterium
PHDDKQV

SEQ ID NO: 1019533 - protein, 12 aa, Mycobacterium
PHDPAGDQPAAI

SEQ ID NO: 1019534 - protein, 6 aa, Mycobacterium
PHDPGR

SEQ ID NO: 1019535 - protein, 11 aa, Mycobacterium
PHDPRAGHRCN

SEQ ID NO: 1019536 - protein, 4 aa, Mycobacterium
PHEN

SEQ ID NO: 1019537 - protein, 5 aa, Mycobacterium
PHEPG

SEQ ID NO: 1019538 - protein, 4 aa, Mycobacterium
PHET

SEQ ID NO: 1019539 - protein, 6 aa, Mycobacterium
PHETGR

SEQ ID NO: 1019540 - protein, 18 aa, Mycobacterium
PHGAGTRLTESRHAENGV

SEQ ID NO: 1019541 - protein, 7 aa, Mycobacterium
PHGEGLE

SEQ ID NO: 1019542 - protein, 7 aa, Mycobacterium
PHGGDAT

SEQ ID NO: 1019543 - protein, 11 aa, Mycobacterium
PHGGGAAAGTV

SEQ ID NO: 1019544 - protein, 16 aa, Mycobacterium
PHGSTGVGPVEGRASH

SEQ ID NO: 1019545 - protein, 8 aa, Mycobacterium
PHGTGKTA

SEQ ID NO: 1019546 - protein, 10 aa, Mycobacterium
PHGTPEEPKG

SEQ ID NO: 1019547 - protein, 9 aa, Mycobacterium
PHKTSSRRI

SEQ ID NO: 1019548 - protein, 5 aa, Mycobacterium
PHPAP

SEQ ID NO: 1019549 - protein, 5 aa, Mycobacterium
PHPEG

SEQ ID NO: 1019550 - protein, 7 aa, Mycobacterium
PHPEGTW

SEQ ID NO: 1019551 - protein, 7 aa, Mycobacterium
PHPGDDD

SEQ ID NO: 1019552 - protein, 13 aa, Mycobacterium
PHPLETSASSTKW

SEQ ID NO: 1019553 - protein, 7 aa, Mycobacterium
PHPPAGV

SEQ ID NO: 1019554 - protein, 4 aa, Mycobacterium
PHPR

SEQ ID NO: 1019555 - protein, 8 aa, Mycobacterium
PHPTDGRT

SEQ ID NO: 1019556 - protein, 7 aa, Mycobacterium
PHPTIPK

SEQ ID NO: 1019557 - protein, 5 aa, Mycobacterium
PHPVG

SEQ ID NO: 1019558 - protein, 13 aa, Mycobacterium
PHQENDYIMVREL

SEQ ID NO: 1019559 - protein, 7 aa, Mycobacterium
PHQSGTA

SEQ ID NO: 1019560 - protein, 4 aa, Mycobacterium
PHRQ

SEQ ID NO: 1019561 - protein, 7 aa, Mycobacterium
PHSEARS

SEQ ID NO: 1019562 - protein, 75 aa, Mycobacterium
PHSGGSGIAVPPGKEKPLGLGDEPEPQEADPTGISNSNDASDAGVTHGHRPAGPREHVAGTEGTATGSPMPTPAL

SEQ ID NO: 1019563 - protein, 6 aa, Mycobacterium
PHTAPT

SEQ ID NO: 1019564 - protein, 4 aa, Mycobacterium
PHTG

SEQ ID NO: 1019565 - protein, 4 aa, Mycobacterium
PHTQ

SEQ ID NO: 1019566 - protein, 14 aa, Mycobacterium
PHTSGLGGTFGGNP

SEQ ID NO: 1019567 - protein, 9 aa, Mycobacterium
PHTTPAPPI

SEQ ID NO: 1019568 - protein, 11 aa, Mycobacterium
PIADPVSRTQV

SEQ ID NO: 1019569 - protein, 5 aa, Mycobacterium
PIAGD

SEQ ID NO: 1019570 - protein, 29 aa, Mycobacterium
PIAHDGDAQQLGAGRSDAAESSSSRPKGR

SEQ ID NO: 1019571 - protein, 17 aa, Mycobacterium
PIDEPTAVPADEPNAAR

SEQ ID NO: 1019572 - protein, 12 aa, Mycobacterium
PIEGAGARAPQV

SEQ ID NO: 1019573 - protein, 6 aa, Mycobacterium
PIESEY

SEQ ID NO: 1019574 - protein, 5 aa, Mycobacterium
PIESG

SEQ ID NO: 1019575 - protein, 5 aa, Mycobacterium
PIGDA

SEQ ID NO: 1019576 - protein, 11 aa, Mycobacterium
PIGDRYDSEDG

SEQ ID NO: 1019577 - protein, 11 aa, Mycobacterium
PIGEPAAPSPE

SEQ ID NO: 1019578 - protein, 7 aa, Mycobacterium
PIGLTQT

SEQ ID NO: 1019579 - protein, 4 aa, Mycobacterium
PIGP

SEQ ID NO: 1019580 - protein, 5 aa, Mycobacterium
PIGRG

SEQ ID NO: 1019581 - protein, 13 aa, Mycobacterium
PIGTARKGTLRDT

SEQ ID NO: 1019582 - protein, 10 aa, Mycobacterium
PIHGDDDEWE

SEQ ID NO: 1019583 - protein, 9 aa, Mycobacterium
PINTPEGSL

SEQ ID NO: 1019584 - protein, 6 aa, Mycobacterium
PIPAAA

SEQ ID NO: 1019585 - protein, 13 aa, Mycobacterium
PIPDPDRAGPSTL

SEQ ID NO: 1019586 - protein, 5 aa, Mycobacterium
PIPGM

SEQ ID NO: 1019587 - protein, 5 aa, Mycobacterium
PIPPG

SEQ ID NO: 1019588 - protein, 15 aa, Mycobacterium
PIPPNTPNIREDESD

SEQ ID NO: 1019589 - protein, 4 aa, Mycobacterium
PIPQ

SEQ ID NO: 1019590 - protein, 16 aa, Mycobacterium
PIPQEAVADPDGTEAT

SEQ ID NO: 1019591 - protein, 9 aa, Mycobacterium
PIPRPPSIR

SEQ ID NO: 1019592 - protein, 5 aa, Mycobacterium
PIQPK

SEQ ID NO: 1019593 - protein, 5 aa, Mycobacterium
PIQTS

SEQ ID NO: 1019594 - protein, 4 aa, Mycobacterium
PIRD

SEQ ID NO: 1019595 - protein, 10 aa, Mycobacterium
PIRGPDGSAT

SEQ ID NO: 1019596 - protein, 7 aa, Mycobacterium
PIRTGDE

SEQ ID NO: 1019597 - protein, 10 aa, Mycobacterium
PISDKSAVEK

SEQ ID NO: 1019598 - protein, 132 aa, Mycobacterium
PISEPVAGDDADDESGDEGDDDEEQADRPGNRRRRRGRRGRGRGRGEQGANDGQDQPGDDGDEAPQKAGGNSTSSDDSEAQDGADSEESDNGDDDNGSADGASRRRRRRRRRKSGAGDDGDEGPAPDDPPNT

SEQ ID NO: 1019599 - protein, 5 aa, Mycobacterium
PISEQ

SEQ ID NO: 1019600 - protein, 4 aa, Mycobacterium
PISG

SEQ ID NO: 1019601 - protein, 15 aa, Mycobacterium
PISGRGRRGGEAARG

SEQ ID NO: 1019602 - protein, 15 aa, Mycobacterium
PISHPDTAILAMLLA

SEQ ID NO: 1019603 - protein, 10 aa, Mycobacterium
PISQSDVGSV

SEQ ID NO: 1019604 - protein, 12 aa, Mycobacterium
PISRDSAESRLG

SEQ ID NO: 1019605 - protein, 10 aa, Mycobacterium
PISRERAETR

SEQ ID NO: 1019606 - protein, 10 aa, Mycobacterium
PISRQRAEAR

SEQ ID NO: 1019607 - protein, 4 aa, Mycobacterium
PIST

SEQ ID NO: 1019608 - protein, 14 aa, Mycobacterium
PITADDATNPITEG

SEQ ID NO: 1019609 - protein, 5 aa, Mycobacterium
PITDG

SEQ ID NO: 1019610 - protein, 7 aa, Mycobacterium
PITDSEA

SEQ ID NO: 1019611 - protein, 10 aa, Mycobacterium
PITGPPPPIG

SEQ ID NO: 1019612 - protein, 5 aa, Mycobacterium
PITPA

SEQ ID NO: 1019613 - protein, 7 aa, Mycobacterium
PITPESI

SEQ ID NO: 1019614 - protein, 6 aa, Mycobacterium
PITPGG

SEQ ID NO: 1019615 - protein, 10 aa, Mycobacterium
PITTAKEAAS

SEQ ID NO: 1019616 - protein, 4 aa, Mycobacterium
PIVG

SEQ ID NO: 1019617 - protein, 10 aa, Mycobacterium
PIVPGANDNL

SEQ ID NO: 1019618 - protein, 7 aa, Mycobacterium
PKAAEFS

SEQ ID NO: 1019619 - protein, 7 aa, Mycobacterium
PKAITGT

SEQ ID NO: 1019620 - protein, 10 aa, Mycobacterium
PKAKNSVNAA

SEQ ID NO: 1019621 - protein, 6 aa, Mycobacterium
PKANLR

SEQ ID NO: 1019622 - protein, 8 aa, Mycobacterium
PKASTPAV

SEQ ID NO: 1019623 - protein, 7 aa, Mycobacterium
PKATGVT

SEQ ID NO: 1019624 - protein, 6 aa, Mycobacterium
PKAVPS

SEQ ID NO: 1019625 - protein, 5 aa, Mycobacterium
PKDAQ

SEQ ID NO: 1019626 - protein, 11 aa, Mycobacterium
PKDAVNAARDI

SEQ ID NO: 1019627 - protein, 10 aa, Mycobacterium
PKDEVSADEY

SEQ ID NO: 1019628 - protein, 4 aa, Mycobacterium
PKDI

SEQ ID NO: 1019629 - protein, 27 aa, Mycobacterium
PKDPPVPPVPGLPPSPPSPPAPPAGPV

SEQ ID NO: 1019630 - protein, 6 aa, Mycobacterium
PKDREL

SEQ ID NO: 1019631 - protein, 7 aa, Mycobacterium
PKDRKQQ

SEQ ID NO: 1019632 - protein, 7 aa, Mycobacterium
PKDTGLA

SEQ ID NO: 1019633 - protein, 7 aa, Mycobacterium
PKDVGRT

SEQ ID NO: 1019634 - protein, 10 aa, Mycobacterium
PKEANDSRCR

SEQ ID NO: 1019635 - protein, 5 aa, Mycobacterium
PKELA

SEQ ID NO: 1019636 - protein, 7 aa, Mycobacterium
PKEVGAD

SEQ ID NO: 1019637 - protein, 13 aa, Mycobacterium
PKFSNSNAQTSAE

SEQ ID NO: 1019638 - protein, 7 aa, Mycobacterium
PKFTTEQ

SEQ ID NO: 1019639 - protein, 5 aa, Mycobacterium
PKGAL

SEQ ID NO: 1019640 - protein, 9 aa, Mycobacterium
PKGDARALP

SEQ ID NO: 1019641 - protein, 4 aa, Mycobacterium
PKGI

SEQ ID NO: 1019642 - protein, 11 aa, Mycobacterium
PKGIQKDPEAV

SEQ ID NO: 1019643 - protein, 12 aa, Mycobacterium
PKGKVDPGETAA

SEQ ID NO: 1019644 - protein, 7 aa, Mycobacterium
PKGMRAS

SEQ ID NO: 1019645 - protein, 6 aa, Mycobacterium
PKGPGH

SEQ ID NO: 1019646 - protein, 12 aa, Mycobacterium
PKGPNDNPDSIA

SEQ ID NO: 1019647 - protein, 7 aa, Mycobacterium
PKGPTGK

SEQ ID NO: 1019648 - protein, 8 aa, Mycobacterium
PKGQHSSF

SEQ ID NO: 1019649 - protein, 4 aa, Mycobacterium
PKGR

SEQ ID NO: 1019650 - protein, 7 aa, Mycobacterium
PKGRAQI

SEQ ID NO: 1019651 - protein, 8 aa, Mycobacterium
PKGRQDYD

SEQ ID NO: 1019652 - protein, 4 aa, Mycobacterium
PKGT

SEQ ID NO: 1019653 - protein, 16 aa, Mycobacterium
PKGTRLARPVEAVREI

SEQ ID NO: 1019654 - protein, 9 aa, Mycobacterium
PKGWTGPKV

SEQ ID NO: 1019655 - protein, 25 aa, Mycobacterium
PKHATDGDDDEVSDWSSTETDPAIA

SEQ ID NO: 1019656 - protein, 6 aa, Mycobacterium
PKHGTP

SEQ ID NO: 1019657 - protein, 4 aa, Mycobacterium
PKHK

SEQ ID NO: 1019658 - protein, 14 aa, Mycobacterium
PKHRGRLVSKLRFW

SEQ ID NO: 1019659 - protein, 8 aa, Mycobacterium
PKKSGKQL

SEQ ID NO: 1019660 - protein, 9 aa, Mycobacterium
PKLDDAGPI

SEQ ID NO: 1019661 - protein, 4 aa, Mycobacterium
PKLE

SEQ ID NO: 1019662 - protein, 6 aa, Mycobacterium
PKLESY

SEQ ID NO: 1019663 - protein, 4 aa, Mycobacterium
PKLR

SEQ ID NO: 1019664 - protein, 9 aa, Mycobacterium
PKLSAGRVQ

SEQ ID NO: 1019665 - protein, 24 aa, Mycobacterium
PKMPGEPKRVQPSRDTDLKPKNAH

SEQ ID NO: 1019666 - protein, 6 aa, Mycobacterium
PKMPNE

SEQ ID NO: 1019667 - protein, 10 aa, Mycobacterium
PKPAQPGGGV

SEQ ID NO: 1019668 - protein, 6 aa, Mycobacterium
PKPDWR

SEQ ID NO: 1019669 - protein, 5 aa, Mycobacterium
PKPGQ

SEQ ID NO: 1019670 - protein, 4 aa, Mycobacterium
PKPL

SEQ ID NO: 1019671 - protein, 7 aa, Mycobacterium
PKPLQNN

SEQ ID NO: 1019672 - protein, 4 aa, Mycobacterium
PKPP

SEQ ID NO: 1019673 - protein, 7 aa, Mycobacterium
PKPPFAQ

SEQ ID NO: 1019674 - protein, 5 aa, Mycobacterium
PKPPR

SEQ ID NO: 1019675 - protein, 30 aa, Mycobacterium; identical to SEQ ID NO: 541796

SEQ ID NO: 1019676 - protein, 8 aa, Mycobacterium
PKPTPEQE

SEQ ID NO: 1019677 - protein, 9 aa, Mycobacterium
PKRARDLPD

SEQ ID NO: 1019678 - protein, 8 aa, Mycobacterium
PKRFNSKL

SEQ ID NO: 1019679 - protein, 4 aa, Mycobacterium
PKRL

SEQ ID NO: 1019680 - protein, 10 aa, Mycobacterium
PKRMGRPEEY

SEQ ID NO: 1019681 - protein, 16 aa, Mycobacterium
PKRPAPSGPGRTRSGS

SEQ ID NO: 1019682 - protein, 7 aa, Mycobacterium
PKRRSGR

SEQ ID NO: 1019683 - protein, 14 aa, Mycobacterium
PKRSPADKDGDTAA

SEQ ID NO: 1019684 - protein, 7 aa, Mycobacterium
PKSANGA

SEQ ID NO: 1019685 - protein, 19 aa, Mycobacterium
PKSARRRRPSWRPSPAAKI

SEQ ID NO: 1019686 - protein, 7 aa, Mycobacterium
PKSDGGR

SEQ ID NO: 1019687 - protein, 9 aa, Mycobacterium
PKSEGHRGG

SEQ ID NO: 1019688 - protein, 7 aa, Mycobacterium
PKSERSE

SEQ ID NO: 1019689 - protein, 7 aa, Mycobacterium
PKSETRR

SEQ ID NO: 1019690 - protein, 12 aa, Mycobacterium
PKSPFGKQGYRY

SEQ ID NO: 1019691 - protein, 8 aa, Mycobacterium
PKTAETAA

SEQ ID NO: 1019692 - protein, 23 aa, Mycobacterium
PKTDPVDPHAPPVTPEEKLVALL

SEQ ID NO: 1019693 - protein, 14 aa, Mycobacterium
PKTEITATDLVDHG

SEQ ID NO: 1019694 - protein, 6 aa, Mycobacterium
PKTGAV

SEQ ID NO: 1019695 - protein, 5 aa, Mycobacterium
PKTGE

SEQ ID NO: 1019696 - protein, 36 aa, Mycobacterium
PKTGGGVDPLTEAPAPITAQQRKEAGIDAKPKQVEG

SEQ ID NO: 1019697 - protein, 15 aa, Mycobacterium
PKTKRTKTGYTTDAD

SEQ ID NO: 1019698 - protein, 16 aa, Mycobacterium
PKTKRTKTGYTTDADA

SEQ ID NO: 1019699 - protein, 7 aa, Mycobacterium
PKTRSGK

SEQ ID NO: 1019700 - protein, 23 aa, Mycobacterium
PKTSSGKLRRRQTSERLRLFDDA

SEQ ID NO: 1019701 - protein, 17 aa, Mycobacterium
PKVLPDPRSARQPDGVH

SEQ ID NO: 1019702 - protein, 6 aa, Mycobacterium
PKVPTS

SEQ ID NO: 1019703 - protein, 5 aa, Mycobacterium
PKYSS

SEQ ID NO: 1019704 - protein, 10 aa, Mycobacterium
PLAAAQAEGA

SEQ ID NO: 1019705 - protein, 10 aa, Mycobacterium
PLAAPDGPLR

SEQ ID NO: 1019706 - protein, 7 aa, Mycobacterium
PLAGESL

SEQ ID NO: 1019707 - protein, 6 aa, Mycobacterium
PLAGHA

SEQ ID NO: 1019708 - protein, 9 aa, Mycobacterium
PLAKAQAAG

SEQ ID NO: 1019709 - protein, 9 aa, Mycobacterium
PLAKGDYSE

SEQ ID NO: 1019710 - protein, 13 aa, Mycobacterium
PLAPAAPNPPFPP

SEQ ID NO: 1019711 - protein, 16 aa, Mycobacterium
PLAPTGRGLPADGGVR

SEQ ID NO: 1019712 - protein, 12 aa, Mycobacterium
PLAQPGTGDAGG

SEQ ID NO: 1019713 - protein, 8 aa, Mycobacterium
PLARPPGH

SEQ ID NO: 1019714 - protein, 5 aa, Mycobacterium
PLART

SEQ ID NO: 1019715 - protein, 4 aa, Mycobacterium
PLAS

SEQ ID NO: 1019716 - protein, 4 aa, Mycobacterium
PLAT

SEQ ID NO: 1019717 - protein, 12 aa, Mycobacterium
PLATRRGDVERG

SEQ ID NO: 1019718 - protein, 8 aa, Mycobacterium
PLCSPSRG

SEQ ID NO: 1019719 - protein, 7 aa, Mycobacterium
PLDDENN

SEQ ID NO: 1019720 - protein, 7 aa, Mycobacterium
PLDDGTA

SEQ ID NO: 1019721 - protein, 8 aa, Mycobacterium
PLDGPPEL

SEQ ID NO: 1019722 - protein, 6 aa, Mycobacterium
PLDKAG

SEQ ID NO: 1019723 - protein, 28 aa, Mycobacterium
PLDPAAAAELENSARNAPLTRPRPGHAD

SEQ ID NO: 1019724 - protein, 5 aa, Mycobacterium
PLDPD

SEQ ID NO: 1019725 - protein, 5 aa, Mycobacterium
PLDRG

SEQ ID NO: 1019726 - protein, 7 aa, Mycobacterium
PLDRGSP

SEQ ID NO: 1019727 - protein, 5 aa, Mycobacterium
PLDTE

SEQ ID NO: 1019728 - protein, 7 aa, Mycobacterium
PLDTQPA

SEQ ID NO: 1019729 - protein, 6 aa, Mycobacterium
PLDTQR

SEQ ID NO: 1019730 - protein, 4 aa, Mycobacterium
PLED

SEQ ID NO: 1019731 - protein, 7 aa, Mycobacterium
PLEDGST

SEQ ID NO: 1019732 - protein, 17 aa, Mycobacterium
PLEGTGEVQTPLSGRAA

SEQ ID NO: 1019733 - protein, 14 aa, Mycobacterium
PLEPPGTPDDPTST

SEQ ID NO: 1019734 - protein, 4 aa, Mycobacterium
PLET

SEQ ID NO: 1019735 - protein, 6 aa, Mycobacterium
PLGAGK

SEQ ID NO: 1019736 - protein, 10 aa, Mycobacterium
PLGASGAGGT

SEQ ID NO: 1019737 - protein, 11 aa, Mycobacterium
PLGEQRAAETG

SEQ ID NO: 1019738 - protein, 14 aa, Mycobacterium
PLGGPDGGNGGRGG

SEQ ID NO: 1019739 - protein, 7 aa, Mycobacterium
PLGGSGA

SEQ ID NO: 1019740 - protein, 6 aa, Mycobacterium
PLGPDS

SEQ ID NO: 1019741 - protein, 8 aa, Mycobacterium
PLGPGQPP

SEQ ID NO: 1019742 - protein, 5 aa, Mycobacterium
PLGPN

SEQ ID NO: 1019743 - protein, 4 aa, Mycobacterium
PLGR

SEQ ID NO: 1019744 - protein, 8 aa, Mycobacterium
PLGRQAEV

SEQ ID NO: 1019745 - protein, 4 aa, Mycobacterium
PLGT

SEQ ID NO: 1019746 - protein, 7 aa, Mycobacterium
PLGTDGR

SEQ ID NO: 1019747 - protein, 8 aa, Mycobacterium
PLHGGAPA

SEQ ID NO: 1019748 - protein, 10 aa, Mycobacterium
PLHPSQSVDH

SEQ ID NO: 1019749 - protein, 4 aa, Mycobacterium
PLKP

SEQ ID NO: 1019750 - protein, 13 aa, Mycobacterium
PLKREDSARSQPF

SEQ ID NO: 1019751 - protein, 13 aa, Mycobacterium
PLKVTGKARYAAD

SEQ ID NO: 1019752 - protein, 8 aa, Mycobacterium
PLNGELTE

SEQ ID NO: 1019753 - protein, 4 aa, Mycobacterium
PLNQ

SEQ ID NO: 1019754 - protein, 4 aa, Mycobacterium
PLPD

SEQ ID NO: 1019755 - protein, 5 aa, Mycobacterium
PLPDD

SEQ ID NO: 1019756 - protein, 18 aa, Mycobacterium
PLPDTPTGGHSGKTVAES

SEQ ID NO: 1019757 - protein, 5 aa, Mycobacterium
PLPEL

SEQ ID NO: 1019758 - protein, 20 aa, Mycobacterium
PLPEPPELPGVSGANPCRRA

SEQ ID NO: 1019759 - protein, 6 aa, Mycobacterium
PLPGHT

SEQ ID NO: 1019760 - protein, 4 aa, Mycobacterium
PLPI

SEQ ID NO: 1019761 - protein, 39 aa, Mycobacterium
PLPLENDHNAQTLGNRPTTTAPTTAPTAPPASPADEVQH

SEQ ID NO: 1019762 - protein, 7 aa, Mycobacterium
PLPMPPS

SEQ ID NO: 1019763 - protein, 12 aa, Mycobacterium
PLPNTAGCRSAA

SEQ ID NO: 1019764 - protein, 6 aa, Mycobacterium
PLPPGL

SEQ ID NO: 1019765 - protein, 13 aa, Mycobacterium
PLPPSPPSPPIPA

SEQ ID NO: 1019766 - protein, 66 aa, Mycobacterium
PLPPVPPVPPMPPAPPLPAALPPGPGAPPVPPVPPVPPAYPAVPKPVSPYPPAPPVPPGCSNEPAP

SEQ ID NO: 1019767 - protein, 6 aa, Mycobacterium
PLPPVT

SEQ ID NO: 1019768 - protein, 22 aa, Mycobacterium
PLPTREPMRRNGPAADESSTAS

SEQ ID NO: 1019769 - protein, 7 aa, Mycobacterium
PLPTTTI

SEQ ID NO: 1019770 - protein, 8 aa, Mycobacterium
PLQGPNGK

SEQ ID NO: 1019771 - protein, 10 aa, Mycobacterium
PLQSGRPLQE

SEQ ID NO: 1019772 - protein, 11 aa, Mycobacterium
PLRDEGENYAT

SEQ ID NO: 1019773 - protein, 7 aa, Mycobacterium
PLRDGGY

SEQ ID NO: 1019774 - protein, 7 aa, Mycobacterium
PLRGSKA

SEQ ID NO: 1019775 - protein, 9 aa, Mycobacterium
PLRPHPSDP

SEQ ID NO: 1019776 - protein, 13 aa, Mycobacterium
PLRSGEPARPAGR

SEQ ID NO: 1019777 - protein, 15 aa, Mycobacterium
PLRSRNVNKCPCQAG

SEQ ID NO: 1019778 - protein, 4 aa, Mycobacterium
PLRT

SEQ ID NO: 1019779 - protein, 10 aa, Mycobacterium
PLSADERQTT

SEQ ID NO: 1019780 - protein, 7 aa, Mycobacterium
PLSAGEL

SEQ ID NO: 1019781 - protein, 9 aa, Mycobacterium
PLSAQEPEA

SEQ ID NO: 1019782 - protein, 5 aa, Mycobacterium
PLSAT

SEQ ID NO: 1019783 - protein, 7 aa, Mycobacterium
PLSDPGD

SEQ ID NO: 1019784 - protein, 13 aa, Mycobacterium
PLSDSSRLSGPLA

SEQ ID NO: 1019785 - protein, 8 aa, Mycobacterium
PLSEPHNQ

SEQ ID NO: 1019786 - protein, 7 aa, Mycobacterium
PLSGRVG

SEQ ID NO: 1019787 - protein, 5 aa, Mycobacterium
PLSGV

SEQ ID NO: 1019788 - protein, 8 aa, Mycobacterium
PLSPERAR

SEQ ID NO: 1019789 - protein, 16 aa, Mycobacterium
PLSPPEAPRDDEASWQ

SEQ ID NO: 1019790 - protein, 4 aa, Mycobacterium
PLSS

SEQ ID NO: 1019791 - protein, 12 aa, Mycobacterium
PLSSVTDSHVTG

SEQ ID NO: 1019792 - protein, 12 aa, Mycobacterium
PLSTASDPHGLT

SEQ ID NO: 1019793 - protein, 16 aa, Mycobacterium
PLSTPDLTGPATRANV

SEQ ID NO: 1019794 - protein, 12 aa, Mycobacterium
PLSVTTQLRTTW

SEQ ID NO: 1019795 - protein, 6 aa, Mycobacterium
PLTAEQ

SEQ ID NO: 1019796 - protein, 8 aa, Mycobacterium
PLTANATS

SEQ ID NO: 1019797 - protein, 13 aa, Mycobacterium
PLTEEQRGQIEEV

SEQ ID NO: 1019798 - protein, 4 aa, Mycobacterium
PLTN

SEQ ID NO: 1019799 - protein, 10 aa, Mycobacterium
PLTPAQRQAR

SEQ ID NO: 1019800 - protein, 5 aa, Mycobacterium
PLTPG

SEQ ID NO: 1019801 - protein, 7 aa, Mycobacterium
PLTPPTT

SEQ ID NO: 1019802 - protein, 8 aa, Mycobacterium
PLTQEQTD

SEQ ID NO: 1019803 - protein, 7 aa, Mycobacterium
PLTSGSK

SEQ ID NO: 1019804 - protein, 4 aa, Mycobacterium
PLVG

SEQ ID NO: 1019805 - protein, 8 aa, Mycobacterium
PMAAAGDP

SEQ ID NO: 1019806 - protein, 12 aa, Mycobacterium
PMAGPIDENAKQ

SEQ ID NO: 1019807 - protein, 13 aa, Mycobacterium
PMDAGRKGQKGIE

SEQ ID NO: 1019808 - protein, 8 aa, Mycobacterium
PMDPDTDI

SEQ ID NO: 1019809 - protein, 6 aa, Mycobacterium
PMGPAD

SEQ ID NO: 1019810 - protein, 4 aa, Mycobacterium
PMGQ

SEQ ID NO: 1019811 - protein, 6 aa, Mycobacterium
PMKKTP

SEQ ID NO: 1019812 - protein, 6 aa, Mycobacterium
PMNPNG

SEQ ID NO: 1019813 - protein, 11 aa, Mycobacterium
PMPDPLAPPPL

SEQ ID NO: 1019814 - protein, 5 aa, Mycobacterium
PMPGG

SEQ ID NO: 1019815 - protein, 16 aa, Mycobacterium
PMPGPGEGSAGAGPRY

SEQ ID NO: 1019816 - protein, 4 aa, Mycobacterium
PMPP

SEQ ID NO: 1019817 - protein, 19 aa, Mycobacterium
PMPVGGSTAPAVLGTGRTD

SEQ ID NO: 1019818 - protein, 7 aa, Mycobacterium
PMQKPHP

SEQ ID NO: 1019819 - protein, 15 aa, Mycobacterium
PMQPPNSHSPEPGTL

SEQ ID NO: 1019820 - protein, 11 aa, Mycobacterium
PMRDPGDGSVI

SEQ ID NO: 1019821 - protein, 6 aa, Mycobacterium
PMRGGL

SEQ ID NO: 1019822 - protein, 15 aa, Mycobacterium
PMSPVNKPFEINVTC

SEQ ID NO: 1019823 - protein, 10 aa, Mycobacterium
PMTAAGSGSI

SEQ ID NO: 1019824 - protein, 4 aa, Mycobacterium
PNAA

SEQ ID NO: 1019825 - protein, 8 aa, Mycobacterium
PNAAPDER

SEQ ID NO: 1019826 - protein, 9 aa, Mycobacterium
PNADGRRPD

SEQ ID NO: 1019827 - protein, 5 aa, Mycobacterium
PNAGI

SEQ ID NO: 1019828 - protein, 7 aa, Mycobacterium
PNALTST

SEQ ID NO: 1019829 - protein, 4 aa, Mycobacterium
PNAP

SEQ ID NO: 1019830 - protein, 5 aa, Mycobacterium
PNAQR

SEQ ID NO: 1019831 - protein, 5 aa, Mycobacterium
PNARG

SEQ ID NO: 1019832 - protein, 9 aa, Mycobacterium
PNASGGTDI

SEQ ID NO: 1019833 - protein, 7 aa, Mycobacterium
PNATDGV

SEQ ID NO: 1019834 - protein, 5 aa, Mycobacterium
PNATE

SEQ ID NO: 1019835 - protein, 8 aa, Mycobacterium
PNDAADRA

SEQ ID NO: 1019836 - protein, 4 aa, Mycobacterium
PNDG

SEQ ID NO: 1019837 - protein, 4 aa, Mycobacterium
PNDL

SEQ ID NO: 1019838 - protein, 5 aa, Mycobacterium
PNDTF

SEQ ID NO: 1019839 - protein, 12 aa, Mycobacterium
PNEDAEVSKEIE

SEQ ID NO: 1019840 - protein, 4 aa, Mycobacterium
PNEH

SEQ ID NO: 1019841 - protein, 5 aa, Mycobacterium
PNGAA

SEQ ID NO: 1019842 - protein, 10 aa, Mycobacterium
PNGAGKTTTV

SEQ ID NO: 1019843 - protein, 14 aa, Mycobacterium
PNGAPDAAPAPVAS

SEQ ID NO: 1019844 - protein, 7 aa, Mycobacterium
PNGEPGV

SEQ ID NO: 1019845 - protein, 16 aa, Mycobacterium
PNGGPKTPRSAAQTPE

SEQ ID NO: 1019846 - protein, 7 aa, Mycobacterium
PNGNLSQ

SEQ ID NO: 1019847 - protein, 11 aa, Mycobacterium
PNGPRSPIPND

SEQ ID NO: 1019848 - protein, 13 aa, Mycobacterium
PNGQGSAVDGGYR

SEQ ID NO: 1019849 - protein, 5 aa, Mycobacterium
PNGRR

SEQ ID NO: 1019850 - protein, 10 aa, Mycobacterium
PNGTVTAGNA

SEQ ID NO: 1019851 - protein, 5 aa, Mycobacterium
PNIGG

SEQ ID NO: 1019852 - protein, 19 aa, Mycobacterium
PNKGQNDERPLQGDGYSRL

SEQ ID NO: 1019853 - protein, 7 aa, Mycobacterium
PNKPGLV

SEQ ID NO: 1019854 - protein, 76 aa, Mycobacterium; identical to SEQ ID NO: 542859

SEQ ID NO: 1019855 - protein, 23 aa, Mycobacterium
PNKQRGSGPSSAPPSFGAGGSAV

SEQ ID NO: 1019856 - protein, 12 aa, Mycobacterium
PNLDAGQERAVE

SEQ ID NO: 1019857 - protein, 5 aa, Mycobacterium
PNLDP

SEQ ID NO: 1019858 - protein, 6 aa, Mycobacterium
PNLKPG

SEQ ID NO: 1019859 - protein, 4 aa, Mycobacterium
PNLN

SEQ ID NO: 1019860 - protein, 6 aa, Mycobacterium
PNLPPG

SEQ ID NO: 1019861 - protein, 11 aa, Mycobacterium
PNLSRHRPTGI

SEQ ID NO: 1019862 - protein, 8 aa, Mycobacterium
PNLTPGQR

SEQ ID NO: 1019863 - protein, 7 aa, Mycobacterium
PNNPTGA

SEQ ID NO: 1019864 - protein, 9 aa, Mycobacterium
PNNPTSTVV

SEQ ID NO: 1019865 - protein, 4 aa, Mycobacterium
PNPA

SEQ ID NO: 1019866 - protein, 9 aa, Mycobacterium
PNPAQRAAD

SEQ ID NO: 1019867 - protein, 8 aa, Mycobacterium
PNPATGAT

SEQ ID NO: 1019868 - protein, 11 aa, Mycobacterium
PNPDAAASWQE

SEQ ID NO: 1019869 - protein, 6 aa, Mycobacterium
PNPIPA

SEQ ID NO: 1019870 - protein, 15 aa, Mycobacterium
PNPPAGGFSPGGHNG

SEQ ID NO: 1019871 - protein, 13 aa, Mycobacterium
PNPQAQAPLGPGQ

SEQ ID NO: 1019872 - protein, 18 aa, Mycobacterium
PNPVGSLAPSDGSPVPED

SEQ ID NO: 1019873 - protein, 5 aa, Mycobacterium
PNPVV

SEQ ID NO: 1019874 - protein, 4 aa, Mycobacterium
PNQG

SEQ ID NO: 1019875 - protein, 7 aa, Mycobacterium
PNQPGAY

SEQ ID NO: 1019876 - protein, 5 aa, Mycobacterium
PNQPN

SEQ ID NO: 1019877 - protein, 4 aa, Mycobacterium
PNQR

SEQ ID NO: 1019878 - protein, 15 aa, Mycobacterium
PNRDRDLSPAPELGA

SEQ ID NO: 1019879 - protein, 8 aa, Mycobacterium
PNRGKRSV

SEQ ID NO: 1019880 - protein, 13 aa, Mycobacterium
PNRPQQDAEKARE

SEQ ID NO: 1019881 - protein, 10 aa, Mycobacterium
PNSAVDADGA

SEQ ID NO: 1019882 - protein, 10 aa, Mycobacterium
PNSIETSAEA

SEQ ID NO: 1019883 - protein, 4 aa, Mycobacterium
PNSP

SEQ ID NO: 1019884 - protein, 5 aa, Mycobacterium
PNSPL

SEQ ID NO: 1019885 - protein, 6 aa, Mycobacterium
PNSPSV

SEQ ID NO: 1019886 - protein, 5 aa, Mycobacterium
PNTDQ

SEQ ID NO: 1019887 - protein, 5 aa, Mycobacterium
PNTGA

SEQ ID NO: 1019888 - protein, 8 aa, Mycobacterium
PNTNQGGN

SEQ ID NO: 1019889 - protein, 6 aa, Mycobacterium
PNTPTL

SEQ ID NO: 1019890 - protein, 5 aa, Mycobacterium
PNTPV

SEQ ID NO: 1019891 - protein, 7 aa, Mycobacterium
PNTSSNI

SEQ ID NO: 1019892 - protein, 6 aa, Mycobacterium
PNVGKS

SEQ ID NO: 1019893 - protein, 8 aa, Mycobacterium
PNVPTEGV

SEQ ID NO: 1019894 - protein, 17 aa, Mycobacterium
PNVTGKPVGSDLARRKK

SEQ ID NO: 1019895 - protein, 5 aa, Mycobacterium
PNYGG

SEQ ID NO: 1019896 - protein, 19 aa, Mycobacterium
PNYPDDHAKPLPDGIEAQT

SEQ ID NO: 1019897 - protein, 14 aa, Mycobacterium
PNYPPMGKRTLQDN

SEQ ID NO: 1019898 - protein, 8 aa, Mycobacterium
PPAADPVS

SEQ ID NO: 1019899 - protein, 9 aa, Mycobacterium
PPAARQPAV

SEQ ID NO: 1019900 - protein, 4 aa, Mycobacterium
PPAD

SEQ ID NO: 1019901 - protein, 5 aa, Mycobacterium
PPAEH

SEQ ID NO: 1019902 - protein, 10 aa, Mycobacterium
PPAEPSSAPR

SEQ ID NO: 1019903 - protein, 8 aa, Mycobacterium
PPAEYDPV

SEQ ID NO: 1019904 - protein, 7 aa, Mycobacterium
PPAGARA

SEQ ID NO: 1019905 - protein, 6 aa, Mycobacterium
PPAGDI

SEQ ID NO: 1019906 - protein, 7 aa, Mycobacterium
PPAGGEE

SEQ ID NO: 1019907 - protein, 7 aa, Mycobacterium
PPAGPAL

SEQ ID NO: 1019908 - protein, 16 aa, Mycobacterium
PPAGPNCSAAEMVALL

SEQ ID NO: 1019909 - protein, 8 aa, Mycobacterium
PPAGSVAG

SEQ ID NO: 1019910 - protein, 5 aa, Mycobacterium
PPAIG

SEQ ID NO: 1019911 - protein, 14 aa, Mycobacterium
PPALPAPTTPVPPV

SEQ ID NO: 1019912 - protein, 4 aa, Mycobacterium
PPAP

SEQ ID NO: 1019913 - protein, 7 aa, Mycobacterium
PPAPLRT

SEQ ID NO: 1019914 - protein, 8 aa, Mycobacterium
PPAPPIPP

SEQ ID NO: 1019915 - protein, 9 aa, Mycobacterium
PPAPPLPPW

SEQ ID NO: 1019916 - protein, 16 aa, Mycobacterium
PPAPPSMTADPDLRAA

SEQ ID NO: 1019917 - protein, 24 aa, Mycobacterium
PPAPTEPASIPEPPAPQQETGTPS

SEQ ID NO: 1019918 - protein, 9 aa, Mycobacterium
PPARPRPAT

SEQ ID NO: 1019919 - protein, 14 aa, Mycobacterium
PPATPNNVVDSTNG

SEQ ID NO: 1019920 - protein, 4 aa, Mycobacterium
PPAV

SEQ ID NO: 1019921 - protein, 6 aa, Mycobacterium
PPCPPL

SEQ ID NO: 1019922 - protein, 5 aa, Mycobacterium
PPCRT

SEQ ID NO: 1019923 - protein, 9 aa, Mycobacterium
PPDAAGPGF

SEQ ID NO: 1019924 - protein, 5 aa, Mycobacterium
PPDAE

SEQ ID NO: 1019925 - protein, 6 aa, Mycobacterium
PPDAEA

SEQ ID NO: 1019926 - protein, 8 aa, Mycobacterium
PPDAKDRV

SEQ ID NO: 1019927 - protein, 5 aa, Mycobacterium
PPDAP

SEQ ID NO: 1019928 - protein, 12 aa, Mycobacterium
PPDAPHNKPTDV

SEQ ID NO: 1019929 - protein, 11 aa, Mycobacterium
PPDAPTPAQTH

SEQ ID NO: 1019930 - protein, 11 aa, Mycobacterium
PPDATERRADL

SEQ ID NO: 1019931 - protein, 8 aa, Mycobacterium
PPDDPRVR

SEQ ID NO: 1019932 - protein, 6 aa, Mycobacterium
PPDGNT

SEQ ID NO: 1019933 - protein, 21 aa, Mycobacterium
PPDGPPRTGRFGPAPVGPATG

SEQ ID NO: 1019934 - protein, 11 aa, Mycobacterium
PPDHPARSEQD

SEQ ID NO: 1019935 - protein, 8 aa, Mycobacterium
PPDHTRYR

SEQ ID NO: 1019936 - protein, 4 aa, Mycobacterium
PPDI

SEQ ID NO: 1019937 - protein, 13 aa, Mycobacterium
PPDLESAYHEFMA

SEQ ID NO: 1019938 - protein, 10 aa, Mycobacterium
PPDLRGDDDA

SEQ ID NO: 1019939 - protein, 13 aa, Mycobacterium
PPDNRPGQPPVGP

SEQ ID NO: 1019940 - protein, 7 aa, Mycobacterium
PPDPRVP

SEQ ID NO: 1019941 - protein, 4 aa, Mycobacterium
PPDR

SEQ ID NO: 1019942 - protein, 9 aa, Mycobacterium
PPDRRSVRD

SEQ ID NO: 1019943 - protein, 7 aa, Mycobacterium
PPDRTDE

SEQ ID NO: 1019944 - protein, 8 aa, Mycobacterium
PPDSEAEQ

SEQ ID NO: 1019945 - protein, 7 aa, Mycobacterium
PPDTPPT

SEQ ID NO: 1019946 - protein, 10 aa, Mycobacterium
PPEARPPQEE

SEQ ID NO: 1019947 - protein, 11 aa, Mycobacterium
PPEAVPPPAPM

SEQ ID NO: 1019948 - protein, 6 aa, Mycobacterium
PPEDAD

SEQ ID NO: 1019949 - protein, 4 aa, Mycobacterium
PPEE

SEQ ID NO: 1019950 - protein, 12 aa, Mycobacterium
PPEEENKTVDDG

SEQ ID NO: 1019951 - protein, 5 aa, Mycobacterium
PPEEL

SEQ ID NO: 1019952 - protein, 16 aa, Mycobacterium
PPEGFGAPKNRRGHAS

SEQ ID NO: 1019953 - protein, 8 aa, Mycobacterium
PPEGLTTT

SEQ ID NO: 1019954 - protein, 6 aa, Mycobacterium
PPEGMT

SEQ ID NO: 1019955 - protein, 7 aa, Mycobacterium
PPEGNGL

SEQ ID NO: 1019956 - protein, 33 aa, Mycobacterium; identical to SEQ ID NO: 543331

SEQ ID NO: 1019957 - protein, 7 aa, Mycobacterium
PPEHSRA

SEQ ID NO: 1019958 - protein, 4 aa, Mycobacterium
PPEQ

SEQ ID NO: 1019959 - protein, 9 aa, Mycobacterium
PPERESEQV

SEQ ID NO: 1019960 - protein, 5 aa, Mycobacterium
PPERT

SEQ ID NO: 1019961 - protein, 4 aa, Mycobacterium
PPET

SEQ ID NO: 1019962 - protein, 4 aa, Mycobacterium
PPEV

SEQ ID NO: 1019963 - protein, 6 aa, Mycobacterium
PPEVNS

SEQ ID NO: 1019964 - protein, 25 aa, Mycobacterium
PPEVPGCPPSTLATNPRAASPSVRG

SEQ ID NO: 1019965 - protein, 4 aa, Mycobacterium
PPFA

SEQ ID NO: 1019966 - protein, 10 aa, Mycobacterium
PPFERRKGES

SEQ ID NO: 1019967 - protein, 11 aa, Mycobacterium
PPFRPPSFNPV

SEQ ID NO: 1019968 - protein, 10 aa, Mycobacterium
PPFSGPEGPF

SEQ ID NO: 1019969 - protein, 4 aa, Mycobacterium
PPGA

SEQ ID NO: 1019970 - protein, 6 aa, Mycobacterium
PPGCGK

SEQ ID NO: 1019971 - protein, 4 aa, Mycobacterium
PPGD

SEQ ID NO: 1019972 - protein, 6 aa, Mycobacterium
PPGDFP

SEQ ID NO: 1019973 - protein, 6 aa, Mycobacterium
PPGDGP

SEQ ID NO: 1019974 - protein, 7 aa, Mycobacterium
PPGEDGA

SEQ ID NO: 1019975 - protein, 5 aa, Mycobacterium
PPGEI

SEQ ID NO: 1019976 - protein, 6 aa, Mycobacterium
PPGELG

SEQ ID NO: 1019977 - protein, 45 aa, Mycobacterium
PPGERRAPGTVGRSTPKSAALRADRAAVGTTAPAPPSEQLVNTSI

SEQ ID NO: 1019978 - protein, 10 aa, Mycobacterium
PPGESGQALD

SEQ ID NO: 1019979 - protein, 5 aa, Mycobacterium
PPGGH

SEQ ID NO: 1019980 - protein, 6 aa, Mycobacterium
PPGGTA

SEQ ID NO: 1019981 - protein, 4 aa, Mycobacterium
PPGH

SEQ ID NO: 1019982 - protein, 14 aa, Mycobacterium
PPGPDPVPAPADDW

SEQ ID NO: 1019983 - protein, 7 aa, Mycobacterium
PPGPPTG

SEQ ID NO: 1019984 - protein, 7 aa, Mycobacterium
PPGQPWN

SEQ ID NO: 1019985 - protein, 6 aa, Mycobacterium
PPGQTG

SEQ ID NO: 1019986 - protein, 7 aa, Mycobacterium
PPGRGYN

SEQ ID NO: 1019987 - protein, 4 aa, Mycobacterium
PPGS

SEQ ID NO: 1019988 - protein, 11 aa, Mycobacterium
PPGSALPPERE

SEQ ID NO: 1019989 - protein, 6 aa, Mycobacterium
PPGSPA

SEQ ID NO: 1019990 - protein, 4 aa, Mycobacterium
PPGT

SEQ ID NO: 1019991 - protein, 22 aa, Mycobacterium
PPGTAGTGGTGGTLIGENGHDG

SEQ ID NO: 1019992 - protein, 9 aa, Mycobacterium
PPGTGASLP

SEQ ID NO: 1019993 - protein, 6 aa, Mycobacterium
PPGTGD

SEQ ID NO: 1019994 - protein, 7 aa, Mycobacterium
PPGTQPA

SEQ ID NO: 1019995 - protein, 6 aa, Mycobacterium
PPGTVG

SEQ ID NO: 1019996 - protein, 5 aa, Mycobacterium
PPGVD

SEQ ID NO: 1019997 - protein, 8 aa, Mycobacterium
PPGVEDGQ

SEQ ID NO: 1019998 - protein, 12 aa, Mycobacterium
PPGVQTRGPRAL

SEQ ID NO: 1019999 - protein, 15 aa, Mycobacterium
PPGVRRPAGTPDGVP

SEQ ID NO: 1020000 - protein, 8 aa, Mycobacterium
PPGWAPCS

SEQ ID NO: 1020001 - protein, 4 aa, Mycobacterium
PPGY

SEQ ID NO: 1020002 - protein, 13 aa, Mycobacterium
PPHAPRAVDADTA

SEQ ID NO: 1020003 - protein, 14 aa, Mycobacterium
PPHGADPATGQPTT

SEQ ID NO: 1020004 - protein, 10 aa, Mycobacterium
PPHQRDEKGR

SEQ ID NO: 1020005 - protein, 8 aa, Mycobacterium
PPHTALRR

SEQ ID NO: 1020006 - protein, 6 aa, Mycobacterium
PPIGGS

SEQ ID NO: 1020007 - protein, 6 aa, Mycobacterium
PPIPDR

SEQ ID NO: 1020008 - protein, 14 aa, Mycobacterium
PPIPKTLLRCSAMT

SEQ ID NO: 1020009 - protein, 7 aa, Mycobacterium
PPIRTPE

SEQ ID NO: 1020010 - protein, 19 aa, Mycobacterium
PPISAGSGWRKRKQQKYED

SEQ ID NO: 1020011 - protein, 4 aa, Mycobacterium
PPKP

SEQ ID NO: 1020012 - protein, 5 aa, Mycobacterium
PPKPL

SEQ ID NO: 1020013 - protein, 8 aa, Mycobacterium
PPKTRAGI

SEQ ID NO: 1020014 - protein, 14 aa, Mycobacterium
PPLAPAGMRTSPVG

SEQ ID NO: 1020015 - protein, 9 aa, Mycobacterium
PPLGPEAAP

SEQ ID NO: 1020016 - protein, 17 aa, Mycobacterium
PPLNEEKTVRGNVEEGL

SEQ ID NO: 1020017 - protein, 23 aa, Mycobacterium
PPLPAGPAASQPVAAGSAETERR

SEQ ID NO: 1020018 - protein, 11 aa, Mycobacterium
PPLPGAQPAPL

SEQ ID NO: 1020019 - protein, 7 aa, Mycobacterium
PPLPNDH

SEQ ID NO: 1020020 - protein, 17 aa, Mycobacterium
PPLPPTPPTPPAPPTDL

SEQ ID NO: 1020021 - protein, 16 aa, Mycobacterium
PPLPTDPGDRNRTSPF

SEQ ID NO: 1020022 - protein, 4 aa, Mycobacterium
PPLR

SEQ ID NO: 1020023 - protein, 4 aa, Mycobacterium
PPLS

SEQ ID NO: 1020024 - protein, 19 aa, Mycobacterium
PPLSTGDAATDREATRAEG

SEQ ID NO: 1020025 - protein, 13 aa, Mycobacterium
PPMRRTGDLDEAY

SEQ ID NO: 1020026 - protein, 4 aa, Mycobacterium
PPMS

SEQ ID NO: 1020027 - protein, 12 aa, Mycobacterium
PPMSTDPDAPTY

SEQ ID NO: 1020028 - protein, 13 aa, Mycobacterium
PPNCGDADTVGGT

SEQ ID NO: 1020029 - protein, 7 aa, Mycobacterium
PPNHTRY

SEQ ID NO: 1020030 - protein, 12 aa, Mycobacterium
PPNLEGAAKEAL

SEQ ID NO: 1020031 - protein, 5 aa, Mycobacterium
PPNLP

SEQ ID NO: 1020032 - protein, 5 aa, Mycobacterium
PPNLV

SEQ ID NO: 1020033 - protein, 28 aa, Mycobacterium
PPNNATDAPRYPAPAPEGPIEENLTDED

SEQ ID NO: 1020034 - protein, 15 aa, Mycobacterium
PPNPASRTLYLTGEI

SEQ ID NO: 1020035 - protein, 13 aa, Mycobacterium
PPNPSRPSLSHPG

SEQ ID NO: 1020036 - protein, 11 aa, Mycobacterium
PPNSSRPNLSH

SEQ ID NO: 1020037 - protein, 5 aa, Mycobacterium
PPNVT

SEQ ID NO: 1020038 - protein, 6 aa, Mycobacterium
PPPADV

SEQ ID NO: 1020039 - protein, 37 aa, Mycobacterium
PPPAPVPRAPEAPAAMAPEPTVATADLGSPDTRHPPT

SEQ ID NO: 1020040 - protein, 10 aa, Mycobacterium
PPPATTNLPG

SEQ ID NO: 1020041 - protein, 9 aa, Mycobacterium
PPPEPDSTV

SEQ ID NO: 1020042 - protein, 8 aa, Mycobacterium
PPPEPGGY

SEQ ID NO: 1020043 - protein, 6 aa, Mycobacterium
PPPGGM

SEQ ID NO: 1020044 - protein, 8 aa, Mycobacterium
PPPGSGAD

SEQ ID NO: 1020045 - protein, 9 aa, Mycobacterium
PPPGTPPDR

SEQ ID NO: 1020046 - protein, 6 aa, Mycobacterium
PPPHGP

SEQ ID NO: 1020047 - protein, 7 aa, Mycobacterium
PPPPADI

SEQ ID NO: 1020048 - protein, 25 aa, Mycobacterium
PPPPAEITAGRPVTDTSSPTAARAR

SEQ ID NO: 1020049 - protein, 16 aa, Mycobacterium
PPPPAPAAPPPPDPLA

SEQ ID NO: 1020050 - protein, 11 aa, Mycobacterium
PPPQGDSEAPL

SEQ ID NO: 1020051 - protein, 14 aa, Mycobacterium
PPPQLDRGARTNDY

SEQ ID NO: 1020052 - protein, 9 aa, Mycobacterium
PPPSAEQEH

SEQ ID NO: 1020053 - protein, 41 aa, Mycobacterium
PPPSPPSPPSPNPPKSHSPPAPPEPPVPKSGPPLPPDPPER

SEQ ID NO: 1020054 - protein, 7 aa, Mycobacterium
PPPTPPC

SEQ ID NO: 1020055 - protein, 14 aa, Mycobacterium
PPPVAGEDVPVAGE

SEQ ID NO: 1020056 - protein, 25 aa, Mycobacterium
PPPWPAAPPAPAAPPTPPTPPAPPT

SEQ ID NO: 1020057 - protein, 11 aa, Mycobacterium
PPQPAGSADGA

SEQ ID NO: 1020058 - protein, 7 aa, Mycobacterium
PPQSRTD

SEQ ID NO: 1020059 - protein, 7 aa, Mycobacterium
PPQVEGV

SEQ ID NO: 1020060 - protein, 14 aa, Mycobacterium
PPQWPTRQADTNAC

SEQ ID NO: 1020061 - protein, 11 aa, Mycobacterium
PPRAGQPSAWP

SEQ ID NO: 1020062 - protein, 8 aa, Mycobacterium
PPRGPGRP

SEQ ID NO: 1020063 - protein, 4 aa, Mycobacterium
PPRH

SEQ ID NO: 1020064 - protein, 7 aa, Mycobacterium
PPRHPPA

SEQ ID NO: 1020065 - protein, 5 aa, Mycobacterium
PPRHT

SEQ ID NO: 1020066 - protein, 5 aa, Mycobacterium
PPRPF

SEQ ID NO: 1020067 - protein, 21 aa, Mycobacterium
PPRPGSPPSPPLPPTAPEPAA

SEQ ID NO: 1020068 - protein, 9 aa, Mycobacterium
PPRTGSTAL

SEQ ID NO: 1020069 - protein, 5 aa, Mycobacterium
PPRTV

SEQ ID NO: 1020070 - protein, 9 aa, Mycobacterium
PPSAAGTGP

SEQ ID NO: 1020071 - protein, 8 aa, Mycobacterium
PPSAEAAL

SEQ ID NO: 1020072 - protein, 11 aa, Mycobacterium
PPSAEPRATGH

SEQ ID NO: 1020073 - protein, 7 aa, Mycobacterium
PPSAPAE

SEQ ID NO: 1020074 - protein, 11 aa, Mycobacterium
PPSDADEAAKG

SEQ ID NO: 1020075 - protein, 9 aa, Mycobacterium
PPSPSNCSS

SEQ ID NO: 1020076 - protein, 7 aa, Mycobacterium
PPSQADV

SEQ ID NO: 1020077 - protein, 8 aa, Mycobacterium
PPSQDSVY

SEQ ID NO: 1020078 - protein, 4 aa, Mycobacterium
PPSW

SEQ ID NO: 1020079 - protein, 11 aa, Mycobacterium
PPSWAGTTEVT

SEQ ID NO: 1020080 - protein, 5 aa, Mycobacterium
PPSWN

SEQ ID NO: 1020081 - protein, 9 aa, Mycobacterium
PPSWTDPKV

SEQ ID NO: 1020082 - protein, 18 aa, Mycobacterium
PPSWTTAAPAPTAGGAAI

SEQ ID NO: 1020083 - protein, 15 aa, Mycobacterium
PPSYSRPKPVRQPHP

SEQ ID NO: 1020084 - protein, 5 aa, Mycobacterium
PPSYT

SEQ ID NO: 1020085 - protein, 6 aa, Mycobacterium
PPTDEQ

SEQ ID NO: 1020086 - protein, 6 aa, Mycobacterium
PPTDRR

SEQ ID NO: 1020087 - protein, 5 aa, Mycobacterium
PPTEI

SEQ ID NO: 1020088 - protein, 14 aa, Mycobacterium
PPTPADEVDTRKAA

SEQ ID NO: 1020089 - protein, 19 aa, Mycobacterium
PPTPTARKDYIGGAAETAT

SEQ ID NO: 1020090 - protein, 29 aa, Mycobacterium
PPTSTTVTEPAQTGAPTPTRPATTPVAPR

SEQ ID NO: 1020091 - protein, 5 aa, Mycobacterium
PPTTA

SEQ ID NO: 1020092 - protein, 4 aa, Mycobacterium
PPTW

SEQ ID NO: 1020093 - protein, 4 aa, Mycobacterium
PPVD

SEQ ID NO: 1020094 - protein, 9 aa, Mycobacterium
PPVDSNIRR

SEQ ID NO: 1020095 - protein, 66 aa, Mycobacterium
PPVGGPPAAPAPAPAGPPVPGGPAPAGPAPAPAGPAPAPGAPAPAGPAPTPTPSGPAPGEPVLTPV

SEQ ID NO: 1020096 - protein, 15 aa, Mycobacterium
PPVGPGADDLNDKKA

SEQ ID NO: 1020097 - protein, 20 aa, Mycobacterium
PPVPAGESSPSAASAPRTKV

SEQ ID NO: 1020098 - protein, 17 aa, Mycobacterium
PPVPPLPPSPPANPAEV

SEQ ID NO: 1020099 - protein, 28 aa, Mycobacterium
PPVPPSPPAPPSPPAPPPPLDAVGESRG

SEQ ID NO: 1020100 - protein, 4 aa, Mycobacterium
PPVT

SEQ ID NO: 1020101 - protein, 7 aa, Mycobacterium
PPVTHTP

SEQ ID NO: 1020102 - protein, 11 aa, Mycobacterium
PPWAGGAPQGR

SEQ ID NO: 1020103 - protein, 5 aa, Mycobacterium
PPWAS

SEQ ID NO: 1020104 - protein, 6 aa, Mycobacterium
PPWDPG

SEQ ID NO: 1020105 - protein, 13 aa, Mycobacterium
PPWQPAERDSAGS

SEQ ID NO: 1020106 - protein, 4 aa, Mycobacterium
PPYD

SEQ ID NO: 1020107 - protein, 5 aa, Mycobacterium
PPYIP

SEQ ID NO: 1020108 - protein, 5 aa, Mycobacterium
PPYPP

SEQ ID NO: 1020109 - protein, 8 aa, Mycobacterium
PQAATSPV

SEQ ID NO: 1020110 - protein, 4 aa, Mycobacterium
PQAC

SEQ ID NO: 1020111 - protein, 4 aa, Mycobacterium
PQAF

SEQ ID NO: 1020112 - protein, 4 aa, Mycobacterium
PQAG

SEQ ID NO: 1020113 - protein, 5 aa, Mycobacterium
PQAGE

SEQ ID NO: 1020114 - protein, 9 aa, Mycobacterium
PQAGTANSP

SEQ ID NO: 1020115 - protein, 11 aa, Mycobacterium
PQARGATVRPP

SEQ ID NO: 1020116 - protein, 10 aa, Mycobacterium
PQARPAQKAD

SEQ ID NO: 1020117 - protein, 11 aa, Mycobacterium
PQASLAPAKLS

SEQ ID NO: 1020118 - protein, 10 aa, Mycobacterium
PQDAATATAG

SEQ ID NO: 1020119 - protein, 5 aa, Mycobacterium
PQDGA

SEQ ID NO: 1020120 - protein, 7 aa, Mycobacterium
PQDPEAL

SEQ ID NO: 1020121 - protein, 9 aa, Mycobacterium
PQDPKEGDL

SEQ ID NO: 1020122 - protein, 7 aa, Mycobacterium
PQDPRPR

SEQ ID NO: 1020123 - protein, 8 aa, Mycobacterium
PQDTAPQI

SEQ ID NO: 1020124 - protein, 11 aa, Mycobacterium
PQDTPADTVRQ

SEQ ID NO: 1020125 - protein, 5 aa, Mycobacterium
PQEAE

SEQ ID NO: 1020126 - protein, 8 aa, Mycobacterium
PQEARGAL

SEQ ID NO: 1020127 - protein, 5 aa, Mycobacterium
PQEDF

SEQ ID NO: 1020128 - protein, 5 aa, Mycobacterium
PQEDR

SEQ ID NO: 1020129 - protein, 6 aa, Mycobacterium
PQEDRG

SEQ ID NO: 1020130 - protein, 12 aa, Mycobacterium
PQEQSQRPGHVP

SEQ ID NO: 1020131 - protein, 7 aa, Mycobacterium
PQETERT

SEQ ID NO: 1020132 - protein, 4 aa, Mycobacterium
PQEY

SEQ ID NO: 1020133 - protein, 14 aa, Mycobacterium
PQFDEPSINSGGQA

SEQ ID NO: 1020134 - protein, 15 aa, Mycobacterium
PQFEGQTKTKLGNTE

SEQ ID NO: 1020135 - protein, 9 aa, Mycobacterium
PQFQQATQD

SEQ ID NO: 1020136 - protein, 7 aa, Mycobacterium
PQGALSA

SEQ ID NO: 1020137 - protein, 10 aa, Mycobacterium
PQGDEEPTQL

SEQ ID NO: 1020138 - protein, 30 aa, Mycobacterium
PQGGAGGHGGDGATDGGAGGAGGFTEIDSS

SEQ ID NO: 1020139 - protein, 7 aa, Mycobacterium
PQGIDRA

SEQ ID NO: 1020140 - protein, 6 aa, Mycobacterium
PQGRQV

SEQ ID NO: 1020141 - protein, 6 aa, Mycobacterium
PQGRSV

SEQ ID NO: 1020142 - protein, 5 aa, Mycobacterium
PQGVP

SEQ ID NO: 1020143 - protein, 5 aa, Mycobacterium
PQGVS

SEQ ID NO: 1020144 - protein, 24 aa, Mycobacterium
PQHKSSKAGPTTEARIRTTGRNKI

SEQ ID NO: 1020145 - protein, 7 aa, Mycobacterium
PQHPSTH

SEQ ID NO: 1020146 - protein, 26 aa, Mycobacterium
PQHQPSGGVINEPTPVASGEVTADPH

SEQ ID NO: 1020147 - protein, 4 aa, Mycobacterium
PQHR

SEQ ID NO: 1020148 - protein, 5 aa, Mycobacterium
PQHSD

SEQ ID NO: 1020149 - protein, 4 aa, Mycobacterium
PQHT

SEQ ID NO: 1020150 - protein, 7 aa, Mycobacterium
PQIETGA

SEQ ID NO: 1020151 - protein, 9 aa, Mycobacterium
PQIGDDRKS

SEQ ID NO: 1020152 - protein, 14 aa, Mycobacterium
PQIPAPAAPPMGNP

SEQ ID NO: 1020153 - protein, 7 aa, Mycobacterium
PQKARHN

SEQ ID NO: 1020154 - protein, 4 aa, Mycobacterium
PQKL

SEQ ID NO: 1020155 - protein, 22 aa, Mycobacterium
PQKSNAATNGLQAAARRSGVPV

SEQ ID NO: 1020156 - protein, 13 aa, Mycobacterium
PQKSWESNEPADL

SEQ ID NO: 1020157 - protein, 12 aa, Mycobacterium
PQLDPDRTGSTA

SEQ ID NO: 1020158 - protein, 6 aa, Mycobacterium
PQLEAS

SEQ ID NO: 1020159 - protein, 8 aa, Mycobacterium
PQLGPTTN

SEQ ID NO: 1020160 - protein, 6 aa, Mycobacterium
PQLGQH

SEQ ID NO: 1020161 - protein, 8 aa, Mycobacterium
PQLGRQEP

SEQ ID NO: 1020162 - protein, 7 aa, Mycobacterium
PQLPGGL

SEQ ID NO: 1020163 - protein, 5 aa, Mycobacterium
PQLPR

SEQ ID NO: 1020164 - protein, 4 aa, Mycobacterium
PQLS

SEQ ID NO: 1020165 - protein, 7 aa, Mycobacterium
PQLSDED

SEQ ID NO: 1020166 - protein, 11 aa, Mycobacterium
PQLSTSDGRGP

SEQ ID NO: 1020167 - protein, 10 aa, Mycobacterium
PQLTGGPLRS

SEQ ID NO: 1020168 - protein, 9 aa, Mycobacterium
PQMPAPPPP

SEQ ID NO: 1020169 - protein, 4 aa, Mycobacterium
PQPD

SEQ ID NO: 1020170 - protein, 17 aa, Mycobacterium
PQPDATDPDSGQGSGVV

SEQ ID NO: 1020171 - protein, 10 aa, Mycobacterium
PQPDFDDRTP

SEQ ID NO: 1020172 - protein, 12 aa, Mycobacterium
PQPEHFADPDKG

SEQ ID NO: 1020173 - protein, 10 aa, Mycobacterium
PQPGPTTSEI

SEQ ID NO: 1020174 - protein, 19 aa, Mycobacterium
PQPHVPAEQPAHHEPPSPS

SEQ ID NO: 1020175 - protein, 6 aa, Mycobacterium
PQPKRA

SEQ ID NO: 1020176 - protein, 10 aa, Mycobacterium
PQPRPPRETW

SEQ ID NO: 1020177 - protein, 6 aa, Mycobacterium
PQPSGI

SEQ ID NO: 1020178 - protein, 6 aa, Mycobacterium
PQPTPL

SEQ ID NO: 1020179 - protein, 7 aa, Mycobacterium
PQQDPYR

SEQ ID NO: 1020180 - protein, 109 aa, Mycobacterium
PQQGAPHPHQDIEEEPKPAAAETPAAPPKSPRPPMPVNGPAPTRPEPPLPPGPPRRRAQPPTAPPNQPGQPKPISGHPPPPPRPAAFTPPARGATPNRHESAEPPPPRR

SEQ ID NO: 1020181 - protein, 17 aa, Mycobacterium
PQQLPQVSEGKHPEPVD

SEQ ID NO: 1020182 - protein, 6 aa, Mycobacterium
PQQNWG

SEQ ID NO: 1020183 - protein, 35 aa, Mycobacterium; identical to SEQ ID NO: 544556

SEQ ID NO: 1020184 - protein, 7 aa, Mycobacterium
PQQVPAG

SEQ ID NO: 1020185 - protein, 11 aa, Mycobacterium
PQRADADAANR

SEQ ID NO: 1020186 - protein, 7 aa, Mycobacterium
PQRATPG

SEQ ID NO: 1020187 - protein, 5 aa, Mycobacterium
PQRGR

SEQ ID NO: 1020188 - protein, 8 aa, Mycobacterium
PQRPDGSG

SEQ ID NO: 1020189 - protein, 11 aa, Mycobacterium
PQRPRESQSFS

SEQ ID NO: 1020190 - protein, 4 aa, Mycobacterium
PQRR

SEQ ID NO: 1020191 - protein, 4 aa, Mycobacterium
PQRS

SEQ ID NO: 1020192 - protein, 4 aa, Mycobacterium
PQRV

SEQ ID NO: 1020193 - protein, 16 aa, Mycobacterium
PQRYAATQTRRTPEHT

SEQ ID NO: 1020194 - protein, 4 aa, Mycobacterium
PQSA

SEQ ID NO: 1020195 - protein, 8 aa, Mycobacterium
PQSAIDNG

SEQ ID NO: 1020196 - protein, 7 aa, Mycobacterium
PQSALSG

SEQ ID NO: 1020197 - protein, 8 aa, Mycobacterium
PQSDGGPG

SEQ ID NO: 1020198 - protein, 7 aa, Mycobacterium
PQSEGLA

SEQ ID NO: 1020199 - protein, 8 aa, Mycobacterium
PQSPAQPE

SEQ ID NO: 1020200 - protein, 15 aa, Mycobacterium
PQSPRQRGTNESTNG

SEQ ID NO: 1020201 - protein, 7 aa, Mycobacterium
PQSRGQI

SEQ ID NO: 1020202 - protein, 8 aa, Mycobacterium
PQSRRELA

SEQ ID NO: 1020203 - protein, 8 aa, Mycobacterium
PQSSGIRG

SEQ ID NO: 1020204 - protein, 4 aa, Mycobacterium
PQSV

SEQ ID NO: 1020205 - protein, 6 aa, Mycobacterium
PQTCAQ

SEQ ID NO: 1020206 - protein, 6 aa, Mycobacterium
PQTDPG

SEQ ID NO: 1020207 - protein, 16 aa, Mycobacterium
PQTGGQKRVTASGDAL

SEQ ID NO: 1020208 - protein, 7 aa, Mycobacterium
PQTPAGG

SEQ ID NO: 1020209 - protein, 6 aa, Mycobacterium
PQTSSV

SEQ ID NO: 1020210 - protein, 18 aa, Mycobacterium
PQVDQNARPPVQRRPRFD

SEQ ID NO: 1020211 - protein, 18 aa, Mycobacterium
PQVEDPKAYTQPALDLLV

SEQ ID NO: 1020212 - protein, 7 aa, Mycobacterium
PQVETDS

SEQ ID NO: 1020213 - protein, 7 aa, Mycobacterium
PQVFPDP

SEQ ID NO: 1020214 - protein, 12 aa, Mycobacterium
PQVNGTQRERLG

SEQ ID NO: 1020215 - protein, 4 aa, Mycobacterium
PQVP

SEQ ID NO: 1020216 - protein, 5 aa, Mycobacterium
PQYQP

SEQ ID NO: 1020217 - protein, 4 aa, Mycobacterium
PRAA

SEQ ID NO: 1020218 - protein, 6 aa, Mycobacterium
PRAAGL

SEQ ID NO: 1020219 - protein, 5 aa, Mycobacterium
PRADA

SEQ ID NO: 1020220 - protein, 5 aa, Mycobacterium
PRAED

SEQ ID NO: 1020221 - protein, 6 aa, Mycobacterium
PRAETK

SEQ ID NO: 1020222 - protein, 7 aa, Mycobacterium
PRAGAPV

SEQ ID NO: 1020223 - protein, 5 aa, Mycobacterium
PRAGQ

SEQ ID NO: 1020224 - protein, 9 aa, Mycobacterium
PRAHKASEA

SEQ ID NO: 1020225 - protein, 8 aa, Mycobacterium
PRAISGPV

SEQ ID NO: 1020226 - protein, 10 aa, Mycobacterium
PRALDNPKDH

SEQ ID NO: 1020227 - protein, 14 aa, Mycobacterium
PRALGPDADRSITG

SEQ ID NO: 1020228 - protein, 4 aa, Mycobacterium
PRAP

SEQ ID NO: 1020229 - protein, 8 aa, Mycobacterium
PRATAAKF

SEQ ID NO: 1020230 - protein, 4 aa, Mycobacterium
PRAV

SEQ ID NO: 1020231 - protein, 4 aa, Mycobacterium
PRCG

SEQ ID NO: 1020232 - protein, 12 aa, Mycobacterium
PRCSDSSSSKAV

SEQ ID NO: 1020233 - protein, 8 aa, Mycobacterium
PRDADNLT

SEQ ID NO: 1020234 - protein, 6 aa, Mycobacterium
PRDADP

SEQ ID NO: 1020235 - protein, 4 aa, Mycobacterium
PRDD

SEQ ID NO: 1020236 - protein, 4 aa, Mycobacterium
PRDG

SEQ ID NO: 1020237 - protein, 4 aa, Mycobacterium
PRDP

SEQ ID NO: 1020238 - protein, 7 aa, Mycobacterium
PRDPHDA

SEQ ID NO: 1020239 - protein, 6 aa, Mycobacterium
PRDPTV

SEQ ID NO: 1020240 - protein, 6 aa, Mycobacterium
PRDWDQ

SEQ ID NO: 1020241 - protein, 10 aa, Mycobacterium
PREATAMDPR

SEQ ID NO: 1020242 - protein, 12 aa, Mycobacterium
PREGEQPNQRQK

SEQ ID NO: 1020243 - protein, 13 aa, Mycobacterium
PREMPDYSNTARE

SEQ ID NO: 1020244 - protein, 4 aa, Mycobacterium
PREQ

SEQ ID NO: 1020245 - protein, 7 aa, Mycobacterium
PRERPTC

SEQ ID NO: 1020246 - protein, 4 aa, Mycobacterium
PRES

SEQ ID NO: 1020247 - protein, 7 aa, Mycobacterium
PRESPID

SEQ ID NO: 1020248 - protein, 7 aa, Mycobacterium
PREVPGS

SEQ ID NO: 1020249 - protein, 5 aa, Mycobacterium
PREYG

SEQ ID NO: 1020250 - protein, 4 aa, Mycobacterium
PRFD

SEQ ID NO: 1020251 - protein, 5 aa, Mycobacterium
PRFDQ

SEQ ID NO: 1020252 - protein, 26 aa, Mycobacterium
PRGARVPAPNQRRPYRPPARPSGETL

SEQ ID NO: 1020253 - protein, 11 aa, Mycobacterium
PRGCGKTSSAR

SEQ ID NO: 1020254 - protein, 9 aa, Mycobacterium
PRGDGPFGQ

SEQ ID NO: 1020255 - protein, 12 aa, Mycobacterium
PRGDTGYGHGAQ

SEQ ID NO: 1020256 - protein, 15 aa, Mycobacterium
PRGEGDPSARRRQDL

SEQ ID NO: 1020257 - protein, 6 aa, Mycobacterium
PRGFGE

SEQ ID NO: 1020258 - protein, 5 aa, Mycobacterium
PRGGA

SEQ ID NO: 1020259 - protein, 7 aa, Mycobacterium
PRGGGAS

SEQ ID NO: 1020260 - protein, 7 aa, Mycobacterium
PRGGPVD

SEQ ID NO: 1020261 - protein, 5 aa, Mycobacterium
PRGMH

SEQ ID NO: 1020262 - protein, 8 aa, Mycobacterium
PRGPQGQV

SEQ ID NO: 1020263 - protein, 7 aa, Mycobacterium
PRGSAAS

SEQ ID NO: 1020264 - protein, 6 aa, Mycobacterium
PRGSQL

SEQ ID NO: 1020265 - protein, 9 aa, Mycobacterium
PRGTPAAEI

SEQ ID NO: 1020266 - protein, 13 aa, Mycobacterium
PRGWRADNTDIDG

SEQ ID NO: 1020267 - protein, 4 aa, Mycobacterium
PRHN

SEQ ID NO: 1020268 - protein, 4 aa, Mycobacterium
PRHQ

SEQ ID NO: 1020269 - protein, 6 aa, Mycobacterium
PRHSPG

SEQ ID NO: 1020270 - protein, 22 aa, Mycobacterium
PRITRAEAAADLGVSAKQLDQD

SEQ ID NO: 1020271 - protein, 4 aa, Mycobacterium
PRKA

SEQ ID NO: 1020272 - protein, 7 aa, Mycobacterium
PRKGQDT

SEQ ID NO: 1020273 - protein, 4 aa, Mycobacterium
PRKI

SEQ ID NO: 1020274 - protein, 13 aa, Mycobacterium
PRKPSRSERRDKS

SEQ ID NO: 1020275 - protein, 11 aa, Mycobacterium
PRLDPDTRAQR

SEQ ID NO: 1020276 - protein, 11 aa, Mycobacterium
PRLGDGGRGYR

SEQ ID NO: 1020277 - protein, 7 aa, Mycobacterium
PRLNTQQ

SEQ ID NO: 1020278 - protein, 4 aa, Mycobacterium
PRLQ

SEQ ID NO: 1020279 - protein, 5 aa, Mycobacterium
PRLRP

SEQ ID NO: 1020280 - protein, 5 aa, Mycobacterium
PRMTS

SEQ ID NO: 1020281 - protein, 16 aa, Mycobacterium
PRNAGGKVVKPQLREL

SEQ ID NO: 1020282 - protein, 4 aa, Mycobacterium
PRNR

SEQ ID NO: 1020283 - protein, 13 aa, Mycobacterium
PRPAAEHGQEIPM

SEQ ID NO: 1020284 - protein, 18 aa, Mycobacterium
PRPAGSPVSPDAQAAAAA

SEQ ID NO: 1020285 - protein, 7 aa, Mycobacterium
PRPAQAR

SEQ ID NO: 1020286 - protein, 30 aa, Mycobacterium
PRPARGCSTRPVPPTGSAPMPRSYPTNGSA

SEQ ID NO: 1020287 - protein, 13 aa, Mycobacterium
PRPATSGWKPPMA

SEQ ID NO: 1020288 - protein, 6 aa, Mycobacterium
PRPDWP

SEQ ID NO: 1020289 - protein, 7 aa, Mycobacterium
PRPEAEV

SEQ ID NO: 1020290 - protein, 7 aa, Mycobacterium
PRPHQAT

SEQ ID NO: 1020291 - protein, 10 aa, Mycobacterium
PRPKSKASIG

SEQ ID NO: 1020292 - protein, 4 aa, Mycobacterium
PRPL

SEQ ID NO: 1020293 - protein, 10 aa, Mycobacterium
PRPLASYTTR

SEQ ID NO: 1020294 - protein, 7 aa, Mycobacterium
PRPPRLE

SEQ ID NO: 1020295 - protein, 4 aa, Mycobacterium
PRPQ

SEQ ID NO: 1020296 - protein, 26 aa, Mycobacterium
PRPQLTAATGGALRAARGPGDSSATV

SEQ ID NO: 1020297 - protein, 17 aa, Mycobacterium
PRPQRPDLPGQARPIGR

SEQ ID NO: 1020298 - protein, 11 aa, Mycobacterium
PRPSRHRPDIP

SEQ ID NO: 1020299 - protein, 8 aa, Mycobacterium
PRPSSDSY

SEQ ID NO: 1020300 - protein, 5 aa, Mycobacterium
PRPTL

SEQ ID NO: 1020301 - protein, 4 aa, Mycobacterium
PRPV

SEQ ID NO: 1020302 - protein, 7 aa, Mycobacterium
PRPVEES

SEQ ID NO: 1020303 - protein, 5 aa, Mycobacterium
PRPVV

SEQ ID NO: 1020304 - protein, 4 aa, Mycobacterium
PRPW

SEQ ID NO: 1020305 - protein, 5 aa, Mycobacterium
PRQDA

SEQ ID NO: 1020306 - protein, 7 aa, Mycobacterium
PRQGEVE

SEQ ID NO: 1020307 - protein, 11 aa, Mycobacterium
PRQPGESPQEF

SEQ ID NO: 1020308 - protein, 4 aa, Mycobacterium
PRQV

SEQ ID NO: 1020309 - protein, 5 aa, Mycobacterium
PRQVP

SEQ ID NO: 1020310 - protein, 7 aa, Mycobacterium
PRRAGSD

SEQ ID NO: 1020311 - protein, 9 aa, Mycobacterium
PRRASSPFG

SEQ ID NO: 1020312 - protein, 8 aa, Mycobacterium
PRRDGGER

SEQ ID NO: 1020313 - protein, 11 aa, Mycobacterium
PRRFDPQSCEQ

SEQ ID NO: 1020314 - protein, 4 aa, Mycobacterium
PRRG

SEQ ID NO: 1020315 - protein, 22 aa, Mycobacterium
PRRGDKRALAETVQRNAKEALQ

SEQ ID NO: 1020316 - protein, 8 aa, Mycobacterium
PRRGIGDR

SEQ ID NO: 1020317 - protein, 9 aa, Mycobacterium
PRRGKPPRH

SEQ ID NO: 1020318 - protein, 11 aa, Mycobacterium
PRRHTQDGSPL

SEQ ID NO: 1020319 - protein, 4 aa, Mycobacterium
PRRK

SEQ ID NO: 1020320 - protein, 7 aa, Mycobacterium
PRRLDDE

SEQ ID NO: 1020321 - protein, 4 aa, Mycobacterium
PRRP

SEQ ID NO: 1020322 - protein, 8 aa, Mycobacterium
PRRPAYTG

SEQ ID NO: 1020323 - protein, 4 aa, Mycobacterium
PRRR

SEQ ID NO: 1020324 - protein, 10 aa, Mycobacterium
PRRRAPRPVP

SEQ ID NO: 1020325 - protein, 13 aa, Mycobacterium
PRRRSNPGHRSSP

SEQ ID NO: 1020326 - protein, 10 aa, Mycobacterium
PRRTAPDGSN

SEQ ID NO: 1020327 - protein, 13 aa, Mycobacterium
PRRTSGGGRRYSE

SEQ ID NO: 1020328 - protein, 4 aa, Mycobacterium
PRSA

SEQ ID NO: 1020329 - protein, 16 aa, Mycobacterium
PRSAEGRHFISLVLQS

SEQ ID NO: 1020330 - protein, 7 aa, Mycobacterium
PRSFTTA

SEQ ID NO: 1020331 - protein, 11 aa, Mycobacterium
PRSGDADEQSL

SEQ ID NO: 1020332 - protein, 11 aa, Mycobacterium
PRSGGRGRRQR

SEQ ID NO: 1020333 - protein, 6 aa, Mycobacterium
PRSLGY

SEQ ID NO: 1020334 - protein, 17 aa, Mycobacterium
PRSPGSGLSVQPQRGTD

SEQ ID NO: 1020335 - protein, 15 aa, Mycobacterium
PRSPTGAAADQSPAA

SEQ ID NO: 1020336 - protein, 8 aa, Mycobacterium
PRSSPTIA

SEQ ID NO: 1020337 - protein, 21 aa, Mycobacterium
PRSTSEAFPGLARTAGLIRML

SEQ ID NO: 1020338 - protein, 27 aa, Mycobacterium
PRSTSGSGRARGRSSTPRWSTGSACWL

SEQ ID NO: 1020339 - protein, 25 aa, Mycobacterium
PRSTTSGCSTDTNRAKSPLRQAAQE

SEQ ID NO: 1020340 - protein, 4 aa, Mycobacterium
PRSV

SEQ ID NO: 1020341 - protein, 6 aa, Mycobacterium
PRSVEQ

SEQ ID NO: 1020342 - protein, 12 aa, Mycobacterium
PRSVRGEQRASG

SEQ ID NO: 1020343 - protein, 16 aa, Mycobacterium
PRTAADVPAKFKSEPW

SEQ ID NO: 1020344 - protein, 18 aa, Mycobacterium
PRTAATKVNRSAMIAARG

SEQ ID NO: 1020345 - protein, 11 aa, Mycobacterium
PRTASGKPDLG

SEQ ID NO: 1020346 - protein, 31 aa, Mycobacterium
PRTCTGPDVGELDQPTTASGSAFSDQPRAPI

SEQ ID NO: 1020347 - protein, 11 aa, Mycobacterium
PRTDPDGPAMT

SEQ ID NO: 1020348 - protein, 4 aa, Mycobacterium
PRTE

SEQ ID NO: 1020349 - protein, 9 aa, Mycobacterium
PRTEAAGAA

SEQ ID NO: 1020350 - protein, 16 aa, Mycobacterium
PRTESAPTNVPDDLDP

SEQ ID NO: 1020351 - protein, 7 aa, Mycobacterium
PRTGRTH

SEQ ID NO: 1020352 - protein, 6 aa, Mycobacterium
PRTGTT

SEQ ID NO: 1020353 - protein, 4 aa, Mycobacterium
PRTK

SEQ ID NO: 1020354 - protein, 18 aa, Mycobacterium
PRTNQRTDSWGGTPAKRR

SEQ ID NO: 1020355 - protein, 4 aa, Mycobacterium
PRTP

SEQ ID NO: 1020356 - protein, 18 aa, Mycobacterium
PRTPAGKVDTSALPPVPA

SEQ ID NO: 1020357 - protein, 11 aa, Mycobacterium
PRTPDQDDPPY

SEQ ID NO: 1020358 - protein, 28 aa, Mycobacterium
PRTPQPTAKSCPRGSPNRLGNPLLTSTN

SEQ ID NO: 1020359 - protein, 7 aa, Mycobacterium
PRTPSGK

SEQ ID NO: 1020360 - protein, 17 aa, Mycobacterium
PRTRSAAPLPRSGDTVA

SEQ ID NO: 1020361 - protein, 7 aa, Mycobacterium
PRTSTGK

SEQ ID NO: 1020362 - protein, 6 aa, Mycobacterium
PRTTHT

SEQ ID NO: 1020363 - protein, 9 aa, Mycobacterium
PRTTTSTAS

SEQ ID NO: 1020364 - protein, 9 aa, Mycobacterium
PRVPPSRAG

SEQ ID NO: 1020365 - protein, 10 aa, Mycobacterium
PRVPSAEEMA

SEQ ID NO: 1020366 - protein, 10 aa, Mycobacterium
PRVVETDDGG

SEQ ID NO: 1020367 - protein, 5 aa, Mycobacterium
PRWEG

SEQ ID NO: 1020368 - protein, 10 aa, Mycobacterium
PRWEPGSAQG

SEQ ID NO: 1020369 - protein, 11 aa, Mycobacterium
PRWPRTTPTTW

SEQ ID NO: 1020370 - protein, 9 aa, Mycobacterium
PRWQGKPGR

SEQ ID NO: 1020371 - protein, 4 aa, Mycobacterium
PRWR

SEQ ID NO: 1020372 - protein, 5 aa, Mycobacterium
PRYEW

SEQ ID NO: 1020373 - protein, 12 aa, Mycobacterium
PRYGDARGRATN

SEQ ID NO: 1020374 - protein, 33 aa, Mycobacterium
PSAARALPKQRGPPASRPAVPHRSPRVARAQAQ

SEQ ID NO: 1020375 - protein, 4 aa, Mycobacterium
PSAF

SEQ ID NO: 1020376 - protein, 12 aa, Mycobacterium
PSAGGGGGATVD

SEQ ID NO: 1020377 - protein, 7 aa, Mycobacterium
PSAGKSS

SEQ ID NO: 1020378 - protein, 4 aa, Mycobacterium
PSAH

SEQ ID NO: 1020379 - protein, 7 aa, Mycobacterium
PSAHERK

SEQ ID NO: 1020380 - protein, 9 aa, Mycobacterium
PSAIPADGS

SEQ ID NO: 1020381 - protein, 6 aa, Mycobacterium
PSALGR

SEQ ID NO: 1020382 - protein, 7 aa, Mycobacterium
PSANPYL

SEQ ID NO: 1020383 - protein, 18 aa, Mycobacterium
PSANSEQLATEQQGSGES

SEQ ID NO: 1020384 - protein, 19 aa, Mycobacterium
PSAPAGRGLTAGQRRRRAI

SEQ ID NO: 1020385 - protein, 8 aa, Mycobacterium
PSAPETTQ

SEQ ID NO: 1020386 - protein, 13 aa, Mycobacterium
PSAPGHDAISEDH

SEQ ID NO: 1020387 - protein, 8 aa, Mycobacterium
PSAPPLPD

SEQ ID NO: 1020388 - protein, 44 aa, Mycobacterium
PSAPVPPFPPTPPSPTRPPSPPAPPFPATDPPSPPAPPAAPAPP

SEQ ID NO: 1020389 - protein, 18 aa, Mycobacterium
PSAQQAPARGTLSTHDPR

SEQ ID NO: 1020390 - protein, 8 aa, Mycobacterium
PSARQKNK

SEQ ID NO: 1020391 - protein, 4 aa, Mycobacterium
PSAS

SEQ ID NO: 1020392 - protein, 17 aa, Mycobacterium
PSASFDDAGPGAGPLPE

SEQ ID NO: 1020393 - protein, 11 aa, Mycobacterium
PSASKAAETAV

SEQ ID NO: 1020394 - protein, 7 aa, Mycobacterium
PSASQTD

SEQ ID NO: 1020395 - protein, 9 aa, Mycobacterium
PSATGSAQQ

SEQ ID NO: 1020396 - protein, 8 aa, Mycobacterium
PSAYQQAA

SEQ ID NO: 1020397 - protein, 5 aa, Mycobacterium
PSCGD

SEQ ID NO: 1020398 - protein, 5 aa, Mycobacterium
PSCPQ

SEQ ID NO: 1020399 - protein, 19 aa, Mycobacterium
PSCSPTRPPMVSTSPTSPP

SEQ ID NO: 1020400 - protein, 5 aa, Mycobacterium
PSDEQ

SEQ ID NO: 1020401 - protein, 7 aa, Mycobacterium
PSDERGA

SEQ ID NO: 1020402 - protein, 4 aa, Mycobacterium
PSDL

SEQ ID NO: 1020403 - protein, 10 aa, Mycobacterium
PSDNAPPGYV

SEQ ID NO: 1020404 - protein, 23 aa, Mycobacterium
PSDPGECTDPIATAERVALMLFE

SEQ ID NO: 1020405 - protein, 9 aa, Mycobacterium
PSDPHDAER

SEQ ID NO: 1020406 - protein, 8 aa, Mycobacterium
PSDPKVPY

SEQ ID NO: 1020407 - protein, 7 aa, Mycobacterium
PSDQPRA

SEQ ID NO: 1020408 - protein, 19 aa, Mycobacterium
PSDQSRYLKPGSTGPLQTA

SEQ ID NO: 1020409 - protein, 4 aa, Mycobacterium
PSEA

SEQ ID NO: 1020410 - protein, 15 aa, Mycobacterium
PSEEELAEAGLPAAA

SEQ ID NO: 1020411 - protein, 12 aa, Mycobacterium
PSEKGNVCSEGK

SEQ ID NO: 1020412 - protein, 7 aa, Mycobacterium
PSELGSP

SEQ ID NO: 1020413 - protein, 4 aa, Mycobacterium
PSEN

SEQ ID NO: 1020414 - protein, 8 aa, Mycobacterium
PSERDPSV

SEQ ID NO: 1020415 - protein, 6 aa, Mycobacterium
PSERKD

SEQ ID NO: 1020416 - protein, 10 aa, Mycobacterium
PSESRDEARI

SEQ ID NO: 1020417 - protein, 7 aa, Mycobacterium
PSETMPS

SEQ ID NO: 1020418 - protein, 5 aa, Mycobacterium
PSETV

SEQ ID NO: 1020419 - protein, 7 aa, Mycobacterium
PSEYGAD

SEQ ID NO: 1020420 - protein, 8 aa, Mycobacterium
PSFPGRDS

SEQ ID NO: 1020421 - protein, 14 aa, Mycobacterium
PSGACTSSGHPEQS

SEQ ID NO: 1020422 - protein, 10 aa, Mycobacterium
PSGAGKSTTQ

SEQ ID NO: 1020423 - protein, 8 aa, Mycobacterium
PSGASAVE

SEQ ID NO: 1020424 - protein, 10 aa, Mycobacterium
PSGATTKAEG

SEQ ID NO: 1020425 - protein, 6 aa, Mycobacterium
PSGDRS

SEQ ID NO: 1020426 - protein, 13 aa, Mycobacterium
PSGELKTKPTQHS

SEQ ID NO: 1020427 - protein, 7 aa, Mycobacterium
PSGETPD

SEQ ID NO: 1020428 - protein, 4 aa, Mycobacterium
PSGI

SEQ ID NO: 1020429 - protein, 10 aa, Mycobacterium
PSGPGNGEAR

SEQ ID NO: 1020430 - protein, 14 aa, Mycobacterium
PSGRPESGYAPSAG

SEQ ID NO: 1020431 - protein, 7 aa, Mycobacterium
PSGRTAD

SEQ ID NO: 1020432 - protein, 11 aa, Mycobacterium
PSGSGPTPIQE

SEQ ID NO: 1020433 - protein, 12 aa, Mycobacterium
PSGSGSNPRASA

SEQ ID NO: 1020434 - protein, 7 aa, Mycobacterium
PSGTEPK

SEQ ID NO: 1020435 - protein, 10 aa, Mycobacterium
PSGTRNMNDY

SEQ ID NO: 1020436 - protein, 4 aa, Mycobacterium
PSGV

SEQ ID NO: 1020437 - protein, 10 aa, Mycobacterium
PSGVGKTELS

SEQ ID NO: 1020438 - protein, 5 aa, Mycobacterium
PSGWD

SEQ ID NO: 1020439 - protein, 14 aa, Mycobacterium
PSGYPRKKGQTMPT

SEQ ID NO: 1020440 - protein, 25 aa, Mycobacterium
PSHLDPPHVPAPPTADEDLRTKPAA

SEQ ID NO: 1020441 - protein, 11 aa, Mycobacterium
PSHNSPPDGGF

SEQ ID NO: 1020442 - protein, 6 aa, Mycobacterium
PSHPGH

SEQ ID NO: 1020443 - protein, 10 aa, Mycobacterium
PSHPTQGEGP

SEQ ID NO: 1020444 - protein, 4 aa, Mycobacterium
PSIE

SEQ ID NO: 1020445 - protein, 4 aa, Mycobacterium
PSIT

SEQ ID NO: 1020446 - protein, 5 aa, Mycobacterium
PSKAT

SEQ ID NO: 1020447 - protein, 12 aa, Mycobacterium
PSKDAARIEGSK

SEQ ID NO: 1020448 - protein, 8 aa, Mycobacterium
PSKVPSMA

SEQ ID NO: 1020449 - protein, 9 aa, Mycobacterium
PSKYTGPHD

SEQ ID NO: 1020450 - protein, 13 aa, Mycobacterium
PSLGGPPAPPQLP

SEQ ID NO: 1020451 - protein, 11 aa, Mycobacterium
PSLGVPSGDGL

SEQ ID NO: 1020452 - protein, 5 aa, Mycobacterium
PSLPD

SEQ ID NO: 1020453 - protein, 7 aa, Mycobacterium
PSLPEAS

SEQ ID NO: 1020454 - protein, 6 aa, Mycobacterium
PSLSAT

SEQ ID NO: 1020455 - protein, 5 aa, Mycobacterium
PSLTT

SEQ ID NO: 1020456 - protein, 7 aa, Mycobacterium
PSLTTPA

SEQ ID NO: 1020457 - protein, 5 aa, Mycobacterium
PSMPP

SEQ ID NO: 1020458 - protein, 6 aa, Mycobacterium
PSMQKS

SEQ ID NO: 1020459 - protein, 10 aa, Mycobacterium
PSNDLRRGDT

SEQ ID NO: 1020460 - protein, 16 aa, Mycobacterium
PSNKAARSASLNGEAA

SEQ ID NO: 1020461 - protein, 30 aa, Mycobacterium
PSNPGERESIDHRETRAATGRRLCLGRFHR

SEQ ID NO: 1020462 - protein, 5 aa, Mycobacterium
PSPAS

SEQ ID NO: 1020463 - protein, 6 aa, Mycobacterium
PSPDRI

SEQ ID NO: 1020464 - protein, 6 aa, Mycobacterium
PSPDYD

SEQ ID NO: 1020465 - protein, 47 aa, Mycobacterium
PSPELPPPPRSEATGSLRKPRRDDAQTRPNSRPKLGRTHCDRTQPQH

SEQ ID NO: 1020466 - protein, 6 aa, Mycobacterium
PSPGRP

SEQ ID NO: 1020467 - protein, 16 aa, Mycobacterium
PSPLDPQDAPQDRPLN

SEQ ID NO: 1020468 - protein, 10 aa, Mycobacterium
PSPLDPRVGE

SEQ ID NO: 1020469 - protein, 9 aa, Mycobacterium
PSPPLPYSH

SEQ ID NO: 1020470 - protein, 12 aa, Mycobacterium
PSPPSPPFPGSD

SEQ ID NO: 1020471 - protein, 4 aa, Mycobacterium
PSPQ

SEQ ID NO: 1020472 - protein, 15 aa, Mycobacterium
PSPQLEDTAGGSETM

SEQ ID NO: 1020473 - protein, 5 aa, Mycobacterium
PSPRH

SEQ ID NO: 1020474 - protein, 5 aa, Mycobacterium
PSPRN

SEQ ID NO: 1020475 - protein, 4 aa, Mycobacterium
PSPS

SEQ ID NO: 1020476 - protein, 6 aa, Mycobacterium
PSPSLG

SEQ ID NO: 1020477 - protein, 6 aa, Mycobacterium
PSPTAA

SEQ ID NO: 1020478 - protein, 9 aa, Mycobacterium
PSPTAAAED

SEQ ID NO: 1020479 - protein, 6 aa, Mycobacterium
PSPVGP

SEQ ID NO: 1020480 - protein, 5 aa, Mycobacterium
PSPVP

SEQ ID NO: 1020481 - protein, 6 aa, Mycobacterium
PSQGAP

SEQ ID NO: 1020482 - protein, 6 aa, Mycobacterium
PSRDRN

SEQ ID NO: 1020483 - protein, 8 aa, Mycobacterium
PSREDKSM

SEQ ID NO: 1020484 - protein, 6 aa, Mycobacterium
PSRNSM

SEQ ID NO: 1020485 - protein, 7 aa, Mycobacterium
PSRPKGK

SEQ ID NO: 1020486 - protein, 7 aa, Mycobacterium
PSRPNSA

SEQ ID NO: 1020487 - protein, 11 aa, Mycobacterium
PSRQPDWDGND

SEQ ID NO: 1020488 - protein, 5 aa, Mycobacterium
PSRQS

SEQ ID NO: 1020489 - protein, 9 aa, Mycobacterium
PSRQSLDRE

SEQ ID NO: 1020490 - protein, 6 aa, Mycobacterium
PSRRDV

SEQ ID NO: 1020491 - protein, 13 aa, Mycobacterium
PSRRRESTSPRSR

SEQ ID NO: 1020492 - protein, 9 aa, Mycobacterium
PSRVTPVGR

SEQ ID NO: 1020493 - protein, 19 aa, Mycobacterium
PSSFSQDPAEVYTSDFLAS

SEQ ID NO: 1020494 - protein, 15 aa, Mycobacterium
PSSGDTTTTPAPGGA

SEQ ID NO: 1020495 - protein, 8 aa, Mycobacterium
PSSGLDIE

SEQ ID NO: 1020496 - protein, 5 aa, Mycobacterium
PSSGR

SEQ ID NO: 1020497 - protein, 4 aa, Mycobacterium
PSSH

SEQ ID NO: 1020498 - protein, 7 aa, Mycobacterium
PSSHAPT

SEQ ID NO: 1020499 - protein, 4 aa, Mycobacterium
PSSL

SEQ ID NO: 1020500 - protein, 11 aa, Mycobacterium
PSSLPSARESA

SEQ ID NO: 1020501 - protein, 5 aa, Mycobacterium
PSSPE

SEQ ID NO: 1020502 - protein, 8 aa, Mycobacterium
PSSPFSGG

SEQ ID NO: 1020503 - protein, 9 aa, Mycobacterium
PSSPRGEDT

SEQ ID NO: 1020504 - protein, 8 aa, Mycobacterium
PSSPRSLN

SEQ ID NO: 1020505 - protein, 7 aa, Mycobacterium
PSSPTGI

SEQ ID NO: 1020506 - protein, 9 aa, Mycobacterium
PSSRETEPN

SEQ ID NO: 1020507 - protein, 19 aa, Mycobacterium
PSSRNGDHNHAAIVGAAGR

SEQ ID NO: 1020508 - protein, 7 aa, Mycobacterium
PSSVQDR

SEQ ID NO: 1020509 - protein, 13 aa, Mycobacterium
PSSWEDRTAGTSK

SEQ ID NO: 1020510 - protein, 14 aa, Mycobacterium
PSTAPHPRKPRPAF

SEQ ID NO: 1020511 - protein, 9 aa, Mycobacterium
PSTASRSSW

SEQ ID NO: 1020512 - protein, 4 aa, Mycobacterium
PSTC

SEQ ID NO: 1020513 - protein, 14 aa, Mycobacterium
PSTDGSWDAKSAWP

SEQ ID NO: 1020514 - protein, 4 aa, Mycobacterium
PSTL

SEQ ID NO: 1020515 - protein, 4 aa, Mycobacterium
PSTP

SEQ ID NO: 1020516 - protein, 6 aa, Mycobacterium
PSTPGD

SEQ ID NO: 1020517 - protein, 5 aa, Mycobacterium
PSTPS

SEQ ID NO: 1020518 - protein, 8 aa, Mycobacterium
PSTPTSWR

SEQ ID NO: 1020519 - protein, 4 aa, Mycobacterium
PSTQ

SEQ ID NO: 1020520 - protein, 11 aa, Mycobacterium
PSTRQPTGARH

SEQ ID NO: 1020521 - protein, 16 aa, Mycobacterium
PSTTEAQDSALSPRGY

SEQ ID NO: 1020522 - protein, 8 aa, Mycobacterium
PSTVSPPM

SEQ ID NO: 1020523 - protein, 12 aa, Mycobacterium
PSTVSVGDDGMR

SEQ ID NO: 1020524 - protein, 10 aa, Mycobacterium
PSVEPKHAQT

SEQ ID NO: 1020525 - protein, 4 aa, Mycobacterium
PSVP

SEQ ID NO: 1020526 - protein, 15 aa, Mycobacterium
PSVPTTDDGLPSGVA

SEQ ID NO: 1020527 - protein, 5 aa, Mycobacterium
PSVQN

SEQ ID NO: 1020528 - protein, 5 aa, Mycobacterium
PSWAT

SEQ ID NO: 1020529 - protein, 7 aa, Mycobacterium
PSWPPQQ

SEQ ID NO: 1020530 - protein, 4 aa, Mycobacterium
PSYD

SEQ ID NO: 1020531 - protein, 7 aa, Mycobacterium
PSYDAAR

SEQ ID NO: 1020532 - protein, 9 aa, Mycobacterium
PSYDPLDGD

SEQ ID NO: 1020533 - protein, 10 aa, Mycobacterium
PSYGLGPTEP

SEQ ID NO: 1020534 - protein, 6 aa, Mycobacterium
PSYGWN

SEQ ID NO: 1020535 - protein, 5 aa, Mycobacterium
PSYPT

SEQ ID NO: 1020536 - protein, 7 aa, Mycobacterium
PSYSQDW

SEQ ID NO: 1020537 - protein, 4 aa, Mycobacterium
PTAA

SEQ ID NO: 1020538 - protein, 8 aa, Mycobacterium
PTAADDVR

SEQ ID NO: 1020539 - protein, 7 aa, Mycobacterium
PTAAEVS

SEQ ID NO: 1020540 - protein, 7 aa, Mycobacterium
PTAANAG

SEQ ID NO: 1020541 - protein, 16 aa, Mycobacterium
PTAASDLRPPVRREGP

SEQ ID NO: 1020542 - protein, 5 aa, Mycobacterium
PTAEQ

SEQ ID NO: 1020543 - protein, 4 aa, Mycobacterium
PTAG

SEQ ID NO: 1020544 - protein, 7 aa, Mycobacterium
PTAGEVG

SEQ ID NO: 1020545 - protein, 8 aa, Mycobacterium
PTAGLDPH

SEQ ID NO: 1020546 - protein, 6 aa, Mycobacterium
PTAGMD

SEQ ID NO: 1020547 - protein, 6 aa, Mycobacterium
PTALQT

SEQ ID NO: 1020548 - protein, 10 aa, Mycobacterium
PTAPEGTPGE

SEQ ID NO: 1020549 - protein, 9 aa, Mycobacterium
PTAPGRDAA

SEQ ID NO: 1020550 - protein, 9 aa, Mycobacterium
PTAPSLAGT

SEQ ID NO: 1020551 - protein, 6 aa, Mycobacterium
PTAPVS

SEQ ID NO: 1020552 - protein, 34 aa, Mycobacterium; identical to SEQ ID NO: 546686

SEQ ID NO: 1020553 - protein, 4 aa, Mycobacterium
PTAT

SEQ ID NO: 1020554 - protein, 5 aa, Mycobacterium
PTATG

SEQ ID NO: 1020555 - protein, 12 aa, Mycobacterium
PTAYDGDSSDEV

SEQ ID NO: 1020556 - protein, 105 aa, Mycobacterium
PTDAAGTVGPPSKSGSKPRTTEKQDDQQGEKSGRARSDAGRRRRTRGGKPVTGHPATTPVASGETATETGSGFGASSPSGNAGATRRRRRRRKPAGVQDNAAASA

SEQ ID NO: 1020557 - protein, 8 aa, Mycobacterium
PTDARRRL

SEQ ID NO: 1020558 - protein, 7 aa, Mycobacterium
PTDASSM

SEQ ID NO: 1020559 - protein, 7 aa, Mycobacterium
PTDEDSL

SEQ ID NO: 1020560 - protein, 8 aa, Mycobacterium
PTDGLSGS

SEQ ID NO: 1020561 - protein, 13 aa, Mycobacterium
PTDITNEDETARA

SEQ ID NO: 1020562 - protein, 5 aa, Mycobacterium
PTDLV

SEQ ID NO: 1020563 - protein, 10 aa, Mycobacterium
PTDNTPDGEG

SEQ ID NO: 1020564 - protein, 4 aa, Mycobacterium
PTDR

SEQ ID NO: 1020565 - protein, 5 aa, Mycobacterium
PTDRG

SEQ ID NO: 1020566 - protein, 6 aa, Mycobacterium
PTDRKI

SEQ ID NO: 1020567 - protein, 15 aa, Mycobacterium
PTDRNSDPKLGASRT

SEQ ID NO: 1020568 - protein, 9 aa, Mycobacterium
PTDRPYPPI

SEQ ID NO: 1020569 - protein, 22 aa, Mycobacterium
PTDRSQTTSPSFRGARRQSAVG

SEQ ID NO: 1020570 - protein, 8 aa, Mycobacterium
PTDSATED

SEQ ID NO: 1020571 - protein, 5 aa, Mycobacterium
PTDTD

SEQ ID NO: 1020572 - protein, 12 aa, Mycobacterium
PTEDNQYQTSKM

SEQ ID NO: 1020573 - protein, 7 aa, Mycobacterium
PTEESTT

SEQ ID NO: 1020574 - protein, 7 aa, Mycobacterium
PTEGATM

SEQ ID NO: 1020575 - protein, 9 aa, Mycobacterium
PTEKEAAPL

SEQ ID NO: 1020576 - protein, 8 aa, Mycobacterium
PTENDPVT

SEQ ID NO: 1020577 - protein, 7 aa, Mycobacterium
PTEPRDQ

SEQ ID NO: 1020578 - protein, 8 aa, Mycobacterium
PTEPTPRQ

SEQ ID NO: 1020579 - protein, 4 aa, Mycobacterium
PTER

SEQ ID NO: 1020580 - protein, 4 aa, Mycobacterium
PTES

SEQ ID NO: 1020581 - protein, 7 aa, Mycobacterium
PTESDNE

SEQ ID NO: 1020582 - protein, 7 aa, Mycobacterium
PTESEDL

SEQ ID NO: 1020583 - protein, 7 aa, Mycobacterium
PTESESL

SEQ ID NO: 1020584 - protein, 7 aa, Mycobacterium
PTESGFP

SEQ ID NO: 1020585 - protein, 13 aa, Mycobacterium
PTETPQQPARIER

SEQ ID NO: 1020586 - protein, 12 aa, Mycobacterium
PTEVSSWPPTAI

SEQ ID NO: 1020587 - protein, 5 aa, Mycobacterium
PTFTD

SEQ ID NO: 1020588 - protein, 4 aa, Mycobacterium
PTGA

SEQ ID NO: 1020589 - protein, 5 aa, Mycobacterium
PTGAT

SEQ ID NO: 1020590 - protein, 7 aa, Mycobacterium
PTGCGGF

SEQ ID NO: 1020591 - protein, 11 aa, Mycobacterium
PTGDRIQTTTN

SEQ ID NO: 1020592 - protein, 8 aa, Mycobacterium
PTGEGPWP

SEQ ID NO: 1020593 - protein, 15 aa, Mycobacterium
PTGEPDADYDTYKHH

SEQ ID NO: 1020594 - protein, 4 aa, Mycobacterium
PTGG

SEQ ID NO: 1020595 - protein, 4 aa, Mycobacterium
PTGH

SEQ ID NO: 1020596 - protein, 8 aa, Mycobacterium
PTGIQAAG

SEQ ID NO: 1020597 - protein, 21 aa, Mycobacterium
PTGPAEGESGAQGFGPRMGSA

SEQ ID NO: 1020598 - protein, 5 aa, Mycobacterium
PTGPC

SEQ ID NO: 1020599 - protein, 16 aa, Mycobacterium
PTGQSASSLGLDGTET

SEQ ID NO: 1020600 - protein, 8 aa, Mycobacterium
PTGQSPTV

SEQ ID NO: 1020601 - protein, 15 aa, Mycobacterium
PTGQTYAAQPPPADE

SEQ ID NO: 1020602 - protein, 7 aa, Mycobacterium
PTGSGKT

SEQ ID NO: 1020603 - protein, 7 aa, Mycobacterium
PTGSTPV

SEQ ID NO: 1020604 - protein, 5 aa, Mycobacterium
PTGSV

SEQ ID NO: 1020605 - protein, 7 aa, Mycobacterium
PTGTERT

SEQ ID NO: 1020606 - protein, 6 aa, Mycobacterium
PTGTPL

SEQ ID NO: 1020607 - protein, 4 aa, Mycobacterium
PTGV

SEQ ID NO: 1020608 - protein, 13 aa, Mycobacterium
PTGYHVGRVNHRI

SEQ ID NO: 1020609 - protein, 10 aa, Mycobacterium
PTHGATTNFR

SEQ ID NO: 1020610 - protein, 5 aa, Mycobacterium
PTHPS

SEQ ID NO: 1020611 - protein, 9 aa, Mycobacterium
PTIGGHEGS

SEQ ID NO: 1020612 - protein, 6 aa, Mycobacterium
PTIQPG

SEQ ID NO: 1020613 - protein, 4 aa, Mycobacterium
PTKE

SEQ ID NO: 1020614 - protein, 8 aa, Mycobacterium
PTKEFEEH

SEQ ID NO: 1020615 - protein, 5 aa, Mycobacterium
PTLDG

SEQ ID NO: 1020616 - protein, 7 aa, Mycobacterium
PTLGQAT

SEQ ID NO: 1020617 - protein, 4 aa, Mycobacterium
PTLP

SEQ ID NO: 1020618 - protein, 10 aa, Mycobacterium
PTLPGRGLSP

SEQ ID NO: 1020619 - protein, 11 aa, Mycobacterium
PTLPRSSTATI

SEQ ID NO: 1020620 - protein, 6 aa, Mycobacterium
PTLSGP

SEQ ID NO: 1020621 - protein, 5 aa, Mycobacterium
PTNAM

SEQ ID NO: 1020622 - protein, 5 aa, Mycobacterium
PTNDL

SEQ ID NO: 1020623 - protein, 8 aa, Mycobacterium
PTNDTEIS

SEQ ID NO: 1020624 - protein, 6 aa, Mycobacterium
PTNDVD

SEQ ID NO: 1020625 - protein, 7 aa, Mycobacterium
PTNGNHH

SEQ ID NO: 1020626 - protein, 5 aa, Mycobacterium
PTNHT

SEQ ID NO: 1020627 - protein, 4 aa, Mycobacterium
PTNI

SEQ ID NO: 1020628 - protein, 12 aa, Mycobacterium
PTNNLDPASREQ

SEQ ID NO: 1020629 - protein, 29 aa, Mycobacterium
PTPAQADAAPPPPPGRRRRGSSNPGHVAR

SEQ ID NO: 1020630 - protein, 6 aa, Mycobacterium
PTPATS

SEQ ID NO: 1020631 - protein, 14 aa, Mycobacterium
PTPAVGGVPTNAAS

SEQ ID NO: 1020632 - protein, 12 aa, Mycobacterium
PTPDDIESSSEH

SEQ ID NO: 1020633 - protein, 9 aa, Mycobacterium
PTPEPQAGE

SEQ ID NO: 1020634 - protein, 11 aa, Mycobacterium
PTPEQAAAAQK

SEQ ID NO: 1020635 - protein, 5 aa, Mycobacterium
PTPET

SEQ ID NO: 1020636 - protein, 5 aa, Mycobacterium
PTPGL

SEQ ID NO: 1020637 - protein, 8 aa, Mycobacterium
PTPGPVDR

SEQ ID NO: 1020638 - protein, 7 aa, Mycobacterium
PTPLNAQ

SEQ ID NO: 1020639 - protein, 6 aa, Mycobacterium
PTPNGL

SEQ ID NO: 1020640 - protein, 12 aa, Mycobacterium
PTPNRPPRVPST

SEQ ID NO: 1020641 - protein, 5 aa, Mycobacterium
PTPRT

SEQ ID NO: 1020642 - protein, 4 aa, Mycobacterium
PTPS

SEQ ID NO: 1020643 - protein, 5 aa, Mycobacterium
PTPSH

SEQ ID NO: 1020644 - protein, 8 aa, Mycobacterium
PTPSSGGV

SEQ ID NO: 1020645 - protein, 12 aa, Mycobacterium
PTPTKPGRTAPG

SEQ ID NO: 1020646 - protein, 5 aa, Mycobacterium
PTPTL

SEQ ID NO: 1020647 - protein, 7 aa, Mycobacterium
PTPTPRI

SEQ ID NO: 1020648 - protein, 6 aa, Mycobacterium
PTPTQW

SEQ ID NO: 1020649 - protein, 5 aa, Mycobacterium
PTPVG

SEQ ID NO: 1020650 - protein, 4 aa, Mycobacterium
PTQP

SEQ ID NO: 1020651 - protein, 6 aa, Mycobacterium
PTQRAR

SEQ ID NO: 1020652 - protein, 4 aa, Mycobacterium
PTQT

SEQ ID NO: 1020653 - protein, 13 aa, Mycobacterium
PTQVTGEGAPISP

SEQ ID NO: 1020654 - protein, 4 aa, Mycobacterium
PTRA

SEQ ID NO: 1020655 - protein, 9 aa, Mycobacterium
PTRAKLADG

SEQ ID NO: 1020656 - protein, 6 aa, Mycobacterium
PTRARI

SEQ ID NO: 1020657 - protein, 4 aa, Mycobacterium
PTRI

SEQ ID NO: 1020658 - protein, 5 aa, Mycobacterium
PTRNG

SEQ ID NO: 1020659 - protein, 16 aa, Mycobacterium
PTRNRRARAGRDGYVC

SEQ ID NO: 1020660 - protein, 9 aa, Mycobacterium
PTRPDPHAQ

SEQ ID NO: 1020661 - protein, 11 aa, Mycobacterium
PTRPPSQSGRS

SEQ ID NO: 1020662 - protein, 16 aa, Mycobacterium
PTRPPTDPEALAPAKA

SEQ ID NO: 1020663 - protein, 20 aa, Mycobacterium
PTRQDDARMEDVRPGQLHGR

SEQ ID NO: 1020664 - protein, 10 aa, Mycobacterium
PTRRAAAEAR

SEQ ID NO: 1020665 - protein, 7 aa, Mycobacterium
PTRRQVD

SEQ ID NO: 1020666 - protein, 18 aa, Mycobacterium
PTRRSPPPRPRAGSAWGC

SEQ ID NO: 1020667 - protein, 4 aa, Mycobacterium
PTSE

SEQ ID NO: 1020668 - protein, 11 aa, Mycobacterium
PTSGMDPVNAR

SEQ ID NO: 1020669 - protein, 5 aa, Mycobacterium
PTSGN

SEQ ID NO: 1020670 - protein, 7 aa, Mycobacterium
PTSGNTG

SEQ ID NO: 1020671 - protein, 4 aa, Mycobacterium
PTSL

SEQ ID NO: 1020672 - protein, 5 aa, Mycobacterium
PTSNG

SEQ ID NO: 1020673 - protein, 8 aa, Mycobacterium
PTSNGRFG

SEQ ID NO: 1020674 - protein, 6 aa, Mycobacterium
PTSNIH

SEQ ID NO: 1020675 - protein, 12 aa, Mycobacterium
PTSNPGPIPFGP

SEQ ID NO: 1020676 - protein, 8 aa, Mycobacterium
PTSPTSSV

SEQ ID NO: 1020677 - protein, 4 aa, Mycobacterium
PTSS

SEQ ID NO: 1020678 - protein, 7 aa, Mycobacterium
PTSSDVE

SEQ ID NO: 1020679 - protein, 7 aa, Mycobacterium
PTSWEQA

SEQ ID NO: 1020680 - protein, 10 aa, Mycobacterium
PTSYTPTSKR

SEQ ID NO: 1020681 - protein, 4 aa, Mycobacterium
PTTA

SEQ ID NO: 1020682 - protein, 7 aa, Mycobacterium
PTTADRD

SEQ ID NO: 1020683 - protein, 11 aa, Mycobacterium
PTTAPPGTPGE

SEQ ID NO: 1020684 - protein, 6 aa, Mycobacterium
PTTATG

SEQ ID NO: 1020685 - protein, 7 aa, Mycobacterium
PTTDRTG

SEQ ID NO: 1020686 - protein, 5 aa, Mycobacterium
PTTFA

SEQ ID NO: 1020687 - protein, 8 aa, Mycobacterium
PTTGLDPA

SEQ ID NO: 1020688 - protein, 5 aa, Mycobacterium
PTTKY

SEQ ID NO: 1020689 - protein, 16 aa, Mycobacterium
PTTPNRQGNDRGTSYR

SEQ ID NO: 1020690 - protein, 7 aa, Mycobacterium
PTTQKSG

SEQ ID NO: 1020691 - protein, 12 aa, Mycobacterium
PTTSGTGSEVSP

SEQ ID NO: 1020692 - protein, 9 aa, Mycobacterium
PTTSRPAGT

SEQ ID NO: 1020693 - protein, 4 aa, Mycobacterium
PTVE

SEQ ID NO: 1020694 - protein, 8 aa, Mycobacterium
PTVEGTGS

SEQ ID NO: 1020695 - protein, 7 aa, Mycobacterium
PTVGTGD

SEQ ID NO: 1020696 - protein, 9 aa, Mycobacterium
PTVPAGTSR

SEQ ID NO: 1020697 - protein, 12 aa, Mycobacterium
PTVPAHDEPAGP

SEQ ID NO: 1020698 - protein, 6 aa, Mycobacterium
PTVSEL

SEQ ID NO: 1020699 - protein, 5 aa, Mycobacterium
PTWAG

SEQ ID NO: 1020700 - protein, 14 aa, Mycobacterium
PTWERSGRTERGRD

SEQ ID NO: 1020701 - protein, 4 aa, Mycobacterium
PTWG

SEQ ID NO: 1020702 - protein, 21 aa, Mycobacterium
PTWPGSSAASTAFSAANSEVD

SEQ ID NO: 1020703 - protein, 7 aa, Mycobacterium
PTYAPGE

SEQ ID NO: 1020704 - protein, 4 aa, Mycobacterium
PTYP

SEQ ID NO: 1020705 - protein, 14 aa, Mycobacterium
PVAGPAELAAGREA

SEQ ID NO: 1020706 - protein, 7 aa, Mycobacterium
PVAPPSW

SEQ ID NO: 1020707 - protein, 6 aa, Mycobacterium
PVARES

SEQ ID NO: 1020708 - protein, 13 aa, Mycobacterium
PVARGGDQPLTGQ

SEQ ID NO: 1020709 - protein, 5 aa, Mycobacterium
PVATT

SEQ ID NO: 1020710 - protein, 5 aa, Mycobacterium
PVCGS

SEQ ID NO: 1020711 - protein, 8 aa, Mycobacterium
PVDDPNRA

SEQ ID NO: 1020712 - protein, 5 aa, Mycobacterium
PVDEC

SEQ ID NO: 1020713 - protein, 6 aa, Mycobacterium
PVDESG

SEQ ID NO: 1020714 - protein, 8 aa, Mycobacterium
PVDESTSD

SEQ ID NO: 1020715 - protein, 4 aa, Mycobacterium
PVDG

SEQ ID NO: 1020716 - protein, 11 aa, Mycobacterium
PVDGSSGKSIR

SEQ ID NO: 1020717 - protein, 7 aa, Mycobacterium
PVDGTTG

SEQ ID NO: 1020718 - protein, 4 aa, Mycobacterium
PVDP

SEQ ID NO: 1020719 - protein, 5 aa, Mycobacterium
PVEDL

SEQ ID NO: 1020720 - protein, 7 aa, Mycobacterium
PVEDRGR

SEQ ID NO: 1020721 - protein, 7 aa, Mycobacterium
PVEGDSG

SEQ ID NO: 1020722 - protein, 6 aa, Mycobacterium
PVEHTT

SEQ ID NO: 1020723 - protein, 10 aa, Mycobacterium
PVERSPAARS

SEQ ID NO: 1020724 - protein, 7 aa, Mycobacterium
PVESGNG

SEQ ID NO: 1020725 - protein, 10 aa, Mycobacterium
PVGAADTCAE

SEQ ID NO: 1020726 - protein, 13 aa, Mycobacterium
PVGAPGESKIPED

SEQ ID NO: 1020727 - protein, 12 aa, Mycobacterium
PVGATESTNPVG

SEQ ID NO: 1020728 - protein, 13 aa, Mycobacterium
PVGATSSVAADPA

SEQ ID NO: 1020729 - protein, 5 aa, Mycobacterium
PVGDG

SEQ ID NO: 1020730 - protein, 5 aa, Mycobacterium
PVGDS

SEQ ID NO: 1020731 - protein, 5 aa, Mycobacterium
PVGHQ

SEQ ID NO: 1020732 - protein, 6 aa, Mycobacterium
PVGNPT

SEQ ID NO: 1020733 - protein, 7 aa, Mycobacterium
PVGPSSV

SEQ ID NO: 1020734 - protein, 5 aa, Mycobacterium
PVGPT

SEQ ID NO: 1020735 - protein, 8 aa, Mycobacterium
PVGPVTGP

SEQ ID NO: 1020736 - protein, 15 aa, Mycobacterium
PVGRSDSETKGASEG

SEQ ID NO: 1020737 - protein, 8 aa, Mycobacterium
PVGSEAAL

SEQ ID NO: 1020738 - protein, 8 aa, Mycobacterium
PVGTADPV

SEQ ID NO: 1020739 - protein, 7 aa, Mycobacterium
PVGTEPR

SEQ ID NO: 1020740 - protein, 17 aa, Mycobacterium
PVMSEPGAADRSSSGYN

SEQ ID NO: 1020741 - protein, 6 aa, Mycobacterium
PVNDLS

SEQ ID NO: 1020742 - protein, 7 aa, Mycobacterium
PVNPSGG

SEQ ID NO: 1020743 - protein, 8 aa, Mycobacterium
PVNPSGGL

SEQ ID NO: 1020744 - protein, 8 aa, Mycobacterium
PVNPSGGV

SEQ ID NO: 1020745 - protein, 4 aa, Mycobacterium
PVPA

SEQ ID NO: 1020746 - protein, 6 aa, Mycobacterium
PVPADP

SEQ ID NO: 1020747 - protein, 5 aa, Mycobacterium
PVPAG

SEQ ID NO: 1020748 - protein, 105 aa, Mycobacterium
PVPAGPTSTAVEPGPAGAAGPAATAGAGAAGAAAAAVAAGAAGTEGRAQTPVPAESARSGAAGCTRRASATRDQTGAGSAARTTGSTVAAGAAGTAGAASAAATI

SEQ ID NO: 1020749 - protein, 8 aa, Mycobacterium
PVPATEAA

SEQ ID NO: 1020750 - protein, 12 aa, Mycobacterium
PVPDPNSPTGSR

SEQ ID NO: 1020751 - protein, 15 aa, Mycobacterium
PVPDSDAGARSWPDS

SEQ ID NO: 1020752 - protein, 8 aa, Mycobacterium
PVPEHGTS

SEQ ID NO: 1020753 - protein, 8 aa, Mycobacterium
PVPGGEWA

SEQ ID NO: 1020754 - protein, 9 aa, Mycobacterium
PVPGYRGPR

SEQ ID NO: 1020755 - protein, 7 aa, Mycobacterium
PVPHDPG

SEQ ID NO: 1020756 - protein, 5 aa, Mycobacterium
PVPIP

SEQ ID NO: 1020757 - protein, 13 aa, Mycobacterium
PVPKDGMPIVLRP

SEQ ID NO: 1020758 - protein, 13 aa, Mycobacterium
PVPNAGAPLGPGQ

SEQ ID NO: 1020759 - protein, 6 aa, Mycobacterium
PVPNDN

SEQ ID NO: 1020760 - protein, 9 aa, Mycobacterium
PVPPPRPEL

SEQ ID NO: 1020761 - protein, 5 aa, Mycobacterium
PVPPS

SEQ ID NO: 1020762 - protein, 7 aa, Mycobacterium
PVPRRDA

SEQ ID NO: 1020763 - protein, 7 aa, Mycobacterium
PVPTEGT

SEQ ID NO: 1020764 - protein, 4 aa, Mycobacterium
PVPV

SEQ ID NO: 1020765 - protein, 22 aa, Mycobacterium
PVPVAPENGLESELGNERRLGP

SEQ ID NO: 1020766 - protein, 7 aa, Mycobacterium
PVQGEAA

SEQ ID NO: 1020767 - protein, 9 aa, Mycobacterium
PVQGRGGKG

SEQ ID NO: 1020768 - protein, 8 aa, Mycobacterium
PVQPGGPP

SEQ ID NO: 1020769 - protein, 13 aa, Mycobacterium
PVQPTKPPKANEV

SEQ ID NO: 1020770 - protein, 7 aa, Mycobacterium
PVQRTGA

SEQ ID NO: 1020771 - protein, 6 aa, Mycobacterium
PVQSTA

SEQ ID NO: 1020772 - protein, 8 aa, Mycobacterium
PVQTPSAQ

SEQ ID NO: 1020773 - protein, 10 aa, Mycobacterium
PVRANRSARG

SEQ ID NO: 1020774 - protein, 5 aa, Mycobacterium
PVRAP

SEQ ID NO: 1020775 - protein, 5 aa, Mycobacterium
PVRAS

SEQ ID NO: 1020776 - protein, 13 aa, Mycobacterium
PVRDHPGARVASS

SEQ ID NO: 1020777 - protein, 11 aa, Mycobacterium
PVRDTSGSSCA

SEQ ID NO: 1020778 - protein, 12 aa, Mycobacterium
PVRNYRDTSHKP

SEQ ID NO: 1020779 - protein, 12 aa, Mycobacterium
PVRPYGAANAAK

SEQ ID NO: 1020780 - protein, 7 aa, Mycobacterium
PVRSGAD

SEQ ID NO: 1020781 - protein, 14 aa, Mycobacterium
PVRTSRTSTRAHQC

SEQ ID NO: 1020782 - protein, 14 aa, Mycobacterium
PVSDGADARVTRGS

SEQ ID NO: 1020783 - protein, 5 aa, Mycobacterium
PVSGD

SEQ ID NO: 1020784 - protein, 6 aa, Mycobacterium
PVSQPD

SEQ ID NO: 1020785 - protein, 28 aa, Mycobacterium
PVSRPESQEALNADSSKGLPRPVSGDEL

SEQ ID NO: 1020786 - protein, 29 aa, Mycobacterium
PVSRPESQEALNADSSKGLPRPVSGDELR

SEQ ID NO: 1020787 - protein, 7 aa, Mycobacterium
PVSSGEP

SEQ ID NO: 1020788 - protein, 4 aa, Mycobacterium
PVTA

SEQ ID NO: 1020789 - protein, 5 aa, Mycobacterium
PVTGG

SEQ ID NO: 1020790 - protein, 5 aa, Mycobacterium
PVTNA

SEQ ID NO: 1020791 - protein, 6 aa, Mycobacterium
PVTNQE

SEQ ID NO: 1020792 - protein, 20 aa, Mycobacterium
PVTNSRRRYPWGDSAGPVGN

SEQ ID NO: 1020793 - protein, 7 aa, Mycobacterium
PVVGSGG

SEQ ID NO: 1020794 - protein, 19 aa, Mycobacterium
PVYGTSRGMPGFTGDPFAN

SEQ ID NO: 1020795 - protein, 7 aa, Mycobacterium
PWATPAR

SEQ ID NO: 1020796 - protein, 19 aa, Mycobacterium
PWDTNPRSFDPSSNYNPCS

SEQ ID NO: 1020797 - protein, 21 aa, Mycobacterium
PWGPDKITEDGREQLRALGFT

SEQ ID NO: 1020798 - protein, 13 aa, Mycobacterium
PWPALSDSVLAEY

SEQ ID NO: 1020799 - protein, 31 aa, Mycobacterium
PWPASTGATRRSSAALAAASSARASASAASA

SEQ ID NO: 1020800 - protein, 5 aa, Mycobacterium
PWPED

SEQ ID NO: 1020801 - protein, 10 aa, Mycobacterium
PWPEDQGPRR

SEQ ID NO: 1020802 - protein, 10 aa, Mycobacterium
PWPKTSGSRG

SEQ ID NO: 1020803 - protein, 13 aa, Mycobacterium
PWPRGAGPRRAGV

SEQ ID NO: 1020804 - protein, 7 aa, Mycobacterium
PWPRGRA

SEQ ID NO: 1020805 - protein, 5 aa, Mycobacterium
PWRDN

SEQ ID NO: 1020806 - protein, 4 aa, Mycobacterium
PWRT

SEQ ID NO: 1020807 - protein, 5 aa, Mycobacterium
PWSGA

SEQ ID NO: 1020808 - protein, 6 aa, Mycobacterium
PWSTGH

SEQ ID NO: 1020809 - protein, 4 aa, Mycobacterium
PYAE

SEQ ID NO: 1020810 - protein, 6 aa, Mycobacterium
PYAGSW

SEQ ID NO: 1020811 - protein, 6 aa, Mycobacterium
PYAPDE

SEQ ID NO: 1020812 - protein, 4 aa, Mycobacterium
PYAT

SEQ ID NO: 1020813 - protein, 8 aa, Mycobacterium
PYDKKNPE

SEQ ID NO: 1020814 - protein, 14 aa, Mycobacterium
PYDNDLDSSSPPRR

SEQ ID NO: 1020815 - protein, 5 aa, Mycobacterium
PYFGD

SEQ ID NO: 1020816 - protein, 6 aa, Mycobacterium
PYGGPA

SEQ ID NO: 1020817 - protein, 11 aa, Mycobacterium
PYGNSGPRVDG

SEQ ID NO: 1020818 - protein, 9 aa, Mycobacterium
PYPDGTIPE

SEQ ID NO: 1020819 - protein, 11 aa, Mycobacterium
PYPGRTGNAGH

SEQ ID NO: 1020820 - protein, 6 aa, Mycobacterium
PYPGTP

SEQ ID NO: 1020821 - protein, 6 aa, Mycobacterium
PYPPDL

SEQ ID NO: 1020822 - protein, 14 aa, Mycobacterium
PYPPLPPLPPSPAW

SEQ ID NO: 1020823 - protein, 5 aa, Mycobacterium
PYPQA

SEQ ID NO: 1020824 - protein, 5 aa, Mycobacterium
PYPRN

SEQ ID NO: 1020825 - protein, 5 aa, Mycobacterium
PYPTG

SEQ ID NO: 1020826 - protein, 64 aa, Mycobacterium
PYQAPAPKQVAAPKKAGAPKKGAAPKKGAAPRNGAAPHGSPRPRSAGSGSLRRGPRPGRMRQET

SEQ ID NO: 1020827 - protein, 4 aa, Mycobacterium
PYQV

SEQ ID NO: 1020828 - protein, 5 aa, Mycobacterium
PYRND

SEQ ID NO: 1020829 - protein, 10 aa, Mycobacterium
PYRSGQRITE

SEQ ID NO: 1020830 - protein, 11 aa, Mycobacterium
PYSDGGATHPS

SEQ ID NO: 1020831 - protein, 8 aa, Mycobacterium
PYSGPTTA

SEQ ID NO: 1020832 - protein, 12 aa, Mycobacterium
PYSRDPRNVARK

SEQ ID NO: 1020833 - protein, 16 aa, Mycobacterium
PYTSKRQLPQQLRAMV

SEQ ID NO: 1020834 - protein, 5 aa, Mycobacterium
PYVEG

SEQ ID NO: 1020835 - protein, 5 aa, Mycobacterium
PYVER

SEQ ID NO: 1020836 - protein, 5 aa, Mycobacterium
PYYGG

SEQ ID NO: 1020837 - protein, 4 aa, Mycobacterium
QAAA

SEQ ID NO: 1020838 - protein, 8 aa, Mycobacterium
QAAAAPAA

SEQ ID NO: 1020839 - protein, 11 aa, Mycobacterium
QAAAASPAATV

SEQ ID NO: 1020840 - protein, 9 aa, Mycobacterium
QAAAEAGTV

SEQ ID NO: 1020841 - protein, 5 aa, Mycobacterium
QAAAP

SEQ ID NO: 1020842 - protein, 15 aa, Mycobacterium
QAAARAGATPEEAAE

SEQ ID NO: 1020843 - protein, 5 aa, Mycobacterium
QAAAV

SEQ ID NO: 1020844 - protein, 5 aa, Mycobacterium
QAADL

SEQ ID NO: 1020845 - protein, 7 aa, Mycobacterium
QAADTGA

SEQ ID NO: 1020846 - protein, 4 aa, Mycobacterium
QAAG

SEQ ID NO: 1020847 - protein, 7 aa, Mycobacterium
QAAGAAP

SEQ ID NO: 1020848 - protein, 8 aa, Mycobacterium
QAAGDNAA

SEQ ID NO: 1020849 - protein, 5 aa, Mycobacterium
QAAGH

SEQ ID NO: 1020850 - protein, 5 aa, Mycobacterium
QAAGI

SEQ ID NO: 1020851 - protein, 6 aa, Mycobacterium
QAAGRD

SEQ ID NO: 1020852 - protein, 5 aa, Mycobacterium
QAAGV

SEQ ID NO: 1020853 - protein, 5 aa, Mycobacterium
QAAIP

SEQ ID NO: 1020854 - protein, 8 aa, Mycobacterium
QAAKDDRD

SEQ ID NO: 1020855 - protein, 14 aa, Mycobacterium
QAAKSRSEQLRITS

SEQ ID NO: 1020856 - protein, 10 aa, Mycobacterium
QAANAQAAAR

SEQ ID NO: 1020857 - protein, 16 aa, Mycobacterium
QAANATAAEYSRYGSS

SEQ ID NO: 1020858 - protein, 4 aa, Mycobacterium
QAAP

SEQ ID NO: 1020859 - protein, 8 aa, Mycobacterium
QAAPGTPV

SEQ ID NO: 1020860 - protein, 12 aa, Mycobacterium
QAAPKQTSDSGV

SEQ ID NO: 1020861 - protein, 7 aa, Mycobacterium
QAAPPDT

SEQ ID NO: 1020862 - protein, 4 aa, Mycobacterium
QAAQ

SEQ ID NO: 1020863 - protein, 7 aa, Mycobacterium
QAAQGLG

SEQ ID NO: 1020864 - protein, 6 aa, Mycobacterium
QAAQYK

SEQ ID NO: 1020865 - protein, 7 aa, Mycobacterium
QAARDHQ

SEQ ID NO: 1020866 - protein, 7 aa, Mycobacterium
QAARPGF

SEQ ID NO: 1020867 - protein, 10 aa, Mycobacterium
QAASASGPLR

SEQ ID NO: 1020868 - protein, 8 aa, Mycobacterium
QAASSLGA

SEQ ID NO: 1020869 - protein, 4 aa, Mycobacterium
QAAT

SEQ ID NO: 1020870 - protein, 8 aa, Mycobacterium
QAATECPA

SEQ ID NO: 1020871 - protein, 12 aa, Mycobacterium
QAATSAAFADNP

SEQ ID NO: 1020872 - protein, 13 aa, Mycobacterium
QAAVQGAAASVRA

SEQ ID NO: 1020873 - protein, 5 aa, Mycobacterium
QADAE

SEQ ID NO: 1020874 - protein, 6 aa, Mycobacterium
QADARA

SEQ ID NO: 1020875 - protein, 5 aa, Mycobacterium
QADAV

SEQ ID NO: 1020876 - protein, 5 aa, Mycobacterium
QADEL

SEQ ID NO: 1020877 - protein, 9 aa, Mycobacterium
QADGPATIE

SEQ ID NO: 1020878 - protein, 7 aa, Mycobacterium
QADLGGT

SEQ ID NO: 1020879 - protein, 9 aa, Mycobacterium
QADLSSRLT

SEQ ID NO: 1020880 - protein, 9 aa, Mycobacterium
QADNPKPLG

SEQ ID NO: 1020881 - protein, 11 aa, Mycobacterium
QADPAAPAAAA

SEQ ID NO: 1020882 - protein, 8 aa, Mycobacterium
QADPPARL

SEQ ID NO: 1020883 - protein, 6 aa, Mycobacterium
QADRAE

SEQ ID NO: 1020884 - protein, 8 aa, Mycobacterium
QADRPDSG

SEQ ID NO: 1020885 - protein, 7 aa, Mycobacterium
QADVDAG

SEQ ID NO: 1020886 - protein, 6 aa, Mycobacterium
QAEAAE

SEQ ID NO: 1020887 - protein, 7 aa, Mycobacterium
QAEAAYR

SEQ ID NO: 1020888 - protein, 8 aa, Mycobacterium
QAEADQAL

SEQ ID NO: 1020889 - protein, 8 aa, Mycobacterium
QAEAERDA

SEQ ID NO: 1020890 - protein, 9 aa, Mycobacterium
QAEDSGGRQ

SEQ ID NO: 1020891 - protein, 7 aa, Mycobacterium
QAEGTEF

SEQ ID NO: 1020892 - protein, 18 aa, Mycobacterium
QAELAGPLAGTGREKEQV

SEQ ID NO: 1020893 - protein, 16 aa, Mycobacterium
QAELGGAADESVNPVP

SEQ ID NO: 1020894 - protein, 7 aa, Mycobacterium
QAEPHEV

SEQ ID NO: 1020895 - protein, 5 aa, Mycobacterium
QAEPN

SEQ ID NO: 1020896 - protein, 7 aa, Mycobacterium
QAEQAAL

SEQ ID NO: 1020897 - protein, 23 aa, Mycobacterium
QAERASLPSPQPDPNHASPAGGG

SEQ ID NO: 1020898 - protein, 5 aa, Mycobacterium
QAERD

SEQ ID NO: 1020899 - protein, 6 aa, Mycobacterium
QAEREQ

SEQ ID NO: 1020900 - protein, 8 aa, Mycobacterium
QAERGNKI

SEQ ID NO: 1020901 - protein, 7 aa, Mycobacterium
QAERSAS

SEQ ID NO: 1020902 - protein, 12 aa, Mycobacterium
QAESAGLAPENG

SEQ ID NO: 1020903 - protein, 6 aa, Mycobacterium
QAFGSP

SEQ ID NO: 1020904 - protein, 4 aa, Mycobacterium
QAFR

SEQ ID NO: 1020905 - protein, 4 aa, Mycobacterium
QAGA

SEQ ID NO: 1020906 - protein, 6 aa, Mycobacterium
QAGAET

SEQ ID NO: 1020907 - protein, 6 aa, Mycobacterium
QAGDDA

SEQ ID NO: 1020908 - protein, 11 aa, Mycobacterium
QAGEKSHDSRC

SEQ ID NO: 1020909 - protein, 10 aa, Mycobacterium
QAGEPAPPMP

SEQ ID NO: 1020910 - protein, 7 aa, Mycobacterium
QAGESPR

SEQ ID NO: 1020911 - protein, 9 aa, Mycobacterium
QAGEVPADA

SEQ ID NO: 1020912 - protein, 9 aa, Mycobacterium
QAGGDPAEA

SEQ ID NO: 1020913 - protein, 16 aa, Mycobacterium
QAGHSAMQASAAAAAY

SEQ ID NO: 1020914 - protein, 7 aa, Mycobacterium
QAGKPGA

SEQ ID NO: 1020915 - protein, 5 aa, Mycobacterium
QAGNA

SEQ ID NO: 1020916 - protein, 6 aa, Mycobacterium
QAGPDE

SEQ ID NO: 1020917 - protein, 5 aa, Mycobacterium
QAGPE

SEQ ID NO: 1020918 - protein, 8 aa, Mycobacterium
QAGPVDSY

SEQ ID NO: 1020919 - protein, 9 aa, Mycobacterium
QAGRPAQIS

SEQ ID NO: 1020920 - protein, 12 aa, Mycobacterium
QAGSQPASEGSG

SEQ ID NO: 1020921 - protein, 18 aa, Mycobacterium
QAGTDCGGKVADDLSELD

SEQ ID NO: 1020922 - protein, 8 aa, Mycobacterium
QAGTPPKI

SEQ ID NO: 1020923 - protein, 14 aa, Mycobacterium
QAGTPTGSQPAGGQ

SEQ ID NO: 1020924 - protein, 7 aa, Mycobacterium
QAGTRAT

SEQ ID NO: 1020925 - protein, 14 aa, Mycobacterium
QAGYEGLSRTPAPV

SEQ ID NO: 1020926 - protein, 8 aa, Mycobacterium
QAHEDDAR

SEQ ID NO: 1020927 - protein, 4 aa, Mycobacterium
QAHG

SEQ ID NO: 1020928 - protein, 6 aa, Mycobacterium
QAHGAD

SEQ ID NO: 1020929 - protein, 9 aa, Mycobacterium
QAHTGGLGP

SEQ ID NO: 1020930 - protein, 4 aa, Mycobacterium
QAIA

SEQ ID NO: 1020931 - protein, 9 aa, Mycobacterium
QAIKGTPLE

SEQ ID NO: 1020932 - protein, 4 aa, Mycobacterium
QAIT

SEQ ID NO: 1020933 - protein, 10 aa, Mycobacterium
QAKGKDSGVT

SEQ ID NO: 1020934 - protein, 14 aa, Mycobacterium
QAKPASAGTPKGGT

SEQ ID NO: 1020935 - protein, 17 aa, Mycobacterium
QAKPTEVATLIREQLKT

SEQ ID NO: 1020936 - protein, 11 aa, Mycobacterium
QALGDKKGIRR

SEQ ID NO: 1020937 - protein, 8 aa, Mycobacterium
QALGPAER

SEQ ID NO: 1020938 - protein, 7 aa, Mycobacterium
QALGTGN

SEQ ID NO: 1020939 - protein, 10 aa, Mycobacterium
QALNPGGGAV

SEQ ID NO: 1020940 - protein, 7 aa, Mycobacterium
QALNSPG

SEQ ID NO: 1020941 - protein, 8 aa, Mycobacterium
QALPDTAN

SEQ ID NO: 1020942 - protein, 6 aa, Mycobacterium
QALSAG

SEQ ID NO: 1020943 - protein, 9 aa, Mycobacterium
QALSGLGDR

SEQ ID NO: 1020944 - protein, 4 aa, Mycobacterium
QAMT

SEQ ID NO: 1020945 - protein, 5 aa, Mycobacterium
QAMVP

SEQ ID NO: 1020946 - protein, 4 aa, Mycobacterium
QANA

SEQ ID NO: 1020947 - protein, 14 aa, Mycobacterium
QANEDYTDEFDPAK

SEQ ID NO: 1020948 - protein, 8 aa, Mycobacterium
QANERSDE

SEQ ID NO: 1020949 - protein, 7 aa, Mycobacterium
QANERTL

SEQ ID NO: 1020950 - protein, 7 aa, Mycobacterium
QANQEKA

SEQ ID NO: 1020951 - protein, 9 aa, Mycobacterium
QANYAASKA

SEQ ID NO: 1020952 - protein, 10 aa, Mycobacterium
QAPAAPLGDA

SEQ ID NO: 1020953 - protein, 4 aa, Mycobacterium
QAPD

SEQ ID NO: 1020954 - protein, 6 aa, Mycobacterium
QAPDKL

SEQ ID NO: 1020955 - protein, 8 aa, Mycobacterium
QAPDSGNA

SEQ ID NO: 1020956 - protein, 8 aa, Mycobacterium
QAPDTGNA

SEQ ID NO: 1020957 - protein, 7 aa, Mycobacterium
QAPERRR

SEQ ID NO: 1020958 - protein, 4 aa, Mycobacterium
QAPL

SEQ ID NO: 1020959 - protein, 8 aa, Mycobacterium
QAPLTETA

SEQ ID NO: 1020960 - protein, 4 aa, Mycobacterium
QAPP

SEQ ID NO: 1020961 - protein, 7 aa, Mycobacterium
QAPPARV

SEQ ID NO: 1020962 - protein, 7 aa, Mycobacterium
QAPPRGT

SEQ ID NO: 1020963 - protein, 4 aa, Mycobacterium
QAPS

SEQ ID NO: 1020964 - protein, 16 aa, Mycobacterium
QAPSDPTSLDDHPKAG

SEQ ID NO: 1020965 - protein, 10 aa, Mycobacterium
QAPTGSNSQG

SEQ ID NO: 1020966 - protein, 7 aa, Mycobacterium
QAPTRAL

SEQ ID NO: 1020967 - protein, 12 aa, Mycobacterium
QAPTTAHSAEKS

SEQ ID NO: 1020968 - protein, 7 aa, Mycobacterium
QAPVGTQ

SEQ ID NO: 1020969 - protein, 6 aa, Mycobacterium
QAQDVV

SEQ ID NO: 1020970 - protein, 4 aa, Mycobacterium
QAQE

SEQ ID NO: 1020971 - protein, 16 aa, Mycobacterium
QAQHPPEVIDGNWNPA

SEQ ID NO: 1020972 - protein, 9 aa, Mycobacterium
QAQNPRTNL

SEQ ID NO: 1020973 - protein, 8 aa, Mycobacterium
QAQPDDVS

SEQ ID NO: 1020974 - protein, 7 aa, Mycobacterium
QAQPTLD

SEQ ID NO: 1020975 - protein, 6 aa, Mycobacterium
QAQRRA

SEQ ID NO: 1020976 - protein, 4 aa, Mycobacterium
QAQT

SEQ ID NO: 1020977 - protein, 13 aa, Mycobacterium
QARADGVAPPVTP

SEQ ID NO: 1020978 - protein, 23 aa, Mycobacterium
QARAEGGEVIDPNPRRDGPAGGY

SEQ ID NO: 1020979 - protein, 9 aa, Mycobacterium
QARAERDAE

SEQ ID NO: 1020980 - protein, 12 aa, Mycobacterium
QARDNADGPIPP

SEQ ID NO: 1020981 - protein, 11 aa, Mycobacterium
QARDNTGTDPV

SEQ ID NO: 1020982 - protein, 7 aa, Mycobacterium
QARDTNF

SEQ ID NO: 1020983 - protein, 10 aa, Mycobacterium
QARDTQRSRR

SEQ ID NO: 1020984 - protein, 5 aa, Mycobacterium
QAREA

SEQ ID NO: 1020985 - protein, 10 aa, Mycobacterium
QAREAASQAT

SEQ ID NO: 1020986 - protein, 6 aa, Mycobacterium
QAREAE

SEQ ID NO: 1020987 - protein, 8 aa, Mycobacterium
QARERGEQ

SEQ ID NO: 1020988 - protein, 18 aa, Mycobacterium
QARGAGSPAHVELVHQLE

SEQ ID NO: 1020989 - protein, 13 aa, Mycobacterium
QARGEDAPWTGAT

SEQ ID NO: 1020990 - protein, 5 aa, Mycobacterium
QARGS

SEQ ID NO: 1020991 - protein, 19 aa, Mycobacterium
QARGYDVDKPRNLAKSVTV

SEQ ID NO: 1020992 - protein, 6 aa, Mycobacterium
QARGYR

SEQ ID NO: 1020993 - protein, 7 aa, Mycobacterium
QARHVDG

SEQ ID NO: 1020994 - protein, 4 aa, Mycobacterium
QARK

SEQ ID NO: 1020995 - protein, 6 aa, Mycobacterium
QARKDR

SEQ ID NO: 1020996 - protein, 8 aa, Mycobacterium
QARNAPQG

SEQ ID NO: 1020997 - protein, 20 aa, Mycobacterium
QARQTIKTASPPVLIRPRAE

SEQ ID NO: 1020998 - protein, 6 aa, Mycobacterium
QARRDR

SEQ ID NO: 1020999 - protein, 13 aa, Mycobacterium
QARRQESNAPQFD

SEQ ID NO: 1021000 - protein, 4 aa, Mycobacterium
QARS

SEQ ID NO: 1021001 - protein, 7 aa, Mycobacterium
QARSDRQ

SEQ ID NO: 1021002 - protein, 13 aa, Mycobacterium
QARSRNTSGASNS

SEQ ID NO: 1021003 - protein, 7 aa, Mycobacterium
QARTGMG

SEQ ID NO: 1021004 - protein, 19 aa, Mycobacterium
QARTRSGVDPRRLHRRAVS

SEQ ID NO: 1021005 - protein, 15 aa, Mycobacterium
QARWRDSAGEEHEAR

SEQ ID NO: 1021006 - protein, 11 aa, Mycobacterium
QASAAQRAGRC

SEQ ID NO: 1021007 - protein, 12 aa, Mycobacterium
QASAFRSGTDIS

SEQ ID NO: 1021008 - protein, 8 aa, Mycobacterium
QASDAAAL

SEQ ID NO: 1021009 - protein, 9 aa, Mycobacterium
QASDEQRRA

SEQ ID NO: 1021010 - protein, 14 aa, Mycobacterium
QASGLDDEAARARV

SEQ ID NO: 1021011 - protein, 7 aa, Mycobacterium
QASNDQL

SEQ ID NO: 1021012 - protein, 12 aa, Mycobacterium
QASQRSTPAADF

SEQ ID NO: 1021013 - protein, 4 aa, Mycobacterium
QASR

SEQ ID NO: 1021014 - protein, 9 aa, Mycobacterium
QASSRYPGG

SEQ ID NO: 1021015 - protein, 14 aa, Mycobacterium
QASTAVRPGPPPTV

SEQ ID NO: 1021016 - protein, 4 aa, Mycobacterium
QASV

SEQ ID NO: 1021017 - protein, 8 aa, Mycobacterium
QATAGAPA

SEQ ID NO: 1021018 - protein, 7 aa, Mycobacterium
QATARPA

SEQ ID NO: 1021019 - protein, 6 aa, Mycobacterium
QATDSV

SEQ ID NO: 1021020 - protein, 7 aa, Mycobacterium
QATEEVA

SEQ ID NO: 1021021 - protein, 5 aa, Mycobacterium
QATEP

SEQ ID NO: 1021022 - protein, 6 aa, Mycobacterium
QATETL

SEQ ID NO: 1021023 - protein, 6 aa, Mycobacterium
QATGGN

SEQ ID NO: 1021024 - protein, 7 aa, Mycobacterium
QATIATT

SEQ ID NO: 1021025 - protein, 13 aa, Mycobacterium
QATLEDNSRTGEQ

SEQ ID NO: 1021026 - protein, 10 aa, Mycobacterium
QATNGHNPRE

SEQ ID NO: 1021027 - protein, 4 aa, Mycobacterium
QATP

SEQ ID NO: 1021028 - protein, 18 aa, Mycobacterium
QATPELRREDRDQSMPAR

SEQ ID NO: 1021029 - protein, 7 aa, Mycobacterium
QATTSLP

SEQ ID NO: 1021030 - protein, 6 aa, Mycobacterium
QATYDI

SEQ ID NO: 1021031 - protein, 10 aa, Mycobacterium
QAVGDTQSAV

SEQ ID NO: 1021032 - protein, 7 aa, Mycobacterium
QAVNEGM

SEQ ID NO: 1021033 - protein, 16 aa, Mycobacterium
QAVPDESSRLPENQGS

SEQ ID NO: 1021034 - protein, 10 aa, Mycobacterium
QAVSGSGVAG

SEQ ID NO: 1021035 - protein, 6 aa, Mycobacterium
QAWRRG

SEQ ID NO: 1021036 - protein, 7 aa, Mycobacterium
QAYGADV

SEQ ID NO: 1021037 - protein, 4 aa, Mycobacterium
QAYS

SEQ ID NO: 1021038 - protein, 6 aa, Mycobacterium
QAYSSA

SEQ ID NO: 1021039 - protein, 7 aa, Mycobacterium
QCDEAEQ

SEQ ID NO: 1021040 - protein, 8 aa, Mycobacterium
QCGSSQQS

SEQ ID NO: 1021041 - protein, 4 aa, Mycobacterium
QCPP

SEQ ID NO: 1021042 - protein, 4 aa, Mycobacterium
QCPQ

SEQ ID NO: 1021043 - protein, 9 aa, Mycobacterium
QCRGQVEGS

SEQ ID NO: 1021044 - protein, 11 aa, Mycobacterium
QCTPGRDPTTL

SEQ ID NO: 1021045 - protein, 17 aa, Mycobacterium
QCTPQPLGADPPPHDRA

SEQ ID NO: 1021046 - protein, 5 aa, Mycobacterium
QCTVS

SEQ ID NO: 1021047 - protein, 8 aa, Mycobacterium
QDAEARAY

SEQ ID NO: 1021048 - protein, 6 aa, Mycobacterium
QDAELA

SEQ ID NO: 1021049 - protein, 9 aa, Mycobacterium
QDAGDDTVD

SEQ ID NO: 1021050 - protein, 6 aa, Mycobacterium
QDAGGE

SEQ ID NO: 1021051 - protein, 8 aa, Mycobacterium
QDANGATL

SEQ ID NO: 1021052 - protein, 7 aa, Mycobacterium
QDAPRRP

SEQ ID NO: 1021053 - protein, 8 aa, Mycobacterium
QDARAAGK

SEQ ID NO: 1021054 - protein, 10 aa, Mycobacterium
QDARLTPEQQ

SEQ ID NO: 1021055 - protein, 8 aa, Mycobacterium
QDATPPAA

SEQ ID NO: 1021056 - protein, 8 aa, Mycobacterium
QDDDHSVA

SEQ ID NO: 1021057 - protein, 9 aa, Mycobacterium
QDDGRPGVL

SEQ ID NO: 1021058 - protein, 20 aa, Mycobacterium
QDDPEATVTAGNASGQNDAA

SEQ ID NO: 1021059 - protein, 7 aa, Mycobacterium
QDEADER

SEQ ID NO: 1021060 - protein, 14 aa, Mycobacterium
QDEAKRLAGEVDRR

SEQ ID NO: 1021061 - protein, 7 aa, Mycobacterium
QDEFDDV

SEQ ID NO: 1021062 - protein, 7 aa, Mycobacterium
QDEKDAE

SEQ ID NO: 1021063 - protein, 5 aa, Mycobacterium
QDELA

SEQ ID NO: 1021064 - protein, 12 aa, Mycobacterium
QDERPAPDAAVS

SEQ ID NO: 1021065 - protein, 5 aa, Mycobacterium
QDEVS

SEQ ID NO: 1021066 - protein, 6 aa, Mycobacterium
QDEVSQ

SEQ ID NO: 1021067 - protein, 5 aa, Mycobacterium
QDGGA

SEQ ID NO: 1021068 - protein, 6 aa, Mycobacterium
QDGGTA

SEQ ID NO: 1021069 - protein, 4 aa, Mycobacterium
QDGL

SEQ ID NO: 1021070 - protein, 11 aa, Mycobacterium
QDGRGGGGQGM

SEQ ID NO: 1021071 - protein, 8 aa, Mycobacterium
QDGRKSPD

SEQ ID NO: 1021072 - protein, 7 aa, Mycobacterium
QDGYGLP

SEQ ID NO: 1021073 - protein, 13 aa, Mycobacterium
QDHARAADAPDEV

SEQ ID NO: 1021074 - protein, 28 aa, Mycobacterium
QDHGAGRAAAASTRAGGGGPTGAHGSTS

SEQ ID NO: 1021075 - protein, 5 aa, Mycobacterium
QDKGV

SEQ ID NO: 1021076 - protein, 8 aa, Mycobacterium
QDKHGTAY

SEQ ID NO: 1021077 - protein, 11 aa, Mycobacterium
QDKKHRGREPI

SEQ ID NO: 1021078 - protein, 11 aa, Mycobacterium
QDLPPDRPTEI

SEQ ID NO: 1021079 - protein, 13 aa, Mycobacterium
QDNDMQAPPAPGG

SEQ ID NO: 1021080 - protein, 5 aa, Mycobacterium
QDNNI

SEQ ID NO: 1021081 - protein, 20 aa, Mycobacterium
QDNPAGPAGEPDWPAYQDGD

SEQ ID NO: 1021082 - protein, 10 aa, Mycobacterium
QDNPKEDPRS

SEQ ID NO: 1021083 - protein, 14 aa, Mycobacterium
QDNPRRSVRLSFLE

SEQ ID NO: 1021084 - protein, 5 aa, Mycobacterium
QDPAP

SEQ ID NO: 1021085 - protein, 5 aa, Mycobacterium
QDPDR

SEQ ID NO: 1021086 - protein, 9 aa, Mycobacterium
QDPGVPDGR

SEQ ID NO: 1021087 - protein, 5 aa, Mycobacterium
QDPHE

SEQ ID NO: 1021088 - protein, 11 aa, Mycobacterium
QDPHNSDRRFT

SEQ ID NO: 1021089 - protein, 12 aa, Mycobacterium
QDPIPARGQGPD

SEQ ID NO: 1021090 - protein, 12 aa, Mycobacterium
QDPKAVADRHGA

SEQ ID NO: 1021091 - protein, 8 aa, Mycobacterium
QDPRRGVG

SEQ ID NO: 1021092 - protein, 5 aa, Mycobacterium
QDPRS

SEQ ID NO: 1021093 - protein, 7 aa, Mycobacterium
QDPSDPG

SEQ ID NO: 1021094 - protein, 6 aa, Mycobacterium
QDPSVA

SEQ ID NO: 1021095 - protein, 9 aa, Mycobacterium
QDPTGKGEA

SEQ ID NO: 1021096 - protein, 7 aa, Mycobacterium
QDPTQSA

SEQ ID NO: 1021097 - protein, 16 aa, Mycobacterium
QDPTSKMSKSASTDAG

SEQ ID NO: 1021098 - protein, 16 aa, Mycobacterium
QDQNLQDGPHKDLRRA

SEQ ID NO: 1021099 - protein, 4 aa, Mycobacterium
QDQV

SEQ ID NO: 1021100 - protein, 12 aa, Mycobacterium
QDREAARGTPER

SEQ ID NO: 1021101 - protein, 8 aa, Mycobacterium
QDREPGRP

SEQ ID NO: 1021102 - protein, 10 aa, Mycobacterium
QDRRGAAEPL

SEQ ID NO: 1021103 - protein, 6 aa, Mycobacterium
QDRSAA

SEQ ID NO: 1021104 - protein, 12 aa, Mycobacterium
QDRTYKPPPDQC

SEQ ID NO: 1021105 - protein, 8 aa, Mycobacterium
QDSGGNLT

SEQ ID NO: 1021106 - protein, 17 aa, Mycobacterium
QDSIKGASTDTSFPAKQ

SEQ ID NO: 1021107 - protein, 8 aa, Mycobacterium
QDSTCDHA

SEQ ID NO: 1021108 - protein, 8 aa, Mycobacterium
QDSTGRVT

SEQ ID NO: 1021109 - protein, 4 aa, Mycobacterium
QDSV

SEQ ID NO: 1021110 - protein, 8 aa, Mycobacterium
QDTAAGGD

SEQ ID NO: 1021111 - protein, 18 aa, Mycobacterium
QDTADRLTSTAKAESDKM

SEQ ID NO: 1021112 - protein, 8 aa, Mycobacterium
QDTGHSQR

SEQ ID NO: 1021113 - protein, 11 aa, Mycobacterium
QDTGNRNSETH

SEQ ID NO: 1021114 - protein, 5 aa, Mycobacterium
QDTLG

SEQ ID NO: 1021115 - protein, 5 aa, Mycobacterium
QDTNH

SEQ ID NO: 1021116 - protein, 8 aa, Mycobacterium
QDTTPEGY

SEQ ID NO: 1021117 - protein, 8 aa, Mycobacterium
QDVPEPLS

SEQ ID NO: 1021118 - protein, 11 aa, Mycobacterium
QDWEPGQSQLT

SEQ ID NO: 1021119 - protein, 5 aa, Mycobacterium
QDWQP

SEQ ID NO: 1021120 - protein, 9 aa, Mycobacterium
QEAGADPAL

SEQ ID NO: 1021121 - protein, 7 aa, Mycobacterium
QEAGAQT

SEQ ID NO: 1021122 - protein, 6 aa, Mycobacterium
QEAGYD

SEQ ID NO: 1021123 - protein, 12 aa, Mycobacterium
QEAIEGDRVPGA

SEQ ID NO: 1021124 - protein, 8 aa, Mycobacterium
QEATDGSH

SEQ ID NO: 1021125 - protein, 7 aa, Mycobacterium
QEATGGV

SEQ ID NO: 1021126 - protein, 5 aa, Mycobacterium
QECGA

SEQ ID NO: 1021127 - protein, 9 aa, Mycobacterium
QEDGRRSYS

SEQ ID NO: 1021128 - protein, 4 aa, Mycobacterium
QEDQ

SEQ ID NO: 1021129 - protein, 11 aa, Mycobacterium
QEEAEGGTETF

SEQ ID NO: 1021130 - protein, 7 aa, Mycobacterium
QEEGEDV

SEQ ID NO: 1021131 - protein, 10 aa, Mycobacterium
QEEGLPPCQP

SEQ ID NO: 1021132 - protein, 5 aa, Mycobacterium
QEERG

SEQ ID NO: 1021133 - protein, 7 aa, Mycobacterium
QEGIKEQ

SEQ ID NO: 1021134 - protein, 4 aa, Mycobacterium
QEGL

SEQ ID NO: 1021135 - protein, 5 aa, Mycobacterium
QEGSG

SEQ ID NO: 1021136 - protein, 7 aa, Mycobacterium
QEGVNDG

SEQ ID NO: 1021137 - protein, 8 aa, Mycobacterium
QEGVSASA

SEQ ID NO: 1021138 - protein, 15 aa, Mycobacterium
QEHSHPGGGLPSYPH

SEQ ID NO: 1021139 - protein, 5 aa, Mycobacterium
QEHVS

SEQ ID NO: 1021140 - protein, 8 aa, Mycobacterium
QEISTQQA

SEQ ID NO: 1021141 - protein, 10 aa, Mycobacterium
QEKAGRDAGE

SEQ ID NO: 1021142 - protein, 8 aa, Mycobacterium
QEKDNATW

SEQ ID NO: 1021143 - protein, 16 aa, Mycobacterium
QELADASGATVKTGAE

SEQ ID NO: 1021144 - protein, 15 aa, Mycobacterium
QELNGGKRAAAPNSA

SEQ ID NO: 1021145 - protein, 5 aa, Mycobacterium
QELRP

SEQ ID NO: 1021146 - protein, 8 aa, Mycobacterium
QELTSPKQ

SEQ ID NO: 1021147 - protein, 6 aa, Mycobacterium
QENQRA

SEQ ID NO: 1021148 - protein, 12 aa, Mycobacterium
QEPASGQPARIP

SEQ ID NO: 1021149 - protein, 12 aa, Mycobacterium
QEPDDVASSGRV

SEQ ID NO: 1021150 - protein, 5 aa, Mycobacterium
QEPGA

SEQ ID NO: 1021151 - protein, 10 aa, Mycobacterium
QEPPNVTEPA

SEQ ID NO: 1021152 - protein, 7 aa, Mycobacterium
QEPSHDD

SEQ ID NO: 1021153 - protein, 8 aa, Mycobacterium
QEPTEMGP

SEQ ID NO: 1021154 - protein, 4 aa, Mycobacterium
QEPY

SEQ ID NO: 1021155 - protein, 9 aa, Mycobacterium
QEQAAAASE

SEQ ID NO: 1021156 - protein, 7 aa, Mycobacterium
QEQANAE

SEQ ID NO: 1021157 - protein, 5 aa, Mycobacterium
QEQGA

SEQ ID NO: 1021158 - protein, 10 aa, Mycobacterium
QEQYGPHPSG

SEQ ID NO: 1021159 - protein, 8 aa, Mycobacterium
QEQYSADP

SEQ ID NO: 1021160 - protein, 6 aa, Mycobacterium
QERANR

SEQ ID NO: 1021161 - protein, 6 aa, Mycobacterium
QERERL

SEQ ID NO: 1021162 - protein, 25 aa, Mycobacterium
QERGANGAGGVRAPSDDSKPTDVGA

SEQ ID NO: 1021163 - protein, 5 aa, Mycobacterium
QERGV

SEQ ID NO: 1021164 - protein, 17 aa, Mycobacterium
QERHAPRPRVDHSRGSR

SEQ ID NO: 1021165 - protein, 7 aa, Mycobacterium
QERLPDG

SEQ ID NO: 1021166 - protein, 7 aa, Mycobacterium
QERPHDA

SEQ ID NO: 1021167 - protein, 8 aa, Mycobacterium
QERRPNKR

SEQ ID NO: 1021168 - protein, 15 aa, Mycobacterium
QERSDPNFSIGPTCW

SEQ ID NO: 1021169 - protein, 8 aa, Mycobacterium
QERYADAR

SEQ ID NO: 1021170 - protein, 12 aa, Mycobacterium
QESASGKTGTDI

SEQ ID NO: 1021171 - protein, 6 aa, Mycobacterium
QESDGG

SEQ ID NO: 1021172 - protein, 4 aa, Mycobacterium
QESR

SEQ ID NO: 1021173 - protein, 13 aa, Mycobacterium
QESRADEGSSNVA

SEQ ID NO: 1021174 - protein, 14 aa, Mycobacterium
QESTTPERRAGGAI

SEQ ID NO: 1021175 - protein, 8 aa, Mycobacterium
QETDGSGA

SEQ ID NO: 1021176 - protein, 7 aa, Mycobacterium
QETGQTV

SEQ ID NO: 1021177 - protein, 4 aa, Mycobacterium
QETR

SEQ ID NO: 1021178 - protein, 8 aa, Mycobacterium
QEVEGGTV

SEQ ID NO: 1021179 - protein, 14 aa, Mycobacterium
QEVSNTWQDTESWT

SEQ ID NO: 1021180 - protein, 13 aa, Mycobacterium
QEVTPEQAGAHPT

SEQ ID NO: 1021181 - protein, 11 aa, Mycobacterium
QEWDPEQSKLS

SEQ ID NO: 1021182 - protein, 5 aa, Mycobacterium
QEYRG

SEQ ID NO: 1021183 - protein, 7 aa, Mycobacterium
QFAPAGT

SEQ ID NO: 1021184 - protein, 13 aa, Mycobacterium
QFDGYTSGTTKDF

SEQ ID NO: 1021185 - protein, 13 aa, Mycobacterium
QFDPSSGGIGAYD

SEQ ID NO: 1021186 - protein, 6 aa, Mycobacterium
QFGEPY

SEQ ID NO: 1021187 - protein, 5 aa, Mycobacterium
QFGKP

SEQ ID NO: 1021188 - protein, 6 aa, Mycobacterium
QFKRPD

SEQ ID NO: 1021189 - protein, 8 aa, Mycobacterium
QFNRTKRR

SEQ ID NO: 1021190 - protein, 17 aa, Mycobacterium
QFNTPSTTTVEFASQVC

SEQ ID NO: 1021191 - protein, 4 aa, Mycobacterium
QFPG

SEQ ID NO: 1021192 - protein, 6 aa, Mycobacterium
QFPYTT

SEQ ID NO: 1021193 - protein, 10 aa, Mycobacterium
QFRASNDDIA

SEQ ID NO: 1021194 - protein, 6 aa, Mycobacterium
QFRDTE

SEQ ID NO: 1021195 - protein, 4 aa, Mycobacterium
QFRP

SEQ ID NO: 1021196 - protein, 5 aa, Mycobacterium
QFTST

SEQ ID NO: 1021197 - protein, 5 aa, Mycobacterium
QGAAR

SEQ ID NO: 1021198 - protein, 5 aa, Mycobacterium
QGAAT

SEQ ID NO: 1021199 - protein, 6 aa, Mycobacterium
QGADGV

SEQ ID NO: 1021200 - protein, 10 aa, Mycobacterium
QGAEGPGELR

SEQ ID NO: 1021201 - protein, 4 aa, Mycobacterium
QGAG

SEQ ID NO: 1021202 - protein, 15 aa, Mycobacterium
QGAGHAASGYAHATG

SEQ ID NO: 1021203 - protein, 13 aa, Mycobacterium
QGAHVTDEQGTRE

SEQ ID NO: 1021204 - protein, 13 aa, Mycobacterium
QGAKPGEGGQLPG

SEQ ID NO: 1021205 - protein, 6 aa, Mycobacterium
QGALGD

SEQ ID NO: 1021206 - protein, 7 aa, Mycobacterium
QGAPAAN

SEQ ID NO: 1021207 - protein, 19 aa, Mycobacterium
QGAPAGHEKRCTRMCQSCV

SEQ ID NO: 1021208 - protein, 7 aa, Mycobacterium
QGAPEDI

SEQ ID NO: 1021209 - protein, 7 aa, Mycobacterium
QGAPEDL

SEQ ID NO: 1021210 - protein, 4 aa, Mycobacterium
QGAQ

SEQ ID NO: 1021211 - protein, 9 aa, Mycobacterium
QGARLARTG

SEQ ID NO: 1021212 - protein, 6 aa, Mycobacterium
QGARPL

SEQ ID NO: 1021213 - protein, 8 aa, Mycobacterium
QGASEERI

SEQ ID NO: 1021214 - protein, 8 aa, Mycobacterium
QGATQHGL

SEQ ID NO: 1021215 - protein, 5 aa, Mycobacterium
QGATY

SEQ ID NO: 1021216 - protein, 10 aa, Mycobacterium
QGDAGPAAKP

SEQ ID NO: 1021217 - protein, 12 aa, Mycobacterium
QGDALAQAKPHA

SEQ ID NO: 1021218 - protein, 7 aa, Mycobacterium
QGDTAPM

SEQ ID NO: 1021219 - protein, 7 aa, Mycobacterium
QGDTASL

SEQ ID NO: 1021220 - protein, 5 aa, Mycobacterium
QGEGQ

SEQ ID NO: 1021221 - protein, 9 aa, Mycobacterium
QGEHSGADG

SEQ ID NO: 1021222 - protein, 5 aa, Mycobacterium
QGEPA

SEQ ID NO: 1021223 - protein, 6 aa, Mycobacterium
QGERAA

SEQ ID NO: 1021224 - protein, 4 aa, Mycobacterium
QGET

SEQ ID NO: 1021225 - protein, 7 aa, Mycobacterium
QGETDQL

SEQ ID NO: 1021226 - protein, 13 aa, Mycobacterium
QGEVGPGGGPSGD

SEQ ID NO: 1021227 - protein, 12 aa, Mycobacterium
QGFPDEDGPPAM

SEQ ID NO: 1021228 - protein, 11 aa, Mycobacterium
QGFRASQAGFA

SEQ ID NO: 1021229 - protein, 29 aa, Mycobacterium
QGGAGGTGGAAVGAGNHGGNGGDGGTGAL

SEQ ID NO: 1021230 - protein, 10 aa, Mycobacterium
QGGDHGGADQ

SEQ ID NO: 1021231 - protein, 6 aa, Mycobacterium
QGGEGL

SEQ ID NO: 1021232 - protein, 6 aa, Mycobacterium
QGGELA

SEQ ID NO: 1021233 - protein, 5 aa, Mycobacterium
QGGFD

SEQ ID NO: 1021234 - protein, 6 aa, Mycobacterium
QGGGIR

SEQ ID NO: 1021235 - protein, 16 aa, Mycobacterium
QGGIGQPLRRAAGRDH

SEQ ID NO: 1021236 - protein, 10 aa, Mycobacterium
QGGQGVRSIS

SEQ ID NO: 1021237 - protein, 7 aa, Mycobacterium
QGGQYPG

SEQ ID NO: 1021238 - protein, 6 aa, Mycobacterium
QGGRTE

SEQ ID NO: 1021239 - protein, 7 aa, Mycobacterium
QGGSAGG

SEQ ID NO: 1021240 - protein, 7 aa, Mycobacterium
QGGTSYT

SEQ ID NO: 1021241 - protein, 7 aa, Mycobacterium
QGGVATS

SEQ ID NO: 1021242 - protein, 5 aa, Mycobacterium
QGGVN

SEQ ID NO: 1021243 - protein, 7 aa, Mycobacterium
QGHDATV

SEQ ID NO: 1021244 - protein, 9 aa, Mycobacterium
QGHDPQLER

SEQ ID NO: 1021245 - protein, 11 aa, Mycobacterium
QGHPQRKDYPL

SEQ ID NO: 1021246 - protein, 5 aa, Mycobacterium
QGIRG

SEQ ID NO: 1021247 - protein, 4 aa, Mycobacterium
QGIS

SEQ ID NO: 1021248 - protein, 7 aa, Mycobacterium
QGKDGKR

SEQ ID NO: 1021249 - protein, 13 aa, Mycobacterium
QGKGTNGDSASIP

SEQ ID NO: 1021250 - protein, 6 aa, Mycobacterium
QGLRDT

SEQ ID NO: 1021251 - protein, 9 aa, Mycobacterium
QGLSTQAQQ

SEQ ID NO: 1021252 - protein, 5 aa, Mycobacterium
QGLTV

SEQ ID NO: 1021253 - protein, 9 aa, Mycobacterium
QGMDAGRDY

SEQ ID NO: 1021254 - protein, 18 aa, Mycobacterium
QGMESGGFGGPKPNPYME

SEQ ID NO: 1021255 - protein, 9 aa, Mycobacterium
QGMRNHAKT

SEQ ID NO: 1021256 - protein, 6 aa, Mycobacterium
QGMTEP

SEQ ID NO: 1021257 - protein, 12 aa, Mycobacterium
QGNAAAASPTIN

SEQ ID NO: 1021258 - protein, 15 aa, Mycobacterium
QGNFGSPGNDPPAAM

SEQ ID NO: 1021259 - protein, 6 aa, Mycobacterium
QGNSAT

SEQ ID NO: 1021260 - protein, 12 aa, Mycobacterium
QGNSIESAEEAE

SEQ ID NO: 1021261 - protein, 9 aa, Mycobacterium
QGPAPAPVT

SEQ ID NO: 1021262 - protein, 6 aa, Mycobacterium
QGPARA

SEQ ID NO: 1021263 - protein, 7 aa, Mycobacterium
QGPATPW

SEQ ID NO: 1021264 - protein, 7 aa, Mycobacterium
QGPDALA

SEQ ID NO: 1021265 - protein, 17 aa, Mycobacterium
QGPELSPAGRRGTDDEV

SEQ ID NO: 1021266 - protein, 22 aa, Mycobacterium
QGPGAGGHRGTFAPDTEPGEES

SEQ ID NO: 1021267 - protein, 9 aa, Mycobacterium
QGPGGAGVE

SEQ ID NO: 1021268 - protein, 7 aa, Mycobacterium
QGPITSA

SEQ ID NO: 1021269 - protein, 4 aa, Mycobacterium
QGPK

SEQ ID NO: 1021270 - protein, 8 aa, Mycobacterium
QGPPRTVG

SEQ ID NO: 1021271 - protein, 7 aa, Mycobacterium
QGPRDSG

SEQ ID NO: 1021272 - protein, 7 aa, Mycobacterium
QGPRSTE

SEQ ID NO: 1021273 - protein, 9 aa, Mycobacterium
QGPYSAAKA

SEQ ID NO: 1021274 - protein, 9 aa, Mycobacterium
QGQAGKLPD

SEQ ID NO: 1021275 - protein, 8 aa, Mycobacterium
QGQAYQEL

SEQ ID NO: 1021276 - protein, 4 aa, Mycobacterium
QGQP

SEQ ID NO: 1021277 - protein, 9 aa, Mycobacterium
QGQQAPSGH

SEQ ID NO: 1021278 - protein, 4 aa, Mycobacterium
QGQR

SEQ ID NO: 1021279 - protein, 34 aa, Mycobacterium
QGQRDPRRQRRGRSADQWRTHRGGRHRGRPDRGF

SEQ ID NO: 1021280 - protein, 9 aa, Mycobacterium
QGQSPSRDE

SEQ ID NO: 1021281 - protein, 7 aa, Mycobacterium
QGQTDSE

SEQ ID NO: 1021282 - protein, 6 aa, Mycobacterium
QGQTLD

SEQ ID NO: 1021283 - protein, 7 aa, Mycobacterium
QGRAGHG

SEQ ID NO: 1021284 - protein, 7 aa, Mycobacterium
QGRAGSR

SEQ ID NO: 1021285 - protein, 16 aa, Mycobacterium
QGRDRSGRGVQAPRRR

SEQ ID NO: 1021286 - protein, 11 aa, Mycobacterium
QGRGDAAEQTI

SEQ ID NO: 1021287 - protein, 5 aa, Mycobacterium
QGRGG

SEQ ID NO: 1021288 - protein, 5 aa, Mycobacterium
QGRGV

SEQ ID NO: 1021289 - protein, 8 aa, Mycobacterium
QGRPGYRE

SEQ ID NO: 1021290 - protein, 5 aa, Mycobacterium
QGRPL

SEQ ID NO: 1021291 - protein, 7 aa, Mycobacterium
QGRQVDD

SEQ ID NO: 1021292 - protein, 5 aa, Mycobacterium
QGSDI

SEQ ID NO: 1021293 - protein, 7 aa, Mycobacterium
QGSEIAE

SEQ ID NO: 1021294 - protein, 7 aa, Mycobacterium
QGSEVDE

SEQ ID NO: 1021295 - protein, 6 aa, Mycobacterium
QGSGEL

SEQ ID NO: 1021296 - protein, 7 aa, Mycobacterium
QGSGGPA

SEQ ID NO: 1021297 - protein, 6 aa, Mycobacterium
QGSGKS

SEQ ID NO: 1021298 - protein, 6 aa, Mycobacterium
QGSIRR

SEQ ID NO: 1021299 - protein, 13 aa, Mycobacterium
QGSKHQVEAGPQS

SEQ ID NO: 1021300 - protein, 7 aa, Mycobacterium
QGSPANG

SEQ ID NO: 1021301 - protein, 11 aa, Mycobacterium
QGSPGAPTPTL

SEQ ID NO: 1021302 - protein, 21 aa, Mycobacterium
QGSSRDAFDAEARTASEKDVK

SEQ ID NO: 1021303 - protein, 5 aa, Mycobacterium
QGSTD

SEQ ID NO: 1021304 - protein, 6 aa, Mycobacterium
QGSYQA

SEQ ID NO: 1021305 - protein, 4 aa, Mycobacterium
QGTE

SEQ ID NO: 1021306 - protein, 4 aa, Mycobacterium
QGTG

SEQ ID NO: 1021307 - protein, 12 aa, Mycobacterium
QGTGEGATFPRS

SEQ ID NO: 1021308 - protein, 20 aa, Mycobacterium
QGTKEYSTQNASGSTSGPFY

SEQ ID NO: 1021309 - protein, 6 aa, Mycobacterium
QGTPVN

SEQ ID NO: 1021310 - protein, 8 aa, Mycobacterium
QGTQVPNE

SEQ ID NO: 1021311 - protein, 4 aa, Mycobacterium
QGTS

SEQ ID NO: 1021312 - protein, 8 aa, Mycobacterium
QGTVRTDS

SEQ ID NO: 1021313 - protein, 9 aa, Mycobacterium
QGVEPPRPL

SEQ ID NO: 1021314 - protein, 4 aa, Mycobacterium
QGVG

SEQ ID NO: 1021315 - protein, 12 aa, Mycobacterium
QGVGDDTAESLA

SEQ ID NO: 1021316 - protein, 13 aa, Mycobacterium
QGVGGAGGAGGKL

SEQ ID NO: 1021317 - protein, 8 aa, Mycobacterium
QGVKTKRQ

SEQ ID NO: 1021318 - protein, 6 aa, Mycobacterium
QGVRNG

SEQ ID NO: 1021319 - protein, 4 aa, Mycobacterium
QGWN

SEQ ID NO: 1021320 - protein, 5 aa, Mycobacterium
QGWRR

SEQ ID NO: 1021321 - protein, 12 aa, Mycobacterium
QGYGRQKGHTEV

SEQ ID NO: 1021322 - protein, 5 aa, Mycobacterium
QGYKD

SEQ ID NO: 1021323 - protein, 6 aa, Mycobacterium
QGYQSI

SEQ ID NO: 1021324 - protein, 5 aa, Mycobacterium
QGYRA

SEQ ID NO: 1021325 - protein, 9 aa, Mycobacterium
QGYSDSQGI

SEQ ID NO: 1021326 - protein, 7 aa, Mycobacterium
QGYTPNF

SEQ ID NO: 1021327 - protein, 5 aa, Mycobacterium
QHAGD

SEQ ID NO: 1021328 - protein, 25 aa, Mycobacterium
QHAGGTEDIEGVPPQIQATPGMPER

SEQ ID NO: 1021329 - protein, 4 aa, Mycobacterium
QHDP

SEQ ID NO: 1021330 - protein, 7 aa, Mycobacterium
QHEDARA

SEQ ID NO: 1021331 - protein, 12 aa, Mycobacterium
QHEHDRDRCATP

SEQ ID NO: 1021332 - protein, 6 aa, Mycobacterium
QHFGSA

SEQ ID NO: 1021333 - protein, 5 aa, Mycobacterium
QHGAP

SEQ ID NO: 1021334 - protein, 11 aa, Mycobacterium
QHGGDTDFSGS

SEQ ID NO: 1021335 - protein, 5 aa, Mycobacterium
QHGGV

SEQ ID NO: 1021336 - protein, 17 aa, Mycobacterium
QHGKPVADGFAEVAVLN

SEQ ID NO: 1021337 - protein, 6 aa, Mycobacterium
QHGNRE

SEQ ID NO: 1021338 - protein, 6 aa, Mycobacterium
QHGPAT

SEQ ID NO: 1021339 - protein, 17 aa, Mycobacterium
QHGRGSRAGKPDGRGAD

SEQ ID NO: 1021340 - protein, 9 aa, Mycobacterium
QHGRPDKKV

SEQ ID NO: 1021341 - protein, 22 aa, Mycobacterium
QHGRTRFAPPPAANGARSALTS

SEQ ID NO: 1021342 - protein, 8 aa, Mycobacterium
QHGTGTAK

SEQ ID NO: 1021343 - protein, 7 aa, Mycobacterium
QHIGPDR

SEQ ID NO: 1021344 - protein, 8 aa, Mycobacterium
QHNTNPAG

SEQ ID NO: 1021345 - protein, 5 aa, Mycobacterium
QHPAS

SEQ ID NO: 1021346 - protein, 7 aa, Mycobacterium
QHPDGDW

SEQ ID NO: 1021347 - protein, 9 aa, Mycobacterium
QHPDPAVSR

SEQ ID NO: 1021348 - protein, 9 aa, Mycobacterium
QHPDTPGLA

SEQ ID NO: 1021349 - protein, 8 aa, Mycobacterium
QHPPYPRG

SEQ ID NO: 1021350 - protein, 5 aa, Mycobacterium
QHPTD

SEQ ID NO: 1021351 - protein, 8 aa, Mycobacterium
QHQRGRGV

SEQ ID NO: 1021352 - protein, 8 aa, Mycobacterium
QHRANGKA

SEQ ID NO: 1021353 - protein, 14 aa, Mycobacterium
QHRAQIAEEYRAAD

SEQ ID NO: 1021354 - protein, 10 aa, Mycobacterium
QHRHDGPRAA

SEQ ID NO: 1021355 - protein, 19 aa, Mycobacterium
QHRNPGARAGPHPRAGPSG

SEQ ID NO: 1021356 - protein, 7 aa, Mycobacterium
QHRSTPA

SEQ ID NO: 1021357 - protein, 4 aa, Mycobacterium
QHRT

SEQ ID NO: 1021358 - protein, 11 aa, Mycobacterium
QHSPAPGHTAS

SEQ ID NO: 1021359 - protein, 4 aa, Mycobacterium
QHTD

SEQ ID NO: 1021360 - protein, 11 aa, Mycobacterium
QHTDKAPPVRT

SEQ ID NO: 1021361 - protein, 5 aa, Mycobacterium
QHTHP

SEQ ID NO: 1021362 - protein, 7 aa, Mycobacterium
QHTTVSD

SEQ ID NO: 1021363 - protein, 5 aa, Mycobacterium
QIAGA

SEQ ID NO: 1021364 - protein, 10 aa, Mycobacterium
QIDAEAPGAR

SEQ ID NO: 1021365 - protein, 7 aa, Mycobacterium
QIDPSAG

SEQ ID NO: 1021366 - protein, 10 aa, Mycobacterium
QIEPSAFTED

SEQ ID NO: 1021367 - protein, 5 aa, Mycobacterium
QIESN

SEQ ID NO: 1021368 - protein, 30 aa, Mycobacterium
QIESNTSVSPAPPGPGSTTTPVSTGPPEVI

SEQ ID NO: 1021369 - protein, 4 aa, Mycobacterium
QIGD

SEQ ID NO: 1021370 - protein, 6 aa, Mycobacterium
QIGGTP

SEQ ID NO: 1021371 - protein, 7 aa, Mycobacterium
QIGPESE

SEQ ID NO: 1021372 - protein, 10 aa, Mycobacterium
QIGPGRSGLS

SEQ ID NO: 1021373 - protein, 6 aa, Mycobacterium
QIGQTG

SEQ ID NO: 1021374 - protein, 14 aa, Mycobacterium
QIGTDGTPYAAPRT

SEQ ID NO: 1021375 - protein, 8 aa, Mycobacterium
QINGVPRE

SEQ ID NO: 1021376 - protein, 8 aa, Mycobacterium
QIPAADAS

SEQ ID NO: 1021377 - protein, 9 aa, Mycobacterium
QIPPSAFTE

SEQ ID NO: 1021378 - protein, 4 aa, Mycobacterium
QIRP

SEQ ID NO: 1021379 - protein, 7 aa, Mycobacterium
QISDGAS

SEQ ID NO: 1021380 - protein, 8 aa, Mycobacterium
QISDPAER

SEQ ID NO: 1021381 - protein, 26 aa, Mycobacterium
QISGGSYQNLSTSASLDLATAINTFL

SEQ ID NO: 1021382 - protein, 12 aa, Mycobacterium
QISGPSHGREKP

SEQ ID NO: 1021383 - protein, 5 aa, Mycobacterium
QITAG

SEQ ID NO: 1021384 - protein, 6 aa, Mycobacterium
QITGRD

SEQ ID NO: 1021385 - protein, 4 aa, Mycobacterium
QITN

SEQ ID NO: 1021386 - protein, 6 aa, Mycobacterium
QKAAGA

SEQ ID NO: 1021387 - protein, 13 aa, Mycobacterium
QKADAPSGTATRT

SEQ ID NO: 1021388 - protein, 7 aa, Mycobacterium
QKAGDAS

SEQ ID NO: 1021389 - protein, 8 aa, Mycobacterium
QKAGDGSV

SEQ ID NO: 1021390 - protein, 4 aa, Mycobacterium
QKAN

SEQ ID NO: 1021391 - protein, 5 aa, Mycobacterium
QKDRD

SEQ ID NO: 1021392 - protein, 6 aa, Mycobacterium
QKEYGQ

SEQ ID NO: 1021393 - protein, 12 aa, Mycobacterium
QKGGVAKTTTVA

SEQ ID NO: 1021394 - protein, 11 aa, Mycobacterium
QKGGVGKTTTA

SEQ ID NO: 1021395 - protein, 8 aa, Mycobacterium
QKKSDRIK

SEQ ID NO: 1021396 - protein, 11 aa, Mycobacterium
QKMSKSLRNYP

SEQ ID NO: 1021397 - protein, 8 aa, Mycobacterium
QKPAGPAR

SEQ ID NO: 1021398 - protein, 6 aa, Mycobacterium
QKPLDG

SEQ ID NO: 1021399 - protein, 8 aa, Mycobacterium
QKPTGETE

SEQ ID NO: 1021400 - protein, 10 aa, Mycobacterium
QKPTNDQSDA

SEQ ID NO: 1021401 - protein, 19 aa, Mycobacterium
QKRGTVPRQAGLGRPRGQP

SEQ ID NO: 1021402 - protein, 29 aa, Mycobacterium
QKRPGTPSAEAARKASAEQSTPPPDADHP

SEQ ID NO: 1021403 - protein, 15 aa, Mycobacterium
QKRSSQKESRGGRKE

SEQ ID NO: 1021404 - protein, 5 aa, Mycobacterium
QKSGA

SEQ ID NO: 1021405 - protein, 6 aa, Mycobacterium
QKSGAA

SEQ ID NO: 1021406 - protein, 5 aa, Mycobacterium
QKSGV

SEQ ID NO: 1021407 - protein, 9 aa, Mycobacterium
QKSPKSLPP

SEQ ID NO: 1021408 - protein, 9 aa, Mycobacterium
QKTATRVVP

SEQ ID NO: 1021409 - protein, 8 aa, Mycobacterium
QKTPAAVT

SEQ ID NO: 1021410 - protein, 8 aa, Mycobacterium
QKTTDGDF

SEQ ID NO: 1021411 - protein, 6 aa, Mycobacterium
QLAAPQ

SEQ ID NO: 1021412 - protein, 11 aa, Mycobacterium
QLAENRPPQEV

SEQ ID NO: 1021413 - protein, 7 aa, Mycobacterium
QLAGRQA

SEQ ID NO: 1021414 - protein, 12 aa, Mycobacterium
QLAPKDEAERRK

SEQ ID NO: 1021415 - protein, 13 aa, Mycobacterium
QLDEASHAAGAAV

SEQ ID NO: 1021416 - protein, 7 aa, Mycobacterium
QLDEDPY

SEQ ID NO: 1021417 - protein, 5 aa, Mycobacterium
QLDPR

SEQ ID NO: 1021418 - protein, 16 aa, Mycobacterium
QLDQPAGTLSGGEKTR

SEQ ID NO: 1021419 - protein, 16 aa, Mycobacterium
QLDSSRAADADIAGSA

SEQ ID NO: 1021420 - protein, 5 aa, Mycobacterium
QLEED

SEQ ID NO: 1021421 - protein, 5 aa, Mycobacterium
QLEGP

SEQ ID NO: 1021422 - protein, 6 aa, Mycobacterium
QLGETE

SEQ ID NO: 1021423 - protein, 6 aa, Mycobacterium
QLGGAA

SEQ ID NO: 1021424 - protein, 5 aa, Mycobacterium
QLGGG

SEQ ID NO: 1021425 - protein, 10 aa, Mycobacterium
QLGGSDGQPI

SEQ ID NO: 1021426 - protein, 10 aa, Mycobacterium
QLGGTDARKR

SEQ ID NO: 1021427 - protein, 4 aa, Mycobacterium
QLGK

SEQ ID NO: 1021428 - protein, 12 aa, Mycobacterium
QLGKKSGQGFYT

SEQ ID NO: 1021429 - protein, 7 aa, Mycobacterium
QLGPQSP

SEQ ID NO: 1021430 - protein, 13 aa, Mycobacterium
QLGPSETKSETKS

SEQ ID NO: 1021431 - protein, 8 aa, Mycobacterium
QLGTAQAT

SEQ ID NO: 1021432 - protein, 10 aa, Mycobacterium
QLGTDPNRTV

SEQ ID NO: 1021433 - protein, 9 aa, Mycobacterium
QLGTKGPSL

SEQ ID NO: 1021434 - protein, 4 aa, Mycobacterium
QLHD

SEQ ID NO: 1021435 - protein, 8 aa, Mycobacterium
QLKSARAQ

SEQ ID NO: 1021436 - protein, 7 aa, Mycobacterium
QLKSSKD

SEQ ID NO: 1021437 - protein, 5 aa, Mycobacterium
QLNEG

SEQ ID NO: 1021438 - protein, 6 aa, Mycobacterium
QLNNNR

SEQ ID NO: 1021439 - protein, 10 aa, Mycobacterium
QLNQQRAQTS

SEQ ID NO: 1021440 - protein, 18 aa, Mycobacterium
QLNSDSGRATTGVGGRAI

SEQ ID NO: 1021441 - protein, 13 aa, Mycobacterium
QLNSPERSGAADQ

SEQ ID NO: 1021442 - protein, 7 aa, Mycobacterium
QLPAGVS

SEQ ID NO: 1021443 - protein, 6 aa, Mycobacterium
QLPAPM

SEQ ID NO: 1021444 - protein, 13 aa, Mycobacterium
QLPDGSPDDPGDL

SEQ ID NO: 1021445 - protein, 8 aa, Mycobacterium
QLPGGESV

SEQ ID NO: 1021446 - protein, 5 aa, Mycobacterium
QLPGR

SEQ ID NO: 1021447 - protein, 11 aa, Mycobacterium
QLPNRSGDGLS

SEQ ID NO: 1021448 - protein, 11 aa, Mycobacterium
QLPPAASEAEA

SEQ ID NO: 1021449 - protein, 16 aa, Mycobacterium
QLPPPGAPISAPISPG

SEQ ID NO: 1021450 - protein, 6 aa, Mycobacterium
QLPQDR

SEQ ID NO: 1021451 - protein, 6 aa, Mycobacterium
QLPRTG

SEQ ID NO: 1021452 - protein, 7 aa, Mycobacterium
QLPSRPE

SEQ ID NO: 1021453 - protein, 4 aa, Mycobacterium
QLQP

SEQ ID NO: 1021454 - protein, 7 aa, Mycobacterium
QLRASGA

SEQ ID NO: 1021455 - protein, 25 aa, Mycobacterium
QLRGGDRVNRNGVTQTGANNTPIQG

SEQ ID NO: 1021456 - protein, 15 aa, Mycobacterium
QLRGRAGRQGDPGSS

SEQ ID NO: 1021457 - protein, 15 aa, Mycobacterium
QLRGRSGRQGDPGES

SEQ ID NO: 1021458 - protein, 6 aa, Mycobacterium
QLSDED

SEQ ID NO: 1021459 - protein, 15 aa, Mycobacterium
QLSGAGGLGDAVGRS

SEQ ID NO: 1021460 - protein, 14 aa, Mycobacterium
QLSGGNHEESDDDK

SEQ ID NO: 1021461 - protein, 8 aa, Mycobacterium
QLSGNPIR

SEQ ID NO: 1021462 - protein, 5 aa, Mycobacterium
QLSGP

SEQ ID NO: 1021463 - protein, 12 aa, Mycobacterium
QLSNTSSGVSQQ

SEQ ID NO: 1021464 - protein, 4 aa, Mycobacterium
QLSP

SEQ ID NO: 1021465 - protein, 13 aa, Mycobacterium
QLSTEASPGDGDD

SEQ ID NO: 1021466 - protein, 8 aa, Mycobacterium
QLTDSQRA

SEQ ID NO: 1021467 - protein, 4 aa, Mycobacterium
QLTE

SEQ ID NO: 1021468 - protein, 8 aa, Mycobacterium
QLTESGVP

SEQ ID NO: 1021469 - protein, 5 aa, Mycobacterium
QLTGI

SEQ ID NO: 1021470 - protein, 5 aa, Mycobacterium
QLTRA

SEQ ID NO: 1021471 - protein, 5 aa, Mycobacterium
QLTTA

SEQ ID NO: 1021472 - protein, 8 aa, Mycobacterium
QMAGRGTD

SEQ ID NO: 1021473 - protein, 10 aa, Mycobacterium
QMNASPKSGF

SEQ ID NO: 1021474 - protein, 15 aa, Mycobacterium
QMPGRSSSVSRTSGV

SEQ ID NO: 1021475 - protein, 13 aa, Mycobacterium
QMSTSTAAAGGPM

SEQ ID NO: 1021476 - protein, 7 aa, Mycobacterium
QMTDGGA

SEQ ID NO: 1021477 - protein, 9 aa, Mycobacterium
QMTDKTAPR

SEQ ID NO: 1021478 - protein, 10 aa, Mycobacterium
QMTDKTAPRV

SEQ ID NO: 1021479 - protein, 13 aa, Mycobacterium
QMTYGEANATANR

SEQ ID NO: 1021480 - protein, 14 aa, Mycobacterium
QNAAQRAVDARGGK

SEQ ID NO: 1021481 - protein, 8 aa, Mycobacterium
QNADDNSM

SEQ ID NO: 1021482 - protein, 20 aa, Mycobacterium
QNAENLNDSLEAGAVAARIP

SEQ ID NO: 1021483 - protein, 8 aa, Mycobacterium
QNAPAIAA

SEQ ID NO: 1021484 - protein, 6 aa, Mycobacterium
QNARSL

SEQ ID NO: 1021485 - protein, 5 aa, Mycobacterium
QNDNL

SEQ ID NO: 1021486 - protein, 5 aa, Mycobacterium
QNDPI

SEQ ID NO: 1021487 - protein, 5 aa, Mycobacterium
QNDPQ

SEQ ID NO: 1021488 - protein, 5 aa, Mycobacterium
QNDYA

SEQ ID NO: 1021489 - protein, 6 aa, Mycobacterium
QNEAPG

SEQ ID NO: 1021490 - protein, 6 aa, Mycobacterium
QNEKNA

SEQ ID NO: 1021491 - protein, 12 aa, Mycobacterium
QNFTPPAPRYKT

SEQ ID NO: 1021492 - protein, 4 aa, Mycobacterium
QNGL

SEQ ID NO: 1021493 - protein, 4 aa, Mycobacterium
QNGN

SEQ ID NO: 1021494 - protein, 6 aa, Mycobacterium
QNGNNE

SEQ ID NO: 1021495 - protein, 7 aa, Mycobacterium
QNGYPDG

SEQ ID NO: 1021496 - protein, 5 aa, Mycobacterium
QNIKS

SEQ ID NO: 1021497 - protein, 7 aa, Mycobacterium
QNITTDS

SEQ ID NO: 1021498 - protein, 5 aa, Mycobacterium
QNLET

SEQ ID NO: 1021499 - protein, 6 aa, Mycobacterium
QNNELG

SEQ ID NO: 1021500 - protein, 6 aa, Mycobacterium
QNPEAA

SEQ ID NO: 1021501 - protein, 7 aa, Mycobacterium
QNPEAAN

SEQ ID NO: 1021502 - protein, 18 aa, Mycobacterium
QNPEVTEKGDHGDDTSPV

SEQ ID NO: 1021503 - protein, 15 aa, Mycobacterium
QNPGGLKPSSRGKPH

SEQ ID NO: 1021504 - protein, 6 aa, Mycobacterium
QNPIEY

SEQ ID NO: 1021505 - protein, 8 aa, Mycobacterium
QNPPRSGL

SEQ ID NO: 1021506 - protein, 10 aa, Mycobacterium
QNPTGATPEL

SEQ ID NO: 1021507 - protein, 10 aa, Mycobacterium
QNRASGAEIG

SEQ ID NO: 1021508 - protein, 6 aa, Mycobacterium
QNRGSG

SEQ ID NO: 1021509 - protein, 11 aa, Mycobacterium
QNRRSHPLQGG

SEQ ID NO: 1021510 - protein, 11 aa, Mycobacterium
QNSGSKTTIAP

SEQ ID NO: 1021511 - protein, 12 aa, Mycobacterium
QNSPAIATTEAN

SEQ ID NO: 1021512 - protein, 8 aa, Mycobacterium
QNSRGRLT

SEQ ID NO: 1021513 - protein, 9 aa, Mycobacterium
QNSTPLDLS

SEQ ID NO: 1021514 - protein, 5 aa, Mycobacterium
QNTDE

SEQ ID NO: 1021515 - protein, 10 aa, Mycobacterium
QNTKDAGGAR

SEQ ID NO: 1021516 - protein, 8 aa, Mycobacterium
QNTPAIAA

SEQ ID NO: 1021517 - protein, 12 aa, Mycobacterium
QNTPAIAATEAA

SEQ ID NO: 1021518 - protein, 11 aa, Mycobacterium
QNTPSIAATEA

SEQ ID NO: 1021519 - protein, 7 aa, Mycobacterium
QNTPTAE

SEQ ID NO: 1021520 - protein, 7 aa, Mycobacterium
QNTYERS

SEQ ID NO: 1021521 - protein, 8 aa, Mycobacterium
QNYSEDGD

SEQ ID NO: 1021522 - protein, 17 aa, Mycobacterium
QNYSGRTTVARDGQIFA

SEQ ID NO: 1021523 - protein, 5 aa, Mycobacterium
QPADI

SEQ ID NO: 1021524 - protein, 10 aa, Mycobacterium
QPADSYRNDH

SEQ ID NO: 1021525 - protein, 5 aa, Mycobacterium
QPAGE

SEQ ID NO: 1021526 - protein, 5 aa, Mycobacterium
QPAGV

SEQ ID NO: 1021527 - protein, 12 aa, Mycobacterium
QPAKTSDPRGLS

SEQ ID NO: 1021528 - protein, 19 aa, Mycobacterium
QPAPGNNNVGMGNTGNNNF

SEQ ID NO: 1021529 - protein, 6 aa, Mycobacterium
QPARAQ

SEQ ID NO: 1021530 - protein, 11 aa, Mycobacterium
QPASADRSRAA

SEQ ID NO: 1021531 - protein, 30 aa, Mycobacterium
QPASVGVPPAGAGLATASAKPVAAHTGAKP

SEQ ID NO: 1021532 - protein, 43 aa, Mycobacterium
QPATGTTGTARAAAHTTASAGTPITPEPGVATGPTDRAGTAHP

SEQ ID NO: 1021533 - protein, 7 aa, Mycobacterium
QPATNVE

SEQ ID NO: 1021534 - protein, 6 aa, Mycobacterium
QPATPT

SEQ ID NO: 1021535 - protein, 6 aa, Mycobacterium
QPATQI

SEQ ID NO: 1021536 - protein, 4 aa, Mycobacterium
QPAV

SEQ ID NO: 1021537 - protein, 7 aa, Mycobacterium
QPAVPAA

SEQ ID NO: 1021538 - protein, 5 aa, Mycobacterium
QPDCK

SEQ ID NO: 1021539 - protein, 8 aa, Mycobacterium
QPDDHPAG

SEQ ID NO: 1021540 - protein, 14 aa, Mycobacterium
QPDFRDRDKTAAAN

SEQ ID NO: 1021541 - protein, 11 aa, Mycobacterium
QPDGPPRVPGI

SEQ ID NO: 1021542 - protein, 6 aa, Mycobacterium
QPDGQT

SEQ ID NO: 1021543 - protein, 5 aa, Mycobacterium
QPDID

SEQ ID NO: 1021544 - protein, 9 aa, Mycobacterium
QPDLGPKQV

SEQ ID NO: 1021545 - protein, 5 aa, Mycobacterium
QPDLR

SEQ ID NO: 1021546 - protein, 6 aa, Mycobacterium
QPDLSA

SEQ ID NO: 1021547 - protein, 14 aa, Mycobacterium
QPDPRLANANPALA

SEQ ID NO: 1021548 - protein, 7 aa, Mycobacterium
QPDPSSH

SEQ ID NO: 1021549 - protein, 8 aa, Mycobacterium
QPDPVDTE

SEQ ID NO: 1021550 - protein, 5 aa, Mycobacterium
QPDQW

SEQ ID NO: 1021551 - protein, 5 aa, Mycobacterium
QPDRR

SEQ ID NO: 1021552 - protein, 5 aa, Mycobacterium
QPDSV

SEQ ID NO: 1021553 - protein, 9 aa, Mycobacterium
QPDSYDPPR

SEQ ID NO: 1021554 - protein, 6 aa, Mycobacterium
QPDTTA

SEQ ID NO: 1021555 - protein, 8 aa, Mycobacterium
QPDVESAA

SEQ ID NO: 1021556 - protein, 4 aa, Mycobacterium
QPEA

SEQ ID NO: 1021557 - protein, 6 aa, Mycobacterium
QPEARR

SEQ ID NO: 1021558 - protein, 4 aa, Mycobacterium
QPED

SEQ ID NO: 1021559 - protein, 6 aa, Mycobacterium
QPEEYR

SEQ ID NO: 1021560 - protein, 6 aa, Mycobacterium
QPEEYS

SEQ ID NO: 1021561 - protein, 4 aa, Mycobacterium
QPEL

SEQ ID NO: 1021562 - protein, 19 aa, Mycobacterium
QPELADDPRFASAESRMAN

SEQ ID NO: 1021563 - protein, 5 aa, Mycobacterium
QPEPI

SEQ ID NO: 1021564 - protein, 8 aa, Mycobacterium
QPERDSIA

SEQ ID NO: 1021565 - protein, 15 aa, Mycobacterium
QPERPVRGSIAPTDR

SEQ ID NO: 1021566 - protein, 5 aa, Mycobacterium
QPERQ

SEQ ID NO: 1021567 - protein, 6 aa, Mycobacterium
QPERRA

SEQ ID NO: 1021568 - protein, 7 aa, Mycobacterium
QPETAAV

SEQ ID NO: 1021569 - protein, 6 aa, Mycobacterium
QPEVST

SEQ ID NO: 1021570 - protein, 12 aa, Mycobacterium
QPFAASAPRIGA

SEQ ID NO: 1021571 - protein, 20 aa, Mycobacterium
QPFGGSRGSGTNDKAGSPQN

SEQ ID NO: 1021572 - protein, 13 aa, Mycobacterium
QPFSAATSESLAA

SEQ ID NO: 1021573 - protein, 8 aa, Mycobacterium
QPGADAVS

SEQ ID NO: 1021574 - protein, 11 aa, Mycobacterium
QPGDHADPTLQ

SEQ ID NO: 1021575 - protein, 6 aa, Mycobacterium
QPGEAQ

SEQ ID NO: 1021576 - protein, 5 aa, Mycobacterium
QPGGE

SEQ ID NO: 1021577 - protein, 5 aa, Mycobacterium
QPGHA

SEQ ID NO: 1021578 - protein, 4 aa, Mycobacterium
QPGQ

SEQ ID NO: 1021579 - protein, 4 aa, Mycobacterium
QPGR

SEQ ID NO: 1021580 - protein, 4 aa, Mycobacterium
QPGV

SEQ ID NO: 1021581 - protein, 8 aa, Mycobacterium
QPGVDPAT

SEQ ID NO: 1021582 - protein, 13 aa, Mycobacterium
QPGVGGSTPRPGR

SEQ ID NO: 1021583 - protein, 5 aa, Mycobacterium
QPGVT

SEQ ID NO: 1021584 - protein, 8 aa, Mycobacterium
QPGVVDPA

SEQ ID NO: 1021585 - protein, 15 aa, Mycobacterium
QPGYGHSDKRAEHGQ

SEQ ID NO: 1021586 - protein, 4 aa, Mycobacterium
QPHK

SEQ ID NO: 1021587 - protein, 18 aa, Mycobacterium
QPHRGTQSGGSGADYHDP

SEQ ID NO: 1021588 - protein, 5 aa, Mycobacterium
QPHRP

SEQ ID NO: 1021589 - protein, 15 aa, Mycobacterium
QPHTSSGRVPTEKGY

SEQ ID NO: 1021590 - protein, 6 aa, Mycobacterium
QPIPNL

SEQ ID NO: 1021591 - protein, 9 aa, Mycobacterium
QPIPPEQPQ

SEQ ID NO: 1021592 - protein, 6 aa, Mycobacterium
QPIPTT

SEQ ID NO: 1021593 - protein, 11 aa, Mycobacterium
QPIPVGKQGGS

SEQ ID NO: 1021594 - protein, 6 aa, Mycobacterium
QPISNG

SEQ ID NO: 1021595 - protein, 13 aa, Mycobacterium
QPISSFQGPQPAE

SEQ ID NO: 1021596 - protein, 5 aa, Mycobacterium
QPKAP

SEQ ID NO: 1021597 - protein, 13 aa, Mycobacterium
QPKFGADKTAKST

SEQ ID NO: 1021598 - protein, 9 aa, Mycobacterium
QPKLADSTW

SEQ ID NO: 1021599 - protein, 7 aa, Mycobacterium
QPKPRRN

SEQ ID NO: 1021600 - protein, 8 aa, Mycobacterium
QPKWSTAE

SEQ ID NO: 1021601 - protein, 4 aa, Mycobacterium
QPLD

SEQ ID NO: 1021602 - protein, 12 aa, Mycobacterium
QPLGGKAQFGGQ

SEQ ID NO: 1021603 - protein, 11 aa, Mycobacterium
QPLGTDKEGKD

SEQ ID NO: 1021604 - protein, 10 aa, Mycobacterium
QPLNGDDAPF

SEQ ID NO: 1021605 - protein, 4 aa, Mycobacterium
QPLP

SEQ ID NO: 1021606 - protein, 8 aa, Mycobacterium
QPLPAELP

SEQ ID NO: 1021607 - protein, 7 aa, Mycobacterium
QPLSPGE

SEQ ID NO: 1021608 - protein, 6 aa, Mycobacterium
QPLSSG

SEQ ID NO: 1021609 - protein, 6 aa, Mycobacterium
QPLTEQ

SEQ ID NO: 1021610 - protein, 7 aa, Mycobacterium
QPMDDDP

SEQ ID NO: 1021611 - protein, 26 aa, Mycobacterium
QPMSAGPYPGLPGEPAPNPDQSPKRG

SEQ ID NO: 1021612 - protein, 8 aa, Mycobacterium
QPNERRAH

SEQ ID NO: 1021613 - protein, 12 aa, Mycobacterium
QPNHPTDDPRGI

SEQ ID NO: 1021614 - protein, 4 aa, Mycobacterium
QPNT

SEQ ID NO: 1021615 - protein, 4 aa, Mycobacterium
QPNV

SEQ ID NO: 1021616 - protein, 6 aa, Mycobacterium
QPPAEV

SEQ ID NO: 1021617 - protein, 15 aa, Mycobacterium
QPPAPAPADQPRSGL

SEQ ID NO: 1021618 - protein, 5 aa, Mycobacterium
QPPEA

SEQ ID NO: 1021619 - protein, 9 aa, Mycobacterium
QPPEDADEN

SEQ ID NO: 1021620 - protein, 6 aa, Mycobacterium
QPPELE

SEQ ID NO: 1021621 - protein, 7 aa, Mycobacterium
QPPFARR

SEQ ID NO: 1021622 - protein, 8 aa, Mycobacterium
QPPGAVSG

SEQ ID NO: 1021623 - protein, 7 aa, Mycobacterium
QPPKGLA

SEQ ID NO: 1021624 - protein, 4 aa, Mycobacterium
QPPM

SEQ ID NO: 1021625 - protein, 12 aa, Mycobacterium
QPPRPLAEARNR

SEQ ID NO: 1021626 - protein, 5 aa, Mycobacterium
QPPSA

SEQ ID NO: 1021627 - protein, 26 aa, Mycobacterium
QPPTPDTTQTPNPTTGSDPAVGSDPA

SEQ ID NO: 1021628 - protein, 11 aa, Mycobacterium
QPQGPLAAATR

SEQ ID NO: 1021629 - protein, 8 aa, Mycobacterium
QPQPETLD

SEQ ID NO: 1021630 - protein, 6 aa, Mycobacterium
QPQRQW

SEQ ID NO: 1021631 - protein, 6 aa, Mycobacterium
QPRDVS

SEQ ID NO: 1021632 - protein, 7 aa, Mycobacterium
QPRERDY

SEQ ID NO: 1021633 - protein, 4 aa, Mycobacterium
QPRF

SEQ ID NO: 1021634 - protein, 4 aa, Mycobacterium
QPRH

SEQ ID NO: 1021635 - protein, 7 aa, Mycobacterium
QPRHPDD

SEQ ID NO: 1021636 - protein, 8 aa, Mycobacterium
QPRTGPSS

SEQ ID NO: 1021637 - protein, 6 aa, Mycobacterium
QPRTGT

SEQ ID NO: 1021638 - protein, 30 aa, Mycobacterium
QPSAVAARTAGRTHGRDSTDSAGAAGTAMA

SEQ ID NO: 1021639 - protein, 15 aa, Mycobacterium
QPSGSVARYESRVGD

SEQ ID NO: 1021640 - protein, 4 aa, Mycobacterium
QPSH

SEQ ID NO: 1021641 - protein, 6 aa, Mycobacterium
QPSRED

SEQ ID NO: 1021642 - protein, 6 aa, Mycobacterium
QPSSGV

SEQ ID NO: 1021643 - protein, 7 aa, Mycobacterium
QPSTTFD

SEQ ID NO: 1021644 - protein, 13 aa, Mycobacterium
QPSVSDSKKSVKA

SEQ ID NO: 1021645 - protein, 8 aa, Mycobacterium
QPTDQTRG

SEQ ID NO: 1021646 - protein, 6 aa, Mycobacterium
QPTEEA

SEQ ID NO: 1021647 - protein, 9 aa, Mycobacterium
QPTKPTDRK

SEQ ID NO: 1021648 - protein, 5 aa, Mycobacterium
QPTLQ

SEQ ID NO: 1021649 - protein, 6 aa, Mycobacterium
QPTPEN

SEQ ID NO: 1021650 - protein, 8 aa, Mycobacterium
QPTSITEG

SEQ ID NO: 1021651 - protein, 8 aa, Mycobacterium
QPTSQADL

SEQ ID NO: 1021652 - protein, 10 aa, Mycobacterium
QPTYNRPDNH

SEQ ID NO: 1021653 - protein, 8 aa, Mycobacterium
QPVAPASK

SEQ ID NO: 1021654 - protein, 8 aa, Mycobacterium
QPVSLSPT

SEQ ID NO: 1021655 - protein, 4 aa, Mycobacterium
QPWE

SEQ ID NO: 1021656 - protein, 9 aa, Mycobacterium
QPYAPAAAS

SEQ ID NO: 1021657 - protein, 26 aa, Mycobacterium
QPYGDGGSDSADGYAMTGTATSVASG

SEQ ID NO: 1021658 - protein, 6 aa, Mycobacterium
QQAADS

SEQ ID NO: 1021659 - protein, 7 aa, Mycobacterium
QQAGDDL

SEQ ID NO: 1021660 - protein, 10 aa, Mycobacterium
QQAGKTVTQS

SEQ ID NO: 1021661 - protein, 9 aa, Mycobacterium
QQAHNATKL

SEQ ID NO: 1021662 - protein, 7 aa, Mycobacterium
QQAPNST

SEQ ID NO: 1021663 - protein, 7 aa, Mycobacterium
QQARPRE

SEQ ID NO: 1021664 - protein, 6 aa, Mycobacterium
QQATGA

SEQ ID NO: 1021665 - protein, 8 aa, Mycobacterium
QQAVESTK

SEQ ID NO: 1021666 - protein, 25 aa, Mycobacterium
QQDIGRTSLSEDDAGATASGKERQA

SEQ ID NO: 1021667 - protein, 4 aa, Mycobacterium
QQDL

SEQ ID NO: 1021668 - protein, 5 aa, Mycobacterium
QQDRT

SEQ ID NO: 1021669 - protein, 6 aa, Mycobacterium
QQEAGK

SEQ ID NO: 1021670 - protein, 16 aa, Mycobacterium
QQESSDEQLAGPASRL

SEQ ID NO: 1021671 - protein, 10 aa, Mycobacterium
QQFADSDPGV

SEQ ID NO: 1021672 - protein, 10 aa, Mycobacterium
QQFNENSAGA

SEQ ID NO: 1021673 - protein, 13 aa, Mycobacterium
QQGDALASAAEDR

SEQ ID NO: 1021674 - protein, 12 aa, Mycobacterium
QQGEHRAGIPNR

SEQ ID NO: 1021675 - protein, 6 aa, Mycobacterium
QQGERL

SEQ ID NO: 1021676 - protein, 4 aa, Mycobacterium
QQGI

SEQ ID NO: 1021677 - protein, 5 aa, Mycobacterium
QQGID

SEQ ID NO: 1021678 - protein, 10 aa, Mycobacterium
QQGNIAETAK

SEQ ID NO: 1021679 - protein, 20 aa, Mycobacterium
QQGPMGEEPAQAVEPQPLPG

SEQ ID NO: 1021680 - protein, 15 aa, Mycobacterium
QQGQQRRKRRKRNRW

SEQ ID NO: 1021681 - protein, 8 aa, Mycobacterium
QQKGNYAK

SEQ ID NO: 1021682 - protein, 15 aa, Mycobacterium
QQLANSEVHGQAGGG

SEQ ID NO: 1021683 - protein, 7 aa, Mycobacterium
QQLDPQA

SEQ ID NO: 1021684 - protein, 6 aa, Mycobacterium
QQLPDG

SEQ ID NO: 1021685 - protein, 10 aa, Mycobacterium
QQLPPTDDHG

SEQ ID NO: 1021686 - protein, 10 aa, Mycobacterium
QQLSARTTLT

SEQ ID NO: 1021687 - protein, 6 aa, Mycobacterium
QQLSED

SEQ ID NO: 1021688 - protein, 5 aa, Mycobacterium
QQLTG

SEQ ID NO: 1021689 - protein, 8 aa, Mycobacterium
QQNGIDPT

SEQ ID NO: 1021690 - protein, 6 aa, Mycobacterium
QQNPVD

SEQ ID NO: 1021691 - protein, 18 aa, Mycobacterium
QQPAELRDPVHPGDLLIR

SEQ ID NO: 1021692 - protein, 15 aa, Mycobacterium
QQPATELPMAQRYFL

SEQ ID NO: 1021693 - protein, 23 aa, Mycobacterium
QQPATPLRSPKSGSCPYRTRRDT

SEQ ID NO: 1021694 - protein, 16 aa, Mycobacterium
QQPGDAVGTDPRPGPD

SEQ ID NO: 1021695 - protein, 6 aa, Mycobacterium
QQPGRA

SEQ ID NO: 1021696 - protein, 4 aa, Mycobacterium
QQPH

SEQ ID NO: 1021697 - protein, 6 aa, Mycobacterium
QQPQEQ

SEQ ID NO: 1021698 - protein, 5 aa, Mycobacterium
QQPQH

SEQ ID NO: 1021699 - protein, 17 aa, Mycobacterium
QQPVSAKGEWNRTDHRP

SEQ ID NO: 1021700 - protein, 12 aa, Mycobacterium
QQQLDSSDLGVA

SEQ ID NO: 1021701 - protein, 11 aa, Mycobacterium
QQQPVGPGEHG

SEQ ID NO: 1021702 - protein, 11 aa, Mycobacterium
QQQQHAPDTAG

SEQ ID NO: 1021703 - protein, 12 aa, Mycobacterium
QQQRAPSVLDPK

SEQ ID NO: 1021704 - protein, 8 aa, Mycobacterium
QQREGVGG

SEQ ID NO: 1021705 - protein, 5 aa, Mycobacterium
QQRER

SEQ ID NO: 1021706 - protein, 19 aa, Mycobacterium
QQRRAEARFRTGPGRGVRR

SEQ ID NO: 1021707 - protein, 5 aa, Mycobacterium
QQRRT

SEQ ID NO: 1021708 - protein, 6 aa, Mycobacterium
QQRYEE

SEQ ID NO: 1021709 - protein, 11 aa, Mycobacterium
QQSDDPRDAQA

SEQ ID NO: 1021710 - protein, 5 aa, Mycobacterium
QQSDL

SEQ ID NO: 1021711 - protein, 7 aa, Mycobacterium
QQSLKNS

SEQ ID NO: 1021712 - protein, 5 aa, Mycobacterium
QQTGV

SEQ ID NO: 1021713 - protein, 7 aa, Mycobacterium
QQVGENG

SEQ ID NO: 1021714 - protein, 8 aa, Mycobacterium
QQVPPAGM

SEQ ID NO: 1021715 - protein, 8 aa, Mycobacterium
QQVRDGAV

SEQ ID NO: 1021716 - protein, 7 aa, Mycobacterium
QQVSAEA

SEQ ID NO: 1021717 - protein, 8 aa, Mycobacterium
QQVTDPAT

SEQ ID NO: 1021718 - protein, 16 aa, Mycobacterium
QQWADESAARGTYPSL

SEQ ID NO: 1021719 - protein, 13 aa, Mycobacterium
QQYDGYPGPDIPG

SEQ ID NO: 1021720 - protein, 14 aa, Mycobacterium
QQYGGGSESAEGYG

SEQ ID NO: 1021721 - protein, 5 aa, Mycobacterium
QRAAA

SEQ ID NO: 1021722 - protein, 46 aa, Mycobacterium
QRAAARQGTHSTKTRGDVSGGGRKPYRQKGTGRARQGSTRTPQFTG

SEQ ID NO: 1021723 - protein, 4 aa, Mycobacterium
QRAD

SEQ ID NO: 1021724 - protein, 8 aa, Mycobacterium
QRAEWSEQ

SEQ ID NO: 1021725 - protein, 7 aa, Mycobacterium
QRAGAGP

SEQ ID NO: 1021726 - protein, 8 aa, Mycobacterium
QRAGREKE

SEQ ID NO: 1021727 - protein, 7 aa, Mycobacterium
QRAGTRL

SEQ ID NO: 1021728 - protein, 14 aa, Mycobacterium
QRAKRQARGQDTSF

SEQ ID NO: 1021729 - protein, 5 aa, Mycobacterium
QRAPA

SEQ ID NO: 1021730 - protein, 5 aa, Mycobacterium
QRARD

SEQ ID NO: 1021731 - protein, 13 aa, Mycobacterium
QRASSVPERNQPW

SEQ ID NO: 1021732 - protein, 4 aa, Mycobacterium
QRAY

SEQ ID NO: 1021733 - protein, 5 aa, Mycobacterium
QRCSE

SEQ ID NO: 1021734 - protein, 4 aa, Mycobacterium
QRDD

SEQ ID NO: 1021735 - protein, 9 aa, Mycobacterium
QRDEANSVM

SEQ ID NO: 1021736 - protein, 5 aa, Mycobacterium
QRDED

SEQ ID NO: 1021737 - protein, 6 aa, Mycobacterium
QRDGDD

SEQ ID NO: 1021738 - protein, 13 aa, Mycobacterium
QRDRPDEAGYRGE

SEQ ID NO: 1021739 - protein, 9 aa, Mycobacterium
QREAAGQER

SEQ ID NO: 1021740 - protein, 19 aa, Mycobacterium
QREDRGGATERNRRIDSDA

SEQ ID NO: 1021741 - protein, 7 aa, Mycobacterium
QREEGER

SEQ ID NO: 1021742 - protein, 6 aa, Mycobacterium
QREIPR

SEQ ID NO: 1021743 - protein, 4 aa, Mycobacterium
QREL

SEQ ID NO: 1021744 - protein, 7 aa, Mycobacterium
QREPQRK

SEQ ID NO: 1021745 - protein, 13 aa, Mycobacterium
QREPSAHAASADV

SEQ ID NO: 1021746 - protein, 8 aa, Mycobacterium
QRERASAR

SEQ ID NO: 1021747 - protein, 17 aa, Mycobacterium
QRERDELARGTHAERRE

SEQ ID NO: 1021748 - protein, 7 aa, Mycobacterium
QRERSAD

SEQ ID NO: 1021749 - protein, 7 aa, Mycobacterium
QRESMGN

SEQ ID NO: 1021750 - protein, 10 aa, Mycobacterium
QRFNQNTEGI

SEQ ID NO: 1021751 - protein, 4 aa, Mycobacterium
QRGA

SEQ ID NO: 1021752 - protein, 10 aa, Mycobacterium
QRGDREGAAR

SEQ ID NO: 1021753 - protein, 10 aa, Mycobacterium
QRGDSRDRRL

SEQ ID NO: 1021754 - protein, 8 aa, Mycobacterium
QRGEDRQR

SEQ ID NO: 1021755 - protein, 9 aa, Mycobacterium
QRGGQPTAY

SEQ ID NO: 1021756 - protein, 5 aa, Mycobacterium
QRGHR

SEQ ID NO: 1021757 - protein, 9 aa, Mycobacterium
QRGMERTRS

SEQ ID NO: 1021758 - protein, 9 aa, Mycobacterium
QRGNPGLEI

SEQ ID NO: 1021759 - protein, 6 aa, Mycobacterium
QRGNPI

SEQ ID NO: 1021760 - protein, 9 aa, Mycobacterium
QRGPDTARS

SEQ ID NO: 1021761 - protein, 6 aa, Mycobacterium
QRGPGA

SEQ ID NO: 1021762 - protein, 6 aa, Mycobacterium
QRGPRE

SEQ ID NO: 1021763 - protein, 4 aa, Mycobacterium
QRGR

SEQ ID NO: 1021764 - protein, 7 aa, Mycobacterium
QRGRLGT

SEQ ID NO: 1021765 - protein, 6 aa, Mycobacterium
QRGSDE

SEQ ID NO: 1021766 - protein, 8 aa, Mycobacterium
QRGSFDRA

SEQ ID NO: 1021767 - protein, 5 aa, Mycobacterium
QRGST

SEQ ID NO: 1021768 - protein, 6 aa, Mycobacterium
QRGTGA

SEQ ID NO: 1021769 - protein, 8 aa, Mycobacterium
QRGTIPND

SEQ ID NO: 1021770 - protein, 11 aa, Mycobacterium
QRGYGRSSKYR

SEQ ID NO: 1021771 - protein, 7 aa, Mycobacterium
QRIAPGG

SEQ ID NO: 1021772 - protein, 7 aa, Mycobacterium
QRIEPDE

SEQ ID NO: 1021773 - protein, 6 aa, Mycobacterium
QRIGRP

SEQ ID NO: 1021774 - protein, 4 aa, Mycobacterium
QRIS

SEQ ID NO: 1021775 - protein, 11 aa, Mycobacterium
QRKKADTRRAL

SEQ ID NO: 1021776 - protein, 7 aa, Mycobacterium
QRLDAGE

SEQ ID NO: 1021777 - protein, 7 aa, Mycobacterium
QRLESSA

SEQ ID NO: 1021778 - protein, 4 aa, Mycobacterium
QRLG

SEQ ID NO: 1021779 - protein, 7 aa, Mycobacterium
QRLTPRE

SEQ ID NO: 1021780 - protein, 6 aa, Mycobacterium
QRNGER

SEQ ID NO: 1021781 - protein, 7 aa, Mycobacterium
QRNPEVA

SEQ ID NO: 1021782 - protein, 6 aa, Mycobacterium
QRNPNS

SEQ ID NO: 1021783 - protein, 8 aa, Mycobacterium
QRNRAASG

SEQ ID NO: 1021784 - protein, 9 aa, Mycobacterium
QRPANQAPL

SEQ ID NO: 1021785 - protein, 5 aa, Mycobacterium
QRPDA

SEQ ID NO: 1021786 - protein, 8 aa, Mycobacterium
QRPDQRSF

SEQ ID NO: 1021787 - protein, 17 aa, Mycobacterium
QRPDRARPTSPGGTATE

SEQ ID NO: 1021788 - protein, 8 aa, Mycobacterium
QRPEIRKA

SEQ ID NO: 1021789 - protein, 6 aa, Mycobacterium
QRPGVG

SEQ ID NO: 1021790 - protein, 7 aa, Mycobacterium
QRPKLER

SEQ ID NO: 1021791 - protein, 15 aa, Mycobacterium
QRPLTTAQQAPPLGV

SEQ ID NO: 1021792 - protein, 6 aa, Mycobacterium
QRPNAR

SEQ ID NO: 1021793 - protein, 7 aa, Mycobacterium
QRPPEET

SEQ ID NO: 1021794 - protein, 6 aa, Mycobacterium
QRPRGA

SEQ ID NO: 1021795 - protein, 6 aa, Mycobacterium
QRPRRR

SEQ ID NO: 1021796 - protein, 4 aa, Mycobacterium
QRPS

SEQ ID NO: 1021797 - protein, 6 aa, Mycobacterium
QRPVSE

SEQ ID NO: 1021798 - protein, 7 aa, Mycobacterium
QRQAYTD

SEQ ID NO: 1021799 - protein, 7 aa, Mycobacterium
QRQPGYE

SEQ ID NO: 1021800 - protein, 6 aa, Mycobacterium
QRRAGR

SEQ ID NO: 1021801 - protein, 5 aa, Mycobacterium
QRRDE

SEQ ID NO: 1021802 - protein, 5 aa, Mycobacterium
QRRDQ

SEQ ID NO: 1021803 - protein, 5 aa, Mycobacterium
QRRGA

SEQ ID NO: 1021804 - protein, 7 aa, Mycobacterium
QRRLPDT

SEQ ID NO: 1021805 - protein, 14 aa, Mycobacterium
QRRNSAPAEASSVR

SEQ ID NO: 1021806 - protein, 6 aa, Mycobacterium
QRRPGW

SEQ ID NO: 1021807 - protein, 6 aa, Mycobacterium
QRRPSA

SEQ ID NO: 1021808 - protein, 6 aa, Mycobacterium
QRRQDP

SEQ ID NO: 1021809 - protein, 14 aa, Mycobacterium
QRRRAKADAAARKH

SEQ ID NO: 1021810 - protein, 5 aa, Mycobacterium
QRRRK

SEQ ID NO: 1021811 - protein, 5 aa, Mycobacterium
QRRVD

SEQ ID NO: 1021812 - protein, 8 aa, Mycobacterium
QRSAGAHP

SEQ ID NO: 1021813 - protein, 8 aa, Mycobacterium
QRSDGRVR

SEQ ID NO: 1021814 - protein, 9 aa, Mycobacterium
QRSDSAESV

SEQ ID NO: 1021815 - protein, 4 aa, Mycobacterium
QRSG

SEQ ID NO: 1021816 - protein, 8 aa, Mycobacterium
QRSGLGPV

SEQ ID NO: 1021817 - protein, 26 aa, Mycobacterium
QRSGQVSPADEAAMSGPTPADRSTPL

SEQ ID NO: 1021818 - protein, 6 aa, Mycobacterium
QRSGRG

SEQ ID NO: 1021819 - protein, 6 aa, Mycobacterium
QRSGST

SEQ ID NO: 1021820 - protein, 14 aa, Mycobacterium
QRSNGIASAAGALK

SEQ ID NO: 1021821 - protein, 19 aa, Mycobacterium
QRSPSGKADYRWAKEQAAD

SEQ ID NO: 1021822 - protein, 8 aa, Mycobacterium
QRSRRSEQ

SEQ ID NO: 1021823 - protein, 9 aa, Mycobacterium
QRSYPQPAG

SEQ ID NO: 1021824 - protein, 4 aa, Mycobacterium
QRTE

SEQ ID NO: 1021825 - protein, 4 aa, Mycobacterium
QRTL

SEQ ID NO: 1021826 - protein, 6 aa, Mycobacterium
QRTPEL

SEQ ID NO: 1021827 - protein, 6 aa, Mycobacterium
QRTQAE

SEQ ID NO: 1021828 - protein, 11 aa, Mycobacterium
QRTSSGQGSAL

SEQ ID NO: 1021829 - protein, 4 aa, Mycobacterium
QRTV

SEQ ID NO: 1021830 - protein, 14 aa, Mycobacterium
QRVDEASRIADTAV

SEQ ID NO: 1021831 - protein, 8 aa, Mycobacterium
QRVRPEDE

SEQ ID NO: 1021832 - protein, 8 aa, Mycobacterium
QRVSRTRA

SEQ ID NO: 1021833 - protein, 8 aa, Mycobacterium
QRYASSGE

SEQ ID NO: 1021834 - protein, 10 aa, Mycobacterium
QSAAGGFTPS

SEQ ID NO: 1021835 - protein, 7 aa, Mycobacterium
QSAANQV

SEQ ID NO: 1021836 - protein, 12 aa, Mycobacterium
QSADAENCRRKR

SEQ ID NO: 1021837 - protein, 8 aa, Mycobacterium
QSADTDDR

SEQ ID NO: 1021838 - protein, 5 aa, Mycobacterium
QSAGA

SEQ ID NO: 1021839 - protein, 7 aa, Mycobacterium
QSAGLSA

SEQ ID NO: 1021840 - protein, 5 aa, Mycobacterium
QSAGS

SEQ ID NO: 1021841 - protein, 15 aa, Mycobacterium
QSAGVEGLEAADGAR

SEQ ID NO: 1021842 - protein, 6 aa, Mycobacterium
QSAMSG

SEQ ID NO: 1021843 - protein, 15 aa, Mycobacterium
QSANDITDAGSDESP

SEQ ID NO: 1021844 - protein, 11 aa, Mycobacterium
QSANGAAAAPI

SEQ ID NO: 1021845 - protein, 8 aa, Mycobacterium
QSAPPGAG

SEQ ID NO: 1021846 - protein, 13 aa, Mycobacterium
QSASAQLADAIKL

SEQ ID NO: 1021847 - protein, 5 aa, Mycobacterium
QSATA

SEQ ID NO: 1021848 - protein, 6 aa, Mycobacterium
QSATIS

SEQ ID NO: 1021849 - protein, 4 aa, Mycobacterium
QSAV

SEQ ID NO: 1021850 - protein, 6 aa, Mycobacterium
QSAVRQ

SEQ ID NO: 1021851 - protein, 6 aa, Mycobacterium
QSDGAS

SEQ ID NO: 1021852 - protein, 5 aa, Mycobacterium
QSDGT

SEQ ID NO: 1021853 - protein, 9 aa, Mycobacterium
QSDLGPKQW

SEQ ID NO: 1021854 - protein, 8 aa, Mycobacterium
QSDPETRW

SEQ ID NO: 1021855 - protein, 8 aa, Mycobacterium
QSDPTPDL

SEQ ID NO: 1021856 - protein, 13 aa, Mycobacterium
QSDQQRATGELRL

SEQ ID NO: 1021857 - protein, 9 aa, Mycobacterium
QSDQTPENL

SEQ ID NO: 1021858 - protein, 6 aa, Mycobacterium
QSDVTS

SEQ ID NO: 1021859 - protein, 10 aa, Mycobacterium
QSEGDPVPMS

SEQ ID NO: 1021860 - protein, 8 aa, Mycobacterium
QSEGMTAT

SEQ ID NO: 1021861 - protein, 7 aa, Mycobacterium
QSEHPGR

SEQ ID NO: 1021862 - protein, 5 aa, Mycobacterium
QSEIT

SEQ ID NO: 1021863 - protein, 8 aa, Mycobacterium
QSEPQRQA

SEQ ID NO: 1021864 - protein, 8 aa, Mycobacterium
QSERPEDY

SEQ ID NO: 1021865 - protein, 7 aa, Mycobacterium
QSERYGV

SEQ ID NO: 1021866 - protein, 4 aa, Mycobacterium
QSEV

SEQ ID NO: 1021867 - protein, 9 aa, Mycobacterium
QSEYRQAAQ

SEQ ID NO: 1021868 - protein, 8 aa, Mycobacterium
QSFETRKS

SEQ ID NO: 1021869 - protein, 5 aa, Mycobacterium
QSFTT

SEQ ID NO: 1021870 - protein, 7 aa, Mycobacterium
QSGAPGG

SEQ ID NO: 1021871 - protein, 6 aa, Mycobacterium
QSGDTV

SEQ ID NO: 1021872 - protein, 11 aa, Mycobacterium
QSGERTPRKNE

SEQ ID NO: 1021873 - protein, 9 aa, Mycobacterium
QSGETADTL

SEQ ID NO: 1021874 - protein, 6 aa, Mycobacterium
QSGETP

SEQ ID NO: 1021875 - protein, 12 aa, Mycobacterium
QSGIGREFGPEG

SEQ ID NO: 1021876 - protein, 6 aa, Mycobacterium
QSGIRT

SEQ ID NO: 1021877 - protein, 4 aa, Mycobacterium
QSGK

SEQ ID NO: 1021878 - protein, 8 aa, Mycobacterium
QSGLGRTG

SEQ ID NO: 1021879 - protein, 5 aa, Mycobacterium
QSGMA

SEQ ID NO: 1021880 - protein, 9 aa, Mycobacterium
QSGPAPATL

SEQ ID NO: 1021881 - protein, 6 aa, Mycobacterium
QSGPHT

SEQ ID NO: 1021882 - protein, 7 aa, Mycobacterium
QSGRAPA

SEQ ID NO: 1021883 - protein, 6 aa, Mycobacterium
QSGRVD

SEQ ID NO: 1021884 - protein, 21 aa, Mycobacterium
QSGSDGREESPEQHLNPRSGR

SEQ ID NO: 1021885 - protein, 17 aa, Mycobacterium
QSGVGHGLPGRCDERPR

SEQ ID NO: 1021886 - protein, 7 aa, Mycobacterium
QSHSGSL

SEQ ID NO: 1021887 - protein, 4 aa, Mycobacterium
QSIK

SEQ ID NO: 1021888 - protein, 19 aa, Mycobacterium
QSIPPGARPTQMTEDAEQS

SEQ ID NO: 1021889 - protein, 5 aa, Mycobacterium
QSISR

SEQ ID NO: 1021890 - protein, 9 aa, Mycobacterium
QSKSAYQAE

SEQ ID NO: 1021891 - protein, 7 aa, Mycobacterium
QSLPGRA

SEQ ID NO: 1021892 - protein, 11 aa, Mycobacterium
QSMGGNGLTQE

SEQ ID NO: 1021893 - protein, 10 aa, Mycobacterium
QSNPGRTGRQ

SEQ ID NO: 1021894 - protein, 14 aa, Mycobacterium
QSPDWSRSYAPGRE

SEQ ID NO: 1021895 - protein, 7 aa, Mycobacterium
QSPDYQD

SEQ ID NO: 1021896 - protein, 17 aa, Mycobacterium
QSPGAGAGHGGANPPVI

SEQ ID NO: 1021897 - protein, 6 aa, Mycobacterium
QSPGHR

SEQ ID NO: 1021898 - protein, 5 aa, Mycobacterium
QSPGL

SEQ ID NO: 1021899 - protein, 9 aa, Mycobacterium
QSPHPDAVA

SEQ ID NO: 1021900 - protein, 8 aa, Mycobacterium
QSPIRPGK

SEQ ID NO: 1021901 - protein, 16 aa, Mycobacterium
QSPQRPAPQPGQDTRE

SEQ ID NO: 1021902 - protein, 7 aa, Mycobacterium
QSPRGGT

SEQ ID NO: 1021903 - protein, 15 aa, Mycobacterium
QSPSEAQLRWELDRC

SEQ ID NO: 1021904 - protein, 8 aa, Mycobacterium
QSPTDDDD

SEQ ID NO: 1021905 - protein, 32 aa, Mycobacterium
QSPTQATYPSGRINTASGAAIAPSTGSSQTPA

SEQ ID NO: 1021906 - protein, 10 aa, Mycobacterium
QSPTSSYEQR

SEQ ID NO: 1021907 - protein, 10 aa, Mycobacterium
QSQAAGGPAM

SEQ ID NO: 1021908 - protein, 11 aa, Mycobacterium
QSQAKGDLTDS

SEQ ID NO: 1021909 - protein, 9 aa, Mycobacterium
QSQFGENGF

SEQ ID NO: 1021910 - protein, 7 aa, Mycobacterium
QSQKTTR

SEQ ID NO: 1021911 - protein, 4 aa, Mycobacterium
QSQN

SEQ ID NO: 1021912 - protein, 5 aa, Mycobacterium
QSQQS

SEQ ID NO: 1021913 - protein, 6 aa, Mycobacterium
QSQVEG

SEQ ID NO: 1021914 - protein, 6 aa, Mycobacterium
QSRDGE

SEQ ID NO: 1021915 - protein, 7 aa, Mycobacterium
QSRDSAG

SEQ ID NO: 1021916 - protein, 4 aa, Mycobacterium
QSRL

SEQ ID NO: 1021917 - protein, 7 aa, Mycobacterium
QSRPEDR

SEQ ID NO: 1021918 - protein, 5 aa, Mycobacterium
QSRPV

SEQ ID NO: 1021919 - protein, 15 aa, Mycobacterium
QSRQRRRPRRQRPRR

SEQ ID NO: 1021920 - protein, 4 aa, Mycobacterium
QSRR

SEQ ID NO: 1021921 - protein, 8 aa, Mycobacterium
QSRSSTHQ

SEQ ID NO: 1021922 - protein, 10 aa, Mycobacterium
QSSASGKGSI

SEQ ID NO: 1021923 - protein, 6 aa, Mycobacterium
QSSDGL

SEQ ID NO: 1021924 - protein, 5 aa, Mycobacterium
QSSGR

SEQ ID NO: 1021925 - protein, 4 aa, Mycobacterium
QSSI

SEQ ID NO: 1021926 - protein, 9 aa, Mycobacterium
QSSKDAAAA

SEQ ID NO: 1021927 - protein, 6 aa, Mycobacterium
QSSLER

SEQ ID NO: 1021928 - protein, 12 aa, Mycobacterium
QSSPSAGGGRAL

SEQ ID NO: 1021929 - protein, 17 aa, Mycobacterium
QSSRRARPAPQWTDATR

SEQ ID NO: 1021930 - protein, 16 aa, Mycobacterium
QSSTRSQRGQTPRSIG

SEQ ID NO: 1021931 - protein, 8 aa, Mycobacterium
QSSTTQAI

SEQ ID NO: 1021932 - protein, 7 aa, Mycobacterium
QSSVSNL

SEQ ID NO: 1021933 - protein, 6 aa, Mycobacterium
QSTAGR

SEQ ID NO: 1021934 - protein, 6 aa, Mycobacterium
QSTATE

SEQ ID NO: 1021935 - protein, 6 aa, Mycobacterium
QSTDLD

SEQ ID NO: 1021936 - protein, 4 aa, Mycobacterium
QSTF

SEQ ID NO: 1021937 - protein, 8 aa, Mycobacterium
QSTHGTWN

SEQ ID NO: 1021938 - protein, 6 aa, Mycobacterium
QSTHTP

SEQ ID NO: 1021939 - protein, 10 aa, Mycobacterium
QSTPAQREGL

SEQ ID NO: 1021940 - protein, 18 aa, Mycobacterium
QSTTTRDQPSPKRATSSV

SEQ ID NO: 1021941 - protein, 11 aa, Mycobacterium
QSTVDGTGHTP

SEQ ID NO: 1021942 - protein, 6 aa, Mycobacterium
QSVPEG

SEQ ID NO: 1021943 - protein, 7 aa, Mycobacterium
QSVSPGI

SEQ ID NO: 1021944 - protein, 14 aa, Mycobacterium
QSWKAPRPREDAAQ

SEQ ID NO: 1021945 - protein, 22 aa, Mycobacterium
QSYPSRSKDPDPVDYSTGSVGI

SEQ ID NO: 1021946 - protein, 10 aa, Mycobacterium
QTAASSSGHP

SEQ ID NO: 1021947 - protein, 5 aa, Mycobacterium
QTADG

SEQ ID NO: 1021948 - protein, 16 aa, Mycobacterium
QTADSSQDRPSLTERE

SEQ ID NO: 1021949 - protein, 4 aa, Mycobacterium
QTAE

SEQ ID NO: 1021950 - protein, 8 aa, Mycobacterium
QTAEEAAS

SEQ ID NO: 1021951 - protein, 10 aa, Mycobacterium
QTAEGAARAG

SEQ ID NO: 1021952 - protein, 4 aa, Mycobacterium
QTAF

SEQ ID NO: 1021953 - protein, 10 aa, Mycobacterium
QTAGATDPVA

SEQ ID NO: 1021954 - protein, 12 aa, Mycobacterium
QTAGDKRTLATN

SEQ ID NO: 1021955 - protein, 9 aa, Mycobacterium
QTAGRGRLG

SEQ ID NO: 1021956 - protein, 15 aa, Mycobacterium
QTAGVADTGDTVTPR

SEQ ID NO: 1021957 - protein, 10 aa, Mycobacterium
QTAMTAPGGV

SEQ ID NO: 1021958 - protein, 11 aa, Mycobacterium
QTAPSPTDQRE

SEQ ID NO: 1021959 - protein, 10 aa, Mycobacterium
QTAQNGISHQ

SEQ ID NO: 1021960 - protein, 4 aa, Mycobacterium
QTAR

SEQ ID NO: 1021961 - protein, 9 aa, Mycobacterium
QTDAKTGKP

SEQ ID NO: 1021962 - protein, 44 aa, Mycobacterium; identical to SEQ ID NO: 555011

SEQ ID NO: 1021963 - protein, 6 aa, Mycobacterium
QTDGRL

SEQ ID NO: 1021964 - protein, 4 aa, Mycobacterium
QTDI

SEQ ID NO: 1021965 - protein, 5 aa, Mycobacterium
QTDPY

SEQ ID NO: 1021966 - protein, 5 aa, Mycobacterium
QTDYN

SEQ ID NO: 1021967 - protein, 5 aa, Mycobacterium
QTEAM

SEQ ID NO: 1021968 - protein, 10 aa, Mycobacterium
QTEESRPHYG

SEQ ID NO: 1021969 - protein, 9 aa, Mycobacterium
QTEGGRERI

SEQ ID NO: 1021970 - protein, 5 aa, Mycobacterium
QTEGM

SEQ ID NO: 1021971 - protein, 7 aa, Mycobacterium
QTEGSGF

SEQ ID NO: 1021972 - protein, 4 aa, Mycobacterium
QTEK

SEQ ID NO: 1021973 - protein, 11 aa, Mycobacterium
QTFGGGSRTAA

SEQ ID NO: 1021974 - protein, 10 aa, Mycobacterium
QTGAAERATV

SEQ ID NO: 1021975 - protein, 4 aa, Mycobacterium
QTGG

SEQ ID NO: 1021976 - protein, 6 aa, Mycobacterium
QTGLDG

SEQ ID NO: 1021977 - protein, 7 aa, Mycobacterium
QTGLSTE

SEQ ID NO: 1021978 - protein, 13 aa, Mycobacterium
QTGPADSLGPEQR

SEQ ID NO: 1021979 - protein, 10 aa, Mycobacterium
QTGPFRPANT

SEQ ID NO: 1021980 - protein, 6 aa, Mycobacterium
QTGQQV

SEQ ID NO: 1021981 - protein, 8 aa, Mycobacterium
QTGSDGAR

SEQ ID NO: 1021982 - protein, 8 aa, Mycobacterium
QTGTAEEL

SEQ ID NO: 1021983 - protein, 30 aa, Mycobacterium
QTGTANSGFANSGTSSSGGLNKSDQQSGFG

SEQ ID NO: 1021984 - protein, 20 aa, Mycobacterium
QTGTEAHDTFSSAERAELHQ

SEQ ID NO: 1021985 - protein, 16 aa, Mycobacterium
QTGTFAQSGRSGGRPA

SEQ ID NO: 1021986 - protein, 12 aa, Mycobacterium
QTGTHPRTRTEA

SEQ ID NO: 1021987 - protein, 4 aa, Mycobacterium
QTHA

SEQ ID NO: 1021988 - protein, 9 aa, Mycobacterium
QTHDPEGPY

SEQ ID NO: 1021989 - protein, 4 aa, Mycobacterium
QTHP

SEQ ID NO: 1021990 - protein, 10 aa, Mycobacterium
QTHREKTAVT

SEQ ID NO: 1021991 - protein, 7 aa, Mycobacterium
QTIEPGG

SEQ ID NO: 1021992 - protein, 9 aa, Mycobacterium
QTIGNQKPE

SEQ ID NO: 1021993 - protein, 10 aa, Mycobacterium
QTKDRESKEN

SEQ ID NO: 1021994 - protein, 34 aa, Mycobacterium
QTKRGGGGGDDEDVTGTTAAGQERRKKLAQDTDD

SEQ ID NO: 1021995 - protein, 9 aa, Mycobacterium
QTKTGTPDE

SEQ ID NO: 1021996 - protein, 11 aa, Mycobacterium
QTLAPQPSRGE

SEQ ID NO: 1021997 - protein, 11 aa, Mycobacterium
QTLDAEQKTAA

SEQ ID NO: 1021998 - protein, 5 aa, Mycobacterium
QTLGA

SEQ ID NO: 1021999 - protein, 6 aa, Mycobacterium
QTLGGS

SEQ ID NO: 1022000 - protein, 7 aa, Mycobacterium
QTLKNRP

SEQ ID NO: 1022001 - protein, 4 aa, Mycobacterium
QTMA

SEQ ID NO: 1022002 - protein, 4 aa, Mycobacterium
QTMD

SEQ ID NO: 1022003 - protein, 6 aa, Mycobacterium
QTMTSR

SEQ ID NO: 1022004 - protein, 22 aa, Mycobacterium
QTNPGDMSPNVDGPLPPGAAPQ

SEQ ID NO: 1022005 - protein, 6 aa, Mycobacterium
QTNPGE

SEQ ID NO: 1022006 - protein, 6 aa, Mycobacterium
QTNYGA

SEQ ID NO: 1022007 - protein, 7 aa, Mycobacterium
QTPAQPV

SEQ ID NO: 1022008 - protein, 4 aa, Mycobacterium
QTPG

SEQ ID NO: 1022009 - protein, 8 aa, Mycobacterium
QTPPKGID

SEQ ID NO: 1022010 - protein, 6 aa, Mycobacterium
QTPQGF

SEQ ID NO: 1022011 - protein, 5 aa, Mycobacterium
QTPSD

SEQ ID NO: 1022012 - protein, 7 aa, Mycobacterium
QTPTEGR

SEQ ID NO: 1022013 - protein, 10 aa, Mycobacterium
QTPTSNGSVE

SEQ ID NO: 1022014 - protein, 4 aa, Mycobacterium
QTQG

SEQ ID NO: 1022015 - protein, 10 aa, Mycobacterium
QTQGQGHETT

SEQ ID NO: 1022016 - protein, 8 aa, Mycobacterium
QTQGTNQD

SEQ ID NO: 1022017 - protein, 8 aa, Mycobacterium
QTQSPGIP

SEQ ID NO: 1022018 - protein, 6 aa, Mycobacterium
QTQTPD

SEQ ID NO: 1022019 - protein, 9 aa, Mycobacterium
QTRADEEGI

SEQ ID NO: 1022020 - protein, 14 aa, Mycobacterium
QTRDTADPPAERSV

SEQ ID NO: 1022021 - protein, 9 aa, Mycobacterium
QTREPNAQV

SEQ ID NO: 1022022 - protein, 5 aa, Mycobacterium
QTRGP

SEQ ID NO: 1022023 - protein, 12 aa, Mycobacterium
QTRGVQRATETG

SEQ ID NO: 1022024 - protein, 10 aa, Mycobacterium
QTRKTEQQLA

SEQ ID NO: 1022025 - protein, 4 aa, Mycobacterium
QTRL

SEQ ID NO: 1022026 - protein, 4 aa, Mycobacterium
QTRP

SEQ ID NO: 1022027 - protein, 12 aa, Mycobacterium
QTSDEELAEYEP

SEQ ID NO: 1022028 - protein, 5 aa, Mycobacterium
QTSLD

SEQ ID NO: 1022029 - protein, 22 aa, Mycobacterium
QTSQDPDHASRIESAANRQAAR

SEQ ID NO: 1022030 - protein, 6 aa, Mycobacterium
QTSSYC

SEQ ID NO: 1022031 - protein, 8 aa, Mycobacterium
QTSTLTET

SEQ ID NO: 1022032 - protein, 5 aa, Mycobacterium
QTTEP

SEQ ID NO: 1022033 - protein, 6 aa, Mycobacterium
QTTGLG

SEQ ID NO: 1022034 - protein, 7 aa, Mycobacterium
QTTGREY

SEQ ID NO: 1022035 - protein, 13 aa, Mycobacterium
QTTPDEAGKSGET

SEQ ID NO: 1022036 - protein, 10 aa, Mycobacterium
QTTPTQLRKD

SEQ ID NO: 1022037 - protein, 8 aa, Mycobacterium
QTTSPLTS

SEQ ID NO: 1022038 - protein, 11 aa, Mycobacterium
QTVPLPDAPQP

SEQ ID NO: 1022039 - protein, 19 aa, Mycobacterium
QTVQAKDAELQKLAGKLTR

SEQ ID NO: 1022040 - protein, 8 aa, Mycobacterium
QTVTGAGR

SEQ ID NO: 1022041 - protein, 11 aa, Mycobacterium
QTYAGTDRQVR

SEQ ID NO: 1022042 - protein, 8 aa, Mycobacterium
QVAAGGDQ

SEQ ID NO: 1022043 - protein, 13 aa, Mycobacterium
QVAATAAAHGYAT

SEQ ID NO: 1022044 - protein, 5 aa, Mycobacterium
QVAEA

SEQ ID NO: 1022045 - protein, 9 aa, Mycobacterium
QVAGPTSSI

SEQ ID NO: 1022046 - protein, 7 aa, Mycobacterium
QVDEDQQ

SEQ ID NO: 1022047 - protein, 8 aa, Mycobacterium
QVDQPGTA

SEQ ID NO: 1022048 - protein, 7 aa, Mycobacterium
QVDSGRV

SEQ ID NO: 1022049 - protein, 6 aa, Mycobacterium
QVEPAR

SEQ ID NO: 1022050 - protein, 4 aa, Mycobacterium
QVGD

SEQ ID NO: 1022051 - protein, 12 aa, Mycobacterium
QVGHRDAAAQVA

SEQ ID NO: 1022052 - protein, 18 aa, Mycobacterium
QVGNRALGDRPSQNLTSG

SEQ ID NO: 1022053 - protein, 6 aa, Mycobacterium
QVGPED

SEQ ID NO: 1022054 - protein, 5 aa, Mycobacterium
QVKPA

SEQ ID NO: 1022055 - protein, 8 aa, Mycobacterium
QVNGRSAA

SEQ ID NO: 1022056 - protein, 7 aa, Mycobacterium
QVNPKRC

SEQ ID NO: 1022057 - protein, 6 aa, Mycobacterium
QVNQGA

SEQ ID NO: 1022058 - protein, 11 aa, Mycobacterium
QVPEPSAPAGR

SEQ ID NO: 1022059 - protein, 12 aa, Mycobacterium
QVPRDYDPAYSK

SEQ ID NO: 1022060 - protein, 13 aa, Mycobacterium
QVPRDYDPAYSKA

SEQ ID NO: 1022061 - protein, 5 aa, Mycobacterium
QVPRG

SEQ ID NO: 1022062 - protein, 12 aa, Mycobacterium
QVQQAIDGKGLL

SEQ ID NO: 1022063 - protein, 11 aa, Mycobacterium
QVQTDAEQGLA

SEQ ID NO: 1022064 - protein, 9 aa, Mycobacterium
QVRAPDPAE

SEQ ID NO: 1022065 - protein, 12 aa, Mycobacterium
QVRDAAPGATES

SEQ ID NO: 1022066 - protein, 5 aa, Mycobacterium
QVRDG

SEQ ID NO: 1022067 - protein, 5 aa, Mycobacterium
QVRPG

SEQ ID NO: 1022068 - protein, 5 aa, Mycobacterium
QVRQP

SEQ ID NO: 1022069 - protein, 21 aa, Mycobacterium
QVRSPSDPGYVPTAPPALSTS

SEQ ID NO: 1022070 - protein, 6 aa, Mycobacterium
QVSDNG

SEQ ID NO: 1022071 - protein, 4 aa, Mycobacterium
QVSQ

SEQ ID NO: 1022072 - protein, 8 aa, Mycobacterium
QVSSGDSD

SEQ ID NO: 1022073 - protein, 5 aa, Mycobacterium
QVTKD

SEQ ID NO: 1022074 - protein, 12 aa, Mycobacterium
QVTTESNGDYGR

SEQ ID NO: 1022075 - protein, 10 aa, Mycobacterium
QVTTTSPQEV

SEQ ID NO: 1022076 - protein, 18 aa, Mycobacterium
QVTVTGTKPGSADYDTDL

SEQ ID NO: 1022077 - protein, 14 aa, Mycobacterium
QVVGPREGDTPRTR

SEQ ID NO: 1022078 - protein, 7 aa, Mycobacterium
QWKATKA

SEQ ID NO: 1022079 - protein, 9 aa, Mycobacterium
QWKQASQQL

SEQ ID NO: 1022080 - protein, 4 aa, Mycobacterium
QWPG

SEQ ID NO: 1022081 - protein, 4 aa, Mycobacterium
QWRP

SEQ ID NO: 1022082 - protein, 5 aa, Mycobacterium
QWSGT

SEQ ID NO: 1022083 - protein, 5 aa, Mycobacterium
QYAKR

SEQ ID NO: 1022084 - protein, 4 aa, Mycobacterium
QYAP

SEQ ID NO: 1022085 - protein, 5 aa, Mycobacterium
QYDRP

SEQ ID NO: 1022086 - protein, 5 aa, Mycobacterium
QYDTP

SEQ ID NO: 1022087 - protein, 5 aa, Mycobacterium
QYEHG

SEQ ID NO: 1022088 - protein, 6 aa, Mycobacterium
QYGAPT

SEQ ID NO: 1022089 - protein, 7 aa, Mycobacterium
QYGGRDA

SEQ ID NO: 1022090 - protein, 12 aa, Mycobacterium
QYGQGPGPGENI

SEQ ID NO: 1022091 - protein, 6 aa, Mycobacterium
QYGSRD

SEQ ID NO: 1022092 - protein, 7 aa, Mycobacterium
QYGSTAE

SEQ ID NO: 1022093 - protein, 12 aa, Mycobacterium
QYPAGDMSVWNW

SEQ ID NO: 1022094 - protein, 4 aa, Mycobacterium
QYPD

SEQ ID NO: 1022095 - protein, 8 aa, Mycobacterium
QYPDDPGK

SEQ ID NO: 1022096 - protein, 5 aa, Mycobacterium
QYPGY

SEQ ID NO: 1022097 - protein, 7 aa, Mycobacterium
QYPPDEL

SEQ ID NO: 1022098 - protein, 10 aa, Mycobacterium
QYPSLTPEQL

SEQ ID NO: 1022099 - protein, 4 aa, Mycobacterium
QYQG

SEQ ID NO: 1022100 - protein, 5 aa, Mycobacterium
QYQSL

SEQ ID NO: 1022101 - protein, 18 aa, Mycobacterium
QYSDAANSSYTTTAGSSK

SEQ ID NO: 1022102 - protein, 12 aa, Mycobacterium
QYSEEQSKGSIT

SEQ ID NO: 1022103 - protein, 5 aa, Mycobacterium
QYTDG

SEQ ID NO: 1022104 - protein, 12 aa, Mycobacterium
QYTREHGEDDPR

SEQ ID NO: 1022105 - protein, 4 aa, Mycobacterium
RAAA

SEQ ID NO: 1022106 - protein, 22 aa, Mycobacterium
RAAAAGEDLESVGRAADATVSR

SEQ ID NO: 1022107 - protein, 7 aa, Mycobacterium
RAAADGK

SEQ ID NO: 1022108 - protein, 6 aa, Mycobacterium
RAAAEA

SEQ ID NO: 1022109 - protein, 8 aa, Mycobacterium
RAAAERGD

SEQ ID NO: 1022110 - protein, 12 aa, Mycobacterium
RAAAGERAQQPR

SEQ ID NO: 1022111 - protein, 5 aa, Mycobacterium
RAAAR

SEQ ID NO: 1022112 - protein, 9 aa, Mycobacterium
RAAAVSGGV

SEQ ID NO: 1022113 - protein, 6 aa, Mycobacterium
RAADAD

SEQ ID NO: 1022114 - protein, 6 aa, Mycobacterium
RAADDR

SEQ ID NO: 1022115 - protein, 17 aa, Mycobacterium
RAADGEALQAASSGGQL

SEQ ID NO: 1022116 - protein, 8 aa, Mycobacterium
RAADPAAM

SEQ ID NO: 1022117 - protein, 5 aa, Mycobacterium
RAADR

SEQ ID NO: 1022118 - protein, 9 aa, Mycobacterium
RAADRAADG

SEQ ID NO: 1022119 - protein, 14 aa, Mycobacterium
RAADTTFDNRTRGQ

SEQ ID NO: 1022120 - protein, 4 aa, Mycobacterium
RAAE

SEQ ID NO: 1022121 - protein, 19 aa, Mycobacterium
RAAEKLSGAVSSALPGSDD

SEQ ID NO: 1022122 - protein, 11 aa, Mycobacterium
RAAETESENPL

SEQ ID NO: 1022123 - protein, 8 aa, Mycobacterium
RAAGADAI

SEQ ID NO: 1022124 - protein, 18 aa, Mycobacterium
RAAGAKAGSSVKPGTPLD

SEQ ID NO: 1022125 - protein, 11 aa, Mycobacterium
RAAGASASASV

SEQ ID NO: 1022126 - protein, 10 aa, Mycobacterium
RAAGDPGEHE

SEQ ID NO: 1022127 - protein, 10 aa, Mycobacterium
RAAGEDAPIP

SEQ ID NO: 1022128 - protein, 6 aa, Mycobacterium
RAAGER

SEQ ID NO: 1022129 - protein, 22 aa, Mycobacterium
RAAGPSSSSMSGGARDRPSIRT

SEQ ID NO: 1022130 - protein, 7 aa, Mycobacterium
RAAGRGA

SEQ ID NO: 1022131 - protein, 65 aa, Mycobacterium
RAAGRGCGAARGAPAGAGQGDGHGLGAGAAQRARPTPKNRYRRVDTGGARVGSGRRVDHAGSRHP

SEQ ID NO: 1022132 - protein, 10 aa, Mycobacterium
RAAGRVEGVR

SEQ ID NO: 1022133 - protein, 10 aa, Mycobacterium
RAAKRRNEAV

SEQ ID NO: 1022134 - protein, 9 aa, Mycobacterium
RAALAGQAQ

SEQ ID NO: 1022135 - protein, 4 aa, Mycobacterium
RAAP

SEQ ID NO: 1022136 - protein, 10 aa, Mycobacterium
RAAPADTGSF

SEQ ID NO: 1022137 - protein, 7 aa, Mycobacterium
RAAPATA

SEQ ID NO: 1022138 - protein, 8 aa, Mycobacterium
RAAPGGQR

SEQ ID NO: 1022139 - protein, 8 aa, Mycobacterium
RAAPGYAA

SEQ ID NO: 1022140 - protein, 5 aa, Mycobacterium
RAAPL

SEQ ID NO: 1022141 - protein, 7 aa, Mycobacterium
RAAPNTD

SEQ ID NO: 1022142 - protein, 11 aa, Mycobacterium
RAAPPHQPGTY

SEQ ID NO: 1022143 - protein, 6 aa, Mycobacterium
RAAPPL

SEQ ID NO: 1022144 - protein, 16 aa, Mycobacterium
RAAPPRCASKSSDWST

SEQ ID NO: 1022145 - protein, 12 aa, Mycobacterium
RAAPRTQQTEVD

SEQ ID NO: 1022146 - protein, 9 aa, Mycobacterium
RAAQAGPAA

SEQ ID NO: 1022147 - protein, 7 aa, Mycobacterium
RAAQDGA

SEQ ID NO: 1022148 - protein, 6 aa, Mycobacterium
RAARDA

SEQ ID NO: 1022149 - protein, 5 aa, Mycobacterium
RAATA

SEQ ID NO: 1022150 - protein, 7 aa, Mycobacterium
RAATAYG

SEQ ID NO: 1022151 - protein, 7 aa, Mycobacterium
RAATDGQ

SEQ ID NO: 1022152 - protein, 8 aa, Mycobacterium
RAATEAAL

SEQ ID NO: 1022153 - protein, 9 aa, Mycobacterium
RAATEDEEQ

SEQ ID NO: 1022154 - protein, 5 aa, Mycobacterium
RAATG

SEQ ID NO: 1022155 - protein, 14 aa, Mycobacterium
RAATGRDESVLTGE

SEQ ID NO: 1022156 - protein, 14 aa, Mycobacterium
RAAVSDADLASAAD

SEQ ID NO: 1022157 - protein, 7 aa, Mycobacterium
RADAEAV

SEQ ID NO: 1022158 - protein, 8 aa, Mycobacterium
RADAPDKV

SEQ ID NO: 1022159 - protein, 7 aa, Mycobacterium
RADAVNP

SEQ ID NO: 1022160 - protein, 4 aa, Mycobacterium
RADD

SEQ ID NO: 1022161 - protein, 5 aa, Mycobacterium
RADDE

SEQ ID NO: 1022162 - protein, 18 aa, Mycobacterium
RADEEAERGHRRTHRTSV

SEQ ID NO: 1022163 - protein, 8 aa, Mycobacterium
RADEIGAG

SEQ ID NO: 1022164 - protein, 8 aa, Mycobacterium
RADEPVAQ

SEQ ID NO: 1022165 - protein, 7 aa, Mycobacterium
RADERAR

SEQ ID NO: 1022166 - protein, 12 aa, Mycobacterium
RADERLRSGESL

SEQ ID NO: 1022167 - protein, 5 aa, Mycobacterium
RADGD

SEQ ID NO: 1022168 - protein, 11 aa, Mycobacterium
RADGDDPRPDF

SEQ ID NO: 1022169 - protein, 7 aa, Mycobacterium
RADGGDA

SEQ ID NO: 1022170 - protein, 9 aa, Mycobacterium
RADGPKINN

SEQ ID NO: 1022171 - protein, 17 aa, Mycobacterium
RADGRQQISRIDSAVPF

SEQ ID NO: 1022172 - protein, 12 aa, Mycobacterium
RADGSNPPERGS

SEQ ID NO: 1022173 - protein, 7 aa, Mycobacterium
RADGTVQ

SEQ ID NO: 1022174 - protein, 5 aa, Mycobacterium
RADGV

SEQ ID NO: 1022175 - protein, 10 aa, Mycobacterium
RADHAEHARR

SEQ ID NO: 1022176 - protein, 9 aa, Mycobacterium
RADPGDTMK

SEQ ID NO: 1022177 - protein, 7 aa, Mycobacterium
RADPPWP

SEQ ID NO: 1022178 - protein, 5 aa, Mycobacterium
RADPQ

SEQ ID NO: 1022179 - protein, 7 aa, Mycobacterium
RADQSLG

SEQ ID NO: 1022180 - protein, 15 aa, Mycobacterium
RADRAFQNRRRCHRP

SEQ ID NO: 1022181 - protein, 8 aa, Mycobacterium
RADRQPEF

SEQ ID NO: 1022182 - protein, 14 aa, Mycobacterium
RADSAVPKKGNDFA

SEQ ID NO: 1022183 - protein, 5 aa, Mycobacterium
RADTQ

SEQ ID NO: 1022184 - protein, 5 aa, Mycobacterium
RAEAA

SEQ ID NO: 1022185 - protein, 9 aa, Mycobacterium
RAEAATAHN

SEQ ID NO: 1022186 - protein, 7 aa, Mycobacterium
RAEADPG

SEQ ID NO: 1022187 - protein, 8 aa, Mycobacterium
RAEAERTI

SEQ ID NO: 1022188 - protein, 6 aa, Mycobacterium
RAEDPV

SEQ ID NO: 1022189 - protein, 6 aa, Mycobacterium
RAEDTI

SEQ ID NO: 1022190 - protein, 4 aa, Mycobacterium
RAEE

SEQ ID NO: 1022191 - protein, 13 aa, Mycobacterium
RAEGDRPATATDA

SEQ ID NO: 1022192 - protein, 5 aa, Mycobacterium
RAEGE

SEQ ID NO: 1022193 - protein, 7 aa, Mycobacterium
RAEGLTD

SEQ ID NO: 1022194 - protein, 9 aa, Mycobacterium
RAEGRDAGW

SEQ ID NO: 1022195 - protein, 9 aa, Mycobacterium
RAEGRRGGE

SEQ ID NO: 1022196 - protein, 11 aa, Mycobacterium
RAEGRVKRDAP

SEQ ID NO: 1022197 - protein, 12 aa, Mycobacterium
RAEHADTRADSL

SEQ ID NO: 1022198 - protein, 7 aa, Mycobacterium
RAEKEQI

SEQ ID NO: 1022199 - protein, 16 aa, Mycobacterium
RAELEEGNFDAARGSY

SEQ ID NO: 1022200 - protein, 10 aa, Mycobacterium
RAENEAGEPL

SEQ ID NO: 1022201 - protein, 9 aa, Mycobacterium
RAENHGEAV

SEQ ID NO: 1022202 - protein, 5 aa, Mycobacterium
RAEPA

SEQ ID NO: 1022203 - protein, 5 aa, Mycobacterium
RAEPD

SEQ ID NO: 1022204 - protein, 5 aa, Mycobacterium
RAEPV

SEQ ID NO: 1022205 - protein, 15 aa, Mycobacterium
RAEQAGSQRESRYGA

SEQ ID NO: 1022206 - protein, 10 aa, Mycobacterium
RAERAGGELS

SEQ ID NO: 1022207 - protein, 8 aa, Mycobacterium
RAERAQRG

SEQ ID NO: 1022208 - protein, 7 aa, Mycobacterium
RAEREQG

SEQ ID NO: 1022209 - protein, 7 aa, Mycobacterium
RAERQGD

SEQ ID NO: 1022210 - protein, 6 aa, Mycobacterium
RAERRE

SEQ ID NO: 1022211 - protein, 15 aa, Mycobacterium
RAERTASQARSAAAA

SEQ ID NO: 1022212 - protein, 6 aa, Mycobacterium
RAESAG

SEQ ID NO: 1022213 - protein, 8 aa, Mycobacterium
RAESGGML

SEQ ID NO: 1022214 - protein, 10 aa, Mycobacterium
RAESRRNGAS

SEQ ID NO: 1022215 - protein, 4 aa, Mycobacterium
RAET

SEQ ID NO: 1022216 - protein, 6 aa, Mycobacterium
RAETNA

SEQ ID NO: 1022217 - protein, 9 aa, Mycobacterium
RAETPEQQQ

SEQ ID NO: 1022218 - protein, 5 aa, Mycobacterium
RAEVA

SEQ ID NO: 1022219 - protein, 7 aa, Mycobacterium
RAEVSQA

SEQ ID NO: 1022220 - protein, 6 aa, Mycobacterium
RAFDGS

SEQ ID NO: 1022221 - protein, 5 aa, Mycobacterium
RAFPG

SEQ ID NO: 1022222 - protein, 7 aa, Mycobacterium
RAFSGGY

SEQ ID NO: 1022223 - protein, 5 aa, Mycobacterium
RAGAA

SEQ ID NO: 1022224 - protein, 7 aa, Mycobacterium
RAGAASE

SEQ ID NO: 1022225 - protein, 6 aa, Mycobacterium
RAGAAV

SEQ ID NO: 1022226 - protein, 51 aa, Mycobacterium; identical to SEQ ID NO: 556719

SEQ ID NO: 1022227 - protein, 19 aa, Mycobacterium
RAGAGYAAADAVNASPLQT

SEQ ID NO: 1022228 - protein, 10 aa, Mycobacterium
RAGAKQIDGS

SEQ ID NO: 1022229 - protein, 11 aa, Mycobacterium
RAGAPEREEND

SEQ ID NO: 1022230 - protein, 9 aa, Mycobacterium
RAGARDERG

SEQ ID NO: 1022231 - protein, 16 aa, Mycobacterium
RAGCPATSRDMGCAGR

SEQ ID NO: 1022232 - protein, 9 aa, Mycobacterium
RAGDFNARS

SEQ ID NO: 1022233 - protein, 4 aa, Mycobacterium
RAGE

SEQ ID NO: 1022234 - protein, 13 aa, Mycobacterium
RAGEADDPAPARL

SEQ ID NO: 1022235 - protein, 7 aa, Mycobacterium
RAGEFRT

SEQ ID NO: 1022236 - protein, 8 aa, Mycobacterium
RAGEPSEV

SEQ ID NO: 1022237 - protein, 5 aa, Mycobacterium
RAGER

SEQ ID NO: 1022238 - protein, 9 aa, Mycobacterium
RAGERGALE

SEQ ID NO: 1022239 - protein, 8 aa, Mycobacterium
RAGETLDD

SEQ ID NO: 1022240 - protein, 6 aa, Mycobacterium
RAGGAP

SEQ ID NO: 1022241 - protein, 7 aa, Mycobacterium
RAGGDAR

SEQ ID NO: 1022242 - protein, 10 aa, Mycobacterium
RAGGDPGSGE

SEQ ID NO: 1022243 - protein, 8 aa, Mycobacterium
RAGGRQAG

SEQ ID NO: 1022244 - protein, 5 aa, Mycobacterium
RAGGT

SEQ ID NO: 1022245 - protein, 6 aa, Mycobacterium
RAGGTA

SEQ ID NO: 1022246 - protein, 8 aa, Mycobacterium
RAGGTAVD

SEQ ID NO: 1022247 - protein, 4 aa, Mycobacterium
RAGH

SEQ ID NO: 1022248 - protein, 8 aa, Mycobacterium
RAGHTDGN

SEQ ID NO: 1022249 - protein, 4 aa, Mycobacterium
RAGI

SEQ ID NO: 1022250 - protein, 5 aa, Mycobacterium
RAGLT

SEQ ID NO: 1022251 - protein, 8 aa, Mycobacterium
RAGNQQAR

SEQ ID NO: 1022252 - protein, 8 aa, Mycobacterium
RAGNSLPT

SEQ ID NO: 1022253 - protein, 8 aa, Mycobacterium
RAGPGEVR

SEQ ID NO: 1022254 - protein, 13 aa, Mycobacterium
RAGPHTGGVDPKI

SEQ ID NO: 1022255 - protein, 5 aa, Mycobacterium
RAGPP

SEQ ID NO: 1022256 - protein, 6 aa, Mycobacterium
RAGQSH

SEQ ID NO: 1022257 - protein, 4 aa, Mycobacterium
RAGR

SEQ ID NO: 1022258 - protein, 9 aa, Mycobacterium
RAGRDQAAV

SEQ ID NO: 1022259 - protein, 5 aa, Mycobacterium
RAGRK

SEQ ID NO: 1022260 - protein, 5 aa, Mycobacterium
RAGRQ

SEQ ID NO: 1022261 - protein, 10 aa, Mycobacterium
RAGRRDGRPV

SEQ ID NO: 1022262 - protein, 10 aa, Mycobacterium
RAGRSRNDQV

SEQ ID NO: 1022263 - protein, 5 aa, Mycobacterium
RAGSA

SEQ ID NO: 1022264 - protein, 7 aa, Mycobacterium
RAGSDAV

SEQ ID NO: 1022265 - protein, 6 aa, Mycobacterium
RAGSDH

SEQ ID NO: 1022266 - protein, 10 aa, Mycobacterium
RAGSGGNGCA

SEQ ID NO: 1022267 - protein, 8 aa, Mycobacterium
RAGSTGAQ

SEQ ID NO: 1022268 - protein, 11 aa, Mycobacterium
RAGTANPISED

SEQ ID NO: 1022269 - protein, 14 aa, Mycobacterium
RAGTPAPAFPSTVG

SEQ ID NO: 1022270 - protein, 4 aa, Mycobacterium
RAGV

SEQ ID NO: 1022271 - protein, 13 aa, Mycobacterium
RAGVRRQKRVEDR

SEQ ID NO: 1022272 - protein, 9 aa, Mycobacterium
RAGVSPASA

SEQ ID NO: 1022273 - protein, 5 aa, Mycobacterium
RAGYE

SEQ ID NO: 1022274 - protein, 25 aa, Mycobacterium
RAHATSRVANRDNNPGFQPNTDGKH

SEQ ID NO: 1022275 - protein, 6 aa, Mycobacterium
RAHEAE

SEQ ID NO: 1022276 - protein, 6 aa, Mycobacterium
RAHEHT

SEQ ID NO: 1022277 - protein, 6 aa, Mycobacterium
RAHPEE

SEQ ID NO: 1022278 - protein, 4 aa, Mycobacterium
RAIT

SEQ ID NO: 1022279 - protein, 29 aa, Mycobacterium
RAKAAKSAPSRPRKAAKPPAPRTRAKATT

SEQ ID NO: 1022280 - protein, 8 aa, Mycobacterium
RAKDAEPL

SEQ ID NO: 1022281 - protein, 6 aa, Mycobacterium
RAKELG

SEQ ID NO: 1022282 - protein, 17 aa, Mycobacterium
RAKPGKAKKAGGTDGLA

SEQ ID NO: 1022283 - protein, 6 aa, Mycobacterium
RAKPGN

SEQ ID NO: 1022284 - protein, 4 aa, Mycobacterium
RAKR

SEQ ID NO: 1022285 - protein, 5 aa, Mycobacterium
RAKTW

SEQ ID NO: 1022286 - protein, 7 aa, Mycobacterium
RALEDPH

SEQ ID NO: 1022287 - protein, 9 aa, Mycobacterium
RALEPAESG

SEQ ID NO: 1022288 - protein, 5 aa, Mycobacterium
RALGD

SEQ ID NO: 1022289 - protein, 22 aa, Mycobacterium
RALPPQPPAPPSRPAAALGADG

SEQ ID NO: 1022290 - protein, 6 aa, Mycobacterium
RALRDG

SEQ ID NO: 1022291 - protein, 5 aa, Mycobacterium
RALSD

SEQ ID NO: 1022292 - protein, 6 aa, Mycobacterium
RALTPP

SEQ ID NO: 1022293 - protein, 7 aa, Mycobacterium
RAMTQTS

SEQ ID NO: 1022294 - protein, 5 aa, Mycobacterium
RANAG

SEQ ID NO: 1022295 - protein, 7 aa, Mycobacterium
RANATAK

SEQ ID NO: 1022296 - protein, 9 aa, Mycobacterium
RANEPTDTE

SEQ ID NO: 1022297 - protein, 5 aa, Mycobacterium
RANGA

SEQ ID NO: 1022298 - protein, 11 aa, Mycobacterium
RANGGGATAIS

SEQ ID NO: 1022299 - protein, 13 aa, Mycobacterium
RANGGKVGGPFAG

SEQ ID NO: 1022300 - protein, 11 aa, Mycobacterium
RANKDNTDSRR

SEQ ID NO: 1022301 - protein, 16 aa, Mycobacterium
RANNPSGHLTVLGHSY

SEQ ID NO: 1022302 - protein, 5 aa, Mycobacterium
RANPH

SEQ ID NO: 1022303 - protein, 47 aa, Mycobacterium
RANPVKAGGTCNRAAPSGATLAPSTRIATSPTIAASQPRARRGIGTT

SEQ ID NO: 1022304 - protein, 7 aa, Mycobacterium
RANRSAR

SEQ ID NO: 1022305 - protein, 8 aa, Mycobacterium
RANTANAL

SEQ ID NO: 1022306 - protein, 12 aa, Mycobacterium
RANTHGPKGLGY

SEQ ID NO: 1022307 - protein, 4 aa, Mycobacterium
RANY

SEQ ID NO: 1022308 - protein, 7 aa, Mycobacterium
RAPADGP

SEQ ID NO: 1022309 - protein, 7 aa, Mycobacterium
RAPAGRW

SEQ ID NO: 1022310 - protein, 9 aa, Mycobacterium
RAPAGTLPG

SEQ ID NO: 1022311 - protein, 6 aa, Mycobacterium
RAPARS

SEQ ID NO: 1022312 - protein, 6 aa, Mycobacterium
RAPATV

SEQ ID NO: 1022313 - protein, 7 aa, Mycobacterium
RAPDSTC

SEQ ID NO: 1022314 - protein, 11 aa, Mycobacterium
RAPDTSPGNLR

SEQ ID NO: 1022315 - protein, 5 aa, Mycobacterium
RAPEF

SEQ ID NO: 1022316 - protein, 5 aa, Mycobacterium
RAPFA

SEQ ID NO: 1022317 - protein, 18 aa, Mycobacterium
RAPGAGRSERSSFPWILL

SEQ ID NO: 1022318 - protein, 6 aa, Mycobacterium
RAPGDP

SEQ ID NO: 1022319 - protein, 7 aa, Mycobacterium
RAPGGAG

SEQ ID NO: 1022320 - protein, 23 aa, Mycobacterium
RAPGLDPGRDQSGVGPISGAVAA

SEQ ID NO: 1022321 - protein, 19 aa, Mycobacterium
RAPGPAGGDDMPDYQRVNV

SEQ ID NO: 1022322 - protein, 5 aa, Mycobacterium
RAPLG

SEQ ID NO: 1022323 - protein, 16 aa, Mycobacterium
RAPPDPRDRGRPPPLR

SEQ ID NO: 1022324 - protein, 7 aa, Mycobacterium
RAPQELT

SEQ ID NO: 1022325 - protein, 4 aa, Mycobacterium
RAPR

SEQ ID NO: 1022326 - protein, 8 aa, Mycobacterium
RAPRGEVS

SEQ ID NO: 1022327 - protein, 6 aa, Mycobacterium
RAPRGI

SEQ ID NO: 1022328 - protein, 14 aa, Mycobacterium
RAPRGYDQGNHADD

SEQ ID NO: 1022329 - protein, 9 aa, Mycobacterium
RAPRSAPIQ

SEQ ID NO: 1022330 - protein, 52 aa, Mycobacterium
RAPRSGDKSGNSDSGDDSGGNEIKGIDGSTRLEAKRQRRRDGRDAGRRRPPV

SEQ ID NO: 1022331 - protein, 7 aa, Mycobacterium
RAPSIHN

SEQ ID NO: 1022332 - protein, 10 aa, Mycobacterium
RAPSPLPPHP

SEQ ID NO: 1022333 - protein, 7 aa, Mycobacterium
RAPSRDT

SEQ ID NO: 1022334 - protein, 4 aa, Mycobacterium
RAPT

SEQ ID NO: 1022335 - protein, 8 aa, Mycobacterium
RAPTNRPD

SEQ ID NO: 1022336 - protein, 8 aa, Mycobacterium
RAPTPPLN

SEQ ID NO: 1022337 - protein, 6 aa, Mycobacterium
RAPVSG

SEQ ID NO: 1022338 - protein, 4 aa, Mycobacterium
RAQA

SEQ ID NO: 1022339 - protein, 8 aa, Mycobacterium
RAQAQDAG

SEQ ID NO: 1022340 - protein, 14 aa, Mycobacterium
RAQARQSVKAATEQ

SEQ ID NO: 1022341 - protein, 10 aa, Mycobacterium
RAQASAAIAD

SEQ ID NO: 1022342 - protein, 8 aa, Mycobacterium
RAQATEDL

SEQ ID NO: 1022343 - protein, 9 aa, Mycobacterium
RAQEAGGQF

SEQ ID NO: 1022344 - protein, 13 aa, Mycobacterium
RAQEGSLSQIDSD

SEQ ID NO: 1022345 - protein, 8 aa, Mycobacterium
RAQEPDWD

SEQ ID NO: 1022346 - protein, 6 aa, Mycobacterium
RAQGAS

SEQ ID NO: 1022347 - protein, 8 aa, Mycobacterium
RAQGNTYQ

SEQ ID NO: 1022348 - protein, 17 aa, Mycobacterium
RAQNPTGAALSAARAEE

SEQ ID NO: 1022349 - protein, 6 aa, Mycobacterium
RAQPGA

SEQ ID NO: 1022350 - protein, 19 aa, Mycobacterium
RAQPGTLKQGEATKKTGTA

SEQ ID NO: 1022351 - protein, 18 aa, Mycobacterium
RAQQRAAARHGAAMRRKR

SEQ ID NO: 1022352 - protein, 4 aa, Mycobacterium
RAQR

SEQ ID NO: 1022353 - protein, 5 aa, Mycobacterium
RAQRA

SEQ ID NO: 1022354 - protein, 10 aa, Mycobacterium
RAQRKTGNVE

SEQ ID NO: 1022355 - protein, 6 aa, Mycobacterium
RAQRNP

SEQ ID NO: 1022356 - protein, 7 aa, Mycobacterium
RAQRRTF

SEQ ID NO: 1022357 - protein, 9 aa, Mycobacterium
RAQSASRGS

SEQ ID NO: 1022358 - protein, 9 aa, Mycobacterium
RAQSEGFTT

SEQ ID NO: 1022359 - protein, 10 aa, Mycobacterium
RAQSVTRTEN

SEQ ID NO: 1022360 - protein, 5 aa, Mycobacterium
RAQTS

SEQ ID NO: 1022361 - protein, 4 aa, Mycobacterium
RAQV

SEQ ID NO: 1022362 - protein, 4 aa, Mycobacterium
RARA

SEQ ID NO: 1022363 - protein, 6 aa, Mycobacterium
RARAAG

SEQ ID NO: 1022364 - protein, 8 aa, Mycobacterium
RARAEAGA

SEQ ID NO: 1022365 - protein, 9 aa, Mycobacterium
RARAGAGPT

SEQ ID NO: 1022366 - protein, 17 aa, Mycobacterium
RARASATGRLHSQDTAG

SEQ ID NO: 1022367 - protein, 16 aa, Mycobacterium
RARDAAQQHGRGSGRG

SEQ ID NO: 1022368 - protein, 14 aa, Mycobacterium
RARDLPKGAVYPGE

SEQ ID NO: 1022369 - protein, 4 aa, Mycobacterium
RARE

SEQ ID NO: 1022370 - protein, 7 aa, Mycobacterium
RAREEGL

SEQ ID NO: 1022371 - protein, 5 aa, Mycobacterium
RARGA

SEQ ID NO: 1022372 - protein, 9 aa, Mycobacterium
RARGDLAPG

SEQ ID NO: 1022373 - protein, 8 aa, Mycobacterium
RARGEEPA

SEQ ID NO: 1022374 - protein, 5 aa, Mycobacterium
RARGG

SEQ ID NO: 1022375 - protein, 7 aa, Mycobacterium
RARGPKV

SEQ ID NO: 1022376 - protein, 10 aa, Mycobacterium
RARGRNQDEL

SEQ ID NO: 1022377 - protein, 7 aa, Mycobacterium
RARKGTL

SEQ ID NO: 1022378 - protein, 5 aa, Mycobacterium
RARLG

SEQ ID NO: 1022379 - protein, 6 aa, Mycobacterium
RARLRT

SEQ ID NO: 1022380 - protein, 6 aa, Mycobacterium
RARNSG

SEQ ID NO: 1022381 - protein, 8 aa, Mycobacterium
RARQAGAT

SEQ ID NO: 1022382 - protein, 5 aa, Mycobacterium
RARQI

SEQ ID NO: 1022383 - protein, 14 aa, Mycobacterium
RARRDQVRATGRSI

SEQ ID NO: 1022384 - protein, 8 aa, Mycobacterium
RARRRGTK

SEQ ID NO: 1022385 - protein, 12 aa, Mycobacterium
RARRSPASRRGS

SEQ ID NO: 1022386 - protein, 13 aa, Mycobacterium
RARSAAVAAAGAA

SEQ ID NO: 1022387 - protein, 9 aa, Mycobacterium
RARSRAGGA

SEQ ID NO: 1022388 - protein, 6 aa, Mycobacterium
RARTNK

SEQ ID NO: 1022389 - protein, 7 aa, Mycobacterium
RARTTGT

SEQ ID NO: 1022390 - protein, 15 aa, Mycobacterium
RASAAERDVTTAAAT

SEQ ID NO: 1022391 - protein, 6 aa, Mycobacterium
RASAGA

SEQ ID NO: 1022392 - protein, 9 aa, Mycobacterium
RASASGPAI

SEQ ID NO: 1022393 - protein, 4 aa, Mycobacterium
RASD

SEQ ID NO: 1022394 - protein, 11 aa, Mycobacterium
RASEPAAEPSI

SEQ ID NO: 1022395 - protein, 4 aa, Mycobacterium
RASF

SEQ ID NO: 1022396 - protein, 4 aa, Mycobacterium
RASG

SEQ ID NO: 1022397 - protein, 10 aa, Mycobacterium
RASGDRRVRS

SEQ ID NO: 1022398 - protein, 9 aa, Mycobacterium
RASGEDSGA

SEQ ID NO: 1022399 - protein, 10 aa, Mycobacterium
RASGSRGPYL

SEQ ID NO: 1022400 - protein, 12 aa, Mycobacterium
RASKAPRSNPEA

SEQ ID NO: 1022401 - protein, 18 aa, Mycobacterium
RASKKRAESWLAAQSAQE

SEQ ID NO: 1022402 - protein, 11 aa, Mycobacterium
RASKQPDAHPT

SEQ ID NO: 1022403 - protein, 8 aa, Mycobacterium
RASNELAS

SEQ ID NO: 1022404 - protein, 17 aa, Mycobacterium
RASPSAGSLAPITDPAK

SEQ ID NO: 1022405 - protein, 8 aa, Mycobacterium
RASQRAEA

SEQ ID NO: 1022406 - protein, 7 aa, Mycobacterium
RASQSGV

SEQ ID NO: 1022407 - protein, 7 aa, Mycobacterium
RASRRGR

SEQ ID NO: 1022408 - protein, 6 aa, Mycobacterium
RASRSD

SEQ ID NO: 1022409 - protein, 8 aa, Mycobacterium
RASRSMQR

SEQ ID NO: 1022410 - protein, 7 aa, Mycobacterium
RASSTQE

SEQ ID NO: 1022411 - protein, 8 aa, Mycobacterium
RASYERRA

SEQ ID NO: 1022412 - protein, 6 aa, Mycobacterium
RATAAG

SEQ ID NO: 1022413 - protein, 7 aa, Mycobacterium
RATAAQS

SEQ ID NO: 1022414 - protein, 13 aa, Mycobacterium
RATADQIGTQTTQ

SEQ ID NO: 1022415 - protein, 14 aa, Mycobacterium
RATADVSAVSGQPM

SEQ ID NO: 1022416 - protein, 16 aa, Mycobacterium
RATALRRAGPSMGPRR

SEQ ID NO: 1022417 - protein, 14 aa, Mycobacterium
RATATGAGWAGPGD

SEQ ID NO: 1022418 - protein, 38 aa, Mycobacterium; identical to SEQ ID NO: 558045

SEQ ID NO: 1022419 - protein, 5 aa, Mycobacterium
RATEE

SEQ ID NO: 1022420 - protein, 4 aa, Mycobacterium
RATG

SEQ ID NO: 1022421 - protein, 9 aa, Mycobacterium
RATGAAEAI

SEQ ID NO: 1022422 - protein, 5 aa, Mycobacterium
RATGE

SEQ ID NO: 1022423 - protein, 12 aa, Mycobacterium
RATGVEYQREGQ

SEQ ID NO: 1022424 - protein, 7 aa, Mycobacterium
RATIGGR

SEQ ID NO: 1022425 - protein, 42 aa, Mycobacterium; identical to SEQ ID NO: 963216

SEQ ID NO: 1022426 - protein, 10 aa, Mycobacterium
RATLREGPVD

SEQ ID NO: 1022427 - protein, 6 aa, Mycobacterium
RATPPI

SEQ ID NO: 1022428 - protein, 8 aa, Mycobacterium
RATQAELT

SEQ ID NO: 1022429 - protein, 7 aa, Mycobacterium
RATRDDI

SEQ ID NO: 1022430 - protein, 7 aa, Mycobacterium
RATRPGA

SEQ ID NO: 1022431 - protein, 6 aa, Mycobacterium
RATRSH

SEQ ID NO: 1022432 - protein, 12 aa, Mycobacterium
RATSAYNQGLEK

SEQ ID NO: 1022433 - protein, 14 aa, Mycobacterium
RATSGDNHLGGDDW

SEQ ID NO: 1022434 - protein, 5 aa, Mycobacterium
RATSQ

SEQ ID NO: 1022435 - protein, 10 aa, Mycobacterium
RATSSALRKA

SEQ ID NO: 1022436 - protein, 6 aa, Mycobacterium
RATTST

SEQ ID NO: 1022437 - protein, 4 aa, Mycobacterium
RATV

SEQ ID NO: 1022438 - protein, 16 aa, Mycobacterium
RAVDDSYANGYSNSKW

SEQ ID NO: 1022439 - protein, 6 aa, Mycobacterium
RAVGPG

SEQ ID NO: 1022440 - protein, 11 aa, Mycobacterium
RAVGPPTRALP

SEQ ID NO: 1022441 - protein, 6 aa, Mycobacterium
RAVKQG

SEQ ID NO: 1022442 - protein, 8 aa, Mycobacterium
RAVPPYES

SEQ ID NO: 1022443 - protein, 4 aa, Mycobacterium
RAVT

SEQ ID NO: 1022444 - protein, 9 aa, Mycobacterium
RAVTTDPAQ

SEQ ID NO: 1022445 - protein, 17 aa, Mycobacterium
RAYDTATRLGERTGQQV

SEQ ID NO: 1022446 - protein, 8 aa, Mycobacterium
RAYEDGGA

SEQ ID NO: 1022447 - protein, 12 aa, Mycobacterium
RAYGTSPDDQAL

SEQ ID NO: 1022448 - protein, 8 aa, Mycobacterium
RAYRSDGQ

SEQ ID NO: 1022449 - protein, 8 aa, Mycobacterium
RCATGTGT

SEQ ID NO: 1022450 - protein, 10 aa, Mycobacterium
RCEACTGDGT

SEQ ID NO: 1022451 - protein, 4 aa, Mycobacterium
RCEG

SEQ ID NO: 1022452 - protein, 7 aa, Mycobacterium
RCEGAAG

SEQ ID NO: 1022453 - protein, 10 aa, Mycobacterium
RCERKSSGIT

SEQ ID NO: 1022454 - protein, 13 aa, Mycobacterium
RCGESDGGQLRSL

SEQ ID NO: 1022455 - protein, 14 aa, Mycobacterium
RCPAPGRRRPARLP

SEQ ID NO: 1022456 - protein, 4 aa, Mycobacterium
RCPN

SEQ ID NO: 1022457 - protein, 31 aa, Mycobacterium
RCRQPRRRRQPRHRHHPGRRRRLGRSRRSER

SEQ ID NO: 1022458 - protein, 11 aa, Mycobacterium
RCTSTAPTSTR

SEQ ID NO: 1022459 - protein, 11 aa, Mycobacterium
RDAAGEPSHVT

SEQ ID NO: 1022460 - protein, 10 aa, Mycobacterium
RDAAGKGGAI

SEQ ID NO: 1022461 - protein, 5 aa, Mycobacterium
RDAAT

SEQ ID NO: 1022462 - protein, 6 aa, Mycobacterium
RDADRP

SEQ ID NO: 1022463 - protein, 13 aa, Mycobacterium
RDAEKQAALAGGG

SEQ ID NO: 1022464 - protein, 5 aa, Mycobacterium
RDAGD

SEQ ID NO: 1022465 - protein, 5 aa, Mycobacterium
RDAGL

SEQ ID NO: 1022466 - protein, 8 aa, Mycobacterium
RDAGYDDV

SEQ ID NO: 1022467 - protein, 9 aa, Mycobacterium
RDAHGDPDW

SEQ ID NO: 1022468 - protein, 6 aa, Mycobacterium
RDAPAQ

SEQ ID NO: 1022469 - protein, 6 aa, Mycobacterium
RDARDR

SEQ ID NO: 1022470 - protein, 10 aa, Mycobacterium
RDATDEERAR

SEQ ID NO: 1022471 - protein, 9 aa, Mycobacterium
RDATRRGRA

SEQ ID NO: 1022472 - protein, 4 aa, Mycobacterium
RDAV

SEQ ID NO: 1022473 - protein, 12 aa, Mycobacterium
RDAVSEFPSDRG

SEQ ID NO: 1022474 - protein, 8 aa, Mycobacterium
RDCEAAGD

SEQ ID NO: 1022475 - protein, 4 aa, Mycobacterium
RDCG

SEQ ID NO: 1022476 - protein, 7 aa, Mycobacterium
RDDAADD

SEQ ID NO: 1022477 - protein, 9 aa, Mycobacterium
RDDDPSAGC

SEQ ID NO: 1022478 - protein, 4 aa, Mycobacterium
RDDF

SEQ ID NO: 1022479 - protein, 10 aa, Mycobacterium
RDDFEPNSVP

SEQ ID NO: 1022480 - protein, 10 aa, Mycobacterium
RDDGAGELGR

SEQ ID NO: 1022481 - protein, 5 aa, Mycobacterium
RDDID

SEQ ID NO: 1022482 - protein, 8 aa, Mycobacterium
RDDLPDGG

SEQ ID NO: 1022483 - protein, 11 aa, Mycobacterium
RDDPETPYATS

SEQ ID NO: 1022484 - protein, 9 aa, Mycobacterium
RDDPSSVDP

SEQ ID NO: 1022485 - protein, 13 aa, Mycobacterium
RDDPTSGAAASAA

SEQ ID NO: 1022486 - protein, 15 aa, Mycobacterium
RDDPVDELEQPVFAW

SEQ ID NO: 1022487 - protein, 9 aa, Mycobacterium
RDDSAARGG

SEQ ID NO: 1022488 - protein, 6 aa, Mycobacterium
RDDTDL

SEQ ID NO: 1022489 - protein, 9 aa, Mycobacterium
RDDTQARQT

SEQ ID NO: 1022490 - protein, 7 aa, Mycobacterium
RDDVDEA

SEQ ID NO: 1022491 - protein, 8 aa, Mycobacterium
RDEADDRP

SEQ ID NO: 1022492 - protein, 7 aa, Mycobacterium
RDEDGRW

SEQ ID NO: 1022493 - protein, 10 aa, Mycobacterium
RDEDRDEIEG

SEQ ID NO: 1022494 - protein, 9 aa, Mycobacterium
RDEDWSGRT

SEQ ID NO: 1022495 - protein, 4 aa, Mycobacterium
RDEG

SEQ ID NO: 1022496 - protein, 7 aa, Mycobacterium
RDEGADI

SEQ ID NO: 1022497 - protein, 7 aa, Mycobacterium
RDEGIAS

SEQ ID NO: 1022498 - protein, 15 aa, Mycobacterium
RDEGPKGVKTQIQGE

SEQ ID NO: 1022499 - protein, 7 aa, Mycobacterium
RDELPAK

SEQ ID NO: 1022500 - protein, 10 aa, Mycobacterium
RDEPHADAEK

SEQ ID NO: 1022501 - protein, 7 aa, Mycobacterium
RDEPPLP

SEQ ID NO: 1022502 - protein, 6 aa, Mycobacterium
RDEPSL

SEQ ID NO: 1022503 - protein, 7 aa, Mycobacterium
RDEQDPR

SEQ ID NO: 1022504 - protein, 4 aa, Mycobacterium
RDER

SEQ ID NO: 1022505 - protein, 7 aa, Mycobacterium
RDERGVP

SEQ ID NO: 1022506 - protein, 11 aa, Mycobacterium
RDERRRANIES

SEQ ID NO: 1022507 - protein, 8 aa, Mycobacterium
RDERTRAK

SEQ ID NO: 1022508 - protein, 5 aa, Mycobacterium
RDESD

SEQ ID NO: 1022509 - protein, 12 aa, Mycobacterium
RDESDRLGDGPL

SEQ ID NO: 1022510 - protein, 4 aa, Mycobacterium
RDFA

SEQ ID NO: 1022511 - protein, 6 aa, Mycobacterium
RDFPGA

SEQ ID NO: 1022512 - protein, 7 aa, Mycobacterium
RDGAAAD

SEQ ID NO: 1022513 - protein, 5 aa, Mycobacterium
RDGAG

SEQ ID NO: 1022514 - protein, 8 aa, Mycobacterium
RDGAPQLY

SEQ ID NO: 1022515 - protein, 18 aa, Mycobacterium
RDGATLAAGGRRPATPEA

SEQ ID NO: 1022516 - protein, 5 aa, Mycobacterium
RDGAY

SEQ ID NO: 1022517 - protein, 4 aa, Mycobacterium
RDGD

SEQ ID NO: 1022518 - protein, 5 aa, Mycobacterium
RDGDD

SEQ ID NO: 1022519 - protein, 6 aa, Mycobacterium
RDGDDL

SEQ ID NO: 1022520 - protein, 18 aa, Mycobacterium
RDGDGPDARYRNTAETAR

SEQ ID NO: 1022521 - protein, 5 aa, Mycobacterium
RDGDL

SEQ ID NO: 1022522 - protein, 8 aa, Mycobacterium
RDGDTARD

SEQ ID NO: 1022523 - protein, 9 aa, Mycobacterium
RDGDTDPVE

SEQ ID NO: 1022524 - protein, 4 aa, Mycobacterium
RDGE

SEQ ID NO: 1022525 - protein, 10 aa, Mycobacterium
RDGEAIRTGR

SEQ ID NO: 1022526 - protein, 7 aa, Mycobacterium
RDGEIDE

SEQ ID NO: 1022527 - protein, 7 aa, Mycobacterium
RDGEIYQ

SEQ ID NO: 1022528 - protein, 5 aa, Mycobacterium
RDGEP

SEQ ID NO: 1022529 - protein, 7 aa, Mycobacterium
RDGEQGR

SEQ ID NO: 1022530 - protein, 9 aa, Mycobacterium
RDGERGQVQ

SEQ ID NO: 1022531 - protein, 26 aa, Mycobacterium
RDGGAGGAGGDGVGSAGGSGGLGGAA

SEQ ID NO: 1022532 - protein, 15 aa, Mycobacterium
RDGGDRYGGKGVKKA

SEQ ID NO: 1022533 - protein, 15 aa, Mycobacterium
RDGGEIRNGSDLPRI

SEQ ID NO: 1022534 - protein, 9 aa, Mycobacterium
RDGGELGDQ

SEQ ID NO: 1022535 - protein, 30 aa, Mycobacterium
RDGGGAADGSARCRAAQRPKTAAARPRSGL

SEQ ID NO: 1022536 - protein, 8 aa, Mycobacterium
RDGGRLSD

SEQ ID NO: 1022537 - protein, 8 aa, Mycobacterium
RDGGTNLT

SEQ ID NO: 1022538 - protein, 5 aa, Mycobacterium
RDGGV

SEQ ID NO: 1022539 - protein, 9 aa, Mycobacterium
RDGGVGAGS

SEQ ID NO: 1022540 - protein, 7 aa, Mycobacterium
RDGHGGA

SEQ ID NO: 1022541 - protein, 6 aa, Mycobacterium
RDGHRN

SEQ ID NO: 1022542 - protein, 4 aa, Mycobacterium
RDGL

SEQ ID NO: 1022543 - protein, 5 aa, Mycobacterium
RDGLP

SEQ ID NO: 1022544 - protein, 7 aa, Mycobacterium
RDGLPDG

SEQ ID NO: 1022545 - protein, 4 aa, Mycobacterium
RDGM

SEQ ID NO: 1022546 - protein, 11 aa, Mycobacterium
RDGNGDPLPAE

SEQ ID NO: 1022547 - protein, 5 aa, Mycobacterium
RDGNQ

SEQ ID NO: 1022548 - protein, 7 aa, Mycobacterium
RDGPASA

SEQ ID NO: 1022549 - protein, 8 aa, Mycobacterium
RDGPDAGL

SEQ ID NO: 1022550 - protein, 7 aa, Mycobacterium
RDGPGAE

SEQ ID NO: 1022551 - protein, 13 aa, Mycobacterium
RDGPSRRKAQTPL

SEQ ID NO: 1022552 - protein, 6 aa, Mycobacterium
RDGPVA

SEQ ID NO: 1022553 - protein, 4 aa, Mycobacterium
RDGQ

SEQ ID NO: 1022554 - protein, 14 aa, Mycobacterium
RDGQGIALNEVLHA

SEQ ID NO: 1022555 - protein, 5 aa, Mycobacterium
RDGQR

SEQ ID NO: 1022556 - protein, 18 aa, Mycobacterium
RDGQRRHPSDNTDEPARA

SEQ ID NO: 1022557 - protein, 7 aa, Mycobacterium
RDGQTIG

SEQ ID NO: 1022558 - protein, 7 aa, Mycobacterium
RDGRAEE

SEQ ID NO: 1022559 - protein, 8 aa, Mycobacterium
RDGRATGV

SEQ ID NO: 1022560 - protein, 14 aa, Mycobacterium
RDGRPIAPGPRPRL

SEQ ID NO: 1022561 - protein, 4 aa, Mycobacterium
RDGS

SEQ ID NO: 1022562 - protein, 8 aa, Mycobacterium
RDGSGVDS

SEQ ID NO: 1022563 - protein, 6 aa, Mycobacterium
RDGTAD

SEQ ID NO: 1022564 - protein, 9 aa, Mycobacterium
RDGTAERRT

SEQ ID NO: 1022565 - protein, 6 aa, Mycobacterium
RDGTAF

SEQ ID NO: 1022566 - protein, 7 aa, Mycobacterium
RDGTVSD

SEQ ID NO: 1022567 - protein, 9 aa, Mycobacterium
RDGVSRTPV

SEQ ID NO: 1022568 - protein, 4 aa, Mycobacterium
RDGW

SEQ ID NO: 1022569 - protein, 6 aa, Mycobacterium
RDGYEG

SEQ ID NO: 1022570 - protein, 10 aa, Mycobacterium
RDGYGQTVRS

SEQ ID NO: 1022571 - protein, 7 aa, Mycobacterium
RDHGPTV

SEQ ID NO: 1022572 - protein, 5 aa, Mycobacterium
RDHHG

SEQ ID NO: 1022573 - protein, 4 aa, Mycobacterium
RDIA

SEQ ID NO: 1022574 - protein, 4 aa, Mycobacterium
RDIE

SEQ ID NO: 1022575 - protein, 7 aa, Mycobacterium
RDIPPEA

SEQ ID NO: 1022576 - protein, 4 aa, Mycobacterium
RDKQ

SEQ ID NO: 1022577 - protein, 10 aa, Mycobacterium
RDKSKGLEQE

SEQ ID NO: 1022578 - protein, 4 aa, Mycobacterium
RDKT

SEQ ID NO: 1022579 - protein, 7 aa, Mycobacterium
RDKTATA

SEQ ID NO: 1022580 - protein, 9 aa, Mycobacterium
RDKTTDLAP

SEQ ID NO: 1022581 - protein, 6 aa, Mycobacterium
RDLRPT

SEQ ID NO: 1022582 - protein, 6 aa, Mycobacterium
RDLSDD

SEQ ID NO: 1022583 - protein, 7 aa, Mycobacterium
RDMATPN

SEQ ID NO: 1022584 - protein, 5 aa, Mycobacterium
RDNEG

SEQ ID NO: 1022585 - protein, 4 aa, Mycobacterium
RDNG

SEQ ID NO: 1022586 - protein, 8 aa, Mycobacterium
RDNGSGRV

SEQ ID NO: 1022587 - protein, 16 aa, Mycobacterium
RDNIPVEAPDQHGGRM

SEQ ID NO: 1022588 - protein, 9 aa, Mycobacterium
RDNKDDGVL

SEQ ID NO: 1022589 - protein, 8 aa, Mycobacterium
RDNPNDLR

SEQ ID NO: 1022590 - protein, 5 aa, Mycobacterium
RDNQQ

SEQ ID NO: 1022591 - protein, 10 aa, Mycobacterium
RDNSRATTCA

SEQ ID NO: 1022592 - protein, 5 aa, Mycobacterium
RDPAA

SEQ ID NO: 1022593 - protein, 13 aa, Mycobacterium
RDPAAEATTEARK

SEQ ID NO: 1022594 - protein, 13 aa, Mycobacterium
RDPAPRPTPPLPI

SEQ ID NO: 1022595 - protein, 7 aa, Mycobacterium
RDPAQAA

SEQ ID NO: 1022596 - protein, 6 aa, Mycobacterium
RDPDGR

SEQ ID NO: 1022597 - protein, 8 aa, Mycobacterium
RDPDRDEL

SEQ ID NO: 1022598 - protein, 8 aa, Mycobacterium
RDPDSAQR

SEQ ID NO: 1022599 - protein, 9 aa, Mycobacterium
RDPDSVSAA

SEQ ID NO: 1022600 - protein, 7 aa, Mycobacterium
RDPDYPA

SEQ ID NO: 1022601 - protein, 4 aa, Mycobacterium
RDPE

SEQ ID NO: 1022602 - protein, 7 aa, Mycobacterium
RDPEHQQ

SEQ ID NO: 1022603 - protein, 16 aa, Mycobacterium
RDPEKAARIREEDDAM

SEQ ID NO: 1022604 - protein, 5 aa, Mycobacterium
RDPEL

SEQ ID NO: 1022605 - protein, 14 aa, Mycobacterium
RDPETGEPGQWTEP

SEQ ID NO: 1022606 - protein, 4 aa, Mycobacterium
RDPG

SEQ ID NO: 1022607 - protein, 5 aa, Mycobacterium
RDPGE

SEQ ID NO: 1022608 - protein, 6 aa, Mycobacterium
RDPGTP

SEQ ID NO: 1022609 - protein, 6 aa, Mycobacterium
RDPKKA

SEQ ID NO: 1022610 - protein, 6 aa, Mycobacterium
RDPNLT

SEQ ID NO: 1022611 - protein, 5 aa, Mycobacterium
RDPNT

SEQ ID NO: 1022612 - protein, 12 aa, Mycobacterium
RDPQAERRSRIN

SEQ ID NO: 1022613 - protein, 8 aa, Mycobacterium
RDPQSQKR

SEQ ID NO: 1022614 - protein, 12 aa, Mycobacterium
RDPQTGEYRLGP

SEQ ID NO: 1022615 - protein, 8 aa, Mycobacterium
RDPRASGE

SEQ ID NO: 1022616 - protein, 6 aa, Mycobacterium
RDPRDA

SEQ ID NO: 1022617 - protein, 8 aa, Mycobacterium
RDPRNGRN

SEQ ID NO: 1022618 - protein, 7 aa, Mycobacterium
RDPRVPN

SEQ ID NO: 1022619 - protein, 4 aa, Mycobacterium
RDPS

SEQ ID NO: 1022620 - protein, 5 aa, Mycobacterium
RDPSA

SEQ ID NO: 1022621 - protein, 6 aa, Mycobacterium
RDPSAL

SEQ ID NO: 1022622 - protein, 5 aa, Mycobacterium
RDPSF

SEQ ID NO: 1022623 - protein, 6 aa, Mycobacterium
RDPSLR

SEQ ID NO: 1022624 - protein, 17 aa, Mycobacterium
RDPSPRASNWRSSTTLE

SEQ ID NO: 1022625 - protein, 11 aa, Mycobacterium
RDPSRDEARRN

SEQ ID NO: 1022626 - protein, 12 aa, Mycobacterium
RDPSSDATSRLR

SEQ ID NO: 1022627 - protein, 9 aa, Mycobacterium
RDPTADSTD

SEQ ID NO: 1022628 - protein, 8 aa, Mycobacterium
RDPTTAYS

SEQ ID NO: 1022629 - protein, 9 aa, Mycobacterium
RDPYGRTAR

SEQ ID NO: 1022630 - protein, 13 aa, Mycobacterium
RDQASATRRANHQ

SEQ ID NO: 1022631 - protein, 7 aa, Mycobacterium
RDQDLGS

SEQ ID NO: 1022632 - protein, 12 aa, Mycobacterium
RDQDSDRDDLTR

SEQ ID NO: 1022633 - protein, 8 aa, Mycobacterium
RDQGGRRR

SEQ ID NO: 1022634 - protein, 6 aa, Mycobacterium
RDQGWG

SEQ ID NO: 1022635 - protein, 5 aa, Mycobacterium
RDQHG

SEQ ID NO: 1022636 - protein, 4 aa, Mycobacterium
RDQL

SEQ ID NO: 1022637 - protein, 5 aa, Mycobacterium
RDQLS

SEQ ID NO: 1022638 - protein, 6 aa, Mycobacterium
RDQPAR

SEQ ID NO: 1022639 - protein, 15 aa, Mycobacterium
RDQPHPSPIVPPRVD

SEQ ID NO: 1022640 - protein, 26 aa, Mycobacterium
RDQQCGNAEQGRGHQQGVGDGGEVDT

SEQ ID NO: 1022641 - protein, 5 aa, Mycobacterium
RDQRD

SEQ ID NO: 1022642 - protein, 10 aa, Mycobacterium
RDQSEHAGAV

SEQ ID NO: 1022643 - protein, 20 aa, Mycobacterium
RDQTGDIGVSNNNGSGVEQT

SEQ ID NO: 1022644 - protein, 13 aa, Mycobacterium
RDQTGDWDAAGQT

SEQ ID NO: 1022645 - protein, 7 aa, Mycobacterium
RDRAALS

SEQ ID NO: 1022646 - protein, 7 aa, Mycobacterium
RDRAEEL

SEQ ID NO: 1022647 - protein, 9 aa, Mycobacterium
RDRAGKLAQ

SEQ ID NO: 1022648 - protein, 5 aa, Mycobacterium
RDRAR

SEQ ID NO: 1022649 - protein, 9 aa, Mycobacterium
RDRARKQGG

SEQ ID NO: 1022650 - protein, 8 aa, Mycobacterium
RDRDSGSE

SEQ ID NO: 1022651 - protein, 4 aa, Mycobacterium
RDRG

SEQ ID NO: 1022652 - protein, 7 aa, Mycobacterium
RDRGATR

SEQ ID NO: 1022653 - protein, 9 aa, Mycobacterium
RDRKTGIRG

SEQ ID NO: 1022654 - protein, 5 aa, Mycobacterium
RDRLD

SEQ ID NO: 1022655 - protein, 18 aa, Mycobacterium
RDRPDPSTYIGSGKAAEL

SEQ ID NO: 1022656 - protein, 10 aa, Mycobacterium
RDRQDLGHQP

SEQ ID NO: 1022657 - protein, 16 aa, Mycobacterium
RDRRDRQPSSHDALPG

SEQ ID NO: 1022658 - protein, 6 aa, Mycobacterium
RDRRQD

SEQ ID NO: 1022659 - protein, 8 aa, Mycobacterium
RDRRSATD

SEQ ID NO: 1022660 - protein, 14 aa, Mycobacterium
RDRSDAYLSDTGAR

SEQ ID NO: 1022661 - protein, 7 aa, Mycobacterium
RDRTPPR

SEQ ID NO: 1022662 - protein, 8 aa, Mycobacterium
RDRTRHQV

SEQ ID NO: 1022663 - protein, 13 aa, Mycobacterium
RDSADDDDEGHGA

SEQ ID NO: 1022664 - protein, 12 aa, Mycobacterium
RDSADGRVSAVQ

SEQ ID NO: 1022665 - protein, 5 aa, Mycobacterium
RDSAP

SEQ ID NO: 1022666 - protein, 5 aa, Mycobacterium
RDSAT

SEQ ID NO: 1022667 - protein, 8 aa, Mycobacterium
RDSDPVRD

SEQ ID NO: 1022668 - protein, 10 aa, Mycobacterium
RDSEDGSITE

SEQ ID NO: 1022669 - protein, 8 aa, Mycobacterium
RDSGDDVS

SEQ ID NO: 1022670 - protein, 6 aa, Mycobacterium
RDSGDE

SEQ ID NO: 1022671 - protein, 8 aa, Mycobacterium
RDSGPTAV

SEQ ID NO: 1022672 - protein, 10 aa, Mycobacterium
RDSGSGVADY

SEQ ID NO: 1022673 - protein, 5 aa, Mycobacterium
RDSLG

SEQ ID NO: 1022674 - protein, 5 aa, Mycobacterium
RDSQK

SEQ ID NO: 1022675 - protein, 8 aa, Mycobacterium
RDSRHGSA

SEQ ID NO: 1022676 - protein, 9 aa, Mycobacterium
RDSRITPTE

SEQ ID NO: 1022677 - protein, 6 aa, Mycobacterium
RDSSAL

SEQ ID NO: 1022678 - protein, 9 aa, Mycobacterium
RDSYGDHGD

SEQ ID NO: 1022679 - protein, 5 aa, Mycobacterium
RDSYN

SEQ ID NO: 1022680 - protein, 10 aa, Mycobacterium
RDTADISDRE

SEQ ID NO: 1022681 - protein, 9 aa, Mycobacterium
RDTANSEHT

SEQ ID NO: 1022682 - protein, 7 aa, Mycobacterium
RDTATTA

SEQ ID NO: 1022683 - protein, 6 aa, Mycobacterium
RDTDDL

SEQ ID NO: 1022684 - protein, 5 aa, Mycobacterium
RDTDG

SEQ ID NO: 1022685 - protein, 10 aa, Mycobacterium
RDTEADWSEA

SEQ ID NO: 1022686 - protein, 8 aa, Mycobacterium
RDTEAQRE

SEQ ID NO: 1022687 - protein, 11 aa, Mycobacterium
RDTEESAASSL

SEQ ID NO: 1022688 - protein, 4 aa, Mycobacterium
RDTG

SEQ ID NO: 1022689 - protein, 12 aa, Mycobacterium
RDTGFGKDATTL

SEQ ID NO: 1022690 - protein, 6 aa, Mycobacterium
RDTGVR

SEQ ID NO: 1022691 - protein, 9 aa, Mycobacterium
RDTHPDDRR

SEQ ID NO: 1022692 - protein, 7 aa, Mycobacterium
RDTLAAG

SEQ ID NO: 1022693 - protein, 15 aa, Mycobacterium
RDTNTGLGNSGNINT

SEQ ID NO: 1022694 - protein, 10 aa, Mycobacterium
RDTRADAEQR

SEQ ID NO: 1022695 - protein, 8 aa, Mycobacterium
RDTRGREI

SEQ ID NO: 1022696 - protein, 18 aa, Mycobacterium
RDTSKDPVGSAGTDPDGI

SEQ ID NO: 1022697 - protein, 16 aa, Mycobacterium
RDTSLTVPAKTSAGYP

SEQ ID NO: 1022698 - protein, 6 aa, Mycobacterium
RDVDGA

SEQ ID NO: 1022699 - protein, 4 aa, Mycobacterium
RDVP

SEQ ID NO: 1022700 - protein, 5 aa, Mycobacterium
RDVQA

SEQ ID NO: 1022701 - protein, 9 aa, Mycobacterium
RDVTDDEHA

SEQ ID NO: 1022702 - protein, 4 aa, Mycobacterium
RDYG

SEQ ID NO: 1022703 - protein, 6 aa, Mycobacterium
RDYPDA

SEQ ID NO: 1022704 - protein, 13 aa, Mycobacterium
REAAEGLARDPDA

SEQ ID NO: 1022705 - protein, 5 aa, Mycobacterium
REAAN

SEQ ID NO: 1022706 - protein, 13 aa, Mycobacterium
REAARAAERGKQS

SEQ ID NO: 1022707 - protein, 8 aa, Mycobacterium
REAARNSQ

SEQ ID NO: 1022708 - protein, 9 aa, Mycobacterium
REAASMDPQ

SEQ ID NO: 1022709 - protein, 8 aa, Mycobacterium
READNKTR

SEQ ID NO: 1022710 - protein, 11 aa, Mycobacterium
READPDDRRKS

SEQ ID NO: 1022711 - protein, 5 aa, Mycobacterium
READR

SEQ ID NO: 1022712 - protein, 10 aa, Mycobacterium
READTAGRLT

SEQ ID NO: 1022713 - protein, 13 aa, Mycobacterium
REAERGLDPRDVG

SEQ ID NO: 1022714 - protein, 22 aa, Mycobacterium
REAFESGRGAARRAGETVITVG

SEQ ID NO: 1022715 - protein, 4 aa, Mycobacterium
REAH

SEQ ID NO: 1022716 - protein, 8 aa, Mycobacterium
REAISGSI

SEQ ID NO: 1022717 - protein, 14 aa, Mycobacterium
REAPEATAATAAPR

SEQ ID NO: 1022718 - protein, 8 aa, Mycobacterium
REAPGRGT

SEQ ID NO: 1022719 - protein, 7 aa, Mycobacterium
REAQPGK

SEQ ID NO: 1022720 - protein, 5 aa, Mycobacterium
REARR

SEQ ID NO: 1022721 - protein, 4 aa, Mycobacterium
REAS

SEQ ID NO: 1022722 - protein, 4 aa, Mycobacterium
REAT

SEQ ID NO: 1022723 - protein, 10 aa, Mycobacterium
REATSIDPQH

SEQ ID NO: 1022724 - protein, 11 aa, Mycobacterium
REAYGDTSQMS

SEQ ID NO: 1022725 - protein, 9 aa, Mycobacterium
RECAEADQA

SEQ ID NO: 1022726 - protein, 6 aa, Mycobacterium
REDAAE

SEQ ID NO: 1022727 - protein, 8 aa, Mycobacterium
REDGREYL

SEQ ID NO: 1022728 - protein, 6 aa, Mycobacterium
REDGVD

SEQ ID NO: 1022729 - protein, 15 aa, Mycobacterium
REDRPLKREGTPEDI

SEQ ID NO: 1022730 - protein, 5 aa, Mycobacterium
REDTD

SEQ ID NO: 1022731 - protein, 6 aa, Mycobacterium
REDVPE

SEQ ID NO: 1022732 - protein, 8 aa, Mycobacterium
REDVTTEL

SEQ ID NO: 1022733 - protein, 6 aa, Mycobacterium
REEASA

SEQ ID NO: 1022734 - protein, 4 aa, Mycobacterium
REED

SEQ ID NO: 1022735 - protein, 4 aa, Mycobacterium
REEF

SEQ ID NO: 1022736 - protein, 4 aa, Mycobacterium
REEH

SEQ ID NO: 1022737 - protein, 4 aa, Mycobacterium
REEL

SEQ ID NO: 1022738 - protein, 5 aa, Mycobacterium
REELE

SEQ ID NO: 1022739 - protein, 6 aa, Mycobacterium
REELEA

SEQ ID NO: 1022740 - protein, 10 aa, Mycobacterium
REENPDPTMP

SEQ ID NO: 1022741 - protein, 7 aa, Mycobacterium
REERMQR

SEQ ID NO: 1022742 - protein, 6 aa, Mycobacterium
REERPD

SEQ ID NO: 1022743 - protein, 6 aa, Mycobacterium
REESGM

SEQ ID NO: 1022744 - protein, 8 aa, Mycobacterium
REETSSLS

SEQ ID NO: 1022745 - protein, 6 aa, Mycobacterium
REFQGQ

SEQ ID NO: 1022746 - protein, 7 aa, Mycobacterium
REGATTI

SEQ ID NO: 1022747 - protein, 6 aa, Mycobacterium
REGEAA

SEQ ID NO: 1022748 - protein, 11 aa, Mycobacterium
REGEDEDLERA

SEQ ID NO: 1022749 - protein, 10 aa, Mycobacterium
REGERGRGRG

SEQ ID NO: 1022750 - protein, 9 aa, Mycobacterium
REGGGRAVA

SEQ ID NO: 1022751 - protein, 7 aa, Mycobacterium
REGGIND

SEQ ID NO: 1022752 - protein, 7 aa, Mycobacterium
REGGNRD

SEQ ID NO: 1022753 - protein, 9 aa, Mycobacterium
REGNGRSTR

SEQ ID NO: 1022754 - protein, 17 aa, Mycobacterium
REGQASSVTPAGLSSDN

SEQ ID NO: 1022755 - protein, 6 aa, Mycobacterium
REGQTV

SEQ ID NO: 1022756 - protein, 6 aa, Mycobacterium
REGREA

SEQ ID NO: 1022757 - protein, 6 aa, Mycobacterium
REGREG

SEQ ID NO: 1022758 - protein, 5 aa, Mycobacterium
REGRH

SEQ ID NO: 1022759 - protein, 5 aa, Mycobacterium
REGRT

SEQ ID NO: 1022760 - protein, 9 aa, Mycobacterium
REGSARSRD

SEQ ID NO: 1022761 - protein, 11 aa, Mycobacterium
REGSDGKSVAE

SEQ ID NO: 1022762 - protein, 5 aa, Mycobacterium
REGSE

SEQ ID NO: 1022763 - protein, 9 aa, Mycobacterium
REGSEEYLD

SEQ ID NO: 1022764 - protein, 5 aa, Mycobacterium
REGTS

SEQ ID NO: 1022765 - protein, 5 aa, Mycobacterium
REHDA

SEQ ID NO: 1022766 - protein, 6 aa, Mycobacterium
REHGGG

SEQ ID NO: 1022767 - protein, 7 aa, Mycobacterium
REHGRGP

SEQ ID NO: 1022768 - protein, 5 aa, Mycobacterium
REHHD

SEQ ID NO: 1022769 - protein, 10 aa, Mycobacterium
REHPSAPDEH

SEQ ID NO: 1022770 - protein, 18 aa, Mycobacterium
REHQGDSSDASGDASDVE

SEQ ID NO: 1022771 - protein, 5 aa, Mycobacterium
REIAA

SEQ ID NO: 1022772 - protein, 10 aa, Mycobacterium
REIRDTAEAL

SEQ ID NO: 1022773 - protein, 6 aa, Mycobacterium
REISET

SEQ ID NO: 1022774 - protein, 4 aa, Mycobacterium
REKL

SEQ ID NO: 1022775 - protein, 9 aa, Mycobacterium
REKSDPDEI

SEQ ID NO: 1022776 - protein, 5 aa, Mycobacterium
RELDG

SEQ ID NO: 1022777 - protein, 4 aa, Mycobacterium
RELG

SEQ ID NO: 1022778 - protein, 13 aa, Mycobacterium
RELGAKGTDVPAD

SEQ ID NO: 1022779 - protein, 5 aa, Mycobacterium
RELRE

SEQ ID NO: 1022780 - protein, 11 aa, Mycobacterium
RELSGGQQQRV

SEQ ID NO: 1022781 - protein, 8 aa, Mycobacterium
RENADNKL

SEQ ID NO: 1022782 - protein, 7 aa, Mycobacterium
RENAREA

SEQ ID NO: 1022783 - protein, 16 aa, Mycobacterium
RENATPTGELVKVDSG

SEQ ID NO: 1022784 - protein, 4 aa, Mycobacterium
RENL

SEQ ID NO: 1022785 - protein, 10 aa, Mycobacterium
REPAEPIRGG

SEQ ID NO: 1022786 - protein, 17 aa, Mycobacterium
REPANDKERTEMTSADT

SEQ ID NO: 1022787 - protein, 9 aa, Mycobacterium
REPAPTAQE

SEQ ID NO: 1022788 - protein, 4 aa, Mycobacterium
REPD

SEQ ID NO: 1022789 - protein, 18 aa, Mycobacterium
REPFNANEELKKAGNPLD

SEQ ID NO: 1022790 - protein, 10 aa, Mycobacterium
REPGAPHRTE

SEQ ID NO: 1022791 - protein, 5 aa, Mycobacterium
REPGP

SEQ ID NO: 1022792 - protein, 6 aa, Mycobacterium
REPGPR

SEQ ID NO: 1022793 - protein, 9 aa, Mycobacterium
REPGRTDAA

SEQ ID NO: 1022794 - protein, 6 aa, Mycobacterium
REPIPN

SEQ ID NO: 1022795 - protein, 6 aa, Mycobacterium
REPKKE

SEQ ID NO: 1022796 - protein, 6 aa, Mycobacterium
REPLTD

SEQ ID NO: 1022797 - protein, 5 aa, Mycobacterium
REPNK

SEQ ID NO: 1022798 - protein, 13 aa, Mycobacterium
REPRGPWGPGRAV

SEQ ID NO: 1022799 - protein, 4 aa, Mycobacterium
REPY

SEQ ID NO: 1022800 - protein, 4 aa, Mycobacterium
REQA

SEQ ID NO: 1022801 - protein, 16 aa, Mycobacterium
REQGYDGSWTGDENID

SEQ ID NO: 1022802 - protein, 12 aa, Mycobacterium
REQLDQRRVDEE

SEQ ID NO: 1022803 - protein, 11 aa, Mycobacterium
REQLTGDEAHE

SEQ ID NO: 1022804 - protein, 11 aa, Mycobacterium
REQPLTGISGA

SEQ ID NO: 1022805 - protein, 4 aa, Mycobacterium
REQR

SEQ ID NO: 1022806 - protein, 13 aa, Mycobacterium
REQYENQGNPYYS

SEQ ID NO: 1022807 - protein, 14 aa, Mycobacterium
RERARQAAGTDDVP

SEQ ID NO: 1022808 - protein, 4 aa, Mycobacterium
RERD

SEQ ID NO: 1022809 - protein, 4 aa, Mycobacterium
RERG

SEQ ID NO: 1022810 - protein, 12 aa, Mycobacterium
RERGIDATTGDL

SEQ ID NO: 1022811 - protein, 9 aa, Mycobacterium
RERGPGATS

SEQ ID NO: 1022812 - protein, 5 aa, Mycobacterium
RERGT

SEQ ID NO: 1022813 - protein, 8 aa, Mycobacterium
RERPAGEP

SEQ ID NO: 1022814 - protein, 5 aa, Mycobacterium
RERPG

SEQ ID NO: 1022815 - protein, 9 aa, Mycobacterium
RERPGTAAD

SEQ ID NO: 1022816 - protein, 9 aa, Mycobacterium
RERRPDRAI

SEQ ID NO: 1022817 - protein, 13 aa, Mycobacterium
RERSGVKQSKERL

SEQ ID NO: 1022818 - protein, 30 aa, Mycobacterium
RERTAPEGDPPTTSSHTTTTTNAAVVRYAT

SEQ ID NO: 1022819 - protein, 9 aa, Mycobacterium
RERTGTGQL

SEQ ID NO: 1022820 - protein, 7 aa, Mycobacterium
RERTRQG

SEQ ID NO: 1022821 - protein, 7 aa, Mycobacterium
RERYSGG

SEQ ID NO: 1022822 - protein, 15 aa, Mycobacterium
RESAAQRGDATPVGG

SEQ ID NO: 1022823 - protein, 7 aa, Mycobacterium
RESDERM

SEQ ID NO: 1022824 - protein, 5 aa, Mycobacterium
RESEG

SEQ ID NO: 1022825 - protein, 7 aa, Mycobacterium
RESGEVT

SEQ ID NO: 1022826 - protein, 9 aa, Mycobacterium
RESGGAIGG

SEQ ID NO: 1022827 - protein, 6 aa, Mycobacterium
RESGRG

SEQ ID NO: 1022828 - protein, 6 aa, Mycobacterium
RESPGC

SEQ ID NO: 1022829 - protein, 4 aa, Mycobacterium
RESQ

SEQ ID NO: 1022830 - protein, 6 aa, Mycobacterium
RESSLP

SEQ ID NO: 1022831 - protein, 15 aa, Mycobacterium
RESTALDAGGSEPLY

SEQ ID NO: 1022832 - protein, 11 aa, Mycobacterium
RESTAPSDELE

SEQ ID NO: 1022833 - protein, 8 aa, Mycobacterium
RETANWPE

SEQ ID NO: 1022834 - protein, 7 aa, Mycobacterium
RETAPTQ

SEQ ID NO: 1022835 - protein, 13 aa, Mycobacterium
RETASADLPGGPF

SEQ ID NO: 1022836 - protein, 7 aa, Mycobacterium
RETEDSA

SEQ ID NO: 1022837 - protein, 5 aa, Mycobacterium
RETGD

SEQ ID NO: 1022838 - protein, 6 aa, Mycobacterium
RETGSA

SEQ ID NO: 1022839 - protein, 4 aa, Mycobacterium
RETL

SEQ ID NO: 1022840 - protein, 6 aa, Mycobacterium
RETRET

SEQ ID NO: 1022841 - protein, 5 aa, Mycobacterium
RETTK

SEQ ID NO: 1022842 - protein, 5 aa, Mycobacterium
REVAG

SEQ ID NO: 1022843 - protein, 11 aa, Mycobacterium
REVGGGESRYD

SEQ ID NO: 1022844 - protein, 8 aa, Mycobacterium
REVNTAGD

SEQ ID NO: 1022845 - protein, 4 aa, Mycobacterium
REVS

SEQ ID NO: 1022846 - protein, 7 aa, Mycobacterium
REVTRGA

SEQ ID NO: 1022847 - protein, 5 aa, Mycobacterium
REWNP

SEQ ID NO: 1022848 - protein, 5 aa, Mycobacterium
REYDP

SEQ ID NO: 1022849 - protein, 6 aa, Mycobacterium
REYGGR

SEQ ID NO: 1022850 - protein, 4 aa, Mycobacterium
REYT

SEQ ID NO: 1022851 - protein, 7 aa, Mycobacterium
RFADEDS

SEQ ID NO: 1022852 - protein, 10 aa, Mycobacterium
RFAEGTPAGL

SEQ ID NO: 1022853 - protein, 8 aa, Mycobacterium
RFANPTPK

SEQ ID NO: 1022854 - protein, 12 aa, Mycobacterium
RFAPKKSKGRDR

SEQ ID NO: 1022855 - protein, 5 aa, Mycobacterium
RFATS

SEQ ID NO: 1022856 - protein, 6 aa, Mycobacterium
RFGDPE

SEQ ID NO: 1022857 - protein, 9 aa, Mycobacterium
RFGGRDGTN

SEQ ID NO: 1022858 - protein, 7 aa, Mycobacterium
RFGSNAA

SEQ ID NO: 1022859 - protein, 6 aa, Mycobacterium
RFPEQA

SEQ ID NO: 1022860 - protein, 17 aa, Mycobacterium
RFPSTDPSAARCGTERD

SEQ ID NO: 1022861 - protein, 5 aa, Mycobacterium
RFSDT

SEQ ID NO: 1022862 - protein, 6 aa, Mycobacterium
RFSTRA

SEQ ID NO: 1022863 - protein, 10 aa, Mycobacterium
RFTDPAESRT

SEQ ID NO: 1022864 - protein, 15 aa, Mycobacterium
RFTPEAAERTAVPGV

SEQ ID NO: 1022865 - protein, 14 aa, Mycobacterium
RGAAGAEPRSGDGA

SEQ ID NO: 1022866 - protein, 9 aa, Mycobacterium
RGAATSKEI

SEQ ID NO: 1022867 - protein, 4 aa, Mycobacterium
RGAD

SEQ ID NO: 1022868 - protein, 24 aa, Mycobacterium
RGADDTVTAAPVTDVAGSDALPEP

SEQ ID NO: 1022869 - protein, 6 aa, Mycobacterium
RGADGG

SEQ ID NO: 1022870 - protein, 7 aa, Mycobacterium
RGADGPR

SEQ ID NO: 1022871 - protein, 13 aa, Mycobacterium
RGADREPATPEDL

SEQ ID NO: 1022872 - protein, 10 aa, Mycobacterium
RGAEAVTTDD

SEQ ID NO: 1022873 - protein, 10 aa, Mycobacterium
RGAEDTPYGR

SEQ ID NO: 1022874 - protein, 8 aa, Mycobacterium
RGAEGPDN

SEQ ID NO: 1022875 - protein, 8 aa, Mycobacterium
RGAEIGPG

SEQ ID NO: 1022876 - protein, 5 aa, Mycobacterium
RGAEP

SEQ ID NO: 1022877 - protein, 8 aa, Mycobacterium
RGAERVSA

SEQ ID NO: 1022878 - protein, 9 aa, Mycobacterium
RGAESDGGG

SEQ ID NO: 1022879 - protein, 6 aa, Mycobacterium
RGAGVP

SEQ ID NO: 1022880 - protein, 6 aa, Mycobacterium
RGAKAT

SEQ ID NO: 1022881 - protein, 26 aa, Mycobacterium
RGAKTRARARHPDDPATHSADGDNQP

SEQ ID NO: 1022882 - protein, 4 aa, Mycobacterium
RGAL

SEQ ID NO: 1022883 - protein, 21 aa, Mycobacterium
RGALEGDPSGRYSADNNRARR

SEQ ID NO: 1022884 - protein, 17 aa, Mycobacterium
RGANTDVPSLYRWWQNN

SEQ ID NO: 1022885 - protein, 4 aa, Mycobacterium
RGAP

SEQ ID NO: 1022886 - protein, 6 aa, Mycobacterium
RGAPDV

SEQ ID NO: 1022887 - protein, 10 aa, Mycobacterium
RGAPGHGGDA

SEQ ID NO: 1022888 - protein, 14 aa, Mycobacterium
RGAPTGRLASLVWM

SEQ ID NO: 1022889 - protein, 6 aa, Mycobacterium
RGAPVP

SEQ ID NO: 1022890 - protein, 10 aa, Mycobacterium
RGARAGRLDP

SEQ ID NO: 1022891 - protein, 22 aa, Mycobacterium
RGARDGQHDDGGHQAPTGQQPF

SEQ ID NO: 1022892 - protein, 24 aa, Mycobacterium
RGARTNGTKLDDADLRGANPDPSL

SEQ ID NO: 1022893 - protein, 7 aa, Mycobacterium
RGASEAE

SEQ ID NO: 1022894 - protein, 7 aa, Mycobacterium
RGASGAY

SEQ ID NO: 1022895 - protein, 15 aa, Mycobacterium
RGASGRGKSAPRAVS

SEQ ID NO: 1022896 - protein, 12 aa, Mycobacterium
RGASPGAARGCG

SEQ ID NO: 1022897 - protein, 16 aa, Mycobacterium
RGASSAASAASASVDA

SEQ ID NO: 1022898 - protein, 4 aa, Mycobacterium
RGAT

SEQ ID NO: 1022899 - protein, 10 aa, Mycobacterium
RGATATSSSE

SEQ ID NO: 1022900 - protein, 8 aa, Mycobacterium
RGATDPTL

SEQ ID NO: 1022901 - protein, 7 aa, Mycobacterium
RGATHSP

SEQ ID NO: 1022902 - protein, 9 aa, Mycobacterium
RGATTTTTY

SEQ ID NO: 1022903 - protein, 29 aa, Mycobacterium
RGCPPSSCRARSTPAPRHSGPRRSPPGWA

SEQ ID NO: 1022904 - protein, 7 aa, Mycobacterium
RGCTRPG

SEQ ID NO: 1022905 - protein, 10 aa, Mycobacterium
RGDAAAGASK

SEQ ID NO: 1022906 - protein, 7 aa, Mycobacterium
RGDAGAA

SEQ ID NO: 1022907 - protein, 6 aa, Mycobacterium
RGDAVA

SEQ ID NO: 1022908 - protein, 5 aa, Mycobacterium
RGDDF

SEQ ID NO: 1022909 - protein, 13 aa, Mycobacterium
RGDDGEQLSDQEI

SEQ ID NO: 1022910 - protein, 6 aa, Mycobacterium
RGDENL

SEQ ID NO: 1022911 - protein, 36 aa, Mycobacterium; identical to SEQ ID NO: 561418

SEQ ID NO: 1022912 - protein, 8 aa, Mycobacterium
RGDGYQPG

SEQ ID NO: 1022913 - protein, 8 aa, Mycobacterium
RGDPAGGG

SEQ ID NO: 1022914 - protein, 8 aa, Mycobacterium
RGDPESGV

SEQ ID NO: 1022915 - protein, 14 aa, Mycobacterium
RGDPPRDDWSPPPI

SEQ ID NO: 1022916 - protein, 19 aa, Mycobacterium
RGDPSDNLPGIPGVGEKTA

SEQ ID NO: 1022917 - protein, 4 aa, Mycobacterium
RGDQ

SEQ ID NO: 1022918 - protein, 9 aa, Mycobacterium
RGDQKNASL

SEQ ID NO: 1022919 - protein, 5 aa, Mycobacterium
RGDQV

SEQ ID NO: 1022920 - protein, 5 aa, Mycobacterium
RGDRA

SEQ ID NO: 1022921 - protein, 14 aa, Mycobacterium
RGDSQAATRTLSDT

SEQ ID NO: 1022922 - protein, 8 aa, Mycobacterium
RGDTGPEL

SEQ ID NO: 1022923 - protein, 20 aa, Mycobacterium
RGDTRGPNRRVSPRRTGGAP

SEQ ID NO: 1022924 - protein, 21 aa, Mycobacterium
RGDVPRGASAGSAPGTDVSDD

SEQ ID NO: 1022925 - protein, 4 aa, Mycobacterium
RGDY

SEQ ID NO: 1022926 - protein, 7 aa, Mycobacterium
RGDYNTG

SEQ ID NO: 1022927 - protein, 8 aa, Mycobacterium
RGDYPKIG

SEQ ID NO: 1022928 - protein, 6 aa, Mycobacterium
RGEAEG

SEQ ID NO: 1022929 - protein, 5 aa, Mycobacterium
RGEAI

SEQ ID NO: 1022930 - protein, 46 aa, Mycobacterium
RGEAKNATRPNRGGAATKTPRRVAHESTDTGSAEPAAARPDPRDPT

SEQ ID NO: 1022931 - protein, 6 aa, Mycobacterium
RGECGG

SEQ ID NO: 1022932 - protein, 4 aa, Mycobacterium
RGEF

SEQ ID NO: 1022933 - protein, 5 aa, Mycobacterium
RGEGA

SEQ ID NO: 1022934 - protein, 7 aa, Mycobacterium
RGEGFTR

SEQ ID NO: 1022935 - protein, 8 aa, Mycobacterium
RGEGLNQE

SEQ ID NO: 1022936 - protein, 6 aa, Mycobacterium
RGEIDG

SEQ ID NO: 1022937 - protein, 13 aa, Mycobacterium
RGEKMSKSLGNTI

SEQ ID NO: 1022938 - protein, 7 aa, Mycobacterium
RGELRGS

SEQ ID NO: 1022939 - protein, 7 aa, Mycobacterium
RGEPADA

SEQ ID NO: 1022940 - protein, 17 aa, Mycobacterium
RGEPERLPSGCEPPPEL

SEQ ID NO: 1022941 - protein, 8 aa, Mycobacterium
RGEPGDPV

SEQ ID NO: 1022942 - protein, 9 aa, Mycobacterium
RGEPGYGSG

SEQ ID NO: 1022943 - protein, 6 aa, Mycobacterium
RGEPSA

SEQ ID NO: 1022944 - protein, 10 aa, Mycobacterium
RGEPVSPSTV

SEQ ID NO: 1022945 - protein, 4 aa, Mycobacterium
RGER

SEQ ID NO: 1022946 - protein, 17 aa, Mycobacterium
RGERRAQIGAGASGPGA

SEQ ID NO: 1022947 - protein, 10 aa, Mycobacterium
RGETDEEDQL

SEQ ID NO: 1022948 - protein, 10 aa, Mycobacterium
RGFPSPREHP

SEQ ID NO: 1022949 - protein, 6 aa, Mycobacterium
RGFSTG

SEQ ID NO: 1022950 - protein, 6 aa, Mycobacterium
RGFTGD

SEQ ID NO: 1022951 - protein, 5 aa, Mycobacterium
RGGAD

SEQ ID NO: 1022952 - protein, 24 aa, Mycobacterium
RGGAGADRHRQDGGVRDPDSVENR

SEQ ID NO: 1022953 - protein, 9 aa, Mycobacterium
RGGAGRTWQ

SEQ ID NO: 1022954 - protein, 10 aa, Mycobacterium
RGGAPGTRET

SEQ ID NO: 1022955 - protein, 4 aa, Mycobacterium
RGGD

SEQ ID NO: 1022956 - protein, 13 aa, Mycobacterium
RGGDDDKDLDEAR

SEQ ID NO: 1022957 - protein, 12 aa, Mycobacterium
RGGDDDSEVSDG

SEQ ID NO: 1022958 - protein, 21 aa, Mycobacterium
RGGDGGNGGNAGATGGNGGNI

SEQ ID NO: 1022959 - protein, 6 aa, Mycobacterium
RGGDLD

SEQ ID NO: 1022960 - protein, 13 aa, Mycobacterium
RGGDPGRPGKNDA

SEQ ID NO: 1022961 - protein, 8 aa, Mycobacterium
RGGDPSAP

SEQ ID NO: 1022962 - protein, 9 aa, Mycobacterium
RGGDRTGNH

SEQ ID NO: 1022963 - protein, 11 aa, Mycobacterium
RGGEKISPERV

SEQ ID NO: 1022964 - protein, 8 aa, Mycobacterium
RGGELDPS

SEQ ID NO: 1022965 - protein, 4 aa, Mycobacterium
RGGF

SEQ ID NO: 1022966 - protein, 10 aa, Mycobacterium
RGGGDGPPLR

SEQ ID NO: 1022967 - protein, 6 aa, Mycobacterium
RGGGEM

SEQ ID NO: 1022968 - protein, 10 aa, Mycobacterium
RGGGEYGPGW

SEQ ID NO: 1022969 - protein, 6 aa, Mycobacterium
RGGGGS

SEQ ID NO: 1022970 - protein, 15 aa, Mycobacterium
RGGGPVRLKSSGKDY

SEQ ID NO: 1022971 - protein, 10 aa, Mycobacterium
RGGISTEESL

SEQ ID NO: 1022972 - protein, 6 aa, Mycobacterium
RGGLTG

SEQ ID NO: 1022973 - protein, 5 aa, Mycobacterium
RGGNA

SEQ ID NO: 1022974 - protein, 11 aa, Mycobacterium
RGGPAGVQATR

SEQ ID NO: 1022975 - protein, 7 aa, Mycobacterium
RGGPARQ

SEQ ID NO: 1022976 - protein, 15 aa, Mycobacterium
RGGPSTGLPTKTEQA

SEQ ID NO: 1022977 - protein, 8 aa, Mycobacterium
RGGQDPDW

SEQ ID NO: 1022978 - protein, 4 aa, Mycobacterium
RGGR

SEQ ID NO: 1022979 - protein, 13 aa, Mycobacterium
RGGRSPAQQERDI

SEQ ID NO: 1022980 - protein, 5 aa, Mycobacterium
RGGSA

SEQ ID NO: 1022981 - protein, 20 aa, Mycobacterium
RGGSARPSRPRRGNDLETET

SEQ ID NO: 1022982 - protein, 6 aa, Mycobacterium
RGGTNE

SEQ ID NO: 1022983 - protein, 12 aa, Mycobacterium
RGHDQPTRLAAP

SEQ ID NO: 1022984 - protein, 14 aa, Mycobacterium
RGHGKSTGRKVPQD

SEQ ID NO: 1022985 - protein, 9 aa, Mycobacterium
RGHGRSGGK

SEQ ID NO: 1022986 - protein, 11 aa, Mycobacterium
RGHGRSSTPQL

SEQ ID NO: 1022987 - protein, 7 aa, Mycobacterium
RGHGTGV

SEQ ID NO: 1022988 - protein, 4 aa, Mycobacterium
RGHL

SEQ ID NO: 1022989 - protein, 5 aa, Mycobacterium
RGHRK

SEQ ID NO: 1022990 - protein, 10 aa, Mycobacterium
RGHSGARETL

SEQ ID NO: 1022991 - protein, 5 aa, Mycobacterium
RGHTS

SEQ ID NO: 1022992 - protein, 6 aa, Mycobacterium
RGITRE

SEQ ID NO: 1022993 - protein, 13 aa, Mycobacterium
RGKARLKRDDHDR

SEQ ID NO: 1022994 - protein, 6 aa, Mycobacterium
RGKEMS

SEQ ID NO: 1022995 - protein, 8 aa, Mycobacterium
RGKESHAA

SEQ ID NO: 1022996 - protein, 16 aa, Mycobacterium
RGKGRLTDADIEATTR

SEQ ID NO: 1022997 - protein, 8 aa, Mycobacterium
RGKLTPRE

SEQ ID NO: 1022998 - protein, 7 aa, Mycobacterium
RGKPIAP

SEQ ID NO: 1022999 - protein, 6 aa, Mycobacterium
RGKRSA

SEQ ID NO: 1023000 - protein, 12 aa, Mycobacterium
RGKTIRPKTLNQ

SEQ ID NO: 1023001 - protein, 13 aa, Mycobacterium
RGLDGDKKARSVR

SEQ ID NO: 1023002 - protein, 9 aa, Mycobacterium
RGLDSDPRI

SEQ ID NO: 1023003 - protein, 5 aa, Mycobacterium
RGLGA

SEQ ID NO: 1023004 - protein, 7 aa, Mycobacterium
RGLGGTQ

SEQ ID NO: 1023005 - protein, 5 aa, Mycobacterium
RGLGR

SEQ ID NO: 1023006 - protein, 8 aa, Mycobacterium
RGLGRPQR

SEQ ID NO: 1023007 - protein, 6 aa, Mycobacterium
RGLPAD

SEQ ID NO: 1023008 - protein, 6 aa, Mycobacterium
RGLPGR

SEQ ID NO: 1023009 - protein, 8 aa, Mycobacterium
RGLPPPQI

SEQ ID NO: 1023010 - protein, 31 aa, Mycobacterium
RGLPTGESDHRPAKTAPLGEGTFDDGYDQVT

SEQ ID NO: 1023011 - protein, 5 aa, Mycobacterium
RGLSG

SEQ ID NO: 1023012 - protein, 12 aa, Mycobacterium
RGLSGAAARFGE

SEQ ID NO: 1023013 - protein, 16 aa, Mycobacterium
RGMKGQSWRGAAGIGE

SEQ ID NO: 1023014 - protein, 11 aa, Mycobacterium
RGMTSEAAERQ

SEQ ID NO: 1023015 - protein, 7 aa, Mycobacterium
RGNAAYT

SEQ ID NO: 1023016 - protein, 8 aa, Mycobacterium
RGNAEVSP

SEQ ID NO: 1023017 - protein, 9 aa, Mycobacterium
RGNGGGLSA

SEQ ID NO: 1023018 - protein, 4 aa, Mycobacterium
RGNP

SEQ ID NO: 1023019 - protein, 9 aa, Mycobacterium
RGNPGPAGY

SEQ ID NO: 1023020 - protein, 11 aa, Mycobacterium
RGNRLPRDERR

SEQ ID NO: 1023021 - protein, 4 aa, Mycobacterium
RGPA

SEQ ID NO: 1023022 - protein, 10 aa, Mycobacterium
RGPAAPGATE

SEQ ID NO: 1023023 - protein, 8 aa, Mycobacterium
RGPAATSI

SEQ ID NO: 1023024 - protein, 5 aa, Mycobacterium
RGPDA

SEQ ID NO: 1023025 - protein, 11 aa, Mycobacterium
RGPDAPGAAEL

SEQ ID NO: 1023026 - protein, 6 aa, Mycobacterium
RGPDAV

SEQ ID NO: 1023027 - protein, 13 aa, Mycobacterium
RGPDYGPEGGPVV

SEQ ID NO: 1023028 - protein, 15 aa, Mycobacterium
RGPEATQLSGDDADE

SEQ ID NO: 1023029 - protein, 8 aa, Mycobacterium
RGPEGDRG

SEQ ID NO: 1023030 - protein, 6 aa, Mycobacterium
RGPGAA

SEQ ID NO: 1023031 - protein, 10 aa, Mycobacterium
RGPGQDAGAR

SEQ ID NO: 1023032 - protein, 4 aa, Mycobacterium
RGPL

SEQ ID NO: 1023033 - protein, 6 aa, Mycobacterium
RGPLRG

SEQ ID NO: 1023034 - protein, 7 aa, Mycobacterium
RGPPALT

SEQ ID NO: 1023035 - protein, 18 aa, Mycobacterium
RGPPRGSGLLRRTVQRHG

SEQ ID NO: 1023036 - protein, 7 aa, Mycobacterium
RGPQAQV

SEQ ID NO: 1023037 - protein, 5 aa, Mycobacterium
RGPRR

SEQ ID NO: 1023038 - protein, 5 aa, Mycobacterium
RGPSA

SEQ ID NO: 1023039 - protein, 8 aa, Mycobacterium
RGPSGFIG

SEQ ID NO: 1023040 - protein, 6 aa, Mycobacterium
RGPSSA

SEQ ID NO: 1023041 - protein, 7 aa, Mycobacterium
RGPSSGF

SEQ ID NO: 1023042 - protein, 4 aa, Mycobacterium
RGPT

SEQ ID NO: 1023043 - protein, 6 aa, Mycobacterium
RGPTGE

SEQ ID NO: 1023044 - protein, 9 aa, Mycobacterium
RGPTGELQR

SEQ ID NO: 1023045 - protein, 4 aa, Mycobacterium
RGPV

SEQ ID NO: 1023046 - protein, 5 aa, Mycobacterium
RGPVA

SEQ ID NO: 1023047 - protein, 10 aa, Mycobacterium
RGPVRGGPDA

SEQ ID NO: 1023048 - protein, 9 aa, Mycobacterium
RGQAYEDPS

SEQ ID NO: 1023049 - protein, 14 aa, Mycobacterium
RGQDGRVLGPGETG

SEQ ID NO: 1023050 - protein, 6 aa, Mycobacterium
RGQDNL

SEQ ID NO: 1023051 - protein, 6 aa, Mycobacterium
RGQEAA

SEQ ID NO: 1023052 - protein, 7 aa, Mycobacterium
RGQEDPF

SEQ ID NO: 1023053 - protein, 20 aa, Mycobacterium
RGQFKTDAASRAEALDLILR

SEQ ID NO: 1023054 - protein, 6 aa, Mycobacterium
RGQGKT

SEQ ID NO: 1023055 - protein, 6 aa, Mycobacterium
RGQGLG

SEQ ID NO: 1023056 - protein, 7 aa, Mycobacterium
RGQPGVH

SEQ ID NO: 1023057 - protein, 5 aa, Mycobacterium
RGQQR

SEQ ID NO: 1023058 - protein, 6 aa, Mycobacterium
RGQSHS

SEQ ID NO: 1023059 - protein, 9 aa, Mycobacterium
RGRDSTEGF

SEQ ID NO: 1023060 - protein, 6 aa, Mycobacterium
RGREDG

SEQ ID NO: 1023061 - protein, 13 aa, Mycobacterium
RGREQPTVAAPRS

SEQ ID NO: 1023062 - protein, 5 aa, Mycobacterium
RGREV

SEQ ID NO: 1023063 - protein, 12 aa, Mycobacterium
RGRGAESAAPLG

SEQ ID NO: 1023064 - protein, 20 aa, Mycobacterium
RGRGDRRGPVGRGSPDGHPS

SEQ ID NO: 1023065 - protein, 6 aa, Mycobacterium
RGRGGF

SEQ ID NO: 1023066 - protein, 6 aa, Mycobacterium
RGRGPV

SEQ ID NO: 1023067 - protein, 10 aa, Mycobacterium
RGRGSTRPDG

SEQ ID NO: 1023068 - protein, 9 aa, Mycobacterium
RGRGVPPER

SEQ ID NO: 1023069 - protein, 10 aa, Mycobacterium
RGRGWETDGG

SEQ ID NO: 1023070 - protein, 5 aa, Mycobacterium
RGRHA

SEQ ID NO: 1023071 - protein, 9 aa, Mycobacterium
RGRITKTEG

SEQ ID NO: 1023072 - protein, 4 aa, Mycobacterium
RGRK

SEQ ID NO: 1023073 - protein, 16 aa, Mycobacterium
RGRLQSTQRQSEREMV

SEQ ID NO: 1023074 - protein, 7 aa, Mycobacterium
RGRPEQR

SEQ ID NO: 1023075 - protein, 13 aa, Mycobacterium
RGRPGGCHRDRAL

SEQ ID NO: 1023076 - protein, 8 aa, Mycobacterium
RGRPPDAD

SEQ ID NO: 1023077 - protein, 19 aa, Mycobacterium
RGRQGATHQRRHYQRYRHR

SEQ ID NO: 1023078 - protein, 5 aa, Mycobacterium
RGRQR

SEQ ID NO: 1023079 - protein, 20 aa, Mycobacterium
RGRQRQTGGPAVAAGSTRAA

SEQ ID NO: 1023080 - protein, 21 aa, Mycobacterium
RGRRRGKRVPEVRDSGTNDLA

SEQ ID NO: 1023081 - protein, 14 aa, Mycobacterium
RGRRTDAKVVEGDP

SEQ ID NO: 1023082 - protein, 4 aa, Mycobacterium
RGRS

SEQ ID NO: 1023083 - protein, 19 aa, Mycobacterium
RGRSEGSAVASDAPGDGPL

SEQ ID NO: 1023084 - protein, 7 aa, Mycobacterium
RGRTEAL

SEQ ID NO: 1023085 - protein, 9 aa, Mycobacterium
RGRTNELNR

SEQ ID NO: 1023086 - protein, 7 aa, Mycobacterium
RGRTPRL

SEQ ID NO: 1023087 - protein, 6 aa, Mycobacterium
RGRVAG

SEQ ID NO: 1023088 - protein, 9 aa, Mycobacterium
RGRVDNDAT

SEQ ID NO: 1023089 - protein, 14 aa, Mycobacterium
RGRYGPAEIPRGTE

SEQ ID NO: 1023090 - protein, 11 aa, Mycobacterium
RGSAKAEDARQ

SEQ ID NO: 1023091 - protein, 6 aa, Mycobacterium
RGSAKR

SEQ ID NO: 1023092 - protein, 11 aa, Mycobacterium
RGSANATTAGF

SEQ ID NO: 1023093 - protein, 4 aa, Mycobacterium
RGSD

SEQ ID NO: 1023094 - protein, 6 aa, Mycobacterium
RGSDEG

SEQ ID NO: 1023095 - protein, 8 aa, Mycobacterium
RGSDGQWR

SEQ ID NO: 1023096 - protein, 7 aa, Mycobacterium
RGSDGRV

SEQ ID NO: 1023097 - protein, 5 aa, Mycobacterium
RGSDV

SEQ ID NO: 1023098 - protein, 8 aa, Mycobacterium
RGSGARSI

SEQ ID NO: 1023099 - protein, 6 aa, Mycobacterium
RGSGFD

SEQ ID NO: 1023100 - protein, 7 aa, Mycobacterium
RGSGPFA

SEQ ID NO: 1023101 - protein, 10 aa, Mycobacterium
RGSGRDAANR

SEQ ID NO: 1023102 - protein, 6 aa, Mycobacterium
RGSMPG

SEQ ID NO: 1023103 - protein, 9 aa, Mycobacterium
RGSNENTNG

SEQ ID NO: 1023104 - protein, 9 aa, Mycobacterium
RGSPGNTIN

SEQ ID NO: 1023105 - protein, 14 aa, Mycobacterium
RGSPRLPPRSRDAH

SEQ ID NO: 1023106 - protein, 11 aa, Mycobacterium
RGSQPTEGAVE

SEQ ID NO: 1023107 - protein, 7 aa, Mycobacterium
RGSRTPD

SEQ ID NO: 1023108 - protein, 8 aa, Mycobacterium
RGSSGERE

SEQ ID NO: 1023109 - protein, 11 aa, Mycobacterium
RGSSSAARSNE

SEQ ID NO: 1023110 - protein, 6 aa, Mycobacterium
RGSTPP

SEQ ID NO: 1023111 - protein, 26 aa, Mycobacterium
RGSTRPPSWQPPATDEYTGEPSPAVR

SEQ ID NO: 1023112 - protein, 6 aa, Mycobacterium
RGSTSA

SEQ ID NO: 1023113 - protein, 9 aa, Mycobacterium
RGSTVSGTR

SEQ ID NO: 1023114 - protein, 4 aa, Mycobacterium
RGSV

SEQ ID NO: 1023115 - protein, 12 aa, Mycobacterium
RGSVGRANPGTQ

SEQ ID NO: 1023116 - protein, 7 aa, Mycobacterium
RGSVPAS

SEQ ID NO: 1023117 - protein, 6 aa, Mycobacterium
RGSVTA

SEQ ID NO: 1023118 - protein, 6 aa, Mycobacterium
RGTADY

SEQ ID NO: 1023119 - protein, 10 aa, Mycobacterium
RGTAGTGGYG

SEQ ID NO: 1023120 - protein, 6 aa, Mycobacterium
RGTANK

SEQ ID NO: 1023121 - protein, 8 aa, Mycobacterium
RGTAQTAG

SEQ ID NO: 1023122 - protein, 4 aa, Mycobacterium
RGTD

SEQ ID NO: 1023123 - protein, 6 aa, Mycobacterium
RGTDAG

SEQ ID NO: 1023124 - protein, 9 aa, Mycobacterium
RGTDPETGT

SEQ ID NO: 1023125 - protein, 7 aa, Mycobacterium
RGTDSLN

SEQ ID NO: 1023126 - protein, 8 aa, Mycobacterium
RGTEADRI

SEQ ID NO: 1023127 - protein, 7 aa, Mycobacterium
RGTEGDL

SEQ ID NO: 1023128 - protein, 11 aa, Mycobacterium
RGTEPGRDRGY

SEQ ID NO: 1023129 - protein, 8 aa, Mycobacterium
RGTGGACP

SEQ ID NO: 1023130 - protein, 9 aa, Mycobacterium
RGTGGSGGT

SEQ ID NO: 1023131 - protein, 11 aa, Mycobacterium
RGTGVSSDVET

SEQ ID NO: 1023132 - protein, 4 aa, Mycobacterium
RGTK

SEQ ID NO: 1023133 - protein, 5 aa, Mycobacterium
RGTLG

SEQ ID NO: 1023134 - protein, 7 aa, Mycobacterium
RGTLGGS

SEQ ID NO: 1023135 - protein, 14 aa, Mycobacterium
RGTLRSGRRQQRES

SEQ ID NO: 1023136 - protein, 9 aa, Mycobacterium
RGTNSGAPN

SEQ ID NO: 1023137 - protein, 4 aa, Mycobacterium
RGTP

SEQ ID NO: 1023138 - protein, 5 aa, Mycobacterium
RGTPD

SEQ ID NO: 1023139 - protein, 6 aa, Mycobacterium
RGTPLS

SEQ ID NO: 1023140 - protein, 10 aa, Mycobacterium
RGTRVRDSSG

SEQ ID NO: 1023141 - protein, 12 aa, Mycobacterium
RGTRYRIASDES

SEQ ID NO: 1023142 - protein, 5 aa, Mycobacterium
RGTSL

SEQ ID NO: 1023143 - protein, 9 aa, Mycobacterium
RGTSVNPVP

SEQ ID NO: 1023144 - protein, 6 aa, Mycobacterium
RGTTPA

SEQ ID NO: 1023145 - protein, 5 aa, Mycobacterium
RGVAP

SEQ ID NO: 1023146 - protein, 5 aa, Mycobacterium
RGVDT

SEQ ID NO: 1023147 - protein, 13 aa, Mycobacterium
RGVEAVGDRGSGR

SEQ ID NO: 1023148 - protein, 5 aa, Mycobacterium
RGVGA

SEQ ID NO: 1023149 - protein, 9 aa, Mycobacterium
RGVGASRPA

SEQ ID NO: 1023150 - protein, 8 aa, Mycobacterium
RGVGHSTP

SEQ ID NO: 1023151 - protein, 7 aa, Mycobacterium
RGVGPGD

SEQ ID NO: 1023152 - protein, 11 aa, Mycobacterium
RGVGSGRYRPQ

SEQ ID NO: 1023153 - protein, 6 aa, Mycobacterium
RGVHTR

SEQ ID NO: 1023154 - protein, 4 aa, Mycobacterium
RGVL

SEQ ID NO: 1023155 - protein, 12 aa, Mycobacterium
RGVPKRSGGSGD

SEQ ID NO: 1023156 - protein, 6 aa, Mycobacterium
RGVSDA

SEQ ID NO: 1023157 - protein, 7 aa, Mycobacterium
RGVSKGE

SEQ ID NO: 1023158 - protein, 5 aa, Mycobacterium
RGVTH

SEQ ID NO: 1023159 - protein, 4 aa, Mycobacterium
RGWG

SEQ ID NO: 1023160 - protein, 7 aa, Mycobacterium
RGWPGQR

SEQ ID NO: 1023161 - protein, 9 aa, Mycobacterium
RGYDGTSIE

SEQ ID NO: 1023162 - protein, 11 aa, Mycobacterium
RGYDSDHPRVQ

SEQ ID NO: 1023163 - protein, 6 aa, Mycobacterium
RGYESK

SEQ ID NO: 1023164 - protein, 6 aa, Mycobacterium
RGYGYG

SEQ ID NO: 1023165 - protein, 7 aa, Mycobacterium
RGYGYGP

SEQ ID NO: 1023166 - protein, 9 aa, Mycobacterium
RGYTPARAA

SEQ ID NO: 1023167 - protein, 11 aa, Mycobacterium
RHAPGSGEEPV

SEQ ID NO: 1023168 - protein, 5 aa, Mycobacterium
RHDPA

SEQ ID NO: 1023169 - protein, 9 aa, Mycobacterium
RHDPDGPYG

SEQ ID NO: 1023170 - protein, 26 aa, Mycobacterium
RHDQRPDRSDGAAQRCPGPLRTHRPP

SEQ ID NO: 1023171 - protein, 10 aa, Mycobacterium
RHDRETGDNF

SEQ ID NO: 1023172 - protein, 14 aa, Mycobacterium
RHEAAGTTHSAEYQ

SEQ ID NO: 1023173 - protein, 9 aa, Mycobacterium
RHEAGPADL

SEQ ID NO: 1023174 - protein, 13 aa, Mycobacterium
RHEGLDDDQRTAQ

SEQ ID NO: 1023175 - protein, 5 aa, Mycobacterium
RHEPS

SEQ ID NO: 1023176 - protein, 4 aa, Mycobacterium
RHER

SEQ ID NO: 1023177 - protein, 8 aa, Mycobacterium
RHGGSGYG

SEQ ID NO: 1023178 - protein, 12 aa, Mycobacterium
RHGHPAKNNYGS

SEQ ID NO: 1023179 - protein, 6 aa, Mycobacterium
RHGPGG

SEQ ID NO: 1023180 - protein, 8 aa, Mycobacterium
RHGRPLDT

SEQ ID NO: 1023181 - protein, 6 aa, Mycobacterium
RHGRSI

SEQ ID NO: 1023182 - protein, 8 aa, Mycobacterium
RHGSTTYT

SEQ ID NO: 1023183 - protein, 5 aa, Mycobacterium
RHGSY

SEQ ID NO: 1023184 - protein, 6 aa, Mycobacterium
RHGTAR

SEQ ID NO: 1023185 - protein, 11 aa, Mycobacterium
RHGVRGVNSGR

SEQ ID NO: 1023186 - protein, 13 aa, Mycobacterium
RHHRQEPQSRSAR

SEQ ID NO: 1023187 - protein, 5 aa, Mycobacterium
RHHTQ

SEQ ID NO: 1023188 - protein, 6 aa, Mycobacterium
RHKGST

SEQ ID NO: 1023189 - protein, 5 aa, Mycobacterium
RHNPD

SEQ ID NO: 1023190 - protein, 16 aa, Mycobacterium
RHPAGPHSSIAKRADH

SEQ ID NO: 1023191 - protein, 5 aa, Mycobacterium
RHPAQ

SEQ ID NO: 1023192 - protein, 10 aa, Mycobacterium
RHPAQSRSHR

SEQ ID NO: 1023193 - protein, 5 aa, Mycobacterium
RHPDE

SEQ ID NO: 1023194 - protein, 6 aa, Mycobacterium
RHPDTS

SEQ ID NO: 1023195 - protein, 4 aa, Mycobacterium
RHPE

SEQ ID NO: 1023196 - protein, 15 aa, Mycobacterium
RHPGAPVPANLGGEP

SEQ ID NO: 1023197 - protein, 6 aa, Mycobacterium
RHPGEQ

SEQ ID NO: 1023198 - protein, 11 aa, Mycobacterium
RHPGGLGPGRR

SEQ ID NO: 1023199 - protein, 5 aa, Mycobacterium
RHPGN

SEQ ID NO: 1023200 - protein, 7 aa, Mycobacterium
RHPGRRS

SEQ ID NO: 1023201 - protein, 12 aa, Mycobacterium
RHPGVKKTKAYK

SEQ ID NO: 1023202 - protein, 22 aa, Mycobacterium
RHPPPGDLSAPGPCRAAGTSDL

SEQ ID NO: 1023203 - protein, 4 aa, Mycobacterium
RHPR

SEQ ID NO: 1023204 - protein, 8 aa, Mycobacterium
RHQGAHGG

SEQ ID NO: 1023205 - protein, 6 aa, Mycobacterium
RHQHGE

SEQ ID NO: 1023206 - protein, 5 aa, Mycobacterium
RHQTP

SEQ ID NO: 1023207 - protein, 12 aa, Mycobacterium
RHRHAGGEYAAR

SEQ ID NO: 1023208 - protein, 31 aa, Mycobacterium
RHRPRPSGSTRPAVPPPPPPTHGATKRSPPD

SEQ ID NO: 1023209 - protein, 14 aa, Mycobacterium
RHRSAGGRAASGWA

SEQ ID NO: 1023210 - protein, 7 aa, Mycobacterium
RHRYESA

SEQ ID NO: 1023211 - protein, 9 aa, Mycobacterium
RHSGKTGEE

SEQ ID NO: 1023212 - protein, 5 aa, Mycobacterium
RHSSG

SEQ ID NO: 1023213 - protein, 17 aa, Mycobacterium
RHTAETTVTEARQRADG

SEQ ID NO: 1023214 - protein, 9 aa, Mycobacterium
RHTGADQAA

SEQ ID NO: 1023215 - protein, 5 aa, Mycobacterium
RHTGS

SEQ ID NO: 1023216 - protein, 6 aa, Mycobacterium
RHTPEG

SEQ ID NO: 1023217 - protein, 6 aa, Mycobacterium
RHTPEI

SEQ ID NO: 1023218 - protein, 15 aa, Mycobacterium
RHTPGGSSGGSAAAV

SEQ ID NO: 1023219 - protein, 17 aa, Mycobacterium
RIAEETAKEEGKPEQAL

SEQ ID NO: 1023220 - protein, 4 aa, Mycobacterium
RIAG

SEQ ID NO: 1023221 - protein, 9 aa, Mycobacterium
RIAQTNASI

SEQ ID NO: 1023222 - protein, 4 aa, Mycobacterium
RIAR

SEQ ID NO: 1023223 - protein, 6 aa, Mycobacterium
RIARDG

SEQ ID NO: 1023224 - protein, 9 aa, Mycobacterium
RIDDPDEAV

SEQ ID NO: 1023225 - protein, 4 aa, Mycobacterium
RIDE

SEQ ID NO: 1023226 - protein, 6 aa, Mycobacterium
RIDENR

SEQ ID NO: 1023227 - protein, 14 aa, Mycobacterium
RIDPGKDADGLHPT

SEQ ID NO: 1023228 - protein, 4 aa, Mycobacterium
RIDT

SEQ ID NO: 1023229 - protein, 5 aa, Mycobacterium
RIEPP

SEQ ID NO: 1023230 - protein, 8 aa, Mycobacterium
RIGDSDQI

SEQ ID NO: 1023231 - protein, 5 aa, Mycobacterium
RIGGA

SEQ ID NO: 1023232 - protein, 20 aa, Mycobacterium
RIGGDGGFGSNTGGAGGSGG

SEQ ID NO: 1023233 - protein, 6 aa, Mycobacterium
RIGPGD

SEQ ID NO: 1023234 - protein, 7 aa, Mycobacterium
RIGPGKA

SEQ ID NO: 1023235 - protein, 75 aa, Mycobacterium
RIGSGSAAAAPPESKPAPAPEAAPETKAAPEPKAAPEPKAAPEPKAAPEPKPAPAATPQPAAAPAPSAGDGTPYV

SEQ ID NO: 1023236 - protein, 5 aa, Mycobacterium
RIGTG

SEQ ID NO: 1023237 - protein, 4 aa, Mycobacterium
RIPA

SEQ ID NO: 1023238 - protein, 8 aa, Mycobacterium
RIPDGSYQ

SEQ ID NO: 1023239 - protein, 10 aa, Mycobacterium
RIPDPDNSRH

SEQ ID NO: 1023240 - protein, 5 aa, Mycobacterium
RIPGK

SEQ ID NO: 1023241 - protein, 5 aa, Mycobacterium
RIPKD

SEQ ID NO: 1023242 - protein, 7 aa, Mycobacterium
RIPNQGL

SEQ ID NO: 1023243 - protein, 13 aa, Mycobacterium
RIPPNQRFESPNP

SEQ ID NO: 1023244 - protein, 15 aa, Mycobacterium
RIPRNAPRRCGSRPA

SEQ ID NO: 1023245 - protein, 9 aa, Mycobacterium
RIPSSSGSA

SEQ ID NO: 1023246 - protein, 7 aa, Mycobacterium
RIPTGPL

SEQ ID NO: 1023247 - protein, 7 aa, Mycobacterium
RIPTRRG

SEQ ID NO: 1023248 - protein, 5 aa, Mycobacterium
RIRAN

SEQ ID NO: 1023249 - protein, 5 aa, Mycobacterium
RIRKT

SEQ ID NO: 1023250 - protein, 9 aa, Mycobacterium
RIRPGASAR

SEQ ID NO: 1023251 - protein, 8 aa, Mycobacterium
RIRRGQVD

SEQ ID NO: 1023252 - protein, 24 aa, Mycobacterium
RIRRQTGDAHRGPGDVGRAETGRP

SEQ ID NO: 1023253 - protein, 10 aa, Mycobacterium
RISGGGNTFE

SEQ ID NO: 1023254 - protein, 9 aa, Mycobacterium
RISSGTHST

SEQ ID NO: 1023255 - protein, 14 aa, Mycobacterium
RISTSACDSRLGAG

SEQ ID NO: 1023256 - protein, 19 aa, Mycobacterium
RITGNTTRSIRHLDLKAQL

SEQ ID NO: 1023257 - protein, 5 aa, Mycobacterium
RITNN

SEQ ID NO: 1023258 - protein, 4 aa, Mycobacterium
RITP

SEQ ID NO: 1023259 - protein, 6 aa, Mycobacterium
RITPAT

SEQ ID NO: 1023260 - protein, 5 aa, Mycobacterium
RITSE

SEQ ID NO: 1023261 - protein, 12 aa, Mycobacterium
RITSPDEPKYDA

SEQ ID NO: 1023262 - protein, 7 aa, Mycobacterium
RITTSGG

SEQ ID NO: 1023263 - protein, 6 aa, Mycobacterium
RKAGRQ

SEQ ID NO: 1023264 - protein, 4 aa, Mycobacterium
RKAM

SEQ ID NO: 1023265 - protein, 15 aa, Mycobacterium
RKAQRDIGGYLDNMG

SEQ ID NO: 1023266 - protein, 6 aa, Mycobacterium
RKATEA

SEQ ID NO: 1023267 - protein, 5 aa, Mycobacterium
RKAVG

SEQ ID NO: 1023268 - protein, 6 aa, Mycobacterium
RKDDPR

SEQ ID NO: 1023269 - protein, 10 aa, Mycobacterium
RKDEGSMAQT

SEQ ID NO: 1023270 - protein, 9 aa, Mycobacterium
RKDTDRDKI

SEQ ID NO: 1023271 - protein, 12 aa, Mycobacterium
RKEAAKTAEAID

SEQ ID NO: 1023272 - protein, 8 aa, Mycobacterium
RKEANTVP

SEQ ID NO: 1023273 - protein, 6 aa, Mycobacterium
RKEGDR

SEQ ID NO: 1023274 - protein, 5 aa, Mycobacterium
RKEGK

SEQ ID NO: 1023275 - protein, 8 aa, Mycobacterium
RKEGSEER

SEQ ID NO: 1023276 - protein, 37 aa, Mycobacterium
RKEGSSKERAARISNAAAAQGTSSVGRKGGKARSYPD

SEQ ID NO: 1023277 - protein, 7 aa, Mycobacterium
RKEIHES

SEQ ID NO: 1023278 - protein, 5 aa, Mycobacterium
RKERL

SEQ ID NO: 1023279 - protein, 18 aa, Mycobacterium
RKESRGGHAREDYPNRDD

SEQ ID NO: 1023280 - protein, 7 aa, Mycobacterium
RKETADR

SEQ ID NO: 1023281 - protein, 6 aa, Mycobacterium
RKFGGG

SEQ ID NO: 1023282 - protein, 9 aa, Mycobacterium
RKGDADAYS

SEQ ID NO: 1023283 - protein, 4 aa, Mycobacterium
RKGL

SEQ ID NO: 1023284 - protein, 8 aa, Mycobacterium
RKGPGQTL

SEQ ID NO: 1023285 - protein, 17 aa, Mycobacterium
RKGPNNNPTAVPGDVGS

SEQ ID NO: 1023286 - protein, 14 aa, Mycobacterium
RKGRKAGSGPQAPE

SEQ ID NO: 1023287 - protein, 8 aa, Mycobacterium
RKGRVEEM

SEQ ID NO: 1023288 - protein, 4 aa, Mycobacterium
RKGS

SEQ ID NO: 1023289 - protein, 6 aa, Mycobacterium
RKHPHS

SEQ ID NO: 1023290 - protein, 9 aa, Mycobacterium
RKIASTAPN

SEQ ID NO: 1023291 - protein, 16 aa, Mycobacterium
RKKGGLSGYPCRAESE

SEQ ID NO: 1023292 - protein, 9 aa, Mycobacterium
RKKGYGTAA

SEQ ID NO: 1023293 - protein, 11 aa, Mycobacterium
RKKKSTPPRYQ

SEQ ID NO: 1023294 - protein, 14 aa, Mycobacterium
RKKQRQPAEYPTDE

SEQ ID NO: 1023295 - protein, 14 aa, Mycobacterium
RKKYGDVDPQRNAQ

SEQ ID NO: 1023296 - protein, 11 aa, Mycobacterium
RKLDKAASKGV

SEQ ID NO: 1023297 - protein, 7 aa, Mycobacterium
RKLGRSG

SEQ ID NO: 1023298 - protein, 7 aa, Mycobacterium
RKLTEGD

SEQ ID NO: 1023299 - protein, 10 aa, Mycobacterium
RKMSKSKGNV

SEQ ID NO: 1023300 - protein, 7 aa, Mycobacterium
RKNGSFA

SEQ ID NO: 1023301 - protein, 8 aa, Mycobacterium
RKNIDTGM

SEQ ID NO: 1023302 - protein, 34 aa, Mycobacterium
RKPAPGRRSRGVRHGDRPHPARAKPVRRETGGAV

SEQ ID NO: 1023303 - protein, 4 aa, Mycobacterium
RKPD

SEQ ID NO: 1023304 - protein, 6 aa, Mycobacterium
RKPEIA

SEQ ID NO: 1023305 - protein, 12 aa, Mycobacterium
RKPGAVTTTSAV

SEQ ID NO: 1023306 - protein, 10 aa, Mycobacterium
RKPGPAQHPT

SEQ ID NO: 1023307 - protein, 13 aa, Mycobacterium
RKPKDLSGGQRQR

SEQ ID NO: 1023308 - protein, 26 aa, Mycobacterium
RKPKPRKRGAHTGAAASGDAVTAPMQ

SEQ ID NO: 1023309 - protein, 7 aa, Mycobacterium
RKPNPHL

SEQ ID NO: 1023310 - protein, 7 aa, Mycobacterium
RKPRPAF

SEQ ID NO: 1023311 - protein, 18 aa, Mycobacterium
RKPVEGPVGSPPELGPYN

SEQ ID NO: 1023312 - protein, 7 aa, Mycobacterium
RKPVPIP

SEQ ID NO: 1023313 - protein, 5 aa, Mycobacterium
RKPVQ

SEQ ID NO: 1023314 - protein, 16 aa, Mycobacterium
RKQESADAAAAEVGER

SEQ ID NO: 1023315 - protein, 8 aa, Mycobacterium
RKQPYSAL

SEQ ID NO: 1023316 - protein, 8 aa, Mycobacterium
RKRDADGA

SEQ ID NO: 1023317 - protein, 9 aa, Mycobacterium
RKREDRDRS

SEQ ID NO: 1023318 - protein, 7 aa, Mycobacterium
RKRGSRC

SEQ ID NO: 1023319 - protein, 5 aa, Mycobacterium
RKRHP

SEQ ID NO: 1023320 - protein, 8 aa, Mycobacterium
RKRKEKAL

SEQ ID NO: 1023321 - protein, 10 aa, Mycobacterium
RKRNTPQAYD

SEQ ID NO: 1023322 - protein, 14 aa, Mycobacterium
RKRPADLDAARSGF

SEQ ID NO: 1023323 - protein, 12 aa, Mycobacterium
RKRPRGRPPKVA

SEQ ID NO: 1023324 - protein, 7 aa, Mycobacterium
RKRREEL

SEQ ID NO: 1023325 - protein, 7 aa, Mycobacterium
RKRSPSA

SEQ ID NO: 1023326 - protein, 8 aa, Mycobacterium
RKRSVSEI

SEQ ID NO: 1023327 - protein, 14 aa, Mycobacterium
RKSAGLPPHPSARQ

SEQ ID NO: 1023328 - protein, 5 aa, Mycobacterium
RKSES

SEQ ID NO: 1023329 - protein, 6 aa, Mycobacterium
RKSGAL

SEQ ID NO: 1023330 - protein, 31 aa, Mycobacterium
RKSGTKKGTSVGSGGQRRRGLEGRGPTPSAH

SEQ ID NO: 1023331 - protein, 9 aa, Mycobacterium
RKSGTPRNA

SEQ ID NO: 1023332 - protein, 20 aa, Mycobacterium
RKSQHPPEVAEPSNGPPVPA

SEQ ID NO: 1023333 - protein, 5 aa, Mycobacterium
RKSRS

SEQ ID NO: 1023334 - protein, 8 aa, Mycobacterium
RKSTGLDV

SEQ ID NO: 1023335 - protein, 7 aa, Mycobacterium
RKTGKTA

SEQ ID NO: 1023336 - protein, 9 aa, Mycobacterium
RKTGQPWRT

SEQ ID NO: 1023337 - protein, 17 aa, Mycobacterium
RKTPPAVPAEYRGLHGR

SEQ ID NO: 1023338 - protein, 9 aa, Mycobacterium
RKTSDDDLA

SEQ ID NO: 1023339 - protein, 4 aa, Mycobacterium
RKTT

SEQ ID NO: 1023340 - protein, 5 aa, Mycobacterium
RKTTV

SEQ ID NO: 1023341 - protein, 7 aa, Mycobacterium
RKTYRYS

SEQ ID NO: 1023342 - protein, 13 aa, Mycobacterium
RKVAADSGIDGPT

SEQ ID NO: 1023343 - protein, 7 aa, Mycobacterium
RKVAEGR

SEQ ID NO: 1023344 - protein, 6 aa, Mycobacterium
RKYGPP

SEQ ID NO: 1023345 - protein, 8 aa, Mycobacterium
RLADEGIG

SEQ ID NO: 1023346 - protein, 6 aa, Mycobacterium
RLADGN

SEQ ID NO: 1023347 - protein, 8 aa, Mycobacterium
RLADSTGA

SEQ ID NO: 1023348 - protein, 10 aa, Mycobacterium
RLAETSTSAT

SEQ ID NO: 1023349 - protein, 7 aa, Mycobacterium
RLAGSDV

SEQ ID NO: 1023350 - protein, 5 aa, Mycobacterium
RLAPG

SEQ ID NO: 1023351 - protein, 17 aa, Mycobacterium
RLAQEESDRITTRLAAL

SEQ ID NO: 1023352 - protein, 15 aa, Mycobacterium
RLAQSGSAHGCPGRP

SEQ ID NO: 1023353 - protein, 16 aa, Mycobacterium
RLASEKNGLMICTDCA

SEQ ID NO: 1023354 - protein, 5 aa, Mycobacterium
RLASN

SEQ ID NO: 1023355 - protein, 14 aa, Mycobacterium
RLDAQTPESQLTTR

SEQ ID NO: 1023356 - protein, 7 aa, Mycobacterium
RLDGPHE

SEQ ID NO: 1023357 - protein, 4 aa, Mycobacterium
RLDP

SEQ ID NO: 1023358 - protein, 4 aa, Mycobacterium
RLDT

SEQ ID NO: 1023359 - protein, 11 aa, Mycobacterium
RLEGPKGNPIY

SEQ ID NO: 1023360 - protein, 41 aa, Mycobacterium
RLEQTRASMRGESLPAGGAATPGATGATETGGAVAEKPFGQ

SEQ ID NO: 1023361 - protein, 27 aa, Mycobacterium
RLESKKVSKTQAVTSNLTGSLAGKVED

SEQ ID NO: 1023362 - protein, 6 aa, Mycobacterium
RLETEG

SEQ ID NO: 1023363 - protein, 9 aa, Mycobacterium
RLGAPTRAT

SEQ ID NO: 1023364 - protein, 12 aa, Mycobacterium
RLGARTTGYDVR

SEQ ID NO: 1023365 - protein, 7 aa, Mycobacterium
RLGATDD

SEQ ID NO: 1023366 - protein, 16 aa, Mycobacterium
RLGDGTAEGADPGALK

SEQ ID NO: 1023367 - protein, 4 aa, Mycobacterium
RLGG

SEQ ID NO: 1023368 - protein, 6 aa, Mycobacterium
RLGGDG

SEQ ID NO: 1023369 - protein, 18 aa, Mycobacterium
RLGGDPGGPVPAPSSGFG

SEQ ID NO: 1023370 - protein, 5 aa, Mycobacterium
RLGGG

SEQ ID NO: 1023371 - protein, 13 aa, Mycobacterium
RLGGSDEADHDQV

SEQ ID NO: 1023372 - protein, 4 aa, Mycobacterium
RLGP

SEQ ID NO: 1023373 - protein, 11 aa, Mycobacterium
RLGPARGAPTV

SEQ ID NO: 1023374 - protein, 5 aa, Mycobacterium
RLGRQ

SEQ ID NO: 1023375 - protein, 5 aa, Mycobacterium
RLGRR

SEQ ID NO: 1023376 - protein, 16 aa, Mycobacterium
RLGRRAHGPAVPTSQA

SEQ ID NO: 1023377 - protein, 9 aa, Mycobacterium
RLGRRQADP

SEQ ID NO: 1023378 - protein, 10 aa, Mycobacterium
RLGSDTHPLP

SEQ ID NO: 1023379 - protein, 6 aa, Mycobacterium
RLGSGK

SEQ ID NO: 1023380 - protein, 6 aa, Mycobacterium
RLGSGR

SEQ ID NO: 1023381 - protein, 13 aa, Mycobacterium
RLGTGADPRVSTA

SEQ ID NO: 1023382 - protein, 22 aa, Mycobacterium
RLGTKEPLTDYPGSLDTDAKRA

SEQ ID NO: 1023383 - protein, 8 aa, Mycobacterium
RLNGSRNP

SEQ ID NO: 1023384 - protein, 6 aa, Mycobacterium
RLPADT

SEQ ID NO: 1023385 - protein, 13 aa, Mycobacterium
RLPANGDIAQTDA

SEQ ID NO: 1023386 - protein, 6 aa, Mycobacterium
RLPART

SEQ ID NO: 1023387 - protein, 7 aa, Mycobacterium
RLPATTK

SEQ ID NO: 1023388 - protein, 6 aa, Mycobacterium
RLPDAT

SEQ ID NO: 1023389 - protein, 12 aa, Mycobacterium
RLPDGNAEQLGA

SEQ ID NO: 1023390 - protein, 5 aa, Mycobacterium
RLPED

SEQ ID NO: 1023391 - protein, 11 aa, Mycobacterium
RLPETPGGEAV

SEQ ID NO: 1023392 - protein, 11 aa, Mycobacterium
RLPGDGPLSGE

SEQ ID NO: 1023393 - protein, 21 aa, Mycobacterium
RLPGGSAGRHIDGTGTEDGSV

SEQ ID NO: 1023394 - protein, 11 aa, Mycobacterium
RLPGYTAGDTD

SEQ ID NO: 1023395 - protein, 8 aa, Mycobacterium
RLPPADLT

SEQ ID NO: 1023396 - protein, 4 aa, Mycobacterium
RLPR

SEQ ID NO: 1023397 - protein, 8 aa, Mycobacterium
RLPRSPIS

SEQ ID NO: 1023398 - protein, 5 aa, Mycobacterium
RLPSR

SEQ ID NO: 1023399 - protein, 8 aa, Mycobacterium
RLPTEDEV

SEQ ID NO: 1023400 - protein, 16 aa, Mycobacterium
RLQDGEPHLSGTARPP

SEQ ID NO: 1023401 - protein, 5 aa, Mycobacterium
RLQRT

SEQ ID NO: 1023402 - protein, 4 aa, Mycobacterium
RLRG

SEQ ID NO: 1023403 - protein, 7 aa, Mycobacterium
RLRGPLT

SEQ ID NO: 1023404 - protein, 7 aa, Mycobacterium
RLRGRTD

SEQ ID NO: 1023405 - protein, 8 aa, Mycobacterium
RLRPEGSR

SEQ ID NO: 1023406 - protein, 20 aa, Mycobacterium
RLRSADSDWSDALPRRKTDL

SEQ ID NO: 1023407 - protein, 6 aa, Mycobacterium
RLRSSA

SEQ ID NO: 1023408 - protein, 12 aa, Mycobacterium
RLSAGDTDVDEA

SEQ ID NO: 1023409 - protein, 7 aa, Mycobacterium
RLSDQEL

SEQ ID NO: 1023410 - protein, 5 aa, Mycobacterium
RLSEA

SEQ ID NO: 1023411 - protein, 7 aa, Mycobacterium
RLSEQTG

SEQ ID NO: 1023412 - protein, 4 aa, Mycobacterium
RLSG

SEQ ID NO: 1023413 - protein, 5 aa, Mycobacterium
RLSGH

SEQ ID NO: 1023414 - protein, 8 aa, Mycobacterium
RLSGPRSD

SEQ ID NO: 1023415 - protein, 7 aa, Mycobacterium
RLSPRGR

SEQ ID NO: 1023416 - protein, 10 aa, Mycobacterium
RLSSDNAQQE

SEQ ID NO: 1023417 - protein, 7 aa, Mycobacterium
RLTADGQ

SEQ ID NO: 1023418 - protein, 10 aa, Mycobacterium
RLTDGQGRTV

SEQ ID NO: 1023419 - protein, 7 aa, Mycobacterium
RLTEGAA

SEQ ID NO: 1023420 - protein, 13 aa, Mycobacterium
RLTENADSTGVDN

SEQ ID NO: 1023421 - protein, 10 aa, Mycobacterium
RLTGKDAELS

SEQ ID NO: 1023422 - protein, 8 aa, Mycobacterium
RLTGSSDL

SEQ ID NO: 1023423 - protein, 6 aa, Mycobacterium
RLTNDT

SEQ ID NO: 1023424 - protein, 4 aa, Mycobacterium
RLTP

SEQ ID NO: 1023425 - protein, 11 aa, Mycobacterium
RLTPGGRAKLE

SEQ ID NO: 1023426 - protein, 7 aa, Mycobacterium
RLTPQDE

SEQ ID NO: 1023427 - protein, 10 aa, Mycobacterium
RLTPRSNSRQ

SEQ ID NO: 1023428 - protein, 4 aa, Mycobacterium
RLTR

SEQ ID NO: 1023429 - protein, 4 aa, Mycobacterium
RLTS

SEQ ID NO: 1023430 - protein, 7 aa, Mycobacterium
RLTTRAP

SEQ ID NO: 1023431 - protein, 8 aa, Mycobacterium
RMAPPDHA

SEQ ID NO: 1023432 - protein, 20 aa, Mycobacterium
RMARDERAIQTAPTGATIDA

SEQ ID NO: 1023433 - protein, 7 aa, Mycobacterium
RMASGGT

SEQ ID NO: 1023434 - protein, 12 aa, Mycobacterium
RMASTGDAVSLG

SEQ ID NO: 1023435 - protein, 6 aa, Mycobacterium
RMDDEE

SEQ ID NO: 1023436 - protein, 9 aa, Mycobacterium
RMDDPDYQG

SEQ ID NO: 1023437 - protein, 15 aa, Mycobacterium
RMDRPGGGLSGGQQQ

SEQ ID NO: 1023438 - protein, 9 aa, Mycobacterium
RMESTDSVG

SEQ ID NO: 1023439 - protein, 15 aa, Mycobacterium
RMGPTPADLGQDDAV

SEQ ID NO: 1023440 - protein, 5 aa, Mycobacterium
RMKAG

SEQ ID NO: 1023441 - protein, 8 aa, Mycobacterium
RMPSSAGQ

SEQ ID NO: 1023442 - protein, 8 aa, Mycobacterium
RMPTPEER

SEQ ID NO: 1023443 - protein, 5 aa, Mycobacterium
RNADG

SEQ ID NO: 1023444 - protein, 7 aa, Mycobacterium
RNADKAA

SEQ ID NO: 1023445 - protein, 7 aa, Mycobacterium
RNAEDTG

SEQ ID NO: 1023446 - protein, 13 aa, Mycobacterium
RNAEQKMATAAPA

SEQ ID NO: 1023447 - protein, 8 aa, Mycobacterium
RNAGGPEL

SEQ ID NO: 1023448 - protein, 6 aa, Mycobacterium
RNAPEE

SEQ ID NO: 1023449 - protein, 6 aa, Mycobacterium
RNAPET

SEQ ID NO: 1023450 - protein, 18 aa, Mycobacterium
RNAQESQHVQAAEPVDRQ

SEQ ID NO: 1023451 - protein, 9 aa, Mycobacterium
RNAQESTAQ

SEQ ID NO: 1023452 - protein, 9 aa, Mycobacterium
RNAQTNARL

SEQ ID NO: 1023453 - protein, 10 aa, Mycobacterium
RNASDADIKR

SEQ ID NO: 1023454 - protein, 12 aa, Mycobacterium
RNASKTPEPVPR

SEQ ID NO: 1023455 - protein, 6 aa, Mycobacterium
RNATHQ

SEQ ID NO: 1023456 - protein, 8 aa, Mycobacterium
RNDDRNDR

SEQ ID NO: 1023457 - protein, 6 aa, Mycobacterium
RNDGPG

SEQ ID NO: 1023458 - protein, 5 aa, Mycobacterium
RNDGT

SEQ ID NO: 1023459 - protein, 7 aa, Mycobacterium
RNDPEFS

SEQ ID NO: 1023460 - protein, 6 aa, Mycobacterium
RNDPRR

SEQ ID NO: 1023461 - protein, 9 aa, Mycobacterium
RNDTDHQGK

SEQ ID NO: 1023462 - protein, 6 aa, Mycobacterium
RNDTEH

SEQ ID NO: 1023463 - protein, 7 aa, Mycobacterium
RNDTEHF

SEQ ID NO: 1023464 - protein, 5 aa, Mycobacterium
RNEGL

SEQ ID NO: 1023465 - protein, 8 aa, Mycobacterium
RNEPDLDD

SEQ ID NO: 1023466 - protein, 7 aa, Mycobacterium
RNEPTKA

SEQ ID NO: 1023467 - protein, 8 aa, Mycobacterium
RNESDQPA

SEQ ID NO: 1023468 - protein, 11 aa, Mycobacterium
RNESHRSPAVQ

SEQ ID NO: 1023469 - protein, 5 aa, Mycobacterium
RNETG

SEQ ID NO: 1023470 - protein, 9 aa, Mycobacterium
RNGAGKTTT

SEQ ID NO: 1023471 - protein, 9 aa, Mycobacterium
RNGAPASRR

SEQ ID NO: 1023472 - protein, 8 aa, Mycobacterium
RNGDGKSS

SEQ ID NO: 1023473 - protein, 9 aa, Mycobacterium
RNGDSRVPT

SEQ ID NO: 1023474 - protein, 5 aa, Mycobacterium
RNGHQ

SEQ ID NO: 1023475 - protein, 10 aa, Mycobacterium
RNGPNPVAEV

SEQ ID NO: 1023476 - protein, 8 aa, Mycobacterium
RNGPPYSP

SEQ ID NO: 1023477 - protein, 8 aa, Mycobacterium
RNGPTKTV

SEQ ID NO: 1023478 - protein, 7 aa, Mycobacterium
RNGSYGQ

SEQ ID NO: 1023479 - protein, 9 aa, Mycobacterium
RNGVRSPDL

SEQ ID NO: 1023480 - protein, 16 aa, Mycobacterium
RNHFTGSARDTLSTRS

SEQ ID NO: 1023481 - protein, 15 aa, Mycobacterium
RNIESTISPDGGDYI

SEQ ID NO: 1023482 - protein, 8 aa, Mycobacterium
RNKDYSQQ

SEQ ID NO: 1023483 - protein, 6 aa, Mycobacterium
RNKPDY

SEQ ID NO: 1023484 - protein, 6 aa, Mycobacterium
RNKPND

SEQ ID NO: 1023485 - protein, 4 aa, Mycobacterium
RNKS

SEQ ID NO: 1023486 - protein, 6 aa, Mycobacterium
RNLPPK

SEQ ID NO: 1023487 - protein, 13 aa, Mycobacterium
RNMPSSELTTDAD

SEQ ID NO: 1023488 - protein, 7 aa, Mycobacterium
RNNESQL

SEQ ID NO: 1023489 - protein, 7 aa, Mycobacterium
RNNGPEL

SEQ ID NO: 1023490 - protein, 9 aa, Mycobacterium
RNPDDDLTA

SEQ ID NO: 1023491 - protein, 6 aa, Mycobacterium
RNPEHE

SEQ ID NO: 1023492 - protein, 4 aa, Mycobacterium
RNPG

SEQ ID NO: 1023493 - protein, 5 aa, Mycobacterium
RNPGQ

SEQ ID NO: 1023494 - protein, 7 aa, Mycobacterium
RNPGQRL

SEQ ID NO: 1023495 - protein, 6 aa, Mycobacterium
RNPGVT

SEQ ID NO: 1023496 - protein, 9 aa, Mycobacterium
RNPKPSNRL

SEQ ID NO: 1023497 - protein, 9 aa, Mycobacterium
RNPLHSDPE

SEQ ID NO: 1023498 - protein, 5 aa, Mycobacterium
RNPNE

SEQ ID NO: 1023499 - protein, 12 aa, Mycobacterium
RNPNPQVGFGGG

SEQ ID NO: 1023500 - protein, 5 aa, Mycobacterium
RNPQR

SEQ ID NO: 1023501 - protein, 5 aa, Mycobacterium
RNPRD

SEQ ID NO: 1023502 - protein, 16 aa, Mycobacterium
RNPRPGIRARGDRIAT

SEQ ID NO: 1023503 - protein, 24 aa, Mycobacterium
RNPSSTGSSVTDLRPAGISAVQDQ

SEQ ID NO: 1023504 - protein, 12 aa, Mycobacterium
RNPTPVHTRVEI

SEQ ID NO: 1023505 - protein, 6 aa, Mycobacterium
RNQPDE

SEQ ID NO: 1023506 - protein, 11 aa, Mycobacterium
RNRARELAQEA

SEQ ID NO: 1023507 - protein, 11 aa, Mycobacterium
RNRDQASELRS

SEQ ID NO: 1023508 - protein, 9 aa, Mycobacterium
RNRDTNAPY

SEQ ID NO: 1023509 - protein, 21 aa, Mycobacterium
RNREASTDAEYAQKATRIARD

SEQ ID NO: 1023510 - protein, 20 aa, Mycobacterium
RNRGQIPQPNEYPPGSTGPP

SEQ ID NO: 1023511 - protein, 5 aa, Mycobacterium
RNRIS

SEQ ID NO: 1023512 - protein, 4 aa, Mycobacterium
RNRP

SEQ ID NO: 1023513 - protein, 7 aa, Mycobacterium
RNRPNDT

SEQ ID NO: 1023514 - protein, 12 aa, Mycobacterium
RNRPSRPGTIDR

SEQ ID NO: 1023515 - protein, 4 aa, Mycobacterium
RNRS

SEQ ID NO: 1023516 - protein, 22 aa, Mycobacterium
RNRTPNWANTSSEAVAAHVAKP

SEQ ID NO: 1023517 - protein, 4 aa, Mycobacterium
RNRV

SEQ ID NO: 1023518 - protein, 7 aa, Mycobacterium
RNRYPRL

SEQ ID NO: 1023519 - protein, 4 aa, Mycobacterium
RNSE

SEQ ID NO: 1023520 - protein, 6 aa, Mycobacterium
RNSGSG

SEQ ID NO: 1023521 - protein, 9 aa, Mycobacterium
RNSNTINPG

SEQ ID NO: 1023522 - protein, 6 aa, Mycobacterium
RNSPDQ

SEQ ID NO: 1023523 - protein, 4 aa, Mycobacterium
RNTA

SEQ ID NO: 1023524 - protein, 17 aa, Mycobacterium
RNTLRRKRTELTDHPEK

SEQ ID NO: 1023525 - protein, 4 aa, Mycobacterium
RNTP

SEQ ID NO: 1023526 - protein, 7 aa, Mycobacterium
RNTPGVT

SEQ ID NO: 1023527 - protein, 5 aa, Mycobacterium
RNTPR

SEQ ID NO: 1023528 - protein, 5 aa, Mycobacterium
RNTRD

SEQ ID NO: 1023529 - protein, 9 aa, Mycobacterium
RNTRPPARY

SEQ ID NO: 1023530 - protein, 10 aa, Mycobacterium
RNTTDHRRDT

SEQ ID NO: 1023531 - protein, 7 aa, Mycobacterium
RNTYPGA

SEQ ID NO: 1023532 - protein, 7 aa, Mycobacterium
RNVPHTG

SEQ ID NO: 1023533 - protein, 10 aa, Mycobacterium
RNYPVDERTR

SEQ ID NO: 1023534 - protein, 8 aa, Mycobacterium
RPAAEPIA

SEQ ID NO: 1023535 - protein, 6 aa, Mycobacterium
RPAAGD

SEQ ID NO: 1023536 - protein, 6 aa, Mycobacterium
RPAAGG

SEQ ID NO: 1023537 - protein, 5 aa, Mycobacterium
RPAAL

SEQ ID NO: 1023538 - protein, 6 aa, Mycobacterium
RPADDA

SEQ ID NO: 1023539 - protein, 6 aa, Mycobacterium
RPADIG

SEQ ID NO: 1023540 - protein, 4 aa, Mycobacterium
RPAE

SEQ ID NO: 1023541 - protein, 13 aa, Mycobacterium
RPAEHGPDDPGGV

SEQ ID NO: 1023542 - protein, 12 aa, Mycobacterium
RPAEHRGRERRL

SEQ ID NO: 1023543 - protein, 6 aa, Mycobacterium
RPAESA

SEQ ID NO: 1023544 - protein, 8 aa, Mycobacterium
RPAESREV

SEQ ID NO: 1023545 - protein, 4 aa, Mycobacterium
RPAG

SEQ ID NO: 1023546 - protein, 6 aa, Mycobacterium
RPAGEA

SEQ ID NO: 1023547 - protein, 7 aa, Mycobacterium
RPAGPRL

SEQ ID NO: 1023548 - protein, 7 aa, Mycobacterium
RPAGSGE

SEQ ID NO: 1023549 - protein, 6 aa, Mycobacterium
RPAHYT

SEQ ID NO: 1023550 - protein, 11 aa, Mycobacterium
RPAISGDSAIQ

SEQ ID NO: 1023551 - protein, 12 aa, Mycobacterium
RPALATAESGPA

SEQ ID NO: 1023552 - protein, 19 aa, Mycobacterium
RPANTSPSDAERAATANAV

SEQ ID NO: 1023553 - protein, 4 aa, Mycobacterium
RPAP

SEQ ID NO: 1023554 - protein, 6 aa, Mycobacterium
RPAPDT

SEQ ID NO: 1023555 - protein, 6 aa, Mycobacterium
RPAPGT

SEQ ID NO: 1023556 - protein, 8 aa, Mycobacterium
RPAPGYPA

SEQ ID NO: 1023557 - protein, 6 aa, Mycobacterium
RPAPLS

SEQ ID NO: 1023558 - protein, 8 aa, Mycobacterium
RPAPPHLR

SEQ ID NO: 1023559 - protein, 8 aa, Mycobacterium
RPAPPSPV

SEQ ID NO: 1023560 - protein, 30 aa, Mycobacterium
RPAQSLPGGGARTSTKTPDMPGASRCQGTV

SEQ ID NO: 1023561 - protein, 8 aa, Mycobacterium
RPARGPLR

SEQ ID NO: 1023562 - protein, 6 aa, Mycobacterium
RPARTA

SEQ ID NO: 1023563 - protein, 8 aa, Mycobacterium
RPASADQV

SEQ ID NO: 1023564 - protein, 7 aa, Mycobacterium
RPASEAE

SEQ ID NO: 1023565 - protein, 8 aa, Mycobacterium
RPASESQP

SEQ ID NO: 1023566 - protein, 6 aa, Mycobacterium
RPASSL

SEQ ID NO: 1023567 - protein, 4 aa, Mycobacterium
RPAT

SEQ ID NO: 1023568 - protein, 14 aa, Mycobacterium
RPATATSEEPGRYA

SEQ ID NO: 1023569 - protein, 9 aa, Mycobacterium
RPATTPDGA

SEQ ID NO: 1023570 - protein, 25 aa, Mycobacterium
RPAYDDAARSQISAARESTPSDSAA

SEQ ID NO: 1023571 - protein, 6 aa, Mycobacterium
RPAYDR

SEQ ID NO: 1023572 - protein, 9 aa, Mycobacterium
RPAYTQSAA

SEQ ID NO: 1023573 - protein, 5 aa, Mycobacterium
RPCQS

SEQ ID NO: 1023574 - protein, 10 aa, Mycobacterium
RPDAGSAGPT

SEQ ID NO: 1023575 - protein, 7 aa, Mycobacterium
RPDAQGR

SEQ ID NO: 1023576 - protein, 6 aa, Mycobacterium
RPDATA

SEQ ID NO: 1023577 - protein, 8 aa, Mycobacterium
RPDATRDA

SEQ ID NO: 1023578 - protein, 8 aa, Mycobacterium
RPDDPTGL

SEQ ID NO: 1023579 - protein, 9 aa, Mycobacterium
RPDDSGRVA

SEQ ID NO: 1023580 - protein, 6 aa, Mycobacterium
RPDDVD

SEQ ID NO: 1023581 - protein, 12 aa, Mycobacterium
RPDEKPRNPTQR

SEQ ID NO: 1023582 - protein, 7 aa, Mycobacterium
RPDERAH

SEQ ID NO: 1023583 - protein, 5 aa, Mycobacterium
RPDET

SEQ ID NO: 1023584 - protein, 5 aa, Mycobacterium
RPDGM

SEQ ID NO: 1023585 - protein, 9 aa, Mycobacterium
RPDGSVETE

SEQ ID NO: 1023586 - protein, 6 aa, Mycobacterium
RPDGTL

SEQ ID NO: 1023587 - protein, 9 aa, Mycobacterium
RPDKIADGS

SEQ ID NO: 1023588 - protein, 4 aa, Mycobacterium
RPDL

SEQ ID NO: 1023589 - protein, 9 aa, Mycobacterium
RPDLTPTSD

SEQ ID NO: 1023590 - protein, 13 aa, Mycobacterium
RPDNLDPNGGRPS

SEQ ID NO: 1023591 - protein, 5 aa, Mycobacterium
RPDPA

SEQ ID NO: 1023592 - protein, 13 aa, Mycobacterium
RPDPDGRRPIDDT

SEQ ID NO: 1023593 - protein, 6 aa, Mycobacterium
RPDPSD

SEQ ID NO: 1023594 - protein, 25 aa, Mycobacterium
RPDPYKGKGVRYEGEQIRRKVGKTG

SEQ ID NO: 1023595 - protein, 9 aa, Mycobacterium
RPDRDPRSC

SEQ ID NO: 1023596 - protein, 22 aa, Mycobacterium
RPDRVDVDGSAEALRRFLARAT

SEQ ID NO: 1023597 - protein, 8 aa, Mycobacterium
RPDSATGL

SEQ ID NO: 1023598 - protein, 6 aa, Mycobacterium
RPDTAE

SEQ ID NO: 1023599 - protein, 9 aa, Mycobacterium
RPEARNAIN

SEQ ID NO: 1023600 - protein, 9 aa, Mycobacterium
RPEATAEAF

SEQ ID NO: 1023601 - protein, 7 aa, Mycobacterium
RPEEVTD

SEQ ID NO: 1023602 - protein, 8 aa, Mycobacterium
RPEGLDKS

SEQ ID NO: 1023603 - protein, 12 aa, Mycobacterium
RPEGNANPEIAT

SEQ ID NO: 1023604 - protein, 6 aa, Mycobacterium
RPEGPE

SEQ ID NO: 1023605 - protein, 5 aa, Mycobacterium
RPEGT

SEQ ID NO: 1023606 - protein, 8 aa, Mycobacterium
RPEGVSAE

SEQ ID NO: 1023607 - protein, 6 aa, Mycobacterium
RPEPFS

SEQ ID NO: 1023608 - protein, 19 aa, Mycobacterium
RPEPGYGRTSPVGSFEPNG

SEQ ID NO: 1023609 - protein, 4 aa, Mycobacterium
RPER

SEQ ID NO: 1023610 - protein, 16 aa, Mycobacterium
RPERAVGVSNSVRAVL

SEQ ID NO: 1023611 - protein, 5 aa, Mycobacterium
RPERF

SEQ ID NO: 1023612 - protein, 16 aa, Mycobacterium
RPERGTGGAPLFAPAG

SEQ ID NO: 1023613 - protein, 6 aa, Mycobacterium
RPERRR

SEQ ID NO: 1023614 - protein, 5 aa, Mycobacterium
RPETE

SEQ ID NO: 1023615 - protein, 5 aa, Mycobacterium
RPEWG

SEQ ID NO: 1023616 - protein, 8 aa, Mycobacterium
RPEYRDRD

SEQ ID NO: 1023617 - protein, 4 aa, Mycobacterium
RPFG

SEQ ID NO: 1023618 - protein, 12 aa, Mycobacterium
RPFPTKAEADAA

SEQ ID NO: 1023619 - protein, 5 aa, Mycobacterium
RPFRP

SEQ ID NO: 1023620 - protein, 8 aa, Mycobacterium
RPFTPPPT

SEQ ID NO: 1023621 - protein, 19 aa, Mycobacterium
RPGAQEEHFRNGSGGKSYR

SEQ ID NO: 1023622 - protein, 5 aa, Mycobacterium
RPGAS

SEQ ID NO: 1023623 - protein, 5 aa, Mycobacterium
RPGAT

SEQ ID NO: 1023624 - protein, 11 aa, Mycobacterium
RPGATITGADL

SEQ ID NO: 1023625 - protein, 4 aa, Mycobacterium
RPGD

SEQ ID NO: 1023626 - protein, 9 aa, Mycobacterium
RPGDLSPGD

SEQ ID NO: 1023627 - protein, 19 aa, Mycobacterium
RPGDTPPFQRGGMGDHTTG

SEQ ID NO: 1023628 - protein, 16 aa, Mycobacterium
RPGEPSWPSPFGPGRP

SEQ ID NO: 1023629 - protein, 9 aa, Mycobacterium
RPGEPVAAG

SEQ ID NO: 1023630 - protein, 4 aa, Mycobacterium
RPGF

SEQ ID NO: 1023631 - protein, 15 aa, Mycobacterium
RPGGGAKLARSAGSS

SEQ ID NO: 1023632 - protein, 11 aa, Mycobacterium
RPGIPPTRPVH

SEQ ID NO: 1023633 - protein, 7 aa, Mycobacterium
RPGKFGG

SEQ ID NO: 1023634 - protein, 6 aa, Mycobacterium
RPGLTD

SEQ ID NO: 1023635 - protein, 9 aa, Mycobacterium
RPGLTDADR

SEQ ID NO: 1023636 - protein, 5 aa, Mycobacterium
RPGNQ

SEQ ID NO: 1023637 - protein, 5 aa, Mycobacterium
RPGPD

SEQ ID NO: 1023638 - protein, 11 aa, Mycobacterium
RPGPDAQTYRD

SEQ ID NO: 1023639 - protein, 9 aa, Mycobacterium
RPGPEFRPS

SEQ ID NO: 1023640 - protein, 7 aa, Mycobacterium
RPGPGPR

SEQ ID NO: 1023641 - protein, 5 aa, Mycobacterium
RPGPQ

SEQ ID NO: 1023642 - protein, 5 aa, Mycobacterium
RPGPR

SEQ ID NO: 1023643 - protein, 6 aa, Mycobacterium
RPGPTM

SEQ ID NO: 1023644 - protein, 5 aa, Mycobacterium
RPGQP

SEQ ID NO: 1023645 - protein, 5 aa, Mycobacterium
RPGQT

SEQ ID NO: 1023646 - protein, 15 aa, Mycobacterium
RPGQYARSHEAGRSV

SEQ ID NO: 1023647 - protein, 22 aa, Mycobacterium
RPGRFGSADLPAASNDNERNSV

SEQ ID NO: 1023648 - protein, 7 aa, Mycobacterium
RPGRSAR

SEQ ID NO: 1023649 - protein, 7 aa, Mycobacterium
RPGSDVQ

SEQ ID NO: 1023650 - protein, 13 aa, Mycobacterium
RPGSGGRSRISDR

SEQ ID NO: 1023651 - protein, 19 aa, Mycobacterium
RPGSGPFSLTGQPNAMGGR

SEQ ID NO: 1023652 - protein, 6 aa, Mycobacterium
RPGSLG

SEQ ID NO: 1023653 - protein, 6 aa, Mycobacterium
RPGTRY

SEQ ID NO: 1023654 - protein, 13 aa, Mycobacterium
RPGVSSGPAAPPE

SEQ ID NO: 1023655 - protein, 6 aa, Mycobacterium
RPGYDP

SEQ ID NO: 1023656 - protein, 13 aa, Mycobacterium
RPGYGRSTFQEGR

SEQ ID NO: 1023657 - protein, 19 aa, Mycobacterium
RPGYGSSAGDPDAMNRPHQ

SEQ ID NO: 1023658 - protein, 6 aa, Mycobacterium
RPGYKY

SEQ ID NO: 1023659 - protein, 9 aa, Mycobacterium
RPGYRQSAQ

SEQ ID NO: 1023660 - protein, 9 aa, Mycobacterium
RPHAPTGAQ

SEQ ID NO: 1023661 - protein, 7 aa, Mycobacterium
RPHPDAP

SEQ ID NO: 1023662 - protein, 6 aa, Mycobacterium
RPHPGQ

SEQ ID NO: 1023663 - protein, 6 aa, Mycobacterium
RPHPRG

SEQ ID NO: 1023664 - protein, 5 aa, Mycobacterium
RPHRP

SEQ ID NO: 1023665 - protein, 17 aa, Mycobacterium
RPHRVGGSDSGESPTRV

SEQ ID NO: 1023666 - protein, 12 aa, Mycobacterium
RPHRVTHRRLTR

SEQ ID NO: 1023667 - protein, 8 aa, Mycobacterium
RPHSAEEA

SEQ ID NO: 1023668 - protein, 4 aa, Mycobacterium
RPHT

SEQ ID NO: 1023669 - protein, 5 aa, Mycobacterium
RPIDI

SEQ ID NO: 1023670 - protein, 5 aa, Mycobacterium
RPIED

SEQ ID NO: 1023671 - protein, 6 aa, Mycobacterium
RPIPMK

SEQ ID NO: 1023672 - protein, 11 aa, Mycobacterium
RPKDDEGGGNA

SEQ ID NO: 1023673 - protein, 6 aa, Mycobacterium
RPKFDS

SEQ ID NO: 1023674 - protein, 5 aa, Mycobacterium
RPKGG

SEQ ID NO: 1023675 - protein, 6 aa, Mycobacterium
RPKPRL

SEQ ID NO: 1023676 - protein, 10 aa, Mycobacterium
RPKQRNAQTR

SEQ ID NO: 1023677 - protein, 9 aa, Mycobacterium
RPKSAADAE

SEQ ID NO: 1023678 - protein, 7 aa, Mycobacterium
RPLDKSR

SEQ ID NO: 1023679 - protein, 18 aa, Mycobacterium
RPLDPADYPGAPPENLQP

SEQ ID NO: 1023680 - protein, 5 aa, Mycobacterium
RPLDT

SEQ ID NO: 1023681 - protein, 9 aa, Mycobacterium
RPLGKPIGH

SEQ ID NO: 1023682 - protein, 7 aa, Mycobacterium
RPLGTGD

SEQ ID NO: 1023683 - protein, 7 aa, Mycobacterium
RPLGYDD

SEQ ID NO: 1023684 - protein, 5 aa, Mycobacterium
RPLPG

SEQ ID NO: 1023685 - protein, 5 aa, Mycobacterium
RPLPR

SEQ ID NO: 1023686 - protein, 4 aa, Mycobacterium
RPLR

SEQ ID NO: 1023687 - protein, 5 aa, Mycobacterium
RPLSA

SEQ ID NO: 1023688 - protein, 5 aa, Mycobacterium
RPMGE

SEQ ID NO: 1023689 - protein, 5 aa, Mycobacterium
RPMTP

SEQ ID NO: 1023690 - protein, 9 aa, Mycobacterium
RPNATGAAP

SEQ ID NO: 1023691 - protein, 4 aa, Mycobacterium
RPND

SEQ ID NO: 1023692 - protein, 10 aa, Mycobacterium
RPNDERRNRS

SEQ ID NO: 1023693 - protein, 9 aa, Mycobacterium
RPNGDHRDL

SEQ ID NO: 1023694 - protein, 28 aa, Mycobacterium
RPNHPAAKRAKAQQRRPARGRTDETETV

SEQ ID NO: 1023695 - protein, 4 aa, Mycobacterium
RPNS

SEQ ID NO: 1023696 - protein, 8 aa, Mycobacterium
RPNTAPTV

SEQ ID NO: 1023697 - protein, 5 aa, Mycobacterium
RPNTG

SEQ ID NO: 1023698 - protein, 4 aa, Mycobacterium
RPNV

SEQ ID NO: 1023699 - protein, 6 aa, Mycobacterium
RPPAEI

SEQ ID NO: 1023700 - protein, 6 aa, Mycobacterium
RPPAPF

SEQ ID NO: 1023701 - protein, 7 aa, Mycobacterium
RPPDSDR

SEQ ID NO: 1023702 - protein, 14 aa, Mycobacterium
RPPEAGVWHGEDFS

SEQ ID NO: 1023703 - protein, 13 aa, Mycobacterium
RPPEARAASTPWP

SEQ ID NO: 1023704 - protein, 7 aa, Mycobacterium
RPPEERE

SEQ ID NO: 1023705 - protein, 5 aa, Mycobacterium
RPPEL

SEQ ID NO: 1023706 - protein, 8 aa, Mycobacterium
RPPGPTVA

SEQ ID NO: 1023707 - protein, 9 aa, Mycobacterium
RPPGQTQPL

SEQ ID NO: 1023708 - protein, 10 aa, Mycobacterium
RPPGREAYPG

SEQ ID NO: 1023709 - protein, 7 aa, Mycobacterium
RPPHEEL

SEQ ID NO: 1023710 - protein, 5 aa, Mycobacterium
RPPHV

SEQ ID NO: 1023711 - protein, 4 aa, Mycobacterium
RPPI

SEQ ID NO: 1023712 - protein, 4 aa, Mycobacterium
RPPK

SEQ ID NO: 1023713 - protein, 4 aa, Mycobacterium
RPPM

SEQ ID NO: 1023714 - protein, 5 aa, Mycobacterium
RPPMA

SEQ ID NO: 1023715 - protein, 25 aa, Mycobacterium
RPPPNSPASTYPKRGGSLADPVSGW

SEQ ID NO: 1023716 - protein, 8 aa, Mycobacterium
RPPPPQRF

SEQ ID NO: 1023717 - protein, 7 aa, Mycobacterium
RPPPRPD

SEQ ID NO: 1023718 - protein, 8 aa, Mycobacterium
RPPPTLGQ

SEQ ID NO: 1023719 - protein, 14 aa, Mycobacterium
RPPRPKSNGGGSSL

SEQ ID NO: 1023720 - protein, 25 aa, Mycobacterium
RPPRPVDTERPVRSITSGPRGYEGE

SEQ ID NO: 1023721 - protein, 10 aa, Mycobacterium
RPPRSPADRH

SEQ ID NO: 1023722 - protein, 8 aa, Mycobacterium
RPPSPSIR

SEQ ID NO: 1023723 - protein, 7 aa, Mycobacterium
RPPTDDE

SEQ ID NO: 1023724 - protein, 7 aa, Mycobacterium
RPQAGRY

SEQ ID NO: 1023725 - protein, 7 aa, Mycobacterium
RPQDGWT

SEQ ID NO: 1023726 - protein, 11 aa, Mycobacterium
RPQDTEGQPAA

SEQ ID NO: 1023727 - protein, 13 aa, Mycobacterium
RPQEELDESSRAA

SEQ ID NO: 1023728 - protein, 7 aa, Mycobacterium
RPQEGIT

SEQ ID NO: 1023729 - protein, 8 aa, Mycobacterium
RPQEYHAA

SEQ ID NO: 1023730 - protein, 4 aa, Mycobacterium
RPQF

SEQ ID NO: 1023731 - protein, 4 aa, Mycobacterium
RPQG

SEQ ID NO: 1023732 - protein, 8 aa, Mycobacterium
RPQKRNSF

SEQ ID NO: 1023733 - protein, 8 aa, Mycobacterium
RPQLPTGA

SEQ ID NO: 1023734 - protein, 22 aa, Mycobacterium
RPQLQPEPGEPADACADATAPK

SEQ ID NO: 1023735 - protein, 6 aa, Mycobacterium
RPQNLN

SEQ ID NO: 1023736 - protein, 9 aa, Mycobacterium
RPQPEPGHG

SEQ ID NO: 1023737 - protein, 12 aa, Mycobacterium
RPQPGQTEGGGP

SEQ ID NO: 1023738 - protein, 6 aa, Mycobacterium
RPQVQE

SEQ ID NO: 1023739 - protein, 7 aa, Mycobacterium
RPQVSGE

SEQ ID NO: 1023740 - protein, 8 aa, Mycobacterium
RPRAAHGV

SEQ ID NO: 1023741 - protein, 6 aa, Mycobacterium
RPRAPL

SEQ ID NO: 1023742 - protein, 6 aa, Mycobacterium
RPRDEL

SEQ ID NO: 1023743 - protein, 6 aa, Mycobacterium
RPRGGR

SEQ ID NO: 1023744 - protein, 8 aa, Mycobacterium
RPRGPGME

SEQ ID NO: 1023745 - protein, 4 aa, Mycobacterium
RPRL

SEQ ID NO: 1023746 - protein, 13 aa, Mycobacterium
RPRPADRLEQPGF

SEQ ID NO: 1023747 - protein, 8 aa, Mycobacterium
RPRPLTRA

SEQ ID NO: 1023748 - protein, 11 aa, Mycobacterium
RPRRDYGRYSP

SEQ ID NO: 1023749 - protein, 12 aa, Mycobacterium
RPRRPDGTRAGN

SEQ ID NO: 1023750 - protein, 7 aa, Mycobacterium
RPRSEQD

SEQ ID NO: 1023751 - protein, 10 aa, Mycobacterium
RPRSPPRVQG

SEQ ID NO: 1023752 - protein, 7 aa, Mycobacterium
RPRSSKV

SEQ ID NO: 1023753 - protein, 5 aa, Mycobacterium
RPSAG

SEQ ID NO: 1023754 - protein, 8 aa, Mycobacterium
RPSATAGV

SEQ ID NO: 1023755 - protein, 16 aa, Mycobacterium
RPSFSSRTTSTRRSNS

SEQ ID NO: 1023756 - protein, 4 aa, Mycobacterium
RPSG

SEQ ID NO: 1023757 - protein, 6 aa, Mycobacterium
RPSGQH

SEQ ID NO: 1023758 - protein, 7 aa, Mycobacterium
RPSGRGA

SEQ ID NO: 1023759 - protein, 8 aa, Mycobacterium
RPSGSGPF

SEQ ID NO: 1023760 - protein, 7 aa, Mycobacterium
RPSGTED

SEQ ID NO: 1023761 - protein, 5 aa, Mycobacterium
RPSIV

SEQ ID NO: 1023762 - protein, 14 aa, Mycobacterium
RPSKTLNAALEAAQ

SEQ ID NO: 1023763 - protein, 9 aa, Mycobacterium
RPSLTRGGL

SEQ ID NO: 1023764 - protein, 6 aa, Mycobacterium
RPSNEI

SEQ ID NO: 1023765 - protein, 11 aa, Mycobacterium
RPSPTSGTLGG

SEQ ID NO: 1023766 - protein, 7 aa, Mycobacterium
RPSQDRR

SEQ ID NO: 1023767 - protein, 5 aa, Mycobacterium
RPSRE

SEQ ID NO: 1023768 - protein, 5 aa, Mycobacterium
RPSRG

SEQ ID NO: 1023769 - protein, 20 aa, Mycobacterium
RPSSDAPKRPEQTPAGARRK

SEQ ID NO: 1023770 - protein, 8 aa, Mycobacterium
RPSSSRDT

SEQ ID NO: 1023771 - protein, 25 aa, Mycobacterium
RPSTTTSTLTSVTTQPAPLTPATEP

SEQ ID NO: 1023772 - protein, 26 aa, Mycobacterium
RPTAAHAEAGQQRIPAGTGVLQNRSL

SEQ ID NO: 1023773 - protein, 14 aa, Mycobacterium
RPTAGDPALAPPGR

SEQ ID NO: 1023774 - protein, 5 aa, Mycobacterium
RPTAW

SEQ ID NO: 1023775 - protein, 7 aa, Mycobacterium
RPTDGEI

SEQ ID NO: 1023776 - protein, 7 aa, Mycobacterium
RPTGTVT

SEQ ID NO: 1023777 - protein, 4 aa, Mycobacterium
RPTL

SEQ ID NO: 1023778 - protein, 7 aa, Mycobacterium
RPTPGRA

SEQ ID NO: 1023779 - protein, 12 aa, Mycobacterium
RPTQADFADRPR

SEQ ID NO: 1023780 - protein, 4 aa, Mycobacterium
RPTR

SEQ ID NO: 1023781 - protein, 7 aa, Mycobacterium
RPTRAGA

SEQ ID NO: 1023782 - protein, 8 aa, Mycobacterium
RPTRASAP

SEQ ID NO: 1023783 - protein, 19 aa, Mycobacterium
RPTRPIPAASTTAATGHFG

SEQ ID NO: 1023784 - protein, 7 aa, Mycobacterium
RPTSHDH

SEQ ID NO: 1023785 - protein, 6 aa, Mycobacterium
RPTSRQ

SEQ ID NO: 1023786 - protein, 10 aa, Mycobacterium
RPTSTKTTVT

SEQ ID NO: 1023787 - protein, 5 aa, Mycobacterium
RPTTR

SEQ ID NO: 1023788 - protein, 32 aa, Mycobacterium; identical to SEQ ID NO: 566751

SEQ ID NO: 1023789 - protein, 4 aa, Mycobacterium
RPVA

SEQ ID NO: 1023790 - protein, 16 aa, Mycobacterium
RPVAPRKGTGQVNGTP

SEQ ID NO: 1023791 - protein, 4 aa, Mycobacterium
RPVD

SEQ ID NO: 1023792 - protein, 4 aa, Mycobacterium
RPVG

SEQ ID NO: 1023793 - protein, 17 aa, Mycobacterium
RPVGQSDRRLASGHRTR

SEQ ID NO: 1023794 - protein, 8 aa, Mycobacterium
RPVGSRPP

SEQ ID NO: 1023795 - protein, 17 aa, Mycobacterium
RPVHPTGLTSPIRADPG

SEQ ID NO: 1023796 - protein, 23 aa, Mycobacterium
RPVPDDAEGPVPPTLFVSAHRPA

SEQ ID NO: 1023797 - protein, 5 aa, Mycobacterium
RPVPE

SEQ ID NO: 1023798 - protein, 7 aa, Mycobacterium
RPVRAGS

SEQ ID NO: 1023799 - protein, 6 aa, Mycobacterium
RPVRRP

SEQ ID NO: 1023800 - protein, 7 aa, Mycobacterium
RPVSGRG

SEQ ID NO: 1023801 - protein, 10 aa, Mycobacterium
RPVSPGNDSE

SEQ ID NO: 1023802 - protein, 6 aa, Mycobacterium
RPVSTP

SEQ ID NO: 1023803 - protein, 14 aa, Mycobacterium
RPVSTTGESGNQNT

SEQ ID NO: 1023804 - protein, 4 aa, Mycobacterium
RPVT

SEQ ID NO: 1023805 - protein, 8 aa, Mycobacterium
RPVTGGYQ

SEQ ID NO: 1023806 - protein, 8 aa, Mycobacterium
RPVTSTDT

SEQ ID NO: 1023807 - protein, 17 aa, Mycobacterium
RPWAKGGPTTADNGLGS

SEQ ID NO: 1023808 - protein, 13 aa, Mycobacterium
RPWPETGRARRAG

SEQ ID NO: 1023809 - protein, 13 aa, Mycobacterium
RPYREPGQRSRDE

SEQ ID NO: 1023810 - protein, 8 aa, Mycobacterium
RPYSASTT

SEQ ID NO: 1023811 - protein, 4 aa, Mycobacterium
RQAA

SEQ ID NO: 1023812 - protein, 7 aa, Mycobacterium
RQAADDA

SEQ ID NO: 1023813 - protein, 5 aa, Mycobacterium
RQAAS

SEQ ID NO: 1023814 - protein, 16 aa, Mycobacterium
RQAATAAHYENRGGVG

SEQ ID NO: 1023815 - protein, 8 aa, Mycobacterium
RQADPELA

SEQ ID NO: 1023816 - protein, 6 aa, Mycobacterium
RQADPG

SEQ ID NO: 1023817 - protein, 5 aa, Mycobacterium
RQAEA

SEQ ID NO: 1023818 - protein, 8 aa, Mycobacterium
RQAEGRSL

SEQ ID NO: 1023819 - protein, 14 aa, Mycobacterium
RQAGDDPHAIRWRG

SEQ ID NO: 1023820 - protein, 7 aa, Mycobacterium
RQAKEQL

SEQ ID NO: 1023821 - protein, 9 aa, Mycobacterium
RQARGHGHS

SEQ ID NO: 1023822 - protein, 6 aa, Mycobacterium
RQARNA

SEQ ID NO: 1023823 - protein, 8 aa, Mycobacterium
RQASPGHA

SEQ ID NO: 1023824 - protein, 8 aa, Mycobacterium
RQASPGVK

SEQ ID NO: 1023825 - protein, 12 aa, Mycobacterium
RQATEASSAPRR

SEQ ID NO: 1023826 - protein, 6 aa, Mycobacterium
RQDEIG

SEQ ID NO: 1023827 - protein, 12 aa, Mycobacterium
RQDGDYSPQHNA

SEQ ID NO: 1023828 - protein, 9 aa, Mycobacterium
RQDNEEEGS

SEQ ID NO: 1023829 - protein, 4 aa, Mycobacterium
RQDR

SEQ ID NO: 1023830 - protein, 5 aa, Mycobacterium
RQDSP

SEQ ID NO: 1023831 - protein, 4 aa, Mycobacterium
RQEC

SEQ ID NO: 1023832 - protein, 6 aa, Mycobacterium
RQEDPV

SEQ ID NO: 1023833 - protein, 6 aa, Mycobacterium
RQEEAP

SEQ ID NO: 1023834 - protein, 9 aa, Mycobacterium
RQEKSLPHT

SEQ ID NO: 1023835 - protein, 6 aa, Mycobacterium
RQEPGL

SEQ ID NO: 1023836 - protein, 9 aa, Mycobacterium
RQFPSTAPK

SEQ ID NO: 1023837 - protein, 7 aa, Mycobacterium
RQGEFRP

SEQ ID NO: 1023838 - protein, 9 aa, Mycobacterium
RQGGPDAAE

SEQ ID NO: 1023839 - protein, 6 aa, Mycobacterium
RQGGPK

SEQ ID NO: 1023840 - protein, 5 aa, Mycobacterium
RQGLD

SEQ ID NO: 1023841 - protein, 14 aa, Mycobacterium
RQGNSDRRAPNAVK

SEQ ID NO: 1023842 - protein, 5 aa, Mycobacterium
RQGQV

SEQ ID NO: 1023843 - protein, 8 aa, Mycobacterium
RQGRRSAD

SEQ ID NO: 1023844 - protein, 6 aa, Mycobacterium
RQGSGT

SEQ ID NO: 1023845 - protein, 8 aa, Mycobacterium
RQGSRGAA

SEQ ID NO: 1023846 - protein, 6 aa, Mycobacterium
RQGTDA

SEQ ID NO: 1023847 - protein, 5 aa, Mycobacterium
RQGTR

SEQ ID NO: 1023848 - protein, 9 aa, Mycobacterium
RQGYRENGV

SEQ ID NO: 1023849 - protein, 9 aa, Mycobacterium
RQHGARPTA

SEQ ID NO: 1023850 - protein, 11 aa, Mycobacterium
RQHGGPDQYAD

SEQ ID NO: 1023851 - protein, 10 aa, Mycobacterium
RQHQQSKAQG

SEQ ID NO: 1023852 - protein, 8 aa, Mycobacterium
RQKARAAQ

SEQ ID NO: 1023853 - protein, 4 aa, Mycobacterium
RQKL

SEQ ID NO: 1023854 - protein, 4 aa, Mycobacterium
RQLP

SEQ ID NO: 1023855 - protein, 17 aa, Mycobacterium
RQLPDDLAADEADEHSA

SEQ ID NO: 1023856 - protein, 6 aa, Mycobacterium
RQLPEN

SEQ ID NO: 1023857 - protein, 7 aa, Mycobacterium
RQLTDED

SEQ ID NO: 1023858 - protein, 6 aa, Mycobacterium
RQMSGP

SEQ ID NO: 1023859 - protein, 5 aa, Mycobacterium
RQNER

SEQ ID NO: 1023860 - protein, 15 aa, Mycobacterium
RQNGEHPINDSAEVQ

SEQ ID NO: 1023861 - protein, 8 aa, Mycobacterium
RQNGYSTA

SEQ ID NO: 1023862 - protein, 5 aa, Mycobacterium
RQNPL

SEQ ID NO: 1023863 - protein, 6 aa, Mycobacterium
RQNSDV

SEQ ID NO: 1023864 - protein, 17 aa, Mycobacterium
RQPALGRAGAARGRHRD

SEQ ID NO: 1023865 - protein, 5 aa, Mycobacterium
RQPDG

SEQ ID NO: 1023866 - protein, 8 aa, Mycobacterium
RQPDGVTI

SEQ ID NO: 1023867 - protein, 5 aa, Mycobacterium
RQPDN

SEQ ID NO: 1023868 - protein, 6 aa, Mycobacterium
RQPDRV

SEQ ID NO: 1023869 - protein, 9 aa, Mycobacterium
RQPEDGGQH

SEQ ID NO: 1023870 - protein, 5 aa, Mycobacterium
RQPEL

SEQ ID NO: 1023871 - protein, 10 aa, Mycobacterium
RQPELAKGQP

SEQ ID NO: 1023872 - protein, 6 aa, Mycobacterium
RQPEQL

SEQ ID NO: 1023873 - protein, 15 aa, Mycobacterium
RQPESEPRQPHRRAR

SEQ ID NO: 1023874 - protein, 6 aa, Mycobacterium
RQPGAT

SEQ ID NO: 1023875 - protein, 6 aa, Mycobacterium
RQPGYT

SEQ ID NO: 1023876 - protein, 8 aa, Mycobacterium
RQPHPTSR

SEQ ID NO: 1023877 - protein, 5 aa, Mycobacterium
RQPPE

SEQ ID NO: 1023878 - protein, 21 aa, Mycobacterium
RQPRAAAGPVRPLSPKRQSGC

SEQ ID NO: 1023879 - protein, 13 aa, Mycobacterium
RQPTNPQQPILAT

SEQ ID NO: 1023880 - protein, 12 aa, Mycobacterium
RQPVGAGAASCS

SEQ ID NO: 1023881 - protein, 9 aa, Mycobacterium
RQQAPADME

SEQ ID NO: 1023882 - protein, 5 aa, Mycobacterium
RQQRR

SEQ ID NO: 1023883 - protein, 8 aa, Mycobacterium
RQRAETGV

SEQ ID NO: 1023884 - protein, 6 aa, Mycobacterium
RQRDRV

SEQ ID NO: 1023885 - protein, 4 aa, Mycobacterium
RQRP

SEQ ID NO: 1023886 - protein, 10 aa, Mycobacterium
RQRPHTRNGA

SEQ ID NO: 1023887 - protein, 8 aa, Mycobacterium
RQRRDAGL

SEQ ID NO: 1023888 - protein, 13 aa, Mycobacterium
RQRRTHDRARSPP

SEQ ID NO: 1023889 - protein, 9 aa, Mycobacterium
RQRSPSPLT

SEQ ID NO: 1023890 - protein, 14 aa, Mycobacterium
RQRTDAHRCEARPT

SEQ ID NO: 1023891 - protein, 5 aa, Mycobacterium
RQRVD

SEQ ID NO: 1023892 - protein, 10 aa, Mycobacterium
RQSCDACEDG

SEQ ID NO: 1023893 - protein, 6 aa, Mycobacterium
RQSDAL

SEQ ID NO: 1023894 - protein, 7 aa, Mycobacterium
RQSDALG

SEQ ID NO: 1023895 - protein, 6 aa, Mycobacterium
RQSEGT

SEQ ID NO: 1023896 - protein, 9 aa, Mycobacterium
RQSGEWKDG

SEQ ID NO: 1023897 - protein, 6 aa, Mycobacterium
RQSGSG

SEQ ID NO: 1023898 - protein, 5 aa, Mycobacterium
RQSKN

SEQ ID NO: 1023899 - protein, 7 aa, Mycobacterium
RQSLDSA

SEQ ID NO: 1023900 - protein, 7 aa, Mycobacterium
RQSTGDV

SEQ ID NO: 1023901 - protein, 17 aa, Mycobacterium
RQTAAPERNWFLEFLLR

SEQ ID NO: 1023902 - protein, 6 aa, Mycobacterium
RQTDPV

SEQ ID NO: 1023903 - protein, 5 aa, Mycobacterium
RQTHE

SEQ ID NO: 1023904 - protein, 5 aa, Mycobacterium
RQTIA

SEQ ID NO: 1023905 - protein, 8 aa, Mycobacterium
RQTRGNLP

SEQ ID NO: 1023906 - protein, 7 aa, Mycobacterium
RQTTSAV

SEQ ID NO: 1023907 - protein, 14 aa, Mycobacterium
RQVSEAAGQGNNAA

SEQ ID NO: 1023908 - protein, 9 aa, Mycobacterium
RQVSTGRLA

SEQ ID NO: 1023909 - protein, 13 aa, Mycobacterium
RQVTTNSNDAAAA

SEQ ID NO: 1023910 - protein, 9 aa, Mycobacterium
RQYHSRTDR

SEQ ID NO: 1023911 - protein, 5 aa, Mycobacterium
RQYNP

SEQ ID NO: 1023912 - protein, 13 aa, Mycobacterium
RRAAGAAARALGT

SEQ ID NO: 1023913 - protein, 5 aa, Mycobacterium
RRAAQ

SEQ ID NO: 1023914 - protein, 11 aa, Mycobacterium
RRAAQADGYPV

SEQ ID NO: 1023915 - protein, 7 aa, Mycobacterium
RRAASGY

SEQ ID NO: 1023916 - protein, 8 aa, Mycobacterium
RRAASRQA

SEQ ID NO: 1023917 - protein, 10 aa, Mycobacterium
RRAATGLGPA

SEQ ID NO: 1023918 - protein, 7 aa, Mycobacterium
RRACRKA

SEQ ID NO: 1023919 - protein, 7 aa, Mycobacterium
RRADASH

SEQ ID NO: 1023920 - protein, 7 aa, Mycobacterium
RRADDAG

SEQ ID NO: 1023921 - protein, 9 aa, Mycobacterium
RRADPTGEL

SEQ ID NO: 1023922 - protein, 10 aa, Mycobacterium
RRAEAARRSL

SEQ ID NO: 1023923 - protein, 7 aa, Mycobacterium
RRAENPH

SEQ ID NO: 1023924 - protein, 6 aa, Mycobacterium
RRAEPL

SEQ ID NO: 1023925 - protein, 6 aa, Mycobacterium
RRAERS

SEQ ID NO: 1023926 - protein, 5 aa, Mycobacterium
RRAGE

SEQ ID NO: 1023927 - protein, 12 aa, Mycobacterium
RRAGEDVAAGTT

SEQ ID NO: 1023928 - protein, 6 aa, Mycobacterium
RRAGGN

SEQ ID NO: 1023929 - protein, 8 aa, Mycobacterium
RRAGLDPP

SEQ ID NO: 1023930 - protein, 9 aa, Mycobacterium
RRAGTDSEI

SEQ ID NO: 1023931 - protein, 12 aa, Mycobacterium
RRAGTHAASAAL

SEQ ID NO: 1023932 - protein, 5 aa, Mycobacterium
RRAGY

SEQ ID NO: 1023933 - protein, 36 aa, Mycobacterium
RRAHPRDRTPLGDRQDPHRAGPGPAAAQPALPRTAS

SEQ ID NO: 1023934 - protein, 9 aa, Mycobacterium
RRAKPEDDT

SEQ ID NO: 1023935 - protein, 8 aa, Mycobacterium
RRALNAGP

SEQ ID NO: 1023936 - protein, 14 aa, Mycobacterium
RRALPAPDYTTSAQ

SEQ ID NO: 1023937 - protein, 4 aa, Mycobacterium
RRAM

SEQ ID NO: 1023938 - protein, 12 aa, Mycobacterium
RRANAGKSRRAL

SEQ ID NO: 1023939 - protein, 15 aa, Mycobacterium
RRAPRRRPDTHPMRA

SEQ ID NO: 1023940 - protein, 10 aa, Mycobacterium
RRAPTGGEGM

SEQ ID NO: 1023941 - protein, 6 aa, Mycobacterium
RRAQRG

SEQ ID NO: 1023942 - protein, 12 aa, Mycobacterium
RRARAELSETEF

SEQ ID NO: 1023943 - protein, 5 aa, Mycobacterium
RRARG

SEQ ID NO: 1023944 - protein, 26 aa, Mycobacterium
RRARGPVKRAAKKTTRKSPAKKAVKR

SEQ ID NO: 1023945 - protein, 9 aa, Mycobacterium
RRARRPAWR

SEQ ID NO: 1023946 - protein, 6 aa, Mycobacterium
RRARTS

SEQ ID NO: 1023947 - protein, 14 aa, Mycobacterium
RRASRVDSGPPRAP

SEQ ID NO: 1023948 - protein, 8 aa, Mycobacterium
RRATRVDE

SEQ ID NO: 1023949 - protein, 13 aa, Mycobacterium
RRATWPTNGRWIA

SEQ ID NO: 1023950 - protein, 5 aa, Mycobacterium
RRAYT

SEQ ID NO: 1023951 - protein, 6 aa, Mycobacterium
RRCGPG

SEQ ID NO: 1023952 - protein, 30 aa, Mycobacterium
RRCRRGGLRRSGGARTVADRPSAAGPPRNP

SEQ ID NO: 1023953 - protein, 6 aa, Mycobacterium
RRDAEL

SEQ ID NO: 1023954 - protein, 6 aa, Mycobacterium
RRDAVG

SEQ ID NO: 1023955 - protein, 7 aa, Mycobacterium
RRDEARK

SEQ ID NO: 1023956 - protein, 9 aa, Mycobacterium
RRDELARQK

SEQ ID NO: 1023957 - protein, 7 aa, Mycobacterium
RRDERKA

SEQ ID NO: 1023958 - protein, 5 aa, Mycobacterium
RRDET

SEQ ID NO: 1023959 - protein, 4 aa, Mycobacterium
RRDF

SEQ ID NO: 1023960 - protein, 6 aa, Mycobacterium
RRDGDD

SEQ ID NO: 1023961 - protein, 8 aa, Mycobacterium
RRDGDKLS

SEQ ID NO: 1023962 - protein, 6 aa, Mycobacterium
RRDGEA

SEQ ID NO: 1023963 - protein, 9 aa, Mycobacterium
RRDGGTGVD

SEQ ID NO: 1023964 - protein, 13 aa, Mycobacterium
RRDGIDAASEIAT

SEQ ID NO: 1023965 - protein, 12 aa, Mycobacterium
RRDGQILDGLAV

SEQ ID NO: 1023966 - protein, 9 aa, Mycobacterium
RRDGSRNGV

SEQ ID NO: 1023967 - protein, 7 aa, Mycobacterium
RRDHPDE

SEQ ID NO: 1023968 - protein, 4 aa, Mycobacterium
RRDK

SEQ ID NO: 1023969 - protein, 9 aa, Mycobacterium
RRDKATSNI

SEQ ID NO: 1023970 - protein, 5 aa, Mycobacterium
RRDLG

SEQ ID NO: 1023971 - protein, 9 aa, Mycobacterium
RRDNDKARA

SEQ ID NO: 1023972 - protein, 4 aa, Mycobacterium
RRDP

SEQ ID NO: 1023973 - protein, 7 aa, Mycobacterium
RRDPAAA

SEQ ID NO: 1023974 - protein, 5 aa, Mycobacterium
RRDPD

SEQ ID NO: 1023975 - protein, 30 aa, Mycobacterium
RRDPIPAAESPTVPSDIGRTPKGTATTQAA

SEQ ID NO: 1023976 - protein, 9 aa, Mycobacterium
RRDPNRPRA

SEQ ID NO: 1023977 - protein, 15 aa, Mycobacterium
RRDPQAARAACSGRS

SEQ ID NO: 1023978 - protein, 4 aa, Mycobacterium
RRDQ

SEQ ID NO: 1023979 - protein, 19 aa, Mycobacterium
RRDQLNDAPLAEEDWEQRR

SEQ ID NO: 1023980 - protein, 10 aa, Mycobacterium
RRDQTGAGAQ

SEQ ID NO: 1023981 - protein, 14 aa, Mycobacterium
RRDSGYQPGRRSSA

SEQ ID NO: 1023982 - protein, 10 aa, Mycobacterium
RRDSPARGSR

SEQ ID NO: 1023983 - protein, 6 aa, Mycobacterium
RRDTEM

SEQ ID NO: 1023984 - protein, 7 aa, Mycobacterium
RRDTNGY

SEQ ID NO: 1023985 - protein, 10 aa, Mycobacterium
RRDVDDGSLA

SEQ ID NO: 1023986 - protein, 11 aa, Mycobacterium
RREASDAMTGK

SEQ ID NO: 1023987 - protein, 12 aa, Mycobacterium
RREEALEAGKEA

SEQ ID NO: 1023988 - protein, 6 aa, Mycobacterium
RREFDG

SEQ ID NO: 1023989 - protein, 4 aa, Mycobacterium
RREG

SEQ ID NO: 1023990 - protein, 8 aa, Mycobacterium
RREGAREG

SEQ ID NO: 1023991 - protein, 6 aa, Mycobacterium
RREGKR

SEQ ID NO: 1023992 - protein, 6 aa, Mycobacterium
RREGQD

SEQ ID NO: 1023993 - protein, 9 aa, Mycobacterium
RREHDEAAA

SEQ ID NO: 1023994 - protein, 11 aa, Mycobacterium
RREKDDVTEVR

SEQ ID NO: 1023995 - protein, 5 aa, Mycobacterium
RREPG

SEQ ID NO: 1023996 - protein, 8 aa, Mycobacterium
RREPRPYP

SEQ ID NO: 1023997 - protein, 5 aa, Mycobacterium
RREQR

SEQ ID NO: 1023998 - protein, 12 aa, Mycobacterium
RREQRRRQSPPG

SEQ ID NO: 1023999 - protein, 12 aa, Mycobacterium
RRERDEASCRST

SEQ ID NO: 1024000 - protein, 10 aa, Mycobacterium
RRERGRGKLR

SEQ ID NO: 1024001 - protein, 108 aa, Mycobacterium
RRERRGASREADVTAGTSTAEATESDCQGTADDDTRTLQGGQSDTKTEERGPDVGNDQGVEQQSSSLQPRGDDDGEGRQGRRGRRFRDRDRRRRGERSGDGAEAELRQ

SEQ ID NO: 1024002 - protein, 8 aa, Mycobacterium
RRERSGKH

SEQ ID NO: 1024003 - protein, 7 aa, Mycobacterium
RRESEAL

SEQ ID NO: 1024004 - protein, 11 aa, Mycobacterium
RRESESVARPS

SEQ ID NO: 1024005 - protein, 20 aa, Mycobacterium
RRESNPLRCPPRASRDRTLP

SEQ ID NO: 1024006 - protein, 11 aa, Mycobacterium
RRETSHRKPGV

SEQ ID NO: 1024007 - protein, 5 aa, Mycobacterium
RRFQG

SEQ ID NO: 1024008 - protein, 16 aa, Mycobacterium
RRGDERLGQGGVPADR

SEQ ID NO: 1024009 - protein, 9 aa, Mycobacterium
RRGDSDQEA

SEQ ID NO: 1024010 - protein, 5 aa, Mycobacterium
RRGEN

SEQ ID NO: 1024011 - protein, 6 aa, Mycobacterium
RRGERR

SEQ ID NO: 1024012 - protein, 17 aa, Mycobacterium
RRGGAQDRVQETHGNGR

SEQ ID NO: 1024013 - protein, 16 aa, Mycobacterium
RRGGEPEGRNQPDIGV

SEQ ID NO: 1024014 - protein, 6 aa, Mycobacterium
RRGGGI

SEQ ID NO: 1024015 - protein, 11 aa, Mycobacterium
RRGGPCPSTYP

SEQ ID NO: 1024016 - protein, 13 aa, Mycobacterium
RRGGQADQESVGK

SEQ ID NO: 1024017 - protein, 6 aa, Mycobacterium
RRGGRT

SEQ ID NO: 1024018 - protein, 6 aa, Mycobacterium
RRGGTE

SEQ ID NO: 1024019 - protein, 5 aa, Mycobacterium
RRGLD

SEQ ID NO: 1024020 - protein, 5 aa, Mycobacterium
RRGLE

SEQ ID NO: 1024021 - protein, 7 aa, Mycobacterium
RRGNRGG

SEQ ID NO: 1024022 - protein, 4 aa, Mycobacterium
RRGP

SEQ ID NO: 1024023 - protein, 6 aa, Mycobacterium
RRGPAH

SEQ ID NO: 1024024 - protein, 6 aa, Mycobacterium
RRGPGA

SEQ ID NO: 1024025 - protein, 7 aa, Mycobacterium
RRGPGGG

SEQ ID NO: 1024026 - protein, 6 aa, Mycobacterium
RRGPNG

SEQ ID NO: 1024027 - protein, 9 aa, Mycobacterium
RRGPSGVGA

SEQ ID NO: 1024028 - protein, 5 aa, Mycobacterium
RRGQP

SEQ ID NO: 1024029 - protein, 12 aa, Mycobacterium
RRGQQPDAGRAE

SEQ ID NO: 1024030 - protein, 10 aa, Mycobacterium
RRGRAAQPGW

SEQ ID NO: 1024031 - protein, 9 aa, Mycobacterium
RRGRAIGSD

SEQ ID NO: 1024032 - protein, 7 aa, Mycobacterium
RRGRERY

SEQ ID NO: 1024033 - protein, 8 aa, Mycobacterium
RRGRGREE

SEQ ID NO: 1024034 - protein, 8 aa, Mycobacterium
RRGRPLTA

SEQ ID NO: 1024035 - protein, 14 aa, Mycobacterium
RRGRRGDFAGPKGK

SEQ ID NO: 1024036 - protein, 13 aa, Mycobacterium
RRGSGSNANPALA

SEQ ID NO: 1024037 - protein, 6 aa, Mycobacterium
RRGSGY

SEQ ID NO: 1024038 - protein, 7 aa, Mycobacterium
RRGSRWS

SEQ ID NO: 1024039 - protein, 6 aa, Mycobacterium
RRGSTA

SEQ ID NO: 1024040 - protein, 17 aa, Mycobacterium
RRGTAASVTSPAPPSPL

SEQ ID NO: 1024041 - protein, 7 aa, Mycobacterium
RRGTDKL

SEQ ID NO: 1024042 - protein, 7 aa, Mycobacterium
RRHGGRS

SEQ ID NO: 1024043 - protein, 24 aa, Mycobacterium
RRHPPATNDRRSTKQPAPIAQRTA

SEQ ID NO: 1024044 - protein, 11 aa, Mycobacterium
RRHRDGATLPD

SEQ ID NO: 1024045 - protein, 4 aa, Mycobacterium
RRHT

SEQ ID NO: 1024046 - protein, 6 aa, Mycobacterium
RRIAPS

SEQ ID NO: 1024047 - protein, 14 aa, Mycobacterium
RRKARRGRGPLSLV

SEQ ID NO: 1024048 - protein, 17 aa, Mycobacterium
RRKDQASQCSSGAATAR

SEQ ID NO: 1024049 - protein, 10 aa, Mycobacterium
RRKKPSDDLT

SEQ ID NO: 1024050 - protein, 9 aa, Mycobacterium
RRKPEAAAR

SEQ ID NO: 1024051 - protein, 15 aa, Mycobacterium
RRKPYQEGEEKRRLS

SEQ ID NO: 1024052 - protein, 25 aa, Mycobacterium
RRKRRHRSRPGGVAGRTLVSPARVR

SEQ ID NO: 1024053 - protein, 8 aa, Mycobacterium
RRKSGNYT

SEQ ID NO: 1024054 - protein, 8 aa, Mycobacterium
RRKTSGTV

SEQ ID NO: 1024055 - protein, 7 aa, Mycobacterium
RRKTSRN

SEQ ID NO: 1024056 - protein, 8 aa, Mycobacterium
RRLDDAQP

SEQ ID NO: 1024057 - protein, 5 aa, Mycobacterium
RRLDP

SEQ ID NO: 1024058 - protein, 20 aa, Mycobacterium
RRLPGQATAEYSADHTSSIR

SEQ ID NO: 1024059 - protein, 5 aa, Mycobacterium
RRLRQ

SEQ ID NO: 1024060 - protein, 15 aa, Mycobacterium
RRLSSTQAPSKTGVT

SEQ ID NO: 1024061 - protein, 4 aa, Mycobacterium
RRLT

SEQ ID NO: 1024062 - protein, 5 aa, Mycobacterium
RRLTG

SEQ ID NO: 1024063 - protein, 5 aa, Mycobacterium
RRLTP

SEQ ID NO: 1024064 - protein, 6 aa, Mycobacterium
RRMGSK

SEQ ID NO: 1024065 - protein, 8 aa, Mycobacterium
RRNEAASS

SEQ ID NO: 1024066 - protein, 6 aa, Mycobacterium
RRNGGD

SEQ ID NO: 1024067 - protein, 4 aa, Mycobacterium
RRNK

SEQ ID NO: 1024068 - protein, 8 aa, Mycobacterium
RRNLGGAG

SEQ ID NO: 1024069 - protein, 4 aa, Mycobacterium
RRNP

SEQ ID NO: 1024070 - protein, 7 aa, Mycobacterium
RRNPGDD

SEQ ID NO: 1024071 - protein, 17 aa, Mycobacterium
RRNRSTFPGWASPDDTL

SEQ ID NO: 1024072 - protein, 5 aa, Mycobacterium
RRNTY

SEQ ID NO: 1024073 - protein, 7 aa, Mycobacterium
RRPAEPN

SEQ ID NO: 1024074 - protein, 5 aa, Mycobacterium
RRPAL

SEQ ID NO: 1024075 - protein, 48 aa, Mycobacterium
RRPAPPEPKSVPEPPPAPEPRPAPEPRRAPEPRPAPVPEPVSAPGELN

SEQ ID NO: 1024076 - protein, 7 aa, Mycobacterium
RRPDELA

SEQ ID NO: 1024077 - protein, 7 aa, Mycobacterium
RRPDGAT

SEQ ID NO: 1024078 - protein, 6 aa, Mycobacterium
RRPDGS

SEQ ID NO: 1024079 - protein, 10 aa, Mycobacterium
RRPDGSLQHP

SEQ ID NO: 1024080 - protein, 5 aa, Mycobacterium
RRPDQ

SEQ ID NO: 1024081 - protein, 4 aa, Mycobacterium
RRPE

SEQ ID NO: 1024082 - protein, 21 aa, Mycobacterium
RRPEAAGEQVGVSGLRQPICS

SEQ ID NO: 1024083 - protein, 7 aa, Mycobacterium
RRPEPGL

SEQ ID NO: 1024084 - protein, 12 aa, Mycobacterium
RRPERSPSSRRP

SEQ ID NO: 1024085 - protein, 17 aa, Mycobacterium
RRPGAPPSATPSSSRRY

SEQ ID NO: 1024086 - protein, 8 aa, Mycobacterium
RRPGEHTG

SEQ ID NO: 1024087 - protein, 7 aa, Mycobacterium
RRPGETA

SEQ ID NO: 1024088 - protein, 8 aa, Mycobacterium
RRPGHTEA

SEQ ID NO: 1024089 - protein, 10 aa, Mycobacterium
RRPGPAPRLG

SEQ ID NO: 1024090 - protein, 11 aa, Mycobacterium
RRPGPEDLGDR

SEQ ID NO: 1024091 - protein, 6 aa, Mycobacterium
RRPISR

SEQ ID NO: 1024092 - protein, 16 aa, Mycobacterium
RRPKDLATKQAAASVG

SEQ ID NO: 1024093 - protein, 9 aa, Mycobacterium
RRPNATQDE

SEQ ID NO: 1024094 - protein, 13 aa, Mycobacterium
RRPPSSPKRRTAR

SEQ ID NO: 1024095 - protein, 6 aa, Mycobacterium
RRPQAY

SEQ ID NO: 1024096 - protein, 11 aa, Mycobacterium
RRPRQLSGGQV

SEQ ID NO: 1024097 - protein, 16 aa, Mycobacterium
RRPSGTDPSTHPSSDL

SEQ ID NO: 1024098 - protein, 7 aa, Mycobacterium
RRPSPAA

SEQ ID NO: 1024099 - protein, 17 aa, Mycobacterium
RRPSTTARRTNRRRKVS

SEQ ID NO: 1024100 - protein, 8 aa, Mycobacterium
RRPSTTKR

SEQ ID NO: 1024101 - protein, 8 aa, Mycobacterium
RRPTALER

SEQ ID NO: 1024102 - protein, 18 aa, Mycobacterium
RRPTSRPKRSPTSWCSGT

SEQ ID NO: 1024103 - protein, 6 aa, Mycobacterium
RRPTYA

SEQ ID NO: 1024104 - protein, 9 aa, Mycobacterium
RRQAGASET

SEQ ID NO: 1024105 - protein, 5 aa, Mycobacterium
RRQAR

SEQ ID NO: 1024106 - protein, 7 aa, Mycobacterium
RRQASLE

SEQ ID NO: 1024107 - protein, 10 aa, Mycobacterium
RRQDEGGSTI

SEQ ID NO: 1024108 - protein, 10 aa, Mycobacterium
RRQDEQLQKR

SEQ ID NO: 1024109 - protein, 5 aa, Mycobacterium
RRQGL

SEQ ID NO: 1024110 - protein, 6 aa, Mycobacterium
RRQGTP

SEQ ID NO: 1024111 - protein, 4 aa, Mycobacterium
RRQP

SEQ ID NO: 1024112 - protein, 5 aa, Mycobacterium
RRQPG

SEQ ID NO: 1024113 - protein, 26 aa, Mycobacterium
RRQPPSVSVAPAAPSVPDATADTTPA

SEQ ID NO: 1024114 - protein, 8 aa, Mycobacterium
RRQPSDVP

SEQ ID NO: 1024115 - protein, 8 aa, Mycobacterium
RRQRAHPG

SEQ ID NO: 1024116 - protein, 7 aa, Mycobacterium
RRQRREQ

SEQ ID NO: 1024117 - protein, 14 aa, Mycobacterium
RRQRSPQRAAGAPE

SEQ ID NO: 1024118 - protein, 6 aa, Mycobacterium
RRRAAA

SEQ ID NO: 1024119 - protein, 8 aa, Mycobacterium
RRRDAADI

SEQ ID NO: 1024120 - protein, 7 aa, Mycobacterium
RRRDPFD

SEQ ID NO: 1024121 - protein, 6 aa, Mycobacterium
RRREAA

SEQ ID NO: 1024122 - protein, 8 aa, Mycobacterium
RRREAAAR

SEQ ID NO: 1024123 - protein, 9 aa, Mycobacterium
RRREDGSIE

SEQ ID NO: 1024124 - protein, 4 aa, Mycobacterium
RRRG

SEQ ID NO: 1024125 - protein, 7 aa, Mycobacterium
RRRGAAA

SEQ ID NO: 1024126 - protein, 5 aa, Mycobacterium
RRRGH

SEQ ID NO: 1024127 - protein, 5 aa, Mycobacterium
RRRHP

SEQ ID NO: 1024128 - protein, 4 aa, Mycobacterium
RRRL

SEQ ID NO: 1024129 - protein, 15 aa, Mycobacterium
RRRPAPETAGEAGDG

SEQ ID NO: 1024130 - protein, 6 aa, Mycobacterium
RRRPDG

SEQ ID NO: 1024131 - protein, 19 aa, Mycobacterium
RRRPGQVEQPQQADDDTLL

SEQ ID NO: 1024132 - protein, 18 aa, Mycobacterium
RRRPKGPPSGSAATDRAG

SEQ ID NO: 1024133 - protein, 13 aa, Mycobacterium
RRRQPHPKPGLRA

SEQ ID NO: 1024134 - protein, 17 aa, Mycobacterium
RRRQTSNSLPSGHSASA

SEQ ID NO: 1024135 - protein, 7 aa, Mycobacterium
RRRRPRN

SEQ ID NO: 1024136 - protein, 15 aa, Mycobacterium
RRRRTTSMSMPPTSP

SEQ ID NO: 1024137 - protein, 5 aa, Mycobacterium
RRRSE

SEQ ID NO: 1024138 - protein, 6 aa, Mycobacterium
RRRTGR

SEQ ID NO: 1024139 - protein, 29 aa, Mycobacterium
RRRTRRGRRAPRNRAASTGLGGLTRVRRR

SEQ ID NO: 1024140 - protein, 7 aa, Mycobacterium
RRRTTAT

SEQ ID NO: 1024141 - protein, 30 aa, Mycobacterium
RRRVSTGVRRRSVGAQRALGRAGNALSPAE

SEQ ID NO: 1024142 - protein, 5 aa, Mycobacterium
RRSAA

SEQ ID NO: 1024143 - protein, 7 aa, Mycobacterium
RRSAADR

SEQ ID NO: 1024144 - protein, 8 aa, Mycobacterium
RRSAGAHP

SEQ ID NO: 1024145 - protein, 5 aa, Mycobacterium
RRSAQ

SEQ ID NO: 1024146 - protein, 6 aa, Mycobacterium
RRSGEP

SEQ ID NO: 1024147 - protein, 16 aa, Mycobacterium
RRSGGDTARTKACPKM

SEQ ID NO: 1024148 - protein, 5 aa, Mycobacterium
RRSGR

SEQ ID NO: 1024149 - protein, 9 aa, Mycobacterium
RRSGVTAED

SEQ ID NO: 1024150 - protein, 11 aa, Mycobacterium
RRSNPRGLTGG

SEQ ID NO: 1024151 - protein, 6 aa, Mycobacterium
RRSPES

SEQ ID NO: 1024152 - protein, 7 aa, Mycobacterium
RRSPRSD

SEQ ID NO: 1024153 - protein, 9 aa, Mycobacterium
RRSPRTKAR

SEQ ID NO: 1024154 - protein, 10 aa, Mycobacterium
RRSRGGRARR

SEQ ID NO: 1024155 - protein, 21 aa, Mycobacterium
RRSRPTTGSCAPTVHQHGIHT

SEQ ID NO: 1024156 - protein, 17 aa, Mycobacterium
RRSRRGGRGSVIPADRA

SEQ ID NO: 1024157 - protein, 9 aa, Mycobacterium
RRSRRGYGG

SEQ ID NO: 1024158 - protein, 7 aa, Mycobacterium
RRSRRRW

SEQ ID NO: 1024159 - protein, 10 aa, Mycobacterium
RRSRTHRRTP

SEQ ID NO: 1024160 - protein, 11 aa, Mycobacterium
RRSSRKLSPEL

SEQ ID NO: 1024161 - protein, 7 aa, Mycobacterium
RRSTHEA

SEQ ID NO: 1024162 - protein, 4 aa, Mycobacterium
RRTA

SEQ ID NO: 1024163 - protein, 9 aa, Mycobacterium
RRTATADKA

SEQ ID NO: 1024164 - protein, 7 aa, Mycobacterium
RRTERER

SEQ ID NO: 1024165 - protein, 5 aa, Mycobacterium
RRTGA

SEQ ID NO: 1024166 - protein, 9 aa, Mycobacterium
RRTGAADDP

SEQ ID NO: 1024167 - protein, 9 aa, Mycobacterium
RRTGEKRKL

SEQ ID NO: 1024168 - protein, 9 aa, Mycobacterium
RRTGGSDAG

SEQ ID NO: 1024169 - protein, 29 aa, Mycobacterium
RRTGSCSPMPTRSAGARRSRAWCPLMDRP

SEQ ID NO: 1024170 - protein, 4 aa, Mycobacterium
RRTI

SEQ ID NO: 1024171 - protein, 6 aa, Mycobacterium
RRTLPG

SEQ ID NO: 1024172 - protein, 6 aa, Mycobacterium
RRTNGL

SEQ ID NO: 1024173 - protein, 11 aa, Mycobacterium
RRTPGQSTRTA

SEQ ID NO: 1024174 - protein, 7 aa, Mycobacterium
RRTPIDP

SEQ ID NO: 1024175 - protein, 5 aa, Mycobacterium
RRTPR

SEQ ID NO: 1024176 - protein, 7 aa, Mycobacterium
RRTQAAG

SEQ ID NO: 1024177 - protein, 15 aa, Mycobacterium
RRTRAGLKDPKRPSG

SEQ ID NO: 1024178 - protein, 7 aa, Mycobacterium
RRTRAQQ

SEQ ID NO: 1024179 - protein, 4 aa, Mycobacterium
RRTS

SEQ ID NO: 1024180 - protein, 6 aa, Mycobacterium
RRTSNN

SEQ ID NO: 1024181 - protein, 6 aa, Mycobacterium
RRTSPQ

SEQ ID NO: 1024182 - protein, 13 aa, Mycobacterium
RRTSTTIRTRLAA

SEQ ID NO: 1024183 - protein, 4 aa, Mycobacterium
RRTT

SEQ ID NO: 1024184 - protein, 13 aa, Mycobacterium
RRTTNAEGREALT

SEQ ID NO: 1024185 - protein, 4 aa, Mycobacterium
RRTY

SEQ ID NO: 1024186 - protein, 6 aa, Mycobacterium
RRVEGR

SEQ ID NO: 1024187 - protein, 4 aa, Mycobacterium
RRVG

SEQ ID NO: 1024188 - protein, 26 aa, Mycobacterium
RRVGGRRRGRSGSGRGRGAIDREQSA

SEQ ID NO: 1024189 - protein, 12 aa, Mycobacterium
RRVRTADGQTYE

SEQ ID NO: 1024190 - protein, 7 aa, Mycobacterium
RRWDETG

SEQ ID NO: 1024191 - protein, 8 aa, Mycobacterium
RRYGERAA

SEQ ID NO: 1024192 - protein, 8 aa, Mycobacterium
RRYRDEAP

SEQ ID NO: 1024193 - protein, 9 aa, Mycobacterium
RRYREGSSA

SEQ ID NO: 1024194 - protein, 11 aa, Mycobacterium
RRYTGHSSRGA

SEQ ID NO: 1024195 - protein, 11 aa, Mycobacterium
RSAAAGDPCGT

SEQ ID NO: 1024196 - protein, 9 aa, Mycobacterium
RSAAANTAS

SEQ ID NO: 1024197 - protein, 6 aa, Mycobacterium
RSAADR

SEQ ID NO: 1024198 - protein, 30 aa, Mycobacterium
RSAAPSACAGATGRSAYCSQPKPHEGVGQP

SEQ ID NO: 1024199 - protein, 10 aa, Mycobacterium
RSAARQSRRA

SEQ ID NO: 1024200 - protein, 16 aa, Mycobacterium
RSAASTAGAHPSARRS

SEQ ID NO: 1024201 - protein, 4 aa, Mycobacterium
RSAD

SEQ ID NO: 1024202 - protein, 10 aa, Mycobacterium
RSADSGAGVL

SEQ ID NO: 1024203 - protein, 8 aa, Mycobacterium
RSAETTIP

SEQ ID NO: 1024204 - protein, 6 aa, Mycobacterium
RSAGEV

SEQ ID NO: 1024205 - protein, 8 aa, Mycobacterium
RSAGGRAV

SEQ ID NO: 1024206 - protein, 5 aa, Mycobacterium
RSAGI

SEQ ID NO: 1024207 - protein, 7 aa, Mycobacterium
RSAGISR

SEQ ID NO: 1024208 - protein, 9 aa, Mycobacterium
RSAGPPPVV

SEQ ID NO: 1024209 - protein, 6 aa, Mycobacterium
RSAGRE

SEQ ID NO: 1024210 - protein, 9 aa, Mycobacterium
RSAGSIKKI

SEQ ID NO: 1024211 - protein, 11 aa, Mycobacterium
RSAGTEPADRI

SEQ ID NO: 1024212 - protein, 7 aa, Mycobacterium
RSAHTRR

SEQ ID NO: 1024213 - protein, 14 aa, Mycobacterium
RSANLAGKDAVGAL

SEQ ID NO: 1024214 - protein, 13 aa, Mycobacterium
RSANPEITHLMGV

SEQ ID NO: 1024215 - protein, 12 aa, Mycobacterium
RSAPDSPQRVAG

SEQ ID NO: 1024216 - protein, 7 aa, Mycobacterium
RSAPTFD

SEQ ID NO: 1024217 - protein, 4 aa, Mycobacterium
RSAQ

SEQ ID NO: 1024218 - protein, 5 aa, Mycobacterium
RSAQG

SEQ ID NO: 1024219 - protein, 4 aa, Mycobacterium
RSAR

SEQ ID NO: 1024220 - protein, 25 aa, Mycobacterium
RSARRRRRHRQQSHQRRQRRQRWGQ

SEQ ID NO: 1024221 - protein, 7 aa, Mycobacterium
RSASPDV

SEQ ID NO: 1024222 - protein, 11 aa, Mycobacterium
RSASTASEPAA

SEQ ID NO: 1024223 - protein, 7 aa, Mycobacterium
RSASTTA

SEQ ID NO: 1024224 - protein, 8 aa, Mycobacterium
RSASVASP

SEQ ID NO: 1024225 - protein, 5 aa, Mycobacterium
RSASW

SEQ ID NO: 1024226 - protein, 4 aa, Mycobacterium
RSAT

SEQ ID NO: 1024227 - protein, 7 aa, Mycobacterium
RSATAVG

SEQ ID NO: 1024228 - protein, 5 aa, Mycobacterium
RSATT

SEQ ID NO: 1024229 - protein, 22 aa, Mycobacterium
RSAVTDSEREIRYDPEAKPGVS

SEQ ID NO: 1024230 - protein, 4 aa, Mycobacterium
RSCE

SEQ ID NO: 1024231 - protein, 18 aa, Mycobacterium
RSDDPADTDRPDAWQTDD

SEQ ID NO: 1024232 - protein, 4 aa, Mycobacterium
RSDE

SEQ ID NO: 1024233 - protein, 7 aa, Mycobacterium
RSDEADV

SEQ ID NO: 1024234 - protein, 6 aa, Mycobacterium
RSDEPE

SEQ ID NO: 1024235 - protein, 5 aa, Mycobacterium
RSDES

SEQ ID NO: 1024236 - protein, 5 aa, Mycobacterium
RSDGS

SEQ ID NO: 1024237 - protein, 6 aa, Mycobacterium
RSDKTV

SEQ ID NO: 1024238 - protein, 10 aa, Mycobacterium
RSDLGRTEQR

SEQ ID NO: 1024239 - protein, 11 aa, Mycobacterium
RSDLNDPSTIT

SEQ ID NO: 1024240 - protein, 8 aa, Mycobacterium
RSDNTGYD

SEQ ID NO: 1024241 - protein, 5 aa, Mycobacterium
RSDPL

SEQ ID NO: 1024242 - protein, 10 aa, Mycobacterium
RSDPPQSLAE

SEQ ID NO: 1024243 - protein, 8 aa, Mycobacterium
RSDPTETA

SEQ ID NO: 1024244 - protein, 4 aa, Mycobacterium
RSDQ

SEQ ID NO: 1024245 - protein, 14 aa, Mycobacterium
RSDQSLSLSEDPPV

SEQ ID NO: 1024246 - protein, 8 aa, Mycobacterium
RSDRDPAW

SEQ ID NO: 1024247 - protein, 7 aa, Mycobacterium
RSDRGVA

SEQ ID NO: 1024248 - protein, 22 aa, Mycobacterium
RSDRVGAAERKAARRQRRERDD

SEQ ID NO: 1024249 - protein, 5 aa, Mycobacterium
RSDVG

SEQ ID NO: 1024250 - protein, 9 aa, Mycobacterium
RSEAGRRVA

SEQ ID NO: 1024251 - protein, 7 aa, Mycobacterium
RSEARKG

SEQ ID NO: 1024252 - protein, 6 aa, Mycobacterium
RSEDGA

SEQ ID NO: 1024253 - protein, 13 aa, Mycobacterium
RSEEDGPRVHPDD

SEQ ID NO: 1024254 - protein, 7 aa, Mycobacterium
RSEEERE

SEQ ID NO: 1024255 - protein, 19 aa, Mycobacterium
RSEFGAGHQPPVPARRDDG

SEQ ID NO: 1024256 - protein, 9 aa, Mycobacterium
RSENLTSTS

SEQ ID NO: 1024257 - protein, 6 aa, Mycobacterium
RSEPGR

SEQ ID NO: 1024258 - protein, 4 aa, Mycobacterium
RSEQ

SEQ ID NO: 1024259 - protein, 5 aa, Mycobacterium
RSEQA

SEQ ID NO: 1024260 - protein, 7 aa, Mycobacterium
RSEQDGD

SEQ ID NO: 1024261 - protein, 7 aa, Mycobacterium
RSERRRP

SEQ ID NO: 1024262 - protein, 26 aa, Mycobacterium
RSESRDRNPAVGDDDLTTSPNSIERR

SEQ ID NO: 1024263 - protein, 8 aa, Mycobacterium
RSETGRRM

SEQ ID NO: 1024264 - protein, 12 aa, Mycobacterium
RSFETREGEKRT

SEQ ID NO: 1024265 - protein, 8 aa, Mycobacterium
RSFTGSQA

SEQ ID NO: 1024266 - protein, 9 aa, Mycobacterium
RSGAANTAA

SEQ ID NO: 1024267 - protein, 6 aa, Mycobacterium
RSGAKD

SEQ ID NO: 1024268 - protein, 8 aa, Mycobacterium
RSGAPRGS

SEQ ID NO: 1024269 - protein, 8 aa, Mycobacterium
RSGAPSNI

SEQ ID NO: 1024270 - protein, 5 aa, Mycobacterium
RSGAS

SEQ ID NO: 1024271 - protein, 9 aa, Mycobacterium
RSGDTPPAV

SEQ ID NO: 1024272 - protein, 5 aa, Mycobacterium
RSGEA

SEQ ID NO: 1024273 - protein, 10 aa, Mycobacterium
RSGEAREKYD

SEQ ID NO: 1024274 - protein, 17 aa, Mycobacterium
RSGEASGTGALDAGGRA

SEQ ID NO: 1024275 - protein, 10 aa, Mycobacterium
RSGEDDESVQ

SEQ ID NO: 1024276 - protein, 11 aa, Mycobacterium
RSGEPIAPTRG

SEQ ID NO: 1024277 - protein, 9 aa, Mycobacterium
RSGERAASE

SEQ ID NO: 1024278 - protein, 11 aa, Mycobacterium
RSGERARRREA

SEQ ID NO: 1024279 - protein, 21 aa, Mycobacterium
RSGERRADLADGKVEPGRPWD

SEQ ID NO: 1024280 - protein, 8 aa, Mycobacterium
RSGESAAV

SEQ ID NO: 1024281 - protein, 15 aa, Mycobacterium
RSGEVTTATDSITSY

SEQ ID NO: 1024282 - protein, 6 aa, Mycobacterium
RSGFGG

SEQ ID NO: 1024283 - protein, 4 aa, Mycobacterium
RSGG

SEQ ID NO: 1024284 - protein, 12 aa, Mycobacterium
RSGGAERPAGSV

SEQ ID NO: 1024285 - protein, 16 aa, Mycobacterium
RSGGEPARVGGPDSVS

SEQ ID NO: 1024286 - protein, 5 aa, Mycobacterium
RSGGF

SEQ ID NO: 1024287 - protein, 4 aa, Mycobacterium
RSGI

SEQ ID NO: 1024288 - protein, 7 aa, Mycobacterium
RSGLPPG

SEQ ID NO: 1024289 - protein, 7 aa, Mycobacterium
RSGLRTD

SEQ ID NO: 1024290 - protein, 21 aa, Mycobacterium
RSGMTLPSEANTQVAGGAPAQ

SEQ ID NO: 1024291 - protein, 6 aa, Mycobacterium
RSGNAQ

SEQ ID NO: 1024292 - protein, 5 aa, Mycobacterium
RSGNF

SEQ ID NO: 1024293 - protein, 25 aa, Mycobacterium
RSGNPANRHRPDPGRSHGTPIEWMS

SEQ ID NO: 1024294 - protein, 12 aa, Mycobacterium
RSGNRTNPSTAT

SEQ ID NO: 1024295 - protein, 4 aa, Mycobacterium
RSGP

SEQ ID NO: 1024296 - protein, 6 aa, Mycobacterium
RSGPDD

SEQ ID NO: 1024297 - protein, 9 aa, Mycobacterium
RSGPHRTQP

SEQ ID NO: 1024298 - protein, 8 aa, Mycobacterium
RSGPKLSG

SEQ ID NO: 1024299 - protein, 4 aa, Mycobacterium
RSGQ

SEQ ID NO: 1024300 - protein, 6 aa, Mycobacterium
RSGQGV

SEQ ID NO: 1024301 - protein, 10 aa, Mycobacterium
RSGQLDPEFA

SEQ ID NO: 1024302 - protein, 8 aa, Mycobacterium
RSGQQEGA

SEQ ID NO: 1024303 - protein, 7 aa, Mycobacterium
RSGRIGG

SEQ ID NO: 1024304 - protein, 5 aa, Mycobacterium
RSGRL

SEQ ID NO: 1024305 - protein, 6 aa, Mycobacterium
RSGRLK

SEQ ID NO: 1024306 - protein, 8 aa, Mycobacterium
RSGRSVDV

SEQ ID NO: 1024307 - protein, 4 aa, Mycobacterium
RSGS

SEQ ID NO: 1024308 - protein, 12 aa, Mycobacterium
RSGSNVDSALDS

SEQ ID NO: 1024309 - protein, 5 aa, Mycobacterium
RSGSS

SEQ ID NO: 1024310 - protein, 5 aa, Mycobacterium
RSGST

SEQ ID NO: 1024311 - protein, 10 aa, Mycobacterium
RSGTCDRDDL

SEQ ID NO: 1024312 - protein, 16 aa, Mycobacterium
RSGTPAQPVREATASG

SEQ ID NO: 1024313 - protein, 5 aa, Mycobacterium
RSGTT

SEQ ID NO: 1024314 - protein, 7 aa, Mycobacterium
RSGTTTY

SEQ ID NO: 1024315 - protein, 4 aa, Mycobacterium
RSGV

SEQ ID NO: 1024316 - protein, 6 aa, Mycobacterium
RSGVDD

SEQ ID NO: 1024317 - protein, 15 aa, Mycobacterium
RSGVDEDYHRGESAY

SEQ ID NO: 1024318 - protein, 6 aa, Mycobacterium
RSGVGD

SEQ ID NO: 1024319 - protein, 5 aa, Mycobacterium
RSGVR

SEQ ID NO: 1024320 - protein, 5 aa, Mycobacterium
RSGVS

SEQ ID NO: 1024321 - protein, 17 aa, Mycobacterium
RSGWSPTRWGSNSTRSA

SEQ ID NO: 1024322 - protein, 4 aa, Mycobacterium
RSGY

SEQ ID NO: 1024323 - protein, 7 aa, Mycobacterium
RSGYGRE

SEQ ID NO: 1024324 - protein, 6 aa, Mycobacterium
RSGYSP

SEQ ID NO: 1024325 - protein, 7 aa, Mycobacterium
RSHEGTM

SEQ ID NO: 1024326 - protein, 11 aa, Mycobacterium
RSHGEITEEQI

SEQ ID NO: 1024327 - protein, 5 aa, Mycobacterium
RSHPA

SEQ ID NO: 1024328 - protein, 10 aa, Mycobacterium
RSHREAAEAR

SEQ ID NO: 1024329 - protein, 5 aa, Mycobacterium
RSIGE

SEQ ID NO: 1024330 - protein, 4 aa, Mycobacterium
RSIP

SEQ ID NO: 1024331 - protein, 4 aa, Mycobacterium
RSIR

SEQ ID NO: 1024332 - protein, 12 aa, Mycobacterium
RSITQDSGGVTV

SEQ ID NO: 1024333 - protein, 6 aa, Mycobacterium
RSKAAR

SEQ ID NO: 1024334 - protein, 10 aa, Mycobacterium
RSKAEAGDTD

SEQ ID NO: 1024335 - protein, 8 aa, Mycobacterium
RSKALGEA

SEQ ID NO: 1024336 - protein, 10 aa, Mycobacterium
RSKAPGDKVS

SEQ ID NO: 1024337 - protein, 9 aa, Mycobacterium
RSKAPTTDL

SEQ ID NO: 1024338 - protein, 6 aa, Mycobacterium
RSKGEY

SEQ ID NO: 1024339 - protein, 10 aa, Mycobacterium
RSKPPEHGPW

SEQ ID NO: 1024340 - protein, 5 aa, Mycobacterium
RSKTS

SEQ ID NO: 1024341 - protein, 5 aa, Mycobacterium
RSLAT

SEQ ID NO: 1024342 - protein, 8 aa, Mycobacterium
RSLEDGRA

SEQ ID NO: 1024343 - protein, 4 aa, Mycobacterium
RSLG

SEQ ID NO: 1024344 - protein, 8 aa, Mycobacterium
RSLGDQGL

SEQ ID NO: 1024345 - protein, 5 aa, Mycobacterium
RSLHR

SEQ ID NO: 1024346 - protein, 5 aa, Mycobacterium
RSLNE

SEQ ID NO: 1024347 - protein, 9 aa, Mycobacterium
RSLPRRDRG

SEQ ID NO: 1024348 - protein, 7 aa, Mycobacterium
RSLRDAA

SEQ ID NO: 1024349 - protein, 8 aa, Mycobacterium
RSNDPDGE

SEQ ID NO: 1024350 - protein, 10 aa, Mycobacterium
RSNGERAAPD

SEQ ID NO: 1024351 - protein, 6 aa, Mycobacterium
RSNGLP

SEQ ID NO: 1024352 - protein, 14 aa, Mycobacterium
RSNHGTCANQSPIV

SEQ ID NO: 1024353 - protein, 4 aa, Mycobacterium
RSNL

SEQ ID NO: 1024354 - protein, 5 aa, Mycobacterium
RSNLD

SEQ ID NO: 1024355 - protein, 7 aa, Mycobacterium
RSNNIGT

SEQ ID NO: 1024356 - protein, 9 aa, Mycobacterium
RSNPLPRSR

SEQ ID NO: 1024357 - protein, 8 aa, Mycobacterium
RSNPRPDH

SEQ ID NO: 1024358 - protein, 6 aa, Mycobacterium
RSNRHT

SEQ ID NO: 1024359 - protein, 11 aa, Mycobacterium
RSPAARRRTYG

SEQ ID NO: 1024360 - protein, 23 aa, Mycobacterium
RSPAGSPRRAQAQGHLAGLDFDL

SEQ ID NO: 1024361 - protein, 13 aa, Mycobacterium
RSPANPEAAAPSS

SEQ ID NO: 1024362 - protein, 6 aa, Mycobacterium
RSPDRQ

SEQ ID NO: 1024363 - protein, 7 aa, Mycobacterium
RSPDVHK

SEQ ID NO: 1024364 - protein, 7 aa, Mycobacterium
RSPEGKQ

SEQ ID NO: 1024365 - protein, 15 aa, Mycobacterium
RSPGFRSTGRLAGDG

SEQ ID NO: 1024366 - protein, 13 aa, Mycobacterium
RSPGGRQGRKPSR

SEQ ID NO: 1024367 - protein, 14 aa, Mycobacterium
RSPMTGERDIRSED

SEQ ID NO: 1024368 - protein, 20 aa, Mycobacterium
RSPPAAAGSPALTVTGTDAA

SEQ ID NO: 1024369 - protein, 10 aa, Mycobacterium
RSPPKLPNIA

SEQ ID NO: 1024370 - protein, 5 aa, Mycobacterium
RSPSE

SEQ ID NO: 1024371 - protein, 5 aa, Mycobacterium
RSPSG

SEQ ID NO: 1024372 - protein, 24 aa, Mycobacterium
RSPSPAGTASAPRPRTSRSVSWSS

SEQ ID NO: 1024373 - protein, 6 aa, Mycobacterium
RSPSVA

SEQ ID NO: 1024374 - protein, 14 aa, Mycobacterium
RSPSWRGDHPGWGT

SEQ ID NO: 1024375 - protein, 5 aa, Mycobacterium
RSPVP

SEQ ID NO: 1024376 - protein, 6 aa, Mycobacterium
RSPWPR

SEQ ID NO: 1024377 - protein, 9 aa, Mycobacterium
RSQDDPDGL

SEQ ID NO: 1024378 - protein, 6 aa, Mycobacterium
RSQDTF

SEQ ID NO: 1024379 - protein, 4 aa, Mycobacterium
RSQE

SEQ ID NO: 1024380 - protein, 11 aa, Mycobacterium
RSQEKAAEAWS

SEQ ID NO: 1024381 - protein, 4 aa, Mycobacterium
RSQG

SEQ ID NO: 1024382 - protein, 7 aa, Mycobacterium
RSQPGED

SEQ ID NO: 1024383 - protein, 12 aa, Mycobacterium
RSQPGPVRLCRS

SEQ ID NO: 1024384 - protein, 11 aa, Mycobacterium
RSQPNPKSRQA

SEQ ID NO: 1024385 - protein, 15 aa, Mycobacterium
RSQRGPGAESPDSDL

SEQ ID NO: 1024386 - protein, 11 aa, Mycobacterium
RSQTDDSGDTM

SEQ ID NO: 1024387 - protein, 7 aa, Mycobacterium
RSQTPYT

SEQ ID NO: 1024388 - protein, 7 aa, Mycobacterium
RSRADLE

SEQ ID NO: 1024389 - protein, 5 aa, Mycobacterium
RSRAG

SEQ ID NO: 1024390 - protein, 8 aa, Mycobacterium
RSRDPSDL

SEQ ID NO: 1024391 - protein, 11 aa, Mycobacterium
RSREQAAEIGR

SEQ ID NO: 1024392 - protein, 8 aa, Mycobacterium
RSRGGEHS

SEQ ID NO: 1024393 - protein, 6 aa, Mycobacterium
RSRGGT

SEQ ID NO: 1024394 - protein, 6 aa, Mycobacterium
RSRHPT

SEQ ID NO: 1024395 - protein, 11 aa, Mycobacterium
RSRNGQTPNHA

SEQ ID NO: 1024396 - protein, 7 aa, Mycobacterium
RSRNSTD

SEQ ID NO: 1024397 - protein, 7 aa, Mycobacterium
RSRPALR

SEQ ID NO: 1024398 - protein, 7 aa, Mycobacterium
RSRPDRA

SEQ ID NO: 1024399 - protein, 10 aa, Mycobacterium
RSRQGGPGSM

SEQ ID NO: 1024400 - protein, 5 aa, Mycobacterium
RSRQS

SEQ ID NO: 1024401 - protein, 22 aa, Mycobacterium
RSRSLGQGKPTARLRFYEMHVS

SEQ ID NO: 1024402 - protein, 17 aa, Mycobacterium
RSRSSRPFRPRPARRST

SEQ ID NO: 1024403 - protein, 13 aa, Mycobacterium
RSRTGPPSSAPPR

SEQ ID NO: 1024404 - protein, 13 aa, Mycobacterium
RSRVISGAPLALA

SEQ ID NO: 1024405 - protein, 14 aa, Mycobacterium
RSRVQEPSGIQMRG

SEQ ID NO: 1024406 - protein, 5 aa, Mycobacterium
RSRYE

SEQ ID NO: 1024407 - protein, 14 aa, Mycobacterium
RSSDAADADGPANL

SEQ ID NO: 1024408 - protein, 7 aa, Mycobacterium
RSSDPAT

SEQ ID NO: 1024409 - protein, 10 aa, Mycobacterium
RSSDTAELSY

SEQ ID NO: 1024410 - protein, 5 aa, Mycobacterium
RSSEP

SEQ ID NO: 1024411 - protein, 12 aa, Mycobacterium
RSSGEVSKQGRL

SEQ ID NO: 1024412 - protein, 16 aa, Mycobacterium
RSSGGARLADANPAWL

SEQ ID NO: 1024413 - protein, 6 aa, Mycobacterium
RSSGLD

SEQ ID NO: 1024414 - protein, 9 aa, Mycobacterium
RSSHAAGGG

SEQ ID NO: 1024415 - protein, 7 aa, Mycobacterium
RSSLQAG

SEQ ID NO: 1024416 - protein, 9 aa, Mycobacterium
RSSPPAPTH

SEQ ID NO: 1024417 - protein, 6 aa, Mycobacterium
RSSPSE

SEQ ID NO: 1024418 - protein, 16 aa, Mycobacterium
RSSREVARRGPGQVPA

SEQ ID NO: 1024419 - protein, 5 aa, Mycobacterium
RSSRI

SEQ ID NO: 1024420 - protein, 8 aa, Mycobacterium
RSTAGTGY

SEQ ID NO: 1024421 - protein, 7 aa, Mycobacterium
RSTDDTA

SEQ ID NO: 1024422 - protein, 9 aa, Mycobacterium
RSTDTGRRR

SEQ ID NO: 1024423 - protein, 6 aa, Mycobacterium
RSTGAS

SEQ ID NO: 1024424 - protein, 30 aa, Mycobacterium
RSTGASTQPPTTTTASTNCPGSTATTAPTA

SEQ ID NO: 1024425 - protein, 6 aa, Mycobacterium
RSTGRE

SEQ ID NO: 1024426 - protein, 5 aa, Mycobacterium
RSTIG

SEQ ID NO: 1024427 - protein, 14 aa, Mycobacterium
RSTQLGREETLPDT

SEQ ID NO: 1024428 - protein, 8 aa, Mycobacterium
RSTRDGNQ

SEQ ID NO: 1024429 - protein, 4 aa, Mycobacterium
RSTS

SEQ ID NO: 1024430 - protein, 6 aa, Mycobacterium
RSTTES

SEQ ID NO: 1024431 - protein, 19 aa, Mycobacterium
RSTTSAPSTIQSRRPTTAR

SEQ ID NO: 1024432 - protein, 6 aa, Mycobacterium
RSTTTF

SEQ ID NO: 1024433 - protein, 6 aa, Mycobacterium
RSVAER

SEQ ID NO: 1024434 - protein, 5 aa, Mycobacterium
RSVEP

SEQ ID NO: 1024435 - protein, 7 aa, Mycobacterium
RSVEQRR

SEQ ID NO: 1024436 - protein, 10 aa, Mycobacterium
RSVKPTGSAA

SEQ ID NO: 1024437 - protein, 14 aa, Mycobacterium
RSVPPPPAPEVPSP

SEQ ID NO: 1024438 - protein, 6 aa, Mycobacterium
RSVPTA

SEQ ID NO: 1024439 - protein, 4 aa, Mycobacterium
RSVR

SEQ ID NO: 1024440 - protein, 5 aa, Mycobacterium
RSVRS

SEQ ID NO: 1024441 - protein, 4 aa, Mycobacterium
RSVS

SEQ ID NO: 1024442 - protein, 5 aa, Mycobacterium
RSVSG

SEQ ID NO: 1024443 - protein, 9 aa, Mycobacterium
RSYAGPERT

SEQ ID NO: 1024444 - protein, 9 aa, Mycobacterium
RSYGTGPRY

SEQ ID NO: 1024445 - protein, 6 aa, Mycobacterium
RSYPRG

SEQ ID NO: 1024446 - protein, 4 aa, Mycobacterium
RSYR

SEQ ID NO: 1024447 - protein, 4 aa, Mycobacterium
RSYT

SEQ ID NO: 1024448 - protein, 6 aa, Mycobacterium
RTAAQA

SEQ ID NO: 1024449 - protein, 6 aa, Mycobacterium
RTAARA

SEQ ID NO: 1024450 - protein, 5 aa, Mycobacterium
RTAAT

SEQ ID NO: 1024451 - protein, 6 aa, Mycobacterium
RTADDG

SEQ ID NO: 1024452 - protein, 6 aa, Mycobacterium
RTADGV

SEQ ID NO: 1024453 - protein, 7 aa, Mycobacterium
RTADGYA

SEQ ID NO: 1024454 - protein, 8 aa, Mycobacterium
RTAERDEL

SEQ ID NO: 1024455 - protein, 9 aa, Mycobacterium
RTAETEGGT

SEQ ID NO: 1024456 - protein, 6 aa, Mycobacterium
RTAGGR

SEQ ID NO: 1024457 - protein, 13 aa, Mycobacterium
RTAGPTQVARRDT

SEQ ID NO: 1024458 - protein, 11 aa, Mycobacterium
RTAGQPPTRER

SEQ ID NO: 1024459 - protein, 5 aa, Mycobacterium
RTAGR

SEQ ID NO: 1024460 - protein, 12 aa, Mycobacterium
RTAHGDEDHSGP

SEQ ID NO: 1024461 - protein, 8 aa, Mycobacterium
RTAIPGLP

SEQ ID NO: 1024462 - protein, 13 aa, Mycobacterium
RTANEDGTFRTDE

SEQ ID NO: 1024463 - protein, 6 aa, Mycobacterium
RTAPAV

SEQ ID NO: 1024464 - protein, 19 aa, Mycobacterium
RTAPPQTPHPPEPHPQIPT

SEQ ID NO: 1024465 - protein, 6 aa, Mycobacterium
RTAPPV

SEQ ID NO: 1024466 - protein, 6 aa, Mycobacterium
RTAPTL

SEQ ID NO: 1024467 - protein, 8 aa, Mycobacterium
RTAQPGGL

SEQ ID NO: 1024468 - protein, 7 aa, Mycobacterium
RTARPGF

SEQ ID NO: 1024469 - protein, 4 aa, Mycobacterium
RTAT

SEQ ID NO: 1024470 - protein, 6 aa, Mycobacterium
RTATAL

SEQ ID NO: 1024471 - protein, 18 aa, Mycobacterium
RTATDPSAAGGQYYGPDG

SEQ ID NO: 1024472 - protein, 7 aa, Mycobacterium
RTATNPV

SEQ ID NO: 1024473 - protein, 8 aa, Mycobacterium
RTATSQEG

SEQ ID NO: 1024474 - protein, 8 aa, Mycobacterium
RTATSRVT

SEQ ID NO: 1024475 - protein, 14 aa, Mycobacterium
RTCQGRPDRRSGTR

SEQ ID NO: 1024476 - protein, 7 aa, Mycobacterium
RTDAGTY

SEQ ID NO: 1024477 - protein, 15 aa, Mycobacterium
RTDDEPVGAAPTTEQ

SEQ ID NO: 1024478 - protein, 9 aa, Mycobacterium
RTDEVDATH

SEQ ID NO: 1024479 - protein, 8 aa, Mycobacterium
RTDGTTNG

SEQ ID NO: 1024480 - protein, 4 aa, Mycobacterium
RTDI

SEQ ID NO: 1024481 - protein, 9 aa, Mycobacterium
RTDIPEQIA

SEQ ID NO: 1024482 - protein, 10 aa, Mycobacterium
RTDPDAAKHR

SEQ ID NO: 1024483 - protein, 10 aa, Mycobacterium
RTDPDAPKHR

SEQ ID NO: 1024484 - protein, 10 aa, Mycobacterium
RTDPGAGAGI

SEQ ID NO: 1024485 - protein, 10 aa, Mycobacterium
RTDPNAPKHN

SEQ ID NO: 1024486 - protein, 9 aa, Mycobacterium
RTDPQSNVN

SEQ ID NO: 1024487 - protein, 8 aa, Mycobacterium
RTDPRSHA

SEQ ID NO: 1024488 - protein, 8 aa, Mycobacterium
RTDQPGRL

SEQ ID NO: 1024489 - protein, 9 aa, Mycobacterium
RTDRAAAIE

SEQ ID NO: 1024490 - protein, 6 aa, Mycobacterium
RTDRGD

SEQ ID NO: 1024491 - protein, 8 aa, Mycobacterium
RTDRGDEI

SEQ ID NO: 1024492 - protein, 7 aa, Mycobacterium
RTDRGER

SEQ ID NO: 1024493 - protein, 7 aa, Mycobacterium
RTDSDLA

SEQ ID NO: 1024494 - protein, 6 aa, Mycobacterium
RTDSRE

SEQ ID NO: 1024495 - protein, 5 aa, Mycobacterium
RTDVS

SEQ ID NO: 1024496 - protein, 4 aa, Mycobacterium
RTEA

SEQ ID NO: 1024497 - protein, 6 aa, Mycobacterium
RTEAQV

SEQ ID NO: 1024498 - protein, 7 aa, Mycobacterium
RTEDRVE

SEQ ID NO: 1024499 - protein, 5 aa, Mycobacterium
RTEDV

SEQ ID NO: 1024500 - protein, 6 aa, Mycobacterium
RTEESR

SEQ ID NO: 1024501 - protein, 5 aa, Mycobacterium
RTEFA

SEQ ID NO: 1024502 - protein, 7 aa, Mycobacterium
RTEKPQE

SEQ ID NO: 1024503 - protein, 19 aa, Mycobacterium
RTEMRDQSQFQTGDDPVAN

SEQ ID NO: 1024504 - protein, 7 aa, Mycobacterium
RTENGEE

SEQ ID NO: 1024505 - protein, 4 aa, Mycobacterium
RTEP

SEQ ID NO: 1024506 - protein, 5 aa, Mycobacterium
RTEPE

SEQ ID NO: 1024507 - protein, 9 aa, Mycobacterium
RTEPPALSK

SEQ ID NO: 1024508 - protein, 11 aa, Mycobacterium
RTEPPHPGSRY

SEQ ID NO: 1024509 - protein, 5 aa, Mycobacterium
RTFQG

SEQ ID NO: 1024510 - protein, 18 aa, Mycobacterium
RTGCPGRRAPRCSKSISH

SEQ ID NO: 1024511 - protein, 5 aa, Mycobacterium
RTGDE

SEQ ID NO: 1024512 - protein, 7 aa, Mycobacterium
RTGDEIH

SEQ ID NO: 1024513 - protein, 14 aa, Mycobacterium
RTGDGANADPRAPI

SEQ ID NO: 1024514 - protein, 12 aa, Mycobacterium
RTGDQRDRDQAA

SEQ ID NO: 1024515 - protein, 13 aa, Mycobacterium
RTGDRVRQRPDGT

SEQ ID NO: 1024516 - protein, 8 aa, Mycobacterium
RTGEQPEQ

SEQ ID NO: 1024517 - protein, 10 aa, Mycobacterium
RTGERQYGNQ

SEQ ID NO: 1024518 - protein, 4 aa, Mycobacterium
RTGF

SEQ ID NO: 1024519 - protein, 6 aa, Mycobacterium
RTGFPA

SEQ ID NO: 1024520 - protein, 9 aa, Mycobacterium
RTGGPGAGG

SEQ ID NO: 1024521 - protein, 5 aa, Mycobacterium
RTGHI

SEQ ID NO: 1024522 - protein, 5 aa, Mycobacterium
RTGIE

SEQ ID NO: 1024523 - protein, 5 aa, Mycobacterium
RTGKP

SEQ ID NO: 1024524 - protein, 8 aa, Mycobacterium
RTGKVGGQ

SEQ ID NO: 1024525 - protein, 6 aa, Mycobacterium
RTGNDA

SEQ ID NO: 1024526 - protein, 5 aa, Mycobacterium
RTGPH

SEQ ID NO: 1024527 - protein, 25 aa, Mycobacterium
RTGQDQYQSARRLTEGEQEPTPRPL

SEQ ID NO: 1024528 - protein, 11 aa, Mycobacterium
RTGQEHDPGSR

SEQ ID NO: 1024529 - protein, 8 aa, Mycobacterium
RTGQGAKL

SEQ ID NO: 1024530 - protein, 7 aa, Mycobacterium
RTGQGQE

SEQ ID NO: 1024531 - protein, 8 aa, Mycobacterium
RTGQRYPD

SEQ ID NO: 1024532 - protein, 4 aa, Mycobacterium
RTGR

SEQ ID NO: 1024533 - protein, 9 aa, Mycobacterium
RTGRAGRSG

SEQ ID NO: 1024534 - protein, 9 aa, Mycobacterium
RTGRAGRTG

SEQ ID NO: 1024535 - protein, 8 aa, Mycobacterium
RTGRANPG

SEQ ID NO: 1024536 - protein, 16 aa, Mycobacterium
RTGRKGQGSHKGQDGD

SEQ ID NO: 1024537 - protein, 6 aa, Mycobacterium
RTGRPY

SEQ ID NO: 1024538 - protein, 5 aa, Mycobacterium
RTGRT

SEQ ID NO: 1024539 - protein, 10 aa, Mycobacterium
RTGRTTSPHL

SEQ ID NO: 1024540 - protein, 5 aa, Mycobacterium
RTGRV

SEQ ID NO: 1024541 - protein, 8 aa, Mycobacterium
RTGSDTEP

SEQ ID NO: 1024542 - protein, 4 aa, Mycobacterium
RTGT

SEQ ID NO: 1024543 - protein, 5 aa, Mycobacterium
RTGTD

SEQ ID NO: 1024544 - protein, 15 aa, Mycobacterium
RTGTKVESISDDGSA

SEQ ID NO: 1024545 - protein, 11 aa, Mycobacterium
RTGTRPRLTDE

SEQ ID NO: 1024546 - protein, 12 aa, Mycobacterium
RTGTVANSHTPL

SEQ ID NO: 1024547 - protein, 14 aa, Mycobacterium
RTGVDRGPQAPPDP

SEQ ID NO: 1024548 - protein, 11 aa, Mycobacterium
RTGVSAEPRLG

SEQ ID NO: 1024549 - protein, 12 aa, Mycobacterium
RTGYADVPTPAS

SEQ ID NO: 1024550 - protein, 18 aa, Mycobacterium
RTHEDPGVGPVGERLPSP

SEQ ID NO: 1024551 - protein, 12 aa, Mycobacterium
RTHGSSSSIGAA

SEQ ID NO: 1024552 - protein, 12 aa, Mycobacterium
RTHQAPPVPGAQ

SEQ ID NO: 1024553 - protein, 9 aa, Mycobacterium
RTIDAGTAR

SEQ ID NO: 1024554 - protein, 8 aa, Mycobacterium
RTIKGEQK

SEQ ID NO: 1024555 - protein, 14 aa, Mycobacterium
RTISRGPKATGELR

SEQ ID NO: 1024556 - protein, 11 aa, Mycobacterium
RTKDQAGEMSE

SEQ ID NO: 1024557 - protein, 5 aa, Mycobacterium
RTKLT

SEQ ID NO: 1024558 - protein, 10 aa, Mycobacterium
RTKPRSPEGL

SEQ ID NO: 1024559 - protein, 8 aa, Mycobacterium
RTKSPIQQ

SEQ ID NO: 1024560 - protein, 7 aa, Mycobacterium
RTLDTAG

SEQ ID NO: 1024561 - protein, 18 aa, Mycobacterium
RTLKTREATYYSRSRGEQ

SEQ ID NO: 1024562 - protein, 6 aa, Mycobacterium
RTLPEE

SEQ ID NO: 1024563 - protein, 13 aa, Mycobacterium
RTLPGAEGFPEGT

SEQ ID NO: 1024564 - protein, 12 aa, Mycobacterium
RTLSGNDEGFVY

SEQ ID NO: 1024565 - protein, 15 aa, Mycobacterium
RTNAATAIGADGTLT

SEQ ID NO: 1024566 - protein, 7 aa, Mycobacterium
RTNITGS

SEQ ID NO: 1024567 - protein, 11 aa, Mycobacterium
RTNRRGEPGTV

SEQ ID NO: 1024568 - protein, 7 aa, Mycobacterium
RTNSESI

SEQ ID NO: 1024569 - protein, 15 aa, Mycobacterium
RTNSPELGSLPTTEP

SEQ ID NO: 1024570 - protein, 9 aa, Mycobacterium
RTPAGLAAQ

SEQ ID NO: 1024571 - protein, 4 aa, Mycobacterium
RTPD

SEQ ID NO: 1024572 - protein, 5 aa, Mycobacterium
RTPDA

SEQ ID NO: 1024573 - protein, 8 aa, Mycobacterium
RTPDGTAT

SEQ ID NO: 1024574 - protein, 14 aa, Mycobacterium
RTPDTPAGSLGPLP

SEQ ID NO: 1024575 - protein, 16 aa, Mycobacterium
RTPEATRKLASRARRR

SEQ ID NO: 1024576 - protein, 8 aa, Mycobacterium
RTPEGRID

SEQ ID NO: 1024577 - protein, 10 aa, Mycobacterium
RTPESLAATR

SEQ ID NO: 1024578 - protein, 13 aa, Mycobacterium
RTPFHDPDRRASL

SEQ ID NO: 1024579 - protein, 8 aa, Mycobacterium
RTPGGAQT

SEQ ID NO: 1024580 - protein, 12 aa, Mycobacterium
RTPGKDPARAEL

SEQ ID NO: 1024581 - protein, 6 aa, Mycobacterium
RTPGRG

SEQ ID NO: 1024582 - protein, 10 aa, Mycobacterium
RTPGSDFEPA

SEQ ID NO: 1024583 - protein, 36 aa, Mycobacterium
RTPNTITATTTVTATAADAIRTRRDPGAAHATSTTC

SEQ ID NO: 1024584 - protein, 4 aa, Mycobacterium
RTPP

SEQ ID NO: 1024585 - protein, 7 aa, Mycobacterium
RTPPGGA

SEQ ID NO: 1024586 - protein, 7 aa, Mycobacterium
RTPPRTL

SEQ ID NO: 1024587 - protein, 9 aa, Mycobacterium
RTPPYATAT

SEQ ID NO: 1024588 - protein, 4 aa, Mycobacterium
RTPR

SEQ ID NO: 1024589 - protein, 7 aa, Mycobacterium
RTPRGRV

SEQ ID NO: 1024590 - protein, 5 aa, Mycobacterium
RTPRR

SEQ ID NO: 1024591 - protein, 8 aa, Mycobacterium
RTPRSSNS

SEQ ID NO: 1024592 - protein, 4 aa, Mycobacterium
RTPS

SEQ ID NO: 1024593 - protein, 9 aa, Mycobacterium
RTPSDAPLS

SEQ ID NO: 1024594 - protein, 14 aa, Mycobacterium
RTPSHADDRPVDAV

SEQ ID NO: 1024595 - protein, 6 aa, Mycobacterium
RTPTVT

SEQ ID NO: 1024596 - protein, 4 aa, Mycobacterium
RTQA

SEQ ID NO: 1024597 - protein, 16 aa, Mycobacterium
RTQHGVEPQQPTRRGD

SEQ ID NO: 1024598 - protein, 4 aa, Mycobacterium
RTQR

SEQ ID NO: 1024599 - protein, 9 aa, Mycobacterium
RTQRPPPFP

SEQ ID NO: 1024600 - protein, 6 aa, Mycobacterium
RTQRPT

SEQ ID NO: 1024601 - protein, 8 aa, Mycobacterium
RTQSQLDE

SEQ ID NO: 1024602 - protein, 14 aa, Mycobacterium
RTRAGDAHADGQTV

SEQ ID NO: 1024603 - protein, 4 aa, Mycobacterium
RTRD

SEQ ID NO: 1024604 - protein, 7 aa, Mycobacterium
RTRDDTP

SEQ ID NO: 1024605 - protein, 6 aa, Mycobacterium
RTRDEQ

SEQ ID NO: 1024606 - protein, 5 aa, Mycobacterium
RTRDQ

SEQ ID NO: 1024607 - protein, 8 aa, Mycobacterium
RTRDQARR

SEQ ID NO: 1024608 - protein, 14 aa, Mycobacterium
RTREAAEDGATAGR

SEQ ID NO: 1024609 - protein, 11 aa, Mycobacterium
RTREELEEGQR

SEQ ID NO: 1024610 - protein, 12 aa, Mycobacterium
RTRERRPDLAPP

SEQ ID NO: 1024611 - protein, 6 aa, Mycobacterium
RTREYR

SEQ ID NO: 1024612 - protein, 4 aa, Mycobacterium
RTRG

SEQ ID NO: 1024613 - protein, 9 aa, Mycobacterium
RTRGPNESY

SEQ ID NO: 1024614 - protein, 9 aa, Mycobacterium
RTRGRADTY

SEQ ID NO: 1024615 - protein, 5 aa, Mycobacterium
RTRGY

SEQ ID NO: 1024616 - protein, 10 aa, Mycobacterium
RTRKLASAKA

SEQ ID NO: 1024617 - protein, 5 aa, Mycobacterium
RTRLA

SEQ ID NO: 1024618 - protein, 5 aa, Mycobacterium
RTRPE

SEQ ID NO: 1024619 - protein, 6 aa, Mycobacterium
RTRSED

SEQ ID NO: 1024620 - protein, 17 aa, Mycobacterium
RTRTIDDSYANGYTTSK

SEQ ID NO: 1024621 - protein, 7 aa, Mycobacterium
RTRTRGE

SEQ ID NO: 1024622 - protein, 7 aa, Mycobacterium
RTRVPGP

SEQ ID NO: 1024623 - protein, 9 aa, Mycobacterium
RTSADRGTK

SEQ ID NO: 1024624 - protein, 14 aa, Mycobacterium
RTSAKWAASEDFSQ

SEQ ID NO: 1024625 - protein, 14 aa, Mycobacterium
RTSDAIPDRSEYGA

SEQ ID NO: 1024626 - protein, 8 aa, Mycobacterium
RTSDEDMA

SEQ ID NO: 1024627 - protein, 15 aa, Mycobacterium
RTSDEMRQDLGVPFA

SEQ ID NO: 1024628 - protein, 16 aa, Mycobacterium
RTSESSPVGGSVVAAG

SEQ ID NO: 1024629 - protein, 10 aa, Mycobacterium
RTSGDERTRV

SEQ ID NO: 1024630 - protein, 11 aa, Mycobacterium
RTSGEPGQARG

SEQ ID NO: 1024631 - protein, 9 aa, Mycobacterium
RTSGHGAQD

SEQ ID NO: 1024632 - protein, 8 aa, Mycobacterium
RTSGVPEG

SEQ ID NO: 1024633 - protein, 6 aa, Mycobacterium
RTSKRT

SEQ ID NO: 1024634 - protein, 7 aa, Mycobacterium
RTSPARA

SEQ ID NO: 1024635 - protein, 26 aa, Mycobacterium
RTSRRSAEQAARQAQAQAQAQATDIR

SEQ ID NO: 1024636 - protein, 5 aa, Mycobacterium
RTSSP

SEQ ID NO: 1024637 - protein, 5 aa, Mycobacterium
RTSVR

SEQ ID NO: 1024638 - protein, 5 aa, Mycobacterium
RTTAG

SEQ ID NO: 1024639 - protein, 9 aa, Mycobacterium
RTTDGDGPL

SEQ ID NO: 1024640 - protein, 11 aa, Mycobacterium
RTTGAPPARPR

SEQ ID NO: 1024641 - protein, 6 aa, Mycobacterium
RTTGPW

SEQ ID NO: 1024642 - protein, 6 aa, Mycobacterium
RTTPRS

SEQ ID NO: 1024643 - protein, 4 aa, Mycobacterium
RTTT

SEQ ID NO: 1024644 - protein, 10 aa, Mycobacterium
RTTTGDTRAG

SEQ ID NO: 1024645 - protein, 7 aa, Mycobacterium
RTVAPGH

SEQ ID NO: 1024646 - protein, 9 aa, Mycobacterium
RTVNPPAPL

SEQ ID NO: 1024647 - protein, 37 aa, Mycobacterium; identical to SEQ ID NO: 572124

SEQ ID NO: 1024648 - protein, 18 aa, Mycobacterium
RTVRPAEADCGAQSADAP

SEQ ID NO: 1024649 - protein, 11 aa, Mycobacterium
RTVSEQRPPFR

SEQ ID NO: 1024650 - protein, 17 aa, Mycobacterium
RTYEPPATVSPLTSWRT

SEQ ID NO: 1024651 - protein, 12 aa, Mycobacterium
RTYGTLSEGERK

SEQ ID NO: 1024652 - protein, 6 aa, Mycobacterium
RTYPKT

SEQ ID NO: 1024653 - protein, 6 aa, Mycobacterium
RTYTPQ

SEQ ID NO: 1024654 - protein, 12 aa, Mycobacterium
RVADSGEREELS

SEQ ID NO: 1024655 - protein, 9 aa, Mycobacterium
RVAEDSARR

SEQ ID NO: 1024656 - protein, 9 aa, Mycobacterium
RVAGAADAQ

SEQ ID NO: 1024657 - protein, 29 aa, Mycobacterium
RVAGGNGAGPVTGPAASVPAANMPSGSVE

SEQ ID NO: 1024658 - protein, 7 aa, Mycobacterium
RVAGGPD

SEQ ID NO: 1024659 - protein, 14 aa, Mycobacterium
RVAGGSSTAEPPLN

SEQ ID NO: 1024660 - protein, 9 aa, Mycobacterium
RVAKETGGH

SEQ ID NO: 1024661 - protein, 6 aa, Mycobacterium
RVAPSD

SEQ ID NO: 1024662 - protein, 15 aa, Mycobacterium
RVATGNDHGGGDTLA

SEQ ID NO: 1024663 - protein, 11 aa, Mycobacterium
RVDGTGARYSS

SEQ ID NO: 1024664 - protein, 4 aa, Mycobacterium
RVDP

SEQ ID NO: 1024665 - protein, 6 aa, Mycobacterium
RVDPDA

SEQ ID NO: 1024666 - protein, 13 aa, Mycobacterium
RVEGETAEQGPEV

SEQ ID NO: 1024667 - protein, 8 aa, Mycobacterium
RVEGTTVA

SEQ ID NO: 1024668 - protein, 6 aa, Mycobacterium
RVEPAT

SEQ ID NO: 1024669 - protein, 7 aa, Mycobacterium
RVGADGV

SEQ ID NO: 1024670 - protein, 5 aa, Mycobacterium
RVGAE

SEQ ID NO: 1024671 - protein, 5 aa, Mycobacterium
RVGAQ

SEQ ID NO: 1024672 - protein, 6 aa, Mycobacterium
RVGDDE

SEQ ID NO: 1024673 - protein, 14 aa, Mycobacterium
RVGEDGEEGFSDGT

SEQ ID NO: 1024674 - protein, 6 aa, Mycobacterium
RVGGAA

SEQ ID NO: 1024675 - protein, 6 aa, Mycobacterium
RVGGAT

SEQ ID NO: 1024676 - protein, 18 aa, Mycobacterium
RVGGPPAALRAETDDGIR

SEQ ID NO: 1024677 - protein, 8 aa, Mycobacterium
RVGGQPMD

SEQ ID NO: 1024678 - protein, 11 aa, Mycobacterium
RVGGSAAGDAL

SEQ ID NO: 1024679 - protein, 10 aa, Mycobacterium
RVGPGDGAWR

SEQ ID NO: 1024680 - protein, 7 aa, Mycobacterium
RVGPHGR

SEQ ID NO: 1024681 - protein, 9 aa, Mycobacterium
RVGPSTGTN

SEQ ID NO: 1024682 - protein, 8 aa, Mycobacterium
RVGQAEQI

SEQ ID NO: 1024683 - protein, 19 aa, Mycobacterium
RVGSGQWPVDDNPLRGAPH

SEQ ID NO: 1024684 - protein, 7 aa, Mycobacterium
RVKGNAP

SEQ ID NO: 1024685 - protein, 6 aa, Mycobacterium
RVKRDD

SEQ ID NO: 1024686 - protein, 5 aa, Mycobacterium
RVNPL

SEQ ID NO: 1024687 - protein, 8 aa, Mycobacterium
RVNSGAVT

SEQ ID NO: 1024688 - protein, 8 aa, Mycobacterium
RVPAGEPG

SEQ ID NO: 1024689 - protein, 9 aa, Mycobacterium
RVPARSGRQ

SEQ ID NO: 1024690 - protein, 5 aa, Mycobacterium
RVPEE

SEQ ID NO: 1024691 - protein, 8 aa, Mycobacterium
RVPPGPGQ

SEQ ID NO: 1024692 - protein, 12 aa, Mycobacterium
RVPQPDDTLEPG

SEQ ID NO: 1024693 - protein, 13 aa, Mycobacterium
RVPSDREKEQLRR

SEQ ID NO: 1024694 - protein, 7 aa, Mycobacterium
RVQEAGA

SEQ ID NO: 1024695 - protein, 7 aa, Mycobacterium
RVQGDGT

SEQ ID NO: 1024696 - protein, 9 aa, Mycobacterium
RVQPESSTF

SEQ ID NO: 1024697 - protein, 6 aa, Mycobacterium
RVQRPH

SEQ ID NO: 1024698 - protein, 5 aa, Mycobacterium
RVRGQ

SEQ ID NO: 1024699 - protein, 7 aa, Mycobacterium
RVRPGSD

SEQ ID NO: 1024700 - protein, 5 aa, Mycobacterium
RVSAE

SEQ ID NO: 1024701 - protein, 8 aa, Mycobacterium
RVSAGKDP

SEQ ID NO: 1024702 - protein, 6 aa, Mycobacterium
RVSAGQ

SEQ ID NO: 1024703 - protein, 7 aa, Mycobacterium
RVSAGQT

SEQ ID NO: 1024704 - protein, 12 aa, Mycobacterium
RVSASESDVEYP

SEQ ID NO: 1024705 - protein, 10 aa, Mycobacterium
RVSDAEQSNT

SEQ ID NO: 1024706 - protein, 7 aa, Mycobacterium
RVSENAD

SEQ ID NO: 1024707 - protein, 8 aa, Mycobacterium
RVSEPERK

SEQ ID NO: 1024708 - protein, 8 aa, Mycobacterium
RVSKNDPR

SEQ ID NO: 1024709 - protein, 8 aa, Mycobacterium
RVSPPESL

SEQ ID NO: 1024710 - protein, 5 aa, Mycobacterium
RVSTT

SEQ ID NO: 1024711 - protein, 4 aa, Mycobacterium
RVTA

SEQ ID NO: 1024712 - protein, 11 aa, Mycobacterium
RVTAAGDPGLS

SEQ ID NO: 1024713 - protein, 6 aa, Mycobacterium
RVTGTT

SEQ ID NO: 1024714 - protein, 9 aa, Mycobacterium
RVTPDDADY

SEQ ID NO: 1024715 - protein, 10 aa, Mycobacterium
RWAPPYAEAG

SEQ ID NO: 1024716 - protein, 9 aa, Mycobacterium
RWEGSSGAR

SEQ ID NO: 1024717 - protein, 16 aa, Mycobacterium
RWEPGSKALATRAASG

SEQ ID NO: 1024718 - protein, 8 aa, Mycobacterium
RWGGDNTD

SEQ ID NO: 1024719 - protein, 21 aa, Mycobacterium
RWPNGSAGPPPRTALSRLTRD

SEQ ID NO: 1024720 - protein, 11 aa, Mycobacterium
RWQEGSATEEL

SEQ ID NO: 1024721 - protein, 16 aa, Mycobacterium
RWRDSGMAGTEQRSRR

SEQ ID NO: 1024722 - protein, 8 aa, Mycobacterium
RWSPESGS

SEQ ID NO: 1024723 - protein, 8 aa, Mycobacterium
RYANPDVT

SEQ ID NO: 1024724 - protein, 5 aa, Mycobacterium
RYAQD

SEQ ID NO: 1024725 - protein, 8 aa, Mycobacterium
RYASESSD

SEQ ID NO: 1024726 - protein, 5 aa, Mycobacterium
RYDAP

SEQ ID NO: 1024727 - protein, 7 aa, Mycobacterium
RYDHGAP

SEQ ID NO: 1024728 - protein, 8 aa, Mycobacterium
RYDSGQRC

SEQ ID NO: 1024729 - protein, 22 aa, Mycobacterium
RYEEPGSGMNRAARRASGTRNR

SEQ ID NO: 1024730 - protein, 7 aa, Mycobacterium
RYEGGST

SEQ ID NO: 1024731 - protein, 16 aa, Mycobacterium
RYEHDRDRPDFEGTSR

SEQ ID NO: 1024732 - protein, 5 aa, Mycobacterium
RYGPD

SEQ ID NO: 1024733 - protein, 5 aa, Mycobacterium
RYGPG

SEQ ID NO: 1024734 - protein, 7 aa, Mycobacterium
RYGRTRS

SEQ ID NO: 1024735 - protein, 4 aa, Mycobacterium
RYGS

SEQ ID NO: 1024736 - protein, 6 aa, Mycobacterium
RYGTPE

SEQ ID NO: 1024737 - protein, 13 aa, Mycobacterium
RYHDPDTSDIRRD

SEQ ID NO: 1024738 - protein, 14 aa, Mycobacterium
RYKSPAARASYGET

SEQ ID NO: 1024739 - protein, 18 aa, Mycobacterium
RYLEPSGAGPLGSDTGFP

SEQ ID NO: 1024740 - protein, 14 aa, Mycobacterium
RYMPGGSQTGGPRL

SEQ ID NO: 1024741 - protein, 5 aa, Mycobacterium
RYNRE

SEQ ID NO: 1024742 - protein, 5 aa, Mycobacterium
RYPDG

SEQ ID NO: 1024743 - protein, 11 aa, Mycobacterium
RYPGADRPAVD

SEQ ID NO: 1024744 - protein, 10 aa, Mycobacterium
RYPNDEPEVG

SEQ ID NO: 1024745 - protein, 9 aa, Mycobacterium
RYPPDGVSA

SEQ ID NO: 1024746 - protein, 7 aa, Mycobacterium
RYPQSNG

SEQ ID NO: 1024747 - protein, 12 aa, Mycobacterium
RYQEGEEPAEDA

SEQ ID NO: 1024748 - protein, 5 aa, Mycobacterium
RYQPV

SEQ ID NO: 1024749 - protein, 4 aa, Mycobacterium
RYQR

SEQ ID NO: 1024750 - protein, 8 aa, Mycobacterium
RYRAGDDE

SEQ ID NO: 1024751 - protein, 12 aa, Mycobacterium
RYRAPDTPAEQT

SEQ ID NO: 1024752 - protein, 7 aa, Mycobacterium
RYRDTAS

SEQ ID NO: 1024753 - protein, 13 aa, Mycobacterium
RYRPEPETDDLEA

SEQ ID NO: 1024754 - protein, 7 aa, Mycobacterium
RYRRPNS

SEQ ID NO: 1024755 - protein, 5 aa, Mycobacterium
RYSAR

SEQ ID NO: 1024756 - protein, 10 aa, Mycobacterium
RYSGRGNPAL

SEQ ID NO: 1024757 - protein, 8 aa, Mycobacterium
RYTQPAGA

SEQ ID NO: 1024758 - protein, 9 aa, Mycobacterium
RYTRAKTEH

SEQ ID NO: 1024759 - protein, 4 aa, Mycobacterium
SAAA

SEQ ID NO: 1024760 - protein, 12 aa, Mycobacterium
SAAAAAAGRAAP

SEQ ID NO: 1024761 - protein, 10 aa, Mycobacterium
SAAAAELAAS

SEQ ID NO: 1024762 - protein, 36 aa, Mycobacterium; identical to SEQ ID NO: 572928

SEQ ID NO: 1024763 - protein, 7 aa, Mycobacterium
SAAAAPA

SEQ ID NO: 1024764 - protein, 13 aa, Mycobacterium
SAAAASASAATIP

SEQ ID NO: 1024765 - protein, 12 aa, Mycobacterium
SAAAELDNDPGI

SEQ ID NO: 1024766 - protein, 13 aa, Mycobacterium
SAAAGGGARPPRI

SEQ ID NO: 1024767 - protein, 17 aa, Mycobacterium
SAAAGSAGNGGAGGAAG

SEQ ID NO: 1024768 - protein, 5 aa, Mycobacterium
SAAAL

SEQ ID NO: 1024769 - protein, 8 aa, Mycobacterium
SAAASTLT

SEQ ID NO: 1024770 - protein, 9 aa, Mycobacterium
SAAASVDRV

SEQ ID NO: 1024771 - protein, 9 aa, Mycobacterium
SAAATSTDT

SEQ ID NO: 1024772 - protein, 6 aa, Mycobacterium
SAADAA

SEQ ID NO: 1024773 - protein, 7 aa, Mycobacterium
SAADAAR

SEQ ID NO: 1024774 - protein, 16 aa, Mycobacterium
SAADALAETAASVGGT

SEQ ID NO: 1024775 - protein, 10 aa, Mycobacterium
SAADGGKPAF

SEQ ID NO: 1024776 - protein, 5 aa, Mycobacterium
SAADP

SEQ ID NO: 1024777 - protein, 6 aa, Mycobacterium
SAADQN

SEQ ID NO: 1024778 - protein, 6 aa, Mycobacterium
SAADSD

SEQ ID NO: 1024779 - protein, 8 aa, Mycobacterium
SAADSFAS

SEQ ID NO: 1024780 - protein, 5 aa, Mycobacterium
SAAED

SEQ ID NO: 1024781 - protein, 11 aa, Mycobacterium
SAAEDAAHQQG

SEQ ID NO: 1024782 - protein, 6 aa, Mycobacterium
SAAEGP

SEQ ID NO: 1024783 - protein, 9 aa, Mycobacterium
SAAELPTPW

SEQ ID NO: 1024784 - protein, 7 aa, Mycobacterium
SAAERDE

SEQ ID NO: 1024785 - protein, 9 aa, Mycobacterium
SAAESFGSV

SEQ ID NO: 1024786 - protein, 20 aa, Mycobacterium
SAAFEPEPLPEPVDPPADQW

SEQ ID NO: 1024787 - protein, 8 aa, Mycobacterium
SAAGATEG

SEQ ID NO: 1024788 - protein, 16 aa, Mycobacterium
SAAGAYSGAEAANVSP

SEQ ID NO: 1024789 - protein, 14 aa, Mycobacterium
SAAGDLMASSGDPM

SEQ ID NO: 1024790 - protein, 5 aa, Mycobacterium
SAAGH

SEQ ID NO: 1024791 - protein, 8 aa, Mycobacterium
SAAGISRG

SEQ ID NO: 1024792 - protein, 9 aa, Mycobacterium
SAAGLDQEQ

SEQ ID NO: 1024793 - protein, 9 aa, Mycobacterium
SAAGLSSPR

SEQ ID NO: 1024794 - protein, 11 aa, Mycobacterium
SAAGPEAVPAA

SEQ ID NO: 1024795 - protein, 8 aa, Mycobacterium
SAAGSDDT

SEQ ID NO: 1024796 - protein, 5 aa, Mycobacterium
SAAGT

SEQ ID NO: 1024797 - protein, 20 aa, Mycobacterium
SAAGVGPWPGEHPDDPRYDP

SEQ ID NO: 1024798 - protein, 13 aa, Mycobacterium
SAAKAEATSSASQ

SEQ ID NO: 1024799 - protein, 5 aa, Mycobacterium
SAAKT

SEQ ID NO: 1024800 - protein, 12 aa, Mycobacterium
SAAKWTRSPGRG

SEQ ID NO: 1024801 - protein, 5 aa, Mycobacterium
SAALT

SEQ ID NO: 1024802 - protein, 12 aa, Mycobacterium
SAANAAATVPTT

SEQ ID NO: 1024803 - protein, 8 aa, Mycobacterium
SAANAGID

SEQ ID NO: 1024804 - protein, 13 aa, Mycobacterium
SAAPAAAPEPSRW

SEQ ID NO: 1024805 - protein, 5 aa, Mycobacterium
SAAPE

SEQ ID NO: 1024806 - protein, 9 aa, Mycobacterium
SAAPLDGGS

SEQ ID NO: 1024807 - protein, 6 aa, Mycobacterium
SAAPPD

SEQ ID NO: 1024808 - protein, 4 aa, Mycobacterium
SAAQ

SEQ ID NO: 1024809 - protein, 8 aa, Mycobacterium
SAAQRESS

SEQ ID NO: 1024810 - protein, 8 aa, Mycobacterium
SAARAGDE

SEQ ID NO: 1024811 - protein, 15 aa, Mycobacterium
SAARRGRAQPGRDDK

SEQ ID NO: 1024812 - protein, 9 aa, Mycobacterium
SAARRRETY

SEQ ID NO: 1024813 - protein, 11 aa, Mycobacterium
SAARSPKARAG

SEQ ID NO: 1024814 - protein, 8 aa, Mycobacterium
SAASEVAG

SEQ ID NO: 1024815 - protein, 7 aa, Mycobacterium
SAASGGR

SEQ ID NO: 1024816 - protein, 6 aa, Mycobacterium
SAASPF

SEQ ID NO: 1024817 - protein, 6 aa, Mycobacterium
SAASPY

SEQ ID NO: 1024818 - protein, 9 aa, Mycobacterium
SAASYEHAE

SEQ ID NO: 1024819 - protein, 15 aa, Mycobacterium
SAATAERAKTCTPGY

SEQ ID NO: 1024820 - protein, 7 aa, Mycobacterium
SAATEVD

SEQ ID NO: 1024821 - protein, 8 aa, Mycobacterium
SAATGGAF

SEQ ID NO: 1024822 - protein, 6 aa, Mycobacterium
SAATGR

SEQ ID NO: 1024823 - protein, 6 aa, Mycobacterium
SAATPI

SEQ ID NO: 1024824 - protein, 49 aa, Mycobacterium
SAATPRDVPPPAALDAPLDAPGINGEPAPLAPPPGDDVPPPADPAPPVE

SEQ ID NO: 1024825 - protein, 20 aa, Mycobacterium
SAATSHRDAGGEGQQDHQGL

SEQ ID NO: 1024826 - protein, 7 aa, Mycobacterium
SAATTVP

SEQ ID NO: 1024827 - protein, 8 aa, Mycobacterium
SACTDGGH

SEQ ID NO: 1024828 - protein, 7 aa, Mycobacterium
SADAGAI

SEQ ID NO: 1024829 - protein, 4 aa, Mycobacterium
SADD

SEQ ID NO: 1024830 - protein, 5 aa, Mycobacterium
SADDI

SEQ ID NO: 1024831 - protein, 8 aa, Mycobacterium
SADDPATD

SEQ ID NO: 1024832 - protein, 8 aa, Mycobacterium
SADEKEAA

SEQ ID NO: 1024833 - protein, 8 aa, Mycobacterium
SADELAAT

SEQ ID NO: 1024834 - protein, 7 aa, Mycobacterium
SADEVAD

SEQ ID NO: 1024835 - protein, 4 aa, Mycobacterium
SADG

SEQ ID NO: 1024836 - protein, 22 aa, Mycobacterium
SADGAANTVDLGSPAARAIWVV

SEQ ID NO: 1024837 - protein, 5 aa, Mycobacterium
SADGE

SEQ ID NO: 1024838 - protein, 9 aa, Mycobacterium
SADGEVDEI

SEQ ID NO: 1024839 - protein, 5 aa, Mycobacterium
SADGG

SEQ ID NO: 1024840 - protein, 5 aa, Mycobacterium
SADGP

SEQ ID NO: 1024841 - protein, 15 aa, Mycobacterium
SADGQSRQWLPILLH

SEQ ID NO: 1024842 - protein, 8 aa, Mycobacterium
SADGTAEV

SEQ ID NO: 1024843 - protein, 7 aa, Mycobacterium
SADGTDV

SEQ ID NO: 1024844 - protein, 12 aa, Mycobacterium
SADGTEVARGKD

SEQ ID NO: 1024845 - protein, 7 aa, Mycobacterium
SADGTSV

SEQ ID NO: 1024846 - protein, 9 aa, Mycobacterium
SADGTTRTL

SEQ ID NO: 1024847 - protein, 17 aa, Mycobacterium
SADGYPDDQPSAGIRPG

SEQ ID NO: 1024848 - protein, 15 aa, Mycobacterium
SADIAAANRADEIRE

SEQ ID NO: 1024849 - protein, 8 aa, Mycobacterium
SADIERSE

SEQ ID NO: 1024850 - protein, 6 aa, Mycobacterium
SADIGG

SEQ ID NO: 1024851 - protein, 16 aa, Mycobacterium
SADIQASTHEPVSGLH

SEQ ID NO: 1024852 - protein, 10 aa, Mycobacterium
SADPAEKAFG

SEQ ID NO: 1024853 - protein, 15 aa, Mycobacterium
SADPEGQLGPGARAR

SEQ ID NO: 1024854 - protein, 9 aa, Mycobacterium
SADPGRPTN

SEQ ID NO: 1024855 - protein, 19 aa, Mycobacterium
SADPHAGAPPPLIMGQATS

SEQ ID NO: 1024856 - protein, 8 aa, Mycobacterium
SADPHAKP

SEQ ID NO: 1024857 - protein, 8 aa, Mycobacterium
SADPHDTT

SEQ ID NO: 1024858 - protein, 6 aa, Mycobacterium
SADPMS

SEQ ID NO: 1024859 - protein, 8 aa, Mycobacterium
SADPQISA

SEQ ID NO: 1024860 - protein, 9 aa, Mycobacterium
SADPSGYRD

SEQ ID NO: 1024861 - protein, 7 aa, Mycobacterium
SADQASE

SEQ ID NO: 1024862 - protein, 9 aa, Mycobacterium
SADRAGDHA

SEQ ID NO: 1024863 - protein, 7 aa, Mycobacterium
SADRSTV

SEQ ID NO: 1024864 - protein, 6 aa, Mycobacterium
SADRTY

SEQ ID NO: 1024865 - protein, 7 aa, Mycobacterium
SADSRAI

SEQ ID NO: 1024866 - protein, 10 aa, Mycobacterium
SADSRGRFPG

SEQ ID NO: 1024867 - protein, 9 aa, Mycobacterium
SADSSDTEV

SEQ ID NO: 1024868 - protein, 4 aa, Mycobacterium
SADT

SEQ ID NO: 1024869 - protein, 26 aa, Mycobacterium
SADTSGGPPDAGVAGDEGQVPGPVSA

SEQ ID NO: 1024870 - protein, 6 aa, Mycobacterium
SADVAS

SEQ ID NO: 1024871 - protein, 6 aa, Mycobacterium
SADVPE

SEQ ID NO: 1024872 - protein, 18 aa, Mycobacterium
SADYPDGLRQARAGDAMS

SEQ ID NO: 1024873 - protein, 4 aa, Mycobacterium
SAEA

SEQ ID NO: 1024874 - protein, 14 aa, Mycobacterium
SAEAAAKGKGYSEK

SEQ ID NO: 1024875 - protein, 6 aa, Mycobacterium
SAEAAD

SEQ ID NO: 1024876 - protein, 7 aa, Mycobacterium
SAEARGA

SEQ ID NO: 1024877 - protein, 6 aa, Mycobacterium
SAEDFE

SEQ ID NO: 1024878 - protein, 14 aa, Mycobacterium
SAEELSEQEFGPSG

SEQ ID NO: 1024879 - protein, 6 aa, Mycobacterium
SAEEQV

SEQ ID NO: 1024880 - protein, 7 aa, Mycobacterium
SAEETAK

SEQ ID NO: 1024881 - protein, 8 aa, Mycobacterium
SAEFGGGP

SEQ ID NO: 1024882 - protein, 10 aa, Mycobacterium
SAEGVTRGSR

SEQ ID NO: 1024883 - protein, 7 aa, Mycobacterium
SAEHARG

SEQ ID NO: 1024884 - protein, 21 aa, Mycobacterium
SAEPATTRGHAHRANSSRAPE

SEQ ID NO: 1024885 - protein, 8 aa, Mycobacterium
SAEPEGKG

SEQ ID NO: 1024886 - protein, 8 aa, Mycobacterium
SAEPPPSW

SEQ ID NO: 1024887 - protein, 7 aa, Mycobacterium
SAEPRRR

SEQ ID NO: 1024888 - protein, 9 aa, Mycobacterium
SAEPTANGG

SEQ ID NO: 1024889 - protein, 18 aa, Mycobacterium
SAEQAAAARKGDADDPKV

SEQ ID NO: 1024890 - protein, 11 aa, Mycobacterium
SAEQKRSIGDP

SEQ ID NO: 1024891 - protein, 13 aa, Mycobacterium
SAEQVPGESYEHG

SEQ ID NO: 1024892 - protein, 12 aa, Mycobacterium
SAERDHAMAPGT

SEQ ID NO: 1024893 - protein, 9 aa, Mycobacterium
SAERPGRDD

SEQ ID NO: 1024894 - protein, 8 aa, Mycobacterium
SAERSAQA

SEQ ID NO: 1024895 - protein, 12 aa, Mycobacterium
SAERSPAGCSDE

SEQ ID NO: 1024896 - protein, 8 aa, Mycobacterium
SAESGLSG

SEQ ID NO: 1024897 - protein, 17 aa, Mycobacterium
SAETMQQTEAGVMSMFT

SEQ ID NO: 1024898 - protein, 17 aa, Mycobacterium
SAETMQQTEAGVTSMFT

SEQ ID NO: 1024899 - protein, 14 aa, Mycobacterium
SAETVESAITAGAQ

SEQ ID NO: 1024900 - protein, 11 aa, Mycobacterium
SAFGNRGPWST

SEQ ID NO: 1024901 - protein, 11 aa, Mycobacterium
SAFQNRPSGLR

SEQ ID NO: 1024902 - protein, 4 aa, Mycobacterium
SAGA

SEQ ID NO: 1024903 - protein, 5 aa, Mycobacterium
SAGAA

SEQ ID NO: 1024904 - protein, 9 aa, Mycobacterium
SAGADDVSQ

SEQ ID NO: 1024905 - protein, 5 aa, Mycobacterium
SAGAG

SEQ ID NO: 1024906 - protein, 14 aa, Mycobacterium
SAGAGPDAEPAQQQ

SEQ ID NO: 1024907 - protein, 8 aa, Mycobacterium
SAGAGRSV

SEQ ID NO: 1024908 - protein, 7 aa, Mycobacterium
SAGAGTA

SEQ ID NO: 1024909 - protein, 6 aa, Mycobacterium
SAGAKV

SEQ ID NO: 1024910 - protein, 18 aa, Mycobacterium
SAGASYAAAEAASANPLQ

SEQ ID NO: 1024911 - protein, 9 aa, Mycobacterium
SAGATELKS

SEQ ID NO: 1024912 - protein, 48 aa, Mycobacterium
SAGATGGAGDGGRGGTGGLGGVGTSTNGGAAGGTGGRGGLSGGHQRRA

SEQ ID NO: 1024913 - protein, 8 aa, Mycobacterium
SAGDTGIR

SEQ ID NO: 1024914 - protein, 6 aa, Mycobacterium
SAGEQQ

SEQ ID NO: 1024915 - protein, 32 aa, Mycobacterium
SAGGAGGVGGAGGYNTSGPGGNGGSGGNAGTL

SEQ ID NO: 1024916 - protein, 8 aa, Mycobacterium
SAGGGGRG

SEQ ID NO: 1024917 - protein, 5 aa, Mycobacterium
SAGGH

SEQ ID NO: 1024918 - protein, 20 aa, Mycobacterium
SAGGRAAGIAGAADHEDTAN

SEQ ID NO: 1024919 - protein, 7 aa, Mycobacterium
SAGGTTL

SEQ ID NO: 1024920 - protein, 5 aa, Mycobacterium
SAGGV

SEQ ID NO: 1024921 - protein, 7 aa, Mycobacterium
SAGHAGA

SEQ ID NO: 1024922 - protein, 7 aa, Mycobacterium
SAGKAIN

SEQ ID NO: 1024923 - protein, 5 aa, Mycobacterium
SAGLA

SEQ ID NO: 1024924 - protein, 8 aa, Mycobacterium
SAGNAAPL

SEQ ID NO: 1024925 - protein, 7 aa, Mycobacterium
SAGNHAQ

SEQ ID NO: 1024926 - protein, 7 aa, Mycobacterium
SAGNRPI

SEQ ID NO: 1024927 - protein, 18 aa, Mycobacterium
SAGPAGAYSPCADTRASR

SEQ ID NO: 1024928 - protein, 8 aa, Mycobacterium
SAGPAPVA

SEQ ID NO: 1024929 - protein, 7 aa, Mycobacterium
SAGPDRV

SEQ ID NO: 1024930 - protein, 10 aa, Mycobacterium
SAGPGPGPLH

SEQ ID NO: 1024931 - protein, 10 aa, Mycobacterium
SAGPGPRPLH

SEQ ID NO: 1024932 - protein, 7 aa, Mycobacterium
SAGPGVP

SEQ ID NO: 1024933 - protein, 20 aa, Mycobacterium
SAGPISGETRKSAPCSHASP

SEQ ID NO: 1024934 - protein, 9 aa, Mycobacterium
SAGPLDETG

SEQ ID NO: 1024935 - protein, 14 aa, Mycobacterium
SAGPVDLDSGTVSP

SEQ ID NO: 1024936 - protein, 7 aa, Mycobacterium
SAGQRDA

SEQ ID NO: 1024937 - protein, 12 aa, Mycobacterium
SAGQSGDFRPNA

SEQ ID NO: 1024938 - protein, 6 aa, Mycobacterium
SAGQVT

SEQ ID NO: 1024939 - protein, 6 aa, Mycobacterium
SAGRPP

SEQ ID NO: 1024940 - protein, 8 aa, Mycobacterium
SAGRPSPV

SEQ ID NO: 1024941 - protein, 9 aa, Mycobacterium
SAGRRATQA

SEQ ID NO: 1024942 - protein, 31 aa, Mycobacterium
SAGRRGAETGGAAAGAGAGGPWGAGRAVGGG

SEQ ID NO: 1024943 - protein, 7 aa, Mycobacterium
SAGSDPQ

SEQ ID NO: 1024944 - protein, 6 aa, Mycobacterium
SAGSET

SEQ ID NO: 1024945 - protein, 6 aa, Mycobacterium
SAGSGL

SEQ ID NO: 1024946 - protein, 7 aa, Mycobacterium
SAGSITD

SEQ ID NO: 1024947 - protein, 8 aa, Mycobacterium
SAGSLRPS

SEQ ID NO: 1024948 - protein, 10 aa, Mycobacterium
SAGSPEVDPD

SEQ ID NO: 1024949 - protein, 8 aa, Mycobacterium
SAGSREAM

SEQ ID NO: 1024950 - protein, 7 aa, Mycobacterium
SAGSTVS

SEQ ID NO: 1024951 - protein, 10 aa, Mycobacterium
SAGTDEQKAA

SEQ ID NO: 1024952 - protein, 5 aa, Mycobacterium
SAGTH

SEQ ID NO: 1024953 - protein, 5 aa, Mycobacterium
SAGVE

SEQ ID NO: 1024954 - protein, 5 aa, Mycobacterium
SAGYN

SEQ ID NO: 1024955 - protein, 5 aa, Mycobacterium
SAHAG

SEQ ID NO: 1024956 - protein, 9 aa, Mycobacterium
SAHEADEAG

SEQ ID NO: 1024957 - protein, 10 aa, Mycobacterium
SAHGINAPAQ

SEQ ID NO: 1024958 - protein, 9 aa, Mycobacterium
SAHGTNAAS

SEQ ID NO: 1024959 - protein, 12 aa, Mycobacterium
SAHGTNAASAAL

SEQ ID NO: 1024960 - protein, 12 aa, Mycobacterium
SAHRDERAFRDP

SEQ ID NO: 1024961 - protein, 7 aa, Mycobacterium
SAHSSVD

SEQ ID NO: 1024962 - protein, 17 aa, Mycobacterium
SAIGARAAGDSLDTAPW

SEQ ID NO: 1024963 - protein, 11 aa, Mycobacterium
SAINDADDQLA

SEQ ID NO: 1024964 - protein, 12 aa, Mycobacterium
SAIRAKGNGGAP

SEQ ID NO: 1024965 - protein, 6 aa, Mycobacterium
SAIRGG

SEQ ID NO: 1024966 - protein, 6 aa, Mycobacterium
SAISRD

SEQ ID NO: 1024967 - protein, 5 aa, Mycobacterium
SAISS

SEQ ID NO: 1024968 - protein, 11 aa, Mycobacterium
SAKDTGEREEV

SEQ ID NO: 1024969 - protein, 4 aa, Mycobacterium
SAKG

SEQ ID NO: 1024970 - protein, 6 aa, Mycobacterium
SAKGIP

SEQ ID NO: 1024971 - protein, 9 aa, Mycobacterium
SAKHDEEHS

SEQ ID NO: 1024972 - protein, 8 aa, Mycobacterium
SAKKNEPE

SEQ ID NO: 1024973 - protein, 9 aa, Mycobacterium
SAKKSTQHA

SEQ ID NO: 1024974 - protein, 4 aa, Mycobacterium
SAKQ

SEQ ID NO: 1024975 - protein, 5 aa, Mycobacterium
SAKQI

SEQ ID NO: 1024976 - protein, 22 aa, Mycobacterium
SALAAPPAATTSASQDQLPDDR

SEQ ID NO: 1024977 - protein, 17 aa, Mycobacterium
SALDEPIDSNAEYRDRQ

SEQ ID NO: 1024978 - protein, 8 aa, Mycobacterium
SALDPETV

SEQ ID NO: 1024979 - protein, 7 aa, Mycobacterium
SALDPQG

SEQ ID NO: 1024980 - protein, 346 aa, Mycobacterium
SALDSGAGAQGGGVPSTTGVPGVDGGKGGTGGTAGAAGVGVDGGAAGSIGTGGVGGTGGNGGAGADNDVNGTSGIAPTAGGQSGQGGQGGQGGDGGGSGGAGSNGGNNTGSTGGVGADGGKGGTGGTAGAAGVGVDGGAAGSIGTGGVGGTGGEGGSGGTGVAGASGITPAVGGPGGQGGAGGTGGDGGAGIGGVGGGAGGQGGQGGAGGNGGIGGAYTGTGPGSSAAGGLGGTGGAGGDGGTPGAGSTTGGMGGNGGSGGTNSSGTSTSPGFGGGGGGGGAGGHGGGSGASGGQGGTGGDGGFGGTAVSPTTGSIGGGGTGGGGGGGGAAGGPGGTAGNGGVGGN

SEQ ID NO: 1024981 - protein, 14 aa, Mycobacterium
SALGEATAAAAAPT

SEQ ID NO: 1024982 - protein, 5 aa, Mycobacterium
SALNG

SEQ ID NO: 1024983 - protein, 6 aa, Mycobacterium
SALNGA

SEQ ID NO: 1024984 - protein, 6 aa, Mycobacterium
SALPAD

SEQ ID NO: 1024985 - protein, 7 aa, Mycobacterium
SALPKSN

SEQ ID NO: 1024986 - protein, 14 aa, Mycobacterium
SALPQPDRGFSPDG

SEQ ID NO: 1024987 - protein, 7 aa, Mycobacterium
SALRTPE

SEQ ID NO: 1024988 - protein, 4 aa, Mycobacterium
SALS

SEQ ID NO: 1024989 - protein, 16 aa, Mycobacterium
SALSDASLAAADPTTN

SEQ ID NO: 1024990 - protein, 9 aa, Mycobacterium
SALSGSAGL

SEQ ID NO: 1024991 - protein, 14 aa, Mycobacterium
SALSGSLSAGLPDL

SEQ ID NO: 1024992 - protein, 34 aa, Mycobacterium
SALSPSRNPLSGSPASAADPGIQPPYEPPDGQSA

SEQ ID NO: 1024993 - protein, 8 aa, Mycobacterium
SALSSNAL

SEQ ID NO: 1024994 - protein, 8 aa, Mycobacterium
SALSSPAE

SEQ ID NO: 1024995 - protein, 6 aa, Mycobacterium
SALSTA

SEQ ID NO: 1024996 - protein, 7 aa, Mycobacterium
SALTEGS

SEQ ID NO: 1024997 - protein, 11 aa, Mycobacterium
SALTGSAPISD

SEQ ID NO: 1024998 - protein, 7 aa, Mycobacterium
SANFAAG

SEQ ID NO: 1024999 - protein, 6 aa, Mycobacterium
SANGDT

SEQ ID NO: 1025000 - protein, 256 aa, Mycobacterium
SANGGDGGNGGDGGTGGTGGVGGLGGQAQAAGFADGTQGVGGAAGVGGTGGNAGNGGHGANADVGSGKAGGNGGDPGVGGIGGQGGAGSIAGVEGAAGVAPTSGGNGGDGASGATGVNGGDGGEGGSGAIGVKGGAGGAGGDGGLYGNGGNGGDGGTGGKGTVGDSGATLSADGDRGGAGATGGVGGAGGDGGAKGGNGGLGGSGGTGGMGGTGGDGAHGADMASGSGANGGYGGYGGFGGVGGAGGTGGVGGQAH

SEQ ID NO: 1025001 - protein, 20 aa, Mycobacterium
SANGNGAAASTHPDHDEDER

SEQ ID NO: 1025002 - protein, 7 aa, Mycobacterium
SANPADV

SEQ ID NO: 1025003 - protein, 7 aa, Mycobacterium
SANPDKF

SEQ ID NO: 1025004 - protein, 15 aa, Mycobacterium
SANRDPEAYPPDPDE

SEQ ID NO: 1025005 - protein, 12 aa, Mycobacterium
SANTAAAASTTD

SEQ ID NO: 1025006 - protein, 6 aa, Mycobacterium
SANVRS

SEQ ID NO: 1025007 - protein, 15 aa, Mycobacterium
SAPAAGGQAAQAAQL

SEQ ID NO: 1025008 - protein, 9 aa, Mycobacterium
SAPAAPLPN

SEQ ID NO: 1025009 - protein, 5 aa, Mycobacterium
SAPAL

SEQ ID NO: 1025010 - protein, 7 aa, Mycobacterium
SAPAMTG

SEQ ID NO: 1025011 - protein, 6 aa, Mycobacterium
SAPAQS

SEQ ID NO: 1025012 - protein, 8 aa, Mycobacterium
SAPARSGF

SEQ ID NO: 1025013 - protein, 13 aa, Mycobacterium
SAPASLQTPPPRP

SEQ ID NO: 1025014 - protein, 15 aa, Mycobacterium
SAPDIAGQGIADPTA

SEQ ID NO: 1025015 - protein, 9 aa, Mycobacterium
SAPDIGPAP

SEQ ID NO: 1025016 - protein, 5 aa, Mycobacterium
SAPDR

SEQ ID NO: 1025017 - protein, 9 aa, Mycobacterium
SAPDSDPHI

SEQ ID NO: 1025018 - protein, 8 aa, Mycobacterium
SAPEARQA

SEQ ID NO: 1025019 - protein, 9 aa, Mycobacterium
SAPEPVATG

SEQ ID NO: 1025020 - protein, 5 aa, Mycobacterium
SAPFT

SEQ ID NO: 1025021 - protein, 8 aa, Mycobacterium
SAPGFSDE

SEQ ID NO: 1025022 - protein, 9 aa, Mycobacterium
SAPGPTTVV

SEQ ID NO: 1025023 - protein, 8 aa, Mycobacterium
SAPGRSSW

SEQ ID NO: 1025024 - protein, 7 aa, Mycobacterium
SAPIDPT

SEQ ID NO: 1025025 - protein, 7 aa, Mycobacterium
SAPKDWS

SEQ ID NO: 1025026 - protein, 6 aa, Mycobacterium
SAPLAE

SEQ ID NO: 1025027 - protein, 6 aa, Mycobacterium
SAPLDE

SEQ ID NO: 1025028 - protein, 6 aa, Mycobacterium
SAPLGQ

SEQ ID NO: 1025029 - protein, 20 aa, Mycobacterium
SAPLGSVGGQAGLAAAGNAA

SEQ ID NO: 1025030 - protein, 9 aa, Mycobacterium
SAPNATALA

SEQ ID NO: 1025031 - protein, 15 aa, Mycobacterium
SAPNIPDGAGDPVQT

SEQ ID NO: 1025032 - protein, 9 aa, Mycobacterium
SAPNPGEVQ

SEQ ID NO: 1025033 - protein, 9 aa, Mycobacterium
SAPNVDKPA

SEQ ID NO: 1025034 - protein, 7 aa, Mycobacterium
SAPPGSA

SEQ ID NO: 1025035 - protein, 13 aa, Mycobacterium
SAPPPAGKADEHG

SEQ ID NO: 1025036 - protein, 9 aa, Mycobacterium
SAPQVQDQR

SEQ ID NO: 1025037 - protein, 6 aa, Mycobacterium
SAPRSR

SEQ ID NO: 1025038 - protein, 7 aa, Mycobacterium
SAPSAVL

SEQ ID NO: 1025039 - protein, 6 aa, Mycobacterium
SAPSSL

SEQ ID NO: 1025040 - protein, 6 aa, Mycobacterium
SAPSWE

SEQ ID NO: 1025041 - protein, 6 aa, Mycobacterium
SAPTDG

SEQ ID NO: 1025042 - protein, 8 aa, Mycobacterium
SAPVRDGR

SEQ ID NO: 1025043 - protein, 6 aa, Mycobacterium
SAPYAS

SEQ ID NO: 1025044 - protein, 11 aa, Mycobacterium
SAQAEKFDPAG

SEQ ID NO: 1025045 - protein, 11 aa, Mycobacterium
SAQAGPGSVGG

SEQ ID NO: 1025046 - protein, 20 aa, Mycobacterium
SAQAPASSTAESPAPEPPAA

SEQ ID NO: 1025047 - protein, 5 aa, Mycobacterium
SAQDL

SEQ ID NO: 1025048 - protein, 6 aa, Mycobacterium
SAQDVR

SEQ ID NO: 1025049 - protein, 4 aa, Mycobacterium
SAQF

SEQ ID NO: 1025050 - protein, 10 aa, Mycobacterium
SAQGERAGAV

SEQ ID NO: 1025051 - protein, 6 aa, Mycobacterium
SAQGGK

SEQ ID NO: 1025052 - protein, 6 aa, Mycobacterium
SAQGNV

SEQ ID NO: 1025053 - protein, 13 aa, Mycobacterium
SAQPESSTQDSLN

SEQ ID NO: 1025054 - protein, 8 aa, Mycobacterium
SAQPGPDG

SEQ ID NO: 1025055 - protein, 8 aa, Mycobacterium
SAQQRNAP

SEQ ID NO: 1025056 - protein, 4 aa, Mycobacterium
SAQR

SEQ ID NO: 1025057 - protein, 12 aa, Mycobacterium
SAQRSDPGLRES

SEQ ID NO: 1025058 - protein, 13 aa, Mycobacterium
SAQRTGPRNNQAL

SEQ ID NO: 1025059 - protein, 10 aa, Mycobacterium
SAQSAGPAPS

SEQ ID NO: 1025060 - protein, 8 aa, Mycobacterium
SAQSKQEL

SEQ ID NO: 1025061 - protein, 9 aa, Mycobacterium
SAQTQVEQQ

SEQ ID NO: 1025062 - protein, 7 aa, Mycobacterium
SARAEES

SEQ ID NO: 1025063 - protein, 12 aa, Mycobacterium
SARDQAEAAKWG

SEQ ID NO: 1025064 - protein, 6 aa, Mycobacterium
SARELN

SEQ ID NO: 1025065 - protein, 9 aa, Mycobacterium
SARGAQIEA

SEQ ID NO: 1025066 - protein, 6 aa, Mycobacterium
SARGDQ

SEQ ID NO: 1025067 - protein, 13 aa, Mycobacterium
SARGGRLRVGSRP

SEQ ID NO: 1025068 - protein, 7 aa, Mycobacterium
SARGLDP

SEQ ID NO: 1025069 - protein, 24 aa, Mycobacterium
SARLGRPDRRSRRLPGGCRPIRIA

SEQ ID NO: 1025070 - protein, 6 aa, Mycobacterium
SARNGA

SEQ ID NO: 1025071 - protein, 5 aa, Mycobacterium
SARNV

SEQ ID NO: 1025072 - protein, 8 aa, Mycobacterium
SARPASPL

SEQ ID NO: 1025073 - protein, 8 aa, Mycobacterium
SARPDGER

SEQ ID NO: 1025074 - protein, 6 aa, Mycobacterium
SARPEV

SEQ ID NO: 1025075 - protein, 7 aa, Mycobacterium
SARPPAR

SEQ ID NO: 1025076 - protein, 7 aa, Mycobacterium
SARPPRY

SEQ ID NO: 1025077 - protein, 7 aa, Mycobacterium
SARPSDS

SEQ ID NO: 1025078 - protein, 13 aa, Mycobacterium
SARPSSRCSPKRG

SEQ ID NO: 1025079 - protein, 13 aa, Mycobacterium
SARQAGHSSSEIT

SEQ ID NO: 1025080 - protein, 12 aa, Mycobacterium
SARQERGDAARN

SEQ ID NO: 1025081 - protein, 8 aa, Mycobacterium
SARQFATR

SEQ ID NO: 1025082 - protein, 6 aa, Mycobacterium
SARRAE

SEQ ID NO: 1025083 - protein, 6 aa, Mycobacterium
SARRDP

SEQ ID NO: 1025084 - protein, 9 aa, Mycobacterium
SARREEEES

SEQ ID NO: 1025085 - protein, 4 aa, Mycobacterium
SART

SEQ ID NO: 1025086 - protein, 12 aa, Mycobacterium
SARTAANPTPRI

SEQ ID NO: 1025087 - protein, 9 aa, Mycobacterium
SARTPGIGG

SEQ ID NO: 1025088 - protein, 10 aa, Mycobacterium
SASAAGTAQQ

SEQ ID NO: 1025089 - protein, 20 aa, Mycobacterium
SASAATSSVRESQRQQSLTT

SEQ ID NO: 1025090 - protein, 8 aa, Mycobacterium
SASAGSTL

SEQ ID NO: 1025091 - protein, 8 aa, Mycobacterium
SASANGGY

SEQ ID NO: 1025092 - protein, 4 aa, Mycobacterium
SASD

SEQ ID NO: 1025093 - protein, 8 aa, Mycobacterium
SASDAESA

SEQ ID NO: 1025094 - protein, 7 aa, Mycobacterium
SASDGRV

SEQ ID NO: 1025095 - protein, 9 aa, Mycobacterium
SASDKYRGT

SEQ ID NO: 1025096 - protein, 8 aa, Mycobacterium
SASDLQSV

SEQ ID NO: 1025097 - protein, 15 aa, Mycobacterium
SASDRRKDAPGEGTP

SEQ ID NO: 1025098 - protein, 8 aa, Mycobacterium
SASEAISG

SEQ ID NO: 1025099 - protein, 15 aa, Mycobacterium
SASGAYASAEAQSAS

SEQ ID NO: 1025100 - protein, 8 aa, Mycobacterium
SASGLGTG

SEQ ID NO: 1025101 - protein, 18 aa, Mycobacterium
SASGNTGFGNAGSTNTGF

SEQ ID NO: 1025102 - protein, 7 aa, Mycobacterium
SASGPDR

SEQ ID NO: 1025103 - protein, 7 aa, Mycobacterium
SASGRTY

SEQ ID NO: 1025104 - protein, 15 aa, Mycobacterium
SASGSSVSKGESLRD

SEQ ID NO: 1025105 - protein, 7 aa, Mycobacterium
SASGTLG

SEQ ID NO: 1025106 - protein, 8 aa, Mycobacterium
SASGTLGT

SEQ ID NO: 1025107 - protein, 5 aa, Mycobacterium
SASGW

SEQ ID NO: 1025108 - protein, 7 aa, Mycobacterium
SASGYAR

SEQ ID NO: 1025109 - protein, 5 aa, Mycobacterium
SASLR

SEQ ID NO: 1025110 - protein, 10 aa, Mycobacterium
SASLSGDLSA

SEQ ID NO: 1025111 - protein, 4 aa, Mycobacterium
SASN

SEQ ID NO: 1025112 - protein, 10 aa, Mycobacterium
SASNAWDDAG

SEQ ID NO: 1025113 - protein, 7 aa, Mycobacterium
SASNENP

SEQ ID NO: 1025114 - protein, 30 aa, Mycobacterium; identical to SEQ ID NO: 916213

SEQ ID NO: 1025115 - protein, 8 aa, Mycobacterium
SASNPWGE

SEQ ID NO: 1025116 - protein, 5 aa, Mycobacterium
SASPG

SEQ ID NO: 1025117 - protein, 13 aa, Mycobacterium
SASPQHTPEPFDA

SEQ ID NO: 1025118 - protein, 11 aa, Mycobacterium
SASRQAGRQPA

SEQ ID NO: 1025119 - protein, 6 aa, Mycobacterium
SASRRN

SEQ ID NO: 1025120 - protein, 14 aa, Mycobacterium
SASSAINAAPDREA

SEQ ID NO: 1025121 - protein, 19 aa, Mycobacterium
SASSASYAGAEASNAAQAS

SEQ ID NO: 1025122 - protein, 5 aa, Mycobacterium
SASSL

SEQ ID NO: 1025123 - protein, 9 aa, Mycobacterium
SASTSRGKA

SEQ ID NO: 1025124 - protein, 7 aa, Mycobacterium
SASVASP

SEQ ID NO: 1025125 - protein, 13 aa, Mycobacterium
SASVSNSVSGTMG

SEQ ID NO: 1025126 - protein, 5 aa, Mycobacterium
SASYP

SEQ ID NO: 1025127 - protein, 5 aa, Mycobacterium
SATAA

SEQ ID NO: 1025128 - protein, 8 aa, Mycobacterium
SATAEGDL

SEQ ID NO: 1025129 - protein, 5 aa, Mycobacterium
SATAR

SEQ ID NO: 1025130 - protein, 7 aa, Mycobacterium
SATARGL

SEQ ID NO: 1025131 - protein, 24 aa, Mycobacterium
SATDGKLSGVAGSEDAEEVDPTVA

SEQ ID NO: 1025132 - protein, 5 aa, Mycobacterium
SATDR

SEQ ID NO: 1025133 - protein, 5 aa, Mycobacterium
SATDT

SEQ ID NO: 1025134 - protein, 5 aa, Mycobacterium
SATEA

SEQ ID NO: 1025135 - protein, 7 aa, Mycobacterium
SATEGVA

SEQ ID NO: 1025136 - protein, 8 aa, Mycobacterium
SATESDDV

SEQ ID NO: 1025137 - protein, 13 aa, Mycobacterium
SATFDRPALGPSA

SEQ ID NO: 1025138 - protein, 4 aa, Mycobacterium
SATG

SEQ ID NO: 1025139 - protein, 21 aa, Mycobacterium
SATGAQGCNAGSTASQHPGAL

SEQ ID NO: 1025140 - protein, 8 aa, Mycobacterium
SATGQPAH

SEQ ID NO: 1025141 - protein, 7 aa, Mycobacterium
SATGRWD

SEQ ID NO: 1025142 - protein, 7 aa, Mycobacterium
SATHHRL

SEQ ID NO: 1025143 - protein, 9 aa, Mycobacterium
SATINSGGE

SEQ ID NO: 1025144 - protein, 17 aa, Mycobacterium
SATIPHSGGRVAGSSNE

SEQ ID NO: 1025145 - protein, 5 aa, Mycobacterium
SATIR

SEQ ID NO: 1025146 - protein, 8 aa, Mycobacterium
SATKDGNT

SEQ ID NO: 1025147 - protein, 16 aa, Mycobacterium
SATNDHRLGANEAPPA

SEQ ID NO: 1025148 - protein, 8 aa, Mycobacterium
SATPDSAV

SEQ ID NO: 1025149 - protein, 13 aa, Mycobacterium
SATPESSTKNRIR

SEQ ID NO: 1025150 - protein, 11 aa, Mycobacterium
SATPGLSARPA

SEQ ID NO: 1025151 - protein, 6 aa, Mycobacterium
SATPIS

SEQ ID NO: 1025152 - protein, 7 aa, Mycobacterium
SATPIYD

SEQ ID NO: 1025153 - protein, 5 aa, Mycobacterium
SATQY

SEQ ID NO: 1025154 - protein, 4 aa, Mycobacterium
SATR

SEQ ID NO: 1025155 - protein, 9 aa, Mycobacterium
SATRDAANR

SEQ ID NO: 1025156 - protein, 17 aa, Mycobacterium
SATRPIARRRDSSTRVP

SEQ ID NO: 1025157 - protein, 20 aa, Mycobacterium
SATSATPSPECGTSAPMPPD

SEQ ID NO: 1025158 - protein, 8 aa, Mycobacterium
SATSMRSG

SEQ ID NO: 1025159 - protein, 11 aa, Mycobacterium
SATSPATGING

SEQ ID NO: 1025160 - protein, 9 aa, Mycobacterium
SATTDEEGR

SEQ ID NO: 1025161 - protein, 5 aa, Mycobacterium
SATTH

SEQ ID NO: 1025162 - protein, 4 aa, Mycobacterium
SATV

SEQ ID NO: 1025163 - protein, 8 aa, Mycobacterium
SATVGGAA

SEQ ID NO: 1025164 - protein, 18 aa, Mycobacterium
SATVGSSLPGLVGALGLS

SEQ ID NO: 1025165 - protein, 7 aa, Mycobacterium
SATVTAR

SEQ ID NO: 1025166 - protein, 10 aa, Mycobacterium
SATVTTTGPA

SEQ ID NO: 1025167 - protein, 6 aa, Mycobacterium
SAVAKG

SEQ ID NO: 1025168 - protein, 5 aa, Mycobacterium
SAVAP

SEQ ID NO: 1025169 - protein, 7 aa, Mycobacterium
SAVDTGG

SEQ ID NO: 1025170 - protein, 9 aa, Mycobacterium
SAVEPTKGD

SEQ ID NO: 1025171 - protein, 6 aa, Mycobacterium
SAVNGL

SEQ ID NO: 1025172 - protein, 21 aa, Mycobacterium
SAVNQDGASHGLTAPNGPAQQ

SEQ ID NO: 1025173 - protein, 22 aa, Mycobacterium
SAVNQDGASSGVTVPNGPAQQE

SEQ ID NO: 1025174 - protein, 10 aa, Mycobacterium
SAVPGNRAPD

SEQ ID NO: 1025175 - protein, 16 aa, Mycobacterium
SAVPTAEKADRGNPGH

SEQ ID NO: 1025176 - protein, 12 aa, Mycobacterium
SAVRSSSDGQVS

SEQ ID NO: 1025177 - protein, 26 aa, Mycobacterium
SAVSAQSAAAVAPTTSVAPAAADQVS

SEQ ID NO: 1025178 - protein, 14 aa, Mycobacterium
SAVSTASRAAAAPT

SEQ ID NO: 1025179 - protein, 11 aa, Mycobacterium
SAVTEGSADPA

SEQ ID NO: 1025180 - protein, 13 aa, Mycobacterium
SAVTNRKQLSDTI

SEQ ID NO: 1025181 - protein, 9 aa, Mycobacterium
SAWQGDTGV

SEQ ID NO: 1025182 - protein, 8 aa, Mycobacterium
SAWRKDPD

SEQ ID NO: 1025183 - protein, 12 aa, Mycobacterium
SAWSEDDTPELR

SEQ ID NO: 1025184 - protein, 14 aa, Mycobacterium
SAYADAAEARGTWD

SEQ ID NO: 1025185 - protein, 7 aa, Mycobacterium
SAYAGAK

SEQ ID NO: 1025186 - protein, 7 aa, Mycobacterium
SCADSSS

SEQ ID NO: 1025187 - protein, 6 aa, Mycobacterium
SCDETG

SEQ ID NO: 1025188 - protein, 12 aa, Mycobacterium
SCDRGKEMSNSG

SEQ ID NO: 1025189 - protein, 5 aa, Mycobacterium
SCGST

SEQ ID NO: 1025190 - protein, 6 aa, Mycobacterium
SCGSVG

SEQ ID NO: 1025191 - protein, 11 aa, Mycobacterium
SCGTNSNATRI

SEQ ID NO: 1025192 - protein, 6 aa, Mycobacterium
SCPGGP

SEQ ID NO: 1025193 - protein, 7 aa, Mycobacterium
SCPPENK

SEQ ID NO: 1025194 - protein, 6 aa, Mycobacterium
SCPPGP

SEQ ID NO: 1025195 - protein, 6 aa, Mycobacterium
SCPPRD

SEQ ID NO: 1025196 - protein, 14 aa, Mycobacterium
SCPQRSPRAARSAR

SEQ ID NO: 1025197 - protein, 18 aa, Mycobacterium
SCRTPKSGTSSAAIPSAP

SEQ ID NO: 1025198 - protein, 6 aa, Mycobacterium
SCSPSE

SEQ ID NO: 1025199 - protein, 18 aa, Mycobacterium
SCSTDCTCQQKSASVTHF

SEQ ID NO: 1025200 - protein, 8 aa, Mycobacterium
SCTDKQAR

SEQ ID NO: 1025201 - protein, 19 aa, Mycobacterium
SCTPDQVAAATTRALAKGR

SEQ ID NO: 1025202 - protein, 5 aa, Mycobacterium
SDAAE

SEQ ID NO: 1025203 - protein, 6 aa, Mycobacterium
SDAATE

SEQ ID NO: 1025204 - protein, 8 aa, Mycobacterium
SDAATPID

SEQ ID NO: 1025205 - protein, 7 aa, Mycobacterium
SDADARA

SEQ ID NO: 1025206 - protein, 6 aa, Mycobacterium
SDADGL

SEQ ID NO: 1025207 - protein, 5 aa, Mycobacterium
SDADP

SEQ ID NO: 1025208 - protein, 19 aa, Mycobacterium
SDADQDGPPLRSTPSQRSG

SEQ ID NO: 1025209 - protein, 9 aa, Mycobacterium
SDADRARLT

SEQ ID NO: 1025210 - protein, 10 aa, Mycobacterium
SDAEGAEGAP

SEQ ID NO: 1025211 - protein, 6 aa, Mycobacterium
SDAEVN

SEQ ID NO: 1025212 - protein, 7 aa, Mycobacterium
SDAFTGA

SEQ ID NO: 1025213 - protein, 4 aa, Mycobacterium
SDAG

SEQ ID NO: 1025214 - protein, 8 aa, Mycobacterium
SDAGCTNR

SEQ ID NO: 1025215 - protein, 12 aa, Mycobacterium
SDAGDRDANEAD

SEQ ID NO: 1025216 - protein, 7 aa, Mycobacterium
SDAGGDS

SEQ ID NO: 1025217 - protein, 12 aa, Mycobacterium
SDAGSHAPPWPG

SEQ ID NO: 1025218 - protein, 6 aa, Mycobacterium
SDAGTE

SEQ ID NO: 1025219 - protein, 12 aa, Mycobacterium
SDAKAGKDAAEL

SEQ ID NO: 1025220 - protein, 6 aa, Mycobacterium
SDALSP

SEQ ID NO: 1025221 - protein, 7 aa, Mycobacterium
SDAPRSI

SEQ ID NO: 1025222 - protein, 8 aa, Mycobacterium
SDAQRDGN

SEQ ID NO: 1025223 - protein, 6 aa, Mycobacterium
SDAQVR

SEQ ID NO: 1025224 - protein, 9 aa, Mycobacterium
SDARANADQ

SEQ ID NO: 1025225 - protein, 4 aa, Mycobacterium
SDAS

SEQ ID NO: 1025226 - protein, 6 aa, Mycobacterium
SDASAN

SEQ ID NO: 1025227 - protein, 6 aa, Mycobacterium
SDASGR

SEQ ID NO: 1025228 - protein, 18 aa, Mycobacterium
SDASRYPAEFSGGQKQRI

SEQ ID NO: 1025229 - protein, 7 aa, Mycobacterium
SDASYAD

SEQ ID NO: 1025230 - protein, 7 aa, Mycobacterium
SDATYEQ

SEQ ID NO: 1025231 - protein, 4 aa, Mycobacterium
SDAY

SEQ ID NO: 1025232 - protein, 6 aa, Mycobacterium
SDDADA

SEQ ID NO: 1025233 - protein, 9 aa, Mycobacterium
SDDARSRVR

SEQ ID NO: 1025234 - protein, 10 aa, Mycobacterium
SDDDDRARLD

SEQ ID NO: 1025235 - protein, 5 aa, Mycobacterium
SDDDH

SEQ ID NO: 1025236 - protein, 6 aa, Mycobacterium
SDDDRQ

SEQ ID NO: 1025237 - protein, 4 aa, Mycobacterium
SDDE

SEQ ID NO: 1025238 - protein, 6 aa, Mycobacterium
SDDEPV

SEQ ID NO: 1025239 - protein, 7 aa, Mycobacterium
SDDERPQ

SEQ ID NO: 1025240 - protein, 9 aa, Mycobacterium
SDDNPHQVP

SEQ ID NO: 1025241 - protein, 4 aa, Mycobacterium
SDDP

SEQ ID NO: 1025242 - protein, 9 aa, Mycobacterium
SDDPRDTEV

SEQ ID NO: 1025243 - protein, 9 aa, Mycobacterium
SDDPTDESF

SEQ ID NO: 1025244 - protein, 12 aa, Mycobacterium
SDDSSAHDQHSK

SEQ ID NO: 1025245 - protein, 6 aa, Mycobacterium
SDDTII

SEQ ID NO: 1025246 - protein, 6 aa, Mycobacterium
SDDTVG

SEQ ID NO: 1025247 - protein, 14 aa, Mycobacterium
SDDVGGTWRDNSYP

SEQ ID NO: 1025248 - protein, 9 aa, Mycobacterium
SDEADPAAA

SEQ ID NO: 1025249 - protein, 8 aa, Mycobacterium
SDEAQGRR

SEQ ID NO: 1025250 - protein, 10 aa, Mycobacterium
SDEESARAMA

SEQ ID NO: 1025251 - protein, 5 aa, Mycobacterium
SDEFT

SEQ ID NO: 1025252 - protein, 7 aa, Mycobacterium
SDEGGHP

SEQ ID NO: 1025253 - protein, 8 aa, Mycobacterium
SDEIQRAR

SEQ ID NO: 1025254 - protein, 5 aa, Mycobacterium
SDELK

SEQ ID NO: 1025255 - protein, 4 aa, Mycobacterium
SDEP

SEQ ID NO: 1025256 - protein, 5 aa, Mycobacterium
SDEPL

SEQ ID NO: 1025257 - protein, 7 aa, Mycobacterium
SDEPNRD

SEQ ID NO: 1025258 - protein, 7 aa, Mycobacterium
SDEPPVS

SEQ ID NO: 1025259 - protein, 8 aa, Mycobacterium
SDESASGF

SEQ ID NO: 1025260 - protein, 7 aa, Mycobacterium
SDESSIA

SEQ ID NO: 1025261 - protein, 6 aa, Mycobacterium
SDETAM

SEQ ID NO: 1025262 - protein, 5 aa, Mycobacterium
SDETT

SEQ ID NO: 1025263 - protein, 6 aa, Mycobacterium
SDFAGR

SEQ ID NO: 1025264 - protein, 6 aa, Mycobacterium
SDFESA

SEQ ID NO: 1025265 - protein, 6 aa, Mycobacterium
SDFGPA

SEQ ID NO: 1025266 - protein, 17 aa, Mycobacterium
SDFPSFDGDYDAAATEP

SEQ ID NO: 1025267 - protein, 6 aa, Mycobacterium
SDFSAA

SEQ ID NO: 1025268 - protein, 5 aa, Mycobacterium
SDGAA

SEQ ID NO: 1025269 - protein, 8 aa, Mycobacterium
SDGAPAPV

SEQ ID NO: 1025270 - protein, 5 aa, Mycobacterium
SDGAT

SEQ ID NO: 1025271 - protein, 6 aa, Mycobacterium
SDGATA

SEQ ID NO: 1025272 - protein, 12 aa, Mycobacterium
SDGAYAEASNQD

SEQ ID NO: 1025273 - protein, 11 aa, Mycobacterium
SDGDAEASGAQ

SEQ ID NO: 1025274 - protein, 7 aa, Mycobacterium
SDGDSWT

SEQ ID NO: 1025275 - protein, 6 aa, Mycobacterium
SDGEDL

SEQ ID NO: 1025276 - protein, 7 aa, Mycobacterium
SDGEFGA

SEQ ID NO: 1025277 - protein, 8 aa, Mycobacterium
SDGEGSLA

SEQ ID NO: 1025278 - protein, 8 aa, Mycobacterium
SDGETDRG

SEQ ID NO: 1025279 - protein, 7 aa, Mycobacterium
SDGETTA

SEQ ID NO: 1025280 - protein, 6 aa, Mycobacterium
SDGFGP

SEQ ID NO: 1025281 - protein, 7 aa, Mycobacterium
SDGGESR

SEQ ID NO: 1025282 - protein, 5 aa, Mycobacterium
SDGHR

SEQ ID NO: 1025283 - protein, 8 aa, Mycobacterium
SDGKPTRI

SEQ ID NO: 1025284 - protein, 6 aa, Mycobacterium
SDGLAS

SEQ ID NO: 1025285 - protein, 9 aa, Mycobacterium
SDGLTELPA

SEQ ID NO: 1025286 - protein, 7 aa, Mycobacterium
SDGPAAL

SEQ ID NO: 1025287 - protein, 7 aa, Mycobacterium
SDGPPLR

SEQ ID NO: 1025288 - protein, 8 aa, Mycobacterium
SDGPPPDW

SEQ ID NO: 1025289 - protein, 7 aa, Mycobacterium
SDGSAPI

SEQ ID NO: 1025290 - protein, 8 aa, Mycobacterium
SDGSATVA

SEQ ID NO: 1025291 - protein, 10 aa, Mycobacterium
SDGSGGNYTY

SEQ ID NO: 1025292 - protein, 9 aa, Mycobacterium
SDGSLAAEQ

SEQ ID NO: 1025293 - protein, 15 aa, Mycobacterium
SDGSPQRQSDSSTDA

SEQ ID NO: 1025294 - protein, 17 aa, Mycobacterium
SDGSTGDPEADDQPQEE

SEQ ID NO: 1025295 - protein, 4 aa, Mycobacterium
SDGT

SEQ ID NO: 1025296 - protein, 17 aa, Mycobacterium
SDGTVLSSNSNDAPQTS

SEQ ID NO: 1025297 - protein, 5 aa, Mycobacterium
SDGTY

SEQ ID NO: 1025298 - protein, 8 aa, Mycobacterium
SDGVDRET

SEQ ID NO: 1025299 - protein, 4 aa, Mycobacterium
SDHA

SEQ ID NO: 1025300 - protein, 6 aa, Mycobacterium
SDHDGQ

SEQ ID NO: 1025301 - protein, 4 aa, Mycobacterium
SDHG

SEQ ID NO: 1025302 - protein, 12 aa, Mycobacterium
SDHGGGSQKKGH

SEQ ID NO: 1025303 - protein, 10 aa, Mycobacterium
SDHQPPDPAA

SEQ ID NO: 1025304 - protein, 4 aa, Mycobacterium
SDIA

SEQ ID NO: 1025305 - protein, 6 aa, Mycobacterium
SDIASI

SEQ ID NO: 1025306 - protein, 5 aa, Mycobacterium
SDIDR

SEQ ID NO: 1025307 - protein, 9 aa, Mycobacterium
SDIEGRTSY

SEQ ID NO: 1025308 - protein, 5 aa, Mycobacterium
SDKPD

SEQ ID NO: 1025309 - protein, 5 aa, Mycobacterium
SDKPG

SEQ ID NO: 1025310 - protein, 7 aa, Mycobacterium
SDKPGTL

SEQ ID NO: 1025311 - protein, 8 aa, Mycobacterium
SDKQRLKR

SEQ ID NO: 1025312 - protein, 7 aa, Mycobacterium
SDLAEGC

SEQ ID NO: 1025313 - protein, 10 aa, Mycobacterium
SDLAGAGSGL

SEQ ID NO: 1025314 - protein, 6 aa, Mycobacterium
SDLAGI

SEQ ID NO: 1025315 - protein, 14 aa, Mycobacterium
SDLAKGGPVHSQAE

SEQ ID NO: 1025316 - protein, 5 aa, Mycobacterium
SDLAS

SEQ ID NO: 1025317 - protein, 4 aa, Mycobacterium
SDLE

SEQ ID NO: 1025318 - protein, 6 aa, Mycobacterium
SDLNDP

SEQ ID NO: 1025319 - protein, 8 aa, Mycobacterium
SDLPSSTQ

SEQ ID NO: 1025320 - protein, 11 aa, Mycobacterium
SDLQGPASYRA

SEQ ID NO: 1025321 - protein, 16 aa, Mycobacterium
SDLQTRTCAAAEEPPP

SEQ ID NO: 1025322 - protein, 6 aa, Mycobacterium
SDLTNI

SEQ ID NO: 1025323 - protein, 7 aa, Mycobacterium
SDLTTAR

SEQ ID NO: 1025324 - protein, 9 aa, Mycobacterium
SDMGASARP

SEQ ID NO: 1025325 - protein, 17 aa, Mycobacterium
SDMTGGMDAADRARLGR

SEQ ID NO: 1025326 - protein, 7 aa, Mycobacterium
SDMTGPV

SEQ ID NO: 1025327 - protein, 6 aa, Mycobacterium
SDNARG

SEQ ID NO: 1025328 - protein, 7 aa, Mycobacterium
SDNEAAQ

SEQ ID NO: 1025329 - protein, 12 aa, Mycobacterium
SDNESPASRNKI

SEQ ID NO: 1025330 - protein, 9 aa, Mycobacterium
SDNSGVSAN

SEQ ID NO: 1025331 - protein, 6 aa, Mycobacterium
SDPAAE

SEQ ID NO: 1025332 - protein, 8 aa, Mycobacterium
SDPAAVPD

SEQ ID NO: 1025333 - protein, 7 aa, Mycobacterium
SDPAGAP

SEQ ID NO: 1025334 - protein, 5 aa, Mycobacterium
SDPAK

SEQ ID NO: 1025335 - protein, 13 aa, Mycobacterium
SDPALAPEALAPS

SEQ ID NO: 1025336 - protein, 14 aa, Mycobacterium
SDPARFPRARATTT

SEQ ID NO: 1025337 - protein, 8 aa, Mycobacterium
SDPATQQA

SEQ ID NO: 1025338 - protein, 9 aa, Mycobacterium
SDPDEAVEK

SEQ ID NO: 1025339 - protein, 7 aa, Mycobacterium
SDPDHSW

SEQ ID NO: 1025340 - protein, 6 aa, Mycobacterium
SDPDRM

SEQ ID NO: 1025341 - protein, 8 aa, Mycobacterium
SDPDSQGV

SEQ ID NO: 1025342 - protein, 8 aa, Mycobacterium
SDPFGTTS

SEQ ID NO: 1025343 - protein, 4 aa, Mycobacterium
SDPG

SEQ ID NO: 1025344 - protein, 11 aa, Mycobacterium
SDPGGRASAEQ

SEQ ID NO: 1025345 - protein, 7 aa, Mycobacterium
SDPGGVD

SEQ ID NO: 1025346 - protein, 11 aa, Mycobacterium
SDPGQAPHGGE

SEQ ID NO: 1025347 - protein, 6 aa, Mycobacterium
SDPHGY

SEQ ID NO: 1025348 - protein, 14 aa, Mycobacterium
SDPIDRAGHARGKA

SEQ ID NO: 1025349 - protein, 4 aa, Mycobacterium
SDPK

SEQ ID NO: 1025350 - protein, 7 aa, Mycobacterium
SDPKSVE

SEQ ID NO: 1025351 - protein, 15 aa, Mycobacterium
SDPLNGTTNIAGPDK

SEQ ID NO: 1025352 - protein, 7 aa, Mycobacterium
SDPNHPA

SEQ ID NO: 1025353 - protein, 7 aa, Mycobacterium
SDPNSVT

SEQ ID NO: 1025354 - protein, 5 aa, Mycobacterium
SDPNW

SEQ ID NO: 1025355 - protein, 6 aa, Mycobacterium
SDPPFE

SEQ ID NO: 1025356 - protein, 6 aa, Mycobacterium
SDPPGL

SEQ ID NO: 1025357 - protein, 9 aa, Mycobacterium
SDPPTPDEV

SEQ ID NO: 1025358 - protein, 6 aa, Mycobacterium
SDPQWG

SEQ ID NO: 1025359 - protein, 6 aa, Mycobacterium
SDPRLR

SEQ ID NO: 1025360 - protein, 8 aa, Mycobacterium
SDPSDVAR

SEQ ID NO: 1025361 - protein, 10 aa, Mycobacterium
SDPSQSASRE

SEQ ID NO: 1025362 - protein, 8 aa, Mycobacterium
SDPTHPAV

SEQ ID NO: 1025363 - protein, 8 aa, Mycobacterium
SDPTRADL

SEQ ID NO: 1025364 - protein, 9 aa, Mycobacterium
SDPTVRGQG

SEQ ID NO: 1025365 - protein, 6 aa, Mycobacterium
SDPVAD

SEQ ID NO: 1025366 - protein, 8 aa, Mycobacterium
SDPVAEPP

SEQ ID NO: 1025367 - protein, 9 aa, Mycobacterium
SDPVARGGF

SEQ ID NO: 1025368 - protein, 4 aa, Mycobacterium
SDPY

SEQ ID NO: 1025369 - protein, 11 aa, Mycobacterium
SDQGLADRQKV

SEQ ID NO: 1025370 - protein, 5 aa, Mycobacterium
SDQLT

SEQ ID NO: 1025371 - protein, 8 aa, Mycobacterium
SDQPGTGV

SEQ ID NO: 1025372 - protein, 10 aa, Mycobacterium
SDRADRVGRK

SEQ ID NO: 1025373 - protein, 8 aa, Mycobacterium
SDRASEVI

SEQ ID NO: 1025374 - protein, 4 aa, Mycobacterium
SDRD

SEQ ID NO: 1025375 - protein, 7 aa, Mycobacterium
SDRERDG

SEQ ID NO: 1025376 - protein, 5 aa, Mycobacterium
SDRGA

SEQ ID NO: 1025377 - protein, 4 aa, Mycobacterium
SDRL

SEQ ID NO: 1025378 - protein, 6 aa, Mycobacterium
SDRNPR

SEQ ID NO: 1025379 - protein, 8 aa, Mycobacterium
SDRPPKQL

SEQ ID NO: 1025380 - protein, 13 aa, Mycobacterium
SDRPYERVGEGAG

SEQ ID NO: 1025381 - protein, 6 aa, Mycobacterium
SDRRTS

SEQ ID NO: 1025382 - protein, 9 aa, Mycobacterium
SDRSQPQTY

SEQ ID NO: 1025383 - protein, 13 aa, Mycobacterium
SDRYPAEDQAPAH

SEQ ID NO: 1025384 - protein, 17 aa, Mycobacterium
SDSAESAQREIALWFPS

SEQ ID NO: 1025385 - protein, 14 aa, Mycobacterium
SDSAPQLGADPQAR

SEQ ID NO: 1025386 - protein, 15 aa, Mycobacterium
SDSDAAGAAAQRGLS

SEQ ID NO: 1025387 - protein, 11 aa, Mycobacterium
SDSGAAPDPGA

SEQ ID NO: 1025388 - protein, 6 aa, Mycobacterium
SDSGRA

SEQ ID NO: 1025389 - protein, 6 aa, Mycobacterium
SDSGYS

SEQ ID NO: 1025390 - protein, 9 aa, Mycobacterium
SDSNKDGGY

SEQ ID NO: 1025391 - protein, 8 aa, Mycobacterium
SDSQAMGR

SEQ ID NO: 1025392 - protein, 5 aa, Mycobacterium
SDSQS

SEQ ID NO: 1025393 - protein, 9 aa, Mycobacterium
SDSRRNSPL

SEQ ID NO: 1025394 - protein, 8 aa, Mycobacterium
SDSSSPTV

SEQ ID NO: 1025395 - protein, 9 aa, Mycobacterium
SDSTSAPRG

SEQ ID NO: 1025396 - protein, 8 aa, Mycobacterium
SDSTSLNT

SEQ ID NO: 1025397 - protein, 5 aa, Mycobacterium
SDSVT

SEQ ID NO: 1025398 - protein, 7 aa, Mycobacterium
SDTADYT

SEQ ID NO: 1025399 - protein, 23 aa, Mycobacterium
SDTAEAPKSAQEKAAESTAPHKV

SEQ ID NO: 1025400 - protein, 6 aa, Mycobacterium
SDTAEF

SEQ ID NO: 1025401 - protein, 12 aa, Mycobacterium
SDTASSASAQER

SEQ ID NO: 1025402 - protein, 18 aa, Mycobacterium
SDTDPAASEAFSADDYTR

SEQ ID NO: 1025403 - protein, 6 aa, Mycobacterium
SDTDVE

SEQ ID NO: 1025404 - protein, 8 aa, Mycobacterium
SDTERQRV

SEQ ID NO: 1025405 - protein, 4 aa, Mycobacterium
SDTF

SEQ ID NO: 1025406 - protein, 8 aa, Mycobacterium
SDTGAGSS

SEQ ID NO: 1025407 - protein, 9 aa, Mycobacterium
SDTKAKELG

SEQ ID NO: 1025408 - protein, 17 aa, Mycobacterium
SDVAATDPGVADGAGAG

SEQ ID NO: 1025409 - protein, 9 aa, Mycobacterium
SDVADGSFG

SEQ ID NO: 1025410 - protein, 7 aa, Mycobacterium
SDVGRSV

SEQ ID NO: 1025411 - protein, 6 aa, Mycobacterium
SDVRQG

SEQ ID NO: 1025412 - protein, 5 aa, Mycobacterium
SDVTR

SEQ ID NO: 1025413 - protein, 4 aa, Mycobacterium
SDYA

SEQ ID NO: 1025414 - protein, 10 aa, Mycobacterium
SDYDATKGSP

SEQ ID NO: 1025415 - protein, 5 aa, Mycobacterium
SDYDP

SEQ ID NO: 1025416 - protein, 12 aa, Mycobacterium
SDYDPDGPLPDI

SEQ ID NO: 1025417 - protein, 15 aa, Mycobacterium
SDYGDQGARSKPTIS

SEQ ID NO: 1025418 - protein, 6 aa, Mycobacterium
SDYGSS

SEQ ID NO: 1025419 - protein, 4 aa, Mycobacterium
SDYL

SEQ ID NO: 1025420 - protein, 5 aa, Mycobacterium
SDYPA

SEQ ID NO: 1025421 - protein, 4 aa, Mycobacterium
SEAA

SEQ ID NO: 1025422 - protein, 6 aa, Mycobacterium
SEAADK

SEQ ID NO: 1025423 - protein, 6 aa, Mycobacterium
SEAAIT

SEQ ID NO: 1025424 - protein, 7 aa, Mycobacterium
SEAARAD

SEQ ID NO: 1025425 - protein, 9 aa, Mycobacterium
SEADKMDPQ

SEQ ID NO: 1025426 - protein, 7 aa, Mycobacterium
SEAEGRL

SEQ ID NO: 1025427 - protein, 6 aa, Mycobacterium
SEAERL

SEQ ID NO: 1025428 - protein, 36 aa, Mycobacterium
SEALPEPSAAVPPAANVAPAPRRGGQHRKQSTSAVK

SEQ ID NO: 1025429 - protein, 8 aa, Mycobacterium
SEANGTTE

SEQ ID NO: 1025430 - protein, 4 aa, Mycobacterium
SEAP

SEQ ID NO: 1025431 - protein, 6 aa, Mycobacterium
SEAQQD

SEQ ID NO: 1025432 - protein, 7 aa, Mycobacterium
SEARPTG

SEQ ID NO: 1025433 - protein, 20 aa, Mycobacterium
SEATGTSARLTDQRSGESFD

SEQ ID NO: 1025434 - protein, 9 aa, Mycobacterium
SEAVSASYD

SEQ ID NO: 1025435 - protein, 12 aa, Mycobacterium
SEDAATDGSRHA

SEQ ID NO: 1025436 - protein, 7 aa, Mycobacterium
SEDAAVG

SEQ ID NO: 1025437 - protein, 14 aa, Mycobacterium
SEDADMGEAYGASV

SEQ ID NO: 1025438 - protein, 9 aa, Mycobacterium
SEDAKEGPL

SEQ ID NO: 1025439 - protein, 6 aa, Mycobacterium
SEDEAN

SEQ ID NO: 1025440 - protein, 20 aa, Mycobacterium
SEDERRALKRRNARTKARSG

SEQ ID NO: 1025441 - protein, 8 aa, Mycobacterium
SEDETERA

SEQ ID NO: 1025442 - protein, 5 aa, Mycobacterium
SEDGH

SEQ ID NO: 1025443 - protein, 22 aa, Mycobacterium
SEDGRPAVGSAGSNQPPGPQFG

SEQ ID NO: 1025444 - protein, 10 aa, Mycobacterium
SEDQPDGLPG

SEQ ID NO: 1025445 - protein, 9 aa, Mycobacterium
SEDVEGPGA

SEQ ID NO: 1025446 - protein, 4 aa, Mycobacterium
SEEG

SEQ ID NO: 1025447 - protein, 6 aa, Mycobacterium
SEEGCR

SEQ ID NO: 1025448 - protein, 5 aa, Mycobacterium
SEEHK

SEQ ID NO: 1025449 - protein, 11 aa, Mycobacterium
SEEKDEATMAE

SEQ ID NO: 1025450 - protein, 10 aa, Mycobacterium
SEEPVAQNEQ

SEQ ID NO: 1025451 - protein, 6 aa, Mycobacterium
SEEQGA

SEQ ID NO: 1025452 - protein, 8 aa, Mycobacterium
SEESATEL

SEQ ID NO: 1025453 - protein, 13 aa, Mycobacterium
SEFDSNRPIAAPL

SEQ ID NO: 1025454 - protein, 9 aa, Mycobacterium
SEFGNGTTT

SEQ ID NO: 1025455 - protein, 15 aa, Mycobacterium
SEGATPDIDVDTTSP

SEQ ID NO: 1025456 - protein, 7 aa, Mycobacterium
SEGGAPA

SEQ ID NO: 1025457 - protein, 5 aa, Mycobacterium
SEGGI

SEQ ID NO: 1025458 - protein, 4 aa, Mycobacterium
SEGI

SEQ ID NO: 1025459 - protein, 6 aa, Mycobacterium
SEGKGL

SEQ ID NO: 1025460 - protein, 6 aa, Mycobacterium
SEGNER

SEQ ID NO: 1025461 - protein, 5 aa, Mycobacterium
SEGNS

SEQ ID NO: 1025462 - protein, 4 aa, Mycobacterium
SEGP

SEQ ID NO: 1025463 - protein, 8 aa, Mycobacterium
SEGPLPQT

SEQ ID NO: 1025464 - protein, 5 aa, Mycobacterium
SEGRA

SEQ ID NO: 1025465 - protein, 20 aa, Mycobacterium
SEGSGRTGAGSKAAASDTDE

SEQ ID NO: 1025466 - protein, 8 aa, Mycobacterium
SEGSTPGA

SEQ ID NO: 1025467 - protein, 5 aa, Mycobacterium
SEGTL

SEQ ID NO: 1025468 - protein, 10 aa, Mycobacterium
SEGVKEDDIR

SEQ ID NO: 1025469 - protein, 9 aa, Mycobacterium
SEGVRGTGP

SEQ ID NO: 1025470 - protein, 4 aa, Mycobacterium
SEGY

SEQ ID NO: 1025471 - protein, 11 aa, Mycobacterium
SEHAGSGEFSD

SEQ ID NO: 1025472 - protein, 5 aa, Mycobacterium
SEHDR

SEQ ID NO: 1025473 - protein, 7 aa, Mycobacterium
SEHEYGN

SEQ ID NO: 1025474 - protein, 15 aa, Mycobacterium
SEHGEGSDPVLSDTG

SEQ ID NO: 1025475 - protein, 5 aa, Mycobacterium
SEHIK

SEQ ID NO: 1025476 - protein, 5 aa, Mycobacterium
SEHNR

SEQ ID NO: 1025477 - protein, 7 aa, Mycobacterium
SEHPSSG

SEQ ID NO: 1025478 - protein, 6 aa, Mycobacterium
SEHRDG

SEQ ID NO: 1025479 - protein, 5 aa, Mycobacterium
SEHSD

SEQ ID NO: 1025480 - protein, 7 aa, Mycobacterium
SEIAEAS

SEQ ID NO: 1025481 - protein, 17 aa, Mycobacterium
SEIDPEDLEDADPFEEG

SEQ ID NO: 1025482 - protein, 17 aa, Mycobacterium
SEIPENMPDPDNDDEGC

SEQ ID NO: 1025483 - protein, 8 aa, Mycobacterium
SEIQPLGR

SEQ ID NO: 1025484 - protein, 15 aa, Mycobacterium
SEKEEAERKSKVRGG

SEQ ID NO: 1025485 - protein, 4 aa, Mycobacterium
SEKL

SEQ ID NO: 1025486 - protein, 8 aa, Mycobacterium
SEKPESVQ

SEQ ID NO: 1025487 - protein, 5 aa, Mycobacterium
SEKYG

SEQ ID NO: 1025488 - protein, 11 aa, Mycobacterium
SELASAGDGGM

SEQ ID NO: 1025489 - protein, 4 aa, Mycobacterium
SELD

SEQ ID NO: 1025490 - protein, 9 aa, Mycobacterium
SELERDDAR

SEQ ID NO: 1025491 - protein, 6 aa, Mycobacterium
SELESD

SEQ ID NO: 1025492 - protein, 13 aa, Mycobacterium
SELGSEAQRERRK

SEQ ID NO: 1025493 - protein, 11 aa, Mycobacterium
SELGTGRGGPR

SEQ ID NO: 1025494 - protein, 12 aa, Mycobacterium
SELNASGRTPGL

SEQ ID NO: 1025495 - protein, 10 aa, Mycobacterium
SELPGPDTYR

SEQ ID NO: 1025496 - protein, 7 aa, Mycobacterium
SELPPPL

SEQ ID NO: 1025497 - protein, 4 aa, Mycobacterium
SELS

SEQ ID NO: 1025498 - protein, 10 aa, Mycobacterium
SELSEDGTAR

SEQ ID NO: 1025499 - protein, 9 aa, Mycobacterium
SELSGGQRR

SEQ ID NO: 1025500 - protein, 10 aa, Mycobacterium
SELSSGIPDI

SEQ ID NO: 1025501 - protein, 4 aa, Mycobacterium
SELT

SEQ ID NO: 1025502 - protein, 5 aa, Mycobacterium
SEMTE

SEQ ID NO: 1025503 - protein, 6 aa, Mycobacterium
SEMTPA

SEQ ID NO: 1025504 - protein, 6 aa, Mycobacterium
SENEYA

SEQ ID NO: 1025505 - protein, 9 aa, Mycobacterium
SENGSSETH

SEQ ID NO: 1025506 - protein, 9 aa, Mycobacterium
SENHGNGYS

SEQ ID NO: 1025507 - protein, 14 aa, Mycobacterium
SENIEEGQQVKRTG

SEQ ID NO: 1025508 - protein, 5 aa, Mycobacterium
SENNT

SEQ ID NO: 1025509 - protein, 10 aa, Mycobacterium
SEPAPAPKRS

SEQ ID NO: 1025510 - protein, 4 aa, Mycobacterium
SEPD

SEQ ID NO: 1025511 - protein, 7 aa, Mycobacterium
SEPDAAT

SEQ ID NO: 1025512 - protein, 8 aa, Mycobacterium
SEPDERGM

SEQ ID NO: 1025513 - protein, 5 aa, Mycobacterium
SEPDR

SEQ ID NO: 1025514 - protein, 11 aa, Mycobacterium
SEPDSGSDLAS

SEQ ID NO: 1025515 - protein, 9 aa, Mycobacterium
SEPEAGSDF

SEQ ID NO: 1025516 - protein, 9 aa, Mycobacterium
SEPEAGSDL

SEQ ID NO: 1025517 - protein, 10 aa, Mycobacterium
SEPEAGSDLA

SEQ ID NO: 1025518 - protein, 9 aa, Mycobacterium
SEPEAGTDL

SEQ ID NO: 1025519 - protein, 10 aa, Mycobacterium
SEPESGSDLA

SEQ ID NO: 1025520 - protein, 9 aa, Mycobacterium
SEPGAGSDL

SEQ ID NO: 1025521 - protein, 9 aa, Mycobacterium
SEPGAGTDL

SEQ ID NO: 1025522 - protein, 6 aa, Mycobacterium
SEPGLS

SEQ ID NO: 1025523 - protein, 9 aa, Mycobacterium
SEPGRGWDP

SEQ ID NO: 1025524 - protein, 6 aa, Mycobacterium
SEPGTL

SEQ ID NO: 1025525 - protein, 5 aa, Mycobacterium
SEPGW

SEQ ID NO: 1025526 - protein, 13 aa, Mycobacterium
SEPQDGGAELRPI

SEQ ID NO: 1025527 - protein, 11 aa, Mycobacterium
SEPQPRGVAAG

SEQ ID NO: 1025528 - protein, 5 aa, Mycobacterium
SEPRV

SEQ ID NO: 1025529 - protein, 13 aa, Mycobacterium
SEPYDNDTDWEDV

SEQ ID NO: 1025530 - protein, 5 aa, Mycobacterium
SEQDL

SEQ ID NO: 1025531 - protein, 16 aa, Mycobacterium
SEQISTAGKEASGTGN

SEQ ID NO: 1025532 - protein, 10 aa, Mycobacterium
SEQKAQSEAE

SEQ ID NO: 1025533 - protein, 18 aa, Mycobacterium
SEQNDPNLLSPEGKSRRF

SEQ ID NO: 1025534 - protein, 5 aa, Mycobacterium
SEQPE

SEQ ID NO: 1025535 - protein, 7 aa, Mycobacterium
SEQQAAE

SEQ ID NO: 1025536 - protein, 11 aa, Mycobacterium
SEQTESLGPQS

SEQ ID NO: 1025537 - protein, 12 aa, Mycobacterium
SERARAGASARL

SEQ ID NO: 1025538 - protein, 22 aa, Mycobacterium
SEREAGSDAGAMRTRAKADGDD

SEQ ID NO: 1025539 - protein, 5 aa, Mycobacterium
SERGR

SEQ ID NO: 1025540 - protein, 14 aa, Mycobacterium
SERKPDGDQHGQHR

SEQ ID NO: 1025541 - protein, 4 aa, Mycobacterium
SERM

SEQ ID NO: 1025542 - protein, 8 aa, Mycobacterium
SERPGGND

SEQ ID NO: 1025543 - protein, 6 aa, Mycobacterium
SERPGH

SEQ ID NO: 1025544 - protein, 7 aa, Mycobacterium
SERPRGV

SEQ ID NO: 1025545 - protein, 4 aa, Mycobacterium
SERQ

SEQ ID NO: 1025546 - protein, 4 aa, Mycobacterium
SERS

SEQ ID NO: 1025547 - protein, 6 aa, Mycobacterium
SERSDA

SEQ ID NO: 1025548 - protein, 8 aa, Mycobacterium
SERSDSIS

SEQ ID NO: 1025549 - protein, 7 aa, Mycobacterium
SERSPLT

SEQ ID NO: 1025550 - protein, 7 aa, Mycobacterium
SERTGSV

SEQ ID NO: 1025551 - protein, 18 aa, Mycobacterium
SERYPEYKANRSSTPDEF

SEQ ID NO: 1025552 - protein, 6 aa, Mycobacterium
SERYTE

SEQ ID NO: 1025553 - protein, 8 aa, Mycobacterium
SESADEVR

SEQ ID NO: 1025554 - protein, 16 aa, Mycobacterium
SESDGAEKGRGYNKVR

SEQ ID NO: 1025555 - protein, 13 aa, Mycobacterium
SESDTVAHPDPST

SEQ ID NO: 1025556 - protein, 7 aa, Mycobacterium
SESEEHE

SEQ ID NO: 1025557 - protein, 9 aa, Mycobacterium
SESETDQAR

SEQ ID NO: 1025558 - protein, 16 aa, Mycobacterium
SESGDSRQNDGQSRPH

SEQ ID NO: 1025559 - protein, 7 aa, Mycobacterium
SESPAAG

SEQ ID NO: 1025560 - protein, 20 aa, Mycobacterium
SESPGQVRSAGPARPGQHND

SEQ ID NO: 1025561 - protein, 8 aa, Mycobacterium
SESTRADW

SEQ ID NO: 1025562 - protein, 6 aa, Mycobacterium
SESYNF

SEQ ID NO: 1025563 - protein, 5 aa, Mycobacterium
SETCS

SEQ ID NO: 1025564 - protein, 17 aa, Mycobacterium
SETEDGDAETPEGLSSQ

SEQ ID NO: 1025565 - protein, 23 aa, Mycobacterium
SETFGTSPQHPADQESDAAEAGG

SEQ ID NO: 1025566 - protein, 9 aa, Mycobacterium
SETGAAQAA

SEQ ID NO: 1025567 - protein, 7 aa, Mycobacterium
SETGDLG

SEQ ID NO: 1025568 - protein, 18 aa, Mycobacterium
SETGDPPEPGSTSPMTRR

SEQ ID NO: 1025569 - protein, 11 aa, Mycobacterium
SETGNGRLKTE

SEQ ID NO: 1025570 - protein, 7 aa, Mycobacterium
SETGRLE

SEQ ID NO: 1025571 - protein, 11 aa, Mycobacterium
SETKASEGVIP

SEQ ID NO: 1025572 - protein, 10 aa, Mycobacterium
SETNDSQSQP

SEQ ID NO: 1025573 - protein, 10 aa, Mycobacterium
SETNPAGNHR

SEQ ID NO: 1025574 - protein, 7 aa, Mycobacterium
SETQSRE

SEQ ID NO: 1025575 - protein, 16 aa, Mycobacterium
SETRDDSGSARTGPPA

SEQ ID NO: 1025576 - protein, 48 aa, Mycobacterium
SETRGWGEPRAATTWASGTPATTTSASATPVRETSASALPATIRWGLG

SEQ ID NO: 1025577 - protein, 6 aa, Mycobacterium
SETVND

SEQ ID NO: 1025578 - protein, 4 aa, Mycobacterium
SEVD

SEQ ID NO: 1025579 - protein, 13 aa, Mycobacterium
SEVEQPEGHHEEA

SEQ ID NO: 1025580 - protein, 12 aa, Mycobacterium
SEVKAGRGTPHG

SEQ ID NO: 1025581 - protein, 9 aa, Mycobacterium
SEVNGHKPL

SEQ ID NO: 1025582 - protein, 9 aa, Mycobacterium
SEVPPPVEG

SEQ ID NO: 1025583 - protein, 5 aa, Mycobacterium
SEVTG

SEQ ID NO: 1025584 - protein, 5 aa, Mycobacterium
SEVTP

SEQ ID NO: 1025585 - protein, 7 aa, Mycobacterium
SEWPPAG

SEQ ID NO: 1025586 - protein, 14 aa, Mycobacterium
SEYEDRDGNRRSSL

SEQ ID NO: 1025587 - protein, 5 aa, Mycobacterium
SEYGG

SEQ ID NO: 1025588 - protein, 13 aa, Mycobacterium
SFAAGNSDLQPLN

SEQ ID NO: 1025589 - protein, 13 aa, Mycobacterium
SFAENGSAGTTVR

SEQ ID NO: 1025590 - protein, 5 aa, Mycobacterium
SFAPE

SEQ ID NO: 1025591 - protein, 5 aa, Mycobacterium
SFATV

SEQ ID NO: 1025592 - protein, 4 aa, Mycobacterium
SFDG

SEQ ID NO: 1025593 - protein, 4 aa, Mycobacterium
SFDS

SEQ ID NO: 1025594 - protein, 5 aa, Mycobacterium
SFEEN

SEQ ID NO: 1025595 - protein, 4 aa, Mycobacterium
SFES

SEQ ID NO: 1025596 - protein, 8 aa, Mycobacterium
SFGAGGAN

SEQ ID NO: 1025597 - protein, 13 aa, Mycobacterium
SFGSGKGKDAITS

SEQ ID NO: 1025598 - protein, 5 aa, Mycobacterium
SFGSN

SEQ ID NO: 1025599 - protein, 15 aa, Mycobacterium
SFGTATPAGSDEEAD

SEQ ID NO: 1025600 - protein, 5 aa, Mycobacterium
SFGTS

SEQ ID NO: 1025601 - protein, 6 aa, Mycobacterium
SFGVQD

SEQ ID NO: 1025602 - protein, 10 aa, Mycobacterium
SFPDPSALSG

SEQ ID NO: 1025603 - protein, 12 aa, Mycobacterium
SFPEVGGTERAE

SEQ ID NO: 1025604 - protein, 4 aa, Mycobacterium
SFPN

SEQ ID NO: 1025605 - protein, 6 aa, Mycobacterium
SFPPGG

SEQ ID NO: 1025606 - protein, 6 aa, Mycobacterium
SFPPTG

SEQ ID NO: 1025607 - protein, 14 aa, Mycobacterium
SFPSPGSAAAVSQA

SEQ ID NO: 1025608 - protein, 4 aa, Mycobacterium
SFQS

SEQ ID NO: 1025609 - protein, 14 aa, Mycobacterium
SFRDATRVAGTAPD

SEQ ID NO: 1025610 - protein, 4 aa, Mycobacterium
SFRR

SEQ ID NO: 1025611 - protein, 9 aa, Mycobacterium
SFSENATAP

SEQ ID NO: 1025612 - protein, 8 aa, Mycobacterium
SFSGGPVG

SEQ ID NO: 1025613 - protein, 12 aa, Mycobacterium
SFSNKPQGSGVV

SEQ ID NO: 1025614 - protein, 10 aa, Mycobacterium
SFSQSGAAMT

SEQ ID NO: 1025615 - protein, 16 aa, Mycobacterium
SFSSGYRNTGPEGINP

SEQ ID NO: 1025616 - protein, 5 aa, Mycobacterium
SFSSV

SEQ ID NO: 1025617 - protein, 29 aa, Mycobacterium
SFSSVTSGLAGDAWQGAASAAMTAAASSY

SEQ ID NO: 1025618 - protein, 12 aa, Mycobacterium
SFSTGRGDPAWR

SEQ ID NO: 1025619 - protein, 5 aa, Mycobacterium
SFTEG

SEQ ID NO: 1025620 - protein, 9 aa, Mycobacterium
SFTENATGE

SEQ ID NO: 1025621 - protein, 6 aa, Mycobacterium
SFYTGR

SEQ ID NO: 1025622 - protein, 8 aa, Mycobacterium
SGAAGQYD

SEQ ID NO: 1025623 - protein, 5 aa, Mycobacterium
SGAAI

SEQ ID NO: 1025624 - protein, 14 aa, Mycobacterium
SGAASYAGAEATSV

SEQ ID NO: 1025625 - protein, 16 aa, Mycobacterium
SGAASYANAEAASIAP

SEQ ID NO: 1025626 - protein, 5 aa, Mycobacterium
SGADD

SEQ ID NO: 1025627 - protein, 5 aa, Mycobacterium
SGADE

SEQ ID NO: 1025628 - protein, 10 aa, Mycobacterium
SGADRDEDGS

SEQ ID NO: 1025629 - protein, 4 aa, Mycobacterium
SGAE

SEQ ID NO: 1025630 - protein, 6 aa, Mycobacterium
SGAERL

SEQ ID NO: 1025631 - protein, 6 aa, Mycobacterium
SGAESI

SEQ ID NO: 1025632 - protein, 6 aa, Mycobacterium
SGAETA

SEQ ID NO: 1025633 - protein, 7 aa, Mycobacterium
SGAGAAG

SEQ ID NO: 1025634 - protein, 6 aa, Mycobacterium
SGAGAS

SEQ ID NO: 1025635 - protein, 7 aa, Mycobacterium
SGAGERA

SEQ ID NO: 1025636 - protein, 25 aa, Mycobacterium
SGAGGAGGASELADGGAGGAGGNGG

SEQ ID NO: 1025637 - protein, 16 aa, Mycobacterium
SGAGGAGGDGGNGGYA

SEQ ID NO: 1025638 - protein, 7 aa, Mycobacterium
SGAGGGL

SEQ ID NO: 1025639 - protein, 9 aa, Mycobacterium
SGAGGGNTG

SEQ ID NO: 1025640 - protein, 19 aa, Mycobacterium
SGAGGNIGIGGAPQTGKST

SEQ ID NO: 1025641 - protein, 8 aa, Mycobacterium
SGAGGVDA

SEQ ID NO: 1025642 - protein, 7 aa, Mycobacterium
SGAGKSS

SEQ ID NO: 1025643 - protein, 5 aa, Mycobacterium
SGAGL

SEQ ID NO: 1025644 - protein, 9 aa, Mycobacterium
SGAGRGTAA

SEQ ID NO: 1025645 - protein, 8 aa, Mycobacterium
SGAGSGPV

SEQ ID NO: 1025646 - protein, 16 aa, Mycobacterium
SGAHAEQAAEQAKTAA

SEQ ID NO: 1025647 - protein, 15 aa, Mycobacterium
SGAISTGTFNAGPDI

SEQ ID NO: 1025648 - protein, 8 aa, Mycobacterium
SGAKASDW

SEQ ID NO: 1025649 - protein, 29 aa, Mycobacterium
SGALSSGISNSGTNSSGGFNTGDDQSGFF

SEQ ID NO: 1025650 - protein, 9 aa, Mycobacterium
SGANHNERH

SEQ ID NO: 1025651 - protein, 8 aa, Mycobacterium
SGANQSMP

SEQ ID NO: 1025652 - protein, 11 aa, Mycobacterium
SGANSSADAGV

SEQ ID NO: 1025653 - protein, 13 aa, Mycobacterium
SGANTAAAAPTTE

SEQ ID NO: 1025654 - protein, 8 aa, Mycobacterium
SGAPEHRA

SEQ ID NO: 1025655 - protein, 10 aa, Mycobacterium
SGAPKFPPTM

SEQ ID NO: 1025656 - protein, 8 aa, Mycobacterium
SGAPPKIS

SEQ ID NO: 1025657 - protein, 9 aa, Mycobacterium
SGAPRGATA

SEQ ID NO: 1025658 - protein, 15 aa, Mycobacterium
SGAQASAGDKRPDFD

SEQ ID NO: 1025659 - protein, 4 aa, Mycobacterium
SGAR

SEQ ID NO: 1025660 - protein, 17 aa, Mycobacterium
SGARYRPESGEATPTRH

SEQ ID NO: 1025661 - protein, 4 aa, Mycobacterium
SGAS

SEQ ID NO: 1025662 - protein, 7 aa, Mycobacterium
SGASRDG

SEQ ID NO: 1025663 - protein, 8 aa, Mycobacterium
SGATDRHG

SEQ ID NO: 1025664 - protein, 5 aa, Mycobacterium
SGATE

SEQ ID NO: 1025665 - protein, 24 aa, Mycobacterium
SGATRYATNETTSPAEMAAVQPRL

SEQ ID NO: 1025666 - protein, 8 aa, Mycobacterium
SGATSQRP

SEQ ID NO: 1025667 - protein, 10 aa, Mycobacterium
SGAVTAPTSV

SEQ ID NO: 1025668 - protein, 15 aa, Mycobacterium
SGAWKDYTERGGRPF

SEQ ID NO: 1025669 - protein, 8 aa, Mycobacterium
SGCGKTST

SEQ ID NO: 1025670 - protein, 7 aa, Mycobacterium
SGDAAAA

SEQ ID NO: 1025671 - protein, 8 aa, Mycobacterium
SGDAEAQA

SEQ ID NO: 1025672 - protein, 15 aa, Mycobacterium
SGDAGAGGQGGASVA

SEQ ID NO: 1025673 - protein, 7 aa, Mycobacterium
SGDATLA

SEQ ID NO: 1025674 - protein, 11 aa, Mycobacterium
SGDDGPPQPAQ

SEQ ID NO: 1025675 - protein, 8 aa, Mycobacterium
SGDEATGA

SEQ ID NO: 1025676 - protein, 6 aa, Mycobacterium
SGDGQV

SEQ ID NO: 1025677 - protein, 41 aa, Mycobacterium; identical to SEQ ID NO: 578365

SEQ ID NO: 1025678 - protein, 9 aa, Mycobacterium
SGDHRRSAA

SEQ ID NO: 1025679 - protein, 4 aa, Mycobacterium
SGDI

SEQ ID NO: 1025680 - protein, 14 aa, Mycobacterium
SGDLTTNPTAAKGN

SEQ ID NO: 1025681 - protein, 4 aa, Mycobacterium
SGDM

SEQ ID NO: 1025682 - protein, 4 aa, Mycobacterium
SGDP

SEQ ID NO: 1025683 - protein, 7 aa, Mycobacterium
SGDPALS

SEQ ID NO: 1025684 - protein, 6 aa, Mycobacterium
SGDPEV

SEQ ID NO: 1025685 - protein, 7 aa, Mycobacterium
SGDPLTK

SEQ ID NO: 1025686 - protein, 7 aa, Mycobacterium
SGDPSLY

SEQ ID NO: 1025687 - protein, 6 aa, Mycobacterium
SGDQGA

SEQ ID NO: 1025688 - protein, 7 aa, Mycobacterium
SGDQGAL

SEQ ID NO: 1025689 - protein, 8 aa, Mycobacterium
SGDRPTDF

SEQ ID NO: 1025690 - protein, 8 aa, Mycobacterium
SGDRYTET

SEQ ID NO: 1025691 - protein, 7 aa, Mycobacterium
SGDSDAA

SEQ ID NO: 1025692 - protein, 7 aa, Mycobacterium
SGDSTDV

SEQ ID NO: 1025693 - protein, 5 aa, Mycobacterium
SGDTA

SEQ ID NO: 1025694 - protein, 9 aa, Mycobacterium
SGDTTKSDN

SEQ ID NO: 1025695 - protein, 12 aa, Mycobacterium
SGDYRRRQSVGT

SEQ ID NO: 1025696 - protein, 11 aa, Mycobacterium
SGEAKRGSPLR

SEQ ID NO: 1025697 - protein, 12 aa, Mycobacterium
SGEDSASVREVS

SEQ ID NO: 1025698 - protein, 8 aa, Mycobacterium
SGEGGEES

SEQ ID NO: 1025699 - protein, 7 aa, Mycobacterium
SGEGRYV

SEQ ID NO: 1025700 - protein, 7 aa, Mycobacterium
SGEPFDA

SEQ ID NO: 1025701 - protein, 4 aa, Mycobacterium
SGEQ

SEQ ID NO: 1025702 - protein, 12 aa, Mycobacterium
SGEQPEIGPTRR

SEQ ID NO: 1025703 - protein, 7 aa, Mycobacterium
SGEQRSS

SEQ ID NO: 1025704 - protein, 7 aa, Mycobacterium
SGESFSS

SEQ ID NO: 1025705 - protein, 6 aa, Mycobacterium
SGETDD

SEQ ID NO: 1025706 - protein, 9 aa, Mycobacterium
SGETLAERA

SEQ ID NO: 1025707 - protein, 12 aa, Mycobacterium
SGETLFAPPVTV

SEQ ID NO: 1025708 - protein, 6 aa, Mycobacterium
SGEVPG

SEQ ID NO: 1025709 - protein, 12 aa, Mycobacterium
SGEWTGATGKRI

SEQ ID NO: 1025710 - protein, 7 aa, Mycobacterium
SGEYAAS

SEQ ID NO: 1025711 - protein, 10 aa, Mycobacterium
SGFDAEAPSA

SEQ ID NO: 1025712 - protein, 4 aa, Mycobacterium
SGFG

SEQ ID NO: 1025713 - protein, 11 aa, Mycobacterium
SGFGNTGSVTP

SEQ ID NO: 1025714 - protein, 12 aa, Mycobacterium
SGFGRDDPRRET

SEQ ID NO: 1025715 - protein, 4 aa, Mycobacterium
SGFI

SEQ ID NO: 1025716 - protein, 18 aa, Mycobacterium
SGFTTSYSSVGGNTPQPL

SEQ ID NO: 1025717 - protein, 14 aa, Mycobacterium
SGGAADAANGELGT

SEQ ID NO: 1025718 - protein, 9 aa, Mycobacterium
SGGADLPTQ

SEQ ID NO: 1025719 - protein, 7 aa, Mycobacterium
SGGAEPP

SEQ ID NO: 1025720 - protein, 8 aa, Mycobacterium
SGGAESLN

SEQ ID NO: 1025721 - protein, 5 aa, Mycobacterium
SGGAG

SEQ ID NO: 1025722 - protein, 18 aa, Mycobacterium
SGGAGAYAAAEAANASPL

SEQ ID NO: 1025723 - protein, 11 aa, Mycobacterium
SGGAGGAGGAA

SEQ ID NO: 1025724 - protein, 14 aa, Mycobacterium
SGGAGGDGGSGAAI

SEQ ID NO: 1025725 - protein, 20 aa, Mycobacterium
SGGAGGQGGTGVAGRNGSNP

SEQ ID NO: 1025726 - protein, 21 aa, Mycobacterium
SGGAGGSGAGGQDGGAGGRAG

SEQ ID NO: 1025727 - protein, 15 aa, Mycobacterium
SGGAGGTGGAGAAGA

SEQ ID NO: 1025728 - protein, 18 aa, Mycobacterium
SGGAGGVGGNGAIGGTGV

SEQ ID NO: 1025729 - protein, 7 aa, Mycobacterium
SGGAGNV

SEQ ID NO: 1025730 - protein, 22 aa, Mycobacterium
SGGANACTGPGGFQDTHATAEA

SEQ ID NO: 1025731 - protein, 45 aa, Mycobacterium
SGGDGAAGGVAGQAGGNGGSAGLIGDGGNGGTGGFGAAGGTGGAG

SEQ ID NO: 1025732 - protein, 11 aa, Mycobacterium
SGGDGGTGGNA

SEQ ID NO: 1025733 - protein, 6 aa, Mycobacterium
SGGDTV

SEQ ID NO: 1025734 - protein, 7 aa, Mycobacterium
SGGDYQF

SEQ ID NO: 1025735 - protein, 4 aa, Mycobacterium
SGGE

SEQ ID NO: 1025736 - protein, 6 aa, Mycobacterium
SGGERQ

SEQ ID NO: 1025737 - protein, 7 aa, Mycobacterium
SGGFATT

SEQ ID NO: 1025738 - protein, 14 aa, Mycobacterium
SGGGASYAAGEAAA

SEQ ID NO: 1025739 - protein, 5 aa, Mycobacterium
SGGGG

SEQ ID NO: 1025740 - protein, 16 aa, Mycobacterium
SGGGIGGKGGGGGAAG

SEQ ID NO: 1025741 - protein, 8 aa, Mycobacterium
SGGGPDTR

SEQ ID NO: 1025742 - protein, 7 aa, Mycobacterium
SGGGPGF

SEQ ID NO: 1025743 - protein, 6 aa, Mycobacterium
SGGGPY

SEQ ID NO: 1025744 - protein, 7 aa, Mycobacterium
SGGGYGY

SEQ ID NO: 1025745 - protein, 4 aa, Mycobacterium
SGGK

SEQ ID NO: 1025746 - protein, 15 aa, Mycobacterium
SGGKAVAEVGTGAGV

SEQ ID NO: 1025747 - protein, 11 aa, Mycobacterium
SGGLPKGDALA

SEQ ID NO: 1025748 - protein, 9 aa, Mycobacterium
SGGLPPEHT

SEQ ID NO: 1025749 - protein, 5 aa, Mycobacterium
SGGLR

SEQ ID NO: 1025750 - protein, 6 aa, Mycobacterium
SGGLSL

SEQ ID NO: 1025751 - protein, 13 aa, Mycobacterium
SGGLTGYGGGLDR

SEQ ID NO: 1025752 - protein, 46 aa, Mycobacterium
SGGNGAAGAAGQAGGSGGSAGLLGNGGAGGAGGTGGASGGNGGSGG

SEQ ID NO: 1025753 - protein, 42 aa, Mycobacterium
SGGNGGAGAGGGDGGYLSGNGGNGGDGVIAGNGSAGGAGGNA

SEQ ID NO: 1025754 - protein, 71 aa, Mycobacterium
SGGNGGTGGTGGTGGIGAAAGVGGIGGDGGDATAASSATGGHGGDGGDSDPSVGTGGNGDTGGNGGNGGAA

SEQ ID NO: 1025755 - protein, 7 aa, Mycobacterium
SGGPDSL

SEQ ID NO: 1025756 - protein, 6 aa, Mycobacterium
SGGPFA

SEQ ID NO: 1025757 - protein, 7 aa, Mycobacterium
SGGPFRG

SEQ ID NO: 1025758 - protein, 6 aa, Mycobacterium
SGGPLA

SEQ ID NO: 1025759 - protein, 7 aa, Mycobacterium
SGGPTVG

SEQ ID NO: 1025760 - protein, 7 aa, Mycobacterium
SGGQRTR

SEQ ID NO: 1025761 - protein, 6 aa, Mycobacterium
SGGQYG

SEQ ID NO: 1025762 - protein, 7 aa, Mycobacterium
SGGRPFD

SEQ ID NO: 1025763 - protein, 6 aa, Mycobacterium
SGGRSN

SEQ ID NO: 1025764 - protein, 4 aa, Mycobacterium
SGGS

SEQ ID NO: 1025765 - protein, 12 aa, Mycobacterium
SGGSDRKPSTLE

SEQ ID NO: 1025766 - protein, 34 aa, Mycobacterium; identical to SEQ ID NO: 578865

SEQ ID NO: 1025767 - protein, 33 aa, Mycobacterium
SGGSGGIGGVGGSGTIGAPSGHGGSCGLGGGTG

SEQ ID NO: 1025768 - protein, 27 aa, Mycobacterium
SGGSGGSGGAGAINDGGSGGAVGNGGR

SEQ ID NO: 1025769 - protein, 23 aa, Mycobacterium
SGGSGYNSATSGVGGGAGGAAGL

SEQ ID NO: 1025770 - protein, 7 aa, Mycobacterium
SGGTADT

SEQ ID NO: 1025771 - protein, 14 aa, Mycobacterium
SGGTAGPGGDGGNA

SEQ ID NO: 1025772 - protein, 8 aa, Mycobacterium
SGGTAPAA

SEQ ID NO: 1025773 - protein, 26 aa, Mycobacterium
SGGTGGAGGFGNSGTGGPGGAGGTGG

SEQ ID NO: 1025774 - protein, 26 aa, Mycobacterium
SGGTGGTGGAGVSSGFGGTGGNGGLG

SEQ ID NO: 1025775 - protein, 9 aa, Mycobacterium
SGGVDGTIS

SEQ ID NO: 1025776 - protein, 5 aa, Mycobacterium
SGGVE

SEQ ID NO: 1025777 - protein, 5 aa, Mycobacterium
SGGVG

SEQ ID NO: 1025778 - protein, 24 aa, Mycobacterium
SGGVGGDGGSGHGNGGDGGGGGNA

SEQ ID NO: 1025779 - protein, 28 aa, Mycobacterium
SGGVGGSGGAGGVVGTGGYGGSGGAAAG

SEQ ID NO: 1025780 - protein, 5 aa, Mycobacterium
SGGVL

SEQ ID NO: 1025781 - protein, 6 aa, Mycobacterium
SGGYNS

SEQ ID NO: 1025782 - protein, 5 aa, Mycobacterium
SGHGA

SEQ ID NO: 1025783 - protein, 13 aa, Mycobacterium
SGIDPTGLRGSAT

SEQ ID NO: 1025784 - protein, 13 aa, Mycobacterium
SGIDPTTLRGSAT

SEQ ID NO: 1025785 - protein, 5 aa, Mycobacterium
SGIGE

SEQ ID NO: 1025786 - protein, 11 aa, Mycobacterium
SGIGKAADAVS

SEQ ID NO: 1025787 - protein, 6 aa, Mycobacterium
SGIGPE

SEQ ID NO: 1025788 - protein, 6 aa, Mycobacterium
SGIGRR

SEQ ID NO: 1025789 - protein, 6 aa, Mycobacterium
SGINPD

SEQ ID NO: 1025790 - protein, 5 aa, Mycobacterium
SGIPG

SEQ ID NO: 1025791 - protein, 7 aa, Mycobacterium
SGISSHP

SEQ ID NO: 1025792 - protein, 4 aa, Mycobacterium
SGIV

SEQ ID NO: 1025793 - protein, 7 aa, Mycobacterium
SGKAEVK

SEQ ID NO: 1025794 - protein, 8 aa, Mycobacterium
SGKANRLP

SEQ ID NO: 1025795 - protein, 9 aa, Mycobacterium
SGKDPHRVD

SEQ ID NO: 1025796 - protein, 11 aa, Mycobacterium
SGKEPDQASDV

SEQ ID NO: 1025797 - protein, 8 aa, Mycobacterium
SGKGEDLY

SEQ ID NO: 1025798 - protein, 11 aa, Mycobacterium
SGKGGVGKSTV

SEQ ID NO: 1025799 - protein, 14 aa, Mycobacterium
SGKGHRIATPDEAN

SEQ ID NO: 1025800 - protein, 11 aa, Mycobacterium
SGKGNKDRRIP

SEQ ID NO: 1025801 - protein, 14 aa, Mycobacterium
SGKGVDTLRTRMLL

SEQ ID NO: 1025802 - protein, 9 aa, Mycobacterium
SGKKQRGEP

SEQ ID NO: 1025803 - protein, 8 aa, Mycobacterium
SGKLPPPV

SEQ ID NO: 1025804 - protein, 6 aa, Mycobacterium
SGKNFS

SEQ ID NO: 1025805 - protein, 7 aa, Mycobacterium
SGKNTHV

SEQ ID NO: 1025806 - protein, 4 aa, Mycobacterium
SGKP

SEQ ID NO: 1025807 - protein, 12 aa, Mycobacterium
SGKPGRDPDAKR

SEQ ID NO: 1025808 - protein, 6 aa, Mycobacterium
SGKPPF

SEQ ID NO: 1025809 - protein, 7 aa, Mycobacterium
SGKQIPA

SEQ ID NO: 1025810 - protein, 8 aa, Mycobacterium
SGKSALSA

SEQ ID NO: 1025811 - protein, 8 aa, Mycobacterium
SGKTGEGV

SEQ ID NO: 1025812 - protein, 20 aa, Mycobacterium
SGKYDSGAINTRTEQSGFFG

SEQ ID NO: 1025813 - protein, 63 aa, Mycobacterium
SGLAGGAGAGSGFAGGSGMVGGAAGSPGSQGGAGAGSDTAGANAGGDASSSVVAGGGAGGAGL

SEQ ID NO: 1025814 - protein, 24 aa, Mycobacterium
SGLAGQAWQGAASAAMTAAASPYA

SEQ ID NO: 1025815 - protein, 13 aa, Mycobacterium
SGLAPPGKHAASA

SEQ ID NO: 1025816 - protein, 10 aa, Mycobacterium
SGLDDQGRAA

SEQ ID NO: 1025817 - protein, 6 aa, Mycobacterium
SGLDPH

SEQ ID NO: 1025818 - protein, 5 aa, Mycobacterium
SGLEG

SEQ ID NO: 1025819 - protein, 7 aa, Mycobacterium
SGLESDP

SEQ ID NO: 1025820 - protein, 9 aa, Mycobacterium
SGLGNLGNS

SEQ ID NO: 1025821 - protein, 7 aa, Mycobacterium
SGLGPED

SEQ ID NO: 1025822 - protein, 10 aa, Mycobacterium
SGLGREGGGI

SEQ ID NO: 1025823 - protein, 17 aa, Mycobacterium
SGLKSRAEQLGRARGAH

SEQ ID NO: 1025824 - protein, 8 aa, Mycobacterium
SGLPNQTD

SEQ ID NO: 1025825 - protein, 7 aa, Mycobacterium
SGLSNRE

SEQ ID NO: 1025826 - protein, 9 aa, Mycobacterium
SGLSPDDGL

SEQ ID NO: 1025827 - protein, 6 aa, Mycobacterium
SGLSTD

SEQ ID NO: 1025828 - protein, 6 aa, Mycobacterium
SGLSTP

SEQ ID NO: 1025829 - protein, 12 aa, Mycobacterium
SGLTATRQGLED

SEQ ID NO: 1025830 - protein, 19 aa, Mycobacterium
SGLTGAEGVDIDSEGLDGA

SEQ ID NO: 1025831 - protein, 7 aa, Mycobacterium
SGLVQPG

SEQ ID NO: 1025832 - protein, 4 aa, Mycobacterium
SGMR

SEQ ID NO: 1025833 - protein, 4 aa, Mycobacterium
SGMS

SEQ ID NO: 1025834 - protein, 7 aa, Mycobacterium
SGMTPTE

SEQ ID NO: 1025835 - protein, 5 aa, Mycobacterium
SGNAT

SEQ ID NO: 1025836 - protein, 5 aa, Mycobacterium
SGNAV

SEQ ID NO: 1025837 - protein, 7 aa, Mycobacterium
SGNDVPE

SEQ ID NO: 1025838 - protein, 8 aa, Mycobacterium
SGNEGQFS

SEQ ID NO: 1025839 - protein, 11 aa, Mycobacterium
SGNFGNANGMD

SEQ ID NO: 1025840 - protein, 43 aa, Mycobacterium
SGNGGAGGSGGSGGDAGNGGNGSGPSTGGDGGDGGNGAAGGVG

SEQ ID NO: 1025841 - protein, 6 aa, Mycobacterium
SGNGQS

SEQ ID NO: 1025842 - protein, 11 aa, Mycobacterium
SGNHGDDAGNT

SEQ ID NO: 1025843 - protein, 8 aa, Mycobacterium
SGNLGNAN

SEQ ID NO: 1025844 - protein, 14 aa, Mycobacterium
SGNLGSSNAGWANL

SEQ ID NO: 1025845 - protein, 5 aa, Mycobacterium
SGNNN

SEQ ID NO: 1025846 - protein, 14 aa, Mycobacterium
SGNPNLGRRRKRNW

SEQ ID NO: 1025847 - protein, 22 aa, Mycobacterium
SGNPPTRERIQSPTDRARYDDT

SEQ ID NO: 1025848 - protein, 28 aa, Mycobacterium
SGNPTRSRRRYRRNSRSVPASPDARCGP

SEQ ID NO: 1025849 - protein, 12 aa, Mycobacterium
SGNQHDAEDLTQ

SEQ ID NO: 1025850 - protein, 12 aa, Mycobacterium
SGNQQDAEDLTQ

SEQ ID NO: 1025851 - protein, 4 aa, Mycobacterium
SGNR

SEQ ID NO: 1025852 - protein, 13 aa, Mycobacterium
SGNSPRARGADGR

SEQ ID NO: 1025853 - protein, 18 aa, Mycobacterium
SGNTGNTNFGNGNRGNLN

SEQ ID NO: 1025854 - protein, 6 aa, Mycobacterium
SGNVSA

SEQ ID NO: 1025855 - protein, 6 aa, Mycobacterium
SGPADL

SEQ ID NO: 1025856 - protein, 7 aa, Mycobacterium
SGPAGVG

SEQ ID NO: 1025857 - protein, 16 aa, Mycobacterium
SGPATDSDSAASQDWD

SEQ ID NO: 1025858 - protein, 4 aa, Mycobacterium
SGPD

SEQ ID NO: 1025859 - protein, 7 aa, Mycobacterium
SGPEAAT

SEQ ID NO: 1025860 - protein, 10 aa, Mycobacterium
SGPEAKELTA

SEQ ID NO: 1025861 - protein, 10 aa, Mycobacterium
SGPESVAASA

SEQ ID NO: 1025862 - protein, 5 aa, Mycobacterium
SGPGC

SEQ ID NO: 1025863 - protein, 8 aa, Mycobacterium
SGPGDRPA

SEQ ID NO: 1025864 - protein, 8 aa, Mycobacterium
SGPGSGQM

SEQ ID NO: 1025865 - protein, 14 aa, Mycobacterium
SGPHGADPHHGYSD

SEQ ID NO: 1025866 - protein, 4 aa, Mycobacterium
SGPI

SEQ ID NO: 1025867 - protein, 4 aa, Mycobacterium
SGPL

SEQ ID NO: 1025868 - protein, 7 aa, Mycobacterium
SGPLDTA

SEQ ID NO: 1025869 - protein, 10 aa, Mycobacterium
SGPNGSQYND

SEQ ID NO: 1025870 - protein, 9 aa, Mycobacterium
SGPPKLGRA

SEQ ID NO: 1025871 - protein, 6 aa, Mycobacterium
SGPPLL

SEQ ID NO: 1025872 - protein, 12 aa, Mycobacterium
SGPPQPDPDEVS

SEQ ID NO: 1025873 - protein, 16 aa, Mycobacterium
SGPPVAGADLAVQSWI

SEQ ID NO: 1025874 - protein, 4 aa, Mycobacterium
SGPQ

SEQ ID NO: 1025875 - protein, 5 aa, Mycobacterium
SGPRS

SEQ ID NO: 1025876 - protein, 7 aa, Mycobacterium
SGPRVGV

SEQ ID NO: 1025877 - protein, 7 aa, Mycobacterium
SGPSTQA

SEQ ID NO: 1025878 - protein, 4 aa, Mycobacterium
SGPV

SEQ ID NO: 1025879 - protein, 5 aa, Mycobacterium
SGPVG

SEQ ID NO: 1025880 - protein, 4 aa, Mycobacterium
SGPW

SEQ ID NO: 1025881 - protein, 8 aa, Mycobacterium
SGQANTGL

SEQ ID NO: 1025882 - protein, 8 aa, Mycobacterium
SGQDCTAA

SEQ ID NO: 1025883 - protein, 8 aa, Mycobacterium
SGQFRTDD

SEQ ID NO: 1025884 - protein, 7 aa, Mycobacterium
SGQGRQL

SEQ ID NO: 1025885 - protein, 5 aa, Mycobacterium
SGQGT

SEQ ID NO: 1025886 - protein, 6 aa, Mycobacterium
SGQPIN

SEQ ID NO: 1025887 - protein, 8 aa, Mycobacterium
SGQPLSGL

SEQ ID NO: 1025888 - protein, 6 aa, Mycobacterium
SGQQLP

SEQ ID NO: 1025889 - protein, 10 aa, Mycobacterium
SGQQRSQEGS

SEQ ID NO: 1025890 - protein, 6 aa, Mycobacterium
SGQRAP

SEQ ID NO: 1025891 - protein, 5 aa, Mycobacterium
SGQTA

SEQ ID NO: 1025892 - protein, 9 aa, Mycobacterium
SGRACPGSL

SEQ ID NO: 1025893 - protein, 7 aa, Mycobacterium
SGRARDG

SEQ ID NO: 1025894 - protein, 4 aa, Mycobacterium
SGRD

SEQ ID NO: 1025895 - protein, 5 aa, Mycobacterium
SGRDD

SEQ ID NO: 1025896 - protein, 5 aa, Mycobacterium
SGREL

SEQ ID NO: 1025897 - protein, 14 aa, Mycobacterium
SGRFAENGSATTRV

SEQ ID NO: 1025898 - protein, 4 aa, Mycobacterium
SGRG

SEQ ID NO: 1025899 - protein, 11 aa, Mycobacterium
SGRGDKDVETA

SEQ ID NO: 1025900 - protein, 10 aa, Mycobacterium
SGRGFSAGTD

SEQ ID NO: 1025901 - protein, 5 aa, Mycobacterium
SGRGG

SEQ ID NO: 1025902 - protein, 8 aa, Mycobacterium
SGRGNPDG

SEQ ID NO: 1025903 - protein, 10 aa, Mycobacterium
SGRGSTYSAS

SEQ ID NO: 1025904 - protein, 7 aa, Mycobacterium
SGRGTDV

SEQ ID NO: 1025905 - protein, 4 aa, Mycobacterium
SGRL

SEQ ID NO: 1025906 - protein, 5 aa, Mycobacterium
SGRLA

SEQ ID NO: 1025907 - protein, 8 aa, Mycobacterium
SGRMTDDD

SEQ ID NO: 1025908 - protein, 4 aa, Mycobacterium
SGRN

SEQ ID NO: 1025909 - protein, 6 aa, Mycobacterium
SGRNKV

SEQ ID NO: 1025910 - protein, 8 aa, Mycobacterium
SGRPARHL

SEQ ID NO: 1025911 - protein, 6 aa, Mycobacterium
SGRPDQ

SEQ ID NO: 1025912 - protein, 6 aa, Mycobacterium
SGRPGA

SEQ ID NO: 1025913 - protein, 6 aa, Mycobacterium
SGRQVA

SEQ ID NO: 1025914 - protein, 6 aa, Mycobacterium
SGRRAR

SEQ ID NO: 1025915 - protein, 12 aa, Mycobacterium
SGRRDRQRDPTD

SEQ ID NO: 1025916 - protein, 24 aa, Mycobacterium
SGRRGERDHRRAGAAGELTGATRP

SEQ ID NO: 1025917 - protein, 13 aa, Mycobacterium
SGRRGKPEPSPVA

SEQ ID NO: 1025918 - protein, 5 aa, Mycobacterium
SGRRR

SEQ ID NO: 1025919 - protein, 8 aa, Mycobacterium
SGRRRGKL

SEQ ID NO: 1025920 - protein, 6 aa, Mycobacterium
SGRSSL

SEQ ID NO: 1025921 - protein, 14 aa, Mycobacterium
SGRSVSSAVAGGSL

SEQ ID NO: 1025922 - protein, 12 aa, Mycobacterium
SGRTARAGNAGD

SEQ ID NO: 1025923 - protein, 8 aa, Mycobacterium
SGRTGVSE

SEQ ID NO: 1025924 - protein, 14 aa, Mycobacterium
SGRTPARRPRLPGS

SEQ ID NO: 1025925 - protein, 7 aa, Mycobacterium
SGRTPVT

SEQ ID NO: 1025926 - protein, 4 aa, Mycobacterium
SGRV

SEQ ID NO: 1025927 - protein, 5 aa, Mycobacterium
SGRVD

SEQ ID NO: 1025928 - protein, 5 aa, Mycobacterium
SGRVP

SEQ ID NO: 1025929 - protein, 4 aa, Mycobacterium
SGRY

SEQ ID NO: 1025930 - protein, 9 aa, Mycobacterium
SGSAAATEK

SEQ ID NO: 1025931 - protein, 13 aa, Mycobacterium
SGSAGADVAPEPV

SEQ ID NO: 1025932 - protein, 18 aa, Mycobacterium
SGSANSAASRQTATYRAI

SEQ ID NO: 1025933 - protein, 17 aa, Mycobacterium
SGSAREQITAAGGSVTE

SEQ ID NO: 1025934 - protein, 6 aa, Mycobacterium
SGSAVA

SEQ ID NO: 1025935 - protein, 6 aa, Mycobacterium
SGSDNI

SEQ ID NO: 1025936 - protein, 8 aa, Mycobacterium
SGSERAQS

SEQ ID NO: 1025937 - protein, 7 aa, Mycobacterium
SGSFNTG

SEQ ID NO: 1025938 - protein, 7 aa, Mycobacterium
SGSGDLA

SEQ ID NO: 1025939 - protein, 12 aa, Mycobacterium
SGSGDWEATKDD

SEQ ID NO: 1025940 - protein, 18 aa, Mycobacterium
SGSGEPYRCTCGDALVPV

SEQ ID NO: 1025941 - protein, 31 aa, Mycobacterium
SGSGGIGGGGGAGGQTDPLGGSTGGSGGVGG

SEQ ID NO: 1025942 - protein, 49 aa, Mycobacterium
SGSGGVGGAGGATSDVGAVAGAGGDGGAGGAGRLGSGATGGAGGAGGPW

SEQ ID NO: 1025943 - protein, 9 aa, Mycobacterium
SGSGGYNSG

SEQ ID NO: 1025944 - protein, 8 aa, Mycobacterium
SGSGKSSL

SEQ ID NO: 1025945 - protein, 6 aa, Mycobacterium
SGSGLG

SEQ ID NO: 1025946 - protein, 8 aa, Mycobacterium
SGSGPLRR

SEQ ID NO: 1025947 - protein, 6 aa, Mycobacterium
SGSGPT

SEQ ID NO: 1025948 - protein, 7 aa, Mycobacterium
SGSHAAY

SEQ ID NO: 1025949 - protein, 8 aa, Mycobacterium
SGSISDPK

SEQ ID NO: 1025950 - protein, 17 aa, Mycobacterium
SGSITEAARRLMAHDDL

SEQ ID NO: 1025951 - protein, 6 aa, Mycobacterium
SGSLAA

SEQ ID NO: 1025952 - protein, 9 aa, Mycobacterium
SGSLGTAVP

SEQ ID NO: 1025953 - protein, 5 aa, Mycobacterium
SGSMG

SEQ ID NO: 1025954 - protein, 5 aa, Mycobacterium
SGSNN

SEQ ID NO: 1025955 - protein, 4 aa, Mycobacterium
SGSP

SEQ ID NO: 1025956 - protein, 13 aa, Mycobacterium
SGSPVSRRTDVGT

SEQ ID NO: 1025957 - protein, 24 aa, Mycobacterium
SGSQTADRTPTATARIGPDGSATY

SEQ ID NO: 1025958 - protein, 18 aa, Mycobacterium
SGSRGGDGGDADRAVATP

SEQ ID NO: 1025959 - protein, 6 aa, Mycobacterium
SGSRMR

SEQ ID NO: 1025960 - protein, 10 aa, Mycobacterium
SGSSASATGG

SEQ ID NO: 1025961 - protein, 10 aa, Mycobacterium
SGSSGISGYQ

SEQ ID NO: 1025962 - protein, 16 aa, Mycobacterium
SGSSGTAAAKKEALEA

SEQ ID NO: 1025963 - protein, 9 aa, Mycobacterium
SGSTAQANA

SEQ ID NO: 1025964 - protein, 9 aa, Mycobacterium
SGSTDDTEI

SEQ ID NO: 1025965 - protein, 9 aa, Mycobacterium
SGSTGAPKG

SEQ ID NO: 1025966 - protein, 13 aa, Mycobacterium
SGSTGAPKGAMYP

SEQ ID NO: 1025967 - protein, 9 aa, Mycobacterium
SGSTGHPKA

SEQ ID NO: 1025968 - protein, 9 aa, Mycobacterium
SGSTGRPKA

SEQ ID NO: 1025969 - protein, 13 aa, Mycobacterium
SGSTGRPKAVTSS

SEQ ID NO: 1025970 - protein, 11 aa, Mycobacterium
SGSTGRPKGVE

SEQ ID NO: 1025971 - protein, 16 aa, Mycobacterium
SGSTNTGAGNSGEVNT

SEQ ID NO: 1025972 - protein, 8 aa, Mycobacterium
SGSTNTGL

SEQ ID NO: 1025973 - protein, 5 aa, Mycobacterium
SGSTP

SEQ ID NO: 1025974 - protein, 8 aa, Mycobacterium
SGSTQPGI

SEQ ID NO: 1025975 - protein, 9 aa, Mycobacterium
SGSTRTPAG

SEQ ID NO: 1025976 - protein, 11 aa, Mycobacterium
SGSTTDAPKSL

SEQ ID NO: 1025977 - protein, 5 aa, Mycobacterium
SGSVD

SEQ ID NO: 1025978 - protein, 8 aa, Mycobacterium
SGSYNSGL

SEQ ID NO: 1025979 - protein, 4 aa, Mycobacterium
SGTA

SEQ ID NO: 1025980 - protein, 5 aa, Mycobacterium
SGTAA

SEQ ID NO: 1025981 - protein, 6 aa, Mycobacterium
SGTAAR

SEQ ID NO: 1025982 - protein, 10 aa, Mycobacterium
SGTAEPDAAL

SEQ ID NO: 1025983 - protein, 6 aa, Mycobacterium
SGTAGF

SEQ ID NO: 1025984 - protein, 10 aa, Mycobacterium
SGTAQPGAAA

SEQ ID NO: 1025985 - protein, 6 aa, Mycobacterium
SGTARR

SEQ ID NO: 1025986 - protein, 5 aa, Mycobacterium
SGTAT

SEQ ID NO: 1025987 - protein, 4 aa, Mycobacterium
SGTC

SEQ ID NO: 1025988 - protein, 41 aa, Mycobacterium
SGTDNVGTDNVGIGNSGTGNSGIGNSGSYNTGIGNSGLANT

SEQ ID NO: 1025989 - protein, 10 aa, Mycobacterium
SGTDVSGYGN

SEQ ID NO: 1025990 - protein, 17 aa, Mycobacterium
SGTEADYQAAMREFGAS

SEQ ID NO: 1025991 - protein, 7 aa, Mycobacterium
SGTEANE

SEQ ID NO: 1025992 - protein, 6 aa, Mycobacterium
SGTEPA

SEQ ID NO: 1025993 - protein, 12 aa, Mycobacterium
SGTEPLNREQNP

SEQ ID NO: 1025994 - protein, 10 aa, Mycobacterium
SGTFDGRDPD

SEQ ID NO: 1025995 - protein, 32 aa, Mycobacterium; identical to SEQ ID NO: 916926

SEQ ID NO: 1025996 - protein, 16 aa, Mycobacterium
SGTGNFGIGNSGAYGT

SEQ ID NO: 1025997 - protein, 17 aa, Mycobacterium
SGTGNVGIGNSGTGNWG

SEQ ID NO: 1025998 - protein, 5 aa, Mycobacterium
SGTGR

SEQ ID NO: 1025999 - protein, 27 aa, Mycobacterium
SGTGSFGIGNSGNYNTGIGNAGATNTG

SEQ ID NO: 1026000 - protein, 15 aa, Mycobacterium
SGTGVPTSGLILAPA

SEQ ID NO: 1026001 - protein, 5 aa, Mycobacterium
SGTID

SEQ ID NO: 1026002 - protein, 5 aa, Mycobacterium
SGTNN

SEQ ID NO: 1026003 - protein, 8 aa, Mycobacterium
SGTNNTGI

SEQ ID NO: 1026004 - protein, 4 aa, Mycobacterium
SGTP

SEQ ID NO: 1026005 - protein, 7 aa, Mycobacterium
SGTPASE

SEQ ID NO: 1026006 - protein, 6 aa, Mycobacterium
SGTQPA

SEQ ID NO: 1026007 - protein, 15 aa, Mycobacterium
SGTRPTHILNPEVLA

SEQ ID NO: 1026008 - protein, 14 aa, Mycobacterium
SGTSGAGRAAKTDL

SEQ ID NO: 1026009 - protein, 11 aa, Mycobacterium
SGTSGDPKAVK

SEQ ID NO: 1026010 - protein, 11 aa, Mycobacterium
SGTSSARQRRA

SEQ ID NO: 1026011 - protein, 8 aa, Mycobacterium
SGTTGFPK

SEQ ID NO: 1026012 - protein, 8 aa, Mycobacterium
SGTTGHPK

SEQ ID NO: 1026013 - protein, 12 aa, Mycobacterium
SGTTGKPKGAEL

SEQ ID NO: 1026014 - protein, 10 aa, Mycobacterium
SGTTGKPKGI

SEQ ID NO: 1026015 - protein, 11 aa, Mycobacterium
SGTTGNPKGVE

SEQ ID NO: 1026016 - protein, 10 aa, Mycobacterium
SGTTGPPNRV

SEQ ID NO: 1026017 - protein, 8 aa, Mycobacterium
SGTTGRSK

SEQ ID NO: 1026018 - protein, 9 aa, Mycobacterium
SGTTGTPKG

SEQ ID NO: 1026019 - protein, 9 aa, Mycobacterium
SGTTGVPKG

SEQ ID NO: 1026020 - protein, 17 aa, Mycobacterium
SGTTMRSRGGPNHRSRP

SEQ ID NO: 1026021 - protein, 6 aa, Mycobacterium
SGTTSI

SEQ ID NO: 1026022 - protein, 8 aa, Mycobacterium
SGVADSTQ

SEQ ID NO: 1026023 - protein, 6 aa, Mycobacterium
SGVANP

SEQ ID NO: 1026024 - protein, 6 aa, Mycobacterium
SGVEDR

SEQ ID NO: 1026025 - protein, 8 aa, Mycobacterium
SGVETGSV

SEQ ID NO: 1026026 - protein, 14 aa, Mycobacterium
SGVGAKDRMPSPYL

SEQ ID NO: 1026027 - protein, 6 aa, Mycobacterium
SGVGES

SEQ ID NO: 1026028 - protein, 49 aa, Mycobacterium
SGVGGAGGAGGQWYGNGGDGGTSWGGAAAGAGGDAGLIDNGGDGDSAGV

SEQ ID NO: 1026029 - protein, 9 aa, Mycobacterium
SGVPTPSAS

SEQ ID NO: 1026030 - protein, 7 aa, Mycobacterium
SGVRGTN

SEQ ID NO: 1026031 - protein, 8 aa, Mycobacterium
SGVSEPFS

SEQ ID NO: 1026032 - protein, 8 aa, Mycobacterium
SGVTEPFS

SEQ ID NO: 1026033 - protein, 7 aa, Mycobacterium
SGVTQDR

SEQ ID NO: 1026034 - protein, 4 aa, Mycobacterium
SGYA

SEQ ID NO: 1026035 - protein, 10 aa, Mycobacterium
SGYDESTGIP

SEQ ID NO: 1026036 - protein, 6 aa, Mycobacterium
SGYDRD

SEQ ID NO: 1026037 - protein, 4 aa, Mycobacterium
SGYE

SEQ ID NO: 1026038 - protein, 4 aa, Mycobacterium
SGYG

SEQ ID NO: 1026039 - protein, 7 aa, Mycobacterium
SGYGGNA

SEQ ID NO: 1026040 - protein, 4 aa, Mycobacterium
SGYN

SEQ ID NO: 1026041 - protein, 17 aa, Mycobacterium
SGYPDRPYDGVDDNAYT

SEQ ID NO: 1026042 - protein, 8 aa, Mycobacterium
SGYSDSEL

SEQ ID NO: 1026043 - protein, 7 aa, Mycobacterium
SHAGPRS

SEQ ID NO: 1026044 - protein, 10 aa, Mycobacterium
SHAGRSFDSN

SEQ ID NO: 1026045 - protein, 18 aa, Mycobacterium
SHAPTDVDPDGSNALSAA

SEQ ID NO: 1026046 - protein, 6 aa, Mycobacterium
SHASAA

SEQ ID NO: 1026047 - protein, 9 aa, Mycobacterium
SHATGRPLP

SEQ ID NO: 1026048 - protein, 7 aa, Mycobacterium
SHCSTRT

SEQ ID NO: 1026049 - protein, 5 aa, Mycobacterium
SHDAD

SEQ ID NO: 1026050 - protein, 18 aa, Mycobacterium
SHDDGTGHLDIESIRDRH

SEQ ID NO: 1026051 - protein, 4 aa, Mycobacterium
SHDE

SEQ ID NO: 1026052 - protein, 9 aa, Mycobacterium
SHDGAGTTA

SEQ ID NO: 1026053 - protein, 11 aa, Mycobacterium
SHDVEGATAHG

SEQ ID NO: 1026054 - protein, 7 aa, Mycobacterium
SHEGGIA

SEQ ID NO: 1026055 - protein, 14 aa, Mycobacterium
SHERRAVTDPTKRH

SEQ ID NO: 1026056 - protein, 4 aa, Mycobacterium
SHET

SEQ ID NO: 1026057 - protein, 6 aa, Mycobacterium
SHGGDP

SEQ ID NO: 1026058 - protein, 7 aa, Mycobacterium
SHGGTRD

SEQ ID NO: 1026059 - protein, 5 aa, Mycobacterium
SHGQG

SEQ ID NO: 1026060 - protein, 12 aa, Mycobacterium
SHGSGPELTGSA

SEQ ID NO: 1026061 - protein, 6 aa, Mycobacterium
SHGSTL

SEQ ID NO: 1026062 - protein, 7 aa, Mycobacterium
SHHERSS

SEQ ID NO: 1026063 - protein, 56 aa, Mycobacterium
SHHRPPPPELPPAPPGPPPARPEAPPQSPTAEAEPPDEAMPVSGPPPGGKSPLPPM

SEQ ID NO: 1026064 - protein, 8 aa, Mycobacterium
SHKPYAQR

SEQ ID NO: 1026065 - protein, 16 aa, Mycobacterium
SHNESDPGALAPGRTT

SEQ ID NO: 1026066 - protein, 4 aa, Mycobacterium
SHPA

SEQ ID NO: 1026067 - protein, 17 aa, Mycobacterium
SHPAEPANEFNRATAKT

SEQ ID NO: 1026068 - protein, 6 aa, Mycobacterium
SHPAIG

SEQ ID NO: 1026069 - protein, 7 aa, Mycobacterium
SHPAIPP

SEQ ID NO: 1026070 - protein, 6 aa, Mycobacterium
SHPATG

SEQ ID NO: 1026071 - protein, 4 aa, Mycobacterium
SHPD

SEQ ID NO: 1026072 - protein, 13 aa, Mycobacterium
SHPESDSVEVTYD

SEQ ID NO: 1026073 - protein, 7 aa, Mycobacterium
SHPEYAT

SEQ ID NO: 1026074 - protein, 5 aa, Mycobacterium
SHPGV

SEQ ID NO: 1026075 - protein, 21 aa, Mycobacterium
SHPPSSTSIPVSRPCPSTCRS

SEQ ID NO: 1026076 - protein, 13 aa, Mycobacterium
SHQRQRSFAQSSK

SEQ ID NO: 1026077 - protein, 4 aa, Mycobacterium
SHQT

SEQ ID NO: 1026078 - protein, 9 aa, Mycobacterium
SHRNTGKAC

SEQ ID NO: 1026079 - protein, 14 aa, Mycobacterium
SHRNTGKASNDPIA

SEQ ID NO: 1026080 - protein, 12 aa, Mycobacterium
SHRPAGLPDPGP

SEQ ID NO: 1026081 - protein, 8 aa, Mycobacterium
SHRVGTDA

SEQ ID NO: 1026082 - protein, 7 aa, Mycobacterium
SHSPQVD

SEQ ID NO: 1026083 - protein, 18 aa, Mycobacterium
SHTERTTARRLSASPPGV

SEQ ID NO: 1026084 - protein, 10 aa, Mycobacterium
SHTGAVPELS

SEQ ID NO: 1026085 - protein, 7 aa, Mycobacterium
SHTPVGP

SEQ ID NO: 1026086 - protein, 7 aa, Mycobacterium
SHTSTHG

SEQ ID NO: 1026087 - protein, 6 aa, Mycobacterium
SIAAAS

SEQ ID NO: 1026088 - protein, 17 aa, Mycobacterium
SIAAGQSPFPADGRDPW

SEQ ID NO: 1026089 - protein, 6 aa, Mycobacterium
SIAGEK

SEQ ID NO: 1026090 - protein, 15 aa, Mycobacterium
SIDGRSAAADGSSQW

SEQ ID NO: 1026091 - protein, 4 aa, Mycobacterium
SIDP

SEQ ID NO: 1026092 - protein, 7 aa, Mycobacterium
SIDPNSG

SEQ ID NO: 1026093 - protein, 17 aa, Mycobacterium
SIDPSRRSYDVTATGAA

SEQ ID NO: 1026094 - protein, 14 aa, Mycobacterium
SIDTGDKMATTAGS

SEQ ID NO: 1026095 - protein, 5 aa, Mycobacterium
SIEDD

SEQ ID NO: 1026096 - protein, 11 aa, Mycobacterium
SIEQGNNDSHA

SEQ ID NO: 1026097 - protein, 5 aa, Mycobacterium
SIESP

SEQ ID NO: 1026098 - protein, 13 aa, Mycobacterium
SIESPHPSPLSAS

SEQ ID NO: 1026099 - protein, 9 aa, Mycobacterium
SIGAGNTAS

SEQ ID NO: 1026100 - protein, 4 aa, Mycobacterium
SIGR

SEQ ID NO: 1026101 - protein, 9 aa, Mycobacterium
SIGSDDPAV

SEQ ID NO: 1026102 - protein, 12 aa, Mycobacterium
SIGSSETGFGGT

SEQ ID NO: 1026103 - protein, 7 aa, Mycobacterium
SIGSTDN

SEQ ID NO: 1026104 - protein, 12 aa, Mycobacterium
SIKPGDPDDART

SEQ ID NO: 1026105 - protein, 8 aa, Mycobacterium
SIKSTKCA

SEQ ID NO: 1026106 - protein, 7 aa, Mycobacterium
SINPPTL

SEQ ID NO: 1026107 - protein, 4 aa, Mycobacterium
SINT

SEQ ID NO: 1026108 - protein, 6 aa, Mycobacterium
SIPFPD

SEQ ID NO: 1026109 - protein, 11 aa, Mycobacterium
SIPGANRDGDS

SEQ ID NO: 1026110 - protein, 5 aa, Mycobacterium
SIPGV

SEQ ID NO: 1026111 - protein, 12 aa, Mycobacterium
SIPLTTSGKVRR

SEQ ID NO: 1026112 - protein, 7 aa, Mycobacterium
SIRSSNT

SEQ ID NO: 1026113 - protein, 6 aa, Mycobacterium
SIRTST

SEQ ID NO: 1026114 - protein, 4 aa, Mycobacterium
SISA

SEQ ID NO: 1026115 - protein, 7 aa, Mycobacterium
SISPDEL

SEQ ID NO: 1026116 - protein, 7 aa, Mycobacterium
SITAGEI

SEQ ID NO: 1026117 - protein, 10 aa, Mycobacterium
SITAPDGRPI

SEQ ID NO: 1026118 - protein, 7 aa, Mycobacterium
SITDRRQ

SEQ ID NO: 1026119 - protein, 6 aa, Mycobacterium
SITPEL

SEQ ID NO: 1026120 - protein, 10 aa, Mycobacterium
SITPPGGESF

SEQ ID NO: 1026121 - protein, 4 aa, Mycobacterium
SITT

SEQ ID NO: 1026122 - protein, 9 aa, Mycobacterium
SIYGGSNEV

SEQ ID NO: 1026123 - protein, 7 aa, Mycobacterium
SKAALSA

SEQ ID NO: 1026124 - protein, 19 aa, Mycobacterium
SKAALSSVTKNLSKSLAKD

SEQ ID NO: 1026125 - protein, 12 aa, Mycobacterium
SKAATADTAATS

SEQ ID NO: 1026126 - protein, 8 aa, Mycobacterium
SKAEIDTT

SEQ ID NO: 1026127 - protein, 8 aa, Mycobacterium
SKAERHQR

SEQ ID NO: 1026128 - protein, 24 aa, Mycobacterium
SKAGNGDAVVRPSGAGIHEVDVKI

SEQ ID NO: 1026129 - protein, 14 aa, Mycobacterium
SKAGYRNDSRLASR

SEQ ID NO: 1026130 - protein, 4 aa, Mycobacterium
SKAL

SEQ ID NO: 1026131 - protein, 8 aa, Mycobacterium
SKARAAAQ

SEQ ID NO: 1026132 - protein, 10 aa, Mycobacterium
SKASASTKVA

SEQ ID NO: 1026133 - protein, 6 aa, Mycobacterium
SKASER

SEQ ID NO: 1026134 - protein, 10 aa, Mycobacterium
SKASESPNHR

SEQ ID NO: 1026135 - protein, 8 aa, Mycobacterium
SKATPSQL

SEQ ID NO: 1026136 - protein, 5 aa, Mycobacterium
SKDAR

SEQ ID NO: 1026137 - protein, 5 aa, Mycobacterium
SKDAT

SEQ ID NO: 1026138 - protein, 9 aa, Mycobacterium
SKDERARAA

SEQ ID NO: 1026139 - protein, 14 aa, Mycobacterium
SKDGPRGVLCSLRI

SEQ ID NO: 1026140 - protein, 7 aa, Mycobacterium
SKDGRRN

SEQ ID NO: 1026141 - protein, 13 aa, Mycobacterium
SKDQAREELANEP

SEQ ID NO: 1026142 - protein, 7 aa, Mycobacterium
SKDRIAN

SEQ ID NO: 1026143 - protein, 9 aa, Mycobacterium
SKDSATPVN

SEQ ID NO: 1026144 - protein, 4 aa, Mycobacterium
SKDT

SEQ ID NO: 1026145 - protein, 4 aa, Mycobacterium
SKEG

SEQ ID NO: 1026146 - protein, 11 aa, Mycobacterium
SKEQADSGGNM

SEQ ID NO: 1026147 - protein, 10 aa, Mycobacterium
SKGASDAEIK

SEQ ID NO: 1026148 - protein, 15 aa, Mycobacterium
SKGDKAKVVPTDAQP

SEQ ID NO: 1026149 - protein, 4 aa, Mycobacterium
SKGE

SEQ ID NO: 1026150 - protein, 31 aa, Mycobacterium
SKGGDGGTGGDGGTGTPVGADGLAGTGGAGG

SEQ ID NO: 1026151 - protein, 8 aa, Mycobacterium
SKGGSAKN

SEQ ID NO: 1026152 - protein, 5 aa, Mycobacterium
SKGGT

SEQ ID NO: 1026153 - protein, 7 aa, Mycobacterium
SKGGYEA

SEQ ID NO: 1026154 - protein, 18 aa, Mycobacterium
SKGLPPIGSGLAPGTGIR

SEQ ID NO: 1026155 - protein, 24 aa, Mycobacterium
SKGNAPNNIGADPERSAAWAAAIS

SEQ ID NO: 1026156 - protein, 10 aa, Mycobacterium
SKGNSVTSGV

SEQ ID NO: 1026157 - protein, 9 aa, Mycobacterium
SKGRQTRQA

SEQ ID NO: 1026158 - protein, 9 aa, Mycobacterium
SKGRSAQVA

SEQ ID NO: 1026159 - protein, 7 aa, Mycobacterium
SKHAPTA

SEQ ID NO: 1026160 - protein, 4 aa, Mycobacterium
SKIA

SEQ ID NO: 1026161 - protein, 11 aa, Mycobacterium
SKIARDGAGTI

SEQ ID NO: 1026162 - protein, 4 aa, Mycobacterium
SKIE

SEQ ID NO: 1026163 - protein, 5 aa, Mycobacterium
SKIPT

SEQ ID NO: 1026164 - protein, 10 aa, Mycobacterium
SKITGTLPTD

SEQ ID NO: 1026165 - protein, 8 aa, Mycobacterium
SKMPPRGL

SEQ ID NO: 1026166 - protein, 6 aa, Mycobacterium
SKNGAY

SEQ ID NO: 1026167 - protein, 13 aa, Mycobacterium
SKNGEFVAYVVGK

SEQ ID NO: 1026168 - protein, 8 aa, Mycobacterium
SKNGHPID

SEQ ID NO: 1026169 - protein, 6 aa, Mycobacterium
SKNTVS

SEQ ID NO: 1026170 - protein, 4 aa, Mycobacterium
SKPG

SEQ ID NO: 1026171 - protein, 8 aa, Mycobacterium
SKPGTYGA

SEQ ID NO: 1026172 - protein, 31 aa, Mycobacterium
SKPKNRSNRIQESSMTSATIPGLDTAPTNHQ

SEQ ID NO: 1026173 - protein, 12 aa, Mycobacterium
SKPNPKTATNAG

SEQ ID NO: 1026174 - protein, 8 aa, Mycobacterium
SKPPKPAV

SEQ ID NO: 1026175 - protein, 17 aa, Mycobacterium
SKPPRPLEETEIPAGGV

SEQ ID NO: 1026176 - protein, 8 aa, Mycobacterium
SKPRPSDI

SEQ ID NO: 1026177 - protein, 6 aa, Mycobacterium
SKPRVK

SEQ ID NO: 1026178 - protein, 21 aa, Mycobacterium
SKPSIKQEGQGDTVNESIPGG

SEQ ID NO: 1026179 - protein, 6 aa, Mycobacterium
SKQGRW

SEQ ID NO: 1026180 - protein, 7 aa, Mycobacterium
SKQGVHQ

SEQ ID NO: 1026181 - protein, 26 aa, Mycobacterium
SKQRDEYRQRSQNLASGGDLKNLFTL

SEQ ID NO: 1026182 - protein, 6 aa, Mycobacterium
SKQRGR

SEQ ID NO: 1026183 - protein, 9 aa, Mycobacterium
SKQTAAPSI

SEQ ID NO: 1026184 - protein, 4 aa, Mycobacterium
SKQV

SEQ ID NO: 1026185 - protein, 6 aa, Mycobacterium
SKRGGG

SEQ ID NO: 1026186 - protein, 9 aa, Mycobacterium
SKRNPDGTG

SEQ ID NO: 1026187 - protein, 17 aa, Mycobacterium
SKRPGSARLSSTGRAAC

SEQ ID NO: 1026188 - protein, 11 aa, Mycobacterium
SKRPGVTKPSL

SEQ ID NO: 1026189 - protein, 16 aa, Mycobacterium
SKRRTRDMIATLATEV

SEQ ID NO: 1026190 - protein, 9 aa, Mycobacterium
SKRSKRMTA

SEQ ID NO: 1026191 - protein, 8 aa, Mycobacterium
SKSDPQFA

SEQ ID NO: 1026192 - protein, 17 aa, Mycobacterium
SKSGGQQVGSGHFGGQG

SEQ ID NO: 1026193 - protein, 6 aa, Mycobacterium
SKSIRG

SEQ ID NO: 1026194 - protein, 6 aa, Mycobacterium
SKSPRC

SEQ ID NO: 1026195 - protein, 6 aa, Mycobacterium
SKSPVA

SEQ ID NO: 1026196 - protein, 8 aa, Mycobacterium
SKSSSLAG

SEQ ID NO: 1026197 - protein, 6 aa, Mycobacterium
SKSTVR

SEQ ID NO: 1026198 - protein, 20 aa, Mycobacterium
SKTCSRAKARDLPSARPGWA

SEQ ID NO: 1026199 - protein, 4 aa, Mycobacterium
SKTF

SEQ ID NO: 1026200 - protein, 7 aa, Mycobacterium
SKTMSRG

SEQ ID NO: 1026201 - protein, 8 aa, Mycobacterium
SKTMSRGF

SEQ ID NO: 1026202 - protein, 7 aa, Mycobacterium
SKTSEQE

SEQ ID NO: 1026203 - protein, 5 aa, Mycobacterium
SKTYG

SEQ ID NO: 1026204 - protein, 9 aa, Mycobacterium
SKVEPRDRQ

SEQ ID NO: 1026205 - protein, 6 aa, Mycobacterium
SKVGPM

SEQ ID NO: 1026206 - protein, 11 aa, Mycobacterium
SKVNALGPTMQ

SEQ ID NO: 1026207 - protein, 6 aa, Mycobacterium
SKVPEI

SEQ ID NO: 1026208 - protein, 6 aa, Mycobacterium
SKVSDK

SEQ ID NO: 1026209 - protein, 13 aa, Mycobacterium
SKWKPQHSPSPAE

SEQ ID NO: 1026210 - protein, 14 aa, Mycobacterium
SKYGEVTKSYDDHP

SEQ ID NO: 1026211 - protein, 11 aa, Mycobacterium
SLAAAKSKSAL

SEQ ID NO: 1026212 - protein, 8 aa, Mycobacterium
SLAESGTP

SEQ ID NO: 1026213 - protein, 17 aa, Mycobacterium
SLAGGGAGGDGGVGGGG

SEQ ID NO: 1026214 - protein, 6 aa, Mycobacterium
SLAGTQ

SEQ ID NO: 1026215 - protein, 20 aa, Mycobacterium
SLAKADEGVRARAIEFLDSR

SEQ ID NO: 1026216 - protein, 5 aa, Mycobacterium
SLANG

SEQ ID NO: 1026217 - protein, 8 aa, Mycobacterium
SLANTASG

SEQ ID NO: 1026218 - protein, 9 aa, Mycobacterium
SLASGQKPT

SEQ ID NO: 1026219 - protein, 8 aa, Mycobacterium
SLASPQIA

SEQ ID NO: 1026220 - protein, 5 aa, Mycobacterium
SLATD

SEQ ID NO: 1026221 - protein, 10 aa, Mycobacterium
SLATGRELGG

SEQ ID NO: 1026222 - protein, 8 aa, Mycobacterium
SLDDTSKA

SEQ ID NO: 1026223 - protein, 16 aa, Mycobacterium
SLDEPGGHGMPSSTPI

SEQ ID NO: 1026224 - protein, 13 aa, Mycobacterium
SLDGGTLPRSTRE

SEQ ID NO: 1026225 - protein, 5 aa, Mycobacterium
SLDGR

SEQ ID NO: 1026226 - protein, 9 aa, Mycobacterium
SLDGSPDLD

SEQ ID NO: 1026227 - protein, 8 aa, Mycobacterium
SLDQGGPC

SEQ ID NO: 1026228 - protein, 7 aa, Mycobacterium
SLDSGPV

SEQ ID NO: 1026229 - protein, 7 aa, Mycobacterium
SLDTATA

SEQ ID NO: 1026230 - protein, 5 aa, Mycobacterium
SLDTS

SEQ ID NO: 1026231 - protein, 16 aa, Mycobacterium
SLDTTDSVGDSGGDSI

SEQ ID NO: 1026232 - protein, 6 aa, Mycobacterium
SLEENQ

SEQ ID NO: 1026233 - protein, 6 aa, Mycobacterium
SLEGED

SEQ ID NO: 1026234 - protein, 14 aa, Mycobacterium
SLEPGDRVHTTSGL

SEQ ID NO: 1026235 - protein, 15 aa, Mycobacterium
SLEPRPPSESLSPDA

SEQ ID NO: 1026236 - protein, 4 aa, Mycobacterium
SLGD

SEQ ID NO: 1026237 - protein, 5 aa, Mycobacterium
SLGDG

SEQ ID NO: 1026238 - protein, 5 aa, Mycobacterium
SLGEG

SEQ ID NO: 1026239 - protein, 6 aa, Mycobacterium
SLGERH

SEQ ID NO: 1026240 - protein, 8 aa, Mycobacterium
SLGESATY

SEQ ID NO: 1026241 - protein, 11 aa, Mycobacterium
SLGGAGASARE

SEQ ID NO: 1026242 - protein, 19 aa, Mycobacterium
SLGGAVGASRAAVDSGYYP

SEQ ID NO: 1026243 - protein, 7 aa, Mycobacterium
SLGGGTA

SEQ ID NO: 1026244 - protein, 11 aa, Mycobacterium
SLGGPETHHKK

SEQ ID NO: 1026245 - protein, 9 aa, Mycobacterium
SLGLGGDPR

SEQ ID NO: 1026246 - protein, 10 aa, Mycobacterium
SLGPDAAANV

SEQ ID NO: 1026247 - protein, 8 aa, Mycobacterium
SLGPETTK

SEQ ID NO: 1026248 - protein, 8 aa, Mycobacterium
SLGPTTRF

SEQ ID NO: 1026249 - protein, 15 aa, Mycobacterium
SLGRRRTGGGDGGRA

SEQ ID NO: 1026250 - protein, 8 aa, Mycobacterium
SLGRSEGA

SEQ ID NO: 1026251 - protein, 9 aa, Mycobacterium
SLGSEGALQ

SEQ ID NO: 1026252 - protein, 7 aa, Mycobacterium
SLGSQQD

SEQ ID NO: 1026253 - protein, 12 aa, Mycobacterium
SLGTDPAELQSR

SEQ ID NO: 1026254 - protein, 5 aa, Mycobacterium
SLGTS

SEQ ID NO: 1026255 - protein, 6 aa, Mycobacterium
SLHGDT

SEQ ID NO: 1026256 - protein, 12 aa, Mycobacterium
SLKRRKGEKLPV

SEQ ID NO: 1026257 - protein, 11 aa, Mycobacterium
SLLGSPGQTAY

SEQ ID NO: 1026258 - protein, 6 aa, Mycobacterium
SLLPSA

SEQ ID NO: 1026259 - protein, 15 aa, Mycobacterium
SLNEATSDADGFHHR

SEQ ID NO: 1026260 - protein, 6 aa, Mycobacterium
SLNEPA

SEQ ID NO: 1026261 - protein, 5 aa, Mycobacterium
SLNGG

SEQ ID NO: 1026262 - protein, 14 aa, Mycobacterium
SLNGGAAAAADPLS

SEQ ID NO: 1026263 - protein, 4 aa, Mycobacterium
SLNP

SEQ ID NO: 1026264 - protein, 7 aa, Mycobacterium
SLNTGPF

SEQ ID NO: 1026265 - protein, 4 aa, Mycobacterium
SLPA

SEQ ID NO: 1026266 - protein, 5 aa, Mycobacterium
SLPAQ

SEQ ID NO: 1026267 - protein, 10 aa, Mycobacterium
SLPAQDDSLS

SEQ ID NO: 1026268 - protein, 12 aa, Mycobacterium
SLPDTPSAQTAV

SEQ ID NO: 1026269 - protein, 10 aa, Mycobacterium
SLPEEAKSMA

SEQ ID NO: 1026270 - protein, 8 aa, Mycobacterium
SLPEQRQR

SEQ ID NO: 1026271 - protein, 6 aa, Mycobacterium
SLPGAL

SEQ ID NO: 1026272 - protein, 16 aa, Mycobacterium
SLPGQAATLSGHTSQY

SEQ ID NO: 1026273 - protein, 11 aa, Mycobacterium
SLPPADEVGAG

SEQ ID NO: 1026274 - protein, 9 aa, Mycobacterium
SLPPASAGP

SEQ ID NO: 1026275 - protein, 5 aa, Mycobacterium
SLPPE

SEQ ID NO: 1026276 - protein, 6 aa, Mycobacterium
SLPPLS

SEQ ID NO: 1026277 - protein, 5 aa, Mycobacterium
SLPRP

SEQ ID NO: 1026278 - protein, 7 aa, Mycobacterium
SLPRQPQ

SEQ ID NO: 1026279 - protein, 5 aa, Mycobacterium
SLQDK

SEQ ID NO: 1026280 - protein, 5 aa, Mycobacterium
SLQGQ

SEQ ID NO: 1026281 - protein, 8 aa, Mycobacterium
SLQQRRPT

SEQ ID NO: 1026282 - protein, 6 aa, Mycobacterium
SLQTGG

SEQ ID NO: 1026283 - protein, 17 aa, Mycobacterium
SLQTGQSLTSITPKSDR

SEQ ID NO: 1026284 - protein, 4 aa, Mycobacterium
SLRE

SEQ ID NO: 1026285 - protein, 5 aa, Mycobacterium
SLRES

SEQ ID NO: 1026286 - protein, 14 aa, Mycobacterium
SLRGSTQQAGQSDH

SEQ ID NO: 1026287 - protein, 7 aa, Mycobacterium
SLRPSET

SEQ ID NO: 1026288 - protein, 8 aa, Mycobacterium
SLRRGGGE

SEQ ID NO: 1026289 - protein, 8 aa, Mycobacterium
SLRSQAAR

SEQ ID NO: 1026290 - protein, 5 aa, Mycobacterium
SLRSR

SEQ ID NO: 1026291 - protein, 9 aa, Mycobacterium
SLSARQRRR

SEQ ID NO: 1026292 - protein, 17 aa, Mycobacterium
SLSASASWAANGKITAD

SEQ ID NO: 1026293 - protein, 8 aa, Mycobacterium
SLSEAGQD

SEQ ID NO: 1026294 - protein, 9 aa, Mycobacterium
SLSGGAKEQ

SEQ ID NO: 1026295 - protein, 9 aa, Mycobacterium
SLSGLSAEQ

SEQ ID NO: 1026296 - protein, 14 aa, Mycobacterium
SLSGSGGPPPGGDG

SEQ ID NO: 1026297 - protein, 13 aa, Mycobacterium
SLSPDRAETIRPS

SEQ ID NO: 1026298 - protein, 6 aa, Mycobacterium
SLSRDG

SEQ ID NO: 1026299 - protein, 25 aa, Mycobacterium
SLSRSGPTTGTPVLPPDGIASATAA

SEQ ID NO: 1026300 - protein, 20 aa, Mycobacterium
SLSTASSPTAAVAEPASLIG

SEQ ID NO: 1026301 - protein, 16 aa, Mycobacterium
SLSTGQAKQCESGAGT

SEQ ID NO: 1026302 - protein, 5 aa, Mycobacterium
SLTAG

SEQ ID NO: 1026303 - protein, 17 aa, Mycobacterium
SLTEEEIGEYSGERKEI

SEQ ID NO: 1026304 - protein, 13 aa, Mycobacterium
SLTGHGPDGRPGK

SEQ ID NO: 1026305 - protein, 5 aa, Mycobacterium
SLTGN

SEQ ID NO: 1026306 - protein, 5 aa, Mycobacterium
SLTGS

SEQ ID NO: 1026307 - protein, 7 aa, Mycobacterium
SLTGSAA

SEQ ID NO: 1026308 - protein, 7 aa, Mycobacterium
SLTNGNH

SEQ ID NO: 1026309 - protein, 7 aa, Mycobacterium
SLTPEQP

SEQ ID NO: 1026310 - protein, 5 aa, Mycobacterium
SLTPP

SEQ ID NO: 1026311 - protein, 39 aa, Mycobacterium
SLTPPAPPVPPPPPLPAAPPVPNAAKPPLPPTPPAPPAP

SEQ ID NO: 1026312 - protein, 6 aa, Mycobacterium
SLTQAA

SEQ ID NO: 1026313 - protein, 18 aa, Mycobacterium
SMAGPSGAIAGAQPADHG

SEQ ID NO: 1026314 - protein, 5 aa, Mycobacterium
SMAGS

SEQ ID NO: 1026315 - protein, 6 aa, Mycobacterium
SMDPSR

SEQ ID NO: 1026316 - protein, 4 aa, Mycobacterium
SMEP

SEQ ID NO: 1026317 - protein, 12 aa, Mycobacterium
SMGKPSRPTPIG

SEQ ID NO: 1026318 - protein, 8 aa, Mycobacterium
SMGNPENE

SEQ ID NO: 1026319 - protein, 10 aa, Mycobacterium
SMGQEDDGLD

SEQ ID NO: 1026320 - protein, 8 aa, Mycobacterium
SMHSTGRV

SEQ ID NO: 1026321 - protein, 6 aa, Mycobacterium
SMITGT

SEQ ID NO: 1026322 - protein, 14 aa, Mycobacterium
SMNPPTCDAAAFSA

SEQ ID NO: 1026323 - protein, 9 aa, Mycobacterium
SMPKPKRRY

SEQ ID NO: 1026324 - protein, 13 aa, Mycobacterium
SMPPPQLDPAEPA

SEQ ID NO: 1026325 - protein, 5 aa, Mycobacterium
SMPQK

SEQ ID NO: 1026326 - protein, 6 aa, Mycobacterium
SMPYKS

SEQ ID NO: 1026327 - protein, 4 aa, Mycobacterium
SMRS

SEQ ID NO: 1026328 - protein, 5 aa, Mycobacterium
SMSDE

SEQ ID NO: 1026329 - protein, 5 aa, Mycobacterium
SMSDN

SEQ ID NO: 1026330 - protein, 5 aa, Mycobacterium
SMSNP

SEQ ID NO: 1026331 - protein, 7 aa, Mycobacterium
SMSSAPR

SEQ ID NO: 1026332 - protein, 6 aa, Mycobacterium
SMTEDG

SEQ ID NO: 1026333 - protein, 10 aa, Mycobacterium
SMTGHAKGGA

SEQ ID NO: 1026334 - protein, 13 aa, Mycobacterium
SMTPAARRTAGPC

SEQ ID NO: 1026335 - protein, 7 aa, Mycobacterium
SMTPEET

SEQ ID NO: 1026336 - protein, 6 aa, Mycobacterium
SMTPVS

SEQ ID NO: 1026337 - protein, 12 aa, Mycobacterium
SMTQGMDTGETM

SEQ ID NO: 1026338 - protein, 10 aa, Mycobacterium
SMTTNGLSTQ

SEQ ID NO: 1026339 - protein, 6 aa, Mycobacterium
SNADQL

SEQ ID NO: 1026340 - protein, 6 aa, Mycobacterium
SNAEFG

SEQ ID NO: 1026341 - protein, 4 aa, Mycobacterium
SNAG

SEQ ID NO: 1026342 - protein, 8 aa, Mycobacterium
SNAGAQGA

SEQ ID NO: 1026343 - protein, 9 aa, Mycobacterium
SNAGPITNA

SEQ ID NO: 1026344 - protein, 20 aa, Mycobacterium
SNAGSAYAAAEAAAASPLAT

SEQ ID NO: 1026345 - protein, 5 aa, Mycobacterium
SNAQN

SEQ ID NO: 1026346 - protein, 7 aa, Mycobacterium
SNATPIE

SEQ ID NO: 1026347 - protein, 7 aa, Mycobacterium
SNAVDRE

SEQ ID NO: 1026348 - protein, 4 aa, Mycobacterium
SNDA

SEQ ID NO: 1026349 - protein, 7 aa, Mycobacterium
SNDGDRD

SEQ ID NO: 1026350 - protein, 14 aa, Mycobacterium
SNDHDVNNQRRGYK

SEQ ID NO: 1026351 - protein, 12 aa, Mycobacterium
SNDLGGLQAPEN

SEQ ID NO: 1026352 - protein, 8 aa, Mycobacterium
SNDPNQLG

SEQ ID NO: 1026353 - protein, 8 aa, Mycobacterium
SNDPTSVA

SEQ ID NO: 1026354 - protein, 5 aa, Mycobacterium
SNEDF

SEQ ID NO: 1026355 - protein, 21 aa, Mycobacterium
SNEKLRNKRAYSHSGYPGGLR

SEQ ID NO: 1026356 - protein, 5 aa, Mycobacterium
SNERL

SEQ ID NO: 1026357 - protein, 10 aa, Mycobacterium
SNESAAVGLP

SEQ ID NO: 1026358 - protein, 6 aa, Mycobacterium
SNESRD

SEQ ID NO: 1026359 - protein, 5 aa, Mycobacterium
SNFKG

SEQ ID NO: 1026360 - protein, 11 aa, Mycobacterium
SNFRPPSDPRT

SEQ ID NO: 1026361 - protein, 5 aa, Mycobacterium
SNGAM

SEQ ID NO: 1026362 - protein, 7 aa, Mycobacterium
SNGARQH

SEQ ID NO: 1026363 - protein, 9 aa, Mycobacterium
SNGDHTHGN

SEQ ID NO: 1026364 - protein, 28 aa, Mycobacterium
SNGGAAGNGGSAGLVGNGGAGGAGGQGG

SEQ ID NO: 1026365 - protein, 10 aa, Mycobacterium
SNGGDGGQGG

SEQ ID NO: 1026366 - protein, 4 aa, Mycobacterium
SNGH

SEQ ID NO: 1026367 - protein, 28 aa, Mycobacterium
SNGLGASVKRREDTHKMAEANRAFAHYR

SEQ ID NO: 1026368 - protein, 16 aa, Mycobacterium
SNGLSGEPYLWRTVTA

SEQ ID NO: 1026369 - protein, 6 aa, Mycobacterium
SNGQTL

SEQ ID NO: 1026370 - protein, 9 aa, Mycobacterium
SNGSRPASV

SEQ ID NO: 1026371 - protein, 4 aa, Mycobacterium
SNGT

SEQ ID NO: 1026372 - protein, 19 aa, Mycobacterium
SNGTGTTGLAATAASQLKR

SEQ ID NO: 1026373 - protein, 15 aa, Mycobacterium
SNGVGGETYRTDPVD

SEQ ID NO: 1026374 - protein, 4 aa, Mycobacterium
SNGW

SEQ ID NO: 1026375 - protein, 15 aa, Mycobacterium
SNHGGNNLDGTPASI

SEQ ID NO: 1026376 - protein, 18 aa, Mycobacterium
SNIAQDGKGYASGTQLGE

SEQ ID NO: 1026377 - protein, 4 aa, Mycobacterium
SNIG

SEQ ID NO: 1026378 - protein, 14 aa, Mycobacterium
SNIGHTGAAAGAAG

SEQ ID NO: 1026379 - protein, 7 aa, Mycobacterium
SNIPDGQ

SEQ ID NO: 1026380 - protein, 8 aa, Mycobacterium
SNKNPSDV

SEQ ID NO: 1026381 - protein, 9 aa, Mycobacterium
SNKTNGVTP

SEQ ID NO: 1026382 - protein, 6 aa, Mycobacterium
SNLGDS

SEQ ID NO: 1026383 - protein, 4 aa, Mycobacterium
SNLP

SEQ ID NO: 1026384 - protein, 6 aa, Mycobacterium
SNLTPD

SEQ ID NO: 1026385 - protein, 6 aa, Mycobacterium
SNMTGG

SEQ ID NO: 1026386 - protein, 42 aa, Mycobacterium
SNNTATEASAVGIGGNTATLGTALSDGNAVSATANGFGNTAT

SEQ ID NO: 1026387 - protein, 7 aa, Mycobacterium
SNNTVTT

SEQ ID NO: 1026388 - protein, 10 aa, Mycobacterium
SNPAAPATDG

SEQ ID NO: 1026389 - protein, 5 aa, Mycobacterium
SNPAI

SEQ ID NO: 1026390 - protein, 5 aa, Mycobacterium
SNPAT

SEQ ID NO: 1026391 - protein, 7 aa, Mycobacterium
SNPATGY

SEQ ID NO: 1026392 - protein, 8 aa, Mycobacterium
SNPEIPPA

SEQ ID NO: 1026393 - protein, 7 aa, Mycobacterium
SNPGRHA

SEQ ID NO: 1026394 - protein, 7 aa, Mycobacterium
SNPQYSA

SEQ ID NO: 1026395 - protein, 16 aa, Mycobacterium
SNPREKSTEDYISGRF

SEQ ID NO: 1026396 - protein, 5 aa, Mycobacterium
SNPRF

SEQ ID NO: 1026397 - protein, 5 aa, Mycobacterium
SNPSV

SEQ ID NO: 1026398 - protein, 6 aa, Mycobacterium
SNPVRD

SEQ ID NO: 1026399 - protein, 4 aa, Mycobacterium
SNQP

SEQ ID NO: 1026400 - protein, 8 aa, Mycobacterium
SNRAGVAR

SEQ ID NO: 1026401 - protein, 12 aa, Mycobacterium
SNRDGKPVTPAA

SEQ ID NO: 1026402 - protein, 15 aa, Mycobacterium
SNRGVAGIDGTVSTA

SEQ ID NO: 1026403 - protein, 9 aa, Mycobacterium
SNRKDEAAE

SEQ ID NO: 1026404 - protein, 8 aa, Mycobacterium
SNRPVGDG

SEQ ID NO: 1026405 - protein, 5 aa, Mycobacterium
SNRST

SEQ ID NO: 1026406 - protein, 7 aa, Mycobacterium
SNRTNPR

SEQ ID NO: 1026407 - protein, 8 aa, Mycobacterium
SNSAGLGE

SEQ ID NO: 1026408 - protein, 4 aa, Mycobacterium
SNSL

SEQ ID NO: 1026409 - protein, 13 aa, Mycobacterium
SNSPSGVGTTIFH

SEQ ID NO: 1026410 - protein, 15 aa, Mycobacterium
SNSRRRTADGGWEPG

SEQ ID NO: 1026411 - protein, 5 aa, Mycobacterium
SNSRS

SEQ ID NO: 1026412 - protein, 10 aa, Mycobacterium
SNSSATMARP

SEQ ID NO: 1026413 - protein, 6 aa, Mycobacterium
SNSSSR

SEQ ID NO: 1026414 - protein, 9 aa, Mycobacterium
SNSTASIPR

SEQ ID NO: 1026415 - protein, 7 aa, Mycobacterium
SNSTTTV

SEQ ID NO: 1026416 - protein, 6 aa, Mycobacterium
SNTAAN

SEQ ID NO: 1026417 - protein, 6 aa, Mycobacterium
SNTAEP

SEQ ID NO: 1026418 - protein, 10 aa, Mycobacterium
SNTASDASWT

SEQ ID NO: 1026419 - protein, 7 aa, Mycobacterium
SNTKDEL

SEQ ID NO: 1026420 - protein, 5 aa, Mycobacterium
SNTQY

SEQ ID NO: 1026421 - protein, 8 aa, Mycobacterium
SNTRPAAR

SEQ ID NO: 1026422 - protein, 9 aa, Mycobacterium
SNTSGLAAY

SEQ ID NO: 1026423 - protein, 5 aa, Mycobacterium
SNTVG

SEQ ID NO: 1026424 - protein, 6 aa, Mycobacterium
SNVDTD

SEQ ID NO: 1026425 - protein, 11 aa, Mycobacterium
SNVHGADDPLA

SEQ ID NO: 1026426 - protein, 6 aa, Mycobacterium
SNVPQS

SEQ ID NO: 1026427 - protein, 6 aa, Mycobacterium
SNVPTA

SEQ ID NO: 1026428 - protein, 7 aa, Mycobacterium
SNVQTGA

SEQ ID NO: 1026429 - protein, 4 aa, Mycobacterium
SNWG

SEQ ID NO: 1026430 - protein, 4 aa, Mycobacterium
SPAA

SEQ ID NO: 1026431 - protein, 9 aa, Mycobacterium
SPAAAERAA

SEQ ID NO: 1026432 - protein, 17 aa, Mycobacterium
SPAAGGGTLLRWSAPLI

SEQ ID NO: 1026433 - protein, 7 aa, Mycobacterium
SPAAIGG

SEQ ID NO: 1026434 - protein, 9 aa, Mycobacterium
SPAAKQTLS

SEQ ID NO: 1026435 - protein, 17 aa, Mycobacterium
SPACAARTSSSATPVNV

SEQ ID NO: 1026436 - protein, 7 aa, Mycobacterium
SPADAAK

SEQ ID NO: 1026437 - protein, 8 aa, Mycobacterium
SPAELDDA

SEQ ID NO: 1026438 - protein, 12 aa, Mycobacterium
SPAGAAGAPKVG

SEQ ID NO: 1026439 - protein, 6 aa, Mycobacterium
SPAGIR

SEQ ID NO: 1026440 - protein, 6 aa, Mycobacterium
SPAISN

SEQ ID NO: 1026441 - protein, 4 aa, Mycobacterium
SPAL

SEQ ID NO: 1026442 - protein, 6 aa, Mycobacterium
SPALPG

SEQ ID NO: 1026443 - protein, 10 aa, Mycobacterium
SPANAEGSET

SEQ ID NO: 1026444 - protein, 13 aa, Mycobacterium
SPANPTGTVIPPE

SEQ ID NO: 1026445 - protein, 5 aa, Mycobacterium
SPANV

SEQ ID NO: 1026446 - protein, 18 aa, Mycobacterium
SPAPERPRGVQTRPGPLR

SEQ ID NO: 1026447 - protein, 8 aa, Mycobacterium
SPAPSEPV

SEQ ID NO: 1026448 - protein, 7 aa, Mycobacterium
SPAPSLV

SEQ ID NO: 1026449 - protein, 6 aa, Mycobacterium
SPAPYT

SEQ ID NO: 1026450 - protein, 7 aa, Mycobacterium
SPAQSDG

SEQ ID NO: 1026451 - protein, 10 aa, Mycobacterium
SPASGDGAGA

SEQ ID NO: 1026452 - protein, 11 aa, Mycobacterium
SPASISSGTYS

SEQ ID NO: 1026453 - protein, 9 aa, Mycobacterium
SPASNAVTG

SEQ ID NO: 1026454 - protein, 7 aa, Mycobacterium
SPASWTS

SEQ ID NO: 1026455 - protein, 4 aa, Mycobacterium
SPAT

SEQ ID NO: 1026456 - protein, 7 aa, Mycobacterium
SPATFSP

SEQ ID NO: 1026457 - protein, 9 aa, Mycobacterium
SPATPELPA

SEQ ID NO: 1026458 - protein, 4 aa, Mycobacterium
SPDA

SEQ ID NO: 1026459 - protein, 6 aa, Mycobacterium
SPDEKY

SEQ ID NO: 1026460 - protein, 19 aa, Mycobacterium
SPDEYTGKRTHMPDYPEEG

SEQ ID NO: 1026461 - protein, 8 aa, Mycobacterium
SPDFQDPK

SEQ ID NO: 1026462 - protein, 9 aa, Mycobacterium
SPDGNGITD

SEQ ID NO: 1026463 - protein, 6 aa, Mycobacterium
SPDIES

SEQ ID NO: 1026464 - protein, 8 aa, Mycobacterium
SPDKPEKL

SEQ ID NO: 1026465 - protein, 4 aa, Mycobacterium
SPDN

SEQ ID NO: 1026466 - protein, 11 aa, Mycobacterium
SPDNATAALRS

SEQ ID NO: 1026467 - protein, 4 aa, Mycobacterium
SPDQ

SEQ ID NO: 1026468 - protein, 7 aa, Mycobacterium
SPDQGPR

SEQ ID NO: 1026469 - protein, 5 aa, Mycobacterium
SPDQW

SEQ ID NO: 1026470 - protein, 9 aa, Mycobacterium
SPDVSSTTN

SEQ ID NO: 1026471 - protein, 5 aa, Mycobacterium
SPDWD

SEQ ID NO: 1026472 - protein, 11 aa, Mycobacterium
SPEADADGRPV

SEQ ID NO: 1026473 - protein, 5 aa, Mycobacterium
SPEEL

SEQ ID NO: 1026474 - protein, 6 aa, Mycobacterium
SPEFGS

SEQ ID NO: 1026475 - protein, 20 aa, Mycobacterium
SPEHRSGRRRGHLRVLPDPS

SEQ ID NO: 1026476 - protein, 6 aa, Mycobacterium
SPELGG

SEQ ID NO: 1026477 - protein, 11 aa, Mycobacterium
SPEPDSTADAL

SEQ ID NO: 1026478 - protein, 11 aa, Mycobacterium
SPEPKASDGLG

SEQ ID NO: 1026479 - protein, 7 aa, Mycobacterium
SPERRAG

SEQ ID NO: 1026480 - protein, 4 aa, Mycobacterium
SPES

SEQ ID NO: 1026481 - protein, 23 aa, Mycobacterium
SPETRARRRNDQNVASGSADDYD

SEQ ID NO: 1026482 - protein, 8 aa, Mycobacterium
SPETTITG

SEQ ID NO: 1026483 - protein, 9 aa, Mycobacterium
SPETTTGGK

SEQ ID NO: 1026484 - protein, 6 aa, Mycobacterium
SPFDTG

SEQ ID NO: 1026485 - protein, 13 aa, Mycobacterium
SPFPQTPSPHDAV

SEQ ID NO: 1026486 - protein, 5 aa, Mycobacterium
SPFTD

SEQ ID NO: 1026487 - protein, 6 aa, Mycobacterium
SPGADV

SEQ ID NO: 1026488 - protein, 14 aa, Mycobacterium
SPGAGEGPAGQGPI

SEQ ID NO: 1026489 - protein, 10 aa, Mycobacterium
SPGDDPATIT

SEQ ID NO: 1026490 - protein, 9 aa, Mycobacterium
SPGDTIAGQ

SEQ ID NO: 1026491 - protein, 5 aa, Mycobacterium
SPGGE

SEQ ID NO: 1026492 - protein, 10 aa, Mycobacterium
SPGGHTSRPH

SEQ ID NO: 1026493 - protein, 6 aa, Mycobacterium
SPGGSD

SEQ ID NO: 1026494 - protein, 7 aa, Mycobacterium
SPGGSIS

SEQ ID NO: 1026495 - protein, 8 aa, Mycobacterium
SPGHDEPG

SEQ ID NO: 1026496 - protein, 11 aa, Mycobacterium
SPGIDRPLTSE

SEQ ID NO: 1026497 - protein, 7 aa, Mycobacterium
SPGLDKA

SEQ ID NO: 1026498 - protein, 5 aa, Mycobacterium
SPGLK

SEQ ID NO: 1026499 - protein, 7 aa, Mycobacterium
SPGMDQA

SEQ ID NO: 1026500 - protein, 9 aa, Mycobacterium
SPGNYDPEK

SEQ ID NO: 1026501 - protein, 9 aa, Mycobacterium
SPGPGPALA

SEQ ID NO: 1026502 - protein, 5 aa, Mycobacterium
SPGPH

SEQ ID NO: 1026503 - protein, 8 aa, Mycobacterium
SPGRDTPI

SEQ ID NO: 1026504 - protein, 4 aa, Mycobacterium
SPGS

SEQ ID NO: 1026505 - protein, 5 aa, Mycobacterium
SPGVA

SEQ ID NO: 1026506 - protein, 6 aa, Mycobacterium
SPGVDT

SEQ ID NO: 1026507 - protein, 7 aa, Mycobacterium
SPGWDNS

SEQ ID NO: 1026508 - protein, 6 aa, Mycobacterium
SPHDVG

SEQ ID NO: 1026509 - protein, 6 aa, Mycobacterium
SPHETH

SEQ ID NO: 1026510 - protein, 10 aa, Mycobacterium
SPHIQPSSAP

SEQ ID NO: 1026511 - protein, 8 aa, Mycobacterium
SPHNPTGA

SEQ ID NO: 1026512 - protein, 8 aa, Mycobacterium
SPHNRNAL

SEQ ID NO: 1026513 - protein, 7 aa, Mycobacterium
SPHPAEF

SEQ ID NO: 1026514 - protein, 6 aa, Mycobacterium
SPHPTD

SEQ ID NO: 1026515 - protein, 5 aa, Mycobacterium
SPIAG

SEQ ID NO: 1026516 - protein, 6 aa, Mycobacterium
SPIGKR

SEQ ID NO: 1026517 - protein, 7 aa, Mycobacterium
SPINPSD

SEQ ID NO: 1026518 - protein, 5 aa, Mycobacterium
SPKAR

SEQ ID NO: 1026519 - protein, 8 aa, Mycobacterium
SPKGSATL

SEQ ID NO: 1026520 - protein, 7 aa, Mycobacterium
SPKQFDG

SEQ ID NO: 1026521 - protein, 14 aa, Mycobacterium
SPLASAASSTAGPI

SEQ ID NO: 1026522 - protein, 4 aa, Mycobacterium
SPLC

SEQ ID NO: 1026523 - protein, 5 aa, Mycobacterium
SPLDE

SEQ ID NO: 1026524 - protein, 10 aa, Mycobacterium
SPLEQSQVGT

SEQ ID NO: 1026525 - protein, 11 aa, Mycobacterium
SPLGSSSSSAV

SEQ ID NO: 1026526 - protein, 5 aa, Mycobacterium
SPLRD

SEQ ID NO: 1026527 - protein, 5 aa, Mycobacterium
SPLRL

SEQ ID NO: 1026528 - protein, 8 aa, Mycobacterium
SPLRQAPH

SEQ ID NO: 1026529 - protein, 13 aa, Mycobacterium
SPLSAADIDNAAE

SEQ ID NO: 1026530 - protein, 6 aa, Mycobacterium
SPLSIT

SEQ ID NO: 1026531 - protein, 20 aa, Mycobacterium
SPLSRSSGNVHNSPLVPKAG

SEQ ID NO: 1026532 - protein, 9 aa, Mycobacterium
SPLSTDAAE

SEQ ID NO: 1026533 - protein, 5 aa, Mycobacterium
SPLTP

SEQ ID NO: 1026534 - protein, 15 aa, Mycobacterium
SPLTPDHVNPERPWP

SEQ ID NO: 1026535 - protein, 5 aa, Mycobacterium
SPMAG

SEQ ID NO: 1026536 - protein, 4 aa, Mycobacterium
SPMD

SEQ ID NO: 1026537 - protein, 4 aa, Mycobacterium
SPML

SEQ ID NO: 1026538 - protein, 6 aa, Mycobacterium
SPMPTR

SEQ ID NO: 1026539 - protein, 7 aa, Mycobacterium
SPNADEN

SEQ ID NO: 1026540 - protein, 32 aa, Mycobacterium
SPNAGYFTDDGDQSGLPGTGVRSADVPEGSAA

SEQ ID NO: 1026541 - protein, 5 aa, Mycobacterium
SPNAL

SEQ ID NO: 1026542 - protein, 6 aa, Mycobacterium
SPNFQR

SEQ ID NO: 1026543 - protein, 12 aa, Mycobacterium
SPNGGDKPTGEL

SEQ ID NO: 1026544 - protein, 5 aa, Mycobacterium
SPNLT

SEQ ID NO: 1026545 - protein, 10 aa, Mycobacterium
SPNNPSGQSI

SEQ ID NO: 1026546 - protein, 11 aa, Mycobacterium
SPNNPSGQSIS

SEQ ID NO: 1026547 - protein, 10 aa, Mycobacterium
SPNNPTGQSV

SEQ ID NO: 1026548 - protein, 8 aa, Mycobacterium
SPNPRVRD

SEQ ID NO: 1026549 - protein, 9 aa, Mycobacterium
SPNRVPSTK

SEQ ID NO: 1026550 - protein, 18 aa, Mycobacterium
SPNSFRGKYRGAGASQYA

SEQ ID NO: 1026551 - protein, 4 aa, Mycobacterium
SPNT

SEQ ID NO: 1026552 - protein, 5 aa, Mycobacterium
SPPAQ

SEQ ID NO: 1026553 - protein, 6 aa, Mycobacterium
SPPENQ

SEQ ID NO: 1026554 - protein, 6 aa, Mycobacterium
SPPEVV

SEQ ID NO: 1026555 - protein, 4 aa, Mycobacterium
SPPF

SEQ ID NO: 1026556 - protein, 10 aa, Mycobacterium
SPPKETREFD

SEQ ID NO: 1026557 - protein, 8 aa, Mycobacterium
SPPKQLAD

SEQ ID NO: 1026558 - protein, 4 aa, Mycobacterium
SPPL

SEQ ID NO: 1026559 - protein, 6 aa, Mycobacterium
SPPLDK

SEQ ID NO: 1026560 - protein, 13 aa, Mycobacterium
SPPLPPGPPWPPW

SEQ ID NO: 1026561 - protein, 9 aa, Mycobacterium
SPPLPPMPP

SEQ ID NO: 1026562 - protein, 4 aa, Mycobacterium
SPPM

SEQ ID NO: 1026563 - protein, 7 aa, Mycobacterium
SPPNPAE

SEQ ID NO: 1026564 - protein, 4 aa, Mycobacterium
SPPP

SEQ ID NO: 1026565 - protein, 8 aa, Mycobacterium
SPPPRRAQ

SEQ ID NO: 1026566 - protein, 18 aa, Mycobacterium
SPPPRRLGRRGPDRRRQP

SEQ ID NO: 1026567 - protein, 5 aa, Mycobacterium
SPPPV

SEQ ID NO: 1026568 - protein, 12 aa, Mycobacterium
SPPQASHGGLPH

SEQ ID NO: 1026569 - protein, 8 aa, Mycobacterium
SPPQGSLR

SEQ ID NO: 1026570 - protein, 33 aa, Mycobacterium
SPPQTTSPTAAATQAGTLARAAATTAGTAQSTL

SEQ ID NO: 1026571 - protein, 9 aa, Mycobacterium
SPPSGPGVR

SEQ ID NO: 1026572 - protein, 6 aa, Mycobacterium
SPPVSA

SEQ ID NO: 1026573 - protein, 4 aa, Mycobacterium
SPPW

SEQ ID NO: 1026574 - protein, 5 aa, Mycobacterium
SPQAT

SEQ ID NO: 1026575 - protein, 8 aa, Mycobacterium
SPQCPPQR

SEQ ID NO: 1026576 - protein, 5 aa, Mycobacterium
SPQDA

SEQ ID NO: 1026577 - protein, 5 aa, Mycobacterium
SPQDM

SEQ ID NO: 1026578 - protein, 11 aa, Mycobacterium
SPQEAEQRRVT

SEQ ID NO: 1026579 - protein, 8 aa, Mycobacterium
SPQGARDV

SEQ ID NO: 1026580 - protein, 10 aa, Mycobacterium
SPQKGADAAT

SEQ ID NO: 1026581 - protein, 4 aa, Mycobacterium
SPQN

SEQ ID NO: 1026582 - protein, 12 aa, Mycobacterium
SPQQKVREAQRL

SEQ ID NO: 1026583 - protein, 6 aa, Mycobacterium
SPQQRG

SEQ ID NO: 1026584 - protein, 4 aa, Mycobacterium
SPQR

SEQ ID NO: 1026585 - protein, 16 aa, Mycobacterium
SPQRRAVQTAESVATA

SEQ ID NO: 1026586 - protein, 11 aa, Mycobacterium
SPQRSADYAPA

SEQ ID NO: 1026587 - protein, 7 aa, Mycobacterium
SPQSIRD

SEQ ID NO: 1026588 - protein, 14 aa, Mycobacterium
SPQSTVVGGATDTV

SEQ ID NO: 1026589 - protein, 20 aa, Mycobacterium
SPRDPSASPPIARSGYDTRC

SEQ ID NO: 1026590 - protein, 8 aa, Mycobacterium
SPREGRED

SEQ ID NO: 1026591 - protein, 7 aa, Mycobacterium
SPRGATA

SEQ ID NO: 1026592 - protein, 5 aa, Mycobacterium
SPRGR

SEQ ID NO: 1026593 - protein, 4 aa, Mycobacterium
SPRH

SEQ ID NO: 1026594 - protein, 9 aa, Mycobacterium
SPRKGTRAV

SEQ ID NO: 1026595 - protein, 8 aa, Mycobacterium
SPRKRTLA

SEQ ID NO: 1026596 - protein, 4 aa, Mycobacterium
SPRP

SEQ ID NO: 1026597 - protein, 10 aa, Mycobacterium
SPRPEPGEPR

SEQ ID NO: 1026598 - protein, 5 aa, Mycobacterium
SPRPP

SEQ ID NO: 1026599 - protein, 7 aa, Mycobacterium
SPRQPEA

SEQ ID NO: 1026600 - protein, 6 aa, Mycobacterium
SPRSAV

SEQ ID NO: 1026601 - protein, 9 aa, Mycobacterium
SPRSSLPPG

SEQ ID NO: 1026602 - protein, 5 aa, Mycobacterium
SPRTH

SEQ ID NO: 1026603 - protein, 4 aa, Mycobacterium
SPSD

SEQ ID NO: 1026604 - protein, 34 aa, Mycobacterium; identical to SEQ ID NO: 583562

SEQ ID NO: 1026605 - protein, 4 aa, Mycobacterium
SPSG

SEQ ID NO: 1026606 - protein, 11 aa, Mycobacterium
SPSGPRLAGSL

SEQ ID NO: 1026607 - protein, 8 aa, Mycobacterium
SPSNPTGR

SEQ ID NO: 1026608 - protein, 13 aa, Mycobacterium
SPSPSKRRTATRD

SEQ ID NO: 1026609 - protein, 6 aa, Mycobacterium
SPSRIA

SEQ ID NO: 1026610 - protein, 6 aa, Mycobacterium
SPSRST

SEQ ID NO: 1026611 - protein, 4 aa, Mycobacterium
SPST

SEQ ID NO: 1026612 - protein, 12 aa, Mycobacterium
SPSVTGLTAVLL

SEQ ID NO: 1026613 - protein, 4 aa, Mycobacterium
SPTA

SEQ ID NO: 1026614 - protein, 13 aa, Mycobacterium
SPTAPEGEIEGYL

SEQ ID NO: 1026615 - protein, 5 aa, Mycobacterium
SPTFG

SEQ ID NO: 1026616 - protein, 8 aa, Mycobacterium
SPTGAEAG

SEQ ID NO: 1026617 - protein, 12 aa, Mycobacterium
SPTGLTSEVPAR

SEQ ID NO: 1026618 - protein, 8 aa, Mycobacterium
SPTHPDAT

SEQ ID NO: 1026619 - protein, 16 aa, Mycobacterium
SPTHSSAETLSALAAA

SEQ ID NO: 1026620 - protein, 4 aa, Mycobacterium
SPTI

SEQ ID NO: 1026621 - protein, 11 aa, Mycobacterium
SPTKARKLSGY

SEQ ID NO: 1026622 - protein, 4 aa, Mycobacterium
SPTN

SEQ ID NO: 1026623 - protein, 6 aa, Mycobacterium
SPTPFA

SEQ ID NO: 1026624 - protein, 9 aa, Mycobacterium
SPTPSTTGR

SEQ ID NO: 1026625 - protein, 5 aa, Mycobacterium
SPTQA

SEQ ID NO: 1026626 - protein, 5 aa, Mycobacterium
SPTRS

SEQ ID NO: 1026627 - protein, 8 aa, Mycobacterium
SPTSSAHI

SEQ ID NO: 1026628 - protein, 10 aa, Mycobacterium
SPVADTTVTV

SEQ ID NO: 1026629 - protein, 7 aa, Mycobacterium
SPVDDPY

SEQ ID NO: 1026630 - protein, 7 aa, Mycobacterium
SPVDSGN

SEQ ID NO: 1026631 - protein, 6 aa, Mycobacterium
SPVGDL

SEQ ID NO: 1026632 - protein, 6 aa, Mycobacterium
SPVGED

SEQ ID NO: 1026633 - protein, 11 aa, Mycobacterium
SPVGKRNGALS

SEQ ID NO: 1026634 - protein, 5 aa, Mycobacterium
SPVGN

SEQ ID NO: 1026635 - protein, 4 aa, Mycobacterium
SPVP

SEQ ID NO: 1026636 - protein, 6 aa, Mycobacterium
SPVQPE

SEQ ID NO: 1026637 - protein, 5 aa, Mycobacterium
SPVRA

SEQ ID NO: 1026638 - protein, 4 aa, Mycobacterium
SPVS

SEQ ID NO: 1026639 - protein, 18 aa, Mycobacterium
SPVSPGAEALQRTSTYDS

SEQ ID NO: 1026640 - protein, 5 aa, Mycobacterium
SPVTE

SEQ ID NO: 1026641 - protein, 8 aa, Mycobacterium
SPVTPTSR

SEQ ID NO: 1026642 - protein, 13 aa, Mycobacterium
SPWQRGSNENANG

SEQ ID NO: 1026643 - protein, 7 aa, Mycobacterium
SPYAGSW

SEQ ID NO: 1026644 - protein, 4 aa, Mycobacterium
SPYD

SEQ ID NO: 1026645 - protein, 5 aa, Mycobacterium
SPYEN

SEQ ID NO: 1026646 - protein, 6 aa, Mycobacterium
SPYPRQ

SEQ ID NO: 1026647 - protein, 8 aa, Mycobacterium
SPYRQYSG

SEQ ID NO: 1026648 - protein, 7 aa, Mycobacterium
SPYRTPQ

SEQ ID NO: 1026649 - protein, 12 aa, Mycobacterium
SPYSPPAADARA

SEQ ID NO: 1026650 - protein, 5 aa, Mycobacterium
SQAES

SEQ ID NO: 1026651 - protein, 10 aa, Mycobacterium
SQAGAGNQVS

SEQ ID NO: 1026652 - protein, 9 aa, Mycobacterium
SQAGEEADK

SEQ ID NO: 1026653 - protein, 4 aa, Mycobacterium
SQAH

SEQ ID NO: 1026654 - protein, 7 aa, Mycobacterium
SQALRRG

SEQ ID NO: 1026655 - protein, 5 aa, Mycobacterium
SQALT

SEQ ID NO: 1026656 - protein, 5 aa, Mycobacterium
SQANA

SEQ ID NO: 1026657 - protein, 6 aa, Mycobacterium
SQANVA

SEQ ID NO: 1026658 - protein, 7 aa, Mycobacterium
SQAPHAH

SEQ ID NO: 1026659 - protein, 9 aa, Mycobacterium
SQAQQPLPA

SEQ ID NO: 1026660 - protein, 8 aa, Mycobacterium
SQAQTVAA

SEQ ID NO: 1026661 - protein, 4 aa, Mycobacterium
SQAR

SEQ ID NO: 1026662 - protein, 5 aa, Mycobacterium
SQASG

SEQ ID NO: 1026663 - protein, 8 aa, Mycobacterium
SQASNDQL

SEQ ID NO: 1026664 - protein, 9 aa, Mycobacterium
SQASSRSEY

SEQ ID NO: 1026665 - protein, 9 aa, Mycobacterium
SQATTLNDE

SEQ ID NO: 1026666 - protein, 28 aa, Mycobacterium
SQAVDPNVTPLAGTRPAAGVNELPTADG

SEQ ID NO: 1026667 - protein, 9 aa, Mycobacterium
SQAYPGATM

SEQ ID NO: 1026668 - protein, 14 aa, Mycobacterium
SQDAACSAPEAGDV

SEQ ID NO: 1026669 - protein, 4 aa, Mycobacterium
SQDH

SEQ ID NO: 1026670 - protein, 10 aa, Mycobacterium
SQDSDTNELK

SEQ ID NO: 1026671 - protein, 7 aa, Mycobacterium
SQDSRTA

SEQ ID NO: 1026672 - protein, 5 aa, Mycobacterium
SQDVA

SEQ ID NO: 1026673 - protein, 10 aa, Mycobacterium
SQDVPAPPER

SEQ ID NO: 1026674 - protein, 6 aa, Mycobacterium
SQELTG

SEQ ID NO: 1026675 - protein, 9 aa, Mycobacterium
SQERPSSTV

SEQ ID NO: 1026676 - protein, 8 aa, Mycobacterium
SQETNTKL

SEQ ID NO: 1026677 - protein, 4 aa, Mycobacterium
SQEV

SEQ ID NO: 1026678 - protein, 6 aa, Mycobacterium
SQEVAQ

SEQ ID NO: 1026679 - protein, 5 aa, Mycobacterium
SQFEK

SEQ ID NO: 1026680 - protein, 10 aa, Mycobacterium
SQGAKPGLGG

SEQ ID NO: 1026681 - protein, 6 aa, Mycobacterium
SQGASV

SEQ ID NO: 1026682 - protein, 10 aa, Mycobacterium
SQGGNATTFP

SEQ ID NO: 1026683 - protein, 7 aa, Mycobacterium
SQGPQID

SEQ ID NO: 1026684 - protein, 8 aa, Mycobacterium
SQGQQDAW

SEQ ID NO: 1026685 - protein, 8 aa, Mycobacterium
SQGSQVPS

SEQ ID NO: 1026686 - protein, 13 aa, Mycobacterium
SQGVTHAEDRDGD

SEQ ID NO: 1026687 - protein, 6 aa, Mycobacterium
SQHDRY

SEQ ID NO: 1026688 - protein, 5 aa, Mycobacterium
SQHNE

SEQ ID NO: 1026689 - protein, 9 aa, Mycobacterium
SQITTGSST

SEQ ID NO: 1026690 - protein, 6 aa, Mycobacterium
SQKGER

SEQ ID NO: 1026691 - protein, 7 aa, Mycobacterium
SQKSNTK

SEQ ID NO: 1026692 - protein, 5 aa, Mycobacterium
SQLAT

SEQ ID NO: 1026693 - protein, 6 aa, Mycobacterium
SQLPTE

SEQ ID NO: 1026694 - protein, 5 aa, Mycobacterium
SQLTA

SEQ ID NO: 1026695 - protein, 5 aa, Mycobacterium
SQLTT

SEQ ID NO: 1026696 - protein, 18 aa, Mycobacterium
SQNPPPTSLARQKRPLRF

SEQ ID NO: 1026697 - protein, 9 aa, Mycobacterium
SQNRAEEAI

SEQ ID NO: 1026698 - protein, 10 aa, Mycobacterium
SQNYEDEAGA

SEQ ID NO: 1026699 - protein, 6 aa, Mycobacterium
SQPGEG

SEQ ID NO: 1026700 - protein, 6 aa, Mycobacterium
SQPGVG

SEQ ID NO: 1026701 - protein, 5 aa, Mycobacterium
SQPLA

SEQ ID NO: 1026702 - protein, 7 aa, Mycobacterium
SQPLPSS

SEQ ID NO: 1026703 - protein, 8 aa, Mycobacterium
SQPNTGEL

SEQ ID NO: 1026704 - protein, 7 aa, Mycobacterium
SQPPWRP

SEQ ID NO: 1026705 - protein, 4 aa, Mycobacterium
SQPR

SEQ ID NO: 1026706 - protein, 101 aa, Mycobacterium
SQPTLDRPSGPMPAAPGAPVESAPGRPDGRRARRRAESRTSAASTPSPLVPTRAQPPGPTRAQPPRTAAAAQPATEATEPLPDAGAPAKQPKKPKKPVPQR

SEQ ID NO: 1026707 - protein, 6 aa, Mycobacterium
SQPTMT

SEQ ID NO: 1026708 - protein, 14 aa, Mycobacterium
SQPTSVDAADGLRA

SEQ ID NO: 1026709 - protein, 7 aa, Mycobacterium
SQQDVAD

SEQ ID NO: 1026710 - protein, 14 aa, Mycobacterium
SQQGAATGTDEQRI

SEQ ID NO: 1026711 - protein, 4 aa, Mycobacterium
SQRD

SEQ ID NO: 1026712 - protein, 7 aa, Mycobacterium
SQRDDIA

SEQ ID NO: 1026713 - protein, 15 aa, Mycobacterium
SQRHPELRRSDHDAV

SEQ ID NO: 1026714 - protein, 6 aa, Mycobacterium
SQRLDR

SEQ ID NO: 1026715 - protein, 4 aa, Mycobacterium
SQRR

SEQ ID NO: 1026716 - protein, 10 aa, Mycobacterium
SQRSRNRHVG

SEQ ID NO: 1026717 - protein, 6 aa, Mycobacterium
SQRTKN

SEQ ID NO: 1026718 - protein, 5 aa, Mycobacterium
SQRWG

SEQ ID NO: 1026719 - protein, 7 aa, Mycobacterium
SQSARER

SEQ ID NO: 1026720 - protein, 7 aa, Mycobacterium
SQSDQDA

SEQ ID NO: 1026721 - protein, 10 aa, Mycobacterium
SQSDTLDPSH

SEQ ID NO: 1026722 - protein, 11 aa, Mycobacterium
SQSGDRRGATH

SEQ ID NO: 1026723 - protein, 8 aa, Mycobacterium
SQSGGHGD

SEQ ID NO: 1026724 - protein, 10 aa, Mycobacterium
SQSGQAEHQH

SEQ ID NO: 1026725 - protein, 6 aa, Mycobacterium
SQSPVP

SEQ ID NO: 1026726 - protein, 12 aa, Mycobacterium
SQSSLSPDAQRR

SEQ ID NO: 1026727 - protein, 5 aa, Mycobacterium
SQSTA

SEQ ID NO: 1026728 - protein, 8 aa, Mycobacterium
SQSTEARR

SEQ ID NO: 1026729 - protein, 11 aa, Mycobacterium
SQTGGENDYER

SEQ ID NO: 1026730 - protein, 9 aa, Mycobacterium
SQTGGGIAT

SEQ ID NO: 1026731 - protein, 10 aa, Mycobacterium
SQTGTPGEDW

SEQ ID NO: 1026732 - protein, 11 aa, Mycobacterium
SQTLGNDTVTR

SEQ ID NO: 1026733 - protein, 6 aa, Mycobacterium
SQTPAG

SEQ ID NO: 1026734 - protein, 14 aa, Mycobacterium
SQTPSASGDCRGKG

SEQ ID NO: 1026735 - protein, 5 aa, Mycobacterium
SQVYA

SEQ ID NO: 1026736 - protein, 17 aa, Mycobacterium
SQWGQTPSGERWLAPPR

SEQ ID NO: 1026737 - protein, 4 aa, Mycobacterium
SRAA

SEQ ID NO: 1026738 - protein, 6 aa, Mycobacterium
SRAAGH

SEQ ID NO: 1026739 - protein, 8 aa, Mycobacterium
SRADERDQ

SEQ ID NO: 1026740 - protein, 6 aa, Mycobacterium
SRADGG

SEQ ID NO: 1026741 - protein, 11 aa, Mycobacterium
SRADSADSTEA

SEQ ID NO: 1026742 - protein, 7 aa, Mycobacterium
SRADTEL

SEQ ID NO: 1026743 - protein, 9 aa, Mycobacterium
SRAESAQVN

SEQ ID NO: 1026744 - protein, 15 aa, Mycobacterium
SRAETGDTLSDKSEP

SEQ ID NO: 1026745 - protein, 4 aa, Mycobacterium
SRAF

SEQ ID NO: 1026746 - protein, 10 aa, Mycobacterium
SRAGDKPIRV

SEQ ID NO: 1026747 - protein, 27 aa, Mycobacterium
SRAGKTPGNNESAGKVKSRRTRPGNPY

SEQ ID NO: 1026748 - protein, 6 aa, Mycobacterium
SRAGTP

SEQ ID NO: 1026749 - protein, 17 aa, Mycobacterium
SRAKDGTGKPAKQKKKK

SEQ ID NO: 1026750 - protein, 4 aa, Mycobacterium
SRAL

SEQ ID NO: 1026751 - protein, 5 aa, Mycobacterium
SRAPA

SEQ ID NO: 1026752 - protein, 9 aa, Mycobacterium
SRAPAVAPI

SEQ ID NO: 1026753 - protein, 10 aa, Mycobacterium
SRAPNRPAID

SEQ ID NO: 1026754 - protein, 14 aa, Mycobacterium
SRARPAGRRPIRSG

SEQ ID NO: 1026755 - protein, 5 aa, Mycobacterium
SRASA

SEQ ID NO: 1026756 - protein, 6 aa, Mycobacterium
SRASAR

SEQ ID NO: 1026757 - protein, 11 aa, Mycobacterium
SRASHADEDLS

SEQ ID NO: 1026758 - protein, 18 aa, Mycobacterium
SRCATTTVTTPRSPPAAP

SEQ ID NO: 1026759 - protein, 4 aa, Mycobacterium
SRCE

SEQ ID NO: 1026760 - protein, 6 aa, Mycobacterium
SRCREE

SEQ ID NO: 1026761 - protein, 15 aa, Mycobacterium
SRDANRIAATDTPWT

SEQ ID NO: 1026762 - protein, 9 aa, Mycobacterium
SRDAPETAT

SEQ ID NO: 1026763 - protein, 7 aa, Mycobacterium
SRDATGQ

SEQ ID NO: 1026764 - protein, 6 aa, Mycobacterium
SRDELR

SEQ ID NO: 1026765 - protein, 15 aa, Mycobacterium
SRDGNTAYRAGRDIK

SEQ ID NO: 1026766 - protein, 15 aa, Mycobacterium
SRDGNTAYRAGRDIQ

SEQ ID NO: 1026767 - protein, 6 aa, Mycobacterium
SRDGTR

SEQ ID NO: 1026768 - protein, 5 aa, Mycobacterium
SRDIT

SEQ ID NO: 1026769 - protein, 4 aa, Mycobacterium
SRDP

SEQ ID NO: 1026770 - protein, 9 aa, Mycobacterium
SRDPAARPT

SEQ ID NO: 1026771 - protein, 6 aa, Mycobacterium
SRDPSV

SEQ ID NO: 1026772 - protein, 5 aa, Mycobacterium
SRDQQ

SEQ ID NO: 1026773 - protein, 8 aa, Mycobacterium
SRDTPLDA

SEQ ID NO: 1026774 - protein, 7 aa, Mycobacterium
SREDQDH

SEQ ID NO: 1026775 - protein, 5 aa, Mycobacterium
SREEC

SEQ ID NO: 1026776 - protein, 27 aa, Mycobacterium
SREGRSRREGGSRGGRDRDRDGEKGNY

SEQ ID NO: 1026777 - protein, 5 aa, Mycobacterium
SREHP

SEQ ID NO: 1026778 - protein, 8 aa, Mycobacterium
SREMKDRG

SEQ ID NO: 1026779 - protein, 6 aa, Mycobacterium
SREQVP

SEQ ID NO: 1026780 - protein, 11 aa, Mycobacterium
SRERRGSPPTV

SEQ ID NO: 1026781 - protein, 10 aa, Mycobacterium
SRETDSPVPA

SEQ ID NO: 1026782 - protein, 8 aa, Mycobacterium
SREYTGNS

SEQ ID NO: 1026783 - protein, 18 aa, Mycobacterium
SRFPPAPAHSASRTTASV

SEQ ID NO: 1026784 - protein, 18 aa, Mycobacterium
SRFSPVDGSPTKPARAGW

SEQ ID NO: 1026785 - protein, 12 aa, Mycobacterium
SRFTQTDKAQSR

SEQ ID NO: 1026786 - protein, 4 aa, Mycobacterium
SRGA

SEQ ID NO: 1026787 - protein, 28 aa, Mycobacterium
SRGAQKQADEIRRSRETKAVRDREHANE

SEQ ID NO: 1026788 - protein, 6 aa, Mycobacterium
SRGAQV

SEQ ID NO: 1026789 - protein, 12 aa, Mycobacterium
SRGATTEGPADE

SEQ ID NO: 1026790 - protein, 7 aa, Mycobacterium
SRGDAGS

SEQ ID NO: 1026791 - protein, 8 aa, Mycobacterium
SRGDQSLS

SEQ ID NO: 1026792 - protein, 5 aa, Mycobacterium
SRGEL

SEQ ID NO: 1026793 - protein, 7 aa, Mycobacterium
SRGGATR

SEQ ID NO: 1026794 - protein, 10 aa, Mycobacterium
SRGGRPDLAG

SEQ ID NO: 1026795 - protein, 6 aa, Mycobacterium
SRGGVG

SEQ ID NO: 1026796 - protein, 7 aa, Mycobacterium
SRGGVGI

SEQ ID NO: 1026797 - protein, 6 aa, Mycobacterium
SRGIGR

SEQ ID NO: 1026798 - protein, 7 aa, Mycobacterium
SRGNPTV

SEQ ID NO: 1026799 - protein, 10 aa, Mycobacterium
SRGPGKAGAR

SEQ ID NO: 1026800 - protein, 6 aa, Mycobacterium
SRGPIV

SEQ ID NO: 1026801 - protein, 5 aa, Mycobacterium
SRGQG

SEQ ID NO: 1026802 - protein, 7 aa, Mycobacterium
SRGRGGF

SEQ ID NO: 1026803 - protein, 7 aa, Mycobacterium
SRGRPGK

SEQ ID NO: 1026804 - protein, 19 aa, Mycobacterium
SRGSKPVAQPRGWCAPTWA

SEQ ID NO: 1026805 - protein, 5 aa, Mycobacterium
SRGSM

SEQ ID NO: 1026806 - protein, 7 aa, Mycobacterium
SRGSREP

SEQ ID NO: 1026807 - protein, 7 aa, Mycobacterium
SRGTGQW

SEQ ID NO: 1026808 - protein, 12 aa, Mycobacterium
SRGTVQGDEDVL

SEQ ID NO: 1026809 - protein, 6 aa, Mycobacterium
SRHDAV

SEQ ID NO: 1026810 - protein, 13 aa, Mycobacterium
SRHDDSGADLPPE

SEQ ID NO: 1026811 - protein, 6 aa, Mycobacterium
SRHEPY

SEQ ID NO: 1026812 - protein, 11 aa, Mycobacterium
SRIEGIGRPRV

SEQ ID NO: 1026813 - protein, 4 aa, Mycobacterium
SRIG

SEQ ID NO: 1026814 - protein, 8 aa, Mycobacterium
SRKAARRR

SEQ ID NO: 1026815 - protein, 4 aa, Mycobacterium
SRKP

SEQ ID NO: 1026816 - protein, 18 aa, Mycobacterium
SRKSAPDAVNAAVNASGN

SEQ ID NO: 1026817 - protein, 6 aa, Mycobacterium
SRLARG

SEQ ID NO: 1026818 - protein, 7 aa, Mycobacterium
SRLARRG

SEQ ID NO: 1026819 - protein, 9 aa, Mycobacterium
SRLDDATAR

SEQ ID NO: 1026820 - protein, 12 aa, Mycobacterium
SRLDSPMPDQSE

SEQ ID NO: 1026821 - protein, 18 aa, Mycobacterium
SRLEPEDARQAREALTPG

SEQ ID NO: 1026822 - protein, 6 aa, Mycobacterium
SRLKQN

SEQ ID NO: 1026823 - protein, 25 aa, Mycobacterium
SRLPGDGPYPDRSGGVLPGYGGSKA

SEQ ID NO: 1026824 - protein, 12 aa, Mycobacterium
SRLTSADVTTVP

SEQ ID NO: 1026825 - protein, 9 aa, Mycobacterium
SRMPQSGGM

SEQ ID NO: 1026826 - protein, 5 aa, Mycobacterium
SRNAP

SEQ ID NO: 1026827 - protein, 12 aa, Mycobacterium
SRNARDRPTAPV

SEQ ID NO: 1026828 - protein, 12 aa, Mycobacterium
SRNESHRSPAVQ

SEQ ID NO: 1026829 - protein, 8 aa, Mycobacterium
SRNGARGA

SEQ ID NO: 1026830 - protein, 14 aa, Mycobacterium
SRNGSDDADPAGDN

SEQ ID NO: 1026831 - protein, 5 aa, Mycobacterium
SRNPE

SEQ ID NO: 1026832 - protein, 8 aa, Mycobacterium
SRNPGQRL

SEQ ID NO: 1026833 - protein, 12 aa, Mycobacterium
SRNPITGASEPF

SEQ ID NO: 1026834 - protein, 10 aa, Mycobacterium
SRNSTSPPIK

SEQ ID NO: 1026835 - protein, 11 aa, Mycobacterium
SRNSTTINPGT

SEQ ID NO: 1026836 - protein, 9 aa, Mycobacterium
SRPADPHAR

SEQ ID NO: 1026837 - protein, 9 aa, Mycobacterium
SRPARARQG

SEQ ID NO: 1026838 - protein, 7 aa, Mycobacterium
SRPDAAG

SEQ ID NO: 1026839 - protein, 9 aa, Mycobacterium
SRPDAPAGT

SEQ ID NO: 1026840 - protein, 9 aa, Mycobacterium
SRPDPTAKR

SEQ ID NO: 1026841 - protein, 9 aa, Mycobacterium
SRPDSPNVA

SEQ ID NO: 1026842 - protein, 8 aa, Mycobacterium
SRPDTSSR

SEQ ID NO: 1026843 - protein, 19 aa, Mycobacterium
SRPGADAMRPAAAERAEQI

SEQ ID NO: 1026844 - protein, 6 aa, Mycobacterium
SRPGDV

SEQ ID NO: 1026845 - protein, 8 aa, Mycobacterium
SRPGGEAL

SEQ ID NO: 1026846 - protein, 8 aa, Mycobacterium
SRPGPESL

SEQ ID NO: 1026847 - protein, 10 aa, Mycobacterium
SRPGSVTDGT

SEQ ID NO: 1026848 - protein, 4 aa, Mycobacterium
SRPH

SEQ ID NO: 1026849 - protein, 6 aa, Mycobacterium
SRPKPL

SEQ ID NO: 1026850 - protein, 6 aa, Mycobacterium
SRPLDR

SEQ ID NO: 1026851 - protein, 7 aa, Mycobacterium
SRPPTEL

SEQ ID NO: 1026852 - protein, 5 aa, Mycobacterium
SRPQT

SEQ ID NO: 1026853 - protein, 7 aa, Mycobacterium
SRPRPAA

SEQ ID NO: 1026854 - protein, 60 aa, Mycobacterium
SRPSKDQRSSKSSRARRAEGSKAAATAPAKKSSASKAPAKKAATKAESKTSEISEAKGGS

SEQ ID NO: 1026855 - protein, 6 aa, Mycobacterium
SRPTFQ

SEQ ID NO: 1026856 - protein, 12 aa, Mycobacterium
SRPTVSPESVDA

SEQ ID NO: 1026857 - protein, 4 aa, Mycobacterium
SRPV

SEQ ID NO: 1026858 - protein, 7 aa, Mycobacterium
SRPVDSP

SEQ ID NO: 1026859 - protein, 6 aa, Mycobacterium
SRQARE

SEQ ID NO: 1026860 - protein, 6 aa, Mycobacterium
SRQGLA

SEQ ID NO: 1026861 - protein, 12 aa, Mycobacterium
SRQGPSGDDDSL

SEQ ID NO: 1026862 - protein, 13 aa, Mycobacterium
SRQHPHRGTGRRQ

SEQ ID NO: 1026863 - protein, 7 aa, Mycobacterium
SRQPDHA

SEQ ID NO: 1026864 - protein, 17 aa, Mycobacterium
SRQRLSPISGRAGIAGR

SEQ ID NO: 1026865 - protein, 8 aa, Mycobacterium
SRQTRHGR

SEQ ID NO: 1026866 - protein, 4 aa, Mycobacterium
SRQV

SEQ ID NO: 1026867 - protein, 14 aa, Mycobacterium
SRQVDPDNNKKGDG

SEQ ID NO: 1026868 - protein, 6 aa, Mycobacterium
SRQVTR

SEQ ID NO: 1026869 - protein, 8 aa, Mycobacterium
SRQWGQRE

SEQ ID NO: 1026870 - protein, 5 aa, Mycobacterium
SRRAA

SEQ ID NO: 1026871 - protein, 5 aa, Mycobacterium
SRRAE

SEQ ID NO: 1026872 - protein, 7 aa, Mycobacterium
SRRDIPD

SEQ ID NO: 1026873 - protein, 5 aa, Mycobacterium
SRRGD

SEQ ID NO: 1026874 - protein, 17 aa, Mycobacterium
SRRGNEIAGLPDDLAAQ

SEQ ID NO: 1026875 - protein, 5 aa, Mycobacterium
SRRGR

SEQ ID NO: 1026876 - protein, 6 aa, Mycobacterium
SRRGRT

SEQ ID NO: 1026877 - protein, 5 aa, Mycobacterium
SRRLG

SEQ ID NO: 1026878 - protein, 7 aa, Mycobacterium
SRRPANA

SEQ ID NO: 1026879 - protein, 14 aa, Mycobacterium
SRRPDREWTNRPIA

SEQ ID NO: 1026880 - protein, 9 aa, Mycobacterium
SRRPDRPGV

SEQ ID NO: 1026881 - protein, 5 aa, Mycobacterium
SRRPI

SEQ ID NO: 1026882 - protein, 8 aa, Mycobacterium
SRRPPAEM

SEQ ID NO: 1026883 - protein, 8 aa, Mycobacterium
SRRPTTGR

SEQ ID NO: 1026884 - protein, 22 aa, Mycobacterium
SRRQTPQSRQLAPPSRRCPPCP

SEQ ID NO: 1026885 - protein, 5 aa, Mycobacterium
SRRRR

SEQ ID NO: 1026886 - protein, 11 aa, Mycobacterium
SRRRRGPETTA

SEQ ID NO: 1026887 - protein, 7 aa, Mycobacterium
SRRRTPP

SEQ ID NO: 1026888 - protein, 4 aa, Mycobacterium
SRRS

SEQ ID NO: 1026889 - protein, 6 aa, Mycobacterium
SRRSEL

SEQ ID NO: 1026890 - protein, 10 aa, Mycobacterium
SRRSPGTASR

SEQ ID NO: 1026891 - protein, 7 aa, Mycobacterium
SRSAARM

SEQ ID NO: 1026892 - protein, 18 aa, Mycobacterium
SRSADQIRAATETHADPL

SEQ ID NO: 1026893 - protein, 8 aa, Mycobacterium
SRSASSEV

SEQ ID NO: 1026894 - protein, 8 aa, Mycobacterium
SRSDPRAP

SEQ ID NO: 1026895 - protein, 6 aa, Mycobacterium
SRSDTY

SEQ ID NO: 1026896 - protein, 10 aa, Mycobacterium
SRSGLTEEVR

SEQ ID NO: 1026897 - protein, 8 aa, Mycobacterium
SRSGPPQV

SEQ ID NO: 1026898 - protein, 6 aa, Mycobacterium
SRSGQP

SEQ ID NO: 1026899 - protein, 12 aa, Mycobacterium
SRSGRDVTTEYP

SEQ ID NO: 1026900 - protein, 9 aa, Mycobacterium
SRSLEDGTA

SEQ ID NO: 1026901 - protein, 5 aa, Mycobacterium
SRSPA

SEQ ID NO: 1026902 - protein, 9 aa, Mycobacterium
SRSPNPHVG

SEQ ID NO: 1026903 - protein, 7 aa, Mycobacterium
SRSRESA

SEQ ID NO: 1026904 - protein, 17 aa, Mycobacterium
SRSSERLSIADNDPASD

SEQ ID NO: 1026905 - protein, 10 aa, Mycobacterium
SRSSPGSEPI

SEQ ID NO: 1026906 - protein, 9 aa, Mycobacterium
SRSSSRGEM

SEQ ID NO: 1026907 - protein, 8 aa, Mycobacterium
SRSTESPA

SEQ ID NO: 1026908 - protein, 5 aa, Mycobacterium
SRSTM

SEQ ID NO: 1026909 - protein, 9 aa, Mycobacterium
SRSTPRAGD

SEQ ID NO: 1026910 - protein, 19 aa, Mycobacterium
SRSVGQGAATLKGEKRSGL

SEQ ID NO: 1026911 - protein, 5 aa, Mycobacterium
SRSVP

SEQ ID NO: 1026912 - protein, 4 aa, Mycobacterium
SRTA

SEQ ID NO: 1026913 - protein, 11 aa, Mycobacterium
SRTADNKESAI

SEQ ID NO: 1026914 - protein, 9 aa, Mycobacterium
SRTANTALT

SEQ ID NO: 1026915 - protein, 12 aa, Mycobacterium
SRTDTDTDTDAG

SEQ ID NO: 1026916 - protein, 5 aa, Mycobacterium
SRTEH

SEQ ID NO: 1026917 - protein, 5 aa, Mycobacterium
SRTES

SEQ ID NO: 1026918 - protein, 11 aa, Mycobacterium
SRTESYAARVR

SEQ ID NO: 1026919 - protein, 11 aa, Mycobacterium
SRTETRDGYRQ

SEQ ID NO: 1026920 - protein, 7 aa, Mycobacterium
SRTGAAM

SEQ ID NO: 1026921 - protein, 7 aa, Mycobacterium
SRTLPAG

SEQ ID NO: 1026922 - protein, 4 aa, Mycobacterium
SRTP

SEQ ID NO: 1026923 - protein, 5 aa, Mycobacterium
SRTPQ

SEQ ID NO: 1026924 - protein, 4 aa, Mycobacterium
SRTR

SEQ ID NO: 1026925 - protein, 13 aa, Mycobacterium
SRTRSPHPGGRAI

SEQ ID NO: 1026926 - protein, 7 aa, Mycobacterium
SRTSVPG

SEQ ID NO: 1026927 - protein, 8 aa, Mycobacterium
SRTTDDYE

SEQ ID NO: 1026928 - protein, 7 aa, Mycobacterium
SRVGSTF

SEQ ID NO: 1026929 - protein, 6 aa, Mycobacterium
SRVQGA

SEQ ID NO: 1026930 - protein, 8 aa, Mycobacterium
SRVTEPGE

SEQ ID NO: 1026931 - protein, 52 aa, Mycobacterium
SRWRGTRSVPSVPSASGSATCPTPSPPNPATPRSTSPASPPSPPRSTRPRCP

SEQ ID NO: 1026932 - protein, 15 aa, Mycobacterium
SRYDAATSKTQGLIF

SEQ ID NO: 1026933 - protein, 5 aa, Mycobacterium
SRYDE

SEQ ID NO: 1026934 - protein, 6 aa, Mycobacterium
SRYGAA

SEQ ID NO: 1026935 - protein, 7 aa, Mycobacterium
SRYPYSE

SEQ ID NO: 1026936 - protein, 7 aa, Mycobacterium
SRYRGDF

SEQ ID NO: 1026937 - protein, 6 aa, Mycobacterium
SRYRSN

SEQ ID NO: 1026938 - protein, 8 aa, Mycobacterium
SRYSTAPT

SEQ ID NO: 1026939 - protein, 4 aa, Mycobacterium
SSAA

SEQ ID NO: 1026940 - protein, 31 aa, Mycobacterium; identical to SEQ ID NO: 585590

SEQ ID NO: 1026941 - protein, 8 aa, Mycobacterium
SSADGVDA

SEQ ID NO: 1026942 - protein, 14 aa, Mycobacterium
SSADYTGESPPVGS

SEQ ID NO: 1026943 - protein, 12 aa, Mycobacterium
SSAEFADANADE

SEQ ID NO: 1026944 - protein, 9 aa, Mycobacterium
SSAEGQQSW

SEQ ID NO: 1026945 - protein, 6 aa, Mycobacterium
SSAEQL

SEQ ID NO: 1026946 - protein, 6 aa, Mycobacterium
SSAGAA

SEQ ID NO: 1026947 - protein, 18 aa, Mycobacterium
SSAGGAYAAAEAANTGPL

SEQ ID NO: 1026948 - protein, 9 aa, Mycobacterium
SSAGGTDTG

SEQ ID NO: 1026949 - protein, 11 aa, Mycobacterium
SSAGRTQYGHS

SEQ ID NO: 1026950 - protein, 10 aa, Mycobacterium
SSAIYDGSPL

SEQ ID NO: 1026951 - protein, 15 aa, Mycobacterium
SSALGTGAPKTANHS

SEQ ID NO: 1026952 - protein, 11 aa, Mycobacterium
SSANTRDPSTC

SEQ ID NO: 1026953 - protein, 9 aa, Mycobacterium
SSAPAASTA

SEQ ID NO: 1026954 - protein, 8 aa, Mycobacterium
SSAPAYEE

SEQ ID NO: 1026955 - protein, 5 aa, Mycobacterium
SSAPE

SEQ ID NO: 1026956 - protein, 8 aa, Mycobacterium
SSAPSASV

SEQ ID NO: 1026957 - protein, 18 aa, Mycobacterium
SSAPTVPTSAARCRTWNA

SEQ ID NO: 1026958 - protein, 6 aa, Mycobacterium
SSAQDV

SEQ ID NO: 1026959 - protein, 10 aa, Mycobacterium
SSAQSHDEDL

SEQ ID NO: 1026960 - protein, 7 aa, Mycobacterium
SSARDAV

SEQ ID NO: 1026961 - protein, 6 aa, Mycobacterium
SSARGD

SEQ ID NO: 1026962 - protein, 5 aa, Mycobacterium
SSASG

SEQ ID NO: 1026963 - protein, 8 aa, Mycobacterium
SSASGDWA

SEQ ID NO: 1026964 - protein, 11 aa, Mycobacterium
SSASKSKVIAD

SEQ ID NO: 1026965 - protein, 13 aa, Mycobacterium
SSASPAAGKPNLG

SEQ ID NO: 1026966 - protein, 9 aa, Mycobacterium
SSASPTELT

SEQ ID NO: 1026967 - protein, 9 aa, Mycobacterium
SSATPPHRT

SEQ ID NO: 1026968 - protein, 9 aa, Mycobacterium
SSATTRSRP

SEQ ID NO: 1026969 - protein, 11 aa, Mycobacterium
SSAVGKEIGRR

SEQ ID NO: 1026970 - protein, 22 aa, Mycobacterium
SSCSDQTKSTVAQRRVEEEPAL

SEQ ID NO: 1026971 - protein, 7 aa, Mycobacterium
SSDDAAV

SEQ ID NO: 1026972 - protein, 10 aa, Mycobacterium
SSDDGGPLSR

SEQ ID NO: 1026973 - protein, 6 aa, Mycobacterium
SSDDPA

SEQ ID NO: 1026974 - protein, 10 aa, Mycobacterium
SSDDPPPVGE

SEQ ID NO: 1026975 - protein, 9 aa, Mycobacterium
SSDDTRADA

SEQ ID NO: 1026976 - protein, 11 aa, Mycobacterium
SSDGGAQTREQ

SEQ ID NO: 1026977 - protein, 8 aa, Mycobacterium
SSDGPDRV

SEQ ID NO: 1026978 - protein, 7 aa, Mycobacterium
SSDNPNV

SEQ ID NO: 1026979 - protein, 7 aa, Mycobacterium
SSDPALR

SEQ ID NO: 1026980 - protein, 4 aa, Mycobacterium
SSDT

SEQ ID NO: 1026981 - protein, 7 aa, Mycobacterium
SSDTGSV

SEQ ID NO: 1026982 - protein, 8 aa, Mycobacterium
SSDTTTDP

SEQ ID NO: 1026983 - protein, 6 aa, Mycobacterium
SSEAIG

SEQ ID NO: 1026984 - protein, 15 aa, Mycobacterium
SSEEKSAIATAAGAT

SEQ ID NO: 1026985 - protein, 6 aa, Mycobacterium
SSEETC

SEQ ID NO: 1026986 - protein, 4 aa, Mycobacterium
SSEG

SEQ ID NO: 1026987 - protein, 5 aa, Mycobacterium
SSEHG

SEQ ID NO: 1026988 - protein, 7 aa, Mycobacterium
SSEKYTD

SEQ ID NO: 1026989 - protein, 12 aa, Mycobacterium
SSEPGAGSDVGA

SEQ ID NO: 1026990 - protein, 8 aa, Mycobacterium
SSFGDDKD

SEQ ID NO: 1026991 - protein, 16 aa, Mycobacterium
SSFRRTDKRGGANGGR

SEQ ID NO: 1026992 - protein, 5 aa, Mycobacterium
SSFSG

SEQ ID NO: 1026993 - protein, 8 aa, Mycobacterium
SSFSSSNL

SEQ ID NO: 1026994 - protein, 8 aa, Mycobacterium
SSGAPVSP

SEQ ID NO: 1026995 - protein, 6 aa, Mycobacterium
SSGASI

SEQ ID NO: 1026996 - protein, 7 aa, Mycobacterium
SSGASLG

SEQ ID NO: 1026997 - protein, 6 aa, Mycobacterium
SSGDPG

SEQ ID NO: 1026998 - protein, 9 aa, Mycobacterium
SSGEPDQAL

SEQ ID NO: 1026999 - protein, 7 aa, Mycobacterium
SSGFSSD

SEQ ID NO: 1027000 - protein, 6 aa, Mycobacterium
SSGGTC

SEQ ID NO: 1027001 - protein, 14 aa, Mycobacterium
SSGGTDDATTHPIT

SEQ ID NO: 1027002 - protein, 13 aa, Mycobacterium
SSGGVAAAARWHR

SEQ ID NO: 1027003 - protein, 5 aa, Mycobacterium
SSGIG

SEQ ID NO: 1027004 - protein, 17 aa, Mycobacterium
SSGITGQTLDVNCGEYH

SEQ ID NO: 1027005 - protein, 15 aa, Mycobacterium
SSGKGGQGVNTTDSA

SEQ ID NO: 1027006 - protein, 13 aa, Mycobacterium
SSGKRDPGELSTR

SEQ ID NO: 1027007 - protein, 5 aa, Mycobacterium
SSGLP

SEQ ID NO: 1027008 - protein, 6 aa, Mycobacterium
SSGLRT

SEQ ID NO: 1027009 - protein, 4 aa, Mycobacterium
SSGN

SEQ ID NO: 1027010 - protein, 17 aa, Mycobacterium
SSGPDIRPALGDPTEVA

SEQ ID NO: 1027011 - protein, 7 aa, Mycobacterium
SSGPDRL

SEQ ID NO: 1027012 - protein, 7 aa, Mycobacterium
SSGPGSF

SEQ ID NO: 1027013 - protein, 5 aa, Mycobacterium
SSGPL

SEQ ID NO: 1027014 - protein, 11 aa, Mycobacterium
SSGQNTRGPSK

SEQ ID NO: 1027015 - protein, 4 aa, Mycobacterium
SSGR

SEQ ID NO: 1027016 - protein, 11 aa, Mycobacterium
SSGRASDGAAA

SEQ ID NO: 1027017 - protein, 6 aa, Mycobacterium
SSGRAY

SEQ ID NO: 1027018 - protein, 8 aa, Mycobacterium
SSGRESYS

SEQ ID NO: 1027019 - protein, 16 aa, Mycobacterium
SSGSYAATEAANAAAA

SEQ ID NO: 1027020 - protein, 4 aa, Mycobacterium
SSGT

SEQ ID NO: 1027021 - protein, 13 aa, Mycobacterium
SSGTGVRPLTGAP

SEQ ID NO: 1027022 - protein, 8 aa, Mycobacterium
SSGTTALA

SEQ ID NO: 1027023 - protein, 11 aa, Mycobacterium
SSGTTGRPKGI

SEQ ID NO: 1027024 - protein, 10 aa, Mycobacterium
SSGVDEEPGV

SEQ ID NO: 1027025 - protein, 7 aa, Mycobacterium
SSGVPGE

SEQ ID NO: 1027026 - protein, 7 aa, Mycobacterium
SSGVPSF

SEQ ID NO: 1027027 - protein, 12 aa, Mycobacterium
SSHAPVNARTAR

SEQ ID NO: 1027028 - protein, 4 aa, Mycobacterium
SSHI

SEQ ID NO: 1027029 - protein, 7 aa, Mycobacterium
SSIAPGA

SEQ ID NO: 1027030 - protein, 8 aa, Mycobacterium
SSIDPDHA

SEQ ID NO: 1027031 - protein, 6 aa, Mycobacterium
SSIEST

SEQ ID NO: 1027032 - protein, 6 aa, Mycobacterium
SSIGGP

SEQ ID NO: 1027033 - protein, 7 aa, Mycobacterium
SSIGRVP

SEQ ID NO: 1027034 - protein, 6 aa, Mycobacterium
SSIPGG

SEQ ID NO: 1027035 - protein, 5 aa, Mycobacterium
SSIPT

SEQ ID NO: 1027036 - protein, 9 aa, Mycobacterium
SSISAEQRS

SEQ ID NO: 1027037 - protein, 10 aa, Mycobacterium
SSKNAAKLRG

SEQ ID NO: 1027038 - protein, 18 aa, Mycobacterium
SSKPENVPYYQRFGFTVT

SEQ ID NO: 1027039 - protein, 15 aa, Mycobacterium
SSKSTLTTKDAPCQR

SEQ ID NO: 1027040 - protein, 8 aa, Mycobacterium
SSLAEAAA

SEQ ID NO: 1027041 - protein, 7 aa, Mycobacterium
SSLAGGV

SEQ ID NO: 1027042 - protein, 6 aa, Mycobacterium
SSLHTG

SEQ ID NO: 1027043 - protein, 9 aa, Mycobacterium
SSLPAGSLG

SEQ ID NO: 1027044 - protein, 9 aa, Mycobacterium
SSLTNNRSR

SEQ ID NO: 1027045 - protein, 9 aa, Mycobacterium
SSLTPQEAQ

SEQ ID NO: 1027046 - protein, 4 aa, Mycobacterium
SSMA

SEQ ID NO: 1027047 - protein, 5 aa, Mycobacterium
SSMGA

SEQ ID NO: 1027048 - protein, 5 aa, Mycobacterium
SSMGG

SEQ ID NO: 1027049 - protein, 15 aa, Mycobacterium
SSMGRGSSCMTSSGS

SEQ ID NO: 1027050 - protein, 6 aa, Mycobacterium
SSMPGY

SEQ ID NO: 1027051 - protein, 5 aa, Mycobacterium
SSNAS

SEQ ID NO: 1027052 - protein, 4 aa, Mycobacterium
SSND

SEQ ID NO: 1027053 - protein, 5 aa, Mycobacterium
SSNGV

SEQ ID NO: 1027054 - protein, 7 aa, Mycobacterium
SSNTAAG

SEQ ID NO: 1027055 - protein, 6 aa, Mycobacterium
SSNTEP

SEQ ID NO: 1027056 - protein, 10 aa, Mycobacterium
SSNTVSTANE

SEQ ID NO: 1027057 - protein, 6 aa, Mycobacterium
SSPAPV

SEQ ID NO: 1027058 - protein, 5 aa, Mycobacterium
SSPDA

SEQ ID NO: 1027059 - protein, 6 aa, Mycobacterium
SSPDVN

SEQ ID NO: 1027060 - protein, 10 aa, Mycobacterium
SSPEIEGREE

SEQ ID NO: 1027061 - protein, 8 aa, Mycobacterium
SSPERPEV

SEQ ID NO: 1027062 - protein, 9 aa, Mycobacterium
SSPESVTEE

SEQ ID NO: 1027063 - protein, 9 aa, Mycobacterium
SSPGAFGES

SEQ ID NO: 1027064 - protein, 5 aa, Mycobacterium
SSPGY

SEQ ID NO: 1027065 - protein, 15 aa, Mycobacterium
SSPGYREAAQRAAAS

SEQ ID NO: 1027066 - protein, 5 aa, Mycobacterium
SSPHP

SEQ ID NO: 1027067 - protein, 6 aa, Mycobacterium
SSPKLP

SEQ ID NO: 1027068 - protein, 9 aa, Mycobacterium
SSPNTPGLR

SEQ ID NO: 1027069 - protein, 6 aa, Mycobacterium
SSPPDC

SEQ ID NO: 1027070 - protein, 14 aa, Mycobacterium
SSPPLNAAQAGPSV

SEQ ID NO: 1027071 - protein, 7 aa, Mycobacterium
SSPPRGV

SEQ ID NO: 1027072 - protein, 15 aa, Mycobacterium
SSPQGKFADSAGAVD

SEQ ID NO: 1027073 - protein, 5 aa, Mycobacterium
SSPQM

SEQ ID NO: 1027074 - protein, 8 aa, Mycobacterium
SSPRPAQE

SEQ ID NO: 1027075 - protein, 6 aa, Mycobacterium
SSPSAA

SEQ ID NO: 1027076 - protein, 8 aa, Mycobacterium
SSPTNESK

SEQ ID NO: 1027077 - protein, 15 aa, Mycobacterium
SSPWWGGEDTGYASN

SEQ ID NO: 1027078 - protein, 9 aa, Mycobacterium
SSQAGFDPG

SEQ ID NO: 1027079 - protein, 6 aa, Mycobacterium
SSQARQ

SEQ ID NO: 1027080 - protein, 4 aa, Mycobacterium
SSQD

SEQ ID NO: 1027081 - protein, 7 aa, Mycobacterium
SSQDDTR

SEQ ID NO: 1027082 - protein, 8 aa, Mycobacterium
SSQDHGLD

SEQ ID NO: 1027083 - protein, 15 aa, Mycobacterium
SSQFKTGPEGSGGPR

SEQ ID NO: 1027084 - protein, 6 aa, Mycobacterium
SSQGVT

SEQ ID NO: 1027085 - protein, 8 aa, Mycobacterium
SSQPFEAT

SEQ ID NO: 1027086 - protein, 13 aa, Mycobacterium
SSRAIGSNGEPIA

SEQ ID NO: 1027087 - protein, 6 aa, Mycobacterium
SSREGV

SEQ ID NO: 1027088 - protein, 20 aa, Mycobacterium
SSRENVDAYTGTGNSHSITA

SEQ ID NO: 1027089 - protein, 7 aa, Mycobacterium
SSRFNRP

SEQ ID NO: 1027090 - protein, 5 aa, Mycobacterium
SSRGH

SEQ ID NO: 1027091 - protein, 5 aa, Mycobacterium
SSRGL

SEQ ID NO: 1027092 - protein, 4 aa, Mycobacterium
SSRH

SEQ ID NO: 1027093 - protein, 12 aa, Mycobacterium
SSRLEDNVGNPM

SEQ ID NO: 1027094 - protein, 7 aa, Mycobacterium
SSRPAAI

SEQ ID NO: 1027095 - protein, 7 aa, Mycobacterium
SSRPRTG

SEQ ID NO: 1027096 - protein, 6 aa, Mycobacterium
SSRRGE

SEQ ID NO: 1027097 - protein, 5 aa, Mycobacterium
SSRRS

SEQ ID NO: 1027098 - protein, 9 aa, Mycobacterium
SSRSPESEI

SEQ ID NO: 1027099 - protein, 11 aa, Mycobacterium
SSRVSSPDALG

SEQ ID NO: 1027100 - protein, 7 aa, Mycobacterium
SSSAAAL

SEQ ID NO: 1027101 - protein, 13 aa, Mycobacterium
SSSCGSRSLANDV

SEQ ID NO: 1027102 - protein, 9 aa, Mycobacterium
SSSDREFSG

SEQ ID NO: 1027103 - protein, 27 aa, Mycobacterium
SSSEGAGLGTSTFTRSSGPVSMGPGRR

SEQ ID NO: 1027104 - protein, 5 aa, Mycobacterium
SSSLA

SEQ ID NO: 1027105 - protein, 10 aa, Mycobacterium
SSSPKEHPGE

SEQ ID NO: 1027106 - protein, 12 aa, Mycobacterium
SSSSKTELFIPQ

SEQ ID NO: 1027107 - protein, 7 aa, Mycobacterium
SSSTAES

SEQ ID NO: 1027108 - protein, 9 aa, Mycobacterium
SSSTHSGTP

SEQ ID NO: 1027109 - protein, 7 aa, Mycobacterium
SSSTNSI

SEQ ID NO: 1027110 - protein, 5 aa, Mycobacterium
SSTAE

SEQ ID NO: 1027111 - protein, 9 aa, Mycobacterium
SSTAPSSGF

SEQ ID NO: 1027112 - protein, 8 aa, Mycobacterium
SSTENLPD

SEQ ID NO: 1027113 - protein, 9 aa, Mycobacterium
SSTEPGDRV

SEQ ID NO: 1027114 - protein, 5 aa, Mycobacterium
SSTIT

SEQ ID NO: 1027115 - protein, 6 aa, Mycobacterium
SSTPEG

SEQ ID NO: 1027116 - protein, 7 aa, Mycobacterium
SSTPERL

SEQ ID NO: 1027117 - protein, 11 aa, Mycobacterium
SSTQGWERNPE

SEQ ID NO: 1027118 - protein, 17 aa, Mycobacterium
SSTSTPQTSSILPGNSV

SEQ ID NO: 1027119 - protein, 10 aa, Mycobacterium
SSTTPLAGAG

SEQ ID NO: 1027120 - protein, 5 aa, Mycobacterium
SSTYV

SEQ ID NO: 1027121 - protein, 7 aa, Mycobacterium
SSVDDVP

SEQ ID NO: 1027122 - protein, 7 aa, Mycobacterium
SSVGSAR

SEQ ID NO: 1027123 - protein, 6 aa, Mycobacterium
SSVPAG

SEQ ID NO: 1027124 - protein, 7 aa, Mycobacterium
SSVPPGR

SEQ ID NO: 1027125 - protein, 5 aa, Mycobacterium
SSVQE

SEQ ID NO: 1027126 - protein, 10 aa, Mycobacterium
SSVSGVEPER

SEQ ID NO: 1027127 - protein, 12 aa, Mycobacterium
SSVTGGQRPFGG

SEQ ID NO: 1027128 - protein, 10 aa, Mycobacterium
SSVTKNAATD

SEQ ID NO: 1027129 - protein, 6 aa, Mycobacterium
SSVTSE

SEQ ID NO: 1027130 - protein, 4 aa, Mycobacterium
SSVY

SEQ ID NO: 1027131 - protein, 5 aa, Mycobacterium
SSWDD

SEQ ID NO: 1027132 - protein, 14 aa, Mycobacterium
SSWHGSGNESYSSV

SEQ ID NO: 1027133 - protein, 15 aa, Mycobacterium
SSWHGSGNESYSSVQ

SEQ ID NO: 1027134 - protein, 4 aa, Mycobacterium
SSWT

SEQ ID NO: 1027135 - protein, 10 aa, Mycobacterium
SSWTPRRSQL

SEQ ID NO: 1027136 - protein, 9 aa, Mycobacterium
SSYSDKPGT

SEQ ID NO: 1027137 - protein, 16 aa, Mycobacterium
SSYSKNAAGAPRQTCR

SEQ ID NO: 1027138 - protein, 5 aa, Mycobacterium
SSYTN

SEQ ID NO: 1027139 - protein, 13 aa, Mycobacterium
SSYTPQPDTHGRS

SEQ ID NO: 1027140 - protein, 16 aa, Mycobacterium
SSYTSGNGGAGGNGGV

SEQ ID NO: 1027141 - protein, 4 aa, Mycobacterium
STAA

SEQ ID NO: 1027142 - protein, 7 aa, Mycobacterium
STAAAVP

SEQ ID NO: 1027143 - protein, 5 aa, Mycobacterium
STAAH

SEQ ID NO: 1027144 - protein, 10 aa, Mycobacterium
STAAIGYPPN

SEQ ID NO: 1027145 - protein, 4 aa, Mycobacterium
STAD

SEQ ID NO: 1027146 - protein, 10 aa, Mycobacterium
STADGSGTTI

SEQ ID NO: 1027147 - protein, 6 aa, Mycobacterium
STADQR

SEQ ID NO: 1027148 - protein, 5 aa, Mycobacterium
STAEV

SEQ ID NO: 1027149 - protein, 5 aa, Mycobacterium
STAFE

SEQ ID NO: 1027150 - protein, 14 aa, Mycobacterium
STAGDGGPRAAARA

SEQ ID NO: 1027151 - protein, 6 aa, Mycobacterium
STAGQP

SEQ ID NO: 1027152 - protein, 4 aa, Mycobacterium
STAK

SEQ ID NO: 1027153 - protein, 6 aa, Mycobacterium
STALGQ

SEQ ID NO: 1027154 - protein, 8 aa, Mycobacterium
STALTEGD

SEQ ID NO: 1027155 - protein, 20 aa, Mycobacterium
STAMSGGASGAAAAPAVPDR

SEQ ID NO: 1027156 - protein, 14 aa, Mycobacterium
STAQVEGGDLLVVV

SEQ ID NO: 1027157 - protein, 9 aa, Mycobacterium
STARREGPL

SEQ ID NO: 1027158 - protein, 7 aa, Mycobacterium
STASSQL

SEQ ID NO: 1027159 - protein, 16 aa, Mycobacterium
STATAVGQHYGARRTT

SEQ ID NO: 1027160 - protein, 17 aa, Mycobacterium
STATAVGQHYGARRTTG

SEQ ID NO: 1027161 - protein, 7 aa, Mycobacterium
STATGRK

SEQ ID NO: 1027162 - protein, 8 aa, Mycobacterium
STATGSSL

SEQ ID NO: 1027163 - protein, 5 aa, Mycobacterium
STATQ

SEQ ID NO: 1027164 - protein, 5 aa, Mycobacterium
STAVR

SEQ ID NO: 1027165 - protein, 17 aa, Mycobacterium
STDADGAPEQSTPDEVG

SEQ ID NO: 1027166 - protein, 6 aa, Mycobacterium
STDANG

SEQ ID NO: 1027167 - protein, 6 aa, Mycobacterium
STDAPT

SEQ ID NO: 1027168 - protein, 8 aa, Mycobacterium
STDASGRY

SEQ ID NO: 1027169 - protein, 10 aa, Mycobacterium
STDCRRRAAH

SEQ ID NO: 1027170 - protein, 8 aa, Mycobacterium
STDEGGNV

SEQ ID NO: 1027171 - protein, 4 aa, Mycobacterium
STDG

SEQ ID NO: 1027172 - protein, 7 aa, Mycobacterium
STDGVGT

SEQ ID NO: 1027173 - protein, 4 aa, Mycobacterium
STDL

SEQ ID NO: 1027174 - protein, 9 aa, Mycobacterium
STDPDDDEI

SEQ ID NO: 1027175 - protein, 7 aa, Mycobacterium
STDPDGR

SEQ ID NO: 1027176 - protein, 6 aa, Mycobacterium
STDPEC

SEQ ID NO: 1027177 - protein, 11 aa, Mycobacterium
STDPHAAGPAR

SEQ ID NO: 1027178 - protein, 7 aa, Mycobacterium
STDPLDR

SEQ ID NO: 1027179 - protein, 13 aa, Mycobacterium
STDRDAKATIDQM

SEQ ID NO: 1027180 - protein, 18 aa, Mycobacterium
STDRPTSPASGDHGSGCR

SEQ ID NO: 1027181 - protein, 5 aa, Mycobacterium
STDRR

SEQ ID NO: 1027182 - protein, 6 aa, Mycobacterium
STDSND

SEQ ID NO: 1027183 - protein, 7 aa, Mycobacterium
STDTGRE

SEQ ID NO: 1027184 - protein, 5 aa, Mycobacterium
STDVD

SEQ ID NO: 1027185 - protein, 9 aa, Mycobacterium
STEASPVQE

SEQ ID NO: 1027186 - protein, 6 aa, Mycobacterium
STEDDE

SEQ ID NO: 1027187 - protein, 5 aa, Mycobacterium
STEEE

SEQ ID NO: 1027188 - protein, 11 aa, Mycobacterium
STEEGQGVPNT

SEQ ID NO: 1027189 - protein, 6 aa, Mycobacterium
STEGQL

SEQ ID NO: 1027190 - protein, 9 aa, Mycobacterium
STEHQQPTF

SEQ ID NO: 1027191 - protein, 7 aa, Mycobacterium
STEPMTA

SEQ ID NO: 1027192 - protein, 17 aa, Mycobacterium
STEQQERARQKADAAYR

SEQ ID NO: 1027193 - protein, 4 aa, Mycobacterium
STER

SEQ ID NO: 1027194 - protein, 10 aa, Mycobacterium
STERARDLRQ

SEQ ID NO: 1027195 - protein, 7 aa, Mycobacterium
STETENI

SEQ ID NO: 1027196 - protein, 6 aa, Mycobacterium
STETEQ

SEQ ID NO: 1027197 - protein, 7 aa, Mycobacterium
STFGGNP

SEQ ID NO: 1027198 - protein, 6 aa, Mycobacterium
STGADV

SEQ ID NO: 1027199 - protein, 7 aa, Mycobacterium
STGAEGS

SEQ ID NO: 1027200 - protein, 13 aa, Mycobacterium
STGASGSGADVDK

SEQ ID NO: 1027201 - protein, 7 aa, Mycobacterium
STGDAEQ

SEQ ID NO: 1027202 - protein, 6 aa, Mycobacterium
STGDPV

SEQ ID NO: 1027203 - protein, 5 aa, Mycobacterium
STGEG

SEQ ID NO: 1027204 - protein, 16 aa, Mycobacterium
STGEQLPINSSRQKLT

SEQ ID NO: 1027205 - protein, 6 aa, Mycobacterium
STGERG

SEQ ID NO: 1027206 - protein, 7 aa, Mycobacterium
STGESEA

SEQ ID NO: 1027207 - protein, 5 aa, Mycobacterium
STGGE

SEQ ID NO: 1027208 - protein, 6 aa, Mycobacterium
STGGEI

SEQ ID NO: 1027209 - protein, 6 aa, Mycobacterium
STGGRQ

SEQ ID NO: 1027210 - protein, 8 aa, Mycobacterium
STGGSNAK

SEQ ID NO: 1027211 - protein, 9 aa, Mycobacterium
STGGSPLSS

SEQ ID NO: 1027212 - protein, 14 aa, Mycobacterium
STGGWDDEGKPVHG

SEQ ID NO: 1027213 - protein, 10 aa, Mycobacterium
STGHDGAPLR

SEQ ID NO: 1027214 - protein, 9 aa, Mycobacterium
STGKATHAS

SEQ ID NO: 1027215 - protein, 9 aa, Mycobacterium
STGKPQAAE

SEQ ID NO: 1027216 - protein, 13 aa, Mycobacterium
STGLQSVSAGAAQ

SEQ ID NO: 1027217 - protein, 6 aa, Mycobacterium
STGLRR

SEQ ID NO: 1027218 - protein, 9 aa, Mycobacterium
STGNNIGDA

SEQ ID NO: 1027219 - protein, 9 aa, Mycobacterium
STGNPHSAA

SEQ ID NO: 1027220 - protein, 15 aa, Mycobacterium
STGNTSASAAAYAAR

SEQ ID NO: 1027221 - protein, 7 aa, Mycobacterium
STGPAEI

SEQ ID NO: 1027222 - protein, 9 aa, Mycobacterium
STGPGPSAL

SEQ ID NO: 1027223 - protein, 4 aa, Mycobacterium
STGQ

SEQ ID NO: 1027224 - protein, 10 aa, Mycobacterium
STGRVKRPQV

SEQ ID NO: 1027225 - protein, 7 aa, Mycobacterium
STGSGPM

SEQ ID NO: 1027226 - protein, 14 aa, Mycobacterium
STGSGTAPDPQFRP

SEQ ID NO: 1027227 - protein, 14 aa, Mycobacterium
STGSTAKTIASKGI

SEQ ID NO: 1027228 - protein, 8 aa, Mycobacterium
STGTAPLS

SEQ ID NO: 1027229 - protein, 7 aa, Mycobacterium
STGTEGY

SEQ ID NO: 1027230 - protein, 9 aa, Mycobacterium
STGTGDSGF

SEQ ID NO: 1027231 - protein, 5 aa, Mycobacterium
STGTL

SEQ ID NO: 1027232 - protein, 11 aa, Mycobacterium
STGTLQDYGPD

SEQ ID NO: 1027233 - protein, 6 aa, Mycobacterium
STGTQE

SEQ ID NO: 1027234 - protein, 53 aa, Mycobacterium
STHRQPLRAGGSDRGGCPGGEYRYGRPHADRTAPTHVRGTGKSARTRRTGGGT

SEQ ID NO: 1027235 - protein, 11 aa, Mycobacterium
STHSEEEPTTL

SEQ ID NO: 1027236 - protein, 11 aa, Mycobacterium
STHTPSPNTVR

SEQ ID NO: 1027237 - protein, 19 aa, Mycobacterium
STIGSGTAAATESASMTPS

SEQ ID NO: 1027238 - protein, 5 aa, Mycobacterium
STIPA

SEQ ID NO: 1027239 - protein, 6 aa, Mycobacterium
STISDY

SEQ ID NO: 1027240 - protein, 19 aa, Mycobacterium
STISGPTLTSTIGNTDGST

SEQ ID NO: 1027241 - protein, 16 aa, Mycobacterium
STITAANAAAAAPTTA

SEQ ID NO: 1027242 - protein, 6 aa, Mycobacterium
STKAGL

SEQ ID NO: 1027243 - protein, 10 aa, Mycobacterium
STKGMTSSDE

SEQ ID NO: 1027244 - protein, 8 aa, Mycobacterium
STKPGITA

SEQ ID NO: 1027245 - protein, 4 aa, Mycobacterium
STKV

SEQ ID NO: 1027246 - protein, 5 aa, Mycobacterium
STLGP

SEQ ID NO: 1027247 - protein, 6 aa, Mycobacterium
STLPDA

SEQ ID NO: 1027248 - protein, 19 aa, Mycobacterium
STLSGAAASVGTQRPAGRR

SEQ ID NO: 1027249 - protein, 6 aa, Mycobacterium
STMPGG

SEQ ID NO: 1027250 - protein, 5 aa, Mycobacterium
STNLP

SEQ ID NO: 1027251 - protein, 10 aa, Mycobacterium
STNRNSQGVL

SEQ ID NO: 1027252 - protein, 12 aa, Mycobacterium
STPAAKAAQPGL

SEQ ID NO: 1027253 - protein, 8 aa, Mycobacterium
STPAAPSI

SEQ ID NO: 1027254 - protein, 7 aa, Mycobacterium
STPAPVR

SEQ ID NO: 1027255 - protein, 9 aa, Mycobacterium
STPAWGGSA

SEQ ID NO: 1027256 - protein, 6 aa, Mycobacterium
STPAYR

SEQ ID NO: 1027257 - protein, 17 aa, Mycobacterium
STPDGDYQTYKANDGAY

SEQ ID NO: 1027258 - protein, 8 aa, Mycobacterium
STPEEGRQ

SEQ ID NO: 1027259 - protein, 5 aa, Mycobacterium
STPEH

SEQ ID NO: 1027260 - protein, 74 aa, Mycobacterium
STPEVDEKLSAKAAEELEEEPEEPEEDEGAAGEDDDASADSADEDDEDEAAEDEDEEDEEDEEDSVEEDRAAGD

SEQ ID NO: 1027261 - protein, 6 aa, Mycobacterium
STPHAA

SEQ ID NO: 1027262 - protein, 9 aa, Mycobacterium
STPKKLTYP

SEQ ID NO: 1027263 - protein, 9 aa, Mycobacterium
STPMPPGED

SEQ ID NO: 1027264 - protein, 22 aa, Mycobacterium
STPSPSRSTKSTTRGCGSKRPP

SEQ ID NO: 1027265 - protein, 6 aa, Mycobacterium
STPSRE

SEQ ID NO: 1027266 - protein, 6 aa, Mycobacterium
STPTAL

SEQ ID NO: 1027267 - protein, 7 aa, Mycobacterium
STPTEHP

SEQ ID NO: 1027268 - protein, 7 aa, Mycobacterium
STPTQVG

SEQ ID NO: 1027269 - protein, 7 aa, Mycobacterium
STPTRTA

SEQ ID NO: 1027270 - protein, 15 aa, Mycobacterium
STPTSAAPGHPMAPG

SEQ ID NO: 1027271 - protein, 6 aa, Mycobacterium
STPVSE

SEQ ID NO: 1027272 - protein, 14 aa, Mycobacterium
STQACTRLLESIGV

SEQ ID NO: 1027273 - protein, 5 aa, Mycobacterium
STQAK

SEQ ID NO: 1027274 - protein, 7 aa, Mycobacterium
STQGQPV

SEQ ID NO: 1027275 - protein, 5 aa, Mycobacterium
STQNV

SEQ ID NO: 1027276 - protein, 6 aa, Mycobacterium
STQPAL

SEQ ID NO: 1027277 - protein, 7 aa, Mycobacterium
STQPPVA

SEQ ID NO: 1027278 - protein, 8 aa, Mycobacterium
STQQGRLR

SEQ ID NO: 1027279 - protein, 8 aa, Mycobacterium
STQRAATV

SEQ ID NO: 1027280 - protein, 13 aa, Mycobacterium
STQRQRWDGRTNC

SEQ ID NO: 1027281 - protein, 6 aa, Mycobacterium
STQSDI

SEQ ID NO: 1027282 - protein, 8 aa, Mycobacterium
STQSGASG

SEQ ID NO: 1027283 - protein, 5 aa, Mycobacterium
STQTL

SEQ ID NO: 1027284 - protein, 10 aa, Mycobacterium
STRADDRRQV

SEQ ID NO: 1027285 - protein, 4 aa, Mycobacterium
STRD

SEQ ID NO: 1027286 - protein, 11 aa, Mycobacterium
STRDDRVHPGH

SEQ ID NO: 1027287 - protein, 4 aa, Mycobacterium
STRE

SEQ ID NO: 1027288 - protein, 6 aa, Mycobacterium
STRGRP

SEQ ID NO: 1027289 - protein, 5 aa, Mycobacterium
STRMP

SEQ ID NO: 1027290 - protein, 7 aa, Mycobacterium
STRPDGV

SEQ ID NO: 1027291 - protein, 7 aa, Mycobacterium
STRPDSI

SEQ ID NO: 1027292 - protein, 9 aa, Mycobacterium
STRPNATLD

SEQ ID NO: 1027293 - protein, 16 aa, Mycobacterium
STRQHSDASAPTLSSE

SEQ ID NO: 1027294 - protein, 9 aa, Mycobacterium
STRRPDGTR

SEQ ID NO: 1027295 - protein, 6 aa, Mycobacterium
STRRRT

SEQ ID NO: 1027296 - protein, 21 aa, Mycobacterium
STRSAFASSGEASVSERTHAH

SEQ ID NO: 1027297 - protein, 12 aa, Mycobacterium
STRSTLVSRDQT

SEQ ID NO: 1027298 - protein, 15 aa, Mycobacterium
STRTDQTKEDVGNQI

SEQ ID NO: 1027299 - protein, 5 aa, Mycobacterium
STRTE

SEQ ID NO: 1027300 - protein, 6 aa, Mycobacterium
STRTGQ

SEQ ID NO: 1027301 - protein, 5 aa, Mycobacterium
STRTR

SEQ ID NO: 1027302 - protein, 4 aa, Mycobacterium
STSA

SEQ ID NO: 1027303 - protein, 11 aa, Mycobacterium
STSADGLRQTA

SEQ ID NO: 1027304 - protein, 6 aa, Mycobacterium
STSAGK

SEQ ID NO: 1027305 - protein, 4 aa, Mycobacterium
STSD

SEQ ID NO: 1027306 - protein, 9 aa, Mycobacterium
STSELPGEL

SEQ ID NO: 1027307 - protein, 4 aa, Mycobacterium
STSG

SEQ ID NO: 1027308 - protein, 12 aa, Mycobacterium
STSGHRHRPHPR

SEQ ID NO: 1027309 - protein, 10 aa, Mycobacterium
STSGKANRQF

SEQ ID NO: 1027310 - protein, 5 aa, Mycobacterium
STSIQ

SEQ ID NO: 1027311 - protein, 8 aa, Mycobacterium
STSPKTAA

SEQ ID NO: 1027312 - protein, 8 aa, Mycobacterium
STSPSFST

SEQ ID NO: 1027313 - protein, 15 aa, Mycobacterium
STSPWAGRPEPADPV

SEQ ID NO: 1027314 - protein, 4 aa, Mycobacterium
STSR

SEQ ID NO: 1027315 - protein, 8 aa, Mycobacterium
STSRHKAE

SEQ ID NO: 1027316 - protein, 10 aa, Mycobacterium
STSSAAAEQL

SEQ ID NO: 1027317 - protein, 12 aa, Mycobacterium
STSSARSAAERE

SEQ ID NO: 1027318 - protein, 8 aa, Mycobacterium
STSSAYGS

SEQ ID NO: 1027319 - protein, 7 aa, Mycobacterium
STSTTTT

SEQ ID NO: 1027320 - protein, 7 aa, Mycobacterium
STSVASG

SEQ ID NO: 1027321 - protein, 20 aa, Mycobacterium
STTANARRPAPNTLSGNTTG

SEQ ID NO: 1027322 - protein, 5 aa, Mycobacterium
STTAY

SEQ ID NO: 1027323 - protein, 7 aa, Mycobacterium
STTEEQK

SEQ ID NO: 1027324 - protein, 13 aa, Mycobacterium
STTGDGEPPDNGA

SEQ ID NO: 1027325 - protein, 10 aa, Mycobacterium
STTGDTTWEN

SEQ ID NO: 1027326 - protein, 8 aa, Mycobacterium
STTGDVAE

SEQ ID NO: 1027327 - protein, 19 aa, Mycobacterium
STTHAQLSPAEQLSTGVSP

SEQ ID NO: 1027328 - protein, 12 aa, Mycobacterium
STTHKTLGGPRG

SEQ ID NO: 1027329 - protein, 26 aa, Mycobacterium
STTNPSSGLLNSGEGSESGVGNYGVG

SEQ ID NO: 1027330 - protein, 14 aa, Mycobacterium
STTSLPETPRGERN

SEQ ID NO: 1027331 - protein, 12 aa, Mycobacterium
STTTSAQPSGAR

SEQ ID NO: 1027332 - protein, 5 aa, Mycobacterium
STTVE

SEQ ID NO: 1027333 - protein, 5 aa, Mycobacterium
STVAH

SEQ ID NO: 1027334 - protein, 6 aa, Mycobacterium
STVTES

SEQ ID NO: 1027335 - protein, 6 aa, Mycobacterium
STWDRR

SEQ ID NO: 1027336 - protein, 11 aa, Mycobacterium
STYAARSTAQF

SEQ ID NO: 1027337 - protein, 10 aa, Mycobacterium
STYAPAPQRF

SEQ ID NO: 1027338 - protein, 11 aa, Mycobacterium
STYESAATQTA

SEQ ID NO: 1027339 - protein, 4 aa, Mycobacterium
STYK

SEQ ID NO: 1027340 - protein, 12 aa, Mycobacterium
SVADDNDGENAV

SEQ ID NO: 1027341 - protein, 9 aa, Mycobacterium
SVADSSQSA

SEQ ID NO: 1027342 - protein, 6 aa, Mycobacterium
SVAEGT

SEQ ID NO: 1027343 - protein, 9 aa, Mycobacterium
SVAPAGPTL

SEQ ID NO: 1027344 - protein, 16 aa, Mycobacterium
SVAPGFAPTDAQDAAA

SEQ ID NO: 1027345 - protein, 13 aa, Mycobacterium
SVAPRDKAQARRD

SEQ ID NO: 1027346 - protein, 10 aa, Mycobacterium
SVASAKSNAY

SEQ ID NO: 1027347 - protein, 5 aa, Mycobacterium
SVASS

SEQ ID NO: 1027348 - protein, 9 aa, Mycobacterium
SVATEDGAA

SEQ ID NO: 1027349 - protein, 6 aa, Mycobacterium
SVDAGR

SEQ ID NO: 1027350 - protein, 10 aa, Mycobacterium
SVDDARPQYG

SEQ ID NO: 1027351 - protein, 6 aa, Mycobacterium
SVDDAT

SEQ ID NO: 1027352 - protein, 4 aa, Mycobacterium
SVDN

SEQ ID NO: 1027353 - protein, 9 aa, Mycobacterium
SVDPDSKSV

SEQ ID NO: 1027354 - protein, 8 aa, Mycobacterium
SVDPGSAK

SEQ ID NO: 1027355 - protein, 11 aa, Mycobacterium
SVDPNKSIHDP

SEQ ID NO: 1027356 - protein, 6 aa, Mycobacterium
SVDPYN

SEQ ID NO: 1027357 - protein, 17 aa, Mycobacterium
SVDRQRHRRGAGIGGAG

SEQ ID NO: 1027358 - protein, 4 aa, Mycobacterium
SVDS

SEQ ID NO: 1027359 - protein, 14 aa, Mycobacterium
SVDSQSNVRTLPDG

SEQ ID NO: 1027360 - protein, 11 aa, Mycobacterium
SVEGRPRRAGV

SEQ ID NO: 1027361 - protein, 6 aa, Mycobacterium
SVEPSG

SEQ ID NO: 1027362 - protein, 6 aa, Mycobacterium
SVERSE

SEQ ID NO: 1027363 - protein, 29 aa, Mycobacterium
SVESPPVVEAPEAAPAETLKTTSSASRRV

SEQ ID NO: 1027364 - protein, 13 aa, Mycobacterium
SVETNGKGCSGGV

SEQ ID NO: 1027365 - protein, 5 aa, Mycobacterium
SVGAD

SEQ ID NO: 1027366 - protein, 13 aa, Mycobacterium
SVGAGQNALAGTG

SEQ ID NO: 1027367 - protein, 7 aa, Mycobacterium
SVGASAS

SEQ ID NO: 1027368 - protein, 6 aa, Mycobacterium
SVGATA

SEQ ID NO: 1027369 - protein, 11 aa, Mycobacterium
SVGDQGKRDVS

SEQ ID NO: 1027370 - protein, 7 aa, Mycobacterium
SVGGQGY

SEQ ID NO: 1027371 - protein, 14 aa, Mycobacterium
SVGLGSSARERNAA

SEQ ID NO: 1027372 - protein, 13 aa, Mycobacterium
SVGLGTDKTRDLA

SEQ ID NO: 1027373 - protein, 7 aa, Mycobacterium
SVGNAER

SEQ ID NO: 1027374 - protein, 5 aa, Mycobacterium
SVGPG

SEQ ID NO: 1027375 - protein, 7 aa, Mycobacterium
SVGRGRH

SEQ ID NO: 1027376 - protein, 9 aa, Mycobacterium
SVGTPRDVG

SEQ ID NO: 1027377 - protein, 13 aa, Mycobacterium
SVGTSARSGRSIC

SEQ ID NO: 1027378 - protein, 15 aa, Mycobacterium
SVGTVEEAAAWVARL

SEQ ID NO: 1027379 - protein, 6 aa, Mycobacterium
SVHNSQ

SEQ ID NO: 1027380 - protein, 18 aa, Mycobacterium
SVKGAQSARSDGFDATTK

SEQ ID NO: 1027381 - protein, 9 aa, Mycobacterium
SVKNGPALA

SEQ ID NO: 1027382 - protein, 6 aa, Mycobacterium
SVKPEE

SEQ ID NO: 1027383 - protein, 6 aa, Mycobacterium
SVKPGF

SEQ ID NO: 1027384 - protein, 9 aa, Mycobacterium
SVLSNDSTR

SEQ ID NO: 1027385 - protein, 14 aa, Mycobacterium
SVNNRPHELMVVPV

SEQ ID NO: 1027386 - protein, 19 aa, Mycobacterium
SVNTAGSDNGATASADGSF

SEQ ID NO: 1027387 - protein, 12 aa, Mycobacterium
SVPDRRPSAEEV

SEQ ID NO: 1027388 - protein, 5 aa, Mycobacterium
SVPGA

SEQ ID NO: 1027389 - protein, 12 aa, Mycobacterium
SVPGGTTADPAT

SEQ ID NO: 1027390 - protein, 4 aa, Mycobacterium
SVPR

SEQ ID NO: 1027391 - protein, 12 aa, Mycobacterium
SVPRTREPKVQQ

SEQ ID NO: 1027392 - protein, 6 aa, Mycobacterium
SVQPGQ

SEQ ID NO: 1027393 - protein, 6 aa, Mycobacterium
SVQSGR

SEQ ID NO: 1027394 - protein, 5 aa, Mycobacterium
SVQTE

SEQ ID NO: 1027395 - protein, 8 aa, Mycobacterium
SVRDPETK

SEQ ID NO: 1027396 - protein, 8 aa, Mycobacterium
SVRDTGRD

SEQ ID NO: 1027397 - protein, 12 aa, Mycobacterium
SVRDTTQPEPAT

SEQ ID NO: 1027398 - protein, 10 aa, Mycobacterium
SVRGKVGDSL

SEQ ID NO: 1027399 - protein, 16 aa, Mycobacterium
SVSARDSRGGTAPKRV

SEQ ID NO: 1027400 - protein, 6 aa, Mycobacterium
SVSDLS

SEQ ID NO: 1027401 - protein, 9 aa, Mycobacterium
SVSDNGRQE

SEQ ID NO: 1027402 - protein, 4 aa, Mycobacterium
SVSG

SEQ ID NO: 1027403 - protein, 11 aa, Mycobacterium
SVSGAGGIRGP

SEQ ID NO: 1027404 - protein, 8 aa, Mycobacterium
SVSGRGDL

SEQ ID NO: 1027405 - protein, 7 aa, Mycobacterium
SVSGSNL

SEQ ID NO: 1027406 - protein, 24 aa, Mycobacterium
SVSPGAAADGIRRRPKDRKAQIAR

SEQ ID NO: 1027407 - protein, 12 aa, Mycobacterium
SVSSTYPRLSGA

SEQ ID NO: 1027408 - protein, 5 aa, Mycobacterium
SVTAT

SEQ ID NO: 1027409 - protein, 14 aa, Mycobacterium
SVTATPRTSPAPQI

SEQ ID NO: 1027410 - protein, 8 aa, Mycobacterium
SVTDEYRK

SEQ ID NO: 1027411 - protein, 5 aa, Mycobacterium
SVTDN

SEQ ID NO: 1027412 - protein, 4 aa, Mycobacterium
SVTE

SEQ ID NO: 1027413 - protein, 17 aa, Mycobacterium
SVTGDAKGGPPKTPGYH

SEQ ID NO: 1027414 - protein, 11 aa, Mycobacterium
SVTGTGVGGRI

SEQ ID NO: 1027415 - protein, 6 aa, Mycobacterium
SVTPAT

SEQ ID NO: 1027416 - protein, 16 aa, Mycobacterium
SVTSGLTGGSWQGPAA

SEQ ID NO: 1027417 - protein, 10 aa, Mycobacterium
SVTSNTRGDA

SEQ ID NO: 1027418 - protein, 11 aa, Mycobacterium
SVTSPGGTTAA

SEQ ID NO: 1027419 - protein, 26 aa, Mycobacterium
SVTTGPIPGSSKAYREVANPDGGPSL

SEQ ID NO: 1027420 - protein, 14 aa, Mycobacterium
SVTTSGAATPADAI

SEQ ID NO: 1027421 - protein, 7 aa, Mycobacterium
SVVESSN

SEQ ID NO: 1027422 - protein, 14 aa, Mycobacterium
SVVETERPEPPEAK

SEQ ID NO: 1027423 - protein, 8 aa, Mycobacterium
SWEYTGDG

SEQ ID NO: 1027424 - protein, 4 aa, Mycobacterium
SWGI

SEQ ID NO: 1027425 - protein, 4 aa, Mycobacterium
SWGT

SEQ ID NO: 1027426 - protein, 9 aa, Mycobacterium
SWKESPPAE

SEQ ID NO: 1027427 - protein, 10 aa, Mycobacterium
SWPADESAVE

SEQ ID NO: 1027428 - protein, 21 aa, Mycobacterium
SWPAGSTSGGSDVEDVDIEYL

SEQ ID NO: 1027429 - protein, 6 aa, Mycobacterium
SWPAGV

SEQ ID NO: 1027430 - protein, 13 aa, Mycobacterium
SWPGVPGRPRRAG

SEQ ID NO: 1027431 - protein, 17 aa, Mycobacterium
SWPPNQPLPANLPWRPC

SEQ ID NO: 1027432 - protein, 12 aa, Mycobacterium
SWQGAAATAMSA

SEQ ID NO: 1027433 - protein, 8 aa, Mycobacterium
SWSNPSRV

SEQ ID NO: 1027434 - protein, 11 aa, Mycobacterium
SYAAAQRARRQ

SEQ ID NO: 1027435 - protein, 5 aa, Mycobacterium
SYAGQ

SEQ ID NO: 1027436 - protein, 6 aa, Mycobacterium
SYAPTA

SEQ ID NO: 1027437 - protein, 9 aa, Mycobacterium
SYDAESRNK

SEQ ID NO: 1027438 - protein, 4 aa, Mycobacterium
SYDG

SEQ ID NO: 1027439 - protein, 8 aa, Mycobacterium
SYDGQGCS

SEQ ID NO: 1027440 - protein, 7 aa, Mycobacterium
SYDQVSR

SEQ ID NO: 1027441 - protein, 9 aa, Mycobacterium
SYDRQRGGW

SEQ ID NO: 1027442 - protein, 49 aa, Mycobacterium
SYEQNGDGQWRRKGPVQARPAHAGEAISTPEGPATAADGDWVVRDGDGE

SEQ ID NO: 1027443 - protein, 15 aa, Mycobacterium
SYGATNSDDAEGYAM

SEQ ID NO: 1027444 - protein, 23 aa, Mycobacterium
SYGATNSDDAEGYAMTGGSTSVM

SEQ ID NO: 1027445 - protein, 17 aa, Mycobacterium
SYGDRGDAFAAAVRAAV

SEQ ID NO: 1027446 - protein, 5 aa, Mycobacterium
SYGGA

SEQ ID NO: 1027447 - protein, 6 aa, Mycobacterium
SYGPIG

SEQ ID NO: 1027448 - protein, 13 aa, Mycobacterium
SYGPQSDGSLGPE

SEQ ID NO: 1027449 - protein, 7 aa, Mycobacterium
SYGPTEA

SEQ ID NO: 1027450 - protein, 11 aa, Mycobacterium
SYGPTRDDARK

SEQ ID NO: 1027451 - protein, 6 aa, Mycobacterium
SYGYGR

SEQ ID NO: 1027452 - protein, 6 aa, Mycobacterium
SYHSRT

SEQ ID NO: 1027453 - protein, 9 aa, Mycobacterium
SYNEETKEI

SEQ ID NO: 1027454 - protein, 8 aa, Mycobacterium
SYPDGHTA

SEQ ID NO: 1027455 - protein, 10 aa, Mycobacterium
SYPGSDANAV

SEQ ID NO: 1027456 - protein, 9 aa, Mycobacterium
SYPPESAGR

SEQ ID NO: 1027457 - protein, 6 aa, Mycobacterium
SYPPMG

SEQ ID NO: 1027458 - protein, 19 aa, Mycobacterium
SYPPSLPASGTTARRSTPE

SEQ ID NO: 1027459 - protein, 5 aa, Mycobacterium
SYQGS

SEQ ID NO: 1027460 - protein, 6 aa, Mycobacterium
SYQRQR

SEQ ID NO: 1027461 - protein, 8 aa, Mycobacterium
SYRTDAPE

SEQ ID NO: 1027462 - protein, 11 aa, Mycobacterium
SYSAAEANRTV

SEQ ID NO: 1027463 - protein, 8 aa, Mycobacterium
SYSKDGAM

SEQ ID NO: 1027464 - protein, 4 aa, Mycobacterium
SYSS

SEQ ID NO: 1027465 - protein, 8 aa, Mycobacterium
SYTDGDKP

SEQ ID NO: 1027466 - protein, 6 aa, Mycobacterium
SYTEGR

SEQ ID NO: 1027467 - protein, 4 aa, Mycobacterium
SYTM

SEQ ID NO: 1027468 - protein, 6 aa, Mycobacterium
SYTPDN

SEQ ID NO: 1027469 - protein, 8 aa, Mycobacterium
SYTPVGGP

SEQ ID NO: 1027470 - protein, 4 aa, Mycobacterium
SYTS

SEQ ID NO: 1027471 - protein, 5 aa, Mycobacterium
TAAAA

SEQ ID NO: 1027472 - protein, 9 aa, Mycobacterium
TAAAELAPA

SEQ ID NO: 1027473 - protein, 8 aa, Mycobacterium
TAAAEQQD

SEQ ID NO: 1027474 - protein, 12 aa, Mycobacterium
TAAAGEADPLNG

SEQ ID NO: 1027475 - protein, 14 aa, Mycobacterium
TAAAGSAPGQPGRD

SEQ ID NO: 1027476 - protein, 11 aa, Mycobacterium
TAAAGTPPVRP

SEQ ID NO: 1027477 - protein, 8 aa, Mycobacterium
TAAAKSNG

SEQ ID NO: 1027478 - protein, 8 aa, Mycobacterium
TAAAPTTT

SEQ ID NO: 1027479 - protein, 6 aa, Mycobacterium
TAAARR

SEQ ID NO: 1027480 - protein, 27 aa, Mycobacterium
TAAASDAAGIGTTISSANAAASAPTTG

SEQ ID NO: 1027481 - protein, 6 aa, Mycobacterium
TAAAYP

SEQ ID NO: 1027482 - protein, 10 aa, Mycobacterium
TAADDDQLGE

SEQ ID NO: 1027483 - protein, 12 aa, Mycobacterium
TAADLPAPVRPG

SEQ ID NO: 1027484 - protein, 15 aa, Mycobacterium
TAADNSVDATASRDF

SEQ ID NO: 1027485 - protein, 22 aa, Mycobacterium
TAAEIGAADGDAVTVSSSRGSI

SEQ ID NO: 1027486 - protein, 12 aa, Mycobacterium
TAAERDARQQRL

SEQ ID NO: 1027487 - protein, 4 aa, Mycobacterium
TAAG

SEQ ID NO: 1027488 - protein, 10 aa, Mycobacterium
TAAGAAEATV

SEQ ID NO: 1027489 - protein, 8 aa, Mycobacterium
TAAGADLE

SEQ ID NO: 1027490 - protein, 11 aa, Mycobacterium
TAAGATRENSL

SEQ ID NO: 1027491 - protein, 17 aa, Mycobacterium
TAAGGEAVANGSDVSNW

SEQ ID NO: 1027492 - protein, 14 aa, Mycobacterium
TAAGGEPDANVEMD

SEQ ID NO: 1027493 - protein, 7 aa, Mycobacterium
TAAGGLT

SEQ ID NO: 1027494 - protein, 8 aa, Mycobacterium
TAAGGNAA

SEQ ID NO: 1027495 - protein, 10 aa, Mycobacterium
TAAGMGPDGK

SEQ ID NO: 1027496 - protein, 8 aa, Mycobacterium
TAAGSGCA

SEQ ID NO: 1027497 - protein, 10 aa, Mycobacterium
TAAGSGNSNV

SEQ ID NO: 1027498 - protein, 8 aa, Mycobacterium
TAAGSGPT

SEQ ID NO: 1027499 - protein, 7 aa, Mycobacterium
TAAGTGV

SEQ ID NO: 1027500 - protein, 7 aa, Mycobacterium
TAAGTSC

SEQ ID NO: 1027501 - protein, 10 aa, Mycobacterium
TAAGVPSETV

SEQ ID NO: 1027502 - protein, 7 aa, Mycobacterium
TAANPVD

SEQ ID NO: 1027503 - protein, 10 aa, Mycobacterium
TAANQDGRSE

SEQ ID NO: 1027504 - protein, 8 aa, Mycobacterium
TAAPDQLD

SEQ ID NO: 1027505 - protein, 13 aa, Mycobacterium
TAAPEPPAPRAPL

SEQ ID NO: 1027506 - protein, 8 aa, Mycobacterium
TAAPRIPA

SEQ ID NO: 1027507 - protein, 21 aa, Mycobacterium
TAAPVATAKTRWSRRSSERRA

SEQ ID NO: 1027508 - protein, 11 aa, Mycobacterium
TAAQAAAAAPT

SEQ ID NO: 1027509 - protein, 19 aa, Mycobacterium
TAAQAEESAVQAAAAAAAY

SEQ ID NO: 1027510 - protein, 16 aa, Mycobacterium
TAAQAELASAQARAAV

SEQ ID NO: 1027511 - protein, 5 aa, Mycobacterium
TAAQH

SEQ ID NO: 1027512 - protein, 4 aa, Mycobacterium
TAAR

SEQ ID NO: 1027513 - protein, 5 aa, Mycobacterium
TAARA

SEQ ID NO: 1027514 - protein, 5 aa, Mycobacterium
TAARR

SEQ ID NO: 1027515 - protein, 12 aa, Mycobacterium
TAARSISSTPLP

SEQ ID NO: 1027516 - protein, 9 aa, Mycobacterium
TAASAPSPG

SEQ ID NO: 1027517 - protein, 9 aa, Mycobacterium
TAASNDEVD

SEQ ID NO: 1027518 - protein, 7 aa, Mycobacterium
TAASSGL

SEQ ID NO: 1027519 - protein, 9 aa, Mycobacterium
TAATDGNLD

SEQ ID NO: 1027520 - protein, 5 aa, Mycobacterium
TAATT

SEQ ID NO: 1027521 - protein, 7 aa, Mycobacterium
TAATYGA

SEQ ID NO: 1027522 - protein, 12 aa, Mycobacterium
TADAATSDLTLP

SEQ ID NO: 1027523 - protein, 7 aa, Mycobacterium
TADAERS

SEQ ID NO: 1027524 - protein, 5 aa, Mycobacterium
TADDG

SEQ ID NO: 1027525 - protein, 32 aa, Mycobacterium
TADDRVPYNGGPGAARSFDGTARVDGPSAAAV

SEQ ID NO: 1027526 - protein, 9 aa, Mycobacterium
TADDTDPTE

SEQ ID NO: 1027527 - protein, 8 aa, Mycobacterium
TADGARAQ

SEQ ID NO: 1027528 - protein, 7 aa, Mycobacterium
TADGEQH

SEQ ID NO: 1027529 - protein, 8 aa, Mycobacterium
TADGKEIA

SEQ ID NO: 1027530 - protein, 6 aa, Mycobacterium
TADGPV

SEQ ID NO: 1027531 - protein, 4 aa, Mycobacterium
TADH

SEQ ID NO: 1027532 - protein, 14 aa, Mycobacterium
TADHGFTASREACK

SEQ ID NO: 1027533 - protein, 5 aa, Mycobacterium
TADIS

SEQ ID NO: 1027534 - protein, 5 aa, Mycobacterium
TADNG

SEQ ID NO: 1027535 - protein, 6 aa, Mycobacterium
TADNVD

SEQ ID NO: 1027536 - protein, 4 aa, Mycobacterium
TADP

SEQ ID NO: 1027537 - protein, 9 aa, Mycobacterium
TADPAEQHT

SEQ ID NO: 1027538 - protein, 10 aa, Mycobacterium
TADPAHHGRP

SEQ ID NO: 1027539 - protein, 8 aa, Mycobacterium
TADPANRH

SEQ ID NO: 1027540 - protein, 8 aa, Mycobacterium
TADPASAS

SEQ ID NO: 1027541 - protein, 5 aa, Mycobacterium
TADPE

SEQ ID NO: 1027542 - protein, 61 aa, Mycobacterium; identical to SEQ ID NO: 918420

SEQ ID NO: 1027543 - protein, 7 aa, Mycobacterium
TADQSEG

SEQ ID NO: 1027544 - protein, 4 aa, Mycobacterium
TADR

SEQ ID NO: 1027545 - protein, 16 aa, Mycobacterium
TADRAELEGVSAERAR

SEQ ID NO: 1027546 - protein, 8 aa, Mycobacterium
TADTARLA

SEQ ID NO: 1027547 - protein, 4 aa, Mycobacterium
TAEA

SEQ ID NO: 1027548 - protein, 9 aa, Mycobacterium
TAEAANASP

SEQ ID NO: 1027549 - protein, 24 aa, Mycobacterium
TAEAGQGGGAQGASGTSGAAAKGV

SEQ ID NO: 1027550 - protein, 25 aa, Mycobacterium
TAEAGRAPGARCAGSGTGRAAGSTL

SEQ ID NO: 1027551 - protein, 9 aa, Mycobacterium
TAEARSGAD

SEQ ID NO: 1027552 - protein, 15 aa, Mycobacterium
TAEERANALRGRADS

SEQ ID NO: 1027553 - protein, 7 aa, Mycobacterium
TAEFSGS

SEQ ID NO: 1027554 - protein, 8 aa, Mycobacterium
TAEGDVDA

SEQ ID NO: 1027555 - protein, 12 aa, Mycobacterium
TAEGKIQVARLA

SEQ ID NO: 1027556 - protein, 9 aa, Mycobacterium
TAEGNRLGP

SEQ ID NO: 1027557 - protein, 6 aa, Mycobacterium
TAEGPM

SEQ ID NO: 1027558 - protein, 12 aa, Mycobacterium
TAEGSPATADGV

SEQ ID NO: 1027559 - protein, 4 aa, Mycobacterium
TAEH

SEQ ID NO: 1027560 - protein, 5 aa, Mycobacterium
TAELS

SEQ ID NO: 1027561 - protein, 5 aa, Mycobacterium
TAELT

SEQ ID NO: 1027562 - protein, 9 aa, Mycobacterium
TAENPARAP

SEQ ID NO: 1027563 - protein, 4 aa, Mycobacterium
TAEP

SEQ ID NO: 1027564 - protein, 7 aa, Mycobacterium
TAEPEER

SEQ ID NO: 1027565 - protein, 10 aa, Mycobacterium
TAEPGRDPIS

SEQ ID NO: 1027566 - protein, 12 aa, Mycobacterium
TAEPHPKLPGTV

SEQ ID NO: 1027567 - protein, 5 aa, Mycobacterium
TAEPK

SEQ ID NO: 1027568 - protein, 8 aa, Mycobacterium
TAEPSIPM

SEQ ID NO: 1027569 - protein, 4 aa, Mycobacterium
TAEQ

SEQ ID NO: 1027570 - protein, 13 aa, Mycobacterium
TAEQNASNDGKGA

SEQ ID NO: 1027571 - protein, 6 aa, Mycobacterium
TAEQRG

SEQ ID NO: 1027572 - protein, 8 aa, Mycobacterium
TAERGGQV

SEQ ID NO: 1027573 - protein, 7 aa, Mycobacterium
TAERRAG

SEQ ID NO: 1027574 - protein, 6 aa, Mycobacterium
TAESCT

SEQ ID NO: 1027575 - protein, 9 aa, Mycobacterium
TAESRRARR

SEQ ID NO: 1027576 - protein, 5 aa, Mycobacterium
TAESV

SEQ ID NO: 1027577 - protein, 6 aa, Mycobacterium
TAETAT

SEQ ID NO: 1027578 - protein, 7 aa, Mycobacterium
TAETEQA

SEQ ID NO: 1027579 - protein, 14 aa, Mycobacterium
TAEVGARAGLAVKA

SEQ ID NO: 1027580 - protein, 4 aa, Mycobacterium
TAFG

SEQ ID NO: 1027581 - protein, 6 aa, Mycobacterium
TAFPTD

SEQ ID NO: 1027582 - protein, 7 aa, Mycobacterium
TAFTDGE

SEQ ID NO: 1027583 - protein, 4 aa, Mycobacterium
TAGA

SEQ ID NO: 1027584 - protein, 39 aa, Mycobacterium
TAGAATAAGVTSAAGAAAGSADAGPAGAASAADAARPAV

SEQ ID NO: 1027585 - protein, 11 aa, Mycobacterium
TAGAPDPTGAA

SEQ ID NO: 1027586 - protein, 27 aa, Mycobacterium
TAGATGTHAGVATSATGSSRATKGPVA

SEQ ID NO: 1027587 - protein, 19 aa, Mycobacterium
TAGATSRTSTVLVVVLGYD

SEQ ID NO: 1027588 - protein, 6 aa, Mycobacterium
TAGDAA

SEQ ID NO: 1027589 - protein, 14 aa, Mycobacterium
TAGDSARAKTLSEQ

SEQ ID NO: 1027590 - protein, 6 aa, Mycobacterium
TAGEPL

SEQ ID NO: 1027591 - protein, 26 aa, Mycobacterium
TAGEQETPAQGAIEPGSGRLQLRRQH

SEQ ID NO: 1027592 - protein, 6 aa, Mycobacterium
TAGERP

SEQ ID NO: 1027593 - protein, 4 aa, Mycobacterium
TAGG

SEQ ID NO: 1027594 - protein, 6 aa, Mycobacterium
TAGGEH

SEQ ID NO: 1027595 - protein, 11 aa, Mycobacterium
TAGGKRTEAAV

SEQ ID NO: 1027596 - protein, 10 aa, Mycobacterium
TAGGPAANRA

SEQ ID NO: 1027597 - protein, 8 aa, Mycobacterium
TAGGPPKV

SEQ ID NO: 1027598 - protein, 43 aa, Mycobacterium
TAGHPAGPAWSGRRPGGIAGSPDGGIRGRPARQGPRATRRTTE

SEQ ID NO: 1027599 - protein, 5 aa, Mycobacterium
TAGIG

SEQ ID NO: 1027600 - protein, 6 aa, Mycobacterium
TAGITD

SEQ ID NO: 1027601 - protein, 5 aa, Mycobacterium
TAGKG

SEQ ID NO: 1027602 - protein, 7 aa, Mycobacterium
TAGKPGE

SEQ ID NO: 1027603 - protein, 62 aa, Mycobacterium
TAGKPPRWPSGEDADPCPNPRTKPGESHRHRAPMQSQGTGSRRRRPRRPVRHPGAGNRSRRA

SEQ ID NO: 1027604 - protein, 4 aa, Mycobacterium
TAGL

SEQ ID NO: 1027605 - protein, 8 aa, Mycobacterium
TAGLPAAA

SEQ ID NO: 1027606 - protein, 9 aa, Mycobacterium
TAGPGVTNG

SEQ ID NO: 1027607 - protein, 5 aa, Mycobacterium
TAGPQ

SEQ ID NO: 1027608 - protein, 8 aa, Mycobacterium
TAGPRVDP

SEQ ID NO: 1027609 - protein, 17 aa, Mycobacterium
TAGQDCASDGPHPEHTG

SEQ ID NO: 1027610 - protein, 16 aa, Mycobacterium
TAGQRAGNLPLTPEQA

SEQ ID NO: 1027611 - protein, 8 aa, Mycobacterium
TAGRNHSS

SEQ ID NO: 1027612 - protein, 12 aa, Mycobacterium
TAGRNTAKGTGP

SEQ ID NO: 1027613 - protein, 11 aa, Mycobacterium
TAGRSELQNVP

SEQ ID NO: 1027614 - protein, 16 aa, Mycobacterium
TAGRTTLTGEGLQHAD

SEQ ID NO: 1027615 - protein, 16 aa, Mycobacterium
TAGRVKPTTAAVSHDG

SEQ ID NO: 1027616 - protein, 11 aa, Mycobacterium
TAGRVQGSSNE

SEQ ID NO: 1027617 - protein, 5 aa, Mycobacterium
TAGSD

SEQ ID NO: 1027618 - protein, 6 aa, Mycobacterium
TAGSHS

SEQ ID NO: 1027619 - protein, 20 aa, Mycobacterium
TAGSPCSALKPGSPPPCKTP

SEQ ID NO: 1027620 - protein, 7 aa, Mycobacterium
TAGSRLD

SEQ ID NO: 1027621 - protein, 9 aa, Mycobacterium
TAGSSEKLQ

SEQ ID NO: 1027622 - protein, 8 aa, Mycobacterium
TAGSVGRN

SEQ ID NO: 1027623 - protein, 6 aa, Mycobacterium
TAGSWE

SEQ ID NO: 1027624 - protein, 7 aa, Mycobacterium
TAGTIAD

SEQ ID NO: 1027625 - protein, 12 aa, Mycobacterium
TAGVTQADSGYL

SEQ ID NO: 1027626 - protein, 6 aa, Mycobacterium
TAHADS

SEQ ID NO: 1027627 - protein, 6 aa, Mycobacterium
TAHGRR

SEQ ID NO: 1027628 - protein, 8 aa, Mycobacterium
TAHKAAPG

SEQ ID NO: 1027629 - protein, 12 aa, Mycobacterium
TAHPRPASNPYP

SEQ ID NO: 1027630 - protein, 7 aa, Mycobacterium
TAHSDRV

SEQ ID NO: 1027631 - protein, 8 aa, Mycobacterium
TAHSTAPA

SEQ ID NO: 1027632 - protein, 8 aa, Mycobacterium
TAIRGEAP

SEQ ID NO: 1027633 - protein, 30 aa, Mycobacterium
TAITPYGAGTQCSRSGPMTAGAVNEAGKTL

SEQ ID NO: 1027634 - protein, 4 aa, Mycobacterium
TAKA

SEQ ID NO: 1027635 - protein, 7 aa, Mycobacterium
TAKEQNV

SEQ ID NO: 1027636 - protein, 5 aa, Mycobacterium
TAKGI

SEQ ID NO: 1027637 - protein, 15 aa, Mycobacterium
TAKPGAFRRPNGQAF

SEQ ID NO: 1027638 - protein, 5 aa, Mycobacterium
TAKPY

SEQ ID NO: 1027639 - protein, 5 aa, Mycobacterium
TAKRD

SEQ ID NO: 1027640 - protein, 16 aa, Mycobacterium
TAKRRAESANVSRVSD

SEQ ID NO: 1027641 - protein, 36 aa, Mycobacterium
TAKTAGAIGPAAAAPAATVAATGAAEAVGAGPVSAS

SEQ ID NO: 1027642 - protein, 6 aa, Mycobacterium
TALGNP

SEQ ID NO: 1027643 - protein, 6 aa, Mycobacterium
TALGQD

SEQ ID NO: 1027644 - protein, 10 aa, Mycobacterium
TALGTGRGEE

SEQ ID NO: 1027645 - protein, 10 aa, Mycobacterium
TALPPPAGVP

SEQ ID NO: 1027646 - protein, 8 aa, Mycobacterium
TALSGTAG

SEQ ID NO: 1027647 - protein, 9 aa, Mycobacterium
TALTTPSGV

SEQ ID NO: 1027648 - protein, 24 aa, Mycobacterium
TAMDGYASSSAAASEVTPVAEPRQ

SEQ ID NO: 1027649 - protein, 8 aa, Mycobacterium
TAMPSPTG

SEQ ID NO: 1027650 - protein, 17 aa, Mycobacterium
TAMTSYSSTSAAARALT

SEQ ID NO: 1027651 - protein, 4 aa, Mycobacterium
TANA

SEQ ID NO: 1027652 - protein, 9 aa, Mycobacterium
TANAAAGGK

SEQ ID NO: 1027653 - protein, 10 aa, Mycobacterium
TANAAEADEI

SEQ ID NO: 1027654 - protein, 12 aa, Mycobacterium
TANAQAAGATTS

SEQ ID NO: 1027655 - protein, 5 aa, Mycobacterium
TANGA

SEQ ID NO: 1027656 - protein, 9 aa, Mycobacterium
TANGKIDQR

SEQ ID NO: 1027657 - protein, 6 aa, Mycobacterium
TANGPL

SEQ ID NO: 1027658 - protein, 6 aa, Mycobacterium
TANITS

SEQ ID NO: 1027659 - protein, 14 aa, Mycobacterium
TANSAAATQTTAVT

SEQ ID NO: 1027660 - protein, 31 aa, Mycobacterium
TANSGAHSGSRATRRATQLRSRAARRAATQP

SEQ ID NO: 1027661 - protein, 7 aa, Mycobacterium
TANTRSI

SEQ ID NO: 1027662 - protein, 5 aa, Mycobacterium
TAPAA

SEQ ID NO: 1027663 - protein, 6 aa, Mycobacterium
TAPALA

SEQ ID NO: 1027664 - protein, 12 aa, Mycobacterium
TAPALAPDERDA

SEQ ID NO: 1027665 - protein, 17 aa, Mycobacterium
TAPANNPASASAVQAQD

SEQ ID NO: 1027666 - protein, 8 aa, Mycobacterium
TAPAPHHT

SEQ ID NO: 1027667 - protein, 27 aa, Mycobacterium
TAPAQWQPDRSAELQTQIDSGASRPVI

SEQ ID NO: 1027668 - protein, 7 aa, Mycobacterium
TAPATAG

SEQ ID NO: 1027669 - protein, 7 aa, Mycobacterium
TAPAVRR

SEQ ID NO: 1027670 - protein, 4 aa, Mycobacterium
TAPC

SEQ ID NO: 1027671 - protein, 10 aa, Mycobacterium
TAPDGASLPR

SEQ ID NO: 1027672 - protein, 5 aa, Mycobacterium
TAPDT

SEQ ID NO: 1027673 - protein, 6 aa, Mycobacterium
TAPDWQ

SEQ ID NO: 1027674 - protein, 9 aa, Mycobacterium
TAPEGKTMG

SEQ ID NO: 1027675 - protein, 9 aa, Mycobacterium
TAPEPESVA

SEQ ID NO: 1027676 - protein, 6 aa, Mycobacterium
TAPESV

SEQ ID NO: 1027677 - protein, 11 aa, Mycobacterium
TAPEYSRSTEY

SEQ ID NO: 1027678 - protein, 6 aa, Mycobacterium
TAPFTD

SEQ ID NO: 1027679 - protein, 24 aa, Mycobacterium
TAPGALRTGSRGCCSKEDASDARR

SEQ ID NO: 1027680 - protein, 12 aa, Mycobacterium
TAPGDDPELRTE

SEQ ID NO: 1027681 - protein, 18 aa, Mycobacterium
TAPGDPVAGASRGSAGLS

SEQ ID NO: 1027682 - protein, 7 aa, Mycobacterium
TAPGGDA

SEQ ID NO: 1027683 - protein, 7 aa, Mycobacterium
TAPGGRT

SEQ ID NO: 1027684 - protein, 15 aa, Mycobacterium
TAPGKSQIGGASNAG

SEQ ID NO: 1027685 - protein, 5 aa, Mycobacterium
TAPGQ

SEQ ID NO: 1027686 - protein, 10 aa, Mycobacterium
TAPGQRIPRT

SEQ ID NO: 1027687 - protein, 20 aa, Mycobacterium
TAPGRAWSGAGAASAGASGV

SEQ ID NO: 1027688 - protein, 6 aa, Mycobacterium
TAPGSA

SEQ ID NO: 1027689 - protein, 8 aa, Mycobacterium
TAPKFPPS

SEQ ID NO: 1027690 - protein, 10 aa, Mycobacterium
TAPKSNAVTT

SEQ ID NO: 1027691 - protein, 8 aa, Mycobacterium
TAPPAAAG

SEQ ID NO: 1027692 - protein, 13 aa, Mycobacterium
TAPPAQQPAAGLK

SEQ ID NO: 1027693 - protein, 6 aa, Mycobacterium
TAPPEL

SEQ ID NO: 1027694 - protein, 10 aa, Mycobacterium
TAPPESNAPA

SEQ ID NO: 1027695 - protein, 7 aa, Mycobacterium
TAPPGIT

SEQ ID NO: 1027696 - protein, 6 aa, Mycobacterium
TAPPGY

SEQ ID NO: 1027697 - protein, 5 aa, Mycobacterium
TAPPH

SEQ ID NO: 1027698 - protein, 20 aa, Mycobacterium
TAPRVTDPRMSPYPYAASKS

SEQ ID NO: 1027699 - protein, 13 aa, Mycobacterium
TAPTAERERPAGD

SEQ ID NO: 1027700 - protein, 11 aa, Mycobacterium
TAPTPTSAATA

SEQ ID NO: 1027701 - protein, 4 aa, Mycobacterium
TAPV

SEQ ID NO: 1027702 - protein, 11 aa, Mycobacterium
TAPVGADGRSH

SEQ ID NO: 1027703 - protein, 7 aa, Mycobacterium
TAPVPAG

SEQ ID NO: 1027704 - protein, 4 aa, Mycobacterium
TAQA

SEQ ID NO: 1027705 - protein, 5 aa, Mycobacterium
TAQAG

SEQ ID NO: 1027706 - protein, 12 aa, Mycobacterium
TAQATATDGTPL

SEQ ID NO: 1027707 - protein, 5 aa, Mycobacterium
TAQDW

SEQ ID NO: 1027708 - protein, 8 aa, Mycobacterium
TAQGRKAE

SEQ ID NO: 1027709 - protein, 13 aa, Mycobacterium
TAQGTALGPAPNH

SEQ ID NO: 1027710 - protein, 4 aa, Mycobacterium
TAQH

SEQ ID NO: 1027711 - protein, 6 aa, Mycobacterium
TAQRDR

SEQ ID NO: 1027712 - protein, 18 aa, Mycobacterium
TAQRPARAHPVRQQDAAD

SEQ ID NO: 1027713 - protein, 9 aa, Mycobacterium
TAQRRSPTA

SEQ ID NO: 1027714 - protein, 6 aa, Mycobacterium
TAQRWS

SEQ ID NO: 1027715 - protein, 8 aa, Mycobacterium
TAQSAEDA

SEQ ID NO: 1027716 - protein, 9 aa, Mycobacterium
TAQSATPTG

SEQ ID NO: 1027717 - protein, 11 aa, Mycobacterium
TAQSNADETIS

SEQ ID NO: 1027718 - protein, 9 aa, Mycobacterium
TAQTELAAQ

SEQ ID NO: 1027719 - protein, 4 aa, Mycobacterium
TARA

SEQ ID NO: 1027720 - protein, 5 aa, Mycobacterium
TARAA

SEQ ID NO: 1027721 - protein, 9 aa, Mycobacterium
TARAASAAA

SEQ ID NO: 1027722 - protein, 5 aa, Mycobacterium
TARAQ

SEQ ID NO: 1027723 - protein, 19 aa, Mycobacterium
TARCANSPTPPRCWRPPTA

SEQ ID NO: 1027724 - protein, 8 aa, Mycobacterium
TARDEQGC

SEQ ID NO: 1027725 - protein, 8 aa, Mycobacterium
TARDNTSR

SEQ ID NO: 1027726 - protein, 6 aa, Mycobacterium
TAREEL

SEQ ID NO: 1027727 - protein, 5 aa, Mycobacterium
TAREF

SEQ ID NO: 1027728 - protein, 6 aa, Mycobacterium
TAREQG

SEQ ID NO: 1027729 - protein, 5 aa, Mycobacterium
TARGQ

SEQ ID NO: 1027730 - protein, 6 aa, Mycobacterium
TARGSR

SEQ ID NO: 1027731 - protein, 25 aa, Mycobacterium
TARKTAATAKSDKFSDGGTTWLCNR

SEQ ID NO: 1027732 - protein, 9 aa, Mycobacterium
TARPSGTAW

SEQ ID NO: 1027733 - protein, 4 aa, Mycobacterium
TARQ

SEQ ID NO: 1027734 - protein, 8 aa, Mycobacterium
TARQRTDA

SEQ ID NO: 1027735 - protein, 10 aa, Mycobacterium
TARRAHPTAD

SEQ ID NO: 1027736 - protein, 25 aa, Mycobacterium
TARREGISTTATVSGAGVESLTSQR

SEQ ID NO: 1027737 - protein, 7 aa, Mycobacterium
TARRGPL

SEQ ID NO: 1027738 - protein, 14 aa, Mycobacterium
TARSGADGSAVDAQ

SEQ ID NO: 1027739 - protein, 11 aa, Mycobacterium
TARSSDFAAAP

SEQ ID NO: 1027740 - protein, 9 aa, Mycobacterium
TASAAGTAT

SEQ ID NO: 1027741 - protein, 9 aa, Mycobacterium
TASAATAER

SEQ ID NO: 1027742 - protein, 8 aa, Mycobacterium
TASADPPV

SEQ ID NO: 1027743 - protein, 5 aa, Mycobacterium
TASAR

SEQ ID NO: 1027744 - protein, 6 aa, Mycobacterium
TASASE

SEQ ID NO: 1027745 - protein, 8 aa, Mycobacterium
TASASTLD

SEQ ID NO: 1027746 - protein, 10 aa, Mycobacterium
TASATATATA

SEQ ID NO: 1027747 - protein, 18 aa, Mycobacterium
TASDGASAIASARAERPD

SEQ ID NO: 1027748 - protein, 6 aa, Mycobacterium
TASEEF

SEQ ID NO: 1027749 - protein, 6 aa, Mycobacterium
TASESI

SEQ ID NO: 1027750 - protein, 11 aa, Mycobacterium
TASGATPDNLY

SEQ ID NO: 1027751 - protein, 14 aa, Mycobacterium
TASGEPQAPTPPVK

SEQ ID NO: 1027752 - protein, 7 aa, Mycobacterium
TASGNAR

SEQ ID NO: 1027753 - protein, 53 aa, Mycobacterium
TASGQSLANADVQSAQRAYTRRTDSDTGGYDQQDNRQRPAKRRFAKKDGDGLL

SEQ ID NO: 1027754 - protein, 20 aa, Mycobacterium
TASGSSYAAAEAANTNPLQG

SEQ ID NO: 1027755 - protein, 6 aa, Mycobacterium
TASKGK

SEQ ID NO: 1027756 - protein, 9 aa, Mycobacterium
TASLAREHN

SEQ ID NO: 1027757 - protein, 4 aa, Mycobacterium
TASN

SEQ ID NO: 1027758 - protein, 5 aa, Mycobacterium
TASND

SEQ ID NO: 1027759 - protein, 8 aa, Mycobacterium
TASPDGRF

SEQ ID NO: 1027760 - protein, 11 aa, Mycobacterium
TASPEDLGNIQ

SEQ ID NO: 1027761 - protein, 4 aa, Mycobacterium
TASR

SEQ ID NO: 1027762 - protein, 5 aa, Mycobacterium
TASRI

SEQ ID NO: 1027763 - protein, 18 aa, Mycobacterium
TASRRQWPGGGPLLGPSD

SEQ ID NO: 1027764 - protein, 5 aa, Mycobacterium
TASRT

SEQ ID NO: 1027765 - protein, 11 aa, Mycobacterium
TASRYRRRDSR

SEQ ID NO: 1027766 - protein, 4 aa, Mycobacterium
TASV

SEQ ID NO: 1027767 - protein, 20 aa, Mycobacterium
TASVPAGSVPPVSAAAAAAG

SEQ ID NO: 1027768 - protein, 4 aa, Mycobacterium
TATA

SEQ ID NO: 1027769 - protein, 13 aa, Mycobacterium
TATADGAEKAAIG

SEQ ID NO: 1027770 - protein, 10 aa, Mycobacterium
TATAGTPRRY

SEQ ID NO: 1027771 - protein, 7 aa, Mycobacterium
TATASAV

SEQ ID NO: 1027772 - protein, 4 aa, Mycobacterium
TATD

SEQ ID NO: 1027773 - protein, 8 aa, Mycobacterium
TATDSGGR

SEQ ID NO: 1027774 - protein, 4 aa, Mycobacterium
TATE

SEQ ID NO: 1027775 - protein, 7 aa, Mycobacterium
TATERSH

SEQ ID NO: 1027776 - protein, 20 aa, Mycobacterium
TATFGGPVETPAGDALAQEG

SEQ ID NO: 1027777 - protein, 17 aa, Mycobacterium
TATGAQPQVAGKPGPQL

SEQ ID NO: 1027778 - protein, 100 aa, Mycobacterium
TATGGEGGVGGAGTTVAAGGVGGHGGNATLAASDAGSSADGTATGGAGGAGGTNYASGGRGGDATIRTSGGGTITGGTATGGVGGAGTTGGSGGGGGSGA

SEQ ID NO: 1027779 - protein, 7 aa, Mycobacterium
TATGIAG

SEQ ID NO: 1027780 - protein, 6 aa, Mycobacterium
TATGSV

SEQ ID NO: 1027781 - protein, 21 aa, Mycobacterium
TATISPTPQQPDGGARSPKYR

SEQ ID NO: 1027782 - protein, 27 aa, Mycobacterium
TATKHRPATTETNDPGEVLVTIIADVK

SEQ ID NO: 1027783 - protein, 6 aa, Mycobacterium
TATNDV

SEQ ID NO: 1027784 - protein, 15 aa, Mycobacterium
TATPATASSLPIQPD

SEQ ID NO: 1027785 - protein, 10 aa, Mycobacterium
TATPEAAGLS

SEQ ID NO: 1027786 - protein, 7 aa, Mycobacterium
TATPERL

SEQ ID NO: 1027787 - protein, 13 aa, Mycobacterium
TATPGPVSDYTGK

SEQ ID NO: 1027788 - protein, 20 aa, Mycobacterium
TATQAAQAATQATAAATAYE

SEQ ID NO: 1027789 - protein, 16 aa, Mycobacterium
TATQAELAANQARGAA

SEQ ID NO: 1027790 - protein, 5 aa, Mycobacterium
TATRA

SEQ ID NO: 1027791 - protein, 20 aa, Mycobacterium
TATRKGVEDAGGTYEPHPAE

SEQ ID NO: 1027792 - protein, 13 aa, Mycobacterium
TATSDGQVYSFAP

SEQ ID NO: 1027793 - protein, 8 aa, Mycobacterium
TATSDSGV

SEQ ID NO: 1027794 - protein, 7 aa, Mycobacterium
TATSGAD

SEQ ID NO: 1027795 - protein, 31 aa, Mycobacterium
TATSRRPWTRPPVPGTPTTPISSPTAPRPRT

SEQ ID NO: 1027796 - protein, 10 aa, Mycobacterium
TATTEPRPEA

SEQ ID NO: 1027797 - protein, 5 aa, Mycobacterium
TATTG

SEQ ID NO: 1027798 - protein, 7 aa, Mycobacterium
TATTGGK

SEQ ID NO: 1027799 - protein, 8 aa, Mycobacterium
TATTPDLG

SEQ ID NO: 1027800 - protein, 7 aa, Mycobacterium
TATTTGM

SEQ ID NO: 1027801 - protein, 9 aa, Mycobacterium
TATVDRRDT

SEQ ID NO: 1027802 - protein, 11 aa, Mycobacterium
TATVPDTARAR

SEQ ID NO: 1027803 - protein, 6 aa, Mycobacterium
TATVVS

SEQ ID NO: 1027804 - protein, 12 aa, Mycobacterium
TAVADPPPNCTT

SEQ ID NO: 1027805 - protein, 5 aa, Mycobacterium
TAVEA

SEQ ID NO: 1027806 - protein, 4 aa, Mycobacterium
TAVG

SEQ ID NO: 1027807 - protein, 7 aa, Mycobacterium
TAVNAPA

SEQ ID NO: 1027808 - protein, 6 aa, Mycobacterium
TAVNRA

SEQ ID NO: 1027809 - protein, 11 aa, Mycobacterium
TAVPDTGSPVD

SEQ ID NO: 1027810 - protein, 15 aa, Mycobacterium
TAVQQATGHSDTPDE

SEQ ID NO: 1027811 - protein, 9 aa, Mycobacterium
TAVQTTSPT

SEQ ID NO: 1027812 - protein, 7 aa, Mycobacterium
TAVRDGD

SEQ ID NO: 1027813 - protein, 8 aa, Mycobacterium
TAVRDGDS

SEQ ID NO: 1027814 - protein, 6 aa, Mycobacterium
TAVRQG

SEQ ID NO: 1027815 - protein, 10 aa, Mycobacterium
TAVRTPSGYR

SEQ ID NO: 1027816 - protein, 5 aa, Mycobacterium
TAVSS

SEQ ID NO: 1027817 - protein, 9 aa, Mycobacterium
TAVSSRFPG

SEQ ID NO: 1027818 - protein, 5 aa, Mycobacterium
TAWNP

SEQ ID NO: 1027819 - protein, 17 aa, Mycobacterium
TAYGDKGAERDVGGYDG

SEQ ID NO: 1027820 - protein, 10 aa, Mycobacterium
TAYGSNDTVY

SEQ ID NO: 1027821 - protein, 6 aa, Mycobacterium
TAYPGD

SEQ ID NO: 1027822 - protein, 5 aa, Mycobacterium
TCPGW

SEQ ID NO: 1027823 - protein, 8 aa, Mycobacterium
TCRPDNTL

SEQ ID NO: 1027824 - protein, 6 aa, Mycobacterium
TDAAAT

SEQ ID NO: 1027825 - protein, 6 aa, Mycobacterium
TDAAPA

SEQ ID NO: 1027826 - protein, 10 aa, Mycobacterium
TDAARDSEES

SEQ ID NO: 1027827 - protein, 8 aa, Mycobacterium
TDAASGYA

SEQ ID NO: 1027828 - protein, 5 aa, Mycobacterium
TDADA

SEQ ID NO: 1027829 - protein, 12 aa, Mycobacterium
TDADGSVSASAL

SEQ ID NO: 1027830 - protein, 6 aa, Mycobacterium
TDADSA

SEQ ID NO: 1027831 - protein, 7 aa, Mycobacterium
TDADSRN

SEQ ID NO: 1027832 - protein, 6 aa, Mycobacterium
TDADSV

SEQ ID NO: 1027833 - protein, 5 aa, Mycobacterium
TDADT

SEQ ID NO: 1027834 - protein, 14 aa, Mycobacterium
TDADVGSFDGGYGS

SEQ ID NO: 1027835 - protein, 14 aa, Mycobacterium
TDAELAKGPDFSAA

SEQ ID NO: 1027836 - protein, 6 aa, Mycobacterium
TDAEPG

SEQ ID NO: 1027837 - protein, 5 aa, Mycobacterium
TDAET

SEQ ID NO: 1027838 - protein, 26 aa, Mycobacterium
TDAGQAADVAHAGKPATDRGTRLPTQ

SEQ ID NO: 1027839 - protein, 7 aa, Mycobacterium
TDAGRQI

SEQ ID NO: 1027840 - protein, 10 aa, Mycobacterium
TDAHESEEPQ

SEQ ID NO: 1027841 - protein, 7 aa, Mycobacterium
TDAKGRH

SEQ ID NO: 1027842 - protein, 5 aa, Mycobacterium
TDALE

SEQ ID NO: 1027843 - protein, 7 aa, Mycobacterium
TDALPER

SEQ ID NO: 1027844 - protein, 4 aa, Mycobacterium
TDAP

SEQ ID NO: 1027845 - protein, 8 aa, Mycobacterium
TDAPAPRH

SEQ ID NO: 1027846 - protein, 7 aa, Mycobacterium
TDAPDYS

SEQ ID NO: 1027847 - protein, 5 aa, Mycobacterium
TDAPV

SEQ ID NO: 1027848 - protein, 7 aa, Mycobacterium
TDAQARA

SEQ ID NO: 1027849 - protein, 16 aa, Mycobacterium
TDAQGTEAIGFGFEPA

SEQ ID NO: 1027850 - protein, 8 aa, Mycobacterium
TDAQQDGD

SEQ ID NO: 1027851 - protein, 8 aa, Mycobacterium
TDARPARE

SEQ ID NO: 1027852 - protein, 8 aa, Mycobacterium
TDARPDLA

SEQ ID NO: 1027853 - protein, 7 aa, Mycobacterium
TDARPQQ

SEQ ID NO: 1027854 - protein, 6 aa, Mycobacterium
TDASMT

SEQ ID NO: 1027855 - protein, 11 aa, Mycobacterium
TDATAATDSRF

SEQ ID NO: 1027856 - protein, 10 aa, Mycobacterium
TDATPSQREI

SEQ ID NO: 1027857 - protein, 9 aa, Mycobacterium
TDAYEQGRA

SEQ ID NO: 1027858 - protein, 6 aa, Mycobacterium
TDAYPK

SEQ ID NO: 1027859 - protein, 13 aa, Mycobacterium
TDCPAAGAPQQPS

SEQ ID NO: 1027860 - protein, 8 aa, Mycobacterium
TDDATTAM

SEQ ID NO: 1027861 - protein, 4 aa, Mycobacterium
TDDD

SEQ ID NO: 1027862 - protein, 19 aa, Mycobacterium
TDDDAGVDAAARAFAQLLS

SEQ ID NO: 1027863 - protein, 12 aa, Mycobacterium
TDDDAWDGKTGD

SEQ ID NO: 1027864 - protein, 10 aa, Mycobacterium
TDDDDDPDFT

SEQ ID NO: 1027865 - protein, 9 aa, Mycobacterium
TDDDGMGGN

SEQ ID NO: 1027866 - protein, 23 aa, Mycobacterium
TDDDNVRSAGRLAGSAASRASLE

SEQ ID NO: 1027867 - protein, 8 aa, Mycobacterium
TDDDPRFN

SEQ ID NO: 1027868 - protein, 6 aa, Mycobacterium
TDDEAK

SEQ ID NO: 1027869 - protein, 6 aa, Mycobacterium
TDDGRR

SEQ ID NO: 1027870 - protein, 7 aa, Mycobacterium
TDDGSIA

SEQ ID NO: 1027871 - protein, 5 aa, Mycobacterium
TDDGT

SEQ ID NO: 1027872 - protein, 4 aa, Mycobacterium
TDDI

SEQ ID NO: 1027873 - protein, 8 aa, Mycobacterium
TDDIPEHG

SEQ ID NO: 1027874 - protein, 7 aa, Mycobacterium
TDDKLKE

SEQ ID NO: 1027875 - protein, 6 aa, Mycobacterium
TDDPAV

SEQ ID NO: 1027876 - protein, 10 aa, Mycobacterium
TDDPGTKQTA

SEQ ID NO: 1027877 - protein, 15 aa, Mycobacterium
TDDTGGYPAAAEPNT

SEQ ID NO: 1027878 - protein, 5 aa, Mycobacterium
TDDTP

SEQ ID NO: 1027879 - protein, 9 aa, Mycobacterium
TDEAQRPRP

SEQ ID NO: 1027880 - protein, 7 aa, Mycobacterium
TDEAREA

SEQ ID NO: 1027881 - protein, 5 aa, Mycobacterium
TDEHG

SEQ ID NO: 1027882 - protein, 4 aa, Mycobacterium
TDEL

SEQ ID NO: 1027883 - protein, 12 aa, Mycobacterium
TDENADPSAVAG

SEQ ID NO: 1027884 - protein, 19 aa, Mycobacterium
TDEPAAAAAGTSRQGANSL

SEQ ID NO: 1027885 - protein, 27 aa, Mycobacterium
TDEPDRRFTPGASLRAKRSRDGGTGRN

SEQ ID NO: 1027886 - protein, 9 aa, Mycobacterium
TDEPGITPG

SEQ ID NO: 1027887 - protein, 8 aa, Mycobacterium
TDEPREPR

SEQ ID NO: 1027888 - protein, 4 aa, Mycobacterium
TDEQ

SEQ ID NO: 1027889 - protein, 6 aa, Mycobacterium
TDEQAL

SEQ ID NO: 1027890 - protein, 9 aa, Mycobacterium
TDEQGNPRF

SEQ ID NO: 1027891 - protein, 12 aa, Mycobacterium
TDESGSVEVGPL

SEQ ID NO: 1027892 - protein, 7 aa, Mycobacterium
TDESPFD

SEQ ID NO: 1027893 - protein, 9 aa, Mycobacterium
TDETGATKR

SEQ ID NO: 1027894 - protein, 6 aa, Mycobacterium
TDETGS

SEQ ID NO: 1027895 - protein, 6 aa, Mycobacterium
TDETRA

SEQ ID NO: 1027896 - protein, 6 aa, Mycobacterium
TDEVGQ

SEQ ID NO: 1027897 - protein, 21 aa, Mycobacterium
TDFGGSDSPLNSDEHTQAEQR

SEQ ID NO: 1027898 - protein, 5 aa, Mycobacterium
TDFPG

SEQ ID NO: 1027899 - protein, 10 aa, Mycobacterium
TDFPGGDSDE

SEQ ID NO: 1027900 - protein, 4 aa, Mycobacterium
TDFR

SEQ ID NO: 1027901 - protein, 5 aa, Mycobacterium
TDGAA

SEQ ID NO: 1027902 - protein, 6 aa, Mycobacterium
TDGAAA

SEQ ID NO: 1027903 - protein, 9 aa, Mycobacterium
TDGAAEDEL

SEQ ID NO: 1027904 - protein, 9 aa, Mycobacterium
TDGDGGRQE

SEQ ID NO: 1027905 - protein, 4 aa, Mycobacterium
TDGE

SEQ ID NO: 1027906 - protein, 24 aa, Mycobacterium
TDGETNASLRKGDEVASITDERAS

SEQ ID NO: 1027907 - protein, 6 aa, Mycobacterium
TDGFDA

SEQ ID NO: 1027908 - protein, 14 aa, Mycobacterium
TDGGGGAAAEVQRA

SEQ ID NO: 1027909 - protein, 12 aa, Mycobacterium
TDGLTAGVPSLV

SEQ ID NO: 1027910 - protein, 5 aa, Mycobacterium
TDGNL

SEQ ID NO: 1027911 - protein, 5 aa, Mycobacterium
TDGNS

SEQ ID NO: 1027912 - protein, 6 aa, Mycobacterium
TDGPAA

SEQ ID NO: 1027913 - protein, 9 aa, Mycobacterium
TDGPSAQAA

SEQ ID NO: 1027914 - protein, 13 aa, Mycobacterium
TDGPWESEQTHDS

SEQ ID NO: 1027915 - protein, 4 aa, Mycobacterium
TDGQ

SEQ ID NO: 1027916 - protein, 7 aa, Mycobacterium
TDGRTPA

SEQ ID NO: 1027917 - protein, 7 aa, Mycobacterium
TDGSPDL

SEQ ID NO: 1027918 - protein, 6 aa, Mycobacterium
TDGTIG

SEQ ID NO: 1027919 - protein, 4 aa, Mycobacterium
TDHG

SEQ ID NO: 1027920 - protein, 6 aa, Mycobacterium
TDHPGY

SEQ ID NO: 1027921 - protein, 6 aa, Mycobacterium
TDHPYR

SEQ ID NO: 1027922 - protein, 4 aa, Mycobacterium
TDHR

SEQ ID NO: 1027923 - protein, 6 aa, Mycobacterium
TDHRPV

SEQ ID NO: 1027924 - protein, 11 aa, Mycobacterium
TDIEGANAAGL

SEQ ID NO: 1027925 - protein, 5 aa, Mycobacterium
TDIPE

SEQ ID NO: 1027926 - protein, 6 aa, Mycobacterium
TDIPPG

SEQ ID NO: 1027927 - protein, 6 aa, Mycobacterium
TDIRDP

SEQ ID NO: 1027928 - protein, 10 aa, Mycobacterium
TDISADKASS

SEQ ID NO: 1027929 - protein, 6 aa, Mycobacterium
TDKADI

SEQ ID NO: 1027930 - protein, 8 aa, Mycobacterium
TDKDASDI

SEQ ID NO: 1027931 - protein, 7 aa, Mycobacterium
TDKSQID

SEQ ID NO: 1027932 - protein, 14 aa, Mycobacterium
TDKTKVNPSGGALA

SEQ ID NO: 1027933 - protein, 11 aa, Mycobacterium
TDKVDTEIPSP

SEQ ID NO: 1027934 - protein, 14 aa, Mycobacterium
TDKVDTEIPSPAAG

SEQ ID NO: 1027935 - protein, 6 aa, Mycobacterium
TDKYGG

SEQ ID NO: 1027936 - protein, 5 aa, Mycobacterium
TDLAG

SEQ ID NO: 1027937 - protein, 6 aa, Mycobacterium
TDLAGL

SEQ ID NO: 1027938 - protein, 12 aa, Mycobacterium
TDLASIGSSINA

SEQ ID NO: 1027939 - protein, 6 aa, Mycobacterium
TDLDGI

SEQ ID NO: 1027940 - protein, 5 aa, Mycobacterium
TDLDS

SEQ ID NO: 1027941 - protein, 4 aa, Mycobacterium
TDLP

SEQ ID NO: 1027942 - protein, 6 aa, Mycobacterium
TDLRPA

SEQ ID NO: 1027943 - protein, 7 aa, Mycobacterium
TDLSPKN

SEQ ID NO: 1027944 - protein, 4 aa, Mycobacterium
TDLT

SEQ ID NO: 1027945 - protein, 13 aa, Mycobacterium
TDLTGSAISTQRA

SEQ ID NO: 1027946 - protein, 7 aa, Mycobacterium
TDNDAVD

SEQ ID NO: 1027947 - protein, 5 aa, Mycobacterium
TDNDP

SEQ ID NO: 1027948 - protein, 6 aa, Mycobacterium
TDNEPA

SEQ ID NO: 1027949 - protein, 27 aa, Mycobacterium
TDNGPHANTWPDGATTPFRSEKNTNWE

SEQ ID NO: 1027950 - protein, 4 aa, Mycobacterium
TDNI

SEQ ID NO: 1027951 - protein, 8 aa, Mycobacterium
TDNPDSPH

SEQ ID NO: 1027952 - protein, 7 aa, Mycobacterium
TDNSAQV

SEQ ID NO: 1027953 - protein, 5 aa, Mycobacterium
TDNTK

SEQ ID NO: 1027954 - protein, 4 aa, Mycobacterium
TDPA

SEQ ID NO: 1027955 - protein, 9 aa, Mycobacterium
TDPAANSGI

SEQ ID NO: 1027956 - protein, 6 aa, Mycobacterium
TDPAAR

SEQ ID NO: 1027957 - protein, 6 aa, Mycobacterium
TDPAHE

SEQ ID NO: 1027958 - protein, 11 aa, Mycobacterium
TDPARADDTEY

SEQ ID NO: 1027959 - protein, 6 aa, Mycobacterium
TDPARE

SEQ ID NO: 1027960 - protein, 14 aa, Mycobacterium
TDPDAAAPHVAESD

SEQ ID NO: 1027961 - protein, 9 aa, Mycobacterium
TDPDAPKHK

SEQ ID NO: 1027962 - protein, 8 aa, Mycobacterium
TDPDAVEQ

SEQ ID NO: 1027963 - protein, 5 aa, Mycobacterium
TDPDG

SEQ ID NO: 1027964 - protein, 6 aa, Mycobacterium
TDPDIP

SEQ ID NO: 1027965 - protein, 5 aa, Mycobacterium
TDPDL

SEQ ID NO: 1027966 - protein, 7 aa, Mycobacterium
TDPDRHR

SEQ ID NO: 1027967 - protein, 6 aa, Mycobacterium
TDPDSI

SEQ ID NO: 1027968 - protein, 6 aa, Mycobacterium
TDPDSR

SEQ ID NO: 1027969 - protein, 6 aa, Mycobacterium
TDPEAV

SEQ ID NO: 1027970 - protein, 7 aa, Mycobacterium
TDPEGGL

SEQ ID NO: 1027971 - protein, 9 aa, Mycobacterium
TDPEKGAQG

SEQ ID NO: 1027972 - protein, 9 aa, Mycobacterium
TDPENGANG

SEQ ID NO: 1027973 - protein, 5 aa, Mycobacterium
TDPGA

SEQ ID NO: 1027974 - protein, 7 aa, Mycobacterium
TDPGELP

SEQ ID NO: 1027975 - protein, 6 aa, Mycobacterium
TDPGGD

SEQ ID NO: 1027976 - protein, 8 aa, Mycobacterium
TDPGLGDV

SEQ ID NO: 1027977 - protein, 9 aa, Mycobacterium
TDPGPERQS

SEQ ID NO: 1027978 - protein, 6 aa, Mycobacterium
TDPGVP

SEQ ID NO: 1027979 - protein, 4 aa, Mycobacterium
TDPH

SEQ ID NO: 1027980 - protein, 10 aa, Mycobacterium
TDPMSRQTGQ

SEQ ID NO: 1027981 - protein, 9 aa, Mycobacterium
TDPNAPPAH

SEQ ID NO: 1027982 - protein, 9 aa, Mycobacterium
TDPNGTPGQ

SEQ ID NO: 1027983 - protein, 13 aa, Mycobacterium
TDPPKLKKQEKHD

SEQ ID NO: 1027984 - protein, 7 aa, Mycobacterium
TDPPSSP

SEQ ID NO: 1027985 - protein, 9 aa, Mycobacterium
TDPQARKHK

SEQ ID NO: 1027986 - protein, 6 aa, Mycobacterium
TDPQEL

SEQ ID NO: 1027987 - protein, 5 aa, Mycobacterium
TDPQG

SEQ ID NO: 1027988 - protein, 7 aa, Mycobacterium
TDPQGYD

SEQ ID NO: 1027989 - protein, 10 aa, Mycobacterium
TDPQSPLAGL

SEQ ID NO: 1027990 - protein, 6 aa, Mycobacterium
TDPSEA

SEQ ID NO: 1027991 - protein, 7 aa, Mycobacterium
TDPSNYP

SEQ ID NO: 1027992 - protein, 8 aa, Mycobacterium
TDPSPEAA

SEQ ID NO: 1027993 - protein, 15 aa, Mycobacterium
TDPSRPTAGSLGSVR

SEQ ID NO: 1027994 - protein, 5 aa, Mycobacterium
TDPSV

SEQ ID NO: 1027995 - protein, 18 aa, Mycobacterium
TDPTAPPGSGKPEPLGDD

SEQ ID NO: 1027996 - protein, 8 aa, Mycobacterium
TDPTAPVH

SEQ ID NO: 1027997 - protein, 7 aa, Mycobacterium
TDPTEAI

SEQ ID NO: 1027998 - protein, 8 aa, Mycobacterium
TDPTNGTR

SEQ ID NO: 1027999 - protein, 5 aa, Mycobacterium
TDPTR

SEQ ID NO: 1028000 - protein, 8 aa, Mycobacterium
TDQADARA

SEQ ID NO: 1028001 - protein, 5 aa, Mycobacterium
TDQAS

SEQ ID NO: 1028002 - protein, 6 aa, Mycobacterium
TDQDRQ

SEQ ID NO: 1028003 - protein, 4 aa, Mycobacterium
TDQH

SEQ ID NO: 1028004 - protein, 8 aa, Mycobacterium
TDQLPSRT

SEQ ID NO: 1028005 - protein, 5 aa, Mycobacterium
TDQLT

SEQ ID NO: 1028006 - protein, 6 aa, Mycobacterium
TDQNSE

SEQ ID NO: 1028007 - protein, 5 aa, Mycobacterium
TDQQE

SEQ ID NO: 1028008 - protein, 5 aa, Mycobacterium
TDQRT

SEQ ID NO: 1028009 - protein, 9 aa, Mycobacterium
TDQSTRDAL

SEQ ID NO: 1028010 - protein, 6 aa, Mycobacterium
TDQVPE

SEQ ID NO: 1028011 - protein, 8 aa, Mycobacterium
TDRARPRV

SEQ ID NO: 1028012 - protein, 13 aa, Mycobacterium
TDRASAQAAMNAA

SEQ ID NO: 1028013 - protein, 6 aa, Mycobacterium
TDREPL

SEQ ID NO: 1028014 - protein, 12 aa, Mycobacterium
TDRGEKLPAAQR

SEQ ID NO: 1028015 - protein, 6 aa, Mycobacterium
TDRGGL

SEQ ID NO: 1028016 - protein, 5 aa, Mycobacterium
TDRGM

SEQ ID NO: 1028017 - protein, 17 aa, Mycobacterium
TDRGNVARGDDFETSAP

SEQ ID NO: 1028018 - protein, 5 aa, Mycobacterium
TDRNG

SEQ ID NO: 1028019 - protein, 6 aa, Mycobacterium
TDRNGQ

SEQ ID NO: 1028020 - protein, 15 aa, Mycobacterium
TDRPAGRSRPAGAPP

SEQ ID NO: 1028021 - protein, 16 aa, Mycobacterium
TDRPAPKLAQSGLFQV

SEQ ID NO: 1028022 - protein, 7 aa, Mycobacterium
TDRPDAR

SEQ ID NO: 1028023 - protein, 8 aa, Mycobacterium
TDRPGSSA

SEQ ID NO: 1028024 - protein, 13 aa, Mycobacterium
TDRPLSDDTLSDA

SEQ ID NO: 1028025 - protein, 7 aa, Mycobacterium
TDRPTQV

SEQ ID NO: 1028026 - protein, 18 aa, Mycobacterium
TDRQAARQGVGGEVLAYV

SEQ ID NO: 1028027 - protein, 11 aa, Mycobacterium
TDRQSGTPSSY

SEQ ID NO: 1028028 - protein, 5 aa, Mycobacterium
TDRSA

SEQ ID NO: 1028029 - protein, 21 aa, Mycobacterium
TDRSRSASADCPAGAGVRSEG

SEQ ID NO: 1028030 - protein, 8 aa, Mycobacterium
TDRSTLTD

SEQ ID NO: 1028031 - protein, 16 aa, Mycobacterium
TDRTESNRVTLGVLGS

SEQ ID NO: 1028032 - protein, 13 aa, Mycobacterium
TDSADGKPNPASS

SEQ ID NO: 1028033 - protein, 8 aa, Mycobacterium
TDSALNGA

SEQ ID NO: 1028034 - protein, 14 aa, Mycobacterium
TDSDGDGTADGASA

SEQ ID NO: 1028035 - protein, 9 aa, Mycobacterium
TDSDHYEAS

SEQ ID NO: 1028036 - protein, 7 aa, Mycobacterium
TDSEFSE

SEQ ID NO: 1028037 - protein, 14 aa, Mycobacterium
TDSGASADNDPAAI

SEQ ID NO: 1028038 - protein, 18 aa, Mycobacterium
TDSGATNSGFGNTAGLRR

SEQ ID NO: 1028039 - protein, 8 aa, Mycobacterium
TDSGEERT

SEQ ID NO: 1028040 - protein, 7 aa, Mycobacterium
TDSGRRA

SEQ ID NO: 1028041 - protein, 8 aa, Mycobacterium
TDSKDSTR

SEQ ID NO: 1028042 - protein, 4 aa, Mycobacterium
TDSP

SEQ ID NO: 1028043 - protein, 4 aa, Mycobacterium
TDSR

SEQ ID NO: 1028044 - protein, 6 aa, Mycobacterium
TDSRAR

SEQ ID NO: 1028045 - protein, 8 aa, Mycobacterium
TDSRDDVA

SEQ ID NO: 1028046 - protein, 6 aa, Mycobacterium
TDTAAG

SEQ ID NO: 1028047 - protein, 6 aa, Mycobacterium
TDTAAQ

SEQ ID NO: 1028048 - protein, 8 aa, Mycobacterium
TDTAGDDV

SEQ ID NO: 1028049 - protein, 8 aa, Mycobacterium
TDTARNAV

SEQ ID NO: 1028050 - protein, 7 aa, Mycobacterium
TDTARSC

SEQ ID NO: 1028051 - protein, 8 aa, Mycobacterium
TDTDANAR

SEQ ID NO: 1028052 - protein, 6 aa, Mycobacterium
TDTDND

SEQ ID NO: 1028053 - protein, 5 aa, Mycobacterium
TDTDQ

SEQ ID NO: 1028054 - protein, 8 aa, Mycobacterium
TDTKGKKN

SEQ ID NO: 1028055 - protein, 5 aa, Mycobacterium
TDTLE

SEQ ID NO: 1028056 - protein, 5 aa, Mycobacterium
TDTLR

SEQ ID NO: 1028057 - protein, 6 aa, Mycobacterium
TDTPGV

SEQ ID NO: 1028058 - protein, 7 aa, Mycobacterium
TDTPLDS

SEQ ID NO: 1028059 - protein, 5 aa, Mycobacterium
TDTQR

SEQ ID NO: 1028060 - protein, 17 aa, Mycobacterium
TDTRESLANSGKNPDLE

SEQ ID NO: 1028061 - protein, 5 aa, Mycobacterium
TDTSV

SEQ ID NO: 1028062 - protein, 8 aa, Mycobacterium
TDTTAAQR

SEQ ID NO: 1028063 - protein, 8 aa, Mycobacterium
TDTTDPAK

SEQ ID NO: 1028064 - protein, 26 aa, Mycobacterium
TDTVGSGLTPGATRTACATTPAGAAL

SEQ ID NO: 1028065 - protein, 8 aa, Mycobacterium
TDTVNGPQ

SEQ ID NO: 1028066 - protein, 5 aa, Mycobacterium
TDVDD

SEQ ID NO: 1028067 - protein, 5 aa, Mycobacterium
TDVEG

SEQ ID NO: 1028068 - protein, 4 aa, Mycobacterium
TDVG

SEQ ID NO: 1028069 - protein, 6 aa, Mycobacterium
TDVPRD

SEQ ID NO: 1028070 - protein, 15 aa, Mycobacterium
TDVSAGGSTDRTPGF

SEQ ID NO: 1028071 - protein, 10 aa, Mycobacterium
TDVSAPSSAT

SEQ ID NO: 1028072 - protein, 21 aa, Mycobacterium
TDVSGGTAGGGGTGGDGGRGG

SEQ ID NO: 1028073 - protein, 4 aa, Mycobacterium
TDVT

SEQ ID NO: 1028074 - protein, 6 aa, Mycobacterium
TDVTDP

SEQ ID NO: 1028075 - protein, 7 aa, Mycobacterium
TDVTNTG

SEQ ID NO: 1028076 - protein, 9 aa, Mycobacterium
TDVTTPTEL

SEQ ID NO: 1028077 - protein, 18 aa, Mycobacterium
TDYQNKSESVLTQGSGVV

SEQ ID NO: 1028078 - protein, 8 aa, Mycobacterium
TDYTPPNK

SEQ ID NO: 1028079 - protein, 4 aa, Mycobacterium
TEAA

SEQ ID NO: 1028080 - protein, 5 aa, Mycobacterium
TEAAG

SEQ ID NO: 1028081 - protein, 7 aa, Mycobacterium
TEAAQSA

SEQ ID NO: 1028082 - protein, 7 aa, Mycobacterium
TEAAQSR

SEQ ID NO: 1028083 - protein, 13 aa, Mycobacterium
TEAARRQLEETED

SEQ ID NO: 1028084 - protein, 10 aa, Mycobacterium
TEADKGARTL

SEQ ID NO: 1028085 - protein, 12 aa, Mycobacterium
TEADSKATGPGV

SEQ ID NO: 1028086 - protein, 4 aa, Mycobacterium
TEAE

SEQ ID NO: 1028087 - protein, 8 aa, Mycobacterium
TEAEGRPE

SEQ ID NO: 1028088 - protein, 9 aa, Mycobacterium
TEAGETAIG

SEQ ID NO: 1028089 - protein, 10 aa, Mycobacterium
TEAGIGPSRT

SEQ ID NO: 1028090 - protein, 6 aa, Mycobacterium
TEAGIS

SEQ ID NO: 1028091 - protein, 8 aa, Mycobacterium
TEAGRHSG

SEQ ID NO: 1028092 - protein, 7 aa, Mycobacterium
TEAGTQK

SEQ ID NO: 1028093 - protein, 6 aa, Mycobacterium
TEAGVS

SEQ ID NO: 1028094 - protein, 9 aa, Mycobacterium
TEAKQEASL

SEQ ID NO: 1028095 - protein, 4 aa, Mycobacterium
TEAQ

SEQ ID NO: 1028096 - protein, 21 aa, Mycobacterium
TEATEGDGMPAPGEISEQEAA

SEQ ID NO: 1028097 - protein, 12 aa, Mycobacterium
TEATEPAPADSS

SEQ ID NO: 1028098 - protein, 15 aa, Mycobacterium
TEATISPDVDKAGEH

SEQ ID NO: 1028099 - protein, 9 aa, Mycobacterium
TEATRTAGR

SEQ ID NO: 1028100 - protein, 12 aa, Mycobacterium
TEATSASPLQAA

SEQ ID NO: 1028101 - protein, 8 aa, Mycobacterium
TEATTVPL

SEQ ID NO: 1028102 - protein, 7 aa, Mycobacterium
TEDAPND

SEQ ID NO: 1028103 - protein, 13 aa, Mycobacterium
TEDAQSRHGSAEL

SEQ ID NO: 1028104 - protein, 5 aa, Mycobacterium
TEDAS

SEQ ID NO: 1028105 - protein, 14 aa, Mycobacterium
TEDEAPNAKGGVDK

SEQ ID NO: 1028106 - protein, 6 aa, Mycobacterium
TEDGID

SEQ ID NO: 1028107 - protein, 20 aa, Mycobacterium
TEDGQRQIGTVTSGALSPTL

SEQ ID NO: 1028108 - protein, 5 aa, Mycobacterium
TEDGR

SEQ ID NO: 1028109 - protein, 5 aa, Mycobacterium
TEDKY

SEQ ID NO: 1028110 - protein, 7 aa, Mycobacterium
TEDPAAT

SEQ ID NO: 1028111 - protein, 8 aa, Mycobacterium
TEDPAHTV

SEQ ID NO: 1028112 - protein, 7 aa, Mycobacterium
TEDQKAR

SEQ ID NO: 1028113 - protein, 4 aa, Mycobacterium
TEDR

SEQ ID NO: 1028114 - protein, 8 aa, Mycobacterium
TEDRKIGY

SEQ ID NO: 1028115 - protein, 6 aa, Mycobacterium
TEDSVD

SEQ ID NO: 1028116 - protein, 15 aa, Mycobacterium
TEDYWSDEYRDLIEL

SEQ ID NO: 1028117 - protein, 9 aa, Mycobacterium
TEEAKTGKL

SEQ ID NO: 1028118 - protein, 17 aa, Mycobacterium
TEEDDRASRLRAGEATS

SEQ ID NO: 1028119 - protein, 4 aa, Mycobacterium
TEEF

SEQ ID NO: 1028120 - protein, 7 aa, Mycobacterium
TEEGRRL

SEQ ID NO: 1028121 - protein, 6 aa, Mycobacterium
TEEIET

SEQ ID NO: 1028122 - protein, 7 aa, Mycobacterium
TEELGPN

SEQ ID NO: 1028123 - protein, 21 aa, Mycobacterium
TEEMGAAGDGSGGPAGTVDDE

SEQ ID NO: 1028124 - protein, 5 aa, Mycobacterium
TEEPA

SEQ ID NO: 1028125 - protein, 5 aa, Mycobacterium
TEEQK

SEQ ID NO: 1028126 - protein, 8 aa, Mycobacterium
TEEQKQRR

SEQ ID NO: 1028127 - protein, 6 aa, Mycobacterium
TEEQRD

SEQ ID NO: 1028128 - protein, 4 aa, Mycobacterium
TEER

SEQ ID NO: 1028129 - protein, 9 aa, Mycobacterium
TEESGRGEG

SEQ ID NO: 1028130 - protein, 21 aa, Mycobacterium
TEETDETDMSPPQSGQPIPHR

SEQ ID NO: 1028131 - protein, 4 aa, Mycobacterium
TEEV

SEQ ID NO: 1028132 - protein, 6 aa, Mycobacterium
TEEVDI

SEQ ID NO: 1028133 - protein, 15 aa, Mycobacterium
TEEVSGKQAKELTDD

SEQ ID NO: 1028134 - protein, 5 aa, Mycobacterium
TEFGG

SEQ ID NO: 1028135 - protein, 4 aa, Mycobacterium
TEGA

SEQ ID NO: 1028136 - protein, 12 aa, Mycobacterium
TEGAADSESDFA

SEQ ID NO: 1028137 - protein, 10 aa, Mycobacterium
TEGAGGGHAP

SEQ ID NO: 1028138 - protein, 10 aa, Mycobacterium
TEGDEPSGAD

SEQ ID NO: 1028139 - protein, 5 aa, Mycobacterium
TEGEC

SEQ ID NO: 1028140 - protein, 7 aa, Mycobacterium
TEGGEPR

SEQ ID NO: 1028141 - protein, 6 aa, Mycobacterium
TEGGFP

SEQ ID NO: 1028142 - protein, 5 aa, Mycobacterium
TEGGT

SEQ ID NO: 1028143 - protein, 4 aa, Mycobacterium
TEGL

SEQ ID NO: 1028144 - protein, 8 aa, Mycobacterium
TEGLGADY

SEQ ID NO: 1028145 - protein, 5 aa, Mycobacterium
TEGMH

SEQ ID NO: 1028146 - protein, 8 aa, Mycobacterium
TEGRPPAE

SEQ ID NO: 1028147 - protein, 5 aa, Mycobacterium
TEGSA

SEQ ID NO: 1028148 - protein, 5 aa, Mycobacterium
TEGVS

SEQ ID NO: 1028149 - protein, 5 aa, Mycobacterium
TEGYT

SEQ ID NO: 1028150 - protein, 7 aa, Mycobacterium
TEHGTPS

SEQ ID NO: 1028151 - protein, 12 aa, Mycobacterium
TEHIEDTSDPKM

SEQ ID NO: 1028152 - protein, 6 aa, Mycobacterium
TEHPAG

SEQ ID NO: 1028153 - protein, 5 aa, Mycobacterium
TEHRG

SEQ ID NO: 1028154 - protein, 5 aa, Mycobacterium
TEHVD

SEQ ID NO: 1028155 - protein, 11 aa, Mycobacterium
TEIESETGRSA

SEQ ID NO: 1028156 - protein, 4 aa, Mycobacterium
TEIG

SEQ ID NO: 1028157 - protein, 15 aa, Mycobacterium
TEIPATVSSDTVTSW

SEQ ID NO: 1028158 - protein, 5 aa, Mycobacterium
TEIPG

SEQ ID NO: 1028159 - protein, 4 aa, Mycobacterium
TEIT

SEQ ID NO: 1028160 - protein, 11 aa, Mycobacterium
TEKGRAEAVRS

SEQ ID NO: 1028161 - protein, 9 aa, Mycobacterium
TEKGSKRHA

SEQ ID NO: 1028162 - protein, 8 aa, Mycobacterium
TEKPADEL

SEQ ID NO: 1028163 - protein, 13 aa, Mycobacterium
TEKPDPPGSHLLV

SEQ ID NO: 1028164 - protein, 9 aa, Mycobacterium
TEKQAASWD

SEQ ID NO: 1028165 - protein, 25 aa, Mycobacterium
TEKQGGSDVRAGTTQATPNSDGTYR

SEQ ID NO: 1028166 - protein, 30 aa, Mycobacterium
TEKRRKALTDLSNEEWNAATTTPAGPDSHG

SEQ ID NO: 1028167 - protein, 7 aa, Mycobacterium
TEKRTGF

SEQ ID NO: 1028168 - protein, 7 aa, Mycobacterium
TEKYAKG

SEQ ID NO: 1028169 - protein, 5 aa, Mycobacterium
TELDE

SEQ ID NO: 1028170 - protein, 8 aa, Mycobacterium
TELGPGGV

SEQ ID NO: 1028171 - protein, 17 aa, Mycobacterium
TELSEGDRLEVVTAVQG

SEQ ID NO: 1028172 - protein, 12 aa, Mycobacterium
TELSSATADYSS

SEQ ID NO: 1028173 - protein, 15 aa, Mycobacterium
TEMTDPGPENSLSTE

SEQ ID NO: 1028174 - protein, 6 aa, Mycobacterium
TEMTPP

SEQ ID NO: 1028175 - protein, 6 aa, Mycobacterium
TENPLH

SEQ ID NO: 1028176 - protein, 7 aa, Mycobacterium
TENPNPA

SEQ ID NO: 1028177 - protein, 6 aa, Mycobacterium
TENREA

SEQ ID NO: 1028178 - protein, 10 aa, Mycobacterium
TENSGRGAPP

SEQ ID NO: 1028179 - protein, 7 aa, Mycobacterium
TEPADDI

SEQ ID NO: 1028180 - protein, 5 aa, Mycobacterium
TEPAG

SEQ ID NO: 1028181 - protein, 8 aa, Mycobacterium
TEPAPPTL

SEQ ID NO: 1028182 - protein, 7 aa, Mycobacterium
TEPDTPQ

SEQ ID NO: 1028183 - protein, 4 aa, Mycobacterium
TEPE

SEQ ID NO: 1028184 - protein, 9 aa, Mycobacterium
TEPEAGTDL

SEQ ID NO: 1028185 - protein, 11 aa, Mycobacterium
TEPEGGSDVAT

SEQ ID NO: 1028186 - protein, 5 aa, Mycobacterium
TEPEV

SEQ ID NO: 1028187 - protein, 19 aa, Mycobacterium
TEPGAGSDAGSTRTTARLD

SEQ ID NO: 1028188 - protein, 9 aa, Mycobacterium
TEPGASRHR

SEQ ID NO: 1028189 - protein, 5 aa, Mycobacterium
TEPGD

SEQ ID NO: 1028190 - protein, 13 aa, Mycobacterium
TEPGGGSDLQNMS

SEQ ID NO: 1028191 - protein, 10 aa, Mycobacterium
TEPGGGSDVG

SEQ ID NO: 1028192 - protein, 10 aa, Mycobacterium
TEPGLARSGG

SEQ ID NO: 1028193 - protein, 12 aa, Mycobacterium
TEPGTGSDLQGI

SEQ ID NO: 1028194 - protein, 13 aa, Mycobacterium
TEPHGGSDAFHPE

SEQ ID NO: 1028195 - protein, 4 aa, Mycobacterium
TEPI

SEQ ID NO: 1028196 - protein, 8 aa, Mycobacterium
TEPPPTGF

SEQ ID NO: 1028197 - protein, 12 aa, Mycobacterium
TEPQGGSDPGSF

SEQ ID NO: 1028198 - protein, 15 aa, Mycobacterium
TEPRAKTRNLRRDPR

SEQ ID NO: 1028199 - protein, 5 aa, Mycobacterium
TEPRQ

SEQ ID NO: 1028200 - protein, 18 aa, Mycobacterium
TEPRTDPKSEAAEQRTPW

SEQ ID NO: 1028201 - protein, 7 aa, Mycobacterium
TEPSTSE

SEQ ID NO: 1028202 - protein, 11 aa, Mycobacterium
TEQEADRALKA

SEQ ID NO: 1028203 - protein, 5 aa, Mycobacterium
TEQGA

SEQ ID NO: 1028204 - protein, 6 aa, Mycobacterium
TEQGER

SEQ ID NO: 1028205 - protein, 6 aa, Mycobacterium
TEQGGM

SEQ ID NO: 1028206 - protein, 18 aa, Mycobacterium
TEQPAAAQHPAPNGREID

SEQ ID NO: 1028207 - protein, 7 aa, Mycobacterium
TEQPEPD

SEQ ID NO: 1028208 - protein, 5 aa, Mycobacterium
TEQPI

SEQ ID NO: 1028209 - protein, 8 aa, Mycobacterium
TEQQDSGH

SEQ ID NO: 1028210 - protein, 4 aa, Mycobacterium
TEQR

SEQ ID NO: 1028211 - protein, 29 aa, Mycobacterium
TEQRNDVDGFTRRQQDEYSAASHQKAAAA

SEQ ID NO: 1028212 - protein, 8 aa, Mycobacterium
TEQTVKPS

SEQ ID NO: 1028213 - protein, 9 aa, Mycobacterium
TERAAAERR

SEQ ID NO: 1028214 - protein, 6 aa, Mycobacterium
TERADN

SEQ ID NO: 1028215 - protein, 11 aa, Mycobacterium
TERAKAVTRGI

SEQ ID NO: 1028216 - protein, 9 aa, Mycobacterium
TERAPRPGH

SEQ ID NO: 1028217 - protein, 6 aa, Mycobacterium
TERATA

SEQ ID NO: 1028218 - protein, 11 aa, Mycobacterium
TERDSDYAGAL

SEQ ID NO: 1028219 - protein, 9 aa, Mycobacterium
TERDSVGGN

SEQ ID NO: 1028220 - protein, 4 aa, Mycobacterium
TERG

SEQ ID NO: 1028221 - protein, 25 aa, Mycobacterium
TERGATRADDRISESGMEDRKRQGY

SEQ ID NO: 1028222 - protein, 8 aa, Mycobacterium
TERPDTGS

SEQ ID NO: 1028223 - protein, 7 aa, Mycobacterium
TERPEED

SEQ ID NO: 1028224 - protein, 8 aa, Mycobacterium
TERPPAKP

SEQ ID NO: 1028225 - protein, 4 aa, Mycobacterium
TERQ

SEQ ID NO: 1028226 - protein, 4 aa, Mycobacterium
TERR

SEQ ID NO: 1028227 - protein, 6 aa, Mycobacterium
TERRAR

SEQ ID NO: 1028228 - protein, 6 aa, Mycobacterium
TERRGE

SEQ ID NO: 1028229 - protein, 10 aa, Mycobacterium
TERRGQEGND

SEQ ID NO: 1028230 - protein, 10 aa, Mycobacterium
TERSELAGHE

SEQ ID NO: 1028231 - protein, 10 aa, Mycobacterium
TERSGAAAGA

SEQ ID NO: 1028232 - protein, 10 aa, Mycobacterium
TERSTRDERH

SEQ ID NO: 1028233 - protein, 8 aa, Mycobacterium
TESDCDDA

SEQ ID NO: 1028234 - protein, 9 aa, Mycobacterium
TESEHRGSA

SEQ ID NO: 1028235 - protein, 12 aa, Mycobacterium
TESGKSKGQFYT

SEQ ID NO: 1028236 - protein, 13 aa, Mycobacterium
TESMDDRALITLH

SEQ ID NO: 1028237 - protein, 14 aa, Mycobacterium
TESQATEKTENTAA

SEQ ID NO: 1028238 - protein, 6 aa, Mycobacterium
TESSWD

SEQ ID NO: 1028239 - protein, 7 aa, Mycobacterium
TESSYRA

SEQ ID NO: 1028240 - protein, 8 aa, Mycobacterium
TESVGKTI

SEQ ID NO: 1028241 - protein, 12 aa, Mycobacterium
TESYQREPAPED

SEQ ID NO: 1028242 - protein, 4 aa, Mycobacterium
TETA

SEQ ID NO: 1028243 - protein, 5 aa, Mycobacterium
TETAR

SEQ ID NO: 1028244 - protein, 8 aa, Mycobacterium
TETDDPHQ

SEQ ID NO: 1028245 - protein, 6 aa, Mycobacterium
TETELK

SEQ ID NO: 1028246 - protein, 8 aa, Mycobacterium
TETGGSLA

SEQ ID NO: 1028247 - protein, 5 aa, Mycobacterium
TETGS

SEQ ID NO: 1028248 - protein, 15 aa, Mycobacterium
TETKQAIGRATNNVA

SEQ ID NO: 1028249 - protein, 5 aa, Mycobacterium
TETNE

SEQ ID NO: 1028250 - protein, 5 aa, Mycobacterium
TETPE

SEQ ID NO: 1028251 - protein, 9 aa, Mycobacterium
TETPEGPRL

SEQ ID NO: 1028252 - protein, 9 aa, Mycobacterium
TETPSGPVA

SEQ ID NO: 1028253 - protein, 7 aa, Mycobacterium
TETRDEV

SEQ ID NO: 1028254 - protein, 6 aa, Mycobacterium
TETSLP

SEQ ID NO: 1028255 - protein, 5 aa, Mycobacterium
TETSS

SEQ ID NO: 1028256 - protein, 11 aa, Mycobacterium
TETTDHPGGYA

SEQ ID NO: 1028257 - protein, 9 aa, Mycobacterium
TETTKQFRN

SEQ ID NO: 1028258 - protein, 4 aa, Mycobacterium
TETW

SEQ ID NO: 1028259 - protein, 31 aa, Mycobacterium
TETYAGQARSPGTAGPAPQPPQPDGGAWRPA

SEQ ID NO: 1028260 - protein, 5 aa, Mycobacterium
TEVPP

SEQ ID NO: 1028261 - protein, 13 aa, Mycobacterium
TEVSTSNTPTASF

SEQ ID NO: 1028262 - protein, 10 aa, Mycobacterium
TEVTDTGRPI

SEQ ID NO: 1028263 - protein, 5 aa, Mycobacterium
TEWSA

SEQ ID NO: 1028264 - protein, 14 aa, Mycobacterium
TEYEPDRAARERDR

SEQ ID NO: 1028265 - protein, 23 aa, Mycobacterium
TEYGSGVGRSKKEAEQKAAAAAY

SEQ ID NO: 1028266 - protein, 4 aa, Mycobacterium
TEYP

SEQ ID NO: 1028267 - protein, 6 aa, Mycobacterium
TEYSGW

SEQ ID NO: 1028268 - protein, 5 aa, Mycobacterium
TFAEH

SEQ ID NO: 1028269 - protein, 6 aa, Mycobacterium
TFDGSA

SEQ ID NO: 1028270 - protein, 7 aa, Mycobacterium
TFDSGAP

SEQ ID NO: 1028271 - protein, 4 aa, Mycobacterium
TFEH

SEQ ID NO: 1028272 - protein, 5 aa, Mycobacterium
TFERQ

SEQ ID NO: 1028273 - protein, 9 aa, Mycobacterium
TFESTSRYA

SEQ ID NO: 1028274 - protein, 6 aa, Mycobacterium
TFGDDE

SEQ ID NO: 1028275 - protein, 13 aa, Mycobacterium
TFGGANRAAGVAG

SEQ ID NO: 1028276 - protein, 5 aa, Mycobacterium
TFGST

SEQ ID NO: 1028277 - protein, 6 aa, Mycobacterium
TFGTAA

SEQ ID NO: 1028278 - protein, 9 aa, Mycobacterium
TFKEARAKG

SEQ ID NO: 1028279 - protein, 22 aa, Mycobacterium
TFKQNPPPAPVDPKDMTAEEAR

SEQ ID NO: 1028280 - protein, 4 aa, Mycobacterium
TFPD

SEQ ID NO: 1028281 - protein, 15 aa, Mycobacterium
TFPDGTKLVTVHHPI

SEQ ID NO: 1028282 - protein, 8 aa, Mycobacterium
TFPSSHTA

SEQ ID NO: 1028283 - protein, 9 aa, Mycobacterium
TFPSSSPNE

SEQ ID NO: 1028284 - protein, 11 aa, Mycobacterium
TFQASSEAHPD

SEQ ID NO: 1028285 - protein, 6 aa, Mycobacterium
TFQQRG

SEQ ID NO: 1028286 - protein, 13 aa, Mycobacterium
TFSARTSLRVVRQ

SEQ ID NO: 1028287 - protein, 14 aa, Mycobacterium
TFSDRPDNGSATSA

SEQ ID NO: 1028288 - protein, 7 aa, Mycobacterium
TFTPPAQ

SEQ ID NO: 1028289 - protein, 7 aa, Mycobacterium
TFTTPTD

SEQ ID NO: 1028290 - protein, 6 aa, Mycobacterium
TGAAAP

SEQ ID NO: 1028291 - protein, 9 aa, Mycobacterium
TGAADGYAR

SEQ ID NO: 1028292 - protein, 9 aa, Mycobacterium
TGAAGGREA

SEQ ID NO: 1028293 - protein, 11 aa, Mycobacterium
TGAAGSSALPE

SEQ ID NO: 1028294 - protein, 10 aa, Mycobacterium
TGAANPSVPS

SEQ ID NO: 1028295 - protein, 11 aa, Mycobacterium
TGAAPAGHDSK

SEQ ID NO: 1028296 - protein, 13 aa, Mycobacterium
TGAAPSAAGPRVK

SEQ ID NO: 1028297 - protein, 10 aa, Mycobacterium
TGAATRSGGL

SEQ ID NO: 1028298 - protein, 16 aa, Mycobacterium
TGAATSVQRDRGSRSR

SEQ ID NO: 1028299 - protein, 6 aa, Mycobacterium
TGADAV

SEQ ID NO: 1028300 - protein, 7 aa, Mycobacterium
TGADGAT

SEQ ID NO: 1028301 - protein, 8 aa, Mycobacterium
TGADGGAG

SEQ ID NO: 1028302 - protein, 10 aa, Mycobacterium
TGADGRPSQV

SEQ ID NO: 1028303 - protein, 6 aa, Mycobacterium
TGADYP

SEQ ID NO: 1028304 - protein, 4 aa, Mycobacterium
TGAE

SEQ ID NO: 1028305 - protein, 13 aa, Mycobacterium
TGAEDSGGSGASW

SEQ ID NO: 1028306 - protein, 8 aa, Mycobacterium
TGAEGPRG

SEQ ID NO: 1028307 - protein, 7 aa, Mycobacterium
TGAFGSA

SEQ ID NO: 1028308 - protein, 6 aa, Mycobacterium
TGAGAG

SEQ ID NO: 1028309 - protein, 5 aa, Mycobacterium
TGAGE

SEQ ID NO: 1028310 - protein, 74 aa, Mycobacterium
TGAGGQGGAGGTGGQLSGNGGSGGTGGEGDYVGGADSGGAGGAGGNAGLTGDGGNGGSGGTPGSPGGGGTGGAL

SEQ ID NO: 1028311 - protein, 8 aa, Mycobacterium
TGAGHGDG

SEQ ID NO: 1028312 - protein, 18 aa, Mycobacterium
TGAGNAYAAAEAANASPL

SEQ ID NO: 1028313 - protein, 6 aa, Mycobacterium
TGAGNV

SEQ ID NO: 1028314 - protein, 8 aa, Mycobacterium
TGAGSDHD

SEQ ID NO: 1028315 - protein, 7 aa, Mycobacterium
TGAGSSG

SEQ ID NO: 1028316 - protein, 12 aa, Mycobacterium
TGAGTLGVSSPR

SEQ ID NO: 1028317 - protein, 10 aa, Mycobacterium
TGAGVPPGQT

SEQ ID NO: 1028318 - protein, 5 aa, Mycobacterium
TGAIP

SEQ ID NO: 1028319 - protein, 9 aa, Mycobacterium
TGAKPVGPS

SEQ ID NO: 1028320 - protein, 10 aa, Mycobacterium
TGAKSGRPRL

SEQ ID NO: 1028321 - protein, 16 aa, Mycobacterium
TGAKTEGRDSINGQSA

SEQ ID NO: 1028322 - protein, 10 aa, Mycobacterium
TGALNTGDYN

SEQ ID NO: 1028323 - protein, 6 aa, Mycobacterium
TGALPG

SEQ ID NO: 1028324 - protein, 7 aa, Mycobacterium
TGAPAAL

SEQ ID NO: 1028325 - protein, 7 aa, Mycobacterium
TGAPDDY

SEQ ID NO: 1028326 - protein, 6 aa, Mycobacterium
TGAPQR

SEQ ID NO: 1028327 - protein, 5 aa, Mycobacterium
TGAPT

SEQ ID NO: 1028328 - protein, 9 aa, Mycobacterium
TGAPVRAAD

SEQ ID NO: 1028329 - protein, 4 aa, Mycobacterium
TGAQ

SEQ ID NO: 1028330 - protein, 6 aa, Mycobacterium
TGAQTG

SEQ ID NO: 1028331 - protein, 6 aa, Mycobacterium
TGARGL

SEQ ID NO: 1028332 - protein, 5 aa, Mycobacterium
TGASG

SEQ ID NO: 1028333 - protein, 14 aa, Mycobacterium
TGASSYASAEAASQ

SEQ ID NO: 1028334 - protein, 5 aa, Mycobacterium
TGAST

SEQ ID NO: 1028335 - protein, 4 aa, Mycobacterium
TGAT

SEQ ID NO: 1028336 - protein, 6 aa, Mycobacterium
TGATDY

SEQ ID NO: 1028337 - protein, 13 aa, Mycobacterium
TGATGPDEQLPAS

SEQ ID NO: 1028338 - protein, 7 aa, Mycobacterium
TGATQPV

SEQ ID NO: 1028339 - protein, 9 aa, Mycobacterium
TGAYEDADP

SEQ ID NO: 1028340 - protein, 8 aa, Mycobacterium
TGCPSGEV

SEQ ID NO: 1028341 - protein, 4 aa, Mycobacterium
TGDA

SEQ ID NO: 1028342 - protein, 11 aa, Mycobacterium
TGDANGRAPTA

SEQ ID NO: 1028343 - protein, 18 aa, Mycobacterium
TGDAQTAPQPSMEEPCVS

SEQ ID NO: 1028344 - protein, 5 aa, Mycobacterium
TGDAR

SEQ ID NO: 1028345 - protein, 9 aa, Mycobacterium
TGDASGHNM

SEQ ID NO: 1028346 - protein, 10 aa, Mycobacterium
TGDDGTTGLS

SEQ ID NO: 1028347 - protein, 5 aa, Mycobacterium
TGDDP

SEQ ID NO: 1028348 - protein, 5 aa, Mycobacterium
TGDER

SEQ ID NO: 1028349 - protein, 5 aa, Mycobacterium
TGDHQ

SEQ ID NO: 1028350 - protein, 12 aa, Mycobacterium
TGDHTCFDATVL

SEQ ID NO: 1028351 - protein, 19 aa, Mycobacterium
TGDLTTHPNTVASGNATIT

SEQ ID NO: 1028352 - protein, 15 aa, Mycobacterium
TGDPAAGAGIIPDST

SEQ ID NO: 1028353 - protein, 7 aa, Mycobacterium
TGDQLQG

SEQ ID NO: 1028354 - protein, 10 aa, Mycobacterium
TGDSDARAAK

SEQ ID NO: 1028355 - protein, 9 aa, Mycobacterium
TGDSETLRR

SEQ ID NO: 1028356 - protein, 8 aa, Mycobacterium
TGDSLAGG

SEQ ID NO: 1028357 - protein, 11 aa, Mycobacterium
TGDSQPGTSAL

SEQ ID NO: 1028358 - protein, 6 aa, Mycobacterium
TGDTAI

SEQ ID NO: 1028359 - protein, 7 aa, Mycobacterium
TGDTATG

SEQ ID NO: 1028360 - protein, 5 aa, Mycobacterium
TGDTE

SEQ ID NO: 1028361 - protein, 9 aa, Mycobacterium
TGEAEPHDA

SEQ ID NO: 1028362 - protein, 10 aa, Mycobacterium
TGEAGKPADG

SEQ ID NO: 1028363 - protein, 4 aa, Mycobacterium
TGED

SEQ ID NO: 1028364 - protein, 4 aa, Mycobacterium
TGEE

SEQ ID NO: 1028365 - protein, 13 aa, Mycobacterium
TGEESDDESLGGA

SEQ ID NO: 1028366 - protein, 7 aa, Mycobacterium
TGEFGGT

SEQ ID NO: 1028367 - protein, 8 aa, Mycobacterium
TGEGKTLA

SEQ ID NO: 1028368 - protein, 11 aa, Mycobacterium
TGEGRKDTLTA

SEQ ID NO: 1028369 - protein, 11 aa, Mycobacterium
TGEGRTADVSR

SEQ ID NO: 1028370 - protein, 4 aa, Mycobacterium
TGEP

SEQ ID NO: 1028371 - protein, 8 aa, Mycobacterium
TGEPAPHA

SEQ ID NO: 1028372 - protein, 7 aa, Mycobacterium
TGEPHTP

SEQ ID NO: 1028373 - protein, 11 aa, Mycobacterium
TGEPPRGPEAM

SEQ ID NO: 1028374 - protein, 6 aa, Mycobacterium
TGEPQQ

SEQ ID NO: 1028375 - protein, 6 aa, Mycobacterium
TGEPSY

SEQ ID NO: 1028376 - protein, 8 aa, Mycobacterium
TGEPTKEG

SEQ ID NO: 1028377 - protein, 100 aa, Mycobacterium
TGEPVKRTATKSPAKAGAKRPTKTANGAPPAKRAAKTPGQADDATTGDAPKKTRPSARGTKAARGTKAPGEGATDPDANLDTADDLDADPDIDVDSSDDL

SEQ ID NO: 1028378 - protein, 5 aa, Mycobacterium
TGEQA

SEQ ID NO: 1028379 - protein, 8 aa, Mycobacterium
TGEQAANT

SEQ ID NO: 1028380 - protein, 16 aa, Mycobacterium
TGEQRALGGRGIPSGN

SEQ ID NO: 1028381 - protein, 6 aa, Mycobacterium
TGEQTI

SEQ ID NO: 1028382 - protein, 7 aa, Mycobacterium
TGERGSG

SEQ ID NO: 1028383 - protein, 9 aa, Mycobacterium
TGERGSYQC

SEQ ID NO: 1028384 - protein, 15 aa, Mycobacterium
TGERPTSEALVEVRD

SEQ ID NO: 1028385 - protein, 10 aa, Mycobacterium
TGERSGSSRL

SEQ ID NO: 1028386 - protein, 9 aa, Mycobacterium
TGESAAAHA

SEQ ID NO: 1028387 - protein, 10 aa, Mycobacterium
TGESLAGGFG

SEQ ID NO: 1028388 - protein, 9 aa, Mycobacterium
TGESSTGGI

SEQ ID NO: 1028389 - protein, 7 aa, Mycobacterium
TGETGRC

SEQ ID NO: 1028390 - protein, 6 aa, Mycobacterium
TGETPT

SEQ ID NO: 1028391 - protein, 10 aa, Mycobacterium
TGETRTTLPG

SEQ ID NO: 1028392 - protein, 7 aa, Mycobacterium
TGETSPY

SEQ ID NO: 1028393 - protein, 14 aa, Mycobacterium
TGEVTDPDNVPETV

SEQ ID NO: 1028394 - protein, 11 aa, Mycobacterium
TGEYTDTKTQG

SEQ ID NO: 1028395 - protein, 4 aa, Mycobacterium
TGFA

SEQ ID NO: 1028396 - protein, 6 aa, Mycobacterium
TGFETG

SEQ ID NO: 1028397 - protein, 6 aa, Mycobacterium
TGFGEP

SEQ ID NO: 1028398 - protein, 13 aa, Mycobacterium
TGFHPAGGASTRA

SEQ ID NO: 1028399 - protein, 7 aa, Mycobacterium
TGFTPGK

SEQ ID NO: 1028400 - protein, 13 aa, Mycobacterium
TGGAGGAGGTASS

SEQ ID NO: 1028401 - protein, 25 aa, Mycobacterium
TGGAGGHGGLGSVGAAGTNPSAPYL

SEQ ID NO: 1028402 - protein, 9 aa, Mycobacterium
TGGAGGIGR

SEQ ID NO: 1028403 - protein, 10 aa, Mycobacterium
TGGARPRTRP

SEQ ID NO: 1028404 - protein, 6 aa, Mycobacterium
TGGASG

SEQ ID NO: 1028405 - protein, 6 aa, Mycobacterium
TGGASN

SEQ ID NO: 1028406 - protein, 5 aa, Mycobacterium
TGGCP

SEQ ID NO: 1028407 - protein, 11 aa, Mycobacterium
TGGESVASPQT

SEQ ID NO: 1028408 - protein, 15 aa, Mycobacterium
TGGGERTVSDPADTR

SEQ ID NO: 1028409 - protein, 6 aa, Mycobacterium
TGGGFG

SEQ ID NO: 1028410 - protein, 54 aa, Mycobacterium; identical to SEQ ID NO: 594801

SEQ ID NO: 1028411 - protein, 105 aa, Mycobacterium
TGGGHGGLGGAGVTAGGDGGAGGDGGPLIGRGGDGGAGGLSNSVDAVGGAGGAGGDGGRLVGSGGAGGTGGTSFVGDGGAGGAGGTSGFLGTGSGGAGGDSGNAS

SEQ ID NO: 1028412 - protein, 5 aa, Mycobacterium
TGGGR

SEQ ID NO: 1028413 - protein, 4 aa, Mycobacterium
TGGH

SEQ ID NO: 1028414 - protein, 9 aa, Mycobacterium
TGGHRGRTK

SEQ ID NO: 1028415 - protein, 6 aa, Mycobacterium
TGGKHR

SEQ ID NO: 1028416 - protein, 5 aa, Mycobacterium
TGGLA

SEQ ID NO: 1028417 - protein, 5 aa, Mycobacterium
TGGLS

SEQ ID NO: 1028418 - protein, 29 aa, Mycobacterium
TGGNGGAGVPPASGGSGGRGGLIGSAGQN

SEQ ID NO: 1028419 - protein, 34 aa, Mycobacterium
TGGNGGNGGTGTAKGTPGTGGTGGLIGVDGLSGA

SEQ ID NO: 1028420 - protein, 14 aa, Mycobacterium
TGGNGGQGGTGGTL

SEQ ID NO: 1028421 - protein, 27 aa, Mycobacterium
TGGNGGSGGAGGNGSNGGNGGNGGNAQ

SEQ ID NO: 1028422 - protein, 6 aa, Mycobacterium
TGGPFP

SEQ ID NO: 1028423 - protein, 12 aa, Mycobacterium
TGGPGTGKTTTV

SEQ ID NO: 1028424 - protein, 9 aa, Mycobacterium
TGGPLGGPI

SEQ ID NO: 1028425 - protein, 9 aa, Mycobacterium
TGGPPQPPP

SEQ ID NO: 1028426 - protein, 4 aa, Mycobacterium
TGGQ

SEQ ID NO: 1028427 - protein, 12 aa, Mycobacterium
TGGQGGAGGNAG

SEQ ID NO: 1028428 - protein, 5 aa, Mycobacterium
TGGRG

SEQ ID NO: 1028429 - protein, 5 aa, Mycobacterium
TGGSE

SEQ ID NO: 1028430 - protein, 22 aa, Mycobacterium
TGGSGGAGGGSNAFTAGDGGAG

SEQ ID NO: 1028431 - protein, 10 aa, Mycobacterium
TGGSGGAGGV

SEQ ID NO: 1028432 - protein, 67 aa, Mycobacterium
TGGSGGDGGPLQAPCSETGVTAAPAGPAARCPASAGTVEPAGSAKSAGARAGTAAAAGPAAAAGAPA

SEQ ID NO: 1028433 - protein, 11 aa, Mycobacterium
TGGSGGTGGFG

SEQ ID NO: 1028434 - protein, 19 aa, Mycobacterium
TGGSGRMYKTTSNAHTLTG

SEQ ID NO: 1028435 - protein, 4 aa, Mycobacterium
TGGT

SEQ ID NO: 1028436 - protein, 55 aa, Mycobacterium
TGGTGDATHPAGGNGGNAGLIGNGGAGGAGKDGPLQSNGGNAGHGGDGAAGGEGG

SEQ ID NO: 1028437 - protein, 50 aa, Mycobacterium
TGGTGDATHPAGGNGGNAGLIGNGGAGGTGYSPATGTGAGGGAGGSGGRG

SEQ ID NO: 1028438 - protein, 27 aa, Mycobacterium
TGGTGGAGGWAAAGATGGIGGQGGAGG

SEQ ID NO: 1028439 - protein, 26 aa, Mycobacterium
TGGTGGTGGFGDGPLGGQGGDGGNAG

SEQ ID NO: 1028440 - protein, 7 aa, Mycobacterium
TGGTGSD

SEQ ID NO: 1028441 - protein, 5 aa, Mycobacterium
TGGTI

SEQ ID NO: 1028442 - protein, 7 aa, Mycobacterium
TGGTLGA

SEQ ID NO: 1028443 - protein, 8 aa, Mycobacterium
TGGTSGIG

SEQ ID NO: 1028444 - protein, 6 aa, Mycobacterium
TGGVDR

SEQ ID NO: 1028445 - protein, 6 aa, Mycobacterium
TGGVGQ

SEQ ID NO: 1028446 - protein, 11 aa, Mycobacterium
TGHAANDTLAD

SEQ ID NO: 1028447 - protein, 11 aa, Mycobacterium
TGHAPAPAVAS

SEQ ID NO: 1028448 - protein, 20 aa, Mycobacterium
TGHEGGAGTVHANSPGEVPA

SEQ ID NO: 1028449 - protein, 5 aa, Mycobacterium
TGHEP

SEQ ID NO: 1028450 - protein, 11 aa, Mycobacterium
TGHETGSDSAT

SEQ ID NO: 1028451 - protein, 10 aa, Mycobacterium
TGHGDSTTIG

SEQ ID NO: 1028452 - protein, 6 aa, Mycobacterium
TGHGTT

SEQ ID NO: 1028453 - protein, 6 aa, Mycobacterium
TGHPRP

SEQ ID NO: 1028454 - protein, 13 aa, Mycobacterium
TGHPSGTAKDVED

SEQ ID NO: 1028455 - protein, 9 aa, Mycobacterium
TGHSNSHQI

SEQ ID NO: 1028456 - protein, 15 aa, Mycobacterium
TGHTGQDQPQGSGVV

SEQ ID NO: 1028457 - protein, 29 aa, Mycobacterium
TGIAAGARRAGEAVGQAPQAGPAGPARPA

SEQ ID NO: 1028458 - protein, 12 aa, Mycobacterium
TGIAGHDGRQVV

SEQ ID NO: 1028459 - protein, 6 aa, Mycobacterium
TGIDPD

SEQ ID NO: 1028460 - protein, 8 aa, Mycobacterium
TGIDPERL

SEQ ID NO: 1028461 - protein, 14 aa, Mycobacterium
TGIDPTTLRGSPTG

SEQ ID NO: 1028462 - protein, 6 aa, Mycobacterium
TGIDTV

SEQ ID NO: 1028463 - protein, 4 aa, Mycobacterium
TGIE

SEQ ID NO: 1028464 - protein, 13 aa, Mycobacterium
TGIEPDKTTPAQW

SEQ ID NO: 1028465 - protein, 20 aa, Mycobacterium
TGIPGAHRRADRPQHHRDVQ

SEQ ID NO: 1028466 - protein, 6 aa, Mycobacterium
TGIPRP

SEQ ID NO: 1028467 - protein, 9 aa, Mycobacterium
TGIPSEDIR

SEQ ID NO: 1028468 - protein, 84 aa, Mycobacterium
TGITGAGGNGGTGGNGGNGATGTTGTNPTPAPSPAPPPPEPTAPPPTAETVRPAATAPPRDNKAAPAATATTAAARATRIPSEA

SEQ ID NO: 1028469 - protein, 10 aa, Mycobacterium
TGKAPPAARA

SEQ ID NO: 1028470 - protein, 9 aa, Mycobacterium
TGKDPNTVP

SEQ ID NO: 1028471 - protein, 5 aa, Mycobacterium
TGKIA

SEQ ID NO: 1028472 - protein, 6 aa, Mycobacterium
TGKIGD

SEQ ID NO: 1028473 - protein, 4 aa, Mycobacterium
TGKN

SEQ ID NO: 1028474 - protein, 4 aa, Mycobacterium
TGKP

SEQ ID NO: 1028475 - protein, 15 aa, Mycobacterium
TGKPAPLDRDEPRRV

SEQ ID NO: 1028476 - protein, 14 aa, Mycobacterium
TGKPLRSYRAPRRR

SEQ ID NO: 1028477 - protein, 14 aa, Mycobacterium
TGKPTAAGYAQAGG

SEQ ID NO: 1028478 - protein, 4 aa, Mycobacterium
TGKR

SEQ ID NO: 1028479 - protein, 8 aa, Mycobacterium
TGKSDSAI

SEQ ID NO: 1028480 - protein, 8 aa, Mycobacterium
TGKSWGDA

SEQ ID NO: 1028481 - protein, 9 aa, Mycobacterium
TGKYSELDA

SEQ ID NO: 1028482 - protein, 4 aa, Mycobacterium
TGLA

SEQ ID NO: 1028483 - protein, 7 aa, Mycobacterium
TGLADEN

SEQ ID NO: 1028484 - protein, 10 aa, Mycobacterium
TGLAGGDPHA

SEQ ID NO: 1028485 - protein, 10 aa, Mycobacterium
TGLAQPRPLD

SEQ ID NO: 1028486 - protein, 5 aa, Mycobacterium
TGLDE

SEQ ID NO: 1028487 - protein, 9 aa, Mycobacterium
TGLKGDAAR

SEQ ID NO: 1028488 - protein, 8 aa, Mycobacterium
TGLNRNGV

SEQ ID NO: 1028489 - protein, 6 aa, Mycobacterium
TGLPDN

SEQ ID NO: 1028490 - protein, 7 aa, Mycobacterium
TGLPRAT

SEQ ID NO: 1028491 - protein, 12 aa, Mycobacterium
TGLSSSLRATPI

SEQ ID NO: 1028492 - protein, 6 aa, Mycobacterium
TGLTDD

SEQ ID NO: 1028493 - protein, 20 aa, Mycobacterium
TGLTGRASYGGIGARRPAAA

SEQ ID NO: 1028494 - protein, 5 aa, Mycobacterium
TGMIG

SEQ ID NO: 1028495 - protein, 6 aa, Mycobacterium
TGMTDE

SEQ ID NO: 1028496 - protein, 5 aa, Mycobacterium
TGNGN

SEQ ID NO: 1028497 - protein, 6 aa, Mycobacterium
TGNGYY

SEQ ID NO: 1028498 - protein, 14 aa, Mycobacterium
TGNNTYKAVQRSAG

SEQ ID NO: 1028499 - protein, 8 aa, Mycobacterium
TGNPANTN

SEQ ID NO: 1028500 - protein, 13 aa, Mycobacterium
TGNRTIPQLDNAP

SEQ ID NO: 1028501 - protein, 10 aa, Mycobacterium
TGNYNSKTAR

SEQ ID NO: 1028502 - protein, 16 aa, Mycobacterium
TGPADRDGEQDRVDPR

SEQ ID NO: 1028503 - protein, 6 aa, Mycobacterium
TGPAQQ

SEQ ID NO: 1028504 - protein, 12 aa, Mycobacterium
TGPASPSWRKGP

SEQ ID NO: 1028505 - protein, 9 aa, Mycobacterium
TGPDAGDHQ

SEQ ID NO: 1028506 - protein, 9 aa, Mycobacterium
TGPEPAERY

SEQ ID NO: 1028507 - protein, 7 aa, Mycobacterium
TGPGADA

SEQ ID NO: 1028508 - protein, 9 aa, Mycobacterium
TGPGALPSD

SEQ ID NO: 1028509 - protein, 14 aa, Mycobacterium
TGPGAQLLRSRCSG

SEQ ID NO: 1028510 - protein, 6 aa, Mycobacterium
TGPGES

SEQ ID NO: 1028511 - protein, 7 aa, Mycobacterium
TGPGGER

SEQ ID NO: 1028512 - protein, 10 aa, Mycobacterium
TGPGNDAAGL

SEQ ID NO: 1028513 - protein, 8 aa, Mycobacterium
TGPGPLTE

SEQ ID NO: 1028514 - protein, 9 aa, Mycobacterium
TGPGVTETP

SEQ ID NO: 1028515 - protein, 10 aa, Mycobacterium
TGPKPSVADA

SEQ ID NO: 1028516 - protein, 7 aa, Mycobacterium
TGPNGYD

SEQ ID NO: 1028517 - protein, 7 aa, Mycobacterium
TGPPDDV

SEQ ID NO: 1028518 - protein, 13 aa, Mycobacterium
TGPPGAGKSTTIT

SEQ ID NO: 1028519 - protein, 9 aa, Mycobacterium
TGPSAGLGT

SEQ ID NO: 1028520 - protein, 5 aa, Mycobacterium
TGPTV

SEQ ID NO: 1028521 - protein, 5 aa, Mycobacterium
TGPVP

SEQ ID NO: 1028522 - protein, 16 aa, Mycobacterium
TGPVPGARVVPTPGTP

SEQ ID NO: 1028523 - protein, 8 aa, Mycobacterium
TGPVPQAE

SEQ ID NO: 1028524 - protein, 9 aa, Mycobacterium
TGPVREGDT

SEQ ID NO: 1028525 - protein, 40 aa, Mycobacterium
TGPVTEARPDTNAREPGDRTPAAPPAATPAATTDQLPEDR

SEQ ID NO: 1028526 - protein, 7 aa, Mycobacterium
TGPYTDD

SEQ ID NO: 1028527 - protein, 8 aa, Mycobacterium
TGQAPAAY

SEQ ID NO: 1028528 - protein, 15 aa, Mycobacterium
TGQAPDQPAVTSTNG

SEQ ID NO: 1028529 - protein, 12 aa, Mycobacterium
TGQATVATVNST

SEQ ID NO: 1028530 - protein, 4 aa, Mycobacterium
TGQD

SEQ ID NO: 1028531 - protein, 7 aa, Mycobacterium
TGQDSGV

SEQ ID NO: 1028532 - protein, 5 aa, Mycobacterium
TGQGG

SEQ ID NO: 1028533 - protein, 6 aa, Mycobacterium
TGQGVE

SEQ ID NO: 1028534 - protein, 5 aa, Mycobacterium
TGQGY

SEQ ID NO: 1028535 - protein, 5 aa, Mycobacterium
TGQID

SEQ ID NO: 1028536 - protein, 4 aa, Mycobacterium
TGQN

SEQ ID NO: 1028537 - protein, 8 aa, Mycobacterium
TGQPAAHA

SEQ ID NO: 1028538 - protein, 6 aa, Mycobacterium
TGQPLG

SEQ ID NO: 1028539 - protein, 14 aa, Mycobacterium
TGQPSDLDPDLATQ

SEQ ID NO: 1028540 - protein, 5 aa, Mycobacterium
TGQPV

SEQ ID NO: 1028541 - protein, 4 aa, Mycobacterium
TGQQ

SEQ ID NO: 1028542 - protein, 23 aa, Mycobacterium
TGQREPGPAPSFDEYPDEVAEAT

SEQ ID NO: 1028543 - protein, 4 aa, Mycobacterium
TGQS

SEQ ID NO: 1028544 - protein, 9 aa, Mycobacterium
TGQTPVDED

SEQ ID NO: 1028545 - protein, 9 aa, Mycobacterium
TGQVDTGGG

SEQ ID NO: 1028546 - protein, 10 aa, Mycobacterium
TGRANAKTLP

SEQ ID NO: 1028547 - protein, 10 aa, Mycobacterium
TGRCPSGVAT

SEQ ID NO: 1028548 - protein, 47 aa, Mycobacterium; identical to SEQ ID NO: 595591

SEQ ID NO: 1028549 - protein, 10 aa, Mycobacterium
TGRDPTQPRD

SEQ ID NO: 1028550 - protein, 10 aa, Mycobacterium
TGREADDVTA

SEQ ID NO: 1028551 - protein, 12 aa, Mycobacterium
TGRGADPIDWRL

SEQ ID NO: 1028552 - protein, 13 aa, Mycobacterium
TGRGADRPNGPDG

SEQ ID NO: 1028553 - protein, 7 aa, Mycobacterium
TGRGAEL

SEQ ID NO: 1028554 - protein, 8 aa, Mycobacterium
TGRGGTGA

SEQ ID NO: 1028555 - protein, 10 aa, Mycobacterium
TGRIGTPDDI

SEQ ID NO: 1028556 - protein, 15 aa, Mycobacterium
TGRNAPARGPLAGNQ

SEQ ID NO: 1028557 - protein, 8 aa, Mycobacterium
TGRNQHGD

SEQ ID NO: 1028558 - protein, 4 aa, Mycobacterium
TGRP

SEQ ID NO: 1028559 - protein, 5 aa, Mycobacterium
TGRPA

SEQ ID NO: 1028560 - protein, 7 aa, Mycobacterium
TGRPDLR

SEQ ID NO: 1028561 - protein, 6 aa, Mycobacterium
TGRPGV

SEQ ID NO: 1028562 - protein, 5 aa, Mycobacterium
TGRPL

SEQ ID NO: 1028563 - protein, 6 aa, Mycobacterium
TGRPQR

SEQ ID NO: 1028564 - protein, 7 aa, Mycobacterium
TGRPSAF

SEQ ID NO: 1028565 - protein, 7 aa, Mycobacterium
TGRPSTD

SEQ ID NO: 1028566 - protein, 11 aa, Mycobacterium
TGRPVPAAHPE

SEQ ID NO: 1028567 - protein, 12 aa, Mycobacterium
TGRQVQRETPLP

SEQ ID NO: 1028568 - protein, 5 aa, Mycobacterium
TGRSD

SEQ ID NO: 1028569 - protein, 9 aa, Mycobacterium
TGRSDYPNQ

SEQ ID NO: 1028570 - protein, 5 aa, Mycobacterium
TGRTA

SEQ ID NO: 1028571 - protein, 10 aa, Mycobacterium
TGRTFGSGPH

SEQ ID NO: 1028572 - protein, 4 aa, Mycobacterium
TGRV

SEQ ID NO: 1028573 - protein, 19 aa, Mycobacterium
TGRVPTRSAAQGACGDGRG

SEQ ID NO: 1028574 - protein, 16 aa, Mycobacterium
TGSAGAALQSEPRTPM

SEQ ID NO: 1028575 - protein, 10 aa, Mycobacterium
TGSAPGAFDS

SEQ ID NO: 1028576 - protein, 9 aa, Mycobacterium
TGSAPPTPS

SEQ ID NO: 1028577 - protein, 9 aa, Mycobacterium
TGSAPQTRT

SEQ ID NO: 1028578 - protein, 18 aa, Mycobacterium
TGSAPRGWYGGRDSPHTR

SEQ ID NO: 1028579 - protein, 19 aa, Mycobacterium
TGSASGGVEVGTEVGGEIP

SEQ ID NO: 1028580 - protein, 7 aa, Mycobacterium
TGSATAA

SEQ ID NO: 1028581 - protein, 9 aa, Mycobacterium
TGSDEDINR

SEQ ID NO: 1028582 - protein, 9 aa, Mycobacterium
TGSDGPGPT

SEQ ID NO: 1028583 - protein, 7 aa, Mycobacterium
TGSEATV

SEQ ID NO: 1028584 - protein, 9 aa, Mycobacterium
TGSENQKKR

SEQ ID NO: 1028585 - protein, 9 aa, Mycobacterium
TGSGAARAD

SEQ ID NO: 1028586 - protein, 6 aa, Mycobacterium
TGSGPM

SEQ ID NO: 1028587 - protein, 21 aa, Mycobacterium
TGSGSAYAAAEAANASPLQTA

SEQ ID NO: 1028588 - protein, 9 aa, Mycobacterium
TGSKPVGNV

SEQ ID NO: 1028589 - protein, 18 aa, Mycobacterium
TGSNDPQKFDPDASRETL

SEQ ID NO: 1028590 - protein, 9 aa, Mycobacterium
TGSNPKAKR

SEQ ID NO: 1028591 - protein, 10 aa, Mycobacterium
TGSPAQIADQ

SEQ ID NO: 1028592 - protein, 6 aa, Mycobacterium
TGSPDI

SEQ ID NO: 1028593 - protein, 10 aa, Mycobacterium
TGSPGYQPTE

SEQ ID NO: 1028594 - protein, 8 aa, Mycobacterium
TGSRRQRT

SEQ ID NO: 1028595 - protein, 6 aa, Mycobacterium
TGSRTV

SEQ ID NO: 1028596 - protein, 9 aa, Mycobacterium
TGSSATGRR

SEQ ID NO: 1028597 - protein, 5 aa, Mycobacterium
TGSSG

SEQ ID NO: 1028598 - protein, 7 aa, Mycobacterium
TGSSGLV

SEQ ID NO: 1028599 - protein, 7 aa, Mycobacterium
TGSSNLE

SEQ ID NO: 1028600 - protein, 7 aa, Mycobacterium
TGSTAAQ

SEQ ID NO: 1028601 - protein, 6 aa, Mycobacterium
TGSTAV

SEQ ID NO: 1028602 - protein, 6 aa, Mycobacterium
TGSTIW

SEQ ID NO: 1028603 - protein, 8 aa, Mycobacterium
TGSVPPTV

SEQ ID NO: 1028604 - protein, 12 aa, Mycobacterium
TGSWARRDRRTF

SEQ ID NO: 1028605 - protein, 6 aa, Mycobacterium
TGSYDQ

SEQ ID NO: 1028606 - protein, 11 aa, Mycobacterium
TGTAADDPWSA

SEQ ID NO: 1028607 - protein, 29 aa, Mycobacterium
TGTAELSDPVRAGGTVSENATDTPRRRRR

SEQ ID NO: 1028608 - protein, 10 aa, Mycobacterium
TGTANATTTF

SEQ ID NO: 1028609 - protein, 5 aa, Mycobacterium
TGTAS

SEQ ID NO: 1028610 - protein, 9 aa, Mycobacterium
TGTASGKSL

SEQ ID NO: 1028611 - protein, 4 aa, Mycobacterium
TGTD

SEQ ID NO: 1028612 - protein, 6 aa, Mycobacterium
TGTDEM

SEQ ID NO: 1028613 - protein, 10 aa, Mycobacterium
TGTDTGAVTA

SEQ ID NO: 1028614 - protein, 7 aa, Mycobacterium
TGTEDQA

SEQ ID NO: 1028615 - protein, 6 aa, Mycobacterium
TGTFAG

SEQ ID NO: 1028616 - protein, 7 aa, Mycobacterium
TGTGARS

SEQ ID NO: 1028617 - protein, 8 aa, Mycobacterium
TGTGIAPA

SEQ ID NO: 1028618 - protein, 7 aa, Mycobacterium
TGTGNSF

SEQ ID NO: 1028619 - protein, 7 aa, Mycobacterium
TGTGPAV

SEQ ID NO: 1028620 - protein, 11 aa, Mycobacterium
TGTGRGGVAPR

SEQ ID NO: 1028621 - protein, 6 aa, Mycobacterium
TGTGRR

SEQ ID NO: 1028622 - protein, 7 aa, Mycobacterium
TGTGTRS

SEQ ID NO: 1028623 - protein, 9 aa, Mycobacterium
TGTKAPGDI

SEQ ID NO: 1028624 - protein, 12 aa, Mycobacterium
TGTNDVGVGNSA

SEQ ID NO: 1028625 - protein, 9 aa, Mycobacterium
TGTNGKTTC

SEQ ID NO: 1028626 - protein, 4 aa, Mycobacterium
TGTP

SEQ ID NO: 1028627 - protein, 7 aa, Mycobacterium
TGTPDPF

SEQ ID NO: 1028628 - protein, 7 aa, Mycobacterium
TGTPNPS

SEQ ID NO: 1028629 - protein, 8 aa, Mycobacterium
TGTPVSGD

SEQ ID NO: 1028630 - protein, 19 aa, Mycobacterium
TGTQASANSQTTASGSVPE

SEQ ID NO: 1028631 - protein, 8 aa, Mycobacterium
TGTRAHSA

SEQ ID NO: 1028632 - protein, 7 aa, Mycobacterium
TGTRGTS

SEQ ID NO: 1028633 - protein, 27 aa, Mycobacterium
TGTRKPPSEPDLAKAGAHSAGGPGPTE

SEQ ID NO: 1028634 - protein, 5 aa, Mycobacterium
TGTSG

SEQ ID NO: 1028635 - protein, 10 aa, Mycobacterium
TGTSGKTTTT

SEQ ID NO: 1028636 - protein, 4 aa, Mycobacterium
TGTT

SEQ ID NO: 1028637 - protein, 8 aa, Mycobacterium
TGTTVSPP

SEQ ID NO: 1028638 - protein, 6 aa, Mycobacterium
TGTVQQ

SEQ ID NO: 1028639 - protein, 20 aa, Mycobacterium
TGTWSTEGAYDDQDYAETEQ

SEQ ID NO: 1028640 - protein, 8 aa, Mycobacterium
TGVAGEPQ

SEQ ID NO: 1028641 - protein, 12 aa, Mycobacterium
TGVDPDRGGGQI

SEQ ID NO: 1028642 - protein, 52 aa, Mycobacterium
TGVGNAGNYNSGGFNTGSTNTGSFNSGDHNTGYLNSGDYNTGLANSGDVNTG

SEQ ID NO: 1028643 - protein, 15 aa, Mycobacterium
TGVGTHARADPYGLG

SEQ ID NO: 1028644 - protein, 8 aa, Mycobacterium
TGVKPNTG

SEQ ID NO: 1028645 - protein, 12 aa, Mycobacterium
TGVPAAGADDVS

SEQ ID NO: 1028646 - protein, 6 aa, Mycobacterium
TGVPEH

SEQ ID NO: 1028647 - protein, 4 aa, Mycobacterium
TGVQ

SEQ ID NO: 1028648 - protein, 5 aa, Mycobacterium
TGVRE

SEQ ID NO: 1028649 - protein, 17 aa, Mycobacterium
TGVSSEPEVTERDDEVA

SEQ ID NO: 1028650 - protein, 4 aa, Mycobacterium
TGVT

SEQ ID NO: 1028651 - protein, 4 aa, Mycobacterium
TGWG

SEQ ID NO: 1028652 - protein, 30 aa, Mycobacterium; identical to SEQ ID NO: 57507

SEQ ID NO: 1028653 - protein, 7 aa, Mycobacterium
TGYDRTY

SEQ ID NO: 1028654 - protein, 16 aa, Mycobacterium
TGYGSAANRAGVRGGD

SEQ ID NO: 1028655 - protein, 5 aa, Mycobacterium
TGYND

SEQ ID NO: 1028656 - protein, 5 aa, Mycobacterium
TGYRR

SEQ ID NO: 1028657 - protein, 7 aa, Mycobacterium
TGYTRED

SEQ ID NO: 1028658 - protein, 4 aa, Mycobacterium
TGYY

SEQ ID NO: 1028659 - protein, 8 aa, Mycobacterium
THDDSASI

SEQ ID NO: 1028660 - protein, 8 aa, Mycobacterium
THDGAPAA

SEQ ID NO: 1028661 - protein, 8 aa, Mycobacterium
THDGGVSA

SEQ ID NO: 1028662 - protein, 6 aa, Mycobacterium
THDGTC

SEQ ID NO: 1028663 - protein, 10 aa, Mycobacterium
THDNAQHRDQ

SEQ ID NO: 1028664 - protein, 11 aa, Mycobacterium
THDTKRGEDVR

SEQ ID NO: 1028665 - protein, 8 aa, Mycobacterium
THEATAAG

SEQ ID NO: 1028666 - protein, 5 aa, Mycobacterium
THEHR

SEQ ID NO: 1028667 - protein, 4 aa, Mycobacterium
THEQ

SEQ ID NO: 1028668 - protein, 17 aa, Mycobacterium
THETGENPINDSAEVRR

SEQ ID NO: 1028669 - protein, 7 aa, Mycobacterium
THGARAG

SEQ ID NO: 1028670 - protein, 6 aa, Mycobacterium
THGGQL

SEQ ID NO: 1028671 - protein, 10 aa, Mycobacterium
THGGRRGTGI

SEQ ID NO: 1028672 - protein, 17 aa, Mycobacterium
THGRPTDRNAHPHRDAA

SEQ ID NO: 1028673 - protein, 5 aa, Mycobacterium
THGST

SEQ ID NO: 1028674 - protein, 7 aa, Mycobacterium
THGTGTV

SEQ ID NO: 1028675 - protein, 7 aa, Mycobacterium
THGYDTT

SEQ ID NO: 1028676 - protein, 9 aa, Mycobacterium
THKRTGVPI

SEQ ID NO: 1028677 - protein, 8 aa, Mycobacterium
THLPEGSA

SEQ ID NO: 1028678 - protein, 9 aa, Mycobacterium
THPADTPTE

SEQ ID NO: 1028679 - protein, 5 aa, Mycobacterium
THPAS

SEQ ID NO: 1028680 - protein, 11 aa, Mycobacterium
THPDRPDAPNM

SEQ ID NO: 1028681 - protein, 11 aa, Mycobacterium
THPENLTSEEA

SEQ ID NO: 1028682 - protein, 10 aa, Mycobacterium
THPPGDSTYV

SEQ ID NO: 1028683 - protein, 9 aa, Mycobacterium
THPPNRHET

SEQ ID NO: 1028684 - protein, 7 aa, Mycobacterium
THPQDRA

SEQ ID NO: 1028685 - protein, 4 aa, Mycobacterium
THPS

SEQ ID NO: 1028686 - protein, 5 aa, Mycobacterium
THPSA

SEQ ID NO: 1028687 - protein, 6 aa, Mycobacterium
THQGTA

SEQ ID NO: 1028688 - protein, 10 aa, Mycobacterium
THQRGGVRTP

SEQ ID NO: 1028689 - protein, 9 aa, Mycobacterium
THRDSTGNH

SEQ ID NO: 1028690 - protein, 6 aa, Mycobacterium
THRDTE

SEQ ID NO: 1028691 - protein, 6 aa, Mycobacterium
THRETP

SEQ ID NO: 1028692 - protein, 7 aa, Mycobacterium
THRETPR

SEQ ID NO: 1028693 - protein, 18 aa, Mycobacterium
THRGHRPRRHRRRDPAPH

SEQ ID NO: 1028694 - protein, 18 aa, Mycobacterium
THRNPDRQLPSEGTTRGA

SEQ ID NO: 1028695 - protein, 4 aa, Mycobacterium
THRR

SEQ ID NO: 1028696 - protein, 4 aa, Mycobacterium
THRS

SEQ ID NO: 1028697 - protein, 5 aa, Mycobacterium
THRTT

SEQ ID NO: 1028698 - protein, 7 aa, Mycobacterium
THTRRGE

SEQ ID NO: 1028699 - protein, 16 aa, Mycobacterium
THTTHGPQTPHPAEPH

SEQ ID NO: 1028700 - protein, 11 aa, Mycobacterium
TIAPGSNSKRY

SEQ ID NO: 1028701 - protein, 12 aa, Mycobacterium
TIAPNGDVRPPI

SEQ ID NO: 1028702 - protein, 8 aa, Mycobacterium
TIDADTAA

SEQ ID NO: 1028703 - protein, 8 aa, Mycobacterium
TIDDETTE

SEQ ID NO: 1028704 - protein, 7 aa, Mycobacterium
TIDGSDT

SEQ ID NO: 1028705 - protein, 14 aa, Mycobacterium
TIDPADPRSGRGEG

SEQ ID NO: 1028706 - protein, 5 aa, Mycobacterium
TIEPG

SEQ ID NO: 1028707 - protein, 10 aa, Mycobacterium
TIGDEGDSQL

SEQ ID NO: 1028708 - protein, 12 aa, Mycobacterium
TIGGGARSGELT

SEQ ID NO: 1028709 - protein, 9 aa, Mycobacterium
TIGHTQPRR

SEQ ID NO: 1028710 - protein, 6 aa, Mycobacterium
TIGPGL

SEQ ID NO: 1028711 - protein, 7 aa, Mycobacterium
TIGRDGS

SEQ ID NO: 1028712 - protein, 10 aa, Mycobacterium
TIGRSSTEDT

SEQ ID NO: 1028713 - protein, 4 aa, Mycobacterium
TIHP

SEQ ID NO: 1028714 - protein, 4 aa, Mycobacterium
TINY

SEQ ID NO: 1028715 - protein, 14 aa, Mycobacterium
TIPANEGADLSPAG

SEQ ID NO: 1028716 - protein, 4 aa, Mycobacterium
TIPE

SEQ ID NO: 1028717 - protein, 8 aa, Mycobacterium
TIPPQGSR

SEQ ID NO: 1028718 - protein, 13 aa, Mycobacterium
TIPTDGGTAAAGG

SEQ ID NO: 1028719 - protein, 5 aa, Mycobacterium
TIQGD

SEQ ID NO: 1028720 - protein, 5 aa, Mycobacterium
TIRAG

SEQ ID NO: 1028721 - protein, 6 aa, Mycobacterium
TIRGRS

SEQ ID NO: 1028722 - protein, 13 aa, Mycobacterium
TISDTGTETPPGA

SEQ ID NO: 1028723 - protein, 15 aa, Mycobacterium
TISGTGSGSSARAAV

SEQ ID NO: 1028724 - protein, 5 aa, Mycobacterium
TITAK

SEQ ID NO: 1028725 - protein, 23 aa, Mycobacterium
TITGQTPARSVYEPAPRSPALGA

SEQ ID NO: 1028726 - protein, 5 aa, Mycobacterium
TITRG

SEQ ID NO: 1028727 - protein, 14 aa, Mycobacterium
TKAKIRDTRKTLPG

SEQ ID NO: 1028728 - protein, 34 aa, Mycobacterium
TKAPRGNSPRWPTQPARSSPTLPVSTGSCSPTPG

SEQ ID NO: 1028729 - protein, 7 aa, Mycobacterium
TKAPTVQ

SEQ ID NO: 1028730 - protein, 5 aa, Mycobacterium
TKASD

SEQ ID NO: 1028731 - protein, 8 aa, Mycobacterium
TKASGIEG

SEQ ID NO: 1028732 - protein, 5 aa, Mycobacterium
TKATG

SEQ ID NO: 1028733 - protein, 7 aa, Mycobacterium
TKAYSGM

SEQ ID NO: 1028734 - protein, 8 aa, Mycobacterium
TKDAEAAA

SEQ ID NO: 1028735 - protein, 9 aa, Mycobacterium
TKDGTLAGP

SEQ ID NO: 1028736 - protein, 6 aa, Mycobacterium
TKDLEP

SEQ ID NO: 1028737 - protein, 8 aa, Mycobacterium
TKDPDKFV

SEQ ID NO: 1028738 - protein, 6 aa, Mycobacterium
TKDQAE

SEQ ID NO: 1028739 - protein, 5 aa, Mycobacterium
TKEDA

SEQ ID NO: 1028740 - protein, 10 aa, Mycobacterium
TKEHSAEYQS

SEQ ID NO: 1028741 - protein, 32 aa, Mycobacterium
TKEHTESRHAETRASLEAHGGKSLGEGPAQGW

SEQ ID NO: 1028742 - protein, 5 aa, Mycobacterium
TKELG

SEQ ID NO: 1028743 - protein, 9 aa, Mycobacterium
TKENAEQVK

SEQ ID NO: 1028744 - protein, 4 aa, Mycobacterium
TKEP

SEQ ID NO: 1028745 - protein, 5 aa, Mycobacterium
TKETP

SEQ ID NO: 1028746 - protein, 5 aa, Mycobacterium
TKGDV

SEQ ID NO: 1028747 - protein, 4 aa, Mycobacterium
TKGG

SEQ ID NO: 1028748 - protein, 9 aa, Mycobacterium
TKGGASEVR

SEQ ID NO: 1028749 - protein, 13 aa, Mycobacterium
TKGPQGKRLGKTS

SEQ ID NO: 1028750 - protein, 7 aa, Mycobacterium
TKGTTTA

SEQ ID NO: 1028751 - protein, 5 aa, Mycobacterium
TKHAR

SEQ ID NO: 1028752 - protein, 9 aa, Mycobacterium
TKIDRAQTP

SEQ ID NO: 1028753 - protein, 19 aa, Mycobacterium
TKIDSTNWSSSQSFSYRRD

SEQ ID NO: 1028754 - protein, 13 aa, Mycobacterium
TKIEQTDTGPGGI

SEQ ID NO: 1028755 - protein, 7 aa, Mycobacterium
TKKESGV

SEQ ID NO: 1028756 - protein, 7 aa, Mycobacterium
TKKQGND

SEQ ID NO: 1028757 - protein, 4 aa, Mycobacterium
TKLA

SEQ ID NO: 1028758 - protein, 7 aa, Mycobacterium
TKLDGYT

SEQ ID NO: 1028759 - protein, 6 aa, Mycobacterium
TKLGAN

SEQ ID NO: 1028760 - protein, 8 aa, Mycobacterium
TKLPNGRT

SEQ ID NO: 1028761 - protein, 4 aa, Mycobacterium
TKLQ

SEQ ID NO: 1028762 - protein, 7 aa, Mycobacterium
TKMAAGD

SEQ ID NO: 1028763 - protein, 5 aa, Mycobacterium
TKNGI

SEQ ID NO: 1028764 - protein, 8 aa, Mycobacterium
TKNRATIG

SEQ ID NO: 1028765 - protein, 8 aa, Mycobacterium
TKNSINAA

SEQ ID NO: 1028766 - protein, 8 aa, Mycobacterium
TKPDAIDP

SEQ ID NO: 1028767 - protein, 40 aa, Mycobacterium
TKPEVTDEDDDAAVPSSEARPSQAAAASSIGADPAPENIK

SEQ ID NO: 1028768 - protein, 5 aa, Mycobacterium
TKPGA

SEQ ID NO: 1028769 - protein, 7 aa, Mycobacterium
TKPGLTT

SEQ ID NO: 1028770 - protein, 9 aa, Mycobacterium
TKPGRQDDY

SEQ ID NO: 1028771 - protein, 16 aa, Mycobacterium
TKPLADAKASTETASG

SEQ ID NO: 1028772 - protein, 12 aa, Mycobacterium
TKPSPFCGNPSN

SEQ ID NO: 1028773 - protein, 10 aa, Mycobacterium
TKPTPADAAD

SEQ ID NO: 1028774 - protein, 8 aa, Mycobacterium
TKPTRPDL

SEQ ID NO: 1028775 - protein, 6 aa, Mycobacterium
TKPYSA

SEQ ID NO: 1028776 - protein, 10 aa, Mycobacterium
TKQANRAAEN

SEQ ID NO: 1028777 - protein, 4 aa, Mycobacterium
TKQC

SEQ ID NO: 1028778 - protein, 8 aa, Mycobacterium
TKQRKQFG

SEQ ID NO: 1028779 - protein, 5 aa, Mycobacterium
TKRGA

SEQ ID NO: 1028780 - protein, 5 aa, Mycobacterium
TKRPP

SEQ ID NO: 1028781 - protein, 8 aa, Mycobacterium
TKSAPDLR

SEQ ID NO: 1028782 - protein, 10 aa, Mycobacterium
TKSDQTPWYE

SEQ ID NO: 1028783 - protein, 11 aa, Mycobacterium
TKSELPQAVPA

SEQ ID NO: 1028784 - protein, 8 aa, Mycobacterium
TKSRDAEA

SEQ ID NO: 1028785 - protein, 8 aa, Mycobacterium
TKTKDEAM

SEQ ID NO: 1028786 - protein, 11 aa, Mycobacterium
TKVDPAADPAV

SEQ ID NO: 1028787 - protein, 7 aa, Mycobacterium
TKVGEEI

SEQ ID NO: 1028788 - protein, 9 aa, Mycobacterium
TKVTTPDGI

SEQ ID NO: 1028789 - protein, 5 aa, Mycobacterium
TKYGA

SEQ ID NO: 1028790 - protein, 5 aa, Mycobacterium
TKYPT

SEQ ID NO: 1028791 - protein, 10 aa, Mycobacterium
TLAGGEPIDP

SEQ ID NO: 1028792 - protein, 5 aa, Mycobacterium
TLAGR

SEQ ID NO: 1028793 - protein, 7 aa, Mycobacterium
TLANATG

SEQ ID NO: 1028794 - protein, 10 aa, Mycobacterium
TLAPAAAQRC

SEQ ID NO: 1028795 - protein, 8 aa, Mycobacterium
TLDDDDSE

SEQ ID NO: 1028796 - protein, 5 aa, Mycobacterium
TLDDN

SEQ ID NO: 1028797 - protein, 13 aa, Mycobacterium
TLDDRQREATEEV

SEQ ID NO: 1028798 - protein, 10 aa, Mycobacterium
TLDGEPDYAA

SEQ ID NO: 1028799 - protein, 14 aa, Mycobacterium
TLDPAGILNPGKLI

SEQ ID NO: 1028800 - protein, 20 aa, Mycobacterium
TLDRADGKSLNVAGSGNNLT

SEQ ID NO: 1028801 - protein, 12 aa, Mycobacterium
TLGADSAQPAAD

SEQ ID NO: 1028802 - protein, 14 aa, Mycobacterium
TLGADSGDAQSGSI

SEQ ID NO: 1028803 - protein, 13 aa, Mycobacterium
TLGAPGQANYAAG

SEQ ID NO: 1028804 - protein, 10 aa, Mycobacterium
TLGDTPAADV

SEQ ID NO: 1028805 - protein, 15 aa, Mycobacterium
TLGEAAKANTDGSEV

SEQ ID NO: 1028806 - protein, 8 aa, Mycobacterium
TLGGGPTI

SEQ ID NO: 1028807 - protein, 5 aa, Mycobacterium
TLGGS

SEQ ID NO: 1028808 - protein, 5 aa, Mycobacterium
TLGNE

SEQ ID NO: 1028809 - protein, 4 aa, Mycobacterium
TLGP

SEQ ID NO: 1028810 - protein, 8 aa, Mycobacterium
TLGPGGSF

SEQ ID NO: 1028811 - protein, 7 aa, Mycobacterium
TLGPKGR

SEQ ID NO: 1028812 - protein, 5 aa, Mycobacterium
TLGRA

SEQ ID NO: 1028813 - protein, 4 aa, Mycobacterium
TLGT

SEQ ID NO: 1028814 - protein, 9 aa, Mycobacterium
TLGTGDSAY

SEQ ID NO: 1028815 - protein, 8 aa, Mycobacterium
TLHGGANE

SEQ ID NO: 1028816 - protein, 5 aa, Mycobacterium
TLHSD

SEQ ID NO: 1028817 - protein, 4 aa, Mycobacterium
TLNN

SEQ ID NO: 1028818 - protein, 4 aa, Mycobacterium
TLPA

SEQ ID NO: 1028819 - protein, 9 aa, Mycobacterium
TLPAGPDAA

SEQ ID NO: 1028820 - protein, 8 aa, Mycobacterium
TLPASQHD

SEQ ID NO: 1028821 - protein, 12 aa, Mycobacterium
TLPDAAPPEPLC

SEQ ID NO: 1028822 - protein, 22 aa, Mycobacterium
TLPDGTTVSTNDGPRAGTTYEK

SEQ ID NO: 1028823 - protein, 23 aa, Mycobacterium
TLPEDDDHPYRTGPWRPQTTEWN

SEQ ID NO: 1028824 - protein, 5 aa, Mycobacterium
TLPGA

SEQ ID NO: 1028825 - protein, 8 aa, Mycobacterium
TLPGAAGP

SEQ ID NO: 1028826 - protein, 16 aa, Mycobacterium
TLPGDSADDAQARDTA

SEQ ID NO: 1028827 - protein, 18 aa, Mycobacterium
TLPGGYTAHPHRDPQTGE

SEQ ID NO: 1028828 - protein, 19 aa, Mycobacterium
TLPPGAELTPTGRAQAQAF

SEQ ID NO: 1028829 - protein, 48 aa, Mycobacterium
TLPQGAAPSGAATAPSLPSMPSLGDGSGAATPSGAGSVPNLPAGPALS

SEQ ID NO: 1028830 - protein, 16 aa, Mycobacterium
TLPTEDQVAGYEALID

SEQ ID NO: 1028831 - protein, 14 aa, Mycobacterium
TLPTGERVRAGGDG

SEQ ID NO: 1028832 - protein, 13 aa, Mycobacterium
TLPTLPEDTGTLP

SEQ ID NO: 1028833 - protein, 10 aa, Mycobacterium
TLQAGPSAKV

SEQ ID NO: 1028834 - protein, 8 aa, Mycobacterium
TLQDDGAA

SEQ ID NO: 1028835 - protein, 8 aa, Mycobacterium
TLQGPSGA

SEQ ID NO: 1028836 - protein, 20 aa, Mycobacterium
TLQRGQAALTGPVARGDAAA

SEQ ID NO: 1028837 - protein, 14 aa, Mycobacterium
TLQTPASGWGGRAP

SEQ ID NO: 1028838 - protein, 13 aa, Mycobacterium
TLRDSRERRLRTG

SEQ ID NO: 1028839 - protein, 7 aa, Mycobacterium
TLREGDR

SEQ ID NO: 1028840 - protein, 6 aa, Mycobacterium
TLRGAS

SEQ ID NO: 1028841 - protein, 9 aa, Mycobacterium
TLRPEGTAG

SEQ ID NO: 1028842 - protein, 11 aa, Mycobacterium
TLRPGVGTGGP

SEQ ID NO: 1028843 - protein, 10 aa, Mycobacterium
TLRQDSPGAL

SEQ ID NO: 1028844 - protein, 15 aa, Mycobacterium
TLRQPRSNEFCCGTI

SEQ ID NO: 1028845 - protein, 18 aa, Mycobacterium
TLSATGQPCASDPAYRGR

SEQ ID NO: 1028846 - protein, 16 aa, Mycobacterium
TLSDAVRRNAEGSPHH

SEQ ID NO: 1028847 - protein, 8 aa, Mycobacterium
TLSDDEDA

SEQ ID NO: 1028848 - protein, 6 aa, Mycobacterium
TLSEDP

SEQ ID NO: 1028849 - protein, 7 aa, Mycobacterium
TLSEETT

SEQ ID NO: 1028850 - protein, 8 aa, Mycobacterium
TLSGAPKV

SEQ ID NO: 1028851 - protein, 9 aa, Mycobacterium
TLSGGQRRR

SEQ ID NO: 1028852 - protein, 7 aa, Mycobacterium
TLSGRAD

SEQ ID NO: 1028853 - protein, 8 aa, Mycobacterium
TLSGSPMK

SEQ ID NO: 1028854 - protein, 10 aa, Mycobacterium
TLSKPEDSFE

SEQ ID NO: 1028855 - protein, 7 aa, Mycobacterium
TLSNQQV

SEQ ID NO: 1028856 - protein, 10 aa, Mycobacterium
TLSRPRSAKD

SEQ ID NO: 1028857 - protein, 10 aa, Mycobacterium
TLSSTDNANG

SEQ ID NO: 1028858 - protein, 4 aa, Mycobacterium
TLST

SEQ ID NO: 1028859 - protein, 4 aa, Mycobacterium
TLTA

SEQ ID NO: 1028860 - protein, 10 aa, Mycobacterium
TLTASSRRAL

SEQ ID NO: 1028861 - protein, 5 aa, Mycobacterium
TLTDD

SEQ ID NO: 1028862 - protein, 16 aa, Mycobacterium
TLTEEAYAKNAKRGRQ

SEQ ID NO: 1028863 - protein, 6 aa, Mycobacterium
TLTGAQ

SEQ ID NO: 1028864 - protein, 6 aa, Mycobacterium
TLTGGQ

SEQ ID NO: 1028865 - protein, 13 aa, Mycobacterium
TLTGSEPAGQSVG

SEQ ID NO: 1028866 - protein, 9 aa, Mycobacterium
TLTPDDDAA

SEQ ID NO: 1028867 - protein, 9 aa, Mycobacterium
TLTPEQAAG

SEQ ID NO: 1028868 - protein, 9 aa, Mycobacterium
TLTRRDQGR

SEQ ID NO: 1028869 - protein, 7 aa, Mycobacterium
TLTSSRS

SEQ ID NO: 1028870 - protein, 6 aa, Mycobacterium
TLTSVS

SEQ ID NO: 1028871 - protein, 6 aa, Mycobacterium
TLYDAG

SEQ ID NO: 1028872 - protein, 9 aa, Mycobacterium
TMGPEPNDS

SEQ ID NO: 1028873 - protein, 5 aa, Mycobacterium
TMGPM

SEQ ID NO: 1028874 - protein, 5 aa, Mycobacterium
TMGSS

SEQ ID NO: 1028875 - protein, 5 aa, Mycobacterium
TMHGR

SEQ ID NO: 1028876 - protein, 14 aa, Mycobacterium
TMNDGEGSGVAPTD

SEQ ID NO: 1028877 - protein, 10 aa, Mycobacterium
TMPAPDGTRT

SEQ ID NO: 1028878 - protein, 5 aa, Mycobacterium
TMPPQ

SEQ ID NO: 1028879 - protein, 9 aa, Mycobacterium
TMPRRAPAL

SEQ ID NO: 1028880 - protein, 15 aa, Mycobacterium
TMRTDAGDCTVQDDG

SEQ ID NO: 1028881 - protein, 14 aa, Mycobacterium
TMSTSEVDGVTGGV

SEQ ID NO: 1028882 - protein, 12 aa, Mycobacterium
TMTTGDGQQTNV

SEQ ID NO: 1028883 - protein, 4 aa, Mycobacterium
TNAA

SEQ ID NO: 1028884 - protein, 8 aa, Mycobacterium
TNADGATG

SEQ ID NO: 1028885 - protein, 12 aa, Mycobacterium
TNADSASPGMSD

SEQ ID NO: 1028886 - protein, 8 aa, Mycobacterium
TNAEGVAR

SEQ ID NO: 1028887 - protein, 17 aa, Mycobacterium
TNAEIPGVGPSESEVGP

SEQ ID NO: 1028888 - protein, 7 aa, Mycobacterium
TNAGKSS

SEQ ID NO: 1028889 - protein, 6 aa, Mycobacterium
TNAQRT

SEQ ID NO: 1028890 - protein, 7 aa, Mycobacterium
TNASGGC

SEQ ID NO: 1028891 - protein, 5 aa, Mycobacterium
TNASR

SEQ ID NO: 1028892 - protein, 5 aa, Mycobacterium
TNATA

SEQ ID NO: 1028893 - protein, 16 aa, Mycobacterium
TNDAGKAAKHQIRTTL

SEQ ID NO: 1028894 - protein, 7 aa, Mycobacterium
TNDTVGR

SEQ ID NO: 1028895 - protein, 4 aa, Mycobacterium
TNED

SEQ ID NO: 1028896 - protein, 14 aa, Mycobacterium
TNEDQPETSDDPRV

SEQ ID NO: 1028897 - protein, 4 aa, Mycobacterium
TNER

SEQ ID NO: 1028898 - protein, 10 aa, Mycobacterium
TNGAEKPRGL

SEQ ID NO: 1028899 - protein, 8 aa, Mycobacterium
TNGGSATM

SEQ ID NO: 1028900 - protein, 4 aa, Mycobacterium
TNGI

SEQ ID NO: 1028901 - protein, 40 aa, Mycobacterium
TNGMSTGAPAAAGANSVSAGAMTAATEPPPPTTAPPAAPL

SEQ ID NO: 1028902 - protein, 6 aa, Mycobacterium
TNGSGL

SEQ ID NO: 1028903 - protein, 7 aa, Mycobacterium
TNGTQVR

SEQ ID NO: 1028904 - protein, 4 aa, Mycobacterium
TNGY

SEQ ID NO: 1028905 - protein, 9 aa, Mycobacterium
TNHNGKGKP

SEQ ID NO: 1028906 - protein, 10 aa, Mycobacterium
TNHPAGDADA

SEQ ID NO: 1028907 - protein, 10 aa, Mycobacterium
TNKDGSPTGG

SEQ ID NO: 1028908 - protein, 6 aa, Mycobacterium
TNKERP

SEQ ID NO: 1028909 - protein, 8 aa, Mycobacterium
TNKYPNET

SEQ ID NO: 1028910 - protein, 8 aa, Mycobacterium
TNLESGAR

SEQ ID NO: 1028911 - protein, 6 aa, Mycobacterium
TNLTTK

SEQ ID NO: 1028912 - protein, 9 aa, Mycobacterium
TNMRSSTAD

SEQ ID NO: 1028913 - protein, 10 aa, Mycobacterium
TNNDDPAGAC

SEQ ID NO: 1028914 - protein, 4 aa, Mycobacterium
TNNF

SEQ ID NO: 1028915 - protein, 21 aa, Mycobacterium
TNNPAEAARAHQEKRPPAWDS

SEQ ID NO: 1028916 - protein, 8 aa, Mycobacterium
TNNQPRVA

SEQ ID NO: 1028917 - protein, 8 aa, Mycobacterium
TNPARPRA

SEQ ID NO: 1028918 - protein, 7 aa, Mycobacterium
TNPDGSL

SEQ ID NO: 1028919 - protein, 9 aa, Mycobacterium
TNPEAKKHR

SEQ ID NO: 1028920 - protein, 9 aa, Mycobacterium
TNPGAHQSN

SEQ ID NO: 1028921 - protein, 7 aa, Mycobacterium
TNPGQGV

SEQ ID NO: 1028922 - protein, 5 aa, Mycobacterium
TNPIE

SEQ ID NO: 1028923 - protein, 6 aa, Mycobacterium
TNPKGE

SEQ ID NO: 1028924 - protein, 5 aa, Mycobacterium
TNPLA

SEQ ID NO: 1028925 - protein, 5 aa, Mycobacterium
TNPPI

SEQ ID NO: 1028926 - protein, 9 aa, Mycobacterium
TNPPQHGSD

SEQ ID NO: 1028927 - protein, 9 aa, Mycobacterium
TNPSDWPEG

SEQ ID NO: 1028928 - protein, 9 aa, Mycobacterium
TNPSGADPT

SEQ ID NO: 1028929 - protein, 6 aa, Mycobacterium
TNPYVE

SEQ ID NO: 1028930 - protein, 7 aa, Mycobacterium
TNQAERR

SEQ ID NO: 1028931 - protein, 13 aa, Mycobacterium
TNQANPAEADTRD

SEQ ID NO: 1028932 - protein, 9 aa, Mycobacterium
TNQNDTGLT

SEQ ID NO: 1028933 - protein, 6 aa, Mycobacterium
TNQNPF

SEQ ID NO: 1028934 - protein, 8 aa, Mycobacterium
TNRAEAAS

SEQ ID NO: 1028935 - protein, 4 aa, Mycobacterium
TNRE

SEQ ID NO: 1028936 - protein, 7 aa, Mycobacterium
TNRGDDI

SEQ ID NO: 1028937 - protein, 14 aa, Mycobacterium
TNRHYGTPTPISDE

SEQ ID NO: 1028938 - protein, 8 aa, Mycobacterium
TNRKARHN

SEQ ID NO: 1028939 - protein, 7 aa, Mycobacterium
TNRNPQA

SEQ ID NO: 1028940 - protein, 6 aa, Mycobacterium
TNRPDL

SEQ ID NO: 1028941 - protein, 10 aa, Mycobacterium
TNRPSTCSAA

SEQ ID NO: 1028942 - protein, 8 aa, Mycobacterium
TNRRNPGA

SEQ ID NO: 1028943 - protein, 5 aa, Mycobacterium
TNRSG

SEQ ID NO: 1028944 - protein, 4 aa, Mycobacterium
TNRT

SEQ ID NO: 1028945 - protein, 7 aa, Mycobacterium
TNRYGTR

SEQ ID NO: 1028946 - protein, 10 aa, Mycobacterium
TNSADTAASD

SEQ ID NO: 1028947 - protein, 15 aa, Mycobacterium
TNSGDRAEISPTAQA

SEQ ID NO: 1028948 - protein, 7 aa, Mycobacterium
TNSGQLD

SEQ ID NO: 1028949 - protein, 4 aa, Mycobacterium
TNSP

SEQ ID NO: 1028950 - protein, 6 aa, Mycobacterium
TNSRTG

SEQ ID NO: 1028951 - protein, 11 aa, Mycobacterium
TNTGYHDPGGD

SEQ ID NO: 1028952 - protein, 8 aa, Mycobacterium
TNTPMTDD

SEQ ID NO: 1028953 - protein, 6 aa, Mycobacterium
TNTSMG

SEQ ID NO: 1028954 - protein, 7 aa, Mycobacterium
TNVESTE

SEQ ID NO: 1028955 - protein, 9 aa, Mycobacterium
TNVPGPRQP

SEQ ID NO: 1028956 - protein, 6 aa, Mycobacterium
TNVTSQ

SEQ ID NO: 1028957 - protein, 7 aa, Mycobacterium
TNYSAAK

SEQ ID NO: 1028958 - protein, 10 aa, Mycobacterium
TPAARNSAGF

SEQ ID NO: 1028959 - protein, 5 aa, Mycobacterium
TPADF

SEQ ID NO: 1028960 - protein, 5 aa, Mycobacterium
TPADG

SEQ ID NO: 1028961 - protein, 8 aa, Mycobacterium
TPADGSEP

SEQ ID NO: 1028962 - protein, 12 aa, Mycobacterium
TPADYQRAEDAG

SEQ ID NO: 1028963 - protein, 9 aa, Mycobacterium
TPAEARRHR

SEQ ID NO: 1028964 - protein, 10 aa, Mycobacterium
TPAEESGGGK

SEQ ID NO: 1028965 - protein, 5 aa, Mycobacterium
TPAEL

SEQ ID NO: 1028966 - protein, 8 aa, Mycobacterium
TPAELDTD

SEQ ID NO: 1028967 - protein, 10 aa, Mycobacterium
TPAELGGVNP

SEQ ID NO: 1028968 - protein, 6 aa, Mycobacterium
TPAEQR

SEQ ID NO: 1028969 - protein, 5 aa, Mycobacterium
TPAGL

SEQ ID NO: 1028970 - protein, 5 aa, Mycobacterium
TPAGS

SEQ ID NO: 1028971 - protein, 5 aa, Mycobacterium
TPAKT

SEQ ID NO: 1028972 - protein, 9 aa, Mycobacterium
TPALASRGF

SEQ ID NO: 1028973 - protein, 19 aa, Mycobacterium
TPALPPGRAGLAGTSVEVP

SEQ ID NO: 1028974 - protein, 5 aa, Mycobacterium
TPAMQ

SEQ ID NO: 1028975 - protein, 4 aa, Mycobacterium
TPAP

SEQ ID NO: 1028976 - protein, 5 aa, Mycobacterium
TPAPG

SEQ ID NO: 1028977 - protein, 17 aa, Mycobacterium
TPAPSPRQHLTSTGGAS

SEQ ID NO: 1028978 - protein, 8 aa, Mycobacterium
TPARNADA

SEQ ID NO: 1028979 - protein, 11 aa, Mycobacterium
TPARPRARGAY

SEQ ID NO: 1028980 - protein, 14 aa, Mycobacterium
TPARSEGGTRRYSA

SEQ ID NO: 1028981 - protein, 16 aa, Mycobacterium
TPASARDGSDGSERAI

SEQ ID NO: 1028982 - protein, 8 aa, Mycobacterium
TPASGAPT

SEQ ID NO: 1028983 - protein, 4 aa, Mycobacterium
TPAT

SEQ ID NO: 1028984 - protein, 9 aa, Mycobacterium
TPATDAAGR

SEQ ID NO: 1028985 - protein, 10 aa, Mycobacterium
TPATTDQATA

SEQ ID NO: 1028986 - protein, 12 aa, Mycobacterium
TPDAFTGDEITN

SEQ ID NO: 1028987 - protein, 4 aa, Mycobacterium
TPDD

SEQ ID NO: 1028988 - protein, 6 aa, Mycobacterium
TPDDDQ

SEQ ID NO: 1028989 - protein, 9 aa, Mycobacterium
TPDDGTGVQ

SEQ ID NO: 1028990 - protein, 8 aa, Mycobacterium
TPDDHKAL

SEQ ID NO: 1028991 - protein, 13 aa, Mycobacterium
TPDESAAAAATEL

SEQ ID NO: 1028992 - protein, 6 aa, Mycobacterium
TPDGHG

SEQ ID NO: 1028993 - protein, 12 aa, Mycobacterium
TPDGPEATGRGE

SEQ ID NO: 1028994 - protein, 6 aa, Mycobacterium
TPDGRS

SEQ ID NO: 1028995 - protein, 5 aa, Mycobacterium
TPDHP

SEQ ID NO: 1028996 - protein, 5 aa, Mycobacterium
TPDLE

SEQ ID NO: 1028997 - protein, 7 aa, Mycobacterium
TPDNAFP

SEQ ID NO: 1028998 - protein, 7 aa, Mycobacterium
TPDNYYT

SEQ ID NO: 1028999 - protein, 5 aa, Mycobacterium
TPDQL

SEQ ID NO: 1029000 - protein, 15 aa, Mycobacterium
TPDQLAGKTPLNAEQ

SEQ ID NO: 1029001 - protein, 5 aa, Mycobacterium
TPDQP

SEQ ID NO: 1029002 - protein, 6 aa, Mycobacterium
TPDSFY

SEQ ID NO: 1029003 - protein, 9 aa, Mycobacterium
TPDSSRYWP

SEQ ID NO: 1029004 - protein, 5 aa, Mycobacterium
TPDTA

SEQ ID NO: 1029005 - protein, 6 aa, Mycobacterium
TPEAVV

SEQ ID NO: 1029006 - protein, 5 aa, Mycobacterium
TPEEL

SEQ ID NO: 1029007 - protein, 5 aa, Mycobacterium
TPEER

SEQ ID NO: 1029008 - protein, 10 aa, Mycobacterium
TPEERADPKI

SEQ ID NO: 1029009 - protein, 5 aa, Mycobacterium
TPEEV

SEQ ID NO: 1029010 - protein, 12 aa, Mycobacterium
TPEEVAREAADN

SEQ ID NO: 1029011 - protein, 13 aa, Mycobacterium
TPEFGAKGITEPD

SEQ ID NO: 1029012 - protein, 8 aa, Mycobacterium
TPEFTTPP

SEQ ID NO: 1029013 - protein, 4 aa, Mycobacterium
TPEG

SEQ ID NO: 1029014 - protein, 8 aa, Mycobacterium
TPEGDKTR

SEQ ID NO: 1029015 - protein, 6 aa, Mycobacterium
TPEGET

SEQ ID NO: 1029016 - protein, 6 aa, Mycobacterium
TPEGPN

SEQ ID NO: 1029017 - protein, 5 aa, Mycobacterium
TPEGQ

SEQ ID NO: 1029018 - protein, 8 aa, Mycobacterium
TPEHSPDI

SEQ ID NO: 1029019 - protein, 8 aa, Mycobacterium
TPEHTGAA

SEQ ID NO: 1029020 - protein, 9 aa, Mycobacterium
TPEHTGTAR

SEQ ID NO: 1029021 - protein, 9 aa, Mycobacterium
TPEKADQYG

SEQ ID NO: 1029022 - protein, 12 aa, Mycobacterium
TPEKVGRDAGDL

SEQ ID NO: 1029023 - protein, 7 aa, Mycobacterium
TPEPQTV

SEQ ID NO: 1029024 - protein, 6 aa, Mycobacterium
TPEQQQ

SEQ ID NO: 1029025 - protein, 4 aa, Mycobacterium
TPER

SEQ ID NO: 1029026 - protein, 6 aa, Mycobacterium
TPERAG

SEQ ID NO: 1029027 - protein, 5 aa, Mycobacterium
TPERF

SEQ ID NO: 1029028 - protein, 12 aa, Mycobacterium
TPERPDDADNPL

SEQ ID NO: 1029029 - protein, 10 aa, Mycobacterium
TPESNGEDNR

SEQ ID NO: 1029030 - protein, 12 aa, Mycobacterium
TPETVAERLREL

SEQ ID NO: 1029031 - protein, 5 aa, Mycobacterium
TPEVA

SEQ ID NO: 1029032 - protein, 6 aa, Mycobacterium
TPEYPL

SEQ ID NO: 1029033 - protein, 5 aa, Mycobacterium
TPFAG

SEQ ID NO: 1029034 - protein, 4 aa, Mycobacterium
TPFD

SEQ ID NO: 1029035 - protein, 5 aa, Mycobacterium
TPFND

SEQ ID NO: 1029036 - protein, 4 aa, Mycobacterium
TPFP

SEQ ID NO: 1029037 - protein, 19 aa, Mycobacterium
TPFPPGATQLPAGGGSGVR

SEQ ID NO: 1029038 - protein, 13 aa, Mycobacterium
TPGAEPRAAGGYG

SEQ ID NO: 1029039 - protein, 6 aa, Mycobacterium
TPGAPE

SEQ ID NO: 1029040 - protein, 20 aa, Mycobacterium
TPGARDEQADTITNWIAKRW

SEQ ID NO: 1029041 - protein, 7 aa, Mycobacterium
TPGCRSE

SEQ ID NO: 1029042 - protein, 5 aa, Mycobacterium
TPGDL

SEQ ID NO: 1029043 - protein, 7 aa, Mycobacterium
TPGDPKL

SEQ ID NO: 1029044 - protein, 6 aa, Mycobacterium
TPGDRS

SEQ ID NO: 1029045 - protein, 7 aa, Mycobacterium
TPGDTRA

SEQ ID NO: 1029046 - protein, 8 aa, Mycobacterium
TPGEGSPV

SEQ ID NO: 1029047 - protein, 8 aa, Mycobacterium
TPGERAPS

SEQ ID NO: 1029048 - protein, 17 aa, Mycobacterium
TPGEYTQLTGRAGRRGI

SEQ ID NO: 1029049 - protein, 6 aa, Mycobacterium
TPGGEF

SEQ ID NO: 1029050 - protein, 12 aa, Mycobacterium
TPGGLATQYSSA

SEQ ID NO: 1029051 - protein, 7 aa, Mycobacterium
TPGHSPG

SEQ ID NO: 1029052 - protein, 8 aa, Mycobacterium
TPGMPTDG

SEQ ID NO: 1029053 - protein, 12 aa, Mycobacterium
TPGNSSPLSDSS

SEQ ID NO: 1029054 - protein, 19 aa, Mycobacterium
TPGPAPADTEESAGGGLIG

SEQ ID NO: 1029055 - protein, 8 aa, Mycobacterium
TPGPPRPE

SEQ ID NO: 1029056 - protein, 9 aa, Mycobacterium
TPGPPVPTR

SEQ ID NO: 1029057 - protein, 4 aa, Mycobacterium
TPGQ

SEQ ID NO: 1029058 - protein, 5 aa, Mycobacterium
TPGRT

SEQ ID NO: 1029059 - protein, 4 aa, Mycobacterium
TPGV

SEQ ID NO: 1029060 - protein, 4 aa, Mycobacterium
TPGY

SEQ ID NO: 1029061 - protein, 4 aa, Mycobacterium
TPHE

SEQ ID NO: 1029062 - protein, 15 aa, Mycobacterium
TPHPASAAPISGGTG

SEQ ID NO: 1029063 - protein, 13 aa, Mycobacterium
TPHPEDDDWGQAG

SEQ ID NO: 1029064 - protein, 17 aa, Mycobacterium
TPHSMESADTKSACAPH

SEQ ID NO: 1029065 - protein, 4 aa, Mycobacterium
TPIA

SEQ ID NO: 1029066 - protein, 11 aa, Mycobacterium
TPIGKGKANGA

SEQ ID NO: 1029067 - protein, 6 aa, Mycobacterium
TPIPAS

SEQ ID NO: 1029068 - protein, 8 aa, Mycobacterium
TPIPGEDD

SEQ ID NO: 1029069 - protein, 5 aa, Mycobacterium
TPIPR

SEQ ID NO: 1029070 - protein, 4 aa, Mycobacterium
TPIR

SEQ ID NO: 1029071 - protein, 6 aa, Mycobacterium
TPISHP

SEQ ID NO: 1029072 - protein, 13 aa, Mycobacterium
TPKDGGQIVVHRR

SEQ ID NO: 1029073 - protein, 6 aa, Mycobacterium
TPKIRT

SEQ ID NO: 1029074 - protein, 5 aa, Mycobacterium
TPKLA

SEQ ID NO: 1029075 - protein, 12 aa, Mycobacterium
TPKLDGRAAAAE

SEQ ID NO: 1029076 - protein, 5 aa, Mycobacterium
TPKLT

SEQ ID NO: 1029077 - protein, 5 aa, Mycobacterium
TPKPE

SEQ ID NO: 1029078 - protein, 8 aa, Mycobacterium
TPKPRTHP

SEQ ID NO: 1029079 - protein, 13 aa, Mycobacterium
TPKRLCEKKHAPL

SEQ ID NO: 1029080 - protein, 21 aa, Mycobacterium
TPKTPTAADPDAIRRKGRGIA

SEQ ID NO: 1029081 - protein, 14 aa, Mycobacterium
TPLAPEKEGDADIR

SEQ ID NO: 1029082 - protein, 4 aa, Mycobacterium
TPLD

SEQ ID NO: 1029083 - protein, 8 aa, Mycobacterium
TPLDAPAL

SEQ ID NO: 1029084 - protein, 5 aa, Mycobacterium
TPLED

SEQ ID NO: 1029085 - protein, 4 aa, Mycobacterium
TPLG

SEQ ID NO: 1029086 - protein, 8 aa, Mycobacterium
TPLPPTGQ

SEQ ID NO: 1029087 - protein, 22 aa, Mycobacterium
TPLPSLHSRSGRLDVSAIAANF

SEQ ID NO: 1029088 - protein, 9 aa, Mycobacterium
TPLPYSSGQ

SEQ ID NO: 1029089 - protein, 5 aa, Mycobacterium
TPLSN

SEQ ID NO: 1029090 - protein, 4 aa, Mycobacterium
TPLT

SEQ ID NO: 1029091 - protein, 6 aa, Mycobacterium
TPLTED

SEQ ID NO: 1029092 - protein, 16 aa, Mycobacterium
TPLTGQGSQDGTPRSV

SEQ ID NO: 1029093 - protein, 8 aa, Mycobacterium
TPLTSPAE

SEQ ID NO: 1029094 - protein, 6 aa, Mycobacterium
TPNAAR

SEQ ID NO: 1029095 - protein, 9 aa, Mycobacterium
TPNGDDVNA

SEQ ID NO: 1029096 - protein, 7 aa, Mycobacterium
TPNGPVD

SEQ ID NO: 1029097 - protein, 5 aa, Mycobacterium
TPNKI

SEQ ID NO: 1029098 - protein, 11 aa, Mycobacterium
TPNPKSGGSRL

SEQ ID NO: 1029099 - protein, 14 aa, Mycobacterium
TPNRAPSSPRSPRR

SEQ ID NO: 1029100 - protein, 7 aa, Mycobacterium
TPPAANA

SEQ ID NO: 1029101 - protein, 12 aa, Mycobacterium
TPPAGANQPGLF

SEQ ID NO: 1029102 - protein, 8 aa, Mycobacterium
TPPAHSST

SEQ ID NO: 1029103 - protein, 11 aa, Mycobacterium
TPPAPPAPPKL

SEQ ID NO: 1029104 - protein, 6 aa, Mycobacterium
TPPARQ

SEQ ID NO: 1029105 - protein, 8 aa, Mycobacterium
TPPDDAPA

SEQ ID NO: 1029106 - protein, 10 aa, Mycobacterium
TPPEAADAAQ

SEQ ID NO: 1029107 - protein, 6 aa, Mycobacterium
TPPEER

SEQ ID NO: 1029108 - protein, 7 aa, Mycobacterium
TPPERHQ

SEQ ID NO: 1029109 - protein, 16 aa, Mycobacterium
TPPFGGPLAASKAAIA

SEQ ID NO: 1029110 - protein, 12 aa, Mycobacterium
TPPGGPFGPRPG

SEQ ID NO: 1029111 - protein, 9 aa, Mycobacterium
TPPGSGEPV

SEQ ID NO: 1029112 - protein, 6 aa, Mycobacterium
TPPIPD

SEQ ID NO: 1029113 - protein, 9 aa, Mycobacterium
TPPLGNHPG

SEQ ID NO: 1029114 - protein, 7 aa, Mycobacterium
TPPLPAQ

SEQ ID NO: 1029115 - protein, 6 aa, Mycobacterium
TPPPLP

SEQ ID NO: 1029116 - protein, 8 aa, Mycobacterium
TPPPPRWT

SEQ ID NO: 1029117 - protein, 7 aa, Mycobacterium
TPPPQPE

SEQ ID NO: 1029118 - protein, 38 aa, Mycobacterium
TPPPTNNAPLTSSEPPSPSPAPRSHQRQPTKPQNPQVN

SEQ ID NO: 1029119 - protein, 8 aa, Mycobacterium
TPPQPKQI

SEQ ID NO: 1029120 - protein, 10 aa, Mycobacterium
TPPSARRKPI

SEQ ID NO: 1029121 - protein, 6 aa, Mycobacterium
TPPSGR

SEQ ID NO: 1029122 - protein, 6 aa, Mycobacterium
TPPSRN

SEQ ID NO: 1029123 - protein, 4 aa, Mycobacterium
TPPT

SEQ ID NO: 1029124 - protein, 6 aa, Mycobacterium
TPPTRD

SEQ ID NO: 1029125 - protein, 7 aa, Mycobacterium
TPPTVTP

SEQ ID NO: 1029126 - protein, 4 aa, Mycobacterium
TPPV

SEQ ID NO: 1029127 - protein, 9 aa, Mycobacterium
TPQAEGGAF

SEQ ID NO: 1029128 - protein, 11 aa, Mycobacterium
TPQARTNGSIT

SEQ ID NO: 1029129 - protein, 5 aa, Mycobacterium
TPQEG

SEQ ID NO: 1029130 - protein, 9 aa, Mycobacterium
TPQEVTADS

SEQ ID NO: 1029131 - protein, 4 aa, Mycobacterium
TPQG

SEQ ID NO: 1029132 - protein, 6 aa, Mycobacterium
TPQGTL

SEQ ID NO: 1029133 - protein, 4 aa, Mycobacterium
TPQI

SEQ ID NO: 1029134 - protein, 7 aa, Mycobacterium
TPQITTE

SEQ ID NO: 1029135 - protein, 10 aa, Mycobacterium
TPQPLAPQPG

SEQ ID NO: 1029136 - protein, 4 aa, Mycobacterium
TPQR

SEQ ID NO: 1029137 - protein, 6 aa, Mycobacterium
TPQRLA

SEQ ID NO: 1029138 - protein, 10 aa, Mycobacterium
TPQRPDGSID

SEQ ID NO: 1029139 - protein, 5 aa, Mycobacterium
TPQSY

SEQ ID NO: 1029140 - protein, 5 aa, Mycobacterium
TPRAR

SEQ ID NO: 1029141 - protein, 9 aa, Mycobacterium
TPRDGGGYG

SEQ ID NO: 1029142 - protein, 7 aa, Mycobacterium
TPREGGG

SEQ ID NO: 1029143 - protein, 8 aa, Mycobacterium
TPREGGGE

SEQ ID NO: 1029144 - protein, 5 aa, Mycobacterium
TPRGG

SEQ ID NO: 1029145 - protein, 12 aa, Mycobacterium
TPRGKQKYGSLN

SEQ ID NO: 1029146 - protein, 6 aa, Mycobacterium
TPRGRG

SEQ ID NO: 1029147 - protein, 5 aa, Mycobacterium
TPRIY

SEQ ID NO: 1029148 - protein, 11 aa, Mycobacterium
TPRKGGNTAPT

SEQ ID NO: 1029149 - protein, 4 aa, Mycobacterium
TPRR

SEQ ID NO: 1029150 - protein, 9 aa, Mycobacterium
TPRRAASPR

SEQ ID NO: 1029151 - protein, 9 aa, Mycobacterium
TPRRGTADS

SEQ ID NO: 1029152 - protein, 10 aa, Mycobacterium
TPRSAPAHGA

SEQ ID NO: 1029153 - protein, 6 aa, Mycobacterium
TPRSAT

SEQ ID NO: 1029154 - protein, 4 aa, Mycobacterium
TPRV

SEQ ID NO: 1029155 - protein, 11 aa, Mycobacterium
TPRYPTTSARI

SEQ ID NO: 1029156 - protein, 4 aa, Mycobacterium
TPSA

SEQ ID NO: 1029157 - protein, 20 aa, Mycobacterium
TPSARPAAEADSYDPQQPQF

SEQ ID NO: 1029158 - protein, 8 aa, Mycobacterium
TPSASGTV

SEQ ID NO: 1029159 - protein, 12 aa, Mycobacterium
TPSDESDASSWK

SEQ ID NO: 1029160 - protein, 6 aa, Mycobacterium
TPSFPE

SEQ ID NO: 1029161 - protein, 5 aa, Mycobacterium
TPSGA

SEQ ID NO: 1029162 - protein, 8 aa, Mycobacterium
TPSGAAYS

SEQ ID NO: 1029163 - protein, 14 aa, Mycobacterium
TPSGVGEQSAITGV

SEQ ID NO: 1029164 - protein, 6 aa, Mycobacterium
TPSGVS

SEQ ID NO: 1029165 - protein, 7 aa, Mycobacterium
TPSITGE

SEQ ID NO: 1029166 - protein, 4 aa, Mycobacterium
TPSP

SEQ ID NO: 1029167 - protein, 20 aa, Mycobacterium
TPSPASDTDTVTVTSATAGK

SEQ ID NO: 1029168 - protein, 17 aa, Mycobacterium
TPSPDPDNRRANSADTY

SEQ ID NO: 1029169 - protein, 7 aa, Mycobacterium
TPSPIRD

SEQ ID NO: 1029170 - protein, 9 aa, Mycobacterium
TPSRERVES

SEQ ID NO: 1029171 - protein, 7 aa, Mycobacterium
TPSRSRA

SEQ ID NO: 1029172 - protein, 10 aa, Mycobacterium
TPSSGPAALP

SEQ ID NO: 1029173 - protein, 6 aa, Mycobacterium
TPSSKV

SEQ ID NO: 1029174 - protein, 6 aa, Mycobacterium
TPSSVD

SEQ ID NO: 1029175 - protein, 17 aa, Mycobacterium
TPSSVGERNNTPTDPEW

SEQ ID NO: 1029176 - protein, 10 aa, Mycobacterium
TPSTPALTDD

SEQ ID NO: 1029177 - protein, 11 aa, Mycobacterium
TPTDSGLAPGL

SEQ ID NO: 1029178 - protein, 7 aa, Mycobacterium
TPTDTRE

SEQ ID NO: 1029179 - protein, 57 aa, Mycobacterium
TPTERKSAKASSKRATWPRCGSPSMGSIRAKPASNWNTSTASATMPRRTGPPATTTS

SEQ ID NO: 1029180 - protein, 6 aa, Mycobacterium
TPTGAR

SEQ ID NO: 1029181 - protein, 10 aa, Mycobacterium
TPTGGSSTTY

SEQ ID NO: 1029182 - protein, 10 aa, Mycobacterium
TPTGRPTGEW

SEQ ID NO: 1029183 - protein, 10 aa, Mycobacterium
TPTGTETADT

SEQ ID NO: 1029184 - protein, 6 aa, Mycobacterium
TPTGTV

SEQ ID NO: 1029185 - protein, 10 aa, Mycobacterium
TPTIAGSTAT

SEQ ID NO: 1029186 - protein, 6 aa, Mycobacterium
TPTKQL

SEQ ID NO: 1029187 - protein, 5 aa, Mycobacterium
TPTQT

SEQ ID NO: 1029188 - protein, 5 aa, Mycobacterium
TPTRY

SEQ ID NO: 1029189 - protein, 9 aa, Mycobacterium
TPTSDAADL

SEQ ID NO: 1029190 - protein, 6 aa, Mycobacterium
TPTSGQ

SEQ ID NO: 1029191 - protein, 4 aa, Mycobacterium
TPTV

SEQ ID NO: 1029192 - protein, 5 aa, Mycobacterium
TPTYD

SEQ ID NO: 1029193 - protein, 17 aa, Mycobacterium
TPVDAKGRFDSSVPDYQ

SEQ ID NO: 1029194 - protein, 12 aa, Mycobacterium
TPVDQMRYRCSL

SEQ ID NO: 1029195 - protein, 9 aa, Mycobacterium
TPVENPPPY

SEQ ID NO: 1029196 - protein, 4 aa, Mycobacterium
TPVP

SEQ ID NO: 1029197 - protein, 7 aa, Mycobacterium
TPVPASV

SEQ ID NO: 1029198 - protein, 4 aa, Mycobacterium
TPVR

SEQ ID NO: 1029199 - protein, 6 aa, Mycobacterium
TPYEPG

SEQ ID NO: 1029200 - protein, 15 aa, Mycobacterium
TPYEPYSVGDPNAGV

SEQ ID NO: 1029201 - protein, 9 aa, Mycobacterium
TPYGMTPNP

SEQ ID NO: 1029202 - protein, 6 aa, Mycobacterium
TPYPPA

SEQ ID NO: 1029203 - protein, 9 aa, Mycobacterium
TPYSDEAQR

SEQ ID NO: 1029204 - protein, 7 aa, Mycobacterium
TQAAIDT

SEQ ID NO: 1029205 - protein, 8 aa, Mycobacterium
TQAASSAS

SEQ ID NO: 1029206 - protein, 9 aa, Mycobacterium
TQADPATVT

SEQ ID NO: 1029207 - protein, 7 aa, Mycobacterium
TQAEGEG

SEQ ID NO: 1029208 - protein, 4 aa, Mycobacterium
TQAP

SEQ ID NO: 1029209 - protein, 13 aa, Mycobacterium
TQAPDEIAGPAAT

SEQ ID NO: 1029210 - protein, 11 aa, Mycobacterium
TQAPGNGAPLG

SEQ ID NO: 1029211 - protein, 17 aa, Mycobacterium
TQASGPEKTSGPWSWVL

SEQ ID NO: 1029212 - protein, 15 aa, Mycobacterium
TQASVPPQGGRKHPH

SEQ ID NO: 1029213 - protein, 7 aa, Mycobacterium
TQAVRET

SEQ ID NO: 1029214 - protein, 4 aa, Mycobacterium
TQCR

SEQ ID NO: 1029215 - protein, 5 aa, Mycobacterium
TQDAR

SEQ ID NO: 1029216 - protein, 10 aa, Mycobacterium
TQDDTRGNAL

SEQ ID NO: 1029217 - protein, 9 aa, Mycobacterium
TQDGKTQTA

SEQ ID NO: 1029218 - protein, 9 aa, Mycobacterium
TQDPPTDQI

SEQ ID NO: 1029219 - protein, 6 aa, Mycobacterium
TQDRLA

SEQ ID NO: 1029220 - protein, 16 aa, Mycobacterium
TQDSSGFAGTSGRTLS

SEQ ID NO: 1029221 - protein, 10 aa, Mycobacterium
TQDTGPVGGE

SEQ ID NO: 1029222 - protein, 38 aa, Mycobacterium
TQEFRTSDDVARAARAQSALGGQHPPDCEPDPAAPAIP

SEQ ID NO: 1029223 - protein, 5 aa, Mycobacterium
TQENT

SEQ ID NO: 1029224 - protein, 14 aa, Mycobacterium
TQETQPARGIPSGL

SEQ ID NO: 1029225 - protein, 4 aa, Mycobacterium
TQGE

SEQ ID NO: 1029226 - protein, 9 aa, Mycobacterium
TQGGTESQC

SEQ ID NO: 1029227 - protein, 9 aa, Mycobacterium
TQGHEASGT

SEQ ID NO: 1029228 - protein, 8 aa, Mycobacterium
TQGHQTDA

SEQ ID NO: 1029229 - protein, 8 aa, Mycobacterium
TQGHTQSL

SEQ ID NO: 1029230 - protein, 5 aa, Mycobacterium
TQGPI

SEQ ID NO: 1029231 - protein, 7 aa, Mycobacterium
TQGRARR

SEQ ID NO: 1029232 - protein, 6 aa, Mycobacterium
TQGRGA

SEQ ID NO: 1029233 - protein, 7 aa, Mycobacterium
TQGTGEW

SEQ ID NO: 1029234 - protein, 15 aa, Mycobacterium
TQGTYRELTSTSNCT

SEQ ID NO: 1029235 - protein, 5 aa, Mycobacterium
TQGVR

SEQ ID NO: 1029236 - protein, 12 aa, Mycobacterium
TQIADGGTIAAL

SEQ ID NO: 1029237 - protein, 6 aa, Mycobacterium
TQIDPN

SEQ ID NO: 1029238 - protein, 4 aa, Mycobacterium
TQIP

SEQ ID NO: 1029239 - protein, 11 aa, Mycobacterium
TQKLTEETEEA

SEQ ID NO: 1029240 - protein, 18 aa, Mycobacterium
TQKVQAAEDAWNTRDPQR

SEQ ID NO: 1029241 - protein, 15 aa, Mycobacterium
TQNGRGEMAANEHAE

SEQ ID NO: 1029242 - protein, 5 aa, Mycobacterium
TQPAA

SEQ ID NO: 1029243 - protein, 34 aa, Mycobacterium
TQPAQTTDPSGLASQSAAVTQAVGSTVGNLTQTE

SEQ ID NO: 1029244 - protein, 6 aa, Mycobacterium
TQPDQR

SEQ ID NO: 1029245 - protein, 6 aa, Mycobacterium
TQPDQV

SEQ ID NO: 1029246 - protein, 4 aa, Mycobacterium
TQPG

SEQ ID NO: 1029247 - protein, 5 aa, Mycobacterium
TQPLE

SEQ ID NO: 1029248 - protein, 14 aa, Mycobacterium
TQPNDQTGQRLSSG

SEQ ID NO: 1029249 - protein, 8 aa, Mycobacterium
TQPPEQTA

SEQ ID NO: 1029250 - protein, 8 aa, Mycobacterium
TQPPEYDQ

SEQ ID NO: 1029251 - protein, 9 aa, Mycobacterium
TQPPQPVDT

SEQ ID NO: 1029252 - protein, 4 aa, Mycobacterium
TQPR

SEQ ID NO: 1029253 - protein, 6 aa, Mycobacterium
TQPSLI

SEQ ID NO: 1029254 - protein, 4 aa, Mycobacterium
TQPT

SEQ ID NO: 1029255 - protein, 7 aa, Mycobacterium
TQPTRSR

SEQ ID NO: 1029256 - protein, 4 aa, Mycobacterium
TQPW

SEQ ID NO: 1029257 - protein, 11 aa, Mycobacterium
TQQALGGNTQV

SEQ ID NO: 1029258 - protein, 4 aa, Mycobacterium
TQQG

SEQ ID NO: 1029259 - protein, 4 aa, Mycobacterium
TQQN

SEQ ID NO: 1029260 - protein, 5 aa, Mycobacterium
TQRDR

SEQ ID NO: 1029261 - protein, 5 aa, Mycobacterium
TQRGS

SEQ ID NO: 1029262 - protein, 8 aa, Mycobacterium
TQRIEDGT

SEQ ID NO: 1029263 - protein, 5 aa, Mycobacterium
TQRIQ

SEQ ID NO: 1029264 - protein, 10 aa, Mycobacterium
TQRRGFGGYG

SEQ ID NO: 1029265 - protein, 6 aa, Mycobacterium
TQRRRQ

SEQ ID NO: 1029266 - protein, 4 aa, Mycobacterium
TQSA

SEQ ID NO: 1029267 - protein, 8 aa, Mycobacterium
TQSAAPDQ

SEQ ID NO: 1029268 - protein, 4 aa, Mycobacterium
TQSM

SEQ ID NO: 1029269 - protein, 7 aa, Mycobacterium
TQSQHAA

SEQ ID NO: 1029270 - protein, 7 aa, Mycobacterium
TQSVGDE

SEQ ID NO: 1029271 - protein, 13 aa, Mycobacterium
TQTADGLFALAGE

SEQ ID NO: 1029272 - protein, 11 aa, Mycobacterium
TQTDGIGKRFD

SEQ ID NO: 1029273 - protein, 5 aa, Mycobacterium
TQTED

SEQ ID NO: 1029274 - protein, 9 aa, Mycobacterium
TQTGTGPTV

SEQ ID NO: 1029275 - protein, 10 aa, Mycobacterium
TQTHPDIPEQ

SEQ ID NO: 1029276 - protein, 10 aa, Mycobacterium
TQTNGPADYP

SEQ ID NO: 1029277 - protein, 6 aa, Mycobacterium
TQTPHE

SEQ ID NO: 1029278 - protein, 9 aa, Mycobacterium
TQTQQPCAA

SEQ ID NO: 1029279 - protein, 6 aa, Mycobacterium
TQTRDA

SEQ ID NO: 1029280 - protein, 9 aa, Mycobacterium
TQTSVSANG

SEQ ID NO: 1029281 - protein, 14 aa, Mycobacterium
TQVSATAPDGPDVR

SEQ ID NO: 1029282 - protein, 4 aa, Mycobacterium
TQVT

SEQ ID NO: 1029283 - protein, 8 aa, Mycobacterium
TQYSGNPT

SEQ ID NO: 1029284 - protein, 13 aa, Mycobacterium
TRAADSDQDAASG

SEQ ID NO: 1029285 - protein, 5 aa, Mycobacterium
TRADE

SEQ ID NO: 1029286 - protein, 9 aa, Mycobacterium
TRADGDRRA

SEQ ID NO: 1029287 - protein, 8 aa, Mycobacterium
TRAEAGTA

SEQ ID NO: 1029288 - protein, 9 aa, Mycobacterium
TRAEHGTKE

SEQ ID NO: 1029289 - protein, 9 aa, Mycobacterium
TRAEPTDAA

SEQ ID NO: 1029290 - protein, 9 aa, Mycobacterium
TRAEQAAMQ

SEQ ID NO: 1029291 - protein, 4 aa, Mycobacterium
TRAG

SEQ ID NO: 1029292 - protein, 23 aa, Mycobacterium
TRAGANSNVGAGDTEDAGGARSD

SEQ ID NO: 1029293 - protein, 9 aa, Mycobacterium
TRAGIDPKK

SEQ ID NO: 1029294 - protein, 12 aa, Mycobacterium
TRAGTADSDDAT

SEQ ID NO: 1029295 - protein, 5 aa, Mycobacterium
TRAGV

SEQ ID NO: 1029296 - protein, 8 aa, Mycobacterium
TRAGVSRS

SEQ ID NO: 1029297 - protein, 6 aa, Mycobacterium
TRAQSS

SEQ ID NO: 1029298 - protein, 8 aa, Mycobacterium
TRARPGDR

SEQ ID NO: 1029299 - protein, 7 aa, Mycobacterium
TRARQRQ

SEQ ID NO: 1029300 - protein, 8 aa, Mycobacterium
TRASQAAE

SEQ ID NO: 1029301 - protein, 10 aa, Mycobacterium
TRATADELTG

SEQ ID NO: 1029302 - protein, 12 aa, Mycobacterium
TRATRPEVRGGL

SEQ ID NO: 1029303 - protein, 12 aa, Mycobacterium
TRAVADGTPLHA

SEQ ID NO: 1029304 - protein, 4 aa, Mycobacterium
TRDA

SEQ ID NO: 1029305 - protein, 5 aa, Mycobacterium
TRDAA

SEQ ID NO: 1029306 - protein, 12 aa, Mycobacterium
TRDADGPAAGVD

SEQ ID NO: 1029307 - protein, 6 aa, Mycobacterium
TRDASA

SEQ ID NO: 1029308 - protein, 5 aa, Mycobacterium
TRDDA

SEQ ID NO: 1029309 - protein, 6 aa, Mycobacterium
TRDDTT

SEQ ID NO: 1029310 - protein, 6 aa, Mycobacterium
TRDELD

SEQ ID NO: 1029311 - protein, 11 aa, Mycobacterium
TRDEPHADADR

SEQ ID NO: 1029312 - protein, 7 aa, Mycobacterium
TRDGGSF

SEQ ID NO: 1029313 - protein, 8 aa, Mycobacterium
TRDGQPEK

SEQ ID NO: 1029314 - protein, 6 aa, Mycobacterium
TRDGTP

SEQ ID NO: 1029315 - protein, 12 aa, Mycobacterium
TRDIGAAARKTV

SEQ ID NO: 1029316 - protein, 9 aa, Mycobacterium
TRDLSNEAT

SEQ ID NO: 1029317 - protein, 7 aa, Mycobacterium
TRDLTDD

SEQ ID NO: 1029318 - protein, 10 aa, Mycobacterium
TRDNKGTQPL

SEQ ID NO: 1029319 - protein, 6 aa, Mycobacterium
TRDNPG

SEQ ID NO: 1029320 - protein, 5 aa, Mycobacterium
TRDQQ

SEQ ID NO: 1029321 - protein, 12 aa, Mycobacterium
TRDRRNEAQEAH

SEQ ID NO: 1029322 - protein, 11 aa, Mycobacterium
TRDSGPGPART

SEQ ID NO: 1029323 - protein, 28 aa, Mycobacterium
TRDTPDPKGAKYGRDANGELDGTAEETG

SEQ ID NO: 1029324 - protein, 5 aa, Mycobacterium
TRDWD

SEQ ID NO: 1029325 - protein, 4 aa, Mycobacterium
TRED

SEQ ID NO: 1029326 - protein, 5 aa, Mycobacterium
TREEL

SEQ ID NO: 1029327 - protein, 13 aa, Mycobacterium
TREGASEGGYQLT

SEQ ID NO: 1029328 - protein, 6 aa, Mycobacterium
TRELPE

SEQ ID NO: 1029329 - protein, 4 aa, Mycobacterium
TRES

SEQ ID NO: 1029330 - protein, 14 aa, Mycobacterium
TRESLQATAQLTQT

SEQ ID NO: 1029331 - protein, 26 aa, Mycobacterium
TRESRPDTRNVPAGQAQVCGNTRALP

SEQ ID NO: 1029332 - protein, 8 aa, Mycobacterium
TRETSHEA

SEQ ID NO: 1029333 - protein, 5 aa, Mycobacterium
TRFEY

SEQ ID NO: 1029334 - protein, 6 aa, Mycobacterium
TRFQPT

SEQ ID NO: 1029335 - protein, 9 aa, Mycobacterium
TRGAGSDVK

SEQ ID NO: 1029336 - protein, 5 aa, Mycobacterium
TRGAI

SEQ ID NO: 1029337 - protein, 9 aa, Mycobacterium
TRGDPNNVD

SEQ ID NO: 1029338 - protein, 7 aa, Mycobacterium
TRGGGGV

SEQ ID NO: 1029339 - protein, 7 aa, Mycobacterium
TRGGHPA

SEQ ID NO: 1029340 - protein, 15 aa, Mycobacterium
TRGHGDSDRAPDADY

SEQ ID NO: 1029341 - protein, 11 aa, Mycobacterium
TRGKPSSEQLD

SEQ ID NO: 1029342 - protein, 4 aa, Mycobacterium
TRGP

SEQ ID NO: 1029343 - protein, 9 aa, Mycobacterium
TRGRHAGGC

SEQ ID NO: 1029344 - protein, 4 aa, Mycobacterium
TRGS

SEQ ID NO: 1029345 - protein, 20 aa, Mycobacterium
TRGSDGGGGRPGVEAPTPRL

SEQ ID NO: 1029346 - protein, 8 aa, Mycobacterium
TRGSGLAS

SEQ ID NO: 1029347 - protein, 7 aa, Mycobacterium
TRGSGMD

SEQ ID NO: 1029348 - protein, 8 aa, Mycobacterium
TRGYDTES

SEQ ID NO: 1029349 - protein, 4 aa, Mycobacterium
TRHP

SEQ ID NO: 1029350 - protein, 5 aa, Mycobacterium
TRHSP

SEQ ID NO: 1029351 - protein, 6 aa, Mycobacterium
TRIDER

SEQ ID NO: 1029352 - protein, 10 aa, Mycobacterium
TRIGRSPDND

SEQ ID NO: 1029353 - protein, 5 aa, Mycobacterium
TRKGG

SEQ ID NO: 1029354 - protein, 10 aa, Mycobacterium
TRKNAHGDTE

SEQ ID NO: 1029355 - protein, 5 aa, Mycobacterium
TRKPF

SEQ ID NO: 1029356 - protein, 9 aa, Mycobacterium
TRLAGQSVP

SEQ ID NO: 1029357 - protein, 4 aa, Mycobacterium
TRLE

SEQ ID NO: 1029358 - protein, 5 aa, Mycobacterium
TRLGG

SEQ ID NO: 1029359 - protein, 5 aa, Mycobacterium
TRLGL

SEQ ID NO: 1029360 - protein, 5 aa, Mycobacterium
TRLPD

SEQ ID NO: 1029361 - protein, 6 aa, Mycobacterium
TRLSGQ

SEQ ID NO: 1029362 - protein, 10 aa, Mycobacterium
TRLSSGPNYE

SEQ ID NO: 1029363 - protein, 8 aa, Mycobacterium
TRMDPDLD

SEQ ID NO: 1029364 - protein, 8 aa, Mycobacterium
TRMPAGPA

SEQ ID NO: 1029365 - protein, 12 aa, Mycobacterium
TRNATDERSTDV

SEQ ID NO: 1029366 - protein, 17 aa, Mycobacterium
TRNDEPERASRPFDKDR

SEQ ID NO: 1029367 - protein, 9 aa, Mycobacterium
TRNPADAED

SEQ ID NO: 1029368 - protein, 22 aa, Mycobacterium
TRNPWNPARTPGRSSGGSAAAV

SEQ ID NO: 1029369 - protein, 7 aa, Mycobacterium
TRNSSTG

SEQ ID NO: 1029370 - protein, 5 aa, Mycobacterium
TRPAG

SEQ ID NO: 1029371 - protein, 6 aa, Mycobacterium
TRPAPL

SEQ ID NO: 1029372 - protein, 9 aa, Mycobacterium
TRPAQAANY

SEQ ID NO: 1029373 - protein, 6 aa, Mycobacterium
TRPAQR

SEQ ID NO: 1029374 - protein, 12 aa, Mycobacterium
TRPARNIGPGTG

SEQ ID NO: 1029375 - protein, 15 aa, Mycobacterium
TRPCSGWSSRGGQVR

SEQ ID NO: 1029376 - protein, 9 aa, Mycobacterium
TRPDAGSAH

SEQ ID NO: 1029377 - protein, 7 aa, Mycobacterium
TRPDGSE

SEQ ID NO: 1029378 - protein, 5 aa, Mycobacterium
TRPEY

SEQ ID NO: 1029379 - protein, 5 aa, Mycobacterium
TRPGA

SEQ ID NO: 1029380 - protein, 5 aa, Mycobacterium
TRPGG

SEQ ID NO: 1029381 - protein, 9 aa, Mycobacterium
TRPGGNKKR

SEQ ID NO: 1029382 - protein, 14 aa, Mycobacterium
TRPNPDDPTGQSTM

SEQ ID NO: 1029383 - protein, 5 aa, Mycobacterium
TRPPA

SEQ ID NO: 1029384 - protein, 8 aa, Mycobacterium
TRPPADQL

SEQ ID NO: 1029385 - protein, 13 aa, Mycobacterium
TRPPIGGELAGQS

SEQ ID NO: 1029386 - protein, 9 aa, Mycobacterium
TRPQAAMAD

SEQ ID NO: 1029387 - protein, 5 aa, Mycobacterium
TRPQT

SEQ ID NO: 1029388 - protein, 6 aa, Mycobacterium
TRPTIG

SEQ ID NO: 1029389 - protein, 8 aa, Mycobacterium
TRPTPDVD

SEQ ID NO: 1029390 - protein, 7 aa, Mycobacterium
TRPTSGT

SEQ ID NO: 1029391 - protein, 4 aa, Mycobacterium
TRPV

SEQ ID NO: 1029392 - protein, 7 aa, Mycobacterium
TRPVEDQ

SEQ ID NO: 1029393 - protein, 4 aa, Mycobacterium
TRQA

SEQ ID NO: 1029394 - protein, 16 aa, Mycobacterium
TRQADPSITVSPRPDD

SEQ ID NO: 1029395 - protein, 4 aa, Mycobacterium
TRQD

SEQ ID NO: 1029396 - protein, 7 aa, Mycobacterium
TRQGEEM

SEQ ID NO: 1029397 - protein, 16 aa, Mycobacterium
TRQGSGNVVRDPQSLT

SEQ ID NO: 1029398 - protein, 5 aa, Mycobacterium
TRQRT

SEQ ID NO: 1029399 - protein, 12 aa, Mycobacterium
TRQSAWERFSVQ

SEQ ID NO: 1029400 - protein, 9 aa, Mycobacterium
TRQSGTPLD

SEQ ID NO: 1029401 - protein, 8 aa, Mycobacterium
TRRAEARA

SEQ ID NO: 1029402 - protein, 7 aa, Mycobacterium
TRREVSP

SEQ ID NO: 1029403 - protein, 5 aa, Mycobacterium
TRRGI

SEQ ID NO: 1029404 - protein, 15 aa, Mycobacterium
TRRHRRQQQAEEIRE

SEQ ID NO: 1029405 - protein, 6 aa, Mycobacterium
TRRPEL

SEQ ID NO: 1029406 - protein, 5 aa, Mycobacterium
TRRQA

SEQ ID NO: 1029407 - protein, 14 aa, Mycobacterium
TRRRELEEHSSTEY

SEQ ID NO: 1029408 - protein, 10 aa, Mycobacterium
TRRRREPGHD

SEQ ID NO: 1029409 - protein, 5 aa, Mycobacterium
TRRSI

SEQ ID NO: 1029410 - protein, 4 aa, Mycobacterium
TRRY

SEQ ID NO: 1029411 - protein, 5 aa, Mycobacterium
TRSAD

SEQ ID NO: 1029412 - protein, 5 aa, Mycobacterium
TRSGD

SEQ ID NO: 1029413 - protein, 8 aa, Mycobacterium
TRSGDLDP

SEQ ID NO: 1029414 - protein, 7 aa, Mycobacterium
TRSGNDY

SEQ ID NO: 1029415 - protein, 7 aa, Mycobacterium
TRSGTSR

SEQ ID NO: 1029416 - protein, 6 aa, Mycobacterium
TRSGWG

SEQ ID NO: 1029417 - protein, 16 aa, Mycobacterium
TRSPTDTASPSTPSSC

SEQ ID NO: 1029418 - protein, 7 aa, Mycobacterium
TRSRPND

SEQ ID NO: 1029419 - protein, 6 aa, Mycobacterium
TRSRVG

SEQ ID NO: 1029420 - protein, 7 aa, Mycobacterium
TRSSETL

SEQ ID NO: 1029421 - protein, 7 aa, Mycobacterium
TRSSTKH

SEQ ID NO: 1029422 - protein, 7 aa, Mycobacterium
TRSTAPP

SEQ ID NO: 1029423 - protein, 19 aa, Mycobacterium
TRSVQAYDGREVAPAAATE

SEQ ID NO: 1029424 - protein, 6 aa, Mycobacterium
TRTDRI

SEQ ID NO: 1029425 - protein, 10 aa, Mycobacterium
TRTEGRRRSW

SEQ ID NO: 1029426 - protein, 9 aa, Mycobacterium
TRTGDGYGG

SEQ ID NO: 1029427 - protein, 13 aa, Mycobacterium
TRTPNVNTAAGGR

SEQ ID NO: 1029428 - protein, 24 aa, Mycobacterium
TRTSGSSAGCSGLGSTAATICVSV

SEQ ID NO: 1029429 - protein, 9 aa, Mycobacterium
TRTVSDRSG

SEQ ID NO: 1029430 - protein, 10 aa, Mycobacterium
TRTYKSSGYT

SEQ ID NO: 1029431 - protein, 7 aa, Mycobacterium
TRVDPDT

SEQ ID NO: 1029432 - protein, 8 aa, Mycobacterium
TRVEQRTD

SEQ ID NO: 1029433 - protein, 9 aa, Mycobacterium
TRVGSGPFP

SEQ ID NO: 1029434 - protein, 7 aa, Mycobacterium
TRVPAET

SEQ ID NO: 1029435 - protein, 8 aa, Mycobacterium
TRVPPQRR

SEQ ID NO: 1029436 - protein, 12 aa, Mycobacterium
TRVSGQAPPGAA

SEQ ID NO: 1029437 - protein, 5 aa, Mycobacterium
TRWPT

SEQ ID NO: 1029438 - protein, 6 aa, Mycobacterium
TRYAAT

SEQ ID NO: 1029439 - protein, 8 aa, Mycobacterium
TRYEGPTG

SEQ ID NO: 1029440 - protein, 10 aa, Mycobacterium
TRYGGGTTGL

SEQ ID NO: 1029441 - protein, 15 aa, Mycobacterium
TRYGSAARRAQVRGG

SEQ ID NO: 1029442 - protein, 8 aa, Mycobacterium
TRYPPAGV

SEQ ID NO: 1029443 - protein, 5 aa, Mycobacterium
TRYSS

SEQ ID NO: 1029444 - protein, 4 aa, Mycobacterium
TRYT

SEQ ID NO: 1029445 - protein, 8 aa, Mycobacterium
TSAAGKSS

SEQ ID NO: 1029446 - protein, 8 aa, Mycobacterium
TSAAGRGG

SEQ ID NO: 1029447 - protein, 23 aa, Mycobacterium
TSAALADPGQFAGYTGTAENPKS

SEQ ID NO: 1029448 - protein, 8 aa, Mycobacterium
TSAAQRAE

SEQ ID NO: 1029449 - protein, 8 aa, Mycobacterium
TSAARDVR

SEQ ID NO: 1029450 - protein, 4 aa, Mycobacterium
TSAD

SEQ ID NO: 1029451 - protein, 9 aa, Mycobacterium
TSADPAKPI

SEQ ID NO: 1029452 - protein, 6 aa, Mycobacterium
TSADYA

SEQ ID NO: 1029453 - protein, 13 aa, Mycobacterium
TSADYAATAAEHE

SEQ ID NO: 1029454 - protein, 6 aa, Mycobacterium
TSAEGT

SEQ ID NO: 1029455 - protein, 29 aa, Mycobacterium
TSAEPKSSTNSAGQVAAPGDSQPAATGCP

SEQ ID NO: 1029456 - protein, 6 aa, Mycobacterium
TSAFEQ

SEQ ID NO: 1029457 - protein, 4 aa, Mycobacterium
TSAG

SEQ ID NO: 1029458 - protein, 8 aa, Mycobacterium
TSAGAAAR

SEQ ID NO: 1029459 - protein, 10 aa, Mycobacterium
TSAGCATASA

SEQ ID NO: 1029460 - protein, 5 aa, Mycobacterium
TSAGI

SEQ ID NO: 1029461 - protein, 8 aa, Mycobacterium
TSAGIATT

SEQ ID NO: 1029462 - protein, 9 aa, Mycobacterium
TSAGPEPVA

SEQ ID NO: 1029463 - protein, 7 aa, Mycobacterium
TSAGSTA

SEQ ID NO: 1029464 - protein, 7 aa, Mycobacterium
TSAGTGN

SEQ ID NO: 1029465 - protein, 7 aa, Mycobacterium
TSAPAAA

SEQ ID NO: 1029466 - protein, 5 aa, Mycobacterium
TSAQA

SEQ ID NO: 1029467 - protein, 5 aa, Mycobacterium
TSAQI

SEQ ID NO: 1029468 - protein, 6 aa, Mycobacterium
TSASAL

SEQ ID NO: 1029469 - protein, 6 aa, Mycobacterium
TSASVD

SEQ ID NO: 1029470 - protein, 8 aa, Mycobacterium
TSATPARA

SEQ ID NO: 1029471 - protein, 20 aa, Mycobacterium
TSATSAASYLSTETANAVAS

SEQ ID NO: 1029472 - protein, 8 aa, Mycobacterium
TSATTQAA

SEQ ID NO: 1029473 - protein, 6 aa, Mycobacterium
TSAVPT

SEQ ID NO: 1029474 - protein, 6 aa, Mycobacterium
TSAVSG

SEQ ID NO: 1029475 - protein, 7 aa, Mycobacterium
TSAVTSG

SEQ ID NO: 1029476 - protein, 21 aa, Mycobacterium
TSCGAVTSSSWQPLPNRQARR

SEQ ID NO: 1029477 - protein, 6 aa, Mycobacterium
TSDADA

SEQ ID NO: 1029478 - protein, 6 aa, Mycobacterium
TSDAGL

SEQ ID NO: 1029479 - protein, 10 aa, Mycobacterium
TSDARLPQAV

SEQ ID NO: 1029480 - protein, 6 aa, Mycobacterium
TSDASE

SEQ ID NO: 1029481 - protein, 7 aa, Mycobacterium
TSDDDAN

SEQ ID NO: 1029482 - protein, 7 aa, Mycobacterium
TSDDHAG

SEQ ID NO: 1029483 - protein, 4 aa, Mycobacterium
TSDE

SEQ ID NO: 1029484 - protein, 6 aa, Mycobacterium
TSDEQV

SEQ ID NO: 1029485 - protein, 7 aa, Mycobacterium
TSDERED

SEQ ID NO: 1029486 - protein, 5 aa, Mycobacterium
TSDGA

SEQ ID NO: 1029487 - protein, 25 aa, Mycobacterium
TSDGNPWTSDTTGTHSRSSLASLIL

SEQ ID NO: 1029488 - protein, 7 aa, Mycobacterium
TSDGPHY

SEQ ID NO: 1029489 - protein, 7 aa, Mycobacterium
TSDGRLS

SEQ ID NO: 1029490 - protein, 5 aa, Mycobacterium
TSDGS

SEQ ID NO: 1029491 - protein, 8 aa, Mycobacterium
TSDGVNEA

SEQ ID NO: 1029492 - protein, 5 aa, Mycobacterium
TSDLA

SEQ ID NO: 1029493 - protein, 5 aa, Mycobacterium
TSDNM

SEQ ID NO: 1029494 - protein, 7 aa, Mycobacterium
TSDPDEL

SEQ ID NO: 1029495 - protein, 8 aa, Mycobacterium
TSDPNSVA

SEQ ID NO: 1029496 - protein, 6 aa, Mycobacterium
TSDPQE

SEQ ID NO: 1029497 - protein, 5 aa, Mycobacterium
TSDQD

SEQ ID NO: 1029498 - protein, 5 aa, Mycobacterium
TSDQR

SEQ ID NO: 1029499 - protein, 12 aa, Mycobacterium
TSDRAEAETEEL

SEQ ID NO: 1029500 - protein, 14 aa, Mycobacterium
TSDSGRTRHADPGD

SEQ ID NO: 1029501 - protein, 10 aa, Mycobacterium
TSEAADRAQH

SEQ ID NO: 1029502 - protein, 6 aa, Mycobacterium
TSEDGI

SEQ ID NO: 1029503 - protein, 4 aa, Mycobacterium
TSEE

SEQ ID NO: 1029504 - protein, 8 aa, Mycobacterium
TSEEERAQ

SEQ ID NO: 1029505 - protein, 4 aa, Mycobacterium
TSEI

SEQ ID NO: 1029506 - protein, 16 aa, Mycobacterium
TSEIPAAPSGPPPPVS

SEQ ID NO: 1029507 - protein, 6 aa, Mycobacterium
TSEKGW

SEQ ID NO: 1029508 - protein, 6 aa, Mycobacterium
TSEQRD

SEQ ID NO: 1029509 - protein, 9 aa, Mycobacterium
TSERTATDL

SEQ ID NO: 1029510 - protein, 6 aa, Mycobacterium
TSESDR

SEQ ID NO: 1029511 - protein, 4 aa, Mycobacterium
TSEV

SEQ ID NO: 1029512 - protein, 11 aa, Mycobacterium
TSEVYGSSPHD

SEQ ID NO: 1029513 - protein, 10 aa, Mycobacterium
TSFSNDDRSH

SEQ ID NO: 1029514 - protein, 4 aa, Mycobacterium
TSGA

SEQ ID NO: 1029515 - protein, 7 aa, Mycobacterium
TSGAGGL

SEQ ID NO: 1029516 - protein, 6 aa, Mycobacterium
TSGANG

SEQ ID NO: 1029517 - protein, 7 aa, Mycobacterium
TSGDSDD

SEQ ID NO: 1029518 - protein, 7 aa, Mycobacterium
TSGDSKM

SEQ ID NO: 1029519 - protein, 8 aa, Mycobacterium
TSGEAKPA

SEQ ID NO: 1029520 - protein, 6 aa, Mycobacterium
TSGEQR

SEQ ID NO: 1029521 - protein, 7 aa, Mycobacterium
TSGFRPG

SEQ ID NO: 1029522 - protein, 4 aa, Mycobacterium
TSGG

SEQ ID NO: 1029523 - protein, 12 aa, Mycobacterium
TSGGAGGTGGAG

SEQ ID NO: 1029524 - protein, 9 aa, Mycobacterium
TSGGAIPDR

SEQ ID NO: 1029525 - protein, 8 aa, Mycobacterium
TSGHRGSA

SEQ ID NO: 1029526 - protein, 7 aa, Mycobacterium
TSGIGAG

SEQ ID NO: 1029527 - protein, 4 aa, Mycobacterium
TSGL

SEQ ID NO: 1029528 - protein, 6 aa, Mycobacterium
TSGLSA

SEQ ID NO: 1029529 - protein, 14 aa, Mycobacterium
TSGLTGQAWQGAAA

SEQ ID NO: 1029530 - protein, 9 aa, Mycobacterium
TSGPALERA

SEQ ID NO: 1029531 - protein, 17 aa, Mycobacterium
TSGPALQQNLVAVMEGN

SEQ ID NO: 1029532 - protein, 5 aa, Mycobacterium
TSGPG

SEQ ID NO: 1029533 - protein, 9 aa, Mycobacterium
TSGPGFGHT

SEQ ID NO: 1029534 - protein, 9 aa, Mycobacterium
TSGPGTTNL

SEQ ID NO: 1029535 - protein, 5 aa, Mycobacterium
TSGPW

SEQ ID NO: 1029536 - protein, 9 aa, Mycobacterium
TSGPYTDPD

SEQ ID NO: 1029537 - protein, 9 aa, Mycobacterium
TSGPYTDPN

SEQ ID NO: 1029538 - protein, 6 aa, Mycobacterium
TSGRQV

SEQ ID NO: 1029539 - protein, 10 aa, Mycobacterium
TSGSSGPGGL

SEQ ID NO: 1029540 - protein, 10 aa, Mycobacterium
TSGSTGDPKA

SEQ ID NO: 1029541 - protein, 10 aa, Mycobacterium
TSGSTGQPKG

SEQ ID NO: 1029542 - protein, 9 aa, Mycobacterium
TSGSTREPA

SEQ ID NO: 1029543 - protein, 10 aa, Mycobacterium
TSGSTRPPVG

SEQ ID NO: 1029544 - protein, 10 aa, Mycobacterium
TSGSTRSPAG

SEQ ID NO: 1029545 - protein, 30 aa, Mycobacterium
TSGTENPRPAEDEQEASPGTQPADVQTGAA

SEQ ID NO: 1029546 - protein, 5 aa, Mycobacterium
TSGTI

SEQ ID NO: 1029547 - protein, 8 aa, Mycobacterium
TSGTTGAP

SEQ ID NO: 1029548 - protein, 11 aa, Mycobacterium
TSGTTGAPKGA

SEQ ID NO: 1029549 - protein, 9 aa, Mycobacterium
TSGTTGQPK

SEQ ID NO: 1029550 - protein, 7 aa, Mycobacterium
TSGVHER

SEQ ID NO: 1029551 - protein, 8 aa, Mycobacterium
TSGWRGPA

SEQ ID NO: 1029552 - protein, 9 aa, Mycobacterium
TSHGKDHTT

SEQ ID NO: 1029553 - protein, 13 aa, Mycobacterium
TSHPPTEASRRDP

SEQ ID NO: 1029554 - protein, 9 aa, Mycobacterium
TSHRCNQSG

SEQ ID NO: 1029555 - protein, 17 aa, Mycobacterium
TSHRQATRQQREQGTYA

SEQ ID NO: 1029556 - protein, 4 aa, Mycobacterium
TSIE

SEQ ID NO: 1029557 - protein, 16 aa, Mycobacterium
TSIGDNNTVSATNGLG

SEQ ID NO: 1029558 - protein, 6 aa, Mycobacterium
TSITPA

SEQ ID NO: 1029559 - protein, 10 aa, Mycobacterium
TSKESSGRPM

SEQ ID NO: 1029560 - protein, 8 aa, Mycobacterium
TSKKRDDL

SEQ ID NO: 1029561 - protein, 7 aa, Mycobacterium
TSKLDDE

SEQ ID NO: 1029562 - protein, 19 aa, Mycobacterium
TSKLEGGAAAAGFGATSTV

SEQ ID NO: 1029563 - protein, 6 aa, Mycobacterium
TSKLER

SEQ ID NO: 1029564 - protein, 11 aa, Mycobacterium
TSKLPAKPTLA

SEQ ID NO: 1029565 - protein, 9 aa, Mycobacterium
TSKSATAAE

SEQ ID NO: 1029566 - protein, 17 aa, Mycobacterium
TSKSGLVEGGIGGTEAR

SEQ ID NO: 1029567 - protein, 5 aa, Mycobacterium
TSKTF

SEQ ID NO: 1029568 - protein, 4 aa, Mycobacterium
TSKV

SEQ ID NO: 1029569 - protein, 7 aa, Mycobacterium
TSLAGGT

SEQ ID NO: 1029570 - protein, 5 aa, Mycobacterium
TSLEE

SEQ ID NO: 1029571 - protein, 15 aa, Mycobacterium
TSLNNSQAQADPDGK

SEQ ID NO: 1029572 - protein, 10 aa, Mycobacterium
TSLPAGTAKA

SEQ ID NO: 1029573 - protein, 6 aa, Mycobacterium
TSLPRS

SEQ ID NO: 1029574 - protein, 4 aa, Mycobacterium
TSLT

SEQ ID NO: 1029575 - protein, 9 aa, Mycobacterium
TSMDAPAGL

SEQ ID NO: 1029576 - protein, 9 aa, Mycobacterium
TSMENRGSP

SEQ ID NO: 1029577 - protein, 6 aa, Mycobacterium
TSMEQG

SEQ ID NO: 1029578 - protein, 4 aa, Mycobacterium
TSMS

SEQ ID NO: 1029579 - protein, 10 aa, Mycobacterium
TSNEPGPGPL

SEQ ID NO: 1029580 - protein, 5 aa, Mycobacterium
TSNLP

SEQ ID NO: 1029581 - protein, 18 aa, Mycobacterium
TSNPEGATIQRADADGRT

SEQ ID NO: 1029582 - protein, 7 aa, Mycobacterium
TSNPQEL

SEQ ID NO: 1029583 - protein, 6 aa, Mycobacterium
TSNTAG

SEQ ID NO: 1029584 - protein, 10 aa, Mycobacterium
TSPAGAPSGI

SEQ ID NO: 1029585 - protein, 6 aa, Mycobacterium
TSPAIR

SEQ ID NO: 1029586 - protein, 7 aa, Mycobacterium
TSPANPE

SEQ ID NO: 1029587 - protein, 6 aa, Mycobacterium
TSPAQL

SEQ ID NO: 1029588 - protein, 15 aa, Mycobacterium
TSPASQPASQPATRS

SEQ ID NO: 1029589 - protein, 5 aa, Mycobacterium
TSPEA

SEQ ID NO: 1029590 - protein, 7 aa, Mycobacterium
TSPETGA

SEQ ID NO: 1029591 - protein, 8 aa, Mycobacterium
TSPHDKTL

SEQ ID NO: 1029592 - protein, 6 aa, Mycobacterium
TSPIAS

SEQ ID NO: 1029593 - protein, 12 aa, Mycobacterium
TSPIGPPSIESH

SEQ ID NO: 1029594 - protein, 7 aa, Mycobacterium
TSPKPGD

SEQ ID NO: 1029595 - protein, 4 aa, Mycobacterium
TSPL

SEQ ID NO: 1029596 - protein, 7 aa, Mycobacterium
TSPNPEL

SEQ ID NO: 1029597 - protein, 6 aa, Mycobacterium
TSPPPF

SEQ ID NO: 1029598 - protein, 6 aa, Mycobacterium
TSPPRV

SEQ ID NO: 1029599 - protein, 26 aa, Mycobacterium
TSPPYDVPRGPVPRPMGHDAGAWPSV

SEQ ID NO: 1029600 - protein, 7 aa, Mycobacterium
TSPRRWP

SEQ ID NO: 1029601 - protein, 6 aa, Mycobacterium
TSPTDV

SEQ ID NO: 1029602 - protein, 12 aa, Mycobacterium
TSPTPPDTPYPT

SEQ ID NO: 1029603 - protein, 4 aa, Mycobacterium
TSPV

SEQ ID NO: 1029604 - protein, 7 aa, Mycobacterium
TSQCTGD

SEQ ID NO: 1029605 - protein, 9 aa, Mycobacterium
TSQDDVDAG

SEQ ID NO: 1029606 - protein, 6 aa, Mycobacterium
TSQETA

SEQ ID NO: 1029607 - protein, 5 aa, Mycobacterium
TSQGV

SEQ ID NO: 1029608 - protein, 4 aa, Mycobacterium
TSQR

SEQ ID NO: 1029609 - protein, 12 aa, Mycobacterium
TSQTPEDAEDAL

SEQ ID NO: 1029610 - protein, 5 aa, Mycobacterium
TSQWS

SEQ ID NO: 1029611 - protein, 6 aa, Mycobacterium
TSRAES

SEQ ID NO: 1029612 - protein, 15 aa, Mycobacterium
TSRAETKRASGTTPM

SEQ ID NO: 1029613 - protein, 6 aa, Mycobacterium
TSRAGL

SEQ ID NO: 1029614 - protein, 8 aa, Mycobacterium
TSRDLTEN

SEQ ID NO: 1029615 - protein, 4 aa, Mycobacterium
TSRI

SEQ ID NO: 1029616 - protein, 4 aa, Mycobacterium
TSRK

SEQ ID NO: 1029617 - protein, 4 aa, Mycobacterium
TSRL

SEQ ID NO: 1029618 - protein, 10 aa, Mycobacterium
TSRPGEKPTR

SEQ ID NO: 1029619 - protein, 9 aa, Mycobacterium
TSRPGQPPE

SEQ ID NO: 1029620 - protein, 5 aa, Mycobacterium
TSRPV

SEQ ID NO: 1029621 - protein, 17 aa, Mycobacterium
TSRTGTLATIGPNGQPH

SEQ ID NO: 1029622 - protein, 19 aa, Mycobacterium
TSRWPSGIKDGAEFVIPTM

SEQ ID NO: 1029623 - protein, 7 aa, Mycobacterium
TSSAEED

SEQ ID NO: 1029624 - protein, 9 aa, Mycobacterium
TSSDATTTA

SEQ ID NO: 1029625 - protein, 8 aa, Mycobacterium
TSSDDGHD

SEQ ID NO: 1029626 - protein, 8 aa, Mycobacterium
TSSDGLRS

SEQ ID NO: 1029627 - protein, 4 aa, Mycobacterium
TSSE

SEQ ID NO: 1029628 - protein, 7 aa, Mycobacterium
TSSETVN

SEQ ID NO: 1029629 - protein, 8 aa, Mycobacterium
TSSGERVD

SEQ ID NO: 1029630 - protein, 7 aa, Mycobacterium
TSSGVFD

SEQ ID NO: 1029631 - protein, 9 aa, Mycobacterium
TSSIREGSR

SEQ ID NO: 1029632 - protein, 20 aa, Mycobacterium
TSSNPTAGGAAVGSGIGPTR

SEQ ID NO: 1029633 - protein, 6 aa, Mycobacterium
TSSPGS

SEQ ID NO: 1029634 - protein, 13 aa, Mycobacterium
TSSPVAADSRGLG

SEQ ID NO: 1029635 - protein, 16 aa, Mycobacterium
TSSPVGGKSGPGSART

SEQ ID NO: 1029636 - protein, 7 aa, Mycobacterium
TSSRARD

SEQ ID NO: 1029637 - protein, 10 aa, Mycobacterium
TSSRSRNRSL

SEQ ID NO: 1029638 - protein, 9 aa, Mycobacterium
TSSSSATYG

SEQ ID NO: 1029639 - protein, 7 aa, Mycobacterium
TSSTERP

SEQ ID NO: 1029640 - protein, 5 aa, Mycobacterium
TSTAW

SEQ ID NO: 1029641 - protein, 5 aa, Mycobacterium
TSTEI

SEQ ID NO: 1029642 - protein, 6 aa, Mycobacterium
TSTGNK

SEQ ID NO: 1029643 - protein, 11 aa, Mycobacterium
TSTGRQQGTPQ

SEQ ID NO: 1029644 - protein, 7 aa, Mycobacterium
TSTHSRA

SEQ ID NO: 1029645 - protein, 4 aa, Mycobacterium
TSTI

SEQ ID NO: 1029646 - protein, 6 aa, Mycobacterium
TSTKDL

SEQ ID NO: 1029647 - protein, 10 aa, Mycobacterium
TSTKRAARQI

SEQ ID NO: 1029648 - protein, 4 aa, Mycobacterium
TSTL

SEQ ID NO: 1029649 - protein, 12 aa, Mycobacterium
TSTPDQPQPPTA

SEQ ID NO: 1029650 - protein, 5 aa, Mycobacterium
TSTPR

SEQ ID NO: 1029651 - protein, 12 aa, Mycobacterium
TSTRDDGRPGWR

SEQ ID NO: 1029652 - protein, 9 aa, Mycobacterium
TSTRQSRKG

SEQ ID NO: 1029653 - protein, 10 aa, Mycobacterium
TSTSYQSSDV

SEQ ID NO: 1029654 - protein, 6 aa, Mycobacterium
TSTTWP

SEQ ID NO: 1029655 - protein, 4 aa, Mycobacterium
TSVD

SEQ ID NO: 1029656 - protein, 6 aa, Mycobacterium
TSVEDP

SEQ ID NO: 1029657 - protein, 7 aa, Mycobacterium
TSVGPDL

SEQ ID NO: 1029658 - protein, 15 aa, Mycobacterium
TSVPHAASPAAPGKA

SEQ ID NO: 1029659 - protein, 7 aa, Mycobacterium
TSYEREH

SEQ ID NO: 1029660 - protein, 17 aa, Mycobacterium
TSYGDGNTVTATNSLGL

SEQ ID NO: 1029661 - protein, 4 aa, Mycobacterium
TTAA

SEQ ID NO: 1029662 - protein, 8 aa, Mycobacterium
TTAAATPV

SEQ ID NO: 1029663 - protein, 5 aa, Mycobacterium
TTAAE

SEQ ID NO: 1029664 - protein, 9 aa, Mycobacterium
TTAANADAE

SEQ ID NO: 1029665 - protein, 6 aa, Mycobacterium
TTAAQA

SEQ ID NO: 1029666 - protein, 9 aa, Mycobacterium
TTADAAAAT

SEQ ID NO: 1029667 - protein, 6 aa, Mycobacterium
TTADAD

SEQ ID NO: 1029668 - protein, 8 aa, Mycobacterium
TTADPQVT

SEQ ID NO: 1029669 - protein, 13 aa, Mycobacterium
TTAEPSRYLGPGK

SEQ ID NO: 1029670 - protein, 12 aa, Mycobacterium
TTAEQTERSIAD

SEQ ID NO: 1029671 - protein, 6 aa, Mycobacterium
TTAERS

SEQ ID NO: 1029672 - protein, 5 aa, Mycobacterium
TTAGL

SEQ ID NO: 1029673 - protein, 7 aa, Mycobacterium
TTAGPGT

SEQ ID NO: 1029674 - protein, 7 aa, Mycobacterium
TTAGQDV

SEQ ID NO: 1029675 - protein, 7 aa, Mycobacterium
TTAGQGV

SEQ ID NO: 1029676 - protein, 10 aa, Mycobacterium
TTAGSDAKRE

SEQ ID NO: 1029677 - protein, 4 aa, Mycobacterium
TTAI

SEQ ID NO: 1029678 - protein, 17 aa, Mycobacterium
TTAKPSTTTSTPPSGAD

SEQ ID NO: 1029679 - protein, 10 aa, Mycobacterium
TTAKRAVEGV

SEQ ID NO: 1029680 - protein, 10 aa, Mycobacterium
TTAKTGADRS

SEQ ID NO: 1029681 - protein, 4 aa, Mycobacterium
TTAN

SEQ ID NO: 1029682 - protein, 5 aa, Mycobacterium
TTAPA

SEQ ID NO: 1029683 - protein, 7 aa, Mycobacterium
TTARAKS

SEQ ID NO: 1029684 - protein, 9 aa, Mycobacterium
TTASKNPKE

SEQ ID NO: 1029685 - protein, 11 aa, Mycobacterium
TTASRYATGSH

SEQ ID NO: 1029686 - protein, 6 aa, Mycobacterium
TTATAA

SEQ ID NO: 1029687 - protein, 7 aa, Mycobacterium
TTATAER

SEQ ID NO: 1029688 - protein, 6 aa, Mycobacterium
TTATGR

SEQ ID NO: 1029689 - protein, 16 aa, Mycobacterium
TTATNGPTVTSGTSMN

SEQ ID NO: 1029690 - protein, 15 aa, Mycobacterium
TTAVEPPKTPEQGYT

SEQ ID NO: 1029691 - protein, 10 aa, Mycobacterium
TTCQQRSVET

SEQ ID NO: 1029692 - protein, 18 aa, Mycobacterium
TTCSTPEGAAREIEEWAG

SEQ ID NO: 1029693 - protein, 10 aa, Mycobacterium
TTDEGQQRVS

SEQ ID NO: 1029694 - protein, 17 aa, Mycobacterium
TTDGRSGVGWMEWNRNQ

SEQ ID NO: 1029695 - protein, 13 aa, Mycobacterium
TTDGTRFQNNGTG

SEQ ID NO: 1029696 - protein, 5 aa, Mycobacterium
TTDNP

SEQ ID NO: 1029697 - protein, 10 aa, Mycobacterium
TTDPHTVTDE

SEQ ID NO: 1029698 - protein, 10 aa, Mycobacterium
TTDPQDLATT

SEQ ID NO: 1029699 - protein, 7 aa, Mycobacterium
TTDPYEP

SEQ ID NO: 1029700 - protein, 7 aa, Mycobacterium
TTDRKKT

SEQ ID NO: 1029701 - protein, 9 aa, Mycobacterium
TTDRPEGAQ

SEQ ID NO: 1029702 - protein, 8 aa, Mycobacterium
TTDSGTVI

SEQ ID NO: 1029703 - protein, 8 aa, Mycobacterium
TTDSMESG

SEQ ID NO: 1029704 - protein, 6 aa, Mycobacterium
TTDTGS

SEQ ID NO: 1029705 - protein, 4 aa, Mycobacterium
TTEA

SEQ ID NO: 1029706 - protein, 6 aa, Mycobacterium
TTEAFG

SEQ ID NO: 1029707 - protein, 10 aa, Mycobacterium
TTEANPESTW

SEQ ID NO: 1029708 - protein, 4 aa, Mycobacterium
TTED

SEQ ID NO: 1029709 - protein, 6 aa, Mycobacterium
TTEDGT

SEQ ID NO: 1029710 - protein, 7 aa, Mycobacterium
TTEDPDP

SEQ ID NO: 1029711 - protein, 15 aa, Mycobacterium
TTEDPTNGFRPDTGR

SEQ ID NO: 1029712 - protein, 6 aa, Mycobacterium
TTEEQN

SEQ ID NO: 1029713 - protein, 5 aa, Mycobacterium
TTEGV

SEQ ID NO: 1029714 - protein, 9 aa, Mycobacterium
TTEKPQAMP

SEQ ID NO: 1029715 - protein, 4 aa, Mycobacterium
TTEL

SEQ ID NO: 1029716 - protein, 7 aa, Mycobacterium
TTENSHD

SEQ ID NO: 1029717 - protein, 8 aa, Mycobacterium
TTEPGVDG

SEQ ID NO: 1029718 - protein, 6 aa, Mycobacterium
TTEPPR

SEQ ID NO: 1029719 - protein, 4 aa, Mycobacterium
TTEQ

SEQ ID NO: 1029720 - protein, 5 aa, Mycobacterium
TTEQV

SEQ ID NO: 1029721 - protein, 8 aa, Mycobacterium
TTERPRGR

SEQ ID NO: 1029722 - protein, 14 aa, Mycobacterium
TTETSSGAGMADPS

SEQ ID NO: 1029723 - protein, 6 aa, Mycobacterium
TTETTV

SEQ ID NO: 1029724 - protein, 5 aa, Mycobacterium
TTFGP

SEQ ID NO: 1029725 - protein, 24 aa, Mycobacterium
TTGADRYADEASAGPADVIPGTPR

SEQ ID NO: 1029726 - protein, 11 aa, Mycobacterium
TTGANEKIHRG

SEQ ID NO: 1029727 - protein, 7 aa, Mycobacterium
TTGATVR

SEQ ID NO: 1029728 - protein, 19 aa, Mycobacterium
TTGDPGPITPEPAPQPAED

SEQ ID NO: 1029729 - protein, 5 aa, Mycobacterium
TTGES

SEQ ID NO: 1029730 - protein, 6 aa, Mycobacterium
TTGFPK

SEQ ID NO: 1029731 - protein, 15 aa, Mycobacterium
TTGGSQKAVNADRGG

SEQ ID NO: 1029732 - protein, 4 aa, Mycobacterium
TTGK

SEQ ID NO: 1029733 - protein, 12 aa, Mycobacterium
TTGLSRDTELSN

SEQ ID NO: 1029734 - protein, 4 aa, Mycobacterium
TTGN

SEQ ID NO: 1029735 - protein, 7 aa, Mycobacterium
TTGPAVG

SEQ ID NO: 1029736 - protein, 21 aa, Mycobacterium
TTGPIAGSSKAYREVAGPDGV

SEQ ID NO: 1029737 - protein, 8 aa, Mycobacterium
TTGPLGQG

SEQ ID NO: 1029738 - protein, 23 aa, Mycobacterium
TTGQIEARTDPWDPETEPSADDF

SEQ ID NO: 1029739 - protein, 4 aa, Mycobacterium
TTGR

SEQ ID NO: 1029740 - protein, 11 aa, Mycobacterium
TTGRKTGEPRV

SEQ ID NO: 1029741 - protein, 8 aa, Mycobacterium
TTGSGKSE

SEQ ID NO: 1029742 - protein, 9 aa, Mycobacterium
TTGSSKPVT

SEQ ID NO: 1029743 - protein, 7 aa, Mycobacterium
TTGTHGN

SEQ ID NO: 1029744 - protein, 8 aa, Mycobacterium
TTGYGSAV

SEQ ID NO: 1029745 - protein, 11 aa, Mycobacterium
TTHDPATPYQA

SEQ ID NO: 1029746 - protein, 9 aa, Mycobacterium
TTHGTPLTP

SEQ ID NO: 1029747 - protein, 5 aa, Mycobacterium
TTHIT

SEQ ID NO: 1029748 - protein, 6 aa, Mycobacterium
TTHPGT

SEQ ID NO: 1029749 - protein, 5 aa, Mycobacterium
TTHPI

SEQ ID NO: 1029750 - protein, 7 aa, Mycobacterium
TTHRETP

SEQ ID NO: 1029751 - protein, 8 aa, Mycobacterium
TTIYGGTS

SEQ ID NO: 1029752 - protein, 8 aa, Mycobacterium
TTKDARKH

SEQ ID NO: 1029753 - protein, 12 aa, Mycobacterium
TTKIEDKDGNLV

SEQ ID NO: 1029754 - protein, 14 aa, Mycobacterium
TTKITGNSAADDIA

SEQ ID NO: 1029755 - protein, 13 aa, Mycobacterium
TTLAASAAAATYA

SEQ ID NO: 1029756 - protein, 8 aa, Mycobacterium
TTLDPEQG

SEQ ID NO: 1029757 - protein, 4 aa, Mycobacterium
TTLT

SEQ ID NO: 1029758 - protein, 17 aa, Mycobacterium
TTMSAQNAAAAAPTTGV

SEQ ID NO: 1029759 - protein, 9 aa, Mycobacterium
TTNPQLAGS

SEQ ID NO: 1029760 - protein, 13 aa, Mycobacterium
TTNRSRAESPELA

SEQ ID NO: 1029761 - protein, 10 aa, Mycobacterium
TTNSEEQALN

SEQ ID NO: 1029762 - protein, 15 aa, Mycobacterium
TTNTGEPETTKGEAE

SEQ ID NO: 1029763 - protein, 15 aa, Mycobacterium
TTPAAAAGTGPVPAA

SEQ ID NO: 1029764 - protein, 7 aa, Mycobacterium
TTPAEDD

SEQ ID NO: 1029765 - protein, 8 aa, Mycobacterium
TTPAGAGA

SEQ ID NO: 1029766 - protein, 9 aa, Mycobacterium
TTPAKPELV

SEQ ID NO: 1029767 - protein, 9 aa, Mycobacterium
TTPAPTTTE

SEQ ID NO: 1029768 - protein, 6 aa, Mycobacterium
TTPART

SEQ ID NO: 1029769 - protein, 12 aa, Mycobacterium
TTPDAIDNSHER

SEQ ID NO: 1029770 - protein, 9 aa, Mycobacterium
TTPDGRATD

SEQ ID NO: 1029771 - protein, 4 aa, Mycobacterium
TTPE

SEQ ID NO: 1029772 - protein, 10 aa, Mycobacterium
TTPEQALSRA

SEQ ID NO: 1029773 - protein, 9 aa, Mycobacterium
TTPGAEPAA

SEQ ID NO: 1029774 - protein, 6 aa, Mycobacterium
TTPGFH

SEQ ID NO: 1029775 - protein, 8 aa, Mycobacterium
TTPGKPAL

SEQ ID NO: 1029776 - protein, 6 aa, Mycobacterium
TTPGPV

SEQ ID NO: 1029777 - protein, 13 aa, Mycobacterium
TTPIERPEDAEDY

SEQ ID NO: 1029778 - protein, 9 aa, Mycobacterium
TTPKAPVGV

SEQ ID NO: 1029779 - protein, 4 aa, Mycobacterium
TTPL

SEQ ID NO: 1029780 - protein, 5 aa, Mycobacterium
TTPLP

SEQ ID NO: 1029781 - protein, 5 aa, Mycobacterium
TTPMH

SEQ ID NO: 1029782 - protein, 5 aa, Mycobacterium
TTPPL

SEQ ID NO: 1029783 - protein, 9 aa, Mycobacterium
TTPSAEARQ

SEQ ID NO: 1029784 - protein, 5 aa, Mycobacterium
TTPTA

SEQ ID NO: 1029785 - protein, 9 aa, Mycobacterium
TTPVPEITG

SEQ ID NO: 1029786 - protein, 9 aa, Mycobacterium
TTPVPHDPK

SEQ ID NO: 1029787 - protein, 4 aa, Mycobacterium
TTQA

SEQ ID NO: 1029788 - protein, 6 aa, Mycobacterium
TTQEGI

SEQ ID NO: 1029789 - protein, 4 aa, Mycobacterium
TTQG

SEQ ID NO: 1029790 - protein, 15 aa, Mycobacterium
TTQPVGETGGNGGRA

SEQ ID NO: 1029791 - protein, 4 aa, Mycobacterium
TTRA

SEQ ID NO: 1029792 - protein, 18 aa, Mycobacterium
TTRAAPPSEVLMYGRAFG

SEQ ID NO: 1029793 - protein, 12 aa, Mycobacterium
TTRAFDQPRAEA

SEQ ID NO: 1029794 - protein, 5 aa, Mycobacterium
TTRAG

SEQ ID NO: 1029795 - protein, 8 aa, Mycobacterium
TTRALRTD

SEQ ID NO: 1029796 - protein, 10 aa, Mycobacterium
TTRDESVEVR

SEQ ID NO: 1029797 - protein, 7 aa, Mycobacterium
TTRGGTI

SEQ ID NO: 1029798 - protein, 6 aa, Mycobacterium
TTRPGT

SEQ ID NO: 1029799 - protein, 5 aa, Mycobacterium
TTRPP

SEQ ID NO: 1029800 - protein, 10 aa, Mycobacterium
TTRQQGYGQA

SEQ ID NO: 1029801 - protein, 4 aa, Mycobacterium
TTRR

SEQ ID NO: 1029802 - protein, 4 aa, Mycobacterium
TTRS

SEQ ID NO: 1029803 - protein, 11 aa, Mycobacterium
TTRSGALTGPL

SEQ ID NO: 1029804 - protein, 8 aa, Mycobacterium
TTRTTRAR

SEQ ID NO: 1029805 - protein, 11 aa, Mycobacterium
TTSAVGAATAR

SEQ ID NO: 1029806 - protein, 6 aa, Mycobacterium
TTSDAP

SEQ ID NO: 1029807 - protein, 7 aa, Mycobacterium
TTSDKAL

SEQ ID NO: 1029808 - protein, 7 aa, Mycobacterium
TTSDPYV

SEQ ID NO: 1029809 - protein, 5 aa, Mycobacterium
TTSGL

SEQ ID NO: 1029810 - protein, 6 aa, Mycobacterium
TTSGRD

SEQ ID NO: 1029811 - protein, 15 aa, Mycobacterium
TTSGVDDEITTTAGP

SEQ ID NO: 1029812 - protein, 7 aa, Mycobacterium
TTSNGEV

SEQ ID NO: 1029813 - protein, 11 aa, Mycobacterium
TTSPEKVTARE

SEQ ID NO: 1029814 - protein, 24 aa, Mycobacterium
TTSPGPTGRFRSSSASPSPRRTPD

SEQ ID NO: 1029815 - protein, 14 aa, Mycobacterium
TTSPPRTAATAVSG

SEQ ID NO: 1029816 - protein, 9 aa, Mycobacterium
TTSQPPQPR

SEQ ID NO: 1029817 - protein, 10 aa, Mycobacterium
TTSRKKPPFG

SEQ ID NO: 1029818 - protein, 9 aa, Mycobacterium
TTSSHESKA

SEQ ID NO: 1029819 - protein, 13 aa, Mycobacterium
TTSSPGAPARRPT

SEQ ID NO: 1029820 - protein, 9 aa, Mycobacterium
TTSVQTPPE

SEQ ID NO: 1029821 - protein, 14 aa, Mycobacterium
TTTAKSTGRCSWRC

SEQ ID NO: 1029822 - protein, 14 aa, Mycobacterium
TTTAKSTGRCTWRC

SEQ ID NO: 1029823 - protein, 8 aa, Mycobacterium
TTTATRVG

SEQ ID NO: 1029824 - protein, 6 aa, Mycobacterium
TTTDRG

SEQ ID NO: 1029825 - protein, 9 aa, Mycobacterium
TTTDRRVTE

SEQ ID NO: 1029826 - protein, 7 aa, Mycobacterium
TTTEHPS

SEQ ID NO: 1029827 - protein, 6 aa, Mycobacterium
TTTERL

SEQ ID NO: 1029828 - protein, 7 aa, Mycobacterium
TTTERRE

SEQ ID NO: 1029829 - protein, 13 aa, Mycobacterium
TTTGPYRPADRLR

SEQ ID NO: 1029830 - protein, 5 aa, Mycobacterium
TTTMS

SEQ ID NO: 1029831 - protein, 4 aa, Mycobacterium
TTTQ

SEQ ID NO: 1029832 - protein, 17 aa, Mycobacterium
TTTQAEAHRQAMASTPG

SEQ ID NO: 1029833 - protein, 7 aa, Mycobacterium
TTTQTPM

SEQ ID NO: 1029834 - protein, 10 aa, Mycobacterium
TTTRAGGTSI

SEQ ID NO: 1029835 - protein, 6 aa, Mycobacterium
TTTTAD

SEQ ID NO: 1029836 - protein, 11 aa, Mycobacterium
TTVGDEDPDFA

SEQ ID NO: 1029837 - protein, 10 aa, Mycobacterium
TTVPGPDAEF

SEQ ID NO: 1029838 - protein, 7 aa, Mycobacterium
TTVQGSG

SEQ ID NO: 1029839 - protein, 15 aa, Mycobacterium
TTYKNSRVDSLPRAG

SEQ ID NO: 1029840 - protein, 8 aa, Mycobacterium
TTYPNPPV

SEQ ID NO: 1029841 - protein, 6 aa, Mycobacterium
TTYQRG

SEQ ID NO: 1029842 - protein, 4 aa, Mycobacterium
TTYR

SEQ ID NO: 1029843 - protein, 5 aa, Mycobacterium
TVAEE

SEQ ID NO: 1029844 - protein, 10 aa, Mycobacterium
TVAEHSDSEI

SEQ ID NO: 1029845 - protein, 4 aa, Mycobacterium
TVAG

SEQ ID NO: 1029846 - protein, 7 aa, Mycobacterium
TVAGPGS

SEQ ID NO: 1029847 - protein, 6 aa, Mycobacterium
TVASGH

SEQ ID NO: 1029848 - protein, 25 aa, Mycobacterium
TVCTNRRSVSSEAGPPTLRDHGVAE

SEQ ID NO: 1029849 - protein, 13 aa, Mycobacterium
TVDGAGEAPGVLP

SEQ ID NO: 1029850 - protein, 7 aa, Mycobacterium
TVDGESV

SEQ ID NO: 1029851 - protein, 48 aa, Mycobacterium
TVDGGAGGAGGQGGVGGTSTGGISTNTGGAGGVGGTGGTGGLGQPTTS

SEQ ID NO: 1029852 - protein, 5 aa, Mycobacterium
TVDGQ

SEQ ID NO: 1029853 - protein, 8 aa, Mycobacterium
TVDPGDAR

SEQ ID NO: 1029854 - protein, 9 aa, Mycobacterium
TVDPGGSFD

SEQ ID NO: 1029855 - protein, 10 aa, Mycobacterium
TVDPQPGEDD

SEQ ID NO: 1029856 - protein, 20 aa, Mycobacterium
TVDPTSSTTALAGSTEEGQF

SEQ ID NO: 1029857 - protein, 15 aa, Mycobacterium
TVEAAGAGVDESRIG

SEQ ID NO: 1029858 - protein, 4 aa, Mycobacterium
TVEE

SEQ ID NO: 1029859 - protein, 5 aa, Mycobacterium
TVEGY

SEQ ID NO: 1029860 - protein, 15 aa, Mycobacterium
TVEPATDGGGADTVT

SEQ ID NO: 1029861 - protein, 4 aa, Mycobacterium
TVES

SEQ ID NO: 1029862 - protein, 8 aa, Mycobacterium
TVESGASV

SEQ ID NO: 1029863 - protein, 21 aa, Mycobacterium
TVGAKQGSDTVKGGVTQLPES

SEQ ID NO: 1029864 - protein, 6 aa, Mycobacterium
TVGDGD

SEQ ID NO: 1029865 - protein, 5 aa, Mycobacterium
TVGDI

SEQ ID NO: 1029866 - protein, 5 aa, Mycobacterium
TVGDM

SEQ ID NO: 1029867 - protein, 9 aa, Mycobacterium
TVGDQTAAD

SEQ ID NO: 1029868 - protein, 19 aa, Mycobacterium
TVGGDNNTALAGDQSGGLA

SEQ ID NO: 1029869 - protein, 14 aa, Mycobacterium
TVGGKTRVGPTLSS

SEQ ID NO: 1029870 - protein, 7 aa, Mycobacterium
TVGPTST

SEQ ID NO: 1029871 - protein, 5 aa, Mycobacterium
TVGRQ

SEQ ID NO: 1029872 - protein, 5 aa, Mycobacterium
TVHGN

SEQ ID NO: 1029873 - protein, 4 aa, Mycobacterium
TVHP

SEQ ID NO: 1029874 - protein, 8 aa, Mycobacterium
TVNGGDDH

SEQ ID NO: 1029875 - protein, 15 aa, Mycobacterium
TVNPDTPYGRPSAPI

SEQ ID NO: 1029876 - protein, 4 aa, Mycobacterium
TVPC

SEQ ID NO: 1029877 - protein, 5 aa, Mycobacterium
TVPEH

SEQ ID NO: 1029878 - protein, 6 aa, Mycobacterium
TVPGAS

SEQ ID NO: 1029879 - protein, 9 aa, Mycobacterium
TVPGDTAAQ

SEQ ID NO: 1029880 - protein, 6 aa, Mycobacterium
TVPPNT

SEQ ID NO: 1029881 - protein, 5 aa, Mycobacterium
TVPPP

SEQ ID NO: 1029882 - protein, 10 aa, Mycobacterium
TVPPPEQARA

SEQ ID NO: 1029883 - protein, 8 aa, Mycobacterium
TVPPPQIA

SEQ ID NO: 1029884 - protein, 6 aa, Mycobacterium
TVPPSQ

SEQ ID NO: 1029885 - protein, 5 aa, Mycobacterium
TVPPT

SEQ ID NO: 1029886 - protein, 6 aa, Mycobacterium
TVPRGL

SEQ ID NO: 1029887 - protein, 7 aa, Mycobacterium
TVPVPDP

SEQ ID NO: 1029888 - protein, 7 aa, Mycobacterium
TVQPGPM

SEQ ID NO: 1029889 - protein, 5 aa, Mycobacterium
TVRDG

SEQ ID NO: 1029890 - protein, 6 aa, Mycobacterium
TVRDQA

SEQ ID NO: 1029891 - protein, 7 aa, Mycobacterium
TVREGRE

SEQ ID NO: 1029892 - protein, 14 aa, Mycobacterium
TVRPDSAGFGDQPE

SEQ ID NO: 1029893 - protein, 6 aa, Mycobacterium
TVRPHG

SEQ ID NO: 1029894 - protein, 7 aa, Mycobacterium
TVRPPEE

SEQ ID NO: 1029895 - protein, 8 aa, Mycobacterium
TVRTASRQ

SEQ ID NO: 1029896 - protein, 8 aa, Mycobacterium
TVRTPQGT

SEQ ID NO: 1029897 - protein, 12 aa, Mycobacterium
TVSGSESRSVSN

SEQ ID NO: 1029898 - protein, 10 aa, Mycobacterium
TVSKSTAELQ

SEQ ID NO: 1029899 - protein, 23 aa, Mycobacterium
TVSLNENGQVTTAWANSRNGWRN

SEQ ID NO: 1029900 - protein, 7 aa, Mycobacterium
TVSNAEE

SEQ ID NO: 1029901 - protein, 5 aa, Mycobacterium
TVSNR

SEQ ID NO: 1029902 - protein, 31 aa, Mycobacterium
TVSPAPPSPPEPPTPASPPSPPLPPAWPPRP

SEQ ID NO: 1029903 - protein, 6 aa, Mycobacterium
TVSPSF

SEQ ID NO: 1029904 - protein, 14 aa, Mycobacterium
TVSQPSLQKGRRAG

SEQ ID NO: 1029905 - protein, 10 aa, Mycobacterium
TVSYSSEGRL

SEQ ID NO: 1029906 - protein, 11 aa, Mycobacterium
TVTADAAPVGV

SEQ ID NO: 1029907 - protein, 9 aa, Mycobacterium
TVTAEPRDT

SEQ ID NO: 1029908 - protein, 8 aa, Mycobacterium
TVTAKTAT

SEQ ID NO: 1029909 - protein, 13 aa, Mycobacterium
TVTDKSRAVGSSG

SEQ ID NO: 1029910 - protein, 4 aa, Mycobacterium
TVTE

SEQ ID NO: 1029911 - protein, 8 aa, Mycobacterium
TVTERDGQ

SEQ ID NO: 1029912 - protein, 6 aa, Mycobacterium
TVTGDP

SEQ ID NO: 1029913 - protein, 9 aa, Mycobacterium
TVTGEETTL

SEQ ID NO: 1029914 - protein, 7 aa, Mycobacterium
TVTGPQA

SEQ ID NO: 1029915 - protein, 11 aa, Mycobacterium
TVTGSGNDLQV

SEQ ID NO: 1029916 - protein, 4 aa, Mycobacterium
TVTP

SEQ ID NO: 1029917 - protein, 8 aa, Mycobacterium
TVTPDRVP

SEQ ID NO: 1029918 - protein, 6 aa, Mycobacterium
TVTPPP

SEQ ID NO: 1029919 - protein, 69 aa, Mycobacterium
TVTSEADRARRVKASQAASQDAPSEPQAAEEPAAEEAVAATEAEAAPADAEATDAEAGSADTDADEAPQ

SEQ ID NO: 1029920 - protein, 7 aa, Mycobacterium
TWEPTTY

SEQ ID NO: 1029921 - protein, 14 aa, Mycobacterium
TWGEDDLPLRPWWT

SEQ ID NO: 1029922 - protein, 19 aa, Mycobacterium
TWGLPGGARDSHETPEQTA

SEQ ID NO: 1029923 - protein, 15 aa, Mycobacterium
TWGPVNDGTATASIA

SEQ ID NO: 1029924 - protein, 18 aa, Mycobacterium
TWGSSTAATSSWPRRRPR

SEQ ID NO: 1029925 - protein, 5 aa, Mycobacterium
TWQGT

SEQ ID NO: 1029926 - protein, 15 aa, Mycobacterium
TWRERRGEVEEASDH

SEQ ID NO: 1029927 - protein, 4 aa, Mycobacterium
TWTP

SEQ ID NO: 1029928 - protein, 10 aa, Mycobacterium
TWTTPKADLG

SEQ ID NO: 1029929 - protein, 10 aa, Mycobacterium
TYANRTQHEM

SEQ ID NO: 1029930 - protein, 13 aa, Mycobacterium
TYAPATAADLSET

SEQ ID NO: 1029931 - protein, 7 aa, Mycobacterium
TYAPGRA

SEQ ID NO: 1029932 - protein, 5 aa, Mycobacterium
TYASS

SEQ ID NO: 1029933 - protein, 9 aa, Mycobacterium
TYATADPPV

SEQ ID NO: 1029934 - protein, 8 aa, Mycobacterium
TYDAERDR

SEQ ID NO: 1029935 - protein, 18 aa, Mycobacterium
TYDTEKFRDDSRNGAEKG

SEQ ID NO: 1029936 - protein, 9 aa, Mycobacterium
TYEGREKEI

SEQ ID NO: 1029937 - protein, 12 aa, Mycobacterium
TYEGSSDKHPDI

SEQ ID NO: 1029938 - protein, 6 aa, Mycobacterium
TYEPSR

SEQ ID NO: 1029939 - protein, 11 aa, Mycobacterium
TYERSAQTHPD

SEQ ID NO: 1029940 - protein, 7 aa, Mycobacterium
TYGAGTY

SEQ ID NO: 1029941 - protein, 7 aa, Mycobacterium
TYGDGGN

SEQ ID NO: 1029942 - protein, 7 aa, Mycobacterium
TYGRKSK

SEQ ID NO: 1029943 - protein, 6 aa, Mycobacterium
TYGRPG

SEQ ID NO: 1029944 - protein, 12 aa, Mycobacterium
TYGSGDWGRTPH

SEQ ID NO: 1029945 - protein, 6 aa, Mycobacterium
TYGTNN

SEQ ID NO: 1029946 - protein, 6 aa, Mycobacterium
TYGTTK

SEQ ID NO: 1029947 - protein, 6 aa, Mycobacterium
TYGTYD

SEQ ID NO: 1029948 - protein, 13 aa, Mycobacterium
TYGVNSGADLPPE

SEQ ID NO: 1029949 - protein, 13 aa, Mycobacterium
TYGVPVNSPQGYK

SEQ ID NO: 1029950 - protein, 7 aa, Mycobacterium
TYKPYGP

SEQ ID NO: 1029951 - protein, 15 aa, Mycobacterium
TYNEPNTNLTSPETT

SEQ ID NO: 1029952 - protein, 9 aa, Mycobacterium
TYNRPDPKL

SEQ ID NO: 1029953 - protein, 11 aa, Mycobacterium
TYPGPGGTIGP

SEQ ID NO: 1029954 - protein, 20 aa, Mycobacterium
TYQDQSGSSRTVQVTLGKAE

SEQ ID NO: 1029955 - protein, 4 aa, Mycobacterium
TYQQ

SEQ ID NO: 1029956 - protein, 8 aa, Mycobacterium
TYQRNAQR

SEQ ID NO: 1029957 - protein, 8 aa, Mycobacterium
TYRDGGDV

SEQ ID NO: 1029958 - protein, 4 aa, Mycobacterium
TYRG

SEQ ID NO: 1029959 - protein, 10 aa, Mycobacterium
TYRGPFTPGS

SEQ ID NO: 1029960 - protein, 6 aa, Mycobacterium
TYRPTV

SEQ ID NO: 1029961 - protein, 12 aa, Mycobacterium
TYRRGRERNTPV

SEQ ID NO: 1029962 - protein, 7 aa, Mycobacterium
TYSASGG

SEQ ID NO: 1029963 - protein, 7 aa, Mycobacterium
TYSPDGK

SEQ ID NO: 1029964 - protein, 6 aa, Mycobacterium
TYSPTG

SEQ ID NO: 1029965 - protein, 13 aa, Mycobacterium
TYSQSSRLQAAGL

SEQ ID NO: 1029966 - protein, 5 aa, Mycobacterium
TYTRD

SEQ ID NO: 1029967 - protein, 10 aa, Mycobacterium
VAAADTHAEY

SEQ ID NO: 1029968 - protein, 9 aa, Mycobacterium
VAAAGSTTT

SEQ ID NO: 1029969 - protein, 10 aa, Mycobacterium
VAAASTPIKA

SEQ ID NO: 1029970 - protein, 5 aa, Mycobacterium
VAAAT

SEQ ID NO: 1029971 - protein, 9 aa, Mycobacterium
VAADPTGPG

SEQ ID NO: 1029972 - protein, 10 aa, Mycobacterium
VAAGDDERGT

SEQ ID NO: 1029973 - protein, 17 aa, Mycobacterium
VAAGPDSTLQSQPANAI

SEQ ID NO: 1029974 - protein, 14 aa, Mycobacterium
VAAGPTGPADARGT

SEQ ID NO: 1029975 - protein, 7 aa, Mycobacterium
VAAHGRS

SEQ ID NO: 1029976 - protein, 15 aa, Mycobacterium
VAAKRRTKFDHRIGT

SEQ ID NO: 1029977 - protein, 8 aa, Mycobacterium
VAANPGPF

SEQ ID NO: 1029978 - protein, 13 aa, Mycobacterium
VAANTATATSGAV

SEQ ID NO: 1029979 - protein, 5 aa, Mycobacterium
VAATP

SEQ ID NO: 1029980 - protein, 5 aa, Mycobacterium
VAATS

SEQ ID NO: 1029981 - protein, 6 aa, Mycobacterium
VADAGQ

SEQ ID NO: 1029982 - protein, 9 aa, Mycobacterium
VADATAAAA

SEQ ID NO: 1029983 - protein, 8 aa, Mycobacterium
VADDANGL

SEQ ID NO: 1029984 - protein, 8 aa, Mycobacterium
VADDASRQ

SEQ ID NO: 1029985 - protein, 6 aa, Mycobacterium
VADEQD

SEQ ID NO: 1029986 - protein, 6 aa, Mycobacterium
VADGDA

SEQ ID NO: 1029987 - protein, 6 aa, Mycobacterium
VADGGT

SEQ ID NO: 1029988 - protein, 10 aa, Mycobacterium
VADGGYGLDP

SEQ ID NO: 1029989 - protein, 9 aa, Mycobacterium
VADGRSRAT

SEQ ID NO: 1029990 - protein, 6 aa, Mycobacterium
VADGSR

SEQ ID NO: 1029991 - protein, 33 aa, Mycobacterium
VADNDDHSARDVADTADVAAGADAADGNALPLS

SEQ ID NO: 1029992 - protein, 6 aa, Mycobacterium
VADPVK

SEQ ID NO: 1029993 - protein, 7 aa, Mycobacterium
VADQPTA

SEQ ID NO: 1029994 - protein, 15 aa, Mycobacterium
VADREAPAARARAIR

SEQ ID NO: 1029995 - protein, 8 aa, Mycobacterium
VADSTTKA

SEQ ID NO: 1029996 - protein, 7 aa, Mycobacterium
VADYAKR

SEQ ID NO: 1029997 - protein, 8 aa, Mycobacterium
VADYPTDR

SEQ ID NO: 1029998 - protein, 8 aa, Mycobacterium
VAEAGSPT

SEQ ID NO: 1029999 - protein, 12 aa, Mycobacterium
VAEAKSALAGTD

SEQ ID NO: 1030000 - protein, 11 aa, Mycobacterium
VAEAQKPAARQ

SEQ ID NO: 1030001 - protein, 7 aa, Mycobacterium
VAEASGV

SEQ ID NO: 1030002 - protein, 10 aa, Mycobacterium
VAEDSEKEAH

SEQ ID NO: 1030003 - protein, 8 aa, Mycobacterium
VAEEHDGD

SEQ ID NO: 1030004 - protein, 17 aa, Mycobacterium
VAEGPGREPAGHAERGP

SEQ ID NO: 1030005 - protein, 20 aa, Mycobacterium
VAEGTAELTPPAAAPDDETV

SEQ ID NO: 1030006 - protein, 9 aa, Mycobacterium
VAEGTPSEL

SEQ ID NO: 1030007 - protein, 17 aa, Mycobacterium
VAEKKPAAKDHPITEGP

SEQ ID NO: 1030008 - protein, 18 aa, Mycobacterium
VAEKTPPADGAAEGDDLE

SEQ ID NO: 1030009 - protein, 6 aa, Mycobacterium
VAEPED

SEQ ID NO: 1030010 - protein, 20 aa, Mycobacterium
VAEPEPAGQPDVEEVPDELT

SEQ ID NO: 1030011 - protein, 10 aa, Mycobacterium
VAEPGQTLAS

SEQ ID NO: 1030012 - protein, 6 aa, Mycobacterium
VAERAG

SEQ ID NO: 1030013 - protein, 18 aa, Mycobacterium
VAERDSLDASSNLAGAGS

SEQ ID NO: 1030014 - protein, 9 aa, Mycobacterium
VAEREPGVA

SEQ ID NO: 1030015 - protein, 5 aa, Mycobacterium
VAERG

SEQ ID NO: 1030016 - protein, 7 aa, Mycobacterium
VAERTDE

SEQ ID NO: 1030017 - protein, 4 aa, Mycobacterium
VAES

SEQ ID NO: 1030018 - protein, 8 aa, Mycobacterium
VAETSDTF

SEQ ID NO: 1030019 - protein, 5 aa, Mycobacterium
VAGAD

SEQ ID NO: 1030020 - protein, 9 aa, Mycobacterium
VAGAGADLT

SEQ ID NO: 1030021 - protein, 69 aa, Mycobacterium; identical to SEQ ID NO: 604801

SEQ ID NO: 1030022 - protein, 7 aa, Mycobacterium
VAGARRV

SEQ ID NO: 1030023 - protein, 7 aa, Mycobacterium
VAGASPA

SEQ ID NO: 1030024 - protein, 9 aa, Mycobacterium
VAGATGTST

SEQ ID NO: 1030025 - protein, 6 aa, Mycobacterium
VAGDGA

SEQ ID NO: 1030026 - protein, 14 aa, Mycobacterium
VAGDGSPRLQHGTE

SEQ ID NO: 1030027 - protein, 5 aa, Mycobacterium
VAGDM

SEQ ID NO: 1030028 - protein, 8 aa, Mycobacterium
VAGDTDAG

SEQ ID NO: 1030029 - protein, 5 aa, Mycobacterium
VAGEE

SEQ ID NO: 1030030 - protein, 5 aa, Mycobacterium
VAGKT

SEQ ID NO: 1030031 - protein, 5 aa, Mycobacterium
VAGLE

SEQ ID NO: 1030032 - protein, 7 aa, Mycobacterium
VAGNPAR

SEQ ID NO: 1030033 - protein, 12 aa, Mycobacterium
VAGPDEYSNGVT

SEQ ID NO: 1030034 - protein, 6 aa, Mycobacterium
VAGPGE

SEQ ID NO: 1030035 - protein, 8 aa, Mycobacterium
VAGPGTEI

SEQ ID NO: 1030036 - protein, 7 aa, Mycobacterium
VAGPPAM

SEQ ID NO: 1030037 - protein, 7 aa, Mycobacterium
VAGPTTA

SEQ ID NO: 1030038 - protein, 9 aa, Mycobacterium
VAGPTTGLA

SEQ ID NO: 1030039 - protein, 28 aa, Mycobacterium
VAGRRRQADLSGASRVRRTSPGSAGYGL

SEQ ID NO: 1030040 - protein, 9 aa, Mycobacterium
VAGRSEPDK

SEQ ID NO: 1030041 - protein, 8 aa, Mycobacterium
VAGSPEHA

SEQ ID NO: 1030042 - protein, 6 aa, Mycobacterium
VAGSSR

SEQ ID NO: 1030043 - protein, 29 aa, Mycobacterium
VAGTAGSGLAAGTADPAVPASTADTGKTV

SEQ ID NO: 1030044 - protein, 7 aa, Mycobacterium
VAGTGPE

SEQ ID NO: 1030045 - protein, 6 aa, Mycobacterium
VAGTQT

SEQ ID NO: 1030046 - protein, 4 aa, Mycobacterium
VAHG

SEQ ID NO: 1030047 - protein, 12 aa, Mycobacterium
VAHTGTSEYGRT

SEQ ID NO: 1030048 - protein, 6 aa, Mycobacterium
VAKGAQ

SEQ ID NO: 1030049 - protein, 5 aa, Mycobacterium
VAKPA

SEQ ID NO: 1030050 - protein, 4 aa, Mycobacterium
VALT

SEQ ID NO: 1030051 - protein, 8 aa, Mycobacterium
VANEDDPR

SEQ ID NO: 1030052 - protein, 7 aa, Mycobacterium
VANGAAL

SEQ ID NO: 1030053 - protein, 6 aa, Mycobacterium
VANGDP

SEQ ID NO: 1030054 - protein, 12 aa, Mycobacterium
VANGGSAPLPRF

SEQ ID NO: 1030055 - protein, 27 aa, Mycobacterium
VANRRQVAAGSGLPSDRATESPTEPPT

SEQ ID NO: 1030056 - protein, 5 aa, Mycobacterium
VAPAD

SEQ ID NO: 1030057 - protein, 7 aa, Mycobacterium
VAPAPEL

SEQ ID NO: 1030058 - protein, 24 aa, Mycobacterium
VAPASGTGSGAGSGVPGQHRVVHA

SEQ ID NO: 1030059 - protein, 6 aa, Mycobacterium
VAPATS

SEQ ID NO: 1030060 - protein, 5 aa, Mycobacterium
VAPDE

SEQ ID NO: 1030061 - protein, 5 aa, Mycobacterium
VAPDG

SEQ ID NO: 1030062 - protein, 6 aa, Mycobacterium
VAPDGV

SEQ ID NO: 1030063 - protein, 17 aa, Mycobacterium
VAPDNAARIGPDADGNR

SEQ ID NO: 1030064 - protein, 9 aa, Mycobacterium
VAPEQPETD

SEQ ID NO: 1030065 - protein, 5 aa, Mycobacterium
VAPGA

SEQ ID NO: 1030066 - protein, 5 aa, Mycobacterium
VAPGP

SEQ ID NO: 1030067 - protein, 7 aa, Mycobacterium
VAPGQTY

SEQ ID NO: 1030068 - protein, 25 aa, Mycobacterium
VAPGSGRVAPRVGRPDGYAGSAFPT

SEQ ID NO: 1030069 - protein, 7 aa, Mycobacterium
VAPGTGI

SEQ ID NO: 1030070 - protein, 8 aa, Mycobacterium
VAPGTQTA

SEQ ID NO: 1030071 - protein, 10 aa, Mycobacterium
VAPGTSAPLA

SEQ ID NO: 1030072 - protein, 6 aa, Mycobacterium
VAPGTV

SEQ ID NO: 1030073 - protein, 13 aa, Mycobacterium
VAPNRRPYRTSDG

SEQ ID NO: 1030074 - protein, 21 aa, Mycobacterium
VAPPAAKDTPPSIVTKANSAC

SEQ ID NO: 1030075 - protein, 8 aa, Mycobacterium
VAPPKNTL

SEQ ID NO: 1030076 - protein, 12 aa, Mycobacterium
VAPPPTAAAGMP

SEQ ID NO: 1030077 - protein, 9 aa, Mycobacterium
VAPQDAPAA

SEQ ID NO: 1030078 - protein, 13 aa, Mycobacterium
VAPQDNSSNDQMA

SEQ ID NO: 1030079 - protein, 7 aa, Mycobacterium
VAPQGPV

SEQ ID NO: 1030080 - protein, 20 aa, Mycobacterium
VAPQQPPTVNAGSASDRPLD

SEQ ID NO: 1030081 - protein, 9 aa, Mycobacterium
VAPSSTELG

SEQ ID NO: 1030082 - protein, 13 aa, Mycobacterium
VAPTPSPGDTTFG

SEQ ID NO: 1030083 - protein, 12 aa, Mycobacterium
VAPTRGPDAISG

SEQ ID NO: 1030084 - protein, 11 aa, Mycobacterium
VAPTSGDAPYA

SEQ ID NO: 1030085 - protein, 11 aa, Mycobacterium
VAPTTGVVPPA

SEQ ID NO: 1030086 - protein, 7 aa, Mycobacterium
VAPTTTG

SEQ ID NO: 1030087 - protein, 11 aa, Mycobacterium
VAQEPRGAGGF

SEQ ID NO: 1030088 - protein, 7 aa, Mycobacterium
VAQESGI

SEQ ID NO: 1030089 - protein, 4 aa, Mycobacterium
VAQP

SEQ ID NO: 1030090 - protein, 6 aa, Mycobacterium
VAQRDD

SEQ ID NO: 1030091 - protein, 12 aa, Mycobacterium
VAQSGEGPGGGI

SEQ ID NO: 1030092 - protein, 13 aa, Mycobacterium
VARAASDSTITPQ

SEQ ID NO: 1030093 - protein, 13 aa, Mycobacterium
VARATAPAAAGAA

SEQ ID NO: 1030094 - protein, 9 aa, Mycobacterium
VAREGAAAQ

SEQ ID NO: 1030095 - protein, 12 aa, Mycobacterium
VAREGSRGAPNV

SEQ ID NO: 1030096 - protein, 7 aa, Mycobacterium
VARETEL

SEQ ID NO: 1030097 - protein, 8 aa, Mycobacterium
VARGDASA

SEQ ID NO: 1030098 - protein, 11 aa, Mycobacterium
VARGGGRTSYR

SEQ ID NO: 1030099 - protein, 7 aa, Mycobacterium
VARGKDA

SEQ ID NO: 1030100 - protein, 19 aa, Mycobacterium
VARGTPPAVRSMRPFRGIE

SEQ ID NO: 1030101 - protein, 9 aa, Mycobacterium
VARNGASDL

SEQ ID NO: 1030102 - protein, 11 aa, Mycobacterium
VARNPRTGETV

SEQ ID NO: 1030103 - protein, 27 aa, Mycobacterium
VARPDTQDALNADSSKSLPRPATGDEL

SEQ ID NO: 1030104 - protein, 7 aa, Mycobacterium
VARPEDV

SEQ ID NO: 1030105 - protein, 27 aa, Mycobacterium
VARQDSESDDPRTAARGRARLRAVGAI

SEQ ID NO: 1030106 - protein, 4 aa, Mycobacterium
VARR

SEQ ID NO: 1030107 - protein, 6 aa, Mycobacterium
VARRQA

SEQ ID NO: 1030108 - protein, 11 aa, Mycobacterium
VARSAGPHNKQ

SEQ ID NO: 1030109 - protein, 10 aa, Mycobacterium
VARSQGVTIE

SEQ ID NO: 1030110 - protein, 7 aa, Mycobacterium
VARSRAD

SEQ ID NO: 1030111 - protein, 7 aa, Mycobacterium
VARTGMH

SEQ ID NO: 1030112 - protein, 7 aa, Mycobacterium
VASDNGR

SEQ ID NO: 1030113 - protein, 6 aa, Mycobacterium
VASGAG

SEQ ID NO: 1030114 - protein, 9 aa, Mycobacterium
VASGNGKGQ

SEQ ID NO: 1030115 - protein, 13 aa, Mycobacterium
VASGSTDTTGTTI

SEQ ID NO: 1030116 - protein, 7 aa, Mycobacterium
VASPAAE

SEQ ID NO: 1030117 - protein, 6 aa, Mycobacterium
VASPSI

SEQ ID NO: 1030118 - protein, 8 aa, Mycobacterium
VASPTGYL

SEQ ID NO: 1030119 - protein, 7 aa, Mycobacterium
VASRPDE

SEQ ID NO: 1030120 - protein, 7 aa, Mycobacterium
VASSAAL

SEQ ID NO: 1030121 - protein, 13 aa, Mycobacterium
VASSLGKGLTASS

SEQ ID NO: 1030122 - protein, 14 aa, Mycobacterium
VASSLGKGLTASSL

SEQ ID NO: 1030123 - protein, 11 aa, Mycobacterium
VASSVDEQARF

SEQ ID NO: 1030124 - protein, 12 aa, Mycobacterium
VASTEAACSPPI

SEQ ID NO: 1030125 - protein, 21 aa, Mycobacterium
VASTGVEGSGCDENPAESTGL

SEQ ID NO: 1030126 - protein, 13 aa, Mycobacterium
VASTPTTLRVRPQ

SEQ ID NO: 1030127 - protein, 6 aa, Mycobacterium
VASTTA

SEQ ID NO: 1030128 - protein, 5 aa, Mycobacterium
VASYP

SEQ ID NO: 1030129 - protein, 15 aa, Mycobacterium
VATASVPAGAPAIQG

SEQ ID NO: 1030130 - protein, 6 aa, Mycobacterium
VATATE

SEQ ID NO: 1030131 - protein, 15 aa, Mycobacterium
VATDGTYSSPIDNPN

SEQ ID NO: 1030132 - protein, 14 aa, Mycobacterium
VATDHGSEDGNRLA

SEQ ID NO: 1030133 - protein, 4 aa, Mycobacterium
VATG

SEQ ID NO: 1030134 - protein, 8 aa, Mycobacterium
VATGATAA

SEQ ID NO: 1030135 - protein, 5 aa, Mycobacterium
VATGE

SEQ ID NO: 1030136 - protein, 8 aa, Mycobacterium
VATPGEQA

SEQ ID NO: 1030137 - protein, 7 aa, Mycobacterium
VATPPGV

SEQ ID NO: 1030138 - protein, 9 aa, Mycobacterium
VATRPDLPE

SEQ ID NO: 1030139 - protein, 45 aa, Mycobacterium; identical to SEQ ID NO: 605557

SEQ ID NO: 1030140 - protein, 4 aa, Mycobacterium
VAVK

SEQ ID NO: 1030141 - protein, 4 aa, Mycobacterium
VAYP

SEQ ID NO: 1030142 - protein, 4 aa, Mycobacterium
VDAA

SEQ ID NO: 1030143 - protein, 5 aa, Mycobacterium
VDAAA

SEQ ID NO: 1030144 - protein, 6 aa, Mycobacterium
VDADGG

SEQ ID NO: 1030145 - protein, 7 aa, Mycobacterium
VDADGRR

SEQ ID NO: 1030146 - protein, 7 aa, Mycobacterium
VDADGRT

SEQ ID NO: 1030147 - protein, 4 aa, Mycobacterium
VDAE

SEQ ID NO: 1030148 - protein, 77 aa, Mycobacterium
VDAEPGGPAGVDKGSDAAAGTPAGVATGEADAAEAVEATGPDADGVASAAESADNPTVNVSRETSSEFDTPIGAAAE

SEQ ID NO: 1030149 - protein, 16 aa, Mycobacterium
VDAGDPLSTLTETNTE

SEQ ID NO: 1030150 - protein, 5 aa, Mycobacterium
VDAGG

SEQ ID NO: 1030151 - protein, 7 aa, Mycobacterium
VDAPDGY

SEQ ID NO: 1030152 - protein, 14 aa, Mycobacterium
VDAPTPALLHHRSE

SEQ ID NO: 1030153 - protein, 6 aa, Mycobacterium
VDASQL

SEQ ID NO: 1030154 - protein, 8 aa, Mycobacterium
VDATGQFA

SEQ ID NO: 1030155 - protein, 7 aa, Mycobacterium
VDDAAAA

SEQ ID NO: 1030156 - protein, 10 aa, Mycobacterium
VDDAAGEAYD

SEQ ID NO: 1030157 - protein, 6 aa, Mycobacterium
VDDDEA

SEQ ID NO: 1030158 - protein, 9 aa, Mycobacterium
VDDDPNAAP

SEQ ID NO: 1030159 - protein, 5 aa, Mycobacterium
VDDEE

SEQ ID NO: 1030160 - protein, 5 aa, Mycobacterium
VDDET

SEQ ID NO: 1030161 - protein, 7 aa, Mycobacterium
VDDFAPG

SEQ ID NO: 1030162 - protein, 9 aa, Mycobacterium
VDDGGQPDV

SEQ ID NO: 1030163 - protein, 8 aa, Mycobacterium
VDDGPTAL

SEQ ID NO: 1030164 - protein, 5 aa, Mycobacterium
VDDPD

SEQ ID NO: 1030165 - protein, 8 aa, Mycobacterium
VDDPHINR

SEQ ID NO: 1030166 - protein, 8 aa, Mycobacterium
VDDPTGDA

SEQ ID NO: 1030167 - protein, 8 aa, Mycobacterium
VDDPTRQR

SEQ ID NO: 1030168 - protein, 6 aa, Mycobacterium
VDDQTA

SEQ ID NO: 1030169 - protein, 8 aa, Mycobacterium
VDDRPPNA

SEQ ID NO: 1030170 - protein, 4 aa, Mycobacterium
VDEA

SEQ ID NO: 1030171 - protein, 5 aa, Mycobacterium
VDEAS

SEQ ID NO: 1030172 - protein, 7 aa, Mycobacterium
VDEEAAR

SEQ ID NO: 1030173 - protein, 8 aa, Mycobacterium
VDEEDPVQ

SEQ ID NO: 1030174 - protein, 6 aa, Mycobacterium
VDEGNA

SEQ ID NO: 1030175 - protein, 12 aa, Mycobacterium
VDEKTEGKYSDT

SEQ ID NO: 1030176 - protein, 8 aa, Mycobacterium
VDENDPAG

SEQ ID NO: 1030177 - protein, 8 aa, Mycobacterium
VDEPTGDG

SEQ ID NO: 1030178 - protein, 7 aa, Mycobacterium
VDEQTGA

SEQ ID NO: 1030179 - protein, 11 aa, Mycobacterium
VDESESAESFE

SEQ ID NO: 1030180 - protein, 7 aa, Mycobacterium
VDESNAR

SEQ ID NO: 1030181 - protein, 16 aa, Mycobacterium
VDESQSVGNGRPLEPA

SEQ ID NO: 1030182 - protein, 4 aa, Mycobacterium
VDET

SEQ ID NO: 1030183 - protein, 6 aa, Mycobacterium
VDETGD

SEQ ID NO: 1030184 - protein, 6 aa, Mycobacterium
VDETQG

SEQ ID NO: 1030185 - protein, 9 aa, Mycobacterium
VDGASAPIG

SEQ ID NO: 1030186 - protein, 8 aa, Mycobacterium
VDGDRLAD

SEQ ID NO: 1030187 - protein, 6 aa, Mycobacterium
VDGDRT

SEQ ID NO: 1030188 - protein, 8 aa, Mycobacterium
VDGECGTE

SEQ ID NO: 1030189 - protein, 16 aa, Mycobacterium
VDGEDVPNAAAEGLSH

SEQ ID NO: 1030190 - protein, 9 aa, Mycobacterium
VDGERLSSS

SEQ ID NO: 1030191 - protein, 5 aa, Mycobacterium
VDGGG

SEQ ID NO: 1030192 - protein, 5 aa, Mycobacterium
VDGGL

SEQ ID NO: 1030193 - protein, 7 aa, Mycobacterium
VDGHDER

SEQ ID NO: 1030194 - protein, 8 aa, Mycobacterium
VDGNPEAG

SEQ ID NO: 1030195 - protein, 4 aa, Mycobacterium
VDGP

SEQ ID NO: 1030196 - protein, 6 aa, Mycobacterium
VDGPED

SEQ ID NO: 1030197 - protein, 6 aa, Mycobacterium
VDGPEF

SEQ ID NO: 1030198 - protein, 16 aa, Mycobacterium
VDGPESLPSVTDGTAT

SEQ ID NO: 1030199 - protein, 5 aa, Mycobacterium
VDGQH

SEQ ID NO: 1030200 - protein, 23 aa, Mycobacterium
VDGRGGGKADLAQGSGKKPAGIA

SEQ ID NO: 1030201 - protein, 10 aa, Mycobacterium
VDGRGGGPVA

SEQ ID NO: 1030202 - protein, 10 aa, Mycobacterium
VDGRIGTETM

SEQ ID NO: 1030203 - protein, 7 aa, Mycobacterium
VDGRRDI

SEQ ID NO: 1030204 - protein, 9 aa, Mycobacterium
VDGSDYPNL

SEQ ID NO: 1030205 - protein, 7 aa, Mycobacterium
VDGSEAL

SEQ ID NO: 1030206 - protein, 4 aa, Mycobacterium
VDGY

SEQ ID NO: 1030207 - protein, 10 aa, Mycobacterium
VDHTGRYRGR

SEQ ID NO: 1030208 - protein, 7 aa, Mycobacterium
VDHTTGV

SEQ ID NO: 1030209 - protein, 7 aa, Mycobacterium
VDNASDA

SEQ ID NO: 1030210 - protein, 9 aa, Mycobacterium
VDNDGNPAY

SEQ ID NO: 1030211 - protein, 9 aa, Mycobacterium
VDNNGRDPA

SEQ ID NO: 1030212 - protein, 7 aa, Mycobacterium
VDNPARL

SEQ ID NO: 1030213 - protein, 10 aa, Mycobacterium
VDNPPQTTRA

SEQ ID NO: 1030214 - protein, 8 aa, Mycobacterium
VDNPQRDR

SEQ ID NO: 1030215 - protein, 4 aa, Mycobacterium
VDNR

SEQ ID NO: 1030216 - protein, 6 aa, Mycobacterium
VDNSPG

SEQ ID NO: 1030217 - protein, 9 aa, Mycobacterium
VDPAATGLA

SEQ ID NO: 1030218 - protein, 9 aa, Mycobacterium
VDPAEEEQI

SEQ ID NO: 1030219 - protein, 6 aa, Mycobacterium
VDPAGV

SEQ ID NO: 1030220 - protein, 6 aa, Mycobacterium
VDPATG

SEQ ID NO: 1030221 - protein, 9 aa, Mycobacterium
VDPDAPAPL

SEQ ID NO: 1030222 - protein, 10 aa, Mycobacterium
VDPDAPVSVQ

SEQ ID NO: 1030223 - protein, 5 aa, Mycobacterium
VDPDE

SEQ ID NO: 1030224 - protein, 7 aa, Mycobacterium
VDPDPEE

SEQ ID NO: 1030225 - protein, 6 aa, Mycobacterium
VDPDPR

SEQ ID NO: 1030226 - protein, 6 aa, Mycobacterium
VDPEAD

SEQ ID NO: 1030227 - protein, 5 aa, Mycobacterium
VDPED

SEQ ID NO: 1030228 - protein, 7 aa, Mycobacterium
VDPEFGT

SEQ ID NO: 1030229 - protein, 5 aa, Mycobacterium
VDPGA

SEQ ID NO: 1030230 - protein, 7 aa, Mycobacterium
VDPGRAR

SEQ ID NO: 1030231 - protein, 6 aa, Mycobacterium
VDPGSA

SEQ ID NO: 1030232 - protein, 7 aa, Mycobacterium
VDPGSAK

SEQ ID NO: 1030233 - protein, 7 aa, Mycobacterium
VDPGTVA

SEQ ID NO: 1030234 - protein, 18 aa, Mycobacterium
VDPHTSTDLPYPPAISTE

SEQ ID NO: 1030235 - protein, 5 aa, Mycobacterium
VDPNE

SEQ ID NO: 1030236 - protein, 10 aa, Mycobacterium
VDPNERTPGT

SEQ ID NO: 1030237 - protein, 17 aa, Mycobacterium
VDPPALPDPLPTGPTRR

SEQ ID NO: 1030238 - protein, 13 aa, Mycobacterium
VDPPSHGPVDPHG

SEQ ID NO: 1030239 - protein, 8 aa, Mycobacterium
VDPPYDDA

SEQ ID NO: 1030240 - protein, 5 aa, Mycobacterium
VDPQQ

SEQ ID NO: 1030241 - protein, 6 aa, Mycobacterium
VDPQSA

SEQ ID NO: 1030242 - protein, 6 aa, Mycobacterium
VDPRNS

SEQ ID NO: 1030243 - protein, 9 aa, Mycobacterium
VDPSLKPQA

SEQ ID NO: 1030244 - protein, 11 aa, Mycobacterium
VDPTDATSQFG

SEQ ID NO: 1030245 - protein, 14 aa, Mycobacterium
VDPTDHSKVLIVAP

SEQ ID NO: 1030246 - protein, 9 aa, Mycobacterium
VDPTDPARG

SEQ ID NO: 1030247 - protein, 6 aa, Mycobacterium
VDPTEV

SEQ ID NO: 1030248 - protein, 7 aa, Mycobacterium
VDPTTLD

SEQ ID NO: 1030249 - protein, 5 aa, Mycobacterium
VDQDG

SEQ ID NO: 1030250 - protein, 8 aa, Mycobacterium
VDQDKDQS

SEQ ID NO: 1030251 - protein, 6 aa, Mycobacterium
VDQEGL

SEQ ID NO: 1030252 - protein, 4 aa, Mycobacterium
VDQG

SEQ ID NO: 1030253 - protein, 7 aa, Mycobacterium
VDQPGVT

SEQ ID NO: 1030254 - protein, 8 aa, Mycobacterium
VDQPPHEP

SEQ ID NO: 1030255 - protein, 13 aa, Mycobacterium
VDQRRPGRPAAGH

SEQ ID NO: 1030256 - protein, 25 aa, Mycobacterium
VDRDGNELSRDTESTPTGGPIDSPN

SEQ ID NO: 1030257 - protein, 8 aa, Mycobacterium
VDREDPQV

SEQ ID NO: 1030258 - protein, 4 aa, Mycobacterium
VDRG

SEQ ID NO: 1030259 - protein, 5 aa, Mycobacterium
VDRPQ

SEQ ID NO: 1030260 - protein, 14 aa, Mycobacterium
VDRQRHRLVEQAAA

SEQ ID NO: 1030261 - protein, 8 aa, Mycobacterium
VDRSDARH

SEQ ID NO: 1030262 - protein, 7 aa, Mycobacterium
VDRYGNQ

SEQ ID NO: 1030263 - protein, 35 aa, Mycobacterium; identical to SEQ ID NO: 606433

SEQ ID NO: 1030264 - protein, 5 aa, Mycobacterium
VDSGA

SEQ ID NO: 1030265 - protein, 7 aa, Mycobacterium
VDSGDDA

SEQ ID NO: 1030266 - protein, 6 aa, Mycobacterium
VDSGRE

SEQ ID NO: 1030267 - protein, 24 aa, Mycobacterium
VDSNGRSRNVSDGYQRLGDAPETV

SEQ ID NO: 1030268 - protein, 5 aa, Mycobacterium
VDSNT

SEQ ID NO: 1030269 - protein, 10 aa, Mycobacterium
VDSNTAPTLD

SEQ ID NO: 1030270 - protein, 12 aa, Mycobacterium
VDSQDAPADADY

SEQ ID NO: 1030271 - protein, 9 aa, Mycobacterium
VDTAETRPN

SEQ ID NO: 1030272 - protein, 9 aa, Mycobacterium
VDTDGDGEW

SEQ ID NO: 1030273 - protein, 5 aa, Mycobacterium
VDTDH

SEQ ID NO: 1030274 - protein, 8 aa, Mycobacterium
VDTEGEPY

SEQ ID NO: 1030275 - protein, 9 aa, Mycobacterium
VDTEGLAQT

SEQ ID NO: 1030276 - protein, 4 aa, Mycobacterium
VDTG

SEQ ID NO: 1030277 - protein, 7 aa, Mycobacterium
VDTGTQF

SEQ ID NO: 1030278 - protein, 12 aa, Mycobacterium
VDTKPPRHSAPL

SEQ ID NO: 1030279 - protein, 6 aa, Mycobacterium
VDTNRS

SEQ ID NO: 1030280 - protein, 7 aa, Mycobacterium
VDTPAKV

SEQ ID NO: 1030281 - protein, 10 aa, Mycobacterium
VDTQTEPALA

SEQ ID NO: 1030282 - protein, 14 aa, Mycobacterium
VDTRDDYRRLVESV

SEQ ID NO: 1030283 - protein, 5 aa, Mycobacterium
VDTSG

SEQ ID NO: 1030284 - protein, 7 aa, Mycobacterium
VDTSRDI

SEQ ID NO: 1030285 - protein, 7 aa, Mycobacterium
VDTTGAE

SEQ ID NO: 1030286 - protein, 8 aa, Mycobacterium
VDVDPDAP

SEQ ID NO: 1030287 - protein, 11 aa, Mycobacterium
VDYPPERVRAD

SEQ ID NO: 1030288 - protein, 4 aa, Mycobacterium
VEAG

SEQ ID NO: 1030289 - protein, 12 aa, Mycobacterium
VEAGLGQAAGVG

SEQ ID NO: 1030290 - protein, 5 aa, Mycobacterium
VEAPA

SEQ ID NO: 1030291 - protein, 18 aa, Mycobacterium
VEASGKPACVAESVVRYV

SEQ ID NO: 1030292 - protein, 11 aa, Mycobacterium
VEASSGSTAVS

SEQ ID NO: 1030293 - protein, 9 aa, Mycobacterium
VEATDNPLK

SEQ ID NO: 1030294 - protein, 9 aa, Mycobacterium
VEATGQPVK

SEQ ID NO: 1030295 - protein, 6 aa, Mycobacterium
VEDDVA

SEQ ID NO: 1030296 - protein, 4 aa, Mycobacterium
VEDE

SEQ ID NO: 1030297 - protein, 8 aa, Mycobacterium
VEDEDEAR

SEQ ID NO: 1030298 - protein, 12 aa, Mycobacterium
VEDEDTEPDTAP

SEQ ID NO: 1030299 - protein, 7 aa, Mycobacterium
VEDGEDF

SEQ ID NO: 1030300 - protein, 6 aa, Mycobacterium
VEDITP

SEQ ID NO: 1030301 - protein, 6 aa, Mycobacterium
VEDPDE

SEQ ID NO: 1030302 - protein, 6 aa, Mycobacterium
VEDPEW

SEQ ID NO: 1030303 - protein, 20 aa, Mycobacterium
VEDPGLEASPETSQEVSDEI

SEQ ID NO: 1030304 - protein, 11 aa, Mycobacterium
VEDPGTQAHSV

SEQ ID NO: 1030305 - protein, 16 aa, Mycobacterium
VEDQRDADLEARAQKL

SEQ ID NO: 1030306 - protein, 9 aa, Mycobacterium
VEDTPSASL

SEQ ID NO: 1030307 - protein, 11 aa, Mycobacterium
VEEDEATGSAA

SEQ ID NO: 1030308 - protein, 4 aa, Mycobacterium
VEEG

SEQ ID NO: 1030309 - protein, 12 aa, Mycobacterium
VEEKPYSRRPYP

SEQ ID NO: 1030310 - protein, 6 aa, Mycobacterium
VEEQTT

SEQ ID NO: 1030311 - protein, 5 aa, Mycobacterium
VEETA

SEQ ID NO: 1030312 - protein, 12 aa, Mycobacterium
VEETSAEQIAAD

SEQ ID NO: 1030313 - protein, 6 aa, Mycobacterium
VEGAAS

SEQ ID NO: 1030314 - protein, 6 aa, Mycobacterium
VEGAGK

SEQ ID NO: 1030315 - protein, 10 aa, Mycobacterium
VEGAHGAPLP

SEQ ID NO: 1030316 - protein, 9 aa, Mycobacterium
VEGAPQGTS

SEQ ID NO: 1030317 - protein, 26 aa, Mycobacterium
VEGDKGAYQPAVQDSPETGVYSSPAE

SEQ ID NO: 1030318 - protein, 5 aa, Mycobacterium
VEGEA

SEQ ID NO: 1030319 - protein, 7 aa, Mycobacterium
VEGEPAD

SEQ ID NO: 1030320 - protein, 11 aa, Mycobacterium
VEGEPEGEATG

SEQ ID NO: 1030321 - protein, 9 aa, Mycobacterium
VEGGENVTG

SEQ ID NO: 1030322 - protein, 15 aa, Mycobacterium
VEGGKVTGERETDEG

SEQ ID NO: 1030323 - protein, 8 aa, Mycobacterium
VEGGNKQL

SEQ ID NO: 1030324 - protein, 15 aa, Mycobacterium
VEGGSAVTTGERVSA

SEQ ID NO: 1030325 - protein, 15 aa, Mycobacterium
VEGPQPSDLPPGVED

SEQ ID NO: 1030326 - protein, 10 aa, Mycobacterium
VEGPTDDPAI

SEQ ID NO: 1030327 - protein, 9 aa, Mycobacterium
VEGQGVPKT

SEQ ID NO: 1030328 - protein, 10 aa, Mycobacterium
VEGRPRRAGV

SEQ ID NO: 1030329 - protein, 6 aa, Mycobacterium
VEGSGG

SEQ ID NO: 1030330 - protein, 17 aa, Mycobacterium
VEGTPYKEATAAELADR

SEQ ID NO: 1030331 - protein, 13 aa, Mycobacterium
VEGVGAAAAPTAA

SEQ ID NO: 1030332 - protein, 6 aa, Mycobacterium
VEHGAS

SEQ ID NO: 1030333 - protein, 5 aa, Mycobacterium
VEIPN

SEQ ID NO: 1030334 - protein, 10 aa, Mycobacterium
VEKAGTFTQT

SEQ ID NO: 1030335 - protein, 8 aa, Mycobacterium
VEKGGDSV

SEQ ID NO: 1030336 - protein, 11 aa, Mycobacterium
VEKGSTSGYRA

SEQ ID NO: 1030337 - protein, 16 aa, Mycobacterium
VEKPSGSDAGRSIGAP

SEQ ID NO: 1030338 - protein, 7 aa, Mycobacterium
VEKTTTG

SEQ ID NO: 1030339 - protein, 11 aa, Mycobacterium
VELGSRNERPL

SEQ ID NO: 1030340 - protein, 11 aa, Mycobacterium
VELTSSTEERV

SEQ ID NO: 1030341 - protein, 9 aa, Mycobacterium
VENGLPPAQ

SEQ ID NO: 1030342 - protein, 5 aa, Mycobacterium
VENSP

SEQ ID NO: 1030343 - protein, 8 aa, Mycobacterium
VEPDDGQR

SEQ ID NO: 1030344 - protein, 4 aa, Mycobacterium
VEPE

SEQ ID NO: 1030345 - protein, 14 aa, Mycobacterium
VEPGRAKQGPESEH

SEQ ID NO: 1030346 - protein, 6 aa, Mycobacterium
VEPGSA

SEQ ID NO: 1030347 - protein, 7 aa, Mycobacterium
VEPGSGI

SEQ ID NO: 1030348 - protein, 7 aa, Mycobacterium
VEPGTRI

SEQ ID NO: 1030349 - protein, 10 aa, Mycobacterium
VEPKARRNAV

SEQ ID NO: 1030350 - protein, 12 aa, Mycobacterium
VEPKSLDASPYV

SEQ ID NO: 1030351 - protein, 11 aa, Mycobacterium
VEPPATPEQGY

SEQ ID NO: 1030352 - protein, 8 aa, Mycobacterium
VEPPEGDP

SEQ ID NO: 1030353 - protein, 17 aa, Mycobacterium
VEPPGGSPGRNQAPTLA

SEQ ID NO: 1030354 - protein, 11 aa, Mycobacterium
VEPPGPLPPGA

SEQ ID NO: 1030355 - protein, 10 aa, Mycobacterium
VEPPPSGLAA

SEQ ID NO: 1030356 - protein, 5 aa, Mycobacterium
VEPPR

SEQ ID NO: 1030357 - protein, 7 aa, Mycobacterium
VEPPTAA

SEQ ID NO: 1030358 - protein, 8 aa, Mycobacterium
VEPRPRST

SEQ ID NO: 1030359 - protein, 6 aa, Mycobacterium
VEPSGT

SEQ ID NO: 1030360 - protein, 5 aa, Mycobacterium
VEPSR

SEQ ID NO: 1030361 - protein, 21 aa, Mycobacterium
VEPSSIEQAGSQAGYPAPPLQ

SEQ ID NO: 1030362 - protein, 4 aa, Mycobacterium
VEPT

SEQ ID NO: 1030363 - protein, 17 aa, Mycobacterium
VEPTEAPHAAPATQIPA

SEQ ID NO: 1030364 - protein, 10 aa, Mycobacterium
VEPTSGNTGV

SEQ ID NO: 1030365 - protein, 5 aa, Mycobacterium
VEQPG

SEQ ID NO: 1030366 - protein, 9 aa, Mycobacterium
VEQPGQDNV

SEQ ID NO: 1030367 - protein, 23 aa, Mycobacterium
VEQQHQHGAPSLGDQHTQQPLAG

SEQ ID NO: 1030368 - protein, 12 aa, Mycobacterium
VEQSLKQFVELY

SEQ ID NO: 1030369 - protein, 6 aa, Mycobacterium
VEQTAN

SEQ ID NO: 1030370 - protein, 14 aa, Mycobacterium
VEQTPDAEAALSDE

SEQ ID NO: 1030371 - protein, 12 aa, Mycobacterium
VEQTSKERGHEY

SEQ ID NO: 1030372 - protein, 14 aa, Mycobacterium
VERADPGAQSPKET

SEQ ID NO: 1030373 - protein, 15 aa, Mycobacterium
VERHRTKAVDLRADQ

SEQ ID NO: 1030374 - protein, 11 aa, Mycobacterium
VERLPAETSRR

SEQ ID NO: 1030375 - protein, 6 aa, Mycobacterium
VERPDS

SEQ ID NO: 1030376 - protein, 5 aa, Mycobacterium
VERPP

SEQ ID NO: 1030377 - protein, 15 aa, Mycobacterium
VERSGNELTLVVAAG

SEQ ID NO: 1030378 - protein, 6 aa, Mycobacterium
VERVGA

SEQ ID NO: 1030379 - protein, 9 aa, Mycobacterium
VESAGTTAI

SEQ ID NO: 1030380 - protein, 7 aa, Mycobacterium
VESAREE

SEQ ID NO: 1030381 - protein, 6 aa, Mycobacterium
VESDPG

SEQ ID NO: 1030382 - protein, 7 aa, Mycobacterium
VESEGRK

SEQ ID NO: 1030383 - protein, 22 aa, Mycobacterium
VESERLPRGADPNTHTKLGRGG

SEQ ID NO: 1030384 - protein, 4 aa, Mycobacterium
VESG

SEQ ID NO: 1030385 - protein, 8 aa, Mycobacterium
VESGRAPQ

SEQ ID NO: 1030386 - protein, 7 aa, Mycobacterium
VESGRID

SEQ ID NO: 1030387 - protein, 6 aa, Mycobacterium
VESHTT

SEQ ID NO: 1030388 - protein, 6 aa, Mycobacterium
VESPAA

SEQ ID NO: 1030389 - protein, 9 aa, Mycobacterium
VESPTRANA

SEQ ID NO: 1030390 - protein, 12 aa, Mycobacterium
VESQRGDSGGPV

SEQ ID NO: 1030391 - protein, 13 aa, Mycobacterium
VESRRGAGWSGPS

SEQ ID NO: 1030392 - protein, 6 aa, Mycobacterium
VESTGN

SEQ ID NO: 1030393 - protein, 8 aa, Mycobacterium
VESTPATA

SEQ ID NO: 1030394 - protein, 11 aa, Mycobacterium
VESTPTLPLPT

SEQ ID NO: 1030395 - protein, 6 aa, Mycobacterium
VESTRR

SEQ ID NO: 1030396 - protein, 9 aa, Mycobacterium
VESTSGGHR

SEQ ID NO: 1030397 - protein, 5 aa, Mycobacterium
VETAT

SEQ ID NO: 1030398 - protein, 23 aa, Mycobacterium
VETATPRSSASSALASLADSAGR

SEQ ID NO: 1030399 - protein, 12 aa, Mycobacterium
VETEPGSGDRYG

SEQ ID NO: 1030400 - protein, 5 aa, Mycobacterium
VETGR

SEQ ID NO: 1030401 - protein, 5 aa, Mycobacterium
VETRT

SEQ ID NO: 1030402 - protein, 8 aa, Mycobacterium
VETSPAGG

SEQ ID NO: 1030403 - protein, 8 aa, Mycobacterium
VETTAGEM

SEQ ID NO: 1030404 - protein, 7 aa, Mycobacterium
VETTPLT

SEQ ID NO: 1030405 - protein, 9 aa, Mycobacterium
VEVDGKTER

SEQ ID NO: 1030406 - protein, 10 aa, Mycobacterium
VEVEGDPECQ

SEQ ID NO: 1030407 - protein, 5 aa, Mycobacterium
VEVGT

SEQ ID NO: 1030408 - protein, 6 aa, Mycobacterium
VEYEQD

SEQ ID NO: 1030409 - protein, 13 aa, Mycobacterium
VFDPPGADLSGEE

SEQ ID NO: 1030410 - protein, 17 aa, Mycobacterium
VGAAEAPDYRPAPLPSW

SEQ ID NO: 1030411 - protein, 5 aa, Mycobacterium
VGAAG

SEQ ID NO: 1030412 - protein, 13 aa, Mycobacterium
VGAANTAAAAATT

SEQ ID NO: 1030413 - protein, 10 aa, Mycobacterium
VGAATARSAA

SEQ ID NO: 1030414 - protein, 8 aa, Mycobacterium
VGADGDIA

SEQ ID NO: 1030415 - protein, 7 aa, Mycobacterium
VGAGAAG

SEQ ID NO: 1030416 - protein, 5 aa, Mycobacterium
VGAGR

SEQ ID NO: 1030417 - protein, 9 aa, Mycobacterium
VGAGSGKQI

SEQ ID NO: 1030418 - protein, 6 aa, Mycobacterium
VGAGTG

SEQ ID NO: 1030419 - protein, 9 aa, Mycobacterium
VGAGYGPGH

SEQ ID NO: 1030420 - protein, 7 aa, Mycobacterium
VGAHPSL

SEQ ID NO: 1030421 - protein, 7 aa, Mycobacterium
VGANPRE

SEQ ID NO: 1030422 - protein, 6 aa, Mycobacterium
VGAPGG

SEQ ID NO: 1030423 - protein, 24 aa, Mycobacterium
VGAPGPVTTGAPGAAGAAGAADTI

SEQ ID NO: 1030424 - protein, 5 aa, Mycobacterium
VGAPL

SEQ ID NO: 1030425 - protein, 21 aa, Mycobacterium
VGAPPDGVSIRGSTNHGPVTP

SEQ ID NO: 1030426 - protein, 14 aa, Mycobacterium
VGAPREGYPAGTSW

SEQ ID NO: 1030427 - protein, 28 aa, Mycobacterium
VGAPRNPVADGAPTSTTGRPTAKPGAIP

SEQ ID NO: 1030428 - protein, 11 aa, Mycobacterium
VGARPADPQVR

SEQ ID NO: 1030429 - protein, 6 aa, Mycobacterium
VGASPG

SEQ ID NO: 1030430 - protein, 19 aa, Mycobacterium
VGASSSDKSSATLPPQSVP

SEQ ID NO: 1030431 - protein, 12 aa, Mycobacterium
VGATAAGQLPPG

SEQ ID NO: 1030432 - protein, 5 aa, Mycobacterium
VGATG

SEQ ID NO: 1030433 - protein, 30 aa, Mycobacterium
VGATGGQGGADGAGGLFGPGGTGGAGGTSF

SEQ ID NO: 1030434 - protein, 10 aa, Mycobacterium
VGATTADEAA

SEQ ID NO: 1030435 - protein, 6 aa, Mycobacterium
VGDADN

SEQ ID NO: 1030436 - protein, 12 aa, Mycobacterium
VGDASDRAREAL

SEQ ID NO: 1030437 - protein, 4 aa, Mycobacterium
VGDD

SEQ ID NO: 1030438 - protein, 12 aa, Mycobacterium
VGDDPASVAANR

SEQ ID NO: 1030439 - protein, 34 aa, Mycobacterium
VGDGGAGGGGGITALPGNAGGDGGNGGKAGRSAP

SEQ ID NO: 1030440 - protein, 11 aa, Mycobacterium
VGDGNTVNASS

SEQ ID NO: 1030441 - protein, 8 aa, Mycobacterium
VGDKGPPL

SEQ ID NO: 1030442 - protein, 5 aa, Mycobacterium
VGDNA

SEQ ID NO: 1030443 - protein, 7 aa, Mycobacterium
VGDPAAV

SEQ ID NO: 1030444 - protein, 10 aa, Mycobacterium
VGDPADPDVQ

SEQ ID NO: 1030445 - protein, 11 aa, Mycobacterium
VGDPAPLPADR

SEQ ID NO: 1030446 - protein, 10 aa, Mycobacterium
VGDPATQTTE

SEQ ID NO: 1030447 - protein, 7 aa, Mycobacterium
VGDPDGR

SEQ ID NO: 1030448 - protein, 26 aa, Mycobacterium
VGDPTDPQTQVGPLATEQSRDEIAQQ

SEQ ID NO: 1030449 - protein, 11 aa, Mycobacterium
VGDPTDVPGTV

SEQ ID NO: 1030450 - protein, 4 aa, Mycobacterium
VGDQ

SEQ ID NO: 1030451 - protein, 9 aa, Mycobacterium
VGDQGGDIA

SEQ ID NO: 1030452 - protein, 17 aa, Mycobacterium
VGDRQTQNQPGTTDEYP

SEQ ID NO: 1030453 - protein, 4 aa, Mycobacterium
VGDS

SEQ ID NO: 1030454 - protein, 5 aa, Mycobacterium
VGDYN

SEQ ID NO: 1030455 - protein, 6 aa, Mycobacterium
VGEDDV

SEQ ID NO: 1030456 - protein, 14 aa, Mycobacterium
VGEGDTGPNTGGMG

SEQ ID NO: 1030457 - protein, 5 aa, Mycobacterium
VGEGV

SEQ ID NO: 1030458 - protein, 5 aa, Mycobacterium
VGEHA

SEQ ID NO: 1030459 - protein, 6 aa, Mycobacterium
VGEIDS

SEQ ID NO: 1030460 - protein, 15 aa, Mycobacterium
VGEPEPAGRPADPPF

SEQ ID NO: 1030461 - protein, 16 aa, Mycobacterium
VGEPPPGAEALAQWPR

SEQ ID NO: 1030462 - protein, 7 aa, Mycobacterium
VGEPVGG

SEQ ID NO: 1030463 - protein, 8 aa, Mycobacterium
VGEQTADR

SEQ ID NO: 1030464 - protein, 5 aa, Mycobacterium
VGERD

SEQ ID NO: 1030465 - protein, 7 aa, Mycobacterium
VGERGRL

SEQ ID NO: 1030466 - protein, 13 aa, Mycobacterium
VGESRDQEASAKV

SEQ ID NO: 1030467 - protein, 6 aa, Mycobacterium
VGETKG

SEQ ID NO: 1030468 - protein, 12 aa, Mycobacterium
VGETRSYTVPNG

SEQ ID NO: 1030469 - protein, 13 aa, Mycobacterium
VGGAGGAGGNAGL

SEQ ID NO: 1030470 - protein, 11 aa, Mycobacterium
VGGAGGNGGNG

SEQ ID NO: 1030471 - protein, 6 aa, Mycobacterium
VGGAKN

SEQ ID NO: 1030472 - protein, 15 aa, Mycobacterium
VGGANSSASATGGIN

SEQ ID NO: 1030473 - protein, 5 aa, Mycobacterium
VGGAR

SEQ ID NO: 1030474 - protein, 21 aa, Mycobacterium
VGGDGGAGGAGGGAGGDGGAG

SEQ ID NO: 1030475 - protein, 43 aa, Mycobacterium; identical to SEQ ID NO: 607822

SEQ ID NO: 1030476 - protein, 5 aa, Mycobacterium
VGGDS

SEQ ID NO: 1030477 - protein, 10 aa, Mycobacterium
VGGDSAGGNL

SEQ ID NO: 1030478 - protein, 5 aa, Mycobacterium
VGGEL

SEQ ID NO: 1030479 - protein, 7 aa, Mycobacterium
VGGELPD

SEQ ID NO: 1030480 - protein, 6 aa, Mycobacterium
VGGEPH

SEQ ID NO: 1030481 - protein, 5 aa, Mycobacterium
VGGER

SEQ ID NO: 1030482 - protein, 5 aa, Mycobacterium
VGGFS

SEQ ID NO: 1030483 - protein, 12 aa, Mycobacterium
VGGGAAPGSAAA

SEQ ID NO: 1030484 - protein, 10 aa, Mycobacterium
VGGGANSKFD

SEQ ID NO: 1030485 - protein, 12 aa, Mycobacterium
VGGGDPAGNPTL

SEQ ID NO: 1030486 - protein, 26 aa, Mycobacterium
VGGGGGTGSTGVGGIGGSGGGADINN

SEQ ID NO: 1030487 - protein, 89 aa, Mycobacterium
VGGGGSGDGGGTGTGGTGSGSGGTGDTGGTGSGTGDTGGNGTGTGDTGGTGDTGGTGTGTGDGTGTGDGGDTGGSGTGGTGGDGEVPAT

SEQ ID NO: 1030488 - protein, 16 aa, Mycobacterium
VGGGNVGNGNNGFGNF

SEQ ID NO: 1030489 - protein, 5 aa, Mycobacterium
VGGHD

SEQ ID NO: 1030490 - protein, 73 aa, Mycobacterium
VGGKREVTAVAPAGAERARRERPSGTRPRRSGAAGTTVTGTDAGRAVGGEESAATNIGHSDDSVVTHEPQIAE

SEQ ID NO: 1030491 - protein, 73 aa, Mycobacterium
VGGKREVTAVAPAGAERARRERPSGTRPRRSGAAGTTVTGTDAGRAVGGQESAATNIGHSDDSVVTHEPQIAE

SEQ ID NO: 1030492 - protein, 14 aa, Mycobacterium
VGGKTGINTDAGKN

SEQ ID NO: 1030493 - protein, 4 aa, Mycobacterium
VGGL

SEQ ID NO: 1030494 - protein, 5 aa, Mycobacterium
VGGLP

SEQ ID NO: 1030495 - protein, 22 aa, Mycobacterium
VGGNDANPVTGAGTIGQAGNTG

SEQ ID NO: 1030496 - protein, 24 aa, Mycobacterium
VGGNGAWGAGGIGGDGGVGGAGSA

SEQ ID NO: 1030497 - protein, 9 aa, Mycobacterium
VGGNSAVQG

SEQ ID NO: 1030498 - protein, 7 aa, Mycobacterium
VGGPPRN

SEQ ID NO: 1030499 - protein, 7 aa, Mycobacterium
VGGPSTW

SEQ ID NO: 1030500 - protein, 9 aa, Mycobacterium
VGGQPQNEW

SEQ ID NO: 1030501 - protein, 53 aa, Mycobacterium
VGGRGGSGNGAERNGCNAAQPGHRTRPSVGYRQTPDLGGPANPPETTRHARQR

SEQ ID NO: 1030502 - protein, 9 aa, Mycobacterium
VGGSAAAAA

SEQ ID NO: 1030503 - protein, 7 aa, Mycobacterium
VGGSPAA

SEQ ID NO: 1030504 - protein, 5 aa, Mycobacterium
VGGTE

SEQ ID NO: 1030505 - protein, 11 aa, Mycobacterium
VGGTRGRDAAQ

SEQ ID NO: 1030506 - protein, 6 aa, Mycobacterium
VGGTVE

SEQ ID NO: 1030507 - protein, 7 aa, Mycobacterium
VGGYGNS

SEQ ID NO: 1030508 - protein, 7 aa, Mycobacterium
VGHPGPI

SEQ ID NO: 1030509 - protein, 7 aa, Mycobacterium
VGHPQPR

SEQ ID NO: 1030510 - protein, 13 aa, Mycobacterium
VGKDGQPTQGGYS

SEQ ID NO: 1030511 - protein, 5 aa, Mycobacterium
VGKGD

SEQ ID NO: 1030512 - protein, 11 aa, Mycobacterium
VGKKPADAVTG

SEQ ID NO: 1030513 - protein, 8 aa, Mycobacterium
VGKPAPTV

SEQ ID NO: 1030514 - protein, 13 aa, Mycobacterium
VGKPTAREGTEPW

SEQ ID NO: 1030515 - protein, 18 aa, Mycobacterium
VGKTPSETAVLAREILKG

SEQ ID NO: 1030516 - protein, 6 aa, Mycobacterium
VGKTVA

SEQ ID NO: 1030517 - protein, 6 aa, Mycobacterium
VGLRPE

SEQ ID NO: 1030518 - protein, 7 aa, Mycobacterium
VGMPDSD

SEQ ID NO: 1030519 - protein, 8 aa, Mycobacterium
VGNADPAA

SEQ ID NO: 1030520 - protein, 10 aa, Mycobacterium
VGNDEDSGAV

SEQ ID NO: 1030521 - protein, 12 aa, Mycobacterium
VGNDETTSDGSV

SEQ ID NO: 1030522 - protein, 7 aa, Mycobacterium
VGNDGTC

SEQ ID NO: 1030523 - protein, 7 aa, Mycobacterium
VGNGAVQ

SEQ ID NO: 1030524 - protein, 6 aa, Mycobacterium
VGNGKD

SEQ ID NO: 1030525 - protein, 4 aa, Mycobacterium
VGNP

SEQ ID NO: 1030526 - protein, 7 aa, Mycobacterium
VGNPATV

SEQ ID NO: 1030527 - protein, 8 aa, Mycobacterium
VGNRGAYG

SEQ ID NO: 1030528 - protein, 35 aa, Mycobacterium; identical to SEQ ID NO: 608110

SEQ ID NO: 1030529 - protein, 10 aa, Mycobacterium
VGNSGTGNLG

SEQ ID NO: 1030530 - protein, 7 aa, Mycobacterium
VGNSVRA

SEQ ID NO: 1030531 - protein, 9 aa, Mycobacterium
VGPAGEHAG

SEQ ID NO: 1030532 - protein, 24 aa, Mycobacterium
VGPASRRQSAVSGHPHRFGRRHLR

SEQ ID NO: 1030533 - protein, 12 aa, Mycobacterium
VGPDGMGNSPEH

SEQ ID NO: 1030534 - protein, 4 aa, Mycobacterium
VGPE

SEQ ID NO: 1030535 - protein, 6 aa, Mycobacterium
VGPEDR

SEQ ID NO: 1030536 - protein, 5 aa, Mycobacterium
VGPER

SEQ ID NO: 1030537 - protein, 9 aa, Mycobacterium
VGPESDSYE

SEQ ID NO: 1030538 - protein, 12 aa, Mycobacterium
VGPGDGTGRGGR

SEQ ID NO: 1030539 - protein, 9 aa, Mycobacterium
VGPGGRPGL

SEQ ID NO: 1030540 - protein, 6 aa, Mycobacterium
VGPGGY

SEQ ID NO: 1030541 - protein, 7 aa, Mycobacterium
VGPGQSL

SEQ ID NO: 1030542 - protein, 11 aa, Mycobacterium
VGPGRGSAAGS

SEQ ID NO: 1030543 - protein, 11 aa, Mycobacterium
VGPGVDDIAPG

SEQ ID NO: 1030544 - protein, 8 aa, Mycobacterium
VGPKQTAL

SEQ ID NO: 1030545 - protein, 9 aa, Mycobacterium
VGPLDQDGF

SEQ ID NO: 1030546 - protein, 11 aa, Mycobacterium
VGPNGSGKSNV

SEQ ID NO: 1030547 - protein, 8 aa, Mycobacterium
VGPNPGAD

SEQ ID NO: 1030548 - protein, 7 aa, Mycobacterium
VGPPPTH

SEQ ID NO: 1030549 - protein, 11 aa, Mycobacterium
VGPPSDPAAQI

SEQ ID NO: 1030550 - protein, 5 aa, Mycobacterium
VGPQH

SEQ ID NO: 1030551 - protein, 10 aa, Mycobacterium
VGPQPLAPDE

SEQ ID NO: 1030552 - protein, 8 aa, Mycobacterium
VGPSMGTG

SEQ ID NO: 1030553 - protein, 5 aa, Mycobacterium
VGPTM

SEQ ID NO: 1030554 - protein, 6 aa, Mycobacterium
VGPVDN

SEQ ID NO: 1030555 - protein, 8 aa, Mycobacterium
VGQAGALD

SEQ ID NO: 1030556 - protein, 10 aa, Mycobacterium
VGQERGQDAD

SEQ ID NO: 1030557 - protein, 5 aa, Mycobacterium
VGQGY

SEQ ID NO: 1030558 - protein, 18 aa, Mycobacterium
VGQRVTRADKAAAHNAAA

SEQ ID NO: 1030559 - protein, 4 aa, Mycobacterium
VGQS

SEQ ID NO: 1030560 - protein, 6 aa, Mycobacterium
VGQTGF

SEQ ID NO: 1030561 - protein, 4 aa, Mycobacterium
VGRD

SEQ ID NO: 1030562 - protein, 10 aa, Mycobacterium
VGRDPATIER

SEQ ID NO: 1030563 - protein, 29 aa, Mycobacterium
VGRDSTRGLGAGADPEVGRRAAEDAKDEI

SEQ ID NO: 1030564 - protein, 5 aa, Mycobacterium
VGREI

SEQ ID NO: 1030565 - protein, 6 aa, Mycobacterium
VGRGDT

SEQ ID NO: 1030566 - protein, 4 aa, Mycobacterium
VGRK

SEQ ID NO: 1030567 - protein, 4 aa, Mycobacterium
VGRP

SEQ ID NO: 1030568 - protein, 7 aa, Mycobacterium
VGRPAEL

SEQ ID NO: 1030569 - protein, 6 aa, Mycobacterium
VGRPRS

SEQ ID NO: 1030570 - protein, 6 aa, Mycobacterium
VGRPVP

SEQ ID NO: 1030571 - protein, 5 aa, Mycobacterium
VGRRK

SEQ ID NO: 1030572 - protein, 11 aa, Mycobacterium
VGRSKAQSARD

SEQ ID NO: 1030573 - protein, 8 aa, Mycobacterium
VGRSRERG

SEQ ID NO: 1030574 - protein, 5 aa, Mycobacterium
VGRTH

SEQ ID NO: 1030575 - protein, 7 aa, Mycobacterium
VGRTNTY

SEQ ID NO: 1030576 - protein, 8 aa, Mycobacterium
VGRTPNGV

SEQ ID NO: 1030577 - protein, 8 aa, Mycobacterium
VGRTRTGD

SEQ ID NO: 1030578 - protein, 10 aa, Mycobacterium
VGSAGTVTTL

SEQ ID NO: 1030579 - protein, 28 aa, Mycobacterium
VGSDGGPGEGPGPNRSGGEGGSRGRPGG

SEQ ID NO: 1030580 - protein, 8 aa, Mycobacterium
VGSDRARF

SEQ ID NO: 1030581 - protein, 11 aa, Mycobacterium
VGSDYRGDPSA

SEQ ID NO: 1030582 - protein, 4 aa, Mycobacterium
VGSE

SEQ ID NO: 1030583 - protein, 7 aa, Mycobacterium
VGSEEAD

SEQ ID NO: 1030584 - protein, 8 aa, Mycobacterium
VGSEQAYA

SEQ ID NO: 1030585 - protein, 5 aa, Mycobacterium
VGSER

SEQ ID NO: 1030586 - protein, 10 aa, Mycobacterium
VGSESGPNLG

SEQ ID NO: 1030587 - protein, 14 aa, Mycobacterium
VGSGATSERQPAGD

SEQ ID NO: 1030588 - protein, 37 aa, Mycobacterium
VGSGGNGGNGGFSATPAAGGTGDAGGAVFGSDGVAGL

SEQ ID NO: 1030589 - protein, 7 aa, Mycobacterium
VGSGPSI

SEQ ID NO: 1030590 - protein, 5 aa, Mycobacterium
VGSHS

SEQ ID NO: 1030591 - protein, 6 aa, Mycobacterium
VGSLES

SEQ ID NO: 1030592 - protein, 12 aa, Mycobacterium
VGSNAAERGRPP

SEQ ID NO: 1030593 - protein, 10 aa, Mycobacterium
VGSNNSGLPL

SEQ ID NO: 1030594 - protein, 6 aa, Mycobacterium
VGSPDA

SEQ ID NO: 1030595 - protein, 13 aa, Mycobacterium
VGSPGSDGRRHPD

SEQ ID NO: 1030596 - protein, 10 aa, Mycobacterium
VGSQSPAVGQ

SEQ ID NO: 1030597 - protein, 9 aa, Mycobacterium
VGSRPDPTM

SEQ ID NO: 1030598 - protein, 8 aa, Mycobacterium
VGSSETGA

SEQ ID NO: 1030599 - protein, 11 aa, Mycobacterium
VGSSGQANYAA

SEQ ID NO: 1030600 - protein, 11 aa, Mycobacterium
VGSSGQGNYAA

SEQ ID NO: 1030601 - protein, 8 aa, Mycobacterium
VGSYNTGT

SEQ ID NO: 1030602 - protein, 6 aa, Mycobacterium
VGTAAE

SEQ ID NO: 1030603 - protein, 5 aa, Mycobacterium
VGTAN

SEQ ID NO: 1030604 - protein, 5 aa, Mycobacterium
VGTAP

SEQ ID NO: 1030605 - protein, 4 aa, Mycobacterium
VGTD

SEQ ID NO: 1030606 - protein, 19 aa, Mycobacterium
VGTDRAAGAVSAASATAAV

SEQ ID NO: 1030607 - protein, 5 aa, Mycobacterium
VGTER

SEQ ID NO: 1030608 - protein, 11 aa, Mycobacterium
VGTESSKHASH

SEQ ID NO: 1030609 - protein, 5 aa, Mycobacterium
VGTFP

SEQ ID NO: 1030610 - protein, 15 aa, Mycobacterium
VGTGASCADGEPIGD

SEQ ID NO: 1030611 - protein, 16 aa, Mycobacterium
VGTGGAAASADSTATA

SEQ ID NO: 1030612 - protein, 7 aa, Mycobacterium
VGTGGRL

SEQ ID NO: 1030613 - protein, 28 aa, Mycobacterium
VGTGGVGGAGGIGGAAAGGKGGDGGDAA

SEQ ID NO: 1030614 - protein, 6 aa, Mycobacterium
VGTGRR

SEQ ID NO: 1030615 - protein, 12 aa, Mycobacterium
VGTNPTFSGRTR

SEQ ID NO: 1030616 - protein, 8 aa, Mycobacterium
VGTPNSGW

SEQ ID NO: 1030617 - protein, 27 aa, Mycobacterium
VGTRTGSGAAVTTGASSGADTAVTTHG

SEQ ID NO: 1030618 - protein, 19 aa, Mycobacterium
VGTRVQQGDAETAPLANPE

SEQ ID NO: 1030619 - protein, 12 aa, Mycobacterium
VGTSSRNTIRSS

SEQ ID NO: 1030620 - protein, 14 aa, Mycobacterium
VGTYNKNDGAQDWQ

SEQ ID NO: 1030621 - protein, 11 aa, Mycobacterium
VHDEHSAAGIG

SEQ ID NO: 1030622 - protein, 8 aa, Mycobacterium
VHDPQTAE

SEQ ID NO: 1030623 - protein, 9 aa, Mycobacterium
VHGDQRRTD

SEQ ID NO: 1030624 - protein, 6 aa, Mycobacterium
VHGEPG

SEQ ID NO: 1030625 - protein, 6 aa, Mycobacterium
VHGSSR

SEQ ID NO: 1030626 - protein, 5 aa, Mycobacterium
VHNPT

SEQ ID NO: 1030627 - protein, 6 aa, Mycobacterium
VHPDAE

SEQ ID NO: 1030628 - protein, 5 aa, Mycobacterium
VHPED

SEQ ID NO: 1030629 - protein, 6 aa, Mycobacterium
VHPKAN

SEQ ID NO: 1030630 - protein, 16 aa, Mycobacterium
VHQGEGVATGKRDQRD

SEQ ID NO: 1030631 - protein, 8 aa, Mycobacterium
VHRGRRPA

SEQ ID NO: 1030632 - protein, 13 aa, Mycobacterium
VHSEGARLRSRRE

SEQ ID NO: 1030633 - protein, 12 aa, Mycobacterium
VHSETSIDAAGA

SEQ ID NO: 1030634 - protein, 4 aa, Mycobacterium
VHTG

SEQ ID NO: 1030635 - protein, 7 aa, Mycobacterium
VIDPSGA

SEQ ID NO: 1030636 - protein, 9 aa, Mycobacterium
VIGPDGAAT

SEQ ID NO: 1030637 - protein, 5 aa, Mycobacterium
VIGPN

SEQ ID NO: 1030638 - protein, 5 aa, Mycobacterium
VIGRD

SEQ ID NO: 1030639 - protein, 8 aa, Mycobacterium
VIGTPEAQ

SEQ ID NO: 1030640 - protein, 7 aa, Mycobacterium
VKAGELS

SEQ ID NO: 1030641 - protein, 15 aa, Mycobacterium
VKAGPGQDVDPDTEI

SEQ ID NO: 1030642 - protein, 32 aa, Mycobacterium
VKARSGDGKSAAKKSTAERAPAKKARAKQAAK

SEQ ID NO: 1030643 - protein, 8 aa, Mycobacterium
VKASARRA

SEQ ID NO: 1030644 - protein, 9 aa, Mycobacterium
VKATTDKPF

SEQ ID NO: 1030645 - protein, 5 aa, Mycobacterium
VKDAA

SEQ ID NO: 1030646 - protein, 7 aa, Mycobacterium
VKDGDDA

SEQ ID NO: 1030647 - protein, 6 aa, Mycobacterium
VKDGYG

SEQ ID NO: 1030648 - protein, 11 aa, Mycobacterium
VKEEAGDEATE

SEQ ID NO: 1030649 - protein, 9 aa, Mycobacterium
VKEGNSDQR

SEQ ID NO: 1030650 - protein, 7 aa, Mycobacterium
VKEPLQT

SEQ ID NO: 1030651 - protein, 20 aa, Mycobacterium
VKESLKSEDPETVLRQGSGE

SEQ ID NO: 1030652 - protein, 10 aa, Mycobacterium
VKGAAADADY

SEQ ID NO: 1030653 - protein, 9 aa, Mycobacterium
VKGDPSASV

SEQ ID NO: 1030654 - protein, 7 aa, Mycobacterium
VKGDPTE

SEQ ID NO: 1030655 - protein, 6 aa, Mycobacterium
VKGGRR

SEQ ID NO: 1030656 - protein, 11 aa, Mycobacterium
VKGKGNSGKQL

SEQ ID NO: 1030657 - protein, 8 aa, Mycobacterium
VKGPDFPT

SEQ ID NO: 1030658 - protein, 6 aa, Mycobacterium
VKGPGA

SEQ ID NO: 1030659 - protein, 17 aa, Mycobacterium
VKGRRPSWNAAAPRAVA

SEQ ID NO: 1030660 - protein, 11 aa, Mycobacterium
VKGVTEETTTG

SEQ ID NO: 1030661 - protein, 9 aa, Mycobacterium
VKKTYDPDS

SEQ ID NO: 1030662 - protein, 8 aa, Mycobacterium
VKNDGSPY

SEQ ID NO: 1030663 - protein, 13 aa, Mycobacterium
VKPGGNYDGQHFA

SEQ ID NO: 1030664 - protein, 7 aa, Mycobacterium
VKPGNGV

SEQ ID NO: 1030665 - protein, 6 aa, Mycobacterium
VKPHAS

SEQ ID NO: 1030666 - protein, 15 aa, Mycobacterium
VKPIARSTTQRKSQV

SEQ ID NO: 1030667 - protein, 8 aa, Mycobacterium
VKPPKPSK

SEQ ID NO: 1030668 - protein, 8 aa, Mycobacterium
VKPPSTFG

SEQ ID NO: 1030669 - protein, 9 aa, Mycobacterium
VKPTSVPAF

SEQ ID NO: 1030670 - protein, 6 aa, Mycobacterium
VKPTVA

SEQ ID NO: 1030671 - protein, 6 aa, Mycobacterium
VKQANL

SEQ ID NO: 1030672 - protein, 6 aa, Mycobacterium
VKQEEL

SEQ ID NO: 1030673 - protein, 5 aa, Mycobacterium
VKRAE

SEQ ID NO: 1030674 - protein, 5 aa, Mycobacterium
VKRPE

SEQ ID NO: 1030675 - protein, 13 aa, Mycobacterium
VKRPSCSGGWAPT

SEQ ID NO: 1030676 - protein, 4 aa, Mycobacterium
VKRR

SEQ ID NO: 1030677 - protein, 13 aa, Mycobacterium
VKSEAKTATAENI

SEQ ID NO: 1030678 - protein, 12 aa, Mycobacterium
VKSPADLDELAN

SEQ ID NO: 1030679 - protein, 4 aa, Mycobacterium
VKTD

SEQ ID NO: 1030680 - protein, 25 aa, Mycobacterium
VKTGGRGKAGGVKYAATPEEAYQQA

SEQ ID NO: 1030681 - protein, 9 aa, Mycobacterium
VKTTPQDAV

SEQ ID NO: 1030682 - protein, 16 aa, Mycobacterium
VKVGPKRSPLHTPERA

SEQ ID NO: 1030683 - protein, 5 aa, Mycobacterium
VLDGS

SEQ ID NO: 1030684 - protein, 5 aa, Mycobacterium
VLEPG

SEQ ID NO: 1030685 - protein, 15 aa, Mycobacterium
VLGTDGGLSGIADPS

SEQ ID NO: 1030686 - protein, 4 aa, Mycobacterium
VLPG

SEQ ID NO: 1030687 - protein, 12 aa, Mycobacterium
VLPGPSKRPVTQ

SEQ ID NO: 1030688 - protein, 13 aa, Mycobacterium
VLPSSTNPTRPHT

SEQ ID NO: 1030689 - protein, 12 aa, Mycobacterium
VLSGAGSKKVAK

SEQ ID NO: 1030690 - protein, 22 aa, Mycobacterium
VLSPGSGPEPQDISVPTEQVLV

SEQ ID NO: 1030691 - protein, 14 aa, Mycobacterium
VLTDPAKRKEYDET

SEQ ID NO: 1030692 - protein, 8 aa, Mycobacterium
VMGGTSQI

SEQ ID NO: 1030693 - protein, 8 aa, Mycobacterium
VNAAAAQN

SEQ ID NO: 1030694 - protein, 6 aa, Mycobacterium
VNAEQQ

SEQ ID NO: 1030695 - protein, 5 aa, Mycobacterium
VNAGD

SEQ ID NO: 1030696 - protein, 16 aa, Mycobacterium
VNAGERAAGKPLPGAR

SEQ ID NO: 1030697 - protein, 7 aa, Mycobacterium
VNAPAQA

SEQ ID NO: 1030698 - protein, 12 aa, Mycobacterium
VNARGGPGGRPG

SEQ ID NO: 1030699 - protein, 14 aa, Mycobacterium
VNASGALVTDAMAQ

SEQ ID NO: 1030700 - protein, 4 aa, Mycobacterium
VNAV

SEQ ID NO: 1030701 - protein, 5 aa, Mycobacterium
VNDPG

SEQ ID NO: 1030702 - protein, 4 aa, Mycobacterium
VNDR

SEQ ID NO: 1030703 - protein, 10 aa, Mycobacterium
VNDRGYPPSI

SEQ ID NO: 1030704 - protein, 11 aa, Mycobacterium
VNDTTKTRVSA

SEQ ID NO: 1030705 - protein, 17 aa, Mycobacterium
VNGGDDRNRAAAPDGLA

SEQ ID NO: 1030706 - protein, 5 aa, Mycobacterium
VNGGF

SEQ ID NO: 1030707 - protein, 9 aa, Mycobacterium
VNGGNRTVP

SEQ ID NO: 1030708 - protein, 7 aa, Mycobacterium
VNGGPSV

SEQ ID NO: 1030709 - protein, 16 aa, Mycobacterium
VNGGSVEDAKKRPEFG

SEQ ID NO: 1030710 - protein, 29 aa, Mycobacterium
VNGGTGGTGTTSGGSGGTGGGAGGQGGNS

SEQ ID NO: 1030711 - protein, 4 aa, Mycobacterium
VNGP

SEQ ID NO: 1030712 - protein, 6 aa, Mycobacterium
VNGPDS

SEQ ID NO: 1030713 - protein, 10 aa, Mycobacterium
VNGPTEASLG

SEQ ID NO: 1030714 - protein, 5 aa, Mycobacterium
VNGRS

SEQ ID NO: 1030715 - protein, 20 aa, Mycobacterium
VNGSDGADGNQGAPGTAGQD

SEQ ID NO: 1030716 - protein, 9 aa, Mycobacterium
VNGTPLGGV

SEQ ID NO: 1030717 - protein, 54 aa, Mycobacterium
VNKASRGGGGGGFGGGGGGGARQAPAQASSPAGGDDPWGSAPASGSFGGDDEPP

SEQ ID NO: 1030718 - protein, 6 aa, Mycobacterium
VNKPHA

SEQ ID NO: 1030719 - protein, 13 aa, Mycobacterium
VNMSQSSNDTFPT

SEQ ID NO: 1030720 - protein, 11 aa, Mycobacterium
VNNPQKYGLSA

SEQ ID NO: 1030721 - protein, 9 aa, Mycobacterium
VNPAETAAI

SEQ ID NO: 1030722 - protein, 7 aa, Mycobacterium
VNPAPTV

SEQ ID NO: 1030723 - protein, 9 aa, Mycobacterium
VNPATEETL

SEQ ID NO: 1030724 - protein, 4 aa, Mycobacterium
VNPD

SEQ ID NO: 1030725 - protein, 6 aa, Mycobacterium
VNPGTL

SEQ ID NO: 1030726 - protein, 6 aa, Mycobacterium
VNPNTV

SEQ ID NO: 1030727 - protein, 12 aa, Mycobacterium
VNPPEASAPGSL

SEQ ID NO: 1030728 - protein, 9 aa, Mycobacterium
VNPPLREAS

SEQ ID NO: 1030729 - protein, 9 aa, Mycobacterium
VNPSGQYGD

SEQ ID NO: 1030730 - protein, 8 aa, Mycobacterium
VNQRRSDL

SEQ ID NO: 1030731 - protein, 7 aa, Mycobacterium
VNQSSTA

SEQ ID NO: 1030732 - protein, 4 aa, Mycobacterium
VNQT

SEQ ID NO: 1030733 - protein, 5 aa, Mycobacterium
VNQVG

SEQ ID NO: 1030734 - protein, 5 aa, Mycobacterium
VNRAG

SEQ ID NO: 1030735 - protein, 6 aa, Mycobacterium
VNRDSG

SEQ ID NO: 1030736 - protein, 6 aa, Mycobacterium
VNRNQG

SEQ ID NO: 1030737 - protein, 12 aa, Mycobacterium
VNSASTSPRPRM

SEQ ID NO: 1030738 - protein, 9 aa, Mycobacterium
VNSDAPARG

SEQ ID NO: 1030739 - protein, 26 aa, Mycobacterium
VNSGGQAPAAPVPASRPASAPVSTPV

SEQ ID NO: 1030740 - protein, 17 aa, Mycobacterium
VNSNPARFDQKKADAIN

SEQ ID NO: 1030741 - protein, 7 aa, Mycobacterium
VNSPAEK

SEQ ID NO: 1030742 - protein, 9 aa, Mycobacterium
VNSPGTEIH

SEQ ID NO: 1030743 - protein, 4 aa, Mycobacterium
VNSQ

SEQ ID NO: 1030744 - protein, 8 aa, Mycobacterium
VNSQGYAN

SEQ ID NO: 1030745 - protein, 5 aa, Mycobacterium
VNSQS

SEQ ID NO: 1030746 - protein, 4 aa, Mycobacterium
VNSR

SEQ ID NO: 1030747 - protein, 11 aa, Mycobacterium
VNSSQGGGSKA

SEQ ID NO: 1030748 - protein, 4 aa, Mycobacterium
VNTA

SEQ ID NO: 1030749 - protein, 25 aa, Mycobacterium
VNTANRQGKRKRTRTGYGKRKSTKR

SEQ ID NO: 1030750 - protein, 6 aa, Mycobacterium
VNTGAQ

SEQ ID NO: 1030751 - protein, 10 aa, Mycobacterium
VNTGGVTRDD

SEQ ID NO: 1030752 - protein, 37 aa, Mycobacterium; identical to SEQ ID NO: 609430

SEQ ID NO: 1030753 - protein, 7 aa, Mycobacterium
VNTPPSH

SEQ ID NO: 1030754 - protein, 9 aa, Mycobacterium
VNVSGSGCS

SEQ ID NO: 1030755 - protein, 4 aa, Mycobacterium
VPAA

SEQ ID NO: 1030756 - protein, 8 aa, Mycobacterium
VPAAAQAS

SEQ ID NO: 1030757 - protein, 11 aa, Mycobacterium
VPAAKGNTRRL

SEQ ID NO: 1030758 - protein, 8 aa, Mycobacterium
VPAAPRAP

SEQ ID NO: 1030759 - protein, 9 aa, Mycobacterium
VPAASTRPV

SEQ ID NO: 1030760 - protein, 5 aa, Mycobacterium
VPADA

SEQ ID NO: 1030761 - protein, 8 aa, Mycobacterium
VPADANGL

SEQ ID NO: 1030762 - protein, 10 aa, Mycobacterium
VPADEERRVR

SEQ ID NO: 1030763 - protein, 13 aa, Mycobacterium
VPAERGIRPGRRG

SEQ ID NO: 1030764 - protein, 57 aa, Mycobacterium; identical to SEQ ID NO: 609495

SEQ ID NO: 1030765 - protein, 16 aa, Mycobacterium
VPAGARDLSTGNPAPE

SEQ ID NO: 1030766 - protein, 5 aa, Mycobacterium
VPAGD

SEQ ID NO: 1030767 - protein, 9 aa, Mycobacterium
VPAGEQSSL

SEQ ID NO: 1030768 - protein, 8 aa, Mycobacterium
VPAGGEDD

SEQ ID NO: 1030769 - protein, 6 aa, Mycobacterium
VPAGTT

SEQ ID NO: 1030770 - protein, 17 aa, Mycobacterium
VPAGVDPATVPKPLQPD

SEQ ID NO: 1030771 - protein, 6 aa, Mycobacterium
VPAGVG

SEQ ID NO: 1030772 - protein, 10 aa, Mycobacterium
VPAGVPAAGA

SEQ ID NO: 1030773 - protein, 9 aa, Mycobacterium
VPANASSAQ

SEQ ID NO: 1030774 - protein, 15 aa, Mycobacterium
VPANVSKEIIAKATG

SEQ ID NO: 1030775 - protein, 27 aa, Mycobacterium
VPAPAENATKITSREPAVAGDRPELTE

SEQ ID NO: 1030776 - protein, 6 aa, Mycobacterium
VPAPGA

SEQ ID NO: 1030777 - protein, 9 aa, Mycobacterium
VPAPGAPPL

SEQ ID NO: 1030778 - protein, 10 aa, Mycobacterium
VPAPGGLNPA

SEQ ID NO: 1030779 - protein, 9 aa, Mycobacterium
VPAPGGRRE

SEQ ID NO: 1030780 - protein, 15 aa, Mycobacterium
VPAPHEEGEEPGEET

SEQ ID NO: 1030781 - protein, 28 aa, Mycobacterium
VPAPPAPPAPPLENSNPALPPSPPIPPT

SEQ ID NO: 1030782 - protein, 5 aa, Mycobacterium
VPAPQ

SEQ ID NO: 1030783 - protein, 7 aa, Mycobacterium
VPAPRGH

SEQ ID NO: 1030784 - protein, 10 aa, Mycobacterium
VPAPSDDDPL

SEQ ID NO: 1030785 - protein, 5 aa, Mycobacterium
VPAPV

SEQ ID NO: 1030786 - protein, 15 aa, Mycobacterium
VPAQAVSGAGDGVAP

SEQ ID NO: 1030787 - protein, 16 aa, Mycobacterium
VPARNTPPSDQDAPIP

SEQ ID NO: 1030788 - protein, 6 aa, Mycobacterium
VPARPE

SEQ ID NO: 1030789 - protein, 8 aa, Mycobacterium
VPASRAAA

SEQ ID NO: 1030790 - protein, 10 aa, Mycobacterium
VPDAKLSTKA

SEQ ID NO: 1030791 - protein, 8 aa, Mycobacterium
VPDATTRV

SEQ ID NO: 1030792 - protein, 15 aa, Mycobacterium
VPDDQGGDVSQKVEP

SEQ ID NO: 1030793 - protein, 8 aa, Mycobacterium
VPDGASSV

SEQ ID NO: 1030794 - protein, 16 aa, Mycobacterium
VPDGGPVRLVKPRAPS

SEQ ID NO: 1030795 - protein, 9 aa, Mycobacterium
VPDPGGAAF

SEQ ID NO: 1030796 - protein, 21 aa, Mycobacterium
VPDPTPGKKPGAPGLFGRRRG

SEQ ID NO: 1030797 - protein, 6 aa, Mycobacterium
VPDRGR

SEQ ID NO: 1030798 - protein, 8 aa, Mycobacterium
VPDSAGES

SEQ ID NO: 1030799 - protein, 9 aa, Mycobacterium
VPDSDNTAY

SEQ ID NO: 1030800 - protein, 6 aa, Mycobacterium
VPDSGD

SEQ ID NO: 1030801 - protein, 8 aa, Mycobacterium
VPDSGLRG

SEQ ID NO: 1030802 - protein, 4 aa, Mycobacterium
VPDT

SEQ ID NO: 1030803 - protein, 6 aa, Mycobacterium
VPDTDP

SEQ ID NO: 1030804 - protein, 7 aa, Mycobacterium
VPDTPTL

SEQ ID NO: 1030805 - protein, 4 aa, Mycobacterium
VPEA

SEQ ID NO: 1030806 - protein, 7 aa, Mycobacterium
VPEDDRK

SEQ ID NO: 1030807 - protein, 5 aa, Mycobacterium
VPEDQ

SEQ ID NO: 1030808 - protein, 10 aa, Mycobacterium
VPEEAAPVSG

SEQ ID NO: 1030809 - protein, 6 aa, Mycobacterium
VPEGGV

SEQ ID NO: 1030810 - protein, 5 aa, Mycobacterium
VPEGQ

SEQ ID NO: 1030811 - protein, 6 aa, Mycobacterium
VPEGTR

SEQ ID NO: 1030812 - protein, 8 aa, Mycobacterium
VPEKGGRF

SEQ ID NO: 1030813 - protein, 7 aa, Mycobacterium
VPEQRRG

SEQ ID NO: 1030814 - protein, 4 aa, Mycobacterium
VPER

SEQ ID NO: 1030815 - protein, 7 aa, Mycobacterium
VPESADQ

SEQ ID NO: 1030816 - protein, 5 aa, Mycobacterium
VPESL

SEQ ID NO: 1030817 - protein, 21 aa, Mycobacterium
VPFPTGPRPDVTRADDHDYAA

SEQ ID NO: 1030818 - protein, 6 aa, Mycobacterium
VPGAAR

SEQ ID NO: 1030819 - protein, 5 aa, Mycobacterium
VPGAE

SEQ ID NO: 1030820 - protein, 6 aa, Mycobacterium
VPGAGD

SEQ ID NO: 1030821 - protein, 7 aa, Mycobacterium
VPGAPGL

SEQ ID NO: 1030822 - protein, 7 aa, Mycobacterium
VPGAPNP

SEQ ID NO: 1030823 - protein, 4 aa, Mycobacterium
VPGC

SEQ ID NO: 1030824 - protein, 10 aa, Mycobacterium
VPGDRARHRA

SEQ ID NO: 1030825 - protein, 8 aa, Mycobacterium
VPGDRSTE

SEQ ID NO: 1030826 - protein, 13 aa, Mycobacterium
VPGFTPPSAAGHA

SEQ ID NO: 1030827 - protein, 4 aa, Mycobacterium
VPGG

SEQ ID NO: 1030828 - protein, 7 aa, Mycobacterium
VPGGAQP

SEQ ID NO: 1030829 - protein, 7 aa, Mycobacterium
VPGGDIK

SEQ ID NO: 1030830 - protein, 5 aa, Mycobacterium
VPGGF

SEQ ID NO: 1030831 - protein, 7 aa, Mycobacterium
VPGGLSA

SEQ ID NO: 1030832 - protein, 7 aa, Mycobacterium
VPGGPSS

SEQ ID NO: 1030833 - protein, 12 aa, Mycobacterium
VPGGSGGGSAAA

SEQ ID NO: 1030834 - protein, 6 aa, Mycobacterium
VPGGVS

SEQ ID NO: 1030835 - protein, 4 aa, Mycobacterium
VPGH

SEQ ID NO: 1030836 - protein, 21 aa, Mycobacterium
VPGHDDGGAQPLPVDSTPAAL

SEQ ID NO: 1030837 - protein, 17 aa, Mycobacterium
VPGIQGRVTDSAEGAKT

SEQ ID NO: 1030838 - protein, 19 aa, Mycobacterium
VPGKEDEEVVRKPSTDEPF

SEQ ID NO: 1030839 - protein, 8 aa, Mycobacterium
VPGLGEHR

SEQ ID NO: 1030840 - protein, 7 aa, Mycobacterium
VPGPGSE

SEQ ID NO: 1030841 - protein, 20 aa, Mycobacterium
VPGPPSNRTGSKEHEHTVKS

SEQ ID NO: 1030842 - protein, 6 aa, Mycobacterium
VPGPQS

SEQ ID NO: 1030843 - protein, 13 aa, Mycobacterium
VPGPRDDKYTQGV

SEQ ID NO: 1030844 - protein, 7 aa, Mycobacterium
VPGPRTP

SEQ ID NO: 1030845 - protein, 5 aa, Mycobacterium
VPGPS

SEQ ID NO: 1030846 - protein, 22 aa, Mycobacterium
VPGQAGGAGTTIPADTAGTTRA

SEQ ID NO: 1030847 - protein, 8 aa, Mycobacterium
VPGQRDHS

SEQ ID NO: 1030848 - protein, 4 aa, Mycobacterium
VPGR

SEQ ID NO: 1030849 - protein, 20 aa, Mycobacterium
VPGRGRPQFPGRPRVDPRGC

SEQ ID NO: 1030850 - protein, 7 aa, Mycobacterium
VPGRGTQ

SEQ ID NO: 1030851 - protein, 5 aa, Mycobacterium
VPGRQ

SEQ ID NO: 1030852 - protein, 8 aa, Mycobacterium
VPGRRGGT

SEQ ID NO: 1030853 - protein, 7 aa, Mycobacterium
VPGRTGG

SEQ ID NO: 1030854 - protein, 4 aa, Mycobacterium
VPGS

SEQ ID NO: 1030855 - protein, 7 aa, Mycobacterium
VPGSDQW

SEQ ID NO: 1030856 - protein, 9 aa, Mycobacterium
VPGSGTMDR

SEQ ID NO: 1030857 - protein, 12 aa, Mycobacterium
VPGSNGQTGEIV

SEQ ID NO: 1030858 - protein, 7 aa, Mycobacterium
VPGSNSA

SEQ ID NO: 1030859 - protein, 9 aa, Mycobacterium
VPGSYRPTL

SEQ ID NO: 1030860 - protein, 4 aa, Mycobacterium
VPGV

SEQ ID NO: 1030861 - protein, 10 aa, Mycobacterium
VPGVGKSTTI

SEQ ID NO: 1030862 - protein, 4 aa, Mycobacterium
VPHG

SEQ ID NO: 1030863 - protein, 8 aa, Mycobacterium
VPHGESGK

SEQ ID NO: 1030864 - protein, 13 aa, Mycobacterium
VPHTAQSSQAERV

SEQ ID NO: 1030865 - protein, 12 aa, Mycobacterium
VPITSTDQLTPL

SEQ ID NO: 1030866 - protein, 7 aa, Mycobacterium
VPKEPVD

SEQ ID NO: 1030867 - protein, 4 aa, Mycobacterium
VPKH

SEQ ID NO: 1030868 - protein, 8 aa, Mycobacterium
VPKRREEV

SEQ ID NO: 1030869 - protein, 21 aa, Mycobacterium
VPKTSTPAGPRVSIQFRPRGV

SEQ ID NO: 1030870 - protein, 8 aa, Mycobacterium
VPLPDPDM

SEQ ID NO: 1030871 - protein, 6 aa, Mycobacterium
VPLPTE

SEQ ID NO: 1030872 - protein, 13 aa, Mycobacterium
VPNDEFAGSAEAS

SEQ ID NO: 1030873 - protein, 8 aa, Mycobacterium
VPNDGKGA

SEQ ID NO: 1030874 - protein, 9 aa, Mycobacterium
VPNDRERGQ

SEQ ID NO: 1030875 - protein, 20 aa, Mycobacterium
VPNPHATAEQVAAARKDSKL

SEQ ID NO: 1030876 - protein, 13 aa, Mycobacterium
VPNQGRRGEPGPA

SEQ ID NO: 1030877 - protein, 12 aa, Mycobacterium
VPNRPSEVPPAT

SEQ ID NO: 1030878 - protein, 9 aa, Mycobacterium
VPNTGGRAG

SEQ ID NO: 1030879 - protein, 8 aa, Mycobacterium
VPNTKKLP

SEQ ID NO: 1030880 - protein, 18 aa, Mycobacterium
VPNTSGLANTKDMTVSPD

SEQ ID NO: 1030881 - protein, 4 aa, Mycobacterium
VPPA

SEQ ID NO: 1030882 - protein, 8 aa, Mycobacterium
VPPAADQV

SEQ ID NO: 1030883 - protein, 10 aa, Mycobacterium
VPPAADQVSK

SEQ ID NO: 1030884 - protein, 8 aa, Mycobacterium
VPPADTDQ

SEQ ID NO: 1030885 - protein, 17 aa, Mycobacterium
VPPAKLPPGDYRQISGN

SEQ ID NO: 1030886 - protein, 11 aa, Mycobacterium
VPPAPPSPPLP

SEQ ID NO: 1030887 - protein, 11 aa, Mycobacterium
VPPEDPDSYYS

SEQ ID NO: 1030888 - protein, 11 aa, Mycobacterium
VPPEGVDIGAG

SEQ ID NO: 1030889 - protein, 33 aa, Mycobacterium
VPPEPPEPTAPALPPTPPKPPSPPAPAASLPSS

SEQ ID NO: 1030890 - protein, 7 aa, Mycobacterium
VPPERQW

SEQ ID NO: 1030891 - protein, 23 aa, Mycobacterium
VPPGDTPGGTPPAGADSSAAKVA

SEQ ID NO: 1030892 - protein, 8 aa, Mycobacterium
VPPGTYRP

SEQ ID NO: 1030893 - protein, 5 aa, Mycobacterium
VPPIA

SEQ ID NO: 1030894 - protein, 5 aa, Mycobacterium
VPPIN

SEQ ID NO: 1030895 - protein, 4 aa, Mycobacterium
VPPN

SEQ ID NO: 1030896 - protein, 21 aa, Mycobacterium
VPPNAPEGRPHSTRDRWPDTQ

SEQ ID NO: 1030897 - protein, 12 aa, Mycobacterium
VPPPDGVGAAFS

SEQ ID NO: 1030898 - protein, 9 aa, Mycobacterium
VPPPGGSLS

SEQ ID NO: 1030899 - protein, 12 aa, Mycobacterium
VPPPPEPRPGRS

SEQ ID NO: 1030900 - protein, 13 aa, Mycobacterium
VPPPQGDADAPTR

SEQ ID NO: 1030901 - protein, 5 aa, Mycobacterium
VPPPR

SEQ ID NO: 1030902 - protein, 14 aa, Mycobacterium
VPPRNQGQAGRNFG

SEQ ID NO: 1030903 - protein, 8 aa, Mycobacterium
VPPSDDPV

SEQ ID NO: 1030904 - protein, 6 aa, Mycobacterium
VPPSVP

SEQ ID NO: 1030905 - protein, 9 aa, Mycobacterium
VPPSWPGSG

SEQ ID NO: 1030906 - protein, 23 aa, Mycobacterium
VPPSWTGAAPLASPLGSALGGTP

SEQ ID NO: 1030907 - protein, 6 aa, Mycobacterium
VPPTDS

SEQ ID NO: 1030908 - protein, 6 aa, Mycobacterium
VPPVNA

SEQ ID NO: 1030909 - protein, 5 aa, Mycobacterium
VPPYN

SEQ ID NO: 1030910 - protein, 13 aa, Mycobacterium
VPPYPPGTWAAFG

SEQ ID NO: 1030911 - protein, 4 aa, Mycobacterium
VPQA

SEQ ID NO: 1030912 - protein, 5 aa, Mycobacterium
VPQGG

SEQ ID NO: 1030913 - protein, 13 aa, Mycobacterium
VPQGGASDERATS

SEQ ID NO: 1030914 - protein, 5 aa, Mycobacterium
VPQGL

SEQ ID NO: 1030915 - protein, 8 aa, Mycobacterium
VPQGTADG

SEQ ID NO: 1030916 - protein, 8 aa, Mycobacterium
VPQPDASV

SEQ ID NO: 1030917 - protein, 8 aa, Mycobacterium
VPQPKSDH

SEQ ID NO: 1030918 - protein, 26 aa, Mycobacterium
VPQPPSVRPCQPGPAIGPNPGGPPYG

SEQ ID NO: 1030919 - protein, 8 aa, Mycobacterium
VPQQGHSV

SEQ ID NO: 1030920 - protein, 11 aa, Mycobacterium
VPQRKGDPLQF

SEQ ID NO: 1030921 - protein, 11 aa, Mycobacterium
VPQTEALATTG

SEQ ID NO: 1030922 - protein, 10 aa, Mycobacterium
VPQTQPSTQL

SEQ ID NO: 1030923 - protein, 11 aa, Mycobacterium
VPREESRQRFN

SEQ ID NO: 1030924 - protein, 13 aa, Mycobacterium
VPREGEQGHQRQK

SEQ ID NO: 1030925 - protein, 9 aa, Mycobacterium
VPRERTAEL

SEQ ID NO: 1030926 - protein, 4 aa, Mycobacterium
VPRG

SEQ ID NO: 1030927 - protein, 5 aa, Mycobacterium
VPRPE

SEQ ID NO: 1030928 - protein, 8 aa, Mycobacterium
VPRPRPDH

SEQ ID NO: 1030929 - protein, 15 aa, Mycobacterium
VPRRSEPRTSVPAGS

SEQ ID NO: 1030930 - protein, 17 aa, Mycobacterium
VPRTSVGKYDKKTIRAG

SEQ ID NO: 1030931 - protein, 11 aa, Mycobacterium
VPSAARDRRGF

SEQ ID NO: 1030932 - protein, 5 aa, Mycobacterium
VPSAD

SEQ ID NO: 1030933 - protein, 4 aa, Mycobacterium
VPSD

SEQ ID NO: 1030934 - protein, 8 aa, Mycobacterium
VPSDAPDA

SEQ ID NO: 1030935 - protein, 6 aa, Mycobacterium
VPSGTS

SEQ ID NO: 1030936 - protein, 9 aa, Mycobacterium
VPSRSDDEL

SEQ ID NO: 1030937 - protein, 6 aa, Mycobacterium
VPSRYG

SEQ ID NO: 1030938 - protein, 16 aa, Mycobacterium
VPSSTCVNNPTSARLQ

SEQ ID NO: 1030939 - protein, 4 aa, Mycobacterium
VPST

SEQ ID NO: 1030940 - protein, 7 aa, Mycobacterium
VPTDDAG

SEQ ID NO: 1030941 - protein, 11 aa, Mycobacterium
VPTDDSSLGAL

SEQ ID NO: 1030942 - protein, 7 aa, Mycobacterium
VPTDGED

SEQ ID NO: 1030943 - protein, 4 aa, Mycobacterium
VPTG

SEQ ID NO: 1030944 - protein, 18 aa, Mycobacterium
VPTGEEEELQSSESKVGP

SEQ ID NO: 1030945 - protein, 12 aa, Mycobacterium
VPTGHPGTAVPA

SEQ ID NO: 1030946 - protein, 5 aa, Mycobacterium
VPTGV

SEQ ID NO: 1030947 - protein, 6 aa, Mycobacterium
VPTIET

SEQ ID NO: 1030948 - protein, 5 aa, Mycobacterium
VPTNF

SEQ ID NO: 1030949 - protein, 6 aa, Mycobacterium
VPTPAR

SEQ ID NO: 1030950 - protein, 7 aa, Mycobacterium
VPTPESY

SEQ ID NO: 1030951 - protein, 6 aa, Mycobacterium
VPTPND

SEQ ID NO: 1030952 - protein, 6 aa, Mycobacterium
VPTPVN

SEQ ID NO: 1030953 - protein, 6 aa, Mycobacterium
VPTQAK

SEQ ID NO: 1030954 - protein, 5 aa, Mycobacterium
VPTRG

SEQ ID NO: 1030955 - protein, 4 aa, Mycobacterium
VPTS

SEQ ID NO: 1030956 - protein, 6 aa, Mycobacterium
VPTTTA

SEQ ID NO: 1030957 - protein, 8 aa, Mycobacterium
VPTVPRSP

SEQ ID NO: 1030958 - protein, 6 aa, Mycobacterium
VPVAPE

SEQ ID NO: 1030959 - protein, 12 aa, Mycobacterium
VPVGNEEGEITG

SEQ ID NO: 1030960 - protein, 10 aa, Mycobacterium
VPVPGDTGGA

SEQ ID NO: 1030961 - protein, 12 aa, Mycobacterium
VPWTTDADGGEA

SEQ ID NO: 1030962 - protein, 18 aa, Mycobacterium
VQAEETAARARTAAAAYE

SEQ ID NO: 1030963 - protein, 13 aa, Mycobacterium
VQAERAAKQAEAA

SEQ ID NO: 1030964 - protein, 20 aa, Mycobacterium
VQCRSDTGLTVDGKPLKEPY

SEQ ID NO: 1030965 - protein, 7 aa, Mycobacterium
VQDEGSQ

SEQ ID NO: 1030966 - protein, 5 aa, Mycobacterium
VQDEP

SEQ ID NO: 1030967 - protein, 5 aa, Mycobacterium
VQDGK

SEQ ID NO: 1030968 - protein, 10 aa, Mycobacterium
VQDPQTGRTL

SEQ ID NO: 1030969 - protein, 7 aa, Mycobacterium
VQDRNGP

SEQ ID NO: 1030970 - protein, 13 aa, Mycobacterium
VQEAAATAARAGV

SEQ ID NO: 1030971 - protein, 18 aa, Mycobacterium
VQEGAKKVAGPGAAGEQQ

SEQ ID NO: 1030972 - protein, 19 aa, Mycobacterium
VQGGRPEALGGLGGAAPQQ

SEQ ID NO: 1030973 - protein, 7 aa, Mycobacterium
VQGGRTS

SEQ ID NO: 1030974 - protein, 14 aa, Mycobacterium
VQGPETEHLLAMAG

SEQ ID NO: 1030975 - protein, 7 aa, Mycobacterium
VQKPEAY

SEQ ID NO: 1030976 - protein, 7 aa, Mycobacterium
VQNASSA

SEQ ID NO: 1030977 - protein, 14 aa, Mycobacterium
VQNPLKGCRRAGRY

SEQ ID NO: 1030978 - protein, 6 aa, Mycobacterium
VQNQPG

SEQ ID NO: 1030979 - protein, 16 aa, Mycobacterium
VQPAADTRQPVPSRLQ

SEQ ID NO: 1030980 - protein, 12 aa, Mycobacterium
VQPAEPENFDPE

SEQ ID NO: 1030981 - protein, 10 aa, Mycobacterium
VQPEGDPDQW

SEQ ID NO: 1030982 - protein, 5 aa, Mycobacterium
VQPEL

SEQ ID NO: 1030983 - protein, 10 aa, Mycobacterium
VQPGSRTPGL

SEQ ID NO: 1030984 - protein, 10 aa, Mycobacterium
VQPHSGAQAN

SEQ ID NO: 1030985 - protein, 13 aa, Mycobacterium
VQPHSGATANASS

SEQ ID NO: 1030986 - protein, 10 aa, Mycobacterium
VQPNSAEPEG

SEQ ID NO: 1030987 - protein, 8 aa, Mycobacterium
VQPPADAI

SEQ ID NO: 1030988 - protein, 7 aa, Mycobacterium
VQPPGKK

SEQ ID NO: 1030989 - protein, 4 aa, Mycobacterium
VQPR

SEQ ID NO: 1030990 - protein, 10 aa, Mycobacterium
VQPRVSTDEP

SEQ ID NO: 1030991 - protein, 8 aa, Mycobacterium
VQPTASAR

SEQ ID NO: 1030992 - protein, 7 aa, Mycobacterium
VQPTSDS

SEQ ID NO: 1030993 - protein, 18 aa, Mycobacterium
VQQRDTGAPQYEISDPQP

SEQ ID NO: 1030994 - protein, 4 aa, Mycobacterium
VQRD

SEQ ID NO: 1030995 - protein, 6 aa, Mycobacterium
VQRGAD

SEQ ID NO: 1030996 - protein, 7 aa, Mycobacterium
VQRPDGS

SEQ ID NO: 1030997 - protein, 8 aa, Mycobacterium
VQRQSSAM

SEQ ID NO: 1030998 - protein, 12 aa, Mycobacterium
VQRSSSGKIAGL

SEQ ID NO: 1030999 - protein, 21 aa, Mycobacterium
VQSPGGQPSPETDPKVPSGPG

SEQ ID NO: 1031000 - protein, 4 aa, Mycobacterium
VQSR

SEQ ID NO: 1031001 - protein, 8 aa, Mycobacterium
VQTATTDI

SEQ ID NO: 1031002 - protein, 5 aa, Mycobacterium
VQTES

SEQ ID NO: 1031003 - protein, 11 aa, Mycobacterium
VQTGQSPAGSF

SEQ ID NO: 1031004 - protein, 13 aa, Mycobacterium
VQTGTGNGDDDLA

SEQ ID NO: 1031005 - protein, 23 aa, Mycobacterium
VQTPARNLPPLDERDNPMHYCPE

SEQ ID NO: 1031006 - protein, 7 aa, Mycobacterium
VQTTPDA

SEQ ID NO: 1031007 - protein, 10 aa, Mycobacterium
VQVPPDPAIP

SEQ ID NO: 1031008 - protein, 8 aa, Mycobacterium
VRAAEELG

SEQ ID NO: 1031009 - protein, 9 aa, Mycobacterium
VRADDDPLP

SEQ ID NO: 1031010 - protein, 26 aa, Mycobacterium
VRAESAATVDNSAAAAATADSAARVA

SEQ ID NO: 1031011 - protein, 5 aa, Mycobacterium
VRAGD

SEQ ID NO: 1031012 - protein, 8 aa, Mycobacterium
VRAGEAAL

SEQ ID NO: 1031013 - protein, 10 aa, Mycobacterium
VRANPDARVS

SEQ ID NO: 1031014 - protein, 8 aa, Mycobacterium
VRAPDGHT

SEQ ID NO: 1031015 - protein, 5 aa, Mycobacterium
VRAQS

SEQ ID NO: 1031016 - protein, 4 aa, Mycobacterium
VRAR

SEQ ID NO: 1031017 - protein, 6 aa, Mycobacterium
VRASQP

SEQ ID NO: 1031018 - protein, 6 aa, Mycobacterium
VRATSD

SEQ ID NO: 1031019 - protein, 7 aa, Mycobacterium
VRDADQV

SEQ ID NO: 1031020 - protein, 19 aa, Mycobacterium
VRDAGLESAGRHGTGGGLP

SEQ ID NO: 1031021 - protein, 10 aa, Mycobacterium
VRDDGSTARN

SEQ ID NO: 1031022 - protein, 4 aa, Mycobacterium
VRDE

SEQ ID NO: 1031023 - protein, 9 aa, Mycobacterium
VRDEAEIRG

SEQ ID NO: 1031024 - protein, 5 aa, Mycobacterium
VRDED

SEQ ID NO: 1031025 - protein, 20 aa, Mycobacterium
VRDGADEVAGADRRAAGGWA

SEQ ID NO: 1031026 - protein, 7 aa, Mycobacterium
VRDGAGD

SEQ ID NO: 1031027 - protein, 5 aa, Mycobacterium
VRDGD

SEQ ID NO: 1031028 - protein, 7 aa, Mycobacterium
VRDGEDS

SEQ ID NO: 1031029 - protein, 8 aa, Mycobacterium
VRDTKSSY

SEQ ID NO: 1031030 - protein, 10 aa, Mycobacterium
VREAENSDDV

SEQ ID NO: 1031031 - protein, 12 aa, Mycobacterium
VREAGAASRAQT

SEQ ID NO: 1031032 - protein, 4 aa, Mycobacterium
VRED

SEQ ID NO: 1031033 - protein, 7 aa, Mycobacterium
VREQDVG

SEQ ID NO: 1031034 - protein, 7 aa, Mycobacterium
VREQNGD

SEQ ID NO: 1031035 - protein, 5 aa, Mycobacterium
VRERS

SEQ ID NO: 1031036 - protein, 4 aa, Mycobacterium
VRGA

SEQ ID NO: 1031037 - protein, 7 aa, Mycobacterium
VRGATGL

SEQ ID NO: 1031038 - protein, 14 aa, Mycobacterium
VRGDGGVLKNSDDD

SEQ ID NO: 1031039 - protein, 6 aa, Mycobacterium
VRGDGH

SEQ ID NO: 1031040 - protein, 7 aa, Mycobacterium
VRGEGGR

SEQ ID NO: 1031041 - protein, 5 aa, Mycobacterium
VRGEP

SEQ ID NO: 1031042 - protein, 9 aa, Mycobacterium
VRGGADAST

SEQ ID NO: 1031043 - protein, 7 aa, Mycobacterium
VRGNSTR

SEQ ID NO: 1031044 - protein, 12 aa, Mycobacterium
VRGPDGAHTPAH

SEQ ID NO: 1031045 - protein, 7 aa, Mycobacterium
VRGPDSG

SEQ ID NO: 1031046 - protein, 10 aa, Mycobacterium
VRGPSGTRLK

SEQ ID NO: 1031047 - protein, 8 aa, Mycobacterium
VRGTSYNQ

SEQ ID NO: 1031048 - protein, 10 aa, Mycobacterium
VRKAGRQTKG

SEQ ID NO: 1031049 - protein, 6 aa, Mycobacterium
VRKGDK

SEQ ID NO: 1031050 - protein, 5 aa, Mycobacterium
VRKTG

SEQ ID NO: 1031051 - protein, 8 aa, Mycobacterium
VRNDGGRV

SEQ ID NO: 1031052 - protein, 9 aa, Mycobacterium
VRNGDRAAL

SEQ ID NO: 1031053 - protein, 16 aa, Mycobacterium
VRNSPVGTGLNAATGV

SEQ ID NO: 1031054 - protein, 7 aa, Mycobacterium
VRPAATA

SEQ ID NO: 1031055 - protein, 9 aa, Mycobacterium
VRPARGRSV

SEQ ID NO: 1031056 - protein, 9 aa, Mycobacterium
VRPASSNSI

SEQ ID NO: 1031057 - protein, 7 aa, Mycobacterium
VRPATPV

SEQ ID NO: 1031058 - protein, 8 aa, Mycobacterium
VRPDDGEF

SEQ ID NO: 1031059 - protein, 7 aa, Mycobacterium
VRPDLDG

SEQ ID NO: 1031060 - protein, 14 aa, Mycobacterium
VRPEDEQVARDGVA

SEQ ID NO: 1031061 - protein, 5 aa, Mycobacterium
VRPEE

SEQ ID NO: 1031062 - protein, 9 aa, Mycobacterium
VRPENAASR

SEQ ID NO: 1031063 - protein, 5 aa, Mycobacterium
VRPGD

SEQ ID NO: 1031064 - protein, 7 aa, Mycobacterium
VRPGVTA

SEQ ID NO: 1031065 - protein, 14 aa, Mycobacterium
VRPHEPAYDPEPDA

SEQ ID NO: 1031066 - protein, 5 aa, Mycobacterium
VRPNT

SEQ ID NO: 1031067 - protein, 12 aa, Mycobacterium
VRPPAPPAPPVP

SEQ ID NO: 1031068 - protein, 7 aa, Mycobacterium
VRPPGQG

SEQ ID NO: 1031069 - protein, 10 aa, Mycobacterium
VRPPTPGRRL

SEQ ID NO: 1031070 - protein, 7 aa, Mycobacterium
VRPRSQP

SEQ ID NO: 1031071 - protein, 8 aa, Mycobacterium
VRPRTERQ

SEQ ID NO: 1031072 - protein, 8 aa, Mycobacterium
VRQGPGGC

SEQ ID NO: 1031073 - protein, 8 aa, Mycobacterium
VRQGRHQV

SEQ ID NO: 1031074 - protein, 8 aa, Mycobacterium
VRQGTAEE

SEQ ID NO: 1031075 - protein, 8 aa, Mycobacterium
VRQRSRTT

SEQ ID NO: 1031076 - protein, 5 aa, Mycobacterium
VRRAE

SEQ ID NO: 1031077 - protein, 12 aa, Mycobacterium
VRRGAPSANARW

SEQ ID NO: 1031078 - protein, 13 aa, Mycobacterium
VRRGESSAEAFGE

SEQ ID NO: 1031079 - protein, 23 aa, Mycobacterium
VRRGSGDIATEDALTDDQTAAAI

SEQ ID NO: 1031080 - protein, 7 aa, Mycobacterium
VRRPRGP

SEQ ID NO: 1031081 - protein, 5 aa, Mycobacterium
VRRRG

SEQ ID NO: 1031082 - protein, 19 aa, Mycobacterium
VRRSGEPQSITPSFVLPMS

SEQ ID NO: 1031083 - protein, 4 aa, Mycobacterium
VRSA

SEQ ID NO: 1031084 - protein, 23 aa, Mycobacterium
VRSAEPDAKVYRTGDRVRQRADG

SEQ ID NO: 1031085 - protein, 10 aa, Mycobacterium
VRSDGSGTLV

SEQ ID NO: 1031086 - protein, 7 aa, Mycobacterium
VRSDRAG

SEQ ID NO: 1031087 - protein, 18 aa, Mycobacterium
VRSDSSGLKVGGHQASSA

SEQ ID NO: 1031088 - protein, 4 aa, Mycobacterium
VRSE

SEQ ID NO: 1031089 - protein, 4 aa, Mycobacterium
VRSG

SEQ ID NO: 1031090 - protein, 7 aa, Mycobacterium
VRSGAGT

SEQ ID NO: 1031091 - protein, 7 aa, Mycobacterium
VRSGTDQ

SEQ ID NO: 1031092 - protein, 11 aa, Mycobacterium
VRSMSAQAGGI

SEQ ID NO: 1031093 - protein, 9 aa, Mycobacterium
VRSPDSACN

SEQ ID NO: 1031094 - protein, 7 aa, Mycobacterium
VRSSEPV

SEQ ID NO: 1031095 - protein, 9 aa, Mycobacterium
VRSTDRTGV

SEQ ID NO: 1031096 - protein, 20 aa, Mycobacterium
VRSTNRAGGLEGGMTNGQPL

SEQ ID NO: 1031097 - protein, 11 aa, Mycobacterium
VRSTSSSPVSY

SEQ ID NO: 1031098 - protein, 20 aa, Mycobacterium
VRTAPPQTPHPPEPHPQIPT

SEQ ID NO: 1031099 - protein, 8 aa, Mycobacterium
VRTASSEI

SEQ ID NO: 1031100 - protein, 7 aa, Mycobacterium
VRTATAG

SEQ ID NO: 1031101 - protein, 11 aa, Mycobacterium
VRTDPDVPKHA

SEQ ID NO: 1031102 - protein, 9 aa, Mycobacterium
VRTEAAASG

SEQ ID NO: 1031103 - protein, 11 aa, Mycobacterium
VRTGDERLSQC

SEQ ID NO: 1031104 - protein, 12 aa, Mycobacterium
VRTGIGSRDKHL

SEQ ID NO: 1031105 - protein, 20 aa, Mycobacterium
VRTHGPAVNAPGDVDPGTAH

SEQ ID NO: 1031106 - protein, 7 aa, Mycobacterium
VRTPTTT

SEQ ID NO: 1031107 - protein, 7 aa, Mycobacterium
VRTTGVG

SEQ ID NO: 1031108 - protein, 9 aa, Mycobacterium
VSAAATDLA

SEQ ID NO: 1031109 - protein, 6 aa, Mycobacterium
VSAAQA

SEQ ID NO: 1031110 - protein, 8 aa, Mycobacterium
VSAASAAI

SEQ ID NO: 1031111 - protein, 13 aa, Mycobacterium
VSADRDETGPHST

SEQ ID NO: 1031112 - protein, 7 aa, Mycobacterium
VSAEAAA

SEQ ID NO: 1031113 - protein, 9 aa, Mycobacterium
VSAEGTRDL

SEQ ID NO: 1031114 - protein, 12 aa, Mycobacterium
VSAEIRGDDVTR

SEQ ID NO: 1031115 - protein, 4 aa, Mycobacterium
VSAG

SEQ ID NO: 1031116 - protein, 8 aa, Mycobacterium
VSAGEGVS

SEQ ID NO: 1031117 - protein, 8 aa, Mycobacterium
VSAGNRPI

SEQ ID NO: 1031118 - protein, 10 aa, Mycobacterium
VSAGPGTRAN

SEQ ID NO: 1031119 - protein, 11 aa, Mycobacterium
VSANGEQAGDD

SEQ ID NO: 1031120 - protein, 4 aa, Mycobacterium
VSAP

SEQ ID NO: 1031121 - protein, 14 aa, Mycobacterium
VSAPDGEPAHPDPA

SEQ ID NO: 1031122 - protein, 8 aa, Mycobacterium
VSAPGDGR

SEQ ID NO: 1031123 - protein, 7 aa, Mycobacterium
VSAPRDA

SEQ ID NO: 1031124 - protein, 6 aa, Mycobacterium
VSARRE

SEQ ID NO: 1031125 - protein, 8 aa, Mycobacterium
VSATANRR

SEQ ID NO: 1031126 - protein, 17 aa, Mycobacterium
VSATTTDGLGLTGRGEG

SEQ ID NO: 1031127 - protein, 10 aa, Mycobacterium
VSAYPPDATA

SEQ ID NO: 1031128 - protein, 4 aa, Mycobacterium
VSDA

SEQ ID NO: 1031129 - protein, 5 aa, Mycobacterium
VSDDE

SEQ ID NO: 1031130 - protein, 8 aa, Mycobacterium
VSDEGPVA

SEQ ID NO: 1031131 - protein, 14 aa, Mycobacterium
VSDGNGYPPPAYPP

SEQ ID NO: 1031132 - protein, 10 aa, Mycobacterium
VSDGSNAPAI

SEQ ID NO: 1031133 - protein, 13 aa, Mycobacterium
VSDLSEDSDDLAR

SEQ ID NO: 1031134 - protein, 7 aa, Mycobacterium
VSDPEQM

SEQ ID NO: 1031135 - protein, 10 aa, Mycobacterium
VSDPGGPVTA

SEQ ID NO: 1031136 - protein, 7 aa, Mycobacterium
VSDPQLR

SEQ ID NO: 1031137 - protein, 10 aa, Mycobacterium
VSDPTGPTRA

SEQ ID NO: 1031138 - protein, 11 aa, Mycobacterium
VSDQDPGATAS

SEQ ID NO: 1031139 - protein, 5 aa, Mycobacterium
VSDRA

SEQ ID NO: 1031140 - protein, 6 aa, Mycobacterium
VSDSAS

SEQ ID NO: 1031141 - protein, 7 aa, Mycobacterium
VSDSQTI

SEQ ID NO: 1031142 - protein, 9 aa, Mycobacterium
VSDTTEAAR

SEQ ID NO: 1031143 - protein, 11 aa, Mycobacterium
VSEAGASVYSA

SEQ ID NO: 1031144 - protein, 6 aa, Mycobacterium
VSEDKR

SEQ ID NO: 1031145 - protein, 4 aa, Mycobacterium
VSEE

SEQ ID NO: 1031146 - protein, 7 aa, Mycobacterium
VSEESDD

SEQ ID NO: 1031147 - protein, 17 aa, Mycobacterium
VSEGTNQNLHNFDAPST

SEQ ID NO: 1031148 - protein, 6 aa, Mycobacterium
VSELPD

SEQ ID NO: 1031149 - protein, 8 aa, Mycobacterium
VSEPERSS

SEQ ID NO: 1031150 - protein, 4 aa, Mycobacterium
VSEQ

SEQ ID NO: 1031151 - protein, 4 aa, Mycobacterium
VSES

SEQ ID NO: 1031152 - protein, 10 aa, Mycobacterium
VSESGGAAGE

SEQ ID NO: 1031153 - protein, 6 aa, Mycobacterium
VSESTL

SEQ ID NO: 1031154 - protein, 16 aa, Mycobacterium
VSETAAPAEPADLPGR

SEQ ID NO: 1031155 - protein, 9 aa, Mycobacterium
VSETETRTQ

SEQ ID NO: 1031156 - protein, 9 aa, Mycobacterium
VSETTEHGY

SEQ ID NO: 1031157 - protein, 15 aa, Mycobacterium
VSEYQSKKSAYETGL

SEQ ID NO: 1031158 - protein, 4 aa, Mycobacterium
VSGA

SEQ ID NO: 1031159 - protein, 9 aa, Mycobacterium
VSGAADHLE

SEQ ID NO: 1031160 - protein, 8 aa, Mycobacterium
VSGAGPDR

SEQ ID NO: 1031161 - protein, 4 aa, Mycobacterium
VSGD

SEQ ID NO: 1031162 - protein, 5 aa, Mycobacterium
VSGDG

SEQ ID NO: 1031163 - protein, 10 aa, Mycobacterium
VSGDGSLQAR

SEQ ID NO: 1031164 - protein, 6 aa, Mycobacterium
VSGDLG

SEQ ID NO: 1031165 - protein, 5 aa, Mycobacterium
VSGEL

SEQ ID NO: 1031166 - protein, 8 aa, Mycobacterium
VSGERQGY

SEQ ID NO: 1031167 - protein, 8 aa, Mycobacterium
VSGGAPLD

SEQ ID NO: 1031168 - protein, 8 aa, Mycobacterium
VSGGAPLG

SEQ ID NO: 1031169 - protein, 10 aa, Mycobacterium
VSGGGRPESL

SEQ ID NO: 1031170 - protein, 7 aa, Mycobacterium
VSGGHVG

SEQ ID NO: 1031171 - protein, 9 aa, Mycobacterium
VSGGPQRNI

SEQ ID NO: 1031172 - protein, 9 aa, Mycobacterium
VSGGSPHAI

SEQ ID NO: 1031173 - protein, 5 aa, Mycobacterium
VSGGT

SEQ ID NO: 1031174 - protein, 57 aa, Mycobacterium
VSGGTGGDGGDGGDGGDAREIGNGGNGGNAGAGATAGNEGTGGTGGQLIGVSGTDGS

SEQ ID NO: 1031175 - protein, 11 aa, Mycobacterium
VSGGVGGTGGN

SEQ ID NO: 1031176 - protein, 8 aa, Mycobacterium
VSGGYTRD

SEQ ID NO: 1031177 - protein, 6 aa, Mycobacterium
VSGIAN

SEQ ID NO: 1031178 - protein, 11 aa, Mycobacterium
VSGKGSAARRR

SEQ ID NO: 1031179 - protein, 7 aa, Mycobacterium
VSGPDED

SEQ ID NO: 1031180 - protein, 21 aa, Mycobacterium
VSGPGDGIPARYEEAERADYN

SEQ ID NO: 1031181 - protein, 8 aa, Mycobacterium
VSGPGTDQ

SEQ ID NO: 1031182 - protein, 4 aa, Mycobacterium
VSGQ

SEQ ID NO: 1031183 - protein, 5 aa, Mycobacterium
VSGQG

SEQ ID NO: 1031184 - protein, 4 aa, Mycobacterium
VSGR

SEQ ID NO: 1031185 - protein, 6 aa, Mycobacterium
VSGREP

SEQ ID NO: 1031186 - protein, 7 aa, Mycobacterium
VSGRYTG

SEQ ID NO: 1031187 - protein, 5 aa, Mycobacterium
VSGSD

SEQ ID NO: 1031188 - protein, 16 aa, Mycobacterium
VSGSGESSCPASRSGY

SEQ ID NO: 1031189 - protein, 11 aa, Mycobacterium
VSGSGGPRLPT

SEQ ID NO: 1031190 - protein, 10 aa, Mycobacterium
VSGSHEPSDV

SEQ ID NO: 1031191 - protein, 6 aa, Mycobacterium
VSGTPV

SEQ ID NO: 1031192 - protein, 6 aa, Mycobacterium
VSHGPS

SEQ ID NO: 1031193 - protein, 8 aa, Mycobacterium
VSIDGQTH

SEQ ID NO: 1031194 - protein, 10 aa, Mycobacterium
VSIGGSGGYY

SEQ ID NO: 1031195 - protein, 14 aa, Mycobacterium
VSINSGGEKIYPEE

SEQ ID NO: 1031196 - protein, 4 aa, Mycobacterium
VSKA

SEQ ID NO: 1031197 - protein, 9 aa, Mycobacterium
VSKDDMQQH

SEQ ID NO: 1031198 - protein, 6 aa, Mycobacterium
VSKVSE

SEQ ID NO: 1031199 - protein, 5 aa, Mycobacterium
VSLPE

SEQ ID NO: 1031200 - protein, 6 aa, Mycobacterium
VSNAGG

SEQ ID NO: 1031201 - protein, 5 aa, Mycobacterium
VSNDI

SEQ ID NO: 1031202 - protein, 21 aa, Mycobacterium
VSNGAERRDQVGQSIPEPANR

SEQ ID NO: 1031203 - protein, 9 aa, Mycobacterium
VSNKPKADP

SEQ ID NO: 1031204 - protein, 10 aa, Mycobacterium
VSNPDKVGRD

SEQ ID NO: 1031205 - protein, 17 aa, Mycobacterium
VSNPGAPVAPNLGPEPL

SEQ ID NO: 1031206 - protein, 30 aa, Mycobacterium
VSPAAQRGGPGSAASAETEIDDPADQLAGN

SEQ ID NO: 1031207 - protein, 10 aa, Mycobacterium
VSPAATYRST

SEQ ID NO: 1031208 - protein, 5 aa, Mycobacterium
VSPAE

SEQ ID NO: 1031209 - protein, 7 aa, Mycobacterium
VSPARAA

SEQ ID NO: 1031210 - protein, 17 aa, Mycobacterium
VSPDALADTRQSGGGED

SEQ ID NO: 1031211 - protein, 4 aa, Mycobacterium
VSPE

SEQ ID NO: 1031212 - protein, 6 aa, Mycobacterium
VSPEAL

SEQ ID NO: 1031213 - protein, 5 aa, Mycobacterium
VSPED

SEQ ID NO: 1031214 - protein, 8 aa, Mycobacterium
VSPEKRTR

SEQ ID NO: 1031215 - protein, 17 aa, Mycobacterium
VSPEQAAPGLRETRVPG

SEQ ID NO: 1031216 - protein, 9 aa, Mycobacterium
VSPETTITG

SEQ ID NO: 1031217 - protein, 9 aa, Mycobacterium
VSPGATYRS

SEQ ID NO: 1031218 - protein, 9 aa, Mycobacterium
VSPGNDGRG

SEQ ID NO: 1031219 - protein, 6 aa, Mycobacterium
VSPNPD

SEQ ID NO: 1031220 - protein, 6 aa, Mycobacterium
VSPPFK

SEQ ID NO: 1031221 - protein, 10 aa, Mycobacterium
VSPPTASTKD

SEQ ID NO: 1031222 - protein, 8 aa, Mycobacterium
VSPQNAQA

SEQ ID NO: 1031223 - protein, 12 aa, Mycobacterium
VSPSEATSGPLA

SEQ ID NO: 1031224 - protein, 11 aa, Mycobacterium
VSPSQDAEIER

SEQ ID NO: 1031225 - protein, 13 aa, Mycobacterium
VSPSSVTENPQLR

SEQ ID NO: 1031226 - protein, 19 aa, Mycobacterium
VSPSTAVSAKAASGGDTGI

SEQ ID NO: 1031227 - protein, 148 aa, Mycobacterium
VSPTAGYQGGQGGMGGKGGVGGAGGTGGQGGANTGATGGMGADGGKGGTGGAAGAGGMGTDGGAAGANGTGGVGDTGGAGETGIAGTDDQVSPTAGHQGGQGGMGGKGGDGGAGIGGVGGGAGGKGGVGGAGGTGGQGGGPGGTGGIA

SEQ ID NO: 1031228 - protein, 22 aa, Mycobacterium
VSQATTAAKDKGDGMKSPSRQA

SEQ ID NO: 1031229 - protein, 5 aa, Mycobacterium
VSQED

SEQ ID NO: 1031230 - protein, 7 aa, Mycobacterium
VSQPEQV

SEQ ID NO: 1031231 - protein, 12 aa, Mycobacterium
VSQQFEKTAQDP

SEQ ID NO: 1031232 - protein, 12 aa, Mycobacterium
VSRAAGAGGAVP

SEQ ID NO: 1031233 - protein, 11 aa, Mycobacterium
VSRASTPAGRE

SEQ ID NO: 1031234 - protein, 9 aa, Mycobacterium
VSREKPDSV

SEQ ID NO: 1031235 - protein, 4 aa, Mycobacterium
VSRG

SEQ ID NO: 1031236 - protein, 7 aa, Mycobacterium
VSRNDDG

SEQ ID NO: 1031237 - protein, 4 aa, Mycobacterium
VSRP

SEQ ID NO: 1031238 - protein, 22 aa, Mycobacterium
VSRPASVPSGRALPATLTAPGR

SEQ ID NO: 1031239 - protein, 5 aa, Mycobacterium
VSRQS

SEQ ID NO: 1031240 - protein, 4 aa, Mycobacterium
VSRR

SEQ ID NO: 1031241 - protein, 7 aa, Mycobacterium
VSRSGEV

SEQ ID NO: 1031242 - protein, 5 aa, Mycobacterium
VSRTQ

SEQ ID NO: 1031243 - protein, 10 aa, Mycobacterium
VSRTSGASLS

SEQ ID NO: 1031244 - protein, 24 aa, Mycobacterium
VSRTSKTARSGGRPAARGRPGGSG

SEQ ID NO: 1031245 - protein, 11 aa, Mycobacterium
VSSAAAALPGG

SEQ ID NO: 1031246 - protein, 8 aa, Mycobacterium
VSSAKAQA

SEQ ID NO: 1031247 - protein, 8 aa, Mycobacterium
VSSAPTTA

SEQ ID NO: 1031248 - protein, 10 aa, Mycobacterium
VSSAQARLAA

SEQ ID NO: 1031249 - protein, 9 aa, Mycobacterium
VSSATGTTI

SEQ ID NO: 1031250 - protein, 11 aa, Mycobacterium
VSSDAAPEEIK

SEQ ID NO: 1031251 - protein, 4 aa, Mycobacterium
VSSG

SEQ ID NO: 1031252 - protein, 31 aa, Mycobacterium
VSSGATVAGSTPTAHAAAAPSGPSSAGPVAA

SEQ ID NO: 1031253 - protein, 5 aa, Mycobacterium
VSSGI

SEQ ID NO: 1031254 - protein, 5 aa, Mycobacterium
VSSGV

SEQ ID NO: 1031255 - protein, 7 aa, Mycobacterium
VSSNPEA

SEQ ID NO: 1031256 - protein, 7 aa, Mycobacterium
VSSPGLA

SEQ ID NO: 1031257 - protein, 7 aa, Mycobacterium
VSSPPEV

SEQ ID NO: 1031258 - protein, 9 aa, Mycobacterium
VSSPQRSYE

SEQ ID NO: 1031259 - protein, 4 aa, Mycobacterium
VSSR

SEQ ID NO: 1031260 - protein, 5 aa, Mycobacterium
VSSRD

SEQ ID NO: 1031261 - protein, 9 aa, Mycobacterium
VSSRTPAGL

SEQ ID NO: 1031262 - protein, 4 aa, Mycobacterium
VSSS

SEQ ID NO: 1031263 - protein, 10 aa, Mycobacterium
VSSSGPSRAY

SEQ ID NO: 1031264 - protein, 11 aa, Mycobacterium
VSSTDPTEGYR

SEQ ID NO: 1031265 - protein, 7 aa, Mycobacterium
VSSTEGA

SEQ ID NO: 1031266 - protein, 11 aa, Mycobacterium
VSTAAAASTTN

SEQ ID NO: 1031267 - protein, 15 aa, Mycobacterium
VSTACDDAGATEPPE

SEQ ID NO: 1031268 - protein, 14 aa, Mycobacterium
VSTAKRRSPGSLPG

SEQ ID NO: 1031269 - protein, 14 aa, Mycobacterium
VSTDPHATGPERLE

SEQ ID NO: 1031270 - protein, 10 aa, Mycobacterium
VSTEPVPTGD

SEQ ID NO: 1031271 - protein, 6 aa, Mycobacterium
VSTGGE

SEQ ID NO: 1031272 - protein, 5 aa, Mycobacterium
VSTGQ

SEQ ID NO: 1031273 - protein, 17 aa, Mycobacterium
VSTGSPEDSSDPDDPDH

SEQ ID NO: 1031274 - protein, 9 aa, Mycobacterium
VSTKAARTH

SEQ ID NO: 1031275 - protein, 13 aa, Mycobacterium
VSTKHKEEQPFPY

SEQ ID NO: 1031276 - protein, 12 aa, Mycobacterium
VSTKHKEEQRFP

SEQ ID NO: 1031277 - protein, 7 aa, Mycobacterium
VSTKPGI

SEQ ID NO: 1031278 - protein, 12 aa, Mycobacterium
VSTKQQEPYGDF

SEQ ID NO: 1031279 - protein, 17 aa, Mycobacterium
VSTPEKAKLSRDAGATE

SEQ ID NO: 1031280 - protein, 7 aa, Mycobacterium
VSTPGPV

SEQ ID NO: 1031281 - protein, 7 aa, Mycobacterium
VSTSEAR

SEQ ID NO: 1031282 - protein, 28 aa, Mycobacterium
VSTSPPNSSAIRPLPNSSTVPPCSRWRR

SEQ ID NO: 1031283 - protein, 4 aa, Mycobacterium
VSTT

SEQ ID NO: 1031284 - protein, 8 aa, Mycobacterium
VSTTEPGV

SEQ ID NO: 1031285 - protein, 21 aa, Mycobacterium
VSTTTGPGIPVDPSVTRNFTE

SEQ ID NO: 1031286 - protein, 13 aa, Mycobacterium
VSVDASGLGLSAG

SEQ ID NO: 1031287 - protein, 12 aa, Mycobacterium
VSVEGQAKPLPD

SEQ ID NO: 1031288 - protein, 7 aa, Mycobacterium
VSVPDRD

SEQ ID NO: 1031289 - protein, 6 aa, Mycobacterium
VSVPEQ

SEQ ID NO: 1031290 - protein, 9 aa, Mycobacterium
VSYAGTETA

SEQ ID NO: 1031291 - protein, 6 aa, Mycobacterium
VSYEAG

SEQ ID NO: 1031292 - protein, 4 aa, Mycobacterium
VTAA

SEQ ID NO: 1031293 - protein, 18 aa, Mycobacterium
VTAAETQAEQVERRRTTY

SEQ ID NO: 1031294 - protein, 10 aa, Mycobacterium
VTADEKAAMA

SEQ ID NO: 1031295 - protein, 8 aa, Mycobacterium
VTAEPEYV

SEQ ID NO: 1031296 - protein, 8 aa, Mycobacterium
VTAEPGSQ

SEQ ID NO: 1031297 - protein, 7 aa, Mycobacterium
VTAPEAA

SEQ ID NO: 1031298 - protein, 6 aa, Mycobacterium
VTAPEL

SEQ ID NO: 1031299 - protein, 11 aa, Mycobacterium
VTAPPPSDSSV

SEQ ID NO: 1031300 - protein, 6 aa, Mycobacterium
VTAPVA

SEQ ID NO: 1031301 - protein, 7 aa, Mycobacterium
VTASGED

SEQ ID NO: 1031302 - protein, 5 aa, Mycobacterium
VTASL

SEQ ID NO: 1031303 - protein, 5 aa, Mycobacterium
VTASR

SEQ ID NO: 1031304 - protein, 10 aa, Mycobacterium
VTASRPEWPS

SEQ ID NO: 1031305 - protein, 5 aa, Mycobacterium
VTATT

SEQ ID NO: 1031306 - protein, 19 aa, Mycobacterium
VTATTEAAKLSNARPISLL

SEQ ID NO: 1031307 - protein, 7 aa, Mycobacterium
VTAVDGT

SEQ ID NO: 1031308 - protein, 9 aa, Mycobacterium
VTDAPDGTR

SEQ ID NO: 1031309 - protein, 4 aa, Mycobacterium
VTDD

SEQ ID NO: 1031310 - protein, 7 aa, Mycobacterium
VTDDERA

SEQ ID NO: 1031311 - protein, 6 aa, Mycobacterium
VTDEAA

SEQ ID NO: 1031312 - protein, 18 aa, Mycobacterium
VTDGTATPDTKVAPAYRS

SEQ ID NO: 1031313 - protein, 7 aa, Mycobacterium
VTDPGAK

SEQ ID NO: 1031314 - protein, 7 aa, Mycobacterium
VTDPNSF

SEQ ID NO: 1031315 - protein, 11 aa, Mycobacterium
VTDPNTGRSSA

SEQ ID NO: 1031316 - protein, 4 aa, Mycobacterium
VTDQ

SEQ ID NO: 1031317 - protein, 9 aa, Mycobacterium
VTDQGISSK

SEQ ID NO: 1031318 - protein, 8 aa, Mycobacterium
VTDRSQDT

SEQ ID NO: 1031319 - protein, 7 aa, Mycobacterium
VTDTRPG

SEQ ID NO: 1031320 - protein, 7 aa, Mycobacterium
VTDTTTS

SEQ ID NO: 1031321 - protein, 11 aa, Mycobacterium
VTEEQQGEHDQ

SEQ ID NO: 1031322 - protein, 6 aa, Mycobacterium
VTEETA

SEQ ID NO: 1031323 - protein, 15 aa, Mycobacterium
VTEEYPEKPGPVAPR

SEQ ID NO: 1031324 - protein, 5 aa, Mycobacterium
VTEGD

SEQ ID NO: 1031325 - protein, 8 aa, Mycobacterium
VTEGGSDN

SEQ ID NO: 1031326 - protein, 20 aa, Mycobacterium
VTEPGGAGGNGGAGGTGGVG

SEQ ID NO: 1031327 - protein, 7 aa, Mycobacterium
VTEPPQG

SEQ ID NO: 1031328 - protein, 4 aa, Mycobacterium
VTEQ

SEQ ID NO: 1031329 - protein, 16 aa, Mycobacterium
VTEQTGTGTPGHTVCT

SEQ ID NO: 1031330 - protein, 11 aa, Mycobacterium
VTESQGRVHTS

SEQ ID NO: 1031331 - protein, 8 aa, Mycobacterium
VTETLGRS

SEQ ID NO: 1031332 - protein, 9 aa, Mycobacterium
VTETLGRSQ

SEQ ID NO: 1031333 - protein, 4 aa, Mycobacterium
VTGA

SEQ ID NO: 1031334 - protein, 5 aa, Mycobacterium
VTGAK

SEQ ID NO: 1031335 - protein, 7 aa, Mycobacterium
VTGDGQP

SEQ ID NO: 1031336 - protein, 6 aa, Mycobacterium
VTGDPA

SEQ ID NO: 1031337 - protein, 24 aa, Mycobacterium
VTGDTAKVTATATVENEDEPDTQT

SEQ ID NO: 1031338 - protein, 6 aa, Mycobacterium
VTGEDV

SEQ ID NO: 1031339 - protein, 7 aa, Mycobacterium
VTGEEYQ

SEQ ID NO: 1031340 - protein, 8 aa, Mycobacterium
VTGERSGR

SEQ ID NO: 1031341 - protein, 10 aa, Mycobacterium
VTGGNGGDSG

SEQ ID NO: 1031342 - protein, 5 aa, Mycobacterium
VTGGS

SEQ ID NO: 1031343 - protein, 12 aa, Mycobacterium
VTGKSPGKDGEN

SEQ ID NO: 1031344 - protein, 4 aa, Mycobacterium
VTGL

SEQ ID NO: 1031345 - protein, 7 aa, Mycobacterium
VTGPDEY

SEQ ID NO: 1031346 - protein, 7 aa, Mycobacterium
VTGPSAS

SEQ ID NO: 1031347 - protein, 8 aa, Mycobacterium
VTGQGEDL

SEQ ID NO: 1031348 - protein, 7 aa, Mycobacterium
VTGQSPF

SEQ ID NO: 1031349 - protein, 7 aa, Mycobacterium
VTGRGAG

SEQ ID NO: 1031350 - protein, 10 aa, Mycobacterium
VTGSGAPTAS

SEQ ID NO: 1031351 - protein, 7 aa, Mycobacterium
VTGSGER

SEQ ID NO: 1031352 - protein, 10 aa, Mycobacterium
VTGSGGIRGP

SEQ ID NO: 1031353 - protein, 19 aa, Mycobacterium
VTGSGRVGIGPSGDEPGFQ

SEQ ID NO: 1031354 - protein, 14 aa, Mycobacterium
VTGTDELAVALPVP

SEQ ID NO: 1031355 - protein, 9 aa, Mycobacterium
VTGTDGEDQ

SEQ ID NO: 1031356 - protein, 6 aa, Mycobacterium
VTGTGQ

SEQ ID NO: 1031357 - protein, 12 aa, Mycobacterium
VTHRDDETSTTT

SEQ ID NO: 1031358 - protein, 7 aa, Mycobacterium
VTKDPEL

SEQ ID NO: 1031359 - protein, 4 aa, Mycobacterium
VTKG

SEQ ID NO: 1031360 - protein, 7 aa, Mycobacterium
VTKPHPP

SEQ ID NO: 1031361 - protein, 10 aa, Mycobacterium
VTKRGGGAAL

SEQ ID NO: 1031362 - protein, 6 aa, Mycobacterium
VTKSGL

SEQ ID NO: 1031363 - protein, 5 aa, Mycobacterium
VTLTD

SEQ ID NO: 1031364 - protein, 17 aa, Mycobacterium
VTNPGYRPGDTATALPA

SEQ ID NO: 1031365 - protein, 6 aa, Mycobacterium
VTNPTS

SEQ ID NO: 1031366 - protein, 19 aa, Mycobacterium
VTNPVATASALRKDRPEPV

SEQ ID NO: 1031367 - protein, 5 aa, Mycobacterium
VTNRP

SEQ ID NO: 1031368 - protein, 7 aa, Mycobacterium
VTNRSQV

SEQ ID NO: 1031369 - protein, 16 aa, Mycobacterium
VTNSDTDPDALDAEAE

SEQ ID NO: 1031370 - protein, 10 aa, Mycobacterium
VTNVDPKSRD

SEQ ID NO: 1031371 - protein, 6 aa, Mycobacterium
VTPADT

SEQ ID NO: 1031372 - protein, 5 aa, Mycobacterium
VTPAE

SEQ ID NO: 1031373 - protein, 4 aa, Mycobacterium
VTPE

SEQ ID NO: 1031374 - protein, 5 aa, Mycobacterium
VTPEA

SEQ ID NO: 1031375 - protein, 6 aa, Mycobacterium
VTPELE

SEQ ID NO: 1031376 - protein, 11 aa, Mycobacterium
VTPEPDETTIR

SEQ ID NO: 1031377 - protein, 4 aa, Mycobacterium
VTPG

SEQ ID NO: 1031378 - protein, 12 aa, Mycobacterium
VTPKGETELTPE

SEQ ID NO: 1031379 - protein, 14 aa, Mycobacterium
VTPPSWRPDLQQPA

SEQ ID NO: 1031380 - protein, 5 aa, Mycobacterium
VTPQE

SEQ ID NO: 1031381 - protein, 10 aa, Mycobacterium
VTPQRAASGY

SEQ ID NO: 1031382 - protein, 10 aa, Mycobacterium
VTPRDSQEKA

SEQ ID NO: 1031383 - protein, 13 aa, Mycobacterium
VTPSALSAPAGDF

SEQ ID NO: 1031384 - protein, 34 aa, Mycobacterium
VTPSASDRNPRAKALTPSVRSTQASQRSGPSGVP

SEQ ID NO: 1031385 - protein, 5 aa, Mycobacterium
VTPSG

SEQ ID NO: 1031386 - protein, 6 aa, Mycobacterium
VTPSGE

SEQ ID NO: 1031387 - protein, 6 aa, Mycobacterium
VTPSPA

SEQ ID NO: 1031388 - protein, 8 aa, Mycobacterium
VTPTGDTA

SEQ ID NO: 1031389 - protein, 15 aa, Mycobacterium
VTPVPPAPSEPPGAN

SEQ ID NO: 1031390 - protein, 5 aa, Mycobacterium
VTPYT

SEQ ID NO: 1031391 - protein, 14 aa, Mycobacterium
VTQRQQWSGRPGEV

SEQ ID NO: 1031392 - protein, 19 aa, Mycobacterium
VTRADGGKSGIGKGYGGAR

SEQ ID NO: 1031393 - protein, 5 aa, Mycobacterium
VTRDD

SEQ ID NO: 1031394 - protein, 17 aa, Mycobacterium
VTRGAARPAVAPGPTRT

SEQ ID NO: 1031395 - protein, 17 aa, Mycobacterium
VTRGGKAAGSVSKKTSY

SEQ ID NO: 1031396 - protein, 8 aa, Mycobacterium
VTRPATDR

SEQ ID NO: 1031397 - protein, 8 aa, Mycobacterium
VTRPGQYE

SEQ ID NO: 1031398 - protein, 8 aa, Mycobacterium
VTRPGTER

SEQ ID NO: 1031399 - protein, 7 aa, Mycobacterium
VTRSPTD

SEQ ID NO: 1031400 - protein, 4 aa, Mycobacterium
VTSA

SEQ ID NO: 1031401 - protein, 5 aa, Mycobacterium
VTSAA

SEQ ID NO: 1031402 - protein, 9 aa, Mycobacterium
VTSADGSAA

SEQ ID NO: 1031403 - protein, 10 aa, Mycobacterium
VTSALSNSHG

SEQ ID NO: 1031404 - protein, 10 aa, Mycobacterium
VTSDGETHRA

SEQ ID NO: 1031405 - protein, 11 aa, Mycobacterium
VTSDQPLDTTT

SEQ ID NO: 1031406 - protein, 6 aa, Mycobacterium
VTSDTA

SEQ ID NO: 1031407 - protein, 6 aa, Mycobacterium
VTSDTV

SEQ ID NO: 1031408 - protein, 6 aa, Mycobacterium
VTSGAG

SEQ ID NO: 1031409 - protein, 7 aa, Mycobacterium
VTSGASV

SEQ ID NO: 1031410 - protein, 14 aa, Mycobacterium
VTSNSWKNTGNGNA

SEQ ID NO: 1031411 - protein, 4 aa, Mycobacterium
VTSP

SEQ ID NO: 1031412 - protein, 22 aa, Mycobacterium
VTSPGLEVSGDESVLQTLAGVL

SEQ ID NO: 1031413 - protein, 7 aa, Mycobacterium
VTSPGRL

SEQ ID NO: 1031414 - protein, 9 aa, Mycobacterium
VTSPRGKRQ

SEQ ID NO: 1031415 - protein, 12 aa, Mycobacterium
VTSPYPAPEGGH

SEQ ID NO: 1031416 - protein, 8 aa, Mycobacterium
VTSQPPAD

SEQ ID NO: 1031417 - protein, 5 aa, Mycobacterium
VTSRT

SEQ ID NO: 1031418 - protein, 10 aa, Mycobacterium
VTSTSGPGIS

SEQ ID NO: 1031419 - protein, 5 aa, Mycobacterium
VTTAD

SEQ ID NO: 1031420 - protein, 6 aa, Mycobacterium
VTTAER

SEQ ID NO: 1031421 - protein, 7 aa, Mycobacterium
VTTAKTI

SEQ ID NO: 1031422 - protein, 10 aa, Mycobacterium
VTTDEARERA

SEQ ID NO: 1031423 - protein, 20 aa, Mycobacterium
VTTDHISPAGAIKPGTPAAQ

SEQ ID NO: 1031424 - protein, 13 aa, Mycobacterium
VTTESGDAAGAAL

SEQ ID NO: 1031425 - protein, 7 aa, Mycobacterium
VTTGQAD

SEQ ID NO: 1031426 - protein, 7 aa, Mycobacterium
VTTHPNS

SEQ ID NO: 1031427 - protein, 7 aa, Mycobacterium
VTTKDGN

SEQ ID NO: 1031428 - protein, 4 aa, Mycobacterium
VTTL

SEQ ID NO: 1031429 - protein, 7 aa, Mycobacterium
VTTPART

SEQ ID NO: 1031430 - protein, 10 aa, Mycobacterium
VTTPEEPKDV

SEQ ID NO: 1031431 - protein, 7 aa, Mycobacterium
VTTPTEL

SEQ ID NO: 1031432 - protein, 10 aa, Mycobacterium
VTTRAEQHRA

SEQ ID NO: 1031433 - protein, 7 aa, Mycobacterium
VTTSGDR

SEQ ID NO: 1031434 - protein, 10 aa, Mycobacterium
VTTSGKQRSR

SEQ ID NO: 1031435 - protein, 31 aa, Mycobacterium
VTTSIGDANGSNGGSGADGGSGVTGGTGGVG

SEQ ID NO: 1031436 - protein, 8 aa, Mycobacterium
VTTSLGGT

SEQ ID NO: 1031437 - protein, 20 aa, Mycobacterium
VTTSTPGTTITDQSRIATGP

SEQ ID NO: 1031438 - protein, 9 aa, Mycobacterium
VTTTPPVEG

SEQ ID NO: 1031439 - protein, 7 aa, Mycobacterium
VTTVDSG

SEQ ID NO: 1031440 - protein, 8 aa, Mycobacterium
VTVGPSGR

SEQ ID NO: 1031441 - protein, 6 aa, Mycobacterium
VTYSGS

SEQ ID NO: 1031442 - protein, 6 aa, Mycobacterium
VTYSSS

SEQ ID NO: 1031443 - protein, 8 aa, Mycobacterium
VVAPDSPH

SEQ ID NO: 1031444 - protein, 7 aa, Mycobacterium
VVDRSGE

SEQ ID NO: 1031445 - protein, 29 aa, Mycobacterium
VVEDGELRTADTETLATDAKNAAVTLRER

SEQ ID NO: 1031446 - protein, 5 aa, Mycobacterium
VVEPG

SEQ ID NO: 1031447 - protein, 15 aa, Mycobacterium
VVERDGKVSLCGLDE

SEQ ID NO: 1031448 - protein, 12 aa, Mycobacterium
VVGETADAAGAA

SEQ ID NO: 1031449 - protein, 5 aa, Mycobacterium
VVNPR

SEQ ID NO: 1031450 - protein, 12 aa, Mycobacterium
VVPPAEEDDSAE

SEQ ID NO: 1031451 - protein, 10 aa, Mycobacterium
VVPPKPNTSA

SEQ ID NO: 1031452 - protein, 8 aa, Mycobacterium
VVPRGTAG

SEQ ID NO: 1031453 - protein, 13 aa, Mycobacterium
VVPSTADTSSQLT

SEQ ID NO: 1031454 - protein, 16 aa, Mycobacterium
VVQGPQEGIAADTAHA

SEQ ID NO: 1031455 - protein, 7 aa, Mycobacterium
VVQGTSG

SEQ ID NO: 1031456 - protein, 12 aa, Mycobacterium
VVQPRSGFDTHP

SEQ ID NO: 1031457 - protein, 6 aa, Mycobacterium
VVSERA

SEQ ID NO: 1031458 - protein, 7 aa, Mycobacterium
VVTSEGV

SEQ ID NO: 1031459 - protein, 11 aa, Mycobacterium
VYGGDPQRAAD

SEQ ID NO: 1031460 - protein, 4 aa, Mycobacterium
VYGN

SEQ ID NO: 1031461 - protein, 5 aa, Mycobacterium
VYGPD

SEQ ID NO: 1031462 - protein, 6 aa, Mycobacterium
VYQGNA

SEQ ID NO: 1031463 - protein, 24 aa, Mycobacterium
VYRGDEATKAQATDASPNDPAPTV

SEQ ID NO: 1031464 - protein, 10 aa, Mycobacterium
VYTGPGSEPL

SEQ ID NO: 1031465 - protein, 5 aa, Mycobacterium
VYTPG

SEQ ID NO: 1031466 - protein, 6 aa, Mycobacterium
WAGPAS

SEQ ID NO: 1031467 - protein, 16 aa, Mycobacterium
WAGPDPANPADPNYST

SEQ ID NO: 1031468 - protein, 5 aa, Mycobacterium
WAGPP

SEQ ID NO: 1031469 - protein, 6 aa, Mycobacterium
WAGTSG

SEQ ID NO: 1031470 - protein, 7 aa, Mycobacterium
WAPGPST

SEQ ID NO: 1031471 - protein, 9 aa, Mycobacterium
WAPHGGESR

SEQ ID NO: 1031472 - protein, 9 aa, Mycobacterium
WAPSPQTPA

SEQ ID NO: 1031473 - protein, 11 aa, Mycobacterium
WAQAGKPKPHL

SEQ ID NO: 1031474 - protein, 7 aa, Mycobacterium
WASTERN

SEQ ID NO: 1031475 - protein, 5 aa, Mycobacterium
WATKQ

SEQ ID NO: 1031476 - protein, 8 aa, Mycobacterium
WDDGGQAD

SEQ ID NO: 1031477 - protein, 8 aa, Mycobacterium
WDDPQGVP

SEQ ID NO: 1031478 - protein, 8 aa, Mycobacterium
WDEGPDVE

SEQ ID NO: 1031479 - protein, 4 aa, Mycobacterium
WDEN

SEQ ID NO: 1031480 - protein, 10 aa, Mycobacterium
WDGEGAGEDA

SEQ ID NO: 1031481 - protein, 7 aa, Mycobacterium
WDGTDER

SEQ ID NO: 1031482 - protein, 4 aa, Mycobacterium
WDLS

SEQ ID NO: 1031483 - protein, 9 aa, Mycobacterium
WDNGKPIRE

SEQ ID NO: 1031484 - protein, 10 aa, Mycobacterium
WDPHDPDPEL

SEQ ID NO: 1031485 - protein, 9 aa, Mycobacterium
WDPKAQRPE

SEQ ID NO: 1031486 - protein, 6 aa, Mycobacterium
WDPTTS

SEQ ID NO: 1031487 - protein, 9 aa, Mycobacterium
WDSGDQAFN

SEQ ID NO: 1031488 - protein, 16 aa, Mycobacterium
WDSGGAQTQIDPGRQR

SEQ ID NO: 1031489 - protein, 9 aa, Mycobacterium
WDSQGRDSH

SEQ ID NO: 1031490 - protein, 5 aa, Mycobacterium
WEAGG

SEQ ID NO: 1031491 - protein, 9 aa, Mycobacterium
WEGPSAQSY

SEQ ID NO: 1031492 - protein, 7 aa, Mycobacterium
WENGGLS

SEQ ID NO: 1031493 - protein, 17 aa, Mycobacterium
WEPRRSGRGEYGRGRRP

SEQ ID NO: 1031494 - protein, 8 aa, Mycobacterium
WEPSAEGD

SEQ ID NO: 1031495 - protein, 6 aa, Mycobacterium
WEQAEE

SEQ ID NO: 1031496 - protein, 6 aa, Mycobacterium
WESQTR

SEQ ID NO: 1031497 - protein, 10 aa, Mycobacterium
WESRDETSAA

SEQ ID NO: 1031498 - protein, 4 aa, Mycobacterium
WETD

SEQ ID NO: 1031499 - protein, 6 aa, Mycobacterium
WGEENY

SEQ ID NO: 1031500 - protein, 11 aa, Mycobacterium
WGEESERPGQR

SEQ ID NO: 1031501 - protein, 5 aa, Mycobacterium
WGEGP

SEQ ID NO: 1031502 - protein, 5 aa, Mycobacterium
WGGAN

SEQ ID NO: 1031503 - protein, 6 aa, Mycobacterium
WGGGKS

SEQ ID NO: 1031504 - protein, 6 aa, Mycobacterium
WGGPPI

SEQ ID NO: 1031505 - protein, 6 aa, Mycobacterium
WGGSGP

SEQ ID NO: 1031506 - protein, 10 aa, Mycobacterium
WGGSSTTENV

SEQ ID NO: 1031507 - protein, 7 aa, Mycobacterium
WGGTRNG

SEQ ID NO: 1031508 - protein, 34 aa, Mycobacterium; identical to SEQ ID NO: 614358

SEQ ID NO: 1031509 - protein, 12 aa, Mycobacterium
WGPAQGGRGEGV

SEQ ID NO: 1031510 - protein, 7 aa, Mycobacterium
WGPARDV

SEQ ID NO: 1031511 - protein, 13 aa, Mycobacterium
WGPDSDVDDRADH

SEQ ID NO: 1031512 - protein, 4 aa, Mycobacterium
WGPE

SEQ ID NO: 1031513 - protein, 4 aa, Mycobacterium
WGPG

SEQ ID NO: 1031514 - protein, 4 aa, Mycobacterium
WGPL

SEQ ID NO: 1031515 - protein, 7 aa, Mycobacterium
WGPPAKP

SEQ ID NO: 1031516 - protein, 7 aa, Mycobacterium
WGPPPGE

SEQ ID NO: 1031517 - protein, 7 aa, Mycobacterium
WGPPSSR

SEQ ID NO: 1031518 - protein, 16 aa, Mycobacterium
WGPSSDPAWQRNDPTI

SEQ ID NO: 1031519 - protein, 5 aa, Mycobacterium
WGQPN

SEQ ID NO: 1031520 - protein, 5 aa, Mycobacterium
WGQPP

SEQ ID NO: 1031521 - protein, 8 aa, Mycobacterium
WGQRPTAE

SEQ ID NO: 1031522 - protein, 8 aa, Mycobacterium
WGRASSPV

SEQ ID NO: 1031523 - protein, 35 aa, Mycobacterium
WGRGGNGGLGGTGADGASGQAGSAGGAGGNGGAGG

SEQ ID NO: 1031524 - protein, 9 aa, Mycobacterium
WGSAGGSYA

SEQ ID NO: 1031525 - protein, 16 aa, Mycobacterium
WGSDPKTRISSSYAPM

SEQ ID NO: 1031526 - protein, 8 aa, Mycobacterium
WGSGPGKL

SEQ ID NO: 1031527 - protein, 7 aa, Mycobacterium
WGSSTHS

SEQ ID NO: 1031528 - protein, 21 aa, Mycobacterium
WGTGGTGGSGGSGGTGATGGF

SEQ ID NO: 1031529 - protein, 8 aa, Mycobacterium
WKKPGTSD

SEQ ID NO: 1031530 - protein, 22 aa, Mycobacterium
WKPDQYANPEGPASHYATTGPE

SEQ ID NO: 1031531 - protein, 8 aa, Mycobacterium
WKPKPDTD

SEQ ID NO: 1031532 - protein, 9 aa, Mycobacterium
WKQKDYDEY

SEQ ID NO: 1031533 - protein, 6 aa, Mycobacterium
WKRSAE

SEQ ID NO: 1031534 - protein, 7 aa, Mycobacterium
WKTPSGV

SEQ ID NO: 1031535 - protein, 7 aa, Mycobacterium
WKTQRTV

SEQ ID NO: 1031536 - protein, 9 aa, Mycobacterium
WNAGTTDNV

SEQ ID NO: 1031537 - protein, 9 aa, Mycobacterium
WNDPDSTFE

SEQ ID NO: 1031538 - protein, 9 aa, Mycobacterium
WNEEESGAY

SEQ ID NO: 1031539 - protein, 7 aa, Mycobacterium
WNGGAND

SEQ ID NO: 1031540 - protein, 12 aa, Mycobacterium
WNPDTGKYGPIY

SEQ ID NO: 1031541 - protein, 10 aa, Mycobacterium
WNPQTQTIDP

SEQ ID NO: 1031542 - protein, 8 aa, Mycobacterium
WNSGSGNI

SEQ ID NO: 1031543 - protein, 8 aa, Mycobacterium
WNSGSGNV

SEQ ID NO: 1031544 - protein, 16 aa, Mycobacterium
WNTDHTAGASSSGSGA

SEQ ID NO: 1031545 - protein, 7 aa, Mycobacterium
WNTEARQ

SEQ ID NO: 1031546 - protein, 10 aa, Mycobacterium
WPADGVAGAA

SEQ ID NO: 1031547 - protein, 8 aa, Mycobacterium
WPANLGDK

SEQ ID NO: 1031548 - protein, 5 aa, Mycobacterium
WPAPF

SEQ ID NO: 1031549 - protein, 12 aa, Mycobacterium
WPARTRPEAMLS

SEQ ID NO: 1031550 - protein, 5 aa, Mycobacterium
WPASR

SEQ ID NO: 1031551 - protein, 12 aa, Mycobacterium
WPASTPRSSAVV

SEQ ID NO: 1031552 - protein, 4 aa, Mycobacterium
WPDR

SEQ ID NO: 1031553 - protein, 6 aa, Mycobacterium
WPEGQS

SEQ ID NO: 1031554 - protein, 9 aa, Mycobacterium
WPGAPTEAV

SEQ ID NO: 1031555 - protein, 27 aa, Mycobacterium
WPGLPGDVGYQDGTGGGGGTGGAGGHA

SEQ ID NO: 1031556 - protein, 4 aa, Mycobacterium
WPGR

SEQ ID NO: 1031557 - protein, 9 aa, Mycobacterium
WPGSSDRNF

SEQ ID NO: 1031558 - protein, 12 aa, Mycobacterium
WPKSDRKRREGE

SEQ ID NO: 1031559 - protein, 8 aa, Mycobacterium
WPPEGATA

SEQ ID NO: 1031560 - protein, 7 aa, Mycobacterium
WPPKTTD

SEQ ID NO: 1031561 - protein, 11 aa, Mycobacterium
WPSDSGPRRAA

SEQ ID NO: 1031562 - protein, 6 aa, Mycobacterium
WPSGEA

SEQ ID NO: 1031563 - protein, 8 aa, Mycobacterium
WPSSVSGA

SEQ ID NO: 1031564 - protein, 4 aa, Mycobacterium
WPTA

SEQ ID NO: 1031565 - protein, 8 aa, Mycobacterium
WPTPSGEH

SEQ ID NO: 1031566 - protein, 19 aa, Mycobacterium
WPTSDDDGSNVGARPGRKA

SEQ ID NO: 1031567 - protein, 7 aa, Mycobacterium
WQDESDS

SEQ ID NO: 1031568 - protein, 5 aa, Mycobacterium
WQGAS

SEQ ID NO: 1031569 - protein, 8 aa, Mycobacterium
WQGPASAA

SEQ ID NO: 1031570 - protein, 9 aa, Mycobacterium
WQGTSAQSY

SEQ ID NO: 1031571 - protein, 7 aa, Mycobacterium
WQNEKNA

SEQ ID NO: 1031572 - protein, 12 aa, Mycobacterium
WQPGDAWTAETT

SEQ ID NO: 1031573 - protein, 13 aa, Mycobacterium
WQQAQQPDASDTA

SEQ ID NO: 1031574 - protein, 12 aa, Mycobacterium
WQRDPKQLGRLG

SEQ ID NO: 1031575 - protein, 8 aa, Mycobacterium
WRDPYAGT

SEQ ID NO: 1031576 - protein, 5 aa, Mycobacterium
WRGQG

SEQ ID NO: 1031577 - protein, 9 aa, Mycobacterium
WRGSPPRAD

SEQ ID NO: 1031578 - protein, 10 aa, Mycobacterium
WRGSPPRADW

SEQ ID NO: 1031579 - protein, 5 aa, Mycobacterium
WRGSR

SEQ ID NO: 1031580 - protein, 9 aa, Mycobacterium
WRGTPARDL

SEQ ID NO: 1031581 - protein, 11 aa, Mycobacterium
WRHGQGERVEG

SEQ ID NO: 1031582 - protein, 22 aa, Mycobacterium
WRHGSTPVNVSGGLQSKGHPIA

SEQ ID NO: 1031583 - protein, 9 aa, Mycobacterium
WRKGSGKGW

SEQ ID NO: 1031584 - protein, 6 aa, Mycobacterium
WRNPPR

SEQ ID NO: 1031585 - protein, 10 aa, Mycobacterium
WRPSGLPPIG

SEQ ID NO: 1031586 - protein, 9 aa, Mycobacterium
WRPSPGSVY

SEQ ID NO: 1031587 - protein, 14 aa, Mycobacterium
WRTPKQKSPPGATP

SEQ ID NO: 1031588 - protein, 13 aa, Mycobacterium
WRTRTGLKSKGAR

SEQ ID NO: 1031589 - protein, 8 aa, Mycobacterium
WSAPDSAL

SEQ ID NO: 1031590 - protein, 23 aa, Mycobacterium
WSATRDRAGGDRLSLGRGGATLD

SEQ ID NO: 1031591 - protein, 9 aa, Mycobacterium
WSDESEAAA

SEQ ID NO: 1031592 - protein, 14 aa, Mycobacterium
WSERGAGTNAPGTA

SEQ ID NO: 1031593 - protein, 6 aa, Mycobacterium
WSGPKR

SEQ ID NO: 1031594 - protein, 6 aa, Mycobacterium
WSGQEP

SEQ ID NO: 1031595 - protein, 7 aa, Mycobacterium
WSGSEAP

SEQ ID NO: 1031596 - protein, 6 aa, Mycobacterium
WSGYSG

SEQ ID NO: 1031597 - protein, 11 aa, Mycobacterium
WSHQSTAAELA

SEQ ID NO: 1031598 - protein, 7 aa, Mycobacterium
WSNTGGA

SEQ ID NO: 1031599 - protein, 5 aa, Mycobacterium
WSPGG

SEQ ID NO: 1031600 - protein, 16 aa, Mycobacterium
WSPKAGADDAAKTYRA

SEQ ID NO: 1031601 - protein, 7 aa, Mycobacterium
WSPPTPV

SEQ ID NO: 1031602 - protein, 6 aa, Mycobacterium
WSPRST

SEQ ID NO: 1031603 - protein, 13 aa, Mycobacterium
WSPSSSAHSRKTC

SEQ ID NO: 1031604 - protein, 27 aa, Mycobacterium
WSPTSFGGSSGSSGDSSGGGFLGGGGR

SEQ ID NO: 1031605 - protein, 22 aa, Mycobacterium
WSQRGKSKLDLAQRSRAKPGYS

SEQ ID NO: 1031606 - protein, 7 aa, Mycobacterium
WSSPHQS

SEQ ID NO: 1031607 - protein, 10 aa, Mycobacterium
WSTDPRSRVP

SEQ ID NO: 1031608 - protein, 17 aa, Mycobacterium
WSTGSSIMPQKKNPDIA

SEQ ID NO: 1031609 - protein, 14 aa, Mycobacterium
WSTPSTPAANTDDI

SEQ ID NO: 1031610 - protein, 11 aa, Mycobacterium
WTDEHGTRPLA

SEQ ID NO: 1031611 - protein, 14 aa, Mycobacterium
WTGEPGPAPAAHAA

SEQ ID NO: 1031612 - protein, 8 aa, Mycobacterium
WTGHEGAE

SEQ ID NO: 1031613 - protein, 6 aa, Mycobacterium
WTGNDG

SEQ ID NO: 1031614 - protein, 10 aa, Mycobacterium
WTNPQARRAG

SEQ ID NO: 1031615 - protein, 6 aa, Mycobacterium
WTPQWT

SEQ ID NO: 1031616 - protein, 7 aa, Mycobacterium
WTSASDS

SEQ ID NO: 1031617 - protein, 17 aa, Mycobacterium
WTSGEGDWAVTGGAAQL

SEQ ID NO: 1031618 - protein, 4 aa, Mycobacterium
WTTD

SEQ ID NO: 1031619 - protein, 17 aa, Mycobacterium
WVPGAANQRAQPLPSVG

SEQ ID NO: 1031620 - protein, 23 aa, Mycobacterium
YAADADQLSATTYDQGTYSSGPQ

SEQ ID NO: 1031621 - protein, 10 aa, Mycobacterium
YAADDDERTV

SEQ ID NO: 1031622 - protein, 12 aa, Mycobacterium
YAANRQAGSAVG

SEQ ID NO: 1031623 - protein, 4 aa, Mycobacterium
YAAR

SEQ ID NO: 1031624 - protein, 11 aa, Mycobacterium
YAARGEDPDFH

SEQ ID NO: 1031625 - protein, 16 aa, Mycobacterium
YAASGDAQVDETAAEV

SEQ ID NO: 1031626 - protein, 14 aa, Mycobacterium
YAASPGLAPYNASK

SEQ ID NO: 1031627 - protein, 12 aa, Mycobacterium
YAAWGGADGRTL

SEQ ID NO: 1031628 - protein, 11 aa, Mycobacterium
YADDPEPFTAA

SEQ ID NO: 1031629 - protein, 4 aa, Mycobacterium
YADG

SEQ ID NO: 1031630 - protein, 7 aa, Mycobacterium
YADHEAA

SEQ ID NO: 1031631 - protein, 4 aa, Mycobacterium
YADP

SEQ ID NO: 1031632 - protein, 8 aa, Mycobacterium
YAEAEGDD

SEQ ID NO: 1031633 - protein, 7 aa, Mycobacterium
YAEEAGI

SEQ ID NO: 1031634 - protein, 13 aa, Mycobacterium
YAEERTKRLRPDG

SEQ ID NO: 1031635 - protein, 16 aa, Mycobacterium
YAEGSSSSGAEGGYRG

SEQ ID NO: 1031636 - protein, 8 aa, Mycobacterium
YAEHEGKP

SEQ ID NO: 1031637 - protein, 6 aa, Mycobacterium
YAEPGQ

SEQ ID NO: 1031638 - protein, 16 aa, Mycobacterium
YAEQGTDRLESLAEQP

SEQ ID NO: 1031639 - protein, 9 aa, Mycobacterium
YAESGGQIA

SEQ ID NO: 1031640 - protein, 9 aa, Mycobacterium
YAETAEEAD

SEQ ID NO: 1031641 - protein, 8 aa, Mycobacterium
YAGAGSGS

SEQ ID NO: 1031642 - protein, 4 aa, Mycobacterium
YAGG

SEQ ID NO: 1031643 - protein, 9 aa, Mycobacterium
YAGNGTVAS

SEQ ID NO: 1031644 - protein, 8 aa, Mycobacterium
YAGPAQRD

SEQ ID NO: 1031645 - protein, 11 aa, Mycobacterium
YAGPDQRDKLG

SEQ ID NO: 1031646 - protein, 8 aa, Mycobacterium
YAGPGAGS

SEQ ID NO: 1031647 - protein, 7 aa, Mycobacterium
YAGRAGD

SEQ ID NO: 1031648 - protein, 16 aa, Mycobacterium
YAGRGYGDLKKDTAEA

SEQ ID NO: 1031649 - protein, 8 aa, Mycobacterium
YAGTEDDA

SEQ ID NO: 1031650 - protein, 6 aa, Mycobacterium
YAGTRP

SEQ ID NO: 1031651 - protein, 20 aa, Mycobacterium
YAIPDYPADPKTDEEKALKE

SEQ ID NO: 1031652 - protein, 22 aa, Mycobacterium
YAKDKKLLKDKDPNLTGDDIRE

SEQ ID NO: 1031653 - protein, 13 aa, Mycobacterium
YAKERQSFGQPIG

SEQ ID NO: 1031654 - protein, 6 aa, Mycobacterium
YAKGGK

SEQ ID NO: 1031655 - protein, 4 aa, Mycobacterium
YAPA

SEQ ID NO: 1031656 - protein, 9 aa, Mycobacterium
YAPDNEAIS

SEQ ID NO: 1031657 - protein, 11 aa, Mycobacterium
YAPDNEKTTAV

SEQ ID NO: 1031658 - protein, 5 aa, Mycobacterium
YAPGD

SEQ ID NO: 1031659 - protein, 13 aa, Mycobacterium
YAPHARAGQGGTP

SEQ ID NO: 1031660 - protein, 19 aa, Mycobacterium
YAPHRDRGEAEHPVAARQH

SEQ ID NO: 1031661 - protein, 5 aa, Mycobacterium
YAPNG

SEQ ID NO: 1031662 - protein, 6 aa, Mycobacterium
YAPNRT

SEQ ID NO: 1031663 - protein, 7 aa, Mycobacterium
YAPQAQN

SEQ ID NO: 1031664 - protein, 5 aa, Mycobacterium
YAPRR

SEQ ID NO: 1031665 - protein, 4 aa, Mycobacterium
YAPS

SEQ ID NO: 1031666 - protein, 12 aa, Mycobacterium
YAPTSRFGTPDD

SEQ ID NO: 1031667 - protein, 9 aa, Mycobacterium
YAQTGEETG

SEQ ID NO: 1031668 - protein, 4 aa, Mycobacterium
YARA

SEQ ID NO: 1031669 - protein, 9 aa, Mycobacterium
YARGETPNP

SEQ ID NO: 1031670 - protein, 261 aa, Mycobacterium
YARPQEDPRGGPHGGPDPRGGYPPEAGGYPPQPGYPPPRPQDQGGYPEQGGYPDQRGYPDQRGYQDQRGYPDQRDYQDQGGYPDQRGYPEQGGYPPSYEQCPPAPGGYGAQGYDQGYRQGGGYGQPPGGQPGYGGYGEYGREPARQDEGAYSAPAAPSAPPEAQRPGYPDQGGGYDQGYQQGGAGYGRPEYGQGDYTQYADTSSPGGYPPQGAGYADPAGRDYEYGQAAAPDYGQAPPDYGQPAGGGYGGYGQSGYGAAGS

SEQ ID NO: 1031671 - protein, 11 aa, Mycobacterium
YARTGNPTRTA

SEQ ID NO: 1031672 - protein, 13 aa, Mycobacterium
YASAARGEPAQTA

SEQ ID NO: 1031673 - protein, 15 aa, Mycobacterium
YASDGDSDGVPDPQN

SEQ ID NO: 1031674 - protein, 9 aa, Mycobacterium
YASDSGRTV

SEQ ID NO: 1031675 - protein, 8 aa, Mycobacterium
YASERAAA

SEQ ID NO: 1031676 - protein, 8 aa, Mycobacterium
YASRASNA

SEQ ID NO: 1031677 - protein, 8 aa, Mycobacterium
YASREQEN

SEQ ID NO: 1031678 - protein, 7 aa, Mycobacterium
YASRGGK

SEQ ID NO: 1031679 - protein, 10 aa, Mycobacterium
YASTATQGGV

SEQ ID NO: 1031680 - protein, 9 aa, Mycobacterium
YASTPRFTP

SEQ ID NO: 1031681 - protein, 5 aa, Mycobacterium
YATES

SEQ ID NO: 1031682 - protein, 11 aa, Mycobacterium
YATGGNGGDGG

SEQ ID NO: 1031683 - protein, 5 aa, Mycobacterium
YATQP

SEQ ID NO: 1031684 - protein, 8 aa, Mycobacterium
YDAEGADE

SEQ ID NO: 1031685 - protein, 5 aa, Mycobacterium
YDAET

SEQ ID NO: 1031686 - protein, 9 aa, Mycobacterium
YDDEGVASQ

SEQ ID NO: 1031687 - protein, 4 aa, Mycobacterium
YDDG

SEQ ID NO: 1031688 - protein, 9 aa, Mycobacterium
YDDPAPRRW

SEQ ID NO: 1031689 - protein, 8 aa, Mycobacterium
YDDPVQEA

SEQ ID NO: 1031690 - protein, 15 aa, Mycobacterium
YDEGKGDPREGFPAG

SEQ ID NO: 1031691 - protein, 20 aa, Mycobacterium
YDEPHDAPAPATPPSPEPAR

SEQ ID NO: 1031692 - protein, 8 aa, Mycobacterium
YDEPNGGL

SEQ ID NO: 1031693 - protein, 7 aa, Mycobacterium
YDEPPVN

SEQ ID NO: 1031694 - protein, 8 aa, Mycobacterium
YDESETIR

SEQ ID NO: 1031695 - protein, 6 aa, Mycobacterium
YDGDEQ

SEQ ID NO: 1031696 - protein, 14 aa, Mycobacterium
YDGDVQSGTVAQGY

SEQ ID NO: 1031697 - protein, 16 aa, Mycobacterium
YDGRDRAGRYNNGQDA

SEQ ID NO: 1031698 - protein, 4 aa, Mycobacterium
YDMP

SEQ ID NO: 1031699 - protein, 6 aa, Mycobacterium
YDPAYS

SEQ ID NO: 1031700 - protein, 7 aa, Mycobacterium
YDPDGPG

SEQ ID NO: 1031701 - protein, 6 aa, Mycobacterium
YDPDNT

SEQ ID NO: 1031702 - protein, 9 aa, Mycobacterium
YDPDPAGLP

SEQ ID NO: 1031703 - protein, 7 aa, Mycobacterium
YDPDPEL

SEQ ID NO: 1031704 - protein, 11 aa, Mycobacterium
YDPDPRAPGRM

SEQ ID NO: 1031705 - protein, 5 aa, Mycobacterium
YDPDT

SEQ ID NO: 1031706 - protein, 6 aa, Mycobacterium
YDPDTH

SEQ ID NO: 1031707 - protein, 11 aa, Mycobacterium
YDPEPGVPGRT

SEQ ID NO: 1031708 - protein, 8 aa, Mycobacterium
YDPPNEKL

SEQ ID NO: 1031709 - protein, 4 aa, Mycobacterium
YDPR

SEQ ID NO: 1031710 - protein, 8 aa, Mycobacterium
YDPTCGSG

SEQ ID NO: 1031711 - protein, 12 aa, Mycobacterium
YDPTDPTPTIGG

SEQ ID NO: 1031712 - protein, 10 aa, Mycobacterium
YDQGTEDKIN

SEQ ID NO: 1031713 - protein, 4 aa, Mycobacterium
YDQP

SEQ ID NO: 1031714 - protein, 6 aa, Mycobacterium
YDREYG

SEQ ID NO: 1031715 - protein, 9 aa, Mycobacterium
YDRPPSTAD

SEQ ID NO: 1031716 - protein, 4 aa, Mycobacterium
YDRR

SEQ ID NO: 1031717 - protein, 4 aa, Mycobacterium
YDRS

SEQ ID NO: 1031718 - protein, 4 aa, Mycobacterium
YDSE

SEQ ID NO: 1031719 - protein, 8 aa, Mycobacterium
YDSPPADF

SEQ ID NO: 1031720 - protein, 6 aa, Mycobacterium
YDSPRK

SEQ ID NO: 1031721 - protein, 11 aa, Mycobacterium
YDSSDKGFDGA

SEQ ID NO: 1031722 - protein, 7 aa, Mycobacterium
YDSTTGQ

SEQ ID NO: 1031723 - protein, 9 aa, Mycobacterium
YDTATTAAR

SEQ ID NO: 1031724 - protein, 4 aa, Mycobacterium
YDTK

SEQ ID NO: 1031725 - protein, 8 aa, Mycobacterium
YDTPPPLI

SEQ ID NO: 1031726 - protein, 7 aa, Mycobacterium
YDTPPTI

SEQ ID NO: 1031727 - protein, 5 aa, Mycobacterium
YDTSS

SEQ ID NO: 1031728 - protein, 18 aa, Mycobacterium
YEAAQKARESRRNQQQTV

SEQ ID NO: 1031729 - protein, 4 aa, Mycobacterium
YEDT

SEQ ID NO: 1031730 - protein, 4 aa, Mycobacterium
YEEA

SEQ ID NO: 1031731 - protein, 10 aa, Mycobacterium
YEEDAAAKLG

SEQ ID NO: 1031732 - protein, 5 aa, Mycobacterium
YEEGD

SEQ ID NO: 1031733 - protein, 10 aa, Mycobacterium
YEESGEQEAQ

SEQ ID NO: 1031734 - protein, 6 aa, Mycobacterium
YEGDRA

SEQ ID NO: 1031735 - protein, 7 aa, Mycobacterium
YEGDYEK

SEQ ID NO: 1031736 - protein, 5 aa, Mycobacterium
YEGGV

SEQ ID NO: 1031737 - protein, 6 aa, Mycobacterium
YEGPPG

SEQ ID NO: 1031738 - protein, 7 aa, Mycobacterium
YEGPQTA

SEQ ID NO: 1031739 - protein, 10 aa, Mycobacterium
YENGGLPTNE

SEQ ID NO: 1031740 - protein, 9 aa, Mycobacterium
YENSPYYDS

SEQ ID NO: 1031741 - protein, 11 aa, Mycobacterium
YEPEDPQWPSE

SEQ ID NO: 1031742 - protein, 8 aa, Mycobacterium
YEPHESPV

SEQ ID NO: 1031743 - protein, 9 aa, Mycobacterium
YEPKTDSAQ

SEQ ID NO: 1031744 - protein, 23 aa, Mycobacterium
YEPNASDISKEDSGEGKTEKIRQ

SEQ ID NO: 1031745 - protein, 4 aa, Mycobacterium
YEPQ

SEQ ID NO: 1031746 - protein, 4 aa, Mycobacterium
YEPS

SEQ ID NO: 1031747 - protein, 12 aa, Mycobacterium
YEQHDGTSEELR

SEQ ID NO: 1031748 - protein, 6 aa, Mycobacterium
YEQHPL

SEQ ID NO: 1031749 - protein, 8 aa, Mycobacterium
YEQPDPAR

SEQ ID NO: 1031750 - protein, 8 aa, Mycobacterium
YEQRATEP

SEQ ID NO: 1031751 - protein, 6 aa, Mycobacterium
YERDGR

SEQ ID NO: 1031752 - protein, 5 aa, Mycobacterium
YESAR

SEQ ID NO: 1031753 - protein, 10 aa, Mycobacterium
YESRTAPVEG

SEQ ID NO: 1031754 - protein, 5 aa, Mycobacterium
YETEE

SEQ ID NO: 1031755 - protein, 12 aa, Mycobacterium
YETGAGGSAPKH

SEQ ID NO: 1031756 - protein, 8 aa, Mycobacterium
YETPDPEI

SEQ ID NO: 1031757 - protein, 5 aa, Mycobacterium
YETSF

SEQ ID NO: 1031758 - protein, 9 aa, Mycobacterium
YFPAPGVQP

SEQ ID NO: 1031759 - protein, 4 aa, Mycobacterium
YGAA

SEQ ID NO: 1031760 - protein, 5 aa, Mycobacterium
YGADI

SEQ ID NO: 1031761 - protein, 9 aa, Mycobacterium
YGAESEASR

SEQ ID NO: 1031762 - protein, 8 aa, Mycobacterium
YGAKTDKA

SEQ ID NO: 1031763 - protein, 9 aa, Mycobacterium
YGAQDPAAA

SEQ ID NO: 1031764 - protein, 5 aa, Mycobacterium
YGAQQ

SEQ ID NO: 1031765 - protein, 4 aa, Mycobacterium
YGAR

SEQ ID NO: 1031766 - protein, 10 aa, Mycobacterium
YGASGEHQSF

SEQ ID NO: 1031767 - protein, 4 aa, Mycobacterium
YGAT

SEQ ID NO: 1031768 - protein, 6 aa, Mycobacterium
YGDATR

SEQ ID NO: 1031769 - protein, 9 aa, Mycobacterium
YGDGGHTHA

SEQ ID NO: 1031770 - protein, 18 aa, Mycobacterium
YGDGNSGVLAQSGGVGGN

SEQ ID NO: 1031771 - protein, 15 aa, Mycobacterium
YGDNNNVSATAPGIG

SEQ ID NO: 1031772 - protein, 10 aa, Mycobacterium
YGDNPTKPFT

SEQ ID NO: 1031773 - protein, 8 aa, Mycobacterium
YGDPDNPD

SEQ ID NO: 1031774 - protein, 5 aa, Mycobacterium
YGDPL

SEQ ID NO: 1031775 - protein, 13 aa, Mycobacterium
YGDPTNKPNPNLG

SEQ ID NO: 1031776 - protein, 4 aa, Mycobacterium
YGDR

SEQ ID NO: 1031777 - protein, 10 aa, Mycobacterium
YGDSRTGPKL

SEQ ID NO: 1031778 - protein, 12 aa, Mycobacterium
YGEADQARNVTR

SEQ ID NO: 1031779 - protein, 5 aa, Mycobacterium
YGEDD

SEQ ID NO: 1031780 - protein, 16 aa, Mycobacterium
YGEDSGDESELQTRPP

SEQ ID NO: 1031781 - protein, 13 aa, Mycobacterium
YGEHSRRPAFGDD

SEQ ID NO: 1031782 - protein, 12 aa, Mycobacterium
YGEPEHGPGPFP

SEQ ID NO: 1031783 - protein, 6 aa, Mycobacterium
YGEPQL

SEQ ID NO: 1031784 - protein, 12 aa, Mycobacterium
YGETGPDADRAA

SEQ ID NO: 1031785 - protein, 5 aa, Mycobacterium
YGGAI

SEQ ID NO: 1031786 - protein, 4 aa, Mycobacterium
YGGD

SEQ ID NO: 1031787 - protein, 8 aa, Mycobacterium
YGGDQEHR

SEQ ID NO: 1031788 - protein, 18 aa, Mycobacterium
YGGEVKGGLEGYGLTGST

SEQ ID NO: 1031789 - protein, 7 aa, Mycobacterium
YGGHDEV

SEQ ID NO: 1031790 - protein, 5 aa, Mycobacterium
YGGPD

SEQ ID NO: 1031791 - protein, 4 aa, Mycobacterium
YGGR

SEQ ID NO: 1031792 - protein, 14 aa, Mycobacterium
YGGSGYPAGKAAVN

SEQ ID NO: 1031793 - protein, 4 aa, Mycobacterium
YGGT

SEQ ID NO: 1031794 - protein, 10 aa, Mycobacterium
YGGTEIKYGG

SEQ ID NO: 1031795 - protein, 7 aa, Mycobacterium
YGGYKSE

SEQ ID NO: 1031796 - protein, 18 aa, Mycobacterium
YGHGGGGGAGGTGTGMGV

SEQ ID NO: 1031797 - protein, 4 aa, Mycobacterium
YGHP

SEQ ID NO: 1031798 - protein, 15 aa, Mycobacterium
YGIGEATARKLAAAG

SEQ ID NO: 1031799 - protein, 19 aa, Mycobacterium
YGIRGDDVEDDDAVRAGQT

SEQ ID NO: 1031800 - protein, 7 aa, Mycobacterium
YGKDRLP

SEQ ID NO: 1031801 - protein, 7 aa, Mycobacterium
YGKGSNA

SEQ ID NO: 1031802 - protein, 16 aa, Mycobacterium
YGKRKAGADKDQAAAD

SEQ ID NO: 1031803 - protein, 4 aa, Mycobacterium
YGKT

SEQ ID NO: 1031804 - protein, 6 aa, Mycobacterium
YGLDRS

SEQ ID NO: 1031805 - protein, 13 aa, Mycobacterium
YGLGKDKGADSCA

SEQ ID NO: 1031806 - protein, 12 aa, Mycobacterium
YGLSSAPQVTGD

SEQ ID NO: 1031807 - protein, 8 aa, Mycobacterium
YGLTSPNV

SEQ ID NO: 1031808 - protein, 8 aa, Mycobacterium
YGMTPPDV

SEQ ID NO: 1031809 - protein, 10 aa, Mycobacterium
YGNAAALTTT

SEQ ID NO: 1031810 - protein, 8 aa, Mycobacterium
YGNHADDQ

SEQ ID NO: 1031811 - protein, 10 aa, Mycobacterium
YGNPAESDTA

SEQ ID NO: 1031812 - protein, 7 aa, Mycobacterium
YGNPEAT

SEQ ID NO: 1031813 - protein, 14 aa, Mycobacterium
YGNSRIDAEQYQGL

SEQ ID NO: 1031814 - protein, 4 aa, Mycobacterium
YGPA

SEQ ID NO: 1031815 - protein, 6 aa, Mycobacterium
YGPAGA

SEQ ID NO: 1031816 - protein, 11 aa, Mycobacterium
YGPDGQRRGEG

SEQ ID NO: 1031817 - protein, 14 aa, Mycobacterium
YGPDSHQQMGPAPN

SEQ ID NO: 1031818 - protein, 4 aa, Mycobacterium
YGPG

SEQ ID NO: 1031819 - protein, 17 aa, Mycobacterium
YGPGDRTAEPPPPGEYP

SEQ ID NO: 1031820 - protein, 28 aa, Mycobacterium
YGPGPAGGLPPSEIGSPNPATVNPANPR

SEQ ID NO: 1031821 - protein, 23 aa, Mycobacterium
YGPHSAAASTAAADVDTALGPSL

SEQ ID NO: 1031822 - protein, 13 aa, Mycobacterium
YGPRASVADAYSG

SEQ ID NO: 1031823 - protein, 16 aa, Mycobacterium
YGPRTGGKSKVSGSLR

SEQ ID NO: 1031824 - protein, 5 aa, Mycobacterium
YGPSG

SEQ ID NO: 1031825 - protein, 7 aa, Mycobacterium
YGPTHRE

SEQ ID NO: 1031826 - protein, 8 aa, Mycobacterium
YGPTTGDR

SEQ ID NO: 1031827 - protein, 8 aa, Mycobacterium
YGPTTRRP

SEQ ID NO: 1031828 - protein, 12 aa, Mycobacterium
YGPYRAQGSGVV

SEQ ID NO: 1031829 - protein, 4 aa, Mycobacterium
YGQA

SEQ ID NO: 1031830 - protein, 11 aa, Mycobacterium
YGQNPQAACDG

SEQ ID NO: 1031831 - protein, 7 aa, Mycobacterium
YGQVGDG

SEQ ID NO: 1031832 - protein, 15 aa, Mycobacterium
YGRESARKSRGNGLD

SEQ ID NO: 1031833 - protein, 5 aa, Mycobacterium
YGRGA

SEQ ID NO: 1031834 - protein, 12 aa, Mycobacterium
YGRGTADDKAGI

SEQ ID NO: 1031835 - protein, 8 aa, Mycobacterium
YGRTGGPV

SEQ ID NO: 1031836 - protein, 20 aa, Mycobacterium
YGRYEGRDFEDPRRDPRAGM

SEQ ID NO: 1031837 - protein, 19 aa, Mycobacterium
YGSETQMAPRVGSSAEDDG

SEQ ID NO: 1031838 - protein, 6 aa, Mycobacterium
YGSGGS

SEQ ID NO: 1031839 - protein, 11 aa, Mycobacterium
YGSRSTPVSGA

SEQ ID NO: 1031840 - protein, 4 aa, Mycobacterium
YGSS

SEQ ID NO: 1031841 - protein, 7 aa, Mycobacterium
YGSSITQ

SEQ ID NO: 1031842 - protein, 9 aa, Mycobacterium
YGSSTSSSG

SEQ ID NO: 1031843 - protein, 5 aa, Mycobacterium
YGSTE

SEQ ID NO: 1031844 - protein, 7 aa, Mycobacterium
YGSTEAG

SEQ ID NO: 1031845 - protein, 6 aa, Mycobacterium
YGSTTV

SEQ ID NO: 1031846 - protein, 17 aa, Mycobacterium
YGTDADGTFTSGGTQSN

SEQ ID NO: 1031847 - protein, 7 aa, Mycobacterium
YGTDLRG

SEQ ID NO: 1031848 - protein, 10 aa, Mycobacterium
YGTPPDKNGD

SEQ ID NO: 1031849 - protein, 8 aa, Mycobacterium
YGTSSPSG

SEQ ID NO: 1031850 - protein, 10 aa, Mycobacterium
YGVDNRPAGV

SEQ ID NO: 1031851 - protein, 5 aa, Mycobacterium
YGVPA

SEQ ID NO: 1031852 - protein, 11 aa, Mycobacterium
YGYQPAPAEGR

SEQ ID NO: 1031853 - protein, 6 aa, Mycobacterium
YHAAGQ

SEQ ID NO: 1031854 - protein, 5 aa, Mycobacterium
YHEQE

SEQ ID NO: 1031855 - protein, 5 aa, Mycobacterium
YHETS

SEQ ID NO: 1031856 - protein, 15 aa, Mycobacterium
YIGATGTPPIPPDAK

SEQ ID NO: 1031857 - protein, 6 aa, Mycobacterium
YIPGAG

SEQ ID NO: 1031858 - protein, 4 aa, Mycobacterium
YITS

SEQ ID NO: 1031859 - protein, 19 aa, Mycobacterium
YKAGEPKVDNIGSGNNIEN

SEQ ID NO: 1031860 - protein, 7 aa, Mycobacterium
YKDTDSF

SEQ ID NO: 1031861 - protein, 8 aa, Mycobacterium
YKETSAGG

SEQ ID NO: 1031862 - protein, 8 aa, Mycobacterium
YKRPPREL

SEQ ID NO: 1031863 - protein, 9 aa, Mycobacterium
YKSSARPAL

SEQ ID NO: 1031864 - protein, 6 aa, Mycobacterium
YKSYRG

SEQ ID NO: 1031865 - protein, 8 aa, Mycobacterium
YLPDTATA

SEQ ID NO: 1031866 - protein, 6 aa, Mycobacterium
YLSPGD

SEQ ID NO: 1031867 - protein, 12 aa, Mycobacterium
YLTGGTSDMSTS

SEQ ID NO: 1031868 - protein, 4 aa, Mycobacterium
YMSP

SEQ ID NO: 1031869 - protein, 7 aa, Mycobacterium
YNAAGGH

SEQ ID NO: 1031870 - protein, 9 aa, Mycobacterium
YNANPDSMR

SEQ ID NO: 1031871 - protein, 9 aa, Mycobacterium
YNASNADLT

SEQ ID NO: 1031872 - protein, 19 aa, Mycobacterium
YNESLADPAQMYATATVPY

SEQ ID NO: 1031873 - protein, 11 aa, Mycobacterium
YNNASPASGRI

SEQ ID NO: 1031874 - protein, 15 aa, Mycobacterium
YNPDDPEAFASTGGW

SEQ ID NO: 1031875 - protein, 9 aa, Mycobacterium
YNPDRDAPR

SEQ ID NO: 1031876 - protein, 18 aa, Mycobacterium
YNPPNGGPADTDATNAIA

SEQ ID NO: 1031877 - protein, 6 aa, Mycobacterium
YNPQRE

SEQ ID NO: 1031878 - protein, 14 aa, Mycobacterium
YNQARISGGSTVWP

SEQ ID NO: 1031879 - protein, 7 aa, Mycobacterium
YNSQADH

SEQ ID NO: 1031880 - protein, 11 aa, Mycobacterium
YNTSSEQPSAA

SEQ ID NO: 1031881 - protein, 5 aa, Mycobacterium
YPAEQ

SEQ ID NO: 1031882 - protein, 19 aa, Mycobacterium
YPAESVPERRSADAGPEQL

SEQ ID NO: 1031883 - protein, 6 aa, Mycobacterium
YPANSV

SEQ ID NO: 1031884 - protein, 31 aa, Mycobacterium
YPASPNHPGFPSTELTPGQTYDSTTVFGFGA

SEQ ID NO: 1031885 - protein, 10 aa, Mycobacterium
YPAVANPKTR

SEQ ID NO: 1031886 - protein, 8 aa, Mycobacterium
YPAVSTQA

SEQ ID NO: 1031887 - protein, 19 aa, Mycobacterium
YPAVSTSEIGKGAGIAGPG

SEQ ID NO: 1031888 - protein, 5 aa, Mycobacterium
YPDAQ

SEQ ID NO: 1031889 - protein, 7 aa, Mycobacterium
YPDARSA

SEQ ID NO: 1031890 - protein, 5 aa, Mycobacterium
YPDER

SEQ ID NO: 1031891 - protein, 8 aa, Mycobacterium
YPDGPHNA

SEQ ID NO: 1031892 - protein, 20 aa, Mycobacterium
YPDNVAGGLAGAPPDEQTFA

SEQ ID NO: 1031893 - protein, 21 aa, Mycobacterium
YPDPGADGHGGRIPEAAGGWT

SEQ ID NO: 1031894 - protein, 8 aa, Mycobacterium
YPDPTRDT

SEQ ID NO: 1031895 - protein, 11 aa, Mycobacterium
YPDQLSGGQRQ

SEQ ID NO: 1031896 - protein, 5 aa, Mycobacterium
YPDQR

SEQ ID NO: 1031897 - protein, 4 aa, Mycobacterium
YPDR

SEQ ID NO: 1031898 - protein, 8 aa, Mycobacterium
YPDSQVGT

SEQ ID NO: 1031899 - protein, 6 aa, Mycobacterium
YPDTKM

SEQ ID NO: 1031900 - protein, 13 aa, Mycobacterium
YPDTTTGTSRAAL

SEQ ID NO: 1031901 - protein, 6 aa, Mycobacterium
YPEEVP

SEQ ID NO: 1031902 - protein, 7 aa, Mycobacterium
YPEGKRA

SEQ ID NO: 1031903 - protein, 12 aa, Mycobacterium
YPEHDSHPEEPE

SEQ ID NO: 1031904 - protein, 7 aa, Mycobacterium
YPELNES

SEQ ID NO: 1031905 - protein, 13 aa, Mycobacterium
YPELRTPDSPTQL

SEQ ID NO: 1031906 - protein, 8 aa, Mycobacterium
YPEPPPDS

SEQ ID NO: 1031907 - protein, 9 aa, Mycobacterium
YPEPPPPGM

SEQ ID NO: 1031908 - protein, 4 aa, Mycobacterium
YPER

SEQ ID NO: 1031909 - protein, 4 aa, Mycobacterium
YPGA

SEQ ID NO: 1031910 - protein, 7 aa, Mycobacterium
YPGAPGQ

SEQ ID NO: 1031911 - protein, 14 aa, Mycobacterium
YPGFTSTAPPGDGQ

SEQ ID NO: 1031912 - protein, 10 aa, Mycobacterium
YPGGADPPES

SEQ ID NO: 1031913 - protein, 6 aa, Mycobacterium
YPGGAQ

SEQ ID NO: 1031914 - protein, 5 aa, Mycobacterium
YPGRQ

SEQ ID NO: 1031915 - protein, 19 aa, Mycobacterium
YPGSPSGGSGGNPGGPGGS

SEQ ID NO: 1031916 - protein, 7 aa, Mycobacterium
YPGVGPE

SEQ ID NO: 1031917 - protein, 14 aa, Mycobacterium
YPGYKATPHGRQEP

SEQ ID NO: 1031918 - protein, 14 aa, Mycobacterium
YPHNESTSGYSEKS

SEQ ID NO: 1031919 - protein, 5 aa, Mycobacterium
YPHPE

SEQ ID NO: 1031920 - protein, 11 aa, Mycobacterium
YPIPGNDDAIR

SEQ ID NO: 1031921 - protein, 31 aa, Mycobacterium; identical to SEQ ID NO: 295740

SEQ ID NO: 1031922 - protein, 9 aa, Mycobacterium
YPKTSGGRG

SEQ ID NO: 1031923 - protein, 4 aa, Mycobacterium
YPLG

SEQ ID NO: 1031924 - protein, 7 aa, Mycobacterium
YPNPTHP

SEQ ID NO: 1031925 - protein, 6 aa, Mycobacterium
YPNYPE

SEQ ID NO: 1031926 - protein, 18 aa, Mycobacterium
YPPAPPEAAPPPAPPGPP

SEQ ID NO: 1031927 - protein, 8 aa, Mycobacterium
YPPEEAQT

SEQ ID NO: 1031928 - protein, 11 aa, Mycobacterium
YPPGRGPHTSA

SEQ ID NO: 1031929 - protein, 8 aa, Mycobacterium
YPPGTRPD

SEQ ID NO: 1031930 - protein, 7 aa, Mycobacterium
YPPGVRP

SEQ ID NO: 1031931 - protein, 6 aa, Mycobacterium
YPPKSN

SEQ ID NO: 1031932 - protein, 5 aa, Mycobacterium
YPPPA

SEQ ID NO: 1031933 - protein, 12 aa, Mycobacterium
YPPTSSTCWPRS

SEQ ID NO: 1031934 - protein, 4 aa, Mycobacterium
YPQE

SEQ ID NO: 1031935 - protein, 11 aa, Mycobacterium
YPQRPALGQRA

SEQ ID NO: 1031936 - protein, 9 aa, Mycobacterium
YPRGTENQR

SEQ ID NO: 1031937 - protein, 12 aa, Mycobacterium
YPRTGQGGEPRL

SEQ ID NO: 1031938 - protein, 5 aa, Mycobacterium
YPSGE

SEQ ID NO: 1031939 - protein, 11 aa, Mycobacterium
YPSGTHVGNTS

SEQ ID NO: 1031940 - protein, 8 aa, Mycobacterium
YPSPNDID

SEQ ID NO: 1031941 - protein, 8 aa, Mycobacterium
YPTDLTDE

SEQ ID NO: 1031942 - protein, 8 aa, Mycobacterium
YPTPEEER

SEQ ID NO: 1031943 - protein, 14 aa, Mycobacterium
YPTPPSGAANNTIT

SEQ ID NO: 1031944 - protein, 5 aa, Mycobacterium
YPTPY

SEQ ID NO: 1031945 - protein, 5 aa, Mycobacterium
YPTRA

SEQ ID NO: 1031946 - protein, 15 aa, Mycobacterium
YPTRKDLTPDTLRRV

SEQ ID NO: 1031947 - protein, 6 aa, Mycobacterium
YPTRSG

SEQ ID NO: 1031948 - protein, 11 aa, Mycobacterium
YPTSGQDHRPE

SEQ ID NO: 1031949 - protein, 7 aa, Mycobacterium
YQASKGA

SEQ ID NO: 1031950 - protein, 12 aa, Mycobacterium
YQASTNEKEPAM

SEQ ID NO: 1031951 - protein, 6 aa, Mycobacterium
YQEPDA

SEQ ID NO: 1031952 - protein, 7 aa, Mycobacterium
YQEPRQE

SEQ ID NO: 1031953 - protein, 10 aa, Mycobacterium
YQETLTDPSY

SEQ ID NO: 1031954 - protein, 9 aa, Mycobacterium
YQGAATGVG

SEQ ID NO: 1031955 - protein, 6 aa, Mycobacterium
YQGQFD

SEQ ID NO: 1031956 - protein, 18 aa, Mycobacterium
YQGYGDVPGVAKDSQTET

SEQ ID NO: 1031957 - protein, 9 aa, Mycobacterium
YQKPHPPIG

SEQ ID NO: 1031958 - protein, 11 aa, Mycobacterium
YQPGAENSNQY

SEQ ID NO: 1031959 - protein, 7 aa, Mycobacterium
YQPQLDA

SEQ ID NO: 1031960 - protein, 5 aa, Mycobacterium
YQPTL

SEQ ID NO: 1031961 - protein, 4 aa, Mycobacterium
YQPY

SEQ ID NO: 1031962 - protein, 11 aa, Mycobacterium
YQQDRQDERDR

SEQ ID NO: 1031963 - protein, 10 aa, Mycobacterium
YQQESRDVNA

SEQ ID NO: 1031964 - protein, 13 aa, Mycobacterium
YQQQGAFEGPPPW

SEQ ID NO: 1031965 - protein, 13 aa, Mycobacterium
YQQSTGGGGPHPG

SEQ ID NO: 1031966 - protein, 19 aa, Mycobacterium
YQRASTAARRRGAVGEARG

SEQ ID NO: 1031967 - protein, 6 aa, Mycobacterium
YQRPAP

SEQ ID NO: 1031968 - protein, 5 aa, Mycobacterium
YQRRD

SEQ ID NO: 1031969 - protein, 20 aa, Mycobacterium
YQRRGEEDSQASQRAAEAAA

SEQ ID NO: 1031970 - protein, 14 aa, Mycobacterium
YQSEHDRWTENRNS

SEQ ID NO: 1031971 - protein, 5 aa, Mycobacterium
YQSLG

SEQ ID NO: 1031972 - protein, 8 aa, Mycobacterium
YQSPPVPG

SEQ ID NO: 1031973 - protein, 9 aa, Mycobacterium
YQSRQDPAL

SEQ ID NO: 1031974 - protein, 4 aa, Mycobacterium
YQSS

SEQ ID NO: 1031975 - protein, 10 aa, Mycobacterium
YQSTKVSERH

SEQ ID NO: 1031976 - protein, 8 aa, Mycobacterium
YQTSDGGT

SEQ ID NO: 1031977 - protein, 16 aa, Mycobacterium
YRAEATKDASQYPPNL

SEQ ID NO: 1031978 - protein, 6 aa, Mycobacterium
YRAPTS

SEQ ID NO: 1031979 - protein, 10 aa, Mycobacterium
YRAQSGETKH

SEQ ID NO: 1031980 - protein, 4 aa, Mycobacterium
YRDA

SEQ ID NO: 1031981 - protein, 11 aa, Mycobacterium
YRDANGKPQIA

SEQ ID NO: 1031982 - protein, 12 aa, Mycobacterium
YRDDAKGPSASV

SEQ ID NO: 1031983 - protein, 7 aa, Mycobacterium
YRDGEGD

SEQ ID NO: 1031984 - protein, 7 aa, Mycobacterium
YRDGETL

SEQ ID NO: 1031985 - protein, 9 aa, Mycobacterium
YRDPNTRGF

SEQ ID NO: 1031986 - protein, 4 aa, Mycobacterium
YRDS

SEQ ID NO: 1031987 - protein, 9 aa, Mycobacterium
YRDSTIKQA

SEQ ID NO: 1031988 - protein, 8 aa, Mycobacterium
YREPETAT

SEQ ID NO: 1031989 - protein, 14 aa, Mycobacterium
YRETGQQPLAAGET

SEQ ID NO: 1031990 - protein, 7 aa, Mycobacterium
YRGAANE

SEQ ID NO: 1031991 - protein, 4 aa, Mycobacterium
YRGD

SEQ ID NO: 1031992 - protein, 17 aa, Mycobacterium
YRGDRRQRGGPFSHVVL

SEQ ID NO: 1031993 - protein, 4 aa, Mycobacterium
YRGE

SEQ ID NO: 1031994 - protein, 9 aa, Mycobacterium
YRGEPAYRQ

SEQ ID NO: 1031995 - protein, 9 aa, Mycobacterium
YRGESAEFG

SEQ ID NO: 1031996 - protein, 6 aa, Mycobacterium
YRGKFD

SEQ ID NO: 1031997 - protein, 7 aa, Mycobacterium
YRGPAAD

SEQ ID NO: 1031998 - protein, 5 aa, Mycobacterium
YRGSA

SEQ ID NO: 1031999 - protein, 9 aa, Mycobacterium
YRGSDESGI

SEQ ID NO: 1032000 - protein, 9 aa, Mycobacterium
YRGSPTHQQ

SEQ ID NO: 1032001 - protein, 13 aa, Mycobacterium
YRKPTIGTANAGT

SEQ ID NO: 1032002 - protein, 7 aa, Mycobacterium
YRPDEEK

SEQ ID NO: 1032003 - protein, 11 aa, Mycobacterium
YRPDPAEPTQA

SEQ ID NO: 1032004 - protein, 9 aa, Mycobacterium
YRPGDPPLA

SEQ ID NO: 1032005 - protein, 13 aa, Mycobacterium
YRPPDGRGRPGAD

SEQ ID NO: 1032006 - protein, 4 aa, Mycobacterium
YRPR

SEQ ID NO: 1032007 - protein, 14 aa, Mycobacterium
YRPTGRGGEREIGG

SEQ ID NO: 1032008 - protein, 8 aa, Mycobacterium
YRPTPAAN

SEQ ID NO: 1032009 - protein, 10 aa, Mycobacterium
YRRAAEGTDA

SEQ ID NO: 1032010 - protein, 9 aa, Mycobacterium
YRRRTDPKD

SEQ ID NO: 1032011 - protein, 6 aa, Mycobacterium
YRRSKN

SEQ ID NO: 1032012 - protein, 13 aa, Mycobacterium
YRRSPRAPALGAS

SEQ ID NO: 1032013 - protein, 24 aa, Mycobacterium
YRSEPGTGRGCESGPAGRAGQTRY

SEQ ID NO: 1032014 - protein, 13 aa, Mycobacterium
YRSGDSGRRLSNG

SEQ ID NO: 1032015 - protein, 7 aa, Mycobacterium
YRSRGTR

SEQ ID NO: 1032016 - protein, 8 aa, Mycobacterium
YRSRRRGE

SEQ ID NO: 1032017 - protein, 5 aa, Mycobacterium
YRSTA

SEQ ID NO: 1032018 - protein, 8 aa, Mycobacterium
YRSTGADL

SEQ ID NO: 1032019 - protein, 6 aa, Mycobacterium
YRSTPQ

SEQ ID NO: 1032020 - protein, 6 aa, Mycobacterium
YRTADQ

SEQ ID NO: 1032021 - protein, 58 aa, Mycobacterium
YRTDSREATKKSKSSSGGSSSSESSSSSGSSDAKTSSTSSSSKEKSTSSATPAAASTS

SEQ ID NO: 1032022 - protein, 4 aa, Mycobacterium
YRTE

SEQ ID NO: 1032023 - protein, 4 aa, Mycobacterium
YRTG

SEQ ID NO: 1032024 - protein, 6 aa, Mycobacterium
YRTGVP

SEQ ID NO: 1032025 - protein, 30 aa, Mycobacterium
YRTPPDSGGRGDPGHHDHSARGEQHMSATQ

SEQ ID NO: 1032026 - protein, 9 aa, Mycobacterium
YRTPRPNPR

SEQ ID NO: 1032027 - protein, 9 aa, Mycobacterium
YRTSGDSPI

SEQ ID NO: 1032028 - protein, 8 aa, Mycobacterium
YRTSSGAD

SEQ ID NO: 1032029 - protein, 4 aa, Mycobacterium
YRYQ

SEQ ID NO: 1032030 - protein, 15 aa, Mycobacterium
YSANPELAPPAPISG

SEQ ID NO: 1032031 - protein, 7 aa, Mycobacterium
YSAPKEL

SEQ ID NO: 1032032 - protein, 15 aa, Mycobacterium
YSAYTGGPDPLAPPV

SEQ ID NO: 1032033 - protein, 8 aa, Mycobacterium
YSDAATTR

SEQ ID NO: 1032034 - protein, 4 aa, Mycobacterium
YSDD

SEQ ID NO: 1032035 - protein, 7 aa, Mycobacterium
YSDEHGD

SEQ ID NO: 1032036 - protein, 9 aa, Mycobacterium
YSDGAPENW

SEQ ID NO: 1032037 - protein, 10 aa, Mycobacterium
YSDNATGTVW

SEQ ID NO: 1032038 - protein, 13 aa, Mycobacterium
YSDPDDEASLAAR

SEQ ID NO: 1032039 - protein, 22 aa, Mycobacterium
YSDPGMDGPTIQRATEAALSGG

SEQ ID NO: 1032040 - protein, 5 aa, Mycobacterium
YSDTQ

SEQ ID NO: 1032041 - protein, 20 aa, Mycobacterium
YSEAPGGRSGGRSIEPKPFD

SEQ ID NO: 1032042 - protein, 10 aa, Mycobacterium
YSEPGAGSDL

SEQ ID NO: 1032043 - protein, 5 aa, Mycobacterium
YSEQP

SEQ ID NO: 1032044 - protein, 7 aa, Mycobacterium
YSESDQP

SEQ ID NO: 1032045 - protein, 5 aa, Mycobacterium
YSGAG

SEQ ID NO: 1032046 - protein, 23 aa, Mycobacterium
YSGAQRGVAERQQRQARGQSEVP

SEQ ID NO: 1032047 - protein, 6 aa, Mycobacterium
YSGARG

SEQ ID NO: 1032048 - protein, 7 aa, Mycobacterium
YSGATTA

SEQ ID NO: 1032049 - protein, 9 aa, Mycobacterium
YSGKFSSDR

SEQ ID NO: 1032050 - protein, 9 aa, Mycobacterium
YSGPGSSPL

SEQ ID NO: 1032051 - protein, 9 aa, Mycobacterium
YSGPGSTPL

SEQ ID NO: 1032052 - protein, 8 aa, Mycobacterium
YSGQPVNS

SEQ ID NO: 1032053 - protein, 16 aa, Mycobacterium
YSGRDQVSPQAGRDTA

SEQ ID NO: 1032054 - protein, 4 aa, Mycobacterium
YSGT

SEQ ID NO: 1032055 - protein, 7 aa, Mycobacterium
YSHPGDN

SEQ ID NO: 1032056 - protein, 6 aa, Mycobacterium
YSKPKD

SEQ ID NO: 1032057 - protein, 9 aa, Mycobacterium
YSKSKGQPL

SEQ ID NO: 1032058 - protein, 7 aa, Mycobacterium
YSNEAKA

SEQ ID NO: 1032059 - protein, 7 aa, Mycobacterium
YSPADES

SEQ ID NO: 1032060 - protein, 10 aa, Mycobacterium
YSPAQPDSWE

SEQ ID NO: 1032061 - protein, 15 aa, Mycobacterium
YSPATSSIVPSQDDG

SEQ ID NO: 1032062 - protein, 6 aa, Mycobacterium
YSPDRD

SEQ ID NO: 1032063 - protein, 10 aa, Mycobacterium
YSPERAHRPD

SEQ ID NO: 1032064 - protein, 6 aa, Mycobacterium
YSPGAL

SEQ ID NO: 1032065 - protein, 8 aa, Mycobacterium
YSPGTVDQ

SEQ ID NO: 1032066 - protein, 25 aa, Mycobacterium
YSPQQLPSAMSPELEGTARFKSPNP

SEQ ID NO: 1032067 - protein, 20 aa, Mycobacterium
YSPSLTVSQASGRIRCAPPW

SEQ ID NO: 1032068 - protein, 9 aa, Mycobacterium
YSQDPERHE

SEQ ID NO: 1032069 - protein, 7 aa, Mycobacterium
YSQGAGI

SEQ ID NO: 1032070 - protein, 5 aa, Mycobacterium
YSQGT

SEQ ID NO: 1032071 - protein, 6 aa, Mycobacterium
YSQTDL

SEQ ID NO: 1032072 - protein, 13 aa, Mycobacterium
YSQTLRQITHVLD

SEQ ID NO: 1032073 - protein, 6 aa, Mycobacterium
YSRAKL

SEQ ID NO: 1032074 - protein, 6 aa, Mycobacterium
YSRQGW

SEQ ID NO: 1032075 - protein, 12 aa, Mycobacterium
YSSLTPNAGPYF

SEQ ID NO: 1032076 - protein, 17 aa, Mycobacterium
YSSNNGSAIGTSRTEAT

SEQ ID NO: 1032077 - protein, 9 aa, Mycobacterium
YSSRENAAD

SEQ ID NO: 1032078 - protein, 8 aa, Mycobacterium
YSTEPPGE

SEQ ID NO: 1032079 - protein, 9 aa, Mycobacterium
YSTPESPVS

SEQ ID NO: 1032080 - protein, 8 aa, Mycobacterium
YSTPSERL

SEQ ID NO: 1032081 - protein, 7 aa, Mycobacterium
YSTTGSI

SEQ ID NO: 1032082 - protein, 11 aa, Mycobacterium
YSVTTSTGDTV

SEQ ID NO: 1032083 - protein, 14 aa, Mycobacterium
YSYTEDPTVNWNTP

SEQ ID NO: 1032084 - protein, 4 aa, Mycobacterium
YTAD

SEQ ID NO: 1032085 - protein, 6 aa, Mycobacterium
YTADEA

SEQ ID NO: 1032086 - protein, 6 aa, Mycobacterium
YTAGDG

SEQ ID NO: 1032087 - protein, 8 aa, Mycobacterium
YTAGPAKW

SEQ ID NO: 1032088 - protein, 10 aa, Mycobacterium
YTANGSSAGI

SEQ ID NO: 1032089 - protein, 5 aa, Mycobacterium
YTATG

SEQ ID NO: 1032090 - protein, 5 aa, Mycobacterium
YTDET

SEQ ID NO: 1032091 - protein, 8 aa, Mycobacterium
YTDGSAER

SEQ ID NO: 1032092 - protein, 10 aa, Mycobacterium
YTDPDGGKAV

SEQ ID NO: 1032093 - protein, 8 aa, Mycobacterium
YTDSSRTI

SEQ ID NO: 1032094 - protein, 11 aa, Mycobacterium
YTFEGTPRTAA

SEQ ID NO: 1032095 - protein, 4 aa, Mycobacterium
YTGA

SEQ ID NO: 1032096 - protein, 10 aa, Mycobacterium
YTGEKGEVSA

SEQ ID NO: 1032097 - protein, 13 aa, Mycobacterium
YTGGDSTGGLTGL

SEQ ID NO: 1032098 - protein, 15 aa, Mycobacterium
YTGGTTGKPKGVIGT

SEQ ID NO: 1032099 - protein, 15 aa, Mycobacterium
YTGPGPGSLSAAAAN

SEQ ID NO: 1032100 - protein, 4 aa, Mycobacterium
YTGQ

SEQ ID NO: 1032101 - protein, 6 aa, Mycobacterium
YTGQGL

SEQ ID NO: 1032102 - protein, 11 aa, Mycobacterium
YTGTGNSLNAR

SEQ ID NO: 1032103 - protein, 5 aa, Mycobacterium
YTKEH

SEQ ID NO: 1032104 - protein, 9 aa, Mycobacterium
YTKERKAFG

SEQ ID NO: 1032105 - protein, 16 aa, Mycobacterium
YTKNGETYTSVGPAQR

SEQ ID NO: 1032106 - protein, 5 aa, Mycobacterium
YTNAN

SEQ ID NO: 1032107 - protein, 4 aa, Mycobacterium
YTPI

SEQ ID NO: 1032108 - protein, 13 aa, Mycobacterium
YTPKNGGRIVVHR

SEQ ID NO: 1032109 - protein, 8 aa, Mycobacterium
YTQSGGGD

SEQ ID NO: 1032110 - protein, 6 aa, Mycobacterium
YTRDNA

SEQ ID NO: 1032111 - protein, 8 aa, Mycobacterium
YTREEAAY

SEQ ID NO: 1032112 - protein, 12 aa, Mycobacterium
YTRSPGQCNNDG

SEQ ID NO: 1032113 - protein, 9 aa, Mycobacterium
YTSGQPDPD

SEQ ID NO: 1032114 - protein, 28 aa, Mycobacterium
YTSGTGQGNASATKDGSSYKISGTATGV

SEQ ID NO: 1032115 - protein, 10 aa, Mycobacterium
YTSPSSGTVT

SEQ ID NO: 1032116 - protein, 5 aa, Mycobacterium
YTSRE

SEQ ID NO: 1032117 - protein, 4 aa, Mycobacterium
YTST

SEQ ID NO: 1032118 - protein, 13 aa, Mycobacterium
YTSTNTAHGGQET

SEQ ID NO: 1032119 - protein, 4 aa, Mycobacterium
YTTE

SEQ ID NO: 1032120 - protein, 10 aa, Mycobacterium
YTTEPEPQLG

SEQ ID NO: 1032121 - protein, 32 aa, Mycobacterium; identical to SEQ ID NO: 618179

SEQ ID NO: 1032122 - protein, 7 aa, Mycobacterium
YTTPEDF

SEQ ID NO: 1032123 - protein, 9 aa, Mycobacterium
YTTTTSGDR

SEQ ID NO: 1032124 - protein, 10 aa, Mycobacterium
YTYEDAEYTN

SEQ ID NO: 1032125 - protein, 6 aa, Mycobacterium
YVEESG

SEQ ID NO: 1032126 - protein, 6 aa, Mycobacterium
YVGENK

SEQ ID NO: 1032127 - protein, 8 aa, Mycobacterium
YVGETASQ

SEQ ID NO: 1032128 - protein, 116 aa, Mycobacterium
YVGGDGGTGGIGGEGGGGGEGGSAGGSGGVGGAGGAAGTGGAGGASGPGGIGGDGGDGGTGGDGGNGGEGAGDGGSNGGGGGGGQGGGGGAPSASGGSPGEHGAEGKAGGSGASSA

SEQ ID NO: 1032129 - protein, 17 aa, Mycobacterium
YVPEDDDERNDKQAREA

SEQ ID NO: 1032130 - protein, 7 aa, Mycobacterium
YVPEGDS

SEQ ID NO: 1032131 - protein, 6 aa, Mycobacterium
YVPGGT

SEQ ID NO: 1032132 - protein, 20 aa, Mycobacterium
YVPPATAETNGDGSGPSTQF

SEQ ID NO: 1032133 - protein, 4 aa, Mycobacterium
YVPS

SEQ ID NO: 1032134 - protein, 6 aa, Mycobacterium
YVTPDD

SEQ ID NO: 1032135 - protein, 6 aa, Mycobacterium
YVTTPG

SEQ ID NO: 1032136 - protein, 9 aa, Mycobacterium
YWGPPAKPG

SEQ ID NO: 1032137 - protein, 4 aa, Mycobacterium
YYGD

SEQ ID NO: 1032138 - protein, 9 aa, Mycobacterium
YYGDTRDRV

SEQ ID NO: 1032139 - protein, 13 aa, Mycobacterium
YYGPTGGLPADDP

SEQ ID NO: 1032140 - protein, 9 aa, Mycobacterium
YYPAGTTVN

SEQ ID NO: 1032141 - protein, 6 aa, Mycobacterium
YYPGGG

SEQ ID NO: 1032142 - protein, 16 aa, Mycobacterium
YYPQRQGGEKLPPTSK

SEQ ID NO: 1032143 - protein, 7 aa, Mycobacterium
YYPTGGR

SEQ ID NO: 1032144 - protein, 30 aa, Mycobacterium
TGQKRWTMRWKPALNAFAITFADRMPGSET

SEQ ID NO: 1032145 - protein, 18 aa, Mycobacterium
VADIFFLVCDGLKGLPDS

SEQ ID NO: 1032146 - protein, 18 aa, Mycobacterium
SAKYWLAVLTELKNRGVA

SEQ ID NO: 1032147 - protein, 17 aa, Mycobacterium
LERVYAAVFIDALHVKI

SEQ ID NO: 1032148 - protein, 24 aa, Mycobacterium
ARYRRAIRARGHFPTEQSALKCLY

SEQ ID NO: 1032149 - protein, 27 aa, Mycobacterium
AAIRLWRTAWNEFIPFLDYDTEIRKVI

SEQ ID NO: 1032150 - protein, 19 aa, Mycobacterium
WGHRYPAAIRLWRTAWNEF

SEQ ID NO: 1032151 - protein, 19 aa, Mycobacterium
WGHRYPAAIRLWRNAWNEF

SEQ ID NO: 1032152 - protein, 23 aa, Mycobacterium
ARYRRAIRARGHFPTEQSALKCL

SEQ ID NO: 1032153 - protein, 25 aa, Mycobacterium
SLPFEHARPTAIMTWMRQHCGIENS

SEQ ID NO: 1032154 - protein, 25 aa, Mycobacterium
AIRLWRNAWNEFIPFLDYDTEIRKV

SEQ ID NO: 1032155 - protein, 26 aa, Mycobacterium
AIRLWRNAWNEFIPFLDYDTEIRKVI

SEQ ID NO: 1032156 - protein, 17 aa, Mycobacterium
IRARGHFPTEQSALKCL

SEQ ID NO: 1032157 - protein, 19 aa, Mycobacterium
AGFDAGFFGISPREARAMD

SEQ ID NO: 1032158 - protein, 25 aa, Mycobacterium
AGFFGISPREARAMDPQQRLLLEVC

SEQ ID NO: 1032159 - protein, 25 aa, Mycobacterium
EEPVAVVGMACRFPGGVASADQLWD

SEQ ID NO: 1032160 - protein, 25 aa, Mycobacterium
MDPQQRLLLEVCWEALETAGIPAHT

SEQ ID NO: 1032161 - protein, 20 aa, Mycobacterium
SSSLVAIHLACQSLRNNESQ

SEQ ID NO: 1032162 - protein, 17 aa, Mycobacterium
TYTRYGAFLDDAAGFDA

SEQ ID NO: 1032163 - protein, 24 aa, Mycobacterium
VVGNFPADRGWDVEGLFDPDPDAV

SEQ ID NO: 1032164 - protein, 18 aa, Mycobacterium
AFAAALGQLHCHGISPSW

SEQ ID NO: 1032165 - protein, 41 aa, Mycobacterium; identical to SEQ ID NO: 965628

SEQ ID NO: 1032166 - protein, 17 aa, Mycobacterium
ATSHGLALFDAALATGQ

SEQ ID NO: 1032167 - protein, 25 aa, Mycobacterium
DALADYRHRLGLPATSLAWGYWQTH

SEQ ID NO: 1032168 - protein, 19 aa, Mycobacterium
DEQPEWVLHASAVLTAQTT

SEQ ID NO: 1032169 - protein, 24 aa, Mycobacterium
DQVLAPKIDAAWQLHQLTYEHNLS

SEQ ID NO: 1032170 - protein, 18 aa, Mycobacterium
DTIHIPRLTRHSSDGALT

SEQ ID NO: 1032171 - protein, 19 aa, Mycobacterium
ESAKYWLAVLTELKNRGVA

SEQ ID NO: 1032172 - protein, 18 aa, Mycobacterium
LAHAAVWGLIRSAQNEHP

SEQ ID NO: 1032173 - protein, 23 aa, Mycobacterium
LFAEHLVSAHGVRHLLLTSRRGP

SEQ ID NO: 1032174 - protein, 17 aa, Mycobacterium
LIVHTPLLLAGHDTADL

SEQ ID NO: 1032175 - protein, 22 aa, Mycobacterium
LQQRLTDLGAHVTITACDISDP

SEQ ID NO: 1032176 - protein, 19 aa, Mycobacterium
MRQHWGIENSLHWIRDVTF

SEQ ID NO: 1032177 - protein, 19 aa, Mycobacterium
RPDAVAFAAALGQLHCHGI

SEQ ID NO: 1032178 - protein, 23 aa, Mycobacterium
TGDQVRLPYAFTGISLHATHATR

SEQ ID NO: 1032179 - protein, 18 aa, Mycobacterium
THATRLRVRLTRTGADAI

SEQ ID NO: 1032180 - protein, 23 aa, Mycobacterium
TYAFQHQRYWLLPTAGDFSGANT

SEQ ID NO: 1032181 - protein, 24 aa, Mycobacterium
YEHNLSAFIMFSSMAGMIGSPGQG

SEQ ID NO: 1032182 - protein, 24 aa, Mycobacterium
DGESAKYCKYWLAVLTELKNRGVA

SEQ ID NO: 1032183 - protein, 18 aa, Mycobacterium
IENSLHWIRDVTFDEDRQ

SEQ ID NO: 1032184 - protein, 26 aa, Mycobacterium
LNEHAVESAVLFPGTGFVELALHVAD

SEQ ID NO: 1032185 - protein, 18 aa, Mycobacterium
RYRRAIRARGHFPTEQSA

SEQ ID NO: 1032186 - protein, 21 aa, Mycobacterium
SDPAVGVLVWPLSARSAPGLS

SEQ ID NO: 1032187 - protein, 25 aa, Mycobacterium
SVMSGRIAYTLGLEGPAITVDTACS

SEQ ID NO: 1032188 - protein, 31 aa, Mycobacterium; identical to SEQ ID NO: 967894

SEQ ID NO: 1032189 - protein, 19 aa, Mycobacterium
AHLWKALCQDYEVLGFDAA

SEQ ID NO: 1032190 - protein, 17 aa, Mycobacterium
AKYWLAVLTELKNRGVA

SEQ ID NO: 1032191 - protein, 20 aa, Mycobacterium
APDGRCKAFAATADGTGFGE

SEQ ID NO: 1032192 - protein, 22 aa, Mycobacterium
DIHIGPSDHVGWLDDRKWAYVR

SEQ ID NO: 1032193 - protein, 20 aa, Mycobacterium
DRIVSIGAFEHFGRQRYARF

SEQ ID NO: 1032194 - protein, 24 aa, Mycobacterium
EHFGRQRYARFFKMAHEVLPADSV

SEQ ID NO: 1032195 - protein, 24 aa, Mycobacterium
FILAEIFPGGWLPTVPTVEEHATA

SEQ ID NO: 1032196 - protein, 18 aa, Mycobacterium
FYAQCAINARVAFVNALP

SEQ ID NO: 1032197 - protein, 18 aa, Mycobacterium
GHRYPAAIRLWRTAWNEF

SEQ ID NO: 1032198 - protein, 23 aa, Mycobacterium
GQKRWTMRWKPALNAFAITFADR

SEQ ID NO: 1032199 - protein, 23 aa, Mycobacterium
KSDEITRIVGLLVTTCAKTAFDL

SEQ ID NO: 1032200 - protein, 18 aa, Mycobacterium
LASLHLVHDWNREFVRTS

SEQ ID NO: 1032201 - protein, 24 aa, Mycobacterium
LCGCGLVVPCYLRQARRDTTLGNG

SEQ ID NO: 1032202 - protein, 23 aa, Mycobacterium
LTGCGSSLPMSNVIHLTQQARHH

SEQ ID NO: 1032203 - protein, 23 aa, Mycobacterium
LTHEIVHFTQFILAEIFPGGWLP

SEQ ID NO: 1032204 - protein, 17 aa, Mycobacterium
LTQWYGFNWTTSQIAAQ

SEQ ID NO: 1032205 - protein, 28 aa, Mycobacterium
PPAADDVSILLAHFFSGHGRQYQAHASQ

SEQ ID NO: 1032206 - protein, 26 aa, Mycobacterium
QCAINARVAFVNALPVFIASDPVWAK

SEQ ID NO: 1032207 - protein, 21 aa, Mycobacterium
RKVSLERADQIWLVALPLITL

SEQ ID NO: 1032208 - protein, 18 aa, Mycobacterium
RVLRLVKSFLKVRILSEL

SEQ ID NO: 1032209 - protein, 20 aa, Mycobacterium
TSLFHKGQWVIVLLTAPMPG

SEQ ID NO: 1032210 - protein, 21 aa, Mycobacterium
VTTCAKTAFDLAVQLPTGKAV

SEQ ID NO: 1032211 - protein, 17 aa, Mycobacterium
WRRARKVSLERADQIWL

SEQ ID NO: 1032212 - protein, 30 aa, Mycobacterium; identical to SEQ ID NO: 965592

SEQ ID NO: 1032213 - protein, 23 aa, Mycobacterium
AAAKAAILASIAFHTRVTADDVY

SEQ ID NO: 1032214 - protein, 19 aa, Mycobacterium
AAAVVALRSRVLTDLAGAG

SEQ ID NO: 1032215 - protein, 21 aa, Mycobacterium
AAGLTRSFMAFLIDAYTEDEA

SEQ ID NO: 1032216 - protein, 17 aa, Mycobacterium
AAKVLEDLGWYVADNLP

SEQ ID NO: 1032217 - protein, 24 aa, Mycobacterium
ACDAALQPFTGWSVLAVLHDEPEA

SEQ ID NO: 1032218 - protein, 19 aa, Mycobacterium
ADVLRAWGKLGYPRRAKRL

SEQ ID NO: 1032219 - protein, 19 aa, Mycobacterium
AEQGLSFAREAALAKRLGS

SEQ ID NO: 1032220 - protein, 25 aa, Mycobacterium
AEVLGNWTGIPVFKLTEAETTRLLR

SEQ ID NO: 1032221 - protein, 20 aa, Mycobacterium
AGVPLKAPVAGIAMGLVSDD

SEQ ID NO: 1032222 - protein, 18 aa, Mycobacterium
AKLLHAFGECTVPRVTLV

SEQ ID NO: 1032223 - protein, 17 aa, Mycobacterium
AKSALDAVVSRWHAESS

SEQ ID NO: 1032224 - protein, 18 aa, Mycobacterium
ALAADWRVSGDNVKFGAT

SEQ ID NO: 1032225 - protein, 22 aa, Mycobacterium
ALGAEVRWASCNIFSTQDHAAA

SEQ ID NO: 1032226 - protein, 19 aa, Mycobacterium
ALQKYHWVEKINHVHTGGN

SEQ ID NO: 1032227 - protein, 17 aa, Mycobacterium
ANMQRQAVPLVRSEAPL

SEQ ID NO: 1032228 - protein, 21 aa, Mycobacterium
ANNPLRLGGCLNSESAEKAAR

SEQ ID NO: 1032229 - protein, 17 aa, Mycobacterium
ANPRASRTVPFVSKATA

SEQ ID NO: 1032230 - protein, 20 aa, Mycobacterium
APDGRCKAFAATADGTGWGE

SEQ ID NO: 1032231 - protein, 27 aa, Mycobacterium
AQIYAWRKGIKTLYYIRLRQMALEGTE

SEQ ID NO: 1032232 - protein, 17 aa, Mycobacterium
AQLGSLVAVLVLESTGT

SEQ ID NO: 1032233 - protein, 19 aa, Mycobacterium
AQYERAWGTIEALKEKDEA

SEQ ID NO: 1032234 - protein, 33 aa, Mycobacterium; identical to SEQ ID NO: 78145

SEQ ID NO: 1032235 - protein, 19 aa, Mycobacterium
ARQQLLALREEVDRLGQPP

SEQ ID NO: 1032236 - protein, 21 aa, Mycobacterium
ASAGHIYAVIGLKDTTTGDTL

SEQ ID NO: 1032237 - protein, 18 aa, Mycobacterium
ASRAEQGLSFAREAALAK

SEQ ID NO: 1032238 - protein, 17 aa, Mycobacterium
ATARPPTFVLFTTGFLE

SEQ ID NO: 1032239 - protein, 19 aa, Mycobacterium
AVEAGERLGFLPGTLSEKI

SEQ ID NO: 1032240 - protein, 23 aa, Mycobacterium
AVRELRPDLVLLDLMLPGMNGID

SEQ ID NO: 1032241 - protein, 18 aa, Mycobacterium
AVVLWEAQFGDFVNGAQS

SEQ ID NO: 1032242 - protein, 18 aa, Mycobacterium
AYAARAGITCAVLIPQGK

SEQ ID NO: 1032243 - protein, 18 aa, Mycobacterium
AYADGWPTHGFNLQCSCL

SEQ ID NO: 1032244 - protein, 22 aa, Mycobacterium
AYAEGLRALYLYTATFQDAAVA

SEQ ID NO: 1032245 - protein, 17 aa, Mycobacterium
CKAFAATADGTGWGEGA

SEQ ID NO: 1032246 - protein, 20 aa, Mycobacterium
CNPYLAFAVLLAAGLRGVEK

SEQ ID NO: 1032247 - protein, 20 aa, Mycobacterium
CTSLNEVICHGIPDSTVIAD

SEQ ID NO: 1032248 - protein, 19 aa, Mycobacterium
CYQFGDAKPVYALEGSIAV

SEQ ID NO: 1032249 - protein, 26 aa, Mycobacterium
DAKRLVDFAAGLAFALRGSFDKVATK

SEQ ID NO: 1032250 - protein, 17 aa, Mycobacterium
DALRVPYVINPRMVRGL

SEQ ID NO: 1032251 - protein, 20 aa, Mycobacterium
DAVLYTRAGPEIGVASTKTF

SEQ ID NO: 1032252 - protein, 25 aa, Mycobacterium
DELLDRVSSKYALVIYAAKRARQIN

SEQ ID NO: 1032253 - protein, 23 aa, Mycobacterium
DGADIGARCELLRGARVWPGVSI

SEQ ID NO: 1032254 - protein, 18 aa, Mycobacterium
DGVLHEFTTVPGVKEDVT

SEQ ID NO: 1032255 - protein, 18 aa, Mycobacterium
DIGEAVGIVAAQSIGEPG

SEQ ID NO: 1032256 - protein, 20 aa, Mycobacterium
DITCPVLAFVGEVDDIGQPA

SEQ ID NO: 1032257 - protein, 21 aa, Mycobacterium
DLKERREGDVLGRNQSGKAIT

SEQ ID NO: 1032258 - protein, 18 aa, Mycobacterium
DLQPGSSIMPGKVNPVLP

SEQ ID NO: 1032259 - protein, 23 aa, Mycobacterium
DLTDYLLEMGIRVRYLHSEVDTL

SEQ ID NO: 1032260 - protein, 25 aa, Mycobacterium
DSLPPEFRAAVVLCDIEGLSYEEIG

SEQ ID NO: 1032261 - protein, 21 aa, Mycobacterium
DSLRIFPATHYVAGPERMAQA

SEQ ID NO: 1032262 - protein, 23 aa, Mycobacterium
DTALAAYLVRPGQRSFTLDDLSL

SEQ ID NO: 1032263 - protein, 18 aa, Mycobacterium
DVDTPWRKLPAKARKAIL

SEQ ID NO: 1032264 - protein, 25 aa, Mycobacterium
DYWYRNIRNTVRFHDTVAALLGAGE

SEQ ID NO: 1032265 - protein, 20 aa, Mycobacterium
EAAGRLMFYGQGAGGAPTAS

SEQ ID NO: 1032266 - protein, 24 aa, Mycobacterium
EANLRLVVSLAKRYTGRGMPLLDL

SEQ ID NO: 1032267 - protein, 25 aa, Mycobacterium
EAPARAYNPLFIWGESGLGKTHLLH

SEQ ID NO: 1032268 - protein, 25 aa, Mycobacterium
EDLAYRVAVGLYRYSLLDIIDIADI

SEQ ID NO: 1032269 - protein, 23 aa, Mycobacterium
EDSRGRTSLVITELPYQVNHDNF

SEQ ID NO: 1032270 - protein, 17 aa, Mycobacterium
EEMKRFPEELGKMGFVF

SEQ ID NO: 1032271 - protein, 30 aa, Mycobacterium; identical to SEQ ID NO: 620916

SEQ ID NO: 1032272 - protein, 18 aa, Mycobacterium
EFTEAWTTFATVEKSWAY

SEQ ID NO: 1032273 - protein, 18 aa, Mycobacterium
EIRKEGKIGRVYYPAPYM

SEQ ID NO: 1032274 - protein, 19 aa, Mycobacterium
ELLPELTLAQKWDLTATEL

SEQ ID NO: 1032275 - protein, 26 aa, Mycobacterium
ELPELTPRPSTIAMYSTVDGEPHDTA

SEQ ID NO: 1032276 - protein, 20 aa, Mycobacterium
ELRIGLATAEDIRQWSYGEV

SEQ ID NO: 1032277 - protein, 22 aa, Mycobacterium
ELRRRVKAMSYGLAYGLSAYGL

SEQ ID NO: 1032278 - protein, 26 aa, Mycobacterium
ENLFFKEKRYDLARVGRYKVNKKLGL

SEQ ID NO: 1032279 - protein, 21 aa, Mycobacterium
EPGIPESFKVLLKELQSLCLN

SEQ ID NO: 1032280 - protein, 24 aa, Mycobacterium
EPGLQEKPLSIAMREIHADLLEHT

SEQ ID NO: 1032281 - protein, 20 aa, Mycobacterium
EQANINWGKAGRMRWKGKRP

SEQ ID NO: 1032282 - protein, 19 aa, Mycobacterium
ERILYYTGISYKIGEVHDG

SEQ ID NO: 1032283 - protein, 20 aa, Mycobacterium
ETREIWSYGSGYGGNALLGK

SEQ ID NO: 1032284 - protein, 27 aa, Mycobacterium
EYLSGRWAQAYGFPLMPIDGILVGTAA

SEQ ID NO: 1032285 - protein, 24 aa, Mycobacterium
FDPTRAMPAYNWMTVAKSALESVN

SEQ ID NO: 1032286 - protein, 21 aa, Mycobacterium
FGFAAHRGMTVLPLAKSASGG

SEQ ID NO: 1032287 - protein, 31 aa, Mycobacterium; identical to SEQ ID NO: 199120

SEQ ID NO: 1032288 - protein, 18 aa, Mycobacterium
FGGEVERGLSMVDGVLLL

SEQ ID NO: 1032289 - protein, 26 aa, Mycobacterium
FGQPEIKLGVLPGMGGSQRLTRAIGK

SEQ ID NO: 1032290 - protein, 21 aa, Mycobacterium
FHDRFTASRLFGAPPGYVGYE

SEQ ID NO: 1032291 - protein, 25 aa, Mycobacterium
FHLRNRLVVAAMHWDGDVTGLVRSH

SEQ ID NO: 1032292 - protein, 18 aa, Mycobacterium
FHSPHMDPILEQFRQIAA

SEQ ID NO: 1032293 - protein, 17 aa, Mycobacterium
FIGHTFAVHDGRKHVPV

SEQ ID NO: 1032294 - protein, 25 aa, Mycobacterium
FKVLLKELQSLCLNVEVLSSDGAAI

SEQ ID NO: 1032295 - protein, 24 aa, Mycobacterium
FLESLRYDLAVQEIFVFTPKGDVI

SEQ ID NO: 1032296 - protein, 18 aa, Mycobacterium
FPGCAVVISHDRWFLDRT

SEQ ID NO: 1032297 - protein, 25 aa, Mycobacterium
FPGEISGGMRKRAGLARALVLDPQI

SEQ ID NO: 1032298 - protein, 18 aa, Mycobacterium
FPSACGKTNLAMLQPTIP

SEQ ID NO: 1032299 - protein, 17 aa, Mycobacterium
FSLCMDNGMPILVFNLL

SEQ ID NO: 1032300 - protein, 28 aa, Mycobacterium
FSVMVSLAALWRWAGITPDAVIGHSQGE

SEQ ID NO: 1032301 - protein, 22 aa, Mycobacterium
FTGVPCIVDLATMREAIGDLGG

SEQ ID NO: 1032302 - protein, 17 aa, Mycobacterium
GACIGPMGQRVRNVMSE

SEQ ID NO: 1032303 - protein, 19 aa, Mycobacterium
GALPLLAPMSEVAGRLSAQ

SEQ ID NO: 1032304 - protein, 20 aa, Mycobacterium
GAQDTRLVWEERRMRREVRA

SEQ ID NO: 1032305 - protein, 18 aa, Mycobacterium
GAVLPILALYVVAAEEQG

SEQ ID NO: 1032306 - protein, 21 aa, Mycobacterium
GDGAFGFSGMEWDTLVRHNVP

SEQ ID NO: 1032307 - protein, 17 aa, Mycobacterium
GELTAAYAAGVLSLQDA

SEQ ID NO: 1032308 - protein, 18 aa, Mycobacterium
GERLDAKALVAFTQSGDT

SEQ ID NO: 1032309 - protein, 24 aa, Mycobacterium
GERRRVALCKLLLSKPDLLLLDEP

SEQ ID NO: 1032310 - protein, 18 aa, Mycobacterium
GGDLEFADELTLGRALTG

SEQ ID NO: 1032311 - protein, 23 aa, Mycobacterium
GGERNRLNLALTLKQGGNLILLD

SEQ ID NO: 1032312 - protein, 20 aa, Mycobacterium
GGHHSWEDLDDLLLATYSEL

SEQ ID NO: 1032313 - protein, 23 aa, Mycobacterium
GGKALKFYASVRMDVRRIETLKD

SEQ ID NO: 1032314 - protein, 20 aa, Mycobacterium
GGRRSFILVPGIDVPFHSRV

SEQ ID NO: 1032315 - protein, 18 aa, Mycobacterium
GHRYPAAIRLWRNAWNEF

SEQ ID NO: 1032316 - protein, 24 aa, Mycobacterium
GIETKGGVMTKLIERNTTIPTKRS

SEQ ID NO: 1032317 - protein, 26 aa, Mycobacterium
GKVTKLVPFGAFVRVEEGIEGLVHIS

SEQ ID NO: 1032318 - protein, 26 aa, Mycobacterium
GLKDPKRPSGSFIFAGPSGVGKTELS

SEQ ID NO: 1032319 - protein, 19 aa, Mycobacterium
GLVALPWHAAYSASKYGLR

SEQ ID NO: 1032320 - protein, 26 aa, Mycobacterium
GMEPDLKWERFITAVRLLAERLGVRQ

SEQ ID NO: 1032321 - protein, 17 aa, Mycobacterium
GMLKYGFDDARPVLERA

SEQ ID NO: 1032322 - protein, 24 aa, Mycobacterium
GMRFDKGYISGYFVTDAERQEAVL

SEQ ID NO: 1032323 - protein, 18 aa, Mycobacterium
GMRSHPGVTATFCEALAA

SEQ ID NO: 1032324 - protein, 26 aa, Mycobacterium
GMVFQRPNPFPAMSIRDNVVAGLKLQ

SEQ ID NO: 1032325 - protein, 22 aa, Mycobacterium
GPPGCGKTLIAKAVANSLAKKM

SEQ ID NO: 1032326 - protein, 21 aa, Mycobacterium
GPRRKGVRYFGPYSHAWAIRE

SEQ ID NO: 1032327 - protein, 22 aa, Mycobacterium
GPTGCGKTYLAQTLAKMLNVPF

SEQ ID NO: 1032328 - protein, 27 aa, Mycobacterium
GQVLKEIQSRLGFLLDVGLEYLSLSRA

SEQ ID NO: 1032329 - protein, 21 aa, Mycobacterium
GRGSQWAGMGRQLLADEPAFA

SEQ ID NO: 1032330 - protein, 27 aa, Mycobacterium
GRILGVKGRVLPMCPIALQIEADVSGL

SEQ ID NO: 1032331 - protein, 29 aa, Mycobacterium
GTALHRLFTHAGIHPDYLLGHSIGELTAA

SEQ ID NO: 1032332 - protein, 18 aa, Mycobacterium
HAEACRWEHVMSEDVERR

SEQ ID NO: 1032333 - protein, 17 aa, Mycobacterium
HGGALSPRGDWRAPSDM

SEQ ID NO: 1032334 - protein, 18 aa, Mycobacterium
HKTFCIPHGGGGPGVGPV

SEQ ID NO: 1032335 - protein, 31 aa, Mycobacterium; identical to SEQ ID NO: 80871

SEQ ID NO: 1032336 - protein, 25 aa, Mycobacterium
IDNPDRWAPPYAEAGAYNVTFHAEA

SEQ ID NO: 1032337 - protein, 25 aa, Mycobacterium
IELDGLRLITWRGASRAEQGLSFAR

SEQ ID NO: 1032338 - protein, 17 aa, Mycobacterium
IFDSVYDIYRGVVTYVR

SEQ ID NO: 1032339 - protein, 20 aa, Mycobacterium
IGRPDAWEVQGRGELALAVL

SEQ ID NO: 1032340 - protein, 17 aa, Mycobacterium
IGTMIKQLLEEVRAAPL

SEQ ID NO: 1032341 - protein, 26 aa, Mycobacterium
IHESAKRICKEAHYYGAGTVEYLVGQ

SEQ ID NO: 1032342 - protein, 19 aa, Mycobacterium
IHETREWILRNSPVPVGTV

SEQ ID NO: 1032343 - protein, 23 aa, Mycobacterium
IHPVAACATAAVSVEEGVDKIRL

SEQ ID NO: 1032344 - protein, 25 aa, Mycobacterium
IIYDEVHLLPAPVFRMTADLQSKRR

SEQ ID NO: 1032345 - protein, 19 aa, Mycobacterium
IKTWSRRSTIIPDFIGHTF

SEQ ID NO: 1032346 - protein, 27 aa, Mycobacterium
ILQRYKDLQDIIAILGIDELSEEDKQL

SEQ ID NO: 1032347 - protein, 18 aa, Mycobacterium
INEAASLVQDAAHPDANI

SEQ ID NO: 1032348 - protein, 20 aa, Mycobacterium
IPMDCHLMIDNPDRWAPPYA

SEQ ID NO: 1032349 - protein, 18 aa, Mycobacterium
ISHDRWFLDRTCTHILAW

SEQ ID NO: 1032350 - protein, 34 aa, Mycobacterium; identical to SEQ ID NO: 81328

SEQ ID NO: 1032351 - protein, 24 aa, Mycobacterium
KATATHLVSVFAHRARLVLGQLAV

SEQ ID NO: 1032352 - protein, 20 aa, Mycobacterium
KDVRRWWRSDSLWQAHDARY

SEQ ID NO: 1032353 - protein, 20 aa, Mycobacterium
KDVSTAWQLDAYRFEIPVVA

SEQ ID NO: 1032354 - protein, 18 aa, Mycobacterium
KFADEFHPELQFDKPYLL

SEQ ID NO: 1032355 - protein, 40 aa, Mycobacterium; identical to SEQ ID NO: 81452

SEQ ID NO: 1032356 - protein, 25 aa, Mycobacterium
KINEPRFPSFKGIMAAKKKEVTVLT

SEQ ID NO: 1032357 - protein, 19 aa, Mycobacterium
KLKELIPRQQFEVPVQAAI

SEQ ID NO: 1032358 - protein, 25 aa, Mycobacterium
KLRALKRLKVVAAFQQSGNSPMGMV

SEQ ID NO: 1032359 - protein, 19 aa, Mycobacterium
KPALNAFAITFADRMPGSE

SEQ ID NO: 1032360 - protein, 27 aa, Mycobacterium
KQAEAYRAISLLLRRPPGREAYPGDVF

SEQ ID NO: 1032361 - protein, 24 aa, Mycobacterium
KVGRIARVLGPRGLMPNPKTGTVT

SEQ ID NO: 1032362 - protein, 17 aa, Mycobacterium
LAAHWLSHGQWTDGWDP

SEQ ID NO: 1032363 - protein, 18 aa, Mycobacterium
LATDSWLSAASFQETTRV

SEQ ID NO: 1032364 - protein, 21 aa, Mycobacterium
LDRLYGYEVSPVLWKKVAPKL

SEQ ID NO: 1032365 - protein, 25 aa, Mycobacterium
LDVMMPRLDGLEVCRQLRSTGDDLP

SEQ ID NO: 1032366 - protein, 19 aa, Mycobacterium
LEADLVLLAMGFVGPEKPG

SEQ ID NO: 1032367 - protein, 21 aa, Mycobacterium
LEAIPRISRAQVMDALSSQAN

SEQ ID NO: 1032368 - protein, 36 aa, Mycobacterium; identical to SEQ ID NO: 81820

SEQ ID NO: 1032369 - protein, 17 aa, Mycobacterium
LEDLGWYVADNLPPQLI

SEQ ID NO: 1032370 - protein, 20 aa, Mycobacterium
LEGKSSLGRLGLLTHSTAGF

SEQ ID NO: 1032371 - protein, 17 aa, Mycobacterium
LFGLSRERVRQIERDVM

SEQ ID NO: 1032372 - protein, 18 aa, Mycobacterium
LGLFEINEAASLVQDAAH

SEQ ID NO: 1032373 - protein, 33 aa, Mycobacterium; identical to SEQ ID NO: 81998

SEQ ID NO: 1032374 - protein, 18 aa, Mycobacterium
LIEPGVRTGIPLLVDNPK

SEQ ID NO: 1032375 - protein, 18 aa, Mycobacterium
LITTPGLINVDFADVKGI

SEQ ID NO: 1032376 - protein, 17 aa, Mycobacterium
LKIVARAGVGLDNVDVD

SEQ ID NO: 1032377 - protein, 17 aa, Mycobacterium
LKLKELAYMHAEGFAAG

SEQ ID NO: 1032378 - protein, 26 aa, Mycobacterium
LLDVGCGWGGALVRAVEKYDVNVIGL

SEQ ID NO: 1032379 - protein, 20 aa, Mycobacterium
LLEIEPALKALEGVVMELDD

SEQ ID NO: 1032380 - protein, 22 aa, Mycobacterium
LLPDNLRWLVTVDAMHTQVVTA

SEQ ID NO: 1032381 - protein, 17 aa, Mycobacterium
LMQSCTPGGTMLALQAS

SEQ ID NO: 1032382 - protein, 21 aa, Mycobacterium
LNALVGLARPGKFGGDVSHLN

SEQ ID NO: 1032383 - protein, 20 aa, Mycobacterium
LNIKGPELLNKFVGETERHI

SEQ ID NO: 1032384 - protein, 17 aa, Mycobacterium
LPEDRVVVELSPYDLSR

SEQ ID NO: 1032385 - protein, 26 aa, Mycobacterium
LPSYPHPRLMPDFWEFPTVSMGLGPL

SEQ ID NO: 1032386 - protein, 20 aa, Mycobacterium
LQVSHAFHSPHMDPILEQFR

SEQ ID NO: 1032387 - protein, 19 aa, Mycobacterium
LRNTVRFHDTVAALLGAGE

SEQ ID NO: 1032388 - protein, 20 aa, Mycobacterium
LSLFFVPKFLFDFETGELGE

SEQ ID NO: 1032389 - protein, 17 aa, Mycobacterium
LSSAPVWCSDIRAGAGL

SEQ ID NO: 1032390 - protein, 17 aa, Mycobacterium
LTAAYAAGVLSLQDAAT

SEQ ID NO: 1032391 - protein, 28 aa, Mycobacterium
LTPLEFDLLVALARKPRQVFTRDVLLEQ

SEQ ID NO: 1032392 - protein, 18 aa, Mycobacterium
LTTRVIDLIMPIGKGQRA

SEQ ID NO: 1032393 - protein, 17 aa, Mycobacterium
LVDACRLSRARVVVTPH

SEQ ID NO: 1032394 - protein, 20 aa, Mycobacterium
LWKKVAPKLSAGRVQSVATR

SEQ ID NO: 1032395 - protein, 18 aa, Mycobacterium
MAGNFSFGDYFKRGAIEL

SEQ ID NO: 1032396 - protein, 35 aa, Mycobacterium; identical to SEQ ID NO: 82626

SEQ ID NO: 1032397 - protein, 26 aa, Mycobacterium
MKRFPEELGKMGFVFNFITYGGHQID

SEQ ID NO: 1032398 - protein, 18 aa, Mycobacterium
MLCYRRRGHNEGDDPSMT

SEQ ID NO: 1032399 - protein, 29 aa, Mycobacterium
MLEMAACGAKVLMLRCVEYARRHNIPVHV

SEQ ID NO: 1032400 - protein, 18 aa, Mycobacterium
MRQHWGIENSLHWIRDVT

SEQ ID NO: 1032401 - protein, 22 aa, Mycobacterium
MRVPLEGGGRLVVELTPDEAAA

SEQ ID NO: 1032402 - protein, 24 aa, Mycobacterium
MYAAGRIPGSFFRREGRPSTDAIL

SEQ ID NO: 1032403 - protein, 19 aa, Mycobacterium
NCEIVPWCRFARKNYFYPD

SEQ ID NO: 1032404 - protein, 18 aa, Mycobacterium
NDLSFTRGSFRVRGDTVE

SEQ ID NO: 1032405 - protein, 21 aa, Mycobacterium
NDRDRLVVIIAGYRADLDKFL

SEQ ID NO: 1032406 - protein, 33 aa, Mycobacterium
NEIPCVCALLTLLPDNLRWLVTVDAMHTQVVTA

SEQ ID NO: 1032407 - protein, 23 aa, Mycobacterium
NLARAKMGLPVPVTSRHTLLLGP

SEQ ID NO: 1032408 - protein, 18 aa, Mycobacterium
NMSPEFGSTAAIFPIDEE

SEQ ID NO: 1032409 - protein, 25 aa, Mycobacterium
NWSIRRLSSLVGHGRARAMLLTAEK

SEQ ID NO: 1032410 - protein, 23 aa, Mycobacterium
NYRAWRHFIAMRASEHADVEIRR

SEQ ID NO: 1032411 - protein, 18 aa, Mycobacterium
PDLGGRLRAGRSRNDQVA

SEQ ID NO: 1032412 - protein, 25 aa, Mycobacterium
PDPEVVRALDMLFILHADHEQNCST

SEQ ID NO: 1032413 - protein, 26 aa, Mycobacterium
PEMAYFEVLHELKLIVDLMYEGGIAR

SEQ ID NO: 1032414 - protein, 21 aa, Mycobacterium
PERRRGMAVIISDFLGPINWM

SEQ ID NO: 1032415 - protein, 18 aa, Mycobacterium
PFDAYLTMRGLKTLVLRM

SEQ ID NO: 1032416 - protein, 27 aa, Mycobacterium
PFLHKELYREYALRPPKGVLLYGPPGC

SEQ ID NO: 1032417 - protein, 23 aa, Mycobacterium
PGGYLKAAVDFALDRDDYGPDLR

SEQ ID NO: 1032418 - protein, 19 aa, Mycobacterium
PGMNGIDVCRVLRADSGVP

SEQ ID NO: 1032419 - protein, 18 aa, Mycobacterium
PHLCSRAFITEQYDRYVR

SEQ ID NO: 1032420 - protein, 19 aa, Mycobacterium
PKELVARVRARLRRNDDEP

SEQ ID NO: 1032421 - protein, 18 aa, Mycobacterium
PLERVYAAVFIDALHVKI

SEQ ID NO: 1032422 - protein, 19 aa, Mycobacterium
PLERVYAAVFIDALHVKIR

SEQ ID NO: 1032423 - protein, 18 aa, Mycobacterium
PMAVCANGAVIYDPATDR

SEQ ID NO: 1032424 - protein, 22 aa, Mycobacterium
PPELETRIAILRKKAQMERLAV

SEQ ID NO: 1032425 - protein, 18 aa, Mycobacterium
PRECDAVLYTRAGPEIGV

SEQ ID NO: 1032426 - protein, 17 aa, Mycobacterium
PRRAAVSSFGLGGTNAH

SEQ ID NO: 1032427 - protein, 18 aa, Mycobacterium
PSVPHVLIEPGVRTGIPL

SEQ ID NO: 1032428 - protein, 24 aa, Mycobacterium
PVEIREFLEGYVIGQDTAKRTLAV

SEQ ID NO: 1032429 - protein, 18 aa, Mycobacterium
PVMAKARIGHFVEAQILQ

SEQ ID NO: 1032430 - protein, 25 aa, Mycobacterium
PWLSRKRIQQEWGISDEVMRDLVNA

SEQ ID NO: 1032431 - protein, 35 aa, Mycobacterium; identical to SEQ ID NO: 83529

SEQ ID NO: 1032432 - protein, 25 aa, Mycobacterium
QGHASPGIYARAFLEGRLSADQLDG

SEQ ID NO: 1032433 - protein, 19 aa, Mycobacterium
QKAKVLAICNTNGSQIPRE

SEQ ID NO: 1032434 - protein, 18 aa, Mycobacterium
RADSVLGVAGLVNAARAG

SEQ ID NO: 1032435 - protein, 19 aa, Mycobacterium
RAFVNRPLVLLADEPTGNL

SEQ ID NO: 1032436 - protein, 31 aa, Mycobacterium; identical to SEQ ID NO: 195348

SEQ ID NO: 1032437 - protein, 19 aa, Mycobacterium
RAHGADMLLLIVAALDQSA

SEQ ID NO: 1032438 - protein, 19 aa, Mycobacterium
RCVTLDYDKMRGMDSDEYR

SEQ ID NO: 1032439 - protein, 21 aa, Mycobacterium
REIQTRGAVTIVIAEEGDDTV

SEQ ID NO: 1032440 - protein, 24 aa, Mycobacterium
REKASEGTPVIVFFDEMDSIFRTR

SEQ ID NO: 1032441 - protein, 17 aa, Mycobacterium
RELEAFAAFASDLDATS

SEQ ID NO: 1032442 - protein, 29 aa, Mycobacterium
RFSFNVKGGRCEACTGDGTIKIEMNFLPD

SEQ ID NO: 1032443 - protein, 26 aa, Mycobacterium
RFTAYDCARLRFILTAQRDHYLPLKV

SEQ ID NO: 1032444 - protein, 21 aa, Mycobacterium
RGARVWPGVSIPDGGIRYSSD

SEQ ID NO: 1032445 - protein, 18 aa, Mycobacterium
RGKMFARLIKNIEVAARV

SEQ ID NO: 1032446 - protein, 18 aa, Mycobacterium
RGQISCAPNFGFELAVRR

SEQ ID NO: 1032447 - protein, 20 aa, Mycobacterium
RGRDMPVGVLVGSWHTIEGL

SEQ ID NO: 1032448 - protein, 25 aa, Mycobacterium
RHFFVCSTHDWILFFTTQGRVYRAK

SEQ ID NO: 1032449 - protein, 20 aa, Mycobacterium
RIGAEVRDGDILVGKVTPKG

SEQ ID NO: 1032450 - protein, 19 aa, Mycobacterium
RIGAIEFATTIAPGLRDVL

SEQ ID NO: 1032451 - protein, 18 aa, Mycobacterium
RILVSGIITDSSIAFHIA

SEQ ID NO: 1032452 - protein, 20 aa, Mycobacterium
RINHAYLFSGPRGCGKTSSA

SEQ ID NO: 1032453 - protein, 24 aa, Mycobacterium
RIQEGVVSLGLYSRIFRNNILASG

SEQ ID NO: 1032454 - protein, 17 aa, Mycobacterium
RKPRQVFTRDVLLEQVW

SEQ ID NO: 1032455 - protein, 36 aa, Mycobacterium; identical to SEQ ID NO: 17410

SEQ ID NO: 1032456 - protein, 20 aa, Mycobacterium
RLEDIWSTFTKLAPKQLIVD

SEQ ID NO: 1032457 - protein, 19 aa, Mycobacterium
RLGVTDLQFRPEVSDGLFL

SEQ ID NO: 1032458 - protein, 19 aa, Mycobacterium
RMQGYEVLWQPGMDHAGIA

SEQ ID NO: 1032459 - protein, 19 aa, Mycobacterium
RNNVVLSRRAWLEQTQSEV

SEQ ID NO: 1032460 - protein, 19 aa, Mycobacterium
RPVPFIIGVAGSVAVGKST

SEQ ID NO: 1032461 - protein, 32 aa, Mycobacterium; identical to SEQ ID NO: 91351

SEQ ID NO: 1032462 - protein, 17 aa, Mycobacterium
RRAELLALGAEVFGKRP

SEQ ID NO: 1032463 - protein, 24 aa, Mycobacterium
RRARKGEFRKLWISRINAAARAND

SEQ ID NO: 1032464 - protein, 23 aa, Mycobacterium
RSLNATKVFAWPDAEVAVMGAKA

SEQ ID NO: 1032465 - protein, 20 aa, Mycobacterium
RVSLAHALIGWTRGTGLMGH

SEQ ID NO: 1032466 - protein, 24 aa, Mycobacterium
RVVVPDFQLSLAIGKEGQNARLAA

SEQ ID NO: 1032467 - protein, 20 aa, Mycobacterium
SAATTCFWNDNQINIIDTPG

SEQ ID NO: 1032468 - protein, 27 aa, Mycobacterium
SAKELYEIRTLFGVLFQDGALFGSMNL

SEQ ID NO: 1032469 - protein, 24 aa, Mycobacterium
SEAYPVLCGSAFKNKGVQPMLDAV

SEQ ID NO: 1032470 - protein, 25 aa, Mycobacterium
SEPLTEAIPLWKRPQDGAIITGWDY

SEQ ID NO: 1032471 - protein, 22 aa, Mycobacterium
SFSQFKRSALPNGPKVSHGGAL

SEQ ID NO: 1032472 - protein, 17 aa, Mycobacterium
SGSSRDWAAKGTLLLGV

SEQ ID NO: 1032473 - protein, 26 aa, Mycobacterium
SLPFEHARPTAIMTWMRQHCGIENNL

SEQ ID NO: 1032474 - protein, 26 aa, Mycobacterium
SLPFEHARPTAIMTWMRQHWGIENSL

SEQ ID NO: 1032475 - protein, 26 aa, Mycobacterium
SLPFEHARPTAIMTWMRQHWGTENNL

SEQ ID NO: 1032476 - protein, 23 aa, Mycobacterium
SNICTAQVLLAVMAAMYASYHGA

SEQ ID NO: 1032477 - protein, 22 aa, Mycobacterium
SRANARGLVVVRMGSETKASEG

SEQ ID NO: 1032478 - protein, 23 aa, Mycobacterium
SRTIRLPVHLVEQVNKLARIKRE

SEQ ID NO: 1032479 - protein, 19 aa, Mycobacterium
SSIGSGVRRVEAYVGLDSF

SEQ ID NO: 1032480 - protein, 22 aa, Mycobacterium
SSPRVLSDLFWMGRYGERAENM

SEQ ID NO: 1032481 - protein, 26 aa, Mycobacterium
SVDERARAGLFLAMQYPVEVPGVSVS

SEQ ID NO: 1032482 - protein, 17 aa, Mycobacterium
SVYARVNPFGFIETPYR

SEQ ID NO: 1032483 - protein, 25 aa, Mycobacterium
TAEQMKMFLTRLGFGSKVVVTGDVT

SEQ ID NO: 1032484 - protein, 25 aa, Mycobacterium
TEPEAFKWIQRAAMDRRTTMKRVAE

SEQ ID NO: 1032485 - protein, 21 aa, Mycobacterium
TERHIRLIFQRAREKASEGTP

SEQ ID NO: 1032486 - protein, 24 aa, Mycobacterium
TGPELLSRAAALNWDTTAPATVVV

SEQ ID NO: 1032487 - protein, 17 aa, Mycobacterium
THKRYRADHLIEAYEAK

SEQ ID NO: 1032488 - protein, 17 aa, Mycobacterium
TIIPDFIGHTFAVHDGR

SEQ ID NO: 1032489 - protein, 26 aa, Mycobacterium
TKGFKFSTYATWWIRQAITRGMADQS

SEQ ID NO: 1032490 - protein, 17 aa, Mycobacterium
TKGLSLFFVPKFLFDFE

SEQ ID NO: 1032491 - protein, 17 aa, Mycobacterium
TKRSETFTTADDNQPSV

SEQ ID NO: 1032492 - protein, 25 aa, Mycobacterium
TLEDRLRTRFEWGLITDVQPPELET

SEQ ID NO: 1032493 - protein, 25 aa, Mycobacterium
TLVRMAQPWSLRYPLVDGQGNFGSP

SEQ ID NO: 1032494 - protein, 18 aa, Mycobacterium
TNDYEWDLLLSKTGWSEA

SEQ ID NO: 1032495 - protein, 29 aa, Mycobacterium
TNLDASAFLGRLALVRIYNGKLRKGQQVA

SEQ ID NO: 1032496 - protein, 18 aa, Mycobacterium
TPSGYRLDGVKSLVPAAA

SEQ ID NO: 1032497 - protein, 18 aa, Mycobacterium
TQLLARWDGKITVAAVNG

SEQ ID NO: 1032498 - protein, 18 aa, Mycobacterium
TRMGAQDTRLVWEERRMR

SEQ ID NO: 1032499 - protein, 20 aa, Mycobacterium
TRPSALVAIAALSRLGAVAV

SEQ ID NO: 1032500 - protein, 17 aa, Mycobacterium
TTGTGVCATCYGRSMAT

SEQ ID NO: 1032501 - protein, 25 aa, Mycobacterium
TVEGRPKHYWSIYQKMIVKGRDFDD

SEQ ID NO: 1032502 - protein, 27 aa, Mycobacterium
TVRSYNCLKREGVHTVGELVSRTESDL

SEQ ID NO: 1032503 - protein, 24 aa, Mycobacterium
TVSPQLYIALGISGAIQHRAGMQT

SEQ ID NO: 1032504 - protein, 18 aa, Mycobacterium
VAVTNCLNFGSPEDPGVM

SEQ ID NO: 1032505 - protein, 19 aa, Mycobacterium
VCEPFLVRAGMVARTPRGR

SEQ ID NO: 1032506 - protein, 19 aa, Mycobacterium
VDTAVLCDRCQGKGTNGDS

SEQ ID NO: 1032507 - protein, 17 aa, Mycobacterium
VEFGFAAHRGMTVLPLA

SEQ ID NO: 1032508 - protein, 23 aa, Mycobacterium
VGQKRFSLEGAESVIPMMDAAID

SEQ ID NO: 1032509 - protein, 18 aa, Mycobacterium
VGSSRANLFTSISGGINA

SEQ ID NO: 1032510 - protein, 19 aa, Mycobacterium
VGVLPTPAVAYLTGAYDAD

SEQ ID NO: 1032511 - protein, 17 aa, Mycobacterium
VHRADLIGQHIGETEAK

SEQ ID NO: 1032512 - protein, 24 aa, Mycobacterium
VLHLLYARFWHKVLYDLGHVSSRE

SEQ ID NO: 1032513 - protein, 19 aa, Mycobacterium
VMERLAPLGPVYQAGTLSG

SEQ ID NO: 1032514 - protein, 18 aa, Mycobacterium
VMYFKDFNSGAMIQNVVD

SEQ ID NO: 1032515 - protein, 21 aa, Mycobacterium
VNARYLRICVLTQYKSHSLDR

SEQ ID NO: 1032516 - protein, 25 aa, Mycobacterium
VNPTGKFVLGGPMGDAGLTGRKIIV

SEQ ID NO: 1032517 - protein, 17 aa, Mycobacterium
VNQPWTIRQYAGFSTAA

SEQ ID NO: 1032518 - protein, 18 aa, Mycobacterium
VQELFEARVPRGKAPIAD

SEQ ID NO: 1032519 - protein, 18 aa, Mycobacterium
VRDGDILVGKVTPKGETE

SEQ ID NO: 1032520 - protein, 28 aa, Mycobacterium
VRQLRLRDIGGIVVIDFIDMVLESNRDL

SEQ ID NO: 1032521 - protein, 18 aa, Mycobacterium
VRSVLTCTTGTGVCATCY

SEQ ID NO: 1032522 - protein, 19 aa, Mycobacterium
VSAKGEFLGGAIAPGVQVS

SEQ ID NO: 1032523 - protein, 19 aa, Mycobacterium
VSPVLWKKVAPKLSAGRVQ

SEQ ID NO: 1032524 - protein, 20 aa, Mycobacterium
VTPLRARIAERLEQSGPTVS

SEQ ID NO: 1032525 - protein, 25 aa, Mycobacterium
WDDTPEGFGRIAATTARQVMLQRFR

SEQ ID NO: 1032526 - protein, 20 aa, Mycobacterium
WESQLGPDLLWLGDHVIDDL

SEQ ID NO: 1032527 - protein, 26 aa, Mycobacterium
WEVQGRGELALAVLVETMRREGFELT

SEQ ID NO: 1032528 - protein, 21 aa, Mycobacterium
WKPALNAFAITFADRMPGSET

SEQ ID NO: 1032529 - protein, 21 aa, Mycobacterium
WLIERLQRPTLVMAPNKTLAA

SEQ ID NO: 1032530 - protein, 17 aa, Mycobacterium
WQLGMTRHFLAGDAQPR

SEQ ID NO: 1032531 - protein, 18 aa, Mycobacterium
WRAETLGDDIAWMRFGKD

SEQ ID NO: 1032532 - protein, 21 aa, Mycobacterium
WRNAWNEFIPFLDYDTEIRKV

SEQ ID NO: 1032533 - protein, 17 aa, Mycobacterium
WTCMIPRQVAEELGQPL

SEQ ID NO: 1032534 - protein, 24 aa, Mycobacterium
YDVKRAETGIIYIDEVDKIARKSE

SEQ ID NO: 1032535 - protein, 18 aa, Mycobacterium
YLLGHSIGELTAAYAAGV

SEQ ID NO: 1032536 - protein, 17 aa, Mycobacterium
YLLGLALAQARGTKYPD

SEQ ID NO: 1032537 - protein, 17 aa, Mycobacterium
YLMSRQTPFSAIIAGLT

SEQ ID NO: 1032538 - protein, 22 aa, Mycobacterium
YNKLFEERIIFLGVQVDDASAN

SEQ ID NO: 1032539 - protein, 28 aa, Mycobacterium
YPGMGADLYRQFPVFAHALDACDAALQP

SEQ ID NO: 1032540 - protein, 22 aa, Mycobacterium
YRADSMVNWCPGLGTVLANEEV

SEQ ID NO: 1032541 - protein, 18 aa, Mycobacterium
YVPCEVCQGARYNRETLE

SEQ ID NO: 1032542 - protein, 23 aa, Mycobacterium
AAAAAGIPIRIGVNAGSLDKRFM

SEQ ID NO: 1032543 - protein, 24 aa, Mycobacterium
AAAAGRIHRPFSILILSKELAQQT

SEQ ID NO: 1032544 - protein, 23 aa, Mycobacterium
AAADPRVAGMIARVQLGASPPAA

SEQ ID NO: 1032545 - protein, 23 aa, Mycobacterium
AAAGARALCRGGLVPLLHLLVGT

SEQ ID NO: 1032546 - protein, 24 aa, Mycobacterium
AAAHLVHPGDLVILISYGTMEDAE

SEQ ID NO: 1032547 - protein, 25 aa, Mycobacterium
AAALARRTAELGIRVLRYGSDDRIG

SEQ ID NO: 1032548 - protein, 22 aa, Mycobacterium
AAALELFPQLVLGDGVASGGAG

SEQ ID NO: 1032549 - protein, 19 aa, Mycobacterium
AAALGADVCEIYTDVDGIF

SEQ ID NO: 1032550 - protein, 19 aa, Mycobacterium
AAANAWVDGLVAYRRSLGL

SEQ ID NO: 1032551 - protein, 29 aa, Mycobacterium
AAANSWVDLFAHWRRAQGLPVSAIAWGAW

SEQ ID NO: 1032552 - protein, 23 aa, Mycobacterium
AAAPELPCEVEVDSLEQLDAMLA

SEQ ID NO: 1032553 - protein, 25 aa, Mycobacterium
AAATAGAPAHDWLTLTGGAIGHGIP

SEQ ID NO: 1032554 - protein, 30 aa, Mycobacterium
AADALALAICHCWRAPMIARMAEAEALGAR

SEQ ID NO: 1032555 - protein, 20 aa, Mycobacterium
AADIDGVLQWARESRERLEQ

SEQ ID NO: 1032556 - protein, 19 aa, Mycobacterium
AADLARRLQAAGVRTHVDA

SEQ ID NO: 1032557 - protein, 24 aa, Mycobacterium
AADNRRSLLCGNIGRPVLDVLTEF

SEQ ID NO: 1032558 - protein, 23 aa, Mycobacterium
AADVALNRAWCLRELGDDNAARA

SEQ ID NO: 1032559 - protein, 18 aa, Mycobacterium
AADVKIAVDPACKLSARS

SEQ ID NO: 1032560 - protein, 17 aa, Mycobacterium
AADWQLEIYQLVADAQR

SEQ ID NO: 1032561 - protein, 17 aa, Mycobacterium
AADWSKRPLPSDWLNYA

SEQ ID NO: 1032562 - protein, 31 aa, Mycobacterium
AAEASAALIWRRPRWARRLQPGPVADMLAEG

SEQ ID NO: 1032563 - protein, 20 aa, Mycobacterium
AAEFAHIFSTLGGTGHPGDP

SEQ ID NO: 1032564 - protein, 21 aa, Mycobacterium
AAEIGLGRRWVMSVWGRSAAA

SEQ ID NO: 1032565 - protein, 21 aa, Mycobacterium
AAELINCCGMFNAGAGAGAGA

SEQ ID NO: 1032566 - protein, 20 aa, Mycobacterium
AAELRKCWNSEFDDAGAIGR

SEQ ID NO: 1032567 - protein, 17 aa, Mycobacterium
AAERPRGVFNRQLVLGE

SEQ ID NO: 1032568 - protein, 19 aa, Mycobacterium
AAETVRAAVDFEREVCRRT

SEQ ID NO: 1032569 - protein, 17 aa, Mycobacterium
AAFAEREGVNLTFLPFI

SEQ ID NO: 1032570 - protein, 20 aa, Mycobacterium
AAGDMLVRAWVRSYGVRATI

SEQ ID NO: 1032571 - protein, 18 aa, Mycobacterium
AAGFKFTRIQSLQLHYAK

SEQ ID NO: 1032572 - protein, 19 aa, Mycobacterium
AAGGKCFYTTPLKALSNQK

SEQ ID NO: 1032573 - protein, 24 aa, Mycobacterium
AAGGKRFRPLFTVLSAQIGPRPDA

SEQ ID NO: 1032574 - protein, 20 aa, Mycobacterium
AAGLRGVEKGYVLGPQAEDN

SEQ ID NO: 1032575 - protein, 26 aa, Mycobacterium
AAGNYAQRLFPGMRVKYVSTEEFTND

SEQ ID NO: 1032576 - protein, 30 aa, Mycobacterium
AAGQLFATGMPVEWPAVFAGSSRRRVTLPT

SEQ ID NO: 1032577 - protein, 22 aa, Mycobacterium
AAGSLKAFATFGALTQLAGVLV

SEQ ID NO: 1032578 - protein, 17 aa, Mycobacterium
AAHAFGIGSYQWHDAAA

SEQ ID NO: 1032579 - protein, 22 aa, Mycobacterium
AAIARPELLADMAGQFGSQCIV

SEQ ID NO: 1032580 - protein, 25 aa, Mycobacterium
AAIDYKSAELLPVEIPAVPEISEHL

SEQ ID NO: 1032581 - protein, 20 aa, Mycobacterium
AAIMSLALLLAHLGEDEPAA

SEQ ID NO: 1032582 - protein, 17 aa, Mycobacterium
AAIRELLYAIGEDPDRE

SEQ ID NO: 1032583 - protein, 18 aa, Mycobacterium
AAIREWARRNGHNVSTRG

SEQ ID NO: 1032584 - protein, 24 aa, Mycobacterium
AAKLKVAMLAGQLRAAGVRVDLIY

SEQ ID NO: 1032585 - protein, 18 aa, Mycobacterium
AAKLVGIELPKKAAAPAR

SEQ ID NO: 1032586 - protein, 22 aa, Mycobacterium
AAKRLCRSRVGIDGEAGPTEIA

SEQ ID NO: 1032587 - protein, 24 aa, Mycobacterium
AALAERKLGGGMSISCTAPPLLVS

SEQ ID NO: 1032588 - protein, 26 aa, Mycobacterium
AALAMELGCDAVLLASAVTRAVDPPT

SEQ ID NO: 1032589 - protein, 19 aa, Mycobacterium
AALCERMDYALPAEVQEAT

SEQ ID NO: 1032590 - protein, 19 aa, Mycobacterium
AALEFGALFDGVRPPTVRV

SEQ ID NO: 1032591 - protein, 20 aa, Mycobacterium
AALEGDGLIGVRIMQRTGSH

SEQ ID NO: 1032592 - protein, 19 aa, Mycobacterium
AALERGHGVLVCAPTGAGK

SEQ ID NO: 1032593 - protein, 22 aa, Mycobacterium
AALEVNWPFVLASMLENAVKGG

SEQ ID NO: 1032594 - protein, 17 aa, Mycobacterium
AALFGLPLCEPIYPTPA

SEQ ID NO: 1032595 - protein, 18 aa, Mycobacterium
AALGLPLDGNVVAFVGRI

SEQ ID NO: 1032596 - protein, 19 aa, Mycobacterium
AALQACWGGDTGISYQAWQ

SEQ ID NO: 1032597 - protein, 23 aa, Mycobacterium
AALQIAALKARFLSRDDVPEDVL

SEQ ID NO: 1032598 - protein, 24 aa, Mycobacterium
AALRALRVGEEIDDDVALVATTSG

SEQ ID NO: 1032599 - protein, 17 aa, Mycobacterium
AALRRVELARPRSVVGK

SEQ ID NO: 1032600 - protein, 19 aa, Mycobacterium
AALSSWVAGQAGVFGTRGI

SEQ ID NO: 1032601 - protein, 17 aa, Mycobacterium
AALSWLADHQVHNVAAL

SEQ ID NO: 1032602 - protein, 20 aa, Mycobacterium
AALTGEWFDALAIIAPSLSV

SEQ ID NO: 1032603 - protein, 17 aa, Mycobacterium
AALTRAIHKLPIKARIV

SEQ ID NO: 1032604 - protein, 17 aa, Mycobacterium
AALVKRGLEPDKLSWDA

SEQ ID NO: 1032605 - protein, 17 aa, Mycobacterium
AALWPGAGPDQFDSKAV

SEQ ID NO: 1032606 - protein, 24 aa, Mycobacterium
AANFRDIMITLGMFTHDALLGSEV

SEQ ID NO: 1032607 - protein, 24 aa, Mycobacterium
AANSWLDGFSYWRRAQGLASTTIA

SEQ ID NO: 1032608 - protein, 19 aa, Mycobacterium
AAPCPGRRIGLAFRSASGR

SEQ ID NO: 1032609 - protein, 18 aa, Mycobacterium
AAPEIDFRAVNDRASCKY

SEQ ID NO: 1032610 - protein, 17 aa, Mycobacterium
AAPGATWEDNLRGVGAA

SEQ ID NO: 1032611 - protein, 20 aa, Mycobacterium
AAQAELRPAGYVSVSVTSSQ

SEQ ID NO: 1032612 - protein, 23 aa, Mycobacterium
AAQGLWAQAGFRPVDPAVSADFS

SEQ ID NO: 1032613 - protein, 18 aa, Mycobacterium
AAQHGARIFTYVAGIQKA

SEQ ID NO: 1032614 - protein, 25 aa, Mycobacterium
AAQIKRLKVGAGRRFSATTQRSLAA

SEQ ID NO: 1032615 - protein, 22 aa, Mycobacterium
AAQLKLPIDVVATVPMAENMPS

SEQ ID NO: 1032616 - protein, 18 aa, Mycobacterium
AARLSTSGIPVDWQSVFD

SEQ ID NO: 1032617 - protein, 17 aa, Mycobacterium
AARLTGWRIDIRGDSPP

SEQ ID NO: 1032618 - protein, 24 aa, Mycobacterium
AARWPRAGALGPLIRDPDGSVYPS

SEQ ID NO: 1032619 - protein, 23 aa, Mycobacterium
AASIWPKLWRPRANGASSKSCSC

SEQ ID NO: 1032620 - protein, 25 aa, Mycobacterium
AASPKETWLRLWLIDVNLPVSTGQP

SEQ ID NO: 1032621 - protein, 18 aa, Mycobacterium
AASSLRKAKKLRVRLPLP

SEQ ID NO: 1032622 - protein, 19 aa, Mycobacterium
AASTPWPTYPLMYRVSPAH

SEQ ID NO: 1032623 - protein, 23 aa, Mycobacterium
AATDRPSFISLRTIIGYPAPTLI

SEQ ID NO: 1032624 - protein, 20 aa, Mycobacterium
AATQDPRSWAALPRAGAVIF

SEQ ID NO: 1032625 - protein, 18 aa, Mycobacterium
AATRWVWLADALALDVPE

SEQ ID NO: 1032626 - protein, 17 aa, Mycobacterium
AATVLNLVRPVFTSRLP

SEQ ID NO: 1032627 - protein, 18 aa, Mycobacterium
AATWGIAAAMTRGDIAVT

SEQ ID NO: 1032628 - protein, 24 aa, Mycobacterium
AAVAETWLRLELTTPLVVDPVCAS

SEQ ID NO: 1032629 - protein, 22 aa, Mycobacterium
AAVEASSLWPGKVVTEVSLAED

SEQ ID NO: 1032630 - protein, 31 aa, Mycobacterium
AAVECGIGFRRAAGVVAWWASVHRAGAWQPR

SEQ ID NO: 1032631 - protein, 27 aa, Mycobacterium
AAVLPSHYEPFGLVALEAAAAGTPLVT

SEQ ID NO: 1032632 - protein, 25 aa, Mycobacterium
AAVNDLRLALGVILEIDRPAPERVP

SEQ ID NO: 1032633 - protein, 19 aa, Mycobacterium
AAVSSFGLGGTNAHVVIEQ

SEQ ID NO: 1032634 - protein, 25 aa, Mycobacterium
AAWSNGCSDIHGWLEGVHAARHALT

SEQ ID NO: 1032635 - protein, 24 aa, Mycobacterium
ACADAFAEFVDWSLTDILRDLPGT

SEQ ID NO: 1032636 - protein, 18 aa, Mycobacterium
ACDLQRPAAVNQLQVVGE

SEQ ID NO: 1032637 - protein, 20 aa, Mycobacterium
ACLDAGVRVGCFRPPTVPAG

SEQ ID NO: 1032638 - protein, 19 aa, Mycobacterium
ACLPGRFADVMQVISEVLA

SEQ ID NO: 1032639 - protein, 20 aa, Mycobacterium
ACPECVGLGIRKEIDSDLVV

SEQ ID NO: 1032640 - protein, 24 aa, Mycobacterium
ACQKWPQRMRNILLGHVARRLPKG

SEQ ID NO: 1032641 - protein, 20 aa, Mycobacterium
ACRSLGVHGRVYVPAKTPKQ

SEQ ID NO: 1032642 - protein, 17 aa, Mycobacterium
ACSKCSPLHTPERVRAG

SEQ ID NO: 1032643 - protein, 21 aa, Mycobacterium
ACTATGYSRCSLAGTLPYFDL

SEQ ID NO: 1032644 - protein, 23 aa, Mycobacterium
ACVSACPVGAIASDTRLAPKQLP

SEQ ID NO: 1032645 - protein, 18 aa, Mycobacterium
ADAARLAVRMENDGATAW

SEQ ID NO: 1032646 - protein, 19 aa, Mycobacterium
ADAARLIIRGRTVTADAGH

SEQ ID NO: 1032647 - protein, 24 aa, Mycobacterium
ADAGRATLVLADWLADAGPACVTG

SEQ ID NO: 1032648 - protein, 23 aa, Mycobacterium
ADAGRFLTTIKHRLEEGAFEADL

SEQ ID NO: 1032649 - protein, 18 aa, Mycobacterium
ADAKLVLGSADGTVYTLA

SEQ ID NO: 1032650 - protein, 22 aa, Mycobacterium
ADAKRMFACFDQPDLKATFEVE

SEQ ID NO: 1032651 - protein, 17 aa, Mycobacterium
ADALLVRSATTVDAEVL

SEQ ID NO: 1032652 - protein, 18 aa, Mycobacterium
ADAPRVDIVAAYLGSDSV

SEQ ID NO: 1032653 - protein, 24 aa, Mycobacterium
ADARLAQGHTVVWIHDTTLRTEPL

SEQ ID NO: 1032654 - protein, 21 aa, Mycobacterium
ADATGWSGLAAVARIGAATGA

SEQ ID NO: 1032655 - protein, 18 aa, Mycobacterium
ADAVFWCLENHDADEETM

SEQ ID NO: 1032656 - protein, 19 aa, Mycobacterium
ADCGVGLFDPVTRGVLSTA

SEQ ID NO: 1032657 - protein, 19 aa, Mycobacterium
ADCVVTLGGCWLVTTVRQF

SEQ ID NO: 1032658 - protein, 21 aa, Mycobacterium
ADDCLARAVLVAVLAAESVAG

SEQ ID NO: 1032659 - protein, 27 aa, Mycobacterium
ADDGTWIPVSIVHRAAIRFPAPAVLYG

SEQ ID NO: 1032660 - protein, 18 aa, Mycobacterium
ADEIRRARETKAMRDREH

SEQ ID NO: 1032661 - protein, 21 aa, Mycobacterium
ADFTHTCFIITPYEEYVAVTE

SEQ ID NO: 1032662 - protein, 17 aa, Mycobacterium
ADFVKRQNIGSFTLGPI

SEQ ID NO: 1032663 - protein, 27 aa, Mycobacterium
ADGKEIGGRLAARIGSGLLVDVVDVRE

SEQ ID NO: 1032664 - protein, 18 aa, Mycobacterium
ADGLYRFRVNCADSVITG

SEQ ID NO: 1032665 - protein, 24 aa, Mycobacterium
ADGRCKAFARAADGTGWGEGAGVV

SEQ ID NO: 1032666 - protein, 18 aa, Mycobacterium
ADGYARIAGRPAVVLLHL

SEQ ID NO: 1032667 - protein, 17 aa, Mycobacterium
ADIIMIKPASGYLDVVA

SEQ ID NO: 1032668 - protein, 20 aa, Mycobacterium
ADIPFGLSVDEFMQYSSDEG

SEQ ID NO: 1032669 - protein, 17 aa, Mycobacterium
ADIRESIHLRALGRQSP

SEQ ID NO: 1032670 - protein, 21 aa, Mycobacterium
ADLAYSCFIPRAGRPLMYLAG

SEQ ID NO: 1032671 - protein, 20 aa, Mycobacterium
ADLLVVRSGEKIVVEVPVEV

SEQ ID NO: 1032672 - protein, 23 aa, Mycobacterium
ADLRDARLRLAADDLVSRQGQRD

SEQ ID NO: 1032673 - protein, 17 aa, Mycobacterium
ADMIRLIIRDEAVHGYY

SEQ ID NO: 1032674 - protein, 19 aa, Mycobacterium
ADNVRYRIIADHSRTAAIL

SEQ ID NO: 1032675 - protein, 20 aa, Mycobacterium
ADPAAVWRSAITAFFEVCGT

SEQ ID NO: 1032676 - protein, 26 aa, Mycobacterium
ADPASARGSLRLSLGHNSVEVDVEEV

SEQ ID NO: 1032677 - protein, 26 aa, Mycobacterium
ADPDRYAAEIAHIIGYESGDVLRVSG

SEQ ID NO: 1032678 - protein, 29 aa, Mycobacterium
ADQARTIRIPVHMVEVINKLGRIQRELLQ

SEQ ID NO: 1032679 - protein, 26 aa, Mycobacterium
ADQDEYLCWAVKAFRLATSGVADSTQ

SEQ ID NO: 1032680 - protein, 19 aa, Mycobacterium
ADRARRVAAASAKAAQAQE

SEQ ID NO: 1032681 - protein, 18 aa, Mycobacterium
ADRIRRVAERIVQTKKQG

SEQ ID NO: 1032682 - protein, 26 aa, Mycobacterium
ADSLGWLRDFLRSHTGGLVVISHNVE

SEQ ID NO: 1032683 - protein, 17 aa, Mycobacterium
ADSLLGVAGLVEAQHRG

SEQ ID NO: 1032684 - protein, 17 aa, Mycobacterium
ADTAAGGIRTRRWNQNI

SEQ ID NO: 1032685 - protein, 25 aa, Mycobacterium
ADTIRRAAGVAARSLGRAEVVITTL

SEQ ID NO: 1032686 - protein, 29 aa, Mycobacterium
ADVALVVGVPMDFRLGFGKVFGSQTQLVV

SEQ ID NO: 1032687 - protein, 23 aa, Mycobacterium
ADVGRPDIMIVVGGVIPPDDFDE

SEQ ID NO: 1032688 - protein, 18 aa, Mycobacterium
ADVIDNCRLVYRADSMVN

SEQ ID NO: 1032689 - protein, 22 aa, Mycobacterium
ADVLIAFGRFPIIDDRDPQLGM

SEQ ID NO: 1032690 - protein, 25 aa, Mycobacterium
ADVLPDCFRPAPASDLVSVPASARR

SEQ ID NO: 1032691 - protein, 17 aa, Mycobacterium
ADVPRLASAFLATKQST

SEQ ID NO: 1032692 - protein, 17 aa, Mycobacterium
ADVRFNIETKVAADRPA

SEQ ID NO: 1032693 - protein, 23 aa, Mycobacterium
ADVSLPVVRAFVHRIKERARGTE

SEQ ID NO: 1032694 - protein, 26 aa, Mycobacterium
ADWAEMLMRMYIRWAEQHKYGVEVLD

SEQ ID NO: 1032695 - protein, 29 aa, Mycobacterium
AEADASLRAHIWKRSSFSGTEIFGKTVGV

SEQ ID NO: 1032696 - protein, 19 aa, Mycobacterium
AEAGWSKAGIDEALGGTPM

SEQ ID NO: 1032697 - protein, 22 aa, Mycobacterium
AEAIRASGLSAGITDAGLSRGL

SEQ ID NO: 1032698 - protein, 17 aa, Mycobacterium
AEAPDQLLFVLELTATV

SEQ ID NO: 1032699 - protein, 19 aa, Mycobacterium
AEAQRIVVLAGDQLDALCA

SEQ ID NO: 1032700 - protein, 26 aa, Mycobacterium
AEAQWRTAYYPTVFVVHVDRNIAHQG

SEQ ID NO: 1032701 - protein, 29 aa, Mycobacterium
AEARKAGRRFARLAPIVATHRKLISARDD

SEQ ID NO: 1032702 - protein, 21 aa, Mycobacterium
AEARVPIIPHIVWGSQRIWTK

SEQ ID NO: 1032703 - protein, 29 aa, Mycobacterium
AEASDAFEAVRIIARVSGVDVFFRAVQYL

SEQ ID NO: 1032704 - protein, 19 aa, Mycobacterium
AEDLLGSILEPYSYKGCRY

SEQ ID NO: 1032705 - protein, 28 aa, Mycobacterium
AEDVFAVPSSEHWKFLAYNTKDKNIGQL

SEQ ID NO: 1032706 - protein, 20 aa, Mycobacterium
AEEKFGFLLEAFTFGAPPHG

SEQ ID NO: 1032707 - protein, 22 aa, Mycobacterium
AEELAMKATRVLSLAQDTADQL

SEQ ID NO: 1032708 - protein, 19 aa, Mycobacterium
AEFDGRFLARAVYGQLYAY

SEQ ID NO: 1032709 - protein, 24 aa, Mycobacterium
AEFDRSGADIVLLDLMLPGMSGTD

SEQ ID NO: 1032710 - protein, 20 aa, Mycobacterium
AEFFEPIIGINRYLRTLVDV

SEQ ID NO: 1032711 - protein, 17 aa, Mycobacterium
AEFRDAEALTFPLLSDH

SEQ ID NO: 1032712 - protein, 17 aa, Mycobacterium
AEGARLHLLTARDDIVR

SEQ ID NO: 1032713 - protein, 17 aa, Mycobacterium
AEGCMLAGCALLGGETA

SEQ ID NO: 1032714 - protein, 19 aa, Mycobacterium
AEGKVKVELALARGKKLHD

SEQ ID NO: 1032715 - protein, 23 aa, Mycobacterium
AEGLRVTAVRSRLMAPLSGQGGM

SEQ ID NO: 1032716 - protein, 17 aa, Mycobacterium
AEGRLSDNWQLIVSDVA

SEQ ID NO: 1032717 - protein, 26 aa, Mycobacterium
AEHEWIRRSREDTVRVGLTDFAQSTL

SEQ ID NO: 1032718 - protein, 25 aa, Mycobacterium
AEHLHVHVVPRWGGDANFITIIGGS

SEQ ID NO: 1032719 - protein, 17 aa, Mycobacterium
AEHYVGSGGYRMQIRDV

SEQ ID NO: 1032720 - protein, 17 aa, Mycobacterium
AELAAVVSAVLYETRGD

SEQ ID NO: 1032721 - protein, 18 aa, Mycobacterium
AELAKLPLFDRLAQRIVD

SEQ ID NO: 1032722 - protein, 18 aa, Mycobacterium
AELGRRHELLSGIVPQIS

SEQ ID NO: 1032723 - protein, 20 aa, Mycobacterium
AELGWHYDLLMSPLAWDLVH

SEQ ID NO: 1032724 - protein, 39 aa, Mycobacterium
AELGYKGLLAPLTFICLFGYKAQSAFFKHANIAVTDQQI

SEQ ID NO: 1032725 - protein, 17 aa, Mycobacterium
AELLRRAKHNGLSDRQI

SEQ ID NO: 1032726 - protein, 20 aa, Mycobacterium
AELLTLYLLFGQLSGSDGAH

SEQ ID NO: 1032727 - protein, 21 aa, Mycobacterium
AELMRRLPFELTEGQREVRDV

SEQ ID NO: 1032728 - protein, 20 aa, Mycobacterium
AELPDGSGLVVLDDTVTPEL

SEQ ID NO: 1032729 - protein, 32 aa, Mycobacterium
AELRIAQAQLVGWLEGLFHGIQTALFAQQMAA

SEQ ID NO: 1032730 - protein, 21 aa, Mycobacterium
AELRLGDGMVVSYRICDLIPV

SEQ ID NO: 1032731 - protein, 19 aa, Mycobacterium
AELRSRFSKADVIELSYHT

SEQ ID NO: 1032732 - protein, 20 aa, Mycobacterium
AELRVRLELANEPGGEKAAA

SEQ ID NO: 1032733 - protein, 17 aa, Mycobacterium
AELRYYLGSAHYRSMLE

SEQ ID NO: 1032734 - protein, 33 aa, Mycobacterium
AELSKSGAWCVAADFSVRMLATGGARKVPKVAA

SEQ ID NO: 1032735 - protein, 26 aa, Mycobacterium
AELVARVKALLRRRGATATSSSETIA

SEQ ID NO: 1032736 - protein, 22 aa, Mycobacterium
AELVQRGSPFRGLLYVGLAVTA

SEQ ID NO: 1032737 - protein, 18 aa, Mycobacterium
AEMLPGCTGLQVVDSTYG

SEQ ID NO: 1032738 - protein, 19 aa, Mycobacterium
AENLGRGFLPTDWVLDVLE

SEQ ID NO: 1032739 - protein, 24 aa, Mycobacterium
AENLREHRKGLLVDLVTDVSVGND

SEQ ID NO: 1032740 - protein, 20 aa, Mycobacterium
AENMARLLIVTREHYHDSRH

SEQ ID NO: 1032741 - protein, 25 aa, Mycobacterium
AEPLPRTLVWSTAWEMTREAELRAR

SEQ ID NO: 1032742 - protein, 17 aa, Mycobacterium
AEPRVADRLVVAATQSG

SEQ ID NO: 1032743 - protein, 21 aa, Mycobacterium
AEPYLPLRAVRHLEKGRVVIF

SEQ ID NO: 1032744 - protein, 25 aa, Mycobacterium
AEQAKWARKAIDNEGLAEIAQVRYS

SEQ ID NO: 1032745 - protein, 26 aa, Mycobacterium
AEQRAMPGAGARLVTMLTRHPGGASV

SEQ ID NO: 1032746 - protein, 31 aa, Mycobacterium
AEQRCGSQAWNLPVVFGPIAITYNVNGLSSL

SEQ ID NO: 1032747 - protein, 21 aa, Mycobacterium
AEQRVALDLLLDESVGIVSLG

SEQ ID NO: 1032748 - protein, 20 aa, Mycobacterium
AERGWPVFSVSTVTRENLQS

SEQ ID NO: 1032749 - protein, 17 aa, Mycobacterium
AERKMLASMAFQHIAEY

SEQ ID NO: 1032750 - protein, 21 aa, Mycobacterium
AESIRKFRILPVDFTEQTGEL

SEQ ID NO: 1032751 - protein, 20 aa, Mycobacterium
AESRLHPSDFGLIKTIFTDP

SEQ ID NO: 1032752 - protein, 20 aa, Mycobacterium
AETVARRGGLVILPQDLPIA

SEQ ID NO: 1032753 - protein, 24 aa, Mycobacterium
AEVKKAAAEHGLWYPPDPSSFEIC

SEQ ID NO: 1032754 - protein, 17 aa, Mycobacterium
AEVMARLLVFTRERYHE

SEQ ID NO: 1032755 - protein, 18 aa, Mycobacterium
AEVPARIAFQTLRSPDKK

SEQ ID NO: 1032756 - protein, 18 aa, Mycobacterium
AEVRRIEHQVAHEVLKEV

SEQ ID NO: 1032757 - protein, 17 aa, Mycobacterium
AEWLKLTSLGLRPRAIR

SEQ ID NO: 1032758 - protein, 22 aa, Mycobacterium
AEYEMPGLMSLRHEYAEVQPLK

SEQ ID NO: 1032759 - protein, 22 aa, Mycobacterium
AEYVHLRHGQILFTYLHLAASR

SEQ ID NO: 1032760 - protein, 26 aa, Mycobacterium
AFALGDYEWLLAFEAPGLDRIVDLMR

SEQ ID NO: 1032761 - protein, 17 aa, Mycobacterium
AFAPYGLKQTAVKPSYG

SEQ ID NO: 1032762 - protein, 20 aa, Mycobacterium
AFATMGCLYPNRVFLGVGTG

SEQ ID NO: 1032763 - protein, 17 aa, Mycobacterium
AFEYAAKLGYDGVELMV

SEQ ID NO: 1032764 - protein, 19 aa, Mycobacterium
AFFGHSMGGMLAFEVALRF

SEQ ID NO: 1032765 - protein, 20 aa, Mycobacterium
AFGPFGYEHCDAFFTVAHRV

SEQ ID NO: 1032766 - protein, 19 aa, Mycobacterium
AFIQLAARFLGPAVSGVQP

SEQ ID NO: 1032767 - protein, 22 aa, Mycobacterium
AFLQRPARWMQLLGKYRGQISC

SEQ ID NO: 1032768 - protein, 17 aa, Mycobacterium
AFMVRYTSGYLCAPLDG

SEQ ID NO: 1032769 - protein, 18 aa, Mycobacterium
AFQGFGFELLTGVNCVTI

SEQ ID NO: 1032770 - protein, 23 aa, Mycobacterium
AFQKLEPMAAILNPSSYSPPSAL

SEQ ID NO: 1032771 - protein, 21 aa, Mycobacterium
AFTEGWFKTGDLGAIDEDGFL

SEQ ID NO: 1032772 - protein, 35 aa, Mycobacterium
AFTMTVPPLMVFVNRAQACLLIMSNIFGQNSTAIA

SEQ ID NO: 1032773 - protein, 17 aa, Mycobacterium
AFTVFVLLVEYWAQGDC

SEQ ID NO: 1032774 - protein, 20 aa, Mycobacterium
AGAAESFAFAGADALGDEDN

SEQ ID NO: 1032775 - protein, 26 aa, Mycobacterium
AGAAWIDPRVRGHVVALADPVTGLAR

SEQ ID NO: 1032776 - protein, 17 aa, Mycobacterium
AGAEAIEINDAYQSVRV

SEQ ID NO: 1032777 - protein, 22 aa, Mycobacterium
AGAKYRGEFEQRLKVVLDDIKF

SEQ ID NO: 1032778 - protein, 25 aa, Mycobacterium
AGALGRSAAGYALWHKGIDGFDDLR

SEQ ID NO: 1032779 - protein, 25 aa, Mycobacterium
AGALREISIELSVFGTEGRQGKLDT

SEQ ID NO: 1032780 - protein, 20 aa, Mycobacterium
AGAMKGTFAKAIGLFNAPTS

SEQ ID NO: 1032781 - protein, 24 aa, Mycobacterium
AGAWSSIRTFGWETRRLGVTDLQF

SEQ ID NO: 1032782 - protein, 25 aa, Mycobacterium
AGDFVKIDFGALVAGYHSDMTRTFV

SEQ ID NO: 1032783 - protein, 25 aa, Mycobacterium
AGEACARSIAWYLAMARRSQGNEDA

SEQ ID NO: 1032784 - protein, 21 aa, Mycobacterium
AGERGLCAGGDVVAIYHSALK

SEQ ID NO: 1032785 - protein, 25 aa, Mycobacterium
AGGPEAGVVLWARRPDVAERINTTR

SEQ ID NO: 1032786 - protein, 20 aa, Mycobacterium
AGGSVCVHCRPAGSTTPPRG

SEQ ID NO: 1032787 - protein, 27 aa, Mycobacterium
AGHAKFTAIARRADAKLVLGSADGTVY

SEQ ID NO: 1032788 - protein, 23 aa, Mycobacterium
AGHPFAATGGRILVQTAKQLAEQ

SEQ ID NO: 1032789 - protein, 19 aa, Mycobacterium
AGIELPRRIFAHGFLHNHG

SEQ ID NO: 1032790 - protein, 18 aa, Mycobacterium
AGIGFSRYLTEAVLEPLA

SEQ ID NO: 1032791 - protein, 20 aa, Mycobacterium
AGIKLCQKRHQLPGLEFVRG

SEQ ID NO: 1032792 - protein, 23 aa, Mycobacterium
AGIPEVACTVWSNLVMAAHLSAG

SEQ ID NO: 1032793 - protein, 24 aa, Mycobacterium
AGISRPTFYFYFPSKNAVLLSLLD

SEQ ID NO: 1032794 - protein, 20 aa, Mycobacterium
AGKPDIDFVVVREGTEGPYT

SEQ ID NO: 1032795 - protein, 20 aa, Mycobacterium
AGLARAIVDIAARARSGNLK

SEQ ID NO: 1032796 - protein, 17 aa, Mycobacterium
AGLIARVLHAVAYAFEE

SEQ ID NO: 1032797 - protein, 24 aa, Mycobacterium
AGLLRFLPQLSERLLGETLLLPSA

SEQ ID NO: 1032798 - protein, 24 aa, Mycobacterium
AGLREPRGPWGPGRLAEASDAFEA

SEQ ID NO: 1032799 - protein, 23 aa, Mycobacterium
AGLSGHFGFVVGINRTGRVDQAE

SEQ ID NO: 1032800 - protein, 20 aa, Mycobacterium
AGLSSHAEWSPAWDDGLARA

SEQ ID NO: 1032801 - protein, 22 aa, Mycobacterium
AGLSVRPGYVLSDGFRVPGLSV

SEQ ID NO: 1032802 - protein, 18 aa, Mycobacterium
AGMGAELFAKEPVFAAAI

SEQ ID NO: 1032803 - protein, 18 aa, Mycobacterium
AGMLDCKSVLVETDGNFD

SEQ ID NO: 1032804 - protein, 24 aa, Mycobacterium
AGPAYNTDSPWGYTPKGATGVPTR

SEQ ID NO: 1032805 - protein, 18 aa, Mycobacterium
AGPEIGVASTKTFLAQVA

SEQ ID NO: 1032806 - protein, 27 aa, Mycobacterium
AGPQAGWAVRMWLVYDLALTGISLSSP

SEQ ID NO: 1032807 - protein, 25 aa, Mycobacterium
AGPRAKRALTVNGLRQLIAFISRMT

SEQ ID NO: 1032808 - protein, 25 aa, Mycobacterium
AGPRVRTAVLTKLYPTRSHTGAAQG

SEQ ID NO: 1032809 - protein, 19 aa, Mycobacterium
AGPSDLYKATGYRPSASIN

SEQ ID NO: 1032810 - protein, 19 aa, Mycobacterium
AGPYAAWYASYRDEHGEIP

SEQ ID NO: 1032811 - protein, 19 aa, Mycobacterium
AGQFCLANTIAVAPAAANL

SEQ ID NO: 1032812 - protein, 24 aa, Mycobacterium
AGQGVKAHAPFRIVGAHTDSPNLR

SEQ ID NO: 1032813 - protein, 20 aa, Mycobacterium
AGQPQHPWCDTNRSGSAVTK

SEQ ID NO: 1032814 - protein, 21 aa, Mycobacterium
AGQPQPVRWVVKHLSVASAHN

SEQ ID NO: 1032815 - protein, 24 aa, Mycobacterium
AGQQYSWLPFGRNVAASPVRYGDQ

SEQ ID NO: 1032816 - protein, 25 aa, Mycobacterium
AGRANRARLNRSLVRGMREVVGVLR

SEQ ID NO: 1032817 - protein, 25 aa, Mycobacterium
AGRIVSFDAAGGWNIEEEGYQSVGS

SEQ ID NO: 1032818 - protein, 25 aa, Mycobacterium
AGRSRLMPPMPLIPGRRSKPTVVVV

SEQ ID NO: 1032819 - protein, 22 aa, Mycobacterium
AGRTDWAVHIALWQRTTGGVAD

SEQ ID NO: 1032820 - protein, 23 aa, Mycobacterium
AGSEEKLEFCRALGAQITINYRD

SEQ ID NO: 1032821 - protein, 17 aa, Mycobacterium
AGSRATHIVVWATLDKS

SEQ ID NO: 1032822 - protein, 18 aa, Mycobacterium
AGSRPATVIVGRDSRHGS

SEQ ID NO: 1032823 - protein, 19 aa, Mycobacterium
AGTGVRFTPTLTFIRDTTS

SEQ ID NO: 1032824 - protein, 21 aa, Mycobacterium
AGTIARQFLRQALGVEVLSHV

SEQ ID NO: 1032825 - protein, 21 aa, Mycobacterium
AGTQACRVLRAEGLQVSLVNS

SEQ ID NO: 1032826 - protein, 25 aa, Mycobacterium
AGVDKGYKCSIRKPWWSTPSLWIPD

SEQ ID NO: 1032827 - protein, 19 aa, Mycobacterium
AGVKVVNLYAAEHLEIQTA

SEQ ID NO: 1032828 - protein, 25 aa, Mycobacterium
AGVLELVWTTGLIRWEDDPQPGWYD

SEQ ID NO: 1032829 - protein, 25 aa, Mycobacterium
AGVLKGEVKDVLLLDVTPLSLGIET

SEQ ID NO: 1032830 - protein, 26 aa, Mycobacterium
AGVLLRYVLLTAKRVTGIVSRGGSIM

SEQ ID NO: 1032831 - protein, 18 aa, Mycobacterium
AGVLRPLPVKTFDVRRAP

SEQ ID NO: 1032832 - protein, 25 aa, Mycobacterium
AGVLSRMRPLFSFALGARIGNGRQY

SEQ ID NO: 1032833 - protein, 25 aa, Mycobacterium
AGVYPPCSTFEAWFVSAALDDAAFG

SEQ ID NO: 1032834 - protein, 20 aa, Mycobacterium
AGWDVLGHSVLLPFGIAPTG

SEQ ID NO: 1032835 - protein, 24 aa, Mycobacterium
AHEGSLRFGDKVVLGRDNVINCYL

SEQ ID NO: 1032836 - protein, 18 aa, Mycobacterium
AHGTVMLRMPLHSVAIEL

SEQ ID NO: 1032837 - protein, 17 aa, Mycobacterium
AHHRLFSHVPWLASQLL

SEQ ID NO: 1032838 - protein, 17 aa, Mycobacterium
AHHYLKSSTIFTLHTGI

SEQ ID NO: 1032839 - protein, 17 aa, Mycobacterium
AHLRAAHHISLCAQCAA

SEQ ID NO: 1032840 - protein, 25 aa, Mycobacterium
AHPERAVAVLAALPAWNGAPESAPA

SEQ ID NO: 1032841 - protein, 18 aa, Mycobacterium
AHRPRRALATPWWEAGHR

SEQ ID NO: 1032842 - protein, 17 aa, Mycobacterium
AHVIDGRVKHCVLVELL

SEQ ID NO: 1032843 - protein, 21 aa, Mycobacterium
AIADAEFKAAGAQLISTPEQV

SEQ ID NO: 1032844 - protein, 19 aa, Mycobacterium
AIAKARFVRVSPRKARRVI

SEQ ID NO: 1032845 - protein, 29 aa, Mycobacterium
AIAPLPGGFPVELGMSIRLARDKNYNLLL

SEQ ID NO: 1032846 - protein, 26 aa, Mycobacterium
AIARFKRLDGLDVRFLTGTDEHGLKV

SEQ ID NO: 1032847 - protein, 29 aa, Mycobacterium
AICLSTRLAKARLYLCTDARRERGDLAQF

SEQ ID NO: 1032848 - protein, 18 aa, Mycobacterium
AIDAERWLAEHAGSKANE

SEQ ID NO: 1032849 - protein, 26 aa, Mycobacterium
AIDLGWSLIATRSMFEHRAVVVGADR

SEQ ID NO: 1032850 - protein, 27 aa, Mycobacterium
AIDPLLPEVAWSWLIEALESRIDHVTA

SEQ ID NO: 1032851 - protein, 23 aa, Mycobacterium
AIEAPEFHSAVLAELALIEHRGP

SEQ ID NO: 1032852 - protein, 24 aa, Mycobacterium
AIELARSGAKLAISDVDGEGLAQT

SEQ ID NO: 1032853 - protein, 24 aa, Mycobacterium
AIEPRFYYEKGLCDIIKYHVSMTS

SEQ ID NO: 1032854 - protein, 26 aa, Mycobacterium
AIFSDALIGYAMKRRDIVAITAAMPG

SEQ ID NO: 1032855 - protein, 20 aa, Mycobacterium
AIGKAAPVGLFVETFGTEAV

SEQ ID NO: 1032856 - protein, 24 aa, Mycobacterium
AILTARHLDCWVLGTVCKGSKVGP

SEQ ID NO: 1032857 - protein, 26 aa, Mycobacterium
AINGPAIGGGLCLALAADVRVASTRA

SEQ ID NO: 1032858 - protein, 22 aa, Mycobacterium
AIPAEASGTVGTPRKAQVKRRK

SEQ ID NO: 1032859 - protein, 23 aa, Mycobacterium
AIPDILREKGLAWIDWVVNETTY

SEQ ID NO: 1032860 - protein, 25 aa, Mycobacterium
AIQRSREVWLMVSGTAKADAVAAAM

SEQ ID NO: 1032861 - protein, 27 aa, Mycobacterium
AIRADFPILKRVMRGGNQLAYLDSGAT

SEQ ID NO: 1032862 - protein, 25 aa, Mycobacterium
AIRNYRIGVDFVPYLYLSDLQDQRI

SEQ ID NO: 1032863 - protein, 20 aa, Mycobacterium
AIRRQGRFLSMDEIAGKIGV

SEQ ID NO: 1032864 - protein, 17 aa, Mycobacterium
AIRRVGLDVTIERSDDL

SEQ ID NO: 1032865 - protein, 20 aa, Mycobacterium
AITGCLIAGVPVVPVPADIG

SEQ ID NO: 1032866 - protein, 23 aa, Mycobacterium
AITKLAPQHLVVVLGHEHQRIAP

SEQ ID NO: 1032867 - protein, 18 aa, Mycobacterium
AITRSSWGQPILNPESRF

SEQ ID NO: 1032868 - protein, 18 aa, Mycobacterium
AITSEWRYADSTNPDAQF

SEQ ID NO: 1032869 - protein, 23 aa, Mycobacterium
AIVEGPRAVAAVRQLTGGTDPVE

SEQ ID NO: 1032870 - protein, 23 aa, Mycobacterium
AKAAELRYGRIPEVEKKLEAAVP

SEQ ID NO: 1032871 - protein, 20 aa, Mycobacterium
AKAATLYVGWLNAAGTGGVG

SEQ ID NO: 1032872 - protein, 17 aa, Mycobacterium
AKACAIEPTGMSAVLGG

SEQ ID NO: 1032873 - protein, 19 aa, Mycobacterium
AKADARRKFRDGGEREMRQ

SEQ ID NO: 1032874 - protein, 25 aa, Mycobacterium
AKALEFRPKVLIAGWSAYPRILDFA

SEQ ID NO: 1032875 - protein, 18 aa, Mycobacterium
AKDQLRFSAPPRLDLSLL

SEQ ID NO: 1032876 - protein, 20 aa, Mycobacterium
AKFEFNNGFATITIATTGVG

SEQ ID NO: 1032877 - protein, 18 aa, Mycobacterium
AKFTPAREALDNNNFRLT

SEQ ID NO: 1032878 - protein, 18 aa, Mycobacterium
AKGGAAVFQMMGLCQMLR

SEQ ID NO: 1032879 - protein, 20 aa, Mycobacterium
AKKTAYRPARLQILHHKLTE

SEQ ID NO: 1032880 - protein, 18 aa, Mycobacterium
AKLAVKINDLMLPLVKGV

SEQ ID NO: 1032881 - protein, 19 aa, Mycobacterium
AKLEVPSRFQAKGMGSGGA

SEQ ID NO: 1032882 - protein, 25 aa, Mycobacterium
AKLLKSCYLLALSQNWLLNLVDGVP

SEQ ID NO: 1032883 - protein, 18 aa, Mycobacterium
AKLPGVWVVDVEGVQREP

SEQ ID NO: 1032884 - protein, 25 aa, Mycobacterium
AKLQKRLTDELAWVRSGAKARQAKS

SEQ ID NO: 1032885 - protein, 23 aa, Mycobacterium
AKLRHVAEFEVGKPERIVLVWPP

SEQ ID NO: 1032886 - protein, 18 aa, Mycobacterium
AKMFLLLFSSLHRQLQLA

SEQ ID NO: 1032887 - protein, 25 aa, Mycobacterium
AKMFNCTGWKIGWPAEQQISSPGSY

SEQ ID NO: 1032888 - protein, 18 aa, Mycobacterium
AKNLSWLANFSDIRGSDS

SEQ ID NO: 1032889 - protein, 21 aa, Mycobacterium
AKPERRRGIIRNELTEIAEKY

SEQ ID NO: 1032890 - protein, 20 aa, Mycobacterium
AKQLRMAYLRVTRPQIAVSE

SEQ ID NO: 1032891 - protein, 27 aa, Mycobacterium
AKQRAFEVLDRLRLIDISNNFGDVKSL

SEQ ID NO: 1032892 - protein, 20 aa, Mycobacterium
AKQYPAILAMTSLHDTRVHY

SEQ ID NO: 1032893 - protein, 20 aa, Mycobacterium
AKRDRAGIVVRGLRSSRDRV

SEQ ID NO: 1032894 - protein, 23 aa, Mycobacterium
AKRFSDAVTAIWQGRVEIDRFNE

SEQ ID NO: 1032895 - protein, 22 aa, Mycobacterium
AKRTLAVAVYNHYKRIQAGEKG

SEQ ID NO: 1032896 - protein, 31 aa, Mycobacterium
AKSEYFTGTGLKGWFTSWFYRATGQVPIDRT

SEQ ID NO: 1032897 - protein, 25 aa, Mycobacterium
AKTDPVIGCAAALEAHGALVTIITI

SEQ ID NO: 1032898 - protein, 23 aa, Mycobacterium
AKVGNLRFEWSRSLDNLAEYVLV

SEQ ID NO: 1032899 - protein, 18 aa, Mycobacterium
ALAARYSASHLRRDGLAA

SEQ ID NO: 1032900 - protein, 18 aa, Mycobacterium
ALADFLFDDQRAMVRVDM

SEQ ID NO: 1032901 - protein, 19 aa, Mycobacterium
ALAQCLRGGTPDEVAKLVL

SEQ ID NO: 1032902 - protein, 21 aa, Mycobacterium
ALAQPGLRLPQIIQTALDGYA

SEQ ID NO: 1032903 - protein, 25 aa, Mycobacterium
ALARARRALDEFEVEGLATVIPFHR

SEQ ID NO: 1032904 - protein, 25 aa, Mycobacterium
ALASRTRKVPGFALLGEQGESRDLT

SEQ ID NO: 1032905 - protein, 21 aa, Mycobacterium
ALAYMDLRPGTPMRDIAVDAV

SEQ ID NO: 1032906 - protein, 25 aa, Mycobacterium
ALCRSIKFPTFLAGIDAVCRVAEHA

SEQ ID NO: 1032907 - protein, 20 aa, Mycobacterium
ALCTFGTALNPQFGPDSSAQ

SEQ ID NO: 1032908 - protein, 20 aa, Mycobacterium
ALDEVGRILGVKGRVLPMCP

SEQ ID NO: 1032909 - protein, 29 aa, Mycobacterium
ALDIYRVGQYTAWRRWMEIAFTLTSDPQE

SEQ ID NO: 1032910 - protein, 22 aa, Mycobacterium
ALDKLRLEAFRNKDLDPRTVDT

SEQ ID NO: 1032911 - protein, 27 aa, Mycobacterium
ALDQYLRLPLRQVMWGDDEGLLNSTEF

SEQ ID NO: 1032912 - protein, 19 aa, Mycobacterium
ALDRCAMLLADIAGGTVSE

SEQ ID NO: 1032913 - protein, 18 aa, Mycobacterium
ALERAGIDPAGLRGSATG

SEQ ID NO: 1032914 - protein, 19 aa, Mycobacterium
ALFTYLRSLVLHWGATDRG

SEQ ID NO: 1032915 - protein, 19 aa, Mycobacterium
ALGAHVARWLAHKYESVDL

SEQ ID NO: 1032916 - protein, 20 aa, Mycobacterium
ALGLVCRVDEQRLFGGSCLC

SEQ ID NO: 1032917 - protein, 25 aa, Mycobacterium
ALHAGGFKHYAKVEVVWVASDDCET

SEQ ID NO: 1032918 - protein, 24 aa, Mycobacterium
ALHKILHNFKMPGFLVPEFRRKAV

SEQ ID NO: 1032919 - protein, 20 aa, Mycobacterium
ALHLACLSLLSGECDMALAG

SEQ ID NO: 1032920 - protein, 22 aa, Mycobacterium
ALHRRCADVCYLGSWPAGLATG

SEQ ID NO: 1032921 - protein, 21 aa, Mycobacterium
ALIKVCAELGLDTSRVNGRSG

SEQ ID NO: 1032922 - protein, 25 aa, Mycobacterium
ALINRYATVCGMTGTALAAGEQLRQ

SEQ ID NO: 1032923 - protein, 21 aa, Mycobacterium
ALITKVWKMPSFFLTHPQGIA

SEQ ID NO: 1032924 - protein, 23 aa, Mycobacterium
ALKEASYRLGARTLYHRFGAPLS

SEQ ID NO: 1032925 - protein, 18 aa, Mycobacterium
ALLCLYRAVFGSGCRALR

SEQ ID NO: 1032926 - protein, 23 aa, Mycobacterium
ALLHPRLVRAIALINSPHPAALR

SEQ ID NO: 1032927 - protein, 18 aa, Mycobacterium
ALLKVLRGVYSRGEMTTA

SEQ ID NO: 1032928 - protein, 23 aa, Mycobacterium
ALLLRRDISCVPLLHGGGQERDI

SEQ ID NO: 1032929 - protein, 22 aa, Mycobacterium
ALLSDRPTKVFGDGTHTRDYVF

SEQ ID NO: 1032930 - protein, 24 aa, Mycobacterium
ALMSGFERRGRWNVPRKLTTFSLW

SEQ ID NO: 1032931 - protein, 20 aa, Mycobacterium
ALPALCRLIDSPRHDVIAVL

SEQ ID NO: 1032932 - protein, 20 aa, Mycobacterium
ALPDDYGGIVVVTSGDTPLL

SEQ ID NO: 1032933 - protein, 18 aa, Mycobacterium
ALPDSRHVWEFAPRDKTD

SEQ ID NO: 1032934 - protein, 17 aa, Mycobacterium
ALPELDYACGLGTGRLF

SEQ ID NO: 1032935 - protein, 20 aa, Mycobacterium
ALPRVWYLVIAACNRNRGFV

SEQ ID NO: 1032936 - protein, 19 aa, Mycobacterium
ALQAGRIAVPLSVPQGGVT

SEQ ID NO: 1032937 - protein, 25 aa, Mycobacterium
ALQELMRLVFFLKRGDLEALDKVFW

SEQ ID NO: 1032938 - protein, 32 aa, Mycobacterium
ALQGKDLRPEWTIPPREEFYFGYSDKDIDAVV

SEQ ID NO: 1032939 - protein, 17 aa, Mycobacterium
ALQRGLPVLGICRGAQL

SEQ ID NO: 1032940 - protein, 21 aa, Mycobacterium
ALRWSGMIAERVCRLLRTPSV

SEQ ID NO: 1032941 - protein, 17 aa, Mycobacterium
ALSDLRLFTAIVDAACR

SEQ ID NO: 1032942 - protein, 19 aa, Mycobacterium
ALSTLRDIYGATLGYQVDA

SEQ ID NO: 1032943 - protein, 20 aa, Mycobacterium
ALTGGMCWEALNNIAATPRP

SEQ ID NO: 1032944 - protein, 37 aa, Mycobacterium
ALTQIGSPYAWGGAAPGGFDCSGLVMWAYQQAGIALP

SEQ ID NO: 1032945 - protein, 19 aa, Mycobacterium
ALTQLREVLGYDLRCYSDL

SEQ ID NO: 1032946 - protein, 19 aa, Mycobacterium
ALTSARFGALNLRVDTKPD

SEQ ID NO: 1032947 - protein, 29 aa, Mycobacterium
ALTTRGVACAGLVIGSWTGRPGAVQISNR

SEQ ID NO: 1032948 - protein, 23 aa, Mycobacterium
ALVAQHRGYKCVFVCPDKVSEDK

SEQ ID NO: 1032949 - protein, 24 aa, Mycobacterium
ALVGACWPAVFSAIGSAVTEAGVL

SEQ ID NO: 1032950 - protein, 18 aa, Mycobacterium
ALVGLGFAAKQAEEATDQ

SEQ ID NO: 1032951 - protein, 18 aa, Mycobacterium
ALVIKGGYMDGHPMTVAE

SEQ ID NO: 1032952 - protein, 26 aa, Mycobacterium
ALVNSWSAAFARYGRAVGQVLLTAQD

SEQ ID NO: 1032953 - protein, 17 aa, Mycobacterium
ALVQRLQGLAANRQLEL

SEQ ID NO: 1032954 - protein, 25 aa, Mycobacterium
ALVSGLRLRLPITTTLGTYRTASVA

SEQ ID NO: 1032955 - protein, 17 aa, Mycobacterium
ALVYRLEKSSSETLRSI

SEQ ID NO: 1032956 - protein, 25 aa, Mycobacterium
ALYEAKAGFAWPEPTVRALPGLAEK

SEQ ID NO: 1032957 - protein, 29 aa, Mycobacterium
ALYMDRYPLVSAISRPLIVKHLVAAARAH

SEQ ID NO: 1032958 - protein, 19 aa, Mycobacterium
AMGLLRRIDADTVILPRRV

SEQ ID NO: 1032959 - protein, 26 aa, Mycobacterium
AMGPEGRAAIGLGDGVVRISIGLEDA

SEQ ID NO: 1032960 - protein, 23 aa, Mycobacterium
AMIDLAFKLGIIVCAKRVETPGQ

SEQ ID NO: 1032961 - protein, 19 aa, Mycobacterium
AMLAVMYRPSHLMTVHFVG

SEQ ID NO: 1032962 - protein, 35 aa, Mycobacterium
AMLGQPVSMLIPWVVGFKLSGEIQPGVTATDVVLT

SEQ ID NO: 1032963 - protein, 25 aa, Mycobacterium
AMNLAVVLRATWAVAQVLLQRAGSR

SEQ ID NO: 1032964 - protein, 22 aa, Mycobacterium
AMPPCTGTGMGIDRLLMSLTGL

SEQ ID NO: 1032965 - protein, 19 aa, Mycobacterium
AMYLCRELTDLSLPKIGQA

SEQ ID NO: 1032966 - protein, 18 aa, Mycobacterium
ANAEGREALIESVRRVSS

SEQ ID NO: 1032967 - protein, 17 aa, Mycobacterium
ANAKLKAVIARCPPGFA

SEQ ID NO: 1032968 - protein, 22 aa, Mycobacterium
ANARIALHVRVLYGRDPHHITE

SEQ ID NO: 1032969 - protein, 18 aa, Mycobacterium
ANEAILVARIATLERVKS

SEQ ID NO: 1032970 - protein, 26 aa, Mycobacterium
ANELSRFAEIWLRGGELDGIRVLRSE

SEQ ID NO: 1032971 - protein, 33 aa, Mycobacterium
ANFDEGLRATIDWYRNNESWWRPLKDAVEARYE

SEQ ID NO: 1032972 - protein, 18 aa, Mycobacterium
ANFFRIKPAYFTNDEYYE

SEQ ID NO: 1032973 - protein, 23 aa, Mycobacterium
ANFLLIKDIRTLLDIASITYTQS

SEQ ID NO: 1032974 - protein, 17 aa, Mycobacterium
ANFSDIRGSDSVRQYPF

SEQ ID NO: 1032975 - protein, 17 aa, Mycobacterium
ANGISAFIVHKDDEGFS

SEQ ID NO: 1032976 - protein, 18 aa, Mycobacterium
ANGVRQIATEAGITIIAG

SEQ ID NO: 1032977 - protein, 34 aa, Mycobacterium
ANHAVGWVRMDFIVPSRGLIGFRTDFLTLTRGTG

SEQ ID NO: 1032978 - protein, 22 aa, Mycobacterium
ANIAAIPRCKINVGDGTGPDVR

SEQ ID NO: 1032979 - protein, 19 aa, Mycobacterium
ANIGSIMGIGFPPWTGGSA

SEQ ID NO: 1032980 - protein, 18 aa, Mycobacterium
ANKVNLWLADVSLNTDVI

SEQ ID NO: 1032981 - protein, 18 aa, Mycobacterium
ANLHMIGKDIIRFHAVYW

SEQ ID NO: 1032982 - protein, 18 aa, Mycobacterium
ANLLGSGGPAFAVTVGGR

SEQ ID NO: 1032983 - protein, 23 aa, Mycobacterium
ANPAHAVLWGFGRTLALEHPEIW

SEQ ID NO: 1032984 - protein, 20 aa, Mycobacterium
ANPSAPFVSAFLVTNVLESQ

SEQ ID NO: 1032985 - protein, 24 aa, Mycobacterium
ANPTPKGCVFEYVYLARPDSTLAG

SEQ ID NO: 1032986 - protein, 17 aa, Mycobacterium
ANQFVAFLVWSPNRQSA

SEQ ID NO: 1032987 - protein, 24 aa, Mycobacterium
ANQPIQFAGCLDINASEKAARFVR

SEQ ID NO: 1032988 - protein, 18 aa, Mycobacterium
ANQTYGLQWANWPVDGYP

SEQ ID NO: 1032989 - protein, 26 aa, Mycobacterium
ANRDKRLLVFPVKRLADLGFHVIATE

SEQ ID NO: 1032990 - protein, 18 aa, Mycobacterium
ANRLCAQILLLAAEDAFK

SEQ ID NO: 1032991 - protein, 28 aa, Mycobacterium
ANRLGLIDPEAWAFVWVVDPPLFERADE

SEQ ID NO: 1032992 - protein, 17 aa, Mycobacterium
ANRLVDAGCDGLVLSGT

SEQ ID NO: 1032993 - protein, 24 aa, Mycobacterium
ANSEPRTGLSMGEHAAITAKKMGI

SEQ ID NO: 1032994 - protein, 21 aa, Mycobacterium
ANSLRTAERLTIQINEIHAER

SEQ ID NO: 1032995 - protein, 17 aa, Mycobacterium
ANTGWWGLDTKWSVADD

SEQ ID NO: 1032996 - protein, 22 aa, Mycobacterium
ANVQAALRIEQLEQLVLEQFGI

SEQ ID NO: 1032997 - protein, 21 aa, Mycobacterium
ANVVSAWTGIPAGRLLEGETA

SEQ ID NO: 1032998 - protein, 17 aa, Mycobacterium
ANWEIAESDLLLERWRV

SEQ ID NO: 1032999 - protein, 18 aa, Mycobacterium
ANYSMVFNSYSEVPANVS

SEQ ID NO: 1033000 - protein, 18 aa, Mycobacterium
APALIRRSSVSMPNAAQW

SEQ ID NO: 1033001 - protein, 19 aa, Mycobacterium
APARARAAVLSAMHAAHPY

SEQ ID NO: 1033002 - protein, 24 aa, Mycobacterium
APDDLLDALSLWTPMQSVAAYDAV

SEQ ID NO: 1033003 - protein, 22 aa, Mycobacterium
APDDLRFLVGDIRGKLGSDPAV

SEQ ID NO: 1033004 - protein, 20 aa, Mycobacterium
APDFRLFWDNAYAVHTLTHD

SEQ ID NO: 1033005 - protein, 24 aa, Mycobacterium
APDHRRAASELVRVCRPNGTIGVI

SEQ ID NO: 1033006 - protein, 25 aa, Mycobacterium
APDIPRERFSALTRLDHNRAIAQLA

SEQ ID NO: 1033007 - protein, 18 aa, Mycobacterium
APDQLLFVLELTATVDHD

SEQ ID NO: 1033008 - protein, 18 aa, Mycobacterium
APDQLLTAVLFIDLDNFK

SEQ ID NO: 1033009 - protein, 25 aa, Mycobacterium
APEIYRAPLSYPYRDGLLNKDLATD

SEQ ID NO: 1033010 - protein, 24 aa, Mycobacterium
APERVPAGHPLSVHFDVYQWLTVL

SEQ ID NO: 1033011 - protein, 19 aa, Mycobacterium
APESFAPNPARTANYEATK

SEQ ID NO: 1033012 - protein, 19 aa, Mycobacterium
APESPAFMRHLLGNAHDKV

SEQ ID NO: 1033013 - protein, 22 aa, Mycobacterium
APGARLAWREDATWAPHSGESR

SEQ ID NO: 1033014 - protein, 19 aa, Mycobacterium
APGGILMRKSPRYDAYHTN

SEQ ID NO: 1033015 - protein, 17 aa, Mycobacterium
APGRRSVSWLGHSTILL

SEQ ID NO: 1033016 - protein, 18 aa, Mycobacterium
APGTNWKSNPNAMRTIAA

SEQ ID NO: 1033017 - protein, 20 aa, Mycobacterium
APIPRISYADAMRRFGSDKP

SEQ ID NO: 1033018 - protein, 17 aa, Mycobacterium
APKTILVVIVTKIDKVP

SEQ ID NO: 1033019 - protein, 21 aa, Mycobacterium
APLDRRLLLGMLAELPAGVGV

SEQ ID NO: 1033020 - protein, 23 aa, Mycobacterium
APLLCAGITLYSPLRHWNAKPGT

SEQ ID NO: 1033021 - protein, 19 aa, Mycobacterium
APLLNLGRLLTTWRQPDES

SEQ ID NO: 1033022 - protein, 18 aa, Mycobacterium
APLPLLFVVSAVAELAES

SEQ ID NO: 1033023 - protein, 20 aa, Mycobacterium
APLPTWTRRELMLSRESVDH

SEQ ID NO: 1033024 - protein, 17 aa, Mycobacterium
APLPVLADAVLPVRWTD

SEQ ID NO: 1033025 - protein, 24 aa, Mycobacterium
APLRGGSELRPVSGGLLIQQPDQL

SEQ ID NO: 1033026 - protein, 19 aa, Mycobacterium
APLRVTLSLGDGWNPDLAA

SEQ ID NO: 1033027 - protein, 18 aa, Mycobacterium
APMPAPRAILAAAVEGAQ

SEQ ID NO: 1033028 - protein, 17 aa, Mycobacterium
APNAAAVRTMWSTVREK

SEQ ID NO: 1033029 - protein, 22 aa, Mycobacterium
APNARPPVCKIMDYGKYKYEVA

SEQ ID NO: 1033030 - protein, 18 aa, Mycobacterium
APNLAIKALHKILHNFKM

SEQ ID NO: 1033031 - protein, 23 aa, Mycobacterium
APPHGGIAFGWDRTNALLAGMES

SEQ ID NO: 1033032 - protein, 19 aa, Mycobacterium
APQSIDYVAGFYVAVKAGT

SEQ ID NO: 1033033 - protein, 23 aa, Mycobacterium
APRSRLIPSHVIFRTDKFGTTYN

SEQ ID NO: 1033034 - protein, 25 aa, Mycobacterium
APSANLRWSNSVAILAGDYLFATAS

SEQ ID NO: 1033035 - protein, 24 aa, Mycobacterium
APTDLWKVDQFYFDPRWIAIDPRW

SEQ ID NO: 1033036 - protein, 20 aa, Mycobacterium
APTHIAAAFDVSRKTFRSEC

SEQ ID NO: 1033037 - protein, 26 aa, Mycobacterium
APTVHKPRPNFPVINFLDAGTAPLSV

SEQ ID NO: 1033038 - protein, 17 aa, Mycobacterium
APVCAADPQFLRGDGVT

SEQ ID NO: 1033039 - protein, 17 aa, Mycobacterium
APVRYTERLYRADPDTV

SEQ ID NO: 1033040 - protein, 24 aa, Mycobacterium
APVYELRNGGLGVREFKRLAKATG

SEQ ID NO: 1033041 - protein, 18 aa, Mycobacterium
APYVTPLVRKLATENNID

SEQ ID NO: 1033042 - protein, 17 aa, Mycobacterium
AQAKSTFRAQIPKYVDG

SEQ ID NO: 1033043 - protein, 20 aa, Mycobacterium
AQALELFDAALVIDHPFMVT

SEQ ID NO: 1033044 - protein, 25 aa, Mycobacterium
AQARRIAAEIGYPVLVRPSYVLGGR

SEQ ID NO: 1033045 - protein, 17 aa, Mycobacterium
AQDLCARTKVFTLAESL

SEQ ID NO: 1033046 - protein, 25 aa, Mycobacterium
AQEISARVLMKLKRDAEAYLGEDIT

SEQ ID NO: 1033047 - protein, 27 aa, Mycobacterium
AQGGGCWRWLAGYYWPPVHGRCLAWWV

SEQ ID NO: 1033048 - protein, 18 aa, Mycobacterium
AQHQWPTSYGIRTSAQLR

SEQ ID NO: 1033049 - protein, 25 aa, Mycobacterium
AQIRSIPTLVAFKKGKPLLSQAGDL

SEQ ID NO: 1033050 - protein, 17 aa, Mycobacterium
AQLALAHATIHLATAPK

SEQ ID NO: 1033051 - protein, 24 aa, Mycobacterium
AQLALSRPAVFVVEDVHWIDEVSD

SEQ ID NO: 1033052 - protein, 29 aa, Mycobacterium
AQLGRAASIGSLRVPQTWTTASQPVTAAT

SEQ ID NO: 1033053 - protein, 17 aa, Mycobacterium
AQLRGSSVLLAPDPSAV

SEQ ID NO: 1033054 - protein, 26 aa, Mycobacterium
AQLRHAWLDLHESWLIAKSVEIGITD

SEQ ID NO: 1033055 - protein, 21 aa, Mycobacterium
AQLYEQFPVFAAAFDDVVDAL

SEQ ID NO: 1033056 - protein, 19 aa, Mycobacterium
AQNGRYGPYLKRGKDSRPL

SEQ ID NO: 1033057 - protein, 21 aa, Mycobacterium
AQRLVTLAAIDIVKTFFKADR

SEQ ID NO: 1033058 - protein, 25 aa, Mycobacterium
AQSAEALGGGWFWPAAAAHPSLPRG

SEQ ID NO: 1033059 - protein, 18 aa, Mycobacterium
AQTAVEWSEASHRGGPGL

SEQ ID NO: 1033060 - protein, 18 aa, Mycobacterium
AQVLRRQPLLLSLLATHP

SEQ ID NO: 1033061 - protein, 27 aa, Mycobacterium
AQVSYRDLVGFGRRFIDVTADDLLADV

SEQ ID NO: 1033062 - protein, 27 aa, Mycobacterium
AQVVLDLLSQAGFNFVRIVSEGGAPAV

SEQ ID NO: 1033063 - protein, 18 aa, Mycobacterium
ARAALADTVVRRGDTPLP

SEQ ID NO: 1033064 - protein, 28 aa, Mycobacterium
ARAALQILKAETWRPEAVLQHARTLAKI

SEQ ID NO: 1033065 - protein, 22 aa, Mycobacterium
ARACAFTTASTWEFEPLDIDVF

SEQ ID NO: 1033066 - protein, 21 aa, Mycobacterium
ARADIHAALACGADIQASLGI

SEQ ID NO: 1033067 - protein, 22 aa, Mycobacterium
ARAEGLGQLFVRLLTVNVEEAF

SEQ ID NO: 1033068 - protein, 18 aa, Mycobacterium
ARAFLDFAAQHHIAVTTP

SEQ ID NO: 1033069 - protein, 17 aa, Mycobacterium
ARAFLISQQVRWAARSL

SEQ ID NO: 1033070 - protein, 19 aa, Mycobacterium
ARAIKCDHPAYFSEDAAAE

SEQ ID NO: 1033071 - protein, 27 aa, Mycobacterium
ARALGCTIKLLFICERITAADGQQRVS

SEQ ID NO: 1033072 - protein, 25 aa, Mycobacterium
ARALIAVRGLHRFAVAEGLVDLDVA

SEQ ID NO: 1033073 - protein, 22 aa, Mycobacterium
ARALILVRWLGAPVLSFHLRDA

SEQ ID NO: 1033074 - protein, 18 aa, Mycobacterium
ARALSGGSNLLFRRNSVT

SEQ ID NO: 1033075 - protein, 26 aa, Mycobacterium
ARCGLPAWDLPTVFGPSAVIYHINGV

SEQ ID NO: 1033076 - protein, 25 aa, Mycobacterium
ARDFAAEAAFVFAMIAVDLSRLAED

SEQ ID NO: 1033077 - protein, 23 aa, Mycobacterium
ARDLPCHTGIRLLGSNSHALGRV

SEQ ID NO: 1033078 - protein, 18 aa, Mycobacterium
ARDYGWPQFADRILELAR

SEQ ID NO: 1033079 - protein, 19 aa, Mycobacterium
AREAAWRVLDQRPFDVQVM

SEQ ID NO: 1033080 - protein, 19 aa, Mycobacterium
ARELAEFVCDNIAAERGWP

SEQ ID NO: 1033081 - protein, 22 aa, Mycobacterium
AREVADVVAPVLGWTAEDIDRE

SEQ ID NO: 1033082 - protein, 18 aa, Mycobacterium
ARFNRYLHDRGIKDTSDQ

SEQ ID NO: 1033083 - protein, 28 aa, Mycobacterium
ARFTIHAGEAFGLPSIHEAIAFCGADRL

SEQ ID NO: 1033084 - protein, 26 aa, Mycobacterium
ARFVRLCDAFGIPLVVIVDVPGYLPG

SEQ ID NO: 1033085 - protein, 21 aa, Mycobacterium
ARGQRAVLCASTGNTSASAAA

SEQ ID NO: 1033086 - protein, 29 aa, Mycobacterium
ARGYPKTEFNVVLPWTKAVVLNLGVKTQS

SEQ ID NO: 1033087 - protein, 17 aa, Mycobacterium
ARHERSKRIAVQRKAAE

SEQ ID NO: 1033088 - protein, 25 aa, Mycobacterium
ARIAGRPAVVLLHLGPGLGNGLANL

SEQ ID NO: 1033089 - protein, 21 aa, Mycobacterium
ARIALSRGLCSNRFVHEVRQY

SEQ ID NO: 1033090 - protein, 21 aa, Mycobacterium
ARIMADTGLAYYSGDDALNLP

SEQ ID NO: 1033091 - protein, 23 aa, Mycobacterium
ARIPLPGGGVLSKIPGRGDLLAL

SEQ ID NO: 1033092 - protein, 27 aa, Mycobacterium
ARITLHVALELARRGSGYGVAALCGAG

SEQ ID NO: 1033093 - protein, 17 aa, Mycobacterium
ARLDRLIGHTGWTKPEA

SEQ ID NO: 1033094 - protein, 18 aa, Mycobacterium
ARLGHFYRGVGLTIHEGY

SEQ ID NO: 1033095 - protein, 24 aa, Mycobacterium
ARLPDAVHYSARFVKPVVLPATTG

SEQ ID NO: 1033096 - protein, 20 aa, Mycobacterium
ARLPSIALRAARSALAAGAP

SEQ ID NO: 1033097 - protein, 26 aa, Mycobacterium
ARLSALARNAAEFGLIPDTGHLELLS

SEQ ID NO: 1033098 - protein, 20 aa, Mycobacterium
ARLTILEVMAEAIDRPDEMS

SEQ ID NO: 1033099 - protein, 18 aa, Mycobacterium
ARNGRIHAVTELVVGKTP

SEQ ID NO: 1033100 - protein, 18 aa, Mycobacterium
ARNSPKQVRFMLADYRSS

SEQ ID NO: 1033101 - protein, 18 aa, Mycobacterium
ARPKDILRAHGFGSTAVV

SEQ ID NO: 1033102 - protein, 22 aa, Mycobacterium
ARPTLSRRTLGWFVSLAGARIR

SEQ ID NO: 1033103 - protein, 19 aa, Mycobacterium
ARQALRLFDDLRLDHGRLD

SEQ ID NO: 1033104 - protein, 18 aa, Mycobacterium
ARQLISIHRADPAKIDVA

SEQ ID NO: 1033105 - protein, 18 aa, Mycobacterium
ARQLPGRLVGVSVDSDGT

SEQ ID NO: 1033106 - protein, 20 aa, Mycobacterium
ARQRERIHRVANWLYSGAPS

SEQ ID NO: 1033107 - protein, 26 aa, Mycobacterium
ARRGLRSGMLPRSWDPAGVAGERSVD

SEQ ID NO: 1033108 - protein, 19 aa, Mycobacterium
ARRGPGMLATPAIFLNARG

SEQ ID NO: 1033109 - protein, 23 aa, Mycobacterium
ARRITGWVVAFGHCGSGDDAGQY

SEQ ID NO: 1033110 - protein, 19 aa, Mycobacterium
ARRKPPFGIGQIGKSFRNE

SEQ ID NO: 1033111 - protein, 17 aa, Mycobacterium
ARRMAPMVVEYVEESKL

SEQ ID NO: 1033112 - protein, 18 aa, Mycobacterium
ARRRGVVINPILETSEIP

SEQ ID NO: 1033113 - protein, 21 aa, Mycobacterium
ARSAVGVAELPLGAPVEIELI

SEQ ID NO: 1033114 - protein, 24 aa, Mycobacterium
ARSEIEMKVLLWAVQRLIVGLSKI

SEQ ID NO: 1033115 - protein, 18 aa, Mycobacterium
ARSEYRRADVFSETNTDA

SEQ ID NO: 1033116 - protein, 25 aa, Mycobacterium
ARSGLPFGTCLETIYLHPCGSDEFR

SEQ ID NO: 1033117 - protein, 21 aa, Mycobacterium
ARSPLGRKLGRSWHQKTVYGV

SEQ ID NO: 1033118 - protein, 29 aa, Mycobacterium
ARSVTGIAPAGGWTRWSLAKFEVIAKFVA

SEQ ID NO: 1033119 - protein, 23 aa, Mycobacterium
ARTFPLRSSFVPSYNMTINLVHW

SEQ ID NO: 1033120 - protein, 19 aa, Mycobacterium
ARTGAAMIVSIAQFGSTRS

SEQ ID NO: 1033121 - protein, 20 aa, Mycobacterium
ARTHAIGQIVPGKVTKLVPF

SEQ ID NO: 1033122 - protein, 20 aa, Mycobacterium
ARTMPIVIITDGHHVDIQVE

SEQ ID NO: 1033123 - protein, 17 aa, Mycobacterium
ARTQLHYVLNRAESAST

SEQ ID NO: 1033124 - protein, 20 aa, Mycobacterium
ARTRTGASIVAIVRDEDVVV

SEQ ID NO: 1033125 - protein, 17 aa, Mycobacterium
ARTSFALLGNGAMMIGK

SEQ ID NO: 1033126 - protein, 20 aa, Mycobacterium
ARVCGGNVYVAVTGADTNPT

SEQ ID NO: 1033127 - protein, 19 aa, Mycobacterium
ARVDGRTVGVVANQPMHLS

SEQ ID NO: 1033128 - protein, 21 aa, Mycobacterium
ARVLQALLARWDHHTRVDLVT

SEQ ID NO: 1033129 - protein, 17 aa, Mycobacterium
ARVRAMLPTLPKGAQAA

SEQ ID NO: 1033130 - protein, 25 aa, Mycobacterium
ARVSESPWALMHFMVRLSEGAATGS

SEQ ID NO: 1033131 - protein, 24 aa, Mycobacterium
ARVSYPAVLARYSAALVRGDMCDK

SEQ ID NO: 1033132 - protein, 25 aa, Mycobacterium
ARVVAKVYCGLGLLKKENIREVHRA

SEQ ID NO: 1033133 - protein, 20 aa, Mycobacterium
ARWWFWPMDVITLVWSVQSQ

SEQ ID NO: 1033134 - protein, 21 aa, Mycobacterium
ARYDVTFSLGDGLRPGSIADA

SEQ ID NO: 1033135 - protein, 27 aa, Mycobacterium
ARYFPKGPACLIGLWDQRCRTPSFCDA

SEQ ID NO: 1033136 - protein, 23 aa, Mycobacterium
ARYGRNRIGLLTGDQSVNGDSPV

SEQ ID NO: 1033137 - protein, 24 aa, Mycobacterium
ASAIDRAALPYVVGTIAGDDTVFV

SEQ ID NO: 1033138 - protein, 23 aa, Mycobacterium
ASATIDAARDWLLGTPEGNWVSM

SEQ ID NO: 1033139 - protein, 17 aa, Mycobacterium
ASDDASWVRTGDYGTYF

SEQ ID NO: 1033140 - protein, 17 aa, Mycobacterium
ASDGDAVDGVWSRMKFE

SEQ ID NO: 1033141 - protein, 26 aa, Mycobacterium
ASDLARFGEWLTIHRAWRSKLPEVVE

SEQ ID NO: 1033142 - protein, 23 aa, Mycobacterium
ASDSAGFKWLAPYTGSAIAQHWM

SEQ ID NO: 1033143 - protein, 24 aa, Mycobacterium
ASELKHRVGETFCEIVPRDLKDLG

SEQ ID NO: 1033144 - protein, 20 aa, Mycobacterium
ASFQPSVSMPVDLDGARKVF

SEQ ID NO: 1033145 - protein, 23 aa, Mycobacterium
ASGPAVVEFNCRFGDPETQVVLA

SEQ ID NO: 1033146 - protein, 21 aa, Mycobacterium
ASGRVAYTLGLHGPAVTVDTA

SEQ ID NO: 1033147 - protein, 17 aa, Mycobacterium
ASGRVSYVLGLEGPAVS

SEQ ID NO: 1033148 - protein, 18 aa, Mycobacterium
ASHRGGPGLLLRARHAVF

SEQ ID NO: 1033149 - protein, 26 aa, Mycobacterium
ASHVAPVEIPEGFTGLVADVEAIRPR

SEQ ID NO: 1033150 - protein, 23 aa, Mycobacterium
ASIFRPGDYIPLIDYTMPQRMDS

SEQ ID NO: 1033151 - protein, 28 aa, Mycobacterium
ASIYHAAPRLKLFVGLGSRFCGAAAGIN

SEQ ID NO: 1033152 - protein, 25 aa, Mycobacterium
ASKNPKEQFDFFPLTVDVEERMYAA

SEQ ID NO: 1033153 - protein, 22 aa, Mycobacterium
ASKRIAPIVVLTAFSQRDLVER

SEQ ID NO: 1033154 - protein, 27 aa, Mycobacterium
ASKSSRVVCCWCIQHVIAVERQLRVEP

SEQ ID NO: 1033155 - protein, 17 aa, Mycobacterium
ASLAGLVCSLFRAENRE

SEQ ID NO: 1033156 - protein, 26 aa, Mycobacterium
ASLDEARGLFPRHLNTIVNVPTLGFD

SEQ ID NO: 1033157 - protein, 27 aa, Mycobacterium
ASLDESLMWVRIVPRFLGLGVGVDSVV

SEQ ID NO: 1033158 - protein, 25 aa, Mycobacterium
ASLGAGWACGVTVVLTPPGTVGAVD

SEQ ID NO: 1033159 - protein, 18 aa, Mycobacterium
ASLKGVLDRIGNEQEHTK

SEQ ID NO: 1033160 - protein, 18 aa, Mycobacterium
ASLMDIDTIYVWTHDSVG

SEQ ID NO: 1033161 - protein, 23 aa, Mycobacterium
ASMPPELAARCILDEVASQDEKD

SEQ ID NO: 1033162 - protein, 23 aa, Mycobacterium
ASNDFRPSALLEVRLGPNKDRAV

SEQ ID NO: 1033163 - protein, 24 aa, Mycobacterium
ASNSGRLFLGWVHTRCPALWFASS

SEQ ID NO: 1033164 - protein, 24 aa, Mycobacterium
ASPAAVCPHVEWALSSTLQTKANL

SEQ ID NO: 1033165 - protein, 19 aa, Mycobacterium
ASPAFLGFNLFQHAIARAV

SEQ ID NO: 1033166 - protein, 18 aa, Mycobacterium
ASPDSVFAYGNFGIEESA

SEQ ID NO: 1033167 - protein, 23 aa, Mycobacterium
ASRLELMARLTIGVRLGNLAPNY

SEQ ID NO: 1033168 - protein, 26 aa, Mycobacterium
ASRVAAMAGMLADWVEGPGAEVALAD

SEQ ID NO: 1033169 - protein, 17 aa, Mycobacterium
ASRVERARLMLAEIHAS

SEQ ID NO: 1033170 - protein, 23 aa, Mycobacterium
ASRVPSSQIKLHMACQKAFNDID

SEQ ID NO: 1033171 - protein, 25 aa, Mycobacterium
ASSEQARAWWGNFLVQKANEANITL

SEQ ID NO: 1033172 - protein, 22 aa, Mycobacterium
ASSGRPGAVLVDIPKDVLQGQC

SEQ ID NO: 1033173 - protein, 23 aa, Mycobacterium
ASSHGRGGRGYRYYRLIATTDAA

SEQ ID NO: 1033174 - protein, 30 aa, Mycobacterium; identical to SEQ ID NO: 638690

SEQ ID NO: 1033175 - protein, 20 aa, Mycobacterium
ASTADVLRMLTLPSTVGLYV

SEQ ID NO: 1033176 - protein, 18 aa, Mycobacterium
ASTIALPYVAQSVRDIYQ

SEQ ID NO: 1033177 - protein, 19 aa, Mycobacterium
ASTIFWNGPMGVFEFPAYA

SEQ ID NO: 1033178 - protein, 24 aa, Mycobacterium
ASVDALKVVGAWLHAGPQIEKVRC

SEQ ID NO: 1033179 - protein, 41 aa, Mycobacterium; identical to SEQ ID NO: 968536

SEQ ID NO: 1033180 - protein, 20 aa, Mycobacterium
ASVPLTWPAGWSSWQSRGYG

SEQ ID NO: 1033181 - protein, 35 aa, Mycobacterium
ASVTGLRYGNHVPLTYPFALTFPAMMSLVTGFDFP

SEQ ID NO: 1033182 - protein, 22 aa, Mycobacterium
ASWCGPDRLFVPTFHASSNKHS

SEQ ID NO: 1033183 - protein, 30 aa, Mycobacterium
ASWFGKTFKSAACILSLVCVDAGNKDNNAG

SEQ ID NO: 1033184 - protein, 27 aa, Mycobacterium
ATACALFGLDCVIYMGALDTARQALNV

SEQ ID NO: 1033185 - protein, 17 aa, Mycobacterium
ATAKFEFNNGFATITIA

SEQ ID NO: 1033186 - protein, 26 aa, Mycobacterium
ATDIAEWLVRQGVPFRSAHEAAGTAV

SEQ ID NO: 1033187 - protein, 20 aa, Mycobacterium
ATDNLRLVGLHSHIGSQIFD

SEQ ID NO: 1033188 - protein, 19 aa, Mycobacterium
ATDPLEWKAKQHNLNYIKL

SEQ ID NO: 1033189 - protein, 26 aa, Mycobacterium
ATDRFRLAVRELKWSVLSSDFEASVL

SEQ ID NO: 1033190 - protein, 23 aa, Mycobacterium
ATDRRCGPALYSRQVGYAARLVA

SEQ ID NO: 1033191 - protein, 22 aa, Mycobacterium
ATDSITCYGRYCELLSAGNFDE

SEQ ID NO: 1033192 - protein, 26 aa, Mycobacterium
ATDWEVLEAGLIQRSRLLDAVLTDLY

SEQ ID NO: 1033193 - protein, 24 aa, Mycobacterium
ATDWPRYGGYALAGVSSFGFGGAN

SEQ ID NO: 1033194 - protein, 27 aa, Mycobacterium
ATEERLRAGVWLRDYLEQLVKCRRGTP

SEQ ID NO: 1033195 - protein, 24 aa, Mycobacterium
ATFSAVKPSLAWAETYPGTLSYYL

SEQ ID NO: 1033196 - protein, 23 aa, Mycobacterium
ATGELPCCLVAVRSTWKSSPPCR

SEQ ID NO: 1033197 - protein, 25 aa, Mycobacterium
ATGNWACIVPHTWLWTTPIGAEIRA

SEQ ID NO: 1033198 - protein, 18 aa, Mycobacterium
ATGSHCRYHKLVKTCLRR

SEQ ID NO: 1033199 - protein, 27 aa, Mycobacterium
ATGVKRQEDFIGIHFFSPVDKMPLVEI

SEQ ID NO: 1033200 - protein, 18 aa, Mycobacterium
ATIGSFYGRGMVDHHVDF

SEQ ID NO: 1033201 - protein, 24 aa, Mycobacterium
ATIKRFNNRFARFNLKEKAVRPSY

SEQ ID NO: 1033202 - protein, 17 aa, Mycobacterium
ATILSLCAHIASRCATR

SEQ ID NO: 1033203 - protein, 19 aa, Mycobacterium
ATIRPYRPSLSAALPPAAL

SEQ ID NO: 1033204 - protein, 32 aa, Mycobacterium
ATKANRRRCWGAGYRWHLWSLAEAAVLAASTL

SEQ ID NO: 1033205 - protein, 25 aa, Mycobacterium
ATLHHRASALIGRLMRELTKDWNYT

SEQ ID NO: 1033206 - protein, 24 aa, Mycobacterium
ATLQRFTERFARFNLDETAIRPSY

SEQ ID NO: 1033207 - protein, 26 aa, Mycobacterium
ATLRISSQLLANWLRHGVITSEDVRA

SEQ ID NO: 1033208 - protein, 29 aa, Mycobacterium
ATLVVFPEATMCRFGVPLGPVAEPIDGPW

SEQ ID NO: 1033209 - protein, 19 aa, Mycobacterium
ATMPDPIITLARTFMDQPI

SEQ ID NO: 1033210 - protein, 24 aa, Mycobacterium
ATMRALTARSWRAGLRERAAVRVQ

SEQ ID NO: 1033211 - protein, 24 aa, Mycobacterium
ATPIPRTVALTVYGDLEMSTLREL

SEQ ID NO: 1033212 - protein, 25 aa, Mycobacterium
ATPSSITLSGIWLLIVPSELAKTDP

SEQ ID NO: 1033213 - protein, 25 aa, Mycobacterium
ATQKGCGPMRALISVCAAGGQGVAV

SEQ ID NO: 1033214 - protein, 23 aa, Mycobacterium
ATRACAKLSSGDELLFCQHHTNE

SEQ ID NO: 1033215 - protein, 25 aa, Mycobacterium
ATREILDREILGIAEAIRASGLSAG

SEQ ID NO: 1033216 - protein, 18 aa, Mycobacterium
ATRLCGLDSGGLADEVKA

SEQ ID NO: 1033217 - protein, 21 aa, Mycobacterium
ATSRRGQLCLGIDPHPELLRA

SEQ ID NO: 1033218 - protein, 21 aa, Mycobacterium
ATTASLVRRSLQFSTLTAAEL

SEQ ID NO: 1033219 - protein, 17 aa, Mycobacterium
ATTYPARQGHPFNNAIN

SEQ ID NO: 1033220 - protein, 17 aa, Mycobacterium
ATVAKREYEASLNRAQS

SEQ ID NO: 1033221 - protein, 17 aa, Mycobacterium
ATVKAIATDGARKCVEE

SEQ ID NO: 1033222 - protein, 17 aa, Mycobacterium
ATVLNWRSCDHTGPVHE

SEQ ID NO: 1033223 - protein, 18 aa, Mycobacterium
ATVRALRIIKAVATVPGA

SEQ ID NO: 1033224 - protein, 19 aa, Mycobacterium
ATWWQRAVEVWPDYVNYQS

SEQ ID NO: 1033225 - protein, 17 aa, Mycobacterium
ATYQHCRTGLFDEVEHG

SEQ ID NO: 1033226 - protein, 17 aa, Mycobacterium
AVAAALAQPGLRLPQII

SEQ ID NO: 1033227 - protein, 22 aa, Mycobacterium
AVADRKPDVVFIASPNNPSGQS

SEQ ID NO: 1033228 - protein, 28 aa, Mycobacterium
AVADSFYLPLVVRRRITFLAKSEYFTGT

SEQ ID NO: 1033229 - protein, 22 aa, Mycobacterium
AVADWIAMFNMWPIKSTPGLRC

SEQ ID NO: 1033230 - protein, 18 aa, Mycobacterium
AVAEGLHVLGWRNVPTDA

SEQ ID NO: 1033231 - protein, 25 aa, Mycobacterium
AVAEKRPQLLIGWHMQLGNIVIPKQ

SEQ ID NO: 1033232 - protein, 18 aa, Mycobacterium
AVAGRRGGVTVATNMAGR

SEQ ID NO: 1033233 - protein, 21 aa, Mycobacterium
AVAINSRLGGHIVQGHVDGTG

SEQ ID NO: 1033234 - protein, 22 aa, Mycobacterium
AVALFRLGRHRAEVVAVADGIR

SEQ ID NO: 1033235 - protein, 25 aa, Mycobacterium
AVALGAWAVMFGRTYLWGLATAWQT

SEQ ID NO: 1033236 - protein, 20 aa, Mycobacterium
AVAPSTLWSLTTDRNLPGSL

SEQ ID NO: 1033237 - protein, 18 aa, Mycobacterium
AVAPTCKATMYVCGITPY

SEQ ID NO: 1033238 - protein, 17 aa, Mycobacterium
AVARRQARVRAMLPTLP

SEQ ID NO: 1033239 - protein, 19 aa, Mycobacterium
AVASAAWTRGGRIVGVIPE

SEQ ID NO: 1033240 - protein, 25 aa, Mycobacterium
AVAVLARLDLGSVLIPLPEGSQLQV

SEQ ID NO: 1033241 - protein, 18 aa, Mycobacterium
AVAVRLGPTVLRSSTAAA

SEQ ID NO: 1033242 - protein, 23 aa, Mycobacterium
AVCAGQARLILRRETVDDLLSLE

SEQ ID NO: 1033243 - protein, 18 aa, Mycobacterium
AVDDGRFQRTFVDVAGAP

SEQ ID NO: 1033244 - protein, 19 aa, Mycobacterium
AVDFVGWYNAHPNFHERSP

SEQ ID NO: 1033245 - protein, 28 aa, Mycobacterium
AVDGVWSRMKFEGGVHRVQRVPVTESQG

SEQ ID NO: 1033246 - protein, 23 aa, Mycobacterium
AVDRAILRVSIWELLYADDVPEP

SEQ ID NO: 1033247 - protein, 21 aa, Mycobacterium
AVDYLEIWDAQAWHDYQQTHE

SEQ ID NO: 1033248 - protein, 17 aa, Mycobacterium
AVEAFRYLVGLINNDHV

SEQ ID NO: 1033249 - protein, 19 aa, Mycobacterium
AVEKHVFSAASAHGYTVDQ

SEQ ID NO: 1033250 - protein, 20 aa, Mycobacterium
AVESMLAYFTRLIERRRSEP

SEQ ID NO: 1033251 - protein, 23 aa, Mycobacterium
AVFPQAELPGFITPNAAGHTGEL

SEQ ID NO: 1033252 - protein, 17 aa, Mycobacterium
AVGKLIRQTLELADVGS

SEQ ID NO: 1033253 - protein, 17 aa, Mycobacterium
AVHLALAAGGKCFYTTP

SEQ ID NO: 1033254 - protein, 19 aa, Mycobacterium
AVIDARRGKMFARLIKNIE

SEQ ID NO: 1033255 - protein, 21 aa, Mycobacterium
AVIEYNVRFTAVVPVPNDGQG

SEQ ID NO: 1033256 - protein, 17 aa, Mycobacterium
AVIGFRFGSDLLASLGI

SEQ ID NO: 1033257 - protein, 25 aa, Mycobacterium
AVIVCPIGFVADHIEVVWDLDHELR

SEQ ID NO: 1033258 - protein, 21 aa, Mycobacterium
AVKCACPFGPMVVSVPVRMLT

SEQ ID NO: 1033259 - protein, 22 aa, Mycobacterium
AVLDRNGLRPSRIWITDAGLVV

SEQ ID NO: 1033260 - protein, 29 aa, Mycobacterium
AVLEPRLRIPNEFGLCRYLAAGLAALQTV

SEQ ID NO: 1033261 - protein, 20 aa, Mycobacterium
AVLFGAWWIGAETLLGPADP

SEQ ID NO: 1033262 - protein, 20 aa, Mycobacterium
AVLPGYGWIFPLGNGEVNIG

SEQ ID NO: 1033263 - protein, 18 aa, Mycobacterium
AVLPLFRHVDLSPKARDL

SEQ ID NO: 1033264 - protein, 18 aa, Mycobacterium
AVLQHARTLAKICDLSEL

SEQ ID NO: 1033265 - protein, 19 aa, Mycobacterium
AVLQPKIDAAYAYNDNPLN

SEQ ID NO: 1033266 - protein, 19 aa, Mycobacterium
AVLSRRPRMLYDYFHQLFA

SEQ ID NO: 1033267 - protein, 25 aa, Mycobacterium
AVMAARWNKMLGAWPITTTFPGSNE

SEQ ID NO: 1033268 - protein, 18 aa, Mycobacterium
AVMEGSWGLETVNVADPA

SEQ ID NO: 1033269 - protein, 21 aa, Mycobacterium
AVMLQRCQICAADVDEELLLQ

SEQ ID NO: 1033270 - protein, 17 aa, Mycobacterium
AVMRLRLGLYVFGCGGQ

SEQ ID NO: 1033271 - protein, 19 aa, Mycobacterium
AVNLPEELLHAAPNQIVST

SEQ ID NO: 1033272 - protein, 21 aa, Mycobacterium
AVNVKPKFAVDALVATIGQEL

SEQ ID NO: 1033273 - protein, 17 aa, Mycobacterium
AVNWRKSVIEIGHDNLQ

SEQ ID NO: 1033274 - protein, 18 aa, Mycobacterium
AVRAGVGVTVFETTDTLV

SEQ ID NO: 1033275 - protein, 18 aa, Mycobacterium
AVRLRDGVQWSRIRLADR

SEQ ID NO: 1033276 - protein, 25 aa, Mycobacterium
AVRTFARQRIDAILADVEPAGGGAD

SEQ ID NO: 1033277 - protein, 22 aa, Mycobacterium
AVSLDPALRCALRAGMEAGALA

SEQ ID NO: 1033278 - protein, 19 aa, Mycobacterium
AVSLLLLLISCEWPGSAIS

SEQ ID NO: 1033279 - protein, 23 aa, Mycobacterium
AVSRAVLRAGPGVSELRAAGEQM

SEQ ID NO: 1033280 - protein, 23 aa, Mycobacterium
AVTEMAVTLWLTATRHLLNHICE

SEQ ID NO: 1033281 - protein, 18 aa, Mycobacterium
AVTLEALDDLSRSYKLVE

SEQ ID NO: 1033282 - protein, 22 aa, Mycobacterium
AVTRCSNLILLAGVKSLPRSAG

SEQ ID NO: 1033283 - protein, 20 aa, Mycobacterium
AVTVDGRLPAGVTAKDIILA

SEQ ID NO: 1033284 - protein, 17 aa, Mycobacterium
AVVARLAECAVSYRDLV

SEQ ID NO: 1033285 - protein, 20 aa, Mycobacterium
AVVCVLTLTIAGPVRTYFAQ

SEQ ID NO: 1033286 - protein, 30 aa, Mycobacterium
AVVEPKYWGGICLNVGCIPSKVLLHNAELA

SEQ ID NO: 1033287 - protein, 17 aa, Mycobacterium
AVVKGGQLLGVITASRL

SEQ ID NO: 1033288 - protein, 27 aa, Mycobacterium
AVVMSFSAAAVWRVRRAAPLLPTVLLG

SEQ ID NO: 1033289 - protein, 23 aa, Mycobacterium
AVVPRAHGSALFERGETQILGVT

SEQ ID NO: 1033290 - protein, 24 aa, Mycobacterium
AVVRHLRRYGSMKAGVFSGKAMIE

SEQ ID NO: 1033291 - protein, 19 aa, Mycobacterium
AVVRVRLVLGTGKFDLNGR

SEQ ID NO: 1033292 - protein, 21 aa, Mycobacterium
AVYRAELALVDVARKTGIRLR

SEQ ID NO: 1033293 - protein, 34 aa, Mycobacterium; identical to SEQ ID NO: 197336

SEQ ID NO: 1033294 - protein, 18 aa, Mycobacterium
AWALRMSPDGNVWGATIN

SEQ ID NO: 1033295 - protein, 19 aa, Mycobacterium
AWEGLTFAEAAARDPQLHH

SEQ ID NO: 1033296 - protein, 19 aa, Mycobacterium
AWGKLGYPRRAKRLHESAT

SEQ ID NO: 1033297 - protein, 17 aa, Mycobacterium
AWLRCMHTAVASIDSHT

SEQ ID NO: 1033298 - protein, 19 aa, Mycobacterium
AWLRLAHRPTGIWAPECAY

SEQ ID NO: 1033299 - protein, 22 aa, Mycobacterium
AWLYSQRRFEVPTDKIANTMKL

SEQ ID NO: 1033300 - protein, 21 aa, Mycobacterium
AWPRHRRLSIAAGDAPSAAVV

SEQ ID NO: 1033301 - protein, 24 aa, Mycobacterium
AWQPKTGAVGSLWDVVRDHRLNHR

SEQ ID NO: 1033302 - protein, 19 aa, Mycobacterium
AWSGSRFAQRPMLPENIHR

SEQ ID NO: 1033303 - protein, 18 aa, Mycobacterium
AWTKYSLNYWYRIFDPAF

SEQ ID NO: 1033304 - protein, 28 aa, Mycobacterium
AWTLAMGHAMIRTGLSLTRHSSDLPWRP

SEQ ID NO: 1033305 - protein, 24 aa, Mycobacterium
AWVSEPWSRPSLARSGHPPRYTTA

SEQ ID NO: 1033306 - protein, 23 aa, Mycobacterium
AYAAGLAVGFWAGPSDLRANWQE

SEQ ID NO: 1033307 - protein, 18 aa, Mycobacterium
AYAIRLYFCDIDPAELID

SEQ ID NO: 1033308 - protein, 17 aa, Mycobacterium
AYEAFQWARQTASKAGS

SEQ ID NO: 1033309 - protein, 25 aa, Mycobacterium
AYERGRVDIAAFIGAAADELVFTKN

SEQ ID NO: 1033310 - protein, 18 aa, Mycobacterium
AYGVALWVVLYSCHCVGN

SEQ ID NO: 1033311 - protein, 17 aa, Mycobacterium
AYGYPGAPGQWWQQQVV

SEQ ID NO: 1033312 - protein, 19 aa, Mycobacterium
AYHSGCMVWELVVVFDVLV

SEQ ID NO: 1033313 - protein, 18 aa, Mycobacterium
AYIRRLGPQLGLEETTAF

SEQ ID NO: 1033314 - protein, 17 aa, Mycobacterium
AYKACTVVRQLIDAGHE

SEQ ID NO: 1033315 - protein, 17 aa, Mycobacterium
AYLLSTHGVHFGRLPAD

SEQ ID NO: 1033316 - protein, 23 aa, Mycobacterium
AYLRLHMLSHRLVAPHGLNADGL

SEQ ID NO: 1033317 - protein, 23 aa, Mycobacterium
AYMLPRLRGWGESMSRQVGGRAG

SEQ ID NO: 1033318 - protein, 20 aa, Mycobacterium
AYNILRIELQRMGAGSTPGP

SEQ ID NO: 1033319 - protein, 18 aa, Mycobacterium
AYQPRIVFVDADNKPIDL

SEQ ID NO: 1033320 - protein, 20 aa, Mycobacterium
AYRILAVKQHVLFGETSTSS

SEQ ID NO: 1033321 - protein, 22 aa, Mycobacterium
AYRKLRCLVESFATELDAELFW

SEQ ID NO: 1033322 - protein, 19 aa, Mycobacterium
AYRQFLIDIGYLLPEPDDF

SEQ ID NO: 1033323 - protein, 18 aa, Mycobacterium
AYRRARLERQPADPVYPT

SEQ ID NO: 1033324 - protein, 19 aa, Mycobacterium
AYVIRKRAEHELGTKGPGQ

SEQ ID NO: 1033325 - protein, 18 aa, Mycobacterium
AYVPSWSMVVFGADGDCG

SEQ ID NO: 1033326 - protein, 20 aa, Mycobacterium
CAADPQFLRGDGVTLTDREV

SEQ ID NO: 1033327 - protein, 27 aa, Mycobacterium
CAELLDWPAKLRLLEGFRQRENLNWSA

SEQ ID NO: 1033328 - protein, 23 aa, Mycobacterium
CAESGMSRQAFLRGAVGVLTTGA

SEQ ID NO: 1033329 - protein, 25 aa, Mycobacterium
CAGPVRRTGTIFIFTSPSHATEVLN

SEQ ID NO: 1033330 - protein, 18 aa, Mycobacterium
CALSNNMVMPIFAQEHYV

SEQ ID NO: 1033331 - protein, 20 aa, Mycobacterium
CARVLRPSGLLMVSTPNRIT

SEQ ID NO: 1033332 - protein, 19 aa, Mycobacterium
CCAWVPASLATLCWAACAV

SEQ ID NO: 1033333 - protein, 23 aa, Mycobacterium
CCLVKRRFQRGDSHFICVVAEGA

SEQ ID NO: 1033334 - protein, 20 aa, Mycobacterium
CCSFSITLLKGHSWTTPLKA

SEQ ID NO: 1033335 - protein, 21 aa, Mycobacterium
CDALKAYRRGARGLAISAGAP

SEQ ID NO: 1033336 - protein, 24 aa, Mycobacterium
CDCGTQLDAAMAMVAREGRGVVLY

SEQ ID NO: 1033337 - protein, 32 aa, Mycobacterium
CDGYDAGPGCVRWRRDIAVLLGPAVSGRNYEV

SEQ ID NO: 1033338 - protein, 25 aa, Mycobacterium
CDICVEAFSGFAIVKPQVAFFEAYG

SEQ ID NO: 1033339 - protein, 23 aa, Mycobacterium
CDIRVELFGSLAATGAGHGTMSA

SEQ ID NO: 1033340 - protein, 18 aa, Mycobacterium
CDVLVWLTAIAFKHSDLQ

SEQ ID NO: 1033341 - protein, 26 aa, Mycobacterium
CEAEVDWILRHSFPMRSTTDLSQRIR

SEQ ID NO: 1033342 - protein, 27 aa, Mycobacterium
CEALYHFAWDEFCDWYLELAKAQLADG

SEQ ID NO: 1033343 - protein, 18 aa, Mycobacterium
CEAMIAIRGEIARVGAGE

SEQ ID NO: 1033344 - protein, 17 aa, Mycobacterium
CELAMMCDLLIAADTAK

SEQ ID NO: 1033345 - protein, 25 aa, Mycobacterium
CELTSRIRTLFALEGIATRVVLIYH

SEQ ID NO: 1033346 - protein, 19 aa, Mycobacterium
CEMRVRIDGRKGGLIESEA

SEQ ID NO: 1033347 - protein, 26 aa, Mycobacterium
CERYRELRDAWLLARSDLIDRRNRIR

SEQ ID NO: 1033348 - protein, 21 aa, Mycobacterium
CFALVPLEVCTEALVRVVRKF

SEQ ID NO: 1033349 - protein, 18 aa, Mycobacterium
CFGVRPYGSLVFSTVIGA

SEQ ID NO: 1033350 - protein, 21 aa, Mycobacterium
CGADIQASLGISDSMELLAEL

SEQ ID NO: 1033351 - protein, 27 aa, Mycobacterium
CGAPLMSLRTDRDWIADIVRFVESRRR

SEQ ID NO: 1033352 - protein, 18 aa, Mycobacterium
CGCDPSFVVGGELAVVGT

SEQ ID NO: 1033353 - protein, 27 aa, Mycobacterium
CGDRTPPRLAVIAMGKWGARELNYVSD

SEQ ID NO: 1033354 - protein, 20 aa, Mycobacterium
CGEFDVLLGQHIESLRGVES

SEQ ID NO: 1033355 - protein, 25 aa, Mycobacterium
CGGHLSRAWLVAAIGLGVDRVVWMS

SEQ ID NO: 1033356 - protein, 18 aa, Mycobacterium
CGHAIEFRINGEDAGRNF

SEQ ID NO: 1033357 - protein, 17 aa, Mycobacterium
CGIHPVVVHGGGPQITA

SEQ ID NO: 1033358 - protein, 17 aa, Mycobacterium
CGLHFGRQRDDLVSAFT

SEQ ID NO: 1033359 - protein, 20 aa, Mycobacterium
CGSLRDNLWHLLGSKIAAVI

SEQ ID NO: 1033360 - protein, 17 aa, Mycobacterium
CGSTVRPLLAGPDRAEK

SEQ ID NO: 1033361 - protein, 17 aa, Mycobacterium
CGVPGDRVAILAPQGLE

SEQ ID NO: 1033362 - protein, 22 aa, Mycobacterium
CHFVRPNWKLPRRAPADAKADS

SEQ ID NO: 1033363 - protein, 19 aa, Mycobacterium
CHNLGAVVRYIMARLQAQL

SEQ ID NO: 1033364 - protein, 21 aa, Mycobacterium
CIAAKRFIAHADIYDEFVEKF

SEQ ID NO: 1033365 - protein, 24 aa, Mycobacterium
CIECPTGRVGEIWLHGDNVAEGYW

SEQ ID NO: 1033366 - protein, 26 aa, Mycobacterium
CIGMMSWPARWGILYHMYCYRLLYEM

SEQ ID NO: 1033367 - protein, 18 aa, Mycobacterium
CIHRLCIEIIQLRDDDGL

SEQ ID NO: 1033368 - protein, 25 aa, Mycobacterium
CIIAADFLKAVGFVVVAPHQYFPRL

SEQ ID NO: 1033369 - protein, 19 aa, Mycobacterium
CKATMYVCGITPYDATHLG

SEQ ID NO: 1033370 - protein, 25 aa, Mycobacterium
CKTVVMRLYRDWALVLRQHNLGEAD

SEQ ID NO: 1033371 - protein, 19 aa, Mycobacterium
CKVLSAWGAYGKKQIYGKT

SEQ ID NO: 1033372 - protein, 18 aa, Mycobacterium
CLDCERLGVRWASPVNDL

SEQ ID NO: 1033373 - protein, 17 aa, Mycobacterium
CLMDLPTAVLLHRDRLG

SEQ ID NO: 1033374 - protein, 27 aa, Mycobacterium
CLSLPAGDRYTVWAPRWRDGGDEWEAF

SEQ ID NO: 1033375 - protein, 25 aa, Mycobacterium
CLTKSTRSSVRWYFFGRVSVIADYA

SEQ ID NO: 1033376 - protein, 20 aa, Mycobacterium
CNFAGLIGGNGVCARFLGNG

SEQ ID NO: 1033377 - protein, 24 aa, Mycobacterium
CNRCPVTTECLAWALNTGQDSGVW

SEQ ID NO: 1033378 - protein, 24 aa, Mycobacterium
CNSQVWRYPAFFHALLDAGVYPPC

SEQ ID NO: 1033379 - protein, 18 aa, Mycobacterium
CPDPVSYWVFGEMLESAI

SEQ ID NO: 1033380 - protein, 19 aa, Mycobacterium
CPDVQLLVVPGTWESSLQD

SEQ ID NO: 1033381 - protein, 20 aa, Mycobacterium
CPRHRLAQFRPSHQSTPANN

SEQ ID NO: 1033382 - protein, 18 aa, Mycobacterium
CQDQLPSTHPIVADIPDL

SEQ ID NO: 1033383 - protein, 17 aa, Mycobacterium
CQHVRVALTASDERIAA

SEQ ID NO: 1033384 - protein, 19 aa, Mycobacterium
CQKRHQLPGLEFVRGDAEN

SEQ ID NO: 1033385 - protein, 17 aa, Mycobacterium
CQSILGYVVRWVDQGIG

SEQ ID NO: 1033386 - protein, 18 aa, Mycobacterium
CRADNRAALIGYLPTGYP

SEQ ID NO: 1033387 - protein, 21 aa, Mycobacterium
CRCGHQRVRSQWTWLMATSAW

SEQ ID NO: 1033388 - protein, 17 aa, Mycobacterium
CRGGLGLGARLRSVGSG

SEQ ID NO: 1033389 - protein, 18 aa, Mycobacterium
CRGGLVPLLHLLVGTSAW

SEQ ID NO: 1033390 - protein, 17 aa, Mycobacterium
CRIGERSSHTWFVLTHL

SEQ ID NO: 1033391 - protein, 17 aa, Mycobacterium
CRLSGPCAPVWQRNLGN

SEQ ID NO: 1033392 - protein, 18 aa, Mycobacterium
CRMILWISKCRIHKTLMS

SEQ ID NO: 1033393 - protein, 18 aa, Mycobacterium
CRPNWLQTAGWQILACGT

SEQ ID NO: 1033394 - protein, 18 aa, Mycobacterium
CRRRGLIFSQLAASLTVT

SEQ ID NO: 1033395 - protein, 17 aa, Mycobacterium
CRRTINPLAETLCLEPF

SEQ ID NO: 1033396 - protein, 18 aa, Mycobacterium
CSAMDRLGGVTMSKAGLR

SEQ ID NO: 1033397 - protein, 22 aa, Mycobacterium
CSAVSHASRQWVQFRLPETSVA

SEQ ID NO: 1033398 - protein, 21 aa, Mycobacterium
CSTSSTALFCEVQAIRVGGSN

SEQ ID NO: 1033399 - protein, 17 aa, Mycobacterium
CTHILAWEGDDEGKWFW

SEQ ID NO: 1033400 - protein, 19 aa, Mycobacterium
CTPDTFVFDGERRLVYRGQ

SEQ ID NO: 1033401 - protein, 23 aa, Mycobacterium
CTPGCTNARCRIERKLNPAMRRA

SEQ ID NO: 1033402 - protein, 19 aa, Mycobacterium
CTSLKEAFLSISKHSTAPQ

SEQ ID NO: 1033403 - protein, 18 aa, Mycobacterium
CTVGAPLLNLGRLLTTWR

SEQ ID NO: 1033404 - protein, 30 aa, Mycobacterium
CVEARASFAPPARCVMLIWDAPNLDMGLDA

SEQ ID NO: 1033405 - protein, 19 aa, Mycobacterium
CVPRQGAPATGRCIRCDAP

SEQ ID NO: 1033406 - protein, 21 aa, Mycobacterium
CVWAEKRFAAFDNPVIALEVY

SEQ ID NO: 1033407 - protein, 18 aa, Mycobacterium
CWADLCVGCGLFDDRTGS

SEQ ID NO: 1033408 - protein, 17 aa, Mycobacterium
CWAPKHANFDEGLRATI

SEQ ID NO: 1033409 - protein, 18 aa, Mycobacterium
CWAVAEFRIRGMSTSIFF

SEQ ID NO: 1033410 - protein, 18 aa, Mycobacterium
CWNSEFDDAGAIGRRYRR

SEQ ID NO: 1033411 - protein, 18 aa, Mycobacterium
CWPVLTGGVLYVDEVNLL

SEQ ID NO: 1033412 - protein, 17 aa, Mycobacterium
CYEIPDAHFGALVGLAV

SEQ ID NO: 1033413 - protein, 24 aa, Mycobacterium
CYNSKWPMVFLIAASEFVVVATDV

SEQ ID NO: 1033414 - protein, 23 aa, Mycobacterium
DAAEATVDLSLWPPEGAESVDIS

SEQ ID NO: 1033415 - protein, 24 aa, Mycobacterium
DAAEGRLKGILKYVDAPIVSSDIV

SEQ ID NO: 1033416 - protein, 25 aa, Mycobacterium
DAAGTVTDWLVARIFPVSPTSGSLV

SEQ ID NO: 1033417 - protein, 25 aa, Mycobacterium
DAAPTLGAGLDWKTSLQELTAARGM

SEQ ID NO: 1033418 - protein, 22 aa, Mycobacterium
DAARNRARILGVAYEAFATEGL

SEQ ID NO: 1033419 - protein, 17 aa, Mycobacterium
DAAVAWGGANGAFELNV

SEQ ID NO: 1033420 - protein, 25 aa, Mycobacterium
DADAAWRAAFDHEQSCVAIIKHANP

SEQ ID NO: 1033421 - protein, 28 aa, Mycobacterium
DADALQSLFCKTEHPFLQHLLTHRDVTR

SEQ ID NO: 1033422 - protein, 21 aa, Mycobacterium
DADGLRALFTTWITAPQTDID

SEQ ID NO: 1033423 - protein, 29 aa, Mycobacterium
DADLAVLGYYEWREGLLRGLAAHHAGMLP

SEQ ID NO: 1033424 - protein, 23 aa, Mycobacterium
DADRYRRLHVIVGDANLAETSTY

SEQ ID NO: 1033425 - protein, 20 aa, Mycobacterium
DADSALRVAIEALYDAADDD

SEQ ID NO: 1033426 - protein, 25 aa, Mycobacterium
DADVIRYLRWFTFLLPEELVELEQT

SEQ ID NO: 1033427 - protein, 18 aa, Mycobacterium
DAEAVWRGAFLAHGSLTE

SEQ ID NO: 1033428 - protein, 24 aa, Mycobacterium
DAEGLLPAITFVFSRFGCDAAVQQ

SEQ ID NO: 1033429 - protein, 17 aa, Mycobacterium
DAEWRFVGVPDTSSLGR

SEQ ID NO: 1033430 - protein, 23 aa, Mycobacterium
DAGHCPAYFLLLIKTLLQPGLRE

SEQ ID NO: 1033431 - protein, 18 aa, Mycobacterium
DAGMEVCCGGILGMGETV

SEQ ID NO: 1033432 - protein, 21 aa, Mycobacterium
DAGTGLSFVPWVISAKSAEAL

SEQ ID NO: 1033433 - protein, 18 aa, Mycobacterium
DAGVDLFLCDSTNAEIPG

SEQ ID NO: 1033434 - protein, 24 aa, Mycobacterium
DAGYRGEIKVALINLDPVEPLVVH

SEQ ID NO: 1033435 - protein, 18 aa, Mycobacterium
DAHTAFAVRGSECTTEGC

SEQ ID NO: 1033436 - protein, 19 aa, Mycobacterium
DAKLVVLVRAAMARTEAGS

SEQ ID NO: 1033437 - protein, 23 aa, Mycobacterium
DALACSKSGVLVGGAKRLYGIVE

SEQ ID NO: 1033438 - protein, 18 aa, Mycobacterium
DALATEWVAGILAVKPTS

SEQ ID NO: 1033439 - protein, 17 aa, Mycobacterium
DALDGWLALSWLSTPAS

SEQ ID NO: 1033440 - protein, 17 aa, Mycobacterium
DALKFGIDVLAHFLTHC

SEQ ID NO: 1033441 - protein, 26 aa, Mycobacterium
DALNLPWLAVGAIGFISVISHLAAGQ

SEQ ID NO: 1033442 - protein, 17 aa, Mycobacterium
DALRLFIHAIMDTEINS

SEQ ID NO: 1033443 - protein, 25 aa, Mycobacterium
DALSTARFEFRWNDQFALSLDPPTA

SEQ ID NO: 1033444 - protein, 22 aa, Mycobacterium
DAMPTFRQVFMAGATGLTLERR

SEQ ID NO: 1033445 - protein, 20 aa, Mycobacterium
DAPGFKRLLGDGTQFGVNIS

SEQ ID NO: 1033446 - protein, 17 aa, Mycobacterium
DARVGIVTPFQLQSILA

SEQ ID NO: 1033447 - protein, 24 aa, Mycobacterium
DARVSRRLMAMLARRGYSQTTICE

SEQ ID NO: 1033448 - protein, 22 aa, Mycobacterium
DASGNPYLAFSAMLMAGLDGIK

SEQ ID NO: 1033449 - protein, 24 aa, Mycobacterium
DASLRLVALGGVFLEMGKIDIRDP

SEQ ID NO: 1033450 - protein, 19 aa, Mycobacterium
DASVCERLALGFGSSSFRY

SEQ ID NO: 1033451 - protein, 22 aa, Mycobacterium
DATRAICSRSHLMGEGEAMLFG

SEQ ID NO: 1033452 - protein, 21 aa, Mycobacterium
DATRRLALTGTPFRSDDKPIP

SEQ ID NO: 1033453 - protein, 18 aa, Mycobacterium
DATVARVIRVSRGSYSHP

SEQ ID NO: 1033454 - protein, 24 aa, Mycobacterium
DATVEVAIRLGVDSRKADQMVRGT

SEQ ID NO: 1033455 - protein, 18 aa, Mycobacterium
DAVALRQALADGIIDCVT

SEQ ID NO: 1033456 - protein, 18 aa, Mycobacterium
DAVGKLYVQRHFPLHAKA

SEQ ID NO: 1033457 - protein, 23 aa, Mycobacterium
DAVLHLRASIGVVAIKGDDPRNI

SEQ ID NO: 1033458 - protein, 18 aa, Mycobacterium
DAVLPVRWTDGGMSRVRI

SEQ ID NO: 1033459 - protein, 25 aa, Mycobacterium
DAVRLSRDFLSWAVKDAIECGELAS

SEQ ID NO: 1033460 - protein, 25 aa, Mycobacterium
DAWLKVNDMLSWSFAQVPALPGRGP

SEQ ID NO: 1033461 - protein, 19 aa, Mycobacterium
DAYIRVFDSFVERFALGGA

SEQ ID NO: 1033462 - protein, 26 aa, Mycobacterium
DCGADFRLTDAGAWGRFYESPYAGSW

SEQ ID NO: 1033463 - protein, 24 aa, Mycobacterium
DCREPIEVVGCFLALLELYRTRAI

SEQ ID NO: 1033464 - protein, 35 aa, Mycobacterium
DCRTPTIAAVHGWCIGGALDLISAVDIRYASADAK

SEQ ID NO: 1033465 - protein, 20 aa, Mycobacterium
DCSLQRRFQKLVEEAPAPFL

SEQ ID NO: 1033466 - protein, 28 aa, Mycobacterium
DCYDIYRWLWLRGYNPGRLCLAGDSTGG

SEQ ID NO: 1033467 - protein, 24 aa, Mycobacterium
DDAAWERLCALLAQPTDEDQFAIR

SEQ ID NO: 1033468 - protein, 21 aa, Mycobacterium
DDALMKITHVLRGEDLLSSTP

SEQ ID NO: 1033469 - protein, 17 aa, Mycobacterium
DDARPVLERASARETAA

SEQ ID NO: 1033470 - protein, 19 aa, Mycobacterium
DDDCFVDFVADQHWRVAIL

SEQ ID NO: 1033471 - protein, 23 aa, Mycobacterium
DDFEALCAHLATIHPSRYLTLIS

SEQ ID NO: 1033472 - protein, 17 aa, Mycobacterium
DDFFALFLDPTWVYTCA

SEQ ID NO: 1033473 - protein, 19 aa, Mycobacterium
DDFFRLFLDPTLTYSCAYF

SEQ ID NO: 1033474 - protein, 24 aa, Mycobacterium
DDGFVGVIYCWARTGDLAAVLAAA

SEQ ID NO: 1033475 - protein, 26 aa, Mycobacterium
DDGIGMDEFVDWLIDAGCPIQRINDY

SEQ ID NO: 1033476 - protein, 25 aa, Mycobacterium
DDGNCVHNPLVMRRALEYATGLGVL

SEQ ID NO: 1033477 - protein, 17 aa, Mycobacterium
DDGSRSAEEVIALTRAA

SEQ ID NO: 1033478 - protein, 26 aa, Mycobacterium
DDLIRCSSAALVWGLGRVVALEHPGS

SEQ ID NO: 1033479 - protein, 21 aa, Mycobacterium
DDLPDGGAWLYATTVRAIKEL

SEQ ID NO: 1033480 - protein, 25 aa, Mycobacterium
DDLVEAIGVDAARYSLIRSSVDTPI

SEQ ID NO: 1033481 - protein, 21 aa, Mycobacterium
DDLWLNESFATFASVLCQSEA

SEQ ID NO: 1033482 - protein, 17 aa, Mycobacterium
DDLWLTSHLELRSPDGA

SEQ ID NO: 1033483 - protein, 18 aa, Mycobacterium
DDNARWRVIVDQIASYTE

SEQ ID NO: 1033484 - protein, 23 aa, Mycobacterium
DDNRRFSVVSIYGGRAYEPQIEA

SEQ ID NO: 1033485 - protein, 27 aa, Mycobacterium
DDPEPFLRTNVIGTFTILEAVRHHSVR

SEQ ID NO: 1033486 - protein, 23 aa, Mycobacterium
DDPRGVPISVILFGARRKTTVPL

SEQ ID NO: 1033487 - protein, 19 aa, Mycobacterium
DDQRCCASCQITIRRTPTC

SEQ ID NO: 1033488 - protein, 21 aa, Mycobacterium
DDRKVAFKRSYRDVDVLLVDD

SEQ ID NO: 1033489 - protein, 24 aa, Mycobacterium
DDRMWEFLDRLTSIALPRIRDFRG

SEQ ID NO: 1033490 - protein, 24 aa, Mycobacterium
DDTHLAWDLITYWRALLTSAVNLP

SEQ ID NO: 1033491 - protein, 19 aa, Mycobacterium
DDTSVRFLLTAGAIGSLYK

SEQ ID NO: 1033492 - protein, 21 aa, Mycobacterium
DDTWLRLGAASSPYGGEIDDC

SEQ ID NO: 1033493 - protein, 22 aa, Mycobacterium
DDVDGFGALNLVLTETNIAPEV

SEQ ID NO: 1033494 - protein, 22 aa, Mycobacterium
DDVNLCRLIGVFEQLRGQSQLI

SEQ ID NO: 1033495 - protein, 18 aa, Mycobacterium
DDYLAILDIRPFTRGHTL

SEQ ID NO: 1033496 - protein, 20 aa, Mycobacterium
DEALIRLDLAEMLRDEGYDI

SEQ ID NO: 1033497 - protein, 20 aa, Mycobacterium
DEALVPLVLAGATHRETPRL

SEQ ID NO: 1033498 - protein, 23 aa, Mycobacterium
DEDRELLEPFDLTYGEDQGDEDE

SEQ ID NO: 1033499 - protein, 18 aa, Mycobacterium
DEEGLSLDVCSGGELAVA

SEQ ID NO: 1033500 - protein, 24 aa, Mycobacterium
DEELAGAAHFVWLRDTLRLGEKFP

SEQ ID NO: 1033501 - protein, 28 aa, Mycobacterium
DEFHPELQFDKPYLLAMANAGPGTNGSQ

SEQ ID NO: 1033502 - protein, 25 aa, Mycobacterium
DEGAYAFEMLVRYDRPYSGYIPILG

SEQ ID NO: 1033503 - protein, 23 aa, Mycobacterium
DEGKLSIRLARQVVEGVLAGEGE

SEQ ID NO: 1033504 - protein, 21 aa, Mycobacterium
DEHLEYCVSRAVAEGGSEAED

SEQ ID NO: 1033505 - protein, 24 aa, Mycobacterium
DEHRPEVVFHLAAQIDVRHSVVDP

SEQ ID NO: 1033506 - protein, 26 aa, Mycobacterium
DEIADRAGVSKPVLYQHFSSKLELYL

SEQ ID NO: 1033507 - protein, 22 aa, Mycobacterium
DEIARRAGVGAGTVYRHFPTKE

SEQ ID NO: 1033508 - protein, 17 aa, Mycobacterium
DEIEAFESARPAWKPRT

SEQ ID NO: 1033509 - protein, 20 aa, Mycobacterium
DEIHAPLVLSGARFTPYLSI

SEQ ID NO: 1033510 - protein, 29 aa, Mycobacterium
DEIPLPLQWGEYRPGGLTSGPWGLLEPPE

SEQ ID NO: 1033511 - protein, 22 aa, Mycobacterium
DEIVGIGAGATWAADNRTVYYL

SEQ ID NO: 1033512 - protein, 24 aa, Mycobacterium
DELARSWCGQWPLLPDAMEEAAAY

SEQ ID NO: 1033513 - protein, 23 aa, Mycobacterium
DELFAGPTAIAFVTGEPVDAAKA

SEQ ID NO: 1033514 - protein, 23 aa, Mycobacterium
DELGCVLEALLLVVDTPVTVEAL

SEQ ID NO: 1033515 - protein, 32 aa, Mycobacterium
DELIRGGVRDVVLCPGSRNAPLAFALQDADHA

SEQ ID NO: 1033516 - protein, 22 aa, Mycobacterium
DELLRSGTLVDLYPLVSKSIRV

SEQ ID NO: 1033517 - protein, 17 aa, Mycobacterium
DELLWLPVVDAMKKLDY

SEQ ID NO: 1033518 - protein, 17 aa, Mycobacterium
DELPCLVMATASIVSYP

SEQ ID NO: 1033519 - protein, 22 aa, Mycobacterium
DEMRFIQSYSRFHLCVIECVAD

SEQ ID NO: 1033520 - protein, 23 aa, Mycobacterium
DEPCSSLDPISTMAIEELIGELK

SEQ ID NO: 1033521 - protein, 17 aa, Mycobacterium
DEPYRRALRVIRGRLSS

SEQ ID NO: 1033522 - protein, 24 aa, Mycobacterium
DERGRRFLIHGAKIAYVEIGVADA

SEQ ID NO: 1033523 - protein, 17 aa, Mycobacterium
DETGWLLGDYILSQTDK

SEQ ID NO: 1033524 - protein, 24 aa, Mycobacterium
DETTRPLVICDLGMPRDVDPAVAK

SEQ ID NO: 1033525 - protein, 21 aa, Mycobacterium
DEVVDVVLLWWRDGDGDLVDT

SEQ ID NO: 1033526 - protein, 23 aa, Mycobacterium
DEYKEFYKHIAHAWDDPLEVIAM

SEQ ID NO: 1033527 - protein, 20 aa, Mycobacterium
DFALARFVVDYRKILIDTTA

SEQ ID NO: 1033528 - protein, 25 aa, Mycobacterium
DFCDLEVVEALKFHLHDLAVTFRFD

SEQ ID NO: 1033529 - protein, 29 aa, Mycobacterium
DFEEIQIPVGPRLGNMVVEVEHLDKGYGG

SEQ ID NO: 1033530 - protein, 27 aa, Mycobacterium
DFGRELFVDKVWDWKRESGGAIAGQMR

SEQ ID NO: 1033531 - protein, 18 aa, Mycobacterium
DFICMRTQTALAMNSYQA

SEQ ID NO: 1033532 - protein, 23 aa, Mycobacterium
DFKQCPLLYRFRAIDRLPEAPSA

SEQ ID NO: 1033533 - protein, 28 aa, Mycobacterium
DFLSFLPPNCFDKAPIVNPGLEPEIMAH

SEQ ID NO: 1033534 - protein, 17 aa, Mycobacterium
DFRQRFKKDVVIDMLCY

SEQ ID NO: 1033535 - protein, 18 aa, Mycobacterium
DFRQVLSVNGWEITYLGT

SEQ ID NO: 1033536 - protein, 29 aa, Mycobacterium
DFRVMRADRGYFCFPEVDIRIPFTPGMAA

SEQ ID NO: 1033537 - protein, 18 aa, Mycobacterium
DFSGLVVSGDEAWNTINE

SEQ ID NO: 1033538 - protein, 24 aa, Mycobacterium
DFSISRTSFDWGVQVPEHPDHVMY

SEQ ID NO: 1033539 - protein, 17 aa, Mycobacterium
DFSLFQVLRYGFRPSKI

SEQ ID NO: 1033540 - protein, 19 aa, Mycobacterium
DFVGELFVSNSYRDYLEVH

SEQ ID NO: 1033541 - protein, 18 aa, Mycobacterium
DFVGLEHFSMLAALASPP

SEQ ID NO: 1033542 - protein, 21 aa, Mycobacterium
DFVMCRADIAPILLGVIREVW

SEQ ID NO: 1033543 - protein, 23 aa, Mycobacterium
DFVMPINRFEVTTTRELLRRNAL

SEQ ID NO: 1033544 - protein, 25 aa, Mycobacterium
DFVNRLVAEHVKLRLGSAREATDAF

SEQ ID NO: 1033545 - protein, 19 aa, Mycobacterium
DFYWLRGDVDIGELHELVM

SEQ ID NO: 1033546 - protein, 21 aa, Mycobacterium
DGDEEAVRWLARAAHIRPDGR

SEQ ID NO: 1033547 - protein, 19 aa, Mycobacterium
DGDRLRITWHGETVVDVPP

SEQ ID NO: 1033548 - protein, 17 aa, Mycobacterium
DGFAIRPLYTVFDELPE

SEQ ID NO: 1033549 - protein, 17 aa, Mycobacterium
DGGDEWEAFLGKDDNLY

SEQ ID NO: 1033550 - protein, 17 aa, Mycobacterium
DGGGAIFYSVVARDSLD

SEQ ID NO: 1033551 - protein, 24 aa, Mycobacterium
DGGPDIKGPLLINVRADKVATSPV

SEQ ID NO: 1033552 - protein, 25 aa, Mycobacterium
DGHGGGLPSVVSWADYCAGRGNDTG

SEQ ID NO: 1033553 - protein, 18 aa, Mycobacterium
DGIHLVKGFYRRPLNSND

SEQ ID NO: 1033554 - protein, 21 aa, Mycobacterium
DGLEQPRCEILTFLATREAAH

SEQ ID NO: 1033555 - protein, 17 aa, Mycobacterium
DGLVSHRTALHDSTATS

SEQ ID NO: 1033556 - protein, 23 aa, Mycobacterium
DGMAAGRSCARIPTGHEESLVVE

SEQ ID NO: 1033557 - protein, 18 aa, Mycobacterium
DGMPVGMMFTADFGQEAQ

SEQ ID NO: 1033558 - protein, 17 aa, Mycobacterium
DGPYILAGWSLGGVLAY

SEQ ID NO: 1033559 - protein, 29 aa, Mycobacterium
DGQARPAARLIGWTARFLGMAHPGDKVDF

SEQ ID NO: 1033560 - protein, 20 aa, Mycobacterium
DGQFGKWLQGARDWSISRNR

SEQ ID NO: 1033561 - protein, 18 aa, Mycobacterium
DGQWTRAKGHDTFCPVGP

SEQ ID NO: 1033562 - protein, 22 aa, Mycobacterium
DGRIKLSTKFTRLTGRSPILLA

SEQ ID NO: 1033563 - protein, 31 aa, Mycobacterium
DGSEYRGRYGLSVAALARWHRPRLEVLADAG

SEQ ID NO: 1033564 - protein, 17 aa, Mycobacterium
DGSVWAQVMAGHLGGLP

SEQ ID NO: 1033565 - protein, 18 aa, Mycobacterium
DGTHTEWLETVRADDFSL

SEQ ID NO: 1033566 - protein, 25 aa, Mycobacterium
DGTSELRYGQLVAEVNGLAAHLSAQ

SEQ ID NO: 1033567 - protein, 18 aa, Mycobacterium
DGVIPPNRSLDCVDEELA

SEQ ID NO: 1033568 - protein, 17 aa, Mycobacterium
DGVSCCTHIGPGGSGHF

SEQ ID NO: 1033569 - protein, 20 aa, Mycobacterium
DGWVHFDAPAGMLIPDSVAT

SEQ ID NO: 1033570 - protein, 23 aa, Mycobacterium
DGYGRLRGISALVTTFGVGELSA

SEQ ID NO: 1033571 - protein, 23 aa, Mycobacterium
DHGKAPVRRACYAADRTGHMILQ

SEQ ID NO: 1033572 - protein, 24 aa, Mycobacterium
DHGMLPRLLAHLVHPSTTGVPSRY

SEQ ID NO: 1033573 - protein, 21 aa, Mycobacterium
DHLQRLWTPYRMTYLAEAPVN

SEQ ID NO: 1033574 - protein, 21 aa, Mycobacterium
DHLRSGGSIIGVLAENPPAGS

SEQ ID NO: 1033575 - protein, 19 aa, Mycobacterium
DHVELSKRVTWMSESQVAS

SEQ ID NO: 1033576 - protein, 23 aa, Mycobacterium
DIACAPVGFDARFSALRRHYRYR

SEQ ID NO: 1033577 - protein, 19 aa, Mycobacterium
DIAGLRADADFMIWTHAER

SEQ ID NO: 1033578 - protein, 24 aa, Mycobacterium
DIALRRPSLDDVFLSMTTDPSESL

SEQ ID NO: 1033579 - protein, 23 aa, Mycobacterium
DIGKRIERGLALTALLHATLTDV

SEQ ID NO: 1033580 - protein, 27 aa, Mycobacterium
DIGLCSARMYFAYGLGNSVWFPLATGG

SEQ ID NO: 1033581 - protein, 18 aa, Mycobacterium
DIGRGRNGVLYAGEVNWE

SEQ ID NO: 1033582 - protein, 31 aa, Mycobacterium; identical to SEQ ID NO: 968801

SEQ ID NO: 1033583 - protein, 24 aa, Mycobacterium
DIHLAIPIIRAFSHFALLANVAED

SEQ ID NO: 1033584 - protein, 24 aa, Mycobacterium
DIMICARPAVVVPLIETLRQNLTA

SEQ ID NO: 1033585 - protein, 19 aa, Mycobacterium
DIPANRPGRAISVEKHHLM

SEQ ID NO: 1033586 - protein, 26 aa, Mycobacterium
DIQQAAVNRIHWFYSLSPTDRRQYSE

SEQ ID NO: 1033587 - protein, 18 aa, Mycobacterium
DIRAVGIGELLVRIDRLR

SEQ ID NO: 1033588 - protein, 24 aa, Mycobacterium
DIRLGSPTFGCWTSITLNDSNRKT

SEQ ID NO: 1033589 - protein, 19 aa, Mycobacterium
DIRVQRPLSAVIHAAGMLD

SEQ ID NO: 1033590 - protein, 23 aa, Mycobacterium
DISELRARIGLSSSVLTQRVPSN

SEQ ID NO: 1033591 - protein, 23 aa, Mycobacterium
DISRLRYHKIVLMADADVDGQHI

SEQ ID NO: 1033592 - protein, 24 aa, Mycobacterium
DITKEVLGALGITVFAEAGFEADD

SEQ ID NO: 1033593 - protein, 24 aa, Mycobacterium
DITVNVDGFWLLQALLDIRHVAPE

SEQ ID NO: 1033594 - protein, 18 aa, Mycobacterium
DIVDACSLVQVRSHKKQM

SEQ ID NO: 1033595 - protein, 27 aa, Mycobacterium
DIYGDTRLGLFPFRRNLSLYAVDLALL

SEQ ID NO: 1033596 - protein, 17 aa, Mycobacterium
DKAAAYDVITVFDASHD

SEQ ID NO: 1033597 - protein, 30 aa, Mycobacterium
DKAKTAPLWRVLVALSIRHVGPTAARALAT

SEQ ID NO: 1033598 - protein, 17 aa, Mycobacterium
DKASGDFVWDEDESEAL

SEQ ID NO: 1033599 - protein, 17 aa, Mycobacterium
DKAVFALHEAFGLGGED

SEQ ID NO: 1033600 - protein, 24 aa, Mycobacterium
DKFTRSGLGFSVLHVVRDNPTNIT

SEQ ID NO: 1033601 - protein, 17 aa, Mycobacterium
DKGRILTAMSVFFFSFV

SEQ ID NO: 1033602 - protein, 18 aa, Mycobacterium
DKHGPGIQQLACRVSDLD

SEQ ID NO: 1033603 - protein, 20 aa, Mycobacterium
DKHKLALEREMLGLYVSGHP

SEQ ID NO: 1033604 - protein, 24 aa, Mycobacterium
DKIARMGIRVADVLEPGELTHKIE

SEQ ID NO: 1033605 - protein, 19 aa, Mycobacterium
DKLELLRSIEITSGIAEQI

SEQ ID NO: 1033606 - protein, 21 aa, Mycobacterium
DKLKDAGFYWATRSGVTVSMA

SEQ ID NO: 1033607 - protein, 21 aa, Mycobacterium
DKLPLSARVFRTWITQNPGQL

SEQ ID NO: 1033608 - protein, 20 aa, Mycobacterium
DKLTKWSIPLLRPGGQILAI

SEQ ID NO: 1033609 - protein, 25 aa, Mycobacterium
DKPDLRFGLELVECTEFFCDTTFRV

SEQ ID NO: 1033610 - protein, 19 aa, Mycobacterium
DKPWFAIGGIDAQRLPDVL

SEQ ID NO: 1033611 - protein, 33 aa, Mycobacterium
DKRLSYSLKEIRHWLQIFVQRFYSFSQFKRSAL

SEQ ID NO: 1033612 - protein, 17 aa, Mycobacterium
DKSKFLAELKVLPRDEW

SEQ ID NO: 1033613 - protein, 18 aa, Mycobacterium
DKVFWCRVGTSGGIGLPS

SEQ ID NO: 1033614 - protein, 17 aa, Mycobacterium
DLAAALLGQCGDVVIGD

SEQ ID NO: 1033615 - protein, 19 aa, Mycobacterium
DLAIDWPVVDGVDTHLSKR

SEQ ID NO: 1033616 - protein, 25 aa, Mycobacterium
DLARAIPLPTQFEFMAVSSYGSSMS

SEQ ID NO: 1033617 - protein, 17 aa, Mycobacterium
DLARFAAYLQQLTMESN

SEQ ID NO: 1033618 - protein, 26 aa, Mycobacterium
DLARWPELRARLTAAFASHDRDHWAR

SEQ ID NO: 1033619 - protein, 17 aa, Mycobacterium
DLCNAESKVAAAGTPIT

SEQ ID NO: 1033620 - protein, 24 aa, Mycobacterium
DLDDNLRSWLAFGAEKVAEVVVLA

SEQ ID NO: 1033621 - protein, 18 aa, Mycobacterium
DLELDWVHFLPSNGGLVL

SEQ ID NO: 1033622 - protein, 24 aa, Mycobacterium
DLELPWEMLTAMKSIILSLPCADA

SEQ ID NO: 1033623 - protein, 17 aa, Mycobacterium
DLFPADKLQSGYLPVLR

SEQ ID NO: 1033624 - protein, 18 aa, Mycobacterium
DLGDAHGTVMLRMPLHSV

SEQ ID NO: 1033625 - protein, 28 aa, Mycobacterium
DLGEGFGVWRLGDDEAMLRIVTSANVAC

SEQ ID NO: 1033626 - protein, 21 aa, Mycobacterium
DLHTARLALCQANRQVIANGL

SEQ ID NO: 1033627 - protein, 29 aa, Mycobacterium
DLIDAGRPFGFRPEAILPAYGMAETTLAV

SEQ ID NO: 1033628 - protein, 20 aa, Mycobacterium
DLIESVSFFEGRRVGLGGST

SEQ ID NO: 1033629 - protein, 22 aa, Mycobacterium
DLKRLPFPMLSDIKRELSAASG

SEQ ID NO: 1033630 - protein, 17 aa, Mycobacterium
DLLGGRAQWVVRYQGGN

SEQ ID NO: 1033631 - protein, 23 aa, Mycobacterium
DLLQLKAAVLGSRRAMTQAGRHI

SEQ ID NO: 1033632 - protein, 18 aa, Mycobacterium
DLLRAWRLINATTRYPID

SEQ ID NO: 1033633 - protein, 19 aa, Mycobacterium
DLLRLVLDCGVAKMDRTGT

SEQ ID NO: 1033634 - protein, 18 aa, Mycobacterium
DLLVRLAAGDARRVLTAL

SEQ ID NO: 1033635 - protein, 26 aa, Mycobacterium
DLPEFNLKTALKFTRDRKCIVVNTGR

SEQ ID NO: 1033636 - protein, 18 aa, Mycobacterium
DLPPPAALTGEWFDALAI

SEQ ID NO: 1033637 - protein, 33 aa, Mycobacterium
DLQFRPEVSDGLFLRLAVTSVESLACAYAAVLV

SEQ ID NO: 1033638 - protein, 19 aa, Mycobacterium
DLRRARAAALNVVPTSTGA

SEQ ID NO: 1033639 - protein, 25 aa, Mycobacterium
DLSKLARPTSTWTYMVNDAPLSDDT

SEQ ID NO: 1033640 - protein, 21 aa, Mycobacterium
DLSLLGKARKVVMTKDETTIV

SEQ ID NO: 1033641 - protein, 23 aa, Mycobacterium
DLTDGRFYYARVASVTDTGIQPV

SEQ ID NO: 1033642 - protein, 20 aa, Mycobacterium
DLTVASLCARRPRRWGAGAT

SEQ ID NO: 1033643 - protein, 31 aa, Mycobacterium; identical to SEQ ID NO: 95346

SEQ ID NO: 1033644 - protein, 25 aa, Mycobacterium
DLVAEVRAGLPPTLVVAGSHMDGIG

SEQ ID NO: 1033645 - protein, 19 aa, Mycobacterium
DLVGRFGGMSMEYRLPQPD

SEQ ID NO: 1033646 - protein, 24 aa, Mycobacterium
DLVHGRYDPWAGIDDVDLVDCSAV

SEQ ID NO: 1033647 - protein, 23 aa, Mycobacterium
DLVQRYAPKLSLIVTSHQHFDHW

SEQ ID NO: 1033648 - protein, 24 aa, Mycobacterium
DLVRRGRDVLALDIYRVGQYTAWR

SEQ ID NO: 1033649 - protein, 23 aa, Mycobacterium
DMLRRAFAADMAFLRNCGIHPVV

SEQ ID NO: 1033650 - protein, 17 aa, Mycobacterium
DMRSGRMTDDDWTRLAR

SEQ ID NO: 1033651 - protein, 26 aa, Mycobacterium
DMVGKLKVEIGDRVQVIGGNVATRSA

SEQ ID NO: 1033652 - protein, 24 aa, Mycobacterium
DNARLRARIGVMLQGGGGYPAARA

SEQ ID NO: 1033653 - protein, 18 aa, Mycobacterium
DNDGRLLVGAAVGVGGDA

SEQ ID NO: 1033654 - protein, 24 aa, Mycobacterium
DNDRLSAVVAHLVGAEALVLLSDI

SEQ ID NO: 1033655 - protein, 22 aa, Mycobacterium
DNGIKIFGPGGHKLDDDTEDQI

SEQ ID NO: 1033656 - protein, 22 aa, Mycobacterium
DNLRRGGIQFADTRGYAYDRRD

SEQ ID NO: 1033657 - protein, 19 aa, Mycobacterium
DNTYYCFGTASGPHPFPTM

SEQ ID NO: 1033658 - protein, 17 aa, Mycobacterium
DNYNLNMAIPWIAAERG

SEQ ID NO: 1033659 - protein, 25 aa, Mycobacterium
DPDPRAADVVKTWVHVLDQLERDPM

SEQ ID NO: 1033660 - protein, 23 aa, Mycobacterium
DPELIPKLMSSGVIEVASLAYMR

SEQ ID NO: 1033661 - protein, 21 aa, Mycobacterium
DPERGRRLGIDVGSVRIGVAF

SEQ ID NO: 1033662 - protein, 19 aa, Mycobacterium
DPFGDVFLIIDGWSAFTSE

SEQ ID NO: 1033663 - protein, 20 aa, Mycobacterium
DPHPELLRAWDLPTTADGLA

SEQ ID NO: 1033664 - protein, 23 aa, Mycobacterium
DPIHPLQVGVDWVTAAPHAALQT

SEQ ID NO: 1033665 - protein, 21 aa, Mycobacterium
DPIPHGLLFERFLNPERTSMP

SEQ ID NO: 1033666 - protein, 19 aa, Mycobacterium
DPIRRIAVFLVKTVLASPM

SEQ ID NO: 1033667 - protein, 23 aa, Mycobacterium
DPLILRQTYPVRHAPYGLAGSRT

SEQ ID NO: 1033668 - protein, 19 aa, Mycobacterium
DPLTIVALVSKLTSDVDQT

SEQ ID NO: 1033669 - protein, 24 aa, Mycobacterium
DPMGCVIGGTAWDFANRNRVPPGS

SEQ ID NO: 1033670 - protein, 20 aa, Mycobacterium
DPPAPLAMDVHPGRRAAGRA

SEQ ID NO: 1033671 - protein, 25 aa, Mycobacterium
DPQHRLFLQCAWHALEDAGCDPAQF

SEQ ID NO: 1033672 - protein, 18 aa, Mycobacterium
DPQHRLLLETSWDAIEHA

SEQ ID NO: 1033673 - protein, 42 aa, Mycobacterium
DPQLIAEPCRWVYYPWRHVVVSMLGPRGFRAVRLDRNRNEIT

SEQ ID NO: 1033674 - protein, 24 aa, Mycobacterium
DPQQRILLEVAWEALENAGIPPDS

SEQ ID NO: 1033675 - protein, 24 aa, Mycobacterium
DPQQRLLLETSWEAIEQGGLDPAS

SEQ ID NO: 1033676 - protein, 25 aa, Mycobacterium
DPQQRLMLEVSWEALEYAGIDPLSL

SEQ ID NO: 1033677 - protein, 26 aa, Mycobacterium
DPQQRMALELTWEALEHARIPASSLR

SEQ ID NO: 1033678 - protein, 18 aa, Mycobacterium
DPQQRMLLELSWEALERA

SEQ ID NO: 1033679 - protein, 22 aa, Mycobacterium
DPRASILVDVDDGWSYAVAEGT

SEQ ID NO: 1033680 - protein, 21 aa, Mycobacterium
DPRELPVCNGAYWVDNLRNTV

SEQ ID NO: 1033681 - protein, 19 aa, Mycobacterium
DPRGCYPPKPGSYPQQAGH

SEQ ID NO: 1033682 - protein, 24 aa, Mycobacterium
DPRPPMVTSGLRIGTPALATRGFG

SEQ ID NO: 1033683 - protein, 19 aa, Mycobacterium
DPSAVLVARECRIDSSSLP

SEQ ID NO: 1033684 - protein, 21 aa, Mycobacterium
DPTIKGMWTVPVFGNPTGVTY

SEQ ID NO: 1033685 - protein, 17 aa, Mycobacterium
DPTWVYTCAYFERDDMT

SEQ ID NO: 1033686 - protein, 27 aa, Mycobacterium
DPWLPSLGNPLSFLSPFNIAFALGTPM

SEQ ID NO: 1033687 - protein, 17 aa, Mycobacterium
DQELAWLATMRDEGVRR

SEQ ID NO: 1033688 - protein, 24 aa, Mycobacterium
DQIKWLFDKLLGIKPRWNVRRQRS

SEQ ID NO: 1033689 - protein, 22 aa, Mycobacterium
DQKERLAELTARWQNEKNAIDV

SEQ ID NO: 1033690 - protein, 26 aa, Mycobacterium
DQLDALCALGLQYRVAAAALPNDSVS

SEQ ID NO: 1033691 - protein, 22 aa, Mycobacterium
DQLRCNGWKGFGPVPYSHEPNR

SEQ ID NO: 1033692 - protein, 23 aa, Mycobacterium
DQLRHEFGDAVAVIGRPAYTYAG

SEQ ID NO: 1033693 - protein, 18 aa, Mycobacterium
DQRVKLLVAELGNRRPLV

SEQ ID NO: 1033694 - protein, 27 aa, Mycobacterium
DQRWPETCIEPSLTRISALMDVLGSPQ

SEQ ID NO: 1033695 - protein, 23 aa, Mycobacterium
DQTRGGAHLLDLCVDYVGRNGVA

SEQ ID NO: 1033696 - protein, 21 aa, Mycobacterium
DRAAAFAGIKPFLALYMGGMG

SEQ ID NO: 1033697 - protein, 19 aa, Mycobacterium
DRADMFAAIAPVAGTLGVD

SEQ ID NO: 1033698 - protein, 24 aa, Mycobacterium
DRAPVPFHLLPTVAREFGKDTEIL

SEQ ID NO: 1033699 - protein, 31 aa, Mycobacterium
DRARRVYMSRGWLPWLGPTSVLAPTGVIRTP

SEQ ID NO: 1033700 - protein, 18 aa, Mycobacterium
DRASCKYMKMITPGALLR

SEQ ID NO: 1033701 - protein, 26 aa, Mycobacterium
DRCAVGIPTNSGWRMLSGDETGWLLG

SEQ ID NO: 1033702 - protein, 25 aa, Mycobacterium
DRDGFVFGEAGALMLIETEDSAKAR

SEQ ID NO: 1033703 - protein, 25 aa, Mycobacterium
DRDWSPKVYGSWNLHCATIGQPLDW

SEQ ID NO: 1033704 - protein, 20 aa, Mycobacterium
DRDYPRPVAAGLYGDLPAIL

SEQ ID NO: 1033705 - protein, 19 aa, Mycobacterium
DREHFAISAGGVVVVGKGV

SEQ ID NO: 1033706 - protein, 19 aa, Mycobacterium
DRFEARIAVREALAVQGRI

SEQ ID NO: 1033707 - protein, 40 aa, Mycobacterium
DRFTAMPPAERWHLLASTWLDLQCRPALIGSRGPDAKSYG

SEQ ID NO: 1033708 - protein, 30 aa, Mycobacterium
DRGALPVKLCYAGPFFRYERPQAGRCRQLQ

SEQ ID NO: 1033709 - protein, 17 aa, Mycobacterium
DRGEFFLVYQPIVRLND

SEQ ID NO: 1033710 - protein, 31 aa, Mycobacterium
DRGTALLCLFDPVIFFWQWVEWLFGFRYCIE

SEQ ID NO: 1033711 - protein, 20 aa, Mycobacterium
DRHFWLVKGGEWLASCHYGA

SEQ ID NO: 1033712 - protein, 19 aa, Mycobacterium
DRIDPWWAKLTDMLAPDVP

SEQ ID NO: 1033713 - protein, 20 aa, Mycobacterium
DRIVGLLIERDFIRGPADDP

SEQ ID NO: 1033714 - protein, 20 aa, Mycobacterium
DRIVPRKVVNWFNNGPAEQF

SEQ ID NO: 1033715 - protein, 21 aa, Mycobacterium
DRIVRRPGARWATDLLSAAEA

SEQ ID NO: 1033716 - protein, 20 aa, Mycobacterium
DRIVSIGAFEHFGHDRYDDF

SEQ ID NO: 1033717 - protein, 22 aa, Mycobacterium
DRLAASLAYGVALWVVLYSCHC

SEQ ID NO: 1033718 - protein, 19 aa, Mycobacterium
DRLAQLRPGDSILGEEGGG

SEQ ID NO: 1033719 - protein, 20 aa, Mycobacterium
DRLARLGVEDELLRVGAQPG

SEQ ID NO: 1033720 - protein, 21 aa, Mycobacterium
DRLDGWRGWRSGLVPPVNRFR

SEQ ID NO: 1033721 - protein, 17 aa, Mycobacterium
DRLEELLALAHDVRMRW

SEQ ID NO: 1033722 - protein, 20 aa, Mycobacterium
DRLFPRSIFYSLKLAEHNLD

SEQ ID NO: 1033723 - protein, 19 aa, Mycobacterium
DRLGLLPMFAVNQDKHGTA

SEQ ID NO: 1033724 - protein, 20 aa, Mycobacterium
DRLKFALSEIDSVDPQPGED

SEQ ID NO: 1033725 - protein, 22 aa, Mycobacterium
DRLQELRIGKGVSLDDFTVLTG

SEQ ID NO: 1033726 - protein, 21 aa, Mycobacterium
DRLRAIADRLGRGIGPEILDK

SEQ ID NO: 1033727 - protein, 26 aa, Mycobacterium
DRLVLDFYRCAMLPASAAWHPHDALN

SEQ ID NO: 1033728 - protein, 18 aa, Mycobacterium
DRNAVMFGPPGRLYTYCS

SEQ ID NO: 1033729 - protein, 25 aa, Mycobacterium
DRNRITGGFTVRFARPGETIVTIDG

SEQ ID NO: 1033730 - protein, 20 aa, Mycobacterium
DRPDALVLDVMMPRLDGLEV

SEQ ID NO: 1033731 - protein, 23 aa, Mycobacterium
DRRGKYLWFLLDTDIALVVHLGM

SEQ ID NO: 1033732 - protein, 23 aa, Mycobacterium
DRRKKIRGGDIFAPVFDPVQVEI

SEQ ID NO: 1033733 - protein, 18 aa, Mycobacterium
DRRLLSLIFLARDHVMHG

SEQ ID NO: 1033734 - protein, 21 aa, Mycobacterium
DRSIATVLGRWPVAAGSASVL

SEQ ID NO: 1033735 - protein, 23 aa, Mycobacterium
DRSLDVMAMDVVWTAEFAEAGWT

SEQ ID NO: 1033736 - protein, 23 aa, Mycobacterium
DRVDTVLRAKVDAAWNLHEATRD

SEQ ID NO: 1033737 - protein, 26 aa, Mycobacterium
DRVGGVSRNGCWTTFVICDARHAVTL

SEQ ID NO: 1033738 - protein, 21 aa, Mycobacterium
DRVGLELGRGNYLTVDRVSRT

SEQ ID NO: 1033739 - protein, 20 aa, Mycobacterium
DRYLEVWNLVFMQNERGEGT

SEQ ID NO: 1033740 - protein, 24 aa, Mycobacterium
DSAELPLFRYIGGSNAHILPVPMM

SEQ ID NO: 1033741 - protein, 27 aa, Mycobacterium
DSAFDGYEFSRACEALYHFAWDEFCDW

SEQ ID NO: 1033742 - protein, 18 aa, Mycobacterium
DSATVRRLATEGTAPDIV

SEQ ID NO: 1033743 - protein, 20 aa, Mycobacterium
DSDAIYNSWASPSYEHGQVE

SEQ ID NO: 1033744 - protein, 23 aa, Mycobacterium
DSEAIEAFRLLCRTEGILPALES

SEQ ID NO: 1033745 - protein, 23 aa, Mycobacterium
DSELIPLPPNWGGYLIVPEVVEF

SEQ ID NO: 1033746 - protein, 18 aa, Mycobacterium
DSFEWSNGAWILKNCASL

SEQ ID NO: 1033747 - protein, 28 aa, Mycobacterium
DSFWDEIFRELSIPYLPVRWRTDNPDSI

SEQ ID NO: 1033748 - protein, 18 aa, Mycobacterium
DSIEPLYETFTFNGGQYA

SEQ ID NO: 1033749 - protein, 17 aa, Mycobacterium
DSIGQSFQNTWEGQAAS

SEQ ID NO: 1033750 - protein, 23 aa, Mycobacterium
DSILRVLAMHRFAKSPMLVGGQM

SEQ ID NO: 1033751 - protein, 18 aa, Mycobacterium
DSLMPCGRCRQLLYEHGG

SEQ ID NO: 1033752 - protein, 18 aa, Mycobacterium
DSMFQAILPLRGKIINVE

SEQ ID NO: 1033753 - protein, 23 aa, Mycobacterium
DSMRAGLQALAWIAHGGTHDKNQ

SEQ ID NO: 1033754 - protein, 23 aa, Mycobacterium
DSNRHPLHFALGIMDEPRRHRQD

SEQ ID NO: 1033755 - protein, 20 aa, Mycobacterium
DSPRAPMLPRTWGADPTFCY

SEQ ID NO: 1033756 - protein, 17 aa, Mycobacterium
DSSKCEVIYRFFADIAD

SEQ ID NO: 1033757 - protein, 21 aa, Mycobacterium
DSSRGALLIHGHLDVVPAETA

SEQ ID NO: 1033758 - protein, 26 aa, Mycobacterium
DSVLPRLRTLYCDQLLVLAALDLAAT

SEQ ID NO: 1033759 - protein, 24 aa, Mycobacterium
DSVSCPRSGEVIVRKNRHWYSTGA

SEQ ID NO: 1033760 - protein, 25 aa, Mycobacterium
DTACSSGLMAVHQARGSLDCGESDL

SEQ ID NO: 1033761 - protein, 26 aa, Mycobacterium
DTACSSSLVAIHWAMSSLRSGECDLA

SEQ ID NO: 1033762 - protein, 23 aa, Mycobacterium
DTAKAMGAIALFGEAYPDEVRVV

SEQ ID NO: 1033763 - protein, 27 aa, Mycobacterium
DTATDWPRYGGYALAGVSSFGFGGANA

SEQ ID NO: 1033764 - protein, 18 aa, Mycobacterium
DTDRALAILTARHLDCWV

SEQ ID NO: 1033765 - protein, 19 aa, Mycobacterium
DTDSELFGRYWPANLHMIG

SEQ ID NO: 1033766 - protein, 24 aa, Mycobacterium
DTEIPSPAAGVLTKIIAQEDDTVE

SEQ ID NO: 1033767 - protein, 22 aa, Mycobacterium
DTEPWRGEPLLEYLRKMVFWSE

SEQ ID NO: 1033768 - protein, 24 aa, Mycobacterium
DTEVARPYFAEAVELARTQGDKWT

SEQ ID NO: 1033769 - protein, 24 aa, Mycobacterium
DTFRKLRGSFDLILNTVSANLDLG

SEQ ID NO: 1033770 - protein, 26 aa, Mycobacterium
DTGSRWKADEAVGLTLSIEERVKAAV

SEQ ID NO: 1033771 - protein, 23 aa, Mycobacterium
DTHARLLVWELIDTLRRDGVTVV

SEQ ID NO: 1033772 - protein, 23 aa, Mycobacterium
DTIRSALLTAYRHTQGHQIDARI

SEQ ID NO: 1033773 - protein, 21 aa, Mycobacterium
DTLHGTRCISIGTLQRDADDT

SEQ ID NO: 1033774 - protein, 17 aa, Mycobacterium
DTLPRRGIGKVDRTALV

SEQ ID NO: 1033775 - protein, 23 aa, Mycobacterium
DTLRTEMGYPLYGHELSLDISPL

SEQ ID NO: 1033776 - protein, 31 aa, Mycobacterium
DTNPEMAREFQVVSIPTMILFQGGQPVKRIV

SEQ ID NO: 1033777 - protein, 23 aa, Mycobacterium
DTNRWCAIATNVLGGCRGSTGPS

SEQ ID NO: 1033778 - protein, 17 aa, Mycobacterium
DTNYMRHTMAYKQGTDL

SEQ ID NO: 1033779 - protein, 28 aa, Mycobacterium
DTPELMPLPIALAHRLARRLTEVRKNGV

SEQ ID NO: 1033780 - protein, 18 aa, Mycobacterium
DTPKAIAALDGWVTDALE

SEQ ID NO: 1033781 - protein, 22 aa, Mycobacterium
DTPKWNWINTLHKMGTSTVGIH

SEQ ID NO: 1033782 - protein, 25 aa, Mycobacterium
DTPSRGNFLLTLRAAILERDSTVNL

SEQ ID NO: 1033783 - protein, 23 aa, Mycobacterium
DTQLRRLAVFDVLINNADRKGGH

SEQ ID NO: 1033784 - protein, 30 aa, Mycobacterium
DTRAYFRGECLRRFSADIAAASWDSVIFDL

SEQ ID NO: 1033785 - protein, 18 aa, Mycobacterium
DTRMQWYVELGIDPQNLR

SEQ ID NO: 1033786 - protein, 17 aa, Mycobacterium
DTWFSSALWPFSTLGWP

SEQ ID NO: 1033787 - protein, 25 aa, Mycobacterium
DTYGFPIELTLEMAAEAGLTVDEKG

SEQ ID NO: 1033788 - protein, 35 aa, Mycobacterium
DTYIFYMRNFLMANALYWLKELHIEGLRVDAVASM

SEQ ID NO: 1033789 - protein, 24 aa, Mycobacterium
DVAADVWSVTSWGELNRDGMSIET

SEQ ID NO: 1033790 - protein, 22 aa, Mycobacterium
DVDAALHYLARMLIAGEDPRFI

SEQ ID NO: 1033791 - protein, 26 aa, Mycobacterium
DVDAYLHVGGQWEWDSAAPAGVVLAA

SEQ ID NO: 1033792 - protein, 17 aa, Mycobacterium
DVDIVVEVMGPVELSRK

SEQ ID NO: 1033793 - protein, 21 aa, Mycobacterium
DVEFPHGFVPELFNALNAKTT

SEQ ID NO: 1033794 - protein, 26 aa, Mycobacterium
DVEFYKWTQWIFLQIYNAWFDVAANK

SEQ ID NO: 1033795 - protein, 24 aa, Mycobacterium
DVEILRLSALRGLFSTVIEDAVTF

SEQ ID NO: 1033796 - protein, 17 aa, Mycobacterium
DVFAEAIGQVAIAAGRD

SEQ ID NO: 1033797 - protein, 20 aa, Mycobacterium
DVFDREWPLRVGDIDRTGRL

SEQ ID NO: 1033798 - protein, 18 aa, Mycobacterium
DVFFRAVQYLPWHPGRCA

SEQ ID NO: 1033799 - protein, 19 aa, Mycobacterium
DVGGFDCDFFGMTEREAIA

SEQ ID NO: 1033800 - protein, 21 aa, Mycobacterium
DVGHIPGAVKVDWHTDLNDPK

SEQ ID NO: 1033801 - protein, 20 aa, Mycobacterium
DVGKHFSINLMLDRDTIRRR

SEQ ID NO: 1033802 - protein, 18 aa, Mycobacterium
DVGLRYYSAALFHVIPQV

SEQ ID NO: 1033803 - protein, 19 aa, Mycobacterium
DVGPSWLRPLVDNIAVMPG

SEQ ID NO: 1033804 - protein, 26 aa, Mycobacterium
DVIADLAFPLAVAVICRLLGVPYEDA

SEQ ID NO: 1033805 - protein, 17 aa, Mycobacterium
DVIAVAPSTLWSLTTDR

SEQ ID NO: 1033806 - protein, 30 aa, Mycobacterium
DVIEVPGLLDLSSLWQIYGLDRPALKDRAF

SEQ ID NO: 1033807 - protein, 17 aa, Mycobacterium
DVIPEVLGPVVDLRDGS

SEQ ID NO: 1033808 - protein, 24 aa, Mycobacterium
DVLGRVCSARARIIAEYQGETVLV

SEQ ID NO: 1033809 - protein, 21 aa, Mycobacterium
DVLKATALPVYVHAPYLINVA

SEQ ID NO: 1033810 - protein, 20 aa, Mycobacterium
DVLMYPAWRSSALLGHLQDR

SEQ ID NO: 1033811 - protein, 23 aa, Mycobacterium
DVMPEDLIKFGLIPEFIGRLPVI

SEQ ID NO: 1033812 - protein, 22 aa, Mycobacterium
DVNRRFAETTSRTAAYGGTVWV

SEQ ID NO: 1033813 - protein, 17 aa, Mycobacterium
DVPARLGTLLTAMVTPF

SEQ ID NO: 1033814 - protein, 25 aa, Mycobacterium
DVPAVQAVDCILGYTIGNDMSARDQ

SEQ ID NO: 1033815 - protein, 20 aa, Mycobacterium
DVPGGFAAGLARTLPVTGGQ

SEQ ID NO: 1033816 - protein, 33 aa, Mycobacterium
DVPSVLRFSGYELIKRLGIRRTIAIPVFGDHAD

SEQ ID NO: 1033817 - protein, 18 aa, Mycobacterium
DVPTGAGLSVRQQALLAA

SEQ ID NO: 1033818 - protein, 28 aa, Mycobacterium
DVRTGSVSFRFGDRTQINGVARDSAVEA

SEQ ID NO: 1033819 - protein, 17 aa, Mycobacterium
DVSFPLGVLTSVTGVSG

SEQ ID NO: 1033820 - protein, 19 aa, Mycobacterium
DVSLPEYVVSAGRAIPIPY

SEQ ID NO: 1033821 - protein, 23 aa, Mycobacterium
DVTEIIPVDGFDDFDDLYDLDFA

SEQ ID NO: 1033822 - protein, 23 aa, Mycobacterium
DVTRGVCAVGLLTATEGLDRLVG

SEQ ID NO: 1033823 - protein, 23 aa, Mycobacterium
DVVARCRRIFCTRRVGHAGTLDP

SEQ ID NO: 1033824 - protein, 26 aa, Mycobacterium
DVVARKCGVPYLYRFELMGTEDDVTA

SEQ ID NO: 1033825 - protein, 17 aa, Mycobacterium
DVVDVLLVWPGQQHVVI

SEQ ID NO: 1033826 - protein, 18 aa, Mycobacterium
DVVRKDTHVHAWALRMSP

SEQ ID NO: 1033827 - protein, 23 aa, Mycobacterium
DWAAKGTLLLGVRAVIAESFERI

SEQ ID NO: 1033828 - protein, 23 aa, Mycobacterium
DWDGVKITLTWSQLYRRTLNVAQ

SEQ ID NO: 1033829 - protein, 26 aa, Mycobacterium
DWDYYTIRAGDEFFPDVNRKLIDYPA

SEQ ID NO: 1033830 - protein, 17 aa, Mycobacterium
DWNGMVAEAARLHAAGE

SEQ ID NO: 1033831 - protein, 21 aa, Mycobacterium
DWPAEAVVVGPLHFEPTDRVL

SEQ ID NO: 1033832 - protein, 25 aa, Mycobacterium
DYAQRLATRHLLRYPGLQHAASYGA

SEQ ID NO: 1033833 - protein, 20 aa, Mycobacterium
DYFRKHAFANATFDDLLVAL

SEQ ID NO: 1033834 - protein, 22 aa, Mycobacterium
DYFTYRDVLGFIYAQAKFQLLG

SEQ ID NO: 1033835 - protein, 17 aa, Mycobacterium
DYITRATALSHEHPVLV

SEQ ID NO: 1033836 - protein, 21 aa, Mycobacterium
DYTLPMLTGIRIEISGDTVVL

SEQ ID NO: 1033837 - protein, 25 aa, Mycobacterium
DYVKAFWNVVNWADVQSRYMAATSK

SEQ ID NO: 1033838 - protein, 22 aa, Mycobacterium
EAAARILLRSGKLVFLAANKVD

SEQ ID NO: 1033839 - protein, 23 aa, Mycobacterium
EAAARNPAPFGFHVVAVARHGDR

SEQ ID NO: 1033840 - protein, 19 aa, Mycobacterium
EAAGFKPGADVALALDAAA

SEQ ID NO: 1033841 - protein, 24 aa, Mycobacterium
EAAHAAAFPCLVAVVPPAADPVSL

SEQ ID NO: 1033842 - protein, 23 aa, Mycobacterium
EAAKGVAMPLRLTSPAPCTNCHG

SEQ ID NO: 1033843 - protein, 25 aa, Mycobacterium
EAALERLRSRPVFEDASARAEGYVD

SEQ ID NO: 1033844 - protein, 25 aa, Mycobacterium
EAATFGVAYLTAWHCLCEVGRLSPG

SEQ ID NO: 1033845 - protein, 18 aa, Mycobacterium
EACALPEVMTAVRDEWIA

SEQ ID NO: 1033846 - protein, 19 aa, Mycobacterium
EACRDELIEVVRLLEQGGL

SEQ ID NO: 1033847 - protein, 22 aa, Mycobacterium
EADGRRPRILVAKMGQDGHDRG

SEQ ID NO: 1033848 - protein, 17 aa, Mycobacterium
EADLRLLDDLQMPIKAL

SEQ ID NO: 1033849 - protein, 20 aa, Mycobacterium
EADVLWDLASRLEGRMAAIG

SEQ ID NO: 1033850 - protein, 19 aa, Mycobacterium
EAGLCRKCYSEYKNRDIGS

SEQ ID NO: 1033851 - protein, 23 aa, Mycobacterium
EAGSKVKVTIMFRGREQSRPELG

SEQ ID NO: 1033852 - protein, 19 aa, Mycobacterium
EAGVDCFVAGSAVYGAADP

SEQ ID NO: 1033853 - protein, 25 aa, Mycobacterium
EAGVVRLRFGLTDGQPRTLDEIGQV

SEQ ID NO: 1033854 - protein, 19 aa, Mycobacterium
EAIAARGAVPVVVGGSMLY

SEQ ID NO: 1033855 - protein, 17 aa, Mycobacterium
EAIAHAWQQIVLGEADS

SEQ ID NO: 1033856 - protein, 19 aa, Mycobacterium
EAIARGIGVVGLLNVQYAL

SEQ ID NO: 1033857 - protein, 18 aa, Mycobacterium
EAIFCVASDDFTLDRIVP

SEQ ID NO: 1033858 - protein, 20 aa, Mycobacterium
EAISEFASQRWQWHDLDVSR

SEQ ID NO: 1033859 - protein, 20 aa, Mycobacterium
EAKIKLADMRSGRMTDDDWT

SEQ ID NO: 1033860 - protein, 19 aa, Mycobacterium
EALAYRLLLEGNWISFEHR

SEQ ID NO: 1033861 - protein, 17 aa, Mycobacterium
EALHPYKGLVIATKAGL

SEQ ID NO: 1033862 - protein, 18 aa, Mycobacterium
EALIKLEVPVQVAGQDFD

SEQ ID NO: 1033863 - protein, 19 aa, Mycobacterium
EALLHPATWWADVVTDDFA

SEQ ID NO: 1033864 - protein, 20 aa, Mycobacterium
EALRAAKTEPLGILPRPNEL

SEQ ID NO: 1033865 - protein, 17 aa, Mycobacterium
EALRRINEGAAMIRSKG

SEQ ID NO: 1033866 - protein, 25 aa, Mycobacterium
EAMRQAAVYRLAWVVLCGCPESSVR

SEQ ID NO: 1033867 - protein, 20 aa, Mycobacterium
EAMRRACGSTVRPLLAGPDR

SEQ ID NO: 1033868 - protein, 17 aa, Mycobacterium
EAPSHFDSGAAAGPKVA

SEQ ID NO: 1033869 - protein, 20 aa, Mycobacterium
EARGRSVLNVVDYFVPQEDQ

SEQ ID NO: 1033870 - protein, 28 aa, Mycobacterium
EARGVPMTAGCVVPRGDVLELIDDIKDA

SEQ ID NO: 1033871 - protein, 20 aa, Mycobacterium
EARLTPLAMEMLREIDEETV

SEQ ID NO: 1033872 - protein, 18 aa, Mycobacterium
EATARLAVEQGKAALEVN

SEQ ID NO: 1033873 - protein, 20 aa, Mycobacterium
EATVAFGRGECFVERYLDKP

SEQ ID NO: 1033874 - protein, 21 aa, Mycobacterium
EAVAACGPAGVPVIADGGLQY

SEQ ID NO: 1033875 - protein, 20 aa, Mycobacterium
EAVARLGRHQFPLVTTDTVV

SEQ ID NO: 1033876 - protein, 25 aa, Mycobacterium
EAVEAEIPLLVIITEGIPVQDSVYA

SEQ ID NO: 1033877 - protein, 30 aa, Mycobacterium
EAVGACSRGLMPRADVDAIERAICPGEGAC

SEQ ID NO: 1033878 - protein, 22 aa, Mycobacterium
EAVLPFNRLRRADGAAIDSLLG

SEQ ID NO: 1033879 - protein, 21 aa, Mycobacterium
EAVSGMNAVAGWSGAPRPVQA

SEQ ID NO: 1033880 - protein, 20 aa, Mycobacterium
EAWNALSPARVFAFSTLANT

SEQ ID NO: 1033881 - protein, 25 aa, Mycobacterium
EAYVIAYLPYLGWLRQASVDSAVMA

SEQ ID NO: 1033882 - protein, 20 aa, Mycobacterium
ECAWRHAGYPPAQGPARRAQ

SEQ ID NO: 1033883 - protein, 17 aa, Mycobacterium
ECGCSTSALYLAGEGAF

SEQ ID NO: 1033884 - protein, 27 aa, Mycobacterium
ECHGLQCGFCTPGFVISLTALLRDSYE

SEQ ID NO: 1033885 - protein, 20 aa, Mycobacterium
ECLRAGVPATALYVALGTEV

SEQ ID NO: 1033886 - protein, 21 aa, Mycobacterium
EDAAVALLEWLQTTHPESKVS

SEQ ID NO: 1033887 - protein, 18 aa, Mycobacterium
EDAIARAYARFDNYRHTT

SEQ ID NO: 1033888 - protein, 21 aa, Mycobacterium
EDCHFCSQSGLFMSPVRSAWL

SEQ ID NO: 1033889 - protein, 23 aa, Mycobacterium
EDCKSLTFALRFRAPDRTLTEDD

SEQ ID NO: 1033890 - protein, 24 aa, Mycobacterium
EDDTTWRVEIERAHMEEDTGKLTH

SEQ ID NO: 1033891 - protein, 19 aa, Mycobacterium
EDEEFRVGVLPTLRAARII

SEQ ID NO: 1033892 - protein, 25 aa, Mycobacterium
EDGLRVICRRSQLMSRVAGSGAMAS

SEQ ID NO: 1033893 - protein, 23 aa, Mycobacterium
EDGRVFTGMPFGAIGQTLGEAVF

SEQ ID NO: 1033894 - protein, 24 aa, Mycobacterium
EDIDIPTLVPVSVTALREVATDED

SEQ ID NO: 1033895 - protein, 22 aa, Mycobacterium
EDIPALKRRSGVDVLAVPATGL

SEQ ID NO: 1033896 - protein, 22 aa, Mycobacterium
EDPDFASSCYVNAQKLSSRHTV

SEQ ID NO: 1033897 - protein, 21 aa, Mycobacterium
EDPRFRFFGNVIVGKHIEPAE

SEQ ID NO: 1033898 - protein, 25 aa, Mycobacterium
EDQVVYRACLRRAPRLQRRTASAVS

SEQ ID NO: 1033899 - protein, 18 aa, Mycobacterium
EEHERGVVMLGGVVPIVP

SEQ ID NO: 1033900 - protein, 17 aa, Mycobacterium
EEINRYLTRFLKQVHGP

SEQ ID NO: 1033901 - protein, 18 aa, Mycobacterium
EELAWFLSGLVPPTNPTT

SEQ ID NO: 1033902 - protein, 20 aa, Mycobacterium
EELDRRLDVLAMAKVKPADS

SEQ ID NO: 1033903 - protein, 19 aa, Mycobacterium
EELGRSASRLSLDETVATM

SEQ ID NO: 1033904 - protein, 22 aa, Mycobacterium
EENACLPVLIAALGKITGTDTG

SEQ ID NO: 1033905 - protein, 17 aa, Mycobacterium
EENRVLIGRIVELLVTT

SEQ ID NO: 1033906 - protein, 21 aa, Mycobacterium
EERIVCLAEPLVAENLLDGVP

SEQ ID NO: 1033907 - protein, 31 aa, Mycobacterium
EESALFAADLARMYIRYAERHGWTVTVLDET

SEQ ID NO: 1033908 - protein, 17 aa, Mycobacterium
EESENRQSAGPVVAGHN

SEQ ID NO: 1033909 - protein, 18 aa, Mycobacterium
EESRRFDAGLVLTSVGYR

SEQ ID NO: 1033910 - protein, 26 aa, Mycobacterium
EETLKLPRTVLMCPMTLASQVAHIVM

SEQ ID NO: 1033911 - protein, 26 aa, Mycobacterium
EETRLSELSALSWVVYSLPGVPLFDH

SEQ ID NO: 1033912 - protein, 21 aa, Mycobacterium
EEVLRLEGLEVIRSVRPLAPA

SEQ ID NO: 1033913 - protein, 22 aa, Mycobacterium
EEVPPGFSHCLLLSEAKVVAAG

SEQ ID NO: 1033914 - protein, 24 aa, Mycobacterium
EEVREYMAQLGFRTFNEAVGQVGA

SEQ ID NO: 1033915 - protein, 20 aa, Mycobacterium
EEYCRQCLGLDTALGPIDRS

SEQ ID NO: 1033916 - protein, 24 aa, Mycobacterium
EFALGSRFMFDWYLTDVVWHNSVR

SEQ ID NO: 1033917 - protein, 19 aa, Mycobacterium
EFDDAGAIGRRYRRQDEVG

SEQ ID NO: 1033918 - protein, 26 aa, Mycobacterium
EFDSRAVGPGGLFLALPGARSDGHDH

SEQ ID NO: 1033919 - protein, 17 aa, Mycobacterium
EFIPRPVKSSFREGLTV

SEQ ID NO: 1033920 - protein, 25 aa, Mycobacterium
EFLARLCKTAMWIDHGVIELSGGIE

SEQ ID NO: 1033921 - protein, 20 aa, Mycobacterium
EFPTDRGWDVDGLFDPDPDA

SEQ ID NO: 1033922 - protein, 22 aa, Mycobacterium
EFRIYELVWRRTVASQMADARG

SEQ ID NO: 1033923 - protein, 17 aa, Mycobacterium
EGADVVQIFLGNPQSWK

SEQ ID NO: 1033924 - protein, 18 aa, Mycobacterium
EGAVAPWSAGRTAEYFTR

SEQ ID NO: 1033925 - protein, 26 aa, Mycobacterium
EGEAMLFGEYIRLMALVEYSADEIKT

SEQ ID NO: 1033926 - protein, 23 aa, Mycobacterium
EGESAAALAERVTPYEKWLTQNA

SEQ ID NO: 1033927 - protein, 20 aa, Mycobacterium
EGFHAVTVRRIRPGEELVLG

SEQ ID NO: 1033928 - protein, 29 aa, Mycobacterium
EGFMRNIPCPVCQGTRLKPEILAVTLAAG

SEQ ID NO: 1033929 - protein, 21 aa, Mycobacterium
EGGPRPNHFDGVLTVVLKLLQ

SEQ ID NO: 1033930 - protein, 24 aa, Mycobacterium
EGIIAAAAIRCMGGAIQAQLAPRD

SEQ ID NO: 1033931 - protein, 17 aa, Mycobacterium
EGKRTRWTAVWAPLEEI

SEQ ID NO: 1033932 - protein, 25 aa, Mycobacterium
EGKSRIFAMAAQTAVEWSEASHRGG

SEQ ID NO: 1033933 - protein, 20 aa, Mycobacterium
EGLGEIFITAGAQWRQPGCS

SEQ ID NO: 1033934 - protein, 21 aa, Mycobacterium
EGLPGRRYYDGCEHVDVVENI

SEQ ID NO: 1033935 - protein, 23 aa, Mycobacterium
EGPLPQTRFVLRKTLAAHLPVIL

SEQ ID NO: 1033936 - protein, 25 aa, Mycobacterium
EGPSYTRPPTWRGLDVPPVLLSGDH

SEQ ID NO: 1033937 - protein, 20 aa, Mycobacterium
EGPWLRTGDLGVMSDGELFI

SEQ ID NO: 1033938 - protein, 20 aa, Mycobacterium
EGPWLRTGDSGFVIDGKMFI

SEQ ID NO: 1033939 - protein, 18 aa, Mycobacterium
EGRVLRFDECGEIITDVA

SEQ ID NO: 1033940 - protein, 23 aa, Mycobacterium
EGSFPDFPLPLGDPLEPTQADIV

SEQ ID NO: 1033941 - protein, 18 aa, Mycobacterium
EGSVATELISYGSPDASA

SEQ ID NO: 1033942 - protein, 17 aa, Mycobacterium
EGSYRLVPKGSTTEVTY

SEQ ID NO: 1033943 - protein, 21 aa, Mycobacterium
EGVEIRYYLVIYQAIDDIEKA

SEQ ID NO: 1033944 - protein, 21 aa, Mycobacterium
EGWCPYCGSPYSFLPQLSPGD

SEQ ID NO: 1033945 - protein, 24 aa, Mycobacterium
EGWDQRAPIGWNMKDPTPVAKTVC

SEQ ID NO: 1033946 - protein, 19 aa, Mycobacterium
EHALALLLAASRQIAEADA

SEQ ID NO: 1033947 - protein, 19 aa, Mycobacterium
EHANRLSVLMITYPSTHGV

SEQ ID NO: 1033948 - protein, 25 aa, Mycobacterium
EHGEIPLGIYCRASLAQFMDAERLF

SEQ ID NO: 1033949 - protein, 21 aa, Mycobacterium
EHKFYRTVWHTNDGVVSAAFG

SEQ ID NO: 1033950 - protein, 25 aa, Mycobacterium
EHLAALRAIPRLSVVRPADANETAY

SEQ ID NO: 1033951 - protein, 20 aa, Mycobacterium
EHLERMFSLDNAFSGDELNA

SEQ ID NO: 1033952 - protein, 25 aa, Mycobacterium
EHNTRFKRLFVVTPKGARQAKPIDA

SEQ ID NO: 1033953 - protein, 21 aa, Mycobacterium
EHPFDLLAWARFRVTVNTDNR

SEQ ID NO: 1033954 - protein, 19 aa, Mycobacterium
EHRFRAGSVARVATAIPSP

SEQ ID NO: 1033955 - protein, 23 aa, Mycobacterium
EHRRFRFFLNVEIGRHLSHDELL

SEQ ID NO: 1033956 - protein, 21 aa, Mycobacterium
EIAESDLLLERWRVLFEPIML

SEQ ID NO: 1033957 - protein, 18 aa, Mycobacterium
EIAFKIAGSQVLKKAAAQ

SEQ ID NO: 1033958 - protein, 26 aa, Mycobacterium
EIARLQRRLGATTVYVTHDQTEAMTL

SEQ ID NO: 1033959 - protein, 25 aa, Mycobacterium
EIASHNKLLGSFELTGIPPAPRGVP

SEQ ID NO: 1033960 - protein, 26 aa, Mycobacterium
EIATRLRELFSWVVPMLGPMVQDIHV

SEQ ID NO: 1033961 - protein, 25 aa, Mycobacterium
EIDKVFVVACGTAYHSGLLAKYTIE

SEQ ID NO: 1033962 - protein, 18 aa, Mycobacterium
EIEALYYLHPLTGEVIRQ

SEQ ID NO: 1033963 - protein, 31 aa, Mycobacterium
EIHDRMPLILAEYDWDVWLNPYIPLDPQLLA

SEQ ID NO: 1033964 - protein, 21 aa, Mycobacterium
EILREVVPPDAGVIIRTASEG

SEQ ID NO: 1033965 - protein, 27 aa, Mycobacterium
EILTELWMLIGYHIPAPIPRISYADAM

SEQ ID NO: 1033966 - protein, 21 aa, Mycobacterium
EILTRYLNLVSFGNNSFGVQD

SEQ ID NO: 1033967 - protein, 17 aa, Mycobacterium
EIMGRSYGGGILELEPR

SEQ ID NO: 1033968 - protein, 22 aa, Mycobacterium
EISMRTVAVFAHRLYGGITSGH

SEQ ID NO: 1033969 - protein, 25 aa, Mycobacterium
EISSGTYRFVYRKRFNKKCETALTV

SEQ ID NO: 1033970 - protein, 30 aa, Mycobacterium
EKADDPLAMYLFDLCTLPLNLAGHCGMSVP

SEQ ID NO: 1033971 - protein, 23 aa, Mycobacterium
EKAPKDRDIAMVFQSYALYPHMT

SEQ ID NO: 1033972 - protein, 24 aa, Mycobacterium
EKPAKARKCVFCAKKNQQIDYKDT

SEQ ID NO: 1033973 - protein, 23 aa, Mycobacterium
EKQARVALLDHIDIPPSQVHPMP

SEQ ID NO: 1033974 - protein, 36 aa, Mycobacterium; identical to SEQ ID NO: 87794

SEQ ID NO: 1033975 - protein, 18 aa, Mycobacterium
EKVKATGHQVIWQCDPMH

SEQ ID NO: 1033976 - protein, 17 aa, Mycobacterium
EKVQAAGHQVIWQCDPM

SEQ ID NO: 1033977 - protein, 18 aa, Mycobacterium
ELAAKLQSDFGVAPGHVF

SEQ ID NO: 1033978 - protein, 17 aa, Mycobacterium
ELAALDLGAPVHLDRVQ

SEQ ID NO: 1033979 - protein, 18 aa, Mycobacterium
ELAGLWRAGFIMAPTHTR

SEQ ID NO: 1033980 - protein, 19 aa, Mycobacterium
ELAIKTGRPLIGINDGAGA

SEQ ID NO: 1033981 - protein, 17 aa, Mycobacterium
ELAKALADFLFDDQRAM

SEQ ID NO: 1033982 - protein, 20 aa, Mycobacterium
ELAKLGGPVDRDEWFMTPQT

SEQ ID NO: 1033983 - protein, 22 aa, Mycobacterium
ELALPMRLALPGSVNRGNAAQA

SEQ ID NO: 1033984 - protein, 26 aa, Mycobacterium
ELARRIGATLRWYGVTDDGQIDLDSL

SEQ ID NO: 1033985 - protein, 18 aa, Mycobacterium
ELASVLGAAGQLFATGMP

SEQ ID NO: 1033986 - protein, 20 aa, Mycobacterium
ELAVRTGGVTGRRVCAVVGS

SEQ ID NO: 1033987 - protein, 19 aa, Mycobacterium
ELDEFATLAGWYGATLRIT

SEQ ID NO: 1033988 - protein, 24 aa, Mycobacterium
ELDNLRSAFAWSRETGDIAGALQL

SEQ ID NO: 1033989 - protein, 23 aa, Mycobacterium
ELDSWRYQVTWLSSPATPSSITL

SEQ ID NO: 1033990 - protein, 20 aa, Mycobacterium
ELEPVFLAEAGFSLHDVLAN

SEQ ID NO: 1033991 - protein, 20 aa, Mycobacterium
ELEPVFVVHAGFSLHDVLAN

SEQ ID NO: 1033992 - protein, 22 aa, Mycobacterium
ELEQRIAEFLGFTKVLASVGQV

SEQ ID NO: 1033993 - protein, 24 aa, Mycobacterium
ELESRAAQLVACWGNNDGPELRSR

SEQ ID NO: 1033994 - protein, 23 aa, Mycobacterium
ELHAPYELVIEVARTNKLPVTLF

SEQ ID NO: 1033995 - protein, 22 aa, Mycobacterium
ELIARCVFALVGLDPSTGIIHA

SEQ ID NO: 1033996 - protein, 19 aa, Mycobacterium
ELIGPDVTREWIKDLPPYE

SEQ ID NO: 1033997 - protein, 26 aa, Mycobacterium
ELKARAEALARAFIDQGITFSLSGQE

SEQ ID NO: 1033998 - protein, 25 aa, Mycobacterium
ELKLDRKIAERRVFPAVDVNPSGTR

SEQ ID NO: 1033999 - protein, 20 aa, Mycobacterium
ELKRATEGYWAKRTSRSELE

SEQ ID NO: 1034000 - protein, 21 aa, Mycobacterium
ELLEFPGGILGVALNLDEHNV

SEQ ID NO: 1034001 - protein, 18 aa, Mycobacterium
ELLGGKGYNINAMRRHQL

SEQ ID NO: 1034002 - protein, 21 aa, Mycobacterium
ELLGIPWIELNPHPLYLPSKG

SEQ ID NO: 1034003 - protein, 18 aa, Mycobacterium
ELLGRGDTLGVFQLDGGP

SEQ ID NO: 1034004 - protein, 18 aa, Mycobacterium
ELLRFGKTLMAIWRTIQF

SEQ ID NO: 1034005 - protein, 30 aa, Mycobacterium
ELLRQLRLGDYDVLVGINLLREGLDLPEVS

SEQ ID NO: 1034006 - protein, 20 aa, Mycobacterium
ELLTALPFAPGYGVEIGLLV

SEQ ID NO: 1034007 - protein, 25 aa, Mycobacterium
ELLVIPGPHDDWFIDPDVLVHTDWV

SEQ ID NO: 1034008 - protein, 18 aa, Mycobacterium
ELMINLFWHGLKGAPADR

SEQ ID NO: 1034009 - protein, 19 aa, Mycobacterium
ELNPSTGVELLIPDFNGQP

SEQ ID NO: 1034010 - protein, 18 aa, Mycobacterium
ELNVMGAMQLFAACQKAP

SEQ ID NO: 1034011 - protein, 19 aa, Mycobacterium
ELPGRFVYEDDDVVAFLTI

SEQ ID NO: 1034012 - protein, 20 aa, Mycobacterium
ELPKGWVITTSGRVSGVTEP

SEQ ID NO: 1034013 - protein, 24 aa, Mycobacterium
ELQFGTNHLGHFAFTGLLLDRLLP

SEQ ID NO: 1034014 - protein, 22 aa, Mycobacterium
ELQPMWRRAVMTAATREAIADR

SEQ ID NO: 1034015 - protein, 23 aa, Mycobacterium
ELQRLGRPVFGPTFEVDIDSDLR

SEQ ID NO: 1034016 - protein, 19 aa, Mycobacterium
ELRLLVAAMGYRRLLVTVI

SEQ ID NO: 1034017 - protein, 20 aa, Mycobacterium
ELRPIASMPGVVQHTRDSLR

SEQ ID NO: 1034018 - protein, 25 aa, Mycobacterium
ELRPRKLREAAVLWERLTQAAGVDA

SEQ ID NO: 1034019 - protein, 25 aa, Mycobacterium
ELRPRMLLRTIEFLWQEGHSAHIEK

SEQ ID NO: 1034020 - protein, 23 aa, Mycobacterium
ELRRLPVGIVVNGVLTRSVRDTA

SEQ ID NO: 1034021 - protein, 27 aa, Mycobacterium
ELRSLRARFGTLIGVDRPVALGDFVSI

SEQ ID NO: 1034022 - protein, 17 aa, Mycobacterium
ELSAAGVLELVWTTGLI

SEQ ID NO: 1034023 - protein, 26 aa, Mycobacterium
ELSRDELLEALLIDAQHAYAAREAEL

SEQ ID NO: 1034024 - protein, 24 aa, Mycobacterium
ELTEAIKLVALVADRGAQVRMEFG

SEQ ID NO: 1034025 - protein, 18 aa, Mycobacterium
ELTGLALQRIYLDRVAKL

SEQ ID NO: 1034026 - protein, 22 aa, Mycobacterium
ELTRTLPALIAPIFSVAELFLT

SEQ ID NO: 1034027 - protein, 28 aa, Mycobacterium
ELVEHFILEGWWGRWLGRWTAEEHLHAI

SEQ ID NO: 1034028 - protein, 24 aa, Mycobacterium
ELVGIYCTLLSLLAENGARWVQFD

SEQ ID NO: 1034029 - protein, 18 aa, Mycobacterium
ELVLPFSWQSFSLHATGA

SEQ ID NO: 1034030 - protein, 17 aa, Mycobacterium
ELVPRYLDNDAIAVIEG

SEQ ID NO: 1034031 - protein, 18 aa, Mycobacterium
ELWFGAHPGDSVWLQAAN

SEQ ID NO: 1034032 - protein, 25 aa, Mycobacterium
EMALAKFWFSEMVCRIVYELIQTRG

SEQ ID NO: 1034033 - protein, 22 aa, Mycobacterium
EMAVRYEMQRQGAILVSGGRIA

SEQ ID NO: 1034034 - protein, 19 aa, Mycobacterium
EMHSRSGLINEVESSIVDL

SEQ ID NO: 1034035 - protein, 26 aa, Mycobacterium
EMLDLGFFPDIERLLGQIPTDRQSML

SEQ ID NO: 1034036 - protein, 18 aa, Mycobacterium
EMSARRPGNIAALAAIAP

SEQ ID NO: 1034037 - protein, 24 aa, Mycobacterium
EMVRRMGSGLVHLHLCDGSGLPAD

SEQ ID NO: 1034038 - protein, 24 aa, Mycobacterium
ENDLKGGVNERQFGYVRLLNEDLL

SEQ ID NO: 1034039 - protein, 19 aa, Mycobacterium
ENIKRQWWRSVVTGREDVV

SEQ ID NO: 1034040 - protein, 19 aa, Mycobacterium
ENIREVHRADLIGQHIGET

SEQ ID NO: 1034041 - protein, 20 aa, Mycobacterium
ENITKAWGPARVVIAAEQAN

SEQ ID NO: 1034042 - protein, 21 aa, Mycobacterium
ENLRYTVRFAAAVQAALKDGF

SEQ ID NO: 1034043 - protein, 18 aa, Mycobacterium
ENMFPFRADRFFGADQSR

SEQ ID NO: 1034044 - protein, 17 aa, Mycobacterium
ENRLHAQKALLVWLLER

SEQ ID NO: 1034045 - protein, 26 aa, Mycobacterium
ENRRLAQQVEWAWQMVRDAVLDRVLS

SEQ ID NO: 1034046 - protein, 25 aa, Mycobacterium
ENTTARCELVGLTLNLPTSEQAAAE

SEQ ID NO: 1034047 - protein, 25 aa, Mycobacterium
ENVDAFLAVCRKWEVLATVIGEVTD

SEQ ID NO: 1034048 - protein, 26 aa, Mycobacterium
ENWPRVRISGRLVRNVMAVWQRLHFG

SEQ ID NO: 1034049 - protein, 25 aa, Mycobacterium
EPALAERLVEFFGGIPILDGIGSSE

SEQ ID NO: 1034050 - protein, 22 aa, Mycobacterium
EPCTECRGSGSIIEHPCEECKG

SEQ ID NO: 1034051 - protein, 24 aa, Mycobacterium
EPCTMCAGALVLARIERLVFGAWQ

SEQ ID NO: 1034052 - protein, 26 aa, Mycobacterium
EPELSRTAAVWHLCTPISGRLRDTSI

SEQ ID NO: 1034053 - protein, 19 aa, Mycobacterium
EPGGFGFAGNGGAGCLSGL

SEQ ID NO: 1034054 - protein, 18 aa, Mycobacterium
EPGMTLLDIGCGWGATMK

SEQ ID NO: 1034055 - protein, 20 aa, Mycobacterium
EPHRNVCLIPSSAHGTNAAS

SEQ ID NO: 1034056 - protein, 19 aa, Mycobacterium
EPHRVCRYLEDLAGDYHRF

SEQ ID NO: 1034057 - protein, 17 aa, Mycobacterium
EPIARVLPMLSVPHLDR

SEQ ID NO: 1034058 - protein, 32 aa, Mycobacterium
EPKVPYYSATLWDPRERPSFTGEYWAENLRYT

SEQ ID NO: 1034059 - protein, 20 aa, Mycobacterium
EPKVSVWDLAALDIVVREAG

SEQ ID NO: 1034060 - protein, 24 aa, Mycobacterium
EPLAFASLDRWSGTVSDYLNTMFD

SEQ ID NO: 1034061 - protein, 24 aa, Mycobacterium
EPLLGVASLDKWVIYVPLEHVAAV

SEQ ID NO: 1034062 - protein, 17 aa, Mycobacterium
EPLQWVAQSSVFRLWSW

SEQ ID NO: 1034063 - protein, 25 aa, Mycobacterium
EPLRLLFKDEVRAVGRQLDLPEEIV

SEQ ID NO: 1034064 - protein, 23 aa, Mycobacterium
EPMIPIYIFYSMFGFQRTGDGLW

SEQ ID NO: 1034065 - protein, 20 aa, Mycobacterium
EPPRPLTHDLIRDVIAALGH

SEQ ID NO: 1034066 - protein, 18 aa, Mycobacterium
EPPRRSWPRPTGSDRTTR

SEQ ID NO: 1034067 - protein, 25 aa, Mycobacterium
EPPRTADMRVLFDAIINDDPLPLEN

SEQ ID NO: 1034068 - protein, 22 aa, Mycobacterium
EPRAYPELFLAQRDSIFDYVYE

SEQ ID NO: 1034069 - protein, 26 aa, Mycobacterium
EPRESDIWLLGAIGPRMVYSTNLDAA

SEQ ID NO: 1034070 - protein, 22 aa, Mycobacterium
EPRGYGGFGYDSIFIPDGPGLG

SEQ ID NO: 1034071 - protein, 20 aa, Mycobacterium
EPRLADLDYGRCHEQAIEYI

SEQ ID NO: 1034072 - protein, 22 aa, Mycobacterium
EPSDFRLWMCLHEVTHWIQFTA

SEQ ID NO: 1034073 - protein, 20 aa, Mycobacterium
EPTFRRSVIYIVEHNEGGTL

SEQ ID NO: 1034074 - protein, 20 aa, Mycobacterium
EPWLVDWLLHLSWASITSPT

SEQ ID NO: 1034075 - protein, 19 aa, Mycobacterium
EPYGVEWTKPVARFQEALA

SEQ ID NO: 1034076 - protein, 18 aa, Mycobacterium
EQELPFGLRGFIADVHSA

SEQ ID NO: 1034077 - protein, 18 aa, Mycobacterium
EQEVGVFIDLAEQERTRH

SEQ ID NO: 1034078 - protein, 19 aa, Mycobacterium
EQFDGRFAIQHVSLPRSPD

SEQ ID NO: 1034079 - protein, 17 aa, Mycobacterium
EQIGALVGEGMNKVGTD

SEQ ID NO: 1034080 - protein, 18 aa, Mycobacterium
EQLKLISAAVEFTATADI

SEQ ID NO: 1034081 - protein, 23 aa, Mycobacterium
EQLQCRTSMKWRAHPEDVLPLWV

SEQ ID NO: 1034082 - protein, 26 aa, Mycobacterium
EQMATHWGNWAKIFFNNKGVVAKATE

SEQ ID NO: 1034083 - protein, 28 aa, Mycobacterium
EQPPTAFPQWFGRSWRRSAILRYGENPH

SEQ ID NO: 1034084 - protein, 20 aa, Mycobacterium
EQRGAAALELPGRPRLSRKV

SEQ ID NO: 1034085 - protein, 30 aa, Mycobacterium
EQRLKVVLDDIKFSAGQIITFIDELHTIVG

SEQ ID NO: 1034086 - protein, 22 aa, Mycobacterium
EQRTNWLNNFYFGGNHGVSDSI

SEQ ID NO: 1034087 - protein, 17 aa, Mycobacterium
EQRYCGAPDQLLTAVLF

SEQ ID NO: 1034088 - protein, 18 aa, Mycobacterium
EQYISVGVGRDYTDVAPL

SEQ ID NO: 1034089 - protein, 30 aa, Mycobacterium
ERAGTRVVRAHVPLSEMFGYVGDLRSKTQG

SEQ ID NO: 1034090 - protein, 17 aa, Mycobacterium
ERAMEFCSFDECVEVTP

SEQ ID NO: 1034091 - protein, 20 aa, Mycobacterium
ERDSRLVLETTVERPHYMPL

SEQ ID NO: 1034092 - protein, 17 aa, Mycobacterium
EREAGVVRLRFGLTDGQ

SEQ ID NO: 1034093 - protein, 29 aa, Mycobacterium
EREGVNLTFLPFIAKAAIDALKIHPNINA

SEQ ID NO: 1034094 - protein, 17 aa, Mycobacterium
ERIRRLLDEFAQDVRTV

SEQ ID NO: 1034095 - protein, 32 aa, Mycobacterium
ERITFYRALYRDHARYGAALWVVAANMASYSD

SEQ ID NO: 1034096 - protein, 25 aa, Mycobacterium
ERLDMVIGGAVLKHSRDFNLMRECV

SEQ ID NO: 1034097 - protein, 25 aa, Mycobacterium
ERLETICRLIMLYHLDRGWADHLAY

SEQ ID NO: 1034098 - protein, 22 aa, Mycobacterium
ERLIAGLEWVFAAAGGPPKVLR

SEQ ID NO: 1034099 - protein, 18 aa, Mycobacterium
ERLSWMCRRVPDGGYSLQ

SEQ ID NO: 1034100 - protein, 25 aa, Mycobacterium
ERNNCPLRTFPALSRALKLDEHRST

SEQ ID NO: 1034101 - protein, 24 aa, Mycobacterium
ERPFPLDLVPRVISASEWSRLERG

SEQ ID NO: 1034102 - protein, 19 aa, Mycobacterium
ERPGRKVGHINFRGTDKDR

SEQ ID NO: 1034103 - protein, 18 aa, Mycobacterium
ERRFANRRVDAIQDGMLL

SEQ ID NO: 1034104 - protein, 27 aa, Mycobacterium
ERRSEPWFDPAGLFLAFGDSSSNQPGK

SEQ ID NO: 1034105 - protein, 27 aa, Mycobacterium
ERRYRTWIRWNAAIMVHRAQRPGVGVG

SEQ ID NO: 1034106 - protein, 17 aa, Mycobacterium
ERSRAMLTPTSDRITMP

SEQ ID NO: 1034107 - protein, 22 aa, Mycobacterium
ERSSHTWFVLTHLLGKPGVRNY

SEQ ID NO: 1034108 - protein, 22 aa, Mycobacterium
ERTAGGSGRIEICVDAMTEGTR

SEQ ID NO: 1034109 - protein, 18 aa, Mycobacterium
ERVCRLLRTPSVDPPLDV

SEQ ID NO: 1034110 - protein, 26 aa, Mycobacterium
ERVKGPDFPTAGLIVGSQGIADAYKT

SEQ ID NO: 1034111 - protein, 26 aa, Mycobacterium
ERVLVHPRPRLSIMAVGGELVDISRT

SEQ ID NO: 1034112 - protein, 19 aa, Mycobacterium
ERYSPRSVSALSFEPARHR

SEQ ID NO: 1034113 - protein, 18 aa, Mycobacterium
ERYVREWLGDMTTGHVVD

SEQ ID NO: 1034114 - protein, 21 aa, Mycobacterium
ESAAALAERVTPYEKWLTQNA

SEQ ID NO: 1034115 - protein, 17 aa, Mycobacterium
ESACAELVSLLVGAVSG

SEQ ID NO: 1034116 - protein, 18 aa, Mycobacterium
ESCTAGLLAARLTERPGS

SEQ ID NO: 1034117 - protein, 26 aa, Mycobacterium
ESDPLRGGMRLGLIPTVAPYVLPTML

SEQ ID NO: 1034118 - protein, 20 aa, Mycobacterium
ESFADFLSGFHIVDQHFQNA

SEQ ID NO: 1034119 - protein, 17 aa, Mycobacterium
ESFPVCEFFISLTSKHI

SEQ ID NO: 1034120 - protein, 24 aa, Mycobacterium
ESGTVGRWLAKHADDGRRSGLAIV

SEQ ID NO: 1034121 - protein, 17 aa, Mycobacterium
ESIFTNLLLAKKILAEH

SEQ ID NO: 1034122 - protein, 24 aa, Mycobacterium
ESKEKTGVFLGRYATNPATGKPVP

SEQ ID NO: 1034123 - protein, 25 aa, Mycobacterium
ESLAGLKPAFRCGGTITPGSASQIS

SEQ ID NO: 1034124 - protein, 21 aa, Mycobacterium
ESLAYKMWLPPLLDPLPLNEL

SEQ ID NO: 1034125 - protein, 17 aa, Mycobacterium
ESMARPSKIVIVADIPR

SEQ ID NO: 1034126 - protein, 24 aa, Mycobacterium
ESNAPVLLGLIGLWYSDFLGAQSR

SEQ ID NO: 1034127 - protein, 22 aa, Mycobacterium
ESRADGPLVLRNRALLELLYST

SEQ ID NO: 1034128 - protein, 20 aa, Mycobacterium
ESSLPFRQCRTVLRCACLGV

SEQ ID NO: 1034129 - protein, 17 aa, Mycobacterium
ESSRRAVSVYSRGDQSH

SEQ ID NO: 1034130 - protein, 24 aa, Mycobacterium
ESTEILQRWKRGVMSTVGDISAHN

SEQ ID NO: 1034131 - protein, 20 aa, Mycobacterium
ESVAVLRAAARLSTSGIPVD

SEQ ID NO: 1034132 - protein, 18 aa, Mycobacterium
ESVDLLLTSRRGMAADGA

SEQ ID NO: 1034133 - protein, 19 aa, Mycobacterium
ESVYRLRLALPQLDFAALT

SEQ ID NO: 1034134 - protein, 28 aa, Mycobacterium
ESWSLAIALRLAAYELLRADGNEPVLLL

SEQ ID NO: 1034135 - protein, 20 aa, Mycobacterium
ETALARQVAYLAYFRSSSKA

SEQ ID NO: 1034136 - protein, 17 aa, Mycobacterium
ETAYAWRTILARGANSG

SEQ ID NO: 1034137 - protein, 30 aa, Mycobacterium
ETCIGWTCPRWPARSFLSSTCTPRTKCASL

SEQ ID NO: 1034138 - protein, 24 aa, Mycobacterium
ETHFRIRAGPGMRIILADLTADEI

SEQ ID NO: 1034139 - protein, 17 aa, Mycobacterium
ETHSITLPESFKKSCRA

SEQ ID NO: 1034140 - protein, 24 aa, Mycobacterium
ETIGPRPTTPFAQALRLALIDAAP

SEQ ID NO: 1034141 - protein, 17 aa, Mycobacterium
ETIPEFLAALQTPRRVL

SEQ ID NO: 1034142 - protein, 24 aa, Mycobacterium
ETLNLANLPGYRVGGTIHIIVNNQ

SEQ ID NO: 1034143 - protein, 23 aa, Mycobacterium
ETLPRKEIASGMAEVVKAGFIAD

SEQ ID NO: 1034144 - protein, 19 aa, Mycobacterium
ETLTGFKWLARADANLPGT

SEQ ID NO: 1034145 - protein, 29 aa, Mycobacterium
ETMLTCSIRPSGIWGRGDQTMFRKAFESV

SEQ ID NO: 1034146 - protein, 26 aa, Mycobacterium
ETNRAWRLYRRLGFMDIIRRHYFAGD

SEQ ID NO: 1034147 - protein, 24 aa, Mycobacterium
ETNVEFWAAVILDFARVPANMMLV

SEQ ID NO: 1034148 - protein, 20 aa, Mycobacterium
ETPLRNCIMEATLNQLSVIV

SEQ ID NO: 1034149 - protein, 23 aa, Mycobacterium
ETSKRYMHHYNFPPFSTGETGRV

SEQ ID NO: 1034150 - protein, 23 aa, Mycobacterium
ETSLRETGFWRFVSDPYDPTESQ

SEQ ID NO: 1034151 - protein, 25 aa, Mycobacterium
ETTRGEAECAQWVASQLAEVGYQPE

SEQ ID NO: 1034152 - protein, 20 aa, Mycobacterium
ETTSRTAAYGGTVWVQDYQL

SEQ ID NO: 1034153 - protein, 20 aa, Mycobacterium
ETTVSCPIYTYIGDKDWIAT

SEQ ID NO: 1034154 - protein, 21 aa, Mycobacterium
ETYKNTALEVMNKMCALNQFR

SEQ ID NO: 1034155 - protein, 29 aa, Mycobacterium
EVALFALLRFWGVVPDYVIGHSVGELAAA

SEQ ID NO: 1034156 - protein, 25 aa, Mycobacterium
EVALSLPLGAGRLTREWLPDDPPGR

SEQ ID NO: 1034157 - protein, 21 aa, Mycobacterium
EVAPYCLGLSYVVFTDIDRWD

SEQ ID NO: 1034158 - protein, 19 aa, Mycobacterium
EVASLRKGQTVRLNEALTV

SEQ ID NO: 1034159 - protein, 19 aa, Mycobacterium
EVAVLKILALQFIMSDPRH

SEQ ID NO: 1034160 - protein, 17 aa, Mycobacterium
EVAWVCVGLGGVEAIHH

SEQ ID NO: 1034161 - protein, 20 aa, Mycobacterium
EVDMGVGVATDFCVSRTDQG

SEQ ID NO: 1034162 - protein, 19 aa, Mycobacterium
EVDPAAALKAELRSKPGDW

SEQ ID NO: 1034163 - protein, 23 aa, Mycobacterium
EVEINIACSLGMLTVEQVEQLSG

SEQ ID NO: 1034164 - protein, 24 aa, Mycobacterium
EVERWPDHPGRYFIVRAGSLVAWS

SEQ ID NO: 1034165 - protein, 24 aa, Mycobacterium
EVFARYEVFTSMTIQLRGVLDIDA

SEQ ID NO: 1034166 - protein, 25 aa, Mycobacterium
EVFEGLKAYRWADGSIVSFRPDANA

SEQ ID NO: 1034167 - protein, 17 aa, Mycobacterium
EVFGVNIGCELERGKVL

SEQ ID NO: 1034168 - protein, 21 aa, Mycobacterium
EVGAKLWVDMAHFAGLVAVGL

SEQ ID NO: 1034169 - protein, 21 aa, Mycobacterium
EVGKPERIVLVWPPTGNSCTS

SEQ ID NO: 1034170 - protein, 26 aa, Mycobacterium
EVGRLRRGQTLIGFLASRNADNWIGE

SEQ ID NO: 1034171 - protein, 24 aa, Mycobacterium
EVIADGPIALARLIPAGVDVRSNA

SEQ ID NO: 1034172 - protein, 27 aa, Mycobacterium
EVIEPRLSLQWWVRVESLAKAAGDAVR

SEQ ID NO: 1034173 - protein, 23 aa, Mycobacterium
EVIPDVLRHRLVLTYNALADEIS

SEQ ID NO: 1034174 - protein, 19 aa, Mycobacterium
EVIRRYGLLGRREAVHLAL

SEQ ID NO: 1034175 - protein, 17 aa, Mycobacterium
EVLVAMKRYRLDALVQE

SEQ ID NO: 1034176 - protein, 19 aa, Mycobacterium
EVLVPFVGAIVKLVSLDDG

SEQ ID NO: 1034177 - protein, 27 aa, Mycobacterium
EVPIDLRQDWPPALRSAGFDPSARTAW

SEQ ID NO: 1034178 - protein, 17 aa, Mycobacterium
EVPWRIERRRMYDKVVN

SEQ ID NO: 1034179 - protein, 19 aa, Mycobacterium
EVQTVLRWASANRVPVVAR

SEQ ID NO: 1034180 - protein, 21 aa, Mycobacterium
EVQVWDCAAGALIAAEAGACV

SEQ ID NO: 1034181 - protein, 22 aa, Mycobacterium
EVRKLWSTFMQKWISYTAAVID

SEQ ID NO: 1034182 - protein, 24 aa, Mycobacterium
EVSSRAYVSAFGFKGPDQQKLAGV

SEQ ID NO: 1034183 - protein, 23 aa, Mycobacterium
EVVARFCNREMVLDVELENKIAA

SEQ ID NO: 1034184 - protein, 19 aa, Mycobacterium
EVVGPVDAMVCERAHELGG

SEQ ID NO: 1034185 - protein, 28 aa, Mycobacterium
EVVPRGISFLLNRNRLNVAVSRAQYAAV

SEQ ID NO: 1034186 - protein, 27 aa, Mycobacterium
EVYDVFHIDRGYPLFVENLANLGAEIE

SEQ ID NO: 1034187 - protein, 20 aa, Mycobacterium
EVYDYLRLLYARAGTPHCPI

SEQ ID NO: 1034188 - protein, 35 aa, Mycobacterium; identical to SEQ ID NO: 198923

SEQ ID NO: 1034189 - protein, 20 aa, Mycobacterium
EWAKASLIGPEEYVAAVAAI

SEQ ID NO: 1034190 - protein, 26 aa, Mycobacterium
EWMLQARLKALRVFERKPMPRWGSNL

SEQ ID NO: 1034191 - protein, 20 aa, Mycobacterium
EWRHGAAVSVGLVFAAELAR

SEQ ID NO: 1034192 - protein, 24 aa, Mycobacterium
EWYTARLRPGPLRQAERRTVVVQN

SEQ ID NO: 1034193 - protein, 20 aa, Mycobacterium
EYAAVGFEYGYTVGNPDAVV

SEQ ID NO: 1034194 - protein, 26 aa, Mycobacterium
EYEVMSRLKPGIIMCREKQDSTSAVL

SEQ ID NO: 1034195 - protein, 19 aa, Mycobacterium
EYPDIFKQYLGTVIPAGDN

SEQ ID NO: 1034196 - protein, 20 aa, Mycobacterium
EYPDTAFSFAGAQAGITDAE

SEQ ID NO: 1034197 - protein, 25 aa, Mycobacterium
EYQRRLRTANALDFDDLIGETVGIL

SEQ ID NO: 1034198 - protein, 17 aa, Mycobacterium
EYRRCLNLLDDCDPAAR

SEQ ID NO: 1034199 - protein, 24 aa, Mycobacterium
EYSRRKHIEAGYQFVNTPHITKAQ

SEQ ID NO: 1034200 - protein, 27 aa, Mycobacterium
EYVDGKRSGLWLGLRETFKSGSSQPPL

SEQ ID NO: 1034201 - protein, 17 aa, Mycobacterium
EYVKDFVGLGCFGMHEY

SEQ ID NO: 1034202 - protein, 23 aa, Mycobacterium
FAAAGRYVLDRAIFDALRRVSRG

SEQ ID NO: 1034203 - protein, 18 aa, Mycobacterium
FAARRARTGPAELLYVGR

SEQ ID NO: 1034204 - protein, 30 aa, Mycobacterium
FAAVRQFRASVCVLGPLVGRCKQARVALPG

SEQ ID NO: 1034205 - protein, 28 aa, Mycobacterium
FAAVSPWWLQRRLLLSGIRAISPAVDVT

SEQ ID NO: 1034206 - protein, 21 aa, Mycobacterium
FAEGYCLPTVLNNALYMDRYP

SEQ ID NO: 1034207 - protein, 18 aa, Mycobacterium
FAEIAAFTFTPRPVPIVA

SEQ ID NO: 1034208 - protein, 17 aa, Mycobacterium
FAETGGWQSFRVPCLPT

SEQ ID NO: 1034209 - protein, 17 aa, Mycobacterium
FAFLGGRDWDPSQATLA

SEQ ID NO: 1034210 - protein, 18 aa, Mycobacterium
FAGLPAYQQGLGRKVRFM

SEQ ID NO: 1034211 - protein, 17 aa, Mycobacterium
FAGREFIGVQGTQLSRY

SEQ ID NO: 1034212 - protein, 17 aa, Mycobacterium
FAGSGAIYLEVRTDNET

SEQ ID NO: 1034213 - protein, 21 aa, Mycobacterium
FAIELGRLGGLGVLNGEGLIG

SEQ ID NO: 1034214 - protein, 24 aa, Mycobacterium
FAIRPSGVFLRRLIHAPATTTSKS

SEQ ID NO: 1034215 - protein, 18 aa, Mycobacterium
FANGEIFVRFHESVRGCD

SEQ ID NO: 1034216 - protein, 19 aa, Mycobacterium
FANRRVDAIQDGMLLSSAM

SEQ ID NO: 1034217 - protein, 21 aa, Mycobacterium
FAPRELVELGVAAEAHGMDSA

SEQ ID NO: 1034218 - protein, 17 aa, Mycobacterium
FAQKPSVLMIGERTNAN

SEQ ID NO: 1034219 - protein, 20 aa, Mycobacterium
FAQSTTVLFLGRHVGYPVAL

SEQ ID NO: 1034220 - protein, 19 aa, Mycobacterium
FAQTVAVFATRAKPLGIDI

SEQ ID NO: 1034221 - protein, 22 aa, Mycobacterium
FARALACVVFLGRAGRSTGRDI

SEQ ID NO: 1034222 - protein, 26 aa, Mycobacterium
FARDTRLRFIRTYRRIVDPLNPPPAN

SEQ ID NO: 1034223 - protein, 17 aa, Mycobacterium
FARVVGGTFARIQFTPD

SEQ ID NO: 1034224 - protein, 18 aa, Mycobacterium
FASVRWWSNFVHAKDKMM

SEQ ID NO: 1034225 - protein, 17 aa, Mycobacterium
FATLAGWYGATLRITRL

SEQ ID NO: 1034226 - protein, 18 aa, Mycobacterium
FATLLSNASTIFWNGPMG

SEQ ID NO: 1034227 - protein, 17 aa, Mycobacterium
FATLNWPESEITSCPAH

SEQ ID NO: 1034228 - protein, 17 aa, Mycobacterium
FATWRVDPSFVLNLSPF

SEQ ID NO: 1034229 - protein, 21 aa, Mycobacterium
FCGFATHALRARITDADTKLL

SEQ ID NO: 1034230 - protein, 17 aa, Mycobacterium
FCVGPCWPTPTKPDRPA

SEQ ID NO: 1034231 - protein, 17 aa, Mycobacterium
FDAALVIDHPFMVTALL

SEQ ID NO: 1034232 - protein, 23 aa, Mycobacterium
FDADFFSAWGKLAAVRTPMIAAV

SEQ ID NO: 1034233 - protein, 17 aa, Mycobacterium
FDAGLVLTSVGYRGKRI

SEQ ID NO: 1034234 - protein, 24 aa, Mycobacterium
FDALPHPRWWIDLLTTEPLAFASL

SEQ ID NO: 1034235 - protein, 24 aa, Mycobacterium
FDELYAAGATAIFPPGTVIAYAAI

SEQ ID NO: 1034236 - protein, 29 aa, Mycobacterium
FDGDRAACIKAMIEKVVDRMYAEIDDNRF

SEQ ID NO: 1034237 - protein, 19 aa, Mycobacterium
FDGEPQLGGYSAWVDAEAP

SEQ ID NO: 1034238 - protein, 17 aa, Mycobacterium
FDHQLTRVELRRMGYLQ

SEQ ID NO: 1034239 - protein, 24 aa, Mycobacterium
FDKNYISGVLLDFQPDRLPERACG

SEQ ID NO: 1034240 - protein, 25 aa, Mycobacterium
FDLDELALAIGLRVMVNILSRLCPS

SEQ ID NO: 1034241 - protein, 23 aa, Mycobacterium
FDLIHRLWLDLGHEVHYVQNVTD

SEQ ID NO: 1034242 - protein, 17 aa, Mycobacterium
FDLKVAYAVGHDDLEEP

SEQ ID NO: 1034243 - protein, 20 aa, Mycobacterium
FDLTVCTKGDVEIEAHHTIE

SEQ ID NO: 1034244 - protein, 17 aa, Mycobacterium
FDRARKALFDEGISTSR

SEQ ID NO: 1034245 - protein, 24 aa, Mycobacterium
FDRPAFKTCIAHGVVLGSNGQKMS

SEQ ID NO: 1034246 - protein, 19 aa, Mycobacterium
FDSFVERFALGGALVVCND

SEQ ID NO: 1034247 - protein, 19 aa, Mycobacterium
FDSILGRLPHDVSLEEEDT

SEQ ID NO: 1034248 - protein, 26 aa, Mycobacterium
FDTACSSGLMAVHLACRSLHDGESDL

SEQ ID NO: 1034249 - protein, 20 aa, Mycobacterium
FEAACTVAGARFVGGVLACC

SEQ ID NO: 1034250 - protein, 18 aa, Mycobacterium
FEALDELGAIVEEARGVP

SEQ ID NO: 1034251 - protein, 25 aa, Mycobacterium
FEALLPRYLTIRVYAAMLESAASEL

SEQ ID NO: 1034252 - protein, 24 aa, Mycobacterium
FEARFRFVEEMIRLGADARTDGHH

SEQ ID NO: 1034253 - protein, 20 aa, Mycobacterium
FEETHPLWIVRRTMVDLIRP

SEQ ID NO: 1034254 - protein, 32 aa, Mycobacterium
FEFMSRVYQQFPRCHPLYGAGPVKAVVDDVNA

SEQ ID NO: 1034255 - protein, 23 aa, Mycobacterium
FEGELALVVGRSCKDVPAVQAVD

SEQ ID NO: 1034256 - protein, 18 aa, Mycobacterium
FEHRAVVLGADRDGLLAG

SEQ ID NO: 1034257 - protein, 23 aa, Mycobacterium
FEKCEDCLLSAVARRRQVKSKEM

SEQ ID NO: 1034258 - protein, 19 aa, Mycobacterium
FELANCAKLAVGPSTPLDV

SEQ ID NO: 1034259 - protein, 19 aa, Mycobacterium
FELHEELILAVGLTREEAT

SEQ ID NO: 1034260 - protein, 17 aa, Mycobacterium
FENAIAVVMAFGGSTNA

SEQ ID NO: 1034261 - protein, 17 aa, Mycobacterium
FEPEVACEITLQPLRRY

SEQ ID NO: 1034262 - protein, 18 aa, Mycobacterium
FEPQRPLIEVLRDLTTRI

SEQ ID NO: 1034263 - protein, 22 aa, Mycobacterium
FEQHLRAVLDYPLGETDAVAPV

SEQ ID NO: 1034264 - protein, 18 aa, Mycobacterium
FEQLRLEHRRVLRSHPDA

SEQ ID NO: 1034265 - protein, 19 aa, Mycobacterium
FEQVEYRLLAAWEKDAGLM

SEQ ID NO: 1034266 - protein, 30 aa, Mycobacterium
FERISRFVGGPGVRTAWSAIFEDLSRRARP

SEQ ID NO: 1034267 - protein, 20 aa, Mycobacterium
FERSKYASGEFFDKYIEQTW

SEQ ID NO: 1034268 - protein, 27 aa, Mycobacterium
FETFVIGASNRFAHAAALAIAEAPARA

SEQ ID NO: 1034269 - protein, 17 aa, Mycobacterium
FEVALRFQSAGYRLIAL

SEQ ID NO: 1034270 - protein, 17 aa, Mycobacterium
FEVDWWLTFSSASSLLG

SEQ ID NO: 1034271 - protein, 19 aa, Mycobacterium
FEVLIRTALTPGYAPTESA

SEQ ID NO: 1034272 - protein, 25 aa, Mycobacterium
FEVMTIDCPEEFVGAITQLMAGRKG

SEQ ID NO: 1034273 - protein, 17 aa, Mycobacterium
FFAAPISWQQRLWPTEE

SEQ ID NO: 1034274 - protein, 18 aa, Mycobacterium
FFEGRRVGLGGSTWRDPR

SEQ ID NO: 1034275 - protein, 20 aa, Mycobacterium
FFFLRPKDIAIYVGSGDLDF

SEQ ID NO: 1034276 - protein, 21 aa, Mycobacterium
FFGDRRKAFLEDLAIVTGGQV

SEQ ID NO: 1034277 - protein, 17 aa, Mycobacterium
FFGGIPILDGIGSSEVG

SEQ ID NO: 1034278 - protein, 25 aa, Mycobacterium
FFIILRPAPSGTRLLLSDATAALDY

SEQ ID NO: 1034279 - protein, 30 aa, Mycobacterium
FFLHIPFPPVELFMQIPWRTEIIEGLLGAD

SEQ ID NO: 1034280 - protein, 20 aa, Mycobacterium
FFNPIGMRIADKWSDPLSGV

SEQ ID NO: 1034281 - protein, 20 aa, Mycobacterium
FFPDPWPKVRHHKRRFLQPA

SEQ ID NO: 1034282 - protein, 17 aa, Mycobacterium
FGAHSYGRVDARGKFHT

SEQ ID NO: 1034283 - protein, 20 aa, Mycobacterium
FGATMTFRYFCTDETVLNVM

SEQ ID NO: 1034284 - protein, 26 aa, Mycobacterium
FGAVARGGLRWSDRLDDFRTEILGLV

SEQ ID NO: 1034285 - protein, 19 aa, Mycobacterium
FGDLLGRSASVWTIVPVLA

SEQ ID NO: 1034286 - protein, 26 aa, Mycobacterium
FGDYFKRGAIELAWALLTNSFADGGY

SEQ ID NO: 1034287 - protein, 19 aa, Mycobacterium
FGEELPVRWEMIDKAVRKA

SEQ ID NO: 1034288 - protein, 25 aa, Mycobacterium
FGEQDLRGLLGAFMFSGPQLDQLAG

SEQ ID NO: 1034289 - protein, 22 aa, Mycobacterium
FGFECYDIFFKFAYNALPANGV

SEQ ID NO: 1034290 - protein, 27 aa, Mycobacterium
FGFTPLRLPPELDFTALFHGVDERVSI

SEQ ID NO: 1034291 - protein, 20 aa, Mycobacterium
FGGAYRLVDFVLSNLVNARY

SEQ ID NO: 1034292 - protein, 19 aa, Mycobacterium
FGGKGMRSLQRLLPMPSYR

SEQ ID NO: 1034293 - protein, 22 aa, Mycobacterium
FGGRLRTRYSSAYDLEGAVKHA

SEQ ID NO: 1034294 - protein, 17 aa, Mycobacterium
FGHAVKTFYKEAFAKHQ

SEQ ID NO: 1034295 - protein, 24 aa, Mycobacterium
FGHWWYEGPIWLQRVLRALPTAGV

SEQ ID NO: 1034296 - protein, 25 aa, Mycobacterium
FGISGDASFDYGIAYDRSRKVSEGR

SEQ ID NO: 1034297 - protein, 29 aa, Mycobacterium
FGLIPEFIGRLPVIASVINLDMESLVKIL

SEQ ID NO: 1034298 - protein, 17 aa, Mycobacterium
FGMDSAIAWNIRSMVIR

SEQ ID NO: 1034299 - protein, 18 aa, Mycobacterium
FGNIIRLLPPLTISDELL

SEQ ID NO: 1034300 - protein, 18 aa, Mycobacterium
FGNLAEVMAGVFAARRSS

SEQ ID NO: 1034301 - protein, 17 aa, Mycobacterium
FGPIGMIVAVALRTDIR

SEQ ID NO: 1034302 - protein, 22 aa, Mycobacterium
FGRLADRGWLVLALPHKLLRSW

SEQ ID NO: 1034303 - protein, 17 aa, Mycobacterium
FGRPGGAPRRGRKSKRQ

SEQ ID NO: 1034304 - protein, 20 aa, Mycobacterium
FGRRDKRLWTDAGKGELIVG

SEQ ID NO: 1034305 - protein, 26 aa, Mycobacterium
FGRRVAIIVCKFSFLGGRIGVAAAER

SEQ ID NO: 1034306 - protein, 26 aa, Mycobacterium
FGRTLALEHPEIWGSVIDLDASMPPE

SEQ ID NO: 1034307 - protein, 18 aa, Mycobacterium
FGRVSALLVQSVDPFITI

SEQ ID NO: 1034308 - protein, 27 aa, Mycobacterium
FGSSSFRYAGPAGRDWTTSDLAGKRIA

SEQ ID NO: 1034309 - protein, 17 aa, Mycobacterium
FGTAKIAVFDADSGVNL

SEQ ID NO: 1034310 - protein, 19 aa, Mycobacterium
FGTGGFRLIIENMAYASTA

SEQ ID NO: 1034311 - protein, 26 aa, Mycobacterium
FGTTQRFGVPMGFGGPHAGYLALHTK

SEQ ID NO: 1034312 - protein, 22 aa, Mycobacterium
FGVPAADALRGWLDDGRPALVT

SEQ ID NO: 1034313 - protein, 18 aa, Mycobacterium
FGVSCYRAIFADTPGRDD

SEQ ID NO: 1034314 - protein, 23 aa, Mycobacterium
FGYQRLRLGTATALGERQLQLSM

SEQ ID NO: 1034315 - protein, 19 aa, Mycobacterium
FIARRLLILASEDIGLADS

SEQ ID NO: 1034316 - protein, 21 aa, Mycobacterium
FIDACGLGYLLDLAERALTDD

SEQ ID NO: 1034317 - protein, 25 aa, Mycobacterium
FIIGRIKDLLIVYGRNHSPDDIEGT

SEQ ID NO: 1034318 - protein, 24 aa, Mycobacterium
FIQREIVARTGLRDCRTHGRTWDL

SEQ ID NO: 1034319 - protein, 31 aa, Mycobacterium
FIVPAEGFLATLLDWCRKNNVMFIADEVQTG

SEQ ID NO: 1034320 - protein, 17 aa, Mycobacterium
FIVRAGSLVAWSAGQGV

SEQ ID NO: 1034321 - protein, 25 aa, Mycobacterium
FKALDITLPVPTRWTQVPDPNVPDA

SEQ ID NO: 1034322 - protein, 17 aa, Mycobacterium
FKFTRIQSLQLHYAKTL

SEQ ID NO: 1034323 - protein, 23 aa, Mycobacterium
FKGKAQIGKGMWAMTELMADMVE

SEQ ID NO: 1034324 - protein, 26 aa, Mycobacterium
FKGRNVEIPDHFRIHVSQRLARLERF

SEQ ID NO: 1034325 - protein, 17 aa, Mycobacterium
FKGSRKSTPFAAQLAAE

SEQ ID NO: 1034326 - protein, 17 aa, Mycobacterium
FKRLAWWPYGVVMKQVN

SEQ ID NO: 1034327 - protein, 18 aa, Mycobacterium
FKRPSLRVLASVVRSLGV

SEQ ID NO: 1034328 - protein, 18 aa, Mycobacterium
FKTGVARMIVEAPKAGTD

SEQ ID NO: 1034329 - protein, 25 aa, Mycobacterium
FLAHLPGYQGWQWAVVVAAYPGAEH

SEQ ID NO: 1034330 - protein, 20 aa, Mycobacterium
FLAIAGRRVQLEIFTKFNIP

SEQ ID NO: 1034331 - protein, 25 aa, Mycobacterium
FLDERALFLGQWGLRGVRGGAGPSY

SEQ ID NO: 1034332 - protein, 17 aa, Mycobacterium
FLDGLPWQAGQPPRLGV

SEQ ID NO: 1034333 - protein, 18 aa, Mycobacterium
FLEGCGRTDFPGGNSDEM

SEQ ID NO: 1034334 - protein, 27 aa, Mycobacterium
FLEKHPAVSWVRYPFLVSHPQYDLAKR

SEQ ID NO: 1034335 - protein, 24 aa, Mycobacterium
FLGEPRLAQRIAQARTRGGYLKDI

SEQ ID NO: 1034336 - protein, 17 aa, Mycobacterium
FLGESPVAIGPAHQAKA

SEQ ID NO: 1034337 - protein, 17 aa, Mycobacterium
FLGFNLFQHAIARAVIH

SEQ ID NO: 1034338 - protein, 17 aa, Mycobacterium
FLGRAVVIDGNQLRLEH

SEQ ID NO: 1034339 - protein, 17 aa, Mycobacterium
FLIDIGYLLPEPDDFTI

SEQ ID NO: 1034340 - protein, 17 aa, Mycobacterium
FLILIGPSGCGKTTTLN

SEQ ID NO: 1034341 - protein, 24 aa, Mycobacterium
FLKLKLRTGGLLLNHCITRRDNKS

SEQ ID NO: 1034342 - protein, 17 aa, Mycobacterium
FLLQGGDCAETFTDNTE

SEQ ID NO: 1034343 - protein, 17 aa, Mycobacterium
FLLQGGDCAETFVDNTE

SEQ ID NO: 1034344 - protein, 17 aa, Mycobacterium
FLLTAGAIGSLYKELAS

SEQ ID NO: 1034345 - protein, 26 aa, Mycobacterium
FLMSVGDLIIGWLLQRQAAVAVQALD

SEQ ID NO: 1034346 - protein, 18 aa, Mycobacterium
FLPPFPGIDDVRALANRV

SEQ ID NO: 1034347 - protein, 23 aa, Mycobacterium
FLRTYRRLLSLVVDGYRREGKRY

SEQ ID NO: 1034348 - protein, 18 aa, Mycobacterium
FLRWGQGAFNDFKVVPPG

SEQ ID NO: 1034349 - protein, 17 aa, Mycobacterium
FLSYCLLAEGAIDVAAE

SEQ ID NO: 1034350 - protein, 17 aa, Mycobacterium
FLTGGSMIETVTMESTT

SEQ ID NO: 1034351 - protein, 18 aa, Mycobacterium
FLTGWQPDEFDAEFFSIS

SEQ ID NO: 1034352 - protein, 17 aa, Mycobacterium
FLVEMFGMVPSDVVDGN

SEQ ID NO: 1034353 - protein, 26 aa, Mycobacterium
FLVPARLRPGTFYALPQSPQLFKQLL

SEQ ID NO: 1034354 - protein, 19 aa, Mycobacterium
FLWHRPCLSAGRTAITQSL

SEQ ID NO: 1034355 - protein, 18 aa, Mycobacterium
FMADLLLLNGPLYSGASQ

SEQ ID NO: 1034356 - protein, 31 aa, Mycobacterium
FMEVAKLRAGRLLWSELVAKFGPQSPKSLSL

SEQ ID NO: 1034357 - protein, 29 aa, Mycobacterium
FNAFPASYWRRWTICKSVVLRVEVTGAGR

SEQ ID NO: 1034358 - protein, 17 aa, Mycobacterium
FNFVRIVSEGGAPAVIA

SEQ ID NO: 1034359 - protein, 30 aa, Mycobacterium
FNNAIIRPFLRFFFKSWFRVEVSGIENLPS

SEQ ID NO: 1034360 - protein, 22 aa, Mycobacterium
FNVFAVEVLKSFIFTCPSSEKY

SEQ ID NO: 1034361 - protein, 21 aa, Mycobacterium
FPAMMSLVTGFDFPFAAMGSV

SEQ ID NO: 1034362 - protein, 21 aa, Mycobacterium
FPAPSKYVAPIAFNVVPLAGS

SEQ ID NO: 1034363 - protein, 23 aa, Mycobacterium
FPARTCSPGVFKRHKQIDRPCLL

SEQ ID NO: 1034364 - protein, 19 aa, Mycobacterium
FPASGGVVLTGRLSPNMQG

SEQ ID NO: 1034365 - protein, 22 aa, Mycobacterium
FPDEIGSGLAIFHPKGSIVRRE

SEQ ID NO: 1034366 - protein, 24 aa, Mycobacterium
FPDLEVCVYAAPTQIVIGGPPEQV

SEQ ID NO: 1034367 - protein, 24 aa, Mycobacterium
FPEAAARLGDRLSIHDQPNLGGSG

SEQ ID NO: 1034368 - protein, 17 aa, Mycobacterium
FPEDKRLSYSLKEIRHW

SEQ ID NO: 1034369 - protein, 23 aa, Mycobacterium
FPESYNRRALMRFVTSVKSGADY

SEQ ID NO: 1034370 - protein, 19 aa, Mycobacterium
FPEVLKRLSPRLVGWGSGS

SEQ ID NO: 1034371 - protein, 21 aa, Mycobacterium
FPHVYCELDFTSPLELTVATI

SEQ ID NO: 1034372 - protein, 23 aa, Mycobacterium
FPIAKIAVKLAVGYTLDEILNDI

SEQ ID NO: 1034373 - protein, 20 aa, Mycobacterium
FPLAGGLGVISNRASEVVAN

SEQ ID NO: 1034374 - protein, 18 aa, Mycobacterium
FPLPRELVGEGTLFLLKV

SEQ ID NO: 1034375 - protein, 19 aa, Mycobacterium
FPLWQTVRFAAPALMAGNV

SEQ ID NO: 1034376 - protein, 21 aa, Mycobacterium
FPNRAAYKFIDYDVDPAGFTE

SEQ ID NO: 1034377 - protein, 20 aa, Mycobacterium
FPTKEALCAAVIGDRMPHLV

SEQ ID NO: 1034378 - protein, 24 aa, Mycobacterium
FQAEARQLLDLMVHSVYSNKDAFL

SEQ ID NO: 1034379 - protein, 17 aa, Mycobacterium
FQDVSCPDVQLLVVPGT

SEQ ID NO: 1034380 - protein, 17 aa, Mycobacterium
FQEASALPHTAKGSLDR

SEQ ID NO: 1034381 - protein, 19 aa, Mycobacterium
FQLDIMRVPGIIVARTDAE

SEQ ID NO: 1034382 - protein, 18 aa, Mycobacterium
FQLLRPIKGENRYFVVTH

SEQ ID NO: 1034383 - protein, 23 aa, Mycobacterium
FQMMGLCQMLRDGVIPPNRSLDC

SEQ ID NO: 1034384 - protein, 18 aa, Mycobacterium
FQRQRFWLDANRIGQGDP

SEQ ID NO: 1034385 - protein, 23 aa, Mycobacterium
FQSFPAVAGSSLFANLRDTATLK

SEQ ID NO: 1034386 - protein, 18 aa, Mycobacterium
FRACHRSFVNVAVVTGGG

SEQ ID NO: 1034387 - protein, 18 aa, Mycobacterium
FRALPLWGAVADRDTMSS

SEQ ID NO: 1034388 - protein, 29 aa, Mycobacterium
FRAVQYLPWHPGRCAEVFVGETPIGHAGQ

SEQ ID NO: 1034389 - protein, 17 aa, Mycobacterium
FRCNGVIRNVDAFYDAF

SEQ ID NO: 1034390 - protein, 17 aa, Mycobacterium
FRDAEALTFPLLSDHDC

SEQ ID NO: 1034391 - protein, 18 aa, Mycobacterium
FRDGKAFFRNSFIRTDGF

SEQ ID NO: 1034392 - protein, 21 aa, Mycobacterium
FRISLEPVTPFVALRHIRFHL

SEQ ID NO: 1034393 - protein, 20 aa, Mycobacterium
FRLDWSTPHDVGRKAIAQNA

SEQ ID NO: 1034394 - protein, 23 aa, Mycobacterium
FRLLSPRTMRALVGRICAQEGVV

SEQ ID NO: 1034395 - protein, 17 aa, Mycobacterium
FRLPALTSIPIRVDCDD

SEQ ID NO: 1034396 - protein, 30 aa, Mycobacterium
FRPKVWPPVRRIDGVYGDRNLVCSCLPVEA

SEQ ID NO: 1034397 - protein, 18 aa, Mycobacterium
FRPTFAWFDPRLIHILVG

SEQ ID NO: 1034398 - protein, 18 aa, Mycobacterium
FRQIAARLGLPIVQLGSR

SEQ ID NO: 1034399 - protein, 20 aa, Mycobacterium
FRRIEFRLEPPVGNIGLLRE

SEQ ID NO: 1034400 - protein, 18 aa, Mycobacterium
FRRSHLEALTAQRTLARL

SEQ ID NO: 1034401 - protein, 19 aa, Mycobacterium
FRRVFSWLPAQFASQNDAP

SEQ ID NO: 1034402 - protein, 25 aa, Mycobacterium
FRSKRAKLRFIRSCSAPLTQETAQA

SEQ ID NO: 1034403 - protein, 18 aa, Mycobacterium
FRTGSSWLDALLQGLEAN

SEQ ID NO: 1034404 - protein, 26 aa, Mycobacterium
FRVGVLPTLRAARIIAGYNCPPETTV

SEQ ID NO: 1034405 - protein, 18 aa, Mycobacterium
FSAFTGHRLDVRQANCSV

SEQ ID NO: 1034406 - protein, 21 aa, Mycobacterium
FSAGGPVLWPDLEAILVVPNN

SEQ ID NO: 1034407 - protein, 21 aa, Mycobacterium
FSDVFVAWLLEAGHDLQRIDD

SEQ ID NO: 1034408 - protein, 20 aa, Mycobacterium
FSDVLKAMGVYPGLDGGAPA

SEQ ID NO: 1034409 - protein, 19 aa, Mycobacterium
FSEGGCWRTFLTCDANLAV

SEQ ID NO: 1034410 - protein, 17 aa, Mycobacterium
FSFLGGRIGVAAAERIT

SEQ ID NO: 1034411 - protein, 19 aa, Mycobacterium
FSFSGLKTAVARYVESHPD

SEQ ID NO: 1034412 - protein, 17 aa, Mycobacterium
FSGQLSLHYKDVIGDDM

SEQ ID NO: 1034413 - protein, 17 aa, Mycobacterium
FSKADVIELSYHTGIES

SEQ ID NO: 1034414 - protein, 17 aa, Mycobacterium
FSLLVMYPASGVPITAL

SEQ ID NO: 1034415 - protein, 24 aa, Mycobacterium
FSSKLELYLAVLERHMNNLVSSVQ

SEQ ID NO: 1034416 - protein, 30 aa, Mycobacterium
FSSNAAMARRCVDAGWMLSLSGTVSFRNAR

SEQ ID NO: 1034417 - protein, 22 aa, Mycobacterium
FSSSMGLRVGYAISYSDTITVL

SEQ ID NO: 1034418 - protein, 22 aa, Mycobacterium
FSVLPRSYWATKISELPAVTGR

SEQ ID NO: 1034419 - protein, 18 aa, Mycobacterium
FSYVRLSVDFSVGGEHRR

SEQ ID NO: 1034420 - protein, 17 aa, Mycobacterium
FTASEALEYGFVDHIIT

SEQ ID NO: 1034421 - protein, 24 aa, Mycobacterium
FTDAPRYSKPVPHGSIEDNLTAKD

SEQ ID NO: 1034422 - protein, 19 aa, Mycobacterium
FTDDARVLLVFGGSQGAVS

SEQ ID NO: 1034423 - protein, 17 aa, Mycobacterium
FTDHNGVDWPGTLTGLA

SEQ ID NO: 1034424 - protein, 24 aa, Mycobacterium
FTEHRIPIDMLPGALSEVNSLYEY

SEQ ID NO: 1034425 - protein, 31 aa, Mycobacterium
FTELPYDCALELGCGTGFFLLNLIQSGVARR

SEQ ID NO: 1034426 - protein, 20 aa, Mycobacterium
FTETLTWWQVYRRSMSVAYE

SEQ ID NO: 1034427 - protein, 24 aa, Mycobacterium
FTFTPRPVPIVATGHLHELKISVP

SEQ ID NO: 1034428 - protein, 24 aa, Mycobacterium
FTGKLPQAGWCGSGQAVSGSATAT

SEQ ID NO: 1034429 - protein, 17 aa, Mycobacterium
FTIDAALRDDFARAAAA

SEQ ID NO: 1034430 - protein, 20 aa, Mycobacterium
FTKHGLRLGVEASLRSLARV

SEQ ID NO: 1034431 - protein, 21 aa, Mycobacterium
FTLSGGHLFSIYDGCRSESIR

SEQ ID NO: 1034432 - protein, 24 aa, Mycobacterium
FTNICYTGCRFCAFAQRKGDTDAY

SEQ ID NO: 1034433 - protein, 19 aa, Mycobacterium
FTPLEMGDALEALASILVR

SEQ ID NO: 1034434 - protein, 20 aa, Mycobacterium
FTQKAIRVIKNVSRPHGFNV

SEQ ID NO: 1034435 - protein, 19 aa, Mycobacterium
FTQRAKWANATADLLEAEA

SEQ ID NO: 1034436 - protein, 24 aa, Mycobacterium
FTRALRFGTSGLRGPVRGGPDAMN

SEQ ID NO: 1034437 - protein, 21 aa, Mycobacterium
FTRDRKCIVVNTGRLNSAGLE

SEQ ID NO: 1034438 - protein, 18 aa, Mycobacterium
FTRIQSLQLHYAKTLDLW

SEQ ID NO: 1034439 - protein, 27 aa, Mycobacterium
FTSDIKNLLPMLAVFKPTVVVSVPRVF

SEQ ID NO: 1034440 - protein, 36 aa, Mycobacterium
FTTGFLEACYRRFLERRLRETFGFEGSPIRINVRVR

SEQ ID NO: 1034441 - protein, 17 aa, Mycobacterium
FVAAFDVDAKKVGVDLS

SEQ ID NO: 1034442 - protein, 18 aa, Mycobacterium
FVDAMCRKALRLTPQDIG

SEQ ID NO: 1034443 - protein, 23 aa, Mycobacterium
FVDFPMDYVFSMADDVGGGPGAL

SEQ ID NO: 1034444 - protein, 23 aa, Mycobacterium
FVDKGTVIVIEWAALGFHRRQGL

SEQ ID NO: 1034445 - protein, 31 aa, Mycobacterium
FVGATSRPSALALDDVVKFLLPSGSAKKDAK

SEQ ID NO: 1034446 - protein, 17 aa, Mycobacterium
FVHARAAALSAADPGPG

SEQ ID NO: 1034447 - protein, 19 aa, Mycobacterium
FVHFQWRAQHEDLKRLPFP

SEQ ID NO: 1034448 - protein, 18 aa, Mycobacterium
FVHRGRSTIRACSMSAIA

SEQ ID NO: 1034449 - protein, 17 aa, Mycobacterium
FVIDGKMFIIGRIKDLL

SEQ ID NO: 1034450 - protein, 29 aa, Mycobacterium
FVLATGRPPRWVRPVVDALGFPPMAVCAN

SEQ ID NO: 1034451 - protein, 17 aa, Mycobacterium
FVLWPNLLLARAAVVAL

SEQ ID NO: 1034452 - protein, 23 aa, Mycobacterium
FVNRAQACLLIMSNIFGQNSTAI

SEQ ID NO: 1034453 - protein, 25 aa, Mycobacterium
FVPAFSGLFSPYWRSDARGAIVGLS

SEQ ID NO: 1034454 - protein, 22 aa, Mycobacterium
FVRGEGAGVVVLKRLTDAVRDG

SEQ ID NO: 1034455 - protein, 24 aa, Mycobacterium
FVRSEGCAMVLLKRLPDALRDGNR

SEQ ID NO: 1034456 - protein, 17 aa, Mycobacterium
FVRVSPRKARRVIDLVR

SEQ ID NO: 1034457 - protein, 18 aa, Mycobacterium
FVSQLGFTVAPQVHAAIE

SEQ ID NO: 1034458 - protein, 22 aa, Mycobacterium
FVTDDCRVHKTVHHYLMRFSGG

SEQ ID NO: 1034459 - protein, 19 aa, Mycobacterium
FVTGPRSARSFSVAPQHDV

SEQ ID NO: 1034460 - protein, 27 aa, Mycobacterium
FVVCNEILPRWGVETVFVDGEDLVQWE

SEQ ID NO: 1034461 - protein, 17 aa, Mycobacterium
FVVSVLLGIGWELIRSG

SEQ ID NO: 1034462 - protein, 17 aa, Mycobacterium
FWYCCIPEYLLYSISCI

SEQ ID NO: 1034463 - protein, 24 aa, Mycobacterium
FYGRPRNASSWELVTDALACSKSG

SEQ ID NO: 1034464 - protein, 17 aa, Mycobacterium
FYPKANLSIVQRAFEVA

SEQ ID NO: 1034465 - protein, 19 aa, Mycobacterium
FYRGVGLTIHEGYGLTETS

SEQ ID NO: 1034466 - protein, 20 aa, Mycobacterium
GAALDFAALYPAGRLLDAPL

SEQ ID NO: 1034467 - protein, 26 aa, Mycobacterium
GAAQRAGIELLAFGGRFVEIGKRDIY

SEQ ID NO: 1034468 - protein, 20 aa, Mycobacterium
GAASTWAIAVYNHFGGIRTP

SEQ ID NO: 1034469 - protein, 20 aa, Mycobacterium
GACDSTLLIAERVQSYADVW

SEQ ID NO: 1034470 - protein, 25 aa, Mycobacterium
GACLNREMSRFIAMVRADIDFTQSP

SEQ ID NO: 1034471 - protein, 17 aa, Mycobacterium
GACPIVASFGGRDPLGI

SEQ ID NO: 1034472 - protein, 35 aa, Mycobacterium
GADALASILSWQGWDELFDLARFVGVSRPGYELGQ

SEQ ID NO: 1034473 - protein, 30 aa, Mycobacterium
GADGRLPITYSRKVFIPVTHLCRDSCHYCT

SEQ ID NO: 1034474 - protein, 27 aa, Mycobacterium
GADVSIIFVPPRFAKEAIIEAVEAEIP

SEQ ID NO: 1034475 - protein, 18 aa, Mycobacterium
GAEIGRIPVDSIYSPVLK

SEQ ID NO: 1034476 - protein, 18 aa, Mycobacterium
GAELRPAYSNADAARQVA

SEQ ID NO: 1034477 - protein, 24 aa, Mycobacterium
GAEPRDWLEVSLIPTTRELTTLGR

SEQ ID NO: 1034478 - protein, 24 aa, Mycobacterium
GAEPRPFYASSFMFLDPPDHTRLR

SEQ ID NO: 1034479 - protein, 20 aa, Mycobacterium
GAGAIGIEFGYVLKNYGVDV

SEQ ID NO: 1034480 - protein, 19 aa, Mycobacterium
GAGAMLAMAHDFRVMRADR

SEQ ID NO: 1034481 - protein, 37 aa, Mycobacterium
GAGAMVGPFTYLRPGTVLGTKGKLGAFVETKNSTIGT

SEQ ID NO: 1034482 - protein, 17 aa, Mycobacterium
GAGFLIRIQRHCRPSAL

SEQ ID NO: 1034483 - protein, 25 aa, Mycobacterium
GAGGLRVATVVGFPSGEHVSIVKAQ

SEQ ID NO: 1034484 - protein, 19 aa, Mycobacterium
GAGGSVWYRCDGGRRFAGG

SEQ ID NO: 1034485 - protein, 20 aa, Mycobacterium
GAGKWPDKFLAGAAGVAHGV

SEQ ID NO: 1034486 - protein, 24 aa, Mycobacterium
GAGVTVLAKGRFVTGQQFEDVLAM

SEQ ID NO: 1034487 - protein, 32 aa, Mycobacterium
GAIRYARARGLPVLGLCLGLQCIVIEATRSVG

SEQ ID NO: 1034488 - protein, 22 aa, Mycobacterium
GAKEQLGILARFAGATLVAKED

SEQ ID NO: 1034489 - protein, 19 aa, Mycobacterium
GAKVGMVFGELVHGEVDVR

SEQ ID NO: 1034490 - protein, 18 aa, Mycobacterium
GALARRNLVLDTMIENLP

SEQ ID NO: 1034491 - protein, 25 aa, Mycobacterium
GALGLRPTLAALHTGARLALANKES

SEQ ID NO: 1034492 - protein, 17 aa, Mycobacterium
GALIRIGHDASLLDLLP

SEQ ID NO: 1034493 - protein, 17 aa, Mycobacterium
GALREFGHAVVADRINE

SEQ ID NO: 1034494 - protein, 28 aa, Mycobacterium
GAMADPGSVAYLFSRKGVVTLEKNGLTE

SEQ ID NO: 1034495 - protein, 18 aa, Mycobacterium
GAMGCKDFDSAWAEGAAM

SEQ ID NO: 1034496 - protein, 18 aa, Mycobacterium
GAMHSWCLAAERPDLVSA

SEQ ID NO: 1034497 - protein, 19 aa, Mycobacterium
GANITRSEIRVVFDEINRY

SEQ ID NO: 1034498 - protein, 22 aa, Mycobacterium
GANSGPVGLILTRQSVPVLEGT

SEQ ID NO: 1034499 - protein, 24 aa, Mycobacterium
GAPISRLLVRVPREQGWQLAASLR

SEQ ID NO: 1034500 - protein, 24 aa, Mycobacterium
GAPLSAGDFVRWCRQVLDLLDQLR

SEQ ID NO: 1034501 - protein, 33 aa, Mycobacterium
GAPSFVEALRWGAEVYHALKSVLKKKGLSTGLG

SEQ ID NO: 1034502 - protein, 21 aa, Mycobacterium
GAQDYNAWLGKIACQRLAKGV

SEQ ID NO: 1034503 - protein, 20 aa, Mycobacterium
GAQGRAVYCWNVDDYDDIDF

SEQ ID NO: 1034504 - protein, 19 aa, Mycobacterium
GAREHALLLALSRDPQVKG

SEQ ID NO: 1034505 - protein, 21 aa, Mycobacterium
GARIGDAWAADIVVKVAPPAA

SEQ ID NO: 1034506 - protein, 18 aa, Mycobacterium
GARPRGPGMERGDLLEAN

SEQ ID NO: 1034507 - protein, 17 aa, Mycobacterium
GASAIVFHDTAHAAEFA

SEQ ID NO: 1034508 - protein, 24 aa, Mycobacterium
GASARRGLSEDVVRDISAKKDEPE

SEQ ID NO: 1034509 - protein, 21 aa, Mycobacterium
GASASSRTDCQWQLVPRPTSG

SEQ ID NO: 1034510 - protein, 20 aa, Mycobacterium
GASFLRRDGSVWTTDKDGII

SEQ ID NO: 1034511 - protein, 20 aa, Mycobacterium
GASMGGMIAQIFAARFPTRT

SEQ ID NO: 1034512 - protein, 22 aa, Mycobacterium
GASNWYTEFARLVRLMDKDVHY

SEQ ID NO: 1034513 - protein, 20 aa, Mycobacterium
GASVLKQLVAYVGLEQFLAG

SEQ ID NO: 1034514 - protein, 30 aa, Mycobacterium
GATAPRLLLEVVCARLLLPSATDAESALLQ

SEQ ID NO: 1034515 - protein, 26 aa, Mycobacterium
GATGFLGRYLALKWLERMDLVEGKVI

SEQ ID NO: 1034516 - protein, 24 aa, Mycobacterium
GATKRRLEAALTIQDLRCIAKQRT

SEQ ID NO: 1034517 - protein, 24 aa, Mycobacterium
GAVEVPRLLKPLLPGGIHVDHKSV

SEQ ID NO: 1034518 - protein, 17 aa, Mycobacterium
GAVRLQKILSRAGIASR

SEQ ID NO: 1034519 - protein, 19 aa, Mycobacterium
GAVYAGLAAADWGGRWLVV

SEQ ID NO: 1034520 - protein, 19 aa, Mycobacterium
GAYNDALDVDVVFSASFNA

SEQ ID NO: 1034521 - protein, 20 aa, Mycobacterium
GCGAFIGFEWQLRVRMAGDP

SEQ ID NO: 1034522 - protein, 19 aa, Mycobacterium
GCGKTTLAALISQATGHRF

SEQ ID NO: 1034523 - protein, 17 aa, Mycobacterium
GCGSRLSIRRPVLALQS

SEQ ID NO: 1034524 - protein, 17 aa, Mycobacterium
GCIPTKMFVSTAKNFNF

SEQ ID NO: 1034525 - protein, 24 aa, Mycobacterium
GCQPWCFIQNLFLEGLLGLRPRFC

SEQ ID NO: 1034526 - protein, 20 aa, Mycobacterium
GCQSEGFRNYTITIQRDHRN

SEQ ID NO: 1034527 - protein, 20 aa, Mycobacterium
GCRQWPGVVTRLDAPVVPHM

SEQ ID NO: 1034528 - protein, 23 aa, Mycobacterium
GCSTGPWEPWLRGIPVEFDSVEK

SEQ ID NO: 1034529 - protein, 18 aa, Mycobacterium
GCYQGLRHRRGLPVRGQR

SEQ ID NO: 1034530 - protein, 20 aa, Mycobacterium
GDAGVLASLLLNRISLTPGE

SEQ ID NO: 1034531 - protein, 26 aa, Mycobacterium
GDAHAARQCPRSIGLGQIPLGMPSVG

SEQ ID NO: 1034532 - protein, 18 aa, Mycobacterium
GDEAILFGPGARGEPTAQ

SEQ ID NO: 1034533 - protein, 33 aa, Mycobacterium
GDEALGIDVFFEALKAPLYWIATNAGLDGAVVV

SEQ ID NO: 1034534 - protein, 18 aa, Mycobacterium
GDEPLKRKVASTLLESFL

SEQ ID NO: 1034535 - protein, 19 aa, Mycobacterium
GDETFVLEVRSDFEDVSFH

SEQ ID NO: 1034536 - protein, 27 aa, Mycobacterium
GDEVQIGKFRLVFLIGSKQDDDTGRTA

SEQ ID NO: 1034537 - protein, 24 aa, Mycobacterium
GDFSRNQFLSGRMALFQSGTYNLA

SEQ ID NO: 1034538 - protein, 20 aa, Mycobacterium
GDGLPRLRALAEELAAGVRQ

SEQ ID NO: 1034539 - protein, 20 aa, Mycobacterium
GDGWIKLIGDWDRPPDRRSC

SEQ ID NO: 1034540 - protein, 24 aa, Mycobacterium
GDHIAGAIKLDWRADLQDPIKRDF

SEQ ID NO: 1034541 - protein, 17 aa, Mycobacterium
GDILPRLVDGGMAAVYD

SEQ ID NO: 1034542 - protein, 24 aa, Mycobacterium
GDILTRLTAPVIRGLGVGIVPVAN

SEQ ID NO: 1034543 - protein, 17 aa, Mycobacterium
GDISRLFPEGGTISVND

SEQ ID NO: 1034544 - protein, 17 aa, Mycobacterium
GDKRALAETVQRNAKEE

SEQ ID NO: 1034545 - protein, 25 aa, Mycobacterium
GDKSNWWAAYALWVFTLFGHPDVRL

SEQ ID NO: 1034546 - protein, 17 aa, Mycobacterium
GDLAKLRASVVNTQALA

SEQ ID NO: 1034547 - protein, 31 aa, Mycobacterium
GDLATIWRGGCIIRAKFLNRIKEAFDAAPDL

SEQ ID NO: 1034548 - protein, 26 aa, Mycobacterium
GDLKRSCLDIGLATTVLGWSPQVQLD

SEQ ID NO: 1034549 - protein, 25 aa, Mycobacterium
GDLLEFRSLVGMPFQRPNPFPKSIM

SEQ ID NO: 1034550 - protein, 18 aa, Mycobacterium
GDLLKGVRYYAGGCTTQS

SEQ ID NO: 1034551 - protein, 24 aa, Mycobacterium
GDLRAEIAAPMYLTLTTWSRATIG

SEQ ID NO: 1034552 - protein, 23 aa, Mycobacterium
GDLVSCPQWVLSVTVLGDLDGRA

SEQ ID NO: 1034553 - protein, 19 aa, Mycobacterium
GDPEFLPLLRRLSRLLPVD

SEQ ID NO: 1034554 - protein, 24 aa, Mycobacterium
GDPKRQVRCVYVAIGQKGTTIASV

SEQ ID NO: 1034555 - protein, 28 aa, Mycobacterium
GDRLLAISAGKAWKVKRIRNNPRITLAT

SEQ ID NO: 1034556 - protein, 23 aa, Mycobacterium
GDRLTCIFVDHGLLRDGERGQVQ

SEQ ID NO: 1034557 - protein, 20 aa, Mycobacterium
GDRPIPSWLQVVGEHQRILI

SEQ ID NO: 1034558 - protein, 17 aa, Mycobacterium
GDRRFVLAQARLTAYAR

SEQ ID NO: 1034559 - protein, 17 aa, Mycobacterium
GDRSVHYPFPIKDLVAL

SEQ ID NO: 1034560 - protein, 21 aa, Mycobacterium
GDRVLLCLPDSPDLVQLLLAC

SEQ ID NO: 1034561 - protein, 21 aa, Mycobacterium
GDRVRRAGVSSFGISGTNAHV

SEQ ID NO: 1034562 - protein, 25 aa, Mycobacterium
GDSMVEAAICDGDWVVVRQQKVADN

SEQ ID NO: 1034563 - protein, 25 aa, Mycobacterium
GDTDRVTLFRAWYSRRNFGQLSGSV

SEQ ID NO: 1034564 - protein, 20 aa, Mycobacterium
GDTPLPVRTPLPVQLPEQMA

SEQ ID NO: 1034565 - protein, 19 aa, Mycobacterium
GDVGKGCAEAAKGQGARVT

SEQ ID NO: 1034566 - protein, 19 aa, Mycobacterium
GDYRRASIRVDFDNAHDVV

SEQ ID NO: 1034567 - protein, 19 aa, Mycobacterium
GEAVGAPLDPGAIITEGGV

SEQ ID NO: 1034568 - protein, 23 aa, Mycobacterium
GEELRTLILVPLFHVTGCNSQLL

SEQ ID NO: 1034569 - protein, 19 aa, Mycobacterium
GEGAVHLDKGCYRGQETVA

SEQ ID NO: 1034570 - protein, 17 aa, Mycobacterium
GEIDVLVCTNVIEVGVD

SEQ ID NO: 1034571 - protein, 18 aa, Mycobacterium
GEKLGFDVDTPWRKLPAK

SEQ ID NO: 1034572 - protein, 20 aa, Mycobacterium
GEKYDVVGIPTDLQEKAEEY

SEQ ID NO: 1034573 - protein, 19 aa, Mycobacterium
GEKYPDVEVVYQHIDAATI

SEQ ID NO: 1034574 - protein, 17 aa, Mycobacterium
GELDGIRVLRSETLLGA

SEQ ID NO: 1034575 - protein, 27 aa, Mycobacterium
GELFIMGRIKDLLIVDGRNHYPDDIEA

SEQ ID NO: 1034576 - protein, 24 aa, Mycobacterium
GELGEPFTSVGLCCYRDGSDSIAW

SEQ ID NO: 1034577 - protein, 21 aa, Mycobacterium
GELLKPFTARYFAAIPGVWTR

SEQ ID NO: 1034578 - protein, 20 aa, Mycobacterium
GELLLKTQNMFPGYYKRPEV

SEQ ID NO: 1034579 - protein, 17 aa, Mycobacterium
GELPRLFVVTRQAQIVQ

SEQ ID NO: 1034580 - protein, 23 aa, Mycobacterium
GELTEFAIELDLCGTEFQQRVWQ

SEQ ID NO: 1034581 - protein, 27 aa, Mycobacterium
GELTHKIEAALEFKNQVLVKIYNRKAL

SEQ ID NO: 1034582 - protein, 20 aa, Mycobacterium
GELTPRFAAALDDDLAVPIA

SEQ ID NO: 1034583 - protein, 21 aa, Mycobacterium
GELVAKLTYFGLYALQHRGQE

SEQ ID NO: 1034584 - protein, 18 aa, Mycobacterium
GEPFVLHPGGFVLGSTLE

SEQ ID NO: 1034585 - protein, 20 aa, Mycobacterium
GEPHAISAMHGRGVADLLDK

SEQ ID NO: 1034586 - protein, 17 aa, Mycobacterium
GEQRSSNFMLWQAAYTE

SEQ ID NO: 1034587 - protein, 19 aa, Mycobacterium
GERFKLPADDRLRAAVRGD

SEQ ID NO: 1034588 - protein, 18 aa, Mycobacterium
GERRAGWVGLPLAGVQTR

SEQ ID NO: 1034589 - protein, 33 aa, Mycobacterium
GERYLAALMPMVWAACERADFVAEVQAMRRRVE

SEQ ID NO: 1034590 - protein, 17 aa, Mycobacterium
GESDLVLAGVVTVNVTP

SEQ ID NO: 1034591 - protein, 24 aa, Mycobacterium
GETAVRWSVMLSWNSKSAAALVLP

SEQ ID NO: 1034592 - protein, 23 aa, Mycobacterium
GETRANVIPLHIKRGRVASRRRA

SEQ ID NO: 1034593 - protein, 18 aa, Mycobacterium
GETRVHRLAVGIYDNCGE

SEQ ID NO: 1034594 - protein, 30 aa, Mycobacterium
GEVFDLRPGAIIRDLHLLRPIYAQTAAYGH

SEQ ID NO: 1034595 - protein, 19 aa, Mycobacterium
GEVLERSLIHLGLKHYFLV

SEQ ID NO: 1034596 - protein, 17 aa, Mycobacterium
GEVVALVAMEDLVNDLR

SEQ ID NO: 1034597 - protein, 19 aa, Mycobacterium
GFDGASCGVNIGIGAQSSD

SEQ ID NO: 1034598 - protein, 19 aa, Mycobacterium
GFDRLRLIQRIADRLPDKA

SEQ ID NO: 1034599 - protein, 21 aa, Mycobacterium
GFDSRRVRQWGYNAANDPQAI

SEQ ID NO: 1034600 - protein, 19 aa, Mycobacterium
GFFEKTFAPLGLKKIQAEV

SEQ ID NO: 1034601 - protein, 17 aa, Mycobacterium
GFFRLPIQSTAHRNLIS

SEQ ID NO: 1034602 - protein, 20 aa, Mycobacterium
GFFYIKGRSSEMIVSGGVNI

SEQ ID NO: 1034603 - protein, 26 aa, Mycobacterium
GFGPEVKRRIMIGAYALSAGYYDSYY

SEQ ID NO: 1034604 - protein, 18 aa, Mycobacterium
GFGSLRPLLEVAAAHDRG

SEQ ID NO: 1034605 - protein, 18 aa, Mycobacterium
GFHGAPKFSPSAMVEEVA

SEQ ID NO: 1034606 - protein, 29 aa, Mycobacterium
GFHTPHLADGIGIVGGWAEKVGLDVTLAR

SEQ ID NO: 1034607 - protein, 26 aa, Mycobacterium
GFINARPKPLAAYLFTKSRKTRDRVI

SEQ ID NO: 1034608 - protein, 23 aa, Mycobacterium
GFPKFAMICCTLLNRLEGDQVTA

SEQ ID NO: 1034609 - protein, 17 aa, Mycobacterium
GFPRTGRTPTVIEQAPK

SEQ ID NO: 1034610 - protein, 30 aa, Mycobacterium
GFQHVKPGKGPAFVRTKLKNVLSGKVVDKT

SEQ ID NO: 1034611 - protein, 23 aa, Mycobacterium
GFREAMDDLDLHSAIFNGTAIDL

SEQ ID NO: 1034612 - protein, 20 aa, Mycobacterium
GFTAEGLPIGVQLMGPTNSE

SEQ ID NO: 1034613 - protein, 18 aa, Mycobacterium
GFVLKRPPLPTGDAAADR

SEQ ID NO: 1034614 - protein, 20 aa, Mycobacterium
GGAIEACARKLFVHPNTVRY

SEQ ID NO: 1034615 - protein, 17 aa, Mycobacterium
GGANGAFELNVYIPMMA

SEQ ID NO: 1034616 - protein, 21 aa, Mycobacterium
GGAPGDFLSAGGHFQVPGHTV

SEQ ID NO: 1034617 - protein, 20 aa, Mycobacterium
GGAPRRGRKSKRQKRQEYDS

SEQ ID NO: 1034618 - protein, 18 aa, Mycobacterium
GGAVLLVYDPLFYSKKLR

SEQ ID NO: 1034619 - protein, 18 aa, Mycobacterium
GGAVSAWGSGFATTVTDR

SEQ ID NO: 1034620 - protein, 22 aa, Mycobacterium
GGEGKRLYPLTADRAKPAVPFG

SEQ ID NO: 1034621 - protein, 19 aa, Mycobacterium
GGEGRLRLTDPDDMLTTGI

SEQ ID NO: 1034622 - protein, 19 aa, Mycobacterium
GGELARIGVTLDSIATPAP

SEQ ID NO: 1034623 - protein, 20 aa, Mycobacterium
GGELAVALHASFPPERISLH

SEQ ID NO: 1034624 - protein, 20 aa, Mycobacterium
GGELQRIRIAQALVNDPTLL

SEQ ID NO: 1034625 - protein, 23 aa, Mycobacterium
GGESARSKVCFTMDEVRETVEDL

SEQ ID NO: 1034626 - protein, 25 aa, Mycobacterium
GGFLGMAASFARRIARNTQLLLLEE

SEQ ID NO: 1034627 - protein, 21 aa, Mycobacterium
GGGEMGRLWYEHGKLLEKKNT

SEQ ID NO: 1034628 - protein, 19 aa, Mycobacterium
GGGIRLGPLASILRDKRIP

SEQ ID NO: 1034629 - protein, 17 aa, Mycobacterium
GGGLGVGQLQGHRCGAC

SEQ ID NO: 1034630 - protein, 23 aa, Mycobacterium
GGGQRFNIGTGIETSDRQLHTAV

SEQ ID NO: 1034631 - protein, 20 aa, Mycobacterium
GGGTVVWRWNQAIADATRRT

SEQ ID NO: 1034632 - protein, 22 aa, Mycobacterium
GGIPTLLWKLIGEIRSGDYVVL

SEQ ID NO: 1034633 - protein, 23 aa, Mycobacterium
GGISRKADRWIPLLENRTPMVAA

SEQ ID NO: 1034634 - protein, 18 aa, Mycobacterium
GGKLQWILENVDGVGAAA

SEQ ID NO: 1034635 - protein, 19 aa, Mycobacterium
GGKNCGWQKLTNARLKSTA

SEQ ID NO: 1034636 - protein, 22 aa, Mycobacterium
GGKTFPLPNPFLVMATQNPIEH

SEQ ID NO: 1034637 - protein, 17 aa, Mycobacterium
GGLGLLAFITTIASQCG

SEQ ID NO: 1034638 - protein, 21 aa, Mycobacterium
GGLHGLPGLRAIFAELLGIPV

SEQ ID NO: 1034639 - protein, 18 aa, Mycobacterium
GGLLRYGIPEFKMEKRFL

SEQ ID NO: 1034640 - protein, 19 aa, Mycobacterium
GGLRADMAVGQLVLISDHL

SEQ ID NO: 1034641 - protein, 20 aa, Mycobacterium
GGLRCISSRITVSGSTLLEL

SEQ ID NO: 1034642 - protein, 20 aa, Mycobacterium
GGLRRSMAKAGYCDLKEFQK

SEQ ID NO: 1034643 - protein, 19 aa, Mycobacterium
GGLTRVALVEGSRVVNSSQ

SEQ ID NO: 1034644 - protein, 22 aa, Mycobacterium
GGPGLRPAGVAIGRVIDAEDAT

SEQ ID NO: 1034645 - protein, 17 aa, Mycobacterium
GGPGYKFADEFHPELQF

SEQ ID NO: 1034646 - protein, 17 aa, Mycobacterium
GGPRKVSPLAVQMIMPN

SEQ ID NO: 1034647 - protein, 22 aa, Mycobacterium
GGPSLRLPLTHGDLLVMGGSCQ

SEQ ID NO: 1034648 - protein, 17 aa, Mycobacterium
GGRTSYRGLVQVNKGAH

SEQ ID NO: 1034649 - protein, 18 aa, Mycobacterium
GGSALVEFAGRACYQSWS

SEQ ID NO: 1034650 - protein, 24 aa, Mycobacterium
GGSDFGINWNCHADCYDQPGRQHR

SEQ ID NO: 1034651 - protein, 18 aa, Mycobacterium
GGSGMERTWCSFCEGSVP

SEQ ID NO: 1034652 - protein, 17 aa, Mycobacterium
GGTMRLGAYPAVLQPAS

SEQ ID NO: 1034653 - protein, 29 aa, Mycobacterium
GGTPKGVAAWLVLCCRALHAGAQEALSIA

SEQ ID NO: 1034654 - protein, 23 aa, Mycobacterium
GGVIALAAARRGIDVHFHTPSEV

SEQ ID NO: 1034655 - protein, 23 aa, Mycobacterium
GGVTGRRVCAVVGSGDNGGDALW

SEQ ID NO: 1034656 - protein, 19 aa, Mycobacterium
GGYTYGGRIAALADSVREN

SEQ ID NO: 1034657 - protein, 20 aa, Mycobacterium
GHAEAALLRLAEECQIPVLM

SEQ ID NO: 1034658 - protein, 18 aa, Mycobacterium
GHAFFALGTFMVSLDSNL

SEQ ID NO: 1034659 - protein, 27 aa, Mycobacterium
GHAGPRRCIKELSWAHVAEQTLDIYRK

SEQ ID NO: 1034660 - protein, 17 aa, Mycobacterium
GHDMFGWHGLSRRRAIG

SEQ ID NO: 1034661 - protein, 20 aa, Mycobacterium
GHGFDIGWRMGMSNYETYTP

SEQ ID NO: 1034662 - protein, 25 aa, Mycobacterium
GHLDWYAEGIFPPMHLDAEHNDDGT

SEQ ID NO: 1034663 - protein, 18 aa, Mycobacterium
GHRRIVFRFLTSPIEIKG

SEQ ID NO: 1034664 - protein, 17 aa, Mycobacterium
GHRYPAAIRLWRNAWNE

SEQ ID NO: 1034665 - protein, 18 aa, Mycobacterium
GHSIRWSLTLSYDRIHGC

SEQ ID NO: 1034666 - protein, 20 aa, Mycobacterium
GHSVLLPFGIAPTGFTRLMH

SEQ ID NO: 1034667 - protein, 23 aa, Mycobacterium
GHTSRWIEIAAEWGTRDYWEHWL

SEQ ID NO: 1034668 - protein, 20 aa, Mycobacterium
GHYSFLNVFKLFGPGNQAPL

SEQ ID NO: 1034669 - protein, 24 aa, Mycobacterium
GIAEVIYWVAAWVSLGVADFIPPD

SEQ ID NO: 1034670 - protein, 21 aa, Mycobacterium
GIAVADLNAAISWYHDHLGMI

SEQ ID NO: 1034671 - protein, 23 aa, Mycobacterium
GIAYQVRGGEGFFNRQEIKQALL

SEQ ID NO: 1034672 - protein, 17 aa, Mycobacterium
GICAIELDLAAMPIVEG

SEQ ID NO: 1034673 - protein, 20 aa, Mycobacterium
GIDVGEWLYVRAHLVDGRRK

SEQ ID NO: 1034674 - protein, 19 aa, Mycobacterium
GIEAFELVVVNLYPFSQTV

SEQ ID NO: 1034675 - protein, 19 aa, Mycobacterium
GIEFCKLSFAETRVRAQSL

SEQ ID NO: 1034676 - protein, 24 aa, Mycobacterium
GIGAIVKRPRVVIDASGNESIGVR

SEQ ID NO: 1034677 - protein, 18 aa, Mycobacterium
GIGPSRTRLISGRGQDVL

SEQ ID NO: 1034678 - protein, 23 aa, Mycobacterium
GIGPTRIHTVLGILKAYTTRVGS

SEQ ID NO: 1034679 - protein, 31 aa, Mycobacterium
GIGVLYARRELLSVMPPFLTGGSMIETVTME

SEQ ID NO: 1034680 - protein, 17 aa, Mycobacterium
GILKYSRDLAFTAATAY

SEQ ID NO: 1034681 - protein, 17 aa, Mycobacterium
GIMSGAGTALMGIGSAR

SEQ ID NO: 1034682 - protein, 24 aa, Mycobacterium
GIPDIPGYAAKVFRAVADADVNID

SEQ ID NO: 1034683 - protein, 22 aa, Mycobacterium
GIPKLRIEEAAARTQARIDSGR

SEQ ID NO: 1034684 - protein, 24 aa, Mycobacterium
GIPVRRVRATHAFHTSSMEPMLRE

SEQ ID NO: 1034685 - protein, 24 aa, Mycobacterium
GIRRRVAADLQILKRFAQAVELAK

SEQ ID NO: 1034686 - protein, 25 aa, Mycobacterium
GISRVSSWGQLPSAIAYARRHDPKV

SEQ ID NO: 1034687 - protein, 25 aa, Mycobacterium
GISSPRLLFDMFWVGHCAELAEVMA

SEQ ID NO: 1034688 - protein, 24 aa, Mycobacterium
GITRARVYLALSWALSRTPGGRQS

SEQ ID NO: 1034689 - protein, 17 aa, Mycobacterium
GITRCLWRAIDQDGNVS

SEQ ID NO: 1034690 - protein, 21 aa, Mycobacterium
GIVDHLWHFIAGALTGLKDIV

SEQ ID NO: 1034691 - protein, 19 aa, Mycobacterium
GIVRPWAHRAFLHRHPPGY

SEQ ID NO: 1034692 - protein, 19 aa, Mycobacterium
GKAKALRYFSEQAGVPMEQ

SEQ ID NO: 1034693 - protein, 20 aa, Mycobacterium
GKAVYLKDIWPSQKDVTDTI

SEQ ID NO: 1034694 - protein, 19 aa, Mycobacterium
GKDISCNLGSLNIAKTMDS

SEQ ID NO: 1034695 - protein, 26 aa, Mycobacterium
GKDRMVGIDVTHAWASVWTPQQSGQC

SEQ ID NO: 1034696 - protein, 17 aa, Mycobacterium
GKFTRFSVMQSGAEPGA

SEQ ID NO: 1034697 - protein, 17 aa, Mycobacterium
GKFVKAADWVGRDEAEA

SEQ ID NO: 1034698 - protein, 18 aa, Mycobacterium
GKGEALWRSLAVTSGDIV

SEQ ID NO: 1034699 - protein, 20 aa, Mycobacterium
GKGLAKGRIVLATVKGDVHD

SEQ ID NO: 1034700 - protein, 18 aa, Mycobacterium
GKGLSRLVRHSCDEVVSI

SEQ ID NO: 1034701 - protein, 19 aa, Mycobacterium
GKGSEYFLRNMLKSTSTFR

SEQ ID NO: 1034702 - protein, 23 aa, Mycobacterium
GKKSFCLLQRVGMSASDIDLDEI

SEQ ID NO: 1034703 - protein, 23 aa, Mycobacterium
GKLPRLSQRLGVLTRTNSESIVG

SEQ ID NO: 1034704 - protein, 25 aa, Mycobacterium
GKNTFHGLLLLRHVDELVKTGWPVL

SEQ ID NO: 1034705 - protein, 24 aa, Mycobacterium
GKPWGSRFPLISIRDQVEADIAAL

SEQ ID NO: 1034706 - protein, 27 aa, Mycobacterium
GKPWKVPKFYWSVFALSAFEAGMNALQ

SEQ ID NO: 1034707 - protein, 20 aa, Mycobacterium
GKQRPHVFSVDGPVTNGPVW

SEQ ID NO: 1034708 - protein, 22 aa, Mycobacterium
GKRIERREWLTSLLEAISSKDR

SEQ ID NO: 1034709 - protein, 19 aa, Mycobacterium
GKTPILYVVGRKALNYYTF

SEQ ID NO: 1034710 - protein, 21 aa, Mycobacterium
GKTYTRWGAFLDDAAGFDAGF

SEQ ID NO: 1034711 - protein, 23 aa, Mycobacterium
GKVARFVKQYADIAGELRRAAMQ

SEQ ID NO: 1034712 - protein, 20 aa, Mycobacterium
GKVVGCGALHVLWSDLGEIR

SEQ ID NO: 1034713 - protein, 19 aa, Mycobacterium
GLAAADWGGRWLVVDADID

SEQ ID NO: 1034714 - protein, 18 aa, Mycobacterium
GLADIEWTVQLMQLRHAH

SEQ ID NO: 1034715 - protein, 20 aa, Mycobacterium
GLAERIEVQVAYAIGKAAPV

SEQ ID NO: 1034716 - protein, 19 aa, Mycobacterium
GLAHIRPDDVVLAFSDLTE

SEQ ID NO: 1034717 - protein, 23 aa, Mycobacterium
GLAREIACAYDLAFVDPASDQAV

SEQ ID NO: 1034718 - protein, 25 aa, Mycobacterium
GLARRIKRLIVFDVDSTLVQGEVIE

SEQ ID NO: 1034719 - protein, 18 aa, Mycobacterium
GLAVAIPFGMVGLIHPRS

SEQ ID NO: 1034720 - protein, 22 aa, Mycobacterium
GLDGASFCWRTIRGQECSAYWP

SEQ ID NO: 1034721 - protein, 27 aa, Mycobacterium
GLDGLEVPLRIAVMGCVVNGPGEARDA

SEQ ID NO: 1034722 - protein, 18 aa, Mycobacterium
GLDIKRYSPRLMANAISN

SEQ ID NO: 1034723 - protein, 21 aa, Mycobacterium
GLDLCSPRGATYLATAPGELG

SEQ ID NO: 1034724 - protein, 22 aa, Mycobacterium
GLDLRTGIACQFRDLGVMSIED

SEQ ID NO: 1034725 - protein, 17 aa, Mycobacterium
GLDQAGHCHRVHVEITG

SEQ ID NO: 1034726 - protein, 27 aa, Mycobacterium
GLDRLKETIVYCRIGERSSHTWFVLRE

SEQ ID NO: 1034727 - protein, 17 aa, Mycobacterium
GLDSGGLADEVKAAEVL

SEQ ID NO: 1034728 - protein, 25 aa, Mycobacterium
GLDSRAYRLDWPTGTTVYEIDQPKV

SEQ ID NO: 1034729 - protein, 27 aa, Mycobacterium
GLDYQIWQCPVVLLADVRSVGVQGDNR

SEQ ID NO: 1034730 - protein, 19 aa, Mycobacterium
GLEIALACHHRIAADVKGS

SEQ ID NO: 1034731 - protein, 17 aa, Mycobacterium
GLETLAIRVDHCNSSAH

SEQ ID NO: 1034732 - protein, 18 aa, Mycobacterium
GLETLSLRVKWHVVNVQR

SEQ ID NO: 1034733 - protein, 29 aa, Mycobacterium
GLFDPRLKRPIPFLPNMIGIITGRASAAE

SEQ ID NO: 1034734 - protein, 19 aa, Mycobacterium
GLIGSRWLAHYTATSAFLD

SEQ ID NO: 1034735 - protein, 17 aa, Mycobacterium
GLIGVRIMQRTGSHRIW

SEQ ID NO: 1034736 - protein, 17 aa, Mycobacterium
GLIQKGRQVSVRDIDEM

SEQ ID NO: 1034737 - protein, 18 aa, Mycobacterium
GLKASLLPHCRLINRITI

SEQ ID NO: 1034738 - protein, 20 aa, Mycobacterium
GLKSYRGDMINGFAPDAAAR

SEQ ID NO: 1034739 - protein, 19 aa, Mycobacterium
GLKSYRGDMINGFPPDAAA

SEQ ID NO: 1034740 - protein, 18 aa, Mycobacterium
GLKVRRRAHSWHERLCAE

SEQ ID NO: 1034741 - protein, 26 aa, Mycobacterium
GLLDKLIPVKRITFVVDTDRKLLNVI

SEQ ID NO: 1034742 - protein, 25 aa, Mycobacterium
GLLGSLRIGNRFVHTGKPTPTAYAQ

SEQ ID NO: 1034743 - protein, 19 aa, Mycobacterium
GLLKLLSRLDIMPLPNTAG

SEQ ID NO: 1034744 - protein, 25 aa, Mycobacterium
GLLLRRQATEIIVFFVVDPPAGLTE

SEQ ID NO: 1034745 - protein, 25 aa, Mycobacterium
GLLTGIRKLAWPKLKQHYGARLEQL

SEQ ID NO: 1034746 - protein, 25 aa, Mycobacterium
GLLTLEGTNTWVLRGPGSGELVIVD

SEQ ID NO: 1034747 - protein, 25 aa, Mycobacterium
GLNLPGVAFGHDWLTGTARYAGLLE

SEQ ID NO: 1034748 - protein, 20 aa, Mycobacterium
GLPAEDLMSVAVSVEPVLAA

SEQ ID NO: 1034749 - protein, 20 aa, Mycobacterium
GLPELRWVVFEASKCVVQRS

SEQ ID NO: 1034750 - protein, 21 aa, Mycobacterium
GLPLAIARPDLQVVLLEPLLR

SEQ ID NO: 1034751 - protein, 18 aa, Mycobacterium
GLQGSGWAVLGYDTLGNK

SEQ ID NO: 1034752 - protein, 27 aa, Mycobacterium
GLRALLRAGIYWAHEALAYGMTKRPNT

SEQ ID NO: 1034753 - protein, 20 aa, Mycobacterium
GLRNLFKLSSLASFEGQLSK

SEQ ID NO: 1034754 - protein, 18 aa, Mycobacterium
GLRVMVNILSRLCPSSHE

SEQ ID NO: 1034755 - protein, 25 aa, Mycobacterium
GLSHPMGPLRLSDLVGLDTLKLIAD

SEQ ID NO: 1034756 - protein, 24 aa, Mycobacterium
GLTDAGSITSYWCAEDADITGILT

SEQ ID NO: 1034757 - protein, 17 aa, Mycobacterium
GLTEVLRAAAQHRGATL

SEQ ID NO: 1034758 - protein, 18 aa, Mycobacterium
GLTHRLPTLTLRVVEDQT

SEQ ID NO: 1034759 - protein, 19 aa, Mycobacterium
GLTPRARMVATATSGADPV

SEQ ID NO: 1034760 - protein, 17 aa, Mycobacterium
GLTQMWEAVECHRQVLT

SEQ ID NO: 1034761 - protein, 19 aa, Mycobacterium
GLVAGRLSRIVVSPLDSDS

SEQ ID NO: 1034762 - protein, 23 aa, Mycobacterium
GLVGARPRCGPVATVLAAGTASP

SEQ ID NO: 1034763 - protein, 19 aa, Mycobacterium
GLVGHGFGGSAAVLAAAGL

SEQ ID NO: 1034764 - protein, 26 aa, Mycobacterium
GLVGISVDCARYWLDTNRPISKSDAV

SEQ ID NO: 1034765 - protein, 19 aa, Mycobacterium
GLVKRADVVVGGQRGYGLP

SEQ ID NO: 1034766 - protein, 23 aa, Mycobacterium
GLVKRSRDLSDLRAVLVDITPRG

SEQ ID NO: 1034767 - protein, 26 aa, Mycobacterium
GLVMPELKGKLDGYALRVPIPTGSVT

SEQ ID NO: 1034768 - protein, 17 aa, Mycobacterium
GLWQEIAGLPPERIQRR

SEQ ID NO: 1034769 - protein, 19 aa, Mycobacterium
GLYTRWPERDSLVNEIDSA

SEQ ID NO: 1034770 - protein, 19 aa, Mycobacterium
GMAASDCALRVMLRPGDHV

SEQ ID NO: 1034771 - protein, 27 aa, Mycobacterium
GMAAVQFARHWGVEIFVTASRGKWDTL

SEQ ID NO: 1034772 - protein, 24 aa, Mycobacterium
GMAHLFPLVVVVHADVELRVRRLV

SEQ ID NO: 1034773 - protein, 24 aa, Mycobacterium
GMAKIRFTRNIFKHLLYRARDLRA

SEQ ID NO: 1034774 - protein, 18 aa, Mycobacterium
GMDGFGVLRWLRRRHSHP

SEQ ID NO: 1034775 - protein, 19 aa, Mycobacterium
GMERTWCSFCEGSVPYSSV

SEQ ID NO: 1034776 - protein, 23 aa, Mycobacterium
GMGGSIPFIAEFASAFPQAKILV

SEQ ID NO: 1034777 - protein, 17 aa, Mycobacterium
GMLQCNCYVLADRAGTD

SEQ ID NO: 1034778 - protein, 21 aa, Mycobacterium
GMNDVKTWISFGASPRASLGI

SEQ ID NO: 1034779 - protein, 22 aa, Mycobacterium
GMPNRIRWTVVRYKAPEAMTLN

SEQ ID NO: 1034780 - protein, 20 aa, Mycobacterium
GMPVLFWLDPYRPHENELIK

SEQ ID NO: 1034781 - protein, 23 aa, Mycobacterium
GMPVLGICNGFQVLCEAGLLPGA

SEQ ID NO: 1034782 - protein, 27 aa, Mycobacterium
GMRSLQRLLPMPSYRTVSNFTKRPFGR

SEQ ID NO: 1034783 - protein, 19 aa, Mycobacterium
GMSGARITLHVALELARRG

SEQ ID NO: 1034784 - protein, 22 aa, Mycobacterium
GMVWRYSDYFIVGREQCREFAR

SEQ ID NO: 1034785 - protein, 23 aa, Mycobacterium
GNALPAWRDVVAVEHVKQRIVEA

SEQ ID NO: 1034786 - protein, 18 aa, Mycobacterium
GNDGIAIVPVLAKTGYTT

SEQ ID NO: 1034787 - protein, 21 aa, Mycobacterium
GNEAFGLWVSTFVFNRFISFI

SEQ ID NO: 1034788 - protein, 23 aa, Mycobacterium
GNFDPKEAITHGFVDTQQLSAWQ

SEQ ID NO: 1034789 - protein, 25 aa, Mycobacterium
GNFLLLGYQRCRVHYGLVSCDRSTG

SEQ ID NO: 1034790 - protein, 18 aa, Mycobacterium
GNGFLLSLIYNSYITRFF

SEQ ID NO: 1034791 - protein, 20 aa, Mycobacterium
GNGHPGTAMSLAPLAYTLFQ

SEQ ID NO: 1034792 - protein, 27 aa, Mycobacterium
GNIEMTDWWSYLDGVRKTYPLSYSPQS

SEQ ID NO: 1034793 - protein, 19 aa, Mycobacterium
GNKAMLAKVRRAPELIKVE

SEQ ID NO: 1034794 - protein, 28 aa, Mycobacterium
GNLDPVVLLAGWPAVERVARTVVDDGRR

SEQ ID NO: 1034795 - protein, 25 aa, Mycobacterium
GNPEIRPVHLLLAMLMQNDGIAAPL

SEQ ID NO: 1034796 - protein, 22 aa, Mycobacterium
GNSFGAFVPKGITLRVYGDAND

SEQ ID NO: 1034797 - protein, 19 aa, Mycobacterium
GNSLVRLLFGKSIRIGDIV

SEQ ID NO: 1034798 - protein, 20 aa, Mycobacterium
GNSTLRFSRLPTTERSPAGV

SEQ ID NO: 1034799 - protein, 20 aa, Mycobacterium
GNSWPMARLTLSLATLPTMG

SEQ ID NO: 1034800 - protein, 24 aa, Mycobacterium
GNTEVKSFVQRVCNEQLIHWFEAN

SEQ ID NO: 1034801 - protein, 20 aa, Mycobacterium
GNVHPFSGVAVISRGIVDGR

SEQ ID NO: 1034802 - protein, 25 aa, Mycobacterium
GNVTKLKLAEHMVEGAAILAVLLGP

SEQ ID NO: 1034803 - protein, 22 aa, Mycobacterium
GPAELGAAVIITQRGHQIILYQ

SEQ ID NO: 1034804 - protein, 18 aa, Mycobacterium
GPAKLAIKTGAALLPVHC

SEQ ID NO: 1034805 - protein, 23 aa, Mycobacterium
GPALRLVPAVSTLVVSGKTVQRV

SEQ ID NO: 1034806 - protein, 31 aa, Mycobacterium
GPATLTDLVFAWRACRAVKSNAIVIAADGAT

SEQ ID NO: 1034807 - protein, 30 aa, Mycobacterium
GPDKGAVVYGHLQIRVCKFGEAVVVIDHRG

SEQ ID NO: 1034808 - protein, 21 aa, Mycobacterium
GPDLVLRWAALLHDIGKPATR

SEQ ID NO: 1034809 - protein, 20 aa, Mycobacterium
GPDYRHRDLLPAPQPLWDEQ

SEQ ID NO: 1034810 - protein, 18 aa, Mycobacterium
GPELKIMTPKGVQTMAQL

SEQ ID NO: 1034811 - protein, 19 aa, Mycobacterium
GPGATILLRLDQDVPGDVR

SEQ ID NO: 1034812 - protein, 21 aa, Mycobacterium
GPGCGRCRACTTTMAGTHADV

SEQ ID NO: 1034813 - protein, 25 aa, Mycobacterium
GPGHPTPGWWDWIAGPGAPIDTNRW

SEQ ID NO: 1034814 - protein, 19 aa, Mycobacterium
GPGIANPWTPIADLRERIA

SEQ ID NO: 1034815 - protein, 19 aa, Mycobacterium
GPKTGRVTQLFTGDCLFPG

SEQ ID NO: 1034816 - protein, 26 aa, Mycobacterium
GPLDWAVELDERWVIIGPNGAGKTSL

SEQ ID NO: 1034817 - protein, 17 aa, Mycobacterium
GPLEASRPWATKDVVGA

SEQ ID NO: 1034818 - protein, 25 aa, Mycobacterium
GPLLEAIGLTVGWITAESTREDRKA

SEQ ID NO: 1034819 - protein, 26 aa, Mycobacterium
GPLMTKEIFGPILPVLTVQSLDEAIG

SEQ ID NO: 1034820 - protein, 19 aa, Mycobacterium
GPPMPPSVGSQVIEIPGLP

SEQ ID NO: 1034821 - protein, 17 aa, Mycobacterium
GPQTPWIDAEMQRDPTA

SEQ ID NO: 1034822 - protein, 24 aa, Mycobacterium
GPRGCGKTSSARILARSLNCAQGT

SEQ ID NO: 1034823 - protein, 17 aa, Mycobacterium
GPRVYELLYGEPFPSDI

SEQ ID NO: 1034824 - protein, 25 aa, Mycobacterium
GPSRYRHCCRVCSHSSGPVFVPIGV

SEQ ID NO: 1034825 - protein, 20 aa, Mycobacterium
GPTAALAVATRFMKEGGAHA

SEQ ID NO: 1034826 - protein, 23 aa, Mycobacterium
GPTLMVSDLFDFSLYVDARIQDI

SEQ ID NO: 1034827 - protein, 19 aa, Mycobacterium
GPVDPSGWEVYGRGGQFLT

SEQ ID NO: 1034828 - protein, 19 aa, Mycobacterium
GPVWPRNPWTAAYRQERLE

SEQ ID NO: 1034829 - protein, 28 aa, Mycobacterium
GPWAEVGRAQFFAGLGVSLLTAEQGLAA

SEQ ID NO: 1034830 - protein, 19 aa, Mycobacterium
GPYPTMYVNQPWTIRQYAG

SEQ ID NO: 1034831 - protein, 25 aa, Mycobacterium
GPYSEFPRFYSLMAEMSGAMFDAAF

SEQ ID NO: 1034832 - protein, 30 aa, Mycobacterium
GQAIPRLLSNWRVNPVLAVLAASTRAAGAG

SEQ ID NO: 1034833 - protein, 24 aa, Mycobacterium
GQERLTTAVIEWRTQGRNYLTIQY

SEQ ID NO: 1034834 - protein, 25 aa, Mycobacterium
GQEVCALLAGGGYAEYVAVPASQVM

SEQ ID NO: 1034835 - protein, 22 aa, Mycobacterium
GQFQFALELTERVSTTNPQVAA

SEQ ID NO: 1034836 - protein, 18 aa, Mycobacterium
GQGSRLATILSLCAHIAS

SEQ ID NO: 1034837 - protein, 23 aa, Mycobacterium
GQHEFPSFLGHAGSNDCHSVTPR

SEQ ID NO: 1034838 - protein, 17 aa, Mycobacterium
GQIAGLNVLRIVNEPTA

SEQ ID NO: 1034839 - protein, 19 aa, Mycobacterium
GQITWAEIIALRRRAYAML

SEQ ID NO: 1034840 - protein, 17 aa, Mycobacterium
GQLCLPFYGALVTNCGL

SEQ ID NO: 1034841 - protein, 23 aa, Mycobacterium
GQLEFGSAVWMDVCTVVESAVGR

SEQ ID NO: 1034842 - protein, 23 aa, Mycobacterium
GQLPGRKVYPWIAQVRNSTPGVG

SEQ ID NO: 1034843 - protein, 17 aa, Mycobacterium
GQLRLADFDRLELSNLN

SEQ ID NO: 1034844 - protein, 19 aa, Mycobacterium
GQLSKWSRMDAELIGEYAE

SEQ ID NO: 1034845 - protein, 20 aa, Mycobacterium
GQLYTGHCVIRLLNNETTYS

SEQ ID NO: 1034846 - protein, 24 aa, Mycobacterium
GQPTMRGSDAWVPRNAFDDGEFTR

SEQ ID NO: 1034847 - protein, 25 aa, Mycobacterium
GQQLRYDLSVGFPLVTTKKVHFKSV

SEQ ID NO: 1034848 - protein, 19 aa, Mycobacterium
GQRKALAFIEGRSVEQLVA

SEQ ID NO: 1034849 - protein, 30 aa, Mycobacterium
GQRRLVNRKVLPGYILVRMDLTDDSWAAVR

SEQ ID NO: 1034850 - protein, 17 aa, Mycobacterium
GQTLLLWAPMQYRTDLQ

SEQ ID NO: 1034851 - protein, 20 aa, Mycobacterium
GRANIAVGIPTFNRPADCTN

SEQ ID NO: 1034852 - protein, 18 aa, Mycobacterium
GRAVAWVQRIEYQRLRLP

SEQ ID NO: 1034853 - protein, 32 aa, Mycobacterium
GRDAAQPGSCWVRSSWLARYWPACSATAGCLP

SEQ ID NO: 1034854 - protein, 35 aa, Mycobacterium
GRDLLFARLLQYRAFKRVAQIFAELEATALRSYPH

SEQ ID NO: 1034855 - protein, 28 aa, Mycobacterium
GRDLRWLRRVGLLAASACAVFFRHPSRV

SEQ ID NO: 1034856 - protein, 20 aa, Mycobacterium
GREAYPGDVFYLHSRLLERC

SEQ ID NO: 1034857 - protein, 18 aa, Mycobacterium
GRGALPRIPLTHSVSVSN

SEQ ID NO: 1034858 - protein, 25 aa, Mycobacterium
GRGAWLHPDMQCVQQAIRRRAFTGA

SEQ ID NO: 1034859 - protein, 24 aa, Mycobacterium
GRGESACALGAVKTNLGHLEAAAG

SEQ ID NO: 1034860 - protein, 17 aa, Mycobacterium
GRGLPRCKGRRLPGRCS

SEQ ID NO: 1034861 - protein, 21 aa, Mycobacterium
GRGSQWAGMGRQLLADEPAFT

SEQ ID NO: 1034862 - protein, 17 aa, Mycobacterium
GRGSQWAGMGRQLMADE

SEQ ID NO: 1034863 - protein, 25 aa, Mycobacterium
GRGVTVGRPLGLLLTRRSENATVTL

SEQ ID NO: 1034864 - protein, 18 aa, Mycobacterium
GRHIPVFVHVTVETTGTM

SEQ ID NO: 1034865 - protein, 19 aa, Mycobacterium
GRIAVPLSVPQGGVTDERF

SEQ ID NO: 1034866 - protein, 25 aa, Mycobacterium
GRIDRRGRMLWSLPKGHIEQGETAE

SEQ ID NO: 1034867 - protein, 20 aa, Mycobacterium
GRIGFPAIVATIADVLQRAD

SEQ ID NO: 1034868 - protein, 20 aa, Mycobacterium
GRIKDLVIIDGRNHYPQDLE

SEQ ID NO: 1034869 - protein, 19 aa, Mycobacterium
GRILRQWLANYCGRRQERS

SEQ ID NO: 1034870 - protein, 20 aa, Mycobacterium
GRISHTLGLHGPAMTFDTAC

SEQ ID NO: 1034871 - protein, 25 aa, Mycobacterium
GRIVTSTSWRLRIQGSLDRVGTRTP

SEQ ID NO: 1034872 - protein, 21 aa, Mycobacterium
GRLILADAIVRACQDNPDYLI

SEQ ID NO: 1034873 - protein, 17 aa, Mycobacterium
GRLPAGVTAKDIILALI

SEQ ID NO: 1034874 - protein, 20 aa, Mycobacterium
GRLRVPPVPILKGDKGEPCW

SEQ ID NO: 1034875 - protein, 19 aa, Mycobacterium
GRLSLVLNGMLTQIQEALA

SEQ ID NO: 1034876 - protein, 21 aa, Mycobacterium
GRLTGLCYENTIVTVPQNGVA

SEQ ID NO: 1034877 - protein, 20 aa, Mycobacterium
GRMHPVVAIYSTFLNRAFDQ

SEQ ID NO: 1034878 - protein, 18 aa, Mycobacterium
GRMLPYAIELDGNFCGQL

SEQ ID NO: 1034879 - protein, 19 aa, Mycobacterium
GRNQLRVAMFPAVEPDDVR

SEQ ID NO: 1034880 - protein, 23 aa, Mycobacterium
GRPLPPIIAAIFRKAIGGTVHEV

SEQ ID NO: 1034881 - protein, 21 aa, Mycobacterium
GRPPKSICFDYQHLSAGKAKR

SEQ ID NO: 1034882 - protein, 19 aa, Mycobacterium
GRPPTGMAALRITTTDQHD

SEQ ID NO: 1034883 - protein, 25 aa, Mycobacterium
GRRRRLIKYLSLIDVQRYRSLIERL

SEQ ID NO: 1034884 - protein, 23 aa, Mycobacterium
GRRSAESLYDFNLATYDEGDTFD

SEQ ID NO: 1034885 - protein, 33 aa, Mycobacterium
GRRVQLEIFTKFNIPINVARVFHRDQKFRFYRT

SEQ ID NO: 1034886 - protein, 18 aa, Mycobacterium
GRSAGWFIVISRLRELVL

SEQ ID NO: 1034887 - protein, 20 aa, Mycobacterium
GRSDLARRGPGMLATPAIFL

SEQ ID NO: 1034888 - protein, 29 aa, Mycobacterium
GRSGEPFPYPVTVGYMYIMKLHHLVDDKI

SEQ ID NO: 1034889 - protein, 20 aa, Mycobacterium
GRSLRACIDLAALGENTIAV

SEQ ID NO: 1034890 - protein, 22 aa, Mycobacterium
GRSTTRLTLKRPCIPTNDIRLR

SEQ ID NO: 1034891 - protein, 29 aa, Mycobacterium
GRSVLRPDVDVRRTIGWFTNYYPIPLVCV

SEQ ID NO: 1034892 - protein, 26 aa, Mycobacterium
GRSVPDMLDQLALRHGVHDVTAISRR

SEQ ID NO: 1034893 - protein, 23 aa, Mycobacterium
GRSWEHRWALSVLHTALGGGLSS

SEQ ID NO: 1034894 - protein, 18 aa, Mycobacterium
GRSWRIIVTLVCIGDLEG

SEQ ID NO: 1034895 - protein, 18 aa, Mycobacterium
GRTALDAVTACFPAGTLS

SEQ ID NO: 1034896 - protein, 23 aa, Mycobacterium
GRTLGGLAGRIAVVIGAGAMGAL

SEQ ID NO: 1034897 - protein, 21 aa, Mycobacterium
GRTQIGECCVIGPDTTLTDVL

SEQ ID NO: 1034898 - protein, 19 aa, Mycobacterium
GRTVDFKNTVLIFTSNLGT

SEQ ID NO: 1034899 - protein, 19 aa, Mycobacterium
GRTVLPLLPAQDFKRVGEG

SEQ ID NO: 1034900 - protein, 18 aa, Mycobacterium
GRVIFARNSGKLCFATLQ

SEQ ID NO: 1034901 - protein, 20 aa, Mycobacterium
GRVIVACFASNVDRVQQVID

SEQ ID NO: 1034902 - protein, 28 aa, Mycobacterium
GRVQEPMVLPSRFPNLLANGSGGIAVGM

SEQ ID NO: 1034903 - protein, 18 aa, Mycobacterium
GRVRLDRYLYTPMAYPTD

SEQ ID NO: 1034904 - protein, 22 aa, Mycobacterium
GRVTAANILRYIAGHPTKSPGG

SEQ ID NO: 1034905 - protein, 32 aa, Mycobacterium
GRVTQLFTGDCLFPGGVGKTWQRSDFTQLLDD

SEQ ID NO: 1034906 - protein, 25 aa, Mycobacterium
GRVVALEHPGSWGGLVDLPESPDDA

SEQ ID NO: 1034907 - protein, 18 aa, Mycobacterium
GRVWRFVDTAGLRRKVGQ

SEQ ID NO: 1034908 - protein, 24 aa, Mycobacterium
GRWTDSFGGLVFDATGITAPAELK

SEQ ID NO: 1034909 - protein, 24 aa, Mycobacterium
GRYADAWIPIVLVRPTDYSCALEV

SEQ ID NO: 1034910 - protein, 24 aa, Mycobacterium
GRYDEPRKGMSVLLDALPGVMECF

SEQ ID NO: 1034911 - protein, 20 aa, Mycobacterium
GSAIAQHWMYDGKHVLIVFD

SEQ ID NO: 1034912 - protein, 26 aa, Mycobacterium
GSALVQCGAALKQLRTSLTGDEALGI

SEQ ID NO: 1034913 - protein, 20 aa, Mycobacterium
GSARCASPCDGYDAGPGCVR

SEQ ID NO: 1034914 - protein, 23 aa, Mycobacterium
GSASLLPITWAYIRMMGADGLRT

SEQ ID NO: 1034915 - protein, 22 aa, Mycobacterium
GSDSLLPMWLDLEECATGVTKQ

SEQ ID NO: 1034916 - protein, 25 aa, Mycobacterium
GSDVLPEPTFVPILGRIAAGSPIFA

SEQ ID NO: 1034917 - protein, 32 aa, Mycobacterium
GSEKIKALAVREGPAALPWHAFGVDVVVESTG

SEQ ID NO: 1034918 - protein, 20 aa, Mycobacterium
GSGAGAAYLVDWAKDIDPAW

SEQ ID NO: 1034919 - protein, 18 aa, Mycobacterium
GSGFNWPAPDHLRLVTLP

SEQ ID NO: 1034920 - protein, 21 aa, Mycobacterium
GSGKDWQVWAGDKVADLVQLN

SEQ ID NO: 1034921 - protein, 21 aa, Mycobacterium
GSGKGSPEWWVVNVKPGRVLF

SEQ ID NO: 1034922 - protein, 17 aa, Mycobacterium
GSGLWLYITELDTAAHA

SEQ ID NO: 1034923 - protein, 19 aa, Mycobacterium
GSGPAYFFLLVEALVDAGV

SEQ ID NO: 1034924 - protein, 21 aa, Mycobacterium
GSGPLRPAAAAVFATVSASGV

SEQ ID NO: 1034925 - protein, 19 aa, Mycobacterium
GSGSLLIKNAQNLDQQRTP

SEQ ID NO: 1034926 - protein, 27 aa, Mycobacterium
GSGTVRARYRLKLAHCGVRGTDGSPDR

SEQ ID NO: 1034927 - protein, 18 aa, Mycobacterium
GSHKAVTCAGQVTRDNTE

SEQ ID NO: 1034928 - protein, 19 aa, Mycobacterium
GSIAAVDFVGWYNAHPNFH

SEQ ID NO: 1034929 - protein, 19 aa, Mycobacterium
GSIEIWKLITAAVKHDPYG

SEQ ID NO: 1034930 - protein, 27 aa, Mycobacterium
GSITYNEWSFASARKLNTAKIATSADP

SEQ ID NO: 1034931 - protein, 19 aa, Mycobacterium
GSKDTWVLAPHASYGAREL

SEQ ID NO: 1034932 - protein, 22 aa, Mycobacterium
GSKRFIGCGQILFEDVVIGVAQ

SEQ ID NO: 1034933 - protein, 24 aa, Mycobacterium
GSKSELAATIAGYRASKTLEGNIH

SEQ ID NO: 1034934 - protein, 28 aa, Mycobacterium
GSLADFGELHWRSGAAVAVVLAAENYPR

SEQ ID NO: 1034935 - protein, 18 aa, Mycobacterium
GSLHLALDNMRAMGVDIE

SEQ ID NO: 1034936 - protein, 21 aa, Mycobacterium
GSLPERLRVLALTLASERTVV

SEQ ID NO: 1034937 - protein, 21 aa, Mycobacterium
GSLRQLGPINWVIAKLAASLL

SEQ ID NO: 1034938 - protein, 24 aa, Mycobacterium
GSLYFGVPTVWSRLVADEAVARAL

SEQ ID NO: 1034939 - protein, 23 aa, Mycobacterium
GSMGGARALEWIIGHPDQVRAGL

SEQ ID NO: 1034940 - protein, 20 aa, Mycobacterium
GSPPRADWSLPPIRIAVDLP

SEQ ID NO: 1034941 - protein, 19 aa, Mycobacterium
GSPQLSYPSIHVAGTNGKT

SEQ ID NO: 1034942 - protein, 27 aa, Mycobacterium
GSRIGAARFRLARELMPIEGSKRVRDL

SEQ ID NO: 1034943 - protein, 17 aa, Mycobacterium
GSSIEFYNAQFISPNGT

SEQ ID NO: 1034944 - protein, 25 aa, Mycobacterium
GSSIKGGIVDLDIGQLIGDRIKLLT

SEQ ID NO: 1034945 - protein, 20 aa, Mycobacterium
GSSIMPGKVNPVLPEAVTQV

SEQ ID NO: 1034946 - protein, 17 aa, Mycobacterium
GSSIQLLGKESSYASLR

SEQ ID NO: 1034947 - protein, 23 aa, Mycobacterium
GSTCIPVGHGLYLAKQIARSRFV

SEQ ID NO: 1034948 - protein, 18 aa, Mycobacterium
GSVARLQFSPAVHSRVRR

SEQ ID NO: 1034949 - protein, 23 aa, Mycobacterium
GSVPIAPIWLCPLRLRDHNSWPL

SEQ ID NO: 1034950 - protein, 19 aa, Mycobacterium
GSYPIVLATYEIVCSKYPD

SEQ ID NO: 1034951 - protein, 19 aa, Mycobacterium
GSYTARAVACFAYHQPVPV

SEQ ID NO: 1034952 - protein, 29 aa, Mycobacterium
GSYVPQLPWPFGLIDHAARVLLPVTNAAR

SEQ ID NO: 1034953 - protein, 18 aa, Mycobacterium
GTAIWKRSPGGLVTALEP

SEQ ID NO: 1034954 - protein, 22 aa, Mycobacterium
GTAYLAGFAWGMSRDYSVLVEM

SEQ ID NO: 1034955 - protein, 21 aa, Mycobacterium
GTEKQKKWAVWAAERNWGSTM

SEQ ID NO: 1034956 - protein, 17 aa, Mycobacterium
GTFFKGFERSKYASGEF

SEQ ID NO: 1034957 - protein, 18 aa, Mycobacterium
GTFSLRLSDIRAVGIGEL

SEQ ID NO: 1034958 - protein, 27 aa, Mycobacterium
GTGAGVSGLWLLSGMSYDGVLTTIDIE

SEQ ID NO: 1034959 - protein, 23 aa, Mycobacterium
GTGKSVFLKSLIGLLRPERGSIL

SEQ ID NO: 1034960 - protein, 25 aa, Mycobacterium
GTHPSLCLLASWVSPGSPAGRRLCA

SEQ ID NO: 1034961 - protein, 19 aa, Mycobacterium
GTIDSWSMFAVGILNATAM

SEQ ID NO: 1034962 - protein, 21 aa, Mycobacterium
GTIFPILPIRRCRMHTRPAIS

SEQ ID NO: 1034963 - protein, 24 aa, Mycobacterium
GTKIPVTVKFRIGIDDEHHTHLDA

SEQ ID NO: 1034964 - protein, 17 aa, Mycobacterium
GTLKRVDVVLRRVDADY

SEQ ID NO: 1034965 - protein, 18 aa, Mycobacterium
GTLPLAAWPSALQASAKE

SEQ ID NO: 1034966 - protein, 27 aa, Mycobacterium
GTLPRPESLSAFVARVGAALPQTSSGV

SEQ ID NO: 1034967 - protein, 20 aa, Mycobacterium
GTLQWVRPDGADVFEAKTMV

SEQ ID NO: 1034968 - protein, 18 aa, Mycobacterium
GTLREVFDLAEVIQQSPM

SEQ ID NO: 1034969 - protein, 24 aa, Mycobacterium
GTMVIRPYGYRIWELLQDELDSKI

SEQ ID NO: 1034970 - protein, 18 aa, Mycobacterium
GTPCARDVDLSTADIDIT

SEQ ID NO: 1034971 - protein, 20 aa, Mycobacterium
GTPHCPICGEQISRQTPQQI

SEQ ID NO: 1034972 - protein, 20 aa, Mycobacterium
GTPHPAWLQRCAEMNQHAIS

SEQ ID NO: 1034973 - protein, 19 aa, Mycobacterium
GTPLRSRVGHSYIKALMAE

SEQ ID NO: 1034974 - protein, 17 aa, Mycobacterium
GTPRIANRLLRRVRDFA

SEQ ID NO: 1034975 - protein, 26 aa, Mycobacterium
GTPVICLQGKIIPDLIAWWCERDGVR

SEQ ID NO: 1034976 - protein, 20 aa, Mycobacterium
GTQQWGWDRDVAVARLAGAY

SEQ ID NO: 1034977 - protein, 28 aa, Mycobacterium
GTRCRVRLASVLRRCMVLGAQLRGSELT

SEQ ID NO: 1034978 - protein, 25 aa, Mycobacterium
GTRGKRYALPHARILMHQPLGGVTG

SEQ ID NO: 1034979 - protein, 23 aa, Mycobacterium
GTSNHPLLCLVNVGGIPTLLWKL

SEQ ID NO: 1034980 - protein, 18 aa, Mycobacterium
GTSSLSLFNGLGHGAAHI

SEQ ID NO: 1034981 - protein, 20 aa, Mycobacterium
GTVDYHIAWQLQRDLADARV

SEQ ID NO: 1034982 - protein, 19 aa, Mycobacterium
GTVEDIFPLPRELVGEGTL

SEQ ID NO: 1034983 - protein, 18 aa, Mycobacterium
GTVICGPNFAYSLFTKRL

SEQ ID NO: 1034984 - protein, 19 aa, Mycobacterium
GTVTRWLKKIGDSVQADEP

SEQ ID NO: 1034985 - protein, 18 aa, Mycobacterium
GTVTRWLKQEGDTVELDE

SEQ ID NO: 1034986 - protein, 24 aa, Mycobacterium
GTVVKWKLQVTRSRVRDVQVNVDV

SEQ ID NO: 1034987 - protein, 26 aa, Mycobacterium
GVAARLRPAMLEFMDSVAINAVEDTF

SEQ ID NO: 1034988 - protein, 19 aa, Mycobacterium
GVACTLCAILDTREPQAAP

SEQ ID NO: 1034989 - protein, 25 aa, Mycobacterium
GVAELGFPLSIHFEATYGMSPAAFD

SEQ ID NO: 1034990 - protein, 22 aa, Mycobacterium
GVAKSGFSIREWLISLREAGLD

SEQ ID NO: 1034991 - protein, 18 aa, Mycobacterium
GVALSLVYRDGRLTRATT

SEQ ID NO: 1034992 - protein, 17 aa, Mycobacterium
GVAQCWHKLVGDTGKIV

SEQ ID NO: 1034993 - protein, 19 aa, Mycobacterium
GVAYACRSLGVHGRVYVPA

SEQ ID NO: 1034994 - protein, 18 aa, Mycobacterium
GVDGWPATVSCDFDAELP

SEQ ID NO: 1034995 - protein, 25 aa, Mycobacterium
GVDKFPRMVDYVVPTGVRIANADRV

SEQ ID NO: 1034996 - protein, 21 aa, Mycobacterium
GVDQVRYFLLREIPFGQDGNY

SEQ ID NO: 1034997 - protein, 24 aa, Mycobacterium
GVDTLMCVAMHRASPTAKTQQNPA

SEQ ID NO: 1034998 - protein, 25 aa, Mycobacterium
GVEARRFWRSEYLLNSQIARFPKPY

SEQ ID NO: 1034999 - protein, 17 aa, Mycobacterium
GVEDELLRVGAQPGCTV

SEQ ID NO: 1035000 - protein, 24 aa, Mycobacterium
GVEFADRAAFEFNITQLAYVIDEN

SEQ ID NO: 1035001 - protein, 18 aa, Mycobacterium
GVEILLQILHAERYAYHP

SEQ ID NO: 1035002 - protein, 25 aa, Mycobacterium
GVGDAFRAGFLTGRSAGLSLERSAQ

SEQ ID NO: 1035003 - protein, 18 aa, Mycobacterium
GVGEDFWPAAYDPMVPDQ

SEQ ID NO: 1035004 - protein, 25 aa, Mycobacterium
GVGELRGGFEYARTGNPMRAALEAS

SEQ ID NO: 1035005 - protein, 24 aa, Mycobacterium
GVGGRAAVQIGRRLARLARTHQVI

SEQ ID NO: 1035006 - protein, 19 aa, Mycobacterium
GVGPRLAMATLAVHDAAAL

SEQ ID NO: 1035007 - protein, 25 aa, Mycobacterium
GVGRLKRPWLDDYLGPDVMELNQRI

SEQ ID NO: 1035008 - protein, 24 aa, Mycobacterium
GVGRPQFSAVLECASAARKLNRHV

SEQ ID NO: 1035009 - protein, 17 aa, Mycobacterium
GVHRVQRVPVTESQGRV

SEQ ID NO: 1035010 - protein, 25 aa, Mycobacterium
GVIDVRVCGAIGVIECDRSVDLAVA

SEQ ID NO: 1035011 - protein, 18 aa, Mycobacterium
GVIREFIGLPGPTAGRTD

SEQ ID NO: 1035012 - protein, 24 aa, Mycobacterium
GVIWGIDSFDQWGVELGKKQAEAL

SEQ ID NO: 1035013 - protein, 24 aa, Mycobacterium
GVKGHVFNALGYCLDEPGYGDEFE

SEQ ID NO: 1035014 - protein, 17 aa, Mycobacterium
GVLAEAVVDLGAIDYNV

SEQ ID NO: 1035015 - protein, 18 aa, Mycobacterium
GVLDLRYADFTSTEVELH

SEQ ID NO: 1035016 - protein, 39 aa, Mycobacterium
GVLERGLLLRLRFELDHHINLRPARLYPGVNSLLAGKPD

SEQ ID NO: 1035017 - protein, 21 aa, Mycobacterium
GVLGGPLVRSSYRAGRLYEQA

SEQ ID NO: 1035018 - protein, 19 aa, Mycobacterium
GVLSARWSGSYGDDAGNTA

SEQ ID NO: 1035019 - protein, 23 aa, Mycobacterium
GVMECFDDVQLLIVGRGDEEQLR

SEQ ID NO: 1035020 - protein, 18 aa, Mycobacterium
GVPADVWTLNHLDEALAD

SEQ ID NO: 1035021 - protein, 23 aa, Mycobacterium
GVPGEAWARHGVEHPMGADFAGV

SEQ ID NO: 1035022 - protein, 24 aa, Mycobacterium
GVPGRSVSRWGGFLDDVAGFDAEF

SEQ ID NO: 1035023 - protein, 37 aa, Mycobacterium
GVREFKRLAKATGINEPRLGLLLEVTAAAGLIASGIP

SEQ ID NO: 1035024 - protein, 18 aa, Mycobacterium
GVRPEHFELGSLGVEVEI

SEQ ID NO: 1035025 - protein, 25 aa, Mycobacterium
GVSADAALGLLRRNKIEKLPVVDGH

SEQ ID NO: 1035026 - protein, 25 aa, Mycobacterium
GVSSFGFGGANAHLVVREVLPRDVI

SEQ ID NO: 1035027 - protein, 19 aa, Mycobacterium
GVTGWRVSAEYSFSRDVSY

SEQ ID NO: 1035028 - protein, 20 aa, Mycobacterium
GVVGYITWRATFLLPADAAI

SEQ ID NO: 1035029 - protein, 25 aa, Mycobacterium
GVVIPDPCCQCVGDGRVRARREITV

SEQ ID NO: 1035030 - protein, 31 aa, Mycobacterium
GVVRFIGVDGYRWMIRCVVNGPLETIDVLSE

SEQ ID NO: 1035031 - protein, 18 aa, Mycobacterium
GVVRQLRGEGYQSGVLAS

SEQ ID NO: 1035032 - protein, 20 aa, Mycobacterium
GVVVLPCGAGKTLVGAAAMA

SEQ ID NO: 1035033 - protein, 18 aa, Mycobacterium
GVVVSRTLAVYAHSVVIS

SEQ ID NO: 1035034 - protein, 28 aa, Mycobacterium
GVYRFLLKRNRRLFCVSYTLDNVGDIYL

SEQ ID NO: 1035035 - protein, 22 aa, Mycobacterium
GWGPRPLLVSIRSGAVQSMPGM

SEQ ID NO: 1035036 - protein, 20 aa, Mycobacterium
GWHSLARGWDGRALVLAGTD

SEQ ID NO: 1035037 - protein, 25 aa, Mycobacterium
GWLDDRKWAYVRLEGRGFGDVPLNL

SEQ ID NO: 1035038 - protein, 17 aa, Mycobacterium
GWLHDCDFVIFQVQGLV

SEQ ID NO: 1035039 - protein, 19 aa, Mycobacterium
GWPGHHIIATYLRGPHAGE

SEQ ID NO: 1035040 - protein, 26 aa, Mycobacterium
GWSAYPRILDFAAFRSIADEVGAKLW

SEQ ID NO: 1035041 - protein, 20 aa, Mycobacterium
GWYPRLVVGLGNPGKNYGRT

SEQ ID NO: 1035042 - protein, 18 aa, Mycobacterium
GYHPKWTTAGAFDDYVRG

SEQ ID NO: 1035043 - protein, 18 aa, Mycobacterium
GYIATALHLLERKIAHLP

SEQ ID NO: 1035044 - protein, 26 aa, Mycobacterium
GYLQRMSTVLSRRLWENAGSPEVDTN

SEQ ID NO: 1035045 - protein, 19 aa, Mycobacterium
GYMSKIFNDAWMSSYGFLR

SEQ ID NO: 1035046 - protein, 25 aa, Mycobacterium
GYPALVAPLTFLAIAGRRVQLEIFT

SEQ ID NO: 1035047 - protein, 21 aa, Mycobacterium
GYPRLHAKLTAFGVAVSVAGL

SEQ ID NO: 1035048 - protein, 26 aa, Mycobacterium
GYQVKTLEAIKCVASLNLGVPLVAGN

SEQ ID NO: 1035049 - protein, 19 aa, Mycobacterium
GYVLRRLLRRIIRSAKLLG

SEQ ID NO: 1035050 - protein, 21 aa, Mycobacterium
GYVMPHWPQPWGRSADAVEQL

SEQ ID NO: 1035051 - protein, 18 aa, Mycobacterium
GYYPGQFQIGQTGKTVSP

SEQ ID NO: 1035052 - protein, 19 aa, Mycobacterium
HAAVFPACRAVVHHGGAGT

SEQ ID NO: 1035053 - protein, 19 aa, Mycobacterium
HACHIVRFRILAKRHRGAR

SEQ ID NO: 1035054 - protein, 18 aa, Mycobacterium
HACRIALTPVDINAGNDV

SEQ ID NO: 1035055 - protein, 17 aa, Mycobacterium
HADCAKVGITSIRRDLP

SEQ ID NO: 1035056 - protein, 33 aa, Mycobacterium
HADHCLDMPGLFVWRRYHPTRPVGKALLYGPDD

SEQ ID NO: 1035057 - protein, 18 aa, Mycobacterium
HAELARRDLAAAAAILPT

SEQ ID NO: 1035058 - protein, 18 aa, Mycobacterium
HAHICCQRGLRFLVSGRH

SEQ ID NO: 1035059 - protein, 18 aa, Mycobacterium
HAKEQKAKVLAICNTNGS

SEQ ID NO: 1035060 - protein, 18 aa, Mycobacterium
HAKLFYQPLLESIGPASL

SEQ ID NO: 1035061 - protein, 18 aa, Mycobacterium
HALAEFDIPIEVRVVSAH

SEQ ID NO: 1035062 - protein, 20 aa, Mycobacterium
HALDGIKRPLIVFTPKSMLR

SEQ ID NO: 1035063 - protein, 19 aa, Mycobacterium
HALVIVIESAVVWRAPVTI

SEQ ID NO: 1035064 - protein, 18 aa, Mycobacterium
HAMYPRIDEWIAVRRKVD

SEQ ID NO: 1035065 - protein, 18 aa, Mycobacterium
HARVRYTTIQNWSNNVYN

SEQ ID NO: 1035066 - protein, 23 aa, Mycobacterium
HCALPLHRRFALAATARASFAVY

SEQ ID NO: 1035067 - protein, 17 aa, Mycobacterium
HDCKVLSAWGAYGKKQI

SEQ ID NO: 1035068 - protein, 23 aa, Mycobacterium
HDEGWLAEHMLILKLISPENKAY

SEQ ID NO: 1035069 - protein, 23 aa, Mycobacterium
HDGDGLFKLLSLSMFELAKPVSD

SEQ ID NO: 1035070 - protein, 19 aa, Mycobacterium
HDHHSRRGLLLLVGRRRRL

SEQ ID NO: 1035071 - protein, 21 aa, Mycobacterium
HDLTLMFYDCEEIDSAANGLV

SEQ ID NO: 1035072 - protein, 20 aa, Mycobacterium
HDLVVFLVLYGGLDSSRPWK

SEQ ID NO: 1035073 - protein, 23 aa, Mycobacterium
HDLYRRAGIGVAMVSSDRSHTVD

SEQ ID NO: 1035074 - protein, 28 aa, Mycobacterium
HDPRRFATDLLERFRDLIVLQAVPDAAA

SEQ ID NO: 1035075 - protein, 17 aa, Mycobacterium
HDPRYLCDVRDICRRHD

SEQ ID NO: 1035076 - protein, 19 aa, Mycobacterium
HDRPRTVIWVAGRGTAETA

SEQ ID NO: 1035077 - protein, 27 aa, Mycobacterium
HEADERFWLAVGLSRSEAYIFIAAGSA

SEQ ID NO: 1035078 - protein, 17 aa, Mycobacterium
HEAYVRLYPAQVIKQAD

SEQ ID NO: 1035079 - protein, 25 aa, Mycobacterium
HEDLKRFYDGFPRNAHPMPVLSSVV

SEQ ID NO: 1035080 - protein, 25 aa, Mycobacterium
HEPRKAVVAAARWARSKLDYIPGTT

SEQ ID NO: 1035081 - protein, 24 aa, Mycobacterium
HESKPFFGSLLEFITSGPVMAAIV

SEQ ID NO: 1035082 - protein, 17 aa, Mycobacterium
HEVYRRFFYGYGLTVPV

SEQ ID NO: 1035083 - protein, 17 aa, Mycobacterium
HFELGSLGVEVEIDMVE

SEQ ID NO: 1035084 - protein, 18 aa, Mycobacterium
HFGTALSVRVCTIRTDPW

SEQ ID NO: 1035085 - protein, 22 aa, Mycobacterium
HGAEGLTGIARRVHAQARALAA

SEQ ID NO: 1035086 - protein, 17 aa, Mycobacterium
HGARIAATLTRRQLAAV

SEQ ID NO: 1035087 - protein, 17 aa, Mycobacterium
HGARKGLADTALRTADS

SEQ ID NO: 1035088 - protein, 25 aa, Mycobacterium
HGAVWRRYDVGVITTVIDVPRQRDL

SEQ ID NO: 1035089 - protein, 21 aa, Mycobacterium
HGEFRAIGYTSIYDDVKHVAL

SEQ ID NO: 1035090 - protein, 24 aa, Mycobacterium
HGGLRYLEQLEFGLVREALYEREL

SEQ ID NO: 1035091 - protein, 18 aa, Mycobacterium
HGGVLPLVFDHLFGMISY

SEQ ID NO: 1035092 - protein, 17 aa, Mycobacterium
HGGWLLNAEGLLEVDAA

SEQ ID NO: 1035093 - protein, 24 aa, Mycobacterium
HGIEVPGHHQLFMHGCDLSRLPDG

SEQ ID NO: 1035094 - protein, 17 aa, Mycobacterium
HGLRCVVTLDVLSEGII

SEQ ID NO: 1035095 - protein, 25 aa, Mycobacterium
HGLSWGFDRIFAVSANHSVWFHRQV

SEQ ID NO: 1035096 - protein, 25 aa, Mycobacterium
HGNHPVRLFMGSGMPTGLWERVVEA

SEQ ID NO: 1035097 - protein, 21 aa, Mycobacterium
HGQLPNMRAIVGFAAETGDAS

SEQ ID NO: 1035098 - protein, 24 aa, Mycobacterium
HGQLRIGMAASFVRCEDPALLTQT

SEQ ID NO: 1035099 - protein, 23 aa, Mycobacterium
HGQRGIVGKFVYQPVMIVNGADN

SEQ ID NO: 1035100 - protein, 17 aa, Mycobacterium
HGRACGLHFGRQRDDLV

SEQ ID NO: 1035101 - protein, 24 aa, Mycobacterium
HGRAGDNLLALAINAARVQATVGE

SEQ ID NO: 1035102 - protein, 20 aa, Mycobacterium
HGSSVLLRIAHQVTSATGLS

SEQ ID NO: 1035103 - protein, 22 aa, Mycobacterium
HGVAVMWRYKNIVVLSTLSSMT

SEQ ID NO: 1035104 - protein, 17 aa, Mycobacterium
HGVTLGGPIAIEIDNTE

SEQ ID NO: 1035105 - protein, 19 aa, Mycobacterium
HHHELGWFARQALRLFDDL

SEQ ID NO: 1035106 - protein, 27 aa, Mycobacterium
HHIDKWKFTVPFVCGATNLGEALRRIN

SEQ ID NO: 1035107 - protein, 22 aa, Mycobacterium
HHLVCRGCGSTIEVGDHEVEAW

SEQ ID NO: 1035108 - protein, 24 aa, Mycobacterium
HHRRTAVGTVCWRTTTVSASGVRH

SEQ ID NO: 1035109 - protein, 18 aa, Mycobacterium
HHRYEFSTDFVVLDQRRM

SEQ ID NO: 1035110 - protein, 18 aa, Mycobacterium
HIGAIPFLLKLRSDIPVV

SEQ ID NO: 1035111 - protein, 28 aa, Mycobacterium
HIGGLWWILNCLMHGGLCITGGEHTSSL

SEQ ID NO: 1035112 - protein, 35 aa, Mycobacterium
HIGHVRSGVAFDILRRWLMARGYDVAFIRNVTDID

SEQ ID NO: 1035113 - protein, 26 aa, Mycobacterium
HIRRGKLLPCERVHWLLDMGSPLLEL

SEQ ID NO: 1035114 - protein, 34 aa, Mycobacterium
HISTLLLTLLFRFMRPLIEHGYVFLAQPPLYKLK

SEQ ID NO: 1035115 - protein, 24 aa, Mycobacterium
HKAEAFEAVRCLRSEQSQQYLSIE

SEQ ID NO: 1035116 - protein, 18 aa, Mycobacterium
HKELLRNTVEIVSGICGC

SEQ ID NO: 1035117 - protein, 25 aa, Mycobacterium
HKEVGPRIVPIIPDEARTFGMDSWF

SEQ ID NO: 1035118 - protein, 23 aa, Mycobacterium
HKGARLTTQVSLAGRYLVYVPGA

SEQ ID NO: 1035119 - protein, 18 aa, Mycobacterium
HKTVHHYLMRFSGGELSD

SEQ ID NO: 1035120 - protein, 24 aa, Mycobacterium
HLADGRAVLRTHIGNLGEEVQLSH

SEQ ID NO: 1035121 - protein, 17 aa, Mycobacterium
HLAETWLDGVTALPAGT

SEQ ID NO: 1035122 - protein, 18 aa, Mycobacterium
HLANSALIDLVRVGEVVD

SEQ ID NO: 1035123 - protein, 27 aa, Mycobacterium
HLAPGFHGVHIHKVGKCEPSSAGPTGG

SEQ ID NO: 1035124 - protein, 22 aa, Mycobacterium
HLATIHPSRYLTLISGVTTVLL

SEQ ID NO: 1035125 - protein, 18 aa, Mycobacterium
HLHLRRALVSAALLGGDA

SEQ ID NO: 1035126 - protein, 23 aa, Mycobacterium
HLIEVNAGPVLKVHPNLRYATDG

SEQ ID NO: 1035127 - protein, 18 aa, Mycobacterium
HLLTRGKAMLGIGVGERE

SEQ ID NO: 1035128 - protein, 28 aa, Mycobacterium
HLMRTHRGCGVLMGGVPGVEPADVVVIG

SEQ ID NO: 1035129 - protein, 17 aa, Mycobacterium
HLRDFRVASPITHIDQD

SEQ ID NO: 1035130 - protein, 18 aa, Mycobacterium
HLRGHTPGSIALALDGAT

SEQ ID NO: 1035131 - protein, 18 aa, Mycobacterium
HLSRVARWQRYSIGNLGS

SEQ ID NO: 1035132 - protein, 18 aa, Mycobacterium
HLTEWLAGWQERYPDLTM

SEQ ID NO: 1035133 - protein, 19 aa, Mycobacterium
HLTLVPALRDALADVGRPD

SEQ ID NO: 1035134 - protein, 23 aa, Mycobacterium
HMLASEFPVFSAAPNFAFELATK

SEQ ID NO: 1035135 - protein, 19 aa, Mycobacterium
HMYCYRLLYEMAAAPDVPG

SEQ ID NO: 1035136 - protein, 25 aa, Mycobacterium
HNGELPAVRVGRSFRVHAKAVHDML

SEQ ID NO: 1035137 - protein, 23 aa, Mycobacterium
HNIAWRAAELMAEHVGRAPDVSI

SEQ ID NO: 1035138 - protein, 23 aa, Mycobacterium
HNLPHGVGEFGLLRLSEHMAATA

SEQ ID NO: 1035139 - protein, 19 aa, Mycobacterium
HPAEFTYDVIEAMAQTPNV

SEQ ID NO: 1035140 - protein, 22 aa, Mycobacterium
HPARRPPWLSRYGVTHPQHQTR

SEQ ID NO: 1035141 - protein, 21 aa, Mycobacterium
HPAWKDLTSVHAHKLDPSEDN

SEQ ID NO: 1035142 - protein, 22 aa, Mycobacterium
HPAYRQATAVSFLASSTVSVVS

SEQ ID NO: 1035143 - protein, 17 aa, Mycobacterium
HPCAGCLPPGTRATTQG

SEQ ID NO: 1035144 - protein, 20 aa, Mycobacterium
HPDEYRWTFFSSPEHHHQSR

SEQ ID NO: 1035145 - protein, 17 aa, Mycobacterium
HPDLTAMTKSEIATQLN

SEQ ID NO: 1035146 - protein, 17 aa, Mycobacterium
HPEVVSWADFFDTRKHR

SEQ ID NO: 1035147 - protein, 19 aa, Mycobacterium
HPFMVTALLDRAALDAQAQ

SEQ ID NO: 1035148 - protein, 20 aa, Mycobacterium
HPFQGLYCLAAERKLKVTIR

SEQ ID NO: 1035149 - protein, 17 aa, Mycobacterium
HPGYYQVMFIKSLLDSS

SEQ ID NO: 1035150 - protein, 20 aa, Mycobacterium
HPIMLYFHGGGFVIGTTSIP

SEQ ID NO: 1035151 - protein, 21 aa, Mycobacterium
HPMFVPWLVGPLLTGDGIHLV

SEQ ID NO: 1035152 - protein, 24 aa, Mycobacterium
HPMLVPAFALALMRRSLAGSNIGG

SEQ ID NO: 1035153 - protein, 19 aa, Mycobacterium
HPPGASAIIGMEVAGVVAA

SEQ ID NO: 1035154 - protein, 26 aa, Mycobacterium
HPRAHLRAFVLVPWLAVDSDAELTVA

SEQ ID NO: 1035155 - protein, 31 aa, Mycobacterium
HPSERGRIKQLLLKIGWPAEDLAGYVDGEAH

SEQ ID NO: 1035156 - protein, 24 aa, Mycobacterium
HPSRYRLGTFSALPHLSAHSCEAE

SEQ ID NO: 1035157 - protein, 21 aa, Mycobacterium
HPSSPCSPSGTWLKLNTIAGV

SEQ ID NO: 1035158 - protein, 21 aa, Mycobacterium
HPSTGVAYVLGERLGRIDISE

SEQ ID NO: 1035159 - protein, 21 aa, Mycobacterium
HPTGLAGLGILISEAVRGEGG

SEQ ID NO: 1035160 - protein, 19 aa, Mycobacterium
HPVLPRFGAGPYEAIEAYE

SEQ ID NO: 1035161 - protein, 25 aa, Mycobacterium
HPYRVRHLLDRYGALIGDVLALAAE

SEQ ID NO: 1035162 - protein, 20 aa, Mycobacterium
HQIWLPQPILRNYELAKLVN

SEQ ID NO: 1035163 - protein, 18 aa, Mycobacterium
HQRVMLVEVMGRHAGWIA

SEQ ID NO: 1035164 - protein, 29 aa, Mycobacterium
HQYFPRLRLELDKGFGWKAEVEAALERLL

SEQ ID NO: 1035165 - protein, 27 aa, Mycobacterium
HRAAIRFPAPAVLYGYGAYEICVDPSF

SEQ ID NO: 1035166 - protein, 34 aa, Mycobacterium
HRAAMCIAPRTRLCGIAWRGRFNSSSGFDEVRQL

SEQ ID NO: 1035167 - protein, 17 aa, Mycobacterium
HRADTHPLLGVGVTDPT

SEQ ID NO: 1035168 - protein, 18 aa, Mycobacterium
HRCVHEAMAHARLARVRF

SEQ ID NO: 1035169 - protein, 31 aa, Mycobacterium
HRDALPYVMALEWIGRICARIARRRGGIDVG

SEQ ID NO: 1035170 - protein, 17 aa, Mycobacterium
HRDGGTCYGMICDTSYP

SEQ ID NO: 1035171 - protein, 19 aa, Mycobacterium
HRGAYCLTCGAPLHELRDI

SEQ ID NO: 1035172 - protein, 17 aa, Mycobacterium
HRGGAGVARGFDAVTEP

SEQ ID NO: 1035173 - protein, 24 aa, Mycobacterium
HRGTGARGLRAIMEEVLLPVMYDI

SEQ ID NO: 1035174 - protein, 26 aa, Mycobacterium
HRHLFSVLMDREWKHGVAAAVDVTLL

SEQ ID NO: 1035175 - protein, 22 aa, Mycobacterium
HRKLRMICHGLGHIEGFRPATQ

SEQ ID NO: 1035176 - protein, 21 aa, Mycobacterium
HRLFSHVPWLASQLLGAVEAY

SEQ ID NO: 1035177 - protein, 18 aa, Mycobacterium
HRQECERLSLPVFVKPAR

SEQ ID NO: 1035178 - protein, 18 aa, Mycobacterium
HRQRWHAVRIRSHRHHVI

SEQ ID NO: 1035179 - protein, 18 aa, Mycobacterium
HRRTIAIHKLITGHDDLL

SEQ ID NO: 1035180 - protein, 17 aa, Mycobacterium
HRSKAEGVKELVEETWS

SEQ ID NO: 1035181 - protein, 19 aa, Mycobacterium
HRVAYRLAVVRYDPNNQNM

SEQ ID NO: 1035182 - protein, 17 aa, Mycobacterium
HSAEVLALLGPNGAGKT

SEQ ID NO: 1035183 - protein, 26 aa, Mycobacterium
HSCAAELPWNFLQRSAIRAVSVDVNV

SEQ ID NO: 1035184 - protein, 22 aa, Mycobacterium
HSEAGLYLWASRGEPCRDSVEW

SEQ ID NO: 1035185 - protein, 19 aa, Mycobacterium
HSEIVRWPALSGVTATKRA

SEQ ID NO: 1035186 - protein, 27 aa, Mycobacterium
HSEYRAVKEIVRVGGRFEVISPHEPAG

SEQ ID NO: 1035187 - protein, 18 aa, Mycobacterium
HSGRMGLAGSSSVPMVNI

SEQ ID NO: 1035188 - protein, 27 aa, Mycobacterium
HSGRSRSGRRFALWEGDGQWIAHAGHQ

SEQ ID NO: 1035189 - protein, 17 aa, Mycobacterium
HSIPRIVVFAIVFFHDL

SEQ ID NO: 1035190 - protein, 24 aa, Mycobacterium
HSKIPVIVDIHFQPKYIFAAIDAG

SEQ ID NO: 1035191 - protein, 22 aa, Mycobacterium
HSLKERYSRITVHDKGKSFNSD

SEQ ID NO: 1035192 - protein, 28 aa, Mycobacterium
HSPMAGTGWLPGWRLTFGGEDIGWEGAL

SEQ ID NO: 1035193 - protein, 25 aa, Mycobacterium
HSRVLRVGVAEFRRSLDRVLPQDQD

SEQ ID NO: 1035194 - protein, 19 aa, Mycobacterium
HSRVRRWLVDGDFDVLHLH

SEQ ID NO: 1035195 - protein, 27 aa, Mycobacterium
HSSDLPWRPDVVHAHDWLVAHPAITLA

SEQ ID NO: 1035196 - protein, 19 aa, Mycobacterium
HSVDELHALSAQFADELGQ

SEQ ID NO: 1035197 - protein, 21 aa, Mycobacterium
HTADSMSFVLADAVLTADSVL

SEQ ID NO: 1035198 - protein, 20 aa, Mycobacterium
HTALRLPRDTELIVDGQNVV

SEQ ID NO: 1035199 - protein, 19 aa, Mycobacterium
HTATLFSLTLQELLTNRNQ

SEQ ID NO: 1035200 - protein, 26 aa, Mycobacterium
HTDHRPELLLSFGFVPKAERRVGLIN

SEQ ID NO: 1035201 - protein, 20 aa, Mycobacterium
HTGGALPRTRPFRVSYGTTT

SEQ ID NO: 1035202 - protein, 21 aa, Mycobacterium
HTGLPWPDIHDAGTVSLLQTL

SEQ ID NO: 1035203 - protein, 25 aa, Mycobacterium
HTGPAMSAFNAWILLKGLETLAIRV

SEQ ID NO: 1035204 - protein, 18 aa, Mycobacterium
HTKGPKIRIHKFKNKTGY

SEQ ID NO: 1035205 - protein, 24 aa, Mycobacterium
HTLTGDGIGIVFRKGLPLEDMEFH

SEQ ID NO: 1035206 - protein, 18 aa, Mycobacterium
HTNLGLAIDLQGKDGKRS

SEQ ID NO: 1035207 - protein, 25 aa, Mycobacterium
HTNRGDIKVALFGNHVPKTVANFVG

SEQ ID NO: 1035208 - protein, 22 aa, Mycobacterium
HTPAFFCAVGQGYCNFTQTSDA

SEQ ID NO: 1035209 - protein, 17 aa, Mycobacterium
HTSRLRLLAEIDTRAVV

SEQ ID NO: 1035210 - protein, 17 aa, Mycobacterium
HTWSHPDLTAMTKSEIA

SEQ ID NO: 1035211 - protein, 25 aa, Mycobacterium
HVATEITRLALFLTTPASRHITGQT

SEQ ID NO: 1035212 - protein, 26 aa, Mycobacterium
HVDARPQLTPGWKYNEWELRGVPIRL

SEQ ID NO: 1035213 - protein, 18 aa, Mycobacterium
HVDLYFEAAVAGAIPVIR

SEQ ID NO: 1035214 - protein, 21 aa, Mycobacterium
HVDVPELLRVLDFNPTPEEAL

SEQ ID NO: 1035215 - protein, 21 aa, Mycobacterium
HVIDDLCVLPGAAYAEVALAA

SEQ ID NO: 1035216 - protein, 22 aa, Mycobacterium
HVINISSVFGLFSVPGQAAYNS

SEQ ID NO: 1035217 - protein, 21 aa, Mycobacterium
HVISIGASARYDGPPPGSEDL

SEQ ID NO: 1035218 - protein, 23 aa, Mycobacterium
HVKEVRLSTRLTESPACLITDAF

SEQ ID NO: 1035219 - protein, 17 aa, Mycobacterium
HVKTFIIFFKSMLSHIG

SEQ ID NO: 1035220 - protein, 32 aa, Mycobacterium
HVLARALTLSAFTYKMTVGFTSDIKNLLPMLA

SEQ ID NO: 1035221 - protein, 18 aa, Mycobacterium
HVLGWSNFVVNGTFVDDG

SEQ ID NO: 1035222 - protein, 25 aa, Mycobacterium
HVLNHCGHCLLAFGRLSDCASPRRR

SEQ ID NO: 1035223 - protein, 18 aa, Mycobacterium
HVLSAFGLTGVQPVPLGA

SEQ ID NO: 1035224 - protein, 24 aa, Mycobacterium
HVNGRWLYEYEIPADRSTDGAFRH

SEQ ID NO: 1035225 - protein, 24 aa, Mycobacterium
HVSHPEIHRHSGFARLVQGAVDGT

SEQ ID NO: 1035226 - protein, 19 aa, Mycobacterium
HVVELLLRHGYEVVNASVQ

SEQ ID NO: 1035227 - protein, 17 aa, Mycobacterium
HVWCYRFGGPVNMVESY

SEQ ID NO: 1035228 - protein, 18 aa, Mycobacterium
HWMSPALQRRYLVFTGDS

SEQ ID NO: 1035229 - protein, 20 aa, Mycobacterium
HWNAKPGTRLAIIGLGGLGH

SEQ ID NO: 1035230 - protein, 23 aa, Mycobacterium
HYAGAFPAWLAPIQVVGIPVTGE

SEQ ID NO: 1035231 - protein, 17 aa, Mycobacterium
HYAGILVADEIRILEQL

SEQ ID NO: 1035232 - protein, 29 aa, Mycobacterium
HYDCRSTRELRNWLLLQAYEAGVVPVGAQ

SEQ ID NO: 1035233 - protein, 30 aa, Mycobacterium
HYDRSNEFFKLWLDPSMTYSCAYFERPDLT

SEQ ID NO: 1035234 - protein, 20 aa, Mycobacterium
HYETPASLFGTAAGTCDNSA

SEQ ID NO: 1035235 - protein, 18 aa, Mycobacterium
HYLGCKVAACVVDGYQLC

SEQ ID NO: 1035236 - protein, 18 aa, Mycobacterium
HYPFRLLSPRTMRALVGR

SEQ ID NO: 1035237 - protein, 25 aa, Mycobacterium
IAAHWRYKEAKGRNGVLHPHAAAEI

SEQ ID NO: 1035238 - protein, 18 aa, Mycobacterium
IAALDGWVTDALEYGGHD

SEQ ID NO: 1035239 - protein, 24 aa, Mycobacterium
IAALSRLGAVAVMMRPDADLAASV

SEQ ID NO: 1035240 - protein, 17 aa, Mycobacterium
IADAVGLTSTSSVAHQL

SEQ ID NO: 1035241 - protein, 20 aa, Mycobacterium
IADGLPLAAVTGRAEIMNAP

SEQ ID NO: 1035242 - protein, 25 aa, Mycobacterium
IADIEKRGKISLVLVADDDSATVPA

SEQ ID NO: 1035243 - protein, 19 aa, Mycobacterium
IADIFAIDGEEEFRRIEEG

SEQ ID NO: 1035244 - protein, 18 aa, Mycobacterium
IADLIAWRRKHEKHIERV

SEQ ID NO: 1035245 - protein, 24 aa, Mycobacterium
IAELDPYLTVRVFDNGLTFDTVDQ

SEQ ID NO: 1035246 - protein, 17 aa, Mycobacterium
IAERQLWLAVLRAQAEL

SEQ ID NO: 1035247 - protein, 19 aa, Mycobacterium
IAGALGRLGHTGISDVRQG

SEQ ID NO: 1035248 - protein, 17 aa, Mycobacterium
IAGDIRRLTSLSEDELY

SEQ ID NO: 1035249 - protein, 26 aa, Mycobacterium
IAGIAAVAVEFARLYAVELEHYEKLE

SEQ ID NO: 1035250 - protein, 22 aa, Mycobacterium
IAGLLARRIVCYAHIGDKLTIG

SEQ ID NO: 1035251 - protein, 17 aa, Mycobacterium
IAGRSMLSHSLHAITKL

SEQ ID NO: 1035252 - protein, 21 aa, Mycobacterium
IAGVVLKVIVESAVLLGQANE

SEQ ID NO: 1035253 - protein, 26 aa, Mycobacterium
IAKGSLRGGIILGLEDSNSWMSRLGR

SEQ ID NO: 1035254 - protein, 18 aa, Mycobacterium
IALDFPGSWFRRGSTDNA

SEQ ID NO: 1035255 - protein, 19 aa, Mycobacterium
IALEAAVAYCHLIKSPFTV

SEQ ID NO: 1035256 - protein, 24 aa, Mycobacterium
IALLRDDLDLMLATPTTVTVHKSV

SEQ ID NO: 1035257 - protein, 18 aa, Mycobacterium
IALQTVILAPEQVGGRSD

SEQ ID NO: 1035258 - protein, 18 aa, Mycobacterium
IALSPARLLMVVITESGR

SEQ ID NO: 1035259 - protein, 33 aa, Mycobacterium
IAMRVWQPRWAIWSGHVLRSGGLIRGGIPTAQP

SEQ ID NO: 1035260 - protein, 19 aa, Mycobacterium
IANATPFGLGSNAWTQNES

SEQ ID NO: 1035261 - protein, 22 aa, Mycobacterium
IAPRLREFALHEGLDDAWLRLA

SEQ ID NO: 1035262 - protein, 18 aa, Mycobacterium
IAQLLVQRVELVELVEVS

SEQ ID NO: 1035263 - protein, 24 aa, Mycobacterium
IARIRRFAHPVLLERSRAAELATA

SEQ ID NO: 1035264 - protein, 23 aa, Mycobacterium
IARKPRTDPAFSREWTEHPAELA

SEQ ID NO: 1035265 - protein, 29 aa, Mycobacterium
IARNEIDYVRMWVEAAIAMGTYQEVSTVV

SEQ ID NO: 1035266 - protein, 23 aa, Mycobacterium
IASGIELISRVLLGSSVLPGNNP

SEQ ID NO: 1035267 - protein, 18 aa, Mycobacterium
IASGLPMGGDLEFADELT

SEQ ID NO: 1035268 - protein, 21 aa, Mycobacterium
IASIARKLGALTVGVVTRPFS

SEQ ID NO: 1035269 - protein, 20 aa, Mycobacterium
IATGPLNIWIKAVVAATPPP

SEQ ID NO: 1035270 - protein, 19 aa, Mycobacterium
IATRTSAFLTHPTFTKYRT

SEQ ID NO: 1035271 - protein, 19 aa, Mycobacterium
IATRVVLIYHNRLVGSDGR

SEQ ID NO: 1035272 - protein, 27 aa, Mycobacterium
IATVKRFTERFARFNLSPSVVRPSYGL

SEQ ID NO: 1035273 - protein, 17 aa, Mycobacterium
IAVREALAVQGRIVEEK

SEQ ID NO: 1035274 - protein, 21 aa, Mycobacterium
IAYALAGTMDFDFESQPLDTD

SEQ ID NO: 1035275 - protein, 24 aa, Mycobacterium
IAYLLEILPALSYLHSIGLVYNDL

SEQ ID NO: 1035276 - protein, 20 aa, Mycobacterium
ICAPANRWSVRTVGDLELLG

SEQ ID NO: 1035277 - protein, 19 aa, Mycobacterium
ICARIARRRGGIDVGATDV

SEQ ID NO: 1035278 - protein, 26 aa, Mycobacterium
ICDKGFPAYFLIVADLVNHARSVGIR

SEQ ID NO: 1035279 - protein, 30 aa, Mycobacterium
ICGLRPGQKLRIVKYLAYGWSSLRSRPALH

SEQ ID NO: 1035280 - protein, 26 aa, Mycobacterium
ICGPETLRSLYFLSSRVTGGSPHAIR

SEQ ID NO: 1035281 - protein, 21 aa, Mycobacterium
ICGPNFAYSLFTKRLRKQAKP

SEQ ID NO: 1035282 - protein, 17 aa, Mycobacterium
ICNHCPYVQHVAAGLAI

SEQ ID NO: 1035283 - protein, 20 aa, Mycobacterium
ICPQLRVVTVDGDLVGAGWV

SEQ ID NO: 1035284 - protein, 21 aa, Mycobacterium
ICTECSIAGKIAVRNRILAIR

SEQ ID NO: 1035285 - protein, 20 aa, Mycobacterium
IDCRSEERFALYSVSDTSEP

SEQ ID NO: 1035286 - protein, 21 aa, Mycobacterium
IDDGIPVLLVDEARDVDDDEH

SEQ ID NO: 1035287 - protein, 22 aa, Mycobacterium
IDDSCTMLRTIFVPADEVSPID

SEQ ID NO: 1035288 - protein, 18 aa, Mycobacterium
IDEAFRWSEENNNLQRKA

SEQ ID NO: 1035289 - protein, 18 aa, Mycobacterium
IDEISVLISDDVVDAAMG

SEQ ID NO: 1035290 - protein, 24 aa, Mycobacterium
IDGPAGWGEFGAFLEYQPLEASAW

SEQ ID NO: 1035291 - protein, 24 aa, Mycobacterium
IDGQLWTIIGFQHVKPGKGPAFVR

SEQ ID NO: 1035292 - protein, 24 aa, Mycobacterium
IDGQPPVTITVGFLPPYLQTETTA

SEQ ID NO: 1035293 - protein, 20 aa, Mycobacterium
IDLAKRCGKPLMIHNRQADA

SEQ ID NO: 1035294 - protein, 17 aa, Mycobacterium
IDLGGGGLIYLENLPHV

SEQ ID NO: 1035295 - protein, 20 aa, Mycobacterium
IDLIMPIGKGQRALIVSPPK

SEQ ID NO: 1035296 - protein, 31 aa, Mycobacterium; identical to SEQ ID NO: 201038

SEQ ID NO: 1035297 - protein, 21 aa, Mycobacterium
IDMKDMVGMMIVVARQLKQAG

SEQ ID NO: 1035298 - protein, 21 aa, Mycobacterium
IDMSTELLVSMFESIDNISML

SEQ ID NO: 1035299 - protein, 17 aa, Mycobacterium
IDMVIAVGAALAGDLDA

SEQ ID NO: 1035300 - protein, 17 aa, Mycobacterium
IDNVLAYLGYGPDDSDD

SEQ ID NO: 1035301 - protein, 19 aa, Mycobacterium
IDPARWPFAARRARTGPAE

SEQ ID NO: 1035302 - protein, 17 aa, Mycobacterium
IDPGCGGSCERAPPTQG

SEQ ID NO: 1035303 - protein, 19 aa, Mycobacterium
IDPGFCGHITLELSNVANL

SEQ ID NO: 1035304 - protein, 19 aa, Mycobacterium
IDPQRGWGHRDETWHAKEE

SEQ ID NO: 1035305 - protein, 26 aa, Mycobacterium
IDPRTRWLLRELVFALLVKKDHAAAG

SEQ ID NO: 1035306 - protein, 24 aa, Mycobacterium
IDPYLRPLYDALYDMMDPELIPKL

SEQ ID NO: 1035307 - protein, 23 aa, Mycobacterium
IDQVLKFVKPIVAGDKLYCDVYV

SEQ ID NO: 1035308 - protein, 24 aa, Mycobacterium
IDRPLRPSFVDGLRNEIQVVVTIL

SEQ ID NO: 1035309 - protein, 20 aa, Mycobacterium
IDRVKTCYSLLVPCAGDQSG

SEQ ID NO: 1035310 - protein, 30 aa, Mycobacterium
IDTFAPRLSFFWGIGMNFFMEVAKLRAGRL

SEQ ID NO: 1035311 - protein, 19 aa, Mycobacterium
IDVLRRRIAELVVATDTAV

SEQ ID NO: 1035312 - protein, 32 aa, Mycobacterium
IDVSSIKELCRRWYPRIYFGQPAKGLTHRALA

SEQ ID NO: 1035313 - protein, 19 aa, Mycobacterium
IEAEARRALELQAPSVVQR

SEQ ID NO: 1035314 - protein, 25 aa, Mycobacterium
IEAEYCGWELIKVRIYTDGSRRTLL

SEQ ID NO: 1035315 - protein, 24 aa, Mycobacterium
IEAQLRFMAEAGVDLIVTSGGLGP

SEQ ID NO: 1035316 - protein, 26 aa, Mycobacterium
IEAVLECREALAVNVKPKFAVDALVA

SEQ ID NO: 1035317 - protein, 26 aa, Mycobacterium
IEDFSGSMSLSFSDPRFDEVKAPVEE

SEQ ID NO: 1035318 - protein, 18 aa, Mycobacterium
IEDLRLVADVLRGHKVAD

SEQ ID NO: 1035319 - protein, 23 aa, Mycobacterium
IEELLRGADMVFVTAGEGGGTGT

SEQ ID NO: 1035320 - protein, 27 aa, Mycobacterium
IEESVYGWKEFELELMRDGHDSVVVVC

SEQ ID NO: 1035321 - protein, 25 aa, Mycobacterium
IEFGSRFGGSALFFANVMMHIGQPF

SEQ ID NO: 1035322 - protein, 25 aa, Mycobacterium
IEGLGLKPRKVFGPIRVAATGALVS

SEQ ID NO: 1035323 - protein, 25 aa, Mycobacterium
IEGRAIPRSSCWSDSASSARQLSAQ

SEQ ID NO: 1035324 - protein, 19 aa, Mycobacterium
IEHAELELALADPELHSNP

SEQ ID NO: 1035325 - protein, 17 aa, Mycobacterium
IEHQSSGVIPIMKLLED

SEQ ID NO: 1035326 - protein, 18 aa, Mycobacterium
IELLCEVGPMAVSSANVS

SEQ ID NO: 1035327 - protein, 17 aa, Mycobacterium
IELPDHELDVWSLTDLV

SEQ ID NO: 1035328 - protein, 23 aa, Mycobacterium
IELRIFPLVVMGSIRYDLDDLLA

SEQ ID NO: 1035329 - protein, 35 aa, Mycobacterium
IELRTYRFGGSLHLDWWYDIRRIPQVTAEALAQSF

SEQ ID NO: 1035330 - protein, 24 aa, Mycobacterium
IELTKWGYADCDAMEKLCTVKREV

SEQ ID NO: 1035331 - protein, 17 aa, Mycobacterium
IELVDGLGLPVLSLTSM

SEQ ID NO: 1035332 - protein, 24 aa, Mycobacterium
IENAMCPDLFIAGGGISRKADRWI

SEQ ID NO: 1035333 - protein, 19 aa, Mycobacterium
IENGARASFMPKPFAQHPG

SEQ ID NO: 1035334 - protein, 18 aa, Mycobacterium
IENSLHWIRDVTFDEDRH

SEQ ID NO: 1035335 - protein, 18 aa, Mycobacterium
IENSRIRMLRSFDPSSGA

SEQ ID NO: 1035336 - protein, 23 aa, Mycobacterium
IEPLEPGFGYTLGNSLRRTLLSS

SEQ ID NO: 1035337 - protein, 26 aa, Mycobacterium
IEQSCGRYLAGRAADDGVCILGFESH

SEQ ID NO: 1035338 - protein, 20 aa, Mycobacterium
IESAVVWRAPVTIANCPEIE

SEQ ID NO: 1035339 - protein, 24 aa, Mycobacterium
IETLRKDITWALELMGLHLSETKT

SEQ ID NO: 1035340 - protein, 20 aa, Mycobacterium
IEVAVCKPVQTGTQIGDDDL

SEQ ID NO: 1035341 - protein, 27 aa, Mycobacterium
IEVAVCSTGLIGDRLPMDKVLAGVRAI

SEQ ID NO: 1035342 - protein, 19 aa, Mycobacterium
IEVQVAYAIGKAAPVGLFV

SEQ ID NO: 1035343 - protein, 33 aa, Mycobacterium; identical to SEQ ID NO: 81075

SEQ ID NO: 1035344 - protein, 26 aa, Mycobacterium
IFGCADSRVAAELVFDQGLGDMFVVR

SEQ ID NO: 1035345 - protein, 19 aa, Mycobacterium
IFGIPGGAVLLVYDPLFYS

SEQ ID NO: 1035346 - protein, 31 aa, Mycobacterium
IFITAGAQWRQPGCSMCLGMNPDQLAPGERC

SEQ ID NO: 1035347 - protein, 18 aa, Mycobacterium
IFKDTLIMSYDWTADHQS

SEQ ID NO: 1035348 - protein, 18 aa, Mycobacterium
IFRGCEGDVLLMLLDANG

SEQ ID NO: 1035349 - protein, 35 aa, Mycobacterium
IGAATGARWFCETFPARLERGAGVPAVERLAYFAE

SEQ ID NO: 1035350 - protein, 22 aa, Mycobacterium
IGAAVAAAWALAHPERAVAVLA

SEQ ID NO: 1035351 - protein, 19 aa, Mycobacterium
IGAGCALHSKALKLGVPPR

SEQ ID NO: 1035352 - protein, 17 aa, Mycobacterium
IGAIERFSGHSSGRTWL

SEQ ID NO: 1035353 - protein, 21 aa, Mycobacterium
IGDLFGGLFGRGASVRPSRPR

SEQ ID NO: 1035354 - protein, 25 aa, Mycobacterium
IGDLPCWLADYGYWDLPKRAVGRRY

SEQ ID NO: 1035355 - protein, 28 aa, Mycobacterium
IGDVLRHGYKLGDQVLRHALVGVVDTIA

SEQ ID NO: 1035356 - protein, 18 aa, Mycobacterium
IGEKAKQPIAIAAAPTEL

SEQ ID NO: 1035357 - protein, 26 aa, Mycobacterium
IGERSSHTWFVLRELLGYQNVKNYDG

SEQ ID NO: 1035358 - protein, 17 aa, Mycobacterium
IGERSSHTWFVLTHLLG

SEQ ID NO: 1035359 - protein, 22 aa, Mycobacterium
IGEVSLQTALRCSPYNERLFCL

SEQ ID NO: 1035360 - protein, 17 aa, Mycobacterium
IGFIPWSPLAAGPLAAP

SEQ ID NO: 1035361 - protein, 17 aa, Mycobacterium
IGFPYAKQIIRITRERL

SEQ ID NO: 1035362 - protein, 26 aa, Mycobacterium
IGGAETFKAIVSRFYAQVPEDEILRE

SEQ ID NO: 1035363 - protein, 19 aa, Mycobacterium
IGGGGRYDGLMRQLGGQDL

SEQ ID NO: 1035364 - protein, 23 aa, Mycobacterium
IGGLFAVGDPRWERVSGADMLRH

SEQ ID NO: 1035365 - protein, 20 aa, Mycobacterium
IGGLLHHAPSLLAFTNPTVN

SEQ ID NO: 1035366 - protein, 23 aa, Mycobacterium
IGGLPRGRIVEIYGPESSGKTTV

SEQ ID NO: 1035367 - protein, 26 aa, Mycobacterium
IGGPVKRDAALCLAVLRIGADPDGVA

SEQ ID NO: 1035368 - protein, 24 aa, Mycobacterium
IGIGDLRAPFGPDLLFAAADLLGL

SEQ ID NO: 1035369 - protein, 25 aa, Mycobacterium
IGILANPGPRCWLQHGAGRRRVEVA

SEQ ID NO: 1035370 - protein, 17 aa, Mycobacterium
IGILLLKVRASEMPLLW

SEQ ID NO: 1035371 - protein, 23 aa, Mycobacterium
IGILPRHIPMVAQLVDDNMVRIE

SEQ ID NO: 1035372 - protein, 21 aa, Mycobacterium
IGIWSRWLTGRAVQLGSTGVA

SEQ ID NO: 1035373 - protein, 18 aa, Mycobacterium
IGKDIIRFHAVYWPAFLM

SEQ ID NO: 1035374 - protein, 25 aa, Mycobacterium
IGLAICKRYLRNAPARIVLAAMPDD

SEQ ID NO: 1035375 - protein, 25 aa, Mycobacterium
IGLAKRLEEVWVPFEPYPVIMPRNS

SEQ ID NO: 1035376 - protein, 17 aa, Mycobacterium
IGLALNCEIVPWCRFAR

SEQ ID NO: 1035377 - protein, 17 aa, Mycobacterium
IGLRPRYYPASGADAYL

SEQ ID NO: 1035378 - protein, 27 aa, Mycobacterium
IGMSPEEWRRFVGRASLYAAREKAKEL

SEQ ID NO: 1035379 - protein, 35 aa, Mycobacterium
IGPRPGVAMMAVLMSRGGFCTVTVRYDRASVKSEA

SEQ ID NO: 1035380 - protein, 22 aa, Mycobacterium
IGQVHKAVWSYGREVAVKIQYP

SEQ ID NO: 1035381 - protein, 27 aa, Mycobacterium
IGRMRRSVASFKARYGDSPAMRRIAID

SEQ ID NO: 1035382 - protein, 17 aa, Mycobacterium
IGSPASWTSAVEAQQQS

SEQ ID NO: 1035383 - protein, 17 aa, Mycobacterium
IGTYGMALVAYRHGIPF

SEQ ID NO: 1035384 - protein, 26 aa, Mycobacterium
IHAEFPEQMLAYNLSPSFNWDTTGMS

SEQ ID NO: 1035385 - protein, 30 aa, Mycobacterium
IHDYVWRWDTDWFWCSRAFGAQNQQLRRWW

SEQ ID NO: 1035386 - protein, 23 aa, Mycobacterium
IHGIGAIMEWISAVMTLLPGDLI

SEQ ID NO: 1035387 - protein, 19 aa, Mycobacterium
IHGVEICQHHCPVSHVAEE

SEQ ID NO: 1035388 - protein, 22 aa, Mycobacterium
IHGWGYRPVGLGLREKHCRAPN

SEQ ID NO: 1035389 - protein, 21 aa, Mycobacterium
IHKRAHGVAVVAFEGRPIGLV

SEQ ID NO: 1035390 - protein, 18 aa, Mycobacterium
IHPGVPVLGNHLVGNGFI

SEQ ID NO: 1035391 - protein, 24 aa, Mycobacterium
IHTAKFVALLARLAHLLASAVADV

SEQ ID NO: 1035392 - protein, 24 aa, Mycobacterium
IIADHSRTAAILIGDGVSPVNDGR

SEQ ID NO: 1035393 - protein, 24 aa, Mycobacterium
IIANRVSYFYDFRGPSVTIDTACS

SEQ ID NO: 1035394 - protein, 34 aa, Mycobacterium
IIDRRPGWRDARWVAAVIHYRAGRWSDVVKLLTP

SEQ ID NO: 1035395 - protein, 23 aa, Mycobacterium
IIGGVARGRRIVVPQWGARPTTD

SEQ ID NO: 1035396 - protein, 17 aa, Mycobacterium
IIGHPLIEFVHPDSMPA

SEQ ID NO: 1035397 - protein, 28 aa, Mycobacterium
IIRFHAVYWPAFLMSAGIELPRRIFAHG

SEQ ID NO: 1035398 - protein, 17 aa, Mycobacterium
IITLPVFGTVAEAIENT

SEQ ID NO: 1035399 - protein, 18 aa, Mycobacterium
IITTEYFLRSVFQDTPRE

SEQ ID NO: 1035400 - protein, 24 aa, Mycobacterium
IIVRVVSMPCVEWFESQPYEYRDS

SEQ ID NO: 1035401 - protein, 18 aa, Mycobacterium
IIVVRARFWHGWISSDLT

SEQ ID NO: 1035402 - protein, 18 aa, Mycobacterium
IKAITGRIDLVHCNDSKD

SEQ ID NO: 1035403 - protein, 22 aa, Mycobacterium
IKALLREGARSHGIPVLMATSD

SEQ ID NO: 1035404 - protein, 21 aa, Mycobacterium
IKASRSLALVRGRDYVIPQDV

SEQ ID NO: 1035405 - protein, 17 aa, Mycobacterium
IKDLVALDDALTYSSRA

SEQ ID NO: 1035406 - protein, 22 aa, Mycobacterium
IKDVSVPLLLAGNRGEQLVNES

SEQ ID NO: 1035407 - protein, 24 aa, Mycobacterium
IKEILLQRGKFWINLLHKQIEDRK

SEQ ID NO: 1035408 - protein, 20 aa, Mycobacterium
IKELFSMSATRYYQVLNALV

SEQ ID NO: 1035409 - protein, 21 aa, Mycobacterium
IKKGVLELADIVVVNKADGEH

SEQ ID NO: 1035410 - protein, 21 aa, Mycobacterium
IKLDLDEGADIIMIKPASGYL

SEQ ID NO: 1035411 - protein, 26 aa, Mycobacterium
IKLPQPATCPATFLSVCEHYQYPVYT

SEQ ID NO: 1035412 - protein, 21 aa, Mycobacterium
IKLRPAVERALVTACASEPMY

SEQ ID NO: 1035413 - protein, 17 aa, Mycobacterium
IKLSEHANRLSVLMITY

SEQ ID NO: 1035414 - protein, 23 aa, Mycobacterium
IKRPDYSITGWVILTLIQHGTPW

SEQ ID NO: 1035415 - protein, 18 aa, Mycobacterium
IKSFKKGFAATGGASVVP

SEQ ID NO: 1035416 - protein, 17 aa, Mycobacterium
IKSPFTVVPIWRVADVV

SEQ ID NO: 1035417 - protein, 22 aa, Mycobacterium
IKSREIYEAPGAMVLITAHAEL

SEQ ID NO: 1035418 - protein, 18 aa, Mycobacterium
IKTDPNWQGGDYYETGRA

SEQ ID NO: 1035419 - protein, 17 aa, Mycobacterium
IKTGRPLVDVILDKAEQ

SEQ ID NO: 1035420 - protein, 18 aa, Mycobacterium
IKTQWPGKFVVKGIQTLD

SEQ ID NO: 1035421 - protein, 19 aa, Mycobacterium
IKTRLRLFEITAAPADSDI

SEQ ID NO: 1035422 - protein, 19 aa, Mycobacterium
IKVAIEALGSVSLPMKTVA

SEQ ID NO: 1035423 - protein, 23 aa, Mycobacterium
IKVGVPKTRCALTNSISLPTTVT

SEQ ID NO: 1035424 - protein, 24 aa, Mycobacterium
IKVQICSRLPVTELHRRLGDFELD

SEQ ID NO: 1035425 - protein, 27 aa, Mycobacterium
IKVSARPSDSVAIALRVGVPIYVEDVV

SEQ ID NO: 1035426 - protein, 25 aa, Mycobacterium
IKVVREIVSGLGLKEAKDLVDGVPK

SEQ ID NO: 1035427 - protein, 26 aa, Mycobacterium
ILAAEILDPLGFRWTNFGVAEEDVPL

SEQ ID NO: 1035428 - protein, 23 aa, Mycobacterium
ILAEANHPLVMLVPTMDEAANKA

SEQ ID NO: 1035429 - protein, 18 aa, Mycobacterium
ILALRFANQLWIPIWNAH

SEQ ID NO: 1035430 - protein, 25 aa, Mycobacterium
ILDHVSGRPYGLWVHGNNDTVGAAV

SEQ ID NO: 1035431 - protein, 18 aa, Mycobacterium
ILENPAWYTPYTPYQPEI

SEQ ID NO: 1035432 - protein, 22 aa, Mycobacterium
ILEPYSYKGCRYLIDAQYRASP

SEQ ID NO: 1035433 - protein, 19 aa, Mycobacterium
ILGFPFTKHGLRLGVEASL

SEQ ID NO: 1035434 - protein, 18 aa, Mycobacterium
ILGRIAAGSPIFAEGTVE

SEQ ID NO: 1035435 - protein, 30 aa, Mycobacterium
ILGYARRLVGLPATVVAWGLWKSLADAQQD

SEQ ID NO: 1035436 - protein, 28 aa, Mycobacterium
ILLLDGLPNYQRIGSLRVGQTLREQFEA

SEQ ID NO: 1035437 - protein, 25 aa, Mycobacterium
ILLNSKTRRPSVCNAAETLLIDAAI

SEQ ID NO: 1035438 - protein, 21 aa, Mycobacterium
ILMTEWRLRETPHVPIPYVYP

SEQ ID NO: 1035439 - protein, 25 aa, Mycobacterium
ILQARGRGATMIFTRTKRTAQKVTN

SEQ ID NO: 1035440 - protein, 17 aa, Mycobacterium
ILQCARALSEYGVEPRH

SEQ ID NO: 1035441 - protein, 25 aa, Mycobacterium
ILRYGAEYAGKILAQPSKPTDVSSG

SEQ ID NO: 1035442 - protein, 23 aa, Mycobacterium
ILRYIRPEFVHVFVGGRIVESGG

SEQ ID NO: 1035443 - protein, 19 aa, Mycobacterium
ILSCPRAGSIRVHADNQVV

SEQ ID NO: 1035444 - protein, 18 aa, Mycobacterium
IMEEVLLPVMYDIPSRDD

SEQ ID NO: 1035445 - protein, 20 aa, Mycobacterium
IMGHPKYRVISGAITLDGAD

SEQ ID NO: 1035446 - protein, 22 aa, Mycobacterium
IMQRMMIHFSIEFLGQGAAFLG

SEQ ID NO: 1035447 - protein, 18 aa, Mycobacterium
IMSKMGISTLASYVGAQL

SEQ ID NO: 1035448 - protein, 23 aa, Mycobacterium
IMTRRLLMEKVFVDWSQNRGSKS

SEQ ID NO: 1035449 - protein, 21 aa, Mycobacterium
INAHGPYAVGITGEDAQLFTA

SEQ ID NO: 1035450 - protein, 18 aa, Mycobacterium
INELCDFLGAWFDLELDW

SEQ ID NO: 1035451 - protein, 31 aa, Mycobacterium
INIEASHCYPHFPRFLAEVVRVLRPGGHLAY

SEQ ID NO: 1035452 - protein, 19 aa, Mycobacterium
INQAECEAISAQAFHQGES

SEQ ID NO: 1035453 - protein, 21 aa, Mycobacterium
INRHIKRGGKVWINIFPDRPL

SEQ ID NO: 1035454 - protein, 19 aa, Mycobacterium
INSFGCIYGTPGYQAPEIV

SEQ ID NO: 1035455 - protein, 17 aa, Mycobacterium
INTIFLSTCLKAWRTGG

SEQ ID NO: 1035456 - protein, 30 aa, Mycobacterium
INTMPGFTMTSMYPKLWAVSSVDYPTLLAT

SEQ ID NO: 1035457 - protein, 21 aa, Mycobacterium
INVFGRRSGIAAASYASANDF

SEQ ID NO: 1035458 - protein, 28 aa, Mycobacterium
IPDFVKLAEALGCVGLRCECEEDVVDVI

SEQ ID NO: 1035459 - protein, 18 aa, Mycobacterium
IPDLIAWWCERDGVRPKK

SEQ ID NO: 1035460 - protein, 25 aa, Mycobacterium
IPEGLLNYLALLGWAIADDHDLFSL

SEQ ID NO: 1035461 - protein, 17 aa, Mycobacterium
IPGAPAGQIELDLLVPR

SEQ ID NO: 1035462 - protein, 20 aa, Mycobacterium
IPGWNICVDFPIKSGLNEFV

SEQ ID NO: 1035463 - protein, 21 aa, Mycobacterium
IPLAIHPAMMFSGSDEDLSQC

SEQ ID NO: 1035464 - protein, 18 aa, Mycobacterium
IPLLRPGGQILAIKGEHV

SEQ ID NO: 1035465 - protein, 18 aa, Mycobacterium
IPLTAHFLGGAVIGDNAE

SEQ ID NO: 1035466 - protein, 17 aa, Mycobacterium
IPPALTLRTVFDALPHP

SEQ ID NO: 1035467 - protein, 23 aa, Mycobacterium
IPPELRPMVQLDGGRFATSDLND

SEQ ID NO: 1035468 - protein, 18 aa, Mycobacterium
IPPFRDHIPLMVGGSGEK

SEQ ID NO: 1035469 - protein, 18 aa, Mycobacterium
IPRLPASPRDFWCVVRDG

SEQ ID NO: 1035470 - protein, 20 aa, Mycobacterium
IPRLSLLDRGMMFVIAHVRG

SEQ ID NO: 1035471 - protein, 26 aa, Mycobacterium
IPSFGVWALDLLRWVNRYTEITRDQF

SEQ ID NO: 1035472 - protein, 21 aa, Mycobacterium
IPSLKIGHWVVWFADDALGRF

SEQ ID NO: 1035473 - protein, 24 aa, Mycobacterium
IPTAGGLHFAEWVGACFAECDLAN

SEQ ID NO: 1035474 - protein, 26 aa, Mycobacterium
IPTFTKRATTSWLPNSVGYSGSVSSG

SEQ ID NO: 1035475 - protein, 22 aa, Mycobacterium
IPTRWFRTAVKALWVTYRIDLT

SEQ ID NO: 1035476 - protein, 20 aa, Mycobacterium
IPVGVSYEFLDKLRPHCKTA

SEQ ID NO: 1035477 - protein, 25 aa, Mycobacterium
IQAIKGVEIGDGFATARRRGSCAHD

SEQ ID NO: 1035478 - protein, 24 aa, Mycobacterium
IQAQDFFFRKIVRDKGVALSYVSG

SEQ ID NO: 1035479 - protein, 19 aa, Mycobacterium
IQGGWLEFDAAVATPDQMA

SEQ ID NO: 1035480 - protein, 21 aa, Mycobacterium
IQGIASIGCCGSIADDLGQIT

SEQ ID NO: 1035481 - protein, 20 aa, Mycobacterium
IQLLRYYKSVAFHLINAFLV

SEQ ID NO: 1035482 - protein, 19 aa, Mycobacterium
IQRRSEAGIGLTSPELSTL

SEQ ID NO: 1035483 - protein, 26 aa, Mycobacterium
IQVVVCGKPSFYIGRGTFSLRLSDIR

SEQ ID NO: 1035484 - protein, 18 aa, Mycobacterium
IRAELECQVRAGELTPAM

SEQ ID NO: 1035485 - protein, 19 aa, Mycobacterium
IRAFWPGALSLVVVHAPSL

SEQ ID NO: 1035486 - protein, 20 aa, Mycobacterium
IRAGEGVSYGHDWIAQHDTN

SEQ ID NO: 1035487 - protein, 23 aa, Mycobacterium
IRAICAAVDVLPSCTSLAAETDA

SEQ ID NO: 1035488 - protein, 17 aa, Mycobacterium
IRAMMGILGCDPLDERW

SEQ ID NO: 1035489 - protein, 23 aa, Mycobacterium
IRECDAICQVVRVFSGDDITHVT

SEQ ID NO: 1035490 - protein, 26 aa, Mycobacterium
IRELQELRKLIGLDVSDRIRVLMSVP

SEQ ID NO: 1035491 - protein, 24 aa, Mycobacterium
IRELRFYRRTAFVPPPGPSTREIA

SEQ ID NO: 1035492 - protein, 17 aa, Mycobacterium
IRELRPHVVVTYDPHGG

SEQ ID NO: 1035493 - protein, 18 aa, Mycobacterium
IRGEVLRMLAGIDDEIRR

SEQ ID NO: 1035494 - protein, 24 aa, Mycobacterium
IRGRFAKERTRVIAVDAVPNEVAA

SEQ ID NO: 1035495 - protein, 19 aa, Mycobacterium
IRIPLSIDLLVDLRLDKQR

SEQ ID NO: 1035496 - protein, 18 aa, Mycobacterium
IRIQAMLSEAARTWSDRL

SEQ ID NO: 1035497 - protein, 25 aa, Mycobacterium
IRKSGFDGVELVKALLFSVFEGGLR

SEQ ID NO: 1035498 - protein, 18 aa, Mycobacterium
IRLAYQLTPKRVLGNQRA

SEQ ID NO: 1035499 - protein, 19 aa, Mycobacterium
IRLLRKLKHANAMTRFGEV

SEQ ID NO: 1035500 - protein, 17 aa, Mycobacterium
IRLRFGLDDGQPRTLDQ

SEQ ID NO: 1035501 - protein, 22 aa, Mycobacterium
IRLRLFHGRGGTVGRGGGPSYQ

SEQ ID NO: 1035502 - protein, 17 aa, Mycobacterium
IRLWRNAWNEFIPFLDY

SEQ ID NO: 1035503 - protein, 18 aa, Mycobacterium
IRMEVERRAPATSDGEGA

SEQ ID NO: 1035504 - protein, 19 aa, Mycobacterium
IRNGAIIRKARAHSLATPI

SEQ ID NO: 1035505 - protein, 17 aa, Mycobacterium
IRPDVVIALGFGIPSVT

SEQ ID NO: 1035506 - protein, 22 aa, Mycobacterium
IRRGAKLLFAYGEATVPKITVI

SEQ ID NO: 1035507 - protein, 25 aa, Mycobacterium
IRRLTRLRGATVLAHNYQLPAIQDI

SEQ ID NO: 1035508 - protein, 18 aa, Mycobacterium
IRSFGLAHIRPDDVVLAF

SEQ ID NO: 1035509 - protein, 18 aa, Mycobacterium
IRSSAIVCIACYADRVRL

SEQ ID NO: 1035510 - protein, 20 aa, Mycobacterium
IRSTSRLSGIAIERSKQIFE

SEQ ID NO: 1035511 - protein, 24 aa, Mycobacterium
IRTEVLGGLGGFAGLFALRSGYRE

SEQ ID NO: 1035512 - protein, 17 aa, Mycobacterium
IRTRTSVGLSVVASTQV

SEQ ID NO: 1035513 - protein, 24 aa, Mycobacterium
IRTTRGPRLFLYDHVLSTGPGIDH

SEQ ID NO: 1035514 - protein, 29 aa, Mycobacterium
IRVAGWPNQQFGLLFVDWLKANPGVRADY

SEQ ID NO: 1035515 - protein, 19 aa, Mycobacterium
ISATLAAFRIMLEQSGGGR

SEQ ID NO: 1035516 - protein, 17 aa, Mycobacterium
ISDCSHGAVGVGENLHF

SEQ ID NO: 1035517 - protein, 25 aa, Mycobacterium
ISELPGERPRLFVVTRNAASIKTGD

SEQ ID NO: 1035518 - protein, 19 aa, Mycobacterium
ISFESELMWVSLEANSNWV

SEQ ID NO: 1035519 - protein, 24 aa, Mycobacterium
ISGHACDLVDLFLLCALVAEIEGP

SEQ ID NO: 1035520 - protein, 17 aa, Mycobacterium
ISHAFNLRGPSIAVQTA

SEQ ID NO: 1035521 - protein, 17 aa, Mycobacterium
ISLDSLPAQGEWCAPFP

SEQ ID NO: 1035522 - protein, 18 aa, Mycobacterium
ISLSEIKAAAAAAPAPLD

SEQ ID NO: 1035523 - protein, 17 aa, Mycobacterium
ISPHPTIPLASTANERE

SEQ ID NO: 1035524 - protein, 17 aa, Mycobacterium
ISPKLTVAVRLAPSTGA

SEQ ID NO: 1035525 - protein, 24 aa, Mycobacterium
ISQGRLEALLNFQTLVSDLTGLEI

SEQ ID NO: 1035526 - protein, 24 aa, Mycobacterium
ISQNWRLSGLAGEYITPVPAQQRF

SEQ ID NO: 1035527 - protein, 20 aa, Mycobacterium
ISTVRCFQDNALLKSVLSQT

SEQ ID NO: 1035528 - protein, 17 aa, Mycobacterium
ISVEGGKITGERETDEG

SEQ ID NO: 1035529 - protein, 25 aa, Mycobacterium
ISWTQEGFFGRMLATIRPYRPSLSA

SEQ ID NO: 1035530 - protein, 18 aa, Mycobacterium
ISYADAMRRFGSDKPDLR

SEQ ID NO: 1035531 - protein, 18 aa, Mycobacterium
ISYIPVGVSYEFLDKLRP

SEQ ID NO: 1035532 - protein, 18 aa, Mycobacterium
ITAKGAWEAVKRHFREMG

SEQ ID NO: 1035533 - protein, 24 aa, Mycobacterium
ITARYCARIALGRLRVPPVPILKG

SEQ ID NO: 1035534 - protein, 25 aa, Mycobacterium
ITASGRWVPDFLSLPIAVENSLKNQ

SEQ ID NO: 1035535 - protein, 19 aa, Mycobacterium
ITFTCSRDSGPIAVAKLGS

SEQ ID NO: 1035536 - protein, 18 aa, Mycobacterium
ITGARLVLFDGMGHDLPQ

SEQ ID NO: 1035537 - protein, 17 aa, Mycobacterium
ITGLRLMTRMVQTSSSL

SEQ ID NO: 1035538 - protein, 24 aa, Mycobacterium
ITGWDYPACEAIGLLKMDFLGLRN

SEQ ID NO: 1035539 - protein, 27 aa, Mycobacterium
ITHWQLASWPRGRIVLASDAYYTARGP

SEQ ID NO: 1035540 - protein, 23 aa, Mycobacterium
ITIAEPIAMLLSNRDGKPVASAA

SEQ ID NO: 1035541 - protein, 22 aa, Mycobacterium
ITPRAEDGVIWVLTPKTGKPGH

SEQ ID NO: 1035542 - protein, 20 aa, Mycobacterium
ITQVKVRSVLTCTTGTGVCA

SEQ ID NO: 1035543 - protein, 26 aa, Mycobacterium
IVAEPTAPFGPYRPYPLHPLALPLLH

SEQ ID NO: 1035544 - protein, 19 aa, Mycobacterium
IVALGGFAWQIVLRLPGVS

SEQ ID NO: 1035545 - protein, 28 aa, Mycobacterium
IVAQGLEVAKPFIAALCTAQQELADVVS

SEQ ID NO: 1035546 - protein, 21 aa, Mycobacterium
IVAVLALYRPGPMGMNAHNDY

SEQ ID NO: 1035547 - protein, 23 aa, Mycobacterium
IVDEFTGRVLIGRRYNEGMHQAI

SEQ ID NO: 1035548 - protein, 31 aa, Mycobacterium
IVDSSVLLGDWPIRIPREIASAASEVIIGVR

SEQ ID NO: 1035549 - protein, 18 aa, Mycobacterium
IVDVCISTAPVVHADNVF

SEQ ID NO: 1035550 - protein, 24 aa, Mycobacterium
IVEAAARLTVVWIADWADDMVHLS

SEQ ID NO: 1035551 - protein, 24 aa, Mycobacterium
IVEEPPDHLIFIFATTEPEKVLPT

SEQ ID NO: 1035552 - protein, 19 aa, Mycobacterium
IVGIAGRVIFARNSGKLCF

SEQ ID NO: 1035553 - protein, 24 aa, Mycobacterium
IVGLRAKAKAAFAEREGVNLTFLP

SEQ ID NO: 1035554 - protein, 25 aa, Mycobacterium
IVGRMKDLLIVYGRNHYPEDIESTV

SEQ ID NO: 1035555 - protein, 18 aa, Mycobacterium
IVGRRGPLQTAFTTLELR

SEQ ID NO: 1035556 - protein, 18 aa, Mycobacterium
IVGSRVITVSSLSHRLFA

SEQ ID NO: 1035557 - protein, 18 aa, Mycobacterium
IVLDDEWTVTTADGSRAA

SEQ ID NO: 1035558 - protein, 28 aa, Mycobacterium
IVLGGGMCFTFLAAQGFSVGKSLLETEM

SEQ ID NO: 1035559 - protein, 17 aa, Mycobacterium
IVNRNIPCYLGHHDLAK

SEQ ID NO: 1035560 - protein, 26 aa, Mycobacterium
IVPRYRTMCGYKVERRFGWDTHGLPA

SEQ ID NO: 1035561 - protein, 22 aa, Mycobacterium
IVPVRFRIALHTGEVQISNDDV

SEQ ID NO: 1035562 - protein, 22 aa, Mycobacterium
IVPWWLLRQHLAIQFEVLVDAG

SEQ ID NO: 1035563 - protein, 19 aa, Mycobacterium
IVRGCCALWSLPGQLGDLL

SEQ ID NO: 1035564 - protein, 22 aa, Mycobacterium
IVSCPSCGRAQVDVYKLANEVS

SEQ ID NO: 1035565 - protein, 23 aa, Mycobacterium
IVTTETFTPILYTLTYDNFDEAI

SEQ ID NO: 1035566 - protein, 19 aa, Mycobacterium
IVVAGGGTVVWRWNQAIAD

SEQ ID NO: 1035567 - protein, 18 aa, Mycobacterium
IVVLKAALSVAGAALLAR

SEQ ID NO: 1035568 - protein, 22 aa, Mycobacterium
IVVVSKPNFLATMPRGRHIAQA

SEQ ID NO: 1035569 - protein, 21 aa, Mycobacterium
IWGRRRLAYEISKHAEGIYVV

SEQ ID NO: 1035570 - protein, 19 aa, Mycobacterium
IWPNPWSMYRTLRDHEAVH

SEQ ID NO: 1035571 - protein, 21 aa, Mycobacterium
IYDPMNWLRTSTVSLRSAGGF

SEQ ID NO: 1035572 - protein, 22 aa, Mycobacterium
IYERIGKRGLGFGAEVRSKAEI

SEQ ID NO: 1035573 - protein, 18 aa, Mycobacterium
IYFRADATLQFGYESGYD

SEQ ID NO: 1035574 - protein, 17 aa, Mycobacterium
IYRMGVTPPVPKQILNA

SEQ ID NO: 1035575 - protein, 26 aa, Mycobacterium
IYTSHDIRVLYGFKRLAWWPYGVVMK

SEQ ID NO: 1035576 - protein, 26 aa, Mycobacterium
KAAAAGRPWWEWAATHERAFTAAYDA

SEQ ID NO: 1035577 - protein, 23 aa, Mycobacterium
KAAEETLRFQAALVNHVSDAIIA

SEQ ID NO: 1035578 - protein, 34 aa, Mycobacterium
KAARFVRVCDCFNIPIVMLVDVPGFLPGTEQEYD

SEQ ID NO: 1035579 - protein, 25 aa, Mycobacterium
KAGKAGLVPAHLRDGHYSGAAALGN

SEQ ID NO: 1035580 - protein, 21 aa, Mycobacterium
KAGLLRTGRDVWIPLGNPSYL

SEQ ID NO: 1035581 - protein, 17 aa, Mycobacterium
KAIAALDGWVTDALEYG

SEQ ID NO: 1035582 - protein, 24 aa, Mycobacterium
KAKKLRVRLPLPKLVVAVYNSQRL

SEQ ID NO: 1035583 - protein, 24 aa, Mycobacterium
KALARYQPLGVVLAVMPWNFPLWQ

SEQ ID NO: 1035584 - protein, 20 aa, Mycobacterium
KALDLFVCWVCPPRRMGKFV

SEQ ID NO: 1035585 - protein, 22 aa, Mycobacterium
KALLARIGDAFLAVPEGFTVHP

SEQ ID NO: 1035586 - protein, 17 aa, Mycobacterium
KALLDLLIKDGKFAPDF

SEQ ID NO: 1035587 - protein, 18 aa, Mycobacterium
KALLRRLVEAGTRVVQYG

SEQ ID NO: 1035588 - protein, 18 aa, Mycobacterium
KALWDIILPFADYAFNKS

SEQ ID NO: 1035589 - protein, 18 aa, Mycobacterium
KAMLQDMAILTGAQVISE

SEQ ID NO: 1035590 - protein, 24 aa, Mycobacterium
KAMPEAIAVFLAPPSWEDLEARLV

SEQ ID NO: 1035591 - protein, 20 aa, Mycobacterium
KANVAPSIVQYVIIGQVLTA

SEQ ID NO: 1035592 - protein, 19 aa, Mycobacterium
KAPFSRRPLAGPRGVAVIF

SEQ ID NO: 1035593 - protein, 18 aa, Mycobacterium
KARQILVGELALAESTDD

SEQ ID NO: 1035594 - protein, 25 aa, Mycobacterium
KATATHLVSVFAHRARLVLGQLAVA

SEQ ID NO: 1035595 - protein, 24 aa, Mycobacterium
KATATHLVSVFAHRARLVPGQLAV

SEQ ID NO: 1035596 - protein, 19 aa, Mycobacterium
KATGYRPSASINFVNRTMD

SEQ ID NO: 1035597 - protein, 21 aa, Mycobacterium
KATLEMVAFMVRYTSGYLCAP

SEQ ID NO: 1035598 - protein, 26 aa, Mycobacterium
KATQEDPWRHFARTHAIGQIVPGKVT

SEQ ID NO: 1035599 - protein, 19 aa, Mycobacterium
KATSEALVESALWEASLFE

SEQ ID NO: 1035600 - protein, 26 aa, Mycobacterium
KAVLLPNRTFFAIPDILREKGLAWID

SEQ ID NO: 1035601 - protein, 21 aa, Mycobacterium
KAWFPLTKRWLGFEDAHITFD

SEQ ID NO: 1035602 - protein, 24 aa, Mycobacterium
KAWQETAFQYAWLLAAVDVDQYGT

SEQ ID NO: 1035603 - protein, 24 aa, Mycobacterium
KAYRVAGYRSGWLAITGPKDHASS

SEQ ID NO: 1035604 - protein, 17 aa, Mycobacterium
KCEVAVPRFDAHRLSRD

SEQ ID NO: 1035605 - protein, 19 aa, Mycobacterium
KCEVIYRFFADIADPPDGN

SEQ ID NO: 1035606 - protein, 21 aa, Mycobacterium
KCVEFSAARPGMLGLQTALSV

SEQ ID NO: 1035607 - protein, 29 aa, Mycobacterium
KDAMAREVRRGGLPLQRLVNGESMAAVAR

SEQ ID NO: 1035608 - protein, 17 aa, Mycobacterium
KDARLTILEVMAEAIDR

SEQ ID NO: 1035609 - protein, 20 aa, Mycobacterium
KDAVKAGVGYIVLDSTTEIE

SEQ ID NO: 1035610 - protein, 18 aa, Mycobacterium
KDCPKKLLRPKVPILVLV

SEQ ID NO: 1035611 - protein, 25 aa, Mycobacterium
KDELTAFGRKWLFSSKFSKKDGMDF

SEQ ID NO: 1035612 - protein, 17 aa, Mycobacterium
KDFTFICPTEIAAFGKL

SEQ ID NO: 1035613 - protein, 19 aa, Mycobacterium
KDGALWLRTSAFGDDKDRV

SEQ ID NO: 1035614 - protein, 21 aa, Mycobacterium
KDGKRSLVVAGIKRCEELRFA

SEQ ID NO: 1035615 - protein, 19 aa, Mycobacterium
KDHIEAIANWDRQAEPSIE

SEQ ID NO: 1035616 - protein, 24 aa, Mycobacterium
KDHLELGEALGLIDMQRGAKVSGS

SEQ ID NO: 1035617 - protein, 21 aa, Mycobacterium
KDILRAHGFGSTAVVDPVAVD

SEQ ID NO: 1035618 - protein, 38 aa, Mycobacterium
KDIVEKIIHWFFGLFSHWWSRLHSFFGGIPGLSGATSG

SEQ ID NO: 1035619 - protein, 24 aa, Mycobacterium
KDLPLRVKAAAVGLAADEYHAQDV

SEQ ID NO: 1035620 - protein, 17 aa, Mycobacterium
KDLRVAVDGGFLSVTEE

SEQ ID NO: 1035621 - protein, 22 aa, Mycobacterium
KDPRDGFLLEMIYRVYHTDNRC

SEQ ID NO: 1035622 - protein, 17 aa, Mycobacterium
KDRPELASVLGAAGQLF

SEQ ID NO: 1035623 - protein, 23 aa, Mycobacterium
KDSTRYLLHFSQSGIGLPDESYF

SEQ ID NO: 1035624 - protein, 24 aa, Mycobacterium
KDTRGIIRVHQFDKVEGFVYCAPT

SEQ ID NO: 1035625 - protein, 26 aa, Mycobacterium
KDVLQGQCKFSWPPKMDLPGYKPNTK

SEQ ID NO: 1035626 - protein, 19 aa, Mycobacterium
KDVVIDMLCYRRRGHNEGD

SEQ ID NO: 1035627 - protein, 22 aa, Mycobacterium
KDYKRVLQAIALAERNGVDVNK

SEQ ID NO: 1035628 - protein, 25 aa, Mycobacterium
KEAKADLYSGARIMADTGLAYYSGD

SEQ ID NO: 1035629 - protein, 20 aa, Mycobacterium
KEHGVPIAIKAAFGGGGKGM

SEQ ID NO: 1035630 - protein, 21 aa, Mycobacterium
KEIQARIRAGASVEQVAMASG

SEQ ID NO: 1035631 - protein, 17 aa, Mycobacterium
KEIRPVTISTYQMITHR

SEQ ID NO: 1035632 - protein, 19 aa, Mycobacterium
KEIWRRMDAAGDIYLGTYS

SEQ ID NO: 1035633 - protein, 23 aa, Mycobacterium
KELECRPRKSLGQNFVHDANTVR

SEQ ID NO: 1035634 - protein, 21 aa, Mycobacterium
KENRVGSMAAYRQLRTNRSHP

SEQ ID NO: 1035635 - protein, 25 aa, Mycobacterium
KEPHYGPPPLLLRMVEAGLLGKKSG

SEQ ID NO: 1035636 - protein, 18 aa, Mycobacterium
KERYPAFFERSYNILPDD

SEQ ID NO: 1035637 - protein, 19 aa, Mycobacterium
KEVGRLGSTLNQMLDHITA

SEQ ID NO: 1035638 - protein, 17 aa, Mycobacterium
KFADARVPIVGDDIKSQ

SEQ ID NO: 1035639 - protein, 27 aa, Mycobacterium
KFGTVVARDRIQAVAGLRALAAGKQAP

SEQ ID NO: 1035640 - protein, 20 aa, Mycobacterium
KFLAELKVLPRDEWPSMIRR

SEQ ID NO: 1035641 - protein, 18 aa, Mycobacterium
KGACAQVNKDLGLLASEK

SEQ ID NO: 1035642 - protein, 22 aa, Mycobacterium
KGCAEAAKGQGARVTITEIDPI

SEQ ID NO: 1035643 - protein, 17 aa, Mycobacterium
KGDERWRNLPTPSGNTF

SEQ ID NO: 1035644 - protein, 23 aa, Mycobacterium
KGFVESLTWSQVYMRSCVLADEL

SEQ ID NO: 1035645 - protein, 24 aa, Mycobacterium
KGGGHKRAYRLIDFRRNDTDGVNA

SEQ ID NO: 1035646 - protein, 23 aa, Mycobacterium
KGGPGMREMLAITGAIKGAGLGK

SEQ ID NO: 1035647 - protein, 20 aa, Mycobacterium
KGGQLLGVITASRLLRAALK

SEQ ID NO: 1035648 - protein, 24 aa, Mycobacterium
KGHDTFCPVGPWIVTDLGPLDPAD

SEQ ID NO: 1035649 - protein, 21 aa, Mycobacterium
KGKGFSGTMKRHGFRGQGASH

SEQ ID NO: 1035650 - protein, 21 aa, Mycobacterium
KGLPGAEGRLKVAPPKPSKLE

SEQ ID NO: 1035651 - protein, 20 aa, Mycobacterium
KGLRHSVHFTQGIRNAVDNG

SEQ ID NO: 1035652 - protein, 18 aa, Mycobacterium
KGLSTGLGDEGGFAPEVA

SEQ ID NO: 1035653 - protein, 20 aa, Mycobacterium
KGLTELLERVTVPVHVNTHE

SEQ ID NO: 1035654 - protein, 22 aa, Mycobacterium
KGNPQRRGVCTRVYTSTPKKPN

SEQ ID NO: 1035655 - protein, 20 aa, Mycobacterium
KGNTIAWLYSQRRFEVPTDK

SEQ ID NO: 1035656 - protein, 18 aa, Mycobacterium
KGSGFYRTDSRESGEKSN

SEQ ID NO: 1035657 - protein, 19 aa, Mycobacterium
KGTEAIIVTGGDGFISNTL

SEQ ID NO: 1035658 - protein, 17 aa, Mycobacterium
KGVPCLIAVNQDPTGTG

SEQ ID NO: 1035659 - protein, 19 aa, Mycobacterium
KGYTEYHADGLIDRLPRML

SEQ ID NO: 1035660 - protein, 19 aa, Mycobacterium
KHETFIIATVPNRFAKVSY

SEQ ID NO: 1035661 - protein, 17 aa, Mycobacterium
KHLLYRARDLRAILHEL

SEQ ID NO: 1035662 - protein, 17 aa, Mycobacterium
KHMPLSTVDPSWPAVLS

SEQ ID NO: 1035663 - protein, 21 aa, Mycobacterium
KHQDVAIIFAYNVGINDISNN

SEQ ID NO: 1035664 - protein, 19 aa, Mycobacterium
KHTDGALCRSIKFPTFLAG

SEQ ID NO: 1035665 - protein, 26 aa, Mycobacterium
KHTGLWDLGYTLSRRRGYRPVRTMVL

SEQ ID NO: 1035666 - protein, 24 aa, Mycobacterium
KIALGTALARLGMFAPALSYLEEP

SEQ ID NO: 1035667 - protein, 22 aa, Mycobacterium
KIEALLRVLEPFGVREIVQSGV

SEQ ID NO: 1035668 - protein, 26 aa, Mycobacterium
KIGEKLKLRRAAIFNGTVATYLHKRA

SEQ ID NO: 1035669 - protein, 20 aa, Mycobacterium
KIGQAFGRDHTTVMYAQRKI

SEQ ID NO: 1035670 - protein, 17 aa, Mycobacterium
KIGRVYYPAPYMTNDNL

SEQ ID NO: 1035671 - protein, 28 aa, Mycobacterium
KIHRSIRVSDELAWMFPFCSANPTVSCA

SEQ ID NO: 1035672 - protein, 21 aa, Mycobacterium
KINKGGHTWPGGKQYLPKVVI

SEQ ID NO: 1035673 - protein, 31 aa, Mycobacterium
KIPSYKACFLALVRCFYELGVKELHGHLLYA

SEQ ID NO: 1035674 - protein, 18 aa, Mycobacterium
KIPYILRFLEAERLSPRT

SEQ ID NO: 1035675 - protein, 18 aa, Mycobacterium
KIRAVRQLWARIAEVAGD

SEQ ID NO: 1035676 - protein, 19 aa, Mycobacterium
KIRGFSLWGGVGIKRKARR

SEQ ID NO: 1035677 - protein, 21 aa, Mycobacterium
KIYNRKALDLAQVVETLLEQA

SEQ ID NO: 1035678 - protein, 17 aa, Mycobacterium
KKAAGNVIMLRRAGQRF

SEQ ID NO: 1035679 - protein, 26 aa, Mycobacterium
KKAAHRRAVELLELVGITQPDRRARA

SEQ ID NO: 1035680 - protein, 18 aa, Mycobacterium
KKDGMDFGTLIDVAVGGA

SEQ ID NO: 1035681 - protein, 18 aa, Mycobacterium
KKFADARVPIVGDDIKSQ

SEQ ID NO: 1035682 - protein, 18 aa, Mycobacterium
KKGGLGRGLASLIPTGPV

SEQ ID NO: 1035683 - protein, 17 aa, Mycobacterium
KKHFRPEFLNRIDDIIV

SEQ ID NO: 1035684 - protein, 20 aa, Mycobacterium
KKIKEKLGIGAVVTDDDILP

SEQ ID NO: 1035685 - protein, 21 aa, Mycobacterium
KKKYLRLTVGSGRNKVIATFF

SEQ ID NO: 1035686 - protein, 40 aa, Mycobacterium; identical to SEQ ID NO: 99181

SEQ ID NO: 1035687 - protein, 32 aa, Mycobacterium
KKLSFETARFIKFIITEIFPGGRLPSTKMMVE

SEQ ID NO: 1035688 - protein, 23 aa, Mycobacterium
KKPATEAFVLASLARQKARTSQG

SEQ ID NO: 1035689 - protein, 29 aa, Mycobacterium
KKPSKVVAKRGWRHWVHTVTRINLGLSPD

SEQ ID NO: 1035690 - protein, 17 aa, Mycobacterium
KLAANRPSTFLLESAEN

SEQ ID NO: 1035691 - protein, 19 aa, Mycobacterium
KLACDRADMFAAIAPVAGT

SEQ ID NO: 1035692 - protein, 17 aa, Mycobacterium
KLAEYRTAAQLVGQGVQ

SEQ ID NO: 1035693 - protein, 21 aa, Mycobacterium
KLATLRPVFGVQAGDATMTAG

SEQ ID NO: 1035694 - protein, 19 aa, Mycobacterium
KLDDFDVFHPDRMASRILG

SEQ ID NO: 1035695 - protein, 19 aa, Mycobacterium
KLDVASLLHRLSLKQPVKY

SEQ ID NO: 1035696 - protein, 24 aa, Mycobacterium
KLGKSTGGGSLWLDPEMTSPYAWY

SEQ ID NO: 1035697 - protein, 17 aa, Mycobacterium
KLIADKMFEEFKEPHYG

SEQ ID NO: 1035698 - protein, 30 aa, Mycobacterium
KLIDYPARAPFRYVPTFLVPGPRDEVTIGE

SEQ ID NO: 1035699 - protein, 19 aa, Mycobacterium
KLIKGLDSDAIYNSWASPS

SEQ ID NO: 1035700 - protein, 22 aa, Mycobacterium
KLKGRSGLVYDMLRWCGHSRLS

SEQ ID NO: 1035701 - protein, 21 aa, Mycobacterium
KLKWQRMDPEFAYSDSERDGL

SEQ ID NO: 1035702 - protein, 18 aa, Mycobacterium
KLLLEKVAKEAADDAKAK

SEQ ID NO: 1035703 - protein, 18 aa, Mycobacterium
KLLPEIYPTTVQSVLGSK

SEQ ID NO: 1035704 - protein, 17 aa, Mycobacterium
KLLPRPLDHTSVHIAVA

SEQ ID NO: 1035705 - protein, 22 aa, Mycobacterium
KLPGQPLMRITGFGYNQAATED

SEQ ID NO: 1035706 - protein, 19 aa, Mycobacterium
KLPLFDRLAQRIVDGERNG

SEQ ID NO: 1035707 - protein, 19 aa, Mycobacterium
KLQLQIAVVKSHYLSLSPR

SEQ ID NO: 1035708 - protein, 26 aa, Mycobacterium
KLQSDFGVAPGHVFVTGMSNGGFMSN

SEQ ID NO: 1035709 - protein, 21 aa, Mycobacterium
KLRFESCKILGIPDLLVSGTC

SEQ ID NO: 1035710 - protein, 22 aa, Mycobacterium
KLRHGLPGAVFISARTGDGIDV

SEQ ID NO: 1035711 - protein, 17 aa, Mycobacterium
KLRIEVVNRGFSPGQNH

SEQ ID NO: 1035712 - protein, 23 aa, Mycobacterium
KLRIRAGSFVTPVRVYDVDLATG

SEQ ID NO: 1035713 - protein, 19 aa, Mycobacterium
KLRTVLWGWAGKPIDNQTL

SEQ ID NO: 1035714 - protein, 29 aa, Mycobacterium
KLSELRPFYRPGLVHIYHALTWGPLMREI

SEQ ID NO: 1035715 - protein, 18 aa, Mycobacterium
KLSGKRIIIDPGRGGADR

SEQ ID NO: 1035716 - protein, 22 aa, Mycobacterium
KLTALSWGRHFNKVIGDPSGNC

SEQ ID NO: 1035717 - protein, 19 aa, Mycobacterium
KLVESFGVGAGAYIGYSTG

SEQ ID NO: 1035718 - protein, 24 aa, Mycobacterium
KLVKVRPGYEAALAAVLGPAADAL

SEQ ID NO: 1035719 - protein, 24 aa, Mycobacterium
KLYGYKWHTIEGMFTPHASDVTFD

SEQ ID NO: 1035720 - protein, 24 aa, Mycobacterium
KMHGPAEVAFTCELFSRVEDVLGL

SEQ ID NO: 1035721 - protein, 18 aa, Mycobacterium
KMPARRLPCGTSVKTIGG

SEQ ID NO: 1035722 - protein, 18 aa, Mycobacterium
KMRQAGYRLARREGAREG

SEQ ID NO: 1035723 - protein, 20 aa, Mycobacterium
KMRVAGRIAAGALTEAGKAV

SEQ ID NO: 1035724 - protein, 17 aa, Mycobacterium
KNGIPWASAQLDDLTGG

SEQ ID NO: 1035725 - protein, 20 aa, Mycobacterium
KNIDTGMGVERIALVLQGVH

SEQ ID NO: 1035726 - protein, 17 aa, Mycobacterium
KNIKALLDLLIKDGKFA

SEQ ID NO: 1035727 - protein, 25 aa, Mycobacterium
KNPQRVLGLHFFNPVPVLPLVELVS

SEQ ID NO: 1035728 - protein, 27 aa, Mycobacterium
KNQPGSCARRSWAVLGEMAELGEDSIT

SEQ ID NO: 1035729 - protein, 20 aa, Mycobacterium
KNRIHFRALPLWGAVADRDT

SEQ ID NO: 1035730 - protein, 24 aa, Mycobacterium
KNSLTPIVCIGEYLEIREVGEHVS

SEQ ID NO: 1035731 - protein, 18 aa, Mycobacterium
KPAVVAFDHAYHGRTNLT

SEQ ID NO: 1035732 - protein, 26 aa, Mycobacterium
KPEFINRLDDVLIFDGLNPEELVRIV

SEQ ID NO: 1035733 - protein, 24 aa, Mycobacterium
KPLLANVDTLRCWLDDERQEVLDR

SEQ ID NO: 1035734 - protein, 20 aa, Mycobacterium
KPPEPLRLLGTEAAQLLLHG

SEQ ID NO: 1035735 - protein, 19 aa, Mycobacterium
KPPRMLVLLHLDGSVERTS

SEQ ID NO: 1035736 - protein, 18 aa, Mycobacterium
KPTIPAWEDVLLGVRSAG

SEQ ID NO: 1035737 - protein, 19 aa, Mycobacterium
KPTVVVSVPRVFEKVYNTA

SEQ ID NO: 1035738 - protein, 32 aa, Mycobacterium
KPVLVDFWATWCGPCKMVAPVLEEIASEQRNQ

SEQ ID NO: 1035739 - protein, 26 aa, Mycobacterium
KQFKSYRGMGSLGAMQGRGGDKSYSK

SEQ ID NO: 1035740 - protein, 30 aa, Mycobacterium
KQLAADLNFAWPTARIAVIGADGAAQLLMK

SEQ ID NO: 1035741 - protein, 20 aa, Mycobacterium
KQLLVAAAVIGFRFGSDLLA

SEQ ID NO: 1035742 - protein, 26 aa, Mycobacterium
KQRGEPVSCFLLRIEDNMESIGRSVN

SEQ ID NO: 1035743 - protein, 28 aa, Mycobacterium
KRALLRLDPRLAPIKAAVLPLFRHVDLS

SEQ ID NO: 1035744 - protein, 26 aa, Mycobacterium
KRDSEWMGRVHRFLGLQVGVILASMT

SEQ ID NO: 1035745 - protein, 22 aa, Mycobacterium
KRGNKWRTGINVFFETFGSHKA

SEQ ID NO: 1035746 - protein, 17 aa, Mycobacterium
KRGRCLASNRIAVGKRY

SEQ ID NO: 1035747 - protein, 22 aa, Mycobacterium
KRILGFDPDKTFAVREDVITHT

SEQ ID NO: 1035748 - protein, 19 aa, Mycobacterium
KRKIIGRQFIRAFEGAVRD

SEQ ID NO: 1035749 - protein, 21 aa, Mycobacterium
KRLKELVVAHGIYNQNLQAVP

SEQ ID NO: 1035750 - protein, 21 aa, Mycobacterium
KRMALPNARVLIHQPSLAGVI

SEQ ID NO: 1035751 - protein, 20 aa, Mycobacterium
KRMGIEAIYLGGWATSAKGS

SEQ ID NO: 1035752 - protein, 18 aa, Mycobacterium
KRSRACRSWLGWGLALCP

SEQ ID NO: 1035753 - protein, 24 aa, Mycobacterium
KRSTGRPVTVPQLYSRGFSEDPKA

SEQ ID NO: 1035754 - protein, 24 aa, Mycobacterium
KRSVEEVRFLMGFNRDVVRRRREN

SEQ ID NO: 1035755 - protein, 19 aa, Mycobacterium
KRTRWDYEVESPLRDARGF

SEQ ID NO: 1035756 - protein, 21 aa, Mycobacterium
KRWTMRWKPALNAFAITFADR

SEQ ID NO: 1035757 - protein, 24 aa, Mycobacterium
KRWWERPYIAAGIFLYDRLGGAKS

SEQ ID NO: 1035758 - protein, 19 aa, Mycobacterium
KRYADVRVHTVMNNDRLEM

SEQ ID NO: 1035759 - protein, 25 aa, Mycobacterium
KSDRARLHRRLAAAIEARAPHSVDQ

SEQ ID NO: 1035760 - protein, 23 aa, Mycobacterium
KSDTAPLLAVFSIVYDEVAEANV

SEQ ID NO: 1035761 - protein, 20 aa, Mycobacterium
KSDVLLACIAPTGDPTDLKG

SEQ ID NO: 1035762 - protein, 19 aa, Mycobacterium
KSGVKRFVYTASNSVVMGG

SEQ ID NO: 1035763 - protein, 19 aa, Mycobacterium
KSLARPALDNVNVKIDKGE

SEQ ID NO: 1035764 - protein, 23 aa, Mycobacterium
KSLRSRLASYFADVANLHPRTRQ

SEQ ID NO: 1035765 - protein, 20 aa, Mycobacterium
KSMRIFKSELREMQTENQAQ

SEQ ID NO: 1035766 - protein, 18 aa, Mycobacterium
KSSITPRDALASAGKTLV

SEQ ID NO: 1035767 - protein, 20 aa, Mycobacterium
KSTHFDWVLAPYDITASRAH

SEQ ID NO: 1035768 - protein, 18 aa, Mycobacterium
KSWARSHGFDYERESTEI

SEQ ID NO: 1035769 - protein, 24 aa, Mycobacterium
KTALLRLAGRYGVCEDEVDELLRS

SEQ ID NO: 1035770 - protein, 19 aa, Mycobacterium
KTFRSECYAGYKANRSSIP

SEQ ID NO: 1035771 - protein, 31 aa, Mycobacterium
KTGAALLPVHCWFQGSGWGFSVHPALDCTSG

SEQ ID NO: 1035772 - protein, 18 aa, Mycobacterium
KTGIRLRLFHGRGGTVGR

SEQ ID NO: 1035773 - protein, 26 aa, Mycobacterium
KTIAEVVNAFGWTAPLGVTYPGVVTQ

SEQ ID NO: 1035774 - protein, 20 aa, Mycobacterium
KTKRLPAWIYSLPHEHQLAL

SEQ ID NO: 1035775 - protein, 20 aa, Mycobacterium
KTLDELDCLLNRLDGAVPFP

SEQ ID NO: 1035776 - protein, 24 aa, Mycobacterium
KTLKAVAVKSPFFGDRRKAFLEDL

SEQ ID NO: 1035777 - protein, 21 aa, Mycobacterium
KTLTCVLPAYLNALAGKGVHI

SEQ ID NO: 1035778 - protein, 19 aa, Mycobacterium
KTSQRGWVVFDHRDLRESS

SEQ ID NO: 1035779 - protein, 21 aa, Mycobacterium
KTTGINMLRPDFDVDADGKFT

SEQ ID NO: 1035780 - protein, 17 aa, Mycobacterium
KTVCALLSEWLPATTGS

SEQ ID NO: 1035781 - protein, 17 aa, Mycobacterium
KTVKVLLDEAGVTVTRF

SEQ ID NO: 1035782 - protein, 19 aa, Mycobacterium
KVAAKDIWVLPTERARTEA

SEQ ID NO: 1035783 - protein, 22 aa, Mycobacterium
KVAQATRQWAFRSPSGSYPGQC

SEQ ID NO: 1035784 - protein, 18 aa, Mycobacterium
KVCSTCNGSGVINRNQGA

SEQ ID NO: 1035785 - protein, 24 aa, Mycobacterium
KVDRSAAYAMRWVAKNIVAAGLAE

SEQ ID NO: 1035786 - protein, 19 aa, Mycobacterium
KVGALARCRHRLEHIYCSG

SEQ ID NO: 1035787 - protein, 21 aa, Mycobacterium
KVGLGSVRFLMSVGDLIIGWL

SEQ ID NO: 1035788 - protein, 26 aa, Mycobacterium
KVLPRDEWPSMIRRLVSEQISLLLRR

SEQ ID NO: 1035789 - protein, 19 aa, Mycobacterium
KVLRVSWCTVLRSSQGKLL

SEQ ID NO: 1035790 - protein, 19 aa, Mycobacterium
KVNPLARVDLVIDHSVIAD

SEQ ID NO: 1035791 - protein, 19 aa, Mycobacterium
KVQWTRAAATHGLALDPKF

SEQ ID NO: 1035792 - protein, 18 aa, Mycobacterium
KVRCNSWLFGDHHGQSNG

SEQ ID NO: 1035793 - protein, 20 aa, Mycobacterium
KVRRAACVERYLNHEFNRLD

SEQ ID NO: 1035794 - protein, 22 aa, Mycobacterium
KVSEGRVAGVHFLMKKNKITEI

SEQ ID NO: 1035795 - protein, 21 aa, Mycobacterium
KVSHPIVFGHAVKTFYKEAFA

SEQ ID NO: 1035796 - protein, 19 aa, Mycobacterium
KVVRERLEVALQMVSVEQA

SEQ ID NO: 1035797 - protein, 20 aa, Mycobacterium
KVYPQIRMGSLGFSEAGPTY

SEQ ID NO: 1035798 - protein, 20 aa, Mycobacterium
KWFNAEKGFGFIAPEDGSAD

SEQ ID NO: 1035799 - protein, 24 aa, Mycobacterium
KWHRHRVIEPFDVDAYRQFLIDIG

SEQ ID NO: 1035800 - protein, 18 aa, Mycobacterium
KYGVKIPDEDLAGLRTVG

SEQ ID NO: 1035801 - protein, 26 aa, Mycobacterium
KYHLRYPLNRALRYGVKATFSTAAAT

SEQ ID NO: 1035802 - protein, 27 aa, Mycobacterium
KYPARVKCALLGWMACKDALIHANSAD

SEQ ID NO: 1035803 - protein, 17 aa, Mycobacterium
LAAALALQGLKALVIDL

SEQ ID NO: 1035804 - protein, 30 aa, Mycobacterium
LAAEICDGWLPIFFSPRMADMYNEWLDEGF

SEQ ID NO: 1035805 - protein, 18 aa, Mycobacterium
LAAELSQWSCAVVADRRR

SEQ ID NO: 1035806 - protein, 27 aa, Mycobacterium
LAAGIVRPDLVIGWWVAPTITILAHGI

SEQ ID NO: 1035807 - protein, 18 aa, Mycobacterium
LAALPMGIPPNFGVVLAN

SEQ ID NO: 1035808 - protein, 25 aa, Mycobacterium
LAALSRRGPHRVLRGDLSFAGLPGV

SEQ ID NO: 1035809 - protein, 24 aa, Mycobacterium
LAARIGAPLMLRGIGVRRVAVDRG

SEQ ID NO: 1035810 - protein, 21 aa, Mycobacterium
LAASCQDAACADEPYRRALRV

SEQ ID NO: 1035811 - protein, 30 aa, Mycobacterium
LAATGRLGLIPLRWALACLLIDIGSVTFSE

SEQ ID NO: 1035812 - protein, 17 aa, Mycobacterium
LAATYGRGESACALGAV

SEQ ID NO: 1035813 - protein, 18 aa, Mycobacterium
LACAKLGAIAVMVDGNLP

SEQ ID NO: 1035814 - protein, 19 aa, Mycobacterium
LADFARLYVVMGGKPISGI

SEQ ID NO: 1035815 - protein, 22 aa, Mycobacterium
LADGLPAYGACTGMILLASEIL

SEQ ID NO: 1035816 - protein, 21 aa, Mycobacterium
LADHTFDFYAMLAAITSRTGL

SEQ ID NO: 1035817 - protein, 22 aa, Mycobacterium
LADLVRRLSVVQGCVTLSSGKQ

SEQ ID NO: 1035818 - protein, 20 aa, Mycobacterium
LADMAMKVEAARLIVYAAAA

SEQ ID NO: 1035819 - protein, 27 aa, Mycobacterium
LADVIKRIGVPGIWYSGSHGFESTAPD

SEQ ID NO: 1035820 - protein, 19 aa, Mycobacterium
LAEAGCGRIVLTARSQPNP

SEQ ID NO: 1035821 - protein, 27 aa, Mycobacterium
LAEPGLPQAVPVTRLWLTKQETSDLAA

SEQ ID NO: 1035822 - protein, 18 aa, Mycobacterium
LAERGVLTGERGRYACST

SEQ ID NO: 1035823 - protein, 23 aa, Mycobacterium
LAEVPYDRVVELAPTVHKPRPNF

SEQ ID NO: 1035824 - protein, 31 aa, Mycobacterium
LAEYWHRRIREELKFSGNRTMSADDPEAVED

SEQ ID NO: 1035825 - protein, 22 aa, Mycobacterium
LAFPLRRGLGWHRRASELRTKE

SEQ ID NO: 1035826 - protein, 17 aa, Mycobacterium
LAFRSESIFTNLLLAKK

SEQ ID NO: 1035827 - protein, 27 aa, Mycobacterium
LAGAFLRAGTINRILAYVAPILLGGPV

SEQ ID NO: 1035828 - protein, 24 aa, Mycobacterium
LAGATPHWACTAIELARKTAEAFA

SEQ ID NO: 1035829 - protein, 17 aa, Mycobacterium
LAGAYGEEAAAEITVVL

SEQ ID NO: 1035830 - protein, 18 aa, Mycobacterium
LAGLRTVGDVVTYIQKLE

SEQ ID NO: 1035831 - protein, 20 aa, Mycobacterium
LAGRAMRRIGAIEFATTIAP

SEQ ID NO: 1035832 - protein, 25 aa, Mycobacterium
LAGSVPIELDISAGFDLAKLPDAVG

SEQ ID NO: 1035833 - protein, 26 aa, Mycobacterium
LAGYPRLGKTVLFLGRYDEPRKGMSV

SEQ ID NO: 1035834 - protein, 31 aa, Mycobacterium
LAHNRITEVLNRLRGGCPIEGRAIPRSSCWS

SEQ ID NO: 1035835 - protein, 23 aa, Mycobacterium
LAHSNGWAGLIVNGAVRDAAALR

SEQ ID NO: 1035836 - protein, 17 aa, Mycobacterium
LAHWCHRGGVAGGPVLG

SEQ ID NO: 1035837 - protein, 17 aa, Mycobacterium
LAIGLDGAWMRKIAEAM

SEQ ID NO: 1035838 - protein, 27 aa, Mycobacterium
LAIPTEMAIEFDISWEANEAEMFEEAE

SEQ ID NO: 1035839 - protein, 28 aa, Mycobacterium
LAKAMDRKVWLPSGGTLVIDRTEAMTVI

SEQ ID NO: 1035840 - protein, 17 aa, Mycobacterium
LAKIDAIQGERDLICAE

SEQ ID NO: 1035841 - protein, 21 aa, Mycobacterium
LAKLPTIAAYAYKKSVGQPFL

SEQ ID NO: 1035842 - protein, 21 aa, Mycobacterium
LAKTIKGYALGKHFESRNATH

SEQ ID NO: 1035843 - protein, 30 aa, Mycobacterium
LAKYTIEHWTRLPVEVELASEFRYRDPVLD

SEQ ID NO: 1035844 - protein, 18 aa, Mycobacterium
LALFEADVSLPVVRAFVH

SEQ ID NO: 1035845 - protein, 19 aa, Mycobacterium
LALSRYCWRPMTLVSIDAG

SEQ ID NO: 1035846 - protein, 17 aa, Mycobacterium
LALTPVFHGNMLIGNVI

SEQ ID NO: 1035847 - protein, 17 aa, Mycobacterium
LAMFALGPQLPRSPTRA

SEQ ID NO: 1035848 - protein, 18 aa, Mycobacterium
LANVRLALMHGRLSADEK

SEQ ID NO: 1035849 - protein, 18 aa, Mycobacterium
LAPEVPGELHAMMLDMRR

SEQ ID NO: 1035850 - protein, 18 aa, Mycobacterium
LAPGQRALVRTGLAVAIP

SEQ ID NO: 1035851 - protein, 23 aa, Mycobacterium
LAPLPRRRLGETLDRYENAKEFF

SEQ ID NO: 1035852 - protein, 19 aa, Mycobacterium
LAQALVKEGLRNVAAGANP

SEQ ID NO: 1035853 - protein, 25 aa, Mycobacterium
LAQLRPGQQVRLHWVRTQSSPLERL

SEQ ID NO: 1035854 - protein, 18 aa, Mycobacterium
LAQMLPVVRDVRRIGSAA

SEQ ID NO: 1035855 - protein, 17 aa, Mycobacterium
LAQRMGKTRVIAETGAG

SEQ ID NO: 1035856 - protein, 22 aa, Mycobacterium
LARCRHCTGPLSLLDRATPGTV

SEQ ID NO: 1035857 - protein, 24 aa, Mycobacterium
LARELTEAILVRGVDWVREITRVH

SEQ ID NO: 1035858 - protein, 28 aa, Mycobacterium
LARERGWEIRDFRTARKAARIGVPSALA

SEQ ID NO: 1035859 - protein, 21 aa, Mycobacterium
LARRAAQVIGERTGILKHDVA

SEQ ID NO: 1035860 - protein, 30 aa, Mycobacterium
LARRISAVKAFTAWAKWRGQLAADPAARLQ

SEQ ID NO: 1035861 - protein, 21 aa, Mycobacterium
LARRLTEVRKNGVLPYLRSDG

SEQ ID NO: 1035862 - protein, 22 aa, Mycobacterium
LARRVAPVPVRLVDERLTTVSA

SEQ ID NO: 1035863 - protein, 24 aa, Mycobacterium
LASAEIRVGTYLAEDHALRLLNLR

SEQ ID NO: 1035864 - protein, 17 aa, Mycobacterium
LASKPWVKTTMAPGSQV

SEQ ID NO: 1035865 - protein, 22 aa, Mycobacterium
LASKTPCWFGAYGVTKSPVDHM

SEQ ID NO: 1035866 - protein, 24 aa, Mycobacterium
LASRLASVSYTWIPRTRNSRADRL

SEQ ID NO: 1035867 - protein, 17 aa, Mycobacterium
LATATFLKNAKRAIHRL

SEQ ID NO: 1035868 - protein, 17 aa, Mycobacterium
LATELTVLVHGAAATQA

SEQ ID NO: 1035869 - protein, 18 aa, Mycobacterium
LATLDWLDAHGYARLLQH

SEQ ID NO: 1035870 - protein, 25 aa, Mycobacterium
LATVLSRATFHWVLAFADSSLLTPA

SEQ ID NO: 1035871 - protein, 20 aa, Mycobacterium
LAVMPWNFPLWQTVRFAAPA

SEQ ID NO: 1035872 - protein, 25 aa, Mycobacterium
LAVNHLRKMVGWARNRGVVVVSDEC

SEQ ID NO: 1035873 - protein, 33 aa, Mycobacterium
LAVPPRGWVNLHFSLLPAWRGAAPVQAAIAAGD

SEQ ID NO: 1035874 - protein, 17 aa, Mycobacterium
LAVRMENDGATAWRAVA

SEQ ID NO: 1035875 - protein, 17 aa, Mycobacterium
LAVTECRYSIPLKRIEF

SEQ ID NO: 1035876 - protein, 18 aa, Mycobacterium
LAVYPRAEFEQLARRASK

SEQ ID NO: 1035877 - protein, 21 aa, Mycobacterium
LAYAAVVYGYFPAVSEDNDIV

SEQ ID NO: 1035878 - protein, 30 aa, Mycobacterium
LAYESYRVLPYCWRDETPLSNHELRMDDDV

SEQ ID NO: 1035879 - protein, 21 aa, Mycobacterium
LAYLLKFDSILGRLPHDVSLE

SEQ ID NO: 1035880 - protein, 20 aa, Mycobacterium
LCAQILLLAAEDAFKDISLY

SEQ ID NO: 1035881 - protein, 20 aa, Mycobacterium
LCGLLKIVDVVKIGNRRMSY

SEQ ID NO: 1035882 - protein, 23 aa, Mycobacterium
LCLTCTTWSWPLPPEITKPDKDG

SEQ ID NO: 1035883 - protein, 25 aa, Mycobacterium
LCMATAVLCGSVARVIFQTDQGDVT

SEQ ID NO: 1035884 - protein, 21 aa, Mycobacterium
LCMDNGMPILVFNLLTNGNIA

SEQ ID NO: 1035885 - protein, 24 aa, Mycobacterium
LCRDSCHYCTFVTAPDMLRTQGAG

SEQ ID NO: 1035886 - protein, 17 aa, Mycobacterium
LCSNRFVHEVRQYGVTV

SEQ ID NO: 1035887 - protein, 18 aa, Mycobacterium
LCSQLPVFAEEFDAVTGE

SEQ ID NO: 1035888 - protein, 25 aa, Mycobacterium
LCSRLPRLPFSAIRRMDSPRTTVEL

SEQ ID NO: 1035889 - protein, 20 aa, Mycobacterium
LCTEIARWIDEEGLSLDVCS

SEQ ID NO: 1035890 - protein, 20 aa, Mycobacterium
LCYLRRFAGADVRVVHRVGT

SEQ ID NO: 1035891 - protein, 23 aa, Mycobacterium
LDAALDRFGPPVGDLSWVVKDDR

SEQ ID NO: 1035892 - protein, 31 aa, Mycobacterium
LDACLDRYARLFAWLGLWERRSDLAVIPADG

SEQ ID NO: 1035893 - protein, 20 aa, Mycobacterium
LDAEFPKFRQLLPAEHTAVA

SEQ ID NO: 1035894 - protein, 25 aa, Mycobacterium
LDAGVCGREALPLGAIDITVRRNAF

SEQ ID NO: 1035895 - protein, 18 aa, Mycobacterium
LDALAGHLVALMRIGPEL

SEQ ID NO: 1035896 - protein, 24 aa, Mycobacterium
LDALERNKMRVVPGLTSKAMSVAS

SEQ ID NO: 1035897 - protein, 24 aa, Mycobacterium
LDALKGRGGSSWGNQIRSYVLHPY

SEQ ID NO: 1035898 - protein, 18 aa, Mycobacterium
LDARQWFQSFPAVAGSSL

SEQ ID NO: 1035899 - protein, 18 aa, Mycobacterium
LDATSLSPFVTWGTNPGQ

SEQ ID NO: 1035900 - protein, 18 aa, Mycobacterium
LDDAAVECGIGFRRAAGV

SEQ ID NO: 1035901 - protein, 19 aa, Mycobacterium
LDDEVRWVLTKGKLPTSMW

SEQ ID NO: 1035902 - protein, 25 aa, Mycobacterium
LDDIRASGLLPTWDETQNFIANLGS

SEQ ID NO: 1035903 - protein, 27 aa, Mycobacterium
LDDKGRLTLPAKFRDALVGGLMVTKSQ

SEQ ID NO: 1035904 - protein, 19 aa, Mycobacterium
LDDLSRSYKLVEVDNALHT

SEQ ID NO: 1035905 - protein, 23 aa, Mycobacterium
LDDRFRLLTGGARTAVRRQQTLR

SEQ ID NO: 1035906 - protein, 20 aa, Mycobacterium
LDDSRLASYDGVNRVNPPLR

SEQ ID NO: 1035907 - protein, 18 aa, Mycobacterium
LDEAIGFINARPKPLAAY

SEQ ID NO: 1035908 - protein, 24 aa, Mycobacterium
LDELCLTIAPLIVGGRARRIATGP

SEQ ID NO: 1035909 - protein, 24 aa, Mycobacterium
LDESCRRIRDVVISISIVHQQPRI

SEQ ID NO: 1035910 - protein, 19 aa, Mycobacterium
LDEWQDWAKQRGHRGLAYV

SEQ ID NO: 1035911 - protein, 30 aa, Mycobacterium
LDFMRSCSIKHRLASVIFSLEMSKSEIVMR

SEQ ID NO: 1035912 - protein, 26 aa, Mycobacterium
LDGAPATVWTLNWVHRLIEGAPHPKH

SEQ ID NO: 1035913 - protein, 25 aa, Mycobacterium
LDGDARGGAALSVREVTGVPILFAT

SEQ ID NO: 1035914 - protein, 18 aa, Mycobacterium
LDGIAAFVESGRTVVLGV

SEQ ID NO: 1035915 - protein, 18 aa, Mycobacterium
LDGLAGFRGVRRRFELVG

SEQ ID NO: 1035916 - protein, 17 aa, Mycobacterium
LDGMPLAIELAAARIRT

SEQ ID NO: 1035917 - protein, 18 aa, Mycobacterium
LDGSLGMRKAPNRGTDVV

SEQ ID NO: 1035918 - protein, 17 aa, Mycobacterium
LDHAVCVVGKLPTVPAQ

SEQ ID NO: 1035919 - protein, 21 aa, Mycobacterium
LDHAYPPRFAQSWDSVGLVCG

SEQ ID NO: 1035920 - protein, 19 aa, Mycobacterium
LDIGCGWGATMKRAIEIYD

SEQ ID NO: 1035921 - protein, 20 aa, Mycobacterium
LDIGCGWGATMKRAIEIYDV

SEQ ID NO: 1035922 - protein, 17 aa, Mycobacterium
LDIKALLREGARSHGIP

SEQ ID NO: 1035923 - protein, 17 aa, Mycobacterium
LDITAPIGENIRAVAKV

SEQ ID NO: 1035924 - protein, 18 aa, Mycobacterium
LDKARPVLMLIPELFRPH

SEQ ID NO: 1035925 - protein, 17 aa, Mycobacterium
LDKGCYRGQETVARVQN

SEQ ID NO: 1035926 - protein, 23 aa, Mycobacterium
LDLAEALAKIFGFGSFEEERFVS

SEQ ID NO: 1035927 - protein, 18 aa, Mycobacterium
LDLGAPVHLDRVQFPDGV

SEQ ID NO: 1035928 - protein, 24 aa, Mycobacterium
LDLGSLVAGSRYRGDFEERLKKVL

SEQ ID NO: 1035929 - protein, 17 aa, Mycobacterium
LDLPSLLTALTRPAQDS

SEQ ID NO: 1035930 - protein, 17 aa, Mycobacterium
LDMPVIFREVSLRQTLE

SEQ ID NO: 1035931 - protein, 25 aa, Mycobacterium
LDNAFSGDELNAWVTRIRAEIGNDA

SEQ ID NO: 1035932 - protein, 27 aa, Mycobacterium
LDNLRRCIGDRRMLMVLDNCEYLLDVC

SEQ ID NO: 1035933 - protein, 23 aa, Mycobacterium
LDPAEVADTYFSLMDRLGTDGLL

SEQ ID NO: 1035934 - protein, 19 aa, Mycobacterium
LDPDARRRRLTALINVAQL

SEQ ID NO: 1035935 - protein, 17 aa, Mycobacterium
LDQSVSLLNLRLTPREG

SEQ ID NO: 1035936 - protein, 17 aa, Mycobacterium
LDRFVQQQVDGITLREE

SEQ ID NO: 1035937 - protein, 21 aa, Mycobacterium
LDRLWGDCLVVPVDISQHSGQ

SEQ ID NO: 1035938 - protein, 35 aa, Mycobacterium
LDRVFKVNGFGGWKYKKLRDVLGLLRDAYCRHIGV

SEQ ID NO: 1035939 - protein, 31 aa, Mycobacterium
LDRVGEAFLPDVPRLYLVYILVLNLGSACSD

SEQ ID NO: 1035940 - protein, 20 aa, Mycobacterium
LDSADAFAGYLVVSYRREAL

SEQ ID NO: 1035941 - protein, 25 aa, Mycobacterium
LDSLAEKRRTLGLPATSVAWGLWAG

SEQ ID NO: 1035942 - protein, 21 aa, Mycobacterium
LDVACAVLDSLVDWTTASIED

SEQ ID NO: 1035943 - protein, 18 aa, Mycobacterium
LDVAGAFHTEFMTAALDG

SEQ ID NO: 1035944 - protein, 19 aa, Mycobacterium
LDVARMVLFGQVGRELVNL

SEQ ID NO: 1035945 - protein, 17 aa, Mycobacterium
LDVPVVAGGVLDHRTAL

SEQ ID NO: 1035946 - protein, 19 aa, Mycobacterium
LDWFCSFSTAAALVGSPGQ

SEQ ID NO: 1035947 - protein, 21 aa, Mycobacterium
LDYDCPRSVLDKATLITSGLE

SEQ ID NO: 1035948 - protein, 19 aa, Mycobacterium
LDYSRLMIVSCDQLGQCDI

SEQ ID NO: 1035949 - protein, 27 aa, Mycobacterium
LEAAGDLHAAYGWHMRAAAWATNQDVR

SEQ ID NO: 1035950 - protein, 22 aa, Mycobacterium
LEAFQSGLSWLLILRKRENFRR

SEQ ID NO: 1035951 - protein, 17 aa, Mycobacterium
LEASAWLVAGIEAAYGE

SEQ ID NO: 1035952 - protein, 21 aa, Mycobacterium
LEATVTLSAISARFPQVQLAG

SEQ ID NO: 1035953 - protein, 22 aa, Mycobacterium
LEDFSRIGFKVPHIADVKPFGR

SEQ ID NO: 1035954 - protein, 18 aa, Mycobacterium
LEERAELDALKGRGGSSW

SEQ ID NO: 1035955 - protein, 29 aa, Mycobacterium
LEFTEGVGFDKGFLSAYFVTDFDSQQAVL

SEQ ID NO: 1035956 - protein, 17 aa, Mycobacterium
LEGALTQLAKAGRHHSP

SEQ ID NO: 1035957 - protein, 20 aa, Mycobacterium
LEGKTLPGIEVLGREQPRGG

SEQ ID NO: 1035958 - protein, 20 aa, Mycobacterium
LEGRVLRFDECGEIITDVAD

SEQ ID NO: 1035959 - protein, 24 aa, Mycobacterium
LEGVLARAAGILGIELGVEAGAEI

SEQ ID NO: 1035960 - protein, 31 aa, Mycobacterium
LEHYEKLEGVPLTFAGKVNRLAIMVRSNLTA

SEQ ID NO: 1035961 - protein, 17 aa, Mycobacterium
LEIDRPAPERVPAGHPL

SEQ ID NO: 1035962 - protein, 19 aa, Mycobacterium
LEITTCLRRGEIEMVTRYE

SEQ ID NO: 1035963 - protein, 19 aa, Mycobacterium
LEKGPRLGVLGVVVEIEGR

SEQ ID NO: 1035964 - protein, 21 aa, Mycobacterium
LELAKRLNAAVPRGVGVTLPV

SEQ ID NO: 1035965 - protein, 27 aa, Mycobacterium
LELGFRSSIQKEWDWRISRGESLNNLQ

SEQ ID NO: 1035966 - protein, 25 aa, Mycobacterium
LELLPTVRGAFCLTFMDENTLYACR

SEQ ID NO: 1035967 - protein, 20 aa, Mycobacterium
LELREFKTGVARMIVEAPKA

SEQ ID NO: 1035968 - protein, 33 aa, Mycobacterium
LELRNRLEASLGITLPVALVWAYPTTADLAAAL

SEQ ID NO: 1035969 - protein, 20 aa, Mycobacterium
LELTSLLPPVMLNLKQQADR

SEQ ID NO: 1035970 - protein, 17 aa, Mycobacterium
LELVGLMGIPPLGWNPD

SEQ ID NO: 1035971 - protein, 18 aa, Mycobacterium
LENLKIGRILQRDILLKG

SEQ ID NO: 1035972 - protein, 23 aa, Mycobacterium
LEPELRTSMITWSGTEPSTLFRM

SEQ ID NO: 1035973 - protein, 21 aa, Mycobacterium
LEPGHGLRIGYFAQEHDTLDN

SEQ ID NO: 1035974 - protein, 24 aa, Mycobacterium
LEPPRFCAECGRRMVVQVRPDGWR

SEQ ID NO: 1035975 - protein, 17 aa, Mycobacterium
LEPWRPVVDDSEIFAAG

SEQ ID NO: 1035976 - protein, 25 aa, Mycobacterium
LEQGDPRLSAVSSRIFGTPHDVDVG

SEQ ID NO: 1035977 - protein, 24 aa, Mycobacterium
LERIDCGQDFLALVDYAHKPGALH

SEQ ID NO: 1035978 - protein, 23 aa, Mycobacterium
LERLGKVWAAMAITEPGFGSDSA

SEQ ID NO: 1035979 - protein, 23 aa, Mycobacterium
LERTRGAIHFNRPGIPIVASLPS

SEQ ID NO: 1035980 - protein, 22 aa, Mycobacterium
LESRLDNVIYRAGLARTRRMAR

SEQ ID NO: 1035981 - protein, 19 aa, Mycobacterium
LETEWPVKQSDCLRPAHVR

SEQ ID NO: 1035982 - protein, 18 aa, Mycobacterium
LETGRFGFWTAPDPQGDV

SEQ ID NO: 1035983 - protein, 26 aa, Mycobacterium
LETHLGWVAKSGWKIDVAGGIPDWAV

SEQ ID NO: 1035984 - protein, 30 aa, Mycobacterium
LEVAAGIAGLIKTILCLKNKAIPATLHYTS

SEQ ID NO: 1035985 - protein, 18 aa, Mycobacterium
LEVCTEALVRVVRKFRPH

SEQ ID NO: 1035986 - protein, 24 aa, Mycobacterium
LEVEAVSVLTVWEGKPAYQVIFRD

SEQ ID NO: 1035987 - protein, 20 aa, Mycobacterium
LEVICCYPGVHAVWGHRISH

SEQ ID NO: 1035988 - protein, 17 aa, Mycobacterium
LEVLRLGGLETGSFPSP

SEQ ID NO: 1035989 - protein, 19 aa, Mycobacterium
LEVSARISSGLVMSATARL

SEQ ID NO: 1035990 - protein, 22 aa, Mycobacterium
LEVSQLPGRGWVEYEPYGTVLI

SEQ ID NO: 1035991 - protein, 18 aa, Mycobacterium
LEVVLAVGAQRAQDVAGK

SEQ ID NO: 1035992 - protein, 23 aa, Mycobacterium
LEYKSGRILQSYGVGAHRSALPG

SEQ ID NO: 1035993 - protein, 17 aa, Mycobacterium
LFALRSGYREPVLAAST

SEQ ID NO: 1035994 - protein, 18 aa, Mycobacterium
LFARCLLEGFDEVLALAG

SEQ ID NO: 1035995 - protein, 19 aa, Mycobacterium
LFDPTRLKTIAVRTPSGYR

SEQ ID NO: 1035996 - protein, 23 aa, Mycobacterium
LFEDACAVIPGGVNSPVRAFSAV

SEQ ID NO: 1035997 - protein, 21 aa, Mycobacterium
LFGVPYFPVTPLFPLAGPAGL

SEQ ID NO: 1035998 - protein, 25 aa, Mycobacterium
LFHARAKLRRKGCDLLVVNAVGDGR

SEQ ID NO: 1035999 - protein, 20 aa, Mycobacterium
LFITGRIKDLLVVDGSNHYP

SEQ ID NO: 1036000 - protein, 18 aa, Mycobacterium
LFKQFVCSGKSWDNGLGN

SEQ ID NO: 1036001 - protein, 18 aa, Mycobacterium
LFLGAARTVPGSKYAALN

SEQ ID NO: 1036002 - protein, 25 aa, Mycobacterium
LFPASIRPTLRWRLLPADYVEVARV

SEQ ID NO: 1036003 - protein, 18 aa, Mycobacterium
LFQTPGFGDTVDFFQIKH

SEQ ID NO: 1036004 - protein, 19 aa, Mycobacterium
LFSILRRRTPNGAVSGELT

SEQ ID NO: 1036005 - protein, 17 aa, Mycobacterium
LFYPEFSLWCGTTKTAD

SEQ ID NO: 1036006 - protein, 21 aa, Mycobacterium
LGAAMPRFMALDSVDDLAEID

SEQ ID NO: 1036007 - protein, 22 aa, Mycobacterium
LGALRMLAGDVIEMATGEGKTL

SEQ ID NO: 1036008 - protein, 19 aa, Mycobacterium
LGALTSAMRPTAPPPTPPT

SEQ ID NO: 1036009 - protein, 19 aa, Mycobacterium
LGANVIPIQLPVGSEGDFE

SEQ ID NO: 1036010 - protein, 23 aa, Mycobacterium
LGASRKRFLGRLLAGADGAVRPP

SEQ ID NO: 1036011 - protein, 20 aa, Mycobacterium
LGATRLLDNISIEIGNFSGI

SEQ ID NO: 1036012 - protein, 25 aa, Mycobacterium
LGAVLDRLAAYRARTVDIDGCVYRE

SEQ ID NO: 1036013 - protein, 18 aa, Mycobacterium
LGAYPAVLQPASIVAQAY

SEQ ID NO: 1036014 - protein, 19 aa, Mycobacterium
LGCDAEAGGGFLDALALDT

SEQ ID NO: 1036015 - protein, 32 aa, Mycobacterium
LGCKEALFTLGDRPEDRWAQARDWLAERGYDS

SEQ ID NO: 1036016 - protein, 18 aa, Mycobacterium
LGDCVPSRTFIASTGLLS

SEQ ID NO: 1036017 - protein, 18 aa, Mycobacterium
LGDDCIVEAGLYVTTGTK

SEQ ID NO: 1036018 - protein, 17 aa, Mycobacterium
LGDGVVRISIGLEDAAD

SEQ ID NO: 1036019 - protein, 25 aa, Mycobacterium
LGDRVGALARAWRHDLLHAGYRVCV

SEQ ID NO: 1036020 - protein, 17 aa, Mycobacterium
LGFGRSALRDRIGVSPA

SEQ ID NO: 1036021 - protein, 18 aa, Mycobacterium
LGFRPIKALLSAAGGEAL

SEQ ID NO: 1036022 - protein, 18 aa, Mycobacterium
LGFVEAQGGGTILLARGD

SEQ ID NO: 1036023 - protein, 17 aa, Mycobacterium
LGFYTGMVDGHFGLQTH

SEQ ID NO: 1036024 - protein, 19 aa, Mycobacterium
LGGGLPMAPMVPGGGSGTG

SEQ ID NO: 1036025 - protein, 17 aa, Mycobacterium
LGGLAYEAFQWARQTAS

SEQ ID NO: 1036026 - protein, 19 aa, Mycobacterium
LGGLIVIKFTEADVVLRPQ

SEQ ID NO: 1036027 - protein, 24 aa, Mycobacterium
LGGLKVTTANAWCAARPSGTEDVY

SEQ ID NO: 1036028 - protein, 18 aa, Mycobacterium
LGGMDYLSPERVELRYIM

SEQ ID NO: 1036029 - protein, 20 aa, Mycobacterium
LGGRIGVAAAERITAAVQRA

SEQ ID NO: 1036030 - protein, 23 aa, Mycobacterium
LGGRSLVHAVLMMIPEAWERHES

SEQ ID NO: 1036031 - protein, 25 aa, Mycobacterium
LGHEHQRIAPLVAELADTLERTIDV

SEQ ID NO: 1036032 - protein, 32 aa, Mycobacterium
LGHGNRCWLGRALCWLPRRWAEHPTVSTLPSG

SEQ ID NO: 1036033 - protein, 24 aa, Mycobacterium
LGHMGVKLGRKMGCEVTVLSQSLK

SEQ ID NO: 1036034 - protein, 25 aa, Mycobacterium
LGKELRRGATVALVYLSPDAKPAAT

SEQ ID NO: 1036035 - protein, 18 aa, Mycobacterium
LGKLKLEPGMTLLDIGCG

SEQ ID NO: 1036036 - protein, 20 aa, Mycobacterium
LGLDHCFGPVMLHRVEATVR

SEQ ID NO: 1036037 - protein, 18 aa, Mycobacterium
LGLPTGIDYMGYVDASYA

SEQ ID NO: 1036038 - protein, 20 aa, Mycobacterium
LGLPVFGICYGFQAMAQVLG

SEQ ID NO: 1036039 - protein, 24 aa, Mycobacterium
LGLQAADVAAYWPVPGVHDDKYTQ

SEQ ID NO: 1036040 - protein, 23 aa, Mycobacterium
LGMGRKGSNFQLRPVLSSGPTAA

SEQ ID NO: 1036041 - protein, 24 aa, Mycobacterium
LGMLAELPAGVGVEAAEASAALIW

SEQ ID NO: 1036042 - protein, 18 aa, Mycobacterium
LGNFNAHKLVIWLTRPPR

SEQ ID NO: 1036043 - protein, 17 aa, Mycobacterium
LGNGNFLLLGYQRCRVH

SEQ ID NO: 1036044 - protein, 22 aa, Mycobacterium
LGNLLSRPGVFVFGSNDYFGPH

SEQ ID NO: 1036045 - protein, 21 aa, Mycobacterium
LGNTMARLRGDRVIAVDVDAD

SEQ ID NO: 1036046 - protein, 18 aa, Mycobacterium
LGPHEFLSFIEGRAAMFA

SEQ ID NO: 1036047 - protein, 18 aa, Mycobacterium
LGPLASILRDKRIPLELC

SEQ ID NO: 1036048 - protein, 19 aa, Mycobacterium
LGPQLGLEETTAFLVIAAT

SEQ ID NO: 1036049 - protein, 25 aa, Mycobacterium
LGQHGVNIMEFCKAYNAATENQRGQ

SEQ ID NO: 1036050 - protein, 19 aa, Mycobacterium
LGQLLGFQRTNFADVTLHL

SEQ ID NO: 1036051 - protein, 18 aa, Mycobacterium
LGQPASWRATDIRSPGVG

SEQ ID NO: 1036052 - protein, 25 aa, Mycobacterium
LGREPRGVLEIAYRCPSGEPGVVKT

SEQ ID NO: 1036053 - protein, 21 aa, Mycobacterium
LGRVWLRAGYRFLKTQTALVD

SEQ ID NO: 1036054 - protein, 27 aa, Mycobacterium
LGSDKDFWLQVGIDPVRIMTGAGTFYT

SEQ ID NO: 1036055 - protein, 18 aa, Mycobacterium
LGSIEGRRILIVGDILHS

SEQ ID NO: 1036056 - protein, 24 aa, Mycobacterium
LGSVSKRPAIYVATYFGNPGASLA

SEQ ID NO: 1036057 - protein, 27 aa, Mycobacterium
LGSVSRARFGDVLPFLVKVLAADEPLS

SEQ ID NO: 1036058 - protein, 23 aa, Mycobacterium
LGSYRWLRPSGRCTAKEIASEFS

SEQ ID NO: 1036059 - protein, 18 aa, Mycobacterium
LGTTRWLVAILENHQRPD

SEQ ID NO: 1036060 - protein, 19 aa, Mycobacterium
LGVEASLRSLARVAPTQRH

SEQ ID NO: 1036061 - protein, 18 aa, Mycobacterium
LGVTYTAMMTPVFMVLRS

SEQ ID NO: 1036062 - protein, 17 aa, Mycobacterium
LGYPLPVCGDLTPWAQR

SEQ ID NO: 1036063 - protein, 25 aa, Mycobacterium
LHAGGAGRVRARFTSAGADAIAVDI

SEQ ID NO: 1036064 - protein, 23 aa, Mycobacterium
LHAHVLLQRDVHYIVRDDAVHLV

SEQ ID NO: 1036065 - protein, 18 aa, Mycobacterium
LHAYLRGVGVEVMANSDN

SEQ ID NO: 1036066 - protein, 26 aa, Mycobacterium
LHCELASLLRFVLDLLGDYGLEDFYL

SEQ ID NO: 1036067 - protein, 19 aa, Mycobacterium
LHDATVFYTVMGRTLEDAP

SEQ ID NO: 1036068 - protein, 22 aa, Mycobacterium
LHDEVHAFYAYFEFEASPTDLL

SEQ ID NO: 1036069 - protein, 19 aa, Mycobacterium
LHDVCRRHGALLLVDEAHG

SEQ ID NO: 1036070 - protein, 20 aa, Mycobacterium
LHELIAWLVARPLDKMRPMW

SEQ ID NO: 1036071 - protein, 29 aa, Mycobacterium
LHEMAHMWFGNLVTMTWWDDLWLNESFAT

SEQ ID NO: 1036072 - protein, 19 aa, Mycobacterium
LHERLLRHGVPAVVLNAKN

SEQ ID NO: 1036073 - protein, 30 aa, Mycobacterium
LHEYGVHVLVIRPGQVRTRMSAHVKEAPLT

SEQ ID NO: 1036074 - protein, 18 aa, Mycobacterium
LHGAWGVRVHDVRASVDA

SEQ ID NO: 1036075 - protein, 22 aa, Mycobacterium
LHGEYGRFGPGIANPWTPIADL

SEQ ID NO: 1036076 - protein, 18 aa, Mycobacterium
LHGLRLVFERNREAQRGR

SEQ ID NO: 1036077 - protein, 18 aa, Mycobacterium
LHHELECELAEFVGACVG

SEQ ID NO: 1036078 - protein, 18 aa, Mycobacterium
LHIPRTTWYNEVRFEEVS

SEQ ID NO: 1036079 - protein, 18 aa, Mycobacterium
LHLDILVDRMRREFKVEA

SEQ ID NO: 1036080 - protein, 19 aa, Mycobacterium
LHPPGIDFGPALLADVQIA

SEQ ID NO: 1036081 - protein, 24 aa, Mycobacterium
LHREELDAFVVRRLNLPFRDVDWT

SEQ ID NO: 1036082 - protein, 17 aa, Mycobacterium
LHRGKRIVDLDVNTPSG

SEQ ID NO: 1036083 - protein, 26 aa, Mycobacterium
LHSLPLIGQIAYRFMHSVKAGIKDSL

SEQ ID NO: 1036084 - protein, 22 aa, Mycobacterium
LHSRGVLPARLRLIYLADSQLL

SEQ ID NO: 1036085 - protein, 19 aa, Mycobacterium
LHSRIEVSDPYVLVLPTYG

SEQ ID NO: 1036086 - protein, 18 aa, Mycobacterium
LHTARYSGWQGLLDAQRA

SEQ ID NO: 1036087 - protein, 27 aa, Mycobacterium
LHTHLPWLAHHGRWPVGEEWLYQSWAA

SEQ ID NO: 1036088 - protein, 17 aa, Mycobacterium
LHVRGLDPWVIDFGSPD

SEQ ID NO: 1036089 - protein, 31 aa, Mycobacterium
LHVRIASPPVKWPCFYGIDFPSPAELIANVV

SEQ ID NO: 1036090 - protein, 18 aa, Mycobacterium
LHWALQVHLMLRQGSMTV

SEQ ID NO: 1036091 - protein, 18 aa, Mycobacterium
LIAGVPVVPVPADIGVVE

SEQ ID NO: 1036092 - protein, 26 aa, Mycobacterium
LIAPRSLTGVRVFFPDPWPKVRHHKR

SEQ ID NO: 1036093 - protein, 22 aa, Mycobacterium
LIARPRWQLYMINVLDWLAREF

SEQ ID NO: 1036094 - protein, 17 aa, Mycobacterium
LIDEARTPLIISGSADG

SEQ ID NO: 1036095 - protein, 25 aa, Mycobacterium
LIDRCWAPKVYGAWNLHQALQEGKT

SEQ ID NO: 1036096 - protein, 23 aa, Mycobacterium
LIDWKGNDWYAGKTETPAAHSNS

SEQ ID NO: 1036097 - protein, 18 aa, Mycobacterium
LIERGHRVAVLAVDPSSV

SEQ ID NO: 1036098 - protein, 18 aa, Mycobacterium
LIGELKQEYTIVIVTHNM

SEQ ID NO: 1036099 - protein, 24 aa, Mycobacterium
LIGESCLFVPVLQSAIYSTGFAKA

SEQ ID NO: 1036100 - protein, 20 aa, Mycobacterium
LIGSAGRLGGLFAGAHAEQV

SEQ ID NO: 1036101 - protein, 20 aa, Mycobacterium
LIHVVDRIKAITGRIDLVHC

SEQ ID NO: 1036102 - protein, 23 aa, Mycobacterium
LIKCARTAASMVCPLPTSSPKSI

SEQ ID NO: 1036103 - protein, 20 aa, Mycobacterium
LIKDGRFGPYVTDGETNASL

SEQ ID NO: 1036104 - protein, 26 aa, Mycobacterium
LIKLTSGQYGWLLSIPAIMSHWSELA

SEQ ID NO: 1036105 - protein, 21 aa, Mycobacterium
LIKNIEVAARVGGGDPVGNPT

SEQ ID NO: 1036106 - protein, 20 aa, Mycobacterium
LILFSGCRWVAILGSFSSSR

SEQ ID NO: 1036107 - protein, 17 aa, Mycobacterium
LINRSGEKISPERVEGV

SEQ ID NO: 1036108 - protein, 23 aa, Mycobacterium
LIPDPEPHGAITPQGRPGGKPWT

SEQ ID NO: 1036109 - protein, 22 aa, Mycobacterium
LIPDQRAGCSLADSITPDELCA

SEQ ID NO: 1036110 - protein, 21 aa, Mycobacterium
LIPDWECLRTKNTAFVERALH

SEQ ID NO: 1036111 - protein, 18 aa, Mycobacterium
LIPSCPTNRLQHQRITEI

SEQ ID NO: 1036112 - protein, 22 aa, Mycobacterium
LIPWEFIGGLGVSRSAAPIPSA

SEQ ID NO: 1036113 - protein, 31 aa, Mycobacterium
LIQARGLVDVVIPRGGANLIDAVVRDAQVPI

SEQ ID NO: 1036114 - protein, 17 aa, Mycobacterium
LIVSRSPVALSVTLEAM

SEQ ID NO: 1036115 - protein, 21 aa, Mycobacterium
LIVTCSRDFVLRAPVKLAEGI

SEQ ID NO: 1036116 - protein, 17 aa, Mycobacterium
LIVVPLDPALPVNEQCI

SEQ ID NO: 1036117 - protein, 21 aa, Mycobacterium
LKAALSVAGAALLARQLAHPD

SEQ ID NO: 1036118 - protein, 20 aa, Mycobacterium
LKAFIRKGIRNFGGLLGSRT

SEQ ID NO: 1036119 - protein, 21 aa, Mycobacterium
LKARSPEAWLSRRKEIDLHST

SEQ ID NO: 1036120 - protein, 19 aa, Mycobacterium
LKATLKHLACLEYSTVAIQ

SEQ ID NO: 1036121 - protein, 17 aa, Mycobacterium
LKCTNRALLERSNDPIV

SEQ ID NO: 1036122 - protein, 17 aa, Mycobacterium
LKDPFLFDPPLLLAAEI

SEQ ID NO: 1036123 - protein, 19 aa, Mycobacterium
LKEFMVRNTYIYPPEPSMR

SEQ ID NO: 1036124 - protein, 17 aa, Mycobacterium
LKEILREVVPPDAGVII

SEQ ID NO: 1036125 - protein, 19 aa, Mycobacterium
LKGGVIMDVVIPEQARIAE

SEQ ID NO: 1036126 - protein, 18 aa, Mycobacterium
LKHANAMTRFGEVADVDV

SEQ ID NO: 1036127 - protein, 25 aa, Mycobacterium
LKHSQLRPDAIIFTGDLADRGEPEA

SEQ ID NO: 1036128 - protein, 19 aa, Mycobacterium
LKIGRILQRDILLKGQKSG

SEQ ID NO: 1036129 - protein, 20 aa, Mycobacterium
LKINPLIVCIVEAEWMAMLH

SEQ ID NO: 1036130 - protein, 18 aa, Mycobacterium
LKLARKHFGSARRGESGV

SEQ ID NO: 1036131 - protein, 25 aa, Mycobacterium
LKLHPARYRQLLQHILAHVADGRLP

SEQ ID NO: 1036132 - protein, 21 aa, Mycobacterium
LKLPIPVQRRVAAGVLSAGHA

SEQ ID NO: 1036133 - protein, 23 aa, Mycobacterium
LKLRPSFGTSLIFDARLFANPTA

SEQ ID NO: 1036134 - protein, 19 aa, Mycobacterium
LKNKIALMCDVDIDGVIST

SEQ ID NO: 1036135 - protein, 17 aa, Mycobacterium
LKPVGGLEEVLYELSPI

SEQ ID NO: 1036136 - protein, 18 aa, Mycobacterium
LKQTLVRIGHEIEEMITV

SEQ ID NO: 1036137 - protein, 26 aa, Mycobacterium
LKRKTRKALKELVGGVAQYYPVIRAQ

SEQ ID NO: 1036138 - protein, 21 aa, Mycobacterium
LKSATGLTLPPTVIFDHPTPT

SEQ ID NO: 1036139 - protein, 19 aa, Mycobacterium
LKYPGGVVIAGDRRSTQGN

SEQ ID NO: 1036140 - protein, 18 aa, Mycobacterium
LLAALGDSPRRACINRNA

SEQ ID NO: 1036141 - protein, 32 aa, Mycobacterium
LLALAHDVRMRWCGPEVEIEGIISLKTGGCPE

SEQ ID NO: 1036142 - protein, 24 aa, Mycobacterium
LLALPVGESMWRLAADGGGTLEDL

SEQ ID NO: 1036143 - protein, 24 aa, Mycobacterium
LLASLRPQLGYVLQPLSGEYAATR

SEQ ID NO: 1036144 - protein, 18 aa, Mycobacterium
LLDEAGVTVTRFVRFEVG

SEQ ID NO: 1036145 - protein, 19 aa, Mycobacterium
LLDEARLVIAVACTAAQHG

SEQ ID NO: 1036146 - protein, 25 aa, Mycobacterium
LLDIGCGWGSTMLHAIEKYDVNVIG

SEQ ID NO: 1036147 - protein, 21 aa, Mycobacterium
LLDIGCGWGTTMRRAVEKYDV

SEQ ID NO: 1036148 - protein, 18 aa, Mycobacterium
LLDIVCDLYALSVKARHG

SEQ ID NO: 1036149 - protein, 17 aa, Mycobacterium
LLDIVGLRRDDATRYPT

SEQ ID NO: 1036150 - protein, 19 aa, Mycobacterium
LLDNISIEIGNFSGIASPD

SEQ ID NO: 1036151 - protein, 20 aa, Mycobacterium
LLDYFPEDFLLVIDESHVTV

SEQ ID NO: 1036152 - protein, 18 aa, Mycobacterium
LLEGFDEVLALAGDPTPH

SEQ ID NO: 1036153 - protein, 21 aa, Mycobacterium
LLERWRVLFEPIMLQSNVISD

SEQ ID NO: 1036154 - protein, 24 aa, Mycobacterium
LLEVEEVYLPLARLIHLQVAARQR

SEQ ID NO: 1036155 - protein, 19 aa, Mycobacterium
LLEVHRRFGTPVPPEPAEI

SEQ ID NO: 1036156 - protein, 17 aa, Mycobacterium
LLGEFMLNYLLAPNSEL

SEQ ID NO: 1036157 - protein, 19 aa, Mycobacterium
LLGIPVPNLIAGINSSLEL

SEQ ID NO: 1036158 - protein, 28 aa, Mycobacterium
LLGKKCYSLRIASAMAHDEGWLAEHMLI

SEQ ID NO: 1036159 - protein, 24 aa, Mycobacterium
LLGQLELSAGVARVEGKRITAGSP

SEQ ID NO: 1036160 - protein, 18 aa, Mycobacterium
LLGTGTPCCASWGTHSDH

SEQ ID NO: 1036161 - protein, 25 aa, Mycobacterium
LLGVDEVWAVGGAQAVALLAYGGTD

SEQ ID NO: 1036162 - protein, 19 aa, Mycobacterium
LLHERRLFHSTFVTDDQSE

SEQ ID NO: 1036163 - protein, 17 aa, Mycobacterium
LLITIAAINRLRSIEGV

SEQ ID NO: 1036164 - protein, 18 aa, Mycobacterium
LLKTTAIVVLAERGLDAA

SEQ ID NO: 1036165 - protein, 25 aa, Mycobacterium
LLKVRASEMPLLWSALPANGPARFV

SEQ ID NO: 1036166 - protein, 18 aa, Mycobacterium
LLLDGARTKLTRAALETL

SEQ ID NO: 1036167 - protein, 18 aa, Mycobacterium
LLLETSWDAIEHAGLDPA

SEQ ID NO: 1036168 - protein, 20 aa, Mycobacterium
LLLISCEWPGSAISKLKISP

SEQ ID NO: 1036169 - protein, 20 aa, Mycobacterium
LLLLPSCIRHWCDMGVHPDF

SEQ ID NO: 1036170 - protein, 22 aa, Mycobacterium
LLLQLKAWRLSTAKEQNVPAYV

SEQ ID NO: 1036171 - protein, 22 aa, Mycobacterium
LLMDSRSGYKYGDVTIVDHLAY

SEQ ID NO: 1036172 - protein, 17 aa, Mycobacterium
LLNDALEAGETVLLEGA

SEQ ID NO: 1036173 - protein, 18 aa, Mycobacterium
LLNTAFQKLEPMAAILNP

SEQ ID NO: 1036174 - protein, 18 aa, Mycobacterium
LLNTALDRLAEKLKLYAE

SEQ ID NO: 1036175 - protein, 18 aa, Mycobacterium
LLNTFRFSEVLQHIDEYQ

SEQ ID NO: 1036176 - protein, 18 aa, Mycobacterium
LLPAGSWLDHVYDTPSRG

SEQ ID NO: 1036177 - protein, 20 aa, Mycobacterium
LLPGRDGLVHISKLGKGKRI

SEQ ID NO: 1036178 - protein, 19 aa, Mycobacterium
LLPHGLAIVASRGAQRQAD

SEQ ID NO: 1036179 - protein, 18 aa, Mycobacterium
LLPISKFFPATDVAILSR

SEQ ID NO: 1036180 - protein, 22 aa, Mycobacterium
LLPLYFELDGSFPNHEANPLDP

SEQ ID NO: 1036181 - protein, 27 aa, Mycobacterium
LLPVLVIGAPLRYRHRIYNTAVIIHRG

SEQ ID NO: 1036182 - protein, 17 aa, Mycobacterium
LLQEEIWCQLFSEPDAG

SEQ ID NO: 1036183 - protein, 24 aa, Mycobacterium
LLQPGQRLLVFLPLAHVLARALTL

SEQ ID NO: 1036184 - protein, 19 aa, Mycobacterium
LLRAVACRLPLPIDIVQVH

SEQ ID NO: 1036185 - protein, 31 aa, Mycobacterium
LLREAHDLCGLPVTVFRCDMILADTSYAGQL

SEQ ID NO: 1036186 - protein, 17 aa, Mycobacterium
LLREGVGVFGFHLCGLD

SEQ ID NO: 1036187 - protein, 21 aa, Mycobacterium
LLRFRFTTIGDLFGVLEMGWE

SEQ ID NO: 1036188 - protein, 17 aa, Mycobacterium
LLRNTIVSFLRYIDANR

SEQ ID NO: 1036189 - protein, 24 aa, Mycobacterium
LLRSCGSIDGLERVRFTSPHPAEF

SEQ ID NO: 1036190 - protein, 17 aa, Mycobacterium
LLSAGYPRLEHVTGDAA

SEQ ID NO: 1036191 - protein, 24 aa, Mycobacterium
LLSKHIRLIAAFDHRHVFLDPDPD

SEQ ID NO: 1036192 - protein, 31 aa, Mycobacterium
LLSPMSFLRRPACWMQLLATTQACFSAAPNF

SEQ ID NO: 1036193 - protein, 17 aa, Mycobacterium
LLSRAGLSIAAMWAANP

SEQ ID NO: 1036194 - protein, 17 aa, Mycobacterium
LLSSLQFAHVDLLTLAF

SEQ ID NO: 1036195 - protein, 19 aa, Mycobacterium
LLTADMVRPGAVVVDVGVS

SEQ ID NO: 1036196 - protein, 18 aa, Mycobacterium
LLTALAVSDLDPFIHLLS

SEQ ID NO: 1036197 - protein, 20 aa, Mycobacterium
LLTCGKLYYELAARKIKDNR

SEQ ID NO: 1036198 - protein, 17 aa, Mycobacterium
LLTNKPFLYVFNADEAV

SEQ ID NO: 1036199 - protein, 20 aa, Mycobacterium
LLVESGMAHLFPLVVVVHAD

SEQ ID NO: 1036200 - protein, 19 aa, Mycobacterium
LLVRGNVVFSGYWHNEQGT

SEQ ID NO: 1036201 - protein, 19 aa, Mycobacterium
LMDAVPVTLGQEFGGYARQ

SEQ ID NO: 1036202 - protein, 18 aa, Mycobacterium
LMFVLCSSIAATVGSPGQ

SEQ ID NO: 1036203 - protein, 21 aa, Mycobacterium
LMGANPAVWIYAGGAGFANIL

SEQ ID NO: 1036204 - protein, 18 aa, Mycobacterium
LMGMQLALTELWRSYGVE

SEQ ID NO: 1036205 - protein, 17 aa, Mycobacterium
LMHALATVRSRLAAASQ

SEQ ID NO: 1036206 - protein, 24 aa, Mycobacterium
LMKAALPFGLWIPVLPGTRQVTIG

SEQ ID NO: 1036207 - protein, 25 aa, Mycobacterium
LMLGSYRFTDFRSRKTAPKDNGLRK

SEQ ID NO: 1036208 - protein, 19 aa, Mycobacterium
LMMGVPRFDGAHSADDLVD

SEQ ID NO: 1036209 - protein, 25 aa, Mycobacterium
LMSIPCQRLQLFIVGDMITIRFAKL

SEQ ID NO: 1036210 - protein, 17 aa, Mycobacterium
LNAAISWYHDHLGMILV

SEQ ID NO: 1036211 - protein, 18 aa, Mycobacterium
LNAAVPRGVGVTLPVFVT

SEQ ID NO: 1036212 - protein, 29 aa, Mycobacterium
LNAQISVCRACPRLVDWREEVAVVKRRAF

SEQ ID NO: 1036213 - protein, 23 aa, Mycobacterium
LNEAFASVVLKFQKDLNIPDEKL

SEQ ID NO: 1036214 - protein, 18 aa, Mycobacterium
LNGLRLGVCVTDAGRRNP

SEQ ID NO: 1036215 - protein, 18 aa, Mycobacterium
LNHILRVDIWEYFIDLTH

SEQ ID NO: 1036216 - protein, 23 aa, Mycobacterium
LNIGNPALFGFDAPDVIMRDMIQ

SEQ ID NO: 1036217 - protein, 20 aa, Mycobacterium
LNITGGAAFAAEPDAKRAIM

SEQ ID NO: 1036218 - protein, 25 aa, Mycobacterium
LNKLDLKPGMTLLDIGCGWGTTMRR

SEQ ID NO: 1036219 - protein, 21 aa, Mycobacterium
LNLDMSLKLWERGEQLAKRCE

SEQ ID NO: 1036220 - protein, 25 aa, Mycobacterium
LNLGKVLSKRARIIGSTLRARPVNG

SEQ ID NO: 1036221 - protein, 18 aa, Mycobacterium
LNLVRPVFTSRLPDDDVL

SEQ ID NO: 1036222 - protein, 18 aa, Mycobacterium
LNLYPYNPGHLMVVPYRQ

SEQ ID NO: 1036223 - protein, 19 aa, Mycobacterium
LNNGVPWSNPRMNPTHLNF

SEQ ID NO: 1036224 - protein, 19 aa, Mycobacterium
LNNLVNMFISKSYVDNVKT

SEQ ID NO: 1036225 - protein, 18 aa, Mycobacterium
LNPFYSEGIERIEVRNIV

SEQ ID NO: 1036226 - protein, 25 aa, Mycobacterium
LNRGVLAAVRWVPEPSVAQVVVGAR

SEQ ID NO: 1036227 - protein, 18 aa, Mycobacterium
LNRKESRGGHAREDYPHR

SEQ ID NO: 1036228 - protein, 24 aa, Mycobacterium
LNRSGIGGYHLVGLDFDDIARGTV

SEQ ID NO: 1036229 - protein, 20 aa, Mycobacterium
LPADDPRIWPNIVASQLGWD

SEQ ID NO: 1036230 - protein, 23 aa, Mycobacterium
LPADLRARLDAALAKPAAQQPSW

SEQ ID NO: 1036231 - protein, 19 aa, Mycobacterium
LPADPRRSGQLVSLSHGAG

SEQ ID NO: 1036232 - protein, 17 aa, Mycobacterium
LPAGTPVVRAMPNAAAL

SEQ ID NO: 1036233 - protein, 19 aa, Mycobacterium
LPALCPVIPVIKCRSLVWW

SEQ ID NO: 1036234 - protein, 17 aa, Mycobacterium
LPASLLVSADMAHATHP

SEQ ID NO: 1036235 - protein, 20 aa, Mycobacterium
LPAVRASLYSDPAFQDKYPM

SEQ ID NO: 1036236 - protein, 20 aa, Mycobacterium
LPDDEFSEVVSFTHAASRPT

SEQ ID NO: 1036237 - protein, 17 aa, Mycobacterium
LPDDRLEELLALAHDVR

SEQ ID NO: 1036238 - protein, 19 aa, Mycobacterium
LPDELFIDSLCQLIAVDNA

SEQ ID NO: 1036239 - protein, 21 aa, Mycobacterium
LPDGFAIAACETYGRHSAGMI

SEQ ID NO: 1036240 - protein, 19 aa, Mycobacterium
LPDNFSVRIDRGHRVVARD

SEQ ID NO: 1036241 - protein, 17 aa, Mycobacterium
LPEAGSYDDFCRRQHRF

SEQ ID NO: 1036242 - protein, 18 aa, Mycobacterium
LPERANVTLAGMNFTVVH

SEQ ID NO: 1036243 - protein, 26 aa, Mycobacterium
LPERLRSGAGVADFDCGSGHVVNVLV

SEQ ID NO: 1036244 - protein, 18 aa, Mycobacterium
LPESFKKSCRAVAEAGWS

SEQ ID NO: 1036245 - protein, 18 aa, Mycobacterium
LPEVFALTDYYLADVRFN

SEQ ID NO: 1036246 - protein, 25 aa, Mycobacterium
LPFYHDMGLVLGVVAPILGGWRSEL

SEQ ID NO: 1036247 - protein, 17 aa, Mycobacterium
LPGAFQGTFSYLLQDED

SEQ ID NO: 1036248 - protein, 22 aa, Mycobacterium
LPGDAFVLGVQWHPEKALSDLR

SEQ ID NO: 1036249 - protein, 18 aa, Mycobacterium
LPGHPMAIFTPGHTGGHC

SEQ ID NO: 1036250 - protein, 22 aa, Mycobacterium
LPGRRVTGYLANIALLHLTVAD

SEQ ID NO: 1036251 - protein, 25 aa, Mycobacterium
LPIERTCEFLEWFLGSVPIAPIWLC

SEQ ID NO: 1036252 - protein, 27 aa, Mycobacterium
LPILKGPPFLKRVVLRTAARLSRRGRR

SEQ ID NO: 1036253 - protein, 17 aa, Mycobacterium
LPKLPSFHLTSDSITDG

SEQ ID NO: 1036254 - protein, 28 aa, Mycobacterium
LPLAHWKCYMALGYFKLAIMAAGIDLQT

SEQ ID NO: 1036255 - protein, 18 aa, Mycobacterium
LPLLYVPFPSILEGAQSS

SEQ ID NO: 1036256 - protein, 17 aa, Mycobacterium
LPLRPFKTMAVTVDGRL

SEQ ID NO: 1036257 - protein, 18 aa, Mycobacterium
LPLVRRDLENLVRIESVW

SEQ ID NO: 1036258 - protein, 18 aa, Mycobacterium
LPMDKVLAGVRAIVHKMA

SEQ ID NO: 1036259 - protein, 18 aa, Mycobacterium
LPNKLAFSVSWKGRHQVR

SEQ ID NO: 1036260 - protein, 19 aa, Mycobacterium
LPPAGALTGIAKRELREVT

SEQ ID NO: 1036261 - protein, 22 aa, Mycobacterium
LPPATYFSGGKLQWILENVDGV

SEQ ID NO: 1036262 - protein, 19 aa, Mycobacterium
LPPEARFGSVAAVQRYVDD

SEQ ID NO: 1036263 - protein, 18 aa, Mycobacterium
LPPGVARQIVCRQMLIGL

SEQ ID NO: 1036264 - protein, 18 aa, Mycobacterium
LPPSINFAGPSPYIDFDA

SEQ ID NO: 1036265 - protein, 20 aa, Mycobacterium
LPPVPLDAAIVFAPVGDLVL

SEQ ID NO: 1036266 - protein, 25 aa, Mycobacterium
LPQLPRTALIDILLRRIPRTHSGAT

SEQ ID NO: 1036267 - protein, 19 aa, Mycobacterium
LPQRAAGLGSDPVAAFEEE

SEQ ID NO: 1036268 - protein, 18 aa, Mycobacterium
LPQSAVVSVVLGDPEVAL

SEQ ID NO: 1036269 - protein, 17 aa, Mycobacterium
LPRKLTGDLARLPLRVW

SEQ ID NO: 1036270 - protein, 24 aa, Mycobacterium
LPRQDEVFPYYAHFGRNLVQPSAD

SEQ ID NO: 1036271 - protein, 24 aa, Mycobacterium
LPSARRLLLFKADGSVSVHADDRA

SEQ ID NO: 1036272 - protein, 21 aa, Mycobacterium
LPSNRLAEVSVRVREICDKYD

SEQ ID NO: 1036273 - protein, 17 aa, Mycobacterium
LPSRGVGVIELRGESLT

SEQ ID NO: 1036274 - protein, 26 aa, Mycobacterium
LPTAAPRWVVDPDFELDFHVRRVRVP

SEQ ID NO: 1036275 - protein, 27 aa, Mycobacterium
LPTPFLPADVFDLWGLPADDPRRTTTR

SEQ ID NO: 1036276 - protein, 24 aa, Mycobacterium
LPTQLCAFAAGVLRAEAAHEPGYY

SEQ ID NO: 1036277 - protein, 24 aa, Mycobacterium
LPTRPRATLVLRKDADHSINRLRL

SEQ ID NO: 1036278 - protein, 17 aa, Mycobacterium
LPTSMWIEIVTTAHEVG

SEQ ID NO: 1036279 - protein, 20 aa, Mycobacterium
LPTVWPCTVYPLKETYDGAD

SEQ ID NO: 1036280 - protein, 21 aa, Mycobacterium
LPVDVAETIAYFAIPASNAVT

SEQ ID NO: 1036281 - protein, 25 aa, Mycobacterium
LPVIGTKELIAWLPTLLGLRAGDVV

SEQ ID NO: 1036282 - protein, 18 aa, Mycobacterium
LPVPKLMVEPGRAIAGPG

SEQ ID NO: 1036283 - protein, 18 aa, Mycobacterium
LPVTGYVDLVRAVKTRVP

SEQ ID NO: 1036284 - protein, 17 aa, Mycobacterium
LPVVVRPSFTMGGLGSG

SEQ ID NO: 1036285 - protein, 19 aa, Mycobacterium
LPYSLKVLAENLLRNEDGK

SEQ ID NO: 1036286 - protein, 18 aa, Mycobacterium
LQAELDLAEAQLFDAADT

SEQ ID NO: 1036287 - protein, 21 aa, Mycobacterium
LQGHRCGACRSEIGRGELSCI

SEQ ID NO: 1036288 - protein, 17 aa, Mycobacterium
LQGMATGHITFVTVPTG

SEQ ID NO: 1036289 - protein, 18 aa, Mycobacterium
LQHWGLQPDFVMGHSIGE

SEQ ID NO: 1036290 - protein, 25 aa, Mycobacterium
LQKISELYDRVGFAAAGKFNEFDNL

SEQ ID NO: 1036291 - protein, 24 aa, Mycobacterium
LQLASSLQPIWFGRGHMYEGLAWF

SEQ ID NO: 1036292 - protein, 17 aa, Mycobacterium
LQLHYAKTLDLWAARLE

SEQ ID NO: 1036293 - protein, 19 aa, Mycobacterium
LQLLRVVLEAVGDRARVIA

SEQ ID NO: 1036294 - protein, 25 aa, Mycobacterium
LQLSKRGGGVALLLSNIREHGAPIK

SEQ ID NO: 1036295 - protein, 17 aa, Mycobacterium
LQPDHRLAVVFGAGGER

SEQ ID NO: 1036296 - protein, 23 aa, Mycobacterium
LQPECADHIAAVVLFGMTNFQAM

SEQ ID NO: 1036297 - protein, 24 aa, Mycobacterium
LQPYGGAWLNSWLDRDLGVSGRLS

SEQ ID NO: 1036298 - protein, 18 aa, Mycobacterium
LQQMVRLALVWSAKTTSN

SEQ ID NO: 1036299 - protein, 23 aa, Mycobacterium
LQRPARWMHMLASEFPVFSAAPN

SEQ ID NO: 1036300 - protein, 19 aa, Mycobacterium
LQSRLSCSYLVDSGGAILP

SEQ ID NO: 1036301 - protein, 17 aa, Mycobacterium
LQTAAGFSARGQEHALV

SEQ ID NO: 1036302 - protein, 25 aa, Mycobacterium
LQTTLTTKVTVEWVELPQQGGLIAH

SEQ ID NO: 1036303 - protein, 27 aa, Mycobacterium
LQTVAALLRLQARRMANAEGREALIES

SEQ ID NO: 1036304 - protein, 19 aa, Mycobacterium
LQVRPPVVTVMGHVDHGKT

SEQ ID NO: 1036305 - protein, 17 aa, Mycobacterium
LQWLQKIGYTDFYNTLV

SEQ ID NO: 1036306 - protein, 18 aa, Mycobacterium
LQYFVSCLVYVPRDRYTT

SEQ ID NO: 1036307 - protein, 20 aa, Mycobacterium
LRAAAKLPQVRIVVAGGPSG

SEQ ID NO: 1036308 - protein, 28 aa, Mycobacterium
LRAAEEALWRWMTAAALVRARGDGGVVM

SEQ ID NO: 1036309 - protein, 24 aa, Mycobacterium
LRADEQRHRIALSREPDDGFVGVI

SEQ ID NO: 1036310 - protein, 18 aa, Mycobacterium
LRADRLQYFVSCLVYVPR

SEQ ID NO: 1036311 - protein, 17 aa, Mycobacterium
LRADSLLGVAGLVEAQH

SEQ ID NO: 1036312 - protein, 19 aa, Mycobacterium
LRADSVLAVARRATELGWR

SEQ ID NO: 1036313 - protein, 18 aa, Mycobacterium
LRALAAPVRIAIVLQLRE

SEQ ID NO: 1036314 - protein, 25 aa, Mycobacterium
LRALPERQRHSSLLPLLHNYQKPEK

SEQ ID NO: 1036315 - protein, 20 aa, Mycobacterium
LRAPLLAALGAADLALTTVN

SEQ ID NO: 1036316 - protein, 19 aa, Mycobacterium
LRARDVLIVIGTEEGIAGV

SEQ ID NO: 1036317 - protein, 21 aa, Mycobacterium
LRARHAVFDRLVYRKLRAALG

SEQ ID NO: 1036318 - protein, 20 aa, Mycobacterium
LRATWKYVDHFDATGIALES

SEQ ID NO: 1036319 - protein, 27 aa, Mycobacterium
LRCEPRLPWIWWRSRLGSVAVATGYST

SEQ ID NO: 1036320 - protein, 18 aa, Mycobacterium
LRCLAAYVYAAAGEGEST

SEQ ID NO: 1036321 - protein, 23 aa, Mycobacterium
LRDFGCDAAQGWHFAKALPADFF

SEQ ID NO: 1036322 - protein, 17 aa, Mycobacterium
LRDGHYSGAAALGNAKG

SEQ ID NO: 1036323 - protein, 26 aa, Mycobacterium
LRDGVQWSRIRLADRAYLEPWEPSTE

SEQ ID NO: 1036324 - protein, 23 aa, Mycobacterium
LRDTLLWAKLIDKYKGTVICGPN

SEQ ID NO: 1036325 - protein, 20 aa, Mycobacterium
LRDTRQLLATEWTKQFMSRS

SEQ ID NO: 1036326 - protein, 26 aa, Mycobacterium
LREANGDRYLPIWIGQSEAAAIALEQ

SEQ ID NO: 1036327 - protein, 17 aa, Mycobacterium
LREAVATFSAVKPSLAW

SEQ ID NO: 1036328 - protein, 18 aa, Mycobacterium
LREFGHAVVADRINEALQ

SEQ ID NO: 1036329 - protein, 25 aa, Mycobacterium
LRELERGGLRMVVDAAVQAAKIRSE

SEQ ID NO: 1036330 - protein, 18 aa, Mycobacterium
LRELRRWEDKPVVVVHGH

SEQ ID NO: 1036331 - protein, 21 aa, Mycobacterium
LREPFCAQVYHVNPICGDEIT

SEQ ID NO: 1036332 - protein, 17 aa, Mycobacterium
LRERAELAAHWLSHGQW

SEQ ID NO: 1036333 - protein, 25 aa, Mycobacterium
LRESVRLMRELWRGDRVDFDGDYYQ

SEQ ID NO: 1036334 - protein, 18 aa, Mycobacterium
LREVLGYDLRCYSDLTYS

SEQ ID NO: 1036335 - protein, 22 aa, Mycobacterium
LRFANQLWIPIWNAHVQITVAE

SEQ ID NO: 1036336 - protein, 19 aa, Mycobacterium
LRGHVRFSRETLYLRFMSA

SEQ ID NO: 1036337 - protein, 19 aa, Mycobacterium
LRGKHKPTFAPNVDGGDFV

SEQ ID NO: 1036338 - protein, 24 aa, Mycobacterium
LRGMLPHNAVEYFVSYYDYYQPEA

SEQ ID NO: 1036339 - protein, 23 aa, Mycobacterium
LRGSRVALRVPRRGDKRALAETV

SEQ ID NO: 1036340 - protein, 34 aa, Mycobacterium
LRHSAEGWRLYTRARYAPYVERLLLDGARTKLTR

SEQ ID NO: 1036341 - protein, 17 aa, Mycobacterium
LRIALEAAVAYCHLIKS

SEQ ID NO: 1036342 - protein, 17 aa, Mycobacterium
LRIGDSVVAGDAYGRVR

SEQ ID NO: 1036343 - protein, 22 aa, Mycobacterium
LRIINRYAFVLAGRCNSRYRHA

SEQ ID NO: 1036344 - protein, 20 aa, Mycobacterium
LRIYCGYAYDADVSYWQCGS

SEQ ID NO: 1036345 - protein, 18 aa, Mycobacterium
LRKARGFGGPVIVHVVTR

SEQ ID NO: 1036346 - protein, 19 aa, Mycobacterium
LRKGRYPDRKTARRVSEVV

SEQ ID NO: 1036347 - protein, 24 aa, Mycobacterium
LRKHPKWWDMAIIIAYDDSDGLYD

SEQ ID NO: 1036348 - protein, 20 aa, Mycobacterium
LRKLDAMSANLARLTDLTTE

SEQ ID NO: 1036349 - protein, 17 aa, Mycobacterium
LRKSVLFEMEQEFPEEF

SEQ ID NO: 1036350 - protein, 17 aa, Mycobacterium
LRLADFDRLELSNLNRV

SEQ ID NO: 1036351 - protein, 18 aa, Mycobacterium
LRLALPQLDFAALTLGRV

SEQ ID NO: 1036352 - protein, 20 aa, Mycobacterium
LRLAVRYSIKHRSASATQSD

SEQ ID NO: 1036353 - protein, 20 aa, Mycobacterium
LRLFDDLRLDHGRLDQPIPV

SEQ ID NO: 1036354 - protein, 18 aa, Mycobacterium
LRLFKCGKVTTARHGLFS

SEQ ID NO: 1036355 - protein, 19 aa, Mycobacterium
LRLLHPVMPFITETLWQAL

SEQ ID NO: 1036356 - protein, 26 aa, Mycobacterium
LRLPSPDWQVLLAVSVELAGKRSRYR

SEQ ID NO: 1036357 - protein, 21 aa, Mycobacterium
LRLVIPIALLADRGFLGLYEV

SEQ ID NO: 1036358 - protein, 17 aa, Mycobacterium
LRMLAGIDDEIRRFVAQ

SEQ ID NO: 1036359 - protein, 22 aa, Mycobacterium
LRMLTLPSTVGLYVERAWPRHR

SEQ ID NO: 1036360 - protein, 20 aa, Mycobacterium
LRMVDDLLPAPGEVLMQESE

SEQ ID NO: 1036361 - protein, 18 aa, Mycobacterium
LRNCGAPLMSLRTDRDWI

SEQ ID NO: 1036362 - protein, 17 aa, Mycobacterium
LRPFPANLGDVLRRDPM

SEQ ID NO: 1036363 - protein, 21 aa, Mycobacterium
LRPGDVLLMASIKVSSQLEDN

SEQ ID NO: 1036364 - protein, 25 aa, Mycobacterium
LRPIRGDAVISHFVRTVITMMATAS

SEQ ID NO: 1036365 - protein, 18 aa, Mycobacterium
LRPLARVAHLDFVEPATP

SEQ ID NO: 1036366 - protein, 19 aa, Mycobacterium
LRPMPVGRHTFFTREEGVT

SEQ ID NO: 1036367 - protein, 18 aa, Mycobacterium
LRPPKGVLLYGPPGCGKT

SEQ ID NO: 1036368 - protein, 24 aa, Mycobacterium
LRPYPPRAVLLAANRDPLTRHVRA

SEQ ID NO: 1036369 - protein, 17 aa, Mycobacterium
LRQALQHTSRLSATLRA

SEQ ID NO: 1036370 - protein, 21 aa, Mycobacterium
LRQDGMLALARLQRKMRLVES

SEQ ID NO: 1036371 - protein, 25 aa, Mycobacterium
LRQKRLMTLIHFWLVHRFKADTVIY

SEQ ID NO: 1036372 - protein, 18 aa, Mycobacterium
LRQRRGAWVGWPGVINDN

SEQ ID NO: 1036373 - protein, 19 aa, Mycobacterium
LRQSVMLDLLLGLANEAEG

SEQ ID NO: 1036374 - protein, 20 aa, Mycobacterium
LRRAVRLLAQLTCQVAVVQY

SEQ ID NO: 1036375 - protein, 19 aa, Mycobacterium
LRRCLGRGFAKLKVNKGVD

SEQ ID NO: 1036376 - protein, 30 aa, Mycobacterium; identical to SEQ ID NO: 696621

SEQ ID NO: 1036377 - protein, 18 aa, Mycobacterium
LRRIPRTHSGATLPRGTD

SEQ ID NO: 1036378 - protein, 18 aa, Mycobacterium
LRRLLDVVPGILIVDEAY

SEQ ID NO: 1036379 - protein, 17 aa, Mycobacterium
LRRLSRLLPVDVRVLDI

SEQ ID NO: 1036380 - protein, 19 aa, Mycobacterium
LRSDLLRPWVNWVTPEAEP

SEQ ID NO: 1036381 - protein, 18 aa, Mycobacterium
LRSEARKGRMLPYAIELD

SEQ ID NO: 1036382 - protein, 17 aa, Mycobacterium
LRSGTSLAEVADYLGIP

SEQ ID NO: 1036383 - protein, 23 aa, Mycobacterium
LRSHANITVCVGGGIGTPEKAAE

SEQ ID NO: 1036384 - protein, 18 aa, Mycobacterium
LRSLCFDVLAVGEPDESG

SEQ ID NO: 1036385 - protein, 19 aa, Mycobacterium
LRSLDALGLLETRILAPGH

SEQ ID NO: 1036386 - protein, 18 aa, Mycobacterium
LRSLRLWHEGGFTDRLAP

SEQ ID NO: 1036387 - protein, 17 aa, Mycobacterium
LRSRFATRIEFDTYSPD

SEQ ID NO: 1036388 - protein, 21 aa, Mycobacterium
LRSVMHRLIYNDGITYTGIDP

SEQ ID NO: 1036389 - protein, 20 aa, Mycobacterium
LRTGERYPDEIVGIGAGATW

SEQ ID NO: 1036390 - protein, 22 aa, Mycobacterium
LRTHVPDAGGMIIASDQTAARA

SEQ ID NO: 1036391 - protein, 27 aa, Mycobacterium
LRTKARTGIMPHLLVMTATPIPRTVAL

SEQ ID NO: 1036392 - protein, 23 aa, Mycobacterium
LRTKRVDVILGYDLDDDCSQLHI

SEQ ID NO: 1036393 - protein, 23 aa, Mycobacterium
LRTPESWLLIDFEGEPGQPLDGC

SEQ ID NO: 1036394 - protein, 29 aa, Mycobacterium
LRTRVRRPPRGSYQIGILGLKGGAGKTTV

SEQ ID NO: 1036395 - protein, 21 aa, Mycobacterium
LRTSTVSLRSAGGFDTVHHRP

SEQ ID NO: 1036396 - protein, 20 aa, Mycobacterium
LRTYRGVLDAARVVEFMLLD

SEQ ID NO: 1036397 - protein, 17 aa, Mycobacterium
LRVAAAMYCDADEICGS

SEQ ID NO: 1036398 - protein, 19 aa, Mycobacterium
LRVEFFVVEQVYSYPELDG

SEQ ID NO: 1036399 - protein, 21 aa, Mycobacterium
LRVGNRVNLERAVAINSRLGG

SEQ ID NO: 1036400 - protein, 19 aa, Mycobacterium
LRVMLRPGDHVIIPDDVYG

SEQ ID NO: 1036401 - protein, 21 aa, Mycobacterium
LRVVNCPDYHLIRVAHELIAQ

SEQ ID NO: 1036402 - protein, 17 aa, Mycobacterium
LRYGIPEFKMEKRFLER

SEQ ID NO: 1036403 - protein, 18 aa, Mycobacterium
LRYVAAWNAAFLPSKDLT

SEQ ID NO: 1036404 - protein, 20 aa, Mycobacterium
LRYYSAALFHVIPQVNSEVR

SEQ ID NO: 1036405 - protein, 19 aa, Mycobacterium
LSAALLRLPVANWSILGSM

SEQ ID NO: 1036406 - protein, 20 aa, Mycobacterium
LSAGHARALLSLEANPEVQE

SEQ ID NO: 1036407 - protein, 25 aa, Mycobacterium
LSAIGPKLPELWGGSADLAGSNNTT

SEQ ID NO: 1036408 - protein, 26 aa, Mycobacterium
LSALIERAAVEFGIKAVVRQSDSESQ

SEQ ID NO: 1036409 - protein, 19 aa, Mycobacterium
LSAQASRLLTRLDDDPVVD

SEQ ID NO: 1036410 - protein, 21 aa, Mycobacterium
LSASGIRKSVRYVLRVANDGE

SEQ ID NO: 1036411 - protein, 23 aa, Mycobacterium
LSDEFNFRTLVGVLSVLANKDVD

SEQ ID NO: 1036412 - protein, 18 aa, Mycobacterium
LSDYRMMPRATFCQPNVA

SEQ ID NO: 1036413 - protein, 21 aa, Mycobacterium
LSEDDWDGWAALTASIGEQVQ

SEQ ID NO: 1036414 - protein, 21 aa, Mycobacterium
LSELLQLRWRVIGVLARAGPA

SEQ ID NO: 1036415 - protein, 22 aa, Mycobacterium
LSEMCGLAGIAMERATQALLQA

SEQ ID NO: 1036416 - protein, 17 aa, Mycobacterium
LSERIIFLGSEVNDNIA

SEQ ID NO: 1036417 - protein, 20 aa, Mycobacterium
LSFTLPRNGIVGIIGPNGVG

SEQ ID NO: 1036418 - protein, 19 aa, Mycobacterium
LSGARFTPYLSIPGAENAF

SEQ ID NO: 1036419 - protein, 17 aa, Mycobacterium
LSGLAVADSGTWLLATV

SEQ ID NO: 1036420 - protein, 17 aa, Mycobacterium
LSGPCAPVWQRNLGNSS

SEQ ID NO: 1036421 - protein, 25 aa, Mycobacterium
LSGTEPKLKCYLEVRCSVAGNLPST

SEQ ID NO: 1036422 - protein, 17 aa, Mycobacterium
LSGVPLAFIHKTRDDIH

SEQ ID NO: 1036423 - protein, 17 aa, Mycobacterium
LSHDYKENLVPVIEQVG

SEQ ID NO: 1036424 - protein, 24 aa, Mycobacterium
LSIIQRRKVGVIGYGSQGYAHSLS

SEQ ID NO: 1036425 - protein, 23 aa, Mycobacterium
LSINAEFARPLSPQRARDLLGGA

SEQ ID NO: 1036426 - protein, 19 aa, Mycobacterium
LSITAWFIDPGARQVEGRI

SEQ ID NO: 1036427 - protein, 25 aa, Mycobacterium
LSKHARIPVSVMPNAGLPVLGAKGA

SEQ ID NO: 1036428 - protein, 18 aa, Mycobacterium
LSLYRAWDDATLRIVSKA

SEQ ID NO: 1036429 - protein, 18 aa, Mycobacterium
LSMANAFPRRDYLAHRRW

SEQ ID NO: 1036430 - protein, 18 aa, Mycobacterium
LSNEFFALFQDPTRTYSC

SEQ ID NO: 1036431 - protein, 20 aa, Mycobacterium
LSNIRFWAPLSLAAEQKHSI

SEQ ID NO: 1036432 - protein, 17 aa, Mycobacterium
LSPASIGMRVFTVAQRS

SEQ ID NO: 1036433 - protein, 18 aa, Mycobacterium
LSPEAAQGSMVVVDIDRT

SEQ ID NO: 1036434 - protein, 17 aa, Mycobacterium
LSPSFNWDTTGMSDEEM

SEQ ID NO: 1036435 - protein, 18 aa, Mycobacterium
LSPVGWQYINTALRRIDE

SEQ ID NO: 1036436 - protein, 18 aa, Mycobacterium
LSQELEILLRAEVIIVDE

SEQ ID NO: 1036437 - protein, 25 aa, Mycobacterium
LSRARRLAGKIGESGVPADVWTLNH

SEQ ID NO: 1036438 - protein, 17 aa, Mycobacterium
LSRLAVKSISARRAEVT

SEQ ID NO: 1036439 - protein, 17 aa, Mycobacterium
LSRLGCRSVGESRAQEA

SEQ ID NO: 1036440 - protein, 17 aa, Mycobacterium
LSRNILENPAWYTPYTP

SEQ ID NO: 1036441 - protein, 20 aa, Mycobacterium
LSRSEAYIFIAAGSAITSEW

SEQ ID NO: 1036442 - protein, 18 aa, Mycobacterium
LSRVVGGQIPTGFDPTVW

SEQ ID NO: 1036443 - protein, 26 aa, Mycobacterium
LSTDWPRLVAPVFDVKKAVVFDDRWA

SEQ ID NO: 1036444 - protein, 30 aa, Mycobacterium
LSTFCAGGKCPDVLMAWDLTYAELADRGVL

SEQ ID NO: 1036445 - protein, 20 aa, Mycobacterium
LSTLMAHVKLALKEQMLATE

SEQ ID NO: 1036446 - protein, 31 aa, Mycobacterium
LSTPAPLPCTARGILHLLRRYGVEIAGTHVV

SEQ ID NO: 1036447 - protein, 18 aa, Mycobacterium
LSTQGAAVVREYYFNDHG

SEQ ID NO: 1036448 - protein, 20 aa, Mycobacterium
LSTRSMNRFDIEVEGNHNYF

SEQ ID NO: 1036449 - protein, 17 aa, Mycobacterium
LSTYKMVFGHRGINIPV

SEQ ID NO: 1036450 - protein, 22 aa, Mycobacterium
LSTYRFSTGWFIVGFSSDLTVG

SEQ ID NO: 1036451 - protein, 29 aa, Mycobacterium
LSVGPLRYAGWSSCFRREAGSHGKDTRGI

SEQ ID NO: 1036452 - protein, 23 aa, Mycobacterium
LSVIKHLAHQVAVMLAGTIVEQG

SEQ ID NO: 1036453 - protein, 26 aa, Mycobacterium
LSVPAIKLLIRKSGARSADMAAELAK

SEQ ID NO: 1036454 - protein, 31 aa, Mycobacterium
LTADIVGLAGRWLRPGGLFAVEHDDSTSVPT

SEQ ID NO: 1036455 - protein, 24 aa, Mycobacterium
LTAHLQRYAPWGAQVSVIRGEVSQ

SEQ ID NO: 1036456 - protein, 26 aa, Mycobacterium
LTAKSMPYKSGFGPFAPEIYRAPLSY

SEQ ID NO: 1036457 - protein, 18 aa, Mycobacterium
LTALPTRRAIIMVICGKA

SEQ ID NO: 1036458 - protein, 17 aa, Mycobacterium
LTAQDPFNNVARTCIEA

SEQ ID NO: 1036459 - protein, 28 aa, Mycobacterium
LTATLLTARCPIMFAPAMHTEMWLHPAT

SEQ ID NO: 1036460 - protein, 18 aa, Mycobacterium
LTAVDGLRVATGRDFGAM

SEQ ID NO: 1036461 - protein, 18 aa, Mycobacterium
LTCGAPLHELRDIIRNTV

SEQ ID NO: 1036462 - protein, 17 aa, Mycobacterium
LTDACGFIEIDVPRDRA

SEQ ID NO: 1036463 - protein, 18 aa, Mycobacterium
LTDVISILRREGQKVNAQ

SEQ ID NO: 1036464 - protein, 18 aa, Mycobacterium
LTDYKRSAAVTLPSGGVA

SEQ ID NO: 1036465 - protein, 18 aa, Mycobacterium
LTEIWPVINHNPAVRHRP

SEQ ID NO: 1036466 - protein, 21 aa, Mycobacterium
LTESPACLITDAFGITPALAR

SEQ ID NO: 1036467 - protein, 22 aa, Mycobacterium
LTEVLPRNAVLLVTANHGVLNV

SEQ ID NO: 1036468 - protein, 18 aa, Mycobacterium
LTGCAKLFRDGYTDVDQF

SEQ ID NO: 1036469 - protein, 17 aa, Mycobacterium
LTGKGVWGPPVDRYEAV

SEQ ID NO: 1036470 - protein, 17 aa, Mycobacterium
LTGLAVLDLYAGSGALG

SEQ ID NO: 1036471 - protein, 19 aa, Mycobacterium
LTGLKPARVTGCNVPSEAK

SEQ ID NO: 1036472 - protein, 22 aa, Mycobacterium
LTHPRILSAGLHGRAHNGSVQL

SEQ ID NO: 1036473 - protein, 27 aa, Mycobacterium
LTIRLLERTEIRWLVKELECRPRKSLG

SEQ ID NO: 1036474 - protein, 17 aa, Mycobacterium
LTLKINPLIVCIVEAEW

SEQ ID NO: 1036475 - protein, 18 aa, Mycobacterium
LTLPGRSLLFVRNVGHLT

SEQ ID NO: 1036476 - protein, 17 aa, Mycobacterium
LTLPPTVIFDHPTPTAV

SEQ ID NO: 1036477 - protein, 19 aa, Mycobacterium
LTLRCARCGSEVVRAVVVG

SEQ ID NO: 1036478 - protein, 18 aa, Mycobacterium
LTLTIAGPVRTYFAQHAE

SEQ ID NO: 1036479 - protein, 18 aa, Mycobacterium
LTMLSWNALCGIVEVGGS

SEQ ID NO: 1036480 - protein, 20 aa, Mycobacterium
LTMRGLKTLVLRMQRHNENA

SEQ ID NO: 1036481 - protein, 24 aa, Mycobacterium
LTNKAKALLAKRGFDPVLGARPLR

SEQ ID NO: 1036482 - protein, 23 aa, Mycobacterium
LTPGCTKQACDFRDNLHDLNDAG

SEQ ID NO: 1036483 - protein, 17 aa, Mycobacterium
LTQIGAVVVDTVSSEGH

SEQ ID NO: 1036484 - protein, 25 aa, Mycobacterium
LTRALKVWADQGLRVIGLDHDGDTA

SEQ ID NO: 1036485 - protein, 22 aa, Mycobacterium
LTRELPDSIVIVGAGAIGIEFG

SEQ ID NO: 1036486 - protein, 18 aa, Mycobacterium
LTRMPTVQIDIGYITNPR

SEQ ID NO: 1036487 - protein, 24 aa, Mycobacterium
LTRVKTSRAGECEVDLEVLDQSGA

SEQ ID NO: 1036488 - protein, 18 aa, Mycobacterium
LTSPISFLQRPARWIQAM

SEQ ID NO: 1036489 - protein, 18 aa, Mycobacterium
LTSSAFASDLADYIHEQG

SEQ ID NO: 1036490 - protein, 33 aa, Mycobacterium
LTTCEKCSGRLRKLFNSVGVVFKGSGFYRTDSR

SEQ ID NO: 1036491 - protein, 17 aa, Mycobacterium
LTTFSLWGSGVLDLRYA

SEQ ID NO: 1036492 - protein, 17 aa, Mycobacterium
LTTVCYQFGDAKPVYAL

SEQ ID NO: 1036493 - protein, 24 aa, Mycobacterium
LTVCAGDIPIGVTTSGTFSPTLQV

SEQ ID NO: 1036494 - protein, 25 aa, Mycobacterium
LTVSFAGSSWGEWPSEDIGQLHDGV

SEQ ID NO: 1036495 - protein, 31 aa, Mycobacterium
LTYQMMFELSDFGFSTAIGIGGDPVIGTTHI

SEQ ID NO: 1036496 - protein, 22 aa, Mycobacterium
LVAARIAAFGAHVIAYDPYVAP

SEQ ID NO: 1036497 - protein, 24 aa, Mycobacterium
LVADTRSGQLLVYTIDPLILRQTY

SEQ ID NO: 1036498 - protein, 18 aa, Mycobacterium
LVAEVDRGTWTPAPVFAM

SEQ ID NO: 1036499 - protein, 19 aa, Mycobacterium
LVAFGRYPTFEGYCQLLGI

SEQ ID NO: 1036500 - protein, 27 aa, Mycobacterium
LVAIFKARPSPFYIMDEVEAALDDVNL

SEQ ID NO: 1036501 - protein, 24 aa, Mycobacterium
LVAIWRRGSELFAEVVAPTGVVVD

SEQ ID NO: 1036502 - protein, 19 aa, Mycobacterium
LVARECRIDSSSLPEILHS

SEQ ID NO: 1036503 - protein, 25 aa, Mycobacterium
LVARRRPAAGDGWRKFVTKATLGRV

SEQ ID NO: 1036504 - protein, 19 aa, Mycobacterium
LVDGLGLPVLSLTSMVAQQ

SEQ ID NO: 1036505 - protein, 18 aa, Mycobacterium
LVDLKAAVAEYIIGGHGN

SEQ ID NO: 1036506 - protein, 24 aa, Mycobacterium
LVEAGAVLVPWLRPSQVRVLLMAA

SEQ ID NO: 1036507 - protein, 19 aa, Mycobacterium
LVEALVCATARETFEETGV

SEQ ID NO: 1036508 - protein, 22 aa, Mycobacterium
LVEMRRVRDLQPYIGKEIEAKI

SEQ ID NO: 1036509 - protein, 17 aa, Mycobacterium
LVEPLRLLFKDEVRAVG

SEQ ID NO: 1036510 - protein, 18 aa, Mycobacterium
LVEQARLSIDSDGVCSST

SEQ ID NO: 1036511 - protein, 19 aa, Mycobacterium
LVFCHGVAVVARLAECAVS

SEQ ID NO: 1036512 - protein, 23 aa, Mycobacterium
LVGDKLWARMDIHSVSERFGADI

SEQ ID NO: 1036513 - protein, 18 aa, Mycobacterium
LVGLMGIPPLGWNPDQAF

SEQ ID NO: 1036514 - protein, 25 aa, Mycobacterium
LVGPFQVRIPLMFNASDGHTLVNSY

SEQ ID NO: 1036515 - protein, 18 aa, Mycobacterium
LVGPSAEPTVMLYVESDN

SEQ ID NO: 1036516 - protein, 20 aa, Mycobacterium
LVGREWELATLAAMLDRSIG

SEQ ID NO: 1036517 - protein, 23 aa, Mycobacterium
LVHGLPLFHVHGLVLGLLGSLRI

SEQ ID NO: 1036518 - protein, 23 aa, Mycobacterium
LVIRDLKGRLGVGSDTVRTNANA

SEQ ID NO: 1036519 - protein, 20 aa, Mycobacterium
LVKGGEWLASCHYGAMVSCS

SEQ ID NO: 1036520 - protein, 25 aa, Mycobacterium
LVKKYSDFIAWPIRMEVERRAPATS

SEQ ID NO: 1036521 - protein, 20 aa, Mycobacterium
LVKLRPYFDHPLFVEMFVDA

SEQ ID NO: 1036522 - protein, 23 aa, Mycobacterium
LVKTYRLTKGVGLRRAIGEIRAV

SEQ ID NO: 1036523 - protein, 29 aa, Mycobacterium
LVKYRTLPEIILYPALFLGAARTVPGSKY

SEQ ID NO: 1036524 - protein, 25 aa, Mycobacterium
LVLALGAAAARCLANSGEPGRRVAV

SEQ ID NO: 1036525 - protein, 17 aa, Mycobacterium
LVLGPAMRIQAPPNLVS

SEQ ID NO: 1036526 - protein, 17 aa, Mycobacterium
LVLWSWCWWKDGIRVLL

SEQ ID NO: 1036527 - protein, 17 aa, Mycobacterium
LVMGGSCQRTWEHSVPK

SEQ ID NO: 1036528 - protein, 21 aa, Mycobacterium
LVNKIGFAIAKFRSQDDPSGM

SEQ ID NO: 1036529 - protein, 18 aa, Mycobacterium
LVNLKVTLLDGAYHDVDS

SEQ ID NO: 1036530 - protein, 22 aa, Mycobacterium
LVNRARRIERFLSQNMMAAEQF

SEQ ID NO: 1036531 - protein, 18 aa, Mycobacterium
LVNYVRGMLYFRTKRWPD

SEQ ID NO: 1036532 - protein, 25 aa, Mycobacterium
LVPPGDGPWRLGISSAGTFENLQLE

SEQ ID NO: 1036533 - protein, 18 aa, Mycobacterium
LVPVQFFNPIGMRIADKW

SEQ ID NO: 1036534 - protein, 18 aa, Mycobacterium
LVQILRWLRPGAVIAITK

SEQ ID NO: 1036535 - protein, 34 aa, Mycobacterium
LVRGVDWVREITRVHGAGVRWIIDLGPGDILTRL

SEQ ID NO: 1036536 - protein, 21 aa, Mycobacterium
LVRHVEKWAKVRGDKLAYRFL

SEQ ID NO: 1036537 - protein, 25 aa, Mycobacterium
LVRPEVMSGTGFLGAHAEEVYRVDD

SEQ ID NO: 1036538 - protein, 18 aa, Mycobacterium
LVRRGVRALEAFGRTEVA

SEQ ID NO: 1036539 - protein, 21 aa, Mycobacterium
LVRRSRLQWVAATVVGLDRGT

SEQ ID NO: 1036540 - protein, 17 aa, Mycobacterium
LVSARGRLMQALPAGGA

SEQ ID NO: 1036541 - protein, 23 aa, Mycobacterium
LVTEIPGPVSLELAKRLNAAVPR

SEQ ID NO: 1036542 - protein, 27 aa, Mycobacterium
LVTGYDILFFWVARMMMLGTFVGGDDA

SEQ ID NO: 1036543 - protein, 22 aa, Mycobacterium
LVTYRPEYHGALRHVVGAQIIA

SEQ ID NO: 1036544 - protein, 24 aa, Mycobacterium
LVVARGELVYAVLNLYPYNPGHLM

SEQ ID NO: 1036545 - protein, 18 aa, Mycobacterium
LVVIVDVPGYLPGVDQEW

SEQ ID NO: 1036546 - protein, 24 aa, Mycobacterium
LWAATFLRRRGAAADAVLLNPDRV

SEQ ID NO: 1036547 - protein, 19 aa, Mycobacterium
LWEDRGCPRMPPRPRDLHD

SEQ ID NO: 1036548 - protein, 22 aa, Mycobacterium
LWERVVEAFAPAHVVEFFATVD

SEQ ID NO: 1036549 - protein, 20 aa, Mycobacterium
LWLGDHVIDDLCVLPGAAYA

SEQ ID NO: 1036550 - protein, 19 aa, Mycobacterium
LWRNYFDLFDLFKATMRSL

SEQ ID NO: 1036551 - protein, 17 aa, Mycobacterium
LYADHLIELPAVSTLLQ

SEQ ID NO: 1036552 - protein, 24 aa, Mycobacterium
LYAPSVLGWAAFRDVAQHYSLGMT

SEQ ID NO: 1036553 - protein, 27 aa, Mycobacterium
LYGYPSERAGVWIRANFITSIDGGATA

SEQ ID NO: 1036554 - protein, 26 aa, Mycobacterium
LYIQLYLGGFGLELSDIESLRTWGST

SEQ ID NO: 1036555 - protein, 22 aa, Mycobacterium
LYKLRPGDPSILTPSPASDTDT

SEQ ID NO: 1036556 - protein, 25 aa, Mycobacterium
LYPRKGVSELTRFTPEAVIEKYGVT

SEQ ID NO: 1036557 - protein, 17 aa, Mycobacterium
LYRTLVAARGNWQEVML

SEQ ID NO: 1036558 - protein, 18 aa, Mycobacterium
LYSFVLMSAVLDKMQFTH

SEQ ID NO: 1036559 - protein, 19 aa, Mycobacterium
LYTFVDYRLQTVVDTLAAP

SEQ ID NO: 1036560 - protein, 18 aa, Mycobacterium
LYWIGRYVERADDTARIL

SEQ ID NO: 1036561 - protein, 17 aa, Mycobacterium
MAAEAGLTVDEKGFHEL

SEQ ID NO: 1036562 - protein, 21 aa, Mycobacterium
MAASMGEFLLAAGTRGKRYAL

SEQ ID NO: 1036563 - protein, 17 aa, Mycobacterium
MALGVLSLLTGNYTDVA

SEQ ID NO: 1036564 - protein, 20 aa, Mycobacterium
MALISIKLRPLFLGSTVGSF

SEQ ID NO: 1036565 - protein, 29 aa, Mycobacterium
MARSTKRVCRDCGFFLSLVGSLGAMFGVC

SEQ ID NO: 1036566 - protein, 24 aa, Mycobacterium
MATALRVAEKIVCGDRTPPRLAVI

SEQ ID NO: 1036567 - protein, 18 aa, Mycobacterium
MAVHILIAAVGPLAGAAT

SEQ ID NO: 1036568 - protein, 17 aa, Mycobacterium
MAWLRWLDENGVRNIEM

SEQ ID NO: 1036569 - protein, 19 aa, Mycobacterium
MCGNGVRVFAHYLRASGLE

SEQ ID NO: 1036570 - protein, 25 aa, Mycobacterium
MCPICRKEQLTLVSWVFGNQLGAIS

SEQ ID NO: 1036571 - protein, 18 aa, Mycobacterium
MDARHGGSIIDAQIARAV

SEQ ID NO: 1036572 - protein, 24 aa, Mycobacterium
MDAVLRAKVDAAWNLNELTRNLDV

SEQ ID NO: 1036573 - protein, 23 aa, Mycobacterium
MDEGLRFAIREGGRTVGAGRVVK

SEQ ID NO: 1036574 - protein, 23 aa, Mycobacterium
MDFIWEVLGRIGIGRKDALVSFG

SEQ ID NO: 1036575 - protein, 22 aa, Mycobacterium
MDGIGVPACISAAGRAIEALQA

SEQ ID NO: 1036576 - protein, 20 aa, Mycobacterium
MDIDTIYVWTHDSVGLGEDG

SEQ ID NO: 1036577 - protein, 17 aa, Mycobacterium
MDLYWPGRLDSCAPPDV

SEQ ID NO: 1036578 - protein, 25 aa, Mycobacterium
MDPQQRLLIEVAWEALEDAGVAPHT

SEQ ID NO: 1036579 - protein, 17 aa, Mycobacterium
MDVRARSKAARRVWDDA

SEQ ID NO: 1036580 - protein, 17 aa, Mycobacterium
MDVRFLPNPHWVDELRS

SEQ ID NO: 1036581 - protein, 18 aa, Mycobacterium
MEFCYLHLCESSFAPCWG

SEQ ID NO: 1036582 - protein, 17 aa, Mycobacterium
MEKFDYTKGFKFSTYAT

SEQ ID NO: 1036583 - protein, 24 aa, Mycobacterium
MELDDCAFLLLAGVEIGADPNKVF

SEQ ID NO: 1036584 - protein, 23 aa, Mycobacterium
MEPMLEEFARLASEIVVEQPQIP

SEQ ID NO: 1036585 - protein, 17 aa, Mycobacterium
METYLGVAVYGFPQTIS

SEQ ID NO: 1036586 - protein, 17 aa, Mycobacterium
MEWGAGLAECLAARHLD

SEQ ID NO: 1036587 - protein, 25 aa, Mycobacterium
MEYKLLPQFRGRGSVTPQFVEPTQQ

SEQ ID NO: 1036588 - protein, 17 aa, Mycobacterium
MFCEFLYCQLFSGSAAG

SEQ ID NO: 1036589 - protein, 19 aa, Mycobacterium
MFDGKRYQDQVGIVDEVTA

SEQ ID NO: 1036590 - protein, 18 aa, Mycobacterium
MFEHRAVVVGADRHQLQR

SEQ ID NO: 1036591 - protein, 17 aa, Mycobacterium
MFERGRKYVLVVTSPGF

SEQ ID NO: 1036592 - protein, 19 aa, Mycobacterium
MFFGRPLKASMFFSPGGVT

SEQ ID NO: 1036593 - protein, 24 aa, Mycobacterium
MFFLSDPYGFFAVVEQFLQSVVLQ

SEQ ID NO: 1036594 - protein, 20 aa, Mycobacterium
MGADGLRTASLTAIASANYI

SEQ ID NO: 1036595 - protein, 18 aa, Mycobacterium
MGAGAWGTALAKVLIDAG

SEQ ID NO: 1036596 - protein, 26 aa, Mycobacterium
MGDALEALASILVRRGVSSPPVELPP

SEQ ID NO: 1036597 - protein, 17 aa, Mycobacterium
MGDSYVGLQARLMSQAL

SEQ ID NO: 1036598 - protein, 19 aa, Mycobacterium
MGIPGRYVSGYLHPKRDAV

SEQ ID NO: 1036599 - protein, 18 aa, Mycobacterium
MGKTRVIAETGAGQHGVA

SEQ ID NO: 1036600 - protein, 21 aa, Mycobacterium
MGPPNIITRLNAPDGTQVATA

SEQ ID NO: 1036601 - protein, 17 aa, Mycobacterium
MGRAIVRHPKAFLMDEP

SEQ ID NO: 1036602 - protein, 25 aa, Mycobacterium
MGSLARLPLILSDGHLRELALTGKD

SEQ ID NO: 1036603 - protein, 27 aa, Mycobacterium
MHGVEPNMRWRTFCTELLTIADRLNVD

SEQ ID NO: 1036604 - protein, 17 aa, Mycobacterium
MHLPNLRVEAGEGLVVA

SEQ ID NO: 1036605 - protein, 17 aa, Mycobacterium
MHRGAVMEGSWGLETVN

SEQ ID NO: 1036606 - protein, 19 aa, Mycobacterium
MIADGSVRPIIGARMAVQQ

SEQ ID NO: 1036607 - protein, 21 aa, Mycobacterium
MIAGYLNHWGFPKFAMICCTL

SEQ ID NO: 1036608 - protein, 24 aa, Mycobacterium
MISKMFRLLFYTPRIPPNTGNAIR

SEQ ID NO: 1036609 - protein, 31 aa, Mycobacterium
MKADHGLELPRRLQIEFSRAIQKISEGEGGE

SEQ ID NO: 1036610 - protein, 34 aa, Mycobacterium
MKAEGTFEYQALLFIPSHAPFDLFNSDAKIGMQL

SEQ ID NO: 1036611 - protein, 17 aa, Mycobacterium
MKMEIPVLAGVAGIVSK

SEQ ID NO: 1036612 - protein, 25 aa, Mycobacterium
MKTEPALDVLAGWLANRINRPLRRA

SEQ ID NO: 1036613 - protein, 19 aa, Mycobacterium
MKVEAARLIVYAAAARAER

SEQ ID NO: 1036614 - protein, 17 aa, Mycobacterium
MKYLTGWVFLPQRHPQR

SEQ ID NO: 1036615 - protein, 24 aa, Mycobacterium
MLAHPGLVCDVAIGQSTLVTQRVK

SEQ ID NO: 1036616 - protein, 17 aa, Mycobacterium
MLAKVRRAPELIKVESV

SEQ ID NO: 1036617 - protein, 21 aa, Mycobacterium
MLCEVRELFDTQVLHRLPVTS

SEQ ID NO: 1036618 - protein, 17 aa, Mycobacterium
MLEAAVIAGLTSAGVDA

SEQ ID NO: 1036619 - protein, 20 aa, Mycobacterium
MLELPLYRTLVAARGNWQEV

SEQ ID NO: 1036620 - protein, 19 aa, Mycobacterium
MLGPNGIGVLYARRELLSV

SEQ ID NO: 1036621 - protein, 18 aa, Mycobacterium
MLGWPLRTFESTMPPSKL

SEQ ID NO: 1036622 - protein, 24 aa, Mycobacterium
MLIPRARAKISMRIAPGGDAAVHL

SEQ ID NO: 1036623 - protein, 19 aa, Mycobacterium
MLIVPGSMRVRAQAEAEGL

SEQ ID NO: 1036624 - protein, 17 aa, Mycobacterium
MLLEFGVVSERYCHTVN

SEQ ID NO: 1036625 - protein, 20 aa, Mycobacterium
MLLELSWEALERAGIDPAGL

SEQ ID NO: 1036626 - protein, 17 aa, Mycobacterium
MLLHQAFAQVEQFTGMP

SEQ ID NO: 1036627 - protein, 20 aa, Mycobacterium
MLPNLATVLNWRSCDHTGPV

SEQ ID NO: 1036628 - protein, 25 aa, Mycobacterium
MLPRTWGADPTFCYNAADIGPAGGW

SEQ ID NO: 1036629 - protein, 20 aa, Mycobacterium
MLRAARFVSQLGFTVAPQVH

SEQ ID NO: 1036630 - protein, 18 aa, Mycobacterium
MLRANAKLAASTGVPEDS

SEQ ID NO: 1036631 - protein, 17 aa, Mycobacterium
MLRHVRFGRDDSKLTTR

SEQ ID NO: 1036632 - protein, 27 aa, Mycobacterium
MLRIMRPDLTIGFFLHIPFPPVELFMQ

SEQ ID NO: 1036633 - protein, 17 aa, Mycobacterium
MLSEAARTWSDRLIAAA

SEQ ID NO: 1036634 - protein, 17 aa, Mycobacterium
MLYLHKFFYYLISVREK

SEQ ID NO: 1036635 - protein, 17 aa, Mycobacterium
MMFPLAGGLGVISNRAS

SEQ ID NO: 1036636 - protein, 31 aa, Mycobacterium
MNGGFFPSVREYSCLYGLTERRQALLPGHAV

SEQ ID NO: 1036637 - protein, 25 aa, Mycobacterium
MNILANRKRMVVISFPPSPQPDDHP

SEQ ID NO: 1036638 - protein, 24 aa, Mycobacterium
MPDRVKCLHVLIAHSLAKGPGLNS

SEQ ID NO: 1036639 - protein, 22 aa, Mycobacterium
MPDVRNGIDFKVADLSLANFGR

SEQ ID NO: 1036640 - protein, 20 aa, Mycobacterium
MPEACLEGALTQLAKAGRHH

SEQ ID NO: 1036641 - protein, 20 aa, Mycobacterium
MPGARVGRGAVIRHAILDKN

SEQ ID NO: 1036642 - protein, 23 aa, Mycobacterium
MPGAYVAGWIKRGPTGFIGTNKL

SEQ ID NO: 1036643 - protein, 27 aa, Mycobacterium
MPGFLVPEFRRKAVIIAVGGVYDIRIH

SEQ ID NO: 1036644 - protein, 17 aa, Mycobacterium
MPIPVPVDNAGYFDQAV

SEQ ID NO: 1036645 - protein, 19 aa, Mycobacterium
MPKALLWALHEHLMGANPA

SEQ ID NO: 1036646 - protein, 17 aa, Mycobacterium
MPMRVGVRADERLRSGT

SEQ ID NO: 1036647 - protein, 22 aa, Mycobacterium
MPPLLEKRGLQSFPEVLKRLSP

SEQ ID NO: 1036648 - protein, 22 aa, Mycobacterium
MPPNPAEMVISWVANILSEHGN

SEQ ID NO: 1036649 - protein, 24 aa, Mycobacterium
MPTHRSVAAVPRIGVVIMAGNTVY

SEQ ID NO: 1036650 - protein, 32 aa, Mycobacterium
MPTKGIFTSNFGYRWGVLHAGIDLANAIGTPI

SEQ ID NO: 1036651 - protein, 25 aa, Mycobacterium
MPTLDSFLHYRMIDVSSIKELCRRW

SEQ ID NO: 1036652 - protein, 22 aa, Mycobacterium
MPVIFREVSLRQTLEADRVDQA

SEQ ID NO: 1036653 - protein, 24 aa, Mycobacterium
MPVSEALRQISFRLAADDDQFLTI

SEQ ID NO: 1036654 - protein, 17 aa, Mycobacterium
MQGDGPYILAGWSLGGV

SEQ ID NO: 1036655 - protein, 23 aa, Mycobacterium
MQLALTELWRSYGVEPDAVIGHS

SEQ ID NO: 1036656 - protein, 26 aa, Mycobacterium
MQLTLTELWRSYGIQPDLVIGHSMGE

SEQ ID NO: 1036657 - protein, 25 aa, Mycobacterium
MQLTLTELWRSYGVQPDLVIGHSLG

SEQ ID NO: 1036658 - protein, 17 aa, Mycobacterium
MQRHPACVIGIIDDQFG

SEQ ID NO: 1036659 - protein, 19 aa, Mycobacterium
MQTPACALVPEVSPSSMND

SEQ ID NO: 1036660 - protein, 23 aa, Mycobacterium
MRAEGIACYQLFISGLLDITDNV

SEQ ID NO: 1036661 - protein, 17 aa, Mycobacterium
MRAIVGFAAETGDASGD

SEQ ID NO: 1036662 - protein, 25 aa, Mycobacterium
MRANLERWGGLVADGATLVSLAKGI

SEQ ID NO: 1036663 - protein, 17 aa, Mycobacterium
MRDVRHFTQVGTMSIDG

SEQ ID NO: 1036664 - protein, 21 aa, Mycobacterium
MREVVGVLRAVLFAPEDLALV

SEQ ID NO: 1036665 - protein, 17 aa, Mycobacterium
MRHGEVLIDVRFWGTRL

SEQ ID NO: 1036666 - protein, 22 aa, Mycobacterium
MRHPRWSSGHRAVRLMRHPLQN

SEQ ID NO: 1036667 - protein, 18 aa, Mycobacterium
MRHTMAYKQGTDLLSDIA

SEQ ID NO: 1036668 - protein, 25 aa, Mycobacterium
MRLRRLRRRTADFFATYDVLLTPTV

SEQ ID NO: 1036669 - protein, 18 aa, Mycobacterium
MRNPVRFQQAITHASSGV

SEQ ID NO: 1036670 - protein, 24 aa, Mycobacterium
MRPHDPPWCRPLLGVRRSVPRAAC

SEQ ID NO: 1036671 - protein, 21 aa, Mycobacterium
MRRALEYATGLGVLIAQHAEE

SEQ ID NO: 1036672 - protein, 23 aa, Mycobacterium
MRRIRLSLMVNRCDCINLLDCVS

SEQ ID NO: 1036673 - protein, 25 aa, Mycobacterium
MRRRIDIACGLVVQPQVAFLDEPTT

SEQ ID NO: 1036674 - protein, 24 aa, Mycobacterium
MRRSYRVERYLGIIGQVRAAMPHA

SEQ ID NO: 1036675 - protein, 19 aa, Mycobacterium
MRTNLGVLAVLELVSEQRE

SEQ ID NO: 1036676 - protein, 25 aa, Mycobacterium
MRTNLSTSIYFGWYTTQSGLRANSG

SEQ ID NO: 1036677 - protein, 18 aa, Mycobacterium
MRTQTALAMNSYQAETLL

SEQ ID NO: 1036678 - protein, 19 aa, Mycobacterium
MRTTCIVPQSFSYHDLLRY

SEQ ID NO: 1036679 - protein, 20 aa, Mycobacterium
MRVRLAMGVVTSIDPEILLL

SEQ ID NO: 1036680 - protein, 24 aa, Mycobacterium
MRVSIEYPHRGVACAREVADVVAP

SEQ ID NO: 1036681 - protein, 18 aa, Mycobacterium
MRYTCERLIRGLDTIAAT

SEQ ID NO: 1036682 - protein, 22 aa, Mycobacterium
MSATHLRYAKNYLLDLRTKRVD

SEQ ID NO: 1036683 - protein, 17 aa, Mycobacterium
MSDGELFIMGRIKDLLI

SEQ ID NO: 1036684 - protein, 25 aa, Mycobacterium
MSEALAGDNVRVWQPSAFASPTPSA

SEQ ID NO: 1036685 - protein, 20 aa, Mycobacterium
MSEARSFELFTEITNYDETA

SEQ ID NO: 1036686 - protein, 20 aa, Mycobacterium
MSGGMPAAAFGGRAEVMERL

SEQ ID NO: 1036687 - protein, 20 aa, Mycobacterium
MSLPRVSIFLSLLDVHVQRA

SEQ ID NO: 1036688 - protein, 23 aa, Mycobacterium
MSPGERLLGLDLANGGHLTHGMR

SEQ ID NO: 1036689 - protein, 26 aa, Mycobacterium
MSPICKRRMFDLLVRMGYKEIEVGFP

SEQ ID NO: 1036690 - protein, 17 aa, Mycobacterium
MSQLYPDSQVLVFGHSH

SEQ ID NO: 1036691 - protein, 24 aa, Mycobacterium
MSRKRNLVEYGFRLPSACDNRPLT

SEQ ID NO: 1036692 - protein, 21 aa, Mycobacterium
MSSLRSGECDLALAGGVTVMG

SEQ ID NO: 1036693 - protein, 19 aa, Mycobacterium
MSSYGFLRSRLDGSTEQPI

SEQ ID NO: 1036694 - protein, 19 aa, Mycobacterium
MSVASRYAPRAIVASIVGN

SEQ ID NO: 1036695 - protein, 18 aa, Mycobacterium
MSVIVGRALPEVRDGLKP

SEQ ID NO: 1036696 - protein, 19 aa, Mycobacterium
MTAPTFRRARSASGTIVDL

SEQ ID NO: 1036697 - protein, 20 aa, Mycobacterium
MTASSYPLSILFTGIIVNKL

SEQ ID NO: 1036698 - protein, 23 aa, Mycobacterium
MTLEVDRDCFSRIAPGLPSNVIR

SEQ ID NO: 1036699 - protein, 26 aa, Mycobacterium
MTMTGARPGGFGVLHSRTNEICAPGD

SEQ ID NO: 1036700 - protein, 19 aa, Mycobacterium
MVAAGANPVALGAGISKAA

SEQ ID NO: 1036701 - protein, 25 aa, Mycobacterium
MVEHRLPRGVTFIGQPLWGSIGYTL

SEQ ID NO: 1036702 - protein, 17 aa, Mycobacterium
MVRRARRLLPGDPDFGD

SEQ ID NO: 1036703 - protein, 20 aa, Mycobacterium
MVRSAIAGVVLKVIVESAVL

SEQ ID NO: 1036704 - protein, 17 aa, Mycobacterium
MVSKSLRPLPVAHKEMS

SEQ ID NO: 1036705 - protein, 27 aa, Mycobacterium
MVTARPCPTCRGVGVVIPDPCCQCVGD

SEQ ID NO: 1036706 - protein, 20 aa, Mycobacterium
MVTAVVCTWVPKTTVVIVVD

SEQ ID NO: 1036707 - protein, 24 aa, Mycobacterium
MVTHARARLVAKMSYTNIGFALAP

SEQ ID NO: 1036708 - protein, 18 aa, Mycobacterium
MVVRDRIRTEPPHPGARY

SEQ ID NO: 1036709 - protein, 20 aa, Mycobacterium
MVVSYRICDLIPVYRSQRSL

SEQ ID NO: 1036710 - protein, 18 aa, Mycobacterium
MVYRHSGYPGGLRKRTIG

SEQ ID NO: 1036711 - protein, 18 aa, Mycobacterium
MYSVMWSEHCSYKSSKVH

SEQ ID NO: 1036712 - protein, 20 aa, Mycobacterium
MYTLGFRFRPWTKCQAIADG

SEQ ID NO: 1036713 - protein, 24 aa, Mycobacterium
NADEAVLTAAAWVAELRQLVAPAD

SEQ ID NO: 1036714 - protein, 21 aa, Mycobacterium
NADELASWLSGLRGSRVALRV

SEQ ID NO: 1036715 - protein, 24 aa, Mycobacterium
NADGLFGVLTNVVWTSRGPCAIDG

SEQ ID NO: 1036716 - protein, 25 aa, Mycobacterium
NADIAMAFERYRIVTGDHSLEEECG

SEQ ID NO: 1036717 - protein, 23 aa, Mycobacterium
NADRKGGHILYGLDGHVYGVDHG

SEQ ID NO: 1036718 - protein, 22 aa, Mycobacterium
NAERAGVIIAGFEVPHLHIHVF

SEQ ID NO: 1036719 - protein, 18 aa, Mycobacterium
NAFPRRDYLAHRRWMPTP

SEQ ID NO: 1036720 - protein, 22 aa, Mycobacterium
NAGRQIRDAFVVGSENNGYTEL

SEQ ID NO: 1036721 - protein, 19 aa, Mycobacterium
NALGGPGIELFRRLVEDNE

SEQ ID NO: 1036722 - protein, 25 aa, Mycobacterium
NALRPLTAVVRSARMAAVNAILHSA

SEQ ID NO: 1036723 - protein, 24 aa, Mycobacterium
NALYCCVHCTCTTAAMPPAATVCR

SEQ ID NO: 1036724 - protein, 17 aa, Mycobacterium
NAPILVVSYFTLYADTV

SEQ ID NO: 1036725 - protein, 24 aa, Mycobacterium
NARGGRLSRQSAWQVLQDAAEHAG

SEQ ID NO: 1036726 - protein, 20 aa, Mycobacterium
NARTRFVLVGMPGPPPARTG

SEQ ID NO: 1036727 - protein, 25 aa, Mycobacterium
NASLDRLGMDYVDLYLIHWPAPPVG

SEQ ID NO: 1036728 - protein, 22 aa, Mycobacterium
NATESLNLVSYVFGDNRFEGTS

SEQ ID NO: 1036729 - protein, 29 aa, Mycobacterium
NAVDLPAWYRPNSGLARDLAFIACSTVGG

SEQ ID NO: 1036730 - protein, 17 aa, Mycobacterium
NAVHIRVGYSYSCEYDV

SEQ ID NO: 1036731 - protein, 25 aa, Mycobacterium
NAVKGGVAFLPLDRISELAGSINNV

SEQ ID NO: 1036732 - protein, 24 aa, Mycobacterium
NAWAICVFCAAGPMHPELLELAAE

SEQ ID NO: 1036733 - protein, 21 aa, Mycobacterium
NCVPGLATFIRKHCDNRWVEE

SEQ ID NO: 1036734 - protein, 24 aa, Mycobacterium
NDAEVVEALALLRASPGMARARQV

SEQ ID NO: 1036735 - protein, 25 aa, Mycobacterium
NDEQFRIAYQATRNVFGFAPYPSVS

SEQ ID NO: 1036736 - protein, 25 aa, Mycobacterium
NDGEPINFFDFMGPIIKACGENWPR

SEQ ID NO: 1036737 - protein, 26 aa, Mycobacterium
NDGLDRVKPFWPFQVNARLVGLADSE

SEQ ID NO: 1036738 - protein, 27 aa, Mycobacterium
NDGMTRILVSVAMRPPLTSSITQSSHN

SEQ ID NO: 1036739 - protein, 24 aa, Mycobacterium
NDIEVLKPLIIDSLQKVAKEADLQ

SEQ ID NO: 1036740 - protein, 26 aa, Mycobacterium
NDKRFIGVEALLRWAHPTLGTLLPAR

SEQ ID NO: 1036741 - protein, 23 aa, Mycobacterium
NDPRRPVTVTARHVGHWRFFTLH

SEQ ID NO: 1036742 - protein, 24 aa, Mycobacterium
NDQVATLFRMWLRDAVRRVAAGAL

SEQ ID NO: 1036743 - protein, 19 aa, Mycobacterium
NDRDRLVVIIAGYSSDIDR

SEQ ID NO: 1036744 - protein, 26 aa, Mycobacterium
NDRWHSLARLAIRDDIYASLRSLCFD

SEQ ID NO: 1036745 - protein, 26 aa, Mycobacterium
NDSRRAIHFQEWWVRYRAQVPTHSFA

SEQ ID NO: 1036746 - protein, 17 aa, Mycobacterium
NDVLDLYLSLAMPAEIH

SEQ ID NO: 1036747 - protein, 26 aa, Mycobacterium
NDVLKSGRVYRSWVISDWGAIPNWES

SEQ ID NO: 1036748 - protein, 25 aa, Mycobacterium
NDYDEWLRRFEISLRALPERQRHSS

SEQ ID NO: 1036749 - protein, 20 aa, Mycobacterium
NECAQWRLGETVTLHEHGNP

SEQ ID NO: 1036750 - protein, 22 aa, Mycobacterium
NEDEVDAFLDLVENELTQLIEE

SEQ ID NO: 1036751 - protein, 28 aa, Mycobacterium
NEEVAPWLDLVCKLGVLVAALSDELPAS

SEQ ID NO: 1036752 - protein, 26 aa, Mycobacterium
NEGDVFCSVVRRVALPDSFFAIDGQI

SEQ ID NO: 1036753 - protein, 22 aa, Mycobacterium
NEIPCVRALLTLLPDNLRWLVT

SEQ ID NO: 1036754 - protein, 25 aa, Mycobacterium
NEIPCVRALLTLLPGSLRWLVTVDA

SEQ ID NO: 1036755 - protein, 24 aa, Mycobacterium
NELAFKLSRLTGRTKLVAAQAAFH

SEQ ID NO: 1036756 - protein, 24 aa, Mycobacterium
NELHRRICAPLADVHKVAFVSAKG

SEQ ID NO: 1036757 - protein, 24 aa, Mycobacterium
NELPLPRPKFEIFVYSPRVEGVHL

SEQ ID NO: 1036758 - protein, 25 aa, Mycobacterium
NELPRGCIAAGDRAFFCDYVQEYLS

SEQ ID NO: 1036759 - protein, 23 aa, Mycobacterium
NEVPRDGLLRLLVDVQYTRNDLS

SEQ ID NO: 1036760 - protein, 23 aa, Mycobacterium
NEVYRLPKHLDEKVARVHVEALG

SEQ ID NO: 1036761 - protein, 24 aa, Mycobacterium
NFAAGRLAYILGVRGPAVVIDTAC

SEQ ID NO: 1036762 - protein, 19 aa, Mycobacterium
NFCKTNGAFDPATMGTVPN

SEQ ID NO: 1036763 - protein, 24 aa, Mycobacterium
NFLNPRPGTPFGALEVMPPSEALK

SEQ ID NO: 1036764 - protein, 17 aa, Mycobacterium
NFPERFALEYTSADGTR

SEQ ID NO: 1036765 - protein, 23 aa, Mycobacterium
NFPSLRHELEIAGVEFVSDTDTE

SEQ ID NO: 1036766 - protein, 23 aa, Mycobacterium
NFRRHAIEALEFMGISVEFSHHE

SEQ ID NO: 1036767 - protein, 23 aa, Mycobacterium
NFVRRLGGYNAWFIGPDTVGLDS

SEQ ID NO: 1036768 - protein, 20 aa, Mycobacterium
NGESMAAVARELHYIDVSAL

SEQ ID NO: 1036769 - protein, 19 aa, Mycobacterium
NGFEILLCKANHVKNVPFR

SEQ ID NO: 1036770 - protein, 25 aa, Mycobacterium
NGKLRKGQQVAWMREVDGLPVTTDA

SEQ ID NO: 1036771 - protein, 18 aa, Mycobacterium
NGKPEFVENFFMFIAEEV

SEQ ID NO: 1036772 - protein, 19 aa, Mycobacterium
NGLDLDWLSAHRDQTQWYV

SEQ ID NO: 1036773 - protein, 23 aa, Mycobacterium
NGLTYNFTFNFEKAGQANVAVPV

SEQ ID NO: 1036774 - protein, 17 aa, Mycobacterium
NGPVWVFAGFGAQHREM

SEQ ID NO: 1036775 - protein, 29 aa, Mycobacterium
NGPWLADRLLELGVKLAHITICGDCPADI

SEQ ID NO: 1036776 - protein, 20 aa, Mycobacterium
NGRLRRAGVSSFGISGTNAH

SEQ ID NO: 1036777 - protein, 17 aa, Mycobacterium
NGWPMPLPDELKDDLKS

SEQ ID NO: 1036778 - protein, 20 aa, Mycobacterium
NIARALRWQFDGIDRAGSDL

SEQ ID NO: 1036779 - protein, 20 aa, Mycobacterium
NIEDQVMVLFEWVIAACGAA

SEQ ID NO: 1036780 - protein, 24 aa, Mycobacterium
NIIELPNRFFAIVVEKVDAAKGVL

SEQ ID NO: 1036781 - protein, 24 aa, Mycobacterium
NIIHTMALKAINWFGQVSTTVAAL

SEQ ID NO: 1036782 - protein, 18 aa, Mycobacterium
NIRLRNMLLNGVAGGYTR

SEQ ID NO: 1036783 - protein, 26 aa, Mycobacterium
NKALADFAHRGWIRLDGKSVLISDSE

SEQ ID NO: 1036784 - protein, 23 aa, Mycobacterium
NKDGGYLAANWAVYRAELALVDV

SEQ ID NO: 1036785 - protein, 35 aa, Mycobacterium
NKGLELIEANLLFGIPYDRIEVVVHPQSIVHSMVT

SEQ ID NO: 1036786 - protein, 22 aa, Mycobacterium
NKGMSLPGMHVSAPALSDKDIE

SEQ ID NO: 1036787 - protein, 24 aa, Mycobacterium
NKGQRLAYNRVWVKALGALPNDPT

SEQ ID NO: 1036788 - protein, 20 aa, Mycobacterium
NKLDRRVMELGGRLYTAKDS

SEQ ID NO: 1036789 - protein, 19 aa, Mycobacterium
NKMLAVLFGAWWIGAETLL

SEQ ID NO: 1036790 - protein, 26 aa, Mycobacterium
NKVVGARCALAWSVETARLAREHNNA

SEQ ID NO: 1036791 - protein, 24 aa, Mycobacterium
NKYRLIFEKLRLQPGDRLLDVGCG

SEQ ID NO: 1036792 - protein, 17 aa, Mycobacterium
NLALRDIRIQAAQTGDF

SEQ ID NO: 1036793 - protein, 27 aa, Mycobacterium
NLEDWKCWARWRLIRARAPWLTDDLVA

SEQ ID NO: 1036794 - protein, 24 aa, Mycobacterium
NLGHLEAAAGIAGFIKAVLAVQRG

SEQ ID NO: 1036795 - protein, 24 aa, Mycobacterium
NLGHLEAAAGIAGFIKTVLAVQRG

SEQ ID NO: 1036796 - protein, 18 aa, Mycobacterium
NLGLIRAVEKFDYTKGYK

SEQ ID NO: 1036797 - protein, 19 aa, Mycobacterium
NLGRCARVVVIGTTPDATT

SEQ ID NO: 1036798 - protein, 25 aa, Mycobacterium
NLIEFKKTRLSGLCGQRSADKLVPD

SEQ ID NO: 1036799 - protein, 20 aa, Mycobacterium
NLLLARAAVVALSLTELTVA

SEQ ID NO: 1036800 - protein, 17 aa, Mycobacterium
NLLRYAAGFEALRDRSD

SEQ ID NO: 1036801 - protein, 18 aa, Mycobacterium
NLVADDLLHPGICVVDAN

SEQ ID NO: 1036802 - protein, 30 aa, Mycobacterium
NLVSPELVRRLCWDWEVLPESSVDPVNAVE

SEQ ID NO: 1036803 - protein, 19 aa, Mycobacterium
NMDDCRWDAVLEVNLLAPQ

SEQ ID NO: 1036804 - protein, 25 aa, Mycobacterium
NMIKPMLARGELRLVGATTLDEYRR

SEQ ID NO: 1036805 - protein, 25 aa, Mycobacterium
NMTRRLAREEAMLVGGSCGMAVVAA

SEQ ID NO: 1036806 - protein, 20 aa, Mycobacterium
NMWALCSLGVRRVFALYVGG

SEQ ID NO: 1036807 - protein, 24 aa, Mycobacterium
NMWPIKSTPGLRCQTDVAPQNNRL

SEQ ID NO: 1036808 - protein, 20 aa, Mycobacterium
NNEMKRLLATTLAALTVGTV

SEQ ID NO: 1036809 - protein, 17 aa, Mycobacterium
NNGWRLVTNQLNHERVA

SEQ ID NO: 1036810 - protein, 19 aa, Mycobacterium
NNHWSGFRPDRIKALAGAV

SEQ ID NO: 1036811 - protein, 28 aa, Mycobacterium
NNIARWRWTDIPGALGVANHSSFRAETY

SEQ ID NO: 1036812 - protein, 25 aa, Mycobacterium
NNNWFAAYAYWYFKLYRHDKVKLLD

SEQ ID NO: 1036813 - protein, 20 aa, Mycobacterium
NPAALRILGVSDRSALDDPV

SEQ ID NO: 1036814 - protein, 21 aa, Mycobacterium
NPECASALWITIAGVEHLVET

SEQ ID NO: 1036815 - protein, 21 aa, Mycobacterium
NPEVMLCAALLARNAVEKGLA

SEQ ID NO: 1036816 - protein, 17 aa, Mycobacterium
NPFPSIADYAFLVRLGN

SEQ ID NO: 1036817 - protein, 19 aa, Mycobacterium
NPHLACMDPQLSLEELAAL

SEQ ID NO: 1036818 - protein, 21 aa, Mycobacterium
NPKLRRAGLDYHDLASVTVHT

SEQ ID NO: 1036819 - protein, 21 aa, Mycobacterium
NPLSIVYRLLRGIFHNLTAAD

SEQ ID NO: 1036820 - protein, 22 aa, Mycobacterium
NPRLRRAYRIDDGIPVLLVDEA

SEQ ID NO: 1036821 - protein, 18 aa, Mycobacterium
NPRPLVLTEHRWAGRISS

SEQ ID NO: 1036822 - protein, 25 aa, Mycobacterium
NPTSRSAICPPTINADDMDFQVVAK

SEQ ID NO: 1036823 - protein, 21 aa, Mycobacterium
NPTVFPGHWYSTAPSATLSMV

SEQ ID NO: 1036824 - protein, 21 aa, Mycobacterium
NPVLRYGVCAFARDLESAGGH

SEQ ID NO: 1036825 - protein, 25 aa, Mycobacterium
NQPGKLLGFHWTKVHAAHPGLGEVY

SEQ ID NO: 1036826 - protein, 25 aa, Mycobacterium
NRAILATVWRAHWLLAKKPEDAQRR

SEQ ID NO: 1036827 - protein, 25 aa, Mycobacterium
NRAYLPGTLLPPGIRATADPADALR

SEQ ID NO: 1036828 - protein, 18 aa, Mycobacterium
NRCAAKFKFVYCIVGISI

SEQ ID NO: 1036829 - protein, 24 aa, Mycobacterium
NRDGFVFGEAGALMLIETEEHAKA

SEQ ID NO: 1036830 - protein, 20 aa, Mycobacterium
NRESWIRLDRVFDVPEESIR

SEQ ID NO: 1036831 - protein, 18 aa, Mycobacterium
NRFLARRADQQLALADHS

SEQ ID NO: 1036832 - protein, 20 aa, Mycobacterium
NRIARCFRTDAKQQTKEYKC

SEQ ID NO: 1036833 - protein, 27 aa, Mycobacterium
NRKGKCKRTRTGFGRRKNTKRAIVTLA

SEQ ID NO: 1036834 - protein, 26 aa, Mycobacterium
NRLDIPSWLARAGFQMLDPLKTVKAR

SEQ ID NO: 1036835 - protein, 21 aa, Mycobacterium
NRLEVKGGDWLVIKGTTIDQP

SEQ ID NO: 1036836 - protein, 21 aa, Mycobacterium
NRNQGAFGFSEPCTECRGSGS

SEQ ID NO: 1036837 - protein, 22 aa, Mycobacterium
NRPGYLRFDFNWQGSLTGEQRT

SEQ ID NO: 1036838 - protein, 18 aa, Mycobacterium
NRQEIKQALLALQRSAER

SEQ ID NO: 1036839 - protein, 25 aa, Mycobacterium
NRRRRRGRRGRGRGRGEQGGSDVQS

SEQ ID NO: 1036840 - protein, 20 aa, Mycobacterium
NRSACVRIPITGKNPKAKRL

SEQ ID NO: 1036841 - protein, 18 aa, Mycobacterium
NRSKCSRSLISSADQTVP

SEQ ID NO: 1036842 - protein, 23 aa, Mycobacterium
NRTATLRCRICKNDLTTPAAVML

SEQ ID NO: 1036843 - protein, 37 aa, Mycobacterium
NRTRQCLYFPCQNSVDLLWLLGLWLGDGHTAAPHKHM

SEQ ID NO: 1036844 - protein, 17 aa, Mycobacterium
NRVLIGRIVELLVTTGE

SEQ ID NO: 1036845 - protein, 27 aa, Mycobacterium
NRYPEFLPERLLRLIAGNIGLPADQVV

SEQ ID NO: 1036846 - protein, 20 aa, Mycobacterium
NSCLICRRLTIGWSSLHSTR

SEQ ID NO: 1036847 - protein, 17 aa, Mycobacterium
NSGCIPTKMFVSTAKNF

SEQ ID NO: 1036848 - protein, 19 aa, Mycobacterium
NSLGGWVVFELERRGRARS

SEQ ID NO: 1036849 - protein, 24 aa, Mycobacterium
NSPEAFTRLALINEVVHVIRADKE

SEQ ID NO: 1036850 - protein, 19 aa, Mycobacterium
NSPGFLGFQLLRPIKGENR

SEQ ID NO: 1036851 - protein, 26 aa, Mycobacterium
NSQIARFPKPYVSLMDGIVMGGGVGI

SEQ ID NO: 1036852 - protein, 23 aa, Mycobacterium
NSSCPLLLWGRQGDPSAVPVGVV

SEQ ID NO: 1036853 - protein, 25 aa, Mycobacterium
NSTRTRFSFDIGIAQLGGHAVVVDG

SEQ ID NO: 1036854 - protein, 18 aa, Mycobacterium
NSVFRLPALTSIPIRVDC

SEQ ID NO: 1036855 - protein, 26 aa, Mycobacterium
NTENLRAGIWLEHIRRPGWQAVAAVE

SEQ ID NO: 1036856 - protein, 22 aa, Mycobacterium
NTEWPKWESVMAADPVDAAELE

SEQ ID NO: 1036857 - protein, 19 aa, Mycobacterium
NTGKLIVVVLPDFGERYLS

SEQ ID NO: 1036858 - protein, 17 aa, Mycobacterium
NTKLTWGATNRTMVPDS

SEQ ID NO: 1036859 - protein, 27 aa, Mycobacterium
NTLETWKRLCDPMAQQISTVWAASLPE

SEQ ID NO: 1036860 - protein, 24 aa, Mycobacterium
NTLIKRAASEVGIEGLDELFAGPT

SEQ ID NO: 1036861 - protein, 28 aa, Mycobacterium
NTQVCPVCLGLPGSLPVLNRAAVQSAIR

SEQ ID NO: 1036862 - protein, 17 aa, Mycobacterium
NTRSVKAIAGFVALLDD

SEQ ID NO: 1036863 - protein, 20 aa, Mycobacterium
NTTIPTKRSETFTTADDNQP

SEQ ID NO: 1036864 - protein, 18 aa, Mycobacterium
NTTYPLFLHEAYVRLYPA

SEQ ID NO: 1036865 - protein, 18 aa, Mycobacterium
NTVQFAAAVQAAMEDGYR

SEQ ID NO: 1036866 - protein, 25 aa, Mycobacterium
NTVRYRLKRITDFTGHDPTLPRDAY

SEQ ID NO: 1036867 - protein, 27 aa, Mycobacterium
NVAVDMLEMLPTPWGLVRSGVAPDHPK

SEQ ID NO: 1036868 - protein, 24 aa, Mycobacterium
NVAVSRAQYAAVIVRSETLTEYLP

SEQ ID NO: 1036869 - protein, 19 aa, Mycobacterium
NVDDLRAPLLAALGAADLA

SEQ ID NO: 1036870 - protein, 25 aa, Mycobacterium
NVELIAAVVNRVWFLDAVLGKVDVY

SEQ ID NO: 1036871 - protein, 25 aa, Mycobacterium
NVGWRQARAAARYFAQRGGIAGVVS

SEQ ID NO: 1036872 - protein, 26 aa, Mycobacterium
NVIMLRRAGQRFGFAVGSMSLLSEHR

SEQ ID NO: 1036873 - protein, 28 aa, Mycobacterium
NVMAVWQRLHFGFGLPKPPMEPLAVERV

SEQ ID NO: 1036874 - protein, 24 aa, Mycobacterium
NVMPQWAGSSWYELRYTDPHNSER

SEQ ID NO: 1036875 - protein, 17 aa, Mycobacterium
NVVRVRRPGGLTMPSED

SEQ ID NO: 1036876 - protein, 20 aa, Mycobacterium
NWAANCIVHNLGIEPAEELR

SEQ ID NO: 1036877 - protein, 23 aa, Mycobacterium
NWIKEFDPRFNIRYRDDKSYPVL

SEQ ID NO: 1036878 - protein, 18 aa, Mycobacterium
NWMRAREALMKTDIFGSK

SEQ ID NO: 1036879 - protein, 19 aa, Mycobacterium
NWPAPDHLRLVTLPWSRDL

SEQ ID NO: 1036880 - protein, 19 aa, Mycobacterium
NYCNVEGFFRLPIQSTAHR

SEQ ID NO: 1036881 - protein, 25 aa, Mycobacterium
NYDDFFKRCFNIMPSDGRMTVQSSV

SEQ ID NO: 1036882 - protein, 23 aa, Mycobacterium
NYRNQPCRFSRPKFHRSSLHDHT

SEQ ID NO: 1036883 - protein, 18 aa, Mycobacterium
NYVALEWFTGNGLTGRAD

SEQ ID NO: 1036884 - protein, 19 aa, Mycobacterium
PAAFGFHEFFFFHACTAIF

SEQ ID NO: 1036885 - protein, 26 aa, Mycobacterium
PAALAISRWRFRFMIKAEMRRVKVVN

SEQ ID NO: 1036886 - protein, 20 aa, Mycobacterium
PAALRSEARLVFTAHSVPVA

SEQ ID NO: 1036887 - protein, 24 aa, Mycobacterium
PAARGVGVLVSFAGRVLQPLGLRK

SEQ ID NO: 1036888 - protein, 19 aa, Mycobacterium
PAATCKVPGLILTAPGDPK

SEQ ID NO: 1036889 - protein, 22 aa, Mycobacterium
PAATQCVEFLCIVNLNDVGDYT

SEQ ID NO: 1036890 - protein, 23 aa, Mycobacterium
PADWYSTMEALLFGAFISGGFVF

SEQ ID NO: 1036891 - protein, 22 aa, Mycobacterium
PAEIRMLRMLGADLVGMSTVHE

SEQ ID NO: 1036892 - protein, 24 aa, Mycobacterium
PAGESRVPVFVFHPAGGSTVVYEP

SEQ ID NO: 1036893 - protein, 24 aa, Mycobacterium
PAGLLRVCRLAAERGVRIGAQVSY

SEQ ID NO: 1036894 - protein, 18 aa, Mycobacterium
PAGMGAPWINGAPAPLAP

SEQ ID NO: 1036895 - protein, 18 aa, Mycobacterium
PAGVAAWQLAKMNMAKVT

SEQ ID NO: 1036896 - protein, 20 aa, Mycobacterium
PAGVRRLGGRDGQVIELDIG

SEQ ID NO: 1036897 - protein, 22 aa, Mycobacterium
PAIPGVLPPASLPPIQSVTAVP

SEQ ID NO: 1036898 - protein, 28 aa, Mycobacterium
PAITAANFTHGWLRTGDLGSLSVTGDLR

SEQ ID NO: 1036899 - protein, 18 aa, Mycobacterium
PALDAFYVVLTESARADA

SEQ ID NO: 1036900 - protein, 20 aa, Mycobacterium
PALELMRHVGLRPTKLTNAW

SEQ ID NO: 1036901 - protein, 19 aa, Mycobacterium
PALLAELGLSERQRATTDA

SEQ ID NO: 1036902 - protein, 21 aa, Mycobacterium
PALQRRWWAARGQGAFVAVDG

SEQ ID NO: 1036903 - protein, 17 aa, Mycobacterium
PALRRGRDYVSHLITIV

SEQ ID NO: 1036904 - protein, 26 aa, Mycobacterium
PALSKFEVVTAMAFAAFANAPVDIAV

SEQ ID NO: 1036905 - protein, 20 aa, Mycobacterium
PAMHTEMWLHPATVDNVATL

SEQ ID NO: 1036906 - protein, 17 aa, Mycobacterium
PAMVARALITSAGRHTD

SEQ ID NO: 1036907 - protein, 18 aa, Mycobacterium
PANLNFEMVELEPLDFDD

SEQ ID NO: 1036908 - protein, 21 aa, Mycobacterium
PANLVPADFWCDSNRLASAQI

SEQ ID NO: 1036909 - protein, 18 aa, Mycobacterium
PAPRLVRLLQQIAPRTVA

SEQ ID NO: 1036910 - protein, 27 aa, Mycobacterium
PARKLREIRIALTLDKTFTKPEILTRY

SEQ ID NO: 1036911 - protein, 17 aa, Mycobacterium
PARTWFTAMKPIATKFG

SEQ ID NO: 1036912 - protein, 20 aa, Mycobacterium
PASGAAHLLADWTAAETGED

SEQ ID NO: 1036913 - protein, 29 aa, Mycobacterium
PASGRPLAMPRLDMVTGLYYLTTAVDGDT

SEQ ID NO: 1036914 - protein, 25 aa, Mycobacterium
PASQAGKWAGFELHSDVTVTENSPL

SEQ ID NO: 1036915 - protein, 21 aa, Mycobacterium
PASRGRRSSQLSGDDREQAIL

SEQ ID NO: 1036916 - protein, 24 aa, Mycobacterium
PATAEAMVDCRILPGRQAAFEAAI

SEQ ID NO: 1036917 - protein, 25 aa, Mycobacterium
PATLNRFSDRFARINFRDDMMLPSY

SEQ ID NO: 1036918 - protein, 20 aa, Mycobacterium
PATRSYRYIDYWGTVVTAFD

SEQ ID NO: 1036919 - protein, 18 aa, Mycobacterium
PATTFSLNPGKILGELKE

SEQ ID NO: 1036920 - protein, 17 aa, Mycobacterium
PAVAWRLASWPSATIEV

SEQ ID NO: 1036921 - protein, 27 aa, Mycobacterium
PAVIRRELDRYLPFLATTKVLIAAVRA

SEQ ID NO: 1036922 - protein, 17 aa, Mycobacterium
PAVKRGVATSAAKKAAI

SEQ ID NO: 1036923 - protein, 25 aa, Mycobacterium
PAWPRAGLIGCAFGNLAEVMAGVFA

SEQ ID NO: 1036924 - protein, 24 aa, Mycobacterium
PAYVRRAPLLDGIDEFDADFFGLP

SEQ ID NO: 1036925 - protein, 22 aa, Mycobacterium
PCPEHRYSFINVRRIVTRSNTR

SEQ ID NO: 1036926 - protein, 20 aa, Mycobacterium
PCSSSRCYAGYQLPVDEGVD

SEQ ID NO: 1036927 - protein, 21 aa, Mycobacterium
PDADAVLRPMVRLFENPATGW

SEQ ID NO: 1036928 - protein, 25 aa, Mycobacterium
PDAEQRYRFTFPRQQRGRFLCIADF

SEQ ID NO: 1036929 - protein, 25 aa, Mycobacterium
PDAFLRAVVDFELPAASSYATGIAF

SEQ ID NO: 1036930 - protein, 24 aa, Mycobacterium
PDALRDGNRIFAMILGTATNQDGG

SEQ ID NO: 1036931 - protein, 19 aa, Mycobacterium
PDDEVPAFVRGIAESTGEF

SEQ ID NO: 1036932 - protein, 19 aa, Mycobacterium
PDDGCCSHGAFLSDDADRT

SEQ ID NO: 1036933 - protein, 24 aa, Mycobacterium
PDDLKPGDLVGVAATGAYCYSLSS

SEQ ID NO: 1036934 - protein, 17 aa, Mycobacterium
PDDPEFHPPRLGDLKRS

SEQ ID NO: 1036935 - protein, 24 aa, Mycobacterium
PDDVRVDLVISRRGRTVEVHVHPD

SEQ ID NO: 1036936 - protein, 29 aa, Mycobacterium
PDDVYDIAAAWARRFLDGLPHALAAAKAG

SEQ ID NO: 1036937 - protein, 25 aa, Mycobacterium
PDELAEALAGFIAEFGLSLVGGCCG

SEQ ID NO: 1036938 - protein, 23 aa, Mycobacterium
PDELCAWKDEHPGAAVVSYVNTT

SEQ ID NO: 1036939 - protein, 24 aa, Mycobacterium
PDEMSPYAPRVITIKVPVDKIGEV

SEQ ID NO: 1036940 - protein, 22 aa, Mycobacterium
PDEVRPAFWHDMVELGWPGLHV

SEQ ID NO: 1036941 - protein, 20 aa, Mycobacterium
PDGVLMKRAAYGLASVIIRE

SEQ ID NO: 1036942 - protein, 26 aa, Mycobacterium
PDHELDVWSLTDLVAFSTNAQGGSSI

SEQ ID NO: 1036943 - protein, 19 aa, Mycobacterium
PDHEYEIMAGALVGAGEAM

SEQ ID NO: 1036944 - protein, 28 aa, Mycobacterium
PDHSRGAFPGALWLQVRDIAVTQADLEG

SEQ ID NO: 1036945 - protein, 20 aa, Mycobacterium
PDIPLGSWLADLSDERLIQL

SEQ ID NO: 1036946 - protein, 18 aa, Mycobacterium
PDLAYDLVRPGIAVYGLS

SEQ ID NO: 1036947 - protein, 27 aa, Mycobacterium
PDLRSWVPRFPWLGSTDAVPRCCQTVP

SEQ ID NO: 1036948 - protein, 21 aa, Mycobacterium
PDMADRVAVLACHATPERLLR

SEQ ID NO: 1036949 - protein, 21 aa, Mycobacterium
PDMFTRMMLSLAATGIAPGSF

SEQ ID NO: 1036950 - protein, 19 aa, Mycobacterium
PDNLRFKLVEPLRLLFKDE

SEQ ID NO: 1036951 - protein, 22 aa, Mycobacterium
PDPDAAVSWAERQRMFDLPRSS

SEQ ID NO: 1036952 - protein, 18 aa, Mycobacterium
PDQFDWLVTRLEIARKPR

SEQ ID NO: 1036953 - protein, 17 aa, Mycobacterium
PDQFLGAHVRRVTGRKN

SEQ ID NO: 1036954 - protein, 19 aa, Mycobacterium
PDQLGVWVRTYVGTVDDAE

SEQ ID NO: 1036955 - protein, 27 aa, Mycobacterium
PDQSTWYRGAPRISDLVEQVRRSGVTP

SEQ ID NO: 1036956 - protein, 23 aa, Mycobacterium
PDQVRAGLLLAVGVRATADQIGT

SEQ ID NO: 1036957 - protein, 28 aa, Mycobacterium
PDQVVCRWLTRWADVTVHPVDQQQAQQE

SEQ ID NO: 1036958 - protein, 20 aa, Mycobacterium
PDRADTTGSYIFSFTTTDQH

SEQ ID NO: 1036959 - protein, 23 aa, Mycobacterium
PDSDYRTRWTIPVGVRETDLSVA

SEQ ID NO: 1036960 - protein, 17 aa, Mycobacterium
PDSGLLLVHHPLLLHGV

SEQ ID NO: 1036961 - protein, 19 aa, Mycobacterium
PDSYLRGAQLLDVAPDAAA

SEQ ID NO: 1036962 - protein, 17 aa, Mycobacterium
PDTKIIVMIGEIGGDAE

SEQ ID NO: 1036963 - protein, 23 aa, Mycobacterium
PDTRPRAVIILAHGFGEHARRYD

SEQ ID NO: 1036964 - protein, 26 aa, Mycobacterium
PDTVGEVWLRGSTVVRGYLGDPAITA

SEQ ID NO: 1036965 - protein, 21 aa, Mycobacterium
PDTWLLWNLTGGPRGGVHVTD

SEQ ID NO: 1036966 - protein, 17 aa, Mycobacterium
PDVTWTVTGDGLASRSA

SEQ ID NO: 1036967 - protein, 17 aa, Mycobacterium
PDWAQPVFCLTDDEAEA

SEQ ID NO: 1036968 - protein, 22 aa, Mycobacterium
PDWGCSYVRDRFRAIEKDLDFD

SEQ ID NO: 1036969 - protein, 25 aa, Mycobacterium
PDWMRCGEGGWPPRCSATRDWTTCG

SEQ ID NO: 1036970 - protein, 20 aa, Mycobacterium
PDYRFTLANERTFLSWQRTS

SEQ ID NO: 1036971 - protein, 19 aa, Mycobacterium
PDYSRPEGNWTPNIHSGQE

SEQ ID NO: 1036972 - protein, 20 aa, Mycobacterium
PEAFNGWKQRNSKAADAAIG

SEQ ID NO: 1036973 - protein, 22 aa, Mycobacterium
PEEALRPPTRCEGFAVVYETPT

SEQ ID NO: 1036974 - protein, 42 aa, Mycobacterium
PEEPKGVPVFAWKGETLEEYWWAAEQMLTWPDPDKPVNMILD

SEQ ID NO: 1036975 - protein, 23 aa, Mycobacterium
PEFLEIDCAIIGFDTILDNLPYG

SEQ ID NO: 1036976 - protein, 17 aa, Mycobacterium
PEGASAIVFHDTAHAAE

SEQ ID NO: 1036977 - protein, 18 aa, Mycobacterium
PEGAVAFFGHSMGGMLAF

SEQ ID NO: 1036978 - protein, 21 aa, Mycobacterium
PEGKIRTVYEPVVKITIIAPS

SEQ ID NO: 1036979 - protein, 22 aa, Mycobacterium
PEGPWLRTGDLGFISEDELFIV

SEQ ID NO: 1036980 - protein, 22 aa, Mycobacterium
PEIAEQLLRVLARRLRRTNNNL

SEQ ID NO: 1036981 - protein, 20 aa, Mycobacterium
PEIEVGKGFSGVMETFDNTR

SEQ ID NO: 1036982 - protein, 20 aa, Mycobacterium
PELDYACGLGTGRLFVADVA

SEQ ID NO: 1036983 - protein, 35 aa, Mycobacterium
PELFTSGPASAPWEAARPTGRRGVLATEFTLDLNP

SEQ ID NO: 1036984 - protein, 26 aa, Mycobacterium
PELLVSRFGDRVVCRPFAGSAPRATN

SEQ ID NO: 1036985 - protein, 19 aa, Mycobacterium
PELLVVRHAPGVWHLVSTV

SEQ ID NO: 1036986 - protein, 17 aa, Mycobacterium
PELPVTGYVDLVRAVKT

SEQ ID NO: 1036987 - protein, 21 aa, Mycobacterium
PEPIPDVPAWNSVMGSRRPER

SEQ ID NO: 1036988 - protein, 19 aa, Mycobacterium
PEPSMRIISDIFAYTSAKM

SEQ ID NO: 1036989 - protein, 23 aa, Mycobacterium
PEPSPRPVLVVDFGAQYAQLIAR

SEQ ID NO: 1036990 - protein, 17 aa, Mycobacterium
PEPSVAQVVVGARKVAV

SEQ ID NO: 1036991 - protein, 17 aa, Mycobacterium
PEQMLRFHIGSGAGATV

SEQ ID NO: 1036992 - protein, 20 aa, Mycobacterium
PEQVHEGIVIARLAKSTQNR

SEQ ID NO: 1036993 - protein, 18 aa, Mycobacterium
PERIGVTISEELQLHPEQ

SEQ ID NO: 1036994 - protein, 22 aa, Mycobacterium
PESKVPPALRRLVLEGQAAVKR

SEQ ID NO: 1036995 - protein, 21 aa, Mycobacterium
PESRVLDTLVHIWVSSIYNEI

SEQ ID NO: 1036996 - protein, 33 aa, Mycobacterium
PETLRRYRPSDAPLCGSLLIGGDGRLVEPLRAT

SEQ ID NO: 1036997 - protein, 25 aa, Mycobacterium
PEVDIRIPFTPGMAALIQAKLAPQA

SEQ ID NO: 1036998 - protein, 19 aa, Mycobacterium
PEVGAELAAGKSFGEVEST

SEQ ID NO: 1036999 - protein, 38 aa, Mycobacterium
PEVQKAGAGGLLLPVYVRRLLNYHSMRNAQYCLTRVKT

SEQ ID NO: 1037000 - protein, 33 aa, Mycobacterium
PEVRKARKSIAQFKLREGMPIGVRVTLRDDRMW

SEQ ID NO: 1037001 - protein, 20 aa, Mycobacterium
PEVRRLWSTVMQQWIDYNTA

SEQ ID NO: 1037002 - protein, 20 aa, Mycobacterium
PEVVRAWLSYAPTVVQLPDG

SEQ ID NO: 1037003 - protein, 21 aa, Mycobacterium
PEWPQMLLRALMFRLAVHALH

SEQ ID NO: 1037004 - protein, 19 aa, Mycobacterium
PEYPISYVVFAHGNGSSSR

SEQ ID NO: 1037005 - protein, 34 aa, Mycobacterium
PFAPMCRSDCPGLCAECGTSLVVEPGHPHDRIDP

SEQ ID NO: 1037006 - protein, 18 aa, Mycobacterium
PFEDGGWIWFDITAETRV

SEQ ID NO: 1037007 - protein, 24 aa, Mycobacterium
PFFNNYRPQFYFRTTDVTGVVTLP

SEQ ID NO: 1037008 - protein, 25 aa, Mycobacterium
PFFVMLCQMLGKPVNFVPVIDKDVR

SEQ ID NO: 1037009 - protein, 18 aa, Mycobacterium
PFGPMVVSVPVRMLTTQS

SEQ ID NO: 1037010 - protein, 21 aa, Mycobacterium
PFLLACIDLRGAELTATQLRA

SEQ ID NO: 1037011 - protein, 22 aa, Mycobacterium
PFMDFTPGYVLRSLDALPKQGS

SEQ ID NO: 1037012 - protein, 17 aa, Mycobacterium
PFPVYRALIDYGPMQLP

SEQ ID NO: 1037013 - protein, 25 aa, Mycobacterium
PFRLPANELEFFFVLTFTGSNTAKH

SEQ ID NO: 1037014 - protein, 20 aa, Mycobacterium
PFTPRAKKVLELSLREALQL

SEQ ID NO: 1037015 - protein, 19 aa, Mycobacterium
PGADFRWIVAVAVVVSASA

SEQ ID NO: 1037016 - protein, 18 aa, Mycobacterium
PGALLRCLVEGTDEVHVD

SEQ ID NO: 1037017 - protein, 19 aa, Mycobacterium
PGAPGQWWQQQVVQGLQRS

SEQ ID NO: 1037018 - protein, 17 aa, Mycobacterium
PGATWASSGSWLVVSDA

SEQ ID NO: 1037019 - protein, 18 aa, Mycobacterium
PGAVIGHSMGESAAAVVA

SEQ ID NO: 1037020 - protein, 20 aa, Mycobacterium
PGCGGSCERAPPTQGTYVHY

SEQ ID NO: 1037021 - protein, 17 aa, Mycobacterium
PGDHVIIPDDVYGGTFR

SEQ ID NO: 1037022 - protein, 18 aa, Mycobacterium
PGDQLVLGASNPVRDMAL

SEQ ID NO: 1037023 - protein, 33 aa, Mycobacterium
PGDRLLDVGCGWGGMVRYAARRGVRVIGATLSA

SEQ ID NO: 1037024 - protein, 19 aa, Mycobacterium
PGDVLTQYGGITVEVLNTD

SEQ ID NO: 1037025 - protein, 20 aa, Mycobacterium
PGDYRYAVNNSFGFGGHNVA

SEQ ID NO: 1037026 - protein, 24 aa, Mycobacterium
PGEICFHVLLLAGGYWNFPNVTAE

SEQ ID NO: 1037027 - protein, 28 aa, Mycobacterium
PGGARSGLRAAVDILEHIDDIYVAELAS

SEQ ID NO: 1037028 - protein, 25 aa, Mycobacterium
PGGCAGLRYNLFFDDRTLDGDLTAE

SEQ ID NO: 1037029 - protein, 17 aa, Mycobacterium
PGGYRKLISFTLRQQAT

SEQ ID NO: 1037030 - protein, 20 aa, Mycobacterium
PGHPEFRHTKGVEITTGPLG

SEQ ID NO: 1037031 - protein, 17 aa, Mycobacterium
PGINPGRSAGWFIVISR

SEQ ID NO: 1037032 - protein, 24 aa, Mycobacterium
PGKGNAMGPAFWSEMPEVFAELDT

SEQ ID NO: 1037033 - protein, 19 aa, Mycobacterium
PGLGFAKTGQHNWALLNAL

SEQ ID NO: 1037034 - protein, 23 aa, Mycobacterium
PGLHRPRTLLGKRLNDLVRDTYT

SEQ ID NO: 1037035 - protein, 18 aa, Mycobacterium
PGLKCMQTPACALVPEVS

SEQ ID NO: 1037036 - protein, 30 aa, Mycobacterium
PGLPPLSSGMVGFFAYDMVRRLERLPELAL

SEQ ID NO: 1037037 - protein, 19 aa, Mycobacterium
PGMARARQVLAHYADQASG

SEQ ID NO: 1037038 - protein, 17 aa, Mycobacterium
PGMSRDPPYSWVATIFR

SEQ ID NO: 1037039 - protein, 25 aa, Mycobacterium
PGPSIACSRWGMLSPAGQCKAFDVS

SEQ ID NO: 1037040 - protein, 18 aa, Mycobacterium
PGQMTSYETGTWLTCGHE

SEQ ID NO: 1037041 - protein, 17 aa, Mycobacterium
PGQPGGWSMKSNNGPEE

SEQ ID NO: 1037042 - protein, 29 aa, Mycobacterium
PGRHIPRLRQVIGCVFQDFRLLQQKTVYE

SEQ ID NO: 1037043 - protein, 24 aa, Mycobacterium
PGRRRVAMLRDWLDSELSDASVTV

SEQ ID NO: 1037044 - protein, 23 aa, Mycobacterium
PGSGKTTFALRVMTELLNSHAVE

SEQ ID NO: 1037045 - protein, 28 aa, Mycobacterium
PGSKMWRFGRVTVRFGKPMDFSRFEGAA

SEQ ID NO: 1037046 - protein, 28 aa, Mycobacterium
PGSTPLWGAAEAWISLAEQLMEAAQEVS

SEQ ID NO: 1037047 - protein, 18 aa, Mycobacterium
PGSVPLDISVAAELFDPR

SEQ ID NO: 1037048 - protein, 19 aa, Mycobacterium
PGTITPFALLQLADRGQFF

SEQ ID NO: 1037049 - protein, 17 aa, Mycobacterium
PGTTLFIVASKTFSTLE

SEQ ID NO: 1037050 - protein, 26 aa, Mycobacterium
PGVLARVAALFSRRGFNIESLAVGAT

SEQ ID NO: 1037051 - protein, 25 aa, Mycobacterium
PGVSCVKPTGALYAFPRLDPEVYGI

SEQ ID NO: 1037052 - protein, 18 aa, Mycobacterium
PGYLKVEARYAVTAEGAL

SEQ ID NO: 1037053 - protein, 20 aa, Mycobacterium
PGYYKRPEVTATVFDSDGYY

SEQ ID NO: 1037054 - protein, 19 aa, Mycobacterium
PHFSFSWYRGSPIGRERKT

SEQ ID NO: 1037055 - protein, 20 aa, Mycobacterium
PHGESGKVIGIRVFSHEDDD

SEQ ID NO: 1037056 - protein, 17 aa, Mycobacterium
PHGPRLTFEIKTRQVTI

SEQ ID NO: 1037057 - protein, 25 aa, Mycobacterium
PHLEAFKAKGYEVLLLTDPVDEVWV

SEQ ID NO: 1037058 - protein, 19 aa, Mycobacterium
PHMLRHSFATHLLEGGADI

SEQ ID NO: 1037059 - protein, 19 aa, Mycobacterium
PHPIQGIGAGFVPSVLVLD

SEQ ID NO: 1037060 - protein, 26 aa, Mycobacterium
PHQIPRAGNMFSVFFSEAPVTDFASA

SEQ ID NO: 1037061 - protein, 23 aa, Mycobacterium
PHQTRLLLRKSLHLLRDKQQWWR

SEQ ID NO: 1037062 - protein, 18 aa, Mycobacterium
PHRFTACITDLALSAVNL

SEQ ID NO: 1037063 - protein, 18 aa, Mycobacterium
PHRGRLNVLANIVGKPYS

SEQ ID NO: 1037064 - protein, 23 aa, Mycobacterium
PHRLRGTINVVLPVPGDVHGLVT

SEQ ID NO: 1037065 - protein, 21 aa, Mycobacterium
PHSLLRARTVVVCIDDDAGRA

SEQ ID NO: 1037066 - protein, 19 aa, Mycobacterium
PHTRPPIGELLRGYEQIVQ

SEQ ID NO: 1037067 - protein, 20 aa, Mycobacterium
PHVRRITLVSIDFDGTDITA

SEQ ID NO: 1037068 - protein, 17 aa, Mycobacterium
PIAAWKALKEGNERFVA

SEQ ID NO: 1037069 - protein, 24 aa, Mycobacterium
PIDPWGGSYYVEWLTHQLAARART

SEQ ID NO: 1037070 - protein, 17 aa, Mycobacterium
PIGSVIVNRNIPCYLGH

SEQ ID NO: 1037071 - protein, 18 aa, Mycobacterium
PIMFPLEVRLAVSDDVFT

SEQ ID NO: 1037072 - protein, 24 aa, Mycobacterium
PIQLESMILPPIVHEVKVISIGQF

SEQ ID NO: 1037073 - protein, 20 aa, Mycobacterium
PIRRCRMHTRPAISRTHTPQ

SEQ ID NO: 1037074 - protein, 18 aa, Mycobacterium
PITAADCLGAVDVTGILR

SEQ ID NO: 1037075 - protein, 19 aa, Mycobacterium
PITELGMVKNIDIEPGGNV

SEQ ID NO: 1037076 - protein, 19 aa, Mycobacterium
PITVLDNLRRCIGDRRMLM

SEQ ID NO: 1037077 - protein, 25 aa, Mycobacterium
PIVDDIRAAIAVRHGVAVRDVLLVP

SEQ ID NO: 1037078 - protein, 32 aa, Mycobacterium
PKCSGRVGIAGFCMGGRFALVMSPKGFDASAP

SEQ ID NO: 1037079 - protein, 18 aa, Mycobacterium
PKEVRAWTIHQGDTASKA

SEQ ID NO: 1037080 - protein, 17 aa, Mycobacterium
PKFSGQLSLHYKDVIGD

SEQ ID NO: 1037081 - protein, 20 aa, Mycobacterium
PKGALVHRLIRSGRSLFTAH

SEQ ID NO: 1037082 - protein, 17 aa, Mycobacterium
PKHHAVSVVGVDRSKSS

SEQ ID NO: 1037083 - protein, 22 aa, Mycobacterium
PKKLLRPKVPILVLVGEPIEPT

SEQ ID NO: 1037084 - protein, 18 aa, Mycobacterium
PKLTVAVRLAPSTGAVTG

SEQ ID NO: 1037085 - protein, 18 aa, Mycobacterium
PKPTPIWAAADGDRLLAI

SEQ ID NO: 1037086 - protein, 18 aa, Mycobacterium
PKRARMLMDAKIFKDTLI

SEQ ID NO: 1037087 - protein, 17 aa, Mycobacterium
PKSYLPTYREFYERRQL

SEQ ID NO: 1037088 - protein, 17 aa, Mycobacterium
PKTQPYLDYARNPDNGY

SEQ ID NO: 1037089 - protein, 19 aa, Mycobacterium
PKVKVKMLLLNNIDVSQYW

SEQ ID NO: 1037090 - protein, 17 aa, Mycobacterium
PLAAFAHLAKVDMNLNR

SEQ ID NO: 1037091 - protein, 22 aa, Mycobacterium
PLADPGVCWGRSWRIIVTLVCI

SEQ ID NO: 1037092 - protein, 18 aa, Mycobacterium
PLAHACHIVRFRILAKRH

SEQ ID NO: 1037093 - protein, 28 aa, Mycobacterium
PLAPHLAEELWLRLGHTTSLANGPFPQA

SEQ ID NO: 1037094 - protein, 24 aa, Mycobacterium
PLARFGSWYEMFPRPTGCWDADGN

SEQ ID NO: 1037095 - protein, 18 aa, Mycobacterium
PLASFGMSGDFGMSDLGQ

SEQ ID NO: 1037096 - protein, 20 aa, Mycobacterium
PLDELEVITGIKAGNAQRPE

SEQ ID NO: 1037097 - protein, 17 aa, Mycobacterium
PLFGFGPRVAQVVTGAF

SEQ ID NO: 1037098 - protein, 19 aa, Mycobacterium
PLGGSVWTVSSWVLRKPSR

SEQ ID NO: 1037099 - protein, 19 aa, Mycobacterium
PLHLRTVMITLDHVSKKYK

SEQ ID NO: 1037100 - protein, 18 aa, Mycobacterium
PLLAQGIRHGFWAPNELA

SEQ ID NO: 1037101 - protein, 18 aa, Mycobacterium
PLLVACDLQRPAAVNQLQ

SEQ ID NO: 1037102 - protein, 18 aa, Mycobacterium
PLPPEGASAIVFHDTAHA

SEQ ID NO: 1037103 - protein, 19 aa, Mycobacterium
PLQRKNLDASGWFDSLMTF

SEQ ID NO: 1037104 - protein, 17 aa, Mycobacterium
PLRERFTPEIRSHQLRR

SEQ ID NO: 1037105 - protein, 22 aa, Mycobacterium
PLRRYDVDAAILFSDIVVPLCA

SEQ ID NO: 1037106 - protein, 19 aa, Mycobacterium
PLSAAERRAIQSFLESGVD

SEQ ID NO: 1037107 - protein, 19 aa, Mycobacterium
PLSLGRLDRGWVVASETAG

SEQ ID NO: 1037108 - protein, 18 aa, Mycobacterium
PLSPSLRRDEVLQLAKVA

SEQ ID NO: 1037109 - protein, 26 aa, Mycobacterium
PLSPSPLRCWRRLHTGPAARAKVRGH

SEQ ID NO: 1037110 - protein, 17 aa, Mycobacterium
PLTECLADVVTRFLPYF

SEQ ID NO: 1037111 - protein, 23 aa, Mycobacterium
PLTMGDLRFLKFLRESIFPGGEL

SEQ ID NO: 1037112 - protein, 25 aa, Mycobacterium
PLTPGRMTTKWGGFVSDIAGFDAAF

SEQ ID NO: 1037113 - protein, 29 aa, Mycobacterium
PLVAEAGVAWVLMHWRLMSAERPYEAPNY

SEQ ID NO: 1037114 - protein, 17 aa, Mycobacterium
PLVTELLTEAGFVVDGV

SEQ ID NO: 1037115 - protein, 20 aa, Mycobacterium
PLYNELCWAPKHANFDEGLR

SEQ ID NO: 1037116 - protein, 22 aa, Mycobacterium
PMEELIAAFLPVLFPGTEIVEH

SEQ ID NO: 1037117 - protein, 17 aa, Mycobacterium
PMETIGFISTRYYVSMN

SEQ ID NO: 1037118 - protein, 22 aa, Mycobacterium
PMGIPPNFGVVLANFMADHVFN

SEQ ID NO: 1037119 - protein, 25 aa, Mycobacterium
PMIRKGAMKNSTWIKAYEDANVDIG

SEQ ID NO: 1037120 - protein, 18 aa, Mycobacterium
PMLREFSEFLSRQQLRVP

SEQ ID NO: 1037121 - protein, 17 aa, Mycobacterium
PMMERRKSILLTPKHIS

SEQ ID NO: 1037122 - protein, 18 aa, Mycobacterium
PMSALSRMSRGEHQSITL

SEQ ID NO: 1037123 - protein, 32 aa, Mycobacterium
PMSLLRFIKFILTEIFPGGRLPKISQVDHYSS

SEQ ID NO: 1037124 - protein, 17 aa, Mycobacterium
PNAKGISLIGEFNSWND

SEQ ID NO: 1037125 - protein, 23 aa, Mycobacterium
PNLDEVRLLVGIDVVDTESQRAA

SEQ ID NO: 1037126 - protein, 23 aa, Mycobacterium
PNLWPEVFLQVGMLSSRDGRPVF

SEQ ID NO: 1037127 - protein, 29 aa, Mycobacterium
PNPSRLCGWCPHQEHCPAFGGTPPPYPGW

SEQ ID NO: 1037128 - protein, 25 aa, Mycobacterium
PNRGFLRCVAALARAANAIGETDEY

SEQ ID NO: 1037129 - protein, 18 aa, Mycobacterium
PNRSLDCVDEELAGAAHF

SEQ ID NO: 1037130 - protein, 17 aa, Mycobacterium
PNVPAQHAIQVALGGHQ

SEQ ID NO: 1037131 - protein, 23 aa, Mycobacterium
PNVPDAFAVIADRLGNSLYTSNA

SEQ ID NO: 1037132 - protein, 17 aa, Mycobacterium
PNVSAWSQPASTITEIL

SEQ ID NO: 1037133 - protein, 17 aa, Mycobacterium
PPEAPRPSANQHSRHAR

SEQ ID NO: 1037134 - protein, 22 aa, Mycobacterium
PPEASFRVGHLVDRQPTVSPER

SEQ ID NO: 1037135 - protein, 18 aa, Mycobacterium
PPELYRITYDGSINDEPH

SEQ ID NO: 1037136 - protein, 17 aa, Mycobacterium
PPFALCGPRGTLVADGV

SEQ ID NO: 1037137 - protein, 23 aa, Mycobacterium
PPGPEPWPGVVVIHDAIGYEPDK

SEQ ID NO: 1037138 - protein, 25 aa, Mycobacterium
PPGTRRIYSNYGFRVLAETVQREAG

SEQ ID NO: 1037139 - protein, 18 aa, Mycobacterium
PPIRIAVDLPDRIAGVVY

SEQ ID NO: 1037140 - protein, 19 aa, Mycobacterium
PPIYFGFGSMPIVSPTDTV

SEQ ID NO: 1037141 - protein, 19 aa, Mycobacterium
PPLHCTYCARHLIDALLPK

SEQ ID NO: 1037142 - protein, 20 aa, Mycobacterium
PPLVFCTDATAFPTMRTPPD

SEQ ID NO: 1037143 - protein, 17 aa, Mycobacterium
PPLWVNTSVTVFLAQES

SEQ ID NO: 1037144 - protein, 24 aa, Mycobacterium
PPNPKATVALLRRVEDVLDVEVPL

SEQ ID NO: 1037145 - protein, 20 aa, Mycobacterium
PPNWTQLGALIGHTVADVLA

SEQ ID NO: 1037146 - protein, 18 aa, Mycobacterium
PPPNGCRTMTGWTRSNPP

SEQ ID NO: 1037147 - protein, 17 aa, Mycobacterium
PPPSYLAAQRDWIDECY

SEQ ID NO: 1037148 - protein, 28 aa, Mycobacterium
PPRTMKPDICWQLPIRHSQEWVTRPDGT

SEQ ID NO: 1037149 - protein, 22 aa, Mycobacterium
PPRWVATQVGLWCRTMVGRDNF

SEQ ID NO: 1037150 - protein, 23 aa, Mycobacterium
PPSAIRLGLLAGHYRADRFWSSQ

SEQ ID NO: 1037151 - protein, 24 aa, Mycobacterium
PPSEALKSVAAFRLALPRTILRFA

SEQ ID NO: 1037152 - protein, 19 aa, Mycobacterium
PPSIREIADAVGLTSTSSV

SEQ ID NO: 1037153 - protein, 23 aa, Mycobacterium
PPVHGRCLAWWVGAVTLGVAKII

SEQ ID NO: 1037154 - protein, 19 aa, Mycobacterium
PPVTFKIENPLAVVSTSAH

SEQ ID NO: 1037155 - protein, 21 aa, Mycobacterium
PPYDDVRVIAGQGTIAVELLE

SEQ ID NO: 1037156 - protein, 17 aa, Mycobacterium
PPYFEGMSVEPKPVRNI

SEQ ID NO: 1037157 - protein, 19 aa, Mycobacterium
PPYICPPAEIAQITSAMVE

SEQ ID NO: 1037158 - protein, 23 aa, Mycobacterium
PQAAKVRVRFCPSPTGVPHVGMV

SEQ ID NO: 1037159 - protein, 30 aa, Mycobacterium
PQAFDGLRLAGRWVRRPDLTVATEDHNVPT

SEQ ID NO: 1037160 - protein, 17 aa, Mycobacterium
PQALRAFGARECIEAQR

SEQ ID NO: 1037161 - protein, 17 aa, Mycobacterium
PQARTQLHYVLNRAESA

SEQ ID NO: 1037162 - protein, 17 aa, Mycobacterium
PQCWSRYWWMSSSLSRC

SEQ ID NO: 1037163 - protein, 17 aa, Mycobacterium
PQHDVLMYPAWRSSALL

SEQ ID NO: 1037164 - protein, 19 aa, Mycobacterium
PQKPAGHPVAMSGRGTDAR

SEQ ID NO: 1037165 - protein, 20 aa, Mycobacterium
PQLAGPAVRAFPQPLPLAKD

SEQ ID NO: 1037166 - protein, 23 aa, Mycobacterium
PQLFKQLLMVAGMERYYQIAHCY

SEQ ID NO: 1037167 - protein, 30 aa, Mycobacterium
PQLPHGISRLRFRLRWRGFRLTVDARHADV

SEQ ID NO: 1037168 - protein, 17 aa, Mycobacterium
PQLPSGPLTSGAAANVI

SEQ ID NO: 1037169 - protein, 18 aa, Mycobacterium
PQPLALTPFQTFTAGNIV

SEQ ID NO: 1037170 - protein, 22 aa, Mycobacterium
PQQGGLIAHLAHTWKQVVDTPL

SEQ ID NO: 1037171 - protein, 21 aa, Mycobacterium
PQRRSASVTAVAWRTSAGAAA

SEQ ID NO: 1037172 - protein, 26 aa, Mycobacterium
PQRRTRLRPGTTAPLLSGLGDAKDIT

SEQ ID NO: 1037173 - protein, 20 aa, Mycobacterium
PQVQNWLQWLQKIGYTDFYN

SEQ ID NO: 1037174 - protein, 20 aa, Mycobacterium
PQVVEGWYGQPFPKPLSRTR

SEQ ID NO: 1037175 - protein, 19 aa, Mycobacterium
PQVWDVLEEVIAEHPVLLN

SEQ ID NO: 1037176 - protein, 19 aa, Mycobacterium
PRAPMPVSAPPRSPAASLM

SEQ ID NO: 1037177 - protein, 17 aa, Mycobacterium
PRDIAELAAMVCTVLED

SEQ ID NO: 1037178 - protein, 22 aa, Mycobacterium
PRDKRMEVALTYIYGIGRTRAN

SEQ ID NO: 1037179 - protein, 19 aa, Mycobacterium
PREVRFVDALPRNAMGKVL

SEQ ID NO: 1037180 - protein, 19 aa, Mycobacterium
PRFAGIIRLYTARQVVEQR

SEQ ID NO: 1037181 - protein, 21 aa, Mycobacterium
PRFDLTYKDVFIVPHRSDVAS

SEQ ID NO: 1037182 - protein, 18 aa, Mycobacterium
PRGMTRAGVQVNQPTKSG

SEQ ID NO: 1037183 - protein, 17 aa, Mycobacterium
PRGPGMERGDLLEANGA

SEQ ID NO: 1037184 - protein, 20 aa, Mycobacterium
PRGREVSVEREVFPTLLSDA

SEQ ID NO: 1037185 - protein, 21 aa, Mycobacterium
PRGVPQIEVTFDIDANGIVHV

SEQ ID NO: 1037186 - protein, 18 aa, Mycobacterium
PRIAGQIMRTDSYDLPWH

SEQ ID NO: 1037187 - protein, 25 aa, Mycobacterium
PRIFKRIRPAFTYQRSLDVLTAARE

SEQ ID NO: 1037188 - protein, 27 aa, Mycobacterium
PRIGAPRWDTVIVGLDCDRTILSERLA

SEQ ID NO: 1037189 - protein, 18 aa, Mycobacterium
PRKLRPGDSLLVDPKAGY

SEQ ID NO: 1037190 - protein, 21 aa, Mycobacterium
PRKVSPLAVQMIMPNGAAATV

SEQ ID NO: 1037191 - protein, 20 aa, Mycobacterium
PRLKEMDARHGGSIIDAQIA

SEQ ID NO: 1037192 - protein, 18 aa, Mycobacterium
PRLSGSVYISRHTPVGFG

SEQ ID NO: 1037193 - protein, 19 aa, Mycobacterium
PRLTRFHTATLFSLTLQEL

SEQ ID NO: 1037194 - protein, 27 aa, Mycobacterium
PRMDAEVGLRLGLLVDVVSGRTFAAAP

SEQ ID NO: 1037195 - protein, 19 aa, Mycobacterium
PRMSADELIDYLTMLSWNA

SEQ ID NO: 1037196 - protein, 17 aa, Mycobacterium
PRMSELGYRSFMNDSNG

SEQ ID NO: 1037197 - protein, 20 aa, Mycobacterium
PRPGDKWHLAEVLVKVNGIT

SEQ ID NO: 1037198 - protein, 21 aa, Mycobacterium
PRPLEVTSILAGGVDDVVYSR

SEQ ID NO: 1037199 - protein, 31 aa, Mycobacterium
PRQQLWSVQVPRRLKELHLQLGTATAELSQR

SEQ ID NO: 1037200 - protein, 20 aa, Mycobacterium
PRRALATPWWEAGHRNRPKP

SEQ ID NO: 1037201 - protein, 22 aa, Mycobacterium
PRRFVEIPVVPWVVSAKSQAAL

SEQ ID NO: 1037202 - protein, 18 aa, Mycobacterium
PRRVCIEALWGPASDADY

SEQ ID NO: 1037203 - protein, 20 aa, Mycobacterium
PRTGARLCEVAYSYTDDAVV

SEQ ID NO: 1037204 - protein, 17 aa, Mycobacterium
PRVADRLVVAATQSGLP

SEQ ID NO: 1037205 - protein, 19 aa, Mycobacterium
PRVGISHAADRPWRLWLPG

SEQ ID NO: 1037206 - protein, 18 aa, Mycobacterium
PSAPYTLPNFGFDALQAD

SEQ ID NO: 1037207 - protein, 23 aa, Mycobacterium
PSATLWVARSVSWIFEYYPMRQA

SEQ ID NO: 1037208 - protein, 20 aa, Mycobacterium
PSCESIGVVGYITWRATFLL

SEQ ID NO: 1037209 - protein, 18 aa, Mycobacterium
PSDLAFPAASAVALRKTA

SEQ ID NO: 1037210 - protein, 23 aa, Mycobacterium
PSEVKRKGVLIGDTVVIRKAGDV

SEQ ID NO: 1037211 - protein, 24 aa, Mycobacterium
PSFPSLLRKQLKGAPMPAPRAILA

SEQ ID NO: 1037212 - protein, 29 aa, Mycobacterium
PSGPFYDGAVFHRVIQGFMIQGGDPTGTG

SEQ ID NO: 1037213 - protein, 20 aa, Mycobacterium
PSGTWLKLNTIAGVPDHLLP

SEQ ID NO: 1037214 - protein, 19 aa, Mycobacterium
PSHLMTVHFVGLLRQKGVN

SEQ ID NO: 1037215 - protein, 17 aa, Mycobacterium
PSIAARLASLTSRLTIR

SEQ ID NO: 1037216 - protein, 19 aa, Mycobacterium
PSLPLTVTEWDEWGNPLID

SEQ ID NO: 1037217 - protein, 17 aa, Mycobacterium
PSMRHHPVERWVRPEEF

SEQ ID NO: 1037218 - protein, 25 aa, Mycobacterium
PSNVPPPPGRWARRKPDAAARLEAA

SEQ ID NO: 1037219 - protein, 22 aa, Mycobacterium
PSPCASNWRATGTLEDELVRQR

SEQ ID NO: 1037220 - protein, 19 aa, Mycobacterium
PSPFHVCATVAGRLLDAGY

SEQ ID NO: 1037221 - protein, 25 aa, Mycobacterium
PSQPLTARLIRFWLGQRNACAYTLE

SEQ ID NO: 1037222 - protein, 18 aa, Mycobacterium
PSRGRLPLDSELRRLPVG

SEQ ID NO: 1037223 - protein, 20 aa, Mycobacterium
PSTDAILTCRLIDRPLRPSF

SEQ ID NO: 1037224 - protein, 24 aa, Mycobacterium
PSTEIPGSLGSYVGKNDLLASNAV

SEQ ID NO: 1037225 - protein, 18 aa, Mycobacterium
PSTLFGLLTAIPRCSPDY

SEQ ID NO: 1037226 - protein, 20 aa, Mycobacterium
PSVESRSIVSERFLLIRTVN

SEQ ID NO: 1037227 - protein, 24 aa, Mycobacterium
PSVKLSFFGRVRRCGMVSPTVFWP

SEQ ID NO: 1037228 - protein, 19 aa, Mycobacterium
PSYKHAVVMGVNKAKVPGS

SEQ ID NO: 1037229 - protein, 24 aa, Mycobacterium
PTAARLGLSGWPRAAEESIVARDA

SEQ ID NO: 1037230 - protein, 25 aa, Mycobacterium
PTAEQRLSSWAVRIRQIYATASVVI

SEQ ID NO: 1037231 - protein, 19 aa, Mycobacterium
PTAGYGMWVKLRHADGTVT

SEQ ID NO: 1037232 - protein, 17 aa, Mycobacterium
PTAMTALFDRFGVDLPP

SEQ ID NO: 1037233 - protein, 18 aa, Mycobacterium
PTEHLKVQWTRAAATHGL

SEQ ID NO: 1037234 - protein, 19 aa, Mycobacterium
PTEMWDVFFEEYLSPVQPL

SEQ ID NO: 1037235 - protein, 19 aa, Mycobacterium
PTGIPLRYDLDADLRPVVP

SEQ ID NO: 1037236 - protein, 19 aa, Mycobacterium
PTGQHWRLLSTVKELDPAW

SEQ ID NO: 1037237 - protein, 22 aa, Mycobacterium
PTGVDTLMLWSAIRQSDVVRTL

SEQ ID NO: 1037238 - protein, 24 aa, Mycobacterium
PTHTPAVCQRCCSTHLHGDRISDL

SEQ ID NO: 1037239 - protein, 19 aa, Mycobacterium
PTILHRIRQKLAIEPVAIG

SEQ ID NO: 1037240 - protein, 19 aa, Mycobacterium
PTLEPRRVPGLWATPHPAA

SEQ ID NO: 1037241 - protein, 25 aa, Mycobacterium
PTLKAIEAWHALLGIGVPNDGGVLY

SEQ ID NO: 1037242 - protein, 19 aa, Mycobacterium
PTMCGRDARLQLLHEQDAL

SEQ ID NO: 1037243 - protein, 21 aa, Mycobacterium
PTNLFLWPFGGSISDGADHLV

SEQ ID NO: 1037244 - protein, 17 aa, Mycobacterium
PTPGHAVGLSFSVAPDV

SEQ ID NO: 1037245 - protein, 18 aa, Mycobacterium
PTPPELFTSGPASAPWEA

SEQ ID NO: 1037246 - protein, 25 aa, Mycobacterium
PTRFKRKEHWLDVHFAGDGSVSMPG

SEQ ID NO: 1037247 - protein, 21 aa, Mycobacterium
PTSRRRIRLAYQLTPKRVLGN

SEQ ID NO: 1037248 - protein, 21 aa, Mycobacterium
PTSVPAFRPGAQFKAVVAGAQ

SEQ ID NO: 1037249 - protein, 18 aa, Mycobacterium
PTVEHTIEILKGLRDRYE

SEQ ID NO: 1037250 - protein, 17 aa, Mycobacterium
PTVGERFLGTVVKITEF

SEQ ID NO: 1037251 - protein, 23 aa, Mycobacterium
PTVGRPRRAGVSSFGVSGTNAHV

SEQ ID NO: 1037252 - protein, 18 aa, Mycobacterium
PTVVVSVPRVFEKVYNTA

SEQ ID NO: 1037253 - protein, 24 aa, Mycobacterium
PVAGRCCLDAGASTGGFTEVLLDR

SEQ ID NO: 1037254 - protein, 18 aa, Mycobacterium
PVDEVWVGMAPEFDGKPL

SEQ ID NO: 1037255 - protein, 23 aa, Mycobacterium
PVDRIMSIVAFEHFGHGSYDDFF

SEQ ID NO: 1037256 - protein, 24 aa, Mycobacterium
PVESRGDCAVPLLPATAFGGLVWV

SEQ ID NO: 1037257 - protein, 23 aa, Mycobacterium
PVFAEDWVNLVALAVNEENAVGG

SEQ ID NO: 1037258 - protein, 32 aa, Mycobacterium
PVGGMSVSWLPFYHDMGLILGVCVPILGGCPA

SEQ ID NO: 1037259 - protein, 17 aa, Mycobacterium
PVGLGLREKHCRAPNYP

SEQ ID NO: 1037260 - protein, 24 aa, Mycobacterium
PVGNAGNITAYWKGYTEYHADGLI

SEQ ID NO: 1037261 - protein, 17 aa, Mycobacterium
PVHAPGEHPMFKAMAAG

SEQ ID NO: 1037262 - protein, 24 aa, Mycobacterium
PVHGVCSLDAIGVRTTGDTLVVTD

SEQ ID NO: 1037263 - protein, 19 aa, Mycobacterium
PVHSVRLAGLVAHQEVLFG

SEQ ID NO: 1037264 - protein, 18 aa, Mycobacterium
PVIDLVATRAPRPYDPEN

SEQ ID NO: 1037265 - protein, 25 aa, Mycobacterium
PVKLWTIADLGGWSTVDPQLFDKNT

SEQ ID NO: 1037266 - protein, 19 aa, Mycobacterium
PVLDVAVTCAMIPRRPTPS

SEQ ID NO: 1037267 - protein, 25 aa, Mycobacterium
PVLGVCVGMQILFARGVEFGVETTG

SEQ ID NO: 1037268 - protein, 23 aa, Mycobacterium
PVLKLLKITGDWQKFKGLPGAEG

SEQ ID NO: 1037269 - protein, 26 aa, Mycobacterium
PVLNARFALNAANARWGSLYDALYGT

SEQ ID NO: 1037270 - protein, 22 aa, Mycobacterium
PVLSIRNGWRSVVITGTPEQLS

SEQ ID NO: 1037271 - protein, 21 aa, Mycobacterium
PVNTRVAAVGKRIAKNHEPRK

SEQ ID NO: 1037272 - protein, 22 aa, Mycobacterium
PVPCELSAVLTFATRQNRSLRR

SEQ ID NO: 1037273 - protein, 17 aa, Mycobacterium
PVPREVLVPCLPSNADE

SEQ ID NO: 1037274 - protein, 26 aa, Mycobacterium
PVPSRGDMGLIPAMTVKCAVAMVKSI

SEQ ID NO: 1037275 - protein, 19 aa, Mycobacterium
PVREHWKAHSIDLTPVLHE

SEQ ID NO: 1037276 - protein, 19 aa, Mycobacterium
PVSAIAWGAWGEVGRATFL

SEQ ID NO: 1037277 - protein, 31 aa, Mycobacterium; identical to SEQ ID NO: 90676

SEQ ID NO: 1037278 - protein, 25 aa, Mycobacterium
PVSEKPQVCPVPFFEVDTTLFDSDY

SEQ ID NO: 1037279 - protein, 19 aa, Mycobacterium
PVTGIDFAAVSPWWLQRRL

SEQ ID NO: 1037280 - protein, 18 aa, Mycobacterium
PVTLAMLTFVKKVTGPDK

SEQ ID NO: 1037281 - protein, 19 aa, Mycobacterium
PVVAVAAHGAWLTLIRDGK

SEQ ID NO: 1037282 - protein, 18 aa, Mycobacterium
PVVIEAPEGITFAVQSPT

SEQ ID NO: 1037283 - protein, 27 aa, Mycobacterium
PVWCSDIRAGAGLVLAGLVADGDTEVY

SEQ ID NO: 1037284 - protein, 17 aa, Mycobacterium
PVYSHLRYDTIPGAKHV

SEQ ID NO: 1037285 - protein, 17 aa, Mycobacterium
PWAYLIVGGVQLATHSW

SEQ ID NO: 1037286 - protein, 17 aa, Mycobacterium
PWGHYEGLWAWLHGLID

SEQ ID NO: 1037287 - protein, 21 aa, Mycobacterium
PWLLDAYRRAWEWADSTGWRL

SEQ ID NO: 1037288 - protein, 23 aa, Mycobacterium
PWMTDLIDEFALRPPSPEQIAGF

SEQ ID NO: 1037289 - protein, 17 aa, Mycobacterium
PWYLVRYWRLLKFKLAN

SEQ ID NO: 1037290 - protein, 19 aa, Mycobacterium
PYEVELCVAEVAHYGETKP

SEQ ID NO: 1037291 - protein, 18 aa, Mycobacterium
PYGRLWATILQHRFGGSG

SEQ ID NO: 1037292 - protein, 18 aa, Mycobacterium
PYGTVLIIGAWNYPFYLT

SEQ ID NO: 1037293 - protein, 18 aa, Mycobacterium
PYHSFATSVQRFIEQATA

SEQ ID NO: 1037294 - protein, 21 aa, Mycobacterium
PYILAGWSLGGVLAYACAIGL

SEQ ID NO: 1037295 - protein, 19 aa, Mycobacterium
PYLDTVLFVLGVTRGEIEA

SEQ ID NO: 1037296 - protein, 27 aa, Mycobacterium
PYNERLFCLPAAIDLAGAEIELVSMVA

SEQ ID NO: 1037297 - protein, 29 aa, Mycobacterium
PYPGSLAMRLRTPWTGSYGHDPCRPTMQS

SEQ ID NO: 1037298 - protein, 24 aa, Mycobacterium
PYPLSRGRPGTIADRDVLADYGVF

SEQ ID NO: 1037299 - protein, 22 aa, Mycobacterium
PYQHVEKFIPRQITNVLTGRRP

SEQ ID NO: 1037300 - protein, 18 aa, Mycobacterium
PYRQEFDEAIDIPTVDRP

SEQ ID NO: 1037301 - protein, 18 aa, Mycobacterium
PYTLPNFGFDALQADIQQ

SEQ ID NO: 1037302 - protein, 17 aa, Mycobacterium
QAAAVVILQNWLDQCRA

SEQ ID NO: 1037303 - protein, 32 aa, Mycobacterium
QADLWFDPLCPWCWITSRWILEVEKVRDVEVH

SEQ ID NO: 1037304 - protein, 22 aa, Mycobacterium
QAFRDIEFHPAILRDVTNVCAG

SEQ ID NO: 1037305 - protein, 23 aa, Mycobacterium
QAHERPEAIALRRSDGTSELRYG

SEQ ID NO: 1037306 - protein, 24 aa, Mycobacterium
QAIAECLRAALLRQDLLETRDLHK

SEQ ID NO: 1037307 - protein, 19 aa, Mycobacterium
QAIGVSFGATVDRAPELLH

SEQ ID NO: 1037308 - protein, 19 aa, Mycobacterium
QAKRLLAMLEARGNGQWTS

SEQ ID NO: 1037309 - protein, 19 aa, Mycobacterium
QAKVVSWYDNEWGYSNRLV

SEQ ID NO: 1037310 - protein, 17 aa, Mycobacterium
QALADGIIDCVTTDHAP

SEQ ID NO: 1037311 - protein, 26 aa, Mycobacterium
QALGTPPARRQWWIDRVKTCYSLLVP

SEQ ID NO: 1037312 - protein, 26 aa, Mycobacterium
QAQAGALPPLFSRLVRRSRRRQIEDP

SEQ ID NO: 1037313 - protein, 17 aa, Mycobacterium
QARRDIAESGLFIEPSG

SEQ ID NO: 1037314 - protein, 23 aa, Mycobacterium
QARSRWRRRAKVTPFDSSGSPNP

SEQ ID NO: 1037315 - protein, 23 aa, Mycobacterium
QASLDEFGWLYILVTNAGIGSPA

SEQ ID NO: 1037316 - protein, 30 aa, Mycobacterium
QATTEMRLPFCWRGVSLHAGGAGRVRARFT

SEQ ID NO: 1037317 - protein, 18 aa, Mycobacterium
QAVGGAFVRLLDSSNEFT

SEQ ID NO: 1037318 - protein, 23 aa, Mycobacterium
QCDLRVVAPDAYFQFPTSKYGLA

SEQ ID NO: 1037319 - protein, 17 aa, Mycobacterium
QCHAIPLVDLKAAVAEY

SEQ ID NO: 1037320 - protein, 28 aa, Mycobacterium
QDACVAARIPAVMFWAAVPHYVSHPPNP

SEQ ID NO: 1037321 - protein, 26 aa, Mycobacterium
QDKLVMRRRLAALGAAMPRFMALDSV

SEQ ID NO: 1037322 - protein, 20 aa, Mycobacterium
QDLARRIALRHTVDMVRVTM

SEQ ID NO: 1037323 - protein, 22 aa, Mycobacterium
QDLLSRACVVINHVMPKEPNIA

SEQ ID NO: 1037324 - protein, 19 aa, Mycobacterium
QDQDPDWIIGRYIPNLVPR

SEQ ID NO: 1037325 - protein, 18 aa, Mycobacterium
QDRGCLVTSVLEQTLLTP

SEQ ID NO: 1037326 - protein, 25 aa, Mycobacterium
QDRSAVCGVFSYLPRARIPNTGIAY

SEQ ID NO: 1037327 - protein, 24 aa, Mycobacterium
QDTQLATCDYEYLDARTLQLADGL

SEQ ID NO: 1037328 - protein, 34 aa, Mycobacterium
QECPFAPRCPLVVDECRLREPELVEVRAGHRTAC

SEQ ID NO: 1037329 - protein, 26 aa, Mycobacterium
QEGDRGVSWLPFFHDMGLITVLLPSV

SEQ ID NO: 1037330 - protein, 23 aa, Mycobacterium
QEGKTAQLLDWFCSFSTAAALVG

SEQ ID NO: 1037331 - protein, 25 aa, Mycobacterium
QEGVLKLSIPVAERAKPRKISVDRG

SEQ ID NO: 1037332 - protein, 25 aa, Mycobacterium
QEIDLRFADALSMADNVMTFRYVIK

SEQ ID NO: 1037333 - protein, 25 aa, Mycobacterium
QEIMTELDIAPTRRLRGLGERQRKA

SEQ ID NO: 1037334 - protein, 21 aa, Mycobacterium
QEITRELAERGVLTGERGRYA

SEQ ID NO: 1037335 - protein, 24 aa, Mycobacterium
QEITRGRCAAISVPDRNTEKLVAI

SEQ ID NO: 1037336 - protein, 26 aa, Mycobacterium
QERAEARLGYRLGLTHTAAVIWSDDL

SEQ ID NO: 1037337 - protein, 34 aa, Mycobacterium
QESEFRKALRTCQAERRHNMLFDHVSALVAKAMG

SEQ ID NO: 1037338 - protein, 26 aa, Mycobacterium
QFALDEGRIVLVAGFQGVSQDTRDIT

SEQ ID NO: 1037339 - protein, 17 aa, Mycobacterium
QFDKDVLAARQFFLQHV

SEQ ID NO: 1037340 - protein, 18 aa, Mycobacterium
QFERTVVAGVRVLESSTD

SEQ ID NO: 1037341 - protein, 19 aa, Mycobacterium
QFFQLGFRPIKALLSAAGG

SEQ ID NO: 1037342 - protein, 19 aa, Mycobacterium
QFMCNGFGDLLGRSASVWT

SEQ ID NO: 1037343 - protein, 18 aa, Mycobacterium
QFTGGGIVHGPKLRDYSQ

SEQ ID NO: 1037344 - protein, 20 aa, Mycobacterium
QFVSSVGYEHAWLHPDNTEV

SEQ ID NO: 1037345 - protein, 28 aa, Mycobacterium
QFYHPLDMFGEWNRAYGAAGFLQYQFVI

SEQ ID NO: 1037346 - protein, 33 aa, Mycobacterium
QGAWPRFGLELPELLPRLTGIKRISRRAMSAPS

SEQ ID NO: 1037347 - protein, 36 aa, Mycobacterium
QGDKWTLSQIRLWGVVGFCVSGDPVALRAAAEAADD

SEQ ID NO: 1037348 - protein, 28 aa, Mycobacterium
QGDPGESRFYLSLGDELMRRFHGATLEA

SEQ ID NO: 1037349 - protein, 17 aa, Mycobacterium
QGDPRFVVPNVVASAPK

SEQ ID NO: 1037350 - protein, 17 aa, Mycobacterium
QGHPVIWESAARDIEPL

SEQ ID NO: 1037351 - protein, 18 aa, Mycobacterium
QGILPARRAVVTRYELVD

SEQ ID NO: 1037352 - protein, 22 aa, Mycobacterium
QGKRFAALLAQAHEQGLRFEVA

SEQ ID NO: 1037353 - protein, 20 aa, Mycobacterium
QGLDAWPKCGAASDLPITLW

SEQ ID NO: 1037354 - protein, 24 aa, Mycobacterium
QGLMKNAYVGRTFIQPSQTIRQLG

SEQ ID NO: 1037355 - protein, 18 aa, Mycobacterium
QGLPPVAAGPVFGALDGG

SEQ ID NO: 1037356 - protein, 29 aa, Mycobacterium
QGLVDEVRMLLRWGLRDGVTASRALGYAQ

SEQ ID NO: 1037357 - protein, 21 aa, Mycobacterium
QGMNLVIRYVDQPGALGKIGT

SEQ ID NO: 1037358 - protein, 19 aa, Mycobacterium
QGRTLRIALQTVILAPEQV

SEQ ID NO: 1037359 - protein, 17 aa, Mycobacterium
QGSPAWVALPDSWLTDP

SEQ ID NO: 1037360 - protein, 23 aa, Mycobacterium
QGTDLLSDIALDFKPVVQTRYEP

SEQ ID NO: 1037361 - protein, 17 aa, Mycobacterium
QHDKLPPSINFAGPSPY

SEQ ID NO: 1037362 - protein, 22 aa, Mycobacterium
QHGVPAKGWLVGDVHDGIAQMF

SEQ ID NO: 1037363 - protein, 17 aa, Mycobacterium
QHIAEYEIAVASWMQST

SEQ ID NO: 1037364 - protein, 25 aa, Mycobacterium
QHREMGKSLYLRNQVFAEWIEKVDA

SEQ ID NO: 1037365 - protein, 17 aa, Mycobacterium
QHVWYRLLRPVSVLTEF

SEQ ID NO: 1037366 - protein, 17 aa, Mycobacterium
QIDLTWRTVNNGFVIIE

SEQ ID NO: 1037367 - protein, 17 aa, Mycobacterium
QIKIAIEKIFSVKVASV

SEQ ID NO: 1037368 - protein, 20 aa, Mycobacterium
QILGTDIITAFGQRLAGEEI

SEQ ID NO: 1037369 - protein, 21 aa, Mycobacterium
QIPRPGPCVLGSVKSNIGHLE

SEQ ID NO: 1037370 - protein, 17 aa, Mycobacterium
QIVLRLPGVSAMRKPRF

SEQ ID NO: 1037371 - protein, 21 aa, Mycobacterium
QKLKVLVSIFGRETPVELTFS

SEQ ID NO: 1037372 - protein, 17 aa, Mycobacterium
QKSGILFVAAESLIVID

SEQ ID NO: 1037373 - protein, 20 aa, Mycobacterium
QKTYMRRSTNTVNYSDELPL

SEQ ID NO: 1037374 - protein, 25 aa, Mycobacterium
QLALRLAAELGVVGVFAVELFETAD

SEQ ID NO: 1037375 - protein, 34 aa, Mycobacterium
QLAVLLYAAWRSTYRWRPGVAVLLINKTDQRQIR

SEQ ID NO: 1037376 - protein, 21 aa, Mycobacterium
QLAVVKMPRWSSMTQGSAGRP

SEQ ID NO: 1037377 - protein, 19 aa, Mycobacterium
QLDEVAGFTVDYGWQLGGT

SEQ ID NO: 1037378 - protein, 18 aa, Mycobacterium
QLDPFTLRNLVIKAATFE

SEQ ID NO: 1037379 - protein, 25 aa, Mycobacterium
QLDWLLGNGGLEWAVKRTADSSQRL

SEQ ID NO: 1037380 - protein, 25 aa, Mycobacterium
QLGARCNIEHGCVVASAETLRGAEI

SEQ ID NO: 1037381 - protein, 19 aa, Mycobacterium
QLGGLPFSGPIGGVRVALI

SEQ ID NO: 1037382 - protein, 19 aa, Mycobacterium
QLGGPRTGARLCEVAYSYT

SEQ ID NO: 1037383 - protein, 18 aa, Mycobacterium
QLGRSDHGVRRHCSIDES

SEQ ID NO: 1037384 - protein, 18 aa, Mycobacterium
QLLLRRFGQLITRHLEHT

SEQ ID NO: 1037385 - protein, 19 aa, Mycobacterium
QLLQLGLRSLRLWHEGGFT

SEQ ID NO: 1037386 - protein, 18 aa, Mycobacterium
QLLQTRVASQFGDDGVVE

SEQ ID NO: 1037387 - protein, 28 aa, Mycobacterium
QLLTNVSRLFAERCIKGLSANIEHLREL

SEQ ID NO: 1037388 - protein, 20 aa, Mycobacterium
QLNLRQALTLVDQATATGDV

SEQ ID NO: 1037389 - protein, 17 aa, Mycobacterium
QLPAVSCESGIELTLPA

SEQ ID NO: 1037390 - protein, 20 aa, Mycobacterium
QLPGLSAWRRTQVEIDENSR

SEQ ID NO: 1037391 - protein, 21 aa, Mycobacterium
QLPLLLLDEGHCLRDQTLDIC

SEQ ID NO: 1037392 - protein, 24 aa, Mycobacterium
QLRFRRVSDALGFEQAVDVQELIY

SEQ ID NO: 1037393 - protein, 18 aa, Mycobacterium
QLRGGKVVVTMRLWADQI

SEQ ID NO: 1037394 - protein, 19 aa, Mycobacterium
QLRLERVVLVGVWTEGSAA

SEQ ID NO: 1037395 - protein, 22 aa, Mycobacterium
QLRRRGRCIAKVEIVWRSILPP

SEQ ID NO: 1037396 - protein, 26 aa, Mycobacterium
QLSLPGEMQPMWVPDQRWVMLSCHMK

SEQ ID NO: 1037397 - protein, 24 aa, Mycobacterium
QLSREFPPVRGVIHAAGVLDDGAI

SEQ ID NO: 1037398 - protein, 27 aa, Mycobacterium
QLSRTGWASPRWRNLTGGIVALHAADK

SEQ ID NO: 1037399 - protein, 24 aa, Mycobacterium
QLTAFKVPHRFAIIERLPRSTNGK

SEQ ID NO: 1037400 - protein, 24 aa, Mycobacterium
QLTHPARWDLCNVTLREHNVTAIV

SEQ ID NO: 1037401 - protein, 18 aa, Mycobacterium
QLTMRVFTGLTLLDTIQG

SEQ ID NO: 1037402 - protein, 18 aa, Mycobacterium
QLTPLVFEGTSFGGALMT

SEQ ID NO: 1037403 - protein, 26 aa, Mycobacterium
QLVNSDPYGAGWLLDVHVSDVGALES

SEQ ID NO: 1037404 - protein, 17 aa, Mycobacterium
QLVVPVLNARFALNAAN

SEQ ID NO: 1037405 - protein, 26 aa, Mycobacterium
QMALDFPELVIVCGHVEYPWIEEMVA

SEQ ID NO: 1037406 - protein, 22 aa, Mycobacterium
QMALPPCHAFFQFYVAQGRLSC

SEQ ID NO: 1037407 - protein, 23 aa, Mycobacterium
QMDVLRTAAALARLSQCNGVDWH

SEQ ID NO: 1037408 - protein, 18 aa, Mycobacterium
QMENGHIVVCGRVKDVII

SEQ ID NO: 1037409 - protein, 24 aa, Mycobacterium
QMIGFREHTSWALASAILEFADLE

SEQ ID NO: 1037410 - protein, 25 aa, Mycobacterium
QMPIHMRLPKLKGFRNRLRTEYAVV

SEQ ID NO: 1037411 - protein, 25 aa, Mycobacterium
QMRGFGGMVSLRMRAGRLAAQDLCA

SEQ ID NO: 1037412 - protein, 21 aa, Mycobacterium
QMRVAELLDIVGLRRDDATRY

SEQ ID NO: 1037413 - protein, 18 aa, Mycobacterium
QNARLAARLTGWRIDIRG

SEQ ID NO: 1037414 - protein, 21 aa, Mycobacterium
QNECPDYHFGWGARDVKTDES

SEQ ID NO: 1037415 - protein, 21 aa, Mycobacterium
QNNRLPAYRSIAAPVLVIGFA

SEQ ID NO: 1037416 - protein, 19 aa, Mycobacterium
QNPLPTVRTNQQVIGQIAE

SEQ ID NO: 1037417 - protein, 24 aa, Mycobacterium
QPGDALFFGHGLNIHFELVKPSGD

SEQ ID NO: 1037418 - protein, 38 aa, Mycobacterium
QPNRPMVCINLDWLPQFRGDLIPSYKAHRVAEEISGQA

SEQ ID NO: 1037419 - protein, 21 aa, Mycobacterium
QPSSACIYGKFLRNPSNWLAI

SEQ ID NO: 1037420 - protein, 20 aa, Mycobacterium
QPTIPGWRAETLGDDIAWMR

SEQ ID NO: 1037421 - protein, 24 aa, Mycobacterium
QPVEWRYVNDPSWVMRNKGQRLAY

SEQ ID NO: 1037422 - protein, 23 aa, Mycobacterium
QPVTRARVSAVRGVNVDAVMRTL

SEQ ID NO: 1037423 - protein, 23 aa, Mycobacterium
QPYWGRPVPGWGSEQPRLLIVGL

SEQ ID NO: 1037424 - protein, 17 aa, Mycobacterium
QQAGWEIYEPDKLARMI

SEQ ID NO: 1037425 - protein, 25 aa, Mycobacterium
QQARTAGLGDAWLAICPATPQLVQL

SEQ ID NO: 1037426 - protein, 24 aa, Mycobacterium
QQFNHFSLQPSWIEADWLFHRDQR

SEQ ID NO: 1037427 - protein, 20 aa, Mycobacterium
QQIDWSRVHLFWGDERYVPK

SEQ ID NO: 1037428 - protein, 20 aa, Mycobacterium
QQIRSAVAVFTANVSPAGPH

SEQ ID NO: 1037429 - protein, 23 aa, Mycobacterium
QQPRILGLAANWATSRSIFILIL

SEQ ID NO: 1037430 - protein, 22 aa, Mycobacterium
QQQRLCIARAIAVQPDVLLMDE

SEQ ID NO: 1037431 - protein, 23 aa, Mycobacterium
QQRAWLNLVQPLTIIEGFALLSV

SEQ ID NO: 1037432 - protein, 23 aa, Mycobacterium
QQRLWPTEEFELARSRVPTRLPE

SEQ ID NO: 1037433 - protein, 18 aa, Mycobacterium
QQRSVAIAAVRYEVNTLR

SEQ ID NO: 1037434 - protein, 22 aa, Mycobacterium
QQRVSLEAGQSWSTTATGPTEV

SEQ ID NO: 1037435 - protein, 26 aa, Mycobacterium
QQSWPTVAEWVCWLAANANKPANIHI

SEQ ID NO: 1037436 - protein, 24 aa, Mycobacterium
QQVMDRLMGWVAFTPLQNVTGEPA

SEQ ID NO: 1037437 - protein, 18 aa, Mycobacterium
QQVTRLARDFPLYGGLED

SEQ ID NO: 1037438 - protein, 18 aa, Mycobacterium
QRALVRMLREAGAVELHV

SEQ ID NO: 1037439 - protein, 18 aa, Mycobacterium
QRATGEFHRGVARTTRCP

SEQ ID NO: 1037440 - protein, 28 aa, Mycobacterium
QRCAAAGLMLRIPGPRFCTDNGAMIAAF

SEQ ID NO: 1037441 - protein, 23 aa, Mycobacterium
QRDLRLLVADMVFDLPVVGEAVR

SEQ ID NO: 1037442 - protein, 20 aa, Mycobacterium
QRDRFLFKINVGYPSPEEER

SEQ ID NO: 1037443 - protein, 25 aa, Mycobacterium
QRENLNWSAPRLHLVDLQYSDVRLD

SEQ ID NO: 1037444 - protein, 28 aa, Mycobacterium
QRFAGMLVAGAFLREFVADGVDWAHIDI

SEQ ID NO: 1037445 - protein, 17 aa, Mycobacterium
QRFDGIGGVGEHNFLLP

SEQ ID NO: 1037446 - protein, 26 aa, Mycobacterium
QRFNSRFPDTFVVPDMFIPKMAAKIY

SEQ ID NO: 1037447 - protein, 19 aa, Mycobacterium
QRFSPNMFRPIPGTPEYSI

SEQ ID NO: 1037448 - protein, 20 aa, Mycobacterium
QRGGAAGAFGRPGGAPRRGR

SEQ ID NO: 1037449 - protein, 27 aa, Mycobacterium
QRGQEGMAVYRVFEALDELGAIVEEAR

SEQ ID NO: 1037450 - protein, 20 aa, Mycobacterium
QRILAGWSEQQRYFVKVMPK

SEQ ID NO: 1037451 - protein, 25 aa, Mycobacterium
QRLFGGSCLCVDCGASARSQKIKLN

SEQ ID NO: 1037452 - protein, 17 aa, Mycobacterium
QRLKEILREVVPPDAGV

SEQ ID NO: 1037453 - protein, 18 aa, Mycobacterium
QRMLGVVCNPTFTDADRI

SEQ ID NO: 1037454 - protein, 17 aa, Mycobacterium
QRMSKLLSGRLWESTGS

SEQ ID NO: 1037455 - protein, 19 aa, Mycobacterium
QRPMRVNTFGLKEIADRVG

SEQ ID NO: 1037456 - protein, 23 aa, Mycobacterium
QRQLEMRLNRQLADIEKLQLNLR

SEQ ID NO: 1037457 - protein, 18 aa, Mycobacterium
QRRKPICMPGLQDVAERL

SEQ ID NO: 1037458 - protein, 22 aa, Mycobacterium
QRRSAQALRNWVSREQRTLVQL

SEQ ID NO: 1037459 - protein, 20 aa, Mycobacterium
QRSSNFMLWQAAYTEYIFQD

SEQ ID NO: 1037460 - protein, 19 aa, Mycobacterium
QRTLGGWLLADLMTVDGSV

SEQ ID NO: 1037461 - protein, 21 aa, Mycobacterium
QRTWCAGDFEPLGRRAQFAAV

SEQ ID NO: 1037462 - protein, 25 aa, Mycobacterium
QRVADRLRALLGIIVDGEAGLSKRI

SEQ ID NO: 1037463 - protein, 19 aa, Mycobacterium
QRVPNNLAELGRLTQLPDT

SEQ ID NO: 1037464 - protein, 21 aa, Mycobacterium
QRVREGLLNIGRKLNIPPLAT

SEQ ID NO: 1037465 - protein, 18 aa, Mycobacterium
QRVTVYFYPAALTPGCTK

SEQ ID NO: 1037466 - protein, 25 aa, Mycobacterium
QRYVDLIVCPQVRIVAHQRIAVIRA

SEQ ID NO: 1037467 - protein, 25 aa, Mycobacterium
QSDGVGFDWSAWVTALGNTPESVTE

SEQ ID NO: 1037468 - protein, 20 aa, Mycobacterium
QSGGGRCIVVFQPHLYSRTK

SEQ ID NO: 1037469 - protein, 23 aa, Mycobacterium
QSHLSIARLAWVFWTRDVGGEYG

SEQ ID NO: 1037470 - protein, 26 aa, Mycobacterium
QSLTDWIGVISMPFGVPATPTTMRCY

SEQ ID NO: 1037471 - protein, 22 aa, Mycobacterium
QSNYGPWKWDGVRRAGVSSFGV

SEQ ID NO: 1037472 - protein, 25 aa, Mycobacterium
QSRPSHPARRGLPRHHVPSDTRLHQ

SEQ ID NO: 1037473 - protein, 25 aa, Mycobacterium
QSYGSRCVRPPILYGDVSRPHPMTI

SEQ ID NO: 1037474 - protein, 24 aa, Mycobacterium
QTAKREARLLSRFTGANPHVPVIG

SEQ ID NO: 1037475 - protein, 17 aa, Mycobacterium
QTFATLVGLELRPRKLR

SEQ ID NO: 1037476 - protein, 17 aa, Mycobacterium
QTGIRLGVENIWAANGS

SEQ ID NO: 1037477 - protein, 26 aa, Mycobacterium
QTGPLPTLRITAAVPTRANYRVWISN

SEQ ID NO: 1037478 - protein, 19 aa, Mycobacterium
QTGVFSLDARQWFQSFPAV

SEQ ID NO: 1037479 - protein, 18 aa, Mycobacterium
QTKTGRLSLVLNGMLTQI

SEQ ID NO: 1037480 - protein, 20 aa, Mycobacterium
QTLLRYNRPYSCYAPIMETP

SEQ ID NO: 1037481 - protein, 24 aa, Mycobacterium
QTPTLLFPFAAPRVIGDLSEAGAR

SEQ ID NO: 1037482 - protein, 18 aa, Mycobacterium
QTRSMALVTYRPEYHGAL

SEQ ID NO: 1037483 - protein, 23 aa, Mycobacterium
QTSRRPPLSVVRITVQEVFTALI

SEQ ID NO: 1037484 - protein, 42 aa, Mycobacterium
QTVFGGTVGEMFGRKVARLMEWCAMAGCPIVGINDSGGARIQ

SEQ ID NO: 1037485 - protein, 20 aa, Mycobacterium
QVCIIPGIAAVAGITQMDEP

SEQ ID NO: 1037486 - protein, 26 aa, Mycobacterium
QVDTDLRWRIVTALATAGTLDANGPQ

SEQ ID NO: 1037487 - protein, 22 aa, Mycobacterium
QVFRLWLDAVGISYDLHRYLDG

SEQ ID NO: 1037488 - protein, 24 aa, Mycobacterium
QVIDPRLAMAVAARVLLVLGKLLQ

SEQ ID NO: 1037489 - protein, 23 aa, Mycobacterium
QVIEAVHLFRARVIDVSLESLTV

SEQ ID NO: 1037490 - protein, 19 aa, Mycobacterium
QVIMLGRPTLHRPVSALLA

SEQ ID NO: 1037491 - protein, 17 aa, Mycobacterium
QVLLAQMAYMLPRLRGW

SEQ ID NO: 1037492 - protein, 20 aa, Mycobacterium
QVRLRLAGRLIDRIDGDLVL

SEQ ID NO: 1037493 - protein, 19 aa, Mycobacterium
QVRMEFGDGILRLSAGADD

SEQ ID NO: 1037494 - protein, 37 aa, Mycobacterium
QVRPPADIEARWFGANGWRPGDPWIADTTLGRVMFNE

SEQ ID NO: 1037495 - protein, 23 aa, Mycobacterium
QVSRLKSSVAMELVRKQRGLMVA

SEQ ID NO: 1037496 - protein, 25 aa, Mycobacterium
QVVLSVPVSNGWIDIPFTLPTNTVD

SEQ ID NO: 1037497 - protein, 18 aa, Mycobacterium
QWVLSFTLSYNYYEIVAA

SEQ ID NO: 1037498 - protein, 25 aa, Mycobacterium
RAADLPPAVGVLVEYGAGTDAANST

SEQ ID NO: 1037499 - protein, 25 aa, Mycobacterium
RAAEHPRPDYVLLHISDTHLISDGS

SEQ ID NO: 1037500 - protein, 20 aa, Mycobacterium
RAAGRSGARIALIVDDCAIK

SEQ ID NO: 1037501 - protein, 19 aa, Mycobacterium
RAAHHISLCAQCAAEVDDQ

SEQ ID NO: 1037502 - protein, 28 aa, Mycobacterium
RAALKAIPMQRLWVNPDCGLKTRSVDEV

SEQ ID NO: 1037503 - protein, 30 aa, Mycobacterium
RAASSVKDKYKWSYRTWAKQVTRVLVAIEN

SEQ ID NO: 1037504 - protein, 21 aa, Mycobacterium
RAAVDSGYYPGQFQIGQTGKT

SEQ ID NO: 1037505 - protein, 18 aa, Mycobacterium
RACSPVWSSVALHRPAEF

SEQ ID NO: 1037506 - protein, 20 aa, Mycobacterium
RADIPFLFIRNHKNRPVLAI

SEQ ID NO: 1037507 - protein, 24 aa, Mycobacterium
RADLCSPRLALSPSRAADFKQCPL

SEQ ID NO: 1037508 - protein, 19 aa, Mycobacterium
RAEITAGRFSIDPFDDTLV

SEQ ID NO: 1037509 - protein, 17 aa, Mycobacterium
RAELKDRLKRGGTNLTQ

SEQ ID NO: 1037510 - protein, 24 aa, Mycobacterium
RAELKEYTYELLFELYDNEVEYTQ

SEQ ID NO: 1037511 - protein, 24 aa, Mycobacterium
RAEPWGVWGGEIFDRGLIVSRKRP

SEQ ID NO: 1037512 - protein, 21 aa, Mycobacterium
RAESVQQIWFGLSTLVERVSA

SEQ ID NO: 1037513 - protein, 23 aa, Mycobacterium
RAFPASWFIGIDFSNEAVAIHTA

SEQ ID NO: 1037514 - protein, 21 aa, Mycobacterium
RAGDSRLVAVLAALDDADTRA

SEQ ID NO: 1037515 - protein, 19 aa, Mycobacterium
RAGEQHVVFSASGRTLTFP

SEQ ID NO: 1037516 - protein, 18 aa, Mycobacterium
RAGIVARVLLGGLCGSGG

SEQ ID NO: 1037517 - protein, 25 aa, Mycobacterium
RAGTGFLAQLCQDWEGATLPAQYAG

SEQ ID NO: 1037518 - protein, 17 aa, Mycobacterium
RAHGHRWYGPAFLLNDM

SEQ ID NO: 1037519 - protein, 23 aa, Mycobacterium
RAHVTRRLDAMAAPRELHIVDTL

SEQ ID NO: 1037520 - protein, 26 aa, Mycobacterium
RAHWARGRLSRVWTCRCGHQRVRSQW

SEQ ID NO: 1037521 - protein, 19 aa, Mycobacterium
RAISELVAIVASGHPLTPE

SEQ ID NO: 1037522 - protein, 18 aa, Mycobacterium
RAKLHPEMLVATHRVAKQ

SEQ ID NO: 1037523 - protein, 20 aa, Mycobacterium
RAKPAVPFGGAYRLVDFVLS

SEQ ID NO: 1037524 - protein, 26 aa, Mycobacterium
RAKVRGHRAWPILIRTGALVLSSAAT

SEQ ID NO: 1037525 - protein, 17 aa, Mycobacterium
RALAGMKGLVTNPKGEF

SEQ ID NO: 1037526 - protein, 27 aa, Mycobacterium
RALDLIEAPPWLQGALIAMLYGVVVVN

SEQ ID NO: 1037527 - protein, 24 aa, Mycobacterium
RALGPSEVWELFWTGFPADGLYRF

SEQ ID NO: 1037528 - protein, 24 aa, Mycobacterium
RALHEDLRYGLDITTQATVPAGTV

SEQ ID NO: 1037529 - protein, 17 aa, Mycobacterium
RALTGAGMLDCKSVLVE

SEQ ID NO: 1037530 - protein, 17 aa, Mycobacterium
RALVPRRDINGIMDELA

SEQ ID NO: 1037531 - protein, 20 aa, Mycobacterium
RAPALRWGMGSLQEIDHVPF

SEQ ID NO: 1037532 - protein, 18 aa, Mycobacterium
RAPIGGRIAVIVDDGIAT

SEQ ID NO: 1037533 - protein, 24 aa, Mycobacterium
RAQLEQMRHSALPPGMGKPGQAGG

SEQ ID NO: 1037534 - protein, 29 aa, Mycobacterium
RAQLKGSNLEFALGYSHPVVIEAPEGITF

SEQ ID NO: 1037535 - protein, 24 aa, Mycobacterium
RARAGEITAEMAFIADREGMPAEL

SEQ ID NO: 1037536 - protein, 22 aa, Mycobacterium
RARDAGAMAYLVKPFTISDLIP

SEQ ID NO: 1037537 - protein, 19 aa, Mycobacterium
RAREALMKTDIFGSKADME

SEQ ID NO: 1037538 - protein, 19 aa, Mycobacterium
RARMQLLHDEFAKHGQAGP

SEQ ID NO: 1037539 - protein, 27 aa, Mycobacterium
RARRLAKRICTIVASAIEFEIKDPGLD

SEQ ID NO: 1037540 - protein, 31 aa, Mycobacterium
RASDATACALDLQLAPIVPVRFRIALHTGEV

SEQ ID NO: 1037541 - protein, 20 aa, Mycobacterium
RASFMPKPFAQHPGSAMHTH

SEQ ID NO: 1037542 - protein, 19 aa, Mycobacterium
RATASVLGLVPVRELVQMQ

SEQ ID NO: 1037543 - protein, 20 aa, Mycobacterium
RATDDLLLIAGMRISQRSKL

SEQ ID NO: 1037544 - protein, 18 aa, Mycobacterium
RATHYFEMTSDAFFADET

SEQ ID NO: 1037545 - protein, 17 aa, Mycobacterium
RATLPRLGELAIGGTAV

SEQ ID NO: 1037546 - protein, 36 aa, Mycobacterium
RAVEKFDYTKGYKFSTYATWWIRQAITRAMADQART

SEQ ID NO: 1037547 - protein, 17 aa, Mycobacterium
RAYGDFLSYCLLAEGAI

SEQ ID NO: 1037548 - protein, 19 aa, Mycobacterium
RAYGGTFLQFSDYMRPSVR

SEQ ID NO: 1037549 - protein, 17 aa, Mycobacterium
RAYRAAGARVIAINADP

SEQ ID NO: 1037550 - protein, 24 aa, Mycobacterium
RAYRREVLEAIDLDSVASKGYCFQ

SEQ ID NO: 1037551 - protein, 18 aa, Mycobacterium
RCALRPVTGIDFAAVSPW

SEQ ID NO: 1037552 - protein, 22 aa, Mycobacterium
RCATPVKWARLDSAPFTDRLVS

SEQ ID NO: 1037553 - protein, 22 aa, Mycobacterium
RCEELRFAQFVTAYEDIVRRAR

SEQ ID NO: 1037554 - protein, 23 aa, Mycobacterium
RCGAPCWSSGPTMSRRSDLDGAD

SEQ ID NO: 1037555 - protein, 31 aa, Mycobacterium
RCGMVSPTVFWPIPRVYSGLVRVDRYATSPW

SEQ ID NO: 1037556 - protein, 17 aa, Mycobacterium
RCLVPMDGWYEWQVNVD

SEQ ID NO: 1037557 - protein, 19 aa, Mycobacterium
RCRHRGRRDPVRVGGSDGA

SEQ ID NO: 1037558 - protein, 23 aa, Mycobacterium
RCSGLGCCACAAGSRRIFDRGCS

SEQ ID NO: 1037559 - protein, 19 aa, Mycobacterium
RCTGWYRAEALAYRLLLEG

SEQ ID NO: 1037560 - protein, 17 aa, Mycobacterium
RCYLDCLAAYSAVNFSH

SEQ ID NO: 1037561 - protein, 23 aa, Mycobacterium
RDACQWFALRAIWCSDLDAAGHI

SEQ ID NO: 1037562 - protein, 18 aa, Mycobacterium
RDALQVMIERTRVVHADQ

SEQ ID NO: 1037563 - protein, 18 aa, Mycobacterium
RDALVIGARCHGHVPHNR

SEQ ID NO: 1037564 - protein, 21 aa, Mycobacterium
RDAYCRHIGVEYTHILDPEQQ

SEQ ID NO: 1037565 - protein, 25 aa, Mycobacterium
RDDACQALLCLGGIYDFGGPTADEL

SEQ ID NO: 1037566 - protein, 18 aa, Mycobacterium
RDDMASLRILPPHDYVAA

SEQ ID NO: 1037567 - protein, 18 aa, Mycobacterium
RDDPRGGEADLILAKHRN

SEQ ID NO: 1037568 - protein, 22 aa, Mycobacterium
RDDPRSWIAQPVMELSTVPTQV

SEQ ID NO: 1037569 - protein, 18 aa, Mycobacterium
RDELIAFYVASDVMLVTP

SEQ ID NO: 1037570 - protein, 22 aa, Mycobacterium
RDELWYGFKLKLMKWIKGTELV

SEQ ID NO: 1037571 - protein, 20 aa, Mycobacterium
RDFLLHPVMMDIALQTLGAT

SEQ ID NO: 1037572 - protein, 19 aa, Mycobacterium
RDGDGRYGGKGVKRAVDAV

SEQ ID NO: 1037573 - protein, 23 aa, Mycobacterium
RDGEAIGVLLTRMGAQDTRLVWE

SEQ ID NO: 1037574 - protein, 24 aa, Mycobacterium
RDHTRPDDVLGMLASQGVVTEVGG

SEQ ID NO: 1037575 - protein, 22 aa, Mycobacterium
RDICRRHDVLLIFDEIATGFGR

SEQ ID NO: 1037576 - protein, 24 aa, Mycobacterium
RDISAKKDEPEWMLQARLKALRVF

SEQ ID NO: 1037577 - protein, 23 aa, Mycobacterium
RDKRIPLELCPSSNLQTGAVASI

SEQ ID NO: 1037578 - protein, 17 aa, Mycobacterium
RDLICAELSAVTLTEQL

SEQ ID NO: 1037579 - protein, 18 aa, Mycobacterium
RDLIIGRAMADQIAGVVR

SEQ ID NO: 1037580 - protein, 20 aa, Mycobacterium
RDLQRVIGLETRRQIQYQAG

SEQ ID NO: 1037581 - protein, 24 aa, Mycobacterium
RDLTTRIYADFTYRSGSTTISTGV

SEQ ID NO: 1037582 - protein, 25 aa, Mycobacterium
RDLVLRRLTEVLARDRTRHQVSEVT

SEQ ID NO: 1037583 - protein, 25 aa, Mycobacterium
RDNRAVHALARIMLHGRISHIQTSW

SEQ ID NO: 1037584 - protein, 20 aa, Mycobacterium
RDPMAMLPFMGYHVGDYFQH

SEQ ID NO: 1037585 - protein, 17 aa, Mycobacterium
RDQKFRFYRTILAQDKL

SEQ ID NO: 1037586 - protein, 18 aa, Mycobacterium
RDQRDFTLWKGAKSGEPS

SEQ ID NO: 1037587 - protein, 18 aa, Mycobacterium
RDQWTLLSHRVIFHGRRV

SEQ ID NO: 1037588 - protein, 20 aa, Mycobacterium
RDRRPHLGILDVACQAVSSV

SEQ ID NO: 1037589 - protein, 17 aa, Mycobacterium
RDVKFVAAFDVDAKKVG

SEQ ID NO: 1037590 - protein, 30 aa, Mycobacterium
RDWCISRQLWWGHRIPIWYGPNGEQVCVGP

SEQ ID NO: 1037591 - protein, 18 aa, Mycobacterium
RDYLGTKIEFRLGDVNDT

SEQ ID NO: 1037592 - protein, 18 aa, Mycobacterium
REAALALLHLLAAATPPT

SEQ ID NO: 1037593 - protein, 18 aa, Mycobacterium
REAFAWHIDLAKRCGKPL

SEQ ID NO: 1037594 - protein, 22 aa, Mycobacterium
REAKKICLGCEVRHECLEYALA

SEQ ID NO: 1037595 - protein, 24 aa, Mycobacterium
REEFLAPVICAFGMTEATHQVTTT

SEQ ID NO: 1037596 - protein, 22 aa, Mycobacterium
REELPAQLIVRSIGYRGVPTPG

SEQ ID NO: 1037597 - protein, 21 aa, Mycobacterium
REESIRIATVAKREYEASLNR

SEQ ID NO: 1037598 - protein, 18 aa, Mycobacterium
REFSEFLSRQQLRVPNTP

SEQ ID NO: 1037599 - protein, 22 aa, Mycobacterium
REGARIALNPTQEWIDQLDRAT

SEQ ID NO: 1037600 - protein, 20 aa, Mycobacterium
REGFECGMTLGYSDIKEGDV

SEQ ID NO: 1037601 - protein, 17 aa, Mycobacterium
REGVCQDFARLAIACLR

SEQ ID NO: 1037602 - protein, 21 aa, Mycobacterium
REGVGVFGFHLCGLDMRQNSD

SEQ ID NO: 1037603 - protein, 27 aa, Mycobacterium
REHDILAFERQWWKFAGVKEEAIKELF

SEQ ID NO: 1037604 - protein, 23 aa, Mycobacterium
REIAMTMGMDGAWGQWVNRWTAE

SEQ ID NO: 1037605 - protein, 25 aa, Mycobacterium
REIEFPDRGVILVCGANEIGKSSMI

SEQ ID NO: 1037606 - protein, 19 aa, Mycobacterium
REIGATIIYNVITSRAVPE

SEQ ID NO: 1037607 - protein, 17 aa, Mycobacterium
REIKLDLDEGADIIMIK

SEQ ID NO: 1037608 - protein, 20 aa, Mycobacterium
REISEIGCQIWIEKVRCNSW

SEQ ID NO: 1037609 - protein, 23 aa, Mycobacterium
RELKLGSGGLRDVEFAVQLLQLV

SEQ ID NO: 1037610 - protein, 19 aa, Mycobacterium
RELLTKRGRAFDDILATRD

SEQ ID NO: 1037611 - protein, 20 aa, Mycobacterium
RELRSVGAVFGLLDVDDEFF

SEQ ID NO: 1037612 - protein, 19 aa, Mycobacterium
RELTGGRRSFILVPGIDVP

SEQ ID NO: 1037613 - protein, 19 aa, Mycobacterium
RELVGEGTLFLLKVTGDSM

SEQ ID NO: 1037614 - protein, 20 aa, Mycobacterium
RELVSPGLVKRADVVVGGQR

SEQ ID NO: 1037615 - protein, 27 aa, Mycobacterium
REMALQVAEAFSCYGAHLPQINNVLPD

SEQ ID NO: 1037616 - protein, 17 aa, Mycobacterium
REMLARIEVPYRVIDVA

SEQ ID NO: 1037617 - protein, 25 aa, Mycobacterium
REMLFPLICRYALAYHVVFIPSVEV

SEQ ID NO: 1037618 - protein, 17 aa, Mycobacterium
REPFHPCRPANTSDTGQ

SEQ ID NO: 1037619 - protein, 17 aa, Mycobacterium
REPHSWDLCVDHAARIT

SEQ ID NO: 1037620 - protein, 23 aa, Mycobacterium
REPKPMVYSGLYPVDSSDYPSLR

SEQ ID NO: 1037621 - protein, 19 aa, Mycobacterium
REQALRFGAELRTEDVESV

SEQ ID NO: 1037622 - protein, 28 aa, Mycobacterium
RERDRMAFCSAVYWDIVAKLDASVSDPT

SEQ ID NO: 1037623 - protein, 35 aa, Mycobacterium
RERPSEMARRVLIELLAWQFASPVRWIETQDLLFT

SEQ ID NO: 1037624 - protein, 32 aa, Mycobacterium
RERRSDQQLGFTARRAAVLAAVVCVLTLTIAG

SEQ ID NO: 1037625 - protein, 17 aa, Mycobacterium
RERYSMLAACFEPEVAC

SEQ ID NO: 1037626 - protein, 21 aa, Mycobacterium
RESLPRISLDSLPAQGEWCAP

SEQ ID NO: 1037627 - protein, 26 aa, Mycobacterium
RESVDLIKLGGYRIGAGEIEMALLGH

SEQ ID NO: 1037628 - protein, 28 aa, Mycobacterium
RETDKPFLMPVEDVFTITGRGTVVTGRV

SEQ ID NO: 1037629 - protein, 20 aa, Mycobacterium
RETPHVPIPYVYPVDLRYVL

SEQ ID NO: 1037630 - protein, 18 aa, Mycobacterium
REVCRRTAAAANCRLVET

SEQ ID NO: 1037631 - protein, 20 aa, Mycobacterium
REVHHMAALIGFGAAAVNPY

SEQ ID NO: 1037632 - protein, 18 aa, Mycobacterium
REVLFCPDQFLGAHVRRV

SEQ ID NO: 1037633 - protein, 28 aa, Mycobacterium
REVLNAGIPLFGICFGNQILGRALGLST

SEQ ID NO: 1037634 - protein, 20 aa, Mycobacterium
REVLPRDVIEPERQPESPVP

SEQ ID NO: 1037635 - protein, 22 aa, Mycobacterium
REVTGVPILFATTGEKLDDFDV

SEQ ID NO: 1037636 - protein, 17 aa, Mycobacterium
RFAQSWDSVGLVCGDPE

SEQ ID NO: 1037637 - protein, 25 aa, Mycobacterium
RFDEQANIRWARALEHAGVHVVYGI

SEQ ID NO: 1037638 - protein, 19 aa, Mycobacterium
RFETGRLALQAAGAVVAYL

SEQ ID NO: 1037639 - protein, 22 aa, Mycobacterium
RFFAAPGSWTLRALSSVGNGDA

SEQ ID NO: 1037640 - protein, 21 aa, Mycobacterium
RFGGDEFVALILGKITHTELS

SEQ ID NO: 1037641 - protein, 21 aa, Mycobacterium
RFGSDLLASLGIDLSVDELID

SEQ ID NO: 1037642 - protein, 18 aa, Mycobacterium
RFHVVPVLAYSADPGPVA

SEQ ID NO: 1037643 - protein, 27 aa, Mycobacterium
RFIRFCDAFNIPLVFVVDTPGFLPGVE

SEQ ID NO: 1037644 - protein, 19 aa, Mycobacterium
RFMLTDPLFGFGPRVAQVV

SEQ ID NO: 1037645 - protein, 29 aa, Mycobacterium
RFNELVMRARLTWQQVVLLRAYAKYLRQA

SEQ ID NO: 1037646 - protein, 18 aa, Mycobacterium
RFNSAEGVHNYFKNHYGP

SEQ ID NO: 1037647 - protein, 19 aa, Mycobacterium
RFPTRTRSLAVFFSSNNRP

SEQ ID NO: 1037648 - protein, 17 aa, Mycobacterium
RFRSHPDLDLLTHGLTL

SEQ ID NO: 1037649 - protein, 26 aa, Mycobacterium
RFRSMCEARGLPAMRIGVVDQGSDSI

SEQ ID NO: 1037650 - protein, 21 aa, Mycobacterium
RFVGGVLACCGLAEYELTGAD

SEQ ID NO: 1037651 - protein, 19 aa, Mycobacterium
RFVLAQARLTAYARELGDE

SEQ ID NO: 1037652 - protein, 24 aa, Mycobacterium
RFVSLQCRLLLSIAQLWQGDMDGA

SEQ ID NO: 1037653 - protein, 20 aa, Mycobacterium
RFYDSCRVLPQGDEKPTDLH

SEQ ID NO: 1037654 - protein, 19 aa, Mycobacterium
RFYFLTGRGALLQLGLLQL

SEQ ID NO: 1037655 - protein, 18 aa, Mycobacterium
RGAELGWADDIIAASERQ

SEQ ID NO: 1037656 - protein, 31 aa, Mycobacterium
RGAVREFLRTGTPKTGFIVGIDRPSDGTRVW

SEQ ID NO: 1037657 - protein, 28 aa, Mycobacterium
RGDLALKMGLPVFAVVAFAQSFGDGVHT

SEQ ID NO: 1037658 - protein, 23 aa, Mycobacterium
RGDQTMFRKAFESVVSGHVKVLI

SEQ ID NO: 1037659 - protein, 20 aa, Mycobacterium
RGDSVIYWQVPKGGTLNSTI

SEQ ID NO: 1037660 - protein, 25 aa, Mycobacterium
RGDVEPFAALGLELQRRGHEVRIGV

SEQ ID NO: 1037661 - protein, 17 aa, Mycobacterium
RGDVLELIDDIKDAIPG

SEQ ID NO: 1037662 - protein, 21 aa, Mycobacterium
RGEGGKFLWPGFGENSRVLKW

SEQ ID NO: 1037663 - protein, 19 aa, Mycobacterium
RGENFAFLGGRDWDPSQAT

SEQ ID NO: 1037664 - protein, 25 aa, Mycobacterium
RGERGPTCSTIFCLTIGAWMCQSSQ

SEQ ID NO: 1037665 - protein, 24 aa, Mycobacterium
RGFDEYRAMFALSAMDLNATILDC

SEQ ID NO: 1037666 - protein, 19 aa, Mycobacterium
RGFFTSRVIGTFVNEALAM

SEQ ID NO: 1037667 - protein, 21 aa, Mycobacterium
RGFYAGAVGWCDARGDGHWVV

SEQ ID NO: 1037668 - protein, 25 aa, Mycobacterium
RGGKISFTHLLGYALVQAVKKFPNI

SEQ ID NO: 1037669 - protein, 25 aa, Mycobacterium
RGGPERRYTVVYAREHGARLLVRLA

SEQ ID NO: 1037670 - protein, 22 aa, Mycobacterium
RGGPGLLLRARHAVFDRLVYRK

SEQ ID NO: 1037671 - protein, 19 aa, Mycobacterium
RGGRVRGQRGWIVEKSDDP

SEQ ID NO: 1037672 - protein, 19 aa, Mycobacterium
RGGVGLSLGQQQRLGLARA

SEQ ID NO: 1037673 - protein, 20 aa, Mycobacterium
RGHLPIAIDAGVTFGVGAQI

SEQ ID NO: 1037674 - protein, 19 aa, Mycobacterium
RGIGVVGLLNVQYALKEDV

SEQ ID NO: 1037675 - protein, 20 aa, Mycobacterium
RGIIDVALFAIAQVVEPTEW

SEQ ID NO: 1037676 - protein, 23 aa, Mycobacterium
RGITVNAIACGRSVQAGYEGLSR

SEQ ID NO: 1037677 - protein, 30 aa, Mycobacterium
RGLDALARAGFRTLALQTFLTVGPKEVRAW

SEQ ID NO: 1037678 - protein, 18 aa, Mycobacterium
RGLGEAMAGIDVEQIAQP

SEQ ID NO: 1037679 - protein, 17 aa, Mycobacterium
RGLVDCVVEVATLDHGL

SEQ ID NO: 1037680 - protein, 20 aa, Mycobacterium
RGNDTGVVVWEFGSASAGAQ

SEQ ID NO: 1037681 - protein, 18 aa, Mycobacterium
RGNRLLSVVIARIGSGPT

SEQ ID NO: 1037682 - protein, 18 aa, Mycobacterium
RGPLQTAFTTLELRELAD

SEQ ID NO: 1037683 - protein, 26 aa, Mycobacterium
RGPNAGSRFLLDQAITSAGRHPDSDI

SEQ ID NO: 1037684 - protein, 17 aa, Mycobacterium
RGPQVPFTDVFLHGLIR

SEQ ID NO: 1037685 - protein, 18 aa, Mycobacterium
RGPSKFRMELLALPQDEW

SEQ ID NO: 1037686 - protein, 20 aa, Mycobacterium
RGPVATVLVQRGTLRIGDSV

SEQ ID NO: 1037687 - protein, 18 aa, Mycobacterium
RGRIKELINRSGEKISPE

SEQ ID NO: 1037688 - protein, 21 aa, Mycobacterium
RGRNGVLYAGEVNWEAAGLGG

SEQ ID NO: 1037689 - protein, 19 aa, Mycobacterium
RGRVASRRRAGYRVDGSRQ

SEQ ID NO: 1037690 - protein, 28 aa, Mycobacterium
RGRVQSVLLPRLLNWMSYAPDPDGGLLA

SEQ ID NO: 1037691 - protein, 25 aa, Mycobacterium
RGSAKRITAVIPFYPYARQDKKHRG

SEQ ID NO: 1037692 - protein, 19 aa, Mycobacterium
RGSGYGVAALCGAGGQGDA

SEQ ID NO: 1037693 - protein, 20 aa, Mycobacterium
RGTGEPVVFIAGRGGAGRTW

SEQ ID NO: 1037694 - protein, 27 aa, Mycobacterium
RGTGHAVFCGLSALPDDYGGIVVVTSG

SEQ ID NO: 1037695 - protein, 17 aa, Mycobacterium
RGVAVSIEITEIGVHGE

SEQ ID NO: 1037696 - protein, 18 aa, Mycobacterium
RGVCKHYGSILAVSNLDL

SEQ ID NO: 1037697 - protein, 21 aa, Mycobacterium
RGVEVEALLAVRTAEERVNAV

SEQ ID NO: 1037698 - protein, 26 aa, Mycobacterium
RGVGRRLLGELLDFAGSGAIYLEVRT

SEQ ID NO: 1037699 - protein, 17 aa, Mycobacterium
RGVLEPLGLTAEKPVGS

SEQ ID NO: 1037700 - protein, 17 aa, Mycobacterium
RGVLSVRAKIKVQLTQV

SEQ ID NO: 1037701 - protein, 20 aa, Mycobacterium
RGVRALEAFGRTEVATELQD

SEQ ID NO: 1037702 - protein, 26 aa, Mycobacterium
RGVSACATCDGSFFRGQDIAVIGGGD

SEQ ID NO: 1037703 - protein, 20 aa, Mycobacterium
RGWHDARVIPYGPIQLDPSA

SEQ ID NO: 1037704 - protein, 17 aa, Mycobacterium
RGYGWSATMRRTIEKYE

SEQ ID NO: 1037705 - protein, 18 aa, Mycobacterium
RHAGRPAGVRRLGGRDGQ

SEQ ID NO: 1037706 - protein, 17 aa, Mycobacterium
RHAKFGTVVARDRIQAV

SEQ ID NO: 1037707 - protein, 18 aa, Mycobacterium
RHARVFLDSVLPALGEEG

SEQ ID NO: 1037708 - protein, 26 aa, Mycobacterium
RHDLRIAVLDCDWGVGIIRKGSPESP

SEQ ID NO: 1037709 - protein, 18 aa, Mycobacterium
RHELLSGIVPQISIVLGK

SEQ ID NO: 1037710 - protein, 21 aa, Mycobacterium
RHGNECIPIGTSLIAETSRAT

SEQ ID NO: 1037711 - protein, 18 aa, Mycobacterium
RHGPVTIYGVDKFPRMVD

SEQ ID NO: 1037712 - protein, 27 aa, Mycobacterium
RHHPTDAFHLLDCLRVESGVDIFFESG

SEQ ID NO: 1037713 - protein, 17 aa, Mycobacterium
RHLAFAVGSHFCLGAAL

SEQ ID NO: 1037714 - protein, 20 aa, Mycobacterium
RHLEIRWDGQVALLSDLNST

SEQ ID NO: 1037715 - protein, 17 aa, Mycobacterium
RHNVGFMVANLLAVRLG

SEQ ID NO: 1037716 - protein, 17 aa, Mycobacterium
RHQFPLVTTDTVVQFLA

SEQ ID NO: 1037717 - protein, 19 aa, Mycobacterium
RHQLAVPPAFCITTEVGVR

SEQ ID NO: 1037718 - protein, 18 aa, Mycobacterium
RHRAEVVAVADGIRYVDD

SEQ ID NO: 1037719 - protein, 26 aa, Mycobacterium
RHRVGPEGFRFTLEWVSNDVAANQLV

SEQ ID NO: 1037720 - protein, 32 aa, Mycobacterium
RHSGWWRAPLRWMLRGSLVVRSRLMVRSSRRK

SEQ ID NO: 1037721 - protein, 18 aa, Mycobacterium
RHSVIAWQVLCSSLRSEA

SEQ ID NO: 1037722 - protein, 17 aa, Mycobacterium
RHTILIDIDKAYVEYIR

SEQ ID NO: 1037723 - protein, 19 aa, Mycobacterium
RHVGHWRFFTLHWQVDNGR

SEQ ID NO: 1037724 - protein, 18 aa, Mycobacterium
RIAAAAAVRARFGDRAPI

SEQ ID NO: 1037725 - protein, 25 aa, Mycobacterium
RIAEAMAASVFEFMSRVYQQFPRCH

SEQ ID NO: 1037726 - protein, 17 aa, Mycobacterium
RIAEMERAQSFVFRLQR

SEQ ID NO: 1037727 - protein, 20 aa, Mycobacterium
RIAIPELPDELFIDSLCQLI

SEQ ID NO: 1037728 - protein, 18 aa, Mycobacterium
RIAIQIPAAAHCALEYQR

SEQ ID NO: 1037729 - protein, 19 aa, Mycobacterium
RIALSMAVYYIAVKCACPF

SEQ ID NO: 1037730 - protein, 22 aa, Mycobacterium
RIAVDLPDRIAGVVYNQGATTK

SEQ ID NO: 1037731 - protein, 17 aa, Mycobacterium
RIAVDRANIAAAVCNQI

SEQ ID NO: 1037732 - protein, 25 aa, Mycobacterium
RIAVPGCYPTAILLALLPAMAEGLI

SEQ ID NO: 1037733 - protein, 20 aa, Mycobacterium
RIDDAFTCWMYSKGDRLEHN

SEQ ID NO: 1037734 - protein, 24 aa, Mycobacterium
RIDGDGWVTYGCRADDTEIVGGVN

SEQ ID NO: 1037735 - protein, 21 aa, Mycobacterium
RIDHWWYRNGRFGVGSSRGGP

SEQ ID NO: 1037736 - protein, 18 aa, Mycobacterium
RIELQRMGAGSTPGPKAL

SEQ ID NO: 1037737 - protein, 17 aa, Mycobacterium
RIFAHGFLHNHGEKMSK

SEQ ID NO: 1037738 - protein, 23 aa, Mycobacterium
RIGRLAVRLDVSRLVVVGGGRSI

SEQ ID NO: 1037739 - protein, 25 aa, Mycobacterium
RIIARMLAVMIRRRMQEAGMDAGGV

SEQ ID NO: 1037740 - protein, 22 aa, Mycobacterium
RIIKERRPATQFVAVEPAASPV

SEQ ID NO: 1037741 - protein, 21 aa, Mycobacterium
RILAIRWWIPSGVELDTGTRA

SEQ ID NO: 1037742 - protein, 21 aa, Mycobacterium
RILRVRGRGVPKRSGGHGDLL

SEQ ID NO: 1037743 - protein, 20 aa, Mycobacterium
RILTAMSVFFFSFVDAPNHL

SEQ ID NO: 1037744 - protein, 18 aa, Mycobacterium
RINEGAAMIRSKGEAGTG

SEQ ID NO: 1037745 - protein, 19 aa, Mycobacterium
RINFRDDMMLPSYGLAEGT

SEQ ID NO: 1037746 - protein, 25 aa, Mycobacterium
RINVELPLWLQRVLTNVPGLRALLR

SEQ ID NO: 1037747 - protein, 17 aa, Mycobacterium
RIQGSLDRVGTRTPGKR

SEQ ID NO: 1037748 - protein, 18 aa, Mycobacterium
RIQRCNGCPSSLEENFVR

SEQ ID NO: 1037749 - protein, 20 aa, Mycobacterium
RIRRDKRARLLAEGRDPYPV

SEQ ID NO: 1037750 - protein, 24 aa, Mycobacterium
RISEQSIRHALDIGKTRDWMHALF

SEQ ID NO: 1037751 - protein, 25 aa, Mycobacterium
RISHWLWNRRARLAARAFAELTRIL

SEQ ID NO: 1037752 - protein, 17 aa, Mycobacterium
RITDWTALIAQAHSRGA

SEQ ID NO: 1037753 - protein, 17 aa, Mycobacterium
RITGVAYQGYLPDNAAS

SEQ ID NO: 1037754 - protein, 28 aa, Mycobacterium
RITKNSKVSTVWTWPDKPGVAGCAAMDG

SEQ ID NO: 1037755 - protein, 23 aa, Mycobacterium
RITTDLRAMGWRVAPNTVAAMMC

SEQ ID NO: 1037756 - protein, 25 aa, Mycobacterium
RIVVLGDAWDLLKFLNDDEYSIDSK

SEQ ID NO: 1037757 - protein, 18 aa, Mycobacterium
RIYSKLGLTSRVQLVQEA

SEQ ID NO: 1037758 - protein, 18 aa, Mycobacterium
RKALDAGYNLDRILTTED

SEQ ID NO: 1037759 - protein, 17 aa, Mycobacterium
RKARRVIDLVRGRSVAD

SEQ ID NO: 1037760 - protein, 25 aa, Mycobacterium
RKDMLCINLLWAGRCLVVPEDIGRH

SEQ ID NO: 1037761 - protein, 22 aa, Mycobacterium
RKDTHVHAWALRMSPDGNVWGA

SEQ ID NO: 1037762 - protein, 18 aa, Mycobacterium
RKEKALRKLDAMSANLAR

SEQ ID NO: 1037763 - protein, 18 aa, Mycobacterium
RKFFDRSLIGRVPLIGGG

SEQ ID NO: 1037764 - protein, 18 aa, Mycobacterium
RKGIARGRSVVALAYAGG

SEQ ID NO: 1037765 - protein, 20 aa, Mycobacterium
RKHSEIMGAISQQRTVLEGR

SEQ ID NO: 1037766 - protein, 18 aa, Mycobacterium
RKIFDLLEHAPIDVAVLT

SEQ ID NO: 1037767 - protein, 20 aa, Mycobacterium
RKILTDAGIEICYDKPSHSQ

SEQ ID NO: 1037768 - protein, 19 aa, Mycobacterium
RKLPAKARKAILEGSDHQV

SEQ ID NO: 1037769 - protein, 28 aa, Mycobacterium
RKLTGDLARLPLRVWRAVRETRAVFEVV

SEQ ID NO: 1037770 - protein, 21 aa, Mycobacterium
RKMLASMAFQHIAEYEIAVAS

SEQ ID NO: 1037771 - protein, 19 aa, Mycobacterium
RKNVYVWMGECHVHAGING

SEQ ID NO: 1037772 - protein, 21 aa, Mycobacterium
RKPACGVCVLAKDCPSFGLGP

SEQ ID NO: 1037773 - protein, 20 aa, Mycobacterium
RKPMPRWGSNLDGIDFDNIK

SEQ ID NO: 1037774 - protein, 17 aa, Mycobacterium
RKRFNKKCETALTVLAP

SEQ ID NO: 1037775 - protein, 27 aa, Mycobacterium
RKRIVRRLLTAAGFPVEMLVRTDIGAV

SEQ ID NO: 1037776 - protein, 20 aa, Mycobacterium
RKSEGIAVFRFFRGPMPVPN

SEQ ID NO: 1037777 - protein, 17 aa, Mycobacterium
RKSGCTLTIRLLERTEI

SEQ ID NO: 1037778 - protein, 28 aa, Mycobacterium
RKSRIRSGVQAFRVYWETALPNQQTPNQ

SEQ ID NO: 1037779 - protein, 25 aa, Mycobacterium
RKSRSEMAYCFPAVPMVARAPAADL

SEQ ID NO: 1037780 - protein, 22 aa, Mycobacterium
RKVRFLPYGIAVSVLDSHQEST

SEQ ID NO: 1037781 - protein, 24 aa, Mycobacterium
RKVVVFRPLYAVGGQELGYLPGSE

SEQ ID NO: 1037782 - protein, 26 aa, Mycobacterium
RLAAAKTRLGPVFSTRTRENVVLAML

SEQ ID NO: 1037783 - protein, 24 aa, Mycobacterium
RLAADGRLPLDRAALDAALADKKA

SEQ ID NO: 1037784 - protein, 21 aa, Mycobacterium
RLADSCAHALLDAIARVPEIS

SEQ ID NO: 1037785 - protein, 25 aa, Mycobacterium
RLANALRSWSVLRFEVTEDPSPGVD

SEQ ID NO: 1037786 - protein, 22 aa, Mycobacterium
RLARRIDSMFGQGLVDEVRMLL

SEQ ID NO: 1037787 - protein, 18 aa, Mycobacterium
RLAVLPCTVWLRNNPVRL

SEQ ID NO: 1037788 - protein, 26 aa, Mycobacterium
RLCAVAETMDGFALADLDLKERREGD

SEQ ID NO: 1037789 - protein, 18 aa, Mycobacterium
RLCRELSLLDLVLANGGR

SEQ ID NO: 1037790 - protein, 17 aa, Mycobacterium
RLDAELVGNISIRVVDI

SEQ ID NO: 1037791 - protein, 19 aa, Mycobacterium
RLDDLPVLYELAAEERAAA

SEQ ID NO: 1037792 - protein, 18 aa, Mycobacterium
RLDGAVIFDGAKVEAGSV

SEQ ID NO: 1037793 - protein, 19 aa, Mycobacterium
RLDGVKSLVPAAASAELFI

SEQ ID NO: 1037794 - protein, 18 aa, Mycobacterium
RLDPGLPLPSRAHDGDAG

SEQ ID NO: 1037795 - protein, 23 aa, Mycobacterium
RLDPHRARMVAVGLVGISVDCAR

SEQ ID NO: 1037796 - protein, 18 aa, Mycobacterium
RLDWLCCSYWSVPSASLG

SEQ ID NO: 1037797 - protein, 19 aa, Mycobacterium
RLETEGHRILKLNIGNPAL

SEQ ID NO: 1037798 - protein, 32 aa, Mycobacterium
RLEVSTPLILCRKFQGCLNLSQWIKTFTQAGK

SEQ ID NO: 1037799 - protein, 19 aa, Mycobacterium
RLFHAVRRLAAAMVAGTSK

SEQ ID NO: 1037800 - protein, 26 aa, Mycobacterium
RLGGPGSWLLALPPYHIGGLQVLVRS

SEQ ID NO: 1037801 - protein, 27 aa, Mycobacterium
RLGKMWRCLGCTEFTLDEPHGLDHREN

SEQ ID NO: 1037802 - protein, 23 aa, Mycobacterium
RLIANRLADRGYRAHELAVSHAF

SEQ ID NO: 1037803 - protein, 21 aa, Mycobacterium
RLIDRAGRWLLNYRPQPLAVG

SEQ ID NO: 1037804 - protein, 21 aa, Mycobacterium
RLKLVGALPANIGVEIPANSE

SEQ ID NO: 1037805 - protein, 24 aa, Mycobacterium
RLKNEYPGKIFAILDSDHSMKQVL

SEQ ID NO: 1037806 - protein, 17 aa, Mycobacterium
RLKRGGTNLTQVLKDAE

SEQ ID NO: 1037807 - protein, 19 aa, Mycobacterium
RLKTIAVRTPSGYRLDGVK

SEQ ID NO: 1037808 - protein, 23 aa, Mycobacterium
RLLANWLTYCGWLCDDALIRRLE

SEQ ID NO: 1037809 - protein, 22 aa, Mycobacterium
RLLGSPLLYRYPDRQLPSEGTT

SEQ ID NO: 1037810 - protein, 18 aa, Mycobacterium
RLLHRAINPDPRRRFSSA

SEQ ID NO: 1037811 - protein, 27 aa, Mycobacterium
RLLPAPLPAWLRHPGHRTVFTAPPPIS

SEQ ID NO: 1037812 - protein, 24 aa, Mycobacterium
RLLQRLGADVADYGFVETSAKQDG

SEQ ID NO: 1037813 - protein, 17 aa, Mycobacterium
RLLTIGWQQRTLPESVH

SEQ ID NO: 1037814 - protein, 17 aa, Mycobacterium
RLNQWSNVVRWELRPRM

SEQ ID NO: 1037815 - protein, 24 aa, Mycobacterium
RLPDGGFQINADWTQAPSGAGYAL

SEQ ID NO: 1037816 - protein, 26 aa, Mycobacterium
RLPLTGVPACTVYELSPCAVSSDEKD

SEQ ID NO: 1037817 - protein, 20 aa, Mycobacterium
RLPVANWSILGSMGNASWVQ

SEQ ID NO: 1037818 - protein, 18 aa, Mycobacterium
RLQAGRVWIIDPLDGTRE

SEQ ID NO: 1037819 - protein, 21 aa, Mycobacterium
RLQFSPAVHSRVRRWLVDGDF

SEQ ID NO: 1037820 - protein, 23 aa, Mycobacterium
RLRAGLRSRDVVGRFGGDEFVAL

SEQ ID NO: 1037821 - protein, 21 aa, Mycobacterium
RLRAKGLDVAWFACTAASGDV

SEQ ID NO: 1037822 - protein, 24 aa, Mycobacterium
RLRDYLCDTHGLDVRLREVGSAGK

SEQ ID NO: 1037823 - protein, 22 aa, Mycobacterium
RLRELIDRYPLRGIKGPMGTGQ

SEQ ID NO: 1037824 - protein, 17 aa, Mycobacterium
RLRIAVVTRSVQRECSP

SEQ ID NO: 1037825 - protein, 18 aa, Mycobacterium
RLRIDLVGGDQAFEKRPY

SEQ ID NO: 1037826 - protein, 23 aa, Mycobacterium
RLRKDIFDLYGYNAVVHVLSASG

SEQ ID NO: 1037827 - protein, 17 aa, Mycobacterium
RLRMRHAPFRITAIERD

SEQ ID NO: 1037828 - protein, 18 aa, Mycobacterium
RLSAKVAYRIRISTESRY

SEQ ID NO: 1037829 - protein, 20 aa, Mycobacterium
RLSAQVGAYHLMRTHRGCGV

SEQ ID NO: 1037830 - protein, 19 aa, Mycobacterium
RLSDNWQLIVSDVANSELP

SEQ ID NO: 1037831 - protein, 17 aa, Mycobacterium
RLSFVGWNQQCHVKSSM

SEQ ID NO: 1037832 - protein, 18 aa, Mycobacterium
RLSIPFTTGLLVGIGETL

SEQ ID NO: 1037833 - protein, 19 aa, Mycobacterium
RLSQPLYVMPTKGIFTSNF

SEQ ID NO: 1037834 - protein, 21 aa, Mycobacterium
RLSRLGSIVGTAFQISDDIID

SEQ ID NO: 1037835 - protein, 20 aa, Mycobacterium
RLSTRLAKIDAIQGERDLIC

SEQ ID NO: 1037836 - protein, 26 aa, Mycobacterium
RLTIIRWKMLLVEVGPDYPDKSRLPY

SEQ ID NO: 1037837 - protein, 18 aa, Mycobacterium
RLTLADLLREQQCGLTNT

SEQ ID NO: 1037838 - protein, 26 aa, Mycobacterium
RLTSIALPRIRDFRGLSPKQFDGVGN

SEQ ID NO: 1037839 - protein, 29 aa, Mycobacterium
RLVAACIAAGLPVRCLPGPSAVMTALAVS

SEQ ID NO: 1037840 - protein, 18 aa, Mycobacterium
RLVAHPTESYGLRITDPS

SEQ ID NO: 1037841 - protein, 20 aa, Mycobacterium
RLVATRLCWADQPKADLAAT

SEQ ID NO: 1037842 - protein, 20 aa, Mycobacterium
RLVPEMNYGLAIERHGVTLN

SEQ ID NO: 1037843 - protein, 17 aa, Mycobacterium
RLVVCADRLTGQVSGKL

SEQ ID NO: 1037844 - protein, 18 aa, Mycobacterium
RLYGLPALRRCSDTARSL

SEQ ID NO: 1037845 - protein, 32 aa, Mycobacterium
RLYRRRIAPGGFRFGSRFGVELQFWSFEETLI

SEQ ID NO: 1037846 - protein, 24 aa, Mycobacterium
RMAGRGVLRPGLTVCAGDIPIGVT

SEQ ID NO: 1037847 - protein, 22 aa, Mycobacterium
RMARLAVHPDAYIRPSPTSGTL

SEQ ID NO: 1037848 - protein, 22 aa, Mycobacterium
RMASLRGLLKFRSGVRTPVPLD

SEQ ID NO: 1037849 - protein, 28 aa, Mycobacterium
RMEADWEASYLLSLRAAWQADNNIPNSK

SEQ ID NO: 1037850 - protein, 18 aa, Mycobacterium
RMGALALHVAKTARRRHP

SEQ ID NO: 1037851 - protein, 21 aa, Mycobacterium
RMHPAICAAVSTLSYEGKLHA

SEQ ID NO: 1037852 - protein, 25 aa, Mycobacterium
RMIFKRLYDAGLIYRAERLVNWSPV

SEQ ID NO: 1037853 - protein, 22 aa, Mycobacterium
RMRKEYPDAVVLPAATELPPPV

SEQ ID NO: 1037854 - protein, 23 aa, Mycobacterium
RMRWKGKRPSVRGVVMNPVDHPH

SEQ ID NO: 1037855 - protein, 19 aa, Mycobacterium
RMSSIAFDVVVPFKSELEK

SEQ ID NO: 1037856 - protein, 19 aa, Mycobacterium
RMTGHNVLHAMGFDAFGLP

SEQ ID NO: 1037857 - protein, 18 aa, Mycobacterium
RNADRLVAMLSEALTDAG

SEQ ID NO: 1037858 - protein, 19 aa, Mycobacterium
RNAEGLFTAVVQERSSGDV

SEQ ID NO: 1037859 - protein, 20 aa, Mycobacterium
RNAGVHACAVILSSEPLTEA

SEQ ID NO: 1037860 - protein, 20 aa, Mycobacterium
RNAKVRLLRDNIVVTDNLTV

SEQ ID NO: 1037861 - protein, 21 aa, Mycobacterium
RNGERYQFLRWGQGAFNDFKV

SEQ ID NO: 1037862 - protein, 20 aa, Mycobacterium
RNGLVPPLLHFDRLSDDLTE

SEQ ID NO: 1037863 - protein, 17 aa, Mycobacterium
RNGSPIPRWLRFVLVSD

SEQ ID NO: 1037864 - protein, 19 aa, Mycobacterium
RNIRHTVEFDQAVLSAYKH

SEQ ID NO: 1037865 - protein, 20 aa, Mycobacterium
RNLTVLPVRYIKTIGDAVMF

SEQ ID NO: 1037866 - protein, 17 aa, Mycobacterium
RNPEVRFSDRLDDDLVR

SEQ ID NO: 1037867 - protein, 18 aa, Mycobacterium
RNRMPVFPVPVGHDQASW

SEQ ID NO: 1037868 - protein, 19 aa, Mycobacterium
RNTAKRAGHDWRHDHDIGV

SEQ ID NO: 1037869 - protein, 17 aa, Mycobacterium
RNTIVSFLRYIDANRAS

SEQ ID NO: 1037870 - protein, 19 aa, Mycobacterium
RPACGVVMDALRRMEYRGY

SEQ ID NO: 1037871 - protein, 22 aa, Mycobacterium
RPAEEMLYLAMEDFRVDVIVGK

SEQ ID NO: 1037872 - protein, 19 aa, Mycobacterium
RPATVLDIAGQVGYDRLPA

SEQ ID NO: 1037873 - protein, 34 aa, Mycobacterium
RPDLSRPRLGSWLRNSTRGALAMDPRRMAMLFDE

SEQ ID NO: 1037874 - protein, 24 aa, Mycobacterium
RPDPRRRAQCTIEEYGAIVDHLVD

SEQ ID NO: 1037875 - protein, 23 aa, Mycobacterium
RPDRPGWFYPPTVITDITKDMAL

SEQ ID NO: 1037876 - protein, 29 aa, Mycobacterium
RPDRSTTLALRWLVGFSRQRREKTMIERL

SEQ ID NO: 1037877 - protein, 21 aa, Mycobacterium
RPDSRRLLLLQGLRDRVVDAL

SEQ ID NO: 1037878 - protein, 19 aa, Mycobacterium
RPEFLNRIDDIIVFHQLSR

SEQ ID NO: 1037879 - protein, 19 aa, Mycobacterium
RPELGYRLLQRLGADVADY

SEQ ID NO: 1037880 - protein, 17 aa, Mycobacterium
RPERMGVSPSRYYAGQR

SEQ ID NO: 1037881 - protein, 18 aa, Mycobacterium
RPEVPALLAELGLSERQR

SEQ ID NO: 1037882 - protein, 18 aa, Mycobacterium
RPFGRRVVTWTMEVVLSG

SEQ ID NO: 1037883 - protein, 22 aa, Mycobacterium
RPGAQFKAVVAGAQRLPLEGPA

SEQ ID NO: 1037884 - protein, 19 aa, Mycobacterium
RPGFPIGAGCALHSKALKL

SEQ ID NO: 1037885 - protein, 25 aa, Mycobacterium
RPLPEVPESLPLADAFRRCVAATAI

SEQ ID NO: 1037886 - protein, 24 aa, Mycobacterium
RPLSCAIAAVSVGVVDGRIRVDLS

SEQ ID NO: 1037887 - protein, 19 aa, Mycobacterium
RPQDGAIITGWDYPACEAI

SEQ ID NO: 1037888 - protein, 22 aa, Mycobacterium
RPQDRICLAQAKSTFRAQIPKY

SEQ ID NO: 1037889 - protein, 25 aa, Mycobacterium
RPQVELDLVLPARWWFWPMDVITLV

SEQ ID NO: 1037890 - protein, 18 aa, Mycobacterium
RPQYRKLLQEFLLQLDLD

SEQ ID NO: 1037891 - protein, 18 aa, Mycobacterium
RPRRARLPTPQHRRPYRP

SEQ ID NO: 1037892 - protein, 23 aa, Mycobacterium
RPTLLSRLVIIGGVFDGSGQSKV

SEQ ID NO: 1037893 - protein, 19 aa, Mycobacterium
RPVGMFRMVDEHGGDDKVL

SEQ ID NO: 1037894 - protein, 17 aa, Mycobacterium
RPVKSSFREGLTVLEYF

SEQ ID NO: 1037895 - protein, 20 aa, Mycobacterium
RPVVWLNPWHWYSVPQVAAN

SEQ ID NO: 1037896 - protein, 32 aa, Mycobacterium
RPWATKDVVGAYRFLQRVWRLVVDERTGETRV

SEQ ID NO: 1037897 - protein, 17 aa, Mycobacterium
RPYLVEGVGEDFWPAAY

SEQ ID NO: 1037898 - protein, 20 aa, Mycobacterium
RPYPLHPLALPLLHPKQVIM

SEQ ID NO: 1037899 - protein, 19 aa, Mycobacterium
RPYQTFGLRPNNVDPTACT

SEQ ID NO: 1037900 - protein, 22 aa, Mycobacterium
RQAAIALDWLRHNGYQDLLSRA

SEQ ID NO: 1037901 - protein, 20 aa, Mycobacterium
RQALLPGHAVVLHPGPMLRG

SEQ ID NO: 1037902 - protein, 20 aa, Mycobacterium
RQFVMATLFHQTRSWSNVLK

SEQ ID NO: 1037903 - protein, 18 aa, Mycobacterium
RQGESYRRLAPIAPDHPV

SEQ ID NO: 1037904 - protein, 32 aa, Mycobacterium
RQGLKVSVPEEVSWRMGWIDDEQLALRAHSLA

SEQ ID NO: 1037905 - protein, 25 aa, Mycobacterium
RQGTKRPTFIAIHGRDAGKVHASDL

SEQ ID NO: 1037906 - protein, 24 aa, Mycobacterium
RQLAIQAFRAIDCQGLARVDFFLT

SEQ ID NO: 1037907 - protein, 24 aa, Mycobacterium
RQLDLPATLALPMRVIASVGAILC

SEQ ID NO: 1037908 - protein, 18 aa, Mycobacterium
RQLELLVGVVCLQAAAVL

SEQ ID NO: 1037909 - protein, 20 aa, Mycobacterium
RQLNAVAVAAGWPSDDGSEF

SEQ ID NO: 1037910 - protein, 23 aa, Mycobacterium
RQLRGRDGVVILCGPRAGAPDEQ

SEQ ID NO: 1037911 - protein, 21 aa, Mycobacterium
RQLSCLIDLLPVVNRSGTLTP

SEQ ID NO: 1037912 - protein, 20 aa, Mycobacterium
RQLSERLLTIGWQQRTLPES

SEQ ID NO: 1037913 - protein, 18 aa, Mycobacterium
RQLVSAGVRAGTEGDNRV

SEQ ID NO: 1037914 - protein, 17 aa, Mycobacterium
RQMLRRLAFTRAVRNVD

SEQ ID NO: 1037915 - protein, 22 aa, Mycobacterium
RQNFPGLICAQVILSNSQDTPK

SEQ ID NO: 1037916 - protein, 23 aa, Mycobacterium
RQQRGRFLCIADFIRSRDLATER

SEQ ID NO: 1037917 - protein, 17 aa, Mycobacterium
RQQSQRCSWAMTPSSLH

SEQ ID NO: 1037918 - protein, 19 aa, Mycobacterium
RQREGILLCWELLRQKESA

SEQ ID NO: 1037919 - protein, 22 aa, Mycobacterium
RQRFLAEQGYSYIIRDADDLLG

SEQ ID NO: 1037920 - protein, 18 aa, Mycobacterium
RQRFSPAAWQCVEQDHAI

SEQ ID NO: 1037921 - protein, 25 aa, Mycobacterium
RQRHWVEPRYTIWAQIPGASSGSPV

SEQ ID NO: 1037922 - protein, 18 aa, Mycobacterium
RQRIVGIAGIDTRAVVRH

SEQ ID NO: 1037923 - protein, 18 aa, Mycobacterium
RQRLKGAGFQVADQPTLI

SEQ ID NO: 1037924 - protein, 18 aa, Mycobacterium
RQSAGPVVAGHNLPQRMA

SEQ ID NO: 1037925 - protein, 24 aa, Mycobacterium
RQVARRRVRRFLAEGPNLVEAAIV

SEQ ID NO: 1037926 - protein, 18 aa, Mycobacterium
RQVGFCSGIENYSRHIDG

SEQ ID NO: 1037927 - protein, 17 aa, Mycobacterium
RQVLLPLWNAYSFLALY

SEQ ID NO: 1037928 - protein, 18 aa, Mycobacterium
RQWSRLTGSVTMLCRGLV

SEQ ID NO: 1037929 - protein, 18 aa, Mycobacterium
RQYMSWISLEDEVRALLF

SEQ ID NO: 1037930 - protein, 23 aa, Mycobacterium
RRAGRIPKRFWAQASSPELMRTG

SEQ ID NO: 1037931 - protein, 18 aa, Mycobacterium
RRAIQSFLESGVDLDDVL

SEQ ID NO: 1037932 - protein, 18 aa, Mycobacterium
RRALRVIRGRLSSTAAHI

SEQ ID NO: 1037933 - protein, 21 aa, Mycobacterium
RRARERLTFDEAVGLQWALVT

SEQ ID NO: 1037934 - protein, 33 aa, Mycobacterium; identical to SEQ ID NO: 725317

SEQ ID NO: 1037935 - protein, 17 aa, Mycobacterium
RRCIGLPGLMLVPRRDD

SEQ ID NO: 1037936 - protein, 19 aa, Mycobacterium
RRDAQPCHRRIVTTEVEHH

SEQ ID NO: 1037937 - protein, 25 aa, Mycobacterium
RRDEFRASKIMLGRARNNDKIKFIT

SEQ ID NO: 1037938 - protein, 18 aa, Mycobacterium
RRDGREAAVLVLFSGPES

SEQ ID NO: 1037939 - protein, 23 aa, Mycobacterium
RRDHGGVIFIDLRDSSGITQAVF

SEQ ID NO: 1037940 - protein, 17 aa, Mycobacterium
RRDIVAITAAMPGPTGL

SEQ ID NO: 1037941 - protein, 34 aa, Mycobacterium
RREDKPFWWGHFDRLNFPVGEWADNTDVFVADDA

SEQ ID NO: 1037942 - protein, 19 aa, Mycobacterium
RRERYEWRHGAAVSVGLVF

SEQ ID NO: 1037943 - protein, 21 aa, Mycobacterium
RRFARHYVHAGMIGWDEHKMS

SEQ ID NO: 1037944 - protein, 27 aa, Mycobacterium
RRFCIPAVESKGSLLLEDVGVPLPALG

SEQ ID NO: 1037945 - protein, 17 aa, Mycobacterium
RRFGSFVRLSLRVGAAP

SEQ ID NO: 1037946 - protein, 21 aa, Mycobacterium
RRFLESEGWIAWSGPAISELL

SEQ ID NO: 1037947 - protein, 21 aa, Mycobacterium
RRFSVLSLPTTLIFDTDGQQR

SEQ ID NO: 1037948 - protein, 25 aa, Mycobacterium
RRGAGPSMKRRLGFEDTVAKRSYLL

SEQ ID NO: 1037949 - protein, 18 aa, Mycobacterium
RRGEVFTLVVSKVANFSI

SEQ ID NO: 1037950 - protein, 28 aa, Mycobacterium
RRGIPVLLRSAVLARLMDGCTTLMVAGT

SEQ ID NO: 1037951 - protein, 28 aa, Mycobacterium
RRGPAHSAFTLPELIGLKATSEVVLDAG

SEQ ID NO: 1037952 - protein, 17 aa, Mycobacterium
RRHGWTFPYLYDETQAV

SEQ ID NO: 1037953 - protein, 19 aa, Mycobacterium
RRIAEETAKAAGKPEQSLP

SEQ ID NO: 1037954 - protein, 19 aa, Mycobacterium
RRIEEGVVRAALVEHDGVV

SEQ ID NO: 1037955 - protein, 19 aa, Mycobacterium
RRIEHQVAHEVLKEVDVRP

SEQ ID NO: 1037956 - protein, 21 aa, Mycobacterium
RRIGYRYTHWRPCLRSRKTGS

SEQ ID NO: 1037957 - protein, 19 aa, Mycobacterium
RRIIEPLAHELMLDFVAAN

SEQ ID NO: 1037958 - protein, 18 aa, Mycobacterium
RRIPTDVLTQGWFTGLVP

SEQ ID NO: 1037959 - protein, 21 aa, Mycobacterium
RRKLPSVLYWDRILFCAKEAT

SEQ ID NO: 1037960 - protein, 19 aa, Mycobacterium
RRKMEIGCYQGLRHRRGLP

SEQ ID NO: 1037961 - protein, 21 aa, Mycobacterium
RRKPFSVVLFDEIEKAHQEIY

SEQ ID NO: 1037962 - protein, 21 aa, Mycobacterium
RRKYSPFLCQLLHDRTTDKMV

SEQ ID NO: 1037963 - protein, 21 aa, Mycobacterium
RRLAAAKARATHYFEMTSDAF

SEQ ID NO: 1037964 - protein, 20 aa, Mycobacterium
RRLALCGPVMKLARRFAQPP

SEQ ID NO: 1037965 - protein, 21 aa, Mycobacterium
RRLARECPVEADLVIGVPESG

SEQ ID NO: 1037966 - protein, 20 aa, Mycobacterium
RRLFAGGWLGGRRFDSSFGD

SEQ ID NO: 1037967 - protein, 23 aa, Mycobacterium
RRLKELSPRLTLTHRHIAARPIG

SEQ ID NO: 1037968 - protein, 18 aa, Mycobacterium
RRLMTWRGGYHGDTLTPM

SEQ ID NO: 1037969 - protein, 19 aa, Mycobacterium
RRLQGHFTLVFANADEPGT

SEQ ID NO: 1037970 - protein, 23 aa, Mycobacterium
RRLSVLICAASFPYRPVQQRANQ

SEQ ID NO: 1037971 - protein, 19 aa, Mycobacterium
RRLVGLFCQQGHFDRSKAE

SEQ ID NO: 1037972 - protein, 21 aa, Mycobacterium
RRNTLRCLASLFGDNPLNSLG

SEQ ID NO: 1037973 - protein, 20 aa, Mycobacterium
RRPAVTGGKCVLPRPVAAKL

SEQ ID NO: 1037974 - protein, 17 aa, Mycobacterium
RRPDLSGARFVWGLGLS

SEQ ID NO: 1037975 - protein, 21 aa, Mycobacterium
RRPRMLYDYFHQLFAQVTNPP

SEQ ID NO: 1037976 - protein, 25 aa, Mycobacterium
RRQAEAGWLWSVRPGVIAGLAAAAL

SEQ ID NO: 1037977 - protein, 18 aa, Mycobacterium
RRQAPELLPVSLGGGQSG

SEQ ID NO: 1037978 - protein, 26 aa, Mycobacterium
RRQQTLRASMDWSYALLTESERALFR

SEQ ID NO: 1037979 - protein, 22 aa, Mycobacterium
RRQRYVAAAGLNFSSLSTDTVG

SEQ ID NO: 1037980 - protein, 22 aa, Mycobacterium
RRRELVKQAKCKGEDAKVSVRN

SEQ ID NO: 1037981 - protein, 21 aa, Mycobacterium
RRRFSTVIEFFSYTPEELIAL

SEQ ID NO: 1037982 - protein, 17 aa, Mycobacterium
RRRIAELVVATDTAVDV

SEQ ID NO: 1037983 - protein, 20 aa, Mycobacterium
RRRLIEFCMLISQYDGLAAT

SEQ ID NO: 1037984 - protein, 17 aa, Mycobacterium
RRSCPECGRRFTTVETA

SEQ ID NO: 1037985 - protein, 18 aa, Mycobacterium
RRSENIASIVAFGSPVDT

SEQ ID NO: 1037986 - protein, 30 aa, Mycobacterium
RRSGAIELTGPWPGLRCDVDTPADLAAARR

SEQ ID NO: 1037987 - protein, 24 aa, Mycobacterium
RRSGRIGGVKAWLDTALVLKPLLG

SEQ ID NO: 1037988 - protein, 18 aa, Mycobacterium
RRSIAAQGGGCWRWLAGY

SEQ ID NO: 1037989 - protein, 20 aa, Mycobacterium
RRSLELVFCHGVAVVARLAE

SEQ ID NO: 1037990 - protein, 23 aa, Mycobacterium
RRSSEFDATVKFGLRAVQSDVII

SEQ ID NO: 1037991 - protein, 21 aa, Mycobacterium
RRTAEELGRAFAGMPVITSVG

SEQ ID NO: 1037992 - protein, 24 aa, Mycobacterium
RRVECRRCWGAVVHRLTMRWLRTD

SEQ ID NO: 1037993 - protein, 19 aa, Mycobacterium
RRVHLGMIQHQHWVVTDLR

SEQ ID NO: 1037994 - protein, 20 aa, Mycobacterium
RRVIRGWLLNGGATGLTDKQ

SEQ ID NO: 1037995 - protein, 25 aa, Mycobacterium
RRVRLMRWGLIPPWIKASSDGGPDI

SEQ ID NO: 1037996 - protein, 20 aa, Mycobacterium
RRVTGRKNVYVWMGECHVHA

SEQ ID NO: 1037997 - protein, 26 aa, Mycobacterium
RRWCSGTSNRWCEMRVRIDGRKGGLI

SEQ ID NO: 1037998 - protein, 27 aa, Mycobacterium
RRWWPRRYRRSSVYWKLMAADRRFGIV

SEQ ID NO: 1037999 - protein, 18 aa, Mycobacterium
RRYDWSVVASQIMRVYET

SEQ ID NO: 1038000 - protein, 23 aa, Mycobacterium
RRYRCGQCARALQRSPHVYRVQT

SEQ ID NO: 1038001 - protein, 19 aa, Mycobacterium
RRYRCRFGEDLAGHDRLEK

SEQ ID NO: 1038002 - protein, 17 aa, Mycobacterium
RSAAMWLAALETARQSQ

SEQ ID NO: 1038003 - protein, 24 aa, Mycobacterium
RSADKLVPDWLWHSPSTVKRAFLQ

SEQ ID NO: 1038004 - protein, 21 aa, Mycobacterium
RSADMFLGVPFNIASYALLTH

SEQ ID NO: 1038005 - protein, 19 aa, Mycobacterium
RSAGFAVQAAVSPLIAYQN

SEQ ID NO: 1038006 - protein, 18 aa, Mycobacterium
RSAQVAVRLALQLWQEGL

SEQ ID NO: 1038007 - protein, 27 aa, Mycobacterium
RSCFRCPQCTEQLRATDDLLLIAGMRI

SEQ ID NO: 1038008 - protein, 28 aa, Mycobacterium
RSDELHLSFNFLLAQIINFDAAAIHDAV

SEQ ID NO: 1038009 - protein, 18 aa, Mycobacterium
RSDILAFTLPGFVTGDRT

SEQ ID NO: 1038010 - protein, 23 aa, Mycobacterium
RSELFTLSAERLFTMAKEVVDLG

SEQ ID NO: 1038011 - protein, 23 aa, Mycobacterium
RSEPMVAILWGRDAATLKPLLTV

SEQ ID NO: 1038012 - protein, 17 aa, Mycobacterium
RSFVRCWETDDVGLSTC

SEQ ID NO: 1038013 - protein, 17 aa, Mycobacterium
RSFYPLGVSRQFSAILG

SEQ ID NO: 1038014 - protein, 18 aa, Mycobacterium
RSGALVVMESRARYFPKG

SEQ ID NO: 1038015 - protein, 20 aa, Mycobacterium
RSGDFYRPAHQNVYDAILDL

SEQ ID NO: 1038016 - protein, 18 aa, Mycobacterium
RSGGLIRGGIPTAQPLTA

SEQ ID NO: 1038017 - protein, 21 aa, Mycobacterium
RSGGRPAALYRFTDSQLRVTD

SEQ ID NO: 1038018 - protein, 17 aa, Mycobacterium
RSGKLVFLAANKVDGEK

SEQ ID NO: 1038019 - protein, 20 aa, Mycobacterium
RSGLIASVQLNFDVLWDGGN

SEQ ID NO: 1038020 - protein, 18 aa, Mycobacterium
RSGPDMVDLFPADKLQSG

SEQ ID NO: 1038021 - protein, 19 aa, Mycobacterium
RSHWIRPKIIVDEPTAYLD

SEQ ID NO: 1038022 - protein, 19 aa, Mycobacterium
RSITANVVAPGFIDTEMTR

SEQ ID NO: 1038023 - protein, 17 aa, Mycobacterium
RSKQVWICGSRGTQRGR

SEQ ID NO: 1038024 - protein, 18 aa, Mycobacterium
RSLARGCFTDARCVTHPD

SEQ ID NO: 1038025 - protein, 19 aa, Mycobacterium
RSLEMDWHQLAAFDVLRRT

SEQ ID NO: 1038026 - protein, 23 aa, Mycobacterium
RSLMPRLLLGRRINRIDVADPLP

SEQ ID NO: 1038027 - protein, 25 aa, Mycobacterium
RSMPDSGPSTFAWPLNPERQTGSPY

SEQ ID NO: 1038028 - protein, 24 aa, Mycobacterium
RSPLLTVYWLLGGFLRKRRNIRDM

SEQ ID NO: 1038029 - protein, 22 aa, Mycobacterium
RSPTPASSRMPAAHVLWMRPKL

SEQ ID NO: 1038030 - protein, 18 aa, Mycobacterium
RSRHPGETASIFVPSVPN

SEQ ID NO: 1038031 - protein, 18 aa, Mycobacterium
RSRQAIWDLVASFKQIGI

SEQ ID NO: 1038032 - protein, 18 aa, Mycobacterium
RSSEELERLYDFITPNDK

SEQ ID NO: 1038033 - protein, 20 aa, Mycobacterium
RSSLEMRATPPVGPDLSRVI

SEQ ID NO: 1038034 - protein, 23 aa, Mycobacterium
RSVALRRVRIGAVLGSSTKSIRT

SEQ ID NO: 1038035 - protein, 18 aa, Mycobacterium
RSVCAALYARLVASRSVG

SEQ ID NO: 1038036 - protein, 23 aa, Mycobacterium
RSVHYPFPIKDLVALDDALTYSS

SEQ ID NO: 1038037 - protein, 24 aa, Mycobacterium
RSVKRHMGSDWSIEIDGKKYTAQE

SEQ ID NO: 1038038 - protein, 23 aa, Mycobacterium
RSVPRAACHELGLNAWQDPHNTD

SEQ ID NO: 1038039 - protein, 19 aa, Mycobacterium
RSVSALSFEPARHRSNGFS

SEQ ID NO: 1038040 - protein, 22 aa, Mycobacterium
RSVVALAYAGGVLFVAENPSRS

SEQ ID NO: 1038041 - protein, 18 aa, Mycobacterium
RSYIGKRCYSEQEVGVFI

SEQ ID NO: 1038042 - protein, 17 aa, Mycobacterium
RSYTRKPAVVAFDHAYH

SEQ ID NO: 1038043 - protein, 17 aa, Mycobacterium
RTAAAFEVACQQAGVRL

SEQ ID NO: 1038044 - protein, 19 aa, Mycobacterium
RTDAMASLIVNWYHDQIAT

SEQ ID NO: 1038045 - protein, 19 aa, Mycobacterium
RTDFHAEVLRMQKAINAVA

SEQ ID NO: 1038046 - protein, 22 aa, Mycobacterium
RTDISWDGIVVVCPPRASDESL

SEQ ID NO: 1038047 - protein, 19 aa, Mycobacterium
RTDPEFAEFLQLHRILQLC

SEQ ID NO: 1038048 - protein, 23 aa, Mycobacterium
RTEDARVGKSLIIQLKYGPSRER

SEQ ID NO: 1038049 - protein, 22 aa, Mycobacterium
RTEPRCRRHLINFHIETQPASL

SEQ ID NO: 1038050 - protein, 21 aa, Mycobacterium
RTFGMDSWFPSLKIYNHNGQL

SEQ ID NO: 1038051 - protein, 18 aa, Mycobacterium
RTFHIDWDLAAAEKGGYE

SEQ ID NO: 1038052 - protein, 23 aa, Mycobacterium
RTFHYPGGLVDFVKHINRTKTPI

SEQ ID NO: 1038053 - protein, 22 aa, Mycobacterium
RTGCLECGCCMTGCRHGAKNTL

SEQ ID NO: 1038054 - protein, 28 aa, Mycobacterium
RTGDVLSVPVGEAFMGRVVNPLGQPIDG

SEQ ID NO: 1038055 - protein, 19 aa, Mycobacterium
RTIDYRKFFDRSLIGRVPL

SEQ ID NO: 1038056 - protein, 19 aa, Mycobacterium
RTIVMLSGFAPPNLARHGY

SEQ ID NO: 1038057 - protein, 24 aa, Mycobacterium
RTKIIKFSGCYHGHVDALLADAGS

SEQ ID NO: 1038058 - protein, 24 aa, Mycobacterium
RTKKSVMFIIPWGNHWIIGTTDTD

SEQ ID NO: 1038059 - protein, 17 aa, Mycobacterium
RTKSGALTLPGRDTYAA

SEQ ID NO: 1038060 - protein, 18 aa, Mycobacterium
RTKSVVVLHPVFVRVSIG

SEQ ID NO: 1038061 - protein, 21 aa, Mycobacterium
RTLRLDQMICYYVEHQLDVIV

SEQ ID NO: 1038062 - protein, 17 aa, Mycobacterium
RTMQERLGANVIPIQLP

SEQ ID NO: 1038063 - protein, 17 aa, Mycobacterium
RTNRILLGTSVLTPTFR

SEQ ID NO: 1038064 - protein, 19 aa, Mycobacterium
RTPVICWSTFDGFDVQGYV

SEQ ID NO: 1038065 - protein, 22 aa, Mycobacterium
RTQELLEQFDLLHAGKRRVGTY

SEQ ID NO: 1038066 - protein, 23 aa, Mycobacterium
RTRANEILEATGIERDLRTRDLT

SEQ ID NO: 1038067 - protein, 22 aa, Mycobacterium
RTRLRLEVLPLLEDVLGGGVVE

SEQ ID NO: 1038068 - protein, 18 aa, Mycobacterium
RTRRVIRSFVRCWETDDV

SEQ ID NO: 1038069 - protein, 24 aa, Mycobacterium
RTRVSFEVAGKWMSANVINVSPAG

SEQ ID NO: 1038070 - protein, 28 aa, Mycobacterium
RTSGEQRLSGFLLWQSAYSEMWFTETHW

SEQ ID NO: 1038071 - protein, 22 aa, Mycobacterium
RTTRDSWEFALFEAALQRGLPV

SEQ ID NO: 1038072 - protein, 24 aa, Mycobacterium
RTTSCSNPPFSGLRECSFDVDNYD

SEQ ID NO: 1038073 - protein, 23 aa, Mycobacterium
RTVKPDALVPWGAQGSRGVPSRK

SEQ ID NO: 1038074 - protein, 17 aa, Mycobacterium
RTVLYTTCEVVRIAALL

SEQ ID NO: 1038075 - protein, 18 aa, Mycobacterium
RTVPPERIADFKVCATFL

SEQ ID NO: 1038076 - protein, 17 aa, Mycobacterium
RTVVLERLVKFNGKQHV

SEQ ID NO: 1038077 - protein, 19 aa, Mycobacterium
RVAEVGPLIVLRVGIAQGN

SEQ ID NO: 1038078 - protein, 19 aa, Mycobacterium
RVALSALTMAEWFRDEASQ

SEQ ID NO: 1038079 - protein, 18 aa, Mycobacterium
RVALVSPAPIMMYLRQVR

SEQ ID NO: 1038080 - protein, 19 aa, Mycobacterium
RVAVEPLVLMLAPLAPHLA

SEQ ID NO: 1038081 - protein, 19 aa, Mycobacterium
RVCHARKPACGVCVLAKDC

SEQ ID NO: 1038082 - protein, 18 aa, Mycobacterium
RVCVLGFNSVDYAIIDMA

SEQ ID NO: 1038083 - protein, 23 aa, Mycobacterium
RVDEIPDTVCVTARTNWVENTSV

SEQ ID NO: 1038084 - protein, 25 aa, Mycobacterium
RVEVELADGLLLRGFIDRIDVAATG

SEQ ID NO: 1038085 - protein, 23 aa, Mycobacterium
RVFEELSLRGCVAALDGSDVIRA

SEQ ID NO: 1038086 - protein, 23 aa, Mycobacterium
RVFPNLFATHRVRAVDDYASHLL

SEQ ID NO: 1038087 - protein, 18 aa, Mycobacterium
RVGACRKLADSFGATVLL

SEQ ID NO: 1038088 - protein, 20 aa, Mycobacterium
RVGCLQRYSAVVFASDGNAA

SEQ ID NO: 1038089 - protein, 19 aa, Mycobacterium
RVGRFELDQAWSLEDLAEL

SEQ ID NO: 1038090 - protein, 20 aa, Mycobacterium
RVICRRSKLMNRVAGSGAMG

SEQ ID NO: 1038091 - protein, 19 aa, Mycobacterium
RVIKTGSIDSFEWHAVNND

SEQ ID NO: 1038092 - protein, 21 aa, Mycobacterium
RVIPSDANFVLFGHFSDAAGA

SEQ ID NO: 1038093 - protein, 25 aa, Mycobacterium
RVIVHGWLAFTFEVCRQRIMDPSTD

SEQ ID NO: 1038094 - protein, 22 aa, Mycobacterium
RVLEAPLGRDGRLDLAALQDAF

SEQ ID NO: 1038095 - protein, 17 aa, Mycobacterium
RVLEMVASIQGTRPPTR

SEQ ID NO: 1038096 - protein, 27 aa, Mycobacterium
RVLQIRALVLGCAMDWLADNQASANHI

SEQ ID NO: 1038097 - protein, 17 aa, Mycobacterium
RVLRDRLFEALAAAGER

SEQ ID NO: 1038098 - protein, 17 aa, Mycobacterium
RVLVLAGRIHPYEGHDL

SEQ ID NO: 1038099 - protein, 17 aa, Mycobacterium
RVNGRSGIWVPGSAGQP

SEQ ID NO: 1038100 - protein, 21 aa, Mycobacterium
RVNVALCDAGFALSPAQTNFV

SEQ ID NO: 1038101 - protein, 22 aa, Mycobacterium
RVPALRGAALVRHSAGPAHPDL

SEQ ID NO: 1038102 - protein, 26 aa, Mycobacterium
RVPCLPTDRLLNLLIYIKGYLDGTLT

SEQ ID NO: 1038103 - protein, 26 aa, Mycobacterium
RVPIWGDVELAWRLDAAGYYGPPRRW

SEQ ID NO: 1038104 - protein, 18 aa, Mycobacterium
RVPKVHWEFTGERVLTME

SEQ ID NO: 1038105 - protein, 20 aa, Mycobacterium
RVPTEKGYREFVDRLEDVKP

SEQ ID NO: 1038106 - protein, 18 aa, Mycobacterium
RVQARLRQASFLREAFND

SEQ ID NO: 1038107 - protein, 20 aa, Mycobacterium
RVRFTSPHPAEFTYDVIEAM

SEQ ID NO: 1038108 - protein, 26 aa, Mycobacterium
RVSIFSATCFEWAILDLAILSVGAVT

SEQ ID NO: 1038109 - protein, 20 aa, Mycobacterium
RVSRSGWYGLDPVAADLFIF

SEQ ID NO: 1038110 - protein, 21 aa, Mycobacterium
RVTKSLVHMGFRVIPSDANFV

SEQ ID NO: 1038111 - protein, 20 aa, Mycobacterium
RVTRHLGDNITFVIRIPLSI

SEQ ID NO: 1038112 - protein, 35 aa, Mycobacterium
RVTTESALAWAGYCRPGYRLGIVGDVVLVVAADAV

SEQ ID NO: 1038113 - protein, 25 aa, Mycobacterium
RVVEMGGPFSLELCGGTHVHNTAQI

SEQ ID NO: 1038114 - protein, 26 aa, Mycobacterium
RVVGRGRPADRPALLGAVKTNVGHLE

SEQ ID NO: 1038115 - protein, 18 aa, Mycobacterium
RVVVLPWDKHIAAGTEIR

SEQ ID NO: 1038116 - protein, 20 aa, Mycobacterium
RWALSLAAPESPAFMRHLLG

SEQ ID NO: 1038117 - protein, 21 aa, Mycobacterium
RWFLDRTCTHILAWEGDDEGK

SEQ ID NO: 1038118 - protein, 20 aa, Mycobacterium
RWFLMASPILRGGNLIITEP

SEQ ID NO: 1038119 - protein, 18 aa, Mycobacterium
RWIDAMPQYGPGHADLVA

SEQ ID NO: 1038120 - protein, 17 aa, Mycobacterium
RWMEIAFTLTSDPQELR

SEQ ID NO: 1038121 - protein, 28 aa, Mycobacterium
RWPDAELLSGPILQPGSWIGGDRDGNPN

SEQ ID NO: 1038122 - protein, 19 aa, Mycobacterium
RWRRTSGIRRVRDRRALAA

SEQ ID NO: 1038123 - protein, 19 aa, Mycobacterium
RYCYNFYNFLNINHYMVDI

SEQ ID NO: 1038124 - protein, 18 aa, Mycobacterium
RYDPAIHLIGRVAAKDMT

SEQ ID NO: 1038125 - protein, 20 aa, Mycobacterium
RYFPDPDLEPVAPSRELVEQ

SEQ ID NO: 1038126 - protein, 18 aa, Mycobacterium
RYGALLLVDTWIDLELPW

SEQ ID NO: 1038127 - protein, 21 aa, Mycobacterium
RYGAYEVHATFAPLVEDASPK

SEQ ID NO: 1038128 - protein, 27 aa, Mycobacterium
RYHKLVKTCLRRGSAPIAARKSLPSLG

SEQ ID NO: 1038129 - protein, 20 aa, Mycobacterium
RYILPSFIEHSSFGVKESNP

SEQ ID NO: 1038130 - protein, 18 aa, Mycobacterium
RYIVFNSLVDRGHWDEDE

SEQ ID NO: 1038131 - protein, 23 aa, Mycobacterium
RYLLDRRRALGGFLPERRTKSGA

SEQ ID NO: 1038132 - protein, 20 aa, Mycobacterium
RYLLVTGLPLAHWKCYMALG

SEQ ID NO: 1038133 - protein, 17 aa, Mycobacterium
RYMKYLTGWVFLPQRHP

SEQ ID NO: 1038134 - protein, 25 aa, Mycobacterium
RYNVANCLVALAILDVVGVSPEQAS

SEQ ID NO: 1038135 - protein, 20 aa, Mycobacterium
RYPTFEGYCQLLGIDFAGVV

SEQ ID NO: 1038136 - protein, 25 aa, Mycobacterium
RYPVGAWRWEVPQGTASDLTDFERV

SEQ ID NO: 1038137 - protein, 20 aa, Mycobacterium
RYRIGVSVVVPGAVRTPLVD

SEQ ID NO: 1038138 - protein, 20 aa, Mycobacterium
RYRRAIRARGHFPTEQSALK

SEQ ID NO: 1038139 - protein, 23 aa, Mycobacterium
RYRRAIRARGHFPTEQSALKCLY

SEQ ID NO: 1038140 - protein, 19 aa, Mycobacterium
RYTAGVLFASHGMGMASAS

SEQ ID NO: 1038141 - protein, 22 aa, Mycobacterium
RYTLRFKDLRTGERYPDEIVGI

SEQ ID NO: 1038142 - protein, 26 aa, Mycobacterium
RYVDLVCSWGPMILGHAHPAVVDAVA

SEQ ID NO: 1038143 - protein, 20 aa, Mycobacterium
RYVLMPGIINTLVGVRHAAV

SEQ ID NO: 1038144 - protein, 20 aa, Mycobacterium
RYVVSCWRANTFVAGTPEAR

SEQ ID NO: 1038145 - protein, 19 aa, Mycobacterium
RYYTVHIVAAPKLMRAVLI

SEQ ID NO: 1038146 - protein, 25 aa, Mycobacterium
SAAAPQLWGGFAQHLSPINDTLSMI

SEQ ID NO: 1038147 - protein, 18 aa, Mycobacterium
SAALLDHGPAPTRAERFG

SEQ ID NO: 1038148 - protein, 18 aa, Mycobacterium
SAALREGLGLLVLTDERG

SEQ ID NO: 1038149 - protein, 21 aa, Mycobacterium
SAAMLSTRFEPSVLYGVPSFF

SEQ ID NO: 1038150 - protein, 30 aa, Mycobacterium
SADWQSRLAGVGVRSAGMWAYEAHRVAALR

SEQ ID NO: 1038151 - protein, 25 aa, Mycobacterium
SAENGRSWSQWSFIGVGAPSALTIR

SEQ ID NO: 1038152 - protein, 26 aa, Mycobacterium
SAGISRPTFYFYFASKEAVLLTLLDR

SEQ ID NO: 1038153 - protein, 21 aa, Mycobacterium
SAGLGRFGDSIAMPEKFVGAF

SEQ ID NO: 1038154 - protein, 18 aa, Mycobacterium
SAIGSRQAVQFPYRPSRA

SEQ ID NO: 1038155 - protein, 22 aa, Mycobacterium
SAILVNLNLVYRIRELDYVLTQ

SEQ ID NO: 1038156 - protein, 24 aa, Mycobacterium
SAKHLRRLAELVVELQVVEVVVGL

SEQ ID NO: 1038157 - protein, 18 aa, Mycobacterium
SAKQVRWILQDSDAVLVF

SEQ ID NO: 1038158 - protein, 20 aa, Mycobacterium
SAKRPYAVVLGGSKVSDKLG

SEQ ID NO: 1038159 - protein, 33 aa, Mycobacterium
SALAARSGDAWLADRSWSRPAWTIDELVAAKAG

SEQ ID NO: 1038160 - protein, 23 aa, Mycobacterium
SALARLAPMRATLPAGAGSMDAT

SEQ ID NO: 1038161 - protein, 25 aa, Mycobacterium
SALDPFTRCWELRPDGQWTASPQKG

SEQ ID NO: 1038162 - protein, 19 aa, Mycobacterium
SALHLARRGIEVEIFTRAT

SEQ ID NO: 1038163 - protein, 24 aa, Mycobacterium
SALQNAASIAGLFLTTEAVVADKP

SEQ ID NO: 1038164 - protein, 21 aa, Mycobacterium
SALYRFVRQVIDPTVRRVALP

SEQ ID NO: 1038165 - protein, 17 aa, Mycobacterium
SAMGAVASAAWTRGGRI

SEQ ID NO: 1038166 - protein, 28 aa, Mycobacterium
SANIRRLRRPDPYKGKGVRYEGEQIRRK

SEQ ID NO: 1038167 - protein, 24 aa, Mycobacterium
SAQLRCGLDIIAAAGSTPRHAGRL

SEQ ID NO: 1038168 - protein, 20 aa, Mycobacterium
SAQVQIRIAAFIYGVPVHDM

SEQ ID NO: 1038169 - protein, 25 aa, Mycobacterium
SARHQFAALGLNWLVLHNHRRVILQ

SEQ ID NO: 1038170 - protein, 19 aa, Mycobacterium
SARSRRLAAAKARATHYFE

SEQ ID NO: 1038171 - protein, 17 aa, Mycobacterium
SASFCCCSIRACSRASP

SEQ ID NO: 1038172 - protein, 19 aa, Mycobacterium
SASGLNLIGLKSMSADLAV

SEQ ID NO: 1038173 - protein, 26 aa, Mycobacterium
SASLSFSSLSGWAQRGLRDRFLELTD

SEQ ID NO: 1038174 - protein, 25 aa, Mycobacterium
SASSLGLDGTEVFEINGIDVFNNGK

SEQ ID NO: 1038175 - protein, 27 aa, Mycobacterium
SASTPLFFAQAIGRFVRSRHPGETASI

SEQ ID NO: 1038176 - protein, 19 aa, Mycobacterium
SAVEAIVCWIVDRENDFPT

SEQ ID NO: 1038177 - protein, 19 aa, Mycobacterium
SAVGSRIAVETSPLHGDEW

SEQ ID NO: 1038178 - protein, 17 aa, Mycobacterium
SAVLKWPQPAATSIATV

SEQ ID NO: 1038179 - protein, 21 aa, Mycobacterium
SAVNLDWALPIAAEFEDEELV

SEQ ID NO: 1038180 - protein, 25 aa, Mycobacterium
SCAELARLATPLGVAAAVDDPIHPL

SEQ ID NO: 1038181 - protein, 18 aa, Mycobacterium
SCFKGCRGGLGLGARLRS

SEQ ID NO: 1038182 - protein, 20 aa, Mycobacterium
SCLAIRCLRPVTSWVWPSYF

SEQ ID NO: 1038183 - protein, 21 aa, Mycobacterium
SCNHCGAWIAGVKLVNGTVGT

SEQ ID NO: 1038184 - protein, 18 aa, Mycobacterium
SCPPRDIAELAAMVCTVL

SEQ ID NO: 1038185 - protein, 20 aa, Mycobacterium
SCTQLLLRVISAIDFGNRAQ

SEQ ID NO: 1038186 - protein, 17 aa, Mycobacterium
SCTRYVEAIARARRRAG

SEQ ID NO: 1038187 - protein, 27 aa, Mycobacterium
SDAKIGMQLYVKRVFIMSDCDQLMPMY

SEQ ID NO: 1038188 - protein, 19 aa, Mycobacterium
SDAYLARTGARPQVLLLPL

SEQ ID NO: 1038189 - protein, 28 aa, Mycobacterium
SDCDQLMPMYLRFVKGVVDAEDMSLNVS

SEQ ID NO: 1038190 - protein, 20 aa, Mycobacterium
SDDELLAWAVSDLAAVFDVT

SEQ ID NO: 1038191 - protein, 21 aa, Mycobacterium
SDELPASLSVHVRGELASEDV

SEQ ID NO: 1038192 - protein, 20 aa, Mycobacterium
SDGGEIIFVQALDNVVADYR

SEQ ID NO: 1038193 - protein, 20 aa, Mycobacterium
SDGKNFYALGGQDWDPEQSQ

SEQ ID NO: 1038194 - protein, 22 aa, Mycobacterium
SDGKPTRIGYRVDEETDKRVRI

SEQ ID NO: 1038195 - protein, 17 aa, Mycobacterium
SDHDCKVLSAWGAYGKK

SEQ ID NO: 1038196 - protein, 29 aa, Mycobacterium
SDHWEVVRIEVPPAVARYFVEKGSITVDG

SEQ ID NO: 1038197 - protein, 17 aa, Mycobacterium
SDIAVTILRLADMIGPA

SEQ ID NO: 1038198 - protein, 17 aa, Mycobacterium
SDISKPVGLGFTQGSGE

SEQ ID NO: 1038199 - protein, 22 aa, Mycobacterium
SDKAFRIALVRYSMKVTGSDVY

SEQ ID NO: 1038200 - protein, 24 aa, Mycobacterium
SDKNGRIAAALGISTIFTAPLDDG

SEQ ID NO: 1038201 - protein, 21 aa, Mycobacterium
SDLALAGGCAVLLEPHASVAA

SEQ ID NO: 1038202 - protein, 17 aa, Mycobacterium
SDLEPGTTLFIVASKTF

SEQ ID NO: 1038203 - protein, 18 aa, Mycobacterium
SDLGRAVALQRMLSSGYF

SEQ ID NO: 1038204 - protein, 20 aa, Mycobacterium
SDLIPAIALAMSRFSELTAL

SEQ ID NO: 1038205 - protein, 30 aa, Mycobacterium
SDLLVAECLRTGAWAGLRPAELAAVVSAVL

SEQ ID NO: 1038206 - protein, 17 aa, Mycobacterium
SDLNWQQAALLAGMVQS

SEQ ID NO: 1038207 - protein, 20 aa, Mycobacterium
SDMFLFGALPLDPMRPYGST

SEQ ID NO: 1038208 - protein, 23 aa, Mycobacterium
SDNVECLSSFLVFSSAQNTGSAP

SEQ ID NO: 1038209 - protein, 21 aa, Mycobacterium
SDPWACSRFAEHEVVVPLVVI

SEQ ID NO: 1038210 - protein, 24 aa, Mycobacterium
SDRCVASWYGVRVDKGLRRWRAVA

SEQ ID NO: 1038211 - protein, 19 aa, Mycobacterium
SDTAEFGGYLSGPRVIDAD

SEQ ID NO: 1038212 - protein, 18 aa, Mycobacterium
SDTIVVAVPASFAGETSD

SEQ ID NO: 1038213 - protein, 24 aa, Mycobacterium
SDTRRLRAAFALVYPGAASPKETW

SEQ ID NO: 1038214 - protein, 22 aa, Mycobacterium
SDVPYELAVLTGRDDDRGTETI

SEQ ID NO: 1038215 - protein, 19 aa, Mycobacterium
SDWHAFDRFIAATMIDHVI

SEQ ID NO: 1038216 - protein, 19 aa, Mycobacterium
SDWNARNLFTGWVDVGLTD

SEQ ID NO: 1038217 - protein, 19 aa, Mycobacterium
SDYYVRLAALLNVNASDDT

SEQ ID NO: 1038218 - protein, 21 aa, Mycobacterium
SEAARTWSDRLIAAAASFSEG

SEQ ID NO: 1038219 - protein, 26 aa, Mycobacterium
SEAGRICASLGLPERVLVQQLCTLSG

SEQ ID NO: 1038220 - protein, 17 aa, Mycobacterium
SEALFLLQRVRDEAHRF

SEQ ID NO: 1038221 - protein, 24 aa, Mycobacterium
SEALRWWPAEALRPKLTVARKSAR

SEQ ID NO: 1038222 - protein, 18 aa, Mycobacterium
SECYAGYKANRSSIPAEF

SEQ ID NO: 1038223 - protein, 20 aa, Mycobacterium
SEFAGPISTVRCFQDNALLK

SEQ ID NO: 1038224 - protein, 27 aa, Mycobacterium
SEFPWCGQAADVLRSHFGTALSVRVCT

SEQ ID NO: 1038225 - protein, 40 aa, Mycobacterium
SEGRGHARIEFKLRDWLFARQRYWGEPFPIIYDSDGRPHA

SEQ ID NO: 1038226 - protein, 21 aa, Mycobacterium
SEKHFRRARGRKVELAAVGRI

SEQ ID NO: 1038227 - protein, 23 aa, Mycobacterium
SELARPQTYSWSRVVTEQPFGHD

SEQ ID NO: 1038228 - protein, 21 aa, Mycobacterium
SELDLIQWRLDVWNASVQVSN

SEQ ID NO: 1038229 - protein, 19 aa, Mycobacterium
SELGLSYLLPRAVGSSRAF

SEQ ID NO: 1038230 - protein, 18 aa, Mycobacterium
SELLWSFAPQPRSRPADG

SEQ ID NO: 1038231 - protein, 27 aa, Mycobacterium
SEMTYLQWLQRYVELTIGEGNSTADTA

SEQ ID NO: 1038232 - protein, 21 aa, Mycobacterium
SEMYFAHALRCLGIYHRRVLY

SEQ ID NO: 1038233 - protein, 17 aa, Mycobacterium
SEPAPGRSLIRPVPVDD

SEQ ID NO: 1038234 - protein, 23 aa, Mycobacterium
SEPGEPWLPPSPVPVRENSPAKI

SEQ ID NO: 1038235 - protein, 25 aa, Mycobacterium
SEPTEPIELWAWVGAYDHVALCQLW

SEQ ID NO: 1038236 - protein, 19 aa, Mycobacterium
SESAPLLGGGLPMAPMVPG

SEQ ID NO: 1038237 - protein, 20 aa, Mycobacterium
SESQERMCAVVAPENVDAFL

SEQ ID NO: 1038238 - protein, 22 aa, Mycobacterium
SETLPPLLFRPLTTLLRVVCLL

SEQ ID NO: 1038239 - protein, 25 aa, Mycobacterium
SEVDCPHFDYALAAYYLILPSEVSS

SEQ ID NO: 1038240 - protein, 17 aa, Mycobacterium
SEVFERFARGGTARTQT

SEQ ID NO: 1038241 - protein, 19 aa, Mycobacterium
SEYNADFDILVGIATRDHP

SEQ ID NO: 1038242 - protein, 24 aa, Mycobacterium
SFADIPLRSDRVVWPPSEAAVEKH

SEQ ID NO: 1038243 - protein, 20 aa, Mycobacterium
SFEPKPDWKHLFSYQPEIWD

SEQ ID NO: 1038244 - protein, 25 aa, Mycobacterium
SFGASPRASLGIIKASRSLALVRGR

SEQ ID NO: 1038245 - protein, 23 aa, Mycobacterium
SFIEGRAAMFAGLADSTLSRDDG

SEQ ID NO: 1038246 - protein, 26 aa, Mycobacterium
SFNNELGHPWTVLRATRSTDYLILEM

SEQ ID NO: 1038247 - protein, 21 aa, Mycobacterium
SFSLYCCANGKAILASLPPVR

SEQ ID NO: 1038248 - protein, 31 aa, Mycobacterium
SFTFMTPAAFVRRPGRWIRELARKPEDTGGT

SEQ ID NO: 1038249 - protein, 18 aa, Mycobacterium
SFWSFAFGSGDFTPDTVD

SEQ ID NO: 1038250 - protein, 17 aa, Mycobacterium
SGAAALLAGHQNPGHPC

SEQ ID NO: 1038251 - protein, 21 aa, Mycobacterium
SGAPMPGWLAAALATTPAPAR

SEQ ID NO: 1038252 - protein, 26 aa, Mycobacterium
SGCLTLLEICPDGSALLVPTSDVFTR

SEQ ID NO: 1038253 - protein, 23 aa, Mycobacterium
SGDGLHVGHPLGYIATDVYARYF

SEQ ID NO: 1038254 - protein, 21 aa, Mycobacterium
SGEGCVVLLLKRMPDAERDGD

SEQ ID NO: 1038255 - protein, 19 aa, Mycobacterium
SGENVFFCATGVTDGDLLK

SEQ ID NO: 1038256 - protein, 19 aa, Mycobacterium
SGEYAMICAAAANNWIDER

SEQ ID NO: 1038257 - protein, 31 aa, Mycobacterium
SGGAKGCPKETWCVINAGNYRGSMNVTDALA

SEQ ID NO: 1038258 - protein, 20 aa, Mycobacterium
SGGPERLLLLAVVVALRDVR

SEQ ID NO: 1038259 - protein, 25 aa, Mycobacterium
SGGQQQLLCPVRALAVGPEVVLLEK

SEQ ID NO: 1038260 - protein, 19 aa, Mycobacterium
SGGVFYGLAVREVAVVLYP

SEQ ID NO: 1038261 - protein, 19 aa, Mycobacterium
SGIPVDWQSVFDGRSTQTV

SEQ ID NO: 1038262 - protein, 20 aa, Mycobacterium
SGLHNLLAYQWAHPGKQLLF

SEQ ID NO: 1038263 - protein, 27 aa, Mycobacterium
SGLVSDLRINWVWNPPWGPDKISDDGR

SEQ ID NO: 1038264 - protein, 17 aa, Mycobacterium
SGNELRADIIVTATGLN

SEQ ID NO: 1038265 - protein, 18 aa, Mycobacterium
SGPARWFLDHSRVALTSG

SEQ ID NO: 1038266 - protein, 18 aa, Mycobacterium
SGPLRHCSNGDLYGGNEP

SEQ ID NO: 1038267 - protein, 24 aa, Mycobacterium
SGPSRARYLILRLLERAGEQRVTI

SEQ ID NO: 1038268 - protein, 23 aa, Mycobacterium
SGQFAKVIIKLEPFSGENGATYE

SEQ ID NO: 1038269 - protein, 21 aa, Mycobacterium
SGRDLRRMGISAATVAALGQA

SEQ ID NO: 1038270 - protein, 23 aa, Mycobacterium
SGRSCGIGALLMGIPTAGGLHFA

SEQ ID NO: 1038271 - protein, 17 aa, Mycobacterium
SGRTWLLAIARRVVADH

SEQ ID NO: 1038272 - protein, 23 aa, Mycobacterium
SGSAKWNLLAPYAAKSEGCRNSQ

SEQ ID NO: 1038273 - protein, 23 aa, Mycobacterium
SGSIWNRRRVLLLNSTYEPLTAL

SEQ ID NO: 1038274 - protein, 24 aa, Mycobacterium
SGSVPQRLWAKPAITVIGIDTTSV

SEQ ID NO: 1038275 - protein, 20 aa, Mycobacterium
SGSVRMWLDNSIVTPRLHAS

SEQ ID NO: 1038276 - protein, 20 aa, Mycobacterium
SGTFRPLWAHNRVEERKALT

SEQ ID NO: 1038277 - protein, 21 aa, Mycobacterium
SGVCLSLGAGVGVGKDGLFGI

SEQ ID NO: 1038278 - protein, 23 aa, Mycobacterium
SGVRFPNLLARIVAVRHVTVTGD

SEQ ID NO: 1038279 - protein, 28 aa, Mycobacterium
SGVRPRFYRSLARPEVIAILDAEGLLPA

SEQ ID NO: 1038280 - protein, 29 aa, Mycobacterium
SGVSSLRGSEDFLSILLSAIGSRQAVQFP

SEQ ID NO: 1038281 - protein, 24 aa, Mycobacterium
SGWDCARSALSDLVYRALSAGMVV

SEQ ID NO: 1038282 - protein, 27 aa, Mycobacterium
SGYLCAPLDGAICDRLGLLPMFAVNQD

SEQ ID NO: 1038283 - protein, 21 aa, Mycobacterium
SGYVRPSWTELADAIGGRGRA

SEQ ID NO: 1038284 - protein, 17 aa, Mycobacterium
SHARRLGCVHTDVLDVN

SEQ ID NO: 1038285 - protein, 21 aa, Mycobacterium
SHCSWSVTGTGQFMPHDGASP

SEQ ID NO: 1038286 - protein, 24 aa, Mycobacterium
SHDQLKSGLLLLMDSVDDLGHAVV

SEQ ID NO: 1038287 - protein, 24 aa, Mycobacterium
SHDRVKLGKSWDRHPATLYIAADF

SEQ ID NO: 1038288 - protein, 20 aa, Mycobacterium
SHEVPILVLVWSPRSDACVK

SEQ ID NO: 1038289 - protein, 17 aa, Mycobacterium
SHGSYCAQFNDTLKMYE

SEQ ID NO: 1038290 - protein, 26 aa, Mycobacterium
SHLQGWKLDRLPAVDRAILRVSIWEL

SEQ ID NO: 1038291 - protein, 27 aa, Mycobacterium
SHPGKWRVVFFWPKDFTFICPTEIAAF

SEQ ID NO: 1038292 - protein, 18 aa, Mycobacterium
SHTARFLGSYGVDESSAV

SEQ ID NO: 1038293 - protein, 19 aa, Mycobacterium
SHVMGRGILYGTLGNGGTA

SEQ ID NO: 1038294 - protein, 17 aa, Mycobacterium
SIAKFCDECGSPVVEAE

SEQ ID NO: 1038295 - protein, 27 aa, Mycobacterium
SIEGTWVGEVWIYIQLLPAVDSKSLAE

SEQ ID NO: 1038296 - protein, 17 aa, Mycobacterium
SIFGFGFFALAQRIGVF

SEQ ID NO: 1038297 - protein, 19 aa, Mycobacterium
SIGRRILERGFGFSAGGFA

SEQ ID NO: 1038298 - protein, 26 aa, Mycobacterium
SIGVRAICYLPLTYDHRLIDGADAGR

SEQ ID NO: 1038299 - protein, 20 aa, Mycobacterium
SILQRRVVFRADQATVKAIA

SEQ ID NO: 1038300 - protein, 24 aa, Mycobacterium
SINLPRVLGGLGVVIISTSSGLLT

SEQ ID NO: 1038301 - protein, 22 aa, Mycobacterium
SIPEIRAHALAICDDLVGRGVK

SEQ ID NO: 1038302 - protein, 27 aa, Mycobacterium
SIPGNCGSSWGRCWPPKVVAPSGTRNH

SEQ ID NO: 1038303 - protein, 23 aa, Mycobacterium
SIPHYGIGYGLLRYMYAPTGRVF

SEQ ID NO: 1038304 - protein, 17 aa, Mycobacterium
SIPTVQSLMRWDPASHA

SEQ ID NO: 1038305 - protein, 18 aa, Mycobacterium
SIRACSRASPSWYERSAE

SEQ ID NO: 1038306 - protein, 19 aa, Mycobacterium
SISTFQSIQFMLADMAMKV

SEQ ID NO: 1038307 - protein, 32 aa, Mycobacterium
SITGSEHLVAWLKAVVYGAAERWTDVIDEVKG

SEQ ID NO: 1038308 - protein, 36 aa, Mycobacterium
SITLRPETQIAISAWGLLSPHGRCAAFDAAADGFVR

SEQ ID NO: 1038309 - protein, 20 aa, Mycobacterium
SIVSERFLLIRTVNRRTVCR

SEQ ID NO: 1038310 - protein, 26 aa, Mycobacterium
SIVVRRMRLQPGRMFLVDTAQGRIVS

SEQ ID NO: 1038311 - protein, 19 aa, Mycobacterium
SKHKGYRLVLPSAGRWREV

SEQ ID NO: 1038312 - protein, 22 aa, Mycobacterium
SKIASRFDTWVAHTSPQHAARI

SEQ ID NO: 1038313 - protein, 18 aa, Mycobacterium
SKPACAPQALRAFGAREC

SEQ ID NO: 1038314 - protein, 18 aa, Mycobacterium
SKRIGRRCVWDLVEEGLN

SEQ ID NO: 1038315 - protein, 20 aa, Mycobacterium
SKRLSYPHHHGIDTDLCDLT

SEQ ID NO: 1038316 - protein, 18 aa, Mycobacterium
SKSGAPYRCTCGVAMMPV

SEQ ID NO: 1038317 - protein, 17 aa, Mycobacterium
SKTAWSWTISTTNTIIG

SEQ ID NO: 1038318 - protein, 19 aa, Mycobacterium
SKVEYIRAFQVSYKAAGAV

SEQ ID NO: 1038319 - protein, 17 aa, Mycobacterium
SKYAAASVHSLVATGAF

SEQ ID NO: 1038320 - protein, 17 aa, Mycobacterium
SLADFVKRQNIGSFTLG

SEQ ID NO: 1038321 - protein, 22 aa, Mycobacterium
SLAEAAAVPVVFLTALFGLADL

SEQ ID NO: 1038322 - protein, 25 aa, Mycobacterium
SLAQLEEVALRFSEVHSVLLQALES

SEQ ID NO: 1038323 - protein, 17 aa, Mycobacterium
SLARAACENTLQRGQAG

SEQ ID NO: 1038324 - protein, 24 aa, Mycobacterium
SLCSKAGLFPAYTLNTYVISDQLH

SEQ ID NO: 1038325 - protein, 29 aa, Mycobacterium
SLDISPLQARCGWAIGWKKDAFLGRDALL

SEQ ID NO: 1038326 - protein, 24 aa, Mycobacterium
SLDPMGGVLPELIRRAVTVKAGVV

SEQ ID NO: 1038327 - protein, 22 aa, Mycobacterium
SLDPRLPVFELIAEPLHANGFS

SEQ ID NO: 1038328 - protein, 47 aa, Mycobacterium
SLFQVLRYGFRPSKIAFLTWHAWSDPNCGKWPPGFPEDKRLSYSLKE

SEQ ID NO: 1038329 - protein, 19 aa, Mycobacterium
SLGATRVFALRKRGGGPSL

SEQ ID NO: 1038330 - protein, 24 aa, Mycobacterium
SLGEAACAYFVGGLSLRDATRAIC

SEQ ID NO: 1038331 - protein, 29 aa, Mycobacterium
SLGEGKALARICALNALAAVDSLVGLDSV

SEQ ID NO: 1038332 - protein, 36 aa, Mycobacterium
SLGGVLAYACAIGLRSAGKEVAWVGLIDAVRAGEEI

SEQ ID NO: 1038333 - protein, 25 aa, Mycobacterium
SLGNSRTGVMIGVYFNEYQSMLASS

SEQ ID NO: 1038334 - protein, 21 aa, Mycobacterium
SLGQWVAFVLHDWCAVRLADV

SEQ ID NO: 1038335 - protein, 17 aa, Mycobacterium
SLGRAEVVITTLAELPG

SEQ ID NO: 1038336 - protein, 26 aa, Mycobacterium
SLHAVKGLEWDAVFLVGLADGTLPIS

SEQ ID NO: 1038337 - protein, 19 aa, Mycobacterium
SLHKVVLARALQLVADAPL

SEQ ID NO: 1038338 - protein, 25 aa, Mycobacterium
SLHRLSGLGRRTVLPGHGPDLANLE

SEQ ID NO: 1038339 - protein, 18 aa, Mycobacterium
SLHRPARVLLAGHLDTVP

SEQ ID NO: 1038340 - protein, 17 aa, Mycobacterium
SLIGAGMRSHPGVTATF

SEQ ID NO: 1038341 - protein, 19 aa, Mycobacterium
SLIHLGLKHYFLVDFPQKP

SEQ ID NO: 1038342 - protein, 24 aa, Mycobacterium
SLKQPVKYFLLFSSISGLIGSRWL

SEQ ID NO: 1038343 - protein, 35 aa, Mycobacterium
SLLDRAYAKKFRFSTFLGAFKYYTSYTLKTFDGKR

SEQ ID NO: 1038344 - protein, 24 aa, Mycobacterium
SLLLNRISLTPGEAIFLPAGNLHA

SEQ ID NO: 1038345 - protein, 17 aa, Mycobacterium
SLLLRRTIDPDRLLSDY

SEQ ID NO: 1038346 - protein, 19 aa, Mycobacterium
SLLRELFDIDVPVGVIVSP

SEQ ID NO: 1038347 - protein, 24 aa, Mycobacterium
SLLVDPKAGYAFERVPKAEVEDLV

SEQ ID NO: 1038348 - protein, 19 aa, Mycobacterium
SLMDAFRSADEVLLNGVQG

SEQ ID NO: 1038349 - protein, 24 aa, Mycobacterium
SLMHCMTVSLALQGAPDWMRCGEG

SEQ ID NO: 1038350 - protein, 24 aa, Mycobacterium
SLPAKRWLAQHGFDPVYGARPLRR

SEQ ID NO: 1038351 - protein, 25 aa, Mycobacterium
SLPFEHARPTAIMTLMRQHCGIENS

SEQ ID NO: 1038352 - protein, 25 aa, Mycobacterium
SLPFEHARPTAIMTWMRQHCGIENN

SEQ ID NO: 1038353 - protein, 26 aa, Mycobacterium
SLPFEHARPTAIMTWMRQHCGIENSL

SEQ ID NO: 1038354 - protein, 26 aa, Mycobacterium
SLPFEHARPTAIMTWMRQHGGIENSL

SEQ ID NO: 1038355 - protein, 31 aa, Mycobacterium
SLPGMLMAAARLDLASVFLYAGSILPGRTKL

SEQ ID NO: 1038356 - protein, 24 aa, Mycobacterium
SLPLLERAKFLAIFASNLDEFYMV

SEQ ID NO: 1038357 - protein, 19 aa, Mycobacterium
SLQIGECHLIVGYGEIEVD

SEQ ID NO: 1038358 - protein, 20 aa, Mycobacterium
SLRCEGRVLVGPLDWAVELD

SEQ ID NO: 1038359 - protein, 26 aa, Mycobacterium
SLRRIALKLSLIVACIRLFYPTPVIV

SEQ ID NO: 1038360 - protein, 18 aa, Mycobacterium
SLRYLRRELRAETPEQEQ

SEQ ID NO: 1038361 - protein, 20 aa, Mycobacterium
SLSAPCFSWERYIFGRGPSG

SEQ ID NO: 1038362 - protein, 24 aa, Mycobacterium
SLSELQPGDVLTFYSDASHAGIYV

SEQ ID NO: 1038363 - protein, 18 aa, Mycobacterium
SLTDGMCKRNLDQRNITS

SEQ ID NO: 1038364 - protein, 23 aa, Mycobacterium
SLTSRLTIRPILAVGSYVPQLPW

SEQ ID NO: 1038365 - protein, 18 aa, Mycobacterium
SLVVKAWMGEHGCVVVTT

SEQ ID NO: 1038366 - protein, 21 aa, Mycobacterium
SMAVSIVYRDNCDHRQLIPGL

SEQ ID NO: 1038367 - protein, 23 aa, Mycobacterium
SMCNEIIELFGPGLAEITVIRNG

SEQ ID NO: 1038368 - protein, 20 aa, Mycobacterium
SMGGMLAFEVALRFQSAGYR

SEQ ID NO: 1038369 - protein, 18 aa, Mycobacterium
SMLDGWRAVGPLAAELAS

SEQ ID NO: 1038370 - protein, 19 aa, Mycobacterium
SMLELLLRELDVHPSDVIE

SEQ ID NO: 1038371 - protein, 18 aa, Mycobacterium
SMLSHSLHAITKLAPQHL

SEQ ID NO: 1038372 - protein, 22 aa, Mycobacterium
SMPAMIRAGGKMYGADGRAKDT

SEQ ID NO: 1038373 - protein, 21 aa, Mycobacterium
SMPAMMSRIAPLREVGDASQP

SEQ ID NO: 1038374 - protein, 22 aa, Mycobacterium
SMRKFFEAFAPYGLKQTAVKPS

SEQ ID NO: 1038375 - protein, 17 aa, Mycobacterium
SMVEGRISAGVVVGEGS

SEQ ID NO: 1038376 - protein, 19 aa, Mycobacterium
SNATELCRALGVTFTEIDI

SEQ ID NO: 1038377 - protein, 18 aa, Mycobacterium
SNATLWPLYHDVIVKPIY

SEQ ID NO: 1038378 - protein, 27 aa, Mycobacterium
SNIASWSEPKGGYFINLDVLPGTARRT

SEQ ID NO: 1038379 - protein, 24 aa, Mycobacterium
SNLPKVFFVNWFRRGEGGKFLWPG

SEQ ID NO: 1038380 - protein, 24 aa, Mycobacterium
SNNFPARVLTAVGVDRPTSQRFTD

SEQ ID NO: 1038381 - protein, 20 aa, Mycobacterium
SNRAARCRRGADTTWPGVLS

SEQ ID NO: 1038382 - protein, 23 aa, Mycobacterium
SNREIGEAVGMLMLPQQHLRTNR

SEQ ID NO: 1038383 - protein, 19 aa, Mycobacterium
SNSRWVDYRGVDPLHRYHP

SEQ ID NO: 1038384 - protein, 25 aa, Mycobacterium
SPACGKAGCTTYKWETFLTSELPKW

SEQ ID NO: 1038385 - protein, 19 aa, Mycobacterium
SPALQRRYLVFTGDSTAKQ

SEQ ID NO: 1038386 - protein, 19 aa, Mycobacterium
SPAMRRIAIDADRILSDIE

SEQ ID NO: 1038387 - protein, 17 aa, Mycobacterium
SPATMRCVEPIKVGVYS

SEQ ID NO: 1038388 - protein, 31 aa, Mycobacterium
SPDAWWQQLTWLPQRPVLIPGTVGDNLVLLG

SEQ ID NO: 1038389 - protein, 23 aa, Mycobacterium
SPDEFSGKLLAPAHLPQEQSQRP

SEQ ID NO: 1038390 - protein, 25 aa, Mycobacterium
SPDLDTDWLYDGWLTLFCKWIDDAE

SEQ ID NO: 1038391 - protein, 22 aa, Mycobacterium
SPDSFRSLRCVVTAGEALEPAL

SEQ ID NO: 1038392 - protein, 19 aa, Mycobacterium
SPEETWRALLEGRDAITDL

SEQ ID NO: 1038393 - protein, 21 aa, Mycobacterium
SPESARRFGLEETRYEGPTGI

SEQ ID NO: 1038394 - protein, 18 aa, Mycobacterium
SPFKHSLVTGAQEIPISS

SEQ ID NO: 1038395 - protein, 17 aa, Mycobacterium
SPGQRFDGGQGIDVVVI

SEQ ID NO: 1038396 - protein, 25 aa, Mycobacterium
SPGTTYRFYGPLSHDVIEVLYESTP

SEQ ID NO: 1038397 - protein, 17 aa, Mycobacterium
SPHLVVYDVTRSFNSTQ

SEQ ID NO: 1038398 - protein, 17 aa, Mycobacterium
SPIKGTLPLAAWPSALQ

SEQ ID NO: 1038399 - protein, 23 aa, Mycobacterium
SPILTAAAAWVVLAKELTAAAQG

SEQ ID NO: 1038400 - protein, 17 aa, Mycobacterium
SPIVLALIEAAEAGKQV

SEQ ID NO: 1038401 - protein, 17 aa, Mycobacterium
SPLSRKEYAAAEQRCGS

SEQ ID NO: 1038402 - protein, 27 aa, Mycobacterium
SPPDMKLPISLALGWPQRVGGAARACA

SEQ ID NO: 1038403 - protein, 21 aa, Mycobacterium
SPPPRRCATGAIAGEIESVSS

SEQ ID NO: 1038404 - protein, 18 aa, Mycobacterium
SPQHAARIILKAVRKKKA

SEQ ID NO: 1038405 - protein, 20 aa, Mycobacterium
SPRVRELIREGARIALNPTQ

SEQ ID NO: 1038406 - protein, 25 aa, Mycobacterium
SPTQRLTQQILWDRLCAALTPGNVV

SEQ ID NO: 1038407 - protein, 18 aa, Mycobacterium
SPVALSVTLEAMRRAAKL

SEQ ID NO: 1038408 - protein, 17 aa, Mycobacterium
SQFPNRAAYKFIDYDVD

SEQ ID NO: 1038409 - protein, 18 aa, Mycobacterium
SQHAWTFRPGAALDAELC

SEQ ID NO: 1038410 - protein, 20 aa, Mycobacterium
SQKQCLRSLDALGLLETRIL

SEQ ID NO: 1038411 - protein, 18 aa, Mycobacterium
SQLHICGVVNIIDIGIGE

SEQ ID NO: 1038412 - protein, 18 aa, Mycobacterium
SQPDLPWHHVRQIASELA

SEQ ID NO: 1038413 - protein, 22 aa, Mycobacterium
SQPYCPVGISPLFETIDDLHNG

SEQ ID NO: 1038414 - protein, 21 aa, Mycobacterium
SQSKLPGAVFPVGKELENTSD

SEQ ID NO: 1038415 - protein, 18 aa, Mycobacterium
SQSSCVTPRCRTSRICPS

SEQ ID NO: 1038416 - protein, 19 aa, Mycobacterium
SQTAPGWTGARGTPTRLLL

SEQ ID NO: 1038417 - protein, 27 aa, Mycobacterium
SQWQNCLLRVSFNYREGMMLHAVMYND

SEQ ID NO: 1038418 - protein, 18 aa, Mycobacterium
SQWTVRRTTIDLAGTLAS

SEQ ID NO: 1038419 - protein, 21 aa, Mycobacterium
SRAHSARSWLGDNAIHKLGAV

SEQ ID NO: 1038420 - protein, 21 aa, Mycobacterium
SRAHTKMLFRAGLLNEEQRDG

SEQ ID NO: 1038421 - protein, 18 aa, Mycobacterium
SRAPRWAIAYKYLPEEAQ

SEQ ID NO: 1038422 - protein, 19 aa, Mycobacterium
SRARDRWEALTALAELADD

SEQ ID NO: 1038423 - protein, 24 aa, Mycobacterium
SRASHARFAVYLGDLGNDTAALAR

SEQ ID NO: 1038424 - protein, 17 aa, Mycobacterium
SRASPSWYERSAESVDN

SEQ ID NO: 1038425 - protein, 19 aa, Mycobacterium
SRCAVLDMYLVGSVRSSAA

SEQ ID NO: 1038426 - protein, 20 aa, Mycobacterium
SRCRTWPVPVARTTALCQDN

SEQ ID NO: 1038427 - protein, 24 aa, Mycobacterium
SRDEIIRMVDLMISRVANQLKVKD

SEQ ID NO: 1038428 - protein, 17 aa, Mycobacterium
SRDLAFTAATAYADAAE

SEQ ID NO: 1038429 - protein, 20 aa, Mycobacterium
SRDPPYSWVATIFRSALEID

SEQ ID NO: 1038430 - protein, 19 aa, Mycobacterium
SRDSGPIAVAKLGSLRDEI

SEQ ID NO: 1038431 - protein, 26 aa, Mycobacterium
SREPIGVAGEVIWRVSMLSPADEAVE

SEQ ID NO: 1038432 - protein, 23 aa, Mycobacterium
SREVSLSVLQVWQALTEAIARRP

SEQ ID NO: 1038433 - protein, 18 aa, Mycobacterium
SRFGWYAGNGCAEDRYLG

SEQ ID NO: 1038434 - protein, 22 aa, Mycobacterium
SRLALWGRRLFGETVTQAQYPL

SEQ ID NO: 1038435 - protein, 19 aa, Mycobacterium
SRLATEWLDGSGIEVDNGV

SEQ ID NO: 1038436 - protein, 22 aa, Mycobacterium
SRLEGRMAAIGIETFLSRTTNG

SEQ ID NO: 1038437 - protein, 19 aa, Mycobacterium
SRLIGLVLDRGVARGSTHL

SEQ ID NO: 1038438 - protein, 27 aa, Mycobacterium
SRLPDAATLIAPWPIALWPVRSNDICV

SEQ ID NO: 1038439 - protein, 20 aa, Mycobacterium
SRLRAGQVGVALPRRVGNEL

SEQ ID NO: 1038440 - protein, 20 aa, Mycobacterium
SRLRLLAEIDTRAVVLAATQ

SEQ ID NO: 1038441 - protein, 21 aa, Mycobacterium
SRLRRRDVCSVVHLSDLLDKQ

SEQ ID NO: 1038442 - protein, 17 aa, Mycobacterium
SRLTERGADIFVIGTGP

SEQ ID NO: 1038443 - protein, 20 aa, Mycobacterium
SRLTGSVTMLCRGLVSINSS

SEQ ID NO: 1038444 - protein, 21 aa, Mycobacterium
SRLVSQLGLDAVRIIADTFAQ

SEQ ID NO: 1038445 - protein, 27 aa, Mycobacterium
SRMFRRCMRCGYTAFCVDVFSRRIPGW

SEQ ID NO: 1038446 - protein, 25 aa, Mycobacterium
SRNMIKQRFGRYIFMGSVVGLSGVP

SEQ ID NO: 1038447 - protein, 21 aa, Mycobacterium
SRNPIAIIVPCHRVIGASGQL

SEQ ID NO: 1038448 - protein, 18 aa, Mycobacterium
SRPEYPDTAFSFAGAQAG

SEQ ID NO: 1038449 - protein, 20 aa, Mycobacterium
SRPLITNMIRLLKLPIPVQR

SEQ ID NO: 1038450 - protein, 25 aa, Mycobacterium
SRQARFGTVVARERAQAVAGLRALA

SEQ ID NO: 1038451 - protein, 17 aa, Mycobacterium
SRQIAMYLCRELTDLSL

SEQ ID NO: 1038452 - protein, 18 aa, Mycobacterium
SRQSGLVNESKFFNGYID

SEQ ID NO: 1038453 - protein, 18 aa, Mycobacterium
SRQWVQFRLPETSVASPP

SEQ ID NO: 1038454 - protein, 18 aa, Mycobacterium
SRRIIMKANVSFHARGEV

SEQ ID NO: 1038455 - protein, 22 aa, Mycobacterium
SRRSPRSGMPHVRHPRMKSNSG

SEQ ID NO: 1038456 - protein, 21 aa, Mycobacterium
SRSGPPYVPWLAPDVGDQLMT

SEQ ID NO: 1038457 - protein, 46 aa, Mycobacterium
SRSLEEVFIPTGIPYKVVGGFCFYESKEIRDLIAYLRVLDNPGDAV

SEQ ID NO: 1038458 - protein, 18 aa, Mycobacterium
SRSYKLVEVDNALHTSDN

SEQ ID NO: 1038459 - protein, 26 aa, Mycobacterium
SRTLDETCLLMFPRRDLTVSEVEATS

SEQ ID NO: 1038460 - protein, 24 aa, Mycobacterium
SRTPWRLNQNYLRDIRLIRRGKVA

SEQ ID NO: 1038461 - protein, 21 aa, Mycobacterium
SRTSAELDFDYDVAGSVDCRG

SEQ ID NO: 1038462 - protein, 21 aa, Mycobacterium
SRVDPHWAFATKQIDVRQSPG

SEQ ID NO: 1038463 - protein, 18 aa, Mycobacterium
SRVLKWIVDRIEHKAGGQ

SEQ ID NO: 1038464 - protein, 20 aa, Mycobacterium
SRVVHALRARGALIRIGHDA

SEQ ID NO: 1038465 - protein, 18 aa, Mycobacterium
SRVVRIAWSWLRHPVKSR

SEQ ID NO: 1038466 - protein, 19 aa, Mycobacterium
SRWTVQLMWHAGRSDNLAH

SEQ ID NO: 1038467 - protein, 17 aa, Mycobacterium
SRYFVSLVTGQVAKNMI

SEQ ID NO: 1038468 - protein, 29 aa, Mycobacterium
SSASFGTLWIKSPANMLGYWNNPERTREI

SEQ ID NO: 1038469 - protein, 17 aa, Mycobacterium
SSCQWPKSQIVYAAGAV

SEQ ID NO: 1038470 - protein, 17 aa, Mycobacterium
SSGDVLMVAWMDDQALA

SEQ ID NO: 1038471 - protein, 17 aa, Mycobacterium
SSGSLVVHRGAGWRFVP

SEQ ID NO: 1038472 - protein, 24 aa, Mycobacterium
SSIDVRLDCMFRVFNNTRYTHIDP

SEQ ID NO: 1038473 - protein, 19 aa, Mycobacterium
SSIPAEFHGQIDITKEVLG

SEQ ID NO: 1038474 - protein, 18 aa, Mycobacterium
SSLLSRRDVVVVASVSCI

SEQ ID NO: 1038475 - protein, 19 aa, Mycobacterium
SSLVLRSTYLIRVDLRIDP

SEQ ID NO: 1038476 - protein, 22 aa, Mycobacterium
SSPMGYPRADFVIGNRDVLLNV

SEQ ID NO: 1038477 - protein, 17 aa, Mycobacterium
SSPRIAGQIMRTDSYDL

SEQ ID NO: 1038478 - protein, 23 aa, Mycobacterium
SSRAIRMLSIELGKLSADHDQTN

SEQ ID NO: 1038479 - protein, 18 aa, Mycobacterium
SSRLAIPACSARRIVVRR

SEQ ID NO: 1038480 - protein, 17 aa, Mycobacterium
SSSKGRYLKKVTVSTTM

SEQ ID NO: 1038481 - protein, 20 aa, Mycobacterium
SSSLVALHLACLSLLSGECD

SEQ ID NO: 1038482 - protein, 18 aa, Mycobacterium
SSSLVAVHLACQSLRHRE

SEQ ID NO: 1038483 - protein, 18 aa, Mycobacterium
SSSLVAVHLACQSLRLRE

SEQ ID NO: 1038484 - protein, 25 aa, Mycobacterium
SSSRKEQAWEFVKFATGPAGQALIG

SEQ ID NO: 1038485 - protein, 19 aa, Mycobacterium
SSTEFGYARLHDSWSTGSS

SEQ ID NO: 1038486 - protein, 24 aa, Mycobacterium
SSTEPIAVIGMGCRFPGGVNNPEQ

SEQ ID NO: 1038487 - protein, 17 aa, Mycobacterium
SSTIVFANSLRTAERLT

SEQ ID NO: 1038488 - protein, 17 aa, Mycobacterium
SSTSSHCRPRWPWSVPV

SEQ ID NO: 1038489 - protein, 18 aa, Mycobacterium
SSVLFRFDDWSVHAIGNV

SEQ ID NO: 1038490 - protein, 22 aa, Mycobacterium
SSVYAMALLFAFDRAGAVEDIE

SEQ ID NO: 1038491 - protein, 17 aa, Mycobacterium
SSYRRDLIRYSKHLSDR

SEQ ID NO: 1038492 - protein, 23 aa, Mycobacterium
STALYPPKRFLGAARNIEEGGSL

SEQ ID NO: 1038493 - protein, 18 aa, Mycobacterium
STCSPHLAEMVGVVANAL

SEQ ID NO: 1038494 - protein, 18 aa, Mycobacterium
STIAGRLLGSVPANVSRR

SEQ ID NO: 1038495 - protein, 18 aa, Mycobacterium
STIRACSMSAIAASTSAS

SEQ ID NO: 1038496 - protein, 17 aa, Mycobacterium
STLGYKGYPKSCCTSLN

SEQ ID NO: 1038497 - protein, 18 aa, Mycobacterium
STLLPRQQLWSVQVPRRL

SEQ ID NO: 1038498 - protein, 26 aa, Mycobacterium
STMPPSKLGWGWARFAFTSWKTLSWV

SEQ ID NO: 1038499 - protein, 24 aa, Mycobacterium
STNASWTPRLGIVADAVDQKEALG

SEQ ID NO: 1038500 - protein, 34 aa, Mycobacterium
STNKRLVKDFGINTANMFGFWEWVGGRYSVDSAI

SEQ ID NO: 1038501 - protein, 25 aa, Mycobacterium
STPDPLEWGCFQFGVIQAEEHFTFY

SEQ ID NO: 1038502 - protein, 19 aa, Mycobacterium
STPNLLFGKMSFLINSGAV

SEQ ID NO: 1038503 - protein, 20 aa, Mycobacterium
STRMIGAIVMVHGDDKGLVL

SEQ ID NO: 1038504 - protein, 18 aa, Mycobacterium
STSTPFSLLVMYPASGVP

SEQ ID NO: 1038505 - protein, 23 aa, Mycobacterium
STTASPWLVSPIRNPGQYEVIYD

SEQ ID NO: 1038506 - protein, 26 aa, Mycobacterium
STTWLKLKAVPMLGISVLGEVHDEVA

SEQ ID NO: 1038507 - protein, 17 aa, Mycobacterium
STVCAYVPVGTEPGAIE

SEQ ID NO: 1038508 - protein, 17 aa, Mycobacterium
STVGLYVERAWPRHRRL

SEQ ID NO: 1038509 - protein, 24 aa, Mycobacterium
STVIPARRGWVLWGAGVGALTYAP

SEQ ID NO: 1038510 - protein, 19 aa, Mycobacterium
STVTLPVLAYMPLLSVLQL

SEQ ID NO: 1038511 - protein, 26 aa, Mycobacterium
STWRDPRLWWQLRNPFTPSWGESYIE

SEQ ID NO: 1038512 - protein, 24 aa, Mycobacterium
SVACQEFITQLGRNFQVIYEQANS

SEQ ID NO: 1038513 - protein, 20 aa, Mycobacterium
SVARLVGAPPGYIGHDQGGQ

SEQ ID NO: 1038514 - protein, 25 aa, Mycobacterium
SVEGRPRRAGVSSFGISGTNAHVIL

SEQ ID NO: 1038515 - protein, 21 aa, Mycobacterium
SVELFKPMAVKAIRTEVLGGL

SEQ ID NO: 1038516 - protein, 20 aa, Mycobacterium
SVERVMVVRDRIRTEPPHPG

SEQ ID NO: 1038517 - protein, 25 aa, Mycobacterium
SVESLACAYAAVLVKAKRYAEAAKL

SEQ ID NO: 1038518 - protein, 19 aa, Mycobacterium
SVEYVKVFTDRASSAETND

SEQ ID NO: 1038519 - protein, 19 aa, Mycobacterium
SVFRADFLNELDAPAQAGA

SEQ ID NO: 1038520 - protein, 17 aa, Mycobacterium
SVIPLGIGNMVGTFVSP

SEQ ID NO: 1038521 - protein, 17 aa, Mycobacterium
SVLAGSVPIELDISAGF

SEQ ID NO: 1038522 - protein, 26 aa, Mycobacterium
SVLAYPRVVWVAGGLLKGASVDAEVA

SEQ ID NO: 1038523 - protein, 28 aa, Mycobacterium
SVMPHLVSLPGYPFARQRHWVEPRYTIW

SEQ ID NO: 1038524 - protein, 19 aa, Mycobacterium
SVPEQAKRLLAMLEARGNG

SEQ ID NO: 1038525 - protein, 25 aa, Mycobacterium
SVPTPLLCGALRIVFPVHADVIKHA

SEQ ID NO: 1038526 - protein, 24 aa, Mycobacterium
SVRGCDAFVLQSCPAPVNTWLMEQ

SEQ ID NO: 1038527 - protein, 19 aa, Mycobacterium
SVRNLPGVHLLSPDQLNTY

SEQ ID NO: 1038528 - protein, 17 aa, Mycobacterium
SVSARVAVEAGVAQCWH

SEQ ID NO: 1038529 - protein, 17 aa, Mycobacterium
SVSLICYIGPGVEYAGD

SEQ ID NO: 1038530 - protein, 23 aa, Mycobacterium
SVTGTALAGCYGRTRAIRRNTTP

SEQ ID NO: 1038531 - protein, 30 aa, Mycobacterium
SVYFDYWAAKGIDVTPFFSVLDGPHIPAPG

SEQ ID NO: 1038532 - protein, 24 aa, Mycobacterium
SWDLRKFLWAPKLGCYGIQRIHLL

SEQ ID NO: 1038533 - protein, 17 aa, Mycobacterium
SWGSGKDWQVWAGDKVA

SEQ ID NO: 1038534 - protein, 19 aa, Mycobacterium
SWNALCGIVEVGGSLEKFR

SEQ ID NO: 1038535 - protein, 33 aa, Mycobacterium
SWNLHCATIGQPLDWFCLFSSGAALLGSPGQGA

SEQ ID NO: 1038536 - protein, 19 aa, Mycobacterium
SWRSFREGFAKDSLDIEGY

SEQ ID NO: 1038537 - protein, 21 aa, Mycobacterium
SWSRRACVVIVGWRTVIDSGQ

SEQ ID NO: 1038538 - protein, 19 aa, Mycobacterium
SWYRGSPIGRERKTEELSR

SEQ ID NO: 1038539 - protein, 20 aa, Mycobacterium
SYAGVPVRVCRTGYTGEQGY

SEQ ID NO: 1038540 - protein, 26 aa, Mycobacterium
SYANRFGYNVVRHFTGHGIGTTFHNG

SEQ ID NO: 1038541 - protein, 21 aa, Mycobacterium
SYIDYAMSVIVGRALPEVRDG

SEQ ID NO: 1038542 - protein, 17 aa, Mycobacterium
SYITRFFWFIFTEISQA

SEQ ID NO: 1038543 - protein, 34 aa, Mycobacterium; identical to SEQ ID NO: 206803

SEQ ID NO: 1038544 - protein, 25 aa, Mycobacterium
SYQPTIAGLRAFVAVVEKGHFSAAA

SEQ ID NO: 1038545 - protein, 26 aa, Mycobacterium
SYRELPLRLFEFGTIYRYEKSGVVHG

SEQ ID NO: 1038546 - protein, 20 aa, Mycobacterium
SYSESFGLVAVEAQACGTPV

SEQ ID NO: 1038547 - protein, 19 aa, Mycobacterium
SYVLHPYQMVKDLRNEYEV

SEQ ID NO: 1038548 - protein, 34 aa, Mycobacterium
TAAASGFSRFPIVDGDLDATVGIVHVKQVFEVPS

SEQ ID NO: 1038549 - protein, 17 aa, Mycobacterium
TAAFERLIVLVRSTSGD

SEQ ID NO: 1038550 - protein, 18 aa, Mycobacterium
TAAKWIVDYGSLQGLVDN

SEQ ID NO: 1038551 - protein, 17 aa, Mycobacterium
TAAMPPAATVCRDKFVM

SEQ ID NO: 1038552 - protein, 22 aa, Mycobacterium
TACARCATPGPHRAFHIAAGGS

SEQ ID NO: 1038553 - protein, 18 aa, Mycobacterium
TADRLAAGDMGRYADAKE

SEQ ID NO: 1038554 - protein, 19 aa, Mycobacterium
TADVGLIIAVKRLAAAKTR

SEQ ID NO: 1038555 - protein, 25 aa, Mycobacterium
TADWLWIPVRRSWRLNERHYGALQG

SEQ ID NO: 1038556 - protein, 19 aa, Mycobacterium
TAEFIYLLYCNQIRQNWAV

SEQ ID NO: 1038557 - protein, 23 aa, Mycobacterium
TAEMLRRKGIPCDEVRKHFEPPK

SEQ ID NO: 1038558 - protein, 23 aa, Mycobacterium
TAEPAFAKLGVRDEIVRALAERG

SEQ ID NO: 1038559 - protein, 19 aa, Mycobacterium
TAFCGCDVLVWLTAIAFKH

SEQ ID NO: 1038560 - protein, 17 aa, Mycobacterium
TAGFARHSGGLSVQTFL

SEQ ID NO: 1038561 - protein, 25 aa, Mycobacterium
TAHGAEELGRWGVGVAESGVSYALR

SEQ ID NO: 1038562 - protein, 23 aa, Mycobacterium
TAHGGPHYLGLAVHQMVIDDASR

SEQ ID NO: 1038563 - protein, 37 aa, Mycobacterium
TAIPLAKACARIMLGSSISQLRFEGMLAASGDGGNVA

SEQ ID NO: 1038564 - protein, 26 aa, Mycobacterium
TAIVKGLRTGVDFEYELQMAQMNKHI

SEQ ID NO: 1038565 - protein, 17 aa, Mycobacterium
TALLSAHRVERVRMVAT

SEQ ID NO: 1038566 - protein, 20 aa, Mycobacterium
TALSVRVCTIRTDPWNLGAR

SEQ ID NO: 1038567 - protein, 18 aa, Mycobacterium
TANIALLHFLDGKKRYIL

SEQ ID NO: 1038568 - protein, 24 aa, Mycobacterium
TAPARAAYIAGPWGAVASLSPELF

SEQ ID NO: 1038569 - protein, 24 aa, Mycobacterium
TAPEVIRLAPPLIITESQIDSFIT

SEQ ID NO: 1038570 - protein, 19 aa, Mycobacterium
TAPTWPDRLPDPVNSSVAV

SEQ ID NO: 1038571 - protein, 17 aa, Mycobacterium
TAQRPGDVLTQYGGITV

SEQ ID NO: 1038572 - protein, 17 aa, Mycobacterium
TARDPLAIVLSGGPASV

SEQ ID NO: 1038573 - protein, 25 aa, Mycobacterium
TARKTLVLPVRFAGVHVYGDVTRGV

SEQ ID NO: 1038574 - protein, 20 aa, Mycobacterium
TARMVRGRLDAELVGNISIR

SEQ ID NO: 1038575 - protein, 23 aa, Mycobacterium
TARQIPLPVGVTLVSDPEMLVVN

SEQ ID NO: 1038576 - protein, 25 aa, Mycobacterium
TARRRGSCAHDEMYSGPGGVVRLTN

SEQ ID NO: 1038577 - protein, 23 aa, Mycobacterium
TASGVAISSRLAHGLGEVSETAL

SEQ ID NO: 1038578 - protein, 21 aa, Mycobacterium
TASPGSPWLADTWRDRFQKML

SEQ ID NO: 1038579 - protein, 17 aa, Mycobacterium
TASRAHTKMLFRAGLLN

SEQ ID NO: 1038580 - protein, 20 aa, Mycobacterium
TATAALWFALETDLPVLVDA

SEQ ID NO: 1038581 - protein, 24 aa, Mycobacterium
TATSPVAWTACNRLKQGSTGQHLP

SEQ ID NO: 1038582 - protein, 20 aa, Mycobacterium
TAVACPRFVDFVECGVTSGR

SEQ ID NO: 1038583 - protein, 22 aa, Mycobacterium
TAVRRAKVLAGLDADVDVRIVS

SEQ ID NO: 1038584 - protein, 21 aa, Mycobacterium
TAWLAEGLLMYLPATAQDGLF

SEQ ID NO: 1038585 - protein, 22 aa, Mycobacterium
TAWLGRDRFVLSAGHSSLTLYI

SEQ ID NO: 1038586 - protein, 23 aa, Mycobacterium
TCRSRLASPSAIIVGRRDVTMKK

SEQ ID NO: 1038587 - protein, 18 aa, Mycobacterium
TDAIALLIKEGHPVHVVV

SEQ ID NO: 1038588 - protein, 27 aa, Mycobacterium
TDAKAFARLGIRCFGFTPLRLPPELDF

SEQ ID NO: 1038589 - protein, 21 aa, Mycobacterium
TDAKAILGIDYWDVGGIQITV

SEQ ID NO: 1038590 - protein, 26 aa, Mycobacterium
TDARGRLRIGAAVGINGDVAGKAQSL

SEQ ID NO: 1038591 - protein, 24 aa, Mycobacterium
TDARRHEVYWARYRDGVRIAGPAV

SEQ ID NO: 1038592 - protein, 18 aa, Mycobacterium
TDDLLAFVVELMPMSQEP

SEQ ID NO: 1038593 - protein, 17 aa, Mycobacterium
TDELNFLQFAVIDALLV

SEQ ID NO: 1038594 - protein, 23 aa, Mycobacterium
TDEPLSALAFKVATHPFFGKLTY

SEQ ID NO: 1038595 - protein, 17 aa, Mycobacterium
TDGLPVWIYQFKISPHP

SEQ ID NO: 1038596 - protein, 22 aa, Mycobacterium
TDIDAVLEFRVSQAVVLERLKG

SEQ ID NO: 1038597 - protein, 22 aa, Mycobacterium
TDLPAGRWSEFLGEPRLAQRIA

SEQ ID NO: 1038598 - protein, 26 aa, Mycobacterium
TDLRDLGLDSVRFTLLMKQLGLSQEA

SEQ ID NO: 1038599 - protein, 18 aa, Mycobacterium
TDLTLGFLLGQIDAGVDA

SEQ ID NO: 1038600 - protein, 26 aa, Mycobacterium
TDNYKMLGGQGFAIPIGQAMEVVGAI

SEQ ID NO: 1038601 - protein, 19 aa, Mycobacterium
TDSAVRRYVTDAGPLLSRL

SEQ ID NO: 1038602 - protein, 19 aa, Mycobacterium
TDSGAQAWLGPGPSADSAP

SEQ ID NO: 1038603 - protein, 24 aa, Mycobacterium
TDSYDLPWHRVITAYRHPARHLTT

SEQ ID NO: 1038604 - protein, 17 aa, Mycobacterium
TDVLGELGLPTGIDYMG

SEQ ID NO: 1038605 - protein, 18 aa, Mycobacterium
TDWRGSPPRADWSLPPIR

SEQ ID NO: 1038606 - protein, 25 aa, Mycobacterium
TEAAELHEIYKLGVVAIPTNKPMIR

SEQ ID NO: 1038607 - protein, 21 aa, Mycobacterium
TEALRKIYAGLGIVSRSKIIE

SEQ ID NO: 1038608 - protein, 24 aa, Mycobacterium
TECTNRFDVVQAFTDDALTTCEKC

SEQ ID NO: 1038609 - protein, 21 aa, Mycobacterium
TEDRPVLTLNRAFIAAAAAEA

SEQ ID NO: 1038610 - protein, 19 aa, Mycobacterium
TEDSKLWLLQTRVAERSAQ

SEQ ID NO: 1038611 - protein, 22 aa, Mycobacterium
TEFLPGSLIDRAEFESENRRVV

SEQ ID NO: 1038612 - protein, 18 aa, Mycobacterium
TEIKFRSVLEEPTYEDSI

SEQ ID NO: 1038613 - protein, 18 aa, Mycobacterium
TELATALNLMNERALFAS

SEQ ID NO: 1038614 - protein, 20 aa, Mycobacterium
TELELLGAVCNMGVSNIALY

SEQ ID NO: 1038615 - protein, 19 aa, Mycobacterium
TELEPWFPGDEDIERRYRT

SEQ ID NO: 1038616 - protein, 20 aa, Mycobacterium
TELQARLRLAATRRRSALDC

SEQ ID NO: 1038617 - protein, 17 aa, Mycobacterium
TELSKALANFLFGDDDA

SEQ ID NO: 1038618 - protein, 25 aa, Mycobacterium
TELSRSVFAKGIFPAVDPLASSSTI

SEQ ID NO: 1038619 - protein, 24 aa, Mycobacterium
TELVARGGVRPGLTEREVGRELEG

SEQ ID NO: 1038620 - protein, 19 aa, Mycobacterium
TELVAWINAHPDFAYLPVD

SEQ ID NO: 1038621 - protein, 22 aa, Mycobacterium
TEPLTNWYLRRSRARFWDEDVD

SEQ ID NO: 1038622 - protein, 20 aa, Mycobacterium
TESALRFVGTATFEALSGQP

SEQ ID NO: 1038623 - protein, 19 aa, Mycobacterium
TEVFACGTAAFITPVSRVK

SEQ ID NO: 1038624 - protein, 19 aa, Mycobacterium
TFAEWDFEANTTYPLFLHE

SEQ ID NO: 1038625 - protein, 23 aa, Mycobacterium
TFAGATRGGWWAGVARDGKIGAL

SEQ ID NO: 1038626 - protein, 17 aa, Mycobacterium
TFGGLKPVHALADCGDV

SEQ ID NO: 1038627 - protein, 20 aa, Mycobacterium
TFLRAIGAIERFSGHSSGRT

SEQ ID NO: 1038628 - protein, 24 aa, Mycobacterium
TFLTSELPKWLSANRSVKSTGSAV

SEQ ID NO: 1038629 - protein, 23 aa, Mycobacterium
TFNASAIPDMWASTLTDALKSYG

SEQ ID NO: 1038630 - protein, 18 aa, Mycobacterium
TFQILPWATTAGHHHSAR

SEQ ID NO: 1038631 - protein, 19 aa, Mycobacterium
TFRLIDKVFTQWNVDYTPV

SEQ ID NO: 1038632 - protein, 30 aa, Mycobacterium
TFTGRSWPLADVRLLAPMLASKVVCIGKNY

SEQ ID NO: 1038633 - protein, 23 aa, Mycobacterium
TGAKEILCIRVLGGSSRRYASIG

SEQ ID NO: 1038634 - protein, 17 aa, Mycobacterium
TGAMAGPGDRFVFNMLR

SEQ ID NO: 1038635 - protein, 32 aa, Mycobacterium
TGASPCFLLDFPRRFPDATVVRLERDYRSTPQ

SEQ ID NO: 1038636 - protein, 19 aa, Mycobacterium
TGGFTEFVPLPFVHQNSPL

SEQ ID NO: 1038637 - protein, 18 aa, Mycobacterium
TGGMLKPGLVRRTVDCGI

SEQ ID NO: 1038638 - protein, 23 aa, Mycobacterium
TGGRIPREYIPSVEAGARDAMQY

SEQ ID NO: 1038639 - protein, 29 aa, Mycobacterium
TGIALAMVCAARGYHCVLTMPETMSIERR

SEQ ID NO: 1038640 - protein, 20 aa, Mycobacterium
TGIIIADTKFEFGIDRDGNL

SEQ ID NO: 1038641 - protein, 27 aa, Mycobacterium
TGIVSRGGSIMASWCLANHRESFLYTN

SEQ ID NO: 1038642 - protein, 23 aa, Mycobacterium
TGKSATTAWLIERLQRPTLVMAP

SEQ ID NO: 1038643 - protein, 17 aa, Mycobacterium
TGLESTMRFILSAKSAY

SEQ ID NO: 1038644 - protein, 25 aa, Mycobacterium
TGLLLDRLLPIVGSRVITVSSLSHR

SEQ ID NO: 1038645 - protein, 19 aa, Mycobacterium
TGMELRAAIDAGHVVVAEK

SEQ ID NO: 1038646 - protein, 21 aa, Mycobacterium
TGPGDRWIVNQIRSVAPKTIL

SEQ ID NO: 1038647 - protein, 18 aa, Mycobacterium
TGPSSGQVSCGGKPTLKA

SEQ ID NO: 1038648 - protein, 20 aa, Mycobacterium
TGQGVLKIMSKMGISTLASY

SEQ ID NO: 1038649 - protein, 22 aa, Mycobacterium
TGRDGVARDILWSEFSARNRAV

SEQ ID NO: 1038650 - protein, 20 aa, Mycobacterium
TGRLRDFVIHRITSVVSSDS

SEQ ID NO: 1038651 - protein, 26 aa, Mycobacterium
TGRRRRCGWFDAVIARYATRVNGITD

SEQ ID NO: 1038652 - protein, 20 aa, Mycobacterium
TGSWMPWPVASTTNSAHTTS

SEQ ID NO: 1038653 - protein, 19 aa, Mycobacterium
TGVFDKIRILFAATTEAKV

SEQ ID NO: 1038654 - protein, 17 aa, Mycobacterium
TGVPRAGLSTIFSPSRS

SEQ ID NO: 1038655 - protein, 24 aa, Mycobacterium
TGVTLSVAVAFQYPTIESLANRII

SEQ ID NO: 1038656 - protein, 17 aa, Mycobacterium
TGVVKVIAREVDDDGNV

SEQ ID NO: 1038657 - protein, 24 aa, Mycobacterium
THEKIWRPKVFTISATEGTGLTQM

SEQ ID NO: 1038658 - protein, 21 aa, Mycobacterium
THLPTCWQMRLSSPRVIVVGY

SEQ ID NO: 1038659 - protein, 24 aa, Mycobacterium
THPVGAAGIEFMALAPKQSRDVTL

SEQ ID NO: 1038660 - protein, 18 aa, Mycobacterium
THPVRGPVSLGIAAIETL

SEQ ID NO: 1038661 - protein, 23 aa, Mycobacterium
THSGICRTWWSSKWPTRAGDARC

SEQ ID NO: 1038662 - protein, 25 aa, Mycobacterium
THYHKIHLYDAFGFTESRTVTAGHE

SEQ ID NO: 1038663 - protein, 18 aa, Mycobacterium
THYPLLAGLIQLAMGENV

SEQ ID NO: 1038664 - protein, 20 aa, Mycobacterium
TICIYKHLLGVRRSKNYLRI

SEQ ID NO: 1038665 - protein, 21 aa, Mycobacterium
TICSTEGGFLTGWQPDEFDAE

SEQ ID NO: 1038666 - protein, 26 aa, Mycobacterium
TIDPDHAYPLLVSVFLDKDFAFVVSS

SEQ ID NO: 1038667 - protein, 18 aa, Mycobacterium
TIHEMVLSDSFWDEIFRE

SEQ ID NO: 1038668 - protein, 18 aa, Mycobacterium
TIHRAWRSKLPEVVEKGT

SEQ ID NO: 1038669 - protein, 23 aa, Mycobacterium
TIIDMWLPLSWLLNMVNRSMGHD

SEQ ID NO: 1038670 - protein, 25 aa, Mycobacterium
TILGQRQLLFWAWLIYGGRLLRGKL

SEQ ID NO: 1038671 - protein, 17 aa, Mycobacterium
TIPETGYERLCRSDIDN

SEQ ID NO: 1038672 - protein, 18 aa, Mycobacterium
TIRQRLGSIEGRRILIVG

SEQ ID NO: 1038673 - protein, 17 aa, Mycobacterium
TISDLIPAIALAMSRFS

SEQ ID NO: 1038674 - protein, 23 aa, Mycobacterium
TITFPQFRTLVILSNRGPVNLAT

SEQ ID NO: 1038675 - protein, 17 aa, Mycobacterium
TIWPGVRTTPSGFISTV

SEQ ID NO: 1038676 - protein, 18 aa, Mycobacterium
TIYFPSLSSQTFVYKGML

SEQ ID NO: 1038677 - protein, 19 aa, Mycobacterium
TKAAEFAELLGVSREEKSS

SEQ ID NO: 1038678 - protein, 23 aa, Mycobacterium
TKALRVGYVAAFSVPANQLAQVV

SEQ ID NO: 1038679 - protein, 22 aa, Mycobacterium
TKGRAMAIAVMRKHRLAERLLV

SEQ ID NO: 1038680 - protein, 27 aa, Mycobacterium
TKGWNLCGLKAAIAIAGREAAADLRRI

SEQ ID NO: 1038681 - protein, 17 aa, Mycobacterium
TKHIPAFKLTRSSAAYW

SEQ ID NO: 1038682 - protein, 23 aa, Mycobacterium
TKKHCVPMSISICTQTLHTVGAA

SEQ ID NO: 1038683 - protein, 27 aa, Mycobacterium
TKLPTAQRRDMMWICRDGDRAKNHLLE

SEQ ID NO: 1038684 - protein, 23 aa, Mycobacterium
TKRLRAQGVRLVYDTPRQGTSNA

SEQ ID NO: 1038685 - protein, 26 aa, Mycobacterium
TKTLCANCPIRRPCLEAAMERAEPWG

SEQ ID NO: 1038686 - protein, 17 aa, Mycobacterium
TKVVRCLVKDGHECVVY

SEQ ID NO: 1038687 - protein, 20 aa, Mycobacterium
TLAAPFLFFLQNVRYRSIGV

SEQ ID NO: 1038688 - protein, 18 aa, Mycobacterium
TLAEFYWVVWDAYKTLKY

SEQ ID NO: 1038689 - protein, 18 aa, Mycobacterium
TLAFPRYRQSVAADIAAE

SEQ ID NO: 1038690 - protein, 25 aa, Mycobacterium
TLAPHLVKPLPFLFPLTKRWWERPY

SEQ ID NO: 1038691 - protein, 17 aa, Mycobacterium
TLAVSFSPVGEGLLVDE

SEQ ID NO: 1038692 - protein, 23 aa, Mycobacterium
TLDALVSLVLDWHRPVKIFVETK

SEQ ID NO: 1038693 - protein, 20 aa, Mycobacterium
TLDLSYMESVIWAFKQLWDK

SEQ ID NO: 1038694 - protein, 19 aa, Mycobacterium
TLDYEVWDDGWTVVTKDRK

SEQ ID NO: 1038695 - protein, 17 aa, Mycobacterium
TLEELRAAFDDIRPLND

SEQ ID NO: 1038696 - protein, 24 aa, Mycobacterium
TLFIDEWPQLLTLRASADRDTKIP

SEQ ID NO: 1038697 - protein, 23 aa, Mycobacterium
TLFYCVANMPSAVPKTSTFALTN

SEQ ID NO: 1038698 - protein, 19 aa, Mycobacterium
TLGALAFRAFARALACVVF

SEQ ID NO: 1038699 - protein, 26 aa, Mycobacterium
TLGPKGRNVVLEKKWGAPTITNDGVS

SEQ ID NO: 1038700 - protein, 17 aa, Mycobacterium
TLGSLALMGIRVEELIV

SEQ ID NO: 1038701 - protein, 29 aa, Mycobacterium
TLHAAKGLEFPVVFVTGWEDGMLPHMRTL

SEQ ID NO: 1038702 - protein, 25 aa, Mycobacterium
TLHSVKVIPSRGAWLEFDVDKRDTV

SEQ ID NO: 1038703 - protein, 18 aa, Mycobacterium
TLICAVCVRRRLIELDGP

SEQ ID NO: 1038704 - protein, 17 aa, Mycobacterium
TLLAARVLCEPLENATV

SEQ ID NO: 1038705 - protein, 21 aa, Mycobacterium
TLLALLPLVGVWRGEGEGRGP

SEQ ID NO: 1038706 - protein, 17 aa, Mycobacterium
TLLGLRAGDVVVVPELA

SEQ ID NO: 1038707 - protein, 22 aa, Mycobacterium
TLLPGSLRWLVTVDAMHTQVVT

SEQ ID NO: 1038708 - protein, 20 aa, Mycobacterium
TLNLVGGLRRSMAKAGYCDL

SEQ ID NO: 1038709 - protein, 22 aa, Mycobacterium
TLNPCLKRACGHQFVNRIQGRI

SEQ ID NO: 1038710 - protein, 28 aa, Mycobacterium
TLPLLCRVRHSVSWIWLLRFDVTGLTVN

SEQ ID NO: 1038711 - protein, 29 aa, Mycobacterium
TLRCYLDDHPIFLGRNGRISVFSSERALA

SEQ ID NO: 1038712 - protein, 20 aa, Mycobacterium
TLRLARGVVDPRFVVAGCCR

SEQ ID NO: 1038713 - protein, 22 aa, Mycobacterium
TLSPAACQRVAMAAQDGLARTI

SEQ ID NO: 1038714 - protein, 17 aa, Mycobacterium
TLTALGAEVRWASCNIF

SEQ ID NO: 1038715 - protein, 25 aa, Mycobacterium
TLVAADVWLLLSIPADWSNAEAAGM

SEQ ID NO: 1038716 - protein, 22 aa, Mycobacterium
TLWQTALIRLARLQISDEIDVG

SEQ ID NO: 1038717 - protein, 25 aa, Mycobacterium
TMALKRFAFRLGDIWVQQVKTSVLQ

SEQ ID NO: 1038718 - protein, 24 aa, Mycobacterium
TMDERLHHLFARMPDARVHLYDKV

SEQ ID NO: 1038719 - protein, 27 aa, Mycobacterium
TMGEVRVPAIALWRAQTQRAVENFPIS

SEQ ID NO: 1038720 - protein, 24 aa, Mycobacterium
TMKDLRGGYWRQVRHLLTGSHAGD

SEQ ID NO: 1038721 - protein, 23 aa, Mycobacterium
TMPRTWPLRPVRGLWSETRIYMV

SEQ ID NO: 1038722 - protein, 17 aa, Mycobacterium
TMSAVRLARGFTGRTKI

SEQ ID NO: 1038723 - protein, 20 aa, Mycobacterium
TMSRFRGKAIGTVFQDPMSA

SEQ ID NO: 1038724 - protein, 24 aa, Mycobacterium
TMTERAHRAFGEIMDMAVGLGGTI

SEQ ID NO: 1038725 - protein, 19 aa, Mycobacterium
TMVVTGLHLLGGARADASR

SEQ ID NO: 1038726 - protein, 19 aa, Mycobacterium
TMWVVPFCMGPPGAEDPKL

SEQ ID NO: 1038727 - protein, 19 aa, Mycobacterium
TNCGIGFGCEIKLAEMDMG

SEQ ID NO: 1038728 - protein, 23 aa, Mycobacterium
TNEGLRSRFTRNIDFPSYASHEL

SEQ ID NO: 1038729 - protein, 17 aa, Mycobacterium
TNGKLLRNVLRAQSPTK

SEQ ID NO: 1038730 - protein, 24 aa, Mycobacterium
TNPPRTVSVSVLMDGRIDHVELSK

SEQ ID NO: 1038731 - protein, 23 aa, Mycobacterium
TNRSPRLVAMVRRARRLLPGDPD

SEQ ID NO: 1038732 - protein, 24 aa, Mycobacterium
TNTPRNFARRGIRSYVLPASATFN

SEQ ID NO: 1038733 - protein, 18 aa, Mycobacterium
TNTPVAMVATELCAASLS

SEQ ID NO: 1038734 - protein, 20 aa, Mycobacterium
TNTQFCGGVFTISAVAEQKT

SEQ ID NO: 1038735 - protein, 24 aa, Mycobacterium
TPAALDRRVWLRPFRNLVYAMPPY

SEQ ID NO: 1038736 - protein, 25 aa, Mycobacterium
TPAPVARFLARWVRQAGQKILEPSC

SEQ ID NO: 1038737 - protein, 21 aa, Mycobacterium
TPERLLRCIEAVLECREALAV

SEQ ID NO: 1038738 - protein, 26 aa, Mycobacterium
TPHPPEPHPVLPITPWQHTRHWISAM

SEQ ID NO: 1038739 - protein, 26 aa, Mycobacterium
TPKLRARKLISQWEHRRRGIYCGTVG

SEQ ID NO: 1038740 - protein, 27 aa, Mycobacterium
TPKQKWDRIRYHGGAFIELIVGRSTYD

SEQ ID NO: 1038741 - protein, 18 aa, Mycobacterium
TPLKVTFNNVIIATGSKT

SEQ ID NO: 1038742 - protein, 17 aa, Mycobacterium
TPLMLPSFAVRAALGEF

SEQ ID NO: 1038743 - protein, 18 aa, Mycobacterium
TPNVCPSLHMPLQSGSDR

SEQ ID NO: 1038744 - protein, 17 aa, Mycobacterium
TPPCVNALLEAKVDKVA

SEQ ID NO: 1038745 - protein, 17 aa, Mycobacterium
TPPLRLIVYGGSRVIAA

SEQ ID NO: 1038746 - protein, 23 aa, Mycobacterium
TPPSHLFPAEFAKCAKTLGESAG

SEQ ID NO: 1038747 - protein, 24 aa, Mycobacterium
TPRMISCSFLFLCSGYYNYEQGYA

SEQ ID NO: 1038748 - protein, 26 aa, Mycobacterium
TPRTSDFLHGRWLVLRRGKRNIAGIE

SEQ ID NO: 1038749 - protein, 18 aa, Mycobacterium
TPSFLRYHGYPATICTSV

SEQ ID NO: 1038750 - protein, 26 aa, Mycobacterium
TPSLWIPDLFMLRQIHLAPRLTVNAA

SEQ ID NO: 1038751 - protein, 29 aa, Mycobacterium
TPSQLALAWLLKRSPVMLPIPGTSRVAHL

SEQ ID NO: 1038752 - protein, 25 aa, Mycobacterium
TPVIWRGPMLHRALQQFLSDVYWGD

SEQ ID NO: 1038753 - protein, 26 aa, Mycobacterium
TPWGRGRPGWHLECSAMARAYLGSEF

SEQ ID NO: 1038754 - protein, 19 aa, Mycobacterium
TPWQHTRHWISAMSAAYHR

SEQ ID NO: 1038755 - protein, 17 aa, Mycobacterium
TPYELAATIARRLGLTG

SEQ ID NO: 1038756 - protein, 19 aa, Mycobacterium
TPYPAASLERWLPGSDQLL

SEQ ID NO: 1038757 - protein, 25 aa, Mycobacterium
TQALERLEALLALIEGWVQVVVTAA

SEQ ID NO: 1038758 - protein, 21 aa, Mycobacterium
TQLAVPCGMQPLWGPDNRQTM

SEQ ID NO: 1038759 - protein, 19 aa, Mycobacterium
TQLLGRTQIGECCVIGPDT

SEQ ID NO: 1038760 - protein, 33 aa, Mycobacterium
TQLPPGPWTKWAVSLVGIMPCLRAVSASAGADS

SEQ ID NO: 1038761 - protein, 19 aa, Mycobacterium
TQNMFPGYYKRPEVTATVF

SEQ ID NO: 1038762 - protein, 21 aa, Mycobacterium
TQPRVIVLPGPATALTSDDHG

SEQ ID NO: 1038763 - protein, 22 aa, Mycobacterium
TQQDVWRFVAYLSDVGNADDLT

SEQ ID NO: 1038764 - protein, 18 aa, Mycobacterium
TQQLRALQALMVENEGAI

SEQ ID NO: 1038765 - protein, 18 aa, Mycobacterium
TQQQKWLTMGHQSGGPKK

SEQ ID NO: 1038766 - protein, 29 aa, Mycobacterium
TQRVKANLFYRGLTFHRFPVIGDTLYTST

SEQ ID NO: 1038767 - protein, 27 aa, Mycobacterium
TQYRKILVATEVGMLYQLRRAAPEIDF

SEQ ID NO: 1038768 - protein, 27 aa, Mycobacterium
TRAGVLRFVILDGLAKPGRLVGPDPGL

SEQ ID NO: 1038769 - protein, 26 aa, Mycobacterium
TRARQRLYLSRAITRSSWGQPILNPE

SEQ ID NO: 1038770 - protein, 22 aa, Mycobacterium
TRAYEYPHLGLAPHPGLADLAA

SEQ ID NO: 1038771 - protein, 21 aa, Mycobacterium
TRDVLKITGLDRFVQQQVDGI

SEQ ID NO: 1038772 - protein, 19 aa, Mycobacterium
TRELCLQVADDLATVAKYL

SEQ ID NO: 1038773 - protein, 26 aa, Mycobacterium
TRELVWPAMRISYCRPPGSDRNVVLM

SEQ ID NO: 1038774 - protein, 18 aa, Mycobacterium
TRFEPSVLYGVPSFFARV

SEQ ID NO: 1038775 - protein, 23 aa, Mycobacterium
TRFLSARTIVGWVAVRKFVDKDK

SEQ ID NO: 1038776 - protein, 18 aa, Mycobacterium
TRGKRGAYNDALDVDVVF

SEQ ID NO: 1038777 - protein, 19 aa, Mycobacterium
TRHVKKAAAKLMVHAPEVA

SEQ ID NO: 1038778 - protein, 18 aa, Mycobacterium
TRKSRRLRIDLVGGDQAF

SEQ ID NO: 1038779 - protein, 28 aa, Mycobacterium
TRLACMRAAGTICLGGLIVIKFTEADVV

SEQ ID NO: 1038780 - protein, 18 aa, Mycobacterium
TRLKPEILAVTLAAGERG

SEQ ID NO: 1038781 - protein, 18 aa, Mycobacterium
TRLPAGVMVTHRNLMVNF

SEQ ID NO: 1038782 - protein, 20 aa, Mycobacterium
TRLQEHWEQIEAKTIQTKEK

SEQ ID NO: 1038783 - protein, 21 aa, Mycobacterium
TRLRKDLTWRDLGSFRGIGGC

SEQ ID NO: 1038784 - protein, 20 aa, Mycobacterium
TRLVPERGYHLELITPVPLP

SEQ ID NO: 1038785 - protein, 20 aa, Mycobacterium
TRMPAGPAKLAIKTGAALLP

SEQ ID NO: 1038786 - protein, 20 aa, Mycobacterium
TRMRCAHVLTDDAGYLYTRY

SEQ ID NO: 1038787 - protein, 18 aa, Mycobacterium
TRNGRIGVIGTRATIASH

SEQ ID NO: 1038788 - protein, 19 aa, Mycobacterium
TRNIIPRVVFMEASDDMLV

SEQ ID NO: 1038789 - protein, 20 aa, Mycobacterium
TRPDTMFGVTYLVLAPEHNL

SEQ ID NO: 1038790 - protein, 18 aa, Mycobacterium
TRPHPLFVAFVGAAIDYK

SEQ ID NO: 1038791 - protein, 20 aa, Mycobacterium
TRQANWWYYSRTFEGKQYRV

SEQ ID NO: 1038792 - protein, 20 aa, Mycobacterium
TRQMVTIAAKVEWTVVNTEV

SEQ ID NO: 1038793 - protein, 18 aa, Mycobacterium
TRRDRWRRTSGIRRVRDR

SEQ ID NO: 1038794 - protein, 24 aa, Mycobacterium
TRRQTCVGLRFSDTLFLALSAGME

SEQ ID NO: 1038795 - protein, 22 aa, Mycobacterium
TRSEGGGVLVLKRVNDARRDGD

SEQ ID NO: 1038796 - protein, 18 aa, Mycobacterium
TRSTMSRQCMILHRRLAS

SEQ ID NO: 1038797 - protein, 26 aa, Mycobacterium
TRTPAWRSVRWLARCFRHRRKDDRYP

SEQ ID NO: 1038798 - protein, 26 aa, Mycobacterium
TRTSEIRYRLTFGIVQGYGGHGIGRH

SEQ ID NO: 1038799 - protein, 27 aa, Mycobacterium
TRVPGIGKRGAERIVLELRDKVGPVGA

SEQ ID NO: 1038800 - protein, 21 aa, Mycobacterium
TRWHPLNTLPSMAFDHGPMVT

SEQ ID NO: 1038801 - protein, 19 aa, Mycobacterium
TRYQIVMGERRWRAAQQAG

SEQ ID NO: 1038802 - protein, 20 aa, Mycobacterium
TRYVEAIARARRRAGTGAPN

SEQ ID NO: 1038803 - protein, 18 aa, Mycobacterium
TSAFEWYYQSGLSVVMPV

SEQ ID NO: 1038804 - protein, 33 aa, Mycobacterium
TSARPAVMPMDAWREGEEFVVEFDLPGIKADSL

SEQ ID NO: 1038805 - protein, 21 aa, Mycobacterium
TSCPNCTGRGILLHTDPANST

SEQ ID NO: 1038806 - protein, 20 aa, Mycobacterium
TSDQHVWCFLGDGEMDEPES

SEQ ID NO: 1038807 - protein, 17 aa, Mycobacterium
TSEAMKALTARLEAAHA

SEQ ID NO: 1038808 - protein, 23 aa, Mycobacterium
TSELKNNMIDRFDKVIQALQEPP

SEQ ID NO: 1038809 - protein, 21 aa, Mycobacterium
TSELPCELRRPAVHADDLVSI

SEQ ID NO: 1038810 - protein, 24 aa, Mycobacterium
TSFDPFTIITRGGRPMALREAVAA

SEQ ID NO: 1038811 - protein, 21 aa, Mycobacterium
TSGAQYCRRGLATVRTDPDAP

SEQ ID NO: 1038812 - protein, 29 aa, Mycobacterium
TSGRIERFLQLWAEGSMTFAVPSTPSNYF

SEQ ID NO: 1038813 - protein, 17 aa, Mycobacterium
TSGWSLTAQDPFNNVAR

SEQ ID NO: 1038814 - protein, 17 aa, Mycobacterium
TSHLELRSPDGAVLPGY

SEQ ID NO: 1038815 - protein, 37 aa, Mycobacterium
TSIADLRAIPWVLAWSQSRVMLPGWYGTGSAFQQWVA

SEQ ID NO: 1038816 - protein, 26 aa, Mycobacterium
TSKAFAFAGGRLGYLIATPALVEAML

SEQ ID NO: 1038817 - protein, 25 aa, Mycobacterium
TSNLTLSAFVMFSSVAGIWGGKSQG

SEQ ID NO: 1038818 - protein, 19 aa, Mycobacterium
TSPEAIGLLVALRALANIP

SEQ ID NO: 1038819 - protein, 20 aa, Mycobacterium
TSPIEIKGKGKVERIVLGQN

SEQ ID NO: 1038820 - protein, 22 aa, Mycobacterium
TSRLRLTAHASLDSAKLEVARR

SEQ ID NO: 1038821 - protein, 25 aa, Mycobacterium
TSSHCRPRWPWSVPVRSAPSTFRCL

SEQ ID NO: 1038822 - protein, 17 aa, Mycobacterium
TSSPECAGRAAGSDQGN

SEQ ID NO: 1038823 - protein, 29 aa, Mycobacterium
TSVALGVGYRCGFLGLLHIDITRERLERE

SEQ ID NO: 1038824 - protein, 21 aa, Mycobacterium
TSVAWGLWAGGGMGDRPSASG

SEQ ID NO: 1038825 - protein, 17 aa, Mycobacterium
TSVGLSVVASTQVIELP

SEQ ID NO: 1038826 - protein, 21 aa, Mycobacterium
TSWANGVGILAQLGKDGCIPL

SEQ ID NO: 1038827 - protein, 17 aa, Mycobacterium
TSYGIRTSAQLRCGLDI

SEQ ID NO: 1038828 - protein, 19 aa, Mycobacterium
TTADIWPNPWSMYRTLRDH

SEQ ID NO: 1038829 - protein, 27 aa, Mycobacterium
TTATPCGVCESCLSLAPNAPGHIDVVE

SEQ ID NO: 1038830 - protein, 17 aa, Mycobacterium
TTCEVVRIAALLVQPVM

SEQ ID NO: 1038831 - protein, 25 aa, Mycobacterium
TTCLVPTLLSKLVYELKFGDVVTPP

SEQ ID NO: 1038832 - protein, 23 aa, Mycobacterium
TTFTKRGKLGIRWYSSKQGNGEP

SEQ ID NO: 1038833 - protein, 18 aa, Mycobacterium
TTGAFAIRVFPGDHFYLN

SEQ ID NO: 1038834 - protein, 17 aa, Mycobacterium
TTIMGFITRDGRITAIE

SEQ ID NO: 1038835 - protein, 18 aa, Mycobacterium
TTKLGRACSPVWSSVALH

SEQ ID NO: 1038836 - protein, 26 aa, Mycobacterium
TTLASARLTFHVDVSVGYPIYPPVPT

SEQ ID NO: 1038837 - protein, 21 aa, Mycobacterium
TTLPRQCLLVFGQEGPGITDE

SEQ ID NO: 1038838 - protein, 27 aa, Mycobacterium
TTLRTLRRLGFRCGVVSGGFRRIIEPL

SEQ ID NO: 1038839 - protein, 20 aa, Mycobacterium
TTSHTVWLVAPAHRQTYISK

SEQ ID NO: 1038840 - protein, 25 aa, Mycobacterium
TTTEPPPVFGVPAWLPDRHGDQGGR

SEQ ID NO: 1038841 - protein, 22 aa, Mycobacterium
TTTRLLGALSLRCQPPKTVSPL

SEQ ID NO: 1038842 - protein, 24 aa, Mycobacterium
TTTRWLTGFVPIKIPATGSSFRKI

SEQ ID NO: 1038843 - protein, 24 aa, Mycobacterium
TTTSKSSTAWAPRGTVLITGGTGA

SEQ ID NO: 1038844 - protein, 25 aa, Mycobacterium
TTVAPVRVGFRFGEPAVGELGVRDG

SEQ ID NO: 1038845 - protein, 18 aa, Mycobacterium
TTVGRGGVGLSLGQQQRL

SEQ ID NO: 1038846 - protein, 18 aa, Mycobacterium
TTVPAAFAHHLPSGYSDC

SEQ ID NO: 1038847 - protein, 22 aa, Mycobacterium
TTVRPGALAFELEGGPRPNHFD

SEQ ID NO: 1038848 - protein, 23 aa, Mycobacterium
TTWSRATIGLAYASALINAGRYD

SEQ ID NO: 1038849 - protein, 24 aa, Mycobacterium
TTYLYRDGANFVFMDSQDYEQHPL

SEQ ID NO: 1038850 - protein, 25 aa, Mycobacterium
TVAEPGVLIGFLGPRVYELLYGEPF

SEQ ID NO: 1038851 - protein, 25 aa, Mycobacterium
TVASARWPAARFAIRNTAVQGPNAV

SEQ ID NO: 1038852 - protein, 22 aa, Mycobacterium
TVCAPVPLPSMLITTLRRLNLT

SEQ ID NO: 1038853 - protein, 25 aa, Mycobacterium
TVCCWCGRADLTLRCARCGSEVVRA

SEQ ID NO: 1038854 - protein, 24 aa, Mycobacterium
TVCILDRPRHAQLIDDVRATGARI

SEQ ID NO: 1038855 - protein, 19 aa, Mycobacterium
TVCRHRPAMYVGGIADQIH

SEQ ID NO: 1038856 - protein, 23 aa, Mycobacterium
TVDPRLRLDLAMLADELDSEALH

SEQ ID NO: 1038857 - protein, 31 aa, Mycobacterium
TVDPWGVGGAAHWTIDPIVGFASSSAPQDRG

SEQ ID NO: 1038858 - protein, 24 aa, Mycobacterium
TVEQFGGIDICVNNPSAINLGPIN

SEQ ID NO: 1038859 - protein, 20 aa, Mycobacterium
TVERRFLDGLPWQAGQPPRL

SEQ ID NO: 1038860 - protein, 17 aa, Mycobacterium
TVEVTFGGFSARVCGGN

SEQ ID NO: 1038861 - protein, 19 aa, Mycobacterium
TVHRKRVVAALGGRQSAII

SEQ ID NO: 1038862 - protein, 26 aa, Mycobacterium
TVIDPRWVLPVCDGVLELAHTHKLIV

SEQ ID NO: 1038863 - protein, 24 aa, Mycobacterium
TVITRKAYGGAYCVMGSKNMGCDV

SEQ ID NO: 1038864 - protein, 18 aa, Mycobacterium
TVKDGPWGREVVGTNTGV

SEQ ID NO: 1038865 - protein, 25 aa, Mycobacterium
TVKTFKRAGGQVWLIPHNPAFDPIP

SEQ ID NO: 1038866 - protein, 17 aa, Mycobacterium
TVLKAGYKVNVVPATAE

SEQ ID NO: 1038867 - protein, 21 aa, Mycobacterium
TVLVFPFDVAIPGGFLGMAAS

SEQ ID NO: 1038868 - protein, 24 aa, Mycobacterium
TVPDNMGMLFRKHLVMFGPREVLL

SEQ ID NO: 1038869 - protein, 25 aa, Mycobacterium
TVPGTRLAAVLGEFVEARCYHHQSI

SEQ ID NO: 1038870 - protein, 32 aa, Mycobacterium
TVTEARMAIAMARAGGMGVLHRNLPVGEQAGQ

SEQ ID NO: 1038871 - protein, 24 aa, Mycobacterium
TVTEHWEAWSPYISATAVADGLPG

SEQ ID NO: 1038872 - protein, 34 aa, Mycobacterium
TVTLCNRLAVVTGLRLPETVGWDYGSISGLSRYL

SEQ ID NO: 1038873 - protein, 23 aa, Mycobacterium
TVVEGLGALPLYNDNEDIDIPTL

SEQ ID NO: 1038874 - protein, 26 aa, Mycobacterium
TVVVAFRIVLVGSMGEPVGWDLHDRI

SEQ ID NO: 1038875 - protein, 25 aa, Mycobacterium
TVWPDRTDPRWTYGAATPGAAVAAY

SEQ ID NO: 1038876 - protein, 19 aa, Mycobacterium
TVWVSMEYVRASPGGTGAA

SEQ ID NO: 1038877 - protein, 19 aa, Mycobacterium
TWDLLRLTRMPTVQIDIGY

SEQ ID NO: 1038878 - protein, 29 aa, Mycobacterium
TWHAKEELARYGVQPDWFELGDRDLATHL

SEQ ID NO: 1038879 - protein, 17 aa, Mycobacterium
TWLSGWWAGAGVGVSHT

SEQ ID NO: 1038880 - protein, 24 aa, Mycobacterium
TWRSATCRVLVAATGSRTANAGPV

SEQ ID NO: 1038881 - protein, 24 aa, Mycobacterium
TWSKASGLDLVRLGTTASTEEITD

SEQ ID NO: 1038882 - protein, 28 aa, Mycobacterium
TWTGPRRFSAQLALQWTAAGARIVGGCC

SEQ ID NO: 1038883 - protein, 19 aa, Mycobacterium
TWWQVYRRSMSVAYELRIY

SEQ ID NO: 1038884 - protein, 19 aa, Mycobacterium
TYALLKQRGTQFVVVSAAE

SEQ ID NO: 1038885 - protein, 25 aa, Mycobacterium
TYAVPRLLARNGLSFQDFDFYEIHE

SEQ ID NO: 1038886 - protein, 18 aa, Mycobacterium
TYDAYGWIAVGSVSTEVA

SEQ ID NO: 1038887 - protein, 24 aa, Mycobacterium
TYDRRWLHEQGIPLTMGDLRFLKF

SEQ ID NO: 1038888 - protein, 17 aa, Mycobacterium
TYDSWLWELPAGLLDAA

SEQ ID NO: 1038889 - protein, 30 aa, Mycobacterium
TYEHPYPHCWRCRNPLIYRAVSSWFVAVTE

SEQ ID NO: 1038890 - protein, 17 aa, Mycobacterium
TYFKDHLYIAGRIKDLV

SEQ ID NO: 1038891 - protein, 31 aa, Mycobacterium
TYGHFGQSGGFIWADPEAELALVVLTDRDFG

SEQ ID NO: 1038892 - protein, 17 aa, Mycobacterium
TYGLIVYQEQIMRIAQK

SEQ ID NO: 1038893 - protein, 17 aa, Mycobacterium
TYLCMTPPVGVTGLSQP

SEQ ID NO: 1038894 - protein, 25 aa, Mycobacterium
TYLLSRAPGALGLHVALTGAPFSGA

SEQ ID NO: 1038895 - protein, 25 aa, Mycobacterium
TYNLPRFRIQWSVRQGGRRDVQWGC

SEQ ID NO: 1038896 - protein, 25 aa, Mycobacterium
TYRRSRWPWEPGFNDGRSIQPVLGV

SEQ ID NO: 1038897 - protein, 22 aa, Mycobacterium
TYRYAASMSAFLPPFPGIDDVR

SEQ ID NO: 1038898 - protein, 17 aa, Mycobacterium
VAAAACGAQAMIDVSDG

SEQ ID NO: 1038899 - protein, 23 aa, Mycobacterium
VAAECAWLVAMIVLERLSLGQWV

SEQ ID NO: 1038900 - protein, 18 aa, Mycobacterium
VAAGLAILGRDLADQGVA

SEQ ID NO: 1038901 - protein, 18 aa, Mycobacterium
VAAHGAWLTLIRDGKPIE

SEQ ID NO: 1038902 - protein, 21 aa, Mycobacterium
VAAHSLTPFAYWVDAEIAAVD

SEQ ID NO: 1038903 - protein, 21 aa, Mycobacterium
VAALKGGRLVVMPTDTVYGIG

SEQ ID NO: 1038904 - protein, 19 aa, Mycobacterium
VAALLHWLGNGNFLLLGYQ

SEQ ID NO: 1038905 - protein, 26 aa, Mycobacterium
VAALQRSDLLIALGTRFDDRVTGKLD

SEQ ID NO: 1038906 - protein, 18 aa, Mycobacterium
VAAPKLMRAVLIVNPTAK

SEQ ID NO: 1038907 - protein, 17 aa, Mycobacterium
VAARILAEFPDYLTEEQ

SEQ ID NO: 1038908 - protein, 17 aa, Mycobacterium
VAARRGPAHSAFTLPEL

SEQ ID NO: 1038909 - protein, 18 aa, Mycobacterium
VAATRLSRLSVYLVKLHT

SEQ ID NO: 1038910 - protein, 31 aa, Mycobacterium
VACFAGTALSGWRIIGRVFDGPARVLVDGQE

SEQ ID NO: 1038911 - protein, 29 aa, Mycobacterium
VACGAIELGIKWLSLYAFSTENWKRSVEE

SEQ ID NO: 1038912 - protein, 17 aa, Mycobacterium
VACSAVSHASRQWVQFR

SEQ ID NO: 1038913 - protein, 21 aa, Mycobacterium
VADALDILRWAPQAASEPVAR

SEQ ID NO: 1038914 - protein, 21 aa, Mycobacterium
VADALRPGDQLVLGASNPVRD

SEQ ID NO: 1038915 - protein, 25 aa, Mycobacterium
VADPNRPTGSFLFLGPTGVGKTELA

SEQ ID NO: 1038916 - protein, 18 aa, Mycobacterium
VADSGTWLLATVNVDAVP

SEQ ID NO: 1038917 - protein, 24 aa, Mycobacterium
VADTADGLGCYGPLQRALTVMRDG

SEQ ID NO: 1038918 - protein, 23 aa, Mycobacterium
VADWLNRHGWRATAQSAPDEMRR

SEQ ID NO: 1038919 - protein, 26 aa, Mycobacterium
VAEALGEHVFDFFLRNKRAEWANYRS

SEQ ID NO: 1038920 - protein, 33 aa, Mycobacterium
VAECRRLRPDFVVGLMPARWGTGFILGTNKFGP

SEQ ID NO: 1038921 - protein, 18 aa, Mycobacterium
VAEELFATPHEGRVLGVD

SEQ ID NO: 1038922 - protein, 25 aa, Mycobacterium
VAEELGQPLPLFIKWDDADYGLRAA

SEQ ID NO: 1038923 - protein, 21 aa, Mycobacterium
VAEFRIRGMSTSIFFLHAVLD

SEQ ID NO: 1038924 - protein, 18 aa, Mycobacterium
VAELARMLAGLGESDSGR

SEQ ID NO: 1038925 - protein, 25 aa, Mycobacterium
VAEPIAVVGIGCRFPGDVTGPDSFW

SEQ ID NO: 1038926 - protein, 18 aa, Mycobacterium
VAEVRADLLAGVDQAVAA

SEQ ID NO: 1038927 - protein, 26 aa, Mycobacterium
VAGGFTLDGLGGWFIDAVYGDPSTVV

SEQ ID NO: 1038928 - protein, 21 aa, Mycobacterium
VAGRFGVGVLIYWDLFPCYLV

SEQ ID NO: 1038929 - protein, 23 aa, Mycobacterium
VAHQRIAVIRAIRTALERRGFLE

SEQ ID NO: 1038930 - protein, 19 aa, Mycobacterium
VAIGEPIVALGNTGGQGGL

SEQ ID NO: 1038931 - protein, 20 aa, Mycobacterium
VAIIPCTDWARYELKPSAML

SEQ ID NO: 1038932 - protein, 17 aa, Mycobacterium
VAKRGAAIIDARGASSA

SEQ ID NO: 1038933 - protein, 17 aa, Mycobacterium
VALCGEVFPVTRAAKPG

SEQ ID NO: 1038934 - protein, 25 aa, Mycobacterium
VALHASFPPERISLHGNNKSVAELK

SEQ ID NO: 1038935 - protein, 23 aa, Mycobacterium
VALHKLPVTMVIDRAGITGSDGP

SEQ ID NO: 1038936 - protein, 18 aa, Mycobacterium
VALIDGTWVAFPTVEQLE

SEQ ID NO: 1038937 - protein, 25 aa, Mycobacterium
VAMDSLKFAQLMSQITRYAPEFGVP

SEQ ID NO: 1038938 - protein, 18 aa, Mycobacterium
VAMFPAVEPDDVRALTEC

SEQ ID NO: 1038939 - protein, 20 aa, Mycobacterium
VAMFRPKLDVASLLHRLSLK

SEQ ID NO: 1038940 - protein, 33 aa, Mycobacterium
VANLPITLWPGMKIGQLCVLRLTSPAEHPYGSA

SEQ ID NO: 1038941 - protein, 20 aa, Mycobacterium
VANRRAEIIAAISEDAVVVE

SEQ ID NO: 1038942 - protein, 22 aa, Mycobacterium
VAPRTLLPIGVDGWPATVSCDF

SEQ ID NO: 1038943 - protein, 24 aa, Mycobacterium
VAQEWFRFSWFFLVIRRDPKGLRE

SEQ ID NO: 1038944 - protein, 22 aa, Mycobacterium
VAQKPHGFKALDITLPVPTRWT

SEQ ID NO: 1038945 - protein, 18 aa, Mycobacterium
VARACRELFSGLYTDPQT

SEQ ID NO: 1038946 - protein, 23 aa, Mycobacterium
VARALKRFSFCLGNPTELRKANK

SEQ ID NO: 1038947 - protein, 17 aa, Mycobacterium
VARERFGPDRVISAANL

SEQ ID NO: 1038948 - protein, 17 aa, Mycobacterium
VARGEYKSAANLFTEGG

SEQ ID NO: 1038949 - protein, 24 aa, Mycobacterium
VARMAPQLVGAVLIGRDRAMVAEA

SEQ ID NO: 1038950 - protein, 25 aa, Mycobacterium
VARMSCPYLNLGRYRWRGRSLAQGM

SEQ ID NO: 1038951 - protein, 18 aa, Mycobacterium
VARPAGQPQHPWCDTNRS

SEQ ID NO: 1038952 - protein, 18 aa, Mycobacterium
VARRSCIDIQQLMTEVVK

SEQ ID NO: 1038953 - protein, 21 aa, Mycobacterium
VARTRSGVIMAVRHTELPIHG

SEQ ID NO: 1038954 - protein, 18 aa, Mycobacterium
VASMPVGLGPDIVHVVPE

SEQ ID NO: 1038955 - protein, 25 aa, Mycobacterium
VASRIRCAGAIFVGPWAPVSLGDYC

SEQ ID NO: 1038956 - protein, 24 aa, Mycobacterium
VATLRRRGAIVLEPASGRLTGTDS

SEQ ID NO: 1038957 - protein, 17 aa, Mycobacterium
VATRFMKEGGAHAVKLE

SEQ ID NO: 1038958 - protein, 18 aa, Mycobacterium
VATTMAIVRTFKEVLRHK

SEQ ID NO: 1038959 - protein, 17 aa, Mycobacterium
VAVGDVVKIEKLDFEPG

SEQ ID NO: 1038960 - protein, 18 aa, Mycobacterium
VAVGGGWVGYLSYPDPAA

SEQ ID NO: 1038961 - protein, 19 aa, Mycobacterium
VAVNARAALSGALDDMDVS

SEQ ID NO: 1038962 - protein, 18 aa, Mycobacterium
VAVSVNFLLSRYGTMTLA

SEQ ID NO: 1038963 - protein, 18 aa, Mycobacterium
VCALLSEWLPATTGSIIY

SEQ ID NO: 1038964 - protein, 19 aa, Mycobacterium
VCFKTMYSTVVVHPIYTTN

SEQ ID NO: 1038965 - protein, 23 aa, Mycobacterium
VCLRRRLVAKLALRRRDESTAQA

SEQ ID NO: 1038966 - protein, 19 aa, Mycobacterium
VCPDLDTCMYTLGDGIDPQ

SEQ ID NO: 1038967 - protein, 17 aa, Mycobacterium
VCPSLHMPLQSGSDRVL

SEQ ID NO: 1038968 - protein, 32 aa, Mycobacterium
VCQDFARLAIACLRANGLAASYVSGYLATDPP

SEQ ID NO: 1038969 - protein, 28 aa, Mycobacterium
VCTARSPRCGLCPLNECAWRHAGYPPAQ

SEQ ID NO: 1038970 - protein, 20 aa, Mycobacterium
VCTIRTDPWNLGARRVNDVS

SEQ ID NO: 1038971 - protein, 21 aa, Mycobacterium
VCVSHQLPVWTLRLHLTGKRL

SEQ ID NO: 1038972 - protein, 23 aa, Mycobacterium
VDAEFRVGTMGLGWDSEAQTVVV

SEQ ID NO: 1038973 - protein, 18 aa, Mycobacterium
VDAISGWWNTGAATESDG

SEQ ID NO: 1038974 - protein, 23 aa, Mycobacterium
VDASLRLLVRGGRFLEMGKTDIR

SEQ ID NO: 1038975 - protein, 24 aa, Mycobacterium
VDAVPRVAQIFGVDAVPTVVALAA

SEQ ID NO: 1038976 - protein, 20 aa, Mycobacterium
VDDGGRRVGARIVVVTHGAT

SEQ ID NO: 1038977 - protein, 17 aa, Mycobacterium
VDDGWSYAVAEGTAELT

SEQ ID NO: 1038978 - protein, 22 aa, Mycobacterium
VDEGAVCTAMLDLYQNEGIIAE

SEQ ID NO: 1038979 - protein, 25 aa, Mycobacterium
VDELERCNARRALVTLCIGAGMGVA

SEQ ID NO: 1038980 - protein, 32 aa, Mycobacterium; identical to SEQ ID NO: 743499

SEQ ID NO: 1038981 - protein, 17 aa, Mycobacterium
VDFAIPMIGMLKRKAEH

SEQ ID NO: 1038982 - protein, 19 aa, Mycobacterium
VDFVPKVRIEVVIDDSIAE

SEQ ID NO: 1038983 - protein, 23 aa, Mycobacterium
VDGDIGLWLDLCAGPGGKTALGD

SEQ ID NO: 1038984 - protein, 19 aa, Mycobacterium
VDGGWKITGQKVWTSGAQY

SEQ ID NO: 1038985 - protein, 23 aa, Mycobacterium
VDGHGRLTGLITVKDFVKTEQHP

SEQ ID NO: 1038986 - protein, 22 aa, Mycobacterium
VDGKISPRERIAMMSTGATYEL

SEQ ID NO: 1038987 - protein, 19 aa, Mycobacterium
VDGLVAYRRSLGLPAVGIN

SEQ ID NO: 1038988 - protein, 26 aa, Mycobacterium
VDHAARITAPRGWELVRHAGPLPSNP

SEQ ID NO: 1038989 - protein, 24 aa, Mycobacterium
VDIDGCVYREGLSAVRVDGGVAGN

SEQ ID NO: 1038990 - protein, 24 aa, Mycobacterium
VDIKRDGYEWSQFYDKAVPGILKQ

SEQ ID NO: 1038991 - protein, 18 aa, Mycobacterium
VDKPGTQVHWVLRRYSSV

SEQ ID NO: 1038992 - protein, 20 aa, Mycobacterium
VDLDGARKVFKLVDALEDSD

SEQ ID NO: 1038993 - protein, 24 aa, Mycobacterium
VDLDLPRDSLIVFTGLSGSGKSSL

SEQ ID NO: 1038994 - protein, 19 aa, Mycobacterium
VDLPDELLSLALTHRSYAY

SEQ ID NO: 1038995 - protein, 23 aa, Mycobacterium
VDLQIPVLLIRGKTLLRDHLRGR

SEQ ID NO: 1038996 - protein, 25 aa, Mycobacterium
VDLSRLAEDIILWSSTEFGYARLHD

SEQ ID NO: 1038997 - protein, 25 aa, Mycobacterium
VDLVRSVGVPAWLSYTINGTRTRAG

SEQ ID NO: 1038998 - protein, 18 aa, Mycobacterium
VDNVRRITNFDGPRPDTS

SEQ ID NO: 1038999 - protein, 18 aa, Mycobacterium
VDNWVCRALALLVLPDIS

SEQ ID NO: 1039000 - protein, 31 aa, Mycobacterium
VDPAEWRNELPLIEEWFEFVGDKLPSGMQDE

SEQ ID NO: 1039001 - protein, 20 aa, Mycobacterium
VDPAVAKLPGVWVVDVEGVQ

SEQ ID NO: 1039002 - protein, 18 aa, Mycobacterium
VDPGWRRGAAQGHSGTHI

SEQ ID NO: 1039003 - protein, 24 aa, Mycobacterium
VDPHVHTLLDFHFRPHITAPSGKQ

SEQ ID NO: 1039004 - protein, 18 aa, Mycobacterium
VDPNDLYDVLAINAASAS

SEQ ID NO: 1039005 - protein, 25 aa, Mycobacterium
VDQFTRAGALWGVPQLTDAGIAVFY

SEQ ID NO: 1039006 - protein, 18 aa, Mycobacterium
VDQLRRWLDSLLSVTAGK

SEQ ID NO: 1039007 - protein, 27 aa, Mycobacterium
VDQPFLLSAYIDFAALRAKFDGGTLAP

SEQ ID NO: 1039008 - protein, 22 aa, Mycobacterium
VDRDEVLLDIGYKTEGVIPARE

SEQ ID NO: 1039009 - protein, 18 aa, Mycobacterium
VDRGEVIGLLGPNGAGKT

SEQ ID NO: 1039010 - protein, 25 aa, Mycobacterium
VDRHLPAFLRFAGREFIGVQGTQLS

SEQ ID NO: 1039011 - protein, 23 aa, Mycobacterium
VDRIISLGAFEHFADGAGDAGFE

SEQ ID NO: 1039012 - protein, 23 aa, Mycobacterium
VDRIVSIEAFEHFGHENYDDFFK

SEQ ID NO: 1039013 - protein, 26 aa, Mycobacterium
VDRKIWSGKGTFLFTRTTAGEIGILP

SEQ ID NO: 1039014 - protein, 24 aa, Mycobacterium
VDRQDPRFSRWVDRFRGHAVSAER

SEQ ID NO: 1039015 - protein, 19 aa, Mycobacterium
VDRQLRLWAVSEELTGVVY

SEQ ID NO: 1039016 - protein, 25 aa, Mycobacterium
VDTEIARLVPFIEWLRSAYTDLLIS

SEQ ID NO: 1039017 - protein, 23 aa, Mycobacterium
VDTEIPSPVAGVLVSITTNEDTT

SEQ ID NO: 1039018 - protein, 20 aa, Mycobacterium
VDTHFGRLVRRWRWTAEEDP

SEQ ID NO: 1039019 - protein, 18 aa, Mycobacterium
VDTTWCYRTVTAKYRRRS

SEQ ID NO: 1039020 - protein, 18 aa, Mycobacterium
VDVDWHFDDALLPAASAT

SEQ ID NO: 1039021 - protein, 19 aa, Mycobacterium
VDVLLVWPGQQHVVIIARD

SEQ ID NO: 1039022 - protein, 17 aa, Mycobacterium
VDVRTIVMLSGFAPPNL

SEQ ID NO: 1039023 - protein, 33 aa, Mycobacterium
VDVRVWICPDHRKKGYGTAALRKSRSEMAYCFP

SEQ ID NO: 1039024 - protein, 17 aa, Mycobacterium
VDYKVYDAQGWTIDSTA

SEQ ID NO: 1039025 - protein, 25 aa, Mycobacterium
VEAARGAGVSWVYLAGPEKALGDIN

SEQ ID NO: 1039026 - protein, 20 aa, Mycobacterium
VEACDAVLALLARLDSSRRT

SEQ ID NO: 1039027 - protein, 22 aa, Mycobacterium
VEARAVLVLGARCLILGDPGTG

SEQ ID NO: 1039028 - protein, 18 aa, Mycobacterium
VEARYAVTAEGALHLEDI

SEQ ID NO: 1039029 - protein, 20 aa, Mycobacterium
VEAYVGLDSFRHLAKERALM

SEQ ID NO: 1039030 - protein, 28 aa, Mycobacterium
VEDYFKLGYRGARFAFGYGACPDLEDRI

SEQ ID NO: 1039031 - protein, 20 aa, Mycobacterium
VEFIAEAISTLGDQSLHDRD

SEQ ID NO: 1039032 - protein, 24 aa, Mycobacterium
VEGDQPWMIYELDLHQVLHVTEGT

SEQ ID NO: 1039033 - protein, 27 aa, Mycobacterium
VEGKLAVFGSGFCHLCSQRLGHCQRYT

SEQ ID NO: 1039034 - protein, 25 aa, Mycobacterium
VEGRSHAWIQAWTGGWWNYDPTNDV

SEQ ID NO: 1039035 - protein, 17 aa, Mycobacterium
VEGRTCVLIDDMIDTGG

SEQ ID NO: 1039036 - protein, 17 aa, Mycobacterium
VEGSGGYGIVFGPDASE

SEQ ID NO: 1039037 - protein, 23 aa, Mycobacterium
VEHHAVLDSVNWLVEHEGAEVTW

SEQ ID NO: 1039038 - protein, 20 aa, Mycobacterium
VEINEAFAAVALASARELGI

SEQ ID NO: 1039039 - protein, 26 aa, Mycobacterium
VEIRRLAIVCLRRLVDVAPAVFADFE

SEQ ID NO: 1039040 - protein, 22 aa, Mycobacterium
VEIYRTRLAGLVPQTEEVVPRA

SEQ ID NO: 1039041 - protein, 21 aa, Mycobacterium
VEKLVPDFLWISTEHTARLSL

SEQ ID NO: 1039042 - protein, 17 aa, Mycobacterium
VELERGICLVGPHRDEL

SEQ ID NO: 1039043 - protein, 18 aa, Mycobacterium
VELFELGARELMWGARSD

SEQ ID NO: 1039044 - protein, 23 aa, Mycobacterium
VELPLMEVRALLDLGDVVKANRK

SEQ ID NO: 1039045 - protein, 20 aa, Mycobacterium
VELRNRLKSATGLTLPPTVI

SEQ ID NO: 1039046 - protein, 17 aa, Mycobacterium
VELSRKAILSALEHGKS

SEQ ID NO: 1039047 - protein, 27 aa, Mycobacterium
VEMLHDLYQRWPFFRSVLSNMAQVLAK

SEQ ID NO: 1039048 - protein, 20 aa, Mycobacterium
VEMRNRLKTATGLSLSPTLI

SEQ ID NO: 1039049 - protein, 24 aa, Mycobacterium
VENPRLLVYPLERLRTDLWQLPGA

SEQ ID NO: 1039050 - protein, 17 aa, Mycobacterium
VEPWAYLIVGGVQLATH

SEQ ID NO: 1039051 - protein, 22 aa, Mycobacterium
VEQARVCWDLPAPVVERRIRAV

SEQ ID NO: 1039052 - protein, 25 aa, Mycobacterium
VESFGFKYGLPMDADIVMDVRFLPN

SEQ ID NO: 1039053 - protein, 22 aa, Mycobacterium
VESKLLALLHRFGIAAPASADR

SEQ ID NO: 1039054 - protein, 19 aa, Mycobacterium
VESLALVARERFGPDRVIS

SEQ ID NO: 1039055 - protein, 19 aa, Mycobacterium
VETERRFYLANSVEMMPRN

SEQ ID NO: 1039056 - protein, 19 aa, Mycobacterium
VEVARRVIFQATGSFPEDD

SEQ ID NO: 1039057 - protein, 22 aa, Mycobacterium
VEVLARGTAWLDTGTFDSLLDA

SEQ ID NO: 1039058 - protein, 29 aa, Mycobacterium
VEVPAPPFWGSRIIKGLAVADYTGFLDER

SEQ ID NO: 1039059 - protein, 24 aa, Mycobacterium
VEVSEFSRHLKLLAKELELPVVAI

SEQ ID NO: 1039060 - protein, 19 aa, Mycobacterium
VEVVRRLRAVGAVIIGKTA

SEQ ID NO: 1039061 - protein, 20 aa, Mycobacterium
VEVVVGLPWTLTDRTGSSAK

SEQ ID NO: 1039062 - protein, 21 aa, Mycobacterium
VEYFLWLRAQTDLELSTDGLE

SEQ ID NO: 1039063 - protein, 26 aa, Mycobacterium
VFDVKKAVVFDDRWASAREDLVRLWL

SEQ ID NO: 1039064 - protein, 18 aa, Mycobacterium
VFEGTSFGGALMTTTEVE

SEQ ID NO: 1039065 - protein, 24 aa, Mycobacterium
VFFESPRRLAACLRDAVDQLGSAR

SEQ ID NO: 1039066 - protein, 26 aa, Mycobacterium
VFIPRPETEAILAWVMAQRLPERPVI

SEQ ID NO: 1039067 - protein, 17 aa, Mycobacterium
VFISARTGDGIDVLRRR

SEQ ID NO: 1039068 - protein, 18 aa, Mycobacterium
VFLEERFASLLPEVMIGV

SEQ ID NO: 1039069 - protein, 18 aa, Mycobacterium
VFLVMPFTTDFMKLTPDR

SEQ ID NO: 1039070 - protein, 19 aa, Mycobacterium
VFNMLRELADVIVVGAGTV

SEQ ID NO: 1039071 - protein, 25 aa, Mycobacterium
VFPTCPVVRLLWKVIDLAAAVEGAL

SEQ ID NO: 1039072 - protein, 23 aa, Mycobacterium
VFSGEIVNFIAIVGILAAHAVTT

SEQ ID NO: 1039073 - protein, 23 aa, Mycobacterium
VFVDHGYHAAGMDEIADRAGVSK

SEQ ID NO: 1039074 - protein, 24 aa, Mycobacterium
VFYLHSRLLERCAKLADHLGGGSL

SEQ ID NO: 1039075 - protein, 23 aa, Mycobacterium
VGADIRYGLGAVRNVGANVVGSL

SEQ ID NO: 1039076 - protein, 23 aa, Mycobacterium
VGAGGAGMRAAVEAGPRVRTAVL

SEQ ID NO: 1039077 - protein, 23 aa, Mycobacterium
VGALPACEGMVALPTQEKVPVLD

SEQ ID NO: 1039078 - protein, 21 aa, Mycobacterium
VGALRRYHEALGVSISTLPMA

SEQ ID NO: 1039079 - protein, 21 aa, Mycobacterium
VGANPLELAGWLAEVLAQAGG

SEQ ID NO: 1039080 - protein, 18 aa, Mycobacterium
VGATKAFTAPPLGVNEVG

SEQ ID NO: 1039081 - protein, 23 aa, Mycobacterium
VGAVDCRGGVPGTRETDLLDPAN

SEQ ID NO: 1039082 - protein, 25 aa, Mycobacterium
VGDGFARYWLHNGWVTMGGEKMSKS

SEQ ID NO: 1039083 - protein, 19 aa, Mycobacterium
VGEAACYEIPDAHFGALVG

SEQ ID NO: 1039084 - protein, 25 aa, Mycobacterium
VGEAWRFLKELRLDRGPLTNEEATA

SEQ ID NO: 1039085 - protein, 17 aa, Mycobacterium
VGEEWLYQSWAAAYLPL

SEQ ID NO: 1039086 - protein, 19 aa, Mycobacterium
VGEMRLRAMMAHGADTLAA

SEQ ID NO: 1039087 - protein, 17 aa, Mycobacterium
VGEYVLFEIVALRNSSF

SEQ ID NO: 1039088 - protein, 24 aa, Mycobacterium
VGFDIPNDFVVGYGLDYDERYRDL

SEQ ID NO: 1039089 - protein, 18 aa, Mycobacterium
VGGARIALSRGLCSNRFV

SEQ ID NO: 1039090 - protein, 20 aa, Mycobacterium
VGGDAWVRAMMLVDAGVDVL

SEQ ID NO: 1039091 - protein, 21 aa, Mycobacterium
VGGDPWPWVLGGGEDHALVAC

SEQ ID NO: 1039092 - protein, 17 aa, Mycobacterium
VGGLMMAAGRLERITSE

SEQ ID NO: 1039093 - protein, 25 aa, Mycobacterium
VGGMGGLGFVFARWLAEQGAGLIVL

SEQ ID NO: 1039094 - protein, 20 aa, Mycobacterium
VGGNRGMLVVDMEPSAEPLL

SEQ ID NO: 1039095 - protein, 24 aa, Mycobacterium
VGGPAHKVVADWLRTSCAKTRRRL

SEQ ID NO: 1039096 - protein, 26 aa, Mycobacterium
VGIAKRLRPGGVIQREISMRTVAVFA

SEQ ID NO: 1039097 - protein, 21 aa, Mycobacterium
VGIDEAWFGEHHFMRLRVDGV

SEQ ID NO: 1039098 - protein, 29 aa, Mycobacterium
VGIIAGCIISSGVVRRNAKVRLLRDNIVV

SEQ ID NO: 1039099 - protein, 20 aa, Mycobacterium
VGIRLPGRYNVANCLVALAI

SEQ ID NO: 1039100 - protein, 18 aa, Mycobacterium
VGIVNRRVGLAFPPAQLR

SEQ ID NO: 1039101 - protein, 17 aa, Mycobacterium
VGLAFPPAQLRGSSVLL

SEQ ID NO: 1039102 - protein, 20 aa, Mycobacterium
VGLAGRAVLGLGKRLTGKSK

SEQ ID NO: 1039103 - protein, 18 aa, Mycobacterium
VGLDDVYLVAAEDVPDGP

SEQ ID NO: 1039104 - protein, 24 aa, Mycobacterium
VGLIHPRSGLAVRVGLSIVNSPGT

SEQ ID NO: 1039105 - protein, 32 aa, Mycobacterium
VGLTICYDIRFPALYTELARRGAQLIVVCASW

SEQ ID NO: 1039106 - protein, 17 aa, Mycobacterium
VGMSGLLVKSTVIMKEN

SEQ ID NO: 1039107 - protein, 17 aa, Mycobacterium
VGNELYGSFLSGIQQNL

SEQ ID NO: 1039108 - protein, 26 aa, Mycobacterium
VGNIIGRPMGWESLLTEPLQAYSVDL

SEQ ID NO: 1039109 - protein, 24 aa, Mycobacterium
VGQLGEVWISFLIVAPKYVASVAT

SEQ ID NO: 1039110 - protein, 17 aa, Mycobacterium
VGQRILAGWSEQQRYFV

SEQ ID NO: 1039111 - protein, 29 aa, Mycobacterium
VGREIKKLPTLRGRTVITMFYENSTRTRV

SEQ ID NO: 1039112 - protein, 23 aa, Mycobacterium
VGRGRGGIGTALRGCPVPVVVGG

SEQ ID NO: 1039113 - protein, 22 aa, Mycobacterium
VGRGRPAKHYRLTAVGRAKLGH

SEQ ID NO: 1039114 - protein, 24 aa, Mycobacterium
VGRRRWNRRGAMVTDRYQRLCHHD

SEQ ID NO: 1039115 - protein, 18 aa, Mycobacterium
VGSADNFSVVEALADSLG

SEQ ID NO: 1039116 - protein, 25 aa, Mycobacterium
VGSCGECSSCLAGIEQYCKRGATFT

SEQ ID NO: 1039117 - protein, 18 aa, Mycobacterium
VGSHFCLGAALARLEATV

SEQ ID NO: 1039118 - protein, 24 aa, Mycobacterium
VGSLTLDEGAVWAVVQQRRSLLAA

SEQ ID NO: 1039119 - protein, 26 aa, Mycobacterium
VGSRAGLLLPLGVRSLRVYRPTRNAR

SEQ ID NO: 1039120 - protein, 18 aa, Mycobacterium
VGTDIPLIRAGTIRAIVS

SEQ ID NO: 1039121 - protein, 19 aa, Mycobacterium
VGVTLPVFVTRAAGGVIED

SEQ ID NO: 1039122 - protein, 19 aa, Mycobacterium
VGVVCLQAAAVLGRPSPED

SEQ ID NO: 1039123 - protein, 26 aa, Mycobacterium
VGVVPGKVAGGWFWIHALNSATQAAT

SEQ ID NO: 1039124 - protein, 19 aa, Mycobacterium
VGWTLACRSTFEHRAVVGL

SEQ ID NO: 1039125 - protein, 21 aa, Mycobacterium
VGYPREWRRRKPYSWLRQVLP

SEQ ID NO: 1039126 - protein, 23 aa, Mycobacterium
VGYYCLYELCLFSATTAAQVHPH

SEQ ID NO: 1039127 - protein, 22 aa, Mycobacterium
VHAKGKFTARERIYALLDDDSF

SEQ ID NO: 1039128 - protein, 20 aa, Mycobacterium
VHARVATLVERLKAAEKELE

SEQ ID NO: 1039129 - protein, 17 aa, Mycobacterium
VHATFAPLVEDASPKRC

SEQ ID NO: 1039130 - protein, 23 aa, Mycobacterium
VHDELPHSLAVVIDEVSPRAGRG

SEQ ID NO: 1039131 - protein, 17 aa, Mycobacterium
VHFARGDAVNWALVADD

SEQ ID NO: 1039132 - protein, 23 aa, Mycobacterium
VHFKSVVYELLWFLRGDSNVAWL

SEQ ID NO: 1039133 - protein, 19 aa, Mycobacterium
VHGTWRMLRANAKLAASTG

SEQ ID NO: 1039134 - protein, 24 aa, Mycobacterium
VHGVLIPGGFGIRGIEGKIGAIRY

SEQ ID NO: 1039135 - protein, 20 aa, Mycobacterium
VHISEGFDFFGATFSGTKKQ

SEQ ID NO: 1039136 - protein, 19 aa, Mycobacterium
VHKEFYPKANLSIVQRAFE

SEQ ID NO: 1039137 - protein, 23 aa, Mycobacterium
VHLGSWRPGLSYRQIARKLPDYV

SEQ ID NO: 1039138 - protein, 19 aa, Mycobacterium
VHPEIEFFLLKAGPEDGSM

SEQ ID NO: 1039139 - protein, 17 aa, Mycobacterium
VHPGRRAAGRAEVVEAD

SEQ ID NO: 1039140 - protein, 21 aa, Mycobacterium
VHPPFRWQRRYAEGFSDQVAE

SEQ ID NO: 1039141 - protein, 18 aa, Mycobacterium
VHQPRVGKKAAHRRAVEL

SEQ ID NO: 1039142 - protein, 23 aa, Mycobacterium
VHRGIALTSFYHCSDLYHIEPYP

SEQ ID NO: 1039143 - protein, 18 aa, Mycobacterium
VHSAGALVDFSVQYPNGC

SEQ ID NO: 1039144 - protein, 24 aa, Mycobacterium
VHSGWKVTEVFPVDPATAGVAADE

SEQ ID NO: 1039145 - protein, 22 aa, Mycobacterium
VHSRFPSAVVGFVVAIPTPCLA

SEQ ID NO: 1039146 - protein, 25 aa, Mycobacterium
VHTMVVPGLLSWRDVAQVMSENPAR

SEQ ID NO: 1039147 - protein, 17 aa, Mycobacterium
VIAAAGWDRRVYAAVAL

SEQ ID NO: 1039148 - protein, 25 aa, Mycobacterium
VIARGGFPEDCFQTLLISANGVEAI

SEQ ID NO: 1039149 - protein, 17 aa, Mycobacterium
VICAFGRTGSMFTCDDF

SEQ ID NO: 1039150 - protein, 18 aa, Mycobacterium
VIDAGGLTITVLATPGHT

SEQ ID NO: 1039151 - protein, 22 aa, Mycobacterium
VIDEKFCAAGIKRPDYSITGWV

SEQ ID NO: 1039152 - protein, 19 aa, Mycobacterium
VIEAGGLYVLGTERHESRR

SEQ ID NO: 1039153 - protein, 24 aa, Mycobacterium
VIGPELPLVLGVADAVRAAGIVCF

SEQ ID NO: 1039154 - protein, 24 aa, Mycobacterium
VIISDFLGPINWMRPLRAIAARHE

SEQ ID NO: 1039155 - protein, 19 aa, Mycobacterium
VINKLCAAGAEAIEINDAY

SEQ ID NO: 1039156 - protein, 18 aa, Mycobacterium
VIPGAGLAVERVGDRAHD

SEQ ID NO: 1039157 - protein, 20 aa, Mycobacterium
VISGLQMLLHQAFAQVEQFT

SEQ ID NO: 1039158 - protein, 26 aa, Mycobacterium
VITTPRWTELRSRVRDYLGTKIEFRL

SEQ ID NO: 1039159 - protein, 17 aa, Mycobacterium
VIVESAVLLGQANERTL

SEQ ID NO: 1039160 - protein, 22 aa, Mycobacterium
VIVLEEGRRWAVDELRTSHLID

SEQ ID NO: 1039161 - protein, 19 aa, Mycobacterium
VIVNKWRAAGVRMVDERDT

SEQ ID NO: 1039162 - protein, 20 aa, Mycobacterium
VIVRQMLRRVTIIDSGSTEF

SEQ ID NO: 1039163 - protein, 26 aa, Mycobacterium
VIYARNKLAVARRVYRPADGSCANCG

SEQ ID NO: 1039164 - protein, 19 aa, Mycobacterium
VIYRAGLARTRRMARQLVS

SEQ ID NO: 1039165 - protein, 28 aa, Mycobacterium
VKCSHLARPKVSICIHRPYSEPMARQHP

SEQ ID NO: 1039166 - protein, 25 aa, Mycobacterium
VKDKPGWLDRAWQRILEEVAAGRQA

SEQ ID NO: 1039167 - protein, 24 aa, Mycobacterium
VKEESVGFLFNLAVEAVPASHVAP

SEQ ID NO: 1039168 - protein, 24 aa, Mycobacterium
VKEVKAAMGALEIDPVFAERSVNE

SEQ ID NO: 1039169 - protein, 17 aa, Mycobacterium
VKFVAAFDVDAKKVGVD

SEQ ID NO: 1039170 - protein, 25 aa, Mycobacterium
VKGMLTGPVTILAWSFVRDDQPLAD

SEQ ID NO: 1039171 - protein, 18 aa, Mycobacterium
VKGNLGFDTVFEAVFMIF

SEQ ID NO: 1039172 - protein, 20 aa, Mycobacterium
VKLSPYLLVGISVPENGLQK

SEQ ID NO: 1039173 - protein, 25 aa, Mycobacterium
VKPARGGSSIGISRVSSWGQLPSAI

SEQ ID NO: 1039174 - protein, 19 aa, Mycobacterium
VKQHPDLLVAGWRVVALQP

SEQ ID NO: 1039175 - protein, 23 aa, Mycobacterium
VKQSDCLRPAHVRVENVIAAGGG

SEQ ID NO: 1039176 - protein, 24 aa, Mycobacterium
VKRCEARTGAPLLSYGTPKSPIVR

SEQ ID NO: 1039177 - protein, 22 aa, Mycobacterium
VKRIVGAKGKAALLRDLSDVVP

SEQ ID NO: 1039178 - protein, 22 aa, Mycobacterium
VKRMGDGIMAVFRDPSVAVQAV

SEQ ID NO: 1039179 - protein, 19 aa, Mycobacterium
VKRSGSLLYAHWLPNRRFY

SEQ ID NO: 1039180 - protein, 17 aa, Mycobacterium
VKSFFLRTLDLGIFTSG

SEQ ID NO: 1039181 - protein, 21 aa, Mycobacterium
VKSSLRTAVRAFREAVHAGEK

SEQ ID NO: 1039182 - protein, 22 aa, Mycobacterium
VKVARIAGQYAKPRSADVDALG

SEQ ID NO: 1039183 - protein, 18 aa, Mycobacterium
VKWYDADKGFGFLSQEDG

SEQ ID NO: 1039184 - protein, 18 aa, Mycobacterium
VLAAEGFSVLLLPNPAPT

SEQ ID NO: 1039185 - protein, 22 aa, Mycobacterium
VLACALRLPLLYALMVYNGTIG

SEQ ID NO: 1039186 - protein, 20 aa, Mycobacterium
VLAEALPWLKQLHGKVVVVK

SEQ ID NO: 1039187 - protein, 24 aa, Mycobacterium
VLAERIGALLLEVHRRFGTPVPPE

SEQ ID NO: 1039188 - protein, 24 aa, Mycobacterium
VLAICAAVQVLGQWYETASRERVD

SEQ ID NO: 1039189 - protein, 19 aa, Mycobacterium
VLAKDCPSFGLGPTEPLLA

SEQ ID NO: 1039190 - protein, 18 aa, Mycobacterium
VLARFPGVRTAKVKVAEP

SEQ ID NO: 1039191 - protein, 24 aa, Mycobacterium
VLATLKCPVHPVSERAAKALSDTV

SEQ ID NO: 1039192 - protein, 33 aa, Mycobacterium
VLATQGSGAWPACGHGLSGPSLQEVLPAGMGAP

SEQ ID NO: 1039193 - protein, 18 aa, Mycobacterium
VLAWLHPPGIDFGPALLA

SEQ ID NO: 1039194 - protein, 25 aa, Mycobacterium
VLDAQRWARERALCAVATASSGKVS

SEQ ID NO: 1039195 - protein, 17 aa, Mycobacterium
VLDQRPFDVQVMGGAAL

SEQ ID NO: 1039196 - protein, 22 aa, Mycobacterium
VLDRYLPVLVDLRMRYLDDGDW

SEQ ID NO: 1039197 - protein, 20 aa, Mycobacterium
VLDSGPWRKLSANHDNRIFI

SEQ ID NO: 1039198 - protein, 17 aa, Mycobacterium
VLEPLGLTAEKPVGSRA

SEQ ID NO: 1039199 - protein, 26 aa, Mycobacterium
VLEVRGEVFFRVVDFQALNTSLVEEG

SEQ ID NO: 1039200 - protein, 23 aa, Mycobacterium
VLEVTARLAAPLLPLITEIIWRS

SEQ ID NO: 1039201 - protein, 17 aa, Mycobacterium
VLFEPIMLQSNVISDRT

SEQ ID NO: 1039202 - protein, 25 aa, Mycobacterium
VLFGRAHVVFARLVVPTSDLLALHA

SEQ ID NO: 1039203 - protein, 24 aa, Mycobacterium
VLGGEAVMIWTLRLQLGGMIERMI

SEQ ID NO: 1039204 - protein, 29 aa, Mycobacterium
VLGLDDVVFRLAITPDRGYCMSVRGLARE

SEQ ID NO: 1039205 - protein, 17 aa, Mycobacterium
VLGPLGMGCQLGGAENA

SEQ ID NO: 1039206 - protein, 22 aa, Mycobacterium
VLGRPITARAFGAVAREVAALD

SEQ ID NO: 1039207 - protein, 18 aa, Mycobacterium
VLHAMGFDAFGLPAEQYA

SEQ ID NO: 1039208 - protein, 17 aa, Mycobacterium
VLHEVRIMLDQYWPSVP

SEQ ID NO: 1039209 - protein, 20 aa, Mycobacterium
VLICGYGDVGKGCAEAAKGQ

SEQ ID NO: 1039210 - protein, 23 aa, Mycobacterium
VLIESLGAVPARIVGVSMGSFIA

SEQ ID NO: 1039211 - protein, 25 aa, Mycobacterium
VLIETARLWLSLGHHDRHGVWHLDG

SEQ ID NO: 1039212 - protein, 24 aa, Mycobacterium
VLLDHELWFIQPFRADEWRLYNQT

SEQ ID NO: 1039213 - protein, 18 aa, Mycobacterium
VLLVDEARDVDDDEHAQL

SEQ ID NO: 1039214 - protein, 19 aa, Mycobacterium
VLMETRPSALVAIAALSRL

SEQ ID NO: 1039215 - protein, 26 aa, Mycobacterium
VLMPPRSYLGTHMRVHEAGFGGLFSE

SEQ ID NO: 1039216 - protein, 22 aa, Mycobacterium
VLMSAFERRFFPIYPASTKLQS

SEQ ID NO: 1039217 - protein, 22 aa, Mycobacterium
VLPASQVVRFIVPRYIQDDPSL

SEQ ID NO: 1039218 - protein, 23 aa, Mycobacterium
VLPFKIDDYTAWRLLEGLDDIAL

SEQ ID NO: 1039219 - protein, 18 aa, Mycobacterium
VLQLRGASNLPTAVIGGD

SEQ ID NO: 1039220 - protein, 22 aa, Mycobacterium
VLRRAVELGVNFIDTADSYGPY

SEQ ID NO: 1039221 - protein, 18 aa, Mycobacterium
VLRRIRAANLSVVLSDRM

SEQ ID NO: 1039222 - protein, 25 aa, Mycobacterium
VLSRAQLLELVWGYDFAADTNVVDV

SEQ ID NO: 1039223 - protein, 19 aa, Mycobacterium
VLTLDILLRRGKTVRPKTL

SEQ ID NO: 1039224 - protein, 23 aa, Mycobacterium
VLTRPDAASGRRGKPEPSPVARE

SEQ ID NO: 1039225 - protein, 23 aa, Mycobacterium
VLTYAGTLWCRIVQEVGEKYPDV

SEQ ID NO: 1039226 - protein, 20 aa, Mycobacterium
VLVQRGTLRIGDSVVAGDAY

SEQ ID NO: 1039227 - protein, 19 aa, Mycobacterium
VLYPSLGFCILRLDDPDFA

SEQ ID NO: 1039228 - protein, 25 aa, Mycobacterium
VMISWLPCFHDMGMIGFLTVPMYFG

SEQ ID NO: 1039229 - protein, 24 aa, Mycobacterium
VMLGRPCYEIEFSDGTVIVADAQH

SEQ ID NO: 1039230 - protein, 30 aa, Mycobacterium
VMLLHGFGSFWWSWRHQLRGLTEARLVAVD

SEQ ID NO: 1039231 - protein, 19 aa, Mycobacterium
VMTGFRVSRSGWYGLDPVA

SEQ ID NO: 1039232 - protein, 17 aa, Mycobacterium
VMVKSFFLRTLDLGIFT

SEQ ID NO: 1039233 - protein, 20 aa, Mycobacterium
VNAGVYAFDITALRSALIRL

SEQ ID NO: 1039234 - protein, 24 aa, Mycobacterium
VNDYYDRSGLWPYLEKLGFYLVGY

SEQ ID NO: 1039235 - protein, 17 aa, Mycobacterium
VNESKFFNGYIDTVEES

SEQ ID NO: 1039236 - protein, 19 aa, Mycobacterium
VNFLIKFAGTIPLDRDAGA

SEQ ID NO: 1039237 - protein, 25 aa, Mycobacterium
VNGRGGPQFLPFGISTGGGDTIAAA

SEQ ID NO: 1039238 - protein, 23 aa, Mycobacterium
VNHLPLTLPLRYLGWSDALVDQI

SEQ ID NO: 1039239 - protein, 19 aa, Mycobacterium
VNIGCELERGKVLAKVASG

SEQ ID NO: 1039240 - protein, 19 aa, Mycobacterium
VNISTRLGYNSAVGAGTGI

SEQ ID NO: 1039241 - protein, 20 aa, Mycobacterium
VNLERAVAINSRLGGHIVQG

SEQ ID NO: 1039242 - protein, 24 aa, Mycobacterium
VNLIDRLEGIFGDVDLEYINNGDD

SEQ ID NO: 1039243 - protein, 24 aa, Mycobacterium
VNLSAPIIKRCVDRILDKDMTKDF

SEQ ID NO: 1039244 - protein, 17 aa, Mycobacterium
VNRMPAQVYLTAHSSVQ

SEQ ID NO: 1039245 - protein, 26 aa, Mycobacterium
VNTPVILCVRWNRISKINSIDHDVTL

SEQ ID NO: 1039246 - protein, 17 aa, Mycobacterium
VNTVSMRGVVVIGEGEK

SEQ ID NO: 1039247 - protein, 24 aa, Mycobacterium
VNVKIDKGEFVFLIGPSGSGKSTF

SEQ ID NO: 1039248 - protein, 25 aa, Mycobacterium
VNVPRRCCRPGCPHYAVATLTFVYS

SEQ ID NO: 1039249 - protein, 25 aa, Mycobacterium
VNYNRDVRDAFPLPKGIIANPNCTT

SEQ ID NO: 1039250 - protein, 21 aa, Mycobacterium
VPDEWGMCLARTDPDSPKHKG

SEQ ID NO: 1039251 - protein, 24 aa, Mycobacterium
VPDVDCLWVVLALLSLWTVRCEIK

SEQ ID NO: 1039252 - protein, 17 aa, Mycobacterium
VPESFGGGGADVREVAI

SEQ ID NO: 1039253 - protein, 28 aa, Mycobacterium
VPESKRFCWNCGRPVGRSELEGQEADGA

SEQ ID NO: 1039254 - protein, 20 aa, Mycobacterium
VPGATDWDRAYWRDVGTLDA

SEQ ID NO: 1039255 - protein, 20 aa, Mycobacterium
VPGELHAMMLDMRRTFDEMV

SEQ ID NO: 1039256 - protein, 24 aa, Mycobacterium
VPGELRPALERAFVTGLPSVVNVL

SEQ ID NO: 1039257 - protein, 23 aa, Mycobacterium
VPGLMHVRFGPYHVRDVKFVAAF

SEQ ID NO: 1039258 - protein, 23 aa, Mycobacterium
VPGPTALLAPEWVPWEQRVRPGD

SEQ ID NO: 1039259 - protein, 24 aa, Mycobacterium
VPGTWRFTLALFLAQQLLRPIRGD

SEQ ID NO: 1039260 - protein, 18 aa, Mycobacterium
VPGYTRYPPQPKLVTSCR

SEQ ID NO: 1039261 - protein, 22 aa, Mycobacterium
VPHDCLPVLALFDHEEVGSTSD

SEQ ID NO: 1039262 - protein, 25 aa, Mycobacterium
VPILKGDKGEPCWPDGVVGSLTHCS

SEQ ID NO: 1039263 - protein, 17 aa, Mycobacterium
VPIPGAPPSLAGLQQEC

SEQ ID NO: 1039264 - protein, 19 aa, Mycobacterium
VPIPYVYPVDLRYVLAPPV

SEQ ID NO: 1039265 - protein, 25 aa, Mycobacterium
VPKKLLEEWLALWSEHYQLGEKLRV

SEQ ID NO: 1039266 - protein, 24 aa, Mycobacterium
VPKTLVQHLIRWVIASSQFEEQVD

SEQ ID NO: 1039267 - protein, 18 aa, Mycobacterium
VPLEVSVGFGRSWGAAAH

SEQ ID NO: 1039268 - protein, 25 aa, Mycobacterium
VPLGASWEGGWRCGEVVLSMVADNA

SEQ ID NO: 1039269 - protein, 17 aa, Mycobacterium
VPLNFHRGINVAMDSLK

SEQ ID NO: 1039270 - protein, 23 aa, Mycobacterium
VPLPSKWRIAFGEPIYTTDYAAT

SEQ ID NO: 1039271 - protein, 17 aa, Mycobacterium
VPLRKSVLFEMEQEFPE

SEQ ID NO: 1039272 - protein, 25 aa, Mycobacterium
VPLTAGSFVRRIPGAPAGQIELDLL

SEQ ID NO: 1039273 - protein, 17 aa, Mycobacterium
VPMYFGAELVKVTPIDF

SEQ ID NO: 1039274 - protein, 27 aa, Mycobacterium
VPPNFPDDFLLYWGLLAAMQVRTGRLA

SEQ ID NO: 1039275 - protein, 19 aa, Mycobacterium
VPRKMKLSRVVGGQIPTGF

SEQ ID NO: 1039276 - protein, 23 aa, Mycobacterium
VPRPGGGRPGAPVGGRSDAGGGN

SEQ ID NO: 1039277 - protein, 22 aa, Mycobacterium
VPRTKRGVISYAARDIGERLDA

SEQ ID NO: 1039278 - protein, 20 aa, Mycobacterium
VPSLACGRCRTLARCRHCTG

SEQ ID NO: 1039279 - protein, 26 aa, Mycobacterium
VPSLARIGLELVVIEWGAPINLDLRV

SEQ ID NO: 1039280 - protein, 17 aa, Mycobacterium
VPSRKSATTGSRQVLLQ

SEQ ID NO: 1039281 - protein, 19 aa, Mycobacterium
VPTEPRRFVEIPVVPWVVS

SEQ ID NO: 1039282 - protein, 18 aa, Mycobacterium
VPTGSARTPSGWEATTHG

SEQ ID NO: 1039283 - protein, 18 aa, Mycobacterium
VPVCVGYQIAGVRTHDMP

SEQ ID NO: 1039284 - protein, 17 aa, Mycobacterium
VPVDGDIGLWLDLCAGP

SEQ ID NO: 1039285 - protein, 18 aa, Mycobacterium
VPVFDRLAHLTGHRPIER

SEQ ID NO: 1039286 - protein, 17 aa, Mycobacterium
VPVTNRVGAENNGWRLV

SEQ ID NO: 1039287 - protein, 22 aa, Mycobacterium
VPVYPTCHYVMGGIPTTVTGQV

SEQ ID NO: 1039288 - protein, 18 aa, Mycobacterium
VPWQVLRRGGHFCVMSYK

SEQ ID NO: 1039289 - protein, 23 aa, Mycobacterium
VQAALKDGFRVFGELAPHPLLTY

SEQ ID NO: 1039290 - protein, 20 aa, Mycobacterium
VQARELLPERALMGDASAIV

SEQ ID NO: 1039291 - protein, 21 aa, Mycobacterium
VQGEAAAGVVLLRPASPGTGV

SEQ ID NO: 1039292 - protein, 25 aa, Mycobacterium
VQKKGSALVPSWVAFAVTGLLEQHF

SEQ ID NO: 1039293 - protein, 19 aa, Mycobacterium
VQLRDGTHLMLRPVLPGDT

SEQ ID NO: 1039294 - protein, 26 aa, Mycobacterium
VQLTRKRLGTGLVEAFSTSCPNCTGR

SEQ ID NO: 1039295 - protein, 20 aa, Mycobacterium
VQPLKGARISGSLHMTVQTA

SEQ ID NO: 1039296 - protein, 24 aa, Mycobacterium
VQPPPCTWEQPWSFTEFLDTARAL

SEQ ID NO: 1039297 - protein, 25 aa, Mycobacterium
VQRARDLWYHRILPFAYNLSQRQAV

SEQ ID NO: 1039298 - protein, 28 aa, Mycobacterium
VQRARELLASFGKRISIAAVNGRSAVVV

SEQ ID NO: 1039299 - protein, 18 aa, Mycobacterium
VQRLCARELVGVSPETTI

SEQ ID NO: 1039300 - protein, 17 aa, Mycobacterium
VQSMPGMMDTILNLGIN

SEQ ID NO: 1039301 - protein, 31 aa, Mycobacterium
VQTEGRPRLRYWLDRLSTYGVLAYAAVVYGY

SEQ ID NO: 1039302 - protein, 25 aa, Mycobacterium
VQTGFARTGAMFACEHDGIVPDLIC

SEQ ID NO: 1039303 - protein, 25 aa, Mycobacterium
VQYPNGCLVDAPLPTWTRRELMLSR

SEQ ID NO: 1039304 - protein, 19 aa, Mycobacterium
VRAAVDFEREVCRRTAAAA

SEQ ID NO: 1039305 - protein, 17 aa, Mycobacterium
VRAGELTPAMAAQQILQ

SEQ ID NO: 1039306 - protein, 34 aa, Mycobacterium
VRAVLKIARSALLSGKRTVLFIDEVHRFSKTQQD

SEQ ID NO: 1039307 - protein, 20 aa, Mycobacterium
VRCDSGEVLVPFVGAIVKLV

SEQ ID NO: 1039308 - protein, 19 aa, Mycobacterium
VRDGLKPVHRRVLYAMLDS

SEQ ID NO: 1039309 - protein, 18 aa, Mycobacterium
VREGAVGVHSVFGGVFIV

SEQ ID NO: 1039310 - protein, 18 aa, Mycobacterium
VREPGCLAVTTLLDAYRV

SEQ ID NO: 1039311 - protein, 22 aa, Mycobacterium
VRESLRRSLSFNGYSVELANDG

SEQ ID NO: 1039312 - protein, 23 aa, Mycobacterium
VREVLPRDVIEPERQPESPVPAA

SEQ ID NO: 1039313 - protein, 18 aa, Mycobacterium
VRFSDRLDDDLVRRDFTV

SEQ ID NO: 1039314 - protein, 24 aa, Mycobacterium
VRFTAPVEYAFRHPLIRTVAYESQ

SEQ ID NO: 1039315 - protein, 20 aa, Mycobacterium
VRGEGAGVVVLKRLDDAVRD

SEQ ID NO: 1039316 - protein, 24 aa, Mycobacterium
VRGGICVTPVLGSRSYDVLSAIGP

SEQ ID NO: 1039317 - protein, 28 aa, Mycobacterium
VRGKPLPWKDLRAAFTERGWLDLTHTRR

SEQ ID NO: 1039318 - protein, 22 aa, Mycobacterium
VRGRGAMIAVELVKSGTAEPDP

SEQ ID NO: 1039319 - protein, 19 aa, Mycobacterium
VRGYRNWLGLNKGDLTEEV

SEQ ID NO: 1039320 - protein, 25 aa, Mycobacterium
VRHAPYGLAGSRTLAWVSQTASNIV

SEQ ID NO: 1039321 - protein, 17 aa, Mycobacterium
VRHECLEYALAHDERFG

SEQ ID NO: 1039322 - protein, 22 aa, Mycobacterium
VRHVRFTVVLGYLRSTESPLAT

SEQ ID NO: 1039323 - protein, 22 aa, Mycobacterium
VRIAPTLAMPGLRARLHTSRTG

SEQ ID NO: 1039324 - protein, 27 aa, Mycobacterium
VRIERELPEWLAADVAILGEPTGGYIE

SEQ ID NO: 1039325 - protein, 21 aa, Mycobacterium
VRIGAHRVLVLAGRIHPYEGH

SEQ ID NO: 1039326 - protein, 20 aa, Mycobacterium
VRIVIEIKRDAVAKVVLNNL

SEQ ID NO: 1039327 - protein, 18 aa, Mycobacterium
VRKHKRPGYILLSTDVAR

SEQ ID NO: 1039328 - protein, 19 aa, Mycobacterium
VRLAGLVAHQEVLFGTAGE

SEQ ID NO: 1039329 - protein, 19 aa, Mycobacterium
VRLALGLLIGDAFAVGRAT

SEQ ID NO: 1039330 - protein, 17 aa, Mycobacterium
VRLALMHGRLSADEKDA

SEQ ID NO: 1039331 - protein, 17 aa, Mycobacterium
VRLATFQAAVNKLAAAT

SEQ ID NO: 1039332 - protein, 25 aa, Mycobacterium
VRLGGPRLKDVAGLSLTKLFVGSEG

SEQ ID NO: 1039333 - protein, 23 aa, Mycobacterium
VRLVKACAGEGAHGLLVVTPYYS

SEQ ID NO: 1039334 - protein, 18 aa, Mycobacterium
VRNGRCVVTAAISVSGPI

SEQ ID NO: 1039335 - protein, 18 aa, Mycobacterium
VRPGCAVAVRLDAGHSRE

SEQ ID NO: 1039336 - protein, 23 aa, Mycobacterium
VRQPDYLTAFAALWETINLEDWK

SEQ ID NO: 1039337 - protein, 24 aa, Mycobacterium
VRQRWPRMLPLTVRARRAATAAHY

SEQ ID NO: 1039338 - protein, 17 aa, Mycobacterium
VRRIRPGEELVLGDGVG

SEQ ID NO: 1039339 - protein, 41 aa, Mycobacterium
VRRLARLHTPLPLLAFTAWPEVRSQLAMTWGTETFLVPKML

SEQ ID NO: 1039340 - protein, 21 aa, Mycobacterium
VRRRPYTVVLFDEVEKAHSDV

SEQ ID NO: 1039341 - protein, 17 aa, Mycobacterium
VRRWTRRDLIAEQLNET

SEQ ID NO: 1039342 - protein, 22 aa, Mycobacterium
VRSAVGLAAIHRGHPLVADLNG

SEQ ID NO: 1039343 - protein, 26 aa, Mycobacterium
VRSLRKRLGIHPVYKTVDTCAAEFEA

SEQ ID NO: 1039344 - protein, 24 aa, Mycobacterium
VRSRSWWSGFDVVLLVDDWHMIVS

SEQ ID NO: 1039345 - protein, 18 aa, Mycobacterium
VRSVFKPEFINRLDDVLI

SEQ ID NO: 1039346 - protein, 23 aa, Mycobacterium
VRSYKLRGAYNLLVQLTDEEIAA

SEQ ID NO: 1039347 - protein, 20 aa, Mycobacterium
VRTACAAGARIIVLTNAAGG

SEQ ID NO: 1039348 - protein, 23 aa, Mycobacterium
VRTGSWLRRGRRTFTAAHLLLAA

SEQ ID NO: 1039349 - protein, 18 aa, Mycobacterium
VRTPLPVQLPEQMAEQLR

SEQ ID NO: 1039350 - protein, 20 aa, Mycobacterium
VRTRLIELFELFDPDDPNVI

SEQ ID NO: 1039351 - protein, 18 aa, Mycobacterium
VRVLRPGGHLAYADLRPS

SEQ ID NO: 1039352 - protein, 18 aa, Mycobacterium
VRVPPALVPFVGTELLES

SEQ ID NO: 1039353 - protein, 19 aa, Mycobacterium
VRWTDGGMSRVRILRGAPS

SEQ ID NO: 1039354 - protein, 22 aa, Mycobacterium
VRYDSTCIFSLDTRDGLVSIRE

SEQ ID NO: 1039355 - protein, 18 aa, Mycobacterium
VRYGEVIFHERVLDLCAG

SEQ ID NO: 1039356 - protein, 18 aa, Mycobacterium
VRYIPDYSAVVIEVAAAA

SEQ ID NO: 1039357 - protein, 17 aa, Mycobacterium
VSAALVKRGLEPDKLSW

SEQ ID NO: 1039358 - protein, 25 aa, Mycobacterium
VSALKALEGDAKWVESVTQLMDAVD

SEQ ID NO: 1039359 - protein, 18 aa, Mycobacterium
VSDPYVLVLPTYGGGRTA

SEQ ID NO: 1039360 - protein, 17 aa, Mycobacterium
VSDRCCWATSQWFSGWR

SEQ ID NO: 1039361 - protein, 17 aa, Mycobacterium
VSDRPGTITPFALLQLA

SEQ ID NO: 1039362 - protein, 17 aa, Mycobacterium
VSECVRCLTAVHGHVQV

SEQ ID NO: 1039363 - protein, 17 aa, Mycobacterium
VSEFFCRLLNYMNANDF

SEQ ID NO: 1039364 - protein, 24 aa, Mycobacterium
VSGDELRATLLALLGSPHLCSRAF

SEQ ID NO: 1039365 - protein, 23 aa, Mycobacterium
VSGGTARLSRLLSELLVSADSSA

SEQ ID NO: 1039366 - protein, 21 aa, Mycobacterium
VSGLQILTCRLDVALSKVDGL

SEQ ID NO: 1039367 - protein, 28 aa, Mycobacterium
VSGRKPCRVPVWFMRQAGRSLPEYRALR

SEQ ID NO: 1039368 - protein, 20 aa, Mycobacterium
VSHRTEYRYSDVVTSSYGRG

SEQ ID NO: 1039369 - protein, 20 aa, Mycobacterium
VSIGAILAIPGIRGALRTTT

SEQ ID NO: 1039370 - protein, 27 aa, Mycobacterium
VSKAKAGGLVEGWRMTKVVGLAGPHRA

SEQ ID NO: 1039371 - protein, 19 aa, Mycobacterium
VSLAELRKSVGVRPDAVIG

SEQ ID NO: 1039372 - protein, 20 aa, Mycobacterium
VSLEMAEYVSTIFTEVIVAP

SEQ ID NO: 1039373 - protein, 27 aa, Mycobacterium
VSLFGAQFITWRGIPLIPSDKVPVQDG

SEQ ID NO: 1039374 - protein, 19 aa, Mycobacterium
VSLGKRKGKIVVEFSSVDD

SEQ ID NO: 1039375 - protein, 25 aa, Mycobacterium
VSLPDPRLAKLAELFGSERILPAQV

SEQ ID NO: 1039376 - protein, 20 aa, Mycobacterium
VSLRPVFNLYNKRWPIRGES

SEQ ID NO: 1039377 - protein, 23 aa, Mycobacterium
VSLSSKDKFTFCRYQVIETSNVT

SEQ ID NO: 1039378 - protein, 18 aa, Mycobacterium
VSLYRLRWLSPWPAAFGF

SEQ ID NO: 1039379 - protein, 21 aa, Mycobacterium
VSNFPGSKHKGYRLVLPSAGR

SEQ ID NO: 1039380 - protein, 22 aa, Mycobacterium
VSNRFYEWVLGPSMTYTCAVYP

SEQ ID NO: 1039381 - protein, 19 aa, Mycobacterium
VSPASMRKFFEAFAPYGLK

SEQ ID NO: 1039382 - protein, 24 aa, Mycobacterium
VSPEPKASAGLGVGEVGYLITGVK

SEQ ID NO: 1039383 - protein, 20 aa, Mycobacterium
VSPIAIRGGQLVAFDPGTGR

SEQ ID NO: 1039384 - protein, 24 aa, Mycobacterium
VSRDALDFGKPVRFSTTIGNVNRT

SEQ ID NO: 1039385 - protein, 17 aa, Mycobacterium
VSSELDGSLGMRKAPNR

SEQ ID NO: 1039386 - protein, 20 aa, Mycobacterium
VSSFGFGGANAHLVVREVLP

SEQ ID NO: 1039387 - protein, 25 aa, Mycobacterium
VSTRLDRIISWLICADVDVMAMQET

SEQ ID NO: 1039388 - protein, 18 aa, Mycobacterium
VSVAVLVTRLGRPPRRNA

SEQ ID NO: 1039389 - protein, 21 aa, Mycobacterium
VSVDWRAVLGQANFVEFPTYS

SEQ ID NO: 1039390 - protein, 28 aa, Mycobacterium
VSVGALRVPENWATASQPVMATAHSVPA

SEQ ID NO: 1039391 - protein, 18 aa, Mycobacterium
VSVLSCPISKIMTSVGCQ

SEQ ID NO: 1039392 - protein, 17 aa, Mycobacterium
VSVRRGQLYVTQRFTDC

SEQ ID NO: 1039393 - protein, 19 aa, Mycobacterium
VTACEPGREFGFTVLLGNK

SEQ ID NO: 1039394 - protein, 17 aa, Mycobacterium
VTAETFKNGWLTTDDIA

SEQ ID NO: 1039395 - protein, 17 aa, Mycobacterium
VTARVAALVSLLTDPAS

SEQ ID NO: 1039396 - protein, 26 aa, Mycobacterium
VTDGRWSCVRWGALTPPFYPHLHRPD

SEQ ID NO: 1039397 - protein, 22 aa, Mycobacterium
VTELRAAGLQVLATMVDGETSL

SEQ ID NO: 1039398 - protein, 17 aa, Mycobacterium
VTEWFTVDWHRVIVNKW

SEQ ID NO: 1039399 - protein, 18 aa, Mycobacterium
VTFDIDLVFSWVDGSDPE

SEQ ID NO: 1039400 - protein, 25 aa, Mycobacterium
VTGCALHLVEPIGFDLSNPKLRRAG

SEQ ID NO: 1039401 - protein, 21 aa, Mycobacterium
VTGFDFPFAAMGSVHTENHIT

SEQ ID NO: 1039402 - protein, 17 aa, Mycobacterium
VTHVYPQLIDIIRSRHL

SEQ ID NO: 1039403 - protein, 26 aa, Mycobacterium
VTLGPRGRHVVLAKAFGGPTITNDGV

SEQ ID NO: 1039404 - protein, 22 aa, Mycobacterium
VTLPGAAIWHMAWSDKDDAIDW

SEQ ID NO: 1039405 - protein, 18 aa, Mycobacterium
VTMKTAWTGAGGVKGFFE

SEQ ID NO: 1039406 - protein, 17 aa, Mycobacterium
VTMLTRHPGGASVQVHA

SEQ ID NO: 1039407 - protein, 18 aa, Mycobacterium
VTNPSPYMYLLHVPNSDG

SEQ ID NO: 1039408 - protein, 22 aa, Mycobacterium
VTPKGWRAVVGGSDQPGMATIS

SEQ ID NO: 1039409 - protein, 24 aa, Mycobacterium
VTRTAVCQPGLFNAEVKKAAAEHG

SEQ ID NO: 1039410 - protein, 18 aa, Mycobacterium
VTSFSWVRCCEGRDSRSD

SEQ ID NO: 1039411 - protein, 19 aa, Mycobacterium
VTSLLRFAGGLHIVGGRVV

SEQ ID NO: 1039412 - protein, 24 aa, Mycobacterium
VTSVPRPGTIVAHTSWANGVGILA

SEQ ID NO: 1039413 - protein, 23 aa, Mycobacterium
VTTRCLPIWLTAALLVTDVASQV

SEQ ID NO: 1039414 - protein, 25 aa, Mycobacterium
VTTRLRAAGIPILGKTNMDEFAMGS

SEQ ID NO: 1039415 - protein, 19 aa, Mycobacterium
VTTRPCDALKAYRRGARGL

SEQ ID NO: 1039416 - protein, 22 aa, Mycobacterium
VTVERLEYKLGIRGSDTAAIRF

SEQ ID NO: 1039417 - protein, 17 aa, Mycobacterium
VTVTLGSMFARVRNDRI

SEQ ID NO: 1039418 - protein, 21 aa, Mycobacterium
VTVWPRLGLRVVVHSLVCDAL

SEQ ID NO: 1039419 - protein, 26 aa, Mycobacterium
VVAAADWPLLAAAYQTRGVLRMVDDL

SEQ ID NO: 1039420 - protein, 18 aa, Mycobacterium
VVADVARLLADIRAVPVA

SEQ ID NO: 1039421 - protein, 18 aa, Mycobacterium
VVAELGLDVEVVRGRAEE

SEQ ID NO: 1039422 - protein, 20 aa, Mycobacterium
VVAIRDCILILFRYAGHQNE

SEQ ID NO: 1039423 - protein, 17 aa, Mycobacterium
VVALPMRVRFRGITTRE

SEQ ID NO: 1039424 - protein, 18 aa, Mycobacterium
VVALRSCFGLSVHVYIHD

SEQ ID NO: 1039425 - protein, 24 aa, Mycobacterium
VVCFPDRWLDLRYLRSTSAVGDSE

SEQ ID NO: 1039426 - protein, 17 aa, Mycobacterium
VVCNPTFTDADRILKEV

SEQ ID NO: 1039427 - protein, 24 aa, Mycobacterium
VVEAMAAGALQRFDVDTAAAISGI

SEQ ID NO: 1039428 - protein, 21 aa, Mycobacterium
VVEGVKLADGRAFSVQYHPEA

SEQ ID NO: 1039429 - protein, 21 aa, Mycobacterium
VVEKGKLVGVITRYDLLGFLS

SEQ ID NO: 1039430 - protein, 18 aa, Mycobacterium
VVEKMIKLGRSGRLKGAG

SEQ ID NO: 1039431 - protein, 17 aa, Mycobacterium
VVEMLRLITDRGDGVIV

SEQ ID NO: 1039432 - protein, 18 aa, Mycobacterium
VVGAVLDRNGLRPSRIWI

SEQ ID NO: 1039433 - protein, 20 aa, Mycobacterium
VVGCGPGPFTGLRVGMATAA

SEQ ID NO: 1039434 - protein, 17 aa, Mycobacterium
VVGFGGYVALPAYLAAR

SEQ ID NO: 1039435 - protein, 17 aa, Mycobacterium
VVGFTVHVPHYLTQTDY

SEQ ID NO: 1039436 - protein, 24 aa, Mycobacterium
VVGRKALNYYTFRNWGIAESWTGF

SEQ ID NO: 1039437 - protein, 17 aa, Mycobacterium
VVGVQLLLTPAIRLTNW

SEQ ID NO: 1039438 - protein, 30 aa, Mycobacterium
VVIANGIGAPALWPGLPVRPVKGEVLRLRW

SEQ ID NO: 1039439 - protein, 22 aa, Mycobacterium
VVKVARIAGQYAKPRSADTDAL

SEQ ID NO: 1039440 - protein, 17 aa, Mycobacterium
VVLPSCNSRPILVACLV

SEQ ID NO: 1039441 - protein, 20 aa, Mycobacterium
VVNVQRIVKFLAYHRNNNQG

SEQ ID NO: 1039442 - protein, 18 aa, Mycobacterium
VVNYRLLPKHSIGMALDD

SEQ ID NO: 1039443 - protein, 25 aa, Mycobacterium
VVPGLWRLDSLPLLVSATDWEVLEA

SEQ ID NO: 1039444 - protein, 23 aa, Mycobacterium
VVPRAIRGLVNIDLTDERSLAAA

SEQ ID NO: 1039445 - protein, 22 aa, Mycobacterium
VVQSQRVVPPWSTEQDHTEARP

SEQ ID NO: 1039446 - protein, 18 aa, Mycobacterium
VVRDVRRIGSAALDLCMV

SEQ ID NO: 1039447 - protein, 19 aa, Mycobacterium
VVRGEACADSFYAALESAV

SEQ ID NO: 1039448 - protein, 25 aa, Mycobacterium
VVRQVRFTAAFTFQYSKRPGTPAAE

SEQ ID NO: 1039449 - protein, 28 aa, Mycobacterium
VVRRLKASGVDTVFTLSGGHLFSIYDGC

SEQ ID NO: 1039450 - protein, 17 aa, Mycobacterium
VVRWELRPRMLLRTIEF

SEQ ID NO: 1039451 - protein, 17 aa, Mycobacterium
VVRWIPPTTQDEELAVN

SEQ ID NO: 1039452 - protein, 20 aa, Mycobacterium
VVSGGFRRIIEPLAHELMLD

SEQ ID NO: 1039453 - protein, 25 aa, Mycobacterium
VVSRGSGEFLVFRRKATLYIDHQTR

SEQ ID NO: 1039454 - protein, 20 aa, Mycobacterium
VVTDHVWRRGQQVGLVDVHP

SEQ ID NO: 1039455 - protein, 17 aa, Mycobacterium
VVTLRSKLLTSLAGSGG

SEQ ID NO: 1039456 - protein, 19 aa, Mycobacterium
VVTNFPRLTRFHTATLFSL

SEQ ID NO: 1039457 - protein, 20 aa, Mycobacterium
VVTVDGDLVGAGWVSGGSGR

SEQ ID NO: 1039458 - protein, 23 aa, Mycobacterium
VVVARFDPVFGLEVHVELSTVTK

SEQ ID NO: 1039459 - protein, 19 aa, Mycobacterium
VWLVAPAHRQTYISKVPDR

SEQ ID NO: 1039460 - protein, 25 aa, Mycobacterium
VWRTFGQHRLDAMAATATVPVVNAL

SEQ ID NO: 1039461 - protein, 21 aa, Mycobacterium
VWVAKLAVDFRQRFKKDVVID

SEQ ID NO: 1039462 - protein, 27 aa, Mycobacterium
VYAEMADELVALLVVVPVSSWDGSAAE

SEQ ID NO: 1039463 - protein, 18 aa, Mycobacterium
VYDAQGWTIDSTADGIRF

SEQ ID NO: 1039464 - protein, 27 aa, Mycobacterium
VYGNTRLGLFPFRRGLTFYYLDLALMS

SEQ ID NO: 1039465 - protein, 23 aa, Mycobacterium
VYLADCRKFGITVLPPDVNESVL

SEQ ID NO: 1039466 - protein, 25 aa, Mycobacterium
VYLEIGVSHGFVFRRVAADVKIAVD

SEQ ID NO: 1039467 - protein, 18 aa, Mycobacterium
VYLHRTVVAIRDCILILF

SEQ ID NO: 1039468 - protein, 28 aa, Mycobacterium
VYQAAMFDGRFVGFIDFLVRDGEQYRVV

SEQ ID NO: 1039469 - protein, 18 aa, Mycobacterium
VYQPLAVLVTKARPTAAG

SEQ ID NO: 1039470 - protein, 25 aa, Mycobacterium
VYSDGRYSYQMSIYVIRVEQETAVA

SEQ ID NO: 1039471 - protein, 23 aa, Mycobacterium
VYSRGEMTTALWLCGLDVAAGTT

SEQ ID NO: 1039472 - protein, 17 aa, Mycobacterium
VYYIAVKCACPFGPMVV

SEQ ID NO: 1039473 - protein, 17 aa, Mycobacterium
WAALPRAGAVIFATGGM

SEQ ID NO: 1039474 - protein, 17 aa, Mycobacterium
WADPDIFETTKYDFGTV

SEQ ID NO: 1039475 - protein, 21 aa, Mycobacterium
WAEIIALRRRAYAMLDNPVMP

SEQ ID NO: 1039476 - protein, 17 aa, Mycobacterium
WAELVYDGLWYSPLKTA

SEQ ID NO: 1039477 - protein, 24 aa, Mycobacterium
WAKQRGHRGLAYVLVTDDGTLGGP

SEQ ID NO: 1039478 - protein, 18 aa, Mycobacterium
WAKQVTRVLVAIENAMCP

SEQ ID NO: 1039479 - protein, 19 aa, Mycobacterium
WAKTWEFQALLKARSAVGD

SEQ ID NO: 1039480 - protein, 18 aa, Mycobacterium
WAKVTGRVAPVFDLGIGM

SEQ ID NO: 1039481 - protein, 18 aa, Mycobacterium
WALQLWPAISDAVISEYA

SEQ ID NO: 1039482 - protein, 21 aa, Mycobacterium
WAPECCVVVAYGALLGSPLLA

SEQ ID NO: 1039483 - protein, 22 aa, Mycobacterium
WAPRAGKTISWQPTPATCEKVS

SEQ ID NO: 1039484 - protein, 17 aa, Mycobacterium
WAPSMVVGLGRLSGRTV

SEQ ID NO: 1039485 - protein, 17 aa, Mycobacterium
WAPTVWFDQWNSFLQSS

SEQ ID NO: 1039486 - protein, 17 aa, Mycobacterium
WAPVSLGDYCAGSNHVL

SEQ ID NO: 1039487 - protein, 17 aa, Mycobacterium
WAQRGLRDRFLELTDAV

SEQ ID NO: 1039488 - protein, 19 aa, Mycobacterium
WARVHRDFIAREILATSFE

SEQ ID NO: 1039489 - protein, 18 aa, Mycobacterium
WAVDELRTSHLIDLKPAY

SEQ ID NO: 1039490 - protein, 25 aa, Mycobacterium
WAVTHPARWALLYGSPASGYHALAE

SEQ ID NO: 1039491 - protein, 17 aa, Mycobacterium
WCHITDALLPTVFLRHL

SEQ ID NO: 1039492 - protein, 17 aa, Mycobacterium
WCLGVSPASLFTELFAD

SEQ ID NO: 1039493 - protein, 21 aa, Mycobacterium
WCSLRPKGWRLTSFTGSSAGG

SEQ ID NO: 1039494 - protein, 26 aa, Mycobacterium
WDAFATTVATGWALAIHCGNPECEED

SEQ ID NO: 1039495 - protein, 18 aa, Mycobacterium
WDHIHGIIDVPTFELDAI

SEQ ID NO: 1039496 - protein, 19 aa, Mycobacterium
WDLAQLCWALRGSSTRLSV

SEQ ID NO: 1039497 - protein, 22 aa, Mycobacterium
WDLFRYPGIRSDSDMYTLGFRF

SEQ ID NO: 1039498 - protein, 22 aa, Mycobacterium
WDLLCDGRSGIVRVPSDRWDAD

SEQ ID NO: 1039499 - protein, 18 aa, Mycobacterium
WDLPAPVVERRIRAVTPN

SEQ ID NO: 1039500 - protein, 19 aa, Mycobacterium
WDRLCAALTPGNVVLADQG

SEQ ID NO: 1039501 - protein, 17 aa, Mycobacterium
WDTAAWVGLRDRRLYVA

SEQ ID NO: 1039502 - protein, 18 aa, Mycobacterium
WEAFLGKDDNLYACETVA

SEQ ID NO: 1039503 - protein, 20 aa, Mycobacterium
WEALEHARIPASSLRGEAVG

SEQ ID NO: 1039504 - protein, 20 aa, Mycobacterium
WEALEYAGIDPLSLRGSATG

SEQ ID NO: 1039505 - protein, 17 aa, Mycobacterium
WELATLAAMLDRSIGGR

SEQ ID NO: 1039506 - protein, 19 aa, Mycobacterium
WELEDLSFAILHPKKYEEI

SEQ ID NO: 1039507 - protein, 17 aa, Mycobacterium
WELGDGWVKHVTVEIAL

SEQ ID NO: 1039508 - protein, 25 aa, Mycobacterium
WELSLPRRDLCMLAAKLGSDVPFAL

SEQ ID NO: 1039509 - protein, 17 aa, Mycobacterium
WEQELLAGAGSSALNDS

SEQ ID NO: 1039510 - protein, 25 aa, Mycobacterium
WFGRGHMYEGLAWFDSIFEHKNIEH

SEQ ID NO: 1039511 - protein, 21 aa, Mycobacterium
WFSSALWPFSTLGWPQMTPEL

SEQ ID NO: 1039512 - protein, 22 aa, Mycobacterium
WGADSGMLAALYVLAALGEQQR

SEQ ID NO: 1039513 - protein, 17 aa, Mycobacterium
WGALPLRSADRARRREA

SEQ ID NO: 1039514 - protein, 18 aa, Mycobacterium
WGATMKRAIEIYDVNVIG

SEQ ID NO: 1039515 - protein, 21 aa, Mycobacterium
WGAWGELGLATALAEMAGVAI

SEQ ID NO: 1039516 - protein, 18 aa, Mycobacterium
WGDGVPMADDKDAFAEFV

SEQ ID NO: 1039517 - protein, 17 aa, Mycobacterium
WGGRFAAGPSEALVALS

SEQ ID NO: 1039518 - protein, 18 aa, Mycobacterium
WGHDRVAQVITFGTIKTK

SEQ ID NO: 1039519 - protein, 19 aa, Mycobacterium
WGIAAAMTRGDIAVTGVDP

SEQ ID NO: 1039520 - protein, 17 aa, Mycobacterium
WGLDTKWSVADDELTVV

SEQ ID NO: 1039521 - protein, 17 aa, Mycobacterium
WGLQPDFVMGHSIGELA

SEQ ID NO: 1039522 - protein, 20 aa, Mycobacterium
WGPPVDRYEAVRVLRRAVEL

SEQ ID NO: 1039523 - protein, 17 aa, Mycobacterium
WGQGAFNDFKVVPPGTG

SEQ ID NO: 1039524 - protein, 17 aa, Mycobacterium
WGTETFLVPKMLSTDGM

SEQ ID NO: 1039525 - protein, 26 aa, Mycobacterium
WGVGVAESGVSYALRDAFAVASYLGG

SEQ ID NO: 1039526 - protein, 18 aa, Mycobacterium
WHLERQLKTLPLVERTHQ

SEQ ID NO: 1039527 - protein, 17 aa, Mycobacterium
WIAAERGFIDAVVEPHQ

SEQ ID NO: 1039528 - protein, 17 aa, Mycobacterium
WIAVGLFDPAVREKAGM

SEQ ID NO: 1039529 - protein, 19 aa, Mycobacterium
WICRDGDRAKNHLLEANLR

SEQ ID NO: 1039530 - protein, 17 aa, Mycobacterium
WIDIPFTLPTNTVDGGA

SEQ ID NO: 1039531 - protein, 23 aa, Mycobacterium
WIDTSRLRDEWGFVPVWNVDECI

SEQ ID NO: 1039532 - protein, 21 aa, Mycobacterium
WIELFDWLSVSLICYIGPGVE

SEQ ID NO: 1039533 - protein, 19 aa, Mycobacterium
WIKTRARMGPEYTALKNLV

SEQ ID NO: 1039534 - protein, 26 aa, Mycobacterium
WILNGFKCWITNGGKSTWYTVMAVTD

SEQ ID NO: 1039535 - protein, 19 aa, Mycobacterium
WINAHPDFAYLPVDLSHER

SEQ ID NO: 1039536 - protein, 18 aa, Mycobacterium
WIRELARKPEDTGGTFSA

SEQ ID NO: 1039537 - protein, 21 aa, Mycobacterium
WKIDVAGGIPDWAVNLPEELL

SEQ ID NO: 1039538 - protein, 21 aa, Mycobacterium
WKMPSFFLTHPQGIAAFGREA

SEQ ID NO: 1039539 - protein, 22 aa, Mycobacterium
WKTGDEMLLRLFGTLGEVAFLA

SEQ ID NO: 1039540 - protein, 19 aa, Mycobacterium
WKYIVALFNAKLDENADPK

SEQ ID NO: 1039541 - protein, 19 aa, Mycobacterium
WKYNEWELRGVPIRLELGP

SEQ ID NO: 1039542 - protein, 22 aa, Mycobacterium
WLADHVIGGVVLFPGAGFVELV

SEQ ID NO: 1039543 - protein, 17 aa, Mycobacterium
WLAERGYDSTLSYLRAM

SEQ ID NO: 1039544 - protein, 20 aa, Mycobacterium
WLAPYTGSAIAQHWMYDGKH

SEQ ID NO: 1039545 - protein, 24 aa, Mycobacterium
WLDDRKWAYVRLEGRGFGDVPLNL

SEQ ID NO: 1039546 - protein, 24 aa, Mycobacterium
WLGGRRFDSSFGDFGMGGDGAEFN

SEQ ID NO: 1039547 - protein, 18 aa, Mycobacterium
WLGGWVLLGPGGLNINLF

SEQ ID NO: 1039548 - protein, 27 aa, Mycobacterium
WLHKQRTGLPHVTWKYASSIDGRSAAA

SEQ ID NO: 1039549 - protein, 20 aa, Mycobacterium
WLIDAGCPIQRINDYDEWLR

SEQ ID NO: 1039550 - protein, 21 aa, Mycobacterium
WLKERWEHFEHHTPLRVVNCP

SEQ ID NO: 1039551 - protein, 20 aa, Mycobacterium
WLLAIARRVVADHIRRAQTR

SEQ ID NO: 1039552 - protein, 22 aa, Mycobacterium
WLPFYHDMGLILGVILPMVNQD

SEQ ID NO: 1039553 - protein, 22 aa, Mycobacterium
WLPLFHDMGLILGVCAPMVAGR

SEQ ID NO: 1039554 - protein, 32 aa, Mycobacterium
WLRDTLRLGEKFPLKAGMLTSLGFGHVSGLVA

SEQ ID NO: 1039555 - protein, 21 aa, Mycobacterium
WLRHEVDAGLKRRFPDGPPNG

SEQ ID NO: 1039556 - protein, 27 aa, Mycobacterium
WLSKLGHFRLHLNFTKKALNFFGEVSR

SEQ ID NO: 1039557 - protein, 17 aa, Mycobacterium
WLSVSLICYIGPGVEYA

SEQ ID NO: 1039558 - protein, 23 aa, Mycobacterium
WLTATRARNALVLVRGKTTDQLP

SEQ ID NO: 1039559 - protein, 17 aa, Mycobacterium
WLVGLLFPDNDGCAGHS

SEQ ID NO: 1039560 - protein, 19 aa, Mycobacterium
WLVHRFKADTVIYVTPTED

SEQ ID NO: 1039561 - protein, 19 aa, Mycobacterium
WMGECHVHAGINGDELVDQ

SEQ ID NO: 1039562 - protein, 17 aa, Mycobacterium
WMTRLVLGFGSAVQVQA

SEQ ID NO: 1039563 - protein, 17 aa, Mycobacterium
WNGAVALIEPGATDTEM

SEQ ID NO: 1039564 - protein, 18 aa, Mycobacterium
WNITPGDLATIWRGGCII

SEQ ID NO: 1039565 - protein, 20 aa, Mycobacterium
WNSPRAVAYRTHYGLDDQSG

SEQ ID NO: 1039566 - protein, 18 aa, Mycobacterium
WNTFRIPWRVGIVDFLLW

SEQ ID NO: 1039567 - protein, 20 aa, Mycobacterium
WPAAAAHPSLPRGALLQTAV

SEQ ID NO: 1039568 - protein, 20 aa, Mycobacterium
WPAGWSSWQSRGYGDTRLEL

SEQ ID NO: 1039569 - protein, 26 aa, Mycobacterium
WPDKPGVAGCAAMDGTVLVNLISPKL

SEQ ID NO: 1039570 - protein, 21 aa, Mycobacterium
WPDVLWWSTRVAGVVDGDPTK

SEQ ID NO: 1039571 - protein, 24 aa, Mycobacterium
WPGEPRSKLLRRLIEVGAGILERD

SEQ ID NO: 1039572 - protein, 17 aa, Mycobacterium
WPGTLTGLAGYASGDVD

SEQ ID NO: 1039573 - protein, 21 aa, Mycobacterium
WPNKATSAIARRCLPQVQASL

SEQ ID NO: 1039574 - protein, 25 aa, Mycobacterium
WQAIGSARLDLCFVMTAAADACGFA

SEQ ID NO: 1039575 - protein, 25 aa, Mycobacterium
WQEDKRWTPTWGEDQRAAAYAGWRK

SEQ ID NO: 1039576 - protein, 21 aa, Mycobacterium
WQPHQVPAFLAAGYRVITFDN

SEQ ID NO: 1039577 - protein, 17 aa, Mycobacterium
WQRELVVTILASAVKSS

SEQ ID NO: 1039578 - protein, 18 aa, Mycobacterium
WQTYGDVVVRFDQSSSLH

SEQ ID NO: 1039579 - protein, 24 aa, Mycobacterium
WRAHPEDVLPLWVAEMDVLLAPTV

SEQ ID NO: 1039580 - protein, 17 aa, Mycobacterium
WRATGTLEDELVRQRIV

SEQ ID NO: 1039581 - protein, 19 aa, Mycobacterium
WRDRFQKMLQRAESRLHPS

SEQ ID NO: 1039582 - protein, 21 aa, Mycobacterium
WREWSLRCAALATHPAALDTR

SEQ ID NO: 1039583 - protein, 18 aa, Mycobacterium
WRFVCLSAVALLGHRRVG

SEQ ID NO: 1039584 - protein, 17 aa, Mycobacterium
WRHDLLHAGYRVCVLGF

SEQ ID NO: 1039585 - protein, 19 aa, Mycobacterium
WRHPDLKAAGAAMATSALA

SEQ ID NO: 1039586 - protein, 25 aa, Mycobacterium
WRKKFSQKELDVFRLPGTKPPFTGE

SEQ ID NO: 1039587 - protein, 22 aa, Mycobacterium
WRKMADCIGFEIKIHRIAAVAI

SEQ ID NO: 1039588 - protein, 26 aa, Mycobacterium
WRQADKYEVPRICFVNKMDKIGADFY

SEQ ID NO: 1039589 - protein, 17 aa, Mycobacterium
WRQWWKILPPIKALQQL

SEQ ID NO: 1039590 - protein, 17 aa, Mycobacterium
WRRPLDGGVIEFAGEIL

SEQ ID NO: 1039591 - protein, 25 aa, Mycobacterium
WRSSFRICWLSGGWVVWSRPATAVT

SEQ ID NO: 1039592 - protein, 23 aa, Mycobacterium
WRTALDPSGEWMPAVISAADQRL

SEQ ID NO: 1039593 - protein, 17 aa, Mycobacterium
WRTFLTCDANLAVTLPS

SEQ ID NO: 1039594 - protein, 17 aa, Mycobacterium
WRTIRGQECSAYWPAGT

SEQ ID NO: 1039595 - protein, 17 aa, Mycobacterium
WRVSAEYSFSRDVSYQA

SEQ ID NO: 1039596 - protein, 26 aa, Mycobacterium
WSAGRTAEYFTRMMAGLGEKLGFDVD

SEQ ID NO: 1039597 - protein, 28 aa, Mycobacterium
WSDWLRNFRCTPAIYAVHRYVGNQAQVD

SEQ ID NO: 1039598 - protein, 22 aa, Mycobacterium
WSESVFPSLGTWSGSFLDSGAV

SEQ ID NO: 1039599 - protein, 21 aa, Mycobacterium
WSGRLRRLLVEQASVILRRTI

SEQ ID NO: 1039600 - protein, 17 aa, Mycobacterium
WSGSFLDSGAVALSDAG

SEQ ID NO: 1039601 - protein, 17 aa, Mycobacterium
WSHPDLTAMTKSEIATQ

SEQ ID NO: 1039602 - protein, 23 aa, Mycobacterium
WSLAKFEVIAKFVAGMPLVAVAR

SEQ ID NO: 1039603 - protein, 19 aa, Mycobacterium
WSLTLSYDRIHGCQRTMQL

SEQ ID NO: 1039604 - protein, 19 aa, Mycobacterium
WSQQWLKTTGINMLRPDFD

SEQ ID NO: 1039605 - protein, 22 aa, Mycobacterium
WSRRVDKPSAIPILAPDEDADP

SEQ ID NO: 1039606 - protein, 28 aa, Mycobacterium
WSSPFGPGRPGWHVECAAIALSRIGIGL

SEQ ID NO: 1039607 - protein, 21 aa, Mycobacterium
WSTERHLVFACGRYEGIDQRV

SEQ ID NO: 1039608 - protein, 20 aa, Mycobacterium
WSVLSSDFEASVLVPAKTLV

SEQ ID NO: 1039609 - protein, 23 aa, Mycobacterium
WTAEFAEAGWTLPLSEDPAGLAE

SEQ ID NO: 1039610 - protein, 17 aa, Mycobacterium
WTAPLGVTYPGVVTQGV

SEQ ID NO: 1039611 - protein, 19 aa, Mycobacterium
WTELADAIGGRGRAGLHQL

SEQ ID NO: 1039612 - protein, 19 aa, Mycobacterium
WTELQSMAVIDRFDEVLQP

SEQ ID NO: 1039613 - protein, 17 aa, Mycobacterium
WTGAGGVKGFFEKTFAP

SEQ ID NO: 1039614 - protein, 17 aa, Mycobacterium
WTPLMTQFQLIDKSIAP

SEQ ID NO: 1039615 - protein, 22 aa, Mycobacterium
WTQIRLGTALDRIQMADIASES

SEQ ID NO: 1039616 - protein, 18 aa, Mycobacterium
WTTAGAFDDYVRGRGLTP

SEQ ID NO: 1039617 - protein, 17 aa, Mycobacterium
WTTCKVTACEPGREFGF

SEQ ID NO: 1039618 - protein, 25 aa, Mycobacterium
WTTFVICDARHAVTLSPEVPLEEAA

SEQ ID NO: 1039619 - protein, 17 aa, Mycobacterium
WTVVRYKAPEAMTLNGD

SEQ ID NO: 1039620 - protein, 18 aa, Mycobacterium
WTWDVFTVTGSLRTWGGG

SEQ ID NO: 1039621 - protein, 25 aa, Mycobacterium
WTWVPYEVLECISTRITNEVAEVNR

SEQ ID NO: 1039622 - protein, 21 aa, Mycobacterium
WVAELRQLVAPADAVFLDAAI

SEQ ID NO: 1039623 - protein, 18 aa, Mycobacterium
WVEYEPYGTVLIIGAWNY

SEQ ID NO: 1039624 - protein, 17 aa, Mycobacterium
WVGLPLAGVQTRLVDES

SEQ ID NO: 1039625 - protein, 17 aa, Mycobacterium
WVLAPHASYGARELGAA

SEQ ID NO: 1039626 - protein, 17 aa, Mycobacterium
WVLGPSMTYTCAVYPNA

SEQ ID NO: 1039627 - protein, 20 aa, Mycobacterium
WVLTKGKLPTSMWIEIVTTA

SEQ ID NO: 1039628 - protein, 29 aa, Mycobacterium
WVPDQRWVMLSCHMKWTQLTSRRYRVSHR

SEQ ID NO: 1039629 - protein, 17 aa, Mycobacterium
WVSPRLVARLAVNRRGG

SEQ ID NO: 1039630 - protein, 33 aa, Mycobacterium
WVTCSPWLEAEWRLVSEYVRAIVALGGFAWQIV

SEQ ID NO: 1039631 - protein, 28 aa, Mycobacterium
WVVPTLNVHAFFRFLVEMFGMVPSDVVD

SEQ ID NO: 1039632 - protein, 18 aa, Mycobacterium
WVVYSLPGVPLFDHHELG

SEQ ID NO: 1039633 - protein, 17 aa, Mycobacterium
WWAATQDPRSWAALPRA

SEQ ID NO: 1039634 - protein, 17 aa, Mycobacterium
WWDDLWLNESFATFASV

SEQ ID NO: 1039635 - protein, 18 aa, Mycobacterium
WWKNLSPNGGDKPTGGLA

SEQ ID NO: 1039636 - protein, 18 aa, Mycobacterium
WYGTGSAFQQWVAAGPES

SEQ ID NO: 1039637 - protein, 17 aa, Mycobacterium
WYTATSVAAVIEHDHPL

SEQ ID NO: 1039638 - protein, 18 aa, Mycobacterium
WYYQSGLSVVMPVGGQSS

SEQ ID NO: 1039639 - protein, 20 aa, Mycobacterium
YADAAAVCGCPVGTIRSRVA

SEQ ID NO: 1039640 - protein, 19 aa, Mycobacterium
YADPDWARDYGWPQFADRI

SEQ ID NO: 1039641 - protein, 23 aa, Mycobacterium
YADVLRLPMDIVVTEKFVADSPP

SEQ ID NO: 1039642 - protein, 18 aa, Mycobacterium
YAERHGWTVTVLDETTSD

SEQ ID NO: 1039643 - protein, 25 aa, Mycobacterium
YAFEEARAGMVPLLTVLGNIIHTMA

SEQ ID NO: 1039644 - protein, 23 aa, Mycobacterium
YAGGLAPILCLTKTDLAPLEPFA

SEQ ID NO: 1039645 - protein, 17 aa, Mycobacterium
YAGGVLFVAENPSRSLQ

SEQ ID NO: 1039646 - protein, 21 aa, Mycobacterium
YAGLLEHLASWGIVTGAPDTQ

SEQ ID NO: 1039647 - protein, 18 aa, Mycobacterium
YAGSVTWTGEIGYLPQDP

SEQ ID NO: 1039648 - protein, 17 aa, Mycobacterium
YALRSHLLVDRGETADV

SEQ ID NO: 1039649 - protein, 28 aa, Mycobacterium
YALRSVNMFAPWIRRIFIATDSIPPSWL

SEQ ID NO: 1039650 - protein, 20 aa, Mycobacterium
YARHTGGTFVLRIEDTDADR

SEQ ID NO: 1039651 - protein, 18 aa, Mycobacterium
YASHELVEIAHKMAEQRD

SEQ ID NO: 1039652 - protein, 18 aa, Mycobacterium
YAVNNSFGFGGHNVAIAF

SEQ ID NO: 1039653 - protein, 19 aa, Mycobacterium
YCSISVPLDLYSCGVYEGQ

SEQ ID NO: 1039654 - protein, 23 aa, Mycobacterium
YDDFCRRQHRFTSMLTAESPQIR

SEQ ID NO: 1039655 - protein, 17 aa, Mycobacterium
YDDRLAASLAYGVALWV

SEQ ID NO: 1039656 - protein, 22 aa, Mycobacterium
YDETACDAWIGRIRCGDTDRVT

SEQ ID NO: 1039657 - protein, 17 aa, Mycobacterium
YDISDDFFALFLDPTWV

SEQ ID NO: 1039658 - protein, 22 aa, Mycobacterium
YDIYRGVVTYVRVVDGKISPRE

SEQ ID NO: 1039659 - protein, 17 aa, Mycobacterium
YDLSNEFFALFQDPTRT

SEQ ID NO: 1039660 - protein, 18 aa, Mycobacterium
YDMWPWKQRLRQFARRSR

SEQ ID NO: 1039661 - protein, 18 aa, Mycobacterium
YDPEVKPGVSNLLNIQSA

SEQ ID NO: 1039662 - protein, 18 aa, Mycobacterium
YDPHLATGLAVEYTSLKR

SEQ ID NO: 1039663 - protein, 26 aa, Mycobacterium
YDPLCRPCHRRLFTIANQKGGVGKTT

SEQ ID NO: 1039664 - protein, 19 aa, Mycobacterium
YDPLQKLMWLFKGVSSPSS

SEQ ID NO: 1039665 - protein, 19 aa, Mycobacterium
YDSFFKMCYDVLPDDGRML

SEQ ID NO: 1039666 - protein, 18 aa, Mycobacterium
YDTKAWLCRAQELERNAG

SEQ ID NO: 1039667 - protein, 17 aa, Mycobacterium
YDYLINMCDQMGVVTSE

SEQ ID NO: 1039668 - protein, 25 aa, Mycobacterium
YEAHRVAALRPRLGVDTDQRTIPHE

SEQ ID NO: 1039669 - protein, 30 aa, Mycobacterium
YEALAGEIGRGLAFMSACGVADRNLQTAEI

SEQ ID NO: 1039670 - protein, 18 aa, Mycobacterium
YEELNLLVAPMVRAGSEP

SEQ ID NO: 1039671 - protein, 17 aa, Mycobacterium
YEEPAFDIFALVPPPGD

SEQ ID NO: 1039672 - protein, 19 aa, Mycobacterium
YEGPKGGPGMREMLAITGA

SEQ ID NO: 1039673 - protein, 24 aa, Mycobacterium
YEHGNRLRCYVVGVTRGAREPLIT

SEQ ID NO: 1039674 - protein, 23 aa, Mycobacterium
YELAATIARRLGLTGALGTVAES

SEQ ID NO: 1039675 - protein, 24 aa, Mycobacterium
YELARRVASSSIGFVAPIPATTSS

SEQ ID NO: 1039676 - protein, 18 aa, Mycobacterium
YERLCAGGGLGVGQLQGH

SEQ ID NO: 1039677 - protein, 31 aa, Mycobacterium
YERPVNLFVAGFIGSPVMNFFPAKLTPNGLT

SEQ ID NO: 1039678 - protein, 17 aa, Mycobacterium
YETSSAKQVRWILQDSD

SEQ ID NO: 1039679 - protein, 27 aa, Mycobacterium
YEVKGCIAHGGLGWVYLAFDHNVNDRP

SEQ ID NO: 1039680 - protein, 25 aa, Mycobacterium
YEVPFGTSAGRVWTDGLEFSRRERF

SEQ ID NO: 1039681 - protein, 17 aa, Mycobacterium
YEYLDARTLQLADGLTQ

SEQ ID NO: 1039682 - protein, 18 aa, Mycobacterium
YFAAIPGVWTRRSSEVAQ

SEQ ID NO: 1039683 - protein, 18 aa, Mycobacterium
YFDGGIQIISPIDHQIEN

SEQ ID NO: 1039684 - protein, 31 aa, Mycobacterium
YFLERGLCDTGRWRVPLILRLDPKIGSDDIR

SEQ ID NO: 1039685 - protein, 17 aa, Mycobacterium
YFLRSVFQDTPREELDR

SEQ ID NO: 1039686 - protein, 26 aa, Mycobacterium
YFTSTGRPTGEWAVAISRLSDAETAV

SEQ ID NO: 1039687 - protein, 17 aa, Mycobacterium
YGAAGFLQYQFVIPTEA

SEQ ID NO: 1039688 - protein, 27 aa, Mycobacterium
YGAYEICVDPSFSIPRLSLLDRGMMFV

SEQ ID NO: 1039689 - protein, 24 aa, Mycobacterium
YGDYRYAINNSFGFGGHNVALAFG

SEQ ID NO: 1039690 - protein, 18 aa, Mycobacterium
YGEFSSRPSAVALVGEYP

SEQ ID NO: 1039691 - protein, 17 aa, Mycobacterium
YGGIGAVIGHEIGHGFD

SEQ ID NO: 1039692 - protein, 17 aa, Mycobacterium
YGGWARHGGGAFSGKDP

SEQ ID NO: 1039693 - protein, 18 aa, Mycobacterium
YGIYGAQDYNAWLGKIAC

SEQ ID NO: 1039694 - protein, 26 aa, Mycobacterium
YGKFLRNPSNWLAIIVTQRPPGGTTT

SEQ ID NO: 1039695 - protein, 31 aa, Mycobacterium
YGKTPAQVLLRWNLQLGNAVVFRSAKAEHIA

SEQ ID NO: 1039696 - protein, 18 aa, Mycobacterium
YGLAAADGVMRWLEEHER

SEQ ID NO: 1039697 - protein, 29 aa, Mycobacterium
YGLALCAECSMISALYATGGGRLVAVYCV

SEQ ID NO: 1039698 - protein, 20 aa, Mycobacterium
YGLDPERLWATVYLDDDEAA

SEQ ID NO: 1039699 - protein, 27 aa, Mycobacterium
YGMALVAYRHGIPFILVAPESTGGPAT

SEQ ID NO: 1039700 - protein, 23 aa, Mycobacterium
YGNSKWAGEVLLREAHDLCGLPV

SEQ ID NO: 1039701 - protein, 17 aa, Mycobacterium
YGPAFQGLVAIWRRGSE

SEQ ID NO: 1039702 - protein, 30 aa, Mycobacterium
YGPVFRGLTAMWRRGDELFADVKLPVDTEV

SEQ ID NO: 1039703 - protein, 17 aa, Mycobacterium
YGPYLKRGKDSRPLTTE

SEQ ID NO: 1039704 - protein, 19 aa, Mycobacterium
YGQHVALDFVGRIRGQRKF

SEQ ID NO: 1039705 - protein, 18 aa, Mycobacterium
YGSAGYWVDHIRRPVRFA

SEQ ID NO: 1039706 - protein, 20 aa, Mycobacterium
YGWSSLRSRPALHDQATAAL

SEQ ID NO: 1039707 - protein, 18 aa, Mycobacterium
YHADGLIDRLPRMLGTQA

SEQ ID NO: 1039708 - protein, 20 aa, Mycobacterium
YHALTWGPLMREIIWTATGK

SEQ ID NO: 1039709 - protein, 17 aa, Mycobacterium
YHDVDLASFNGAITQTS

SEQ ID NO: 1039710 - protein, 25 aa, Mycobacterium
YIAARARERLGFVMPGDVPFQVQLP

SEQ ID NO: 1039711 - protein, 25 aa, Mycobacterium
YIAWAGPLLAWWAQRFGVTADLVEA

SEQ ID NO: 1039712 - protein, 19 aa, Mycobacterium
YIIRLMKGTGLAANVAMAA

SEQ ID NO: 1039713 - protein, 30 aa, Mycobacterium
YIPILGAPWLPDLVRRSPWAEMFSSAGQGS

SEQ ID NO: 1039714 - protein, 18 aa, Mycobacterium
YISMFAALVTKVTVVEKR

SEQ ID NO: 1039715 - protein, 24 aa, Mycobacterium
YISRHTPVGFGHRRQDLRGDRGVG

SEQ ID NO: 1039716 - protein, 18 aa, Mycobacterium
YITARFLPDKAIDLVDEA

SEQ ID NO: 1039717 - protein, 18 aa, Mycobacterium
YKCVVCIVRLIDVAGVAM

SEQ ID NO: 1039718 - protein, 22 aa, Mycobacterium
YKDVSLILIFGWFKQLVEAATA

SEQ ID NO: 1039719 - protein, 17 aa, Mycobacterium
YKLSWISSDPVLQKMVA

SEQ ID NO: 1039720 - protein, 24 aa, Mycobacterium
YKMVFGHRGINIPVIDHATGRVAV

SEQ ID NO: 1039721 - protein, 17 aa, Mycobacterium
YKRAVGYEASYVRTSFA

SEQ ID NO: 1039722 - protein, 22 aa, Mycobacterium
YKTGRGSIRIRGVVEVEEDSRG

SEQ ID NO: 1039723 - protein, 17 aa, Mycobacterium
YKVAVGDVVKIEKLDFE

SEQ ID NO: 1039724 - protein, 25 aa, Mycobacterium
YLAEALGVVDICPQLRVVTVDGDLV

SEQ ID NO: 1039725 - protein, 18 aa, Mycobacterium
YLAELRLDHPDAAAEYEV

SEQ ID NO: 1039726 - protein, 27 aa, Mycobacterium
YLALLDALRWLGLNWDEGPEVGGPYGP

SEQ ID NO: 1039727 - protein, 21 aa, Mycobacterium
YLATILPEFLEPEAPSGRTTA

SEQ ID NO: 1039728 - protein, 23 aa, Mycobacterium
YLDFAGNADFAIAIRTALMRDGI

SEQ ID NO: 1039729 - protein, 20 aa, Mycobacterium
YLEQVSLLNIAMRVWQPRWA

SEQ ID NO: 1039730 - protein, 17 aa, Mycobacterium
YLISFFGALYSGRIAVP

SEQ ID NO: 1039731 - protein, 18 aa, Mycobacterium
YLLNWGWVDVDDVVDVLL

SEQ ID NO: 1039732 - protein, 20 aa, Mycobacterium
YLLYCNQIRQNWAVLSNHEV

SEQ ID NO: 1039733 - protein, 18 aa, Mycobacterium
YLMFSVFSVRPGVLGAQR

SEQ ID NO: 1039734 - protein, 31 aa, Mycobacterium
YLNTFRHLCGLDCSHIAPANVYGPRQDPYGE

SEQ ID NO: 1039735 - protein, 17 aa, Mycobacterium
YLPGCWLDSGPFGCLGS

SEQ ID NO: 1039736 - protein, 25 aa, Mycobacterium
YLRAHPTKALTMLAAVPITATAKAG

SEQ ID NO: 1039737 - protein, 21 aa, Mycobacterium
YLRHTCTSWSRRAGTGPDTPA

SEQ ID NO: 1039738 - protein, 23 aa, Mycobacterium
YLRPETAQGIFINFANVVTTARR

SEQ ID NO: 1039739 - protein, 33 aa, Mycobacterium
YLSPERVELRYIMPLGEIIFDFFDSLKSRTRGY

SEQ ID NO: 1039740 - protein, 26 aa, Mycobacterium
YLVDWAKDIDPAWLAGVTTVGVTSGA

SEQ ID NO: 1039741 - protein, 21 aa, Mycobacterium
YLVRYWRLLKFKLANPHIITR

SEQ ID NO: 1039742 - protein, 17 aa, Mycobacterium
YMESVIWAFKQLWDKGL

SEQ ID NO: 1039743 - protein, 20 aa, Mycobacterium
YMKMITPGALLRCLVEGTDE

SEQ ID NO: 1039744 - protein, 21 aa, Mycobacterium
YMSGALKHFFDTVYYPILDHV

SEQ ID NO: 1039745 - protein, 17 aa, Mycobacterium
YNASRLIAVLAAVIAGP

SEQ ID NO: 1039746 - protein, 21 aa, Mycobacterium
YNAVCSVYGHLHIPRTTWYNE

SEQ ID NO: 1039747 - protein, 17 aa, Mycobacterium
YNGGECGKVTSGAVRQA

SEQ ID NO: 1039748 - protein, 17 aa, Mycobacterium
YNHGFLRARMQLLHDEF

SEQ ID NO: 1039749 - protein, 30 aa, Mycobacterium
YNLALIAREARFHWGIAMMPTGPQGRVSVT

SEQ ID NO: 1039750 - protein, 22 aa, Mycobacterium
YNLNMAIPWIAAERGFIDAVVE

SEQ ID NO: 1039751 - protein, 17 aa, Mycobacterium
YNPGHLMVVPYRQVSEL

SEQ ID NO: 1039752 - protein, 28 aa, Mycobacterium
YNRYMKYLRGCAHYFSDEMLDCSLVTYL

SEQ ID NO: 1039753 - protein, 23 aa, Mycobacterium
YPAARAGEMLNLVASYAADPLDP

SEQ ID NO: 1039754 - protein, 22 aa, Mycobacterium
YPEHIARMFTLVYRGERYQDPR

SEQ ID NO: 1039755 - protein, 26 aa, Mycobacterium
YPGMGADLYRQFPVFAHALDEVAAAL

SEQ ID NO: 1039756 - protein, 17 aa, Mycobacterium
YPHAVFLEERFASLLPE

SEQ ID NO: 1039757 - protein, 18 aa, Mycobacterium
YPKKWRDYSQLVIDRDDL

SEQ ID NO: 1039758 - protein, 23 aa, Mycobacterium
YPKVVLVTGACRFLGGYLTARLA

SEQ ID NO: 1039759 - protein, 21 aa, Mycobacterium
YPLAAVKTMSRIVCAVEENST

SEQ ID NO: 1039760 - protein, 21 aa, Mycobacterium
YPLPVCGDLTPWAQRGVLLLN

SEQ ID NO: 1039761 - protein, 18 aa, Mycobacterium
YPLSILFTGIIVNKLGQW

SEQ ID NO: 1039762 - protein, 26 aa, Mycobacterium
YPQWNDGVKGVWVLARYDDGRPSQLR

SEQ ID NO: 1039763 - protein, 20 aa, Mycobacterium
YPVELDTLFNLFAGAAESFA

SEQ ID NO: 1039764 - protein, 17 aa, Mycobacterium
YQDQVGIVDEVTASSQL

SEQ ID NO: 1039765 - protein, 20 aa, Mycobacterium
YQHSGLGYGREDYGRQEYTQ

SEQ ID NO: 1039766 - protein, 17 aa, Mycobacterium
YQLDRLRVDLADLPGSS

SEQ ID NO: 1039767 - protein, 20 aa, Mycobacterium
YQLRRAAPEIDFRAVNDRAS

SEQ ID NO: 1039768 - protein, 22 aa, Mycobacterium
YQPEIWDYLKGVTEKYELRRYI

SEQ ID NO: 1039769 - protein, 17 aa, Mycobacterium
YQTDIAQWTSALQTLSM

SEQ ID NO: 1039770 - protein, 18 aa, Mycobacterium
YQWAHPGKQLLFMGQEFG

SEQ ID NO: 1039771 - protein, 37 aa, Mycobacterium; identical to SEQ ID NO: 92854

SEQ ID NO: 1039772 - protein, 17 aa, Mycobacterium
YRCNFAGLIGGNGVCAR

SEQ ID NO: 1039773 - protein, 21 aa, Mycobacterium
YRDMLPDDLMLIYPEEGIIGT

SEQ ID NO: 1039774 - protein, 25 aa, Mycobacterium
YRELEAMPDLVARVIAGMGPVADLA

SEQ ID NO: 1039775 - protein, 17 aa, Mycobacterium
YRFGMDSAIAWNIRSMV

SEQ ID NO: 1039776 - protein, 20 aa, Mycobacterium
YRFPVVGLDSEFVGYLHIKD

SEQ ID NO: 1039777 - protein, 22 aa, Mycobacterium
YRGKWPEIWVAAHGPRMLQATG

SEQ ID NO: 1039778 - protein, 23 aa, Mycobacterium
YRGPWRAIVKFTVYRECSGQSRF

SEQ ID NO: 1039779 - protein, 22 aa, Mycobacterium
YRKLLQEFLLQLDLDEDTRRRA

SEQ ID NO: 1039780 - protein, 20 aa, Mycobacterium
YRLLPKHSIGMALDDCHDGY

SEQ ID NO: 1039781 - protein, 21 aa, Mycobacterium
YRLLRPVSVLTEFRSWPVEGR

SEQ ID NO: 1039782 - protein, 23 aa, Mycobacterium
YRLRWLSPWPAAFGFHEFFFFHA

SEQ ID NO: 1039783 - protein, 23 aa, Mycobacterium
YRLSQITTALCDRWQPGARLVPA

SEQ ID NO: 1039784 - protein, 17 aa, Mycobacterium
YRPSASINFVNRTMDSR

SEQ ID NO: 1039785 - protein, 26 aa, Mycobacterium
YRPTRNARYCYTRLTKIEPRGGEADL

SEQ ID NO: 1039786 - protein, 23 aa, Mycobacterium
YRREALPRVQLWPIDPDGSYGEP

SEQ ID NO: 1039787 - protein, 27 aa, Mycobacterium
YRSLLDHPVFCWYTERICEQRAVLDNL

SEQ ID NO: 1039788 - protein, 20 aa, Mycobacterium
YRTETSMMRYLRALADKDIA

SEQ ID NO: 1039789 - protein, 19 aa, Mycobacterium
YRTLLEFFFQIHDPTTRNR

SEQ ID NO: 1039790 - protein, 19 aa, Mycobacterium
YRVFAELSPHPLLTHAVEQ

SEQ ID NO: 1039791 - protein, 25 aa, Mycobacterium
YRYLHCCKELLGTNAWIVIEKILAV

SEQ ID NO: 1039792 - protein, 19 aa, Mycobacterium
YSDTGLLGSIAKLVKVRPG

SEQ ID NO: 1039793 - protein, 18 aa, Mycobacterium
YSDVLPWTAGVIGSGVLS

SEQ ID NO: 1039794 - protein, 17 aa, Mycobacterium
YSEAIALARLGWAALAV

SEQ ID NO: 1039795 - protein, 21 aa, Mycobacterium
YSGFCCASFFGLPYCAVAGEG

SEQ ID NO: 1039796 - protein, 17 aa, Mycobacterium
YSHEPNRGFLRCVAALA

SEQ ID NO: 1039797 - protein, 19 aa, Mycobacterium
YSLPGVPLFDHHELGDAEY

SEQ ID NO: 1039798 - protein, 20 aa, Mycobacterium
YSPRVEGVHLRFGAVARGGL

SEQ ID NO: 1039799 - protein, 17 aa, Mycobacterium
YSRDAKFTPAREALDNN

SEQ ID NO: 1039800 - protein, 24 aa, Mycobacterium
YTAAGFGIRYFGKVPAMIFDSPLS

SEQ ID NO: 1039801 - protein, 17 aa, Mycobacterium
YTAIPFAQKPSVLMIGE

SEQ ID NO: 1039802 - protein, 17 aa, Mycobacterium
YTALLRVERRFQTVVAL

SEQ ID NO: 1039803 - protein, 21 aa, Mycobacterium
YTAMMTPVFMVLRSPTGELLG

SEQ ID NO: 1039804 - protein, 17 aa, Mycobacterium
YTERLYRADPDTVIKEI

SEQ ID NO: 1039805 - protein, 24 aa, Mycobacterium
YTFMPIGELWYRKSGTYRGKIQNL

SEQ ID NO: 1039806 - protein, 19 aa, Mycobacterium
YTKRFNDLYTETKVVAEKF

SEQ ID NO: 1039807 - protein, 17 aa, Mycobacterium
YTKTTFEFVHPGLGAQS

SEQ ID NO: 1039808 - protein, 22 aa, Mycobacterium
YTPRIRVGIHTGRPQRLAADWL

SEQ ID NO: 1039809 - protein, 20 aa, Mycobacterium
YTQECRKLGLAFAADPSQQL

SEQ ID NO: 1039810 - protein, 18 aa, Mycobacterium
YTRDFTKPGAPQAFIYDA

SEQ ID NO: 1039811 - protein, 19 aa, Mycobacterium
YTSEWKIRELVKKYSDFIA

SEQ ID NO: 1039812 - protein, 20 aa, Mycobacterium
YVAMSCWMRSVSVSGKTMLT

SEQ ID NO: 1039813 - protein, 17 aa, Mycobacterium
YVDAIVWRTFGQHRLDA

SEQ ID NO: 1039814 - protein, 22 aa, Mycobacterium
YVDFEGVLTFLQRKMEQTESEQ

SEQ ID NO: 1039815 - protein, 20 aa, Mycobacterium
YVEIVAGCRRDGKHATTEVG

SEQ ID NO: 1039816 - protein, 22 aa, Mycobacterium
YVEPAKWIAALRHTKSDGNPVL

SEQ ID NO: 1039817 - protein, 23 aa, Mycobacterium
YVINPRMVRGLDYYTKTTFEFVH

SEQ ID NO: 1039818 - protein, 18 aa, Mycobacterium
YVQHVAAGLAILGRDLAD

SEQ ID NO: 1039819 - protein, 26 aa, Mycobacterium
YVRGMLYFRTKRWPDVLTQFPEGKQW

SEQ ID NO: 1039820 - protein, 26 aa, Mycobacterium
YVRPPWLRRWIRGGYGWVQPRLSPVA

SEQ ID NO: 1039821 - protein, 18 aa, Mycobacterium
YVTDRLVSITSDIGTVAL

SEQ ID NO: 1039822 - protein, 30 aa, Mycobacterium
YVVEGVRLLRSCGIIVVHRAALGGRAGDPA

SEQ ID NO: 1039823 - protein, 24 aa, Mycobacterium
YVVGGVFPSGQWKRLRTVVDTSAL

SEQ ID NO: 1039824 - protein, 25 aa, Mycobacterium
YVVKDLVIASAIRLGNFNAHKLVIW

SEQ ID NO: 1039825 - protein, 24 aa, Mycobacterium
YWFRRHQVVYQWLAQRCTGCEVLE

SEQ ID NO: 1039826 - protein, 17 aa, Mycobacterium
YWKQAFGTVNGEGGEIQ

SEQ ID NO: 1039827 - protein, 22 aa, Mycobacterium
YWPRWLVDGFGGLPAGTAMAPC

SEQ ID NO: 1039828 - protein, 20 aa, Mycobacterium
YWRDFHKTDLIAGETIPTLE

SEQ ID NO: 1039829 - protein, 22 aa, Mycobacterium
YWREAFRLPTMNPHTVAKQVEA

SEQ ID NO: 1039830 - protein, 18 aa, Mycobacterium
YYFRDFWGADSGMLAALY

SEQ ID NO: 1039831 - protein, 21 aa, Mycobacterium
YYGPPRRWLVVTGTNGKTTTT

SEQ ID NO: 1039832 - protein, 23 aa, Mycobacterium
YYNFLWLGRNGYWKVMQALSLTV

SEQ ID NO: 1039833 - protein, 20 aa, Mycobacterium
YYQIRGGIQYAIAKSLAAAP

SEQ ID NO: 1039834 - protein, 21 aa, Mycobacterium
AAAAANGWPNLGIGNTDSNVD

SEQ ID NO: 1039835 - protein, 20 aa, Mycobacterium
AAAADCLAQAVLVGVIAAES

SEQ ID NO: 1039836 - protein, 18 aa, Mycobacterium
AAAAEAFRVLRPGGRLHL

SEQ ID NO: 1039837 - protein, 17 aa, Mycobacterium
AAAAERVVFLFPGQGAQ

SEQ ID NO: 1039838 - protein, 18 aa, Mycobacterium
AAAAFPHQGTEGPWRTCM

SEQ ID NO: 1039839 - protein, 26 aa, Mycobacterium
AAAAGAPARYWAMAGPAAAVDRAAPP

SEQ ID NO: 1039840 - protein, 24 aa, Mycobacterium
AAAAHCADVSRSLRNCGAPLMSLR

SEQ ID NO: 1039841 - protein, 25 aa, Mycobacterium
AAAAHCADVSRSLRNCGAPLMSLRT

SEQ ID NO: 1039842 - protein, 17 aa, Mycobacterium
AAAALFAARANPGIPAR

SEQ ID NO: 1039843 - protein, 18 aa, Mycobacterium
AAAANWASLAAELQTAAG

SEQ ID NO: 1039844 - protein, 26 aa, Mycobacterium
AAAARVALDIATRYALQRRQFSAPDD

SEQ ID NO: 1039845 - protein, 19 aa, Mycobacterium
AAAAYEMAFALTVPPPVIA

SEQ ID NO: 1039846 - protein, 22 aa, Mycobacterium
AAACVAGALSLRDGAAVVALRS

SEQ ID NO: 1039847 - protein, 27 aa, Mycobacterium
AAADEISAAIAELFGNHAQQYQALSAQ

SEQ ID NO: 1039848 - protein, 20 aa, Mycobacterium
AAADFCAGADWVAASTGTQR

SEQ ID NO: 1039849 - protein, 17 aa, Mycobacterium
AAAEAFLSTWDWADYLH

SEQ ID NO: 1039850 - protein, 26 aa, Mycobacterium
AAAELGEQCAFGLALIAPRLPPFDVP

SEQ ID NO: 1039851 - protein, 25 aa, Mycobacterium
AAAELPARLAGAIAGEIRAVLRSTE

SEQ ID NO: 1039852 - protein, 28 aa, Mycobacterium
AAAERPWWEWAATYERAFTAAYDALDVL

SEQ ID NO: 1039853 - protein, 21 aa, Mycobacterium
AAAERRRYVELFAAGQRGPDG

SEQ ID NO: 1039854 - protein, 17 aa, Mycobacterium
AAAESFALVTSGLAGVG

SEQ ID NO: 1039855 - protein, 26 aa, Mycobacterium
AAAGAKFAAVFARRGLIAEFGISWIL

SEQ ID NO: 1039856 - protein, 28 aa, Mycobacterium
AAAGFDVGDRVGIAWLRYTCGVCNYCRS

SEQ ID NO: 1039857 - protein, 25 aa, Mycobacterium
AAAGGKGGDAIGLFGQGGAGGTGGA

SEQ ID NO: 1039858 - protein, 25 aa, Mycobacterium
AAAGRAAPRLTVWVPVAVDPGAAAH

SEQ ID NO: 1039859 - protein, 28 aa, Mycobacterium
AAAGVRPGDAIGVFLGRSVHLAVAALAI

SEQ ID NO: 1039860 - protein, 28 aa, Mycobacterium
AAAGVVRPDLVIGWWAAPTILEHGTPEQ

SEQ ID NO: 1039861 - protein, 17 aa, Mycobacterium
AAAHDFGRRLAITHDAG

SEQ ID NO: 1039862 - protein, 25 aa, Mycobacterium
AAAHLVHPGDLVILIAYGTMQDAEA

SEQ ID NO: 1039863 - protein, 17 aa, Mycobacterium
AAAHPSLPRGALLQIAM

SEQ ID NO: 1039864 - protein, 25 aa, Mycobacterium
AAAHTRLRVGLPMVPNTVFIAFGEV

SEQ ID NO: 1039865 - protein, 25 aa, Mycobacterium
AAAHWQLGVPAGRIRPLAAHPHGRW

SEQ ID NO: 1039866 - protein, 24 aa, Mycobacterium
AAAILLAEWRLRETPHVPIPYCYA

SEQ ID NO: 1039867 - protein, 19 aa, Mycobacterium
AAAKREYEASMSRAKSECD

SEQ ID NO: 1039868 - protein, 18 aa, Mycobacterium
AAALPFRYTVNGYRGCMH

SEQ ID NO: 1039869 - protein, 17 aa, Mycobacterium
AAALPGVVDIVPGARTV

SEQ ID NO: 1039870 - protein, 25 aa, Mycobacterium
AAALREFAGRFGVPMEQTVAVGDGA

SEQ ID NO: 1039871 - protein, 17 aa, Mycobacterium
AAALRTGLRERLGVTVA

SEQ ID NO: 1039872 - protein, 24 aa, Mycobacterium
AAAMEREGMQIPLLIGGATTSRAH

SEQ ID NO: 1039873 - protein, 32 aa, Mycobacterium; identical to SEQ ID NO: 625019

SEQ ID NO: 1039874 - protein, 19 aa, Mycobacterium
AAAPLALLAPRARQAGATR

SEQ ID NO: 1039875 - protein, 20 aa, Mycobacterium
AAAPYLKWLTTAAAQAGQAA

SEQ ID NO: 1039876 - protein, 20 aa, Mycobacterium
AAAQQHLRVAESRDITRQRL

SEQ ID NO: 1039877 - protein, 18 aa, Mycobacterium
AAASWQERQRMFDLPRSS

SEQ ID NO: 1039878 - protein, 25 aa, Mycobacterium
AAATARCRRLLDLGADPEAVVEALS

SEQ ID NO: 1039879 - protein, 21 aa, Mycobacterium
AAATRGGWRAAGVRDGKTGTL

SEQ ID NO: 1039880 - protein, 20 aa, Mycobacterium
AAAVAARSASPIPVKSPAAA

SEQ ID NO: 1039881 - protein, 25 aa, Mycobacterium
AAAVKHLPTLMAFKKGKLVFKQAGI

SEQ ID NO: 1039882 - protein, 17 aa, Mycobacterium
AAAVLANAALVFTDPDV

SEQ ID NO: 1039883 - protein, 29 aa, Mycobacterium
AAAYPRPGRYTYLVSHAWADRTTIHLVYT

SEQ ID NO: 1039884 - protein, 19 aa, Mycobacterium
AACARVEFTPLAAVADQVV

SEQ ID NO: 1039885 - protein, 25 aa, Mycobacterium
AACCATGRSCPRMRRGSGSNANPAL

SEQ ID NO: 1039886 - protein, 18 aa, Mycobacterium
AACTFTFAFTVAEPGWTM

SEQ ID NO: 1039887 - protein, 26 aa, Mycobacterium
AACTLRNWLGMWSLRVAQARAAPHLA

SEQ ID NO: 1039888 - protein, 19 aa, Mycobacterium
AADAARPAVAAGVVTVPRT

SEQ ID NO: 1039889 - protein, 29 aa, Mycobacterium
AADALALAICHCWRAPMIAQMAKAHALAE

SEQ ID NO: 1039890 - protein, 18 aa, Mycobacterium
AADAVVWSPGSRVAEHPR

SEQ ID NO: 1039891 - protein, 29 aa, Mycobacterium
AADDEVSVAIAALFSGHGQAYQAISAQAA

SEQ ID NO: 1039892 - protein, 25 aa, Mycobacterium
AADEVSLAIAGLFSAHAKQYQAFSV

SEQ ID NO: 1039893 - protein, 23 aa, Mycobacterium
AADEVSTAVAHVFDTYAQEYQTF

SEQ ID NO: 1039894 - protein, 24 aa, Mycobacterium
AADGCVRLPLNLSRNDVRASGAQV

SEQ ID NO: 1039895 - protein, 21 aa, Mycobacterium
AADHFRYFAAAIRAQEGSLSQ

SEQ ID NO: 1039896 - protein, 20 aa, Mycobacterium
AADLALRYDAVIYAVGAQSE

SEQ ID NO: 1039897 - protein, 31 aa, Mycobacterium; identical to SEQ ID NO: 625251

SEQ ID NO: 1039898 - protein, 26 aa, Mycobacterium
AADLTNRSTIRWTLHQMVASGVVRVY

SEQ ID NO: 1039899 - protein, 17 aa, Mycobacterium
AADLVSMLTAAQFAAHA

SEQ ID NO: 1039900 - protein, 20 aa, Mycobacterium
AADMGKWRLATVNVDVVPRV

SEQ ID NO: 1039901 - protein, 23 aa, Mycobacterium
AADMYVSLELARSMNFYAAMSIA

SEQ ID NO: 1039902 - protein, 26 aa, Mycobacterium
AADPPPGLPGVRAFLEGAGVARFKIP

SEQ ID NO: 1039903 - protein, 26 aa, Mycobacterium
AADVPFRVMMRLLRAVGQASGLDDEA

SEQ ID NO: 1039904 - protein, 26 aa, Mycobacterium
AADWAEMLMRMYVRWAEQHKYPVEVF

SEQ ID NO: 1039905 - protein, 17 aa, Mycobacterium
AAEALRPARLLVSGSAA

SEQ ID NO: 1039906 - protein, 19 aa, Mycobacterium
AAEATRVGMPYVNQRWLGG

SEQ ID NO: 1039907 - protein, 33 aa, Mycobacterium
AAEATRVGMPYVNQRWLGGMLTNFSTVHKRLQR

SEQ ID NO: 1039908 - protein, 21 aa, Mycobacterium
AAEEALCRWMAAAALVRSRAD

SEQ ID NO: 1039909 - protein, 18 aa, Mycobacterium
AAEFATRFARLLGARKHD

SEQ ID NO: 1039910 - protein, 24 aa, Mycobacterium
AAEGFPSLSCIVLNGGFELHPSIA

SEQ ID NO: 1039911 - protein, 19 aa, Mycobacterium
AAEHPRLGPVRNPWNTDHT

SEQ ID NO: 1039912 - protein, 19 aa, Mycobacterium
AAEKARFRPGPGPRTIDLD

SEQ ID NO: 1039913 - protein, 18 aa, Mycobacterium
AAELAPPSVRRELHSKVA

SEQ ID NO: 1039914 - protein, 17 aa, Mycobacterium
AAELGMAAIYCREDVGG

SEQ ID NO: 1039915 - protein, 17 aa, Mycobacterium
AAELNGWAPDGLLDTYE

SEQ ID NO: 1039916 - protein, 24 aa, Mycobacterium
AAELPMQMICILLGVPESERHWLF

SEQ ID NO: 1039917 - protein, 28 aa, Mycobacterium
AAELVRRGCPFSGLLYAGLAITAKGPAV

SEQ ID NO: 1039918 - protein, 22 aa, Mycobacterium
AAEMMIDLLWRGLKGAPSDREI

SEQ ID NO: 1039919 - protein, 22 aa, Mycobacterium
AAEPRLATAAGRRTHEDVIDDH

SEQ ID NO: 1039920 - protein, 24 aa, Mycobacterium
AAETLRAAGYRVIEIGESWPELAA

SEQ ID NO: 1039921 - protein, 17 aa, Mycobacterium
AAEVIAIVGDDRFPMQH

SEQ ID NO: 1039922 - protein, 26 aa, Mycobacterium
AAEWKPEADGGFSRVRRRIWELEKRR

SEQ ID NO: 1039923 - protein, 20 aa, Mycobacterium
AAFEAGWIQPTWPRRHGGRS

SEQ ID NO: 1039924 - protein, 20 aa, Mycobacterium
AAFHTEFQQALAQAGNAYVQ

SEQ ID NO: 1039925 - protein, 23 aa, Mycobacterium
AAFRAGYGARGWAMNTLFDGIAP

SEQ ID NO: 1039926 - protein, 19 aa, Mycobacterium
AAFRPLGRVPDRGRLAREL

SEQ ID NO: 1039927 - protein, 26 aa, Mycobacterium
AAFWRELCAPTAPSLAGTRYSVLALG

SEQ ID NO: 1039928 - protein, 23 aa, Mycobacterium
AAGAAGIPIRIGVNAGSLDKRFM

SEQ ID NO: 1039929 - protein, 18 aa, Mycobacterium
AAGALAAGCGYDIDAAAP

SEQ ID NO: 1039930 - protein, 22 aa, Mycobacterium
AAGALKAGRLVVMPTDTVYGIG

SEQ ID NO: 1039931 - protein, 25 aa, Mycobacterium
AAGDLTFAGAGGFGGFGGTGGQGGL

SEQ ID NO: 1039932 - protein, 26 aa, Mycobacterium
AAGESHAAYGWQVRAAAWATNRDIAA

SEQ ID NO: 1039933 - protein, 17 aa, Mycobacterium
AAGESLEDLGLRQETVR

SEQ ID NO: 1039934 - protein, 24 aa, Mycobacterium
AAGFKFTRIQSLQLHYAKTLDLWA

SEQ ID NO: 1039935 - protein, 20 aa, Mycobacterium
AAGFKPGVDVALALDAAANE

SEQ ID NO: 1039936 - protein, 20 aa, Mycobacterium
AAGFQWPVAVVASLTGMRVA

SEQ ID NO: 1039937 - protein, 29 aa, Mycobacterium
AAGGAGGNGGWLFGQGGAGGIGGSGAAGG

SEQ ID NO: 1039938 - protein, 25 aa, Mycobacterium
AAGGAGGNGGWLYGDGGAGGQGGAA

SEQ ID NO: 1039939 - protein, 25 aa, Mycobacterium
AAGGDGRPGGILMGKGGDGAPGGPG

SEQ ID NO: 1039940 - protein, 25 aa, Mycobacterium
AAGGKGGNAVLFGAGGNGGIGGTGA

SEQ ID NO: 1039941 - protein, 24 aa, Mycobacterium
AAGGTGDNGGWLYGSGGDGGTGGN

SEQ ID NO: 1039942 - protein, 26 aa, Mycobacterium
AAGGTGGAGGWLFGDGGIGGTGGAGA

SEQ ID NO: 1039943 - protein, 20 aa, Mycobacterium
AAGGWTRQRAVLAIVDGDGA

SEQ ID NO: 1039944 - protein, 24 aa, Mycobacterium
AAGHGGKGGDGFNPATSGQDGGSG

SEQ ID NO: 1039945 - protein, 25 aa, Mycobacterium
AAGHGRSGFLLAPWTAEQIMFELAA

SEQ ID NO: 1039946 - protein, 24 aa, Mycobacterium
AAGHPFAATGGRILAQTAKQLAEK

SEQ ID NO: 1039947 - protein, 19 aa, Mycobacterium
AAGIGELKFFSKIHYGGGA

SEQ ID NO: 1039948 - protein, 18 aa, Mycobacterium
AAGIRHLAPYVGYPTAAV

SEQ ID NO: 1039949 - protein, 22 aa, Mycobacterium
AAGIYRLRFDTGEYFAASGTAG

SEQ ID NO: 1039950 - protein, 28 aa, Mycobacterium
AAGKPLLGICGGFQMLGRVIRDPDGVEG

SEQ ID NO: 1039951 - protein, 26 aa, Mycobacterium
AAGLMQLALAAGRNFPWVERRQGIRG

SEQ ID NO: 1039952 - protein, 21 aa, Mycobacterium
AAGLRHAVAPLSFGGAGVEAG

SEQ ID NO: 1039953 - protein, 24 aa, Mycobacterium
AAGLRSLLAYQWAHPGKQLLFMGQ

SEQ ID NO: 1039954 - protein, 17 aa, Mycobacterium
AAGLVFGAGGAGGHGGS

SEQ ID NO: 1039955 - protein, 20 aa, Mycobacterium
AAGLWREVAGLPADRIQRRG

SEQ ID NO: 1039956 - protein, 17 aa, Mycobacterium
AAGPLAYRLYRPASPGP

SEQ ID NO: 1039957 - protein, 19 aa, Mycobacterium
AAGQCLRTFLREHGHFEVK

SEQ ID NO: 1039958 - protein, 18 aa, Mycobacterium
AAGQIAELLAKWKSTPER

SEQ ID NO: 1039959 - protein, 20 aa, Mycobacterium
AAGRAAVLAPRLSVPDEFGL

SEQ ID NO: 1039960 - protein, 17 aa, Mycobacterium
AAGRAGWSMAAAATVVP

SEQ ID NO: 1039961 - protein, 19 aa, Mycobacterium
AAGSGGWLAGSGGNGGAGG

SEQ ID NO: 1039962 - protein, 18 aa, Mycobacterium
AAGSLWAAPSGWRVGGVT

SEQ ID NO: 1039963 - protein, 17 aa, Mycobacterium
AAGTLIRLFHAETVMCE

SEQ ID NO: 1039964 - protein, 18 aa, Mycobacterium
AAGTVRRGAEAAVDYIRT

SEQ ID NO: 1039965 - protein, 20 aa, Mycobacterium
AAGVGEMFDTLLVFENFPTG

SEQ ID NO: 1039966 - protein, 25 aa, Mycobacterium
AAGVGKLSVPVGWSSAAPALTSGTT

SEQ ID NO: 1039967 - protein, 24 aa, Mycobacterium
AAGYSNVYERWAVRISNNGEFIHA

SEQ ID NO: 1039968 - protein, 18 aa, Mycobacterium
AAGYTRGAFYSQFDSLEE

SEQ ID NO: 1039969 - protein, 17 aa, Mycobacterium
AAHAADLAKGYPRAQER

SEQ ID NO: 1039970 - protein, 25 aa, Mycobacterium
AAHHFGCGFAPSGWDSLTKHLQRKG

SEQ ID NO: 1039971 - protein, 20 aa, Mycobacterium
AAHIRIDRLVAMPSLPTTPV

SEQ ID NO: 1039972 - protein, 24 aa, Mycobacterium
AAHPGRPEVLTAWMDAAVIDENDP

SEQ ID NO: 1039973 - protein, 17 aa, Mycobacterium
AAHQMAGVTVIDPATTW

SEQ ID NO: 1039974 - protein, 30 aa, Mycobacterium; identical to SEQ ID NO: 625795

SEQ ID NO: 1039975 - protein, 25 aa, Mycobacterium
AAHRRAHGLPAISLGWGLWDQASDM

SEQ ID NO: 1039976 - protein, 21 aa, Mycobacterium
AAHRRGVVINPVLETSEIPEN

SEQ ID NO: 1039977 - protein, 20 aa, Mycobacterium
AAHRVIELLHTIHLPVVCGV

SEQ ID NO: 1039978 - protein, 18 aa, Mycobacterium
AAHTEYDTGLSLAAVCAL

SEQ ID NO: 1039979 - protein, 18 aa, Mycobacterium
AAIAAGIGRPARQRTTTY

SEQ ID NO: 1039980 - protein, 20 aa, Mycobacterium
AAIAELFGMYGRDYQRIAFG

SEQ ID NO: 1039981 - protein, 19 aa, Mycobacterium
AAIESCPPGPVEVVANYTA

SEQ ID NO: 1039982 - protein, 18 aa, Mycobacterium
AAIILPHGVLFRGHAEAT

SEQ ID NO: 1039983 - protein, 25 aa, Mycobacterium
AAIKRPDYSITGWVILTLIQHGTAW

SEQ ID NO: 1039984 - protein, 17 aa, Mycobacterium
AAILRYNNSMPYAQNVL

SEQ ID NO: 1039985 - protein, 27 aa, Mycobacterium
AAINKGISPLGCWPGSSALPTVSVPPG

SEQ ID NO: 1039986 - protein, 20 aa, Mycobacterium
AAIQDAWAATRWVADHRSTI

SEQ ID NO: 1039987 - protein, 18 aa, Mycobacterium
AAIQTMRSPAARRRTYGD

SEQ ID NO: 1039988 - protein, 26 aa, Mycobacterium
AAIRLWRTAWNEFIPFLDYDTEIRKV

SEQ ID NO: 1039989 - protein, 27 aa, Mycobacterium
AAIRLWRTAWNEFIPFLDYDTEIRKVT

SEQ ID NO: 1039990 - protein, 27 aa, Mycobacterium
AAIRLWRTAWNEFIPFLDYDTKIRKVI

SEQ ID NO: 1039991 - protein, 19 aa, Mycobacterium
AAIRQRLGPVTILVNAAGL

SEQ ID NO: 1039992 - protein, 18 aa, Mycobacterium
AAISQVFGAYGQEFQALN

SEQ ID NO: 1039993 - protein, 26 aa, Mycobacterium
AAISRLPLVPPLLEWLHAVRQPVVMD

SEQ ID NO: 1039994 - protein, 19 aa, Mycobacterium
AAITALINSHGLGYQSISQ

SEQ ID NO: 1039995 - protein, 19 aa, Mycobacterium
AAKAMAYASAFIAGSLQDN

SEQ ID NO: 1039996 - protein, 23 aa, Mycobacterium
AAKNGDLPLSFTVANIAPAAAGA

SEQ ID NO: 1039997 - protein, 20 aa, Mycobacterium
AALAALAARSIPAVTTVTAV

SEQ ID NO: 1039998 - protein, 17 aa, Mycobacterium
AALAGWMDYLRGVSEPL

SEQ ID NO: 1039999 - protein, 24 aa, Mycobacterium
AALAHPGLVCNAAIGQSTLVTQRV

SEQ ID NO: 1040000 - protein, 28 aa, Mycobacterium
AALAMELGCDALLLATAVTRAADPAAMA

SEQ ID NO: 1040001 - protein, 21 aa, Mycobacterium
AALAQRLGVPFTEADTLHSQA

SEQ ID NO: 1040002 - protein, 18 aa, Mycobacterium
AALARLEAQIVLRLLLER

SEQ ID NO: 1040003 - protein, 18 aa, Mycobacterium
AALASKYNAGLFVDEAHS

SEQ ID NO: 1040004 - protein, 26 aa, Mycobacterium
AALASRARKAPGFALLGEPGQARDLT

SEQ ID NO: 1040005 - protein, 17 aa, Mycobacterium
AALCHSGSFMATGDIDR

SEQ ID NO: 1040006 - protein, 19 aa, Mycobacterium
AALDDGWAAVQWIAEHAGE

SEQ ID NO: 1040007 - protein, 25 aa, Mycobacterium
AALDEGRIVLVAGFQGVSQDSKDVT

SEQ ID NO: 1040008 - protein, 25 aa, Mycobacterium
AALDIPILQGLCLTSPRAQWCANDD

SEQ ID NO: 1040009 - protein, 26 aa, Mycobacterium
AALDLCPRIRVNAIAPGSILTSALEV

SEQ ID NO: 1040010 - protein, 19 aa, Mycobacterium
AALDTWRARHPAVADRLQP

SEQ ID NO: 1040011 - protein, 23 aa, Mycobacterium
AALELNWPYVFASMLENAVKGGV

SEQ ID NO: 1040012 - protein, 19 aa, Mycobacterium
AALERAGVVTGVITQNVDL

SEQ ID NO: 1040013 - protein, 20 aa, Mycobacterium
AALERAKGVLRTKVGAGTGV

SEQ ID NO: 1040014 - protein, 19 aa, Mycobacterium
AALERGIPVLRPSRPNSAE

SEQ ID NO: 1040015 - protein, 18 aa, Mycobacterium
AALFDVQRAVEATGQPVK

SEQ ID NO: 1040016 - protein, 17 aa, Mycobacterium
AALFTLDSPMHVSEFTE

SEQ ID NO: 1040017 - protein, 20 aa, Mycobacterium
AALGARLTIEKAVGAPGPVT

SEQ ID NO: 1040018 - protein, 18 aa, Mycobacterium
AALGRAFQLTNFIRDVDE

SEQ ID NO: 1040019 - protein, 23 aa, Mycobacterium
AALHHPCCGDLVYGADPKLAKRL

SEQ ID NO: 1040020 - protein, 17 aa, Mycobacterium
AALHLACGAAIPGDAPA

SEQ ID NO: 1040021 - protein, 25 aa, Mycobacterium
AALITFAGGDPWKINATLQSGRPAQ

SEQ ID NO: 1040022 - protein, 22 aa, Mycobacterium
AALKAHCPRRVDVYFDNVGGPI

SEQ ID NO: 1040023 - protein, 29 aa, Mycobacterium
AALKAVPAGRLWANPDCGLKTRNVDEVTA

SEQ ID NO: 1040024 - protein, 18 aa, Mycobacterium
AALKREFTVPGVSQTVTL

SEQ ID NO: 1040025 - protein, 18 aa, Mycobacterium
AALLERGAAVLLVDILDQ

SEQ ID NO: 1040026 - protein, 32 aa, Mycobacterium; identical to SEQ ID NO: 626082

SEQ ID NO: 1040027 - protein, 25 aa, Mycobacterium
AALLPTHCWFEPKGWGFQVYPALDC

SEQ ID NO: 1040028 - protein, 30 aa, Mycobacterium
AALMAVEDWPLLRWRMRQYRHGRWGTEIVK

SEQ ID NO: 1040029 - protein, 25 aa, Mycobacterium
AALPEVACTVWSNLVMTAHLGPGQL

SEQ ID NO: 1040030 - protein, 17 aa, Mycobacterium
AALPHRAAARAVHGGVT

SEQ ID NO: 1040031 - protein, 19 aa, Mycobacterium
AALPWDLLQRSGISAVSVD

SEQ ID NO: 1040032 - protein, 25 aa, Mycobacterium
AALQDWQMRLTRRILSASGSPDQDP

SEQ ID NO: 1040033 - protein, 24 aa, Mycobacterium
AALRELRHPKIRVVSTALRMRRSH

SEQ ID NO: 1040034 - protein, 18 aa, Mycobacterium
AALRRRLVDLSDAGMEGV

SEQ ID NO: 1040035 - protein, 20 aa, Mycobacterium
AALRSGGVVLVFPGGDYDAF

SEQ ID NO: 1040036 - protein, 20 aa, Mycobacterium
AALSRLGRPYVWGVTGPDRF

SEQ ID NO: 1040037 - protein, 20 aa, Mycobacterium
AALSRPQLPTGALTSMSAAD

SEQ ID NO: 1040038 - protein, 24 aa, Mycobacterium
AALSRRGPHRVLRGDLAFAGLPGV

SEQ ID NO: 1040039 - protein, 21 aa, Mycobacterium
AALTDQLSRSWRDVRAPDSTC

SEQ ID NO: 1040040 - protein, 19 aa, Mycobacterium
AALTGEWFGALAVIAPSVS

SEQ ID NO: 1040041 - protein, 20 aa, Mycobacterium
AALTPFPLQAAGSVVTANLG

SEQ ID NO: 1040042 - protein, 17 aa, Mycobacterium
AALTRAIHKLPIKARII

SEQ ID NO: 1040043 - protein, 19 aa, Mycobacterium
AALTVTFGGLKPVHALADC

SEQ ID NO: 1040044 - protein, 22 aa, Mycobacterium
AALVACRDFCQEAVQRRAGRKK

SEQ ID NO: 1040045 - protein, 18 aa, Mycobacterium
AALWKAAGITSPIDEIDA

SEQ ID NO: 1040046 - protein, 17 aa, Mycobacterium
AALYRFQFDQVRRLLAW

SEQ ID NO: 1040047 - protein, 22 aa, Mycobacterium
AAMAAKNGWAAMPFDERAGVFL

SEQ ID NO: 1040048 - protein, 18 aa, Mycobacterium
AAMAIRTRFFDDFFLDAT

SEQ ID NO: 1040049 - protein, 25 aa, Mycobacterium
AAMGKARLTGSLSTPSSWGAGVREF

SEQ ID NO: 1040050 - protein, 24 aa, Mycobacterium
AAMGLRPLRHSPLGFGLLLNKPDA

SEQ ID NO: 1040051 - protein, 17 aa, Mycobacterium
AAMLDRLALNPQRVDGI

SEQ ID NO: 1040052 - protein, 19 aa, Mycobacterium
AAMNAIRTATNYVRAHPSM

SEQ ID NO: 1040053 - protein, 23 aa, Mycobacterium
AAMVASVLPYVGWLEATAVQAGH

SEQ ID NO: 1040054 - protein, 19 aa, Mycobacterium
AAMVDKGRRVLLVDLDPQG

SEQ ID NO: 1040055 - protein, 24 aa, Mycobacterium
AANFRDIMITLGMFTHDALIGGEG

SEQ ID NO: 1040056 - protein, 26 aa, Mycobacterium
AANRARLAATIGMPTERVVWMNQVHG

SEQ ID NO: 1040057 - protein, 18 aa, Mycobacterium
AAPAAAPEPSRWGLSVDR

SEQ ID NO: 1040058 - protein, 27 aa, Mycobacterium
AAPACGISWNLLAGIGRIESMHANGGA

SEQ ID NO: 1040059 - protein, 17 aa, Mycobacterium
AAPAGAHAAISCGAALD

SEQ ID NO: 1040060 - protein, 26 aa, Mycobacterium
AAPASDSAGFKWLAPYTGSAVAQHWM

SEQ ID NO: 1040061 - protein, 21 aa, Mycobacterium
AAPCSSRRSPTHAWTSRSRWR

SEQ ID NO: 1040062 - protein, 18 aa, Mycobacterium
AAPEALAETAAPRLETST

SEQ ID NO: 1040063 - protein, 19 aa, Mycobacterium
AAPFCPGAPSASLPMRGRP

SEQ ID NO: 1040064 - protein, 23 aa, Mycobacterium
AAPFELDGRWIGEASFVLPTDLP

SEQ ID NO: 1040065 - protein, 25 aa, Mycobacterium
AAPLLCAGITLFSPLRHWNAGPGKR

SEQ ID NO: 1040066 - protein, 23 aa, Mycobacterium
AAPLYQRWAKLWDGLLLACQPGA

SEQ ID NO: 1040067 - protein, 26 aa, Mycobacterium
AAPPPGDRRPMLWLEVMKPMASNAVD

SEQ ID NO: 1040068 - protein, 17 aa, Mycobacterium
AAPRCEACGNPFAGFGG

SEQ ID NO: 1040069 - protein, 22 aa, Mycobacterium
AAPSGWRVGGVTAPVRTAMQTP

SEQ ID NO: 1040070 - protein, 18 aa, Mycobacterium
AAPYAAWLCTAAAQSESA

SEQ ID NO: 1040071 - protein, 18 aa, Mycobacterium
AAQCLAPGARLVFNAFLA

SEQ ID NO: 1040072 - protein, 20 aa, Mycobacterium
AAQFHQGLMQLLNSAGGAYA

SEQ ID NO: 1040073 - protein, 23 aa, Mycobacterium
AAQGRAVYCWGVDEYEDIDFCRD

SEQ ID NO: 1040074 - protein, 19 aa, Mycobacterium
AAQLGRRFLEACRQGRGWD

SEQ ID NO: 1040075 - protein, 25 aa, Mycobacterium
AAQRAGLELLAFGGRFVEIGKADVY

SEQ ID NO: 1040076 - protein, 25 aa, Mycobacterium
AAQRAGLELLTFGGRFVEIGKADVY

SEQ ID NO: 1040077 - protein, 22 aa, Mycobacterium
AAQRDWLDIRWCAEDDDSGFYR

SEQ ID NO: 1040078 - protein, 25 aa, Mycobacterium
AAQRFADAVTAIWQGRIEIDRFNEL

SEQ ID NO: 1040079 - protein, 23 aa, Mycobacterium
AAQRGLSEAVVRDISAKKNEPEW

SEQ ID NO: 1040080 - protein, 22 aa, Mycobacterium
AAQRRDMMWICRDGDRAKNHLL

SEQ ID NO: 1040081 - protein, 34 aa, Mycobacterium
AAQTYARAEATGAAPLQPVLDLINGPTQALLGRP

SEQ ID NO: 1040082 - protein, 24 aa, Mycobacterium
AAQVCAELALPHIVLARPPWDPGA

SEQ ID NO: 1040083 - protein, 25 aa, Mycobacterium
AAQYQEVMSTYGIYNIDFDDEGAIL

SEQ ID NO: 1040084 - protein, 25 aa, Mycobacterium
AAQYRIRLGGTWKKPGTSDIEIVCA

SEQ ID NO: 1040085 - protein, 24 aa, Mycobacterium
AAQYSQWGALLARTDPNAPKHNGI

SEQ ID NO: 1040086 - protein, 26 aa, Mycobacterium
AARALKELFDQLGLGRVLLVGNSLGG

SEQ ID NO: 1040087 - protein, 30 aa, Mycobacterium
AARANPGIPARGVVAVCDFGGSGTSITLAD

SEQ ID NO: 1040088 - protein, 17 aa, Mycobacterium
AARFRLGPQALDAREAL

SEQ ID NO: 1040089 - protein, 25 aa, Mycobacterium
AARGTLRASWHWPDEVDKASKYRCF

SEQ ID NO: 1040090 - protein, 19 aa, Mycobacterium
AARGYKCVLTMPDTMSIER

SEQ ID NO: 1040091 - protein, 24 aa, Mycobacterium
AARHVSAVLGRRVGPSTGTNLWGA

SEQ ID NO: 1040092 - protein, 19 aa, Mycobacterium
AARILLRSGKPVFLAANKV

SEQ ID NO: 1040093 - protein, 24 aa, Mycobacterium
AARLPDYMLPAAIVAVESLPLTVN

SEQ ID NO: 1040094 - protein, 22 aa, Mycobacterium
AARPDCVLLDLNLPDASGIDAL

SEQ ID NO: 1040095 - protein, 22 aa, Mycobacterium
AARRAMAAYCSATVVPEASGAP

SEQ ID NO: 1040096 - protein, 22 aa, Mycobacterium
AARRIRCPGGSIPPVEVPGGPS

SEQ ID NO: 1040097 - protein, 19 aa, Mycobacterium
AARRRRGRDRAELRRTAGD

SEQ ID NO: 1040098 - protein, 19 aa, Mycobacterium
AARRYYRNWGATKQEAQML

SEQ ID NO: 1040099 - protein, 17 aa, Mycobacterium
AARSAGISRVYLAGPPG

SEQ ID NO: 1040100 - protein, 21 aa, Mycobacterium
AARSARAWTRLSRSCNASATN

SEQ ID NO: 1040101 - protein, 19 aa, Mycobacterium
AARTKAMFDRGLIEEVISL

SEQ ID NO: 1040102 - protein, 26 aa, Mycobacterium
AARVGIWSPNTWHWVVACLAIHHVGA

SEQ ID NO: 1040103 - protein, 17 aa, Mycobacterium
AARVVWLVANGYAEPGQ

SEQ ID NO: 1040104 - protein, 18 aa, Mycobacterium
AARYDGWIGDLIKTERAI

SEQ ID NO: 1040105 - protein, 23 aa, Mycobacterium
AARYLCSGGLNLRDPGQVMAAIL

SEQ ID NO: 1040106 - protein, 19 aa, Mycobacterium
AARYRRWLAALRGGARLVI

SEQ ID NO: 1040107 - protein, 18 aa, Mycobacterium
AASAWGKHLFHHYAGGPV

SEQ ID NO: 1040108 - protein, 17 aa, Mycobacterium
AASDLTGIGSVLGEANA

SEQ ID NO: 1040109 - protein, 23 aa, Mycobacterium
AASIATWVGFLGFLVNRFEPLTW

SEQ ID NO: 1040110 - protein, 24 aa, Mycobacterium
AASKRPRITLFAARNAASAKKDAE

SEQ ID NO: 1040111 - protein, 24 aa, Mycobacterium
AASLELLHAFALLQDDVMDQSPQR

SEQ ID NO: 1040112 - protein, 30 aa, Mycobacterium
AASPATWIDWLVNWYLPISQLFYNTVGLPY

SEQ ID NO: 1040113 - protein, 27 aa, Mycobacterium
AASPRESWLRMVLIDAGLPVPVTQIPV

SEQ ID NO: 1040114 - protein, 29 aa, Mycobacterium
AASPRIVSLPGYPFARQRHWVEPKHMAWA

SEQ ID NO: 1040115 - protein, 26 aa, Mycobacterium
AASQPRARRGIGTTAAITGHAPAPAV

SEQ ID NO: 1040116 - protein, 24 aa, Mycobacterium
AASRAFIPHSVWQQMGDTFLDTAA

SEQ ID NO: 1040117 - protein, 30 aa, Mycobacterium
AASRGMKGQSWRGAAGIGEGHLGLPADFLI

SEQ ID NO: 1040118 - protein, 28 aa, Mycobacterium
AASSCQSVIWGLAFGQWVGASASLMGAA

SEQ ID NO: 1040119 - protein, 23 aa, Mycobacterium
AATACALAHGFTVPDAVSFAKKW

SEQ ID NO: 1040120 - protein, 17 aa, Mycobacterium
AATAVRFEPGVAHTVSL

SEQ ID NO: 1040121 - protein, 24 aa, Mycobacterium
AATGAMPRLPVVPAARAAGVATDM

SEQ ID NO: 1040122 - protein, 23 aa, Mycobacterium
AATGLESTVRFILSAKSAYVDGQ

SEQ ID NO: 1040123 - protein, 22 aa, Mycobacterium
AATGWLPSPLILAAAVAGRTRN

SEQ ID NO: 1040124 - protein, 18 aa, Mycobacterium
AATIPALMTGFRRGGAGA

SEQ ID NO: 1040125 - protein, 17 aa, Mycobacterium
AATIPNARLELIEGART

SEQ ID NO: 1040126 - protein, 28 aa, Mycobacterium
AATKNPRRVLGLHFFNPVPVLPLVELVN

SEQ ID NO: 1040127 - protein, 17 aa, Mycobacterium
AATLDRLYPGGAQQYLD

SEQ ID NO: 1040128 - protein, 19 aa, Mycobacterium
AATLNRWAALRETTGEQIG

SEQ ID NO: 1040129 - protein, 17 aa, Mycobacterium
AATLTRRQLGAVLDAAA

SEQ ID NO: 1040130 - protein, 19 aa, Mycobacterium
AATMKRLFLELGGKSATIV

SEQ ID NO: 1040131 - protein, 31 aa, Mycobacterium
AATPGMGAMAMPIAGMAAARAVMAAGGGQSG

SEQ ID NO: 1040132 - protein, 20 aa, Mycobacterium
AATQDPRSWAALPRAGAVVF

SEQ ID NO: 1040133 - protein, 18 aa, Mycobacterium
AATQPCLAANLGTATKSA

SEQ ID NO: 1040134 - protein, 28 aa, Mycobacterium
AATRARLPVRRLGGGLVEIPRVPDTDPL

SEQ ID NO: 1040135 - protein, 20 aa, Mycobacterium
AAVAFTHWTERVLPPGSEVA

SEQ ID NO: 1040136 - protein, 18 aa, Mycobacterium
AAVASLFAGHAQAYQSLG

SEQ ID NO: 1040137 - protein, 19 aa, Mycobacterium
AAVDADLAFPRVIRSRIVK

SEQ ID NO: 1040138 - protein, 34 aa, Mycobacterium; identical to SEQ ID NO: 626802

SEQ ID NO: 1040139 - protein, 24 aa, Mycobacterium
AAVDFKRFARDGIVAMSSDEALGL

SEQ ID NO: 1040140 - protein, 17 aa, Mycobacterium
AAVDGRFAVPQILGDSE

SEQ ID NO: 1040141 - protein, 17 aa, Mycobacterium
AAVDGRGGGKADLAQGS

SEQ ID NO: 1040142 - protein, 20 aa, Mycobacterium
AAVDHCKRLITATGAVQRIE

SEQ ID NO: 1040143 - protein, 18 aa, Mycobacterium
AAVEAIATDGARRCVEEA

SEQ ID NO: 1040144 - protein, 26 aa, Mycobacterium
AAVFAPGFGPPRSWQGLLVSARKGLL

SEQ ID NO: 1040145 - protein, 18 aa, Mycobacterium
AAVFDRWSDLIAQRFVSD

SEQ ID NO: 1040146 - protein, 25 aa, Mycobacterium
AAVGDWLAMFSMWPIKQTPGLRCQL

SEQ ID NO: 1040147 - protein, 25 aa, Mycobacterium
AAVGLPMRCVFALTAMGFLPQSAEA

SEQ ID NO: 1040148 - protein, 19 aa, Mycobacterium
AAVGRGDRGPVWVFSGQGS

SEQ ID NO: 1040149 - protein, 23 aa, Mycobacterium
AAVLRFAATEVVPRLAGTEAEID

SEQ ID NO: 1040150 - protein, 26 aa, Mycobacterium
AAVNDLRLTLGVLLDVGPRGPERLPA

SEQ ID NO: 1040151 - protein, 31 aa, Mycobacterium; identical to SEQ ID NO: 626870

SEQ ID NO: 1040152 - protein, 24 aa, Mycobacterium
AAVNGFCVGGGIGLVGNSDVIVAS

SEQ ID NO: 1040153 - protein, 20 aa, Mycobacterium
AAVNGLRVTTIFGGVPQGRQ

SEQ ID NO: 1040154 - protein, 22 aa, Mycobacterium
AAVPAWQLLGVVDQYWQSGPAP

SEQ ID NO: 1040155 - protein, 23 aa, Mycobacterium
AAVPEYMVPGAFAVIPEIPMTVS

SEQ ID NO: 1040156 - protein, 24 aa, Mycobacterium
AAVPNIRFLPALSKVLFRKDFPQE

SEQ ID NO: 1040157 - protein, 22 aa, Mycobacterium
AAVPRFDGLRALFINTTLKRSP

SEQ ID NO: 1040158 - protein, 24 aa, Mycobacterium
AAVPTTAVQACAGDQVSAAVAALF

SEQ ID NO: 1040159 - protein, 17 aa, Mycobacterium
AAVQLARHWGLEVFATA

SEQ ID NO: 1040160 - protein, 26 aa, Mycobacterium
AAVQWHKMGAGWSWSRKVGSDDDHAA

SEQ ID NO: 1040161 - protein, 17 aa, Mycobacterium
AAVRAELPRRCVLDGEI

SEQ ID NO: 1040162 - protein, 20 aa, Mycobacterium
AAVRAGALGARMTGGGFGGC

SEQ ID NO: 1040163 - protein, 25 aa, Mycobacterium
AAVRAHLIDAARPFIFDTGLAPGAV

SEQ ID NO: 1040164 - protein, 18 aa, Mycobacterium
AAVRIRGPVDVARIEGAF

SEQ ID NO: 1040165 - protein, 21 aa, Mycobacterium
AAVRLPFVLSGVTLHATAATR

SEQ ID NO: 1040166 - protein, 26 aa, Mycobacterium
AAVRRLAQRLALAAGRRLDDAQPWVD

SEQ ID NO: 1040167 - protein, 17 aa, Mycobacterium
AAVRVFVGPQFRGPGKP

SEQ ID NO: 1040168 - protein, 18 aa, Mycobacterium
AAVTRIGVLPTFRRRQGI

SEQ ID NO: 1040169 - protein, 18 aa, Mycobacterium
AAVVGRLRGVVCAPDGAV

SEQ ID NO: 1040170 - protein, 26 aa, Mycobacterium
AAVVLFGMPNVRAMNFLGEPAVEIGP

SEQ ID NO: 1040171 - protein, 19 aa, Mycobacterium
AAVVPWDFDDDGMPISIQL

SEQ ID NO: 1040172 - protein, 21 aa, Mycobacterium
AAWVGHDWGAVVVWNAPLLHP

SEQ ID NO: 1040173 - protein, 29 aa, Mycobacterium
AAYLARAGLRVRVLERLGYVGGAAVSIQA

SEQ ID NO: 1040174 - protein, 23 aa, Mycobacterium
AAYSAESARVFGLEETRYEGPTG

SEQ ID NO: 1040175 - protein, 24 aa, Mycobacterium
AAYSEMWAQDALAMYDYAANSASA

SEQ ID NO: 1040176 - protein, 21 aa, Mycobacterium
ACAAAGITFVGPRAELLQLTG

SEQ ID NO: 1040177 - protein, 21 aa, Mycobacterium
ACAGAGCPIKVRLLVTAMRHA

SEQ ID NO: 1040178 - protein, 19 aa, Mycobacterium
ACAGASKVIVHFYNSTSIL

SEQ ID NO: 1040179 - protein, 17 aa, Mycobacterium
ACALVGRPELVFLDEPT

SEQ ID NO: 1040180 - protein, 19 aa, Mycobacterium
ACARMGWNVHDTEVISLVT

SEQ ID NO: 1040181 - protein, 24 aa, Mycobacterium
ACASATRLTPFTSPPPITDPVGLA

SEQ ID NO: 1040182 - protein, 23 aa, Mycobacterium
ACATGATALRTAIMAVKAGEVDY

SEQ ID NO: 1040183 - protein, 27 aa, Mycobacterium
ACELPARLAKLFAHSAVVPRVVLVDHN

SEQ ID NO: 1040184 - protein, 19 aa, Mycobacterium
ACGFAVPYYDLVDERPVLD

SEQ ID NO: 1040185 - protein, 17 aa, Mycobacterium
ACGIEAMSRVGLGANAG

SEQ ID NO: 1040186 - protein, 19 aa, Mycobacterium
ACGLAAMSVTAHKFGGPPG

SEQ ID NO: 1040187 - protein, 17 aa, Mycobacterium
ACGLGTGGLFVEDVAEP

SEQ ID NO: 1040188 - protein, 21 aa, Mycobacterium
ACHGLRWKSYQEIDRDTERAH

SEQ ID NO: 1040189 - protein, 17 aa, Mycobacterium
ACKTLGVRGRVYVPAKT

SEQ ID NO: 1040190 - protein, 26 aa, Mycobacterium
ACLYQVKGRPPGTMRLAIVAEIEQRV

SEQ ID NO: 1040191 - protein, 19 aa, Mycobacterium
ACMALRSFPTLTLTEEVTT

SEQ ID NO: 1040192 - protein, 22 aa, Mycobacterium
ACQSLRWRETDMALVGGTNLLL

SEQ ID NO: 1040193 - protein, 18 aa, Mycobacterium
ACRSDLGGALVLSEFTGA

SEQ ID NO: 1040194 - protein, 19 aa, Mycobacterium
ACSSPFCCSLALSDYRAHM

SEQ ID NO: 1040195 - protein, 22 aa, Mycobacterium
ACVRELMELTLFGPTPAQADAA

SEQ ID NO: 1040196 - protein, 22 aa, Mycobacterium
ACWEARRWLGRPTVEHGASADL

SEQ ID NO: 1040197 - protein, 21 aa, Mycobacterium
ACWPSRIPREGGIRSQFTHCI

SEQ ID NO: 1040198 - protein, 21 aa, Mycobacterium
ACYRGAPWLESLAYKIWGRAF

SEQ ID NO: 1040199 - protein, 18 aa, Mycobacterium
ADAAGGLHLVFDFSVALW

SEQ ID NO: 1040200 - protein, 19 aa, Mycobacterium
ADAALKVLVRLAENPDTGW

SEQ ID NO: 1040201 - protein, 18 aa, Mycobacterium
ADAAWKYLSSGVYEHPAR

SEQ ID NO: 1040202 - protein, 24 aa, Mycobacterium
ADAAWRAAFDHEQKCVAIIKHANP

SEQ ID NO: 1040203 - protein, 24 aa, Mycobacterium
ADADGRWLVNPMFIDPLPAHPPYP

SEQ ID NO: 1040204 - protein, 17 aa, Mycobacterium
ADAEFTIVVGVEVADED

SEQ ID NO: 1040205 - protein, 23 aa, Mycobacterium
ADAGRFLTTIKHRLEKGAFEADL

SEQ ID NO: 1040206 - protein, 17 aa, Mycobacterium
ADAGWRKGATQGHSGTH

SEQ ID NO: 1040207 - protein, 17 aa, Mycobacterium
ADALMLLYLLSADELGE

SEQ ID NO: 1040208 - protein, 34 aa, Mycobacterium; identical to SEQ ID NO: 627271

SEQ ID NO: 1040209 - protein, 18 aa, Mycobacterium
ADALRAAALPGVVDIVPG

SEQ ID NO: 1040210 - protein, 21 aa, Mycobacterium
ADANWSLFTRLMPILPTTETS

SEQ ID NO: 1040211 - protein, 17 aa, Mycobacterium
ADAPGALRWLPIDPVSR

SEQ ID NO: 1040212 - protein, 17 aa, Mycobacterium
ADARAFLDFAAQHHIAV

SEQ ID NO: 1040213 - protein, 17 aa, Mycobacterium
ADARCLVHESMAPGLTA

SEQ ID NO: 1040214 - protein, 22 aa, Mycobacterium
ADARGTVVAAIAAGAVVDAADP

SEQ ID NO: 1040215 - protein, 17 aa, Mycobacterium
ADARLAAAHIVHESRAV

SEQ ID NO: 1040216 - protein, 17 aa, Mycobacterium
ADARLLLNNALEAGGTV

SEQ ID NO: 1040217 - protein, 23 aa, Mycobacterium
ADARVVETFGLIAYAVAAVGPCP

SEQ ID NO: 1040218 - protein, 25 aa, Mycobacterium
ADATGSFNRAWAFDQYSDAEVNQAI

SEQ ID NO: 1040219 - protein, 22 aa, Mycobacterium
ADAVGPPFGIPAGSGSGGGAGG

SEQ ID NO: 1040220 - protein, 29 aa, Mycobacterium
ADAVLLIGARLNWLLGHGESPQWSADAKF

SEQ ID NO: 1040221 - protein, 24 aa, Mycobacterium
ADAVSFRFGDRTQINGVPREAAVA

SEQ ID NO: 1040222 - protein, 23 aa, Mycobacterium
ADAWRAIPSWEFHRANVDPGRAR

SEQ ID NO: 1040223 - protein, 17 aa, Mycobacterium
ADCALFVIAANEGVDEP

SEQ ID NO: 1040224 - protein, 32 aa, Mycobacterium; identical to SEQ ID NO: 627360

SEQ ID NO: 1040225 - protein, 17 aa, Mycobacterium
ADCFDLPLDEVKFSYEL

SEQ ID NO: 1040226 - protein, 17 aa, Mycobacterium
ADCGHVVLVPAISPLPE

SEQ ID NO: 1040227 - protein, 17 aa, Mycobacterium
ADDGELLVRGGVVFSGY

SEQ ID NO: 1040228 - protein, 23 aa, Mycobacterium
ADDGRWRVIAGRTGRKGQGSHKG

SEQ ID NO: 1040229 - protein, 23 aa, Mycobacterium
ADDIAGALAWLVSDEARYITGVA

SEQ ID NO: 1040230 - protein, 24 aa, Mycobacterium
ADDLGLGFTTVWNAVVSELNGESN

SEQ ID NO: 1040231 - protein, 20 aa, Mycobacterium
ADDLPRQWAGEGIDGVGGHR

SEQ ID NO: 1040232 - protein, 24 aa, Mycobacterium
ADDLSLGFTTVWNAVVSELNGESN

SEQ ID NO: 1040233 - protein, 21 aa, Mycobacterium
ADDTAHYLWTWTDDAAGDLRS

SEQ ID NO: 1040234 - protein, 23 aa, Mycobacterium
ADDVRLRRMAVFDVLINNADRKG

SEQ ID NO: 1040235 - protein, 17 aa, Mycobacterium
ADEAAIWLQQLREGKPE

SEQ ID NO: 1040236 - protein, 17 aa, Mycobacterium
ADEDIFYVRAQQYSQTL

SEQ ID NO: 1040237 - protein, 25 aa, Mycobacterium
ADEFTCSSCFLVQHRSRLASEKNGL

SEQ ID NO: 1040238 - protein, 19 aa, Mycobacterium
ADEICYCPNTPPPPMSVKA

SEQ ID NO: 1040239 - protein, 24 aa, Mycobacterium
ADEISAAVAALFTGHAQAYQWLGA

SEQ ID NO: 1040240 - protein, 23 aa, Mycobacterium
ADELARSWRVQWPQLPDAMEQAA

SEQ ID NO: 1040241 - protein, 18 aa, Mycobacterium
ADELCDRVAFGVDGSIVA

SEQ ID NO: 1040242 - protein, 21 aa, Mycobacterium
ADERLRRALTPGYPFRCKRVL

SEQ ID NO: 1040243 - protein, 17 aa, Mycobacterium
ADERLRSGTSLAEVADY

SEQ ID NO: 1040244 - protein, 19 aa, Mycobacterium
ADERLRSGTSLAEVADYLG

SEQ ID NO: 1040245 - protein, 23 aa, Mycobacterium
ADEVSAAVAALFDGHAQAYQLIG

SEQ ID NO: 1040246 - protein, 23 aa, Mycobacterium
ADEVSAAVAAMFDAQGQAYQLLS

SEQ ID NO: 1040247 - protein, 23 aa, Mycobacterium
ADEVSAAVAAVFSGHAQAYQALG

SEQ ID NO: 1040248 - protein, 25 aa, Mycobacterium
ADEVSAAVAGLFGGHAQAYQAVSAQ

SEQ ID NO: 1040249 - protein, 26 aa, Mycobacterium
ADEVSGAVASWFGGFAQEHQTATAQA

SEQ ID NO: 1040250 - protein, 23 aa, Mycobacterium
ADEVSTAIAAFFSAHAADYQRLA

SEQ ID NO: 1040251 - protein, 24 aa, Mycobacterium
ADEVVVEWPSRYLAAEVQAGAIDE

SEQ ID NO: 1040252 - protein, 21 aa, Mycobacterium
ADEYYAIVPIDIRRTEEDFMT

SEQ ID NO: 1040253 - protein, 18 aa, Mycobacterium
ADFAKLWRTLAAELGVAG

SEQ ID NO: 1040254 - protein, 18 aa, Mycobacterium
ADFDTLVGIATRDNPGLK

SEQ ID NO: 1040255 - protein, 21 aa, Mycobacterium
ADFGPGGAFHAAGRCTAEADA

SEQ ID NO: 1040256 - protein, 19 aa, Mycobacterium
ADFTARWAGPSTRRIGYLT

SEQ ID NO: 1040257 - protein, 26 aa, Mycobacterium
ADFVEIRRAAGLSAELTVIEAAMAQA

SEQ ID NO: 1040258 - protein, 31 aa, Mycobacterium
ADFWFDPLCPWCWITSRWILEVEKVRDIEVN

SEQ ID NO: 1040259 - protein, 24 aa, Mycobacterium
ADFYAPDATYGWNIGPKEDVMCVG

SEQ ID NO: 1040260 - protein, 27 aa, Mycobacterium
ADGEPRWPTFGIRLSARPGIPPTRPVH

SEQ ID NO: 1040261 - protein, 20 aa, Mycobacterium
ADGGLACWTTALLHPRLVRA

SEQ ID NO: 1040262 - protein, 24 aa, Mycobacterium
ADGGRAALVLGDWPDAHDHRAAGG

SEQ ID NO: 1040263 - protein, 37 aa, Mycobacterium
ADGIGVAAVDWCRWRLRCRGACGCRIRGNAADVHAAD

SEQ ID NO: 1040264 - protein, 24 aa, Mycobacterium
ADGISEFLERIAVQAGHDGAPLPI

SEQ ID NO: 1040265 - protein, 26 aa, Mycobacterium
ADGKEIAGRLAARIGSGLLVDVVGIN

SEQ ID NO: 1040266 - protein, 19 aa, Mycobacterium
ADGKRCWANQVIFGVDGPQ

SEQ ID NO: 1040267 - protein, 17 aa, Mycobacterium
ADGLCKAYAGAADGTTW

SEQ ID NO: 1040268 - protein, 20 aa, Mycobacterium
ADGLPCRTETAGRPRPPSAP

SEQ ID NO: 1040269 - protein, 19 aa, Mycobacterium
ADGLPVFGAFWDRDAELPT

SEQ ID NO: 1040270 - protein, 26 aa, Mycobacterium
ADGLRQTARELAEWVGSRADSADSTE

SEQ ID NO: 1040271 - protein, 18 aa, Mycobacterium
ADGPVVVVGHSFGGAVAL

SEQ ID NO: 1040272 - protein, 17 aa, Mycobacterium
ADGRCKAYAGAADGTAF

SEQ ID NO: 1040273 - protein, 22 aa, Mycobacterium
ADGSFNNAWAFDGSAAEVNTAR

SEQ ID NO: 1040274 - protein, 29 aa, Mycobacterium
ADGSSNWYTEFARLAPLMEKDTHYEVDLR

SEQ ID NO: 1040275 - protein, 18 aa, Mycobacterium
ADGTVLWMADERAVAEHV

SEQ ID NO: 1040276 - protein, 17 aa, Mycobacterium
ADGVPRVDAVVFLLRTL

SEQ ID NO: 1040277 - protein, 20 aa, Mycobacterium
ADGYGYLLGFVFSGIERALG

SEQ ID NO: 1040278 - protein, 17 aa, Mycobacterium
ADGYIDVKGLRLTLTQA

SEQ ID NO: 1040279 - protein, 20 aa, Mycobacterium
ADGYPIVLTHGFVCSIRAWA

SEQ ID NO: 1040280 - protein, 22 aa, Mycobacterium
ADGYRLSGALHIHGTSHQHVID

SEQ ID NO: 1040281 - protein, 19 aa, Mycobacterium
ADHAVGGVVIFPGAGFVEL

SEQ ID NO: 1040282 - protein, 26 aa, Mycobacterium
ADHCLDMPGLFVWRRYHPSRPKGKAL

SEQ ID NO: 1040283 - protein, 19 aa, Mycobacterium
ADHGNVWASGAAAAALDSF

SEQ ID NO: 1040284 - protein, 17 aa, Mycobacterium
ADHPLAAHYDVYQWLTV

SEQ ID NO: 1040285 - protein, 17 aa, Mycobacterium
ADHRLPQGVTFIGQPLW

SEQ ID NO: 1040286 - protein, 17 aa, Mycobacterium
ADHVRPFGVPFIHIPVT

SEQ ID NO: 1040287 - protein, 19 aa, Mycobacterium
ADHWCRAYDLSSLRVVFAG

SEQ ID NO: 1040288 - protein, 20 aa, Mycobacterium
ADIAEVIGFVASRPPHVNLD

SEQ ID NO: 1040289 - protein, 17 aa, Mycobacterium
ADIAFVVADAAWKYLSS

SEQ ID NO: 1040290 - protein, 24 aa, Mycobacterium
ADIDKRGKISLVLVAEDDDSAAAA

SEQ ID NO: 1040291 - protein, 28 aa, Mycobacterium
ADIEDLRVLLARRNELWSREPANDKERT

SEQ ID NO: 1040292 - protein, 17 aa, Mycobacterium
ADIFFLVCDGLKGLPDS

SEQ ID NO: 1040293 - protein, 18 aa, Mycobacterium
ADIPDFEIGLGLNQHVLL

SEQ ID NO: 1040294 - protein, 18 aa, Mycobacterium
ADIPEFPADVTKMVAQLF

SEQ ID NO: 1040295 - protein, 20 aa, Mycobacterium
ADIPQFLAIAREAGERATGL

SEQ ID NO: 1040296 - protein, 17 aa, Mycobacterium
ADIRESIHLRALGRQNP

SEQ ID NO: 1040297 - protein, 27 aa, Mycobacterium
ADKGFGHVRIEDVCAAAGYTRGAFYSQ

SEQ ID NO: 1040298 - protein, 21 aa, Mycobacterium
ADKNNVCVLVITGNDRVSSGD

SEQ ID NO: 1040299 - protein, 22 aa, Mycobacterium
ADKRLAPYALEWDATKHFPVDV

SEQ ID NO: 1040300 - protein, 25 aa, Mycobacterium
ADKVARFMLGLARRYGPAFYTANQL

SEQ ID NO: 1040301 - protein, 20 aa, Mycobacterium
ADKVIGWAIEHDRVPLAGSV

SEQ ID NO: 1040302 - protein, 20 aa, Mycobacterium
ADLANLQAIRAARTTGATST

SEQ ID NO: 1040303 - protein, 31 aa, Mycobacterium
ADLEHTWSSGILDRPLLRYTVSTDEGGNVCG

SEQ ID NO: 1040304 - protein, 26 aa, Mycobacterium
ADLEHWRWMWETNVLGTLRVTRALLP

SEQ ID NO: 1040305 - protein, 19 aa, Mycobacterium
ADLGGTWLRLRVGGPGTEV

SEQ ID NO: 1040306 - protein, 17 aa, Mycobacterium
ADLIEWRRKHEKHIERV

SEQ ID NO: 1040307 - protein, 17 aa, Mycobacterium
ADLKVGMVLEGVVTNVA

SEQ ID NO: 1040308 - protein, 19 aa, Mycobacterium
ADLLARLAGRDHRASFVQI

SEQ ID NO: 1040309 - protein, 35 aa, Mycobacterium; identical to SEQ ID NO: 627864

SEQ ID NO: 1040310 - protein, 25 aa, Mycobacterium
ADLLGIRYLPPFAYFMDSPNAFAVL

SEQ ID NO: 1040311 - protein, 17 aa, Mycobacterium
ADLLRHAKHSGLSDRQI

SEQ ID NO: 1040312 - protein, 23 aa, Mycobacterium
ADLLRHRRLLVDAADEIGVGVVA

SEQ ID NO: 1040313 - protein, 19 aa, Mycobacterium
ADLNANFVVVDGELYATLT

SEQ ID NO: 1040314 - protein, 29 aa, Mycobacterium
ADLNLSFPISLPISIDIGKIVIESFTLPK

SEQ ID NO: 1040315 - protein, 20 aa, Mycobacterium
ADLPDAGAWVRETLGPLSTD

SEQ ID NO: 1040316 - protein, 19 aa, Mycobacterium
ADLPDRFAGVVYGPGTTAR

SEQ ID NO: 1040317 - protein, 24 aa, Mycobacterium
ADLPEYRDPQLLRLALGEKNRALL

SEQ ID NO: 1040318 - protein, 19 aa, Mycobacterium
ADLPRLVAELDRGADLVTG

SEQ ID NO: 1040319 - protein, 22 aa, Mycobacterium
ADLPSIRAGLLAGAPETKVAGI

SEQ ID NO: 1040320 - protein, 26 aa, Mycobacterium
ADLRALSLPVLRSWLATAAGAGAART

SEQ ID NO: 1040321 - protein, 19 aa, Mycobacterium
ADLRANFTIKGVGDPVPLP

SEQ ID NO: 1040322 - protein, 24 aa, Mycobacterium
ADLRAPRALPVLVIDGRDDTDLAA

SEQ ID NO: 1040323 - protein, 19 aa, Mycobacterium
ADLRAWLTTVVSRLGLDKL

SEQ ID NO: 1040324 - protein, 24 aa, Mycobacterium
ADLRDARLRLAADDVVSRRAEREA

SEQ ID NO: 1040325 - protein, 20 aa, Mycobacterium
ADLRPEIVAAVADVAALPEQ

SEQ ID NO: 1040326 - protein, 27 aa, Mycobacterium
ADLSEGIPVRLVCAGSAGSAGSACAAE

SEQ ID NO: 1040327 - protein, 23 aa, Mycobacterium
ADLTAPPDWMGVDLFGTPGANVP

SEQ ID NO: 1040328 - protein, 24 aa, Mycobacterium
ADMLGRAGALLVDLALDTVPRGYR

SEQ ID NO: 1040329 - protein, 25 aa, Mycobacterium
ADMSWQVVDARGWTPQHLHTAIDEA

SEQ ID NO: 1040330 - protein, 21 aa, Mycobacterium
ADNYLSGSFFGPDRLAAPEPR

SEQ ID NO: 1040331 - protein, 18 aa, Mycobacterium
ADPAGWHGLIPVSTTAAL

SEQ ID NO: 1040332 - protein, 17 aa, Mycobacterium
ADPDLIIGRYIPNLVPR

SEQ ID NO: 1040333 - protein, 25 aa, Mycobacterium
ADPDRYAGEIAHIIGCEPGDVLRVS

SEQ ID NO: 1040334 - protein, 20 aa, Mycobacterium
ADPFGHHWSLGQPVREVSME

SEQ ID NO: 1040335 - protein, 21 aa, Mycobacterium
ADPGGRVYLSPAGQSWAATAG

SEQ ID NO: 1040336 - protein, 25 aa, Mycobacterium
ADPHLTSSEFARYLADYIHEQGWQT

SEQ ID NO: 1040337 - protein, 20 aa, Mycobacterium
ADPIRPTMRINPGARYQAME

SEQ ID NO: 1040338 - protein, 17 aa, Mycobacterium
ADPLIRLSIEREDLEDW

SEQ ID NO: 1040339 - protein, 19 aa, Mycobacterium
ADPPPSRWKIDQVYFDPRW

SEQ ID NO: 1040340 - protein, 25 aa, Mycobacterium
ADPQISASMGIQWYRVKLDAEYAAA

SEQ ID NO: 1040341 - protein, 21 aa, Mycobacterium
ADPRAAGLAARRETTRSAAGV

SEQ ID NO: 1040342 - protein, 21 aa, Mycobacterium
ADPRAPIAVKEAVLPFHRFRR

SEQ ID NO: 1040343 - protein, 21 aa, Mycobacterium
ADPRRLEVFLGAMDSASRRNC

SEQ ID NO: 1040344 - protein, 17 aa, Mycobacterium
ADPRYGDARGRATNAVE

SEQ ID NO: 1040345 - protein, 21 aa, Mycobacterium
ADPVCRPTYIGHDLRSLRQDR

SEQ ID NO: 1040346 - protein, 24 aa, Mycobacterium
ADPYPMFRRLREEAPLYYNAQHGF

SEQ ID NO: 1040347 - protein, 28 aa, Mycobacterium
ADQARTIRIPVHMVEVINKLGRIQRELL

SEQ ID NO: 1040348 - protein, 24 aa, Mycobacterium
ADQASWLRYGLPARFGGRDGTNLD

SEQ ID NO: 1040349 - protein, 24 aa, Mycobacterium
ADQRIRAIAEWAARPLRVAVRGRR

SEQ ID NO: 1040350 - protein, 20 aa, Mycobacterium
ADRAGSFPGQLSGGQQQRVA

SEQ ID NO: 1040351 - protein, 21 aa, Mycobacterium
ADRAQFGALLARTDPDAAKHR

SEQ ID NO: 1040352 - protein, 25 aa, Mycobacterium
ADREQLRLLLRDVFISAGGTHDNWD

SEQ ID NO: 1040353 - protein, 27 aa, Mycobacterium
ADRGEAIGYAVDWARTGDVVLIAGKGH

SEQ ID NO: 1040354 - protein, 20 aa, Mycobacterium
ADRGFAFYALDLQKCGRSHR

SEQ ID NO: 1040355 - protein, 19 aa, Mycobacterium
ADRITHIWTNTKMYLVAVH

SEQ ID NO: 1040356 - protein, 21 aa, Mycobacterium
ADRKGGHILCGVDDRVYGVDH

SEQ ID NO: 1040357 - protein, 19 aa, Mycobacterium
ADRLRLVSAAAHGQFARLV

SEQ ID NO: 1040358 - protein, 19 aa, Mycobacterium
ADRPEVRHRIAFLPNYDMS

SEQ ID NO: 1040359 - protein, 23 aa, Mycobacterium
ADRRIAPSAAKLFCTEMAGKVAD

SEQ ID NO: 1040360 - protein, 17 aa, Mycobacterium
ADRSRAAAMSFSAAAVW

SEQ ID NO: 1040361 - protein, 21 aa, Mycobacterium
ADRTYYCFGTAAGPHPFPTMV

SEQ ID NO: 1040362 - protein, 26 aa, Mycobacterium
ADRVSCQWRLVWYRAVADLLTGDYAS

SEQ ID NO: 1040363 - protein, 17 aa, Mycobacterium
ADSEFDWKKVADHPAGR

SEQ ID NO: 1040364 - protein, 29 aa, Mycobacterium
ADSIVIGGGMCFTFLAAQGYSVGTSLLEK

SEQ ID NO: 1040365 - protein, 22 aa, Mycobacterium
ADSRAAIADWLYWKHLSGLLHA

SEQ ID NO: 1040366 - protein, 23 aa, Mycobacterium
ADSRDVPQFLAIVREASERSTGL

SEQ ID NO: 1040367 - protein, 22 aa, Mycobacterium
ADSTAALRPGRLFRSSELSGLD

SEQ ID NO: 1040368 - protein, 27 aa, Mycobacterium
ADSVGWLRDFLRAHTGGLIIISHNVEL

SEQ ID NO: 1040369 - protein, 25 aa, Mycobacterium
ADSVLLQYPLEWPMSREAATNTLDF

SEQ ID NO: 1040370 - protein, 17 aa, Mycobacterium
ADSVVVCQHVLSAVSNI

SEQ ID NO: 1040371 - protein, 24 aa, Mycobacterium
ADTAGKPSLAWRGRRAAEKLSGAV

SEQ ID NO: 1040372 - protein, 22 aa, Mycobacterium
ADTFAGPSFHSAAWDRSVDLTG

SEQ ID NO: 1040373 - protein, 19 aa, Mycobacterium
ADTIEFCAAEVPKFNAISV

SEQ ID NO: 1040374 - protein, 17 aa, Mycobacterium
ADTWLPMPPEWAALTVE

SEQ ID NO: 1040375 - protein, 17 aa, Mycobacterium
ADVAAMLGYHGGASAAA

SEQ ID NO: 1040376 - protein, 20 aa, Mycobacterium
ADVAARLRVGAVNVNGGVWY

SEQ ID NO: 1040377 - protein, 26 aa, Mycobacterium
ADVAGAKPWFAIGGIDGLRLPEVLAA

SEQ ID NO: 1040378 - protein, 20 aa, Mycobacterium
ADVAGLLRRLEGVPIATVVR

SEQ ID NO: 1040379 - protein, 31 aa, Mycobacterium; identical to SEQ ID NO: 628329

SEQ ID NO: 1040380 - protein, 18 aa, Mycobacterium
ADVCGYGPIPAAAARTMV

SEQ ID NO: 1040381 - protein, 22 aa, Mycobacterium
ADVDMRCLLIIGSSQTQWYAVD

SEQ ID NO: 1040382 - protein, 22 aa, Mycobacterium
ADVDPSLIYHYFGSKEGLLDAA

SEQ ID NO: 1040383 - protein, 22 aa, Mycobacterium
ADVEASGLWPGKVVTEVSPAGD

SEQ ID NO: 1040384 - protein, 26 aa, Mycobacterium
ADVGSRIDPVLARSWLLVNGTHADRF

SEQ ID NO: 1040385 - protein, 17 aa, Mycobacterium
ADVLAPWGGMPMAPGMF

SEQ ID NO: 1040386 - protein, 21 aa, Mycobacterium
ADVLIAFGRYPSLEGRLPETG

SEQ ID NO: 1040387 - protein, 20 aa, Mycobacterium
ADVLRTHPIVAIDRRGMGMS

SEQ ID NO: 1040388 - protein, 17 aa, Mycobacterium
ADVPFFVTLCKTLGKPV

SEQ ID NO: 1040389 - protein, 18 aa, Mycobacterium
ADVPRLGYTIQVLQEAMR

SEQ ID NO: 1040390 - protein, 19 aa, Mycobacterium
ADVPWPCSDTKYITHFPET

SEQ ID NO: 1040391 - protein, 18 aa, Mycobacterium
ADVSIIFVPPKFAKDAII

SEQ ID NO: 1040392 - protein, 23 aa, Mycobacterium
ADVSLPVVRAFVHRIKERARGAV

SEQ ID NO: 1040393 - protein, 19 aa, Mycobacterium
ADVVARFLPYFTDVIVGDL

SEQ ID NO: 1040394 - protein, 17 aa, Mycobacterium
ADVVFGCQAQRPGSWWK

SEQ ID NO: 1040395 - protein, 26 aa, Mycobacterium
ADWDRHLRPMLARRYEIATGQRQAKD

SEQ ID NO: 1040396 - protein, 33 aa, Mycobacterium; identical to SEQ ID NO: 628444

SEQ ID NO: 1040397 - protein, 24 aa, Mycobacterium
ADYARMWVQAATVMSVYQAGSTAA

SEQ ID NO: 1040398 - protein, 18 aa, Mycobacterium
ADYKTLFREYGFTAEAVA

SEQ ID NO: 1040399 - protein, 20 aa, Mycobacterium
ADYMMSFQALLGFRSLFSGD

SEQ ID NO: 1040400 - protein, 21 aa, Mycobacterium
AEAAEGWQPIFYLPEKAHDVW

SEQ ID NO: 1040401 - protein, 18 aa, Mycobacterium
AEAAGASSLQSLETDLLG

SEQ ID NO: 1040402 - protein, 24 aa, Mycobacterium
AEAAKRLDEALARNHSAINDADDQ

SEQ ID NO: 1040403 - protein, 24 aa, Mycobacterium
AEAANAAPFQGLLGAVNAPVQTLT

SEQ ID NO: 1040404 - protein, 21 aa, Mycobacterium
AEADARLMAHAAFGLLNSTPH

SEQ ID NO: 1040405 - protein, 24 aa, Mycobacterium
AEAEARGAVHGEILLVPQANPIGL

SEQ ID NO: 1040406 - protein, 22 aa, Mycobacterium
AEAEPWLSAATFTLAEGPCADR

SEQ ID NO: 1040407 - protein, 23 aa, Mycobacterium
AEAEVKAAEAARLQERAAQHQSE

SEQ ID NO: 1040408 - protein, 19 aa, Mycobacterium
AEAGDLAFPAINVNDSVTK

SEQ ID NO: 1040409 - protein, 17 aa, Mycobacterium
AEAGRRGAITVATNMAG

SEQ ID NO: 1040410 - protein, 24 aa, Mycobacterium
AEAGRRLDAAQSYRSTNPTEAIAQ

SEQ ID NO: 1040411 - protein, 18 aa, Mycobacterium
AEAHLAKLATQFRPDQLA

SEQ ID NO: 1040412 - protein, 21 aa, Mycobacterium
AEAIAGIVLIGLLTRPGELEP

SEQ ID NO: 1040413 - protein, 25 aa, Mycobacterium
AEAIGYTGAGTVEFLADDAGEFYFL

SEQ ID NO: 1040414 - protein, 17 aa, Mycobacterium
AEAILAQIQRLLGSPWT

SEQ ID NO: 1040415 - protein, 19 aa, Mycobacterium
AEAIWEMPPYAGWYQGARD

SEQ ID NO: 1040416 - protein, 24 aa, Mycobacterium
AEAKAHRGPLCLGIDPHPELLRAW

SEQ ID NO: 1040417 - protein, 25 aa, Mycobacterium
AEAKIKLADMRSGRMTDDDWTRLAR

SEQ ID NO: 1040418 - protein, 28 aa, Mycobacterium
AEAKRARARLAIGSALFGLLRADDQVPA

SEQ ID NO: 1040419 - protein, 20 aa, Mycobacterium
AEALADFDAVCTMRERMAFP

SEQ ID NO: 1040420 - protein, 22 aa, Mycobacterium
AEALADNGLDVWIVERRGAGGV

SEQ ID NO: 1040421 - protein, 26 aa, Mycobacterium
AEALAEFAALRWQWHDLEVGRTAIVP

SEQ ID NO: 1040422 - protein, 27 aa, Mycobacterium
AEALLLLLCGVGFYAGFVGSYRDMENI

SEQ ID NO: 1040423 - protein, 27 aa, Mycobacterium
AEALMVDPRTGRMLIIDKTSSGNPAIY

SEQ ID NO: 1040424 - protein, 17 aa, Mycobacterium
AEALRGPFWRWSPGLRA

SEQ ID NO: 1040425 - protein, 19 aa, Mycobacterium
AEALWKDHEDPLAANIALG

SEQ ID NO: 1040426 - protein, 18 aa, Mycobacterium
AEAMPCRQVPAPVRALSR

SEQ ID NO: 1040427 - protein, 19 aa, Mycobacterium
AEARRIATAVVGPWETDPT

SEQ ID NO: 1040428 - protein, 20 aa, Mycobacterium
AEASRGNWAPVIDAVHGPAL

SEQ ID NO: 1040429 - protein, 21 aa, Mycobacterium
AEASSAGLLAAVNEPIAALTG

SEQ ID NO: 1040430 - protein, 19 aa, Mycobacterium
AEATLAISVVRPGEGFRVC

SEQ ID NO: 1040431 - protein, 18 aa, Mycobacterium
AEATLAVVQHVLRALEPA

SEQ ID NO: 1040432 - protein, 24 aa, Mycobacterium
AECLLDRNALIMGYSGVYSSFLKH

SEQ ID NO: 1040433 - protein, 25 aa, Mycobacterium
AEDARRLREFSAFDAFSDAELERVV

SEQ ID NO: 1040434 - protein, 23 aa, Mycobacterium
AEDEVSAAIATVLSSHGQGYQVL

SEQ ID NO: 1040435 - protein, 26 aa, Mycobacterium
AEDGTRIPISIVYRGGIQLPAPAMIY

SEQ ID NO: 1040436 - protein, 20 aa, Mycobacterium
AEDHKRREEADVRNQAETLV

SEQ ID NO: 1040437 - protein, 28 aa, Mycobacterium
AEDLLGWCRERMAGFKVPRSVRFVDALP

SEQ ID NO: 1040438 - protein, 21 aa, Mycobacterium
AEDPPALPIDLIITNANIYLP

SEQ ID NO: 1040439 - protein, 22 aa, Mycobacterium
AEDRIADVLGRLRADYQVDGRE

SEQ ID NO: 1040440 - protein, 17 aa, Mycobacterium
AEEAVEDVFPLPRELVG

SEQ ID NO: 1040441 - protein, 24 aa, Mycobacterium
AEEIGRALAPVPWIDHVCAARLLA

SEQ ID NO: 1040442 - protein, 18 aa, Mycobacterium
AEEYYLSFLLDRANRTYL

SEQ ID NO: 1040443 - protein, 17 aa, Mycobacterium
AEFADAMINSGVDVKFM

SEQ ID NO: 1040444 - protein, 22 aa, Mycobacterium
AEFADRALVMYAGRVVEKATVN

SEQ ID NO: 1040445 - protein, 19 aa, Mycobacterium
AEFAGPISTVRCFQDNALL

SEQ ID NO: 1040446 - protein, 23 aa, Mycobacterium
AEFARQAGRFGLRHTALGAAYGL

SEQ ID NO: 1040447 - protein, 19 aa, Mycobacterium
AEFLAELLGLPSPVTFGPF

SEQ ID NO: 1040448 - protein, 23 aa, Mycobacterium
AEFPADLNARMGSYFTAHVASSD

SEQ ID NO: 1040449 - protein, 17 aa, Mycobacterium
AEFPSIRVVTVMVQAEV

SEQ ID NO: 1040450 - protein, 23 aa, Mycobacterium
AEFVRSRRAELFGAHPAAADESD

SEQ ID NO: 1040451 - protein, 20 aa, Mycobacterium
AEGAEVVQIFLGNPQSWKAP

SEQ ID NO: 1040452 - protein, 20 aa, Mycobacterium
AEGAPPIYFGFGSTPLTSPA

SEQ ID NO: 1040453 - protein, 24 aa, Mycobacterium
AEGELYFPGSPVLSVHGSFAECVL

SEQ ID NO: 1040454 - protein, 17 aa, Mycobacterium
AEGEVAAVVGHQFELDM

SEQ ID NO: 1040455 - protein, 20 aa, Mycobacterium
AEGGTFACGGGRPAGRQVGY

SEQ ID NO: 1040456 - protein, 22 aa, Mycobacterium
AEGHKWAMLTVYDYSTARAFDD

SEQ ID NO: 1040457 - protein, 25 aa, Mycobacterium
AEGLADGVVRPVVFLVYSGQARWRN

SEQ ID NO: 1040458 - protein, 22 aa, Mycobacterium
AEGLEAFGRFGAAKTFSARTSL

SEQ ID NO: 1040459 - protein, 18 aa, Mycobacterium
AEGLPYRSVLGLADLGLG

SEQ ID NO: 1040460 - protein, 22 aa, Mycobacterium
AEGLQVRAGLRCGDGKPETEAV

SEQ ID NO: 1040461 - protein, 23 aa, Mycobacterium
AEGLQVRAGLRCGDGKPETEAVE

SEQ ID NO: 1040462 - protein, 18 aa, Mycobacterium
AEGLSRAAEVMRYTALEA

SEQ ID NO: 1040463 - protein, 20 aa, Mycobacterium
AEGLVALDALLAADRGRTGV

SEQ ID NO: 1040464 - protein, 21 aa, Mycobacterium
AEGMTAHWLDRIATALAAQPE

SEQ ID NO: 1040465 - protein, 18 aa, Mycobacterium
AEGQVLLRFQAAGVCGSD

SEQ ID NO: 1040466 - protein, 23 aa, Mycobacterium
AEGSPSRAFWRHQLQGLIPCLFP

SEQ ID NO: 1040467 - protein, 21 aa, Mycobacterium
AEGVRLFRFDRIVVARELDEP

SEQ ID NO: 1040468 - protein, 22 aa, Mycobacterium
AEHCGDLLLMRAGRLVAQTTPT

SEQ ID NO: 1040469 - protein, 18 aa, Mycobacterium
AEHLHVHVVPRWGGDANF

SEQ ID NO: 1040470 - protein, 21 aa, Mycobacterium
AEHPELLSGYLTHNFDVEDVQ

SEQ ID NO: 1040471 - protein, 20 aa, Mycobacterium
AEIAEVLGHVALNVLTNYFN

SEQ ID NO: 1040472 - protein, 21 aa, Mycobacterium
AEIDARLRLVVGRRGGQADQE

SEQ ID NO: 1040473 - protein, 18 aa, Mycobacterium
AEIGPFFADREGGYTRII

SEQ ID NO: 1040474 - protein, 17 aa, Mycobacterium
AEIGRIPVDSIYSPVLK

SEQ ID NO: 1040475 - protein, 24 aa, Mycobacterium
AEIGWAARMGRIPLGYFNDPEATR

SEQ ID NO: 1040476 - protein, 21 aa, Mycobacterium
AEIKDFIGVPWQIYRGDDAWR

SEQ ID NO: 1040477 - protein, 23 aa, Mycobacterium
AEILKAKKWAAASPMVMPQMRPI

SEQ ID NO: 1040478 - protein, 20 aa, Mycobacterium
AEILRYCSDQGIAIVPFGGG

SEQ ID NO: 1040479 - protein, 24 aa, Mycobacterium
AEITTLLGGLGYRGFFELGDERRP

SEQ ID NO: 1040480 - protein, 17 aa, Mycobacterium
AEIYDGFLVHSRFASAA

SEQ ID NO: 1040481 - protein, 19 aa, Mycobacterium
AELAGVAAEFGVPMHSDAV

SEQ ID NO: 1040482 - protein, 24 aa, Mycobacterium
AELANLRLAFRWTADNNDLDDAAS

SEQ ID NO: 1040483 - protein, 25 aa, Mycobacterium
AELARSNGWTGLVVHGAVRDSAALR

SEQ ID NO: 1040484 - protein, 21 aa, Mycobacterium
AELEPVFLAEAGFSLHDVIAD

SEQ ID NO: 1040485 - protein, 20 aa, Mycobacterium
AELGEWLHPFEKLWREKLSA

SEQ ID NO: 1040486 - protein, 21 aa, Mycobacterium
AELGGRLAAVVASRLRITRSE

SEQ ID NO: 1040487 - protein, 28 aa, Mycobacterium
AELHYLGAALWRRGIHRVLHGFVQSGDW

SEQ ID NO: 1040488 - protein, 25 aa, Mycobacterium
AELIAARWGLSRTQLDEFSAASHDK

SEQ ID NO: 1040489 - protein, 17 aa, Mycobacterium
AELKAHGLLAARSAPTF

SEQ ID NO: 1040490 - protein, 33 aa, Mycobacterium; identical to SEQ ID NO: 629198

SEQ ID NO: 1040491 - protein, 19 aa, Mycobacterium
AELLRACGDIDGLERVRFT

SEQ ID NO: 1040492 - protein, 21 aa, Mycobacterium
AELLSDWRLTRGRLHEALLNV

SEQ ID NO: 1040493 - protein, 24 aa, Mycobacterium
AELLTAAGIAAEWCNEPNLVHGYV

SEQ ID NO: 1040494 - protein, 27 aa, Mycobacterium
AELNLGKLLTKRARVIGTTLRARPLQG

SEQ ID NO: 1040495 - protein, 25 aa, Mycobacterium
AELPRLPRTALIDVLLRCPPRTRSA

SEQ ID NO: 1040496 - protein, 17 aa, Mycobacterium
AELPRTSSATGPTLAAG

SEQ ID NO: 1040497 - protein, 17 aa, Mycobacterium
AELQADLGAIVVEANTI

SEQ ID NO: 1040498 - protein, 27 aa, Mycobacterium
AELRDNRFGVCGYCRGGRVSMIVAGRC

SEQ ID NO: 1040499 - protein, 34 aa, Mycobacterium; identical to SEQ ID NO: 629258

SEQ ID NO: 1040500 - protein, 17 aa, Mycobacterium
AELRLLRGMPSVFVPSA

SEQ ID NO: 1040501 - protein, 17 aa, Mycobacterium
AELRRGRRYSVARRLAG

SEQ ID NO: 1040502 - protein, 17 aa, Mycobacterium
AELRSSEPIWWDEQFPG

SEQ ID NO: 1040503 - protein, 17 aa, Mycobacterium
AELSRLYGALGDGPLDD

SEQ ID NO: 1040504 - protein, 17 aa, Mycobacterium
AELTELLLEAGFAEVTM

SEQ ID NO: 1040505 - protein, 17 aa, Mycobacterium
AELTMLILGRDRMKNPE

SEQ ID NO: 1040506 - protein, 26 aa, Mycobacterium
AELVARVKALLRRRGATATSSSEIIT

SEQ ID NO: 1040507 - protein, 46 aa, Mycobacterium
AELVGRMSVPQSWAWQQRWPITPVRQPRAAAGPVRPLSPKRQSGCP

SEQ ID NO: 1040508 - protein, 19 aa, Mycobacterium
AELVPRYLDPDAIAVIEGD

SEQ ID NO: 1040509 - protein, 18 aa, Mycobacterium
AELVWLGAAMIIGAGSTL

SEQ ID NO: 1040510 - protein, 22 aa, Mycobacterium
AEMARRIDVARVYSRSVVERQL

SEQ ID NO: 1040511 - protein, 18 aa, Mycobacterium
AEMEDAFGFTETVDQLTA

SEQ ID NO: 1040512 - protein, 22 aa, Mycobacterium
AEMHARISGLADYFAVDEFDAI

SEQ ID NO: 1040513 - protein, 17 aa, Mycobacterium
AEMLRRNGIPCDEVRKH

SEQ ID NO: 1040514 - protein, 21 aa, Mycobacterium
AEMVRRLRAAGAVIIGKTNVP

SEQ ID NO: 1040515 - protein, 22 aa, Mycobacterium
AEMVVAIGQRLGISAPDIDLLS

SEQ ID NO: 1040516 - protein, 22 aa, Mycobacterium
AEMYSAICIAATLIVPGCDHAS

SEQ ID NO: 1040517 - protein, 20 aa, Mycobacterium
AENLWAAFGQQIAVDFVDGR

SEQ ID NO: 1040518 - protein, 23 aa, Mycobacterium
AENVPLRRVEAFTQIAKNAGAQL

SEQ ID NO: 1040519 - protein, 19 aa, Mycobacterium
AEPASMVVSWVADILSEHG

SEQ ID NO: 1040520 - protein, 20 aa, Mycobacterium
AEPGRRLSLIDLLDPNEHER

SEQ ID NO: 1040521 - protein, 20 aa, Mycobacterium
AEPISAPATFSIAKNSCTTR

SEQ ID NO: 1040522 - protein, 26 aa, Mycobacterium
AEPLPRSLVWSAAWEMTREAELRARD

SEQ ID NO: 1040523 - protein, 24 aa, Mycobacterium
AEPLRMARDLVRLGLDTLALDVYR

SEQ ID NO: 1040524 - protein, 18 aa, Mycobacterium
AEPMPFLLTNTRLARTTW

SEQ ID NO: 1040525 - protein, 22 aa, Mycobacterium
AEPRGYCAGVDRAVETVERSLR

SEQ ID NO: 1040526 - protein, 17 aa, Mycobacterium
AEPRYRDRIPILIGGGG

SEQ ID NO: 1040527 - protein, 22 aa, Mycobacterium
AEPTGVTAWELARMKLAKMTHQ

SEQ ID NO: 1040528 - protein, 24 aa, Mycobacterium
AEPVAVVGIGCRFPGNVTGPDSFW

SEQ ID NO: 1040529 - protein, 17 aa, Mycobacterium
AEQFLELDLQVVAAGRD

SEQ ID NO: 1040530 - protein, 18 aa, Mycobacterium
AEQLRLWVDSLLSATDGK

SEQ ID NO: 1040531 - protein, 31 aa, Mycobacterium; identical to SEQ ID NO: 923849

SEQ ID NO: 1040532 - protein, 21 aa, Mycobacterium
AEQRGTVALMHGEREFPSFQA

SEQ ID NO: 1040533 - protein, 22 aa, Mycobacterium
AEQRPVKVLSCVLTDAEEIVLN

SEQ ID NO: 1040534 - protein, 17 aa, Mycobacterium
AERAAWVGHDWGAVVVW

SEQ ID NO: 1040535 - protein, 19 aa, Mycobacterium
AERAGAAYAELALLRGDPS

SEQ ID NO: 1040536 - protein, 19 aa, Mycobacterium
AERFLAAAGVTDWLVDTGI

SEQ ID NO: 1040537 - protein, 21 aa, Mycobacterium
AERHQRTLLGVALIDTYLPSQ

SEQ ID NO: 1040538 - protein, 20 aa, Mycobacterium
AERINRWRVATAEASYSVVE

SEQ ID NO: 1040539 - protein, 22 aa, Mycobacterium
AERIRRVAERIVETKKQGNDVV

SEQ ID NO: 1040540 - protein, 24 aa, Mycobacterium
AERLAFVLHDVFAVPFDQIAPILE

SEQ ID NO: 1040541 - protein, 22 aa, Mycobacterium
AERLDVVGALFVLRCRESGDRA

SEQ ID NO: 1040542 - protein, 25 aa, Mycobacterium
AERLGIPWIELNPHPLYRPSKGLPP

SEQ ID NO: 1040543 - protein, 31 aa, Mycobacterium
AERLRAGGMGIPGFYTPAGVGTQIADGGLPW

SEQ ID NO: 1040544 - protein, 18 aa, Mycobacterium
AERSGVSARCRFDVVDLD

SEQ ID NO: 1040545 - protein, 24 aa, Mycobacterium
AERYGMDRFCLGVHACEIPVLDLE

SEQ ID NO: 1040546 - protein, 18 aa, Mycobacterium
AERYLRPGQIEEHLIYPV

SEQ ID NO: 1040547 - protein, 20 aa, Mycobacterium
AESCTAGLLAARLTDRPGSS

SEQ ID NO: 1040548 - protein, 42 aa, Mycobacterium; identical to SEQ ID NO: 629630

SEQ ID NO: 1040549 - protein, 17 aa, Mycobacterium
AESGARFGMPEVAVGIP

SEQ ID NO: 1040550 - protein, 21 aa, Mycobacterium
AESGFPMLPPLMPPPISAGSG

SEQ ID NO: 1040551 - protein, 17 aa, Mycobacterium
AESIAAALTPFPLQAAG

SEQ ID NO: 1040552 - protein, 17 aa, Mycobacterium
AESLLALGLPGLSVNVR

SEQ ID NO: 1040553 - protein, 27 aa, Mycobacterium
AESLPSASGSLAWTPLMTQFQLIDKSI

SEQ ID NO: 1040554 - protein, 22 aa, Mycobacterium
AESPRSSLPPGVLPIPSTAPHP

SEQ ID NO: 1040555 - protein, 21 aa, Mycobacterium
AESREVSTFVVFLASDDASYA

SEQ ID NO: 1040556 - protein, 21 aa, Mycobacterium
AESRLGYPLDRSHTAAIIWSD

SEQ ID NO: 1040557 - protein, 20 aa, Mycobacterium
AESSGVLSLQGLQRDVWGDG

SEQ ID NO: 1040558 - protein, 20 aa, Mycobacterium
AESVQHTWFGLSALAERVGT

SEQ ID NO: 1040559 - protein, 19 aa, Mycobacterium
AETFAARTTQEWLDLLEEL

SEQ ID NO: 1040560 - protein, 20 aa, Mycobacterium
AETQPGGWVRLRGDAALVLP

SEQ ID NO: 1040561 - protein, 28 aa, Mycobacterium
AETVGAYFPLGWPIACHVQGDAGVDTTL

SEQ ID NO: 1040562 - protein, 33 aa, Mycobacterium; identical to SEQ ID NO: 620143

SEQ ID NO: 1040563 - protein, 20 aa, Mycobacterium
AEVADTYFALVDRLGADGLL

SEQ ID NO: 1040564 - protein, 17 aa, Mycobacterium
AEVAHRNGIPLIVDNTI

SEQ ID NO: 1040565 - protein, 19 aa, Mycobacterium
AEVARRLHNMGAKLVLTDL

SEQ ID NO: 1040566 - protein, 20 aa, Mycobacterium
AEVEIACGRAQSVIGELEGL

SEQ ID NO: 1040567 - protein, 20 aa, Mycobacterium
AEVKLGAGEDIDFKQYEAGM

SEQ ID NO: 1040568 - protein, 24 aa, Mycobacterium
AEVMPEDLIKFGLIPEFIGRLPVV

SEQ ID NO: 1040569 - protein, 20 aa, Mycobacterium
AEVPWLEPLPDLMADPADPS

SEQ ID NO: 1040570 - protein, 18 aa, Mycobacterium
AEVRRIEHQVAHEVVAEV

SEQ ID NO: 1040571 - protein, 17 aa, Mycobacterium
AEVSGAVGLIVAQHAGG

SEQ ID NO: 1040572 - protein, 17 aa, Mycobacterium
AEVVEFWQGRENRVHNR

SEQ ID NO: 1040573 - protein, 17 aa, Mycobacterium
AEVVVCYRAFNERSGMR

SEQ ID NO: 1040574 - protein, 18 aa, Mycobacterium
AEWMLPRDAIADFAAGRN

SEQ ID NO: 1040575 - protein, 17 aa, Mycobacterium
AEYRVVELLGRRNAQES

SEQ ID NO: 1040576 - protein, 18 aa, Mycobacterium
AFAADMAFLRNCGIHPVV

SEQ ID NO: 1040577 - protein, 20 aa, Mycobacterium
AFAADYGLCLARTNWDVPKH

SEQ ID NO: 1040578 - protein, 20 aa, Mycobacterium
AFAARWRQLLVAAGLIAVSW

SEQ ID NO: 1040579 - protein, 17 aa, Mycobacterium
AFADPYCPTLRSAVTDL

SEQ ID NO: 1040580 - protein, 21 aa, Mycobacterium
AFAGPRFLMRVAELEMHPLDT

SEQ ID NO: 1040581 - protein, 24 aa, Mycobacterium
AFASMCVATVKLLELDADRVNVSG

SEQ ID NO: 1040582 - protein, 18 aa, Mycobacterium
AFASTGGWQSFRVPCLPS

SEQ ID NO: 1040583 - protein, 23 aa, Mycobacterium
AFATMGCLYPNRIFLGVGTGEAL

SEQ ID NO: 1040584 - protein, 21 aa, Mycobacterium
AFATSRRRMMDWLSRRNGDVF

SEQ ID NO: 1040585 - protein, 19 aa, Mycobacterium
AFCSTCDRTRLTADGQVRS

SEQ ID NO: 1040586 - protein, 17 aa, Mycobacterium
AFDNGPWPSTPPKERAT

SEQ ID NO: 1040587 - protein, 18 aa, Mycobacterium
AFEAFKMERYAAFFERSY

SEQ ID NO: 1040588 - protein, 20 aa, Mycobacterium
AFEYVRELLSYLPPNNATDA

SEQ ID NO: 1040589 - protein, 26 aa, Mycobacterium
AFFGRSGLRRNIRWDPLDSVYFAGYA

SEQ ID NO: 1040590 - protein, 19 aa, Mycobacterium
AFFLCRRASRLRAHAAQWA

SEQ ID NO: 1040591 - protein, 18 aa, Mycobacterium
AFGAQMVERGQGGTITNI

SEQ ID NO: 1040592 - protein, 23 aa, Mycobacterium
AFGASPRASLGIIAASRALALVR

SEQ ID NO: 1040593 - protein, 19 aa, Mycobacterium
AFGGFPLPSAVRIPTQYLI

SEQ ID NO: 1040594 - protein, 18 aa, Mycobacterium
AFGPYLEWLEEAGQECQQ

SEQ ID NO: 1040595 - protein, 20 aa, Mycobacterium
AFGSFHMVDGFLLNNQLSDF

SEQ ID NO: 1040596 - protein, 17 aa, Mycobacterium
AFHAQFLQALTNAGGAY

SEQ ID NO: 1040597 - protein, 28 aa, Mycobacterium
AFLQRPARWMQLMGKFRGQISCAPNFGF

SEQ ID NO: 1040598 - protein, 20 aa, Mycobacterium
AFMAGLLDTLWEQGLLDADR

SEQ ID NO: 1040599 - protein, 19 aa, Mycobacterium
AFMALAARFLGPALTGVQP

SEQ ID NO: 1040600 - protein, 21 aa, Mycobacterium
AFNERSGMRFGGSGRTSTETP

SEQ ID NO: 1040601 - protein, 17 aa, Mycobacterium
AFNEVHWVAPAEAVWAC

SEQ ID NO: 1040602 - protein, 23 aa, Mycobacterium
AFNGEGKAAIAIGNPDYARNTAV

SEQ ID NO: 1040603 - protein, 18 aa, Mycobacterium
AFNPKYVRYEVFGPPGTV

SEQ ID NO: 1040604 - protein, 21 aa, Mycobacterium
AFNVVPLAGWLVDDGSGETDE

SEQ ID NO: 1040605 - protein, 23 aa, Mycobacterium
AFPKLFRSEVDWDYTTEPEPQLG

SEQ ID NO: 1040606 - protein, 18 aa, Mycobacterium
AFPPMAVSLSLADEIDIS

SEQ ID NO: 1040607 - protein, 24 aa, Mycobacterium
AFREPGPRLELMNELGVDRSLMFP

SEQ ID NO: 1040608 - protein, 24 aa, Mycobacterium
AFRQRFGEHFFYILYFQQPGVADA

SEQ ID NO: 1040609 - protein, 18 aa, Mycobacterium
AFTEVAERIIGARATGSD

SEQ ID NO: 1040610 - protein, 25 aa, Mycobacterium
AFTHSLALEYARDGLRAVCVAPGSI

SEQ ID NO: 1040611 - protein, 40 aa, Mycobacterium
AFTISGKYGYSYKVLGIKFNYPFNYSFDIPAITIPSIQIG

SEQ ID NO: 1040612 - protein, 29 aa, Mycobacterium
AFVASQADVIWKLRYTMRSQIFSRGLPWP

SEQ ID NO: 1040613 - protein, 24 aa, Mycobacterium
AFVRLRARVAAVLSTTFASHYTRE

SEQ ID NO: 1040614 - protein, 26 aa, Mycobacterium
AFYHLGWLCVWAVLEAVAEPGSAAMA

SEQ ID NO: 1040615 - protein, 27 aa, Mycobacterium
AFYQFLGPPGSMWSQWLTLPAAAGPIV

SEQ ID NO: 1040616 - protein, 17 aa, Mycobacterium
AFYRRCRLVTERLWPTL

SEQ ID NO: 1040617 - protein, 18 aa, Mycobacterium
AGAAFFTPTLVKGGEMIV

SEQ ID NO: 1040618 - protein, 17 aa, Mycobacterium
AGAALLETVWDVTARES

SEQ ID NO: 1040619 - protein, 17 aa, Mycobacterium
AGAATDLAGIGAALQSA

SEQ ID NO: 1040620 - protein, 17 aa, Mycobacterium
AGAATDLAGLGSTLQIA

SEQ ID NO: 1040621 - protein, 29 aa, Mycobacterium
AGAAVKEAICKGTLWALRREAAKPGSYFW

SEQ ID NO: 1040622 - protein, 21 aa, Mycobacterium
AGACPEHVLIIGGTGNLGLES

SEQ ID NO: 1040623 - protein, 19 aa, Mycobacterium
AGADAIYPGYGFLSENPDL

SEQ ID NO: 1040624 - protein, 18 aa, Mycobacterium
AGADAVIYHARFGPTLAE

SEQ ID NO: 1040625 - protein, 27 aa, Mycobacterium
AGADEVSALIAGLFDAHAQAYQALSAQ

SEQ ID NO: 1040626 - protein, 30 aa, Mycobacterium
AGADEVSVGIAALFADHAQEYEVVLEEFLD

SEQ ID NO: 1040627 - protein, 18 aa, Mycobacterium
AGADLLAISRRENIYHPD

SEQ ID NO: 1040628 - protein, 17 aa, Mycobacterium
AGADMAAALGMLEARHI

SEQ ID NO: 1040629 - protein, 23 aa, Mycobacterium
AGADSLKGLCPFHNEKSPSFHVR

SEQ ID NO: 1040630 - protein, 26 aa, Mycobacterium
AGAFLRAGAINRILAYVAPILLGGPV

SEQ ID NO: 1040631 - protein, 18 aa, Mycobacterium
AGAFQRFGADTAVAITGI

SEQ ID NO: 1040632 - protein, 18 aa, Mycobacterium
AGAGDIWVVGGGDLAGQF

SEQ ID NO: 1040633 - protein, 27 aa, Mycobacterium
AGAGSEPMLLAARGWSELSAELQSAAA

SEQ ID NO: 1040634 - protein, 17 aa, Mycobacterium
AGAIGLGVMKRCAQLIY

SEQ ID NO: 1040635 - protein, 18 aa, Mycobacterium
AGALRAATHADLQTTSAA

SEQ ID NO: 1040636 - protein, 18 aa, Mycobacterium
AGAMQVLRLVLSQVGDDL

SEQ ID NO: 1040637 - protein, 17 aa, Mycobacterium
AGAMVRAIWFRGTEHRA

SEQ ID NO: 1040638 - protein, 19 aa, Mycobacterium
AGANGAPGLAGGTGGAGGF

SEQ ID NO: 1040639 - protein, 18 aa, Mycobacterium
AGAPAALADSVRNGDTQV

SEQ ID NO: 1040640 - protein, 21 aa, Mycobacterium
AGAPFCGYSSELLTGTLQGPS

SEQ ID NO: 1040641 - protein, 20 aa, Mycobacterium
AGAQIGGFGIHPALLDAALH

SEQ ID NO: 1040642 - protein, 33 aa, Mycobacterium
AGARDFQRFLIGKLRDIREVVATASLDDTSKAT

SEQ ID NO: 1040643 - protein, 26 aa, Mycobacterium
AGARLSVVVGESWRAEALAEMMREAG

SEQ ID NO: 1040644 - protein, 19 aa, Mycobacterium
AGARPGSWMALSIRLPAGV

SEQ ID NO: 1040645 - protein, 28 aa, Mycobacterium
AGARRLYTSRGWLPWHGPTSVLSPTGPT

SEQ ID NO: 1040646 - protein, 24 aa, Mycobacterium
AGASFLRRDGSVWTTDKDGIIMAL

SEQ ID NO: 1040647 - protein, 20 aa, Mycobacterium
AGASGFQIAPAIAEDVAQLS

SEQ ID NO: 1040648 - protein, 17 aa, Mycobacterium
AGATIINSGFGWHEARI

SEQ ID NO: 1040649 - protein, 17 aa, Mycobacterium
AGATILAELSRLYGALG

SEQ ID NO: 1040650 - protein, 25 aa, Mycobacterium
AGAVDRARVATLLLPGIGGVAHLED

SEQ ID NO: 1040651 - protein, 25 aa, Mycobacterium
AGAVGRAAIRIAQHLGAEVFATADP

SEQ ID NO: 1040652 - protein, 21 aa, Mycobacterium
AGAVIELVHLASLYHDDVMDE

SEQ ID NO: 1040653 - protein, 24 aa, Mycobacterium
AGAVIELVHLASLYHDDVMDEAEV

SEQ ID NO: 1040654 - protein, 33 aa, Mycobacterium; identical to SEQ ID NO: 630436

SEQ ID NO: 1040655 - protein, 20 aa, Mycobacterium
AGAVSVNFMPSVTLAPFGGA

SEQ ID NO: 1040656 - protein, 20 aa, Mycobacterium
AGAYFKGGINPVSVWVSTDY

SEQ ID NO: 1040657 - protein, 19 aa, Mycobacterium
AGCCDLAFAAPDAARAIKS

SEQ ID NO: 1040658 - protein, 20 aa, Mycobacterium
AGCDLAMMCDIRIASQRASF

SEQ ID NO: 1040659 - protein, 23 aa, Mycobacterium
AGCGEAALAMALAGRGHPVVGLD

SEQ ID NO: 1040660 - protein, 19 aa, Mycobacterium
AGCSASLRVALGRVDPQSA

SEQ ID NO: 1040661 - protein, 17 aa, Mycobacterium
AGDAGTALTARTARTAC

SEQ ID NO: 1040662 - protein, 23 aa, Mycobacterium
AGDCLPDVLVLRSLTKTWSLAGL

SEQ ID NO: 1040663 - protein, 20 aa, Mycobacterium
AGDDEWCVVTICSDNEWRCA

SEQ ID NO: 1040664 - protein, 25 aa, Mycobacterium
AGDEISAAVAALFGSYAQGYQSLSA

SEQ ID NO: 1040665 - protein, 24 aa, Mycobacterium
AGDEVSAAIAAVFSAHGQSYETLS

SEQ ID NO: 1040666 - protein, 29 aa, Mycobacterium
AGDEVSAAVATLFGTYGQTYQALAAQASG

SEQ ID NO: 1040667 - protein, 53 aa, Mycobacterium
AGDEVSAAVTRMFGAYAQEFQTLSARMEQFYTDCVRALLTGAGAYSGAEAANA

SEQ ID NO: 1040668 - protein, 18 aa, Mycobacterium
AGDFPAMMAQISDEHIDA

SEQ ID NO: 1040669 - protein, 22 aa, Mycobacterium
AGDFWGGAGSVACQEFISQLGR

SEQ ID NO: 1040670 - protein, 21 aa, Mycobacterium
AGDFWGGAGSVACQEFITQLG

SEQ ID NO: 1040671 - protein, 17 aa, Mycobacterium
AGDGVWAIYTVDADGGA

SEQ ID NO: 1040672 - protein, 18 aa, Mycobacterium
AGDLWPLRDERIPADVPM

SEQ ID NO: 1040673 - protein, 23 aa, Mycobacterium
AGDPRKLAAMVLLITQSTIQSVD

SEQ ID NO: 1040674 - protein, 25 aa, Mycobacterium
AGDRWILHCGDAFYHVGTLDGQSKV

SEQ ID NO: 1040675 - protein, 27 aa, Mycobacterium
AGDTDLAWSRITYWRALLTSAVDQPPH

SEQ ID NO: 1040676 - protein, 22 aa, Mycobacterium
AGDVAECITLTPGERAPSVIEV

SEQ ID NO: 1040677 - protein, 21 aa, Mycobacterium
AGEGPVGVVQAVIGAESDALL

SEQ ID NO: 1040678 - protein, 20 aa, Mycobacterium
AGELCERFDRLYLVRGAQVV

SEQ ID NO: 1040679 - protein, 25 aa, Mycobacterium
AGELGRSAAGYALWHNEIAGFDELR

SEQ ID NO: 1040680 - protein, 24 aa, Mycobacterium
AGELVSRLGAQRVIDTRTEAFERT

SEQ ID NO: 1040681 - protein, 22 aa, Mycobacterium
AGEMPARYVIHAATMELGGPTS

SEQ ID NO: 1040682 - protein, 19 aa, Mycobacterium
AGEPRYQVRYLIRDPDAPS

SEQ ID NO: 1040683 - protein, 26 aa, Mycobacterium
AGERARCVTYPLLAVQAWATHHDTTL

SEQ ID NO: 1040684 - protein, 18 aa, Mycobacterium
AGERFDFDLALDLRGTEF

SEQ ID NO: 1040685 - protein, 20 aa, Mycobacterium
AGERGLCAGGDVVAVYHSAR

SEQ ID NO: 1040686 - protein, 28 aa, Mycobacterium
AGERPPRVPLSFAQSRVWFLEQLQGPSA

SEQ ID NO: 1040687 - protein, 31 aa, Mycobacterium
AGESAAGLARVWSCHLGRPLAADSSLLGAGI

SEQ ID NO: 1040688 - protein, 18 aa, Mycobacterium
AGETGCRIVLPDDADPFV

SEQ ID NO: 1040689 - protein, 21 aa, Mycobacterium
AGEVESGSWLGLRYQGNGLGT

SEQ ID NO: 1040690 - protein, 30 aa, Mycobacterium
AGFADRIATDWAGPASRVIRRRMRLTGSIY

SEQ ID NO: 1040691 - protein, 24 aa, Mycobacterium
AGFARAALFPTLAAALDCGTGDPR

SEQ ID NO: 1040692 - protein, 23 aa, Mycobacterium
AGFDAVFTGEAWGSDAYTPLAWW

SEQ ID NO: 1040693 - protein, 19 aa, Mycobacterium
AGFGVTFGSMFKKTVTEEY

SEQ ID NO: 1040694 - protein, 18 aa, Mycobacterium
AGFHARVAALLGAGADSY

SEQ ID NO: 1040695 - protein, 19 aa, Mycobacterium
AGFNLYAYLYAFNKILPGV

SEQ ID NO: 1040696 - protein, 19 aa, Mycobacterium
AGFPLGWVHDVVWAPRPAA

SEQ ID NO: 1040697 - protein, 18 aa, Mycobacterium
AGFRSLGLDGFRLEITSL

SEQ ID NO: 1040698 - protein, 24 aa, Mycobacterium
AGFTAIRRWAKQFYPDGISGSAAE

SEQ ID NO: 1040699 - protein, 20 aa, Mycobacterium
AGGAAGMWGTGGSGGAGPAG

SEQ ID NO: 1040700 - protein, 23 aa, Mycobacterium
AGGAGAMRGNGGNGGSAGTGTTA

SEQ ID NO: 1040701 - protein, 17 aa, Mycobacterium
AGGAGGDGIARGDAAGG

SEQ ID NO: 1040702 - protein, 26 aa, Mycobacterium
AGGAGGLWGGGGIGGTGGFGALNGAA

SEQ ID NO: 1040703 - protein, 24 aa, Mycobacterium
AGGAGGPGLFGFNGGAGGAGGLLG

SEQ ID NO: 1040704 - protein, 25 aa, Mycobacterium
AGGAGGPWAGLVGAGGGDGGIGGMG

SEQ ID NO: 1040705 - protein, 25 aa, Mycobacterium
AGGAGGSGGWLFGNGGTGGRGGIGT

SEQ ID NO: 1040706 - protein, 20 aa, Mycobacterium
AGGAGRPASFNSNGGPGGNG

SEQ ID NO: 1040707 - protein, 26 aa, Mycobacterium
AGGALPPPFNIVGKLSGPGVSMAGNA

SEQ ID NO: 1040708 - protein, 28 aa, Mycobacterium
AGGDARLIGNGGGGGYEGSLGVLSGGTA

SEQ ID NO: 1040709 - protein, 24 aa, Mycobacterium
AGGDGGFGLGVVGGHGGDGGNAGL

SEQ ID NO: 1040710 - protein, 25 aa, Mycobacterium
AGGDGGVAAGAFGVNGSDGADGNQG

SEQ ID NO: 1040711 - protein, 24 aa, Mycobacterium
AGGDSGLLSGLFGTGGGHGGLGGA

SEQ ID NO: 1040712 - protein, 20 aa, Mycobacterium
AGGEILRLLLGHPAYADDRL

SEQ ID NO: 1040713 - protein, 20 aa, Mycobacterium
AGGEILRLLLGHPAYTSGRL

SEQ ID NO: 1040714 - protein, 22 aa, Mycobacterium
AGGESFGFGAGVGGAGGNGGNG

SEQ ID NO: 1040715 - protein, 20 aa, Mycobacterium
AGGEVKLWARRADVANQIND

SEQ ID NO: 1040716 - protein, 18 aa, Mycobacterium
AGGFDLQSACAVAGSADT

SEQ ID NO: 1040717 - protein, 18 aa, Mycobacterium
AGGFLYGNGGNGFSQTTA

SEQ ID NO: 1040718 - protein, 21 aa, Mycobacterium
AGGFTEIDSSASVIAATGGAG

SEQ ID NO: 1040719 - protein, 26 aa, Mycobacterium
AGGGGRGMRVVRELSALPAEVEAARR

SEQ ID NO: 1040720 - protein, 19 aa, Mycobacterium
AGGGGRTGGVGGDGVTGAT

SEQ ID NO: 1040721 - protein, 19 aa, Mycobacterium
AGGHGGWLAGTGGAGGAGG

SEQ ID NO: 1040722 - protein, 20 aa, Mycobacterium
AGGHGGWLVGNGGIGGDGGS

SEQ ID NO: 1040723 - protein, 18 aa, Mycobacterium
AGGIAWLRRRRRGRRARR

SEQ ID NO: 1040724 - protein, 18 aa, Mycobacterium
AGGLGLFGAGGVATSAGG

SEQ ID NO: 1040725 - protein, 18 aa, Mycobacterium
AGGLLGHSGNPGLGGEGG

SEQ ID NO: 1040726 - protein, 24 aa, Mycobacterium
AGGLPGIFGGLPGVAGAWGGEVPT

SEQ ID NO: 1040727 - protein, 25 aa, Mycobacterium
AGGNGGAGGWIYGHGGDGGIGGAGG

SEQ ID NO: 1040728 - protein, 24 aa, Mycobacterium
AGGNGGTGGFSLVTGGAGGAGGAS

SEQ ID NO: 1040729 - protein, 17 aa, Mycobacterium
AGGNRSGLPVGVEPGRA

SEQ ID NO: 1040730 - protein, 19 aa, Mycobacterium
AGGPGCWVLAGPVVPGDRG

SEQ ID NO: 1040731 - protein, 24 aa, Mycobacterium
AGGPGGLFGAGGLGGAGGFGGSGG

SEQ ID NO: 1040732 - protein, 18 aa, Mycobacterium
AGGQVFLVDCGRGVLQRA

SEQ ID NO: 1040733 - protein, 21 aa, Mycobacterium
AGGRALPDWSPAGSLQAMAEL

SEQ ID NO: 1040734 - protein, 27 aa, Mycobacterium
AGGSAGLLFGSGRIGGDGGFGSNTGGA

SEQ ID NO: 1040735 - protein, 20 aa, Mycobacterium
AGGSFCAGMDLKAFARGENV

SEQ ID NO: 1040736 - protein, 23 aa, Mycobacterium
AGGSGGQGGWLYGNGGVGGAGGA

SEQ ID NO: 1040737 - protein, 24 aa, Mycobacterium
AGGSGGRGGFFFGSGGAGGDGGAS

SEQ ID NO: 1040738 - protein, 21 aa, Mycobacterium
AGGSVTRIWLGPKRLVPPMVM

SEQ ID NO: 1040739 - protein, 24 aa, Mycobacterium
AGGTGGAGGMLFGNGGAGGVGVTA

SEQ ID NO: 1040740 - protein, 24 aa, Mycobacterium
AGGTGGAGGWLYGNGGAGGSGGNG

SEQ ID NO: 1040741 - protein, 26 aa, Mycobacterium
AGGTGGHGGLLIGNGGAGGIGGTRGS

SEQ ID NO: 1040742 - protein, 23 aa, Mycobacterium
AGGTGGMAGLFGAGGAGGEGGGG

SEQ ID NO: 1040743 - protein, 24 aa, Mycobacterium
AGGTGGTAGWLYGSGGSGGAGGAG

SEQ ID NO: 1040744 - protein, 20 aa, Mycobacterium
AGGTGGWLYGSGGSGGIGGV

SEQ ID NO: 1040745 - protein, 35 aa, Mycobacterium
AGGVGCAGVSGGVGGTGGNAMLFGNGGAGGMGGAG

SEQ ID NO: 1040746 - protein, 20 aa, Mycobacterium
AGGVIKPGESLIFVVDLLDV

SEQ ID NO: 1040747 - protein, 17 aa, Mycobacterium
AGGVPAYGNQRTEWDAG

SEQ ID NO: 1040748 - protein, 17 aa, Mycobacterium
AGHAVAGTVLFPGAGFV

SEQ ID NO: 1040749 - protein, 24 aa, Mycobacterium
AGHGRSGFLLAPWTAEQIMFELAA

SEQ ID NO: 1040750 - protein, 29 aa, Mycobacterium
AGHPGCPAKACLHWGAMWGPASDAHHVDP

SEQ ID NO: 1040751 - protein, 17 aa, Mycobacterium
AGHPITIEPTKGRVQVR

SEQ ID NO: 1040752 - protein, 22 aa, Mycobacterium
AGHPTVGASWWLREQGTPVNTL

SEQ ID NO: 1040753 - protein, 18 aa, Mycobacterium
AGHSFVIFLREGFPVNIL

SEQ ID NO: 1040754 - protein, 22 aa, Mycobacterium
AGHSMGGIAISAWSERYRHKVH

SEQ ID NO: 1040755 - protein, 19 aa, Mycobacterium
AGHYGMCGRAYDPRFLFAW

SEQ ID NO: 1040756 - protein, 18 aa, Mycobacterium
AGIARILLDRGGLVSGSD

SEQ ID NO: 1040757 - protein, 25 aa, Mycobacterium
AGIEDSWAALRWVGEHAHELGGDPN

SEQ ID NO: 1040758 - protein, 25 aa, Mycobacterium
AGIELPRRVFAHGFLHNRGEKMSKS

SEQ ID NO: 1040759 - protein, 17 aa, Mycobacterium
AGIKFCQQRHHLPGLDF

SEQ ID NO: 1040760 - protein, 26 aa, Mycobacterium
AGIKLCQRRHNLPGLDFVRGDAENLP

SEQ ID NO: 1040761 - protein, 25 aa, Mycobacterium
AGILDVLDNYAFVRTSGYLAGPHDV

SEQ ID NO: 1040762 - protein, 17 aa, Mycobacterium
AGILPGSLYHHFESKEA

SEQ ID NO: 1040763 - protein, 17 aa, Mycobacterium
AGINPVSVCIGWGGLRI

SEQ ID NO: 1040764 - protein, 17 aa, Mycobacterium
AGIPFLLIRNHSGRPIL

SEQ ID NO: 1040765 - protein, 19 aa, Mycobacterium
AGISRASFYIYFDDKGHLL

SEQ ID NO: 1040766 - protein, 17 aa, Mycobacterium
AGISRVYLAGPPGALDE

SEQ ID NO: 1040767 - protein, 22 aa, Mycobacterium
AGITQVKVRSVLTCTTGTGVCA

SEQ ID NO: 1040768 - protein, 18 aa, Mycobacterium
AGITSLFAATAKTAGAIG

SEQ ID NO: 1040769 - protein, 21 aa, Mycobacterium
AGKARLVLRRETVDDLLSLEV

SEQ ID NO: 1040770 - protein, 25 aa, Mycobacterium
AGLAAWLVLCCRAMEAGAQEALAIA

SEQ ID NO: 1040771 - protein, 18 aa, Mycobacterium
AGLDGYSAADCVALLREA

SEQ ID NO: 1040772 - protein, 21 aa, Mycobacterium
AGLDRKALPALRHIVRIPIEE

SEQ ID NO: 1040773 - protein, 29 aa, Mycobacterium
AGLDSRAWRLPWPAGTTVFELDQPRVLEF

SEQ ID NO: 1040774 - protein, 25 aa, Mycobacterium
AGLELPLGCTFRLAAEEGASIGLPE

SEQ ID NO: 1040775 - protein, 18 aa, Mycobacterium
AGLEQVVILASGRDARAY

SEQ ID NO: 1040776 - protein, 19 aa, Mycobacterium
AGLERLGAQLSQWSSATVD

SEQ ID NO: 1040777 - protein, 29 aa, Mycobacterium
AGLFGVGGDGGLGGTGFFGAGGAGGAAGN

SEQ ID NO: 1040778 - protein, 17 aa, Mycobacterium
AGLGRILAGEIVRTITG

SEQ ID NO: 1040779 - protein, 18 aa, Mycobacterium
AGLGVGESGVSYLAGDAV

SEQ ID NO: 1040780 - protein, 21 aa, Mycobacterium
AGLHRRYLIVLPFLTPTIASL

SEQ ID NO: 1040781 - protein, 24 aa, Mycobacterium
AGLISRRLRGIAALAGVGAGLAIA

SEQ ID NO: 1040782 - protein, 20 aa, Mycobacterium
AGLKESCWKQIDVGNAVEMA

SEQ ID NO: 1040783 - protein, 21 aa, Mycobacterium
AGLLAPHWPAPYGRGASPAEQ

SEQ ID NO: 1040784 - protein, 22 aa, Mycobacterium
AGLLDAMGWLAANVPIYAVNVL

SEQ ID NO: 1040785 - protein, 26 aa, Mycobacterium
AGLLFSDAGGGGFGGFGLAGGGGTGG

SEQ ID NO: 1040786 - protein, 22 aa, Mycobacterium
AGLLLRARHALFDRLVYEKLRS

SEQ ID NO: 1040787 - protein, 25 aa, Mycobacterium
AGLPAPRYGTATTFAQARRIAEDIG

SEQ ID NO: 1040788 - protein, 23 aa, Mycobacterium
AGLPGVWLIDVERVQREPSAHAA

SEQ ID NO: 1040789 - protein, 18 aa, Mycobacterium
AGLPKPGRQAWYFDADTS

SEQ ID NO: 1040790 - protein, 18 aa, Mycobacterium
AGLPVDFTGFVTHRDTVA

SEQ ID NO: 1040791 - protein, 23 aa, Mycobacterium
AGLPYLGHVRRVAAYVDPANAEA

SEQ ID NO: 1040792 - protein, 29 aa, Mycobacterium
AGLRAAGRVAGLIGTIGIRIDGADIPSTL

SEQ ID NO: 1040793 - protein, 23 aa, Mycobacterium
AGLRAGGRVVGLVGTIGIRIDGA

SEQ ID NO: 1040794 - protein, 17 aa, Mycobacterium
AGLRAKLAPALLSGNIA

SEQ ID NO: 1040795 - protein, 18 aa, Mycobacterium
AGLRGVEKGYVLGPQAED

SEQ ID NO: 1040796 - protein, 23 aa, Mycobacterium
AGLSSPRIAGWIMRTDSVDLPWH

SEQ ID NO: 1040797 - protein, 25 aa, Mycobacterium
AGLTSGWRGPAAVPVMRVIAPHWAL

SEQ ID NO: 1040798 - protein, 17 aa, Mycobacterium
AGLWEWAECLGNGVTLD

SEQ ID NO: 1040799 - protein, 25 aa, Mycobacterium
AGMFRTGRAWGFEHCDIEPDMVVMS

SEQ ID NO: 1040800 - protein, 23 aa, Mycobacterium
AGNGDRVAIHWVGEPIEDSRTLT

SEQ ID NO: 1040801 - protein, 17 aa, Mycobacterium
AGNGGAGGDGWTNGDGG

SEQ ID NO: 1040802 - protein, 23 aa, Mycobacterium
AGNGGKGGNAMFFGTAGNGGNGG

SEQ ID NO: 1040803 - protein, 17 aa, Mycobacterium
AGNGGVGGNAFAAGFSG

SEQ ID NO: 1040804 - protein, 18 aa, Mycobacterium
AGNGGWLIGNGGTGGQGG

SEQ ID NO: 1040805 - protein, 20 aa, Mycobacterium
AGNVWEWTVDWYIDTPSARP

SEQ ID NO: 1040806 - protein, 24 aa, Mycobacterium
AGNYAQRLFPGMRVKYVSTEEFTN

SEQ ID NO: 1040807 - protein, 18 aa, Mycobacterium
AGPEIGVASTKTFLAQVT

SEQ ID NO: 1040808 - protein, 29 aa, Mycobacterium
AGPFDNWPLGWGFDHFWGFPSGAAGQYDP

SEQ ID NO: 1040809 - protein, 23 aa, Mycobacterium
AGPGEVRGQLALVTGAGAGIGRA

SEQ ID NO: 1040810 - protein, 18 aa, Mycobacterium
AGPLLDGGIAFTFAIYYL

SEQ ID NO: 1040811 - protein, 25 aa, Mycobacterium
AGPLPAYRSDLRPPTVAPPAVPSAP

SEQ ID NO: 1040812 - protein, 22 aa, Mycobacterium
AGPLPLQIICDMMGIPEEDHEQ

SEQ ID NO: 1040813 - protein, 17 aa, Mycobacterium
AGPPCFLDPELRELNDD

SEQ ID NO: 1040814 - protein, 30 aa, Mycobacterium; identical to SEQ ID NO: 631397

SEQ ID NO: 1040815 - protein, 19 aa, Mycobacterium
AGQCPQTKMVLGGYSQGTA

SEQ ID NO: 1040816 - protein, 25 aa, Mycobacterium
AGQDPRYILWAAWHRSGLQNRWLAA

SEQ ID NO: 1040817 - protein, 20 aa, Mycobacterium
AGQFTALAWSLMKLTTLHRT

SEQ ID NO: 1040818 - protein, 27 aa, Mycobacterium
AGQGCAITTRLVVPRARYDEAVAIAAG

SEQ ID NO: 1040819 - protein, 24 aa, Mycobacterium
AGQIELPAGVGLISDPEMLVVNVV

SEQ ID NO: 1040820 - protein, 18 aa, Mycobacterium
AGQLQGHRCGACRIEIGR

SEQ ID NO: 1040821 - protein, 18 aa, Mycobacterium
AGQPALAVRAMLGAFHDC

SEQ ID NO: 1040822 - protein, 20 aa, Mycobacterium
AGQPPAGGVILSMPAPMNCG

SEQ ID NO: 1040823 - protein, 19 aa, Mycobacterium
AGQRFVVDITMWIDLADGA

SEQ ID NO: 1040824 - protein, 26 aa, Mycobacterium
AGQRRKLLLARAVLSPARIVLLDEPT

SEQ ID NO: 1040825 - protein, 19 aa, Mycobacterium
AGQVLPMPPGVSLIDAAAL

SEQ ID NO: 1040826 - protein, 19 aa, Mycobacterium
AGRADAVLVAARIAPLTRH

SEQ ID NO: 1040827 - protein, 24 aa, Mycobacterium
AGRDHRASFVQIHFALDALPEFAP

SEQ ID NO: 1040828 - protein, 23 aa, Mycobacterium
AGRGARFLLGMVVSTGVGGGLVL

SEQ ID NO: 1040829 - protein, 19 aa, Mycobacterium
AGRLHILEVQRLIRFMPKV

SEQ ID NO: 1040830 - protein, 17 aa, Mycobacterium
AGRLLLGVREEFAAAEG

SEQ ID NO: 1040831 - protein, 21 aa, Mycobacterium
AGRLMYALVRAIRPTTVVEFG

SEQ ID NO: 1040832 - protein, 22 aa, Mycobacterium
AGRLPEDWFEGAPAVVVDREEI

SEQ ID NO: 1040833 - protein, 18 aa, Mycobacterium
AGRLRRLIAEQASVILRR

SEQ ID NO: 1040834 - protein, 26 aa, Mycobacterium
AGRPDIKSVDAYSLLASRGATTEGPA

SEQ ID NO: 1040835 - protein, 20 aa, Mycobacterium
AGRPPRCRPTGAGRHRHGRR

SEQ ID NO: 1040836 - protein, 21 aa, Mycobacterium
AGRPRGAGGTGGIGAGGGNAG

SEQ ID NO: 1040837 - protein, 18 aa, Mycobacterium
AGRRVRRYRPHVVIAELV

SEQ ID NO: 1040838 - protein, 23 aa, Mycobacterium
AGRSLPEYRALRRQHSMLAACFE

SEQ ID NO: 1040839 - protein, 26 aa, Mycobacterium
AGRYLRRWHRRRALWVGVAIGGTVDD

SEQ ID NO: 1040840 - protein, 22 aa, Mycobacterium
AGSALAAIRARQAELARQHDVL

SEQ ID NO: 1040841 - protein, 26 aa, Mycobacterium
AGSDARRLEGSYAWGNALSAGYTAEE

SEQ ID NO: 1040842 - protein, 20 aa, Mycobacterium
AGSGNFRFANTGNNNIGIGL

SEQ ID NO: 1040843 - protein, 26 aa, Mycobacterium
AGSGPMLSAAMAWDGLAVELGSAAES

SEQ ID NO: 1040844 - protein, 23 aa, Mycobacterium
AGSHWSYGELLGYFRQIEDVTAA

SEQ ID NO: 1040845 - protein, 19 aa, Mycobacterium
AGSIMGIVADIERYPEWNE

SEQ ID NO: 1040846 - protein, 18 aa, Mycobacterium
AGSLSWALSWKDAAAPLW

SEQ ID NO: 1040847 - protein, 21 aa, Mycobacterium
AGSPPACWRPGVPAVGEPVGG

SEQ ID NO: 1040848 - protein, 19 aa, Mycobacterium
AGSPQQLWRRELRHRQLRR

SEQ ID NO: 1040849 - protein, 20 aa, Mycobacterium
AGSRATHIVVWATLDKSKGR

SEQ ID NO: 1040850 - protein, 22 aa, Mycobacterium
AGSRPDKVARLILDSPVALGVS

SEQ ID NO: 1040851 - protein, 19 aa, Mycobacterium
AGSSARLAVTVGSRAQTDL

SEQ ID NO: 1040852 - protein, 19 aa, Mycobacterium
AGSSARWASRVTGRGAGAM

SEQ ID NO: 1040853 - protein, 19 aa, Mycobacterium
AGSSIQLLGKEASYASLRM

SEQ ID NO: 1040854 - protein, 23 aa, Mycobacterium
AGSSKLALKWTRSVKGSLAAGPA

SEQ ID NO: 1040855 - protein, 26 aa, Mycobacterium
AGTAGRASAAAAVFEAAQAAIVHPAM

SEQ ID NO: 1040856 - protein, 17 aa, Mycobacterium
AGTARLAFEQGKAALEL

SEQ ID NO: 1040857 - protein, 25 aa, Mycobacterium
AGTEPIAVVGMGCRFPGGVDNPEQF

SEQ ID NO: 1040858 - protein, 26 aa, Mycobacterium
AGTGDLVSPTAGYQGGQGGMGGKGGV

SEQ ID NO: 1040859 - protein, 23 aa, Mycobacterium
AGTGGAGGAAWLVGAGGAGGVGG

SEQ ID NO: 1040860 - protein, 19 aa, Mycobacterium
AGTGVRFTPTLTFTRDVTS

SEQ ID NO: 1040861 - protein, 28 aa, Mycobacterium
AGTILDSWCAALGRAFVADGFDESTAAS

SEQ ID NO: 1040862 - protein, 23 aa, Mycobacterium
AGTQKRLAVWLVEDPRQVPGIAT

SEQ ID NO: 1040863 - protein, 23 aa, Mycobacterium
AGTRATAGLVLWGEPGIGKSRLA

SEQ ID NO: 1040864 - protein, 17 aa, Mycobacterium
AGTSGEWLVSRSGLRYR

SEQ ID NO: 1040865 - protein, 19 aa, Mycobacterium
AGTTDNVWQGGWRHRRVAT

SEQ ID NO: 1040866 - protein, 24 aa, Mycobacterium
AGTVARAFLRQALGVEVLSHVVSI

SEQ ID NO: 1040867 - protein, 17 aa, Mycobacterium
AGTVLFPGAGFVELAIR

SEQ ID NO: 1040868 - protein, 18 aa, Mycobacterium
AGTYCLVGVYAMHRDPAL

SEQ ID NO: 1040869 - protein, 25 aa, Mycobacterium
AGVACTNLLLAMGVFDITVLDSRGT

SEQ ID NO: 1040870 - protein, 17 aa, Mycobacterium
AGVALELQAINSAARAG

SEQ ID NO: 1040871 - protein, 23 aa, Mycobacterium
AGVARGTFYFHFPTKEHVLVELE

SEQ ID NO: 1040872 - protein, 23 aa, Mycobacterium
AGVEGCLREVLVLAAALTIPDPR

SEQ ID NO: 1040873 - protein, 20 aa, Mycobacterium
AGVFEAEFGDGSKLGLQIDY

SEQ ID NO: 1040874 - protein, 29 aa, Mycobacterium
AGVGKGTLFRRFGSRAGLMMVLLDEDERA

SEQ ID NO: 1040875 - protein, 18 aa, Mycobacterium
AGVHSVVVAADWPLLAAA

SEQ ID NO: 1040876 - protein, 24 aa, Mycobacterium
AGVLKGEVKDVLLLDVTPLSLGIE

SEQ ID NO: 1040877 - protein, 25 aa, Mycobacterium
AGVLLRYVPLTAKRVTGIVSRGGSI

SEQ ID NO: 1040878 - protein, 18 aa, Mycobacterium
AGVRAVVEPAFWLGQPRT

SEQ ID NO: 1040879 - protein, 17 aa, Mycobacterium
AGVRLVFMDAARREWNP

SEQ ID NO: 1040880 - protein, 22 aa, Mycobacterium
AGVRRRLDIDLSEVADLRPEIV

SEQ ID NO: 1040881 - protein, 24 aa, Mycobacterium
AGVRSIPTVMAFRDGVLVITSPVP

SEQ ID NO: 1040882 - protein, 24 aa, Mycobacterium
AGVSRPTLYRWFASKEELLATFSR

SEQ ID NO: 1040883 - protein, 18 aa, Mycobacterium
AGVSRPTVYRRWPDTRSI

SEQ ID NO: 1040884 - protein, 18 aa, Mycobacterium
AGVTDWLVDTGIDSDVAG

SEQ ID NO: 1040885 - protein, 24 aa, Mycobacterium
AGVTRWALETAVAYAKVREQFGKP

SEQ ID NO: 1040886 - protein, 22 aa, Mycobacterium
AGVVRLRFGLTDGQPRTLDEIG

SEQ ID NO: 1040887 - protein, 26 aa, Mycobacterium
AGVYPPCSAFEAWFVSAALDDTAFER

SEQ ID NO: 1040888 - protein, 24 aa, Mycobacterium
AGYAADGPAGPAIGNGGDGGHGGA

SEQ ID NO: 1040889 - protein, 17 aa, Mycobacterium
AGYALAGRHVHVVTIND

SEQ ID NO: 1040890 - protein, 19 aa, Mycobacterium
AGYALAGRHVHVVTINDYL

SEQ ID NO: 1040891 - protein, 21 aa, Mycobacterium
AGYKVPRSLWFVDEVKRSPAG

SEQ ID NO: 1040892 - protein, 19 aa, Mycobacterium
AGYPHICVPAGYFCGLPVG

SEQ ID NO: 1040893 - protein, 17 aa, Mycobacterium
AGYRRFLERRLRETFGF

SEQ ID NO: 1040894 - protein, 22 aa, Mycobacterium
AGYRTEAGFEPAVDAGGWLATG

SEQ ID NO: 1040895 - protein, 17 aa, Mycobacterium
AHALAFAVEGARVVVND

SEQ ID NO: 1040896 - protein, 17 aa, Mycobacterium
AHALRFRPFASVREVVR

SEQ ID NO: 1040897 - protein, 20 aa, Mycobacterium
AHALRLARDGADVIAVDLCD

SEQ ID NO: 1040898 - protein, 23 aa, Mycobacterium
AHAVSRWLVTLGHQVAAPLRFQR

SEQ ID NO: 1040899 - protein, 24 aa, Mycobacterium
AHDAATMPVRFVKSIGDAVMLVCP

SEQ ID NO: 1040900 - protein, 24 aa, Mycobacterium
AHDLSSLRLLGSVGEPINPEAWRW

SEQ ID NO: 1040901 - protein, 18 aa, Mycobacterium
AHDRLGPQSGRYHVLAST

SEQ ID NO: 1040902 - protein, 23 aa, Mycobacterium
AHEGSLRFGDKVVLGRDNVINCY

SEQ ID NO: 1040903 - protein, 17 aa, Mycobacterium
AHEPRIALVSNMTGQLA

SEQ ID NO: 1040904 - protein, 28 aa, Mycobacterium
AHGASSKEARSWWGNFLVQKANEAGIGL

SEQ ID NO: 1040905 - protein, 30 aa, Mycobacterium
AHGCASTAWPAAFYALHNWMLALFDERAQS

SEQ ID NO: 1040906 - protein, 17 aa, Mycobacterium
AHGDGLGGSSCCYGFGA

SEQ ID NO: 1040907 - protein, 25 aa, Mycobacterium
AHGIDTVVVGWGYGKADFAAGTHSG

SEQ ID NO: 1040908 - protein, 17 aa, Mycobacterium
AHGLLAARSAPTFDTTV

SEQ ID NO: 1040909 - protein, 18 aa, Mycobacterium
AHGQIHDWVLLTLDGPRY

SEQ ID NO: 1040910 - protein, 17 aa, Mycobacterium
AHHAFLARMHLNLIDQH

SEQ ID NO: 1040911 - protein, 17 aa, Mycobacterium
AHHKLRIFTPGGELAFA

SEQ ID NO: 1040912 - protein, 17 aa, Mycobacterium
AHHNLSLGVANSVVAVE

SEQ ID NO: 1040913 - protein, 21 aa, Mycobacterium
AHHRESFLYTNFEELCDILAR

SEQ ID NO: 1040914 - protein, 19 aa, Mycobacterium
AHIITLRDGHWLHFRDFMN

SEQ ID NO: 1040915 - protein, 24 aa, Mycobacterium
AHIVDVKRALAWVKENIADYGGDP

SEQ ID NO: 1040916 - protein, 17 aa, Mycobacterium
AHLLDRHRPLWETHVIE

SEQ ID NO: 1040917 - protein, 19 aa, Mycobacterium
AHLRKHAPWGARVSVERGD

SEQ ID NO: 1040918 - protein, 17 aa, Mycobacterium
AHLSQWCFVVARTEKGS

SEQ ID NO: 1040919 - protein, 21 aa, Mycobacterium
AHLWRRKLVNAGFTRKRVKDK

SEQ ID NO: 1040920 - protein, 24 aa, Mycobacterium
AHPAGSKAIAGWLSRPQAFTAAEL

SEQ ID NO: 1040921 - protein, 18 aa, Mycobacterium
AHPGRIAISVGDVVGHGL

SEQ ID NO: 1040922 - protein, 18 aa, Mycobacterium
AHQINCRLLFGGYKQSGV

SEQ ID NO: 1040923 - protein, 26 aa, Mycobacterium
AHQIPRAGNMLSVFFSETPVTDFAAA

SEQ ID NO: 1040924 - protein, 17 aa, Mycobacterium
AHRAAMSPRHFTRVFTG

SEQ ID NO: 1040925 - protein, 24 aa, Mycobacterium
AHRARETLQRWECGQDRLALIMHN

SEQ ID NO: 1040926 - protein, 20 aa, Mycobacterium
AHRRGIRVITDLVMNHTSES

SEQ ID NO: 1040927 - protein, 21 aa, Mycobacterium
AHRRIAITGVNEFPNLDESAL

SEQ ID NO: 1040928 - protein, 25 aa, Mycobacterium
AHTGDGIDVLWRKLAELAAPTDTAV

SEQ ID NO: 1040929 - protein, 17 aa, Mycobacterium
AHTGIGFRGWVAAAEGW

SEQ ID NO: 1040930 - protein, 19 aa, Mycobacterium
AHVDLYFEAAVAGAIPVIR

SEQ ID NO: 1040931 - protein, 18 aa, Mycobacterium
AHVLGMFLNTVPLRMRLT

SEQ ID NO: 1040932 - protein, 25 aa, Mycobacterium
AHVVDVKRAIAWVRENIAAYGGNPD

SEQ ID NO: 1040933 - protein, 23 aa, Mycobacterium
AIAAHLPLSLTIALDPDDVSVEF

SEQ ID NO: 1040934 - protein, 19 aa, Mycobacterium
AIAAIGAGCKICDRPSCPQ

SEQ ID NO: 1040935 - protein, 17 aa, Mycobacterium
AIAALEFAFHRVLNQSS

SEQ ID NO: 1040936 - protein, 19 aa, Mycobacterium
AIAASGIPRAQLFVTTKLA

SEQ ID NO: 1040937 - protein, 19 aa, Mycobacterium
AIAELRPADDASLIAIPGI

SEQ ID NO: 1040938 - protein, 18 aa, Mycobacterium
AIAGELYVAPSTVKTHVQ

SEQ ID NO: 1040939 - protein, 26 aa, Mycobacterium
AIALCLGWRLFEPMLRSATGLDELAD

SEQ ID NO: 1040940 - protein, 23 aa, Mycobacterium
AIALRAAEYGRTVVVLTIDPAKR

SEQ ID NO: 1040941 - protein, 27 aa, Mycobacterium
AIATAESWGPLFAEARRATVDAVNARE

SEQ ID NO: 1040942 - protein, 23 aa, Mycobacterium
AIATDGARKCVEEAFKYPGTHWR

SEQ ID NO: 1040943 - protein, 28 aa, Mycobacterium
AIATPRRWDETGSVCASAPVAAVATPPG

SEQ ID NO: 1040944 - protein, 29 aa, Mycobacterium
AICSLPFEHARPTAIMTWMRQHCGIENSL

SEQ ID NO: 1040945 - protein, 30 aa, Mycobacterium; identical to SEQ ID NO: 965597

SEQ ID NO: 1040946 - protein, 23 aa, Mycobacterium
AIDAKSGATLGTYTLSGAKASDW

SEQ ID NO: 1040947 - protein, 19 aa, Mycobacterium
AIDDAFAAFEWAHAHAAEL

SEQ ID NO: 1040948 - protein, 27 aa, Mycobacterium
AIDEFFRFPTSYLIDFDIDPCIDVNTN

SEQ ID NO: 1040949 - protein, 31 aa, Mycobacterium
AIDLELRYRGLRAPHKLKLGVSGCARECAEA

SEQ ID NO: 1040950 - protein, 17 aa, Mycobacterium
AIDLLGVIMSRIDDKPF

SEQ ID NO: 1040951 - protein, 18 aa, Mycobacterium
AIDSGWRQLDVVDETGST

SEQ ID NO: 1040952 - protein, 18 aa, Mycobacterium
AIEAAGGRALPAYCASLR

SEQ ID NO: 1040953 - protein, 24 aa, Mycobacterium
AIEAAWRGAMWAKPAGHGINNPDF

SEQ ID NO: 1040954 - protein, 23 aa, Mycobacterium
AIEAEMLYALAILEASEGEYKTD

SEQ ID NO: 1040955 - protein, 23 aa, Mycobacterium
AIEEMLRWTAPVKNMCRMLTADT

SEQ ID NO: 1040956 - protein, 17 aa, Mycobacterium
AIELLRQVGPMAVSSAN

SEQ ID NO: 1040957 - protein, 17 aa, Mycobacterium
AIELSALGALRVIAGFT

SEQ ID NO: 1040958 - protein, 18 aa, Mycobacterium
AIEPFNYRLSWLGRNVAR

SEQ ID NO: 1040959 - protein, 23 aa, Mycobacterium
AIEPTTRIEFFFRDTYQCGNEEA

SEQ ID NO: 1040960 - protein, 17 aa, Mycobacterium
AIGRPRVPVEVNHEPFV

SEQ ID NO: 1040961 - protein, 25 aa, Mycobacterium
AIGVAARLRMTCVATGAAGTTIPAG

SEQ ID NO: 1040962 - protein, 23 aa, Mycobacterium
AIHRFPGSMAKRVQTLAQIVVDR

SEQ ID NO: 1040963 - protein, 27 aa, Mycobacterium
AIKDAEWWRLGLAEEIGGMPAPPPLTW

SEQ ID NO: 1040964 - protein, 18 aa, Mycobacterium
AILADWGADVIKIEPPAG

SEQ ID NO: 1040965 - protein, 23 aa, Mycobacterium
AILAGEVHFAIGYTEPEAGTDLA

SEQ ID NO: 1040966 - protein, 19 aa, Mycobacterium
AILIDCLTFTIATGQEESR

SEQ ID NO: 1040967 - protein, 20 aa, Mycobacterium
AILIDCLTFTIATGQEESRK

SEQ ID NO: 1040968 - protein, 23 aa, Mycobacterium
AILNRPDLVILRGRTYRPNQLGH

SEQ ID NO: 1040969 - protein, 24 aa, Mycobacterium
AILTARHLDCWVLGTVCKGGKEGP

SEQ ID NO: 1040970 - protein, 25 aa, Mycobacterium
AILTGWRMLLDAGRLQDGEPHLSGT

SEQ ID NO: 1040971 - protein, 17 aa, Mycobacterium
AINGARMVEFDGMGHDL

SEQ ID NO: 1040972 - protein, 24 aa, Mycobacterium
AINLTRPGGVVFYATCSPHLAETV

SEQ ID NO: 1040973 - protein, 21 aa, Mycobacterium
AIPDARFVVVDGMGHDLPQPV

SEQ ID NO: 1040974 - protein, 17 aa, Mycobacterium
AIPDPNCHADLRIADRK

SEQ ID NO: 1040975 - protein, 23 aa, Mycobacterium
AIPLPPDDNGYVFIETKSGQTRC

SEQ ID NO: 1040976 - protein, 17 aa, Mycobacterium
AIPTRYGSAARRAQVRG

SEQ ID NO: 1040977 - protein, 23 aa, Mycobacterium
AIQESLNSLGPIFSELRDAGRDL

SEQ ID NO: 1040978 - protein, 24 aa, Mycobacterium
AIQRSREVWLMVSGGTKAEAVAAA

SEQ ID NO: 1040979 - protein, 24 aa, Mycobacterium
AIQVCAALDQILHLSVEHVSSRVQ

SEQ ID NO: 1040980 - protein, 20 aa, Mycobacterium
AIRADFPILQRVMRSGNQLA

SEQ ID NO: 1040981 - protein, 27 aa, Mycobacterium
AIRERRARRPAWRPAASIRSHSVHGHA

SEQ ID NO: 1040982 - protein, 18 aa, Mycobacterium
AIRLWRNAWNEFIPFLDY

SEQ ID NO: 1040983 - protein, 25 aa, Mycobacterium
AIRLWRTAWNEFIPFLDYDTEIRKV

SEQ ID NO: 1040984 - protein, 19 aa, Mycobacterium
AIRRKGRGIAYTRTAFAYL

SEQ ID NO: 1040985 - protein, 22 aa, Mycobacterium
AIRRYRLAGPREVVHLALRTLL

SEQ ID NO: 1040986 - protein, 24 aa, Mycobacterium
AISAALMLIWACDLIVAADNAKFS

SEQ ID NO: 1040987 - protein, 30 aa, Mycobacterium; identical to SEQ ID NO: 620243

SEQ ID NO: 1040988 - protein, 18 aa, Mycobacterium
AISKVIWSEYFQRYTELA

SEQ ID NO: 1040989 - protein, 26 aa, Mycobacterium
AISPIARPREVHVVPELPKTRSGKIM

SEQ ID NO: 1040990 - protein, 27 aa, Mycobacterium
AISYARSRGLPVFGLCLGLQCIVIEAA

SEQ ID NO: 1040991 - protein, 28 aa, Mycobacterium
AITDELWDLLPGYLIFRSIIPNRPPTPH

SEQ ID NO: 1040992 - protein, 26 aa, Mycobacterium
AITPWNFPLLLTLWKVGPAIAAGNSV

SEQ ID NO: 1040993 - protein, 18 aa, Mycobacterium
AIVAMFNQFCYVQLSGSR

SEQ ID NO: 1040994 - protein, 17 aa, Mycobacterium
AIVEFPPAGTLTGIAKR

SEQ ID NO: 1040995 - protein, 25 aa, Mycobacterium
AIVKGLRTGTDFEYELQMAQMNKHI

SEQ ID NO: 1040996 - protein, 17 aa, Mycobacterium
AIVPWNVPQFLIMPKLI

SEQ ID NO: 1040997 - protein, 17 aa, Mycobacterium
AIVSPVIINANRALTAL

SEQ ID NO: 1040998 - protein, 18 aa, Mycobacterium
AIYPRQSPGGWQLIGHTN

SEQ ID NO: 1040999 - protein, 21 aa, Mycobacterium
AKAAAALAKKWLGLRYTMNVI

SEQ ID NO: 1041000 - protein, 17 aa, Mycobacterium
AKAAGLLDHAQRVAEGR

SEQ ID NO: 1041001 - protein, 18 aa, Mycobacterium
AKAALRLADIDLIELNEA

SEQ ID NO: 1041002 - protein, 18 aa, Mycobacterium
AKAALRYTDTLIWTPARL

SEQ ID NO: 1041003 - protein, 19 aa, Mycobacterium
AKADARRKVRDSGEREMRQ

SEQ ID NO: 1041004 - protein, 18 aa, Mycobacterium
AKAFRPSSLVNISGMSYG

SEQ ID NO: 1041005 - protein, 17 aa, Mycobacterium
AKAIARLGLSYPEVAAI

SEQ ID NO: 1041006 - protein, 21 aa, Mycobacterium
AKALRSGGVVIVFPGGDYDAY

SEQ ID NO: 1041007 - protein, 22 aa, Mycobacterium
AKARSANILARIMGASITSDGF

SEQ ID NO: 1041008 - protein, 30 aa, Mycobacterium; identical to SEQ ID NO: 632816

SEQ ID NO: 1041009 - protein, 26 aa, Mycobacterium
AKDRGCTRPGCDVAGYQCEVHHVAAW

SEQ ID NO: 1041010 - protein, 23 aa, Mycobacterium
AKESRGVHALRARGALIRIGHDA

SEQ ID NO: 1041011 - protein, 17 aa, Mycobacterium
AKFAREHLGSLDGVPSV

SEQ ID NO: 1041012 - protein, 20 aa, Mycobacterium
AKFGMTLCALGIAEEMRDEG

SEQ ID NO: 1041013 - protein, 26 aa, Mycobacterium
AKFKSEPWARLGVNVDADFEPLYIIT

SEQ ID NO: 1041014 - protein, 20 aa, Mycobacterium
AKFVAVAGIGLLSPGDIGQL

SEQ ID NO: 1041015 - protein, 26 aa, Mycobacterium
AKGHDTFCPVGPWIVTDVDPAGLELR

SEQ ID NO: 1041016 - protein, 23 aa, Mycobacterium
AKGLEFPVVFVTGWEDGMFPHMR

SEQ ID NO: 1041017 - protein, 20 aa, Mycobacterium
AKGVPVEMIRHSNLDMLEDK

SEQ ID NO: 1041018 - protein, 18 aa, Mycobacterium
AKIAFLMLPGVGTKEDIK

SEQ ID NO: 1041019 - protein, 22 aa, Mycobacterium
AKIKGALDALSRALRLSSDGGA

SEQ ID NO: 1041020 - protein, 18 aa, Mycobacterium
AKISLPKIHARVKELAAA

SEQ ID NO: 1041021 - protein, 18 aa, Mycobacterium
AKKCGVVNWMRLADKLQP

SEQ ID NO: 1041022 - protein, 24 aa, Mycobacterium
AKKHPDCLEYILVHEMTHYLERNH

SEQ ID NO: 1041023 - protein, 17 aa, Mycobacterium
AKLAVKINDLLLPVVKG

SEQ ID NO: 1041024 - protein, 17 aa, Mycobacterium
AKLEGGEAFTAEEQPAE

SEQ ID NO: 1041025 - protein, 21 aa, Mycobacterium
AKLERELHVTLINRGHSFEGL

SEQ ID NO: 1041026 - protein, 17 aa, Mycobacterium
AKLGGPVDHDEWFMTPQ

SEQ ID NO: 1041027 - protein, 19 aa, Mycobacterium
AKLGKSVAIIERGRMLGGV

SEQ ID NO: 1041028 - protein, 20 aa, Mycobacterium
AKLGLPGGVLLPGVAPGTGI

SEQ ID NO: 1041029 - protein, 18 aa, Mycobacterium
AKLILGREATIVAGGADR

SEQ ID NO: 1041030 - protein, 19 aa, Mycobacterium
AKLKASGHDIEYQITHHTY

SEQ ID NO: 1041031 - protein, 20 aa, Mycobacterium
AKLPTIAAYAYKKSVGQPFL

SEQ ID NO: 1041032 - protein, 17 aa, Mycobacterium
AKLPWSEWLPQQRWYAG

SEQ ID NO: 1041033 - protein, 25 aa, Mycobacterium
AKLQKRLQEELAWVRSGAKARQAKS

SEQ ID NO: 1041034 - protein, 17 aa, Mycobacterium
AKLTEWLKLALDEPHLL

SEQ ID NO: 1041035 - protein, 21 aa, Mycobacterium
AKPGDLALLIGYGAGLSYAAQ

SEQ ID NO: 1041036 - protein, 17 aa, Mycobacterium
AKPGVSNLLSIQSAVSG

SEQ ID NO: 1041037 - protein, 25 aa, Mycobacterium
AKPGYSRYHLIIGFESGNPNLGRRR

SEQ ID NO: 1041038 - protein, 24 aa, Mycobacterium
AKPHLAVAAGRVGALAGLTPEHLA

SEQ ID NO: 1041039 - protein, 23 aa, Mycobacterium
AKPKLPGIAGIASFGGKTFHTSR

SEQ ID NO: 1041040 - protein, 18 aa, Mycobacterium
AKPLLGKPTAWLFGSEPH

SEQ ID NO: 1041041 - protein, 20 aa, Mycobacterium
AKPRLVAYVVTSTGEQLPIN

SEQ ID NO: 1041042 - protein, 18 aa, Mycobacterium
AKQLISIHHADPARIDVV

SEQ ID NO: 1041043 - protein, 17 aa, Mycobacterium
AKQTCIIDDEIYDEMIA

SEQ ID NO: 1041044 - protein, 25 aa, Mycobacterium
AKQVRLPGFRPGRAPVKLLEARFGR

SEQ ID NO: 1041045 - protein, 22 aa, Mycobacterium
AKQWPGVPVRVIPAMTAAQAVA

SEQ ID NO: 1041046 - protein, 18 aa, Mycobacterium
AKRRFAKKDGDGLLDPSC

SEQ ID NO: 1041047 - protein, 22 aa, Mycobacterium
AKRTLAVAVYNHYKRIQAGEKS

SEQ ID NO: 1041048 - protein, 20 aa, Mycobacterium
AKSWDIDMPNQFEAAERIAK

SEQ ID NO: 1041049 - protein, 20 aa, Mycobacterium
AKTAPVECRFIFSETTTFGP

SEQ ID NO: 1041050 - protein, 24 aa, Mycobacterium
AKTGKLRPALFVVPTDTPGFTYTA

SEQ ID NO: 1041051 - protein, 18 aa, Mycobacterium
AKTIAMEIGRPVMVKAQV

SEQ ID NO: 1041052 - protein, 20 aa, Mycobacterium
AKTIFWNGPMGVFEFPAYAT

SEQ ID NO: 1041053 - protein, 21 aa, Mycobacterium
AKTIKGYSLGAHFQGRNATHQ

SEQ ID NO: 1041054 - protein, 18 aa, Mycobacterium
AKVDAAWNLHELTRDLDL

SEQ ID NO: 1041055 - protein, 18 aa, Mycobacterium
AKVDAAWNLHELTRDMDL

SEQ ID NO: 1041056 - protein, 25 aa, Mycobacterium
AKVGRPDIMIVVGGVIPPGDFDELY

SEQ ID NO: 1041057 - protein, 18 aa, Mycobacterium
AKVSLPVALVVDGAAVTS

SEQ ID NO: 1041058 - protein, 19 aa, Mycobacterium
AKVSSNCRIHHGVTIGEGR

SEQ ID NO: 1041059 - protein, 25 aa, Mycobacterium
AKVVAERRLWLAVLRAQRELGAKGT

SEQ ID NO: 1041060 - protein, 29 aa, Mycobacterium
AKYAMVLLLRRVWTATLGLAGRVATLEDS

SEQ ID NO: 1041061 - protein, 21 aa, Mycobacterium
AKYPDRLTVVHWLESLQGLPS

SEQ ID NO: 1041062 - protein, 18 aa, Mycobacterium
AKYPMYRIIRQQLTEAAV

SEQ ID NO: 1041063 - protein, 25 aa, Mycobacterium
ALAAELRLPLVLVIDTAGPALSADA

SEQ ID NO: 1041064 - protein, 18 aa, Mycobacterium
ALAAGSSARWASRVTGRG

SEQ ID NO: 1041065 - protein, 19 aa, Mycobacterium
ALAALRKGDIITITHGRRG

SEQ ID NO: 1041066 - protein, 18 aa, Mycobacterium
ALAASGIPRAELFVTTKV

SEQ ID NO: 1041067 - protein, 19 aa, Mycobacterium
ALAAVEAFFGAGAQRQLDV

SEQ ID NO: 1041068 - protein, 22 aa, Mycobacterium
ALAEQCRRLDALGIGYEIVPGV

SEQ ID NO: 1041069 - protein, 23 aa, Mycobacterium
ALAERSAELGIRVLRYGSAGHAG

SEQ ID NO: 1041070 - protein, 18 aa, Mycobacterium
ALAERWAQRQFPHDLWCD

SEQ ID NO: 1041071 - protein, 19 aa, Mycobacterium
ALAHLGGHPVAVVANQPRV

SEQ ID NO: 1041072 - protein, 27 aa, Mycobacterium
ALALSRECWRSVGGMDLRTFGRYGWGV

SEQ ID NO: 1041073 - protein, 21 aa, Mycobacterium
ALAPHRLRRLVGRITTRLDAT

SEQ ID NO: 1041074 - protein, 19 aa, Mycobacterium
ALAQCLRAGTPDEVAKLVL

SEQ ID NO: 1041075 - protein, 18 aa, Mycobacterium
ALAQIGFRLAADDDQFMT

SEQ ID NO: 1041076 - protein, 18 aa, Mycobacterium
ALARAGFHTLNLQTYLTV

SEQ ID NO: 1041077 - protein, 18 aa, Mycobacterium
ALARLGMFAPALSYLEEP

SEQ ID NO: 1041078 - protein, 21 aa, Mycobacterium
ALARRGCVYVSVNYRLGALGC

SEQ ID NO: 1041079 - protein, 17 aa, Mycobacterium
ALARVLRSLNQRSRPSF

SEQ ID NO: 1041080 - protein, 23 aa, Mycobacterium
ALCADIGAAFARLMRGEGARQVV

SEQ ID NO: 1041081 - protein, 21 aa, Mycobacterium
ALCSPTRQALLTGRGRNHHSV

SEQ ID NO: 1041082 - protein, 30 aa, Mycobacterium; identical to SEQ ID NO: 633426

SEQ ID NO: 1041083 - protein, 23 aa, Mycobacterium
ALDALPPRQRRLVILRDLLGISA

SEQ ID NO: 1041084 - protein, 19 aa, Mycobacterium
ALDDYRRVLAAGVNIVGSG

SEQ ID NO: 1041085 - protein, 17 aa, Mycobacterium
ALDHPLLVEHPQPKRAG

SEQ ID NO: 1041086 - protein, 21 aa, Mycobacterium
ALDKLAKWSMPLLKREGRMLA

SEQ ID NO: 1041087 - protein, 23 aa, Mycobacterium
ALDKLHLEPGMTLLDVGCGWGGA

SEQ ID NO: 1041088 - protein, 23 aa, Mycobacterium
ALDKLRIEAFRNKDLEVDTSDLH

SEQ ID NO: 1041089 - protein, 18 aa, Mycobacterium
ALDLGRPPWEMHFIEGLE

SEQ ID NO: 1041090 - protein, 22 aa, Mycobacterium
ALDPRLVDAVIFGSADMAADLG

SEQ ID NO: 1041091 - protein, 24 aa, Mycobacterium
ALDSFTLRVGRPIGPMLAQSAGSI

SEQ ID NO: 1041092 - protein, 19 aa, Mycobacterium
ALDSSQLVPADWDRIRAAL

SEQ ID NO: 1041093 - protein, 18 aa, Mycobacterium
ALDTRWSPESGSLLDEWS

SEQ ID NO: 1041094 - protein, 22 aa, Mycobacterium
ALDVASTKLVWCDSDATVDQVA

SEQ ID NO: 1041095 - protein, 26 aa, Mycobacterium
ALDVYRVGQNVAWQRWTDIVFGLTTD

SEQ ID NO: 1041096 - protein, 24 aa, Mycobacterium
ALEDGFRVFAELSPHPLLTHAVDQ

SEQ ID NO: 1041097 - protein, 25 aa, Mycobacterium
ALEDILKRFPEWDVDLGNAKLSPTS

SEQ ID NO: 1041098 - protein, 17 aa, Mycobacterium
ALEEAWETAGLRGGGRV

SEQ ID NO: 1041099 - protein, 19 aa, Mycobacterium
ALEEGVRATFMPKPFGQHA

SEQ ID NO: 1041100 - protein, 17 aa, Mycobacterium
ALEEIRKILTDAGIDID

SEQ ID NO: 1041101 - protein, 19 aa, Mycobacterium
ALEELEWCLQRGARTVLVR

SEQ ID NO: 1041102 - protein, 18 aa, Mycobacterium
ALEERGFESLFLAEHTHI

SEQ ID NO: 1041103 - protein, 26 aa, Mycobacterium
ALELLPTVRGAFCLTFMDENTLYACR

SEQ ID NO: 1041104 - protein, 18 aa, Mycobacterium
ALEPIGLMRRIGLGETLR

SEQ ID NO: 1041105 - protein, 21 aa, Mycobacterium
ALERIGSLVPLGRPGDVDEIA

SEQ ID NO: 1041106 - protein, 18 aa, Mycobacterium
ALEVREGPAAMPWGDLGV

SEQ ID NO: 1041107 - protein, 20 aa, Mycobacterium
ALEVSGRLVLAASSRRSAWW

SEQ ID NO: 1041108 - protein, 21 aa, Mycobacterium
ALFGCAHYEAIFAGYQQLRPL

SEQ ID NO: 1041109 - protein, 19 aa, Mycobacterium
ALFGHSMGGMLAFEVALRF

SEQ ID NO: 1041110 - protein, 19 aa, Mycobacterium
ALFNGRWIKLDATIDAPTA

SEQ ID NO: 1041111 - protein, 19 aa, Mycobacterium
ALFQTGGTVLTNFGSALPE

SEQ ID NO: 1041112 - protein, 26 aa, Mycobacterium
ALFRSWKLHRELGLNIVMPVLPMHGP

SEQ ID NO: 1041113 - protein, 17 aa, Mycobacterium
ALGAKFVAARPAVQLHW

SEQ ID NO: 1041114 - protein, 24 aa, Mycobacterium
ALGALRVIAGFTRALAETNGSIVN

SEQ ID NO: 1041115 - protein, 18 aa, Mycobacterium
ALGGSGWTVPEEAAPVSG

SEQ ID NO: 1041116 - protein, 20 aa, Mycobacterium
ALGNARRALVESLCYARQRR

SEQ ID NO: 1041117 - protein, 23 aa, Mycobacterium
ALGNLPLIYPFLVNDPGEGIQAK

SEQ ID NO: 1041118 - protein, 19 aa, Mycobacterium
ALGPLMSGMFGDFAAADAF

SEQ ID NO: 1041119 - protein, 19 aa, Mycobacterium
ALGPNRYESLAALDDSKKL

SEQ ID NO: 1041120 - protein, 19 aa, Mycobacterium
ALGPRMLRLAAQRSAGAHP

SEQ ID NO: 1041121 - protein, 20 aa, Mycobacterium
ALGQALPGVEGFRRAHRQAR

SEQ ID NO: 1041122 - protein, 30 aa, Mycobacterium
ALGRDTRAAIKITTIFGSRYIDLHPTGAGV

SEQ ID NO: 1041123 - protein, 22 aa, Mycobacterium
ALGRHFPFDPSQGVIPEPAPVD

SEQ ID NO: 1041124 - protein, 19 aa, Mycobacterium
ALGVLPVLATDVLRQLRMV

SEQ ID NO: 1041125 - protein, 17 aa, Mycobacterium
ALHALFIAIERCGAVVV

SEQ ID NO: 1041126 - protein, 19 aa, Mycobacterium
ALHAWTDMGPLDFPSINWA

SEQ ID NO: 1041127 - protein, 19 aa, Mycobacterium
ALHGARYSGWQGLIDTQRS

SEQ ID NO: 1041128 - protein, 19 aa, Mycobacterium
ALHGAWGVRVHDVRASVDA

SEQ ID NO: 1041129 - protein, 18 aa, Mycobacterium
ALHIAAVVRLRYDPRSRA

SEQ ID NO: 1041130 - protein, 23 aa, Mycobacterium
ALHRDHVLVLAGLDLAATVEDEP

SEQ ID NO: 1041131 - protein, 24 aa, Mycobacterium
ALHRRCADVRYLGSWPTGQTYAAQ

SEQ ID NO: 1041132 - protein, 18 aa, Mycobacterium
ALHRVGVSVWERYTGPYT

SEQ ID NO: 1041133 - protein, 19 aa, Mycobacterium
ALHSIIIIKKWNAIDRVLP

SEQ ID NO: 1041134 - protein, 19 aa, Mycobacterium
ALIKAREAFSATGLPSVAD

SEQ ID NO: 1041135 - protein, 24 aa, Mycobacterium
ALINRYVTVCGMTGTALAAGEQLR

SEQ ID NO: 1041136 - protein, 18 aa, Mycobacterium
ALIQRANARLVVFPELSL

SEQ ID NO: 1041137 - protein, 26 aa, Mycobacterium
ALIRMARPVASPALDVYGLMSPQADR

SEQ ID NO: 1041138 - protein, 23 aa, Mycobacterium
ALKECLPYYVDLFRQMKSEVKAG

SEQ ID NO: 1041139 - protein, 20 aa, Mycobacterium
ALKPRKAFGPIRVAATGTTV

SEQ ID NO: 1041140 - protein, 18 aa, Mycobacterium
ALKSLRADRFPRIEFSAD

SEQ ID NO: 1041141 - protein, 19 aa, Mycobacterium
ALLADRGRHAEALGHCSAL

SEQ ID NO: 1041142 - protein, 18 aa, Mycobacterium
ALLAELGLSGLQRSTTGA

SEQ ID NO: 1041143 - protein, 19 aa, Mycobacterium
ALLAIGFEWGIALRHLEAR

SEQ ID NO: 1041144 - protein, 19 aa, Mycobacterium
ALLAPAWVPWEQRVRPGDL

SEQ ID NO: 1041145 - protein, 22 aa, Mycobacterium
ALLDERIEAIKALWTDEPAEYH

SEQ ID NO: 1041146 - protein, 18 aa, Mycobacterium
ALLDGGAKVVVAAHLGRP

SEQ ID NO: 1041147 - protein, 32 aa, Mycobacterium; identical to SEQ ID NO: 196639

SEQ ID NO: 1041148 - protein, 24 aa, Mycobacterium
ALLGEPGQGFLILQTRLAGGRLHH

SEQ ID NO: 1041149 - protein, 19 aa, Mycobacterium
ALLGRPLIGNGADGAPGAD

SEQ ID NO: 1041150 - protein, 23 aa, Mycobacterium
ALLHPRLVRAIALISSPHPAALR

SEQ ID NO: 1041151 - protein, 18 aa, Mycobacterium
ALLISRLVSWVDDLWCRA

SEQ ID NO: 1041152 - protein, 18 aa, Mycobacterium
ALLLGAFDLGGLGYLVEE

SEQ ID NO: 1041153 - protein, 21 aa, Mycobacterium
ALLLNRISLAPGEAIFLPAGN

SEQ ID NO: 1041154 - protein, 26 aa, Mycobacterium
ALLPGYRLKHRVQFERLGSGNTLYIP

SEQ ID NO: 1041155 - protein, 21 aa, Mycobacterium
ALLPSLFRGAALSDLPTSEAL

SEQ ID NO: 1041156 - protein, 21 aa, Mycobacterium
ALLRKAPWVDVVFGTHNIGSL

SEQ ID NO: 1041157 - protein, 19 aa, Mycobacterium
ALLTLLPDNLRWLVTVDAM

SEQ ID NO: 1041158 - protein, 20 aa, Mycobacterium
ALLVAGWRALDTVGPQPLAP

SEQ ID NO: 1041159 - protein, 21 aa, Mycobacterium
ALLVAGWRALHAVGPQPLVRD

SEQ ID NO: 1041160 - protein, 19 aa, Mycobacterium
ALLVNRIALVYSELSSGAP

SEQ ID NO: 1041161 - protein, 19 aa, Mycobacterium
ALLYKLAQVTARFADVERI

SEQ ID NO: 1041162 - protein, 21 aa, Mycobacterium
ALMDHCLSVLLQAWGDDPFEY

SEQ ID NO: 1041163 - protein, 25 aa, Mycobacterium
ALNLYRANMPAGFVTDGSSLPQTSV

SEQ ID NO: 1041164 - protein, 27 aa, Mycobacterium
ALNMPAEGLLGRPLIGDGTDGAPGTGQ

SEQ ID NO: 1041165 - protein, 21 aa, Mycobacterium
ALNNTRFWAPLSLSAEQKRSI

SEQ ID NO: 1041166 - protein, 26 aa, Mycobacterium
ALNPPRNRPAPLMLRGPDQQEPAGPI

SEQ ID NO: 1041167 - protein, 18 aa, Mycobacterium
ALNPVGAVQWLRKNARVE

SEQ ID NO: 1041168 - protein, 21 aa, Mycobacterium
ALPAPRAVAIVSQVAEALDAA

SEQ ID NO: 1041169 - protein, 19 aa, Mycobacterium
ALPDRKRRHSLLPLLQNYR

SEQ ID NO: 1041170 - protein, 17 aa, Mycobacterium
ALPDRQRHSSLLPLLHN

SEQ ID NO: 1041171 - protein, 18 aa, Mycobacterium
ALPDWQIIARIACEMGFS

SEQ ID NO: 1041172 - protein, 24 aa, Mycobacterium
ALPEEFRMAVYYADVEGFPYKEIA

SEQ ID NO: 1041173 - protein, 17 aa, Mycobacterium
ALPEYAKDLKLNLGSIS

SEQ ID NO: 1041174 - protein, 20 aa, Mycobacterium
ALPGEVADRFAGYFDAELRN

SEQ ID NO: 1041175 - protein, 21 aa, Mycobacterium
ALPPAIVVAAEFDPLRDEGIE

SEQ ID NO: 1041176 - protein, 23 aa, Mycobacterium
ALPPEVHSALLYAGPGPGPIVGS

SEQ ID NO: 1041177 - protein, 21 aa, Mycobacterium
ALPSPMALTAIELENGSEVVG

SEQ ID NO: 1041178 - protein, 24 aa, Mycobacterium
ALQCGYCTPGQIMSGVACIAEGHA

SEQ ID NO: 1041179 - protein, 17 aa, Mycobacterium
ALQELEPACAALAAQRP

SEQ ID NO: 1041180 - protein, 21 aa, Mycobacterium
ALQELTWLAVHQKTGVRSRLM

SEQ ID NO: 1041181 - protein, 18 aa, Mycobacterium
ALQIREFTAAPVLEEALT

SEQ ID NO: 1041182 - protein, 18 aa, Mycobacterium
ALQKHWNAAMEVLGEYSL

SEQ ID NO: 1041183 - protein, 23 aa, Mycobacterium
ALQKLATHCPVAILSGRDLADVI

SEQ ID NO: 1041184 - protein, 18 aa, Mycobacterium
ALQRLELEALPRQGTGKG

SEQ ID NO: 1041185 - protein, 19 aa, Mycobacterium
ALQTTEVWEPTIPANTPAA

SEQ ID NO: 1041186 - protein, 27 aa, Mycobacterium
ALQVCPVPPPRELDMLLTAGERISNAL

SEQ ID NO: 1041187 - protein, 23 aa, Mycobacterium
ALQYWHVLGLWKLAIIAEGVMRR

SEQ ID NO: 1041188 - protein, 27 aa, Mycobacterium
ALRDGRASWYRNRWVRSMPVCAALGES

SEQ ID NO: 1041189 - protein, 23 aa, Mycobacterium
ALREAGLEWRQIQLVAGADTIRN

SEQ ID NO: 1041190 - protein, 19 aa, Mycobacterium
ALRGHSVVVCIDDEAGRAM

SEQ ID NO: 1041191 - protein, 19 aa, Mycobacterium
ALRGPFWRWSPGLRAGIKL

SEQ ID NO: 1041192 - protein, 20 aa, Mycobacterium
ALRHDARFIVMVPGPVTTEV

SEQ ID NO: 1041193 - protein, 19 aa, Mycobacterium
ALRIIRTANELGIATVAVY

SEQ ID NO: 1041194 - protein, 21 aa, Mycobacterium
ALRLPRDAELIVDGRNVVEDV

SEQ ID NO: 1041195 - protein, 19 aa, Mycobacterium
ALRMIMCYRAAYAGEDPER

SEQ ID NO: 1041196 - protein, 22 aa, Mycobacterium
ALRRPCGRIHWAGTEISAKMCG

SEQ ID NO: 1041197 - protein, 19 aa, Mycobacterium
ALRWLKQLHGRVVVIKYGG

SEQ ID NO: 1041198 - protein, 24 aa, Mycobacterium
ALRWPRVPITLLAGVVAVDYQPRL

SEQ ID NO: 1041199 - protein, 23 aa, Mycobacterium
ALRYPEQIAGIAYMDAPVQPRTW

SEQ ID NO: 1041200 - protein, 20 aa, Mycobacterium
ALSAARRGRAQPGRDDKVVT

SEQ ID NO: 1041201 - protein, 24 aa, Mycobacterium
ALSALSAGVSPEFVLVHDAARALT

SEQ ID NO: 1041202 - protein, 24 aa, Mycobacterium
ALSDVPAELAALVGGDDDRGTEVV

SEQ ID NO: 1041203 - protein, 21 aa, Mycobacterium
ALSEFLGRLVLLPTTPAAAAG

SEQ ID NO: 1041204 - protein, 25 aa, Mycobacterium
ALSELPLLLLDEGHCLRDQALDVCQ

SEQ ID NO: 1041205 - protein, 19 aa, Mycobacterium
ALSGEEWFGPASAMMLEAI

SEQ ID NO: 1041206 - protein, 24 aa, Mycobacterium
ALSLSRLSSVVLRSNLAARTLHVL

SEQ ID NO: 1041207 - protein, 20 aa, Mycobacterium
ALSNFSAWVTGLRRVEAPTR

SEQ ID NO: 1041208 - protein, 18 aa, Mycobacterium
ALSPDIEAAVLVPAKTLG

SEQ ID NO: 1041209 - protein, 25 aa, Mycobacterium
ALSPYRFPTGWFIVAFSSELGAGEV

SEQ ID NO: 1041210 - protein, 24 aa, Mycobacterium
ALSQARFEFRWNDQFALSLDPDTA

SEQ ID NO: 1041211 - protein, 24 aa, Mycobacterium
ALSRPRPAAPMLLADSRASARRID

SEQ ID NO: 1041212 - protein, 33 aa, Mycobacterium
ALSSRVVPIAGLRHTESEWARVLAKQAELQADL

SEQ ID NO: 1041213 - protein, 27 aa, Mycobacterium
ALSSTPAGAVWRIGDDVTHRELGHGWV

SEQ ID NO: 1041214 - protein, 19 aa, Mycobacterium
ALSTLRDIYGATLGYQVDT

SEQ ID NO: 1041215 - protein, 19 aa, Mycobacterium
ALTAARFSAHAQLYQMVSA

SEQ ID NO: 1041216 - protein, 29 aa, Mycobacterium
ALTAEAGRAPGARCAGSGTGRAAGSTLAA

SEQ ID NO: 1041217 - protein, 18 aa, Mycobacterium
ALTAPAPHHTRPVRFVWL

SEQ ID NO: 1041218 - protein, 19 aa, Mycobacterium
ALTDLKLRALAWGDTTVRI

SEQ ID NO: 1041219 - protein, 24 aa, Mycobacterium
ALTFLRGPQTWVLKRPQHCEQLGP

SEQ ID NO: 1041220 - protein, 18 aa, Mycobacterium
ALTGCIRSVWPAATAGGS

SEQ ID NO: 1041221 - protein, 20 aa, Mycobacterium
ALTGGMCWEALNNIAASHRP

SEQ ID NO: 1041222 - protein, 20 aa, Mycobacterium
ALTGGMFDKGFWVAPTILTG

SEQ ID NO: 1041223 - protein, 18 aa, Mycobacterium
ALTGRPVIGNGADGAAGT

SEQ ID NO: 1041224 - protein, 19 aa, Mycobacterium
ALTIGSLIREANRLAEFAT

SEQ ID NO: 1041225 - protein, 17 aa, Mycobacterium
ALTLPSMSLPAITTPAN

SEQ ID NO: 1041226 - protein, 22 aa, Mycobacterium
ALTLRLVSGVGLRRDRSALLQT

SEQ ID NO: 1041227 - protein, 18 aa, Mycobacterium
ALTPWIFGSSKGRSAQVA

SEQ ID NO: 1041228 - protein, 20 aa, Mycobacterium
ALTQPRLWLLGSSMYSARLA

SEQ ID NO: 1041229 - protein, 17 aa, Mycobacterium
ALTVERGMAVWMAADDG

SEQ ID NO: 1041230 - protein, 19 aa, Mycobacterium
ALVATNFFGLNTIPITLNE

SEQ ID NO: 1041231 - protein, 27 aa, Mycobacterium
ALVCDAARRSAIAWRAYRDGSGVDSAI

SEQ ID NO: 1041232 - protein, 17 aa, Mycobacterium
ALVERFGAKAAKPIDYF

SEQ ID NO: 1041233 - protein, 23 aa, Mycobacterium
ALVKRLGPRGVLVVVEAEHLCMA

SEQ ID NO: 1041234 - protein, 26 aa, Mycobacterium
ALVNSWSAAFARYGRTVGQVLLTAHD

SEQ ID NO: 1041235 - protein, 21 aa, Mycobacterium
ALVPGRPAPRLVTAAAVEAMK

SEQ ID NO: 1041236 - protein, 23 aa, Mycobacterium
ALVPMTIDIVGRVAKVFAAAQEV

SEQ ID NO: 1041237 - protein, 23 aa, Mycobacterium
ALVPRAHGSALFERGETQILGVT

SEQ ID NO: 1041238 - protein, 22 aa, Mycobacterium
ALVPRSTALVVWQRAGPAEPAF

SEQ ID NO: 1041239 - protein, 19 aa, Mycobacterium
ALVRAIRPTTVVEFGMSFG

SEQ ID NO: 1041240 - protein, 18 aa, Mycobacterium
ALVREPDPELGLRYPDPT

SEQ ID NO: 1041241 - protein, 19 aa, Mycobacterium
ALVRLGLAVIRGLLLDLVA

SEQ ID NO: 1041242 - protein, 22 aa, Mycobacterium
ALVRLRCELGLPELSPAHRLDR

SEQ ID NO: 1041243 - protein, 19 aa, Mycobacterium
ALWALSFGVLAWRHNNLTY

SEQ ID NO: 1041244 - protein, 19 aa, Mycobacterium
ALWCAVELGIGVLHVPGFR

SEQ ID NO: 1041245 - protein, 17 aa, Mycobacterium
ALWGREAYARGLFGNHV

SEQ ID NO: 1041246 - protein, 21 aa, Mycobacterium
ALWQFLCDRKSSIGRVPDERW

SEQ ID NO: 1041247 - protein, 19 aa, Mycobacterium
ALWRRFKAAQDAFFTARNA

SEQ ID NO: 1041248 - protein, 23 aa, Mycobacterium
ALWTALKTLYPVGIKTDTLMRRD

SEQ ID NO: 1041249 - protein, 28 aa, Mycobacterium
ALYMDRYPLVSAISRPLIVKHLVEAARE

SEQ ID NO: 1041250 - protein, 18 aa, Mycobacterium
ALYRAGGAIDVLAAPPRP

SEQ ID NO: 1041251 - protein, 18 aa, Mycobacterium
ALYRASQVGVRIEVVVRG

SEQ ID NO: 1041252 - protein, 18 aa, Mycobacterium
ALYRRGLQAGRKFLQSWN

SEQ ID NO: 1041253 - protein, 19 aa, Mycobacterium
ALYWIGRYVERADDTARIL

SEQ ID NO: 1041254 - protein, 23 aa, Mycobacterium
AMADNSAALTFPFSAEPFPTEPF

SEQ ID NO: 1041255 - protein, 26 aa, Mycobacterium
AMAKRLLDWPGGLVVYDVRAEAMTPL

SEQ ID NO: 1041256 - protein, 23 aa, Mycobacterium
AMAQAAAPYAAWLSTTAAQAELA

SEQ ID NO: 1041257 - protein, 17 aa, Mycobacterium
AMARRARGILARAQGVN

SEQ ID NO: 1041258 - protein, 27 aa, Mycobacterium
AMDPRQRLALELAWELFEDARIVAESV

SEQ ID NO: 1041259 - protein, 27 aa, Mycobacterium
AMGGTWELFRYPGIRSDSDMHTLGFRF

SEQ ID NO: 1041260 - protein, 20 aa, Mycobacterium
AMHALGIPTTRSLAVVGTGR

SEQ ID NO: 1041261 - protein, 17 aa, Mycobacterium
AMIDGRPVGVFSHDQTV

SEQ ID NO: 1041262 - protein, 27 aa, Mycobacterium
AMIDVLRFWLGLGIDGFRLDAVPYLFE

SEQ ID NO: 1041263 - protein, 23 aa, Mycobacterium
AMLLMRAGREYALKRALAKLSDE

SEQ ID NO: 1041264 - protein, 17 aa, Mycobacterium
AMLPRITAMTVRDGKVC

SEQ ID NO: 1041265 - protein, 22 aa, Mycobacterium
AMLTAVTPYVSWLTTMATRAEQ

SEQ ID NO: 1041266 - protein, 25 aa, Mycobacterium
AMNLAVVLRATWAVARVLAEQTPAG

SEQ ID NO: 1041267 - protein, 22 aa, Mycobacterium
AMPEAISVFLAPPSWEDLKARL

SEQ ID NO: 1041268 - protein, 24 aa, Mycobacterium
AMPRLRRAAEGGGNIVDRIEAVLD

SEQ ID NO: 1041269 - protein, 19 aa, Mycobacterium
AMPVREPLPGLGHAVEIRA

SEQ ID NO: 1041270 - protein, 19 aa, Mycobacterium
AMRDHICAAIKVDAAELPY

SEQ ID NO: 1041271 - protein, 21 aa, Mycobacterium
AMRRISPSMIRMFARLDIRQR

SEQ ID NO: 1041272 - protein, 26 aa, Mycobacterium
AMSGESDPVVLLAIAFVVRALRGGSV

SEQ ID NO: 1041273 - protein, 21 aa, Mycobacterium
AMSRFRGKVIGTVFQDPMSAL

SEQ ID NO: 1041274 - protein, 19 aa, Mycobacterium
AMTAEVLGAVLPGAIAEVI

SEQ ID NO: 1041275 - protein, 19 aa, Mycobacterium
AMTGLGSRYFRLLPQRLVE

SEQ ID NO: 1041276 - protein, 19 aa, Mycobacterium
AMTNFAWTFDDDVELDYHF

SEQ ID NO: 1041277 - protein, 24 aa, Mycobacterium
AMTRAQSQVVAWWSPAYDEPNGGL

SEQ ID NO: 1041278 - protein, 25 aa, Mycobacterium
AMTVAAGHYVGWLRTSALHAAGAAA

SEQ ID NO: 1041279 - protein, 30 aa, Mycobacterium; identical to SEQ ID NO: 634761

SEQ ID NO: 1041280 - protein, 18 aa, Mycobacterium
AMVRQWALRFRDEVNQRA

SEQ ID NO: 1041281 - protein, 21 aa, Mycobacterium
ANAAIPWSLTIVTTLTSVVAH

SEQ ID NO: 1041282 - protein, 17 aa, Mycobacterium
ANAALAIDLARRHNPDE

SEQ ID NO: 1041283 - protein, 26 aa, Mycobacterium
ANAGTRLSGFFFRGDRSLVARSAAGV

SEQ ID NO: 1041284 - protein, 23 aa, Mycobacterium
ANALCAAAVGLECGASVEEVAVA

SEQ ID NO: 1041285 - protein, 24 aa, Mycobacterium
ANALCAAAVGLECGASVEEVAVAL

SEQ ID NO: 1041286 - protein, 20 aa, Mycobacterium
ANALTGLGLVAGDRVAIYLP

SEQ ID NO: 1041287 - protein, 26 aa, Mycobacterium
ANALWRLLPDRVRVLDFPTNFHYDFR

SEQ ID NO: 1041288 - protein, 26 aa, Mycobacterium
ANAPMVGVAYGYPGAPGQWWQQQVVL

SEQ ID NO: 1041289 - protein, 17 aa, Mycobacterium
ANAPVIAAAGPRYTSAL

SEQ ID NO: 1041290 - protein, 23 aa, Mycobacterium
ANCHGVVVLLELRRGVRELLDQR

SEQ ID NO: 1041291 - protein, 20 aa, Mycobacterium
ANDARQLVALRAYWEMDRAA

SEQ ID NO: 1041292 - protein, 25 aa, Mycobacterium
ANEFGLPMPIAREVDAVINHGSTVE

SEQ ID NO: 1041293 - protein, 24 aa, Mycobacterium
ANEVKGQVFPWVLADVDLGDNALE

SEQ ID NO: 1041294 - protein, 20 aa, Mycobacterium
ANFRDVMIALGLYPDPDAAM

SEQ ID NO: 1041295 - protein, 20 aa, Mycobacterium
ANFTDGWLRTGDLGTLSQAG

SEQ ID NO: 1041296 - protein, 18 aa, Mycobacterium
ANFYPRWTYEKAEPDDST

SEQ ID NO: 1041297 - protein, 17 aa, Mycobacterium
ANGAWIICQHGTRSGWG

SEQ ID NO: 1041298 - protein, 25 aa, Mycobacterium
ANGCGDRLVLLPGVIGSALRDEVFC

SEQ ID NO: 1041299 - protein, 18 aa, Mycobacterium
ANGCLVDGPIGRVGLEIE

SEQ ID NO: 1041300 - protein, 22 aa, Mycobacterium
ANGGDGGLLWGNGGNGGSGATG

SEQ ID NO: 1041301 - protein, 27 aa, Mycobacterium
ANGIDAPALWPGLPVRPVKGEVLRLRW

SEQ ID NO: 1041302 - protein, 19 aa, Mycobacterium
ANGVAAVFDAARAAIVHPL

SEQ ID NO: 1041303 - protein, 19 aa, Mycobacterium
ANGVRRIAAQTGITVVAGM

SEQ ID NO: 1041304 - protein, 19 aa, Mycobacterium
ANHGVHCFLVPIRDEDGND

SEQ ID NO: 1041305 - protein, 17 aa, Mycobacterium
ANHLELFVDMHRFSDVD

SEQ ID NO: 1041306 - protein, 19 aa, Mycobacterium
ANHQYLGPVLWSPAGELPR

SEQ ID NO: 1041307 - protein, 19 aa, Mycobacterium
ANILREFKTAKRDALLASL

SEQ ID NO: 1041308 - protein, 17 aa, Mycobacterium
ANKLPRQPLLRITGFGY

SEQ ID NO: 1041309 - protein, 21 aa, Mycobacterium
ANKRPKVVRVYLPPDGNTLLS

SEQ ID NO: 1041310 - protein, 26 aa, Mycobacterium
ANKVPGARCALVWSEQTASLAREHNN

SEQ ID NO: 1041311 - protein, 23 aa, Mycobacterium
ANLAAAVPTTGMLAAGADEVSAA

SEQ ID NO: 1041312 - protein, 21 aa, Mycobacterium
ANLGCLQPRQRQHRFVQHRVG

SEQ ID NO: 1041313 - protein, 23 aa, Mycobacterium
ANLLDLLAALGLPVEPMGVDDDG

SEQ ID NO: 1041314 - protein, 33 aa, Mycobacterium; identical to SEQ ID NO: 196738

SEQ ID NO: 1041315 - protein, 22 aa, Mycobacterium
ANLPDGQWFPGQRLSRDFSSQP

SEQ ID NO: 1041316 - protein, 18 aa, Mycobacterium
ANLRARPQLAVTFRNGWR

SEQ ID NO: 1041317 - protein, 20 aa, Mycobacterium
ANLTAAVPTAGVLAAGADEV

SEQ ID NO: 1041318 - protein, 24 aa, Mycobacterium
ANMAPELFAGILAQVPFVDPLTTI

SEQ ID NO: 1041319 - protein, 21 aa, Mycobacterium
ANNTPVGFLFMLPDVNEITGQ

SEQ ID NO: 1041320 - protein, 17 aa, Mycobacterium
ANPRLGLAATTEALHQA

SEQ ID NO: 1041321 - protein, 23 aa, Mycobacterium
ANPRTCSGIMALELLDTTPDWER

SEQ ID NO: 1041322 - protein, 22 aa, Mycobacterium
ANPSHGVLWGLGRTITLEHPEI

SEQ ID NO: 1041323 - protein, 25 aa, Mycobacterium
ANPTPKGCVFEYVYLARPDSMLNGR

SEQ ID NO: 1041324 - protein, 19 aa, Mycobacterium
ANRDELILAALEFWMDEHH

SEQ ID NO: 1041325 - protein, 19 aa, Mycobacterium
ANRDFPGAVGQLSNTSSGV

SEQ ID NO: 1041326 - protein, 26 aa, Mycobacterium
ANRHGLAVAEVRFLPAGAIPRTTSGK

SEQ ID NO: 1041327 - protein, 25 aa, Mycobacterium
ANRLARWFIGQGFGPEDIIGLRMAN

SEQ ID NO: 1041328 - protein, 21 aa, Mycobacterium
ANRSSLVSLVLSNLFGQNAPA

SEQ ID NO: 1041329 - protein, 17 aa, Mycobacterium
ANSAFYYGALRTLAEAD

SEQ ID NO: 1041330 - protein, 23 aa, Mycobacterium
ANSEPRTGLSMGDHAAITAKQMG

SEQ ID NO: 1041331 - protein, 29 aa, Mycobacterium
ANVPKLADIRIRKAILGLLDVDLLAAVGA

SEQ ID NO: 1041332 - protein, 23 aa, Mycobacterium
ANVPTPFGLFPPVSPLTVAEHLA

SEQ ID NO: 1041333 - protein, 19 aa, Mycobacterium
ANVRTRSTIILNTFYSDRQ

SEQ ID NO: 1041334 - protein, 18 aa, Mycobacterium
ANVVGFGNVPSAATVIGS

SEQ ID NO: 1041335 - protein, 17 aa, Mycobacterium
ANVYLCGPAAMVEATRT

SEQ ID NO: 1041336 - protein, 23 aa, Mycobacterium
ANYIPRPRYRAVSAVEGTALALS

SEQ ID NO: 1041337 - protein, 23 aa, Mycobacterium
APAELKGLHNFFTPLLRNLGRCA

SEQ ID NO: 1041338 - protein, 24 aa, Mycobacterium
APAELKGLHNFFTPLLRNLGRCAR

SEQ ID NO: 1041339 - protein, 24 aa, Mycobacterium
APAELRPALERAFASGLPAVVNVL

SEQ ID NO: 1041340 - protein, 19 aa, Mycobacterium
APAGLRGSLQVRHVDAGSC

SEQ ID NO: 1041341 - protein, 17 aa, Mycobacterium
APANGWADVAMPADYAR

SEQ ID NO: 1041342 - protein, 17 aa, Mycobacterium
APANRWSVRTVGDLELL

SEQ ID NO: 1041343 - protein, 24 aa, Mycobacterium
APAPPRPPFPPSPPEPAELPMVVV

SEQ ID NO: 1041344 - protein, 28 aa, Mycobacterium
APAPVLELRTSWRNPPRALHLANAISAE

SEQ ID NO: 1041345 - protein, 19 aa, Mycobacterium
APARARAAVLSAMRAAHPY

SEQ ID NO: 1041346 - protein, 31 aa, Mycobacterium
APASSSWFCDGCTATTVLVIMRPFRPRHTGA

SEQ ID NO: 1041347 - protein, 23 aa, Mycobacterium
APATRAGAMPVIAAGATPTPRLL

SEQ ID NO: 1041348 - protein, 21 aa, Mycobacterium
APDAYKRAGVRSRLTPLKDLK

SEQ ID NO: 1041349 - protein, 22 aa, Mycobacterium
APDFRLFWDNAYMVHTLTPDFI

SEQ ID NO: 1041350 - protein, 26 aa, Mycobacterium
APDGAGWRVGEGMALAMIATLPPGGH

SEQ ID NO: 1041351 - protein, 25 aa, Mycobacterium
APDIPRERFSALTRLDHNRAISQLA

SEQ ID NO: 1041352 - protein, 25 aa, Mycobacterium
APDLARWRHAIDVAARRWVASTGAE

SEQ ID NO: 1041353 - protein, 24 aa, Mycobacterium
APDLEILGNLGLVIGGGFDTTTAL

SEQ ID NO: 1041354 - protein, 20 aa, Mycobacterium
APDRNLAMELVRVTEAGAMA

SEQ ID NO: 1041355 - protein, 21 aa, Mycobacterium
APDVLRYVMGFGGTPDSALTG

SEQ ID NO: 1041356 - protein, 17 aa, Mycobacterium
APEAEFVVGMSLGGLTA

SEQ ID NO: 1041357 - protein, 19 aa, Mycobacterium
APEAIYGRFVVPQILGDNK

SEQ ID NO: 1041358 - protein, 18 aa, Mycobacterium
APECDLVLVVGSRNSSNS

SEQ ID NO: 1041359 - protein, 18 aa, Mycobacterium
APEFRAMMRLDWSQSQQS

SEQ ID NO: 1041360 - protein, 22 aa, Mycobacterium
APEGKGPLLINARAETVATSPA

SEQ ID NO: 1041361 - protein, 20 aa, Mycobacterium
APEGLFGVECDVTDNDAVDR

SEQ ID NO: 1041362 - protein, 24 aa, Mycobacterium
APEIYRAPVSYPYRDNLLDKDIAT

SEQ ID NO: 1041363 - protein, 20 aa, Mycobacterium
APELLPLAAVGWPDGSVLPL

SEQ ID NO: 1041364 - protein, 18 aa, Mycobacterium
APEPGPAMLGDIVLCPEF

SEQ ID NO: 1041365 - protein, 22 aa, Mycobacterium
APEQMSALLMAIVLQGMDRGET

SEQ ID NO: 1041366 - protein, 18 aa, Mycobacterium
APEQPRQLVLIADDNADM

SEQ ID NO: 1041367 - protein, 18 aa, Mycobacterium
APERAVAAVADFVRSRPD

SEQ ID NO: 1041368 - protein, 24 aa, Mycobacterium
APEVLIPIQCEYYALEGVSQLMRN

SEQ ID NO: 1041369 - protein, 19 aa, Mycobacterium
APFFDAPDVFAGFNDGSSV

SEQ ID NO: 1041370 - protein, 20 aa, Mycobacterium
APFLPGHPFAPGLPQGDPVS

SEQ ID NO: 1041371 - protein, 23 aa, Mycobacterium
APFPLATMQHAYWIGRADEQELG

SEQ ID NO: 1041372 - protein, 17 aa, Mycobacterium
APFRGFLQERRALGHTG

SEQ ID NO: 1041373 - protein, 18 aa, Mycobacterium
APFSLAWMTAVGERTKRM

SEQ ID NO: 1041374 - protein, 18 aa, Mycobacterium
APGALRWLPIDPVSRVSS

SEQ ID NO: 1041375 - protein, 25 aa, Mycobacterium
APGARLAWRENAEWAPHGGESRIDV

SEQ ID NO: 1041376 - protein, 21 aa, Mycobacterium
APGDHKSLCAVMTTIYSAQLE

SEQ ID NO: 1041377 - protein, 24 aa, Mycobacterium
APGEVEAPVPQMAVLPTADPGIAA

SEQ ID NO: 1041378 - protein, 20 aa, Mycobacterium
APGGVAYACSFRITEAVYFV

SEQ ID NO: 1041379 - protein, 17 aa, Mycobacterium
APGLLGLYDDTVDGNQA

SEQ ID NO: 1041380 - protein, 25 aa, Mycobacterium
APGMPPRPGAPGMPGMPGAPGAPGM

SEQ ID NO: 1041381 - protein, 25 aa, Mycobacterium
APGPRPRLARPLSWGRAAPADTGSF

SEQ ID NO: 1041382 - protein, 25 aa, Mycobacterium
APGQAGGAGGLLIGNGGNGAPSAVG

SEQ ID NO: 1041383 - protein, 27 aa, Mycobacterium
APGQNGGDGGLLWGNGGAGGVGTAAHP

SEQ ID NO: 1041384 - protein, 20 aa, Mycobacterium
APGTGRDGGPGGLLYGNGGD

SEQ ID NO: 1041385 - protein, 23 aa, Mycobacterium
APGVEIVPLLAFDMTRPLADVVF

SEQ ID NO: 1041386 - protein, 17 aa, Mycobacterium
APGVWHLVSTVSAQVPV

SEQ ID NO: 1041387 - protein, 19 aa, Mycobacterium
APGYLKVEALYAVTAEGAL

SEQ ID NO: 1041388 - protein, 18 aa, Mycobacterium
APHARLVIEAWRHRTGDL

SEQ ID NO: 1041389 - protein, 24 aa, Mycobacterium
APHLRVGLDLPVRVDPTDHSKVLI

SEQ ID NO: 1041390 - protein, 17 aa, Mycobacterium
APIGRPIANACLYVVDP

SEQ ID NO: 1041391 - protein, 18 aa, Mycobacterium
APIIPLLVQVNGGPLQPI

SEQ ID NO: 1041392 - protein, 23 aa, Mycobacterium
APIPGRLFAGPGLAQPSGVSPAA

SEQ ID NO: 1041393 - protein, 21 aa, Mycobacterium
APIRDSWEFALLRGALQRGLP

SEQ ID NO: 1041394 - protein, 19 aa, Mycobacterium
APISAGFALLLTRRLGLSD

SEQ ID NO: 1041395 - protein, 19 aa, Mycobacterium
APISAPISPGRLQFGDVGQ

SEQ ID NO: 1041396 - protein, 17 aa, Mycobacterium
APISFWPPIELAGLTAG

SEQ ID NO: 1041397 - protein, 19 aa, Mycobacterium
APISPGRLQFGDVGQYTDH

SEQ ID NO: 1041398 - protein, 22 aa, Mycobacterium
APISVQIADGWFQRVTLTNPVG

SEQ ID NO: 1041399 - protein, 19 aa, Mycobacterium
APIWEGEDGVIAWLLSGPE

SEQ ID NO: 1041400 - protein, 17 aa, Mycobacterium
APKDRDIAMVFQSYALY

SEQ ID NO: 1041401 - protein, 19 aa, Mycobacterium
APLAIDLPRDFPRPLRGSF

SEQ ID NO: 1041402 - protein, 21 aa, Mycobacterium
APLDRRLLLGMLAELPAGAGV

SEQ ID NO: 1041403 - protein, 20 aa, Mycobacterium
APLFPLVVVVHADMEVRLRR

SEQ ID NO: 1041404 - protein, 26 aa, Mycobacterium
APLFRKRPASFQGVLTNLGWSVDDDI

SEQ ID NO: 1041405 - protein, 25 aa, Mycobacterium
APLHPRSSPTIATGIDFWLREDTEL

SEQ ID NO: 1041406 - protein, 18 aa, Mycobacterium
APLHRRWHGSRLRDPRQA

SEQ ID NO: 1041407 - protein, 20 aa, Mycobacterium
APLTALACQALLTRAAADVG

SEQ ID NO: 1041408 - protein, 29 aa, Mycobacterium
APLTMKPDVCWQLPIRRSQEWVTRPDGSE

SEQ ID NO: 1041409 - protein, 17 aa, Mycobacterium
APMARIAALASKYNAGL

SEQ ID NO: 1041410 - protein, 17 aa, Mycobacterium
APMIAQMAKAHALAEQQ

SEQ ID NO: 1041411 - protein, 27 aa, Mycobacterium
APMLGAAAAWCGLASELRAAAESFASI

SEQ ID NO: 1041412 - protein, 18 aa, Mycobacterium
APMRSGSRGIQWHMVGQI

SEQ ID NO: 1041413 - protein, 19 aa, Mycobacterium
APMVKMLLNTALDRLAEKL

SEQ ID NO: 1041414 - protein, 22 aa, Mycobacterium
APNARPPVCKIMDYGKYKYEAA

SEQ ID NO: 1041415 - protein, 20 aa, Mycobacterium
APNFAFDLCVEQSTPAQREG

SEQ ID NO: 1041416 - protein, 20 aa, Mycobacterium
APNIKMLAPIPAGDPDKGQL

SEQ ID NO: 1041417 - protein, 25 aa, Mycobacterium
APNLWPQPCIDLYEAVCAGDLEKAQ

SEQ ID NO: 1041418 - protein, 29 aa, Mycobacterium
APNPLYWRGARLVGNYPLSIALDGQAMNI

SEQ ID NO: 1041419 - protein, 18 aa, Mycobacterium
APNQAMKSVHRILRNFKM

SEQ ID NO: 1041420 - protein, 21 aa, Mycobacterium
APNVWAFGDVASWRDQMGHQV

SEQ ID NO: 1041421 - protein, 36 aa, Mycobacterium
APPAPPKLADWMLRVRFCAPAPPAPAAPPLPPSPPI

SEQ ID NO: 1041422 - protein, 24 aa, Mycobacterium
APPARPRLQNHFREFVMLESEAEA

SEQ ID NO: 1041423 - protein, 21 aa, Mycobacterium
APPEIWRDYVRTVGRTPNGVW

SEQ ID NO: 1041424 - protein, 18 aa, Mycobacterium
APPGIPVDIGPGATVAHL

SEQ ID NO: 1041425 - protein, 24 aa, Mycobacterium
APPHGGIAFGWDRVSTLLAGADSI

SEQ ID NO: 1041426 - protein, 19 aa, Mycobacterium
APPMPVARGLGMGFDPTVI

SEQ ID NO: 1041427 - protein, 21 aa, Mycobacterium
APPPAWTHRRFFVDGEGQDSK

SEQ ID NO: 1041428 - protein, 19 aa, Mycobacterium
APPRCTSYFPKFRALCMAE

SEQ ID NO: 1041429 - protein, 18 aa, Mycobacterium
APPSPAGLDRGCPFAPRC

SEQ ID NO: 1041430 - protein, 26 aa, Mycobacterium
APPSRRCPPCPSAGLRRYPQSHHRPP

SEQ ID NO: 1041431 - protein, 21 aa, Mycobacterium
APPTARGWEVVAGDEIWNWTD

SEQ ID NO: 1041432 - protein, 20 aa, Mycobacterium
APQLPGRGWVQYEPYGTVLI

SEQ ID NO: 1041433 - protein, 19 aa, Mycobacterium
APRGFIRDLYEAVSQLAFL

SEQ ID NO: 1041434 - protein, 21 aa, Mycobacterium
APRGMPAPVVLKAGAAEGDGA

SEQ ID NO: 1041435 - protein, 20 aa, Mycobacterium
APRILRPGPVSAERIADVLG

SEQ ID NO: 1041436 - protein, 30 aa, Mycobacterium
APRSAPIQRSWRPSCSPTRPPMVSTSPTSP

SEQ ID NO: 1041437 - protein, 19 aa, Mycobacterium
APRSIEVGYCLGRQWWDMG

SEQ ID NO: 1041438 - protein, 23 aa, Mycobacterium
APRVTVNCGIFGWTPTVQLTTYL

SEQ ID NO: 1041439 - protein, 29 aa, Mycobacterium
APSAVARFCRICGALAAELINCCGMFNAG

SEQ ID NO: 1041440 - protein, 30 aa, Mycobacterium
APSAVARFCRICGALAAELINCCGMFNAGA

SEQ ID NO: 1041441 - protein, 24 aa, Mycobacterium
APSFEPARCRWLLGHEPNAQRWRA

SEQ ID NO: 1041442 - protein, 28 aa, Mycobacterium
APSPLVQRIPGMRAKLFDAARLAAEAIG

SEQ ID NO: 1041443 - protein, 22 aa, Mycobacterium
APSRLFGANGLRTGPDGRVYIA

SEQ ID NO: 1041444 - protein, 18 aa, Mycobacterium
APSTRIATSPTIAASQPR

SEQ ID NO: 1041445 - protein, 23 aa, Mycobacterium
APTGAVLLQVRWLCLEGRDDPVD

SEQ ID NO: 1041446 - protein, 20 aa, Mycobacterium
APTHIAAAFDVSRQTFRSER

SEQ ID NO: 1041447 - protein, 25 aa, Mycobacterium
APTKRELMSSAFLDHLRHLGRIPAT

SEQ ID NO: 1041448 - protein, 24 aa, Mycobacterium
APTLIRTFMKWGRAIPDAHDLSSL

SEQ ID NO: 1041449 - protein, 18 aa, Mycobacterium
APTLSGFWHWAVANLPAD

SEQ ID NO: 1041450 - protein, 19 aa, Mycobacterium
APTPFVWIIGRTQTNGPAD

SEQ ID NO: 1041451 - protein, 25 aa, Mycobacterium
APTQALLNRPLIGNGANGAAGTGAS

SEQ ID NO: 1041452 - protein, 17 aa, Mycobacterium
APTQLLLNRPLIGNGTD

SEQ ID NO: 1041453 - protein, 18 aa, Mycobacterium
APTTGWAGSEDELLAVLR

SEQ ID NO: 1041454 - protein, 21 aa, Mycobacterium
APVAVGAFAPVLDRLIAFTGR

SEQ ID NO: 1041455 - protein, 18 aa, Mycobacterium
APVAVVQRGFGRPSTGRC

SEQ ID NO: 1041456 - protein, 25 aa, Mycobacterium
APVDLPALLPSPGRPFGLYLHVPFC

SEQ ID NO: 1041457 - protein, 20 aa, Mycobacterium
APVEALIGVFDKIGVKTGID

SEQ ID NO: 1041458 - protein, 26 aa, Mycobacterium
APVLAICAAVQVLGHWYETSSGERVD

SEQ ID NO: 1041459 - protein, 26 aa, Mycobacterium
APVLAWLHAPGMDFGPALAADVQIAI

SEQ ID NO: 1041460 - protein, 17 aa, Mycobacterium
APVLCAFGMTEATHQVA

SEQ ID NO: 1041461 - protein, 24 aa, Mycobacterium
APVLDRLIAFTGRRPVHPTGLTSP

SEQ ID NO: 1041462 - protein, 22 aa, Mycobacterium
APVPILGSAWGLVRDSAMYRGD

SEQ ID NO: 1041463 - protein, 31 aa, Mycobacterium
APVTPRAPALLISRLVSWVDDLWCRAIGAAV

SEQ ID NO: 1041464 - protein, 32 aa, Mycobacterium
APVWGGIHLSYVMAVPEIIEAAASTAAASQTA

SEQ ID NO: 1041465 - protein, 17 aa, Mycobacterium
APWKCGVTWTQRLISLL

SEQ ID NO: 1041466 - protein, 17 aa, Mycobacterium
APYEIPRDFIVETTPFT

SEQ ID NO: 1041467 - protein, 22 aa, Mycobacterium
AQAAAFHERFLQTLSGGAGAYA

SEQ ID NO: 1041468 - protein, 32 aa, Mycobacterium
AQAAAFHQQFVPALAAAAGSYGRTEAAGAAVL

SEQ ID NO: 1041469 - protein, 26 aa, Mycobacterium
AQAFPKSRFTGIDFSEPAIAAASQEA

SEQ ID NO: 1041470 - protein, 21 aa, Mycobacterium
AQAGLKWPNDVLAGLPGSLGK

SEQ ID NO: 1041471 - protein, 20 aa, Mycobacterium
AQAGRFGIHPALLNAALHAG

SEQ ID NO: 1041472 - protein, 18 aa, Mycobacterium
AQAIAQVCELNWQLRGQA

SEQ ID NO: 1041473 - protein, 20 aa, Mycobacterium
AQALLGRPLIGDGAAGTAAS

SEQ ID NO: 1041474 - protein, 22 aa, Mycobacterium
AQALLGRPLIGNGANGADGTGA

SEQ ID NO: 1041475 - protein, 22 aa, Mycobacterium
AQALLGRPLIGNGDDGVAGTGQ

SEQ ID NO: 1041476 - protein, 23 aa, Mycobacterium
AQALPGLRQALGLAEDGTDERAA

SEQ ID NO: 1041477 - protein, 27 aa, Mycobacterium
AQDEVSAAIAALFSVHGQTYQQLSAQA

SEQ ID NO: 1041478 - protein, 18 aa, Mycobacterium
AQEDWNFQYGWQATDAIV

SEQ ID NO: 1041479 - protein, 25 aa, Mycobacterium
AQELAARFARPLAFGTAGLRGPVRG

SEQ ID NO: 1041480 - protein, 20 aa, Mycobacterium
AQFGLDWNKFGVMARTATVS

SEQ ID NO: 1041481 - protein, 23 aa, Mycobacterium
AQFKVETGIPVFFADPQSPRQRG

SEQ ID NO: 1041482 - protein, 27 aa, Mycobacterium
AQFLVFCAAVIRAVHKYAELLRVSVAS

SEQ ID NO: 1041483 - protein, 25 aa, Mycobacterium
AQGFAWPWSICRWVTGENPKVGQLV

SEQ ID NO: 1041484 - protein, 17 aa, Mycobacterium
AQGGGLRIGMPAQGGAV

SEQ ID NO: 1041485 - protein, 27 aa, Mycobacterium
AQGILCGSIVSGLRMRPGNWAGAYACW

SEQ ID NO: 1041486 - protein, 19 aa, Mycobacterium
AQGIPPQFLVDILTNLRTD

SEQ ID NO: 1041487 - protein, 22 aa, Mycobacterium
AQGYSRVRVDGVVHPLTDPPKL

SEQ ID NO: 1041488 - protein, 17 aa, Mycobacterium
AQHPVVLPVAEDIPAGR

SEQ ID NO: 1041489 - protein, 19 aa, Mycobacterium
AQIGKGMWAMTELMADMVE

SEQ ID NO: 1041490 - protein, 17 aa, Mycobacterium
AQIHGWCVGGASDYALC

SEQ ID NO: 1041491 - protein, 31 aa, Mycobacterium; identical to SEQ ID NO: 636205

SEQ ID NO: 1041492 - protein, 17 aa, Mycobacterium
AQIQLRVTTLGAKGVDL

SEQ ID NO: 1041493 - protein, 19 aa, Mycobacterium
AQIRAEFGVDLTVRTIFDV

SEQ ID NO: 1041494 - protein, 21 aa, Mycobacterium
AQIRSIPTLMSFKKGKLLFNQ

SEQ ID NO: 1041495 - protein, 26 aa, Mycobacterium
AQKVSCAGLVLGSWPAHPGLVESSNR

SEQ ID NO: 1041496 - protein, 18 aa, Mycobacterium
AQLAALLARCPAVTRGRL

SEQ ID NO: 1041497 - protein, 19 aa, Mycobacterium
AQLAPLVFEGTSFGGALMT

SEQ ID NO: 1041498 - protein, 18 aa, Mycobacterium
AQLARLDLGSVLVPMPEG

SEQ ID NO: 1041499 - protein, 25 aa, Mycobacterium
AQLARWDGGVALGFDGFARLSSSSA

SEQ ID NO: 1041500 - protein, 18 aa, Mycobacterium
AQLCGLCLALRDDYGQAA

SEQ ID NO: 1041501 - protein, 18 aa, Mycobacterium
AQLCVDWEAATLPAQYAG

SEQ ID NO: 1041502 - protein, 20 aa, Mycobacterium
AQLLLPHFVASVLNAEPQCR

SEQ ID NO: 1041503 - protein, 25 aa, Mycobacterium
AQLPRIAGMGFDVVYLPPIHPIGKV

SEQ ID NO: 1041504 - protein, 18 aa, Mycobacterium
AQLQRLQLEFAELADADT

SEQ ID NO: 1041505 - protein, 19 aa, Mycobacterium
AQLRVKPSLAHKPTPQTKP

SEQ ID NO: 1041506 - protein, 24 aa, Mycobacterium
AQMAETLARVALRGSWLDRDATAL

SEQ ID NO: 1041507 - protein, 22 aa, Mycobacterium
AQMAGVHQRFVQALTASGSSYA

SEQ ID NO: 1041508 - protein, 19 aa, Mycobacterium
AQMALPPSVWSYVVGGAGD

SEQ ID NO: 1041509 - protein, 23 aa, Mycobacterium
AQMVRLLVYYAAWHLDRNHHMEV

SEQ ID NO: 1041510 - protein, 19 aa, Mycobacterium
AQNGRYGPYLKRGTDSRSL

SEQ ID NO: 1041511 - protein, 18 aa, Mycobacterium
AQNLDFLVAVARSCVGHV

SEQ ID NO: 1041512 - protein, 19 aa, Mycobacterium
AQNVGAMFGYHVGVSEALS

SEQ ID NO: 1041513 - protein, 20 aa, Mycobacterium
AQPADIGWAAAFLASDLASY

SEQ ID NO: 1041514 - protein, 17 aa, Mycobacterium
AQPGKSLILRYGPGMGQ

SEQ ID NO: 1041515 - protein, 18 aa, Mycobacterium
AQPGLLFTNLPFPLSDSS

SEQ ID NO: 1041516 - protein, 22 aa, Mycobacterium
AQPGPDGWIRAVGYHEAVAGPL

SEQ ID NO: 1041517 - protein, 18 aa, Mycobacterium
AQQRIWLLDRLNLGGPEL

SEQ ID NO: 1041518 - protein, 18 aa, Mycobacterium
AQQWFDLCAMVGHPEWID

SEQ ID NO: 1041519 - protein, 32 aa, Mycobacterium
AQQYQALSAQMARFHDQFVRSLSGAAQTYARA

SEQ ID NO: 1041520 - protein, 26 aa, Mycobacterium
AQRARFGQALPVLGWNMRVSNLRWSG

SEQ ID NO: 1041521 - protein, 22 aa, Mycobacterium
AQRHPATVIRWVTGTPTERAVP

SEQ ID NO: 1041522 - protein, 23 aa, Mycobacterium
AQRLPGLLPPLSRGESLEVTAIH

SEQ ID NO: 1041523 - protein, 20 aa, Mycobacterium
AQRPVIMAGTNVWWGHGERA

SEQ ID NO: 1041524 - protein, 18 aa, Mycobacterium
AQRQLMRLALADHICQAE

SEQ ID NO: 1041525 - protein, 24 aa, Mycobacterium
AQRSSYQFALSIAVVRHLQRDPLL

SEQ ID NO: 1041526 - protein, 20 aa, Mycobacterium
AQSLGQRFAQALAAGAGSYS

SEQ ID NO: 1041527 - protein, 21 aa, Mycobacterium
AQSLLARPIIGNGANATTLGG

SEQ ID NO: 1041528 - protein, 25 aa, Mycobacterium
AQSPKETWLRLLLLDDGLPRPQTQI

SEQ ID NO: 1041529 - protein, 22 aa, Mycobacterium
AQTHPGLRYVVYDISTATPERL

SEQ ID NO: 1041530 - protein, 23 aa, Mycobacterium
AQTKRRVAVLGGNRIPFARSDGA

SEQ ID NO: 1041531 - protein, 26 aa, Mycobacterium
AQTLALHEQFVKLMSGGAAQYAAAEA

SEQ ID NO: 1041532 - protein, 23 aa, Mycobacterium
AQTLRLWRERFLQRQGELAQLGF

SEQ ID NO: 1041533 - protein, 18 aa, Mycobacterium
AQVKTGGRGKAGGVKYAA

SEQ ID NO: 1041534 - protein, 30 aa, Mycobacterium; identical to SEQ ID NO: 636502

SEQ ID NO: 1041535 - protein, 23 aa, Mycobacterium
AQVPELLARFPGARTAKVKVAEP

SEQ ID NO: 1041536 - protein, 17 aa, Mycobacterium
AQVRCYHHQAVAEVGEG

SEQ ID NO: 1041537 - protein, 21 aa, Mycobacterium
AQVRMEFADGMLRLSAGADDV

SEQ ID NO: 1041538 - protein, 25 aa, Mycobacterium
AQVTELRGGLLVNWDARESAFPPGL

SEQ ID NO: 1041539 - protein, 24 aa, Mycobacterium
AQVTRLTVEHPIRTPNTITATTTV

SEQ ID NO: 1041540 - protein, 24 aa, Mycobacterium
AQVYGSGGSRCMLGSVKTNIGHSE

SEQ ID NO: 1041541 - protein, 19 aa, Mycobacterium
ARAAARYGADTCARGDEDA

SEQ ID NO: 1041542 - protein, 17 aa, Mycobacterium
ARAAGWRVLLADELGAQ

SEQ ID NO: 1041543 - protein, 19 aa, Mycobacterium
ARAAHLAAVLQARGAQGER

SEQ ID NO: 1041544 - protein, 23 aa, Mycobacterium
ARACPELRMRVHDGAVLTYPRWL

SEQ ID NO: 1041545 - protein, 18 aa, Mycobacterium
ARADECWSQIQKLMTRRD

SEQ ID NO: 1041546 - protein, 22 aa, Mycobacterium
ARADVKFGIEPWFRYFQKVAAF

SEQ ID NO: 1041547 - protein, 23 aa, Mycobacterium
ARAEADSGAALRDVDDRTYVAVP

SEQ ID NO: 1041548 - protein, 26 aa, Mycobacterium
ARAERAELIDWLFGQGITAAEIRTTN

SEQ ID NO: 1041549 - protein, 18 aa, Mycobacterium
ARAFDALVAIVAGAAARN

SEQ ID NO: 1041550 - protein, 19 aa, Mycobacterium
ARAFSGVKIACVGESTADR

SEQ ID NO: 1041551 - protein, 21 aa, Mycobacterium
ARAHWKAHRLDLTPVLHEPES

SEQ ID NO: 1041552 - protein, 20 aa, Mycobacterium
ARAKGMRNRVTWTVTKWDPP

SEQ ID NO: 1041553 - protein, 17 aa, Mycobacterium
ARALDAFLRDVYSEQAI

SEQ ID NO: 1041554 - protein, 27 aa, Mycobacterium
ARALGCTIKLLSICERLTTDEGQQRVS

SEQ ID NO: 1041555 - protein, 25 aa, Mycobacterium
ARALIAVRGLHRFAAAEGLAALDVA

SEQ ID NO: 1041556 - protein, 26 aa, Mycobacterium
ARALPEHTRWLPGDYRYCDVVATLAA

SEQ ID NO: 1041557 - protein, 18 aa, Mycobacterium
ARALRPYAEKLITHAKKG

SEQ ID NO: 1041558 - protein, 22 aa, Mycobacterium
ARALTPPALVVRLVDMLRAGHA

SEQ ID NO: 1041559 - protein, 18 aa, Mycobacterium
ARCGANVVIASRNLDNCV

SEQ ID NO: 1041560 - protein, 23 aa, Mycobacterium
ARDELLCRAQIFVLPSRNEGLPM

SEQ ID NO: 1041561 - protein, 24 aa, Mycobacterium
ARDGWDFASVLARFANARHTRSLP

SEQ ID NO: 1041562 - protein, 30 aa, Mycobacterium; identical to SEQ ID NO: 636802

SEQ ID NO: 1041563 - protein, 17 aa, Mycobacterium
ARDSAPSLVFLDEVDAL

SEQ ID NO: 1041564 - protein, 18 aa, Mycobacterium
ARDSGCWMGSSIYPDTKM

SEQ ID NO: 1041565 - protein, 24 aa, Mycobacterium
ARDWEVLEAGLVQRSRLLDAVLAD

SEQ ID NO: 1041566 - protein, 20 aa, Mycobacterium
AREAMPYAAALGRAFQLTNF

SEQ ID NO: 1041567 - protein, 23 aa, Mycobacterium
AREIVSFAATGARWRAGDDLEAF

SEQ ID NO: 1041568 - protein, 20 aa, Mycobacterium
ARELSGSSNLLFRRNSVTGA

SEQ ID NO: 1041569 - protein, 19 aa, Mycobacterium
AREPDRFAGLTLMVPATAW

SEQ ID NO: 1041570 - protein, 20 aa, Mycobacterium
ARERGATMIFTRTKRTAQKV

SEQ ID NO: 1041571 - protein, 19 aa, Mycobacterium
AREVLAHELVRAGTAFPTD

SEQ ID NO: 1041572 - protein, 20 aa, Mycobacterium
ARFAGPVVVIELDMRFGSLE

SEQ ID NO: 1041573 - protein, 21 aa, Mycobacterium
ARFGSVFIKAGFSSMDMGTSY

SEQ ID NO: 1041574 - protein, 18 aa, Mycobacterium
ARFLIARILFHDWEHEMS

SEQ ID NO: 1041575 - protein, 17 aa, Mycobacterium
ARFPGLSLPSMGLDFYG

SEQ ID NO: 1041576 - protein, 20 aa, Mycobacterium
ARFTPHLTLGYRDAVAVADS

SEQ ID NO: 1041577 - protein, 26 aa, Mycobacterium
ARFVRLCDAFGIPLVVVVDVPGYLPG

SEQ ID NO: 1041578 - protein, 19 aa, Mycobacterium
ARGAHTLACDYAKIREQYG

SEQ ID NO: 1041579 - protein, 19 aa, Mycobacterium
ARGEAPLAFEGTAEPSAIF

SEQ ID NO: 1041580 - protein, 29 aa, Mycobacterium
ARGFPVTEFNVALPWTKMVVLNPGVQTES

SEQ ID NO: 1041581 - protein, 18 aa, Mycobacterium
ARGGLLLYGPPGCGKSYL

SEQ ID NO: 1041582 - protein, 20 aa, Mycobacterium
ARGHLAWAMADMTRRNRSTF

SEQ ID NO: 1041583 - protein, 21 aa, Mycobacterium
ARGKLTPRERIELLVDPDSPF

SEQ ID NO: 1041584 - protein, 19 aa, Mycobacterium
ARGLGVLIDAVFNHLGPSG

SEQ ID NO: 1041585 - protein, 18 aa, Mycobacterium
ARGLHLFATLLSAAENAT

SEQ ID NO: 1041586 - protein, 25 aa, Mycobacterium
ARGTMLMCKYAIPRLISAGGGAIVN

SEQ ID NO: 1041587 - protein, 17 aa, Mycobacterium
ARGTTSLRRIREIAPPP

SEQ ID NO: 1041588 - protein, 20 aa, Mycobacterium
ARGVARIGLANYFAGALLLP

SEQ ID NO: 1041589 - protein, 17 aa, Mycobacterium
ARIALNPTQQWLDELDR

SEQ ID NO: 1041590 - protein, 19 aa, Mycobacterium
ARIGDLAAVDHCSQPTMTT

SEQ ID NO: 1041591 - protein, 26 aa, Mycobacterium
ARIGHLPEGLGIIGLLIDEPKPLRLE

SEQ ID NO: 1041592 - protein, 19 aa, Mycobacterium
ARIGMGWPECKVGVEFDSA

SEQ ID NO: 1041593 - protein, 19 aa, Mycobacterium
ARIGSAINAATTAAAAQTT

SEQ ID NO: 1041594 - protein, 17 aa, Mycobacterium
ARIGSGLLVDVVGINDG

SEQ ID NO: 1041595 - protein, 17 aa, Mycobacterium
ARIKFPTPAACGRVPLV

SEQ ID NO: 1041596 - protein, 17 aa, Mycobacterium
ARILSQRGYQVVLVARS

SEQ ID NO: 1041597 - protein, 18 aa, Mycobacterium
ARINDLRNEWLFGQSWGI

SEQ ID NO: 1041598 - protein, 25 aa, Mycobacterium
ARIPARGAGPGGPLVRWPTLTKSGR

SEQ ID NO: 1041599 - protein, 17 aa, Mycobacterium
ARIPGVRAKVAVRSRVA

SEQ ID NO: 1041600 - protein, 24 aa, Mycobacterium
ARIPSAPIRLLWRLVYATPVRNFD

SEQ ID NO: 1041601 - protein, 22 aa, Mycobacterium
ARISVRSVIHRHYLEVLRPLVR

SEQ ID NO: 1041602 - protein, 25 aa, Mycobacterium
ARKAAYEVLERVGLNPKVASRYPAQ

SEQ ID NO: 1041603 - protein, 19 aa, Mycobacterium
ARKGIWSDHEMALIHRLHG

SEQ ID NO: 1041604 - protein, 27 aa, Mycobacterium
ARKLGELRPLYPPGLVHIYHALTWGPL

SEQ ID NO: 1041605 - protein, 18 aa, Mycobacterium
ARKLGLRPLARIHTTTVV

SEQ ID NO: 1041606 - protein, 26 aa, Mycobacterium
ARKPKRLTLFLLPMDRPGFTVRPIPS

SEQ ID NO: 1041607 - protein, 18 aa, Mycobacterium
ARKVAGWGADAMIVQGGE

SEQ ID NO: 1041608 - protein, 18 aa, Mycobacterium
ARKVEGFGVRLRKGDIVL

SEQ ID NO: 1041609 - protein, 22 aa, Mycobacterium
ARKWAEQSLHRFRELADDPTSG

SEQ ID NO: 1041610 - protein, 17 aa, Mycobacterium
ARLAAAHIVHESRAVIG

SEQ ID NO: 1041611 - protein, 20 aa, Mycobacterium
ARLAQCPAQIATLDGTVDQL

SEQ ID NO: 1041612 - protein, 25 aa, Mycobacterium
ARLAYPEVRAALAAAARNHDLTESE

SEQ ID NO: 1041613 - protein, 23 aa, Mycobacterium
ARLEAAVALSAIAARFPQARLDG

SEQ ID NO: 1041614 - protein, 19 aa, Mycobacterium
ARLGADPDLAAAVVEETMR

SEQ ID NO: 1041615 - protein, 20 aa, Mycobacterium
ARLGPARTAGICAISPALFS

SEQ ID NO: 1041616 - protein, 26 aa, Mycobacterium
ARLLSKLRAGKVLSLSGIMDDLIQES

SEQ ID NO: 1041617 - protein, 17 aa, Mycobacterium
ARLPFWRGDDVGRPAEL

SEQ ID NO: 1041618 - protein, 20 aa, Mycobacterium
ARLPSIALHAARSSLQAGAP

SEQ ID NO: 1041619 - protein, 22 aa, Mycobacterium
ARLQCRPYWWFLWRLADQARQT

SEQ ID NO: 1041620 - protein, 23 aa, Mycobacterium
ARLQKRLGTTTVYVTHDQTEAMT

SEQ ID NO: 1041621 - protein, 20 aa, Mycobacterium
ARLRARIWVAQVGRVPLLLL

SEQ ID NO: 1041622 - protein, 22 aa, Mycobacterium
ARLRPRHLHWPVLRHSHGHSPA

SEQ ID NO: 1041623 - protein, 22 aa, Mycobacterium
ARLRPRIGVMLQGGGGYPAARA

SEQ ID NO: 1041624 - protein, 18 aa, Mycobacterium
ARLSRLAWFDDVTPVILD

SEQ ID NO: 1041625 - protein, 22 aa, Mycobacterium
ARLTIGAGLGPMLEAANARQGL

SEQ ID NO: 1041626 - protein, 19 aa, Mycobacterium
ARLTILEVMAEAIDTPDEM

SEQ ID NO: 1041627 - protein, 20 aa, Mycobacterium
ARLTSKYAHAYRALGADFGD

SEQ ID NO: 1041628 - protein, 22 aa, Mycobacterium
ARLWEHWGKPDIVWYPGGHTGF

SEQ ID NO: 1041629 - protein, 19 aa, Mycobacterium
ARLYRTRLWLRSESNISVI

SEQ ID NO: 1041630 - protein, 24 aa, Mycobacterium
ARMADKPAAVLLHLGPGLGNGLAN

SEQ ID NO: 1041631 - protein, 17 aa, Mycobacterium
ARMASGGTRLVHNREMK

SEQ ID NO: 1041632 - protein, 19 aa, Mycobacterium
ARMELPFFRTVESAPGPTT

SEQ ID NO: 1041633 - protein, 21 aa, Mycobacterium
ARMNFLLSLTEQFTESGEPAG

SEQ ID NO: 1041634 - protein, 19 aa, Mycobacterium
ARMVGAVSVPPTWEGSMPT

SEQ ID NO: 1041635 - protein, 19 aa, Mycobacterium
ARNGRIHAVTELVAGQTPS

SEQ ID NO: 1041636 - protein, 20 aa, Mycobacterium
ARNRCQFCATTHEAVAAATL

SEQ ID NO: 1041637 - protein, 21 aa, Mycobacterium
ARNSQTWRFAPFFHALLDAGV

SEQ ID NO: 1041638 - protein, 23 aa, Mycobacterium
ARPAGLPPRLSLFGHTRMAVTDI

SEQ ID NO: 1041639 - protein, 20 aa, Mycobacterium
ARPAGRQRLMMITGSRASAN

SEQ ID NO: 1041640 - protein, 21 aa, Mycobacterium
ARPAQIAAFAVAMKMKVPTAA

SEQ ID NO: 1041641 - protein, 20 aa, Mycobacterium
ARPAVAAGVVTVPRTEAAGA

SEQ ID NO: 1041642 - protein, 23 aa, Mycobacterium
ARPDLTLDLVRPGIAVYGLSPVP

SEQ ID NO: 1041643 - protein, 22 aa, Mycobacterium
ARPFRLGGYLIDPGTRIVVHMI

SEQ ID NO: 1041644 - protein, 19 aa, Mycobacterium
ARPGVCLTTSGPGFLNALP

SEQ ID NO: 1041645 - protein, 28 aa, Mycobacterium
ARPQLAVTFRNGWRWATVEGGAELAGPD

SEQ ID NO: 1041646 - protein, 32 aa, Mycobacterium
ARPQQILKIVRPWADAVWDTGIEFGTIGIAKN

SEQ ID NO: 1041647 - protein, 24 aa, Mycobacterium
ARPRAGLIGCAFADLAEIMAGVFA

SEQ ID NO: 1041648 - protein, 25 aa, Mycobacterium
ARPRRRAPRPVPWRPNLSPRGLRWC

SEQ ID NO: 1041649 - protein, 19 aa, Mycobacterium
ARPVPMLVMAHGLGAVRTM

SEQ ID NO: 1041650 - protein, 26 aa, Mycobacterium
ARPWPETGRARRAGISSFGISGTNAH

SEQ ID NO: 1041651 - protein, 18 aa, Mycobacterium
ARPWRFGLGLVLSTQGHR

SEQ ID NO: 1041652 - protein, 26 aa, Mycobacterium
ARQAIWPHRMFSLLAGFVEAGESFEV

SEQ ID NO: 1041653 - protein, 19 aa, Mycobacterium
ARQALCMLGADTPVLTIQN

SEQ ID NO: 1041654 - protein, 18 aa, Mycobacterium
ARQALRILGLGADAVIEV

SEQ ID NO: 1041655 - protein, 18 aa, Mycobacterium
ARQGFNIALVPPGCEAVP

SEQ ID NO: 1041656 - protein, 33 aa, Mycobacterium
ARQGLTVSGTRAWLNRQLRPIGARPRRRGGPDG

SEQ ID NO: 1041657 - protein, 17 aa, Mycobacterium
ARQLPGQILVLGGGEAR

SEQ ID NO: 1041658 - protein, 18 aa, Mycobacterium
ARQLPGRLVGVSVDNDGN

SEQ ID NO: 1041659 - protein, 21 aa, Mycobacterium
ARQRHWVEPKHMAWAQIPTAS

SEQ ID NO: 1041660 - protein, 22 aa, Mycobacterium
ARQRLYLSRAIVRSSWGQPMLN

SEQ ID NO: 1041661 - protein, 25 aa, Mycobacterium
ARQRRLYDIPSRFVKTIGPDPVHID

SEQ ID NO: 1041662 - protein, 19 aa, Mycobacterium
ARQRTLLLSLDNAAANQRA

SEQ ID NO: 1041663 - protein, 19 aa, Mycobacterium
ARRAARFGLGFLPMVPDLV

SEQ ID NO: 1041664 - protein, 19 aa, Mycobacterium
ARRALGDRLGRVAAPHRIL

SEQ ID NO: 1041665 - protein, 38 aa, Mycobacterium
ARRFRWAYRPPLPRRWPTRWPSCWAAMHAPTRRSPPPR

SEQ ID NO: 1041666 - protein, 24 aa, Mycobacterium
ARRGDGWIKLVGDWIDRQIGDLAP

SEQ ID NO: 1041667 - protein, 17 aa, Mycobacterium
ARRGLALQLVEGAAKLG

SEQ ID NO: 1041668 - protein, 18 aa, Mycobacterium
ARRGLTNAIVAYLENSGV

SEQ ID NO: 1041669 - protein, 26 aa, Mycobacterium
ARRGMPVLGICNGFQVLCEAGLLPGA

SEQ ID NO: 1041670 - protein, 18 aa, Mycobacterium
ARRHGWTFPYLYDESQDV

SEQ ID NO: 1041671 - protein, 22 aa, Mycobacterium
ARRHWPEILARMTGDHGAAAYL

SEQ ID NO: 1041672 - protein, 24 aa, Mycobacterium
ARRLAALVDRLVCSGVHAIAALGS

SEQ ID NO: 1041673 - protein, 22 aa, Mycobacterium
ARRLAPGGAIVVGGRLDSAPLL

SEQ ID NO: 1041674 - protein, 23 aa, Mycobacterium
ARRLCPDREVVLVFVGDGSAPPP

SEQ ID NO: 1041675 - protein, 20 aa, Mycobacterium
ARRLLRRRWRKTATRALPRC

SEQ ID NO: 1041676 - protein, 17 aa, Mycobacterium
ARRPDLILLDLNLPKYD

SEQ ID NO: 1041677 - protein, 24 aa, Mycobacterium
ARRRGVPVMLRPVVLAKLMDGRIT

SEQ ID NO: 1041678 - protein, 27 aa, Mycobacterium
ARRTSAVKAFTAWAVRRGLLATDPAAR

SEQ ID NO: 1041679 - protein, 22 aa, Mycobacterium
ARRVADVLGIPFYVWDFAERFK

SEQ ID NO: 1041680 - protein, 21 aa, Mycobacterium
ARRVFTPKVAGSWRLHEATAD

SEQ ID NO: 1041681 - protein, 18 aa, Mycobacterium
ARRVSSCEEFADALRGAF

SEQ ID NO: 1041682 - protein, 21 aa, Mycobacterium
ARRVVAMGATLARAAGWDAEP

SEQ ID NO: 1041683 - protein, 32 aa, Mycobacterium; identical to SEQ ID NO: 637692

SEQ ID NO: 1041684 - protein, 26 aa, Mycobacterium
ARRWQRLLFDNGWLIPGNPPEFGGRN

SEQ ID NO: 1041685 - protein, 28 aa, Mycobacterium
ARRWQRLLFDNGWLLPGQSPEFGGRNAT

SEQ ID NO: 1041686 - protein, 23 aa, Mycobacterium
ARRWRHVIEVFPSFAEMRVLDLG

SEQ ID NO: 1041687 - protein, 24 aa, Mycobacterium
ARRWSGERIRVYSMHPGWADTPGV

SEQ ID NO: 1041688 - protein, 20 aa, Mycobacterium
ARRYEIGVSNMLWGNDFPHP

SEQ ID NO: 1041689 - protein, 21 aa, Mycobacterium
ARSELWFFYHLGRKLREKLSG

SEQ ID NO: 1041690 - protein, 30 aa, Mycobacterium; identical to SEQ ID NO: 637727

SEQ ID NO: 1041691 - protein, 19 aa, Mycobacterium
ARSGADVVRLVAGDPMSVD

SEQ ID NO: 1041692 - protein, 19 aa, Mycobacterium
ARSGAGFRLTGTRTQVGYG

SEQ ID NO: 1041693 - protein, 19 aa, Mycobacterium
ARSGVPLAITHVLPASENL

SEQ ID NO: 1041694 - protein, 19 aa, Mycobacterium
ARSKLEFVQPGVLLESLDS

SEQ ID NO: 1041695 - protein, 25 aa, Mycobacterium
ARSKPTISVGAWLQYLLDNFGTVAE

SEQ ID NO: 1041696 - protein, 21 aa, Mycobacterium
ARSRLAMAMGAIRARQSLDSA

SEQ ID NO: 1041697 - protein, 17 aa, Mycobacterium
ARSVAVDVLKPVLDDLG

SEQ ID NO: 1041698 - protein, 27 aa, Mycobacterium
ARSWRLLCTRQAHFSARQALRILGLGA

SEQ ID NO: 1041699 - protein, 18 aa, Mycobacterium
ARSYLSMPAPEYAEGDTR

SEQ ID NO: 1041700 - protein, 19 aa, Mycobacterium
ARTAGICAISPALFSSFTG

SEQ ID NO: 1041701 - protein, 19 aa, Mycobacterium
ARTALLNGFVTTVVHGMEA

SEQ ID NO: 1041702 - protein, 22 aa, Mycobacterium
ARTARPGFTLTQRNAAAVARIC

SEQ ID NO: 1041703 - protein, 18 aa, Mycobacterium
ARTARYGALDAHRDGPVL

SEQ ID NO: 1041704 - protein, 25 aa, Mycobacterium
ARTECPAGTVGEIWVQGDNVAMGYW

SEQ ID NO: 1041705 - protein, 19 aa, Mycobacterium
ARTLGPPALPAEVVVAEPQ

SEQ ID NO: 1041706 - protein, 24 aa, Mycobacterium
ARTPIAVEVPFEMPVGDTVVRGRI

SEQ ID NO: 1041707 - protein, 19 aa, Mycobacterium
ARTPLLGVCLGHQAIGVAF

SEQ ID NO: 1041708 - protein, 18 aa, Mycobacterium
ARTRFLLIGVPGPPPPRT

SEQ ID NO: 1041709 - protein, 22 aa, Mycobacterium
ARTRHNLGFMVADLLAARLGAK

SEQ ID NO: 1041710 - protein, 24 aa, Mycobacterium
ARTRPVRIAPRIALMAKALNTLGP

SEQ ID NO: 1041711 - protein, 21 aa, Mycobacterium
ARTRTGASIVAIVRGQEVVAS

SEQ ID NO: 1041712 - protein, 17 aa, Mycobacterium
ARTTGCAQGGGLRIGMP

SEQ ID NO: 1041713 - protein, 18 aa, Mycobacterium
ARTTLLISSHVMNEAEHC

SEQ ID NO: 1041714 - protein, 18 aa, Mycobacterium
ARTVALWEPALRTDLTGE

SEQ ID NO: 1041715 - protein, 21 aa, Mycobacterium
ARTVFKSMLSAVADRMPDYRC

SEQ ID NO: 1041716 - protein, 17 aa, Mycobacterium
ARTVIDFAARHVYAPQY

SEQ ID NO: 1041717 - protein, 17 aa, Mycobacterium
ARVADGHPVAWIHATAL

SEQ ID NO: 1041718 - protein, 21 aa, Mycobacterium
ARVAFLLRFGTGVLPEPKTVL

SEQ ID NO: 1041719 - protein, 18 aa, Mycobacterium
ARVARHIEAEIVRRGWTV

SEQ ID NO: 1041720 - protein, 18 aa, Mycobacterium
ARVDEMIDVIKLVLGGGM

SEQ ID NO: 1041721 - protein, 25 aa, Mycobacterium
ARVDQLPLIWKRLVDAGMESGHAYG

SEQ ID NO: 1041722 - protein, 23 aa, Mycobacterium
ARVFADLTWKVTIRVVQLPGLSA

SEQ ID NO: 1041723 - protein, 24 aa, Mycobacterium
ARVFPNLFATHRVRAVDDYPSHLL

SEQ ID NO: 1041724 - protein, 23 aa, Mycobacterium
ARVFWPRTRIVVTRDDVSLFGAE

SEQ ID NO: 1041725 - protein, 20 aa, Mycobacterium
ARVGFSLAVGEHLEYGPALI

SEQ ID NO: 1041726 - protein, 19 aa, Mycobacterium
ARVGKSLIVQLKYGPSRER

SEQ ID NO: 1041727 - protein, 17 aa, Mycobacterium
ARVGRDAVVRHAILDKN

SEQ ID NO: 1041728 - protein, 23 aa, Mycobacterium
ARVLHCAALRRLADKTQVVGPRE

SEQ ID NO: 1041729 - protein, 18 aa, Mycobacterium
ARVLIGSTADWVLHSSPV

SEQ ID NO: 1041730 - protein, 26 aa, Mycobacterium
ARVLPRSVALRMALVGKHERMDARRA

SEQ ID NO: 1041731 - protein, 21 aa, Mycobacterium
ARVLQALLARWDHHPRVDLVT

SEQ ID NO: 1041732 - protein, 27 aa, Mycobacterium
ARVLRPGGRLGLVWNTRDERLGWVREL

SEQ ID NO: 1041733 - protein, 18 aa, Mycobacterium
ARVLRPHGRYAIHELALT

SEQ ID NO: 1041734 - protein, 24 aa, Mycobacterium
ARVPAALLCWGVSQFDADMRPDQV

SEQ ID NO: 1041735 - protein, 18 aa, Mycobacterium
ARVQHGAGIRIHRRPGEP

SEQ ID NO: 1041736 - protein, 21 aa, Mycobacterium
ARVRTGGLLLRTRVPGNRLAD

SEQ ID NO: 1041737 - protein, 26 aa, Mycobacterium
ARVSESPWALMHFMVRLPEDVATGSI

SEQ ID NO: 1041738 - protein, 25 aa, Mycobacterium
ARVTRRLVAMLARRGYSQTVACEVV

SEQ ID NO: 1041739 - protein, 26 aa, Mycobacterium
ARVVAKIYCGLGLLKRENIREVHRAD

SEQ ID NO: 1041740 - protein, 22 aa, Mycobacterium
ARVVSMPCVEWFESQPEEYRDS

SEQ ID NO: 1041741 - protein, 19 aa, Mycobacterium
ARWAGPSTRRIGYLTISSG

SEQ ID NO: 1041742 - protein, 23 aa, Mycobacterium
ARWLNRGQRAFQLATQIALLTQA

SEQ ID NO: 1041743 - protein, 21 aa, Mycobacterium
ARWTSAMLASGPRLDFSDLRA

SEQ ID NO: 1041744 - protein, 17 aa, Mycobacterium
ARYAGDLAFPRFVADPK

SEQ ID NO: 1041745 - protein, 18 aa, Mycobacterium
ARYCGPITTSDAYRLTVL

SEQ ID NO: 1041746 - protein, 20 aa, Mycobacterium
ARYCLGRPGWAEDLQHGLAM

SEQ ID NO: 1041747 - protein, 17 aa, Mycobacterium
ARYFPSLLPEVSDEGPV

SEQ ID NO: 1041748 - protein, 19 aa, Mycobacterium
ARYRRAIRARGHFPTEQSA

SEQ ID NO: 1041749 - protein, 21 aa, Mycobacterium
ARYRRAIRARGHFPTEQSALK

SEQ ID NO: 1041750 - protein, 19 aa, Mycobacterium
ARYRRAIRARGHFSTEQSA

SEQ ID NO: 1041751 - protein, 24 aa, Mycobacterium
ARYRRPNSAIARFAGPTAGSLPLQ

SEQ ID NO: 1041752 - protein, 27 aa, Mycobacterium
ARYTWPRFVCGLPREFFAAVRAELADR

SEQ ID NO: 1041753 - protein, 26 aa, Mycobacterium
ASAALIWQRPRWSRRLQPEPISDLLA

SEQ ID NO: 1041754 - protein, 21 aa, Mycobacterium
ASADGGALVRIIAGEIDGHRG

SEQ ID NO: 1041755 - protein, 17 aa, Mycobacterium
ASADGMVSGDFFAHYID

SEQ ID NO: 1041756 - protein, 26 aa, Mycobacterium
ASADVASDVVVSWLPLFHDMGMMGLL

SEQ ID NO: 1041757 - protein, 17 aa, Mycobacterium
ASAEGKNALARALLSTG

SEQ ID NO: 1041758 - protein, 23 aa, Mycobacterium
ASAERFSIPLARVSPHDVAEAAI

SEQ ID NO: 1041759 - protein, 18 aa, Mycobacterium
ASAIDRAALPYVVGTIAG

SEQ ID NO: 1041760 - protein, 20 aa, Mycobacterium
ASAIHEMFVNTLGISSGSYA

SEQ ID NO: 1041761 - protein, 17 aa, Mycobacterium
ASAKLGKSVAIIERGRM

SEQ ID NO: 1041762 - protein, 23 aa, Mycobacterium
ASASVDAARSWLLGTPADDWVSM

SEQ ID NO: 1041763 - protein, 19 aa, Mycobacterium
ASATLDWLEAHGYEELVRN

SEQ ID NO: 1041764 - protein, 17 aa, Mycobacterium
ASAVHYGLACLELEAAD

SEQ ID NO: 1041765 - protein, 19 aa, Mycobacterium
ASAVTLVLHAMTLAVNHRL

SEQ ID NO: 1041766 - protein, 17 aa, Mycobacterium
ASAWAHANNTPFQWGKQ

SEQ ID NO: 1041767 - protein, 26 aa, Mycobacterium
ASAWDSLWVYDHFHTVPLPSDEATHE

SEQ ID NO: 1041768 - protein, 17 aa, Mycobacterium
ASDGLGVGEVGYLITGV

SEQ ID NO: 1041769 - protein, 25 aa, Mycobacterium
ASDLAARLKARWAPEGLVQRSQRHC

SEQ ID NO: 1041770 - protein, 17 aa, Mycobacterium
ASDLGAIAIKAALEKGN

SEQ ID NO: 1041771 - protein, 22 aa, Mycobacterium
ASDPRPAVLSDHDWLINERGVA

SEQ ID NO: 1041772 - protein, 21 aa, Mycobacterium
ASEEFNLFVSIHHVVVDGFGY

SEQ ID NO: 1041773 - protein, 19 aa, Mycobacterium
ASEHIKAGAGLHPSSTATT

SEQ ID NO: 1041774 - protein, 19 aa, Mycobacterium
ASERPRGVFSRQLVLGENL

SEQ ID NO: 1041775 - protein, 25 aa, Mycobacterium
ASESEPYCPVGISPLFETIEDLHNG

SEQ ID NO: 1041776 - protein, 18 aa, Mycobacterium
ASESQPFNFVAPVAGLAA

SEQ ID NO: 1041777 - protein, 23 aa, Mycobacterium
ASEVKRKGVLIGDTVVIRKAGDV

SEQ ID NO: 1041778 - protein, 17 aa, Mycobacterium
ASEVPECQAGIGVAAGQ

SEQ ID NO: 1041779 - protein, 17 aa, Mycobacterium
ASFTGEFVRFDSVRVNP

SEQ ID NO: 1041780 - protein, 21 aa, Mycobacterium
ASFTRSFARYEPMPESAAARV

SEQ ID NO: 1041781 - protein, 19 aa, Mycobacterium
ASFYSNWYRPAVGNDGTCT

SEQ ID NO: 1041782 - protein, 25 aa, Mycobacterium
ASGAGHRLRMIGVTWSDEASAQAAL

SEQ ID NO: 1041783 - protein, 18 aa, Mycobacterium
ASGAKRCAVSGPKTLTYQ

SEQ ID NO: 1041784 - protein, 18 aa, Mycobacterium
ASGAPIEHIVCIDGAPEG

SEQ ID NO: 1041785 - protein, 24 aa, Mycobacterium
ASGDMEALMAMLAPDATWLADSGG

SEQ ID NO: 1041786 - protein, 19 aa, Mycobacterium
ASGFKGSDYPAIFAEVAPG

SEQ ID NO: 1041787 - protein, 23 aa, Mycobacterium
ASGGFNMAGAFGASVASVNTAGS

SEQ ID NO: 1041788 - protein, 20 aa, Mycobacterium
ASGIPGDWALYDVDGKNGEH

SEQ ID NO: 1041789 - protein, 22 aa, Mycobacterium
ASGIPGMPGMAMTGTGRGGVAP

SEQ ID NO: 1041790 - protein, 24 aa, Mycobacterium
ASGIRREAFCPCYGLAEHTVGITV

SEQ ID NO: 1041791 - protein, 28 aa, Mycobacterium
ASGLDSRAWRLPWPDGTVVYELDQPRVL

SEQ ID NO: 1041792 - protein, 25 aa, Mycobacterium
ASGLHQHFENALAAAGSSYAGAEAA

SEQ ID NO: 1041793 - protein, 17 aa, Mycobacterium
ASGNPFMVVGGLIDAPA

SEQ ID NO: 1041794 - protein, 17 aa, Mycobacterium
ASGPGAALWVEVTEIPE

SEQ ID NO: 1041795 - protein, 25 aa, Mycobacterium
ASGRCASCIGVTLGFPPMTTMWGAP

SEQ ID NO: 1041796 - protein, 17 aa, Mycobacterium
ASGRVAYALGLQGPAIT

SEQ ID NO: 1041797 - protein, 17 aa, Mycobacterium
ASGVRMLLDAAKQVSGA

SEQ ID NO: 1041798 - protein, 22 aa, Mycobacterium
ASGWRALCSDGASGVEVAIVAE

SEQ ID NO: 1041799 - protein, 26 aa, Mycobacterium
ASHPDGYDGGFLYGSGGSGYNSATSG

SEQ ID NO: 1041800 - protein, 20 aa, Mycobacterium
ASHPGEGWAVVDVETSGFRP

SEQ ID NO: 1041801 - protein, 17 aa, Mycobacterium
ASHPRDARLGSVAKLLP

SEQ ID NO: 1041802 - protein, 18 aa, Mycobacterium
ASIAGLFLTTEAVVADKP

SEQ ID NO: 1041803 - protein, 19 aa, Mycobacterium
ASIARKLGALTVGVVTRPF

SEQ ID NO: 1041804 - protein, 27 aa, Mycobacterium
ASIPVKRLRQAGVLELLLALANETGGN

SEQ ID NO: 1041805 - protein, 17 aa, Mycobacterium
ASIRRTGRCVVLHEGPR

SEQ ID NO: 1041806 - protein, 17 aa, Mycobacterium
ASITSDLASGAWQGPAA

SEQ ID NO: 1041807 - protein, 22 aa, Mycobacterium
ASIYSSCAVPPLIGYLNDGKLP

SEQ ID NO: 1041808 - protein, 22 aa, Mycobacterium
ASKMAAAGCGRIVLTARSQPNP

SEQ ID NO: 1041809 - protein, 21 aa, Mycobacterium
ASKNAIPWGDFDTHLAQLQDL

SEQ ID NO: 1041810 - protein, 25 aa, Mycobacterium
ASKNPKEHFNFFPLTVDVEERMYAA

SEQ ID NO: 1041811 - protein, 20 aa, Mycobacterium
ASKYRCFTQELSFPIESAGE

SEQ ID NO: 1041812 - protein, 20 aa, Mycobacterium
ASLAAELQTAAGYYQSVVSG

SEQ ID NO: 1041813 - protein, 24 aa, Mycobacterium
ASLDPRLPISDLLAEPLQANGFNK

SEQ ID NO: 1041814 - protein, 25 aa, Mycobacterium
ASLHAGHLVPLLALRRFQRAGHRPI

SEQ ID NO: 1041815 - protein, 21 aa, Mycobacterium
ASLLGSAVWILATRPDIQQQV

SEQ ID NO: 1041816 - protein, 28 aa, Mycobacterium
ASLSMASAFWPYVTWTSMVATQAREAAS

SEQ ID NO: 1041817 - protein, 24 aa, Mycobacterium
ASLSREFRGADRLYGYAHHSVSTT

SEQ ID NO: 1041818 - protein, 25 aa, Mycobacterium
ASLVERLVPDFLWISTEHTAQVSLD

SEQ ID NO: 1041819 - protein, 20 aa, Mycobacterium
ASMAETLWEQAITAWTRSRN

SEQ ID NO: 1041820 - protein, 23 aa, Mycobacterium
ASMPAMIRAGGKMYGADGKLKDT

SEQ ID NO: 1041821 - protein, 22 aa, Mycobacterium
ASMRTLVWRRWPTTGLAAPVQS

SEQ ID NO: 1041822 - protein, 27 aa, Mycobacterium
ASNEYPVGFAWAMCTPFQFTKQFASHF

SEQ ID NO: 1041823 - protein, 25 aa, Mycobacterium
ASNGRRPGSVVLLTLHRERPDLDAL

SEQ ID NO: 1041824 - protein, 19 aa, Mycobacterium
ASNTHRWFGAYGVTKSAVD

SEQ ID NO: 1041825 - protein, 18 aa, Mycobacterium
ASNVALQLAKKVGANPRE

SEQ ID NO: 1041826 - protein, 25 aa, Mycobacterium
ASPCWSIRALLRVGGRKMGVKLLGT

SEQ ID NO: 1041827 - protein, 27 aa, Mycobacterium
ASPGYPCYRNILSALGCEVVEIPCGPE

SEQ ID NO: 1041828 - protein, 22 aa, Mycobacterium
ASPKSGFWSRSTIGSFSSLNSA

SEQ ID NO: 1041829 - protein, 24 aa, Mycobacterium
ASQHLSRALAQWRGPVLDDLRDFQ

SEQ ID NO: 1041830 - protein, 19 aa, Mycobacterium
ASQSWDLVRDGVFVGYQLD

SEQ ID NO: 1041831 - protein, 25 aa, Mycobacterium
ASRGKWDILRRMGFDDDHIGDSRTV

SEQ ID NO: 1041832 - protein, 28 aa, Mycobacterium
ASRLPSYFPKPLRERFAPEIRSHQLRRE

SEQ ID NO: 1041833 - protein, 23 aa, Mycobacterium
ASRPEWPSPMLPALQQLPADGPD

SEQ ID NO: 1041834 - protein, 17 aa, Mycobacterium
ASRRLALTGTPFRSDDS

SEQ ID NO: 1041835 - protein, 24 aa, Mycobacterium
ASRSEFRATPAFDGEAASLMWRHY

SEQ ID NO: 1041836 - protein, 19 aa, Mycobacterium
ASSRLMAELVPRYLDPDAI

SEQ ID NO: 1041837 - protein, 23 aa, Mycobacterium
ASSSRAGLGYEVIVSRLDDEANI

SEQ ID NO: 1041838 - protein, 26 aa, Mycobacterium
ASSTRRGRPMAHIHFAALHRDRNWLG

SEQ ID NO: 1041839 - protein, 18 aa, Mycobacterium
ASTAWTCTGSRTSTSTRR

SEQ ID NO: 1041840 - protein, 20 aa, Mycobacterium
ASTKVQSWDIFKCVRQVLEV

SEQ ID NO: 1041841 - protein, 23 aa, Mycobacterium
ASTPRSSLDLGVPAGARDLSTGN

SEQ ID NO: 1041842 - protein, 20 aa, Mycobacterium
ASVAARRGVAVALPSAGGGG

SEQ ID NO: 1041843 - protein, 20 aa, Mycobacterium
ASVDALKVVDAWQRAERTGR

SEQ ID NO: 1041844 - protein, 19 aa, Mycobacterium
ASVFRLVAEEALKLTSADA

SEQ ID NO: 1041845 - protein, 19 aa, Mycobacterium
ASVIMEFANEFGLPMPIAR

SEQ ID NO: 1041846 - protein, 18 aa, Mycobacterium
ASVIRYTQLRPFVLHVNH

SEQ ID NO: 1041847 - protein, 32 aa, Mycobacterium
ASVPDILVQGVLKWLAERGYDVVQSVTTANEA

SEQ ID NO: 1041848 - protein, 17 aa, Mycobacterium
ASVPVAFVTAYSALIDI

SEQ ID NO: 1041849 - protein, 31 aa, Mycobacterium; identical to SEQ ID NO: 638802

SEQ ID NO: 1041850 - protein, 20 aa, Mycobacterium
ASVSDEIFCEVFLDDVEVPF

SEQ ID NO: 1041851 - protein, 18 aa, Mycobacterium
ASVTSGLTGQAWQGAAAK

SEQ ID NO: 1041852 - protein, 18 aa, Mycobacterium
ASVTSGLVGGAWQGASSV

SEQ ID NO: 1041853 - protein, 20 aa, Mycobacterium
ASVTSGLVGQAWQGPASAAM

SEQ ID NO: 1041854 - protein, 20 aa, Mycobacterium
ASWERYDRFFKMCYNVLPDD

SEQ ID NO: 1041855 - protein, 19 aa, Mycobacterium
ASYRPGEAVQAAFVSALPS

SEQ ID NO: 1041856 - protein, 20 aa, Mycobacterium
ASYYELGHQLGLPAGIASDG

SEQ ID NO: 1041857 - protein, 24 aa, Mycobacterium
ATAAFGRGECFVERYLDRPRHVEA

SEQ ID NO: 1041858 - protein, 24 aa, Mycobacterium
ATAATRLQVWLTRSSADTFTLYAS

SEQ ID NO: 1041859 - protein, 17 aa, Mycobacterium
ATADPLIRLSIEREDLE

SEQ ID NO: 1041860 - protein, 28 aa, Mycobacterium
ATAEAANASPLEFLLDAVNAPTQTLFGR

SEQ ID NO: 1041861 - protein, 22 aa, Mycobacterium
ATAEALAAVVLRGLDCGAFSAD

SEQ ID NO: 1041862 - protein, 22 aa, Mycobacterium
ATAEAVVDCRVLPGRQAAFEAE

SEQ ID NO: 1041863 - protein, 19 aa, Mycobacterium
ATAEILAAEGFQVVLLPEP

SEQ ID NO: 1041864 - protein, 19 aa, Mycobacterium
ATAEPVAALILGELRTAVA

SEQ ID NO: 1041865 - protein, 24 aa, Mycobacterium
ATAFIYIGEVCRYLLNQPTKPTDR

SEQ ID NO: 1041866 - protein, 23 aa, Mycobacterium
ATAHAAWRGAPAVEEQDVRVAAE

SEQ ID NO: 1041867 - protein, 19 aa, Mycobacterium
ATAKRHSRCQKGRTDREQQ

SEQ ID NO: 1041868 - protein, 22 aa, Mycobacterium
ATAKTRWSRRSSERRAVQVGTG

SEQ ID NO: 1041869 - protein, 19 aa, Mycobacterium
ATALRIVLTHELFHYAARV

SEQ ID NO: 1041870 - protein, 18 aa, Mycobacterium
ATAPIWGAVARRYVNAQL

SEQ ID NO: 1041871 - protein, 29 aa, Mycobacterium
ATAPRLLLEVVCARLLLPSASDAESALLQ

SEQ ID NO: 1041872 - protein, 32 aa, Mycobacterium
ATAQAYRAVAEFVPRIGTLIDIVHRRHLTSAR

SEQ ID NO: 1041873 - protein, 25 aa, Mycobacterium
ATARRLASSYGHWVYSIRAGGGAAP

SEQ ID NO: 1041874 - protein, 27 aa, Mycobacterium
ATASGIVRPSSWLPAWTRARTGCPGRR

SEQ ID NO: 1041875 - protein, 18 aa, Mycobacterium
ATASLALLYAARRYYRNW

SEQ ID NO: 1041876 - protein, 19 aa, Mycobacterium
ATASRTVDLHWQRVQVLRS

SEQ ID NO: 1041877 - protein, 21 aa, Mycobacterium
ATATHLVSVFTHRARLVPGQL

SEQ ID NO: 1041878 - protein, 25 aa, Mycobacterium
ATAYAANAAEGWAMATASVRDLFAE

SEQ ID NO: 1041879 - protein, 26 aa, Mycobacterium
ATCEYHGLHAFRWVAADGSARFVRYH

SEQ ID NO: 1041880 - protein, 23 aa, Mycobacterium
ATCGGVRVWSLYVPNGRALEDPH

SEQ ID NO: 1041881 - protein, 19 aa, Mycobacterium
ATCQTGGKVLPHRRMSRLL

SEQ ID NO: 1041882 - protein, 18 aa, Mycobacterium
ATCSPHLAETVGVVADAL

SEQ ID NO: 1041883 - protein, 25 aa, Mycobacterium
ATDDPRPVMLWAYDPLAFNGEGKAA

SEQ ID NO: 1041884 - protein, 26 aa, Mycobacterium
ATDFECCLRLGGAEVRDDEVFETLLA

SEQ ID NO: 1041885 - protein, 24 aa, Mycobacterium
ATDFLMLCESFRLPVISLCDTPGF

SEQ ID NO: 1041886 - protein, 24 aa, Mycobacterium
ATDFSRPLARVVLAAAPALSLGEL

SEQ ID NO: 1041887 - protein, 18 aa, Mycobacterium
ATDGARRCVEEAAKYPDT

SEQ ID NO: 1041888 - protein, 18 aa, Mycobacterium
ATDLADWSPVRGRATLTV

SEQ ID NO: 1041889 - protein, 21 aa, Mycobacterium
ATDLLRWADEHFGGINGPRGW

SEQ ID NO: 1041890 - protein, 24 aa, Mycobacterium
ATDPLPVVLFFHGGGFVMGDLDTH

SEQ ID NO: 1041891 - protein, 24 aa, Mycobacterium
ATDSRFDEVLARVCADDPMTTRLE

SEQ ID NO: 1041892 - protein, 26 aa, Mycobacterium
ATDVEGWRGYNFAFTFNIADYNVITS

SEQ ID NO: 1041893 - protein, 26 aa, Mycobacterium
ATDVGFRMPSVWLAEGHSRMAPVYLY

SEQ ID NO: 1041894 - protein, 26 aa, Mycobacterium
ATEALRWAMMRGEPLLVLADALAEAI

SEQ ID NO: 1041895 - protein, 23 aa, Mycobacterium
ATEGRTAAAFALACQQAGVNLQR

SEQ ID NO: 1041896 - protein, 21 aa, Mycobacterium
ATELFPLLLSVMSTGATFVRS

SEQ ID NO: 1041897 - protein, 26 aa, Mycobacterium
ATEQLDFLRLAVLDALLVLLADTEPV

SEQ ID NO: 1041898 - protein, 30 aa, Mycobacterium; identical to SEQ ID NO: 639036

SEQ ID NO: 1041899 - protein, 19 aa, Mycobacterium
ATESLNLVSYVLGDSRFDR

SEQ ID NO: 1041900 - protein, 23 aa, Mycobacterium
ATEVIKAGGLYVLGTERHESRRI

SEQ ID NO: 1041901 - protein, 24 aa, Mycobacterium
ATFADLQIHPSVMRAIADVGYESP

SEQ ID NO: 1041902 - protein, 34 aa, Mycobacterium; identical to SEQ ID NO: 639047

SEQ ID NO: 1041903 - protein, 24 aa, Mycobacterium
ATFDLYSCFPVPVFNICDGLGIAT

SEQ ID NO: 1041904 - protein, 29 aa, Mycobacterium
ATFILATGRPPRWVRPVVEELGFTPMAVC

SEQ ID NO: 1041905 - protein, 19 aa, Mycobacterium
ATFMPKPFGQHAGSAMHTH

SEQ ID NO: 1041906 - protein, 23 aa, Mycobacterium
ATGAICRPGSGPFSLTGQPNAMG

SEQ ID NO: 1041907 - protein, 29 aa, Mycobacterium
ATGFLGRYLALEWLERMDLVDGKLICLVR

SEQ ID NO: 1041908 - protein, 18 aa, Mycobacterium
ATGRAVGVLADLQGPKIR

SEQ ID NO: 1041909 - protein, 17 aa, Mycobacterium
ATGRGGTGAAVIDEVDM

SEQ ID NO: 1041910 - protein, 23 aa, Mycobacterium
ATGRLRLVLLLSPPRTGSTALAN

SEQ ID NO: 1041911 - protein, 17 aa, Mycobacterium
ATGSFNTVGAFGGGAAL

SEQ ID NO: 1041912 - protein, 19 aa, Mycobacterium
ATGSRLACEAIPNRPQQDA

SEQ ID NO: 1041913 - protein, 24 aa, Mycobacterium
ATGTRAHSARSWLGDNAIHKLSAV

SEQ ID NO: 1041914 - protein, 27 aa, Mycobacterium
ATHNGRPAFWVAHSFGGVALARAAAQT

SEQ ID NO: 1041915 - protein, 20 aa, Mycobacterium
ATIEMCLTGPLAFEDGEATY

SEQ ID NO: 1041916 - protein, 25 aa, Mycobacterium
ATIRAEADLSRFPADIARVVVRLIH

SEQ ID NO: 1041917 - protein, 20 aa, Mycobacterium
ATIRPYRPSLSAALPPSALW

SEQ ID NO: 1041918 - protein, 24 aa, Mycobacterium
ATKLDPAMCDAWLARLLAGDQTMD

SEQ ID NO: 1041919 - protein, 19 aa, Mycobacterium
ATKQCAHKAQLLASGVSMP

SEQ ID NO: 1041920 - protein, 22 aa, Mycobacterium
ATKRIAPIVVLTAFSQRDLVER

SEQ ID NO: 1041921 - protein, 18 aa, Mycobacterium
ATKSCITAAGWAGLLVTV

SEQ ID NO: 1041922 - protein, 22 aa, Mycobacterium
ATLAVAPQAGWRVQVDGAAVTV

SEQ ID NO: 1041923 - protein, 17 aa, Mycobacterium
ATLERLVKFSRGHLVNM

SEQ ID NO: 1041924 - protein, 30 aa, Mycobacterium
ATLGCWKIGAVPIPMHWDLPEWERDRVRAV

SEQ ID NO: 1041925 - protein, 24 aa, Mycobacterium
ATLIAEARKGLPLKPDATSTSLPG

SEQ ID NO: 1041926 - protein, 25 aa, Mycobacterium
ATLKRFADRFARFNLQEKVLRPSYG

SEQ ID NO: 1041927 - protein, 18 aa, Mycobacterium
ATLLGGITNLGWQYDNEI

SEQ ID NO: 1041928 - protein, 17 aa, Mycobacterium
ATLLPHYAGRLVADEIR

SEQ ID NO: 1041929 - protein, 19 aa, Mycobacterium
ATLLQDWSQFAAPAVFGAA

SEQ ID NO: 1041930 - protein, 20 aa, Mycobacterium
ATLPVLGMTGSVFFQQATDL

SEQ ID NO: 1041931 - protein, 25 aa, Mycobacterium
ATLQRPAVGYGIRYEFGIFDQEIRD

SEQ ID NO: 1041932 - protein, 25 aa, Mycobacterium
ATLRISSQLLANWLRHGVITSEDVR

SEQ ID NO: 1041933 - protein, 22 aa, Mycobacterium
ATLRRPTIAGVRADYDKVLRQR

SEQ ID NO: 1041934 - protein, 19 aa, Mycobacterium
ATLRVARGAGFDQLIVTLG

SEQ ID NO: 1041935 - protein, 19 aa, Mycobacterium
ATLVIKPGWGFSFDYQPGQ

SEQ ID NO: 1041936 - protein, 18 aa, Mycobacterium
ATMHPSRYLTLIDGVSAV

SEQ ID NO: 1041937 - protein, 17 aa, Mycobacterium
ATMLRVLLYPDQMLDEA

SEQ ID NO: 1041938 - protein, 19 aa, Mycobacterium
ATMPDPIITLARTFMIQPT

SEQ ID NO: 1041939 - protein, 19 aa, Mycobacterium
ATMRYWPIAVSYGSVTGAS

SEQ ID NO: 1041940 - protein, 20 aa, Mycobacterium
ATMRYWPIAVSYGSVTGASE

SEQ ID NO: 1041941 - protein, 25 aa, Mycobacterium
ATMSWDRFVATYGRTGGPVRLGHWE

SEQ ID NO: 1041942 - protein, 24 aa, Mycobacterium
ATMVGRLSVPPSWAGTTEVTDHVA

SEQ ID NO: 1041943 - protein, 22 aa, Mycobacterium
ATMVQRLLGFELAKGHGAADWS

SEQ ID NO: 1041944 - protein, 17 aa, Mycobacterium
ATNPIEGVAAWIDGRLD

SEQ ID NO: 1041945 - protein, 24 aa, Mycobacterium
ATNVTKLPGLGGWRRPQEELDESS

SEQ ID NO: 1041946 - protein, 22 aa, Mycobacterium
ATNWRSDSALVDRLQVVLRGAE

SEQ ID NO: 1041947 - protein, 17 aa, Mycobacterium
ATPARPLVRAAMGPAGA

SEQ ID NO: 1041948 - protein, 17 aa, Mycobacterium
ATPAWDALRRHHDEIGA

SEQ ID NO: 1041949 - protein, 19 aa, Mycobacterium
ATPCSEWTVSDLIEHVIGG

SEQ ID NO: 1041950 - protein, 18 aa, Mycobacterium
ATPEALVESALWEASLFE

SEQ ID NO: 1041951 - protein, 22 aa, Mycobacterium
ATPEAYPFTQLEASASTDDLVV

SEQ ID NO: 1041952 - protein, 24 aa, Mycobacterium
ATPEVARAWSSYAPTAVRLPDGRV

SEQ ID NO: 1041953 - protein, 20 aa, Mycobacterium
ATPQWARTAIGLAREAAEGL

SEQ ID NO: 1041954 - protein, 18 aa, Mycobacterium
ATPRRNLSRVVEWPEQLL

SEQ ID NO: 1041955 - protein, 31 aa, Mycobacterium; identical to SEQ ID NO: 639373

SEQ ID NO: 1041956 - protein, 27 aa, Mycobacterium
ATQGRGAWPVCGHGLSAATPRDVPPPA

SEQ ID NO: 1041957 - protein, 23 aa, Mycobacterium
ATQPMPATVWIQETGDHQLAQIR

SEQ ID NO: 1041958 - protein, 21 aa, Mycobacterium
ATQTLPLWPFKTMAVNVDGQL

SEQ ID NO: 1041959 - protein, 24 aa, Mycobacterium
ATRAEGVACYQLFISGLLDVTDNV

SEQ ID NO: 1041960 - protein, 26 aa, Mycobacterium
ATREELPELYALIKREVGDVASFEVL

SEQ ID NO: 1041961 - protein, 28 aa, Mycobacterium
ATRIEFWAFDLLFLDGRSLLRARYRDRR

SEQ ID NO: 1041962 - protein, 24 aa, Mycobacterium
ATRLRDRLGYVFGPPGWKPQTPAN

SEQ ID NO: 1041963 - protein, 29 aa, Mycobacterium
ATRRPVALPRLAALAQWLEAHLPGITPAE

SEQ ID NO: 1041964 - protein, 22 aa, Mycobacterium
ATRRTAVAAGFLRTSTEVVALI

SEQ ID NO: 1041965 - protein, 18 aa, Mycobacterium
ATRVPFVITRVGNEATTA

SEQ ID NO: 1041966 - protein, 17 aa, Mycobacterium
ATSARRALVLNLVAEPG

SEQ ID NO: 1041967 - protein, 18 aa, Mycobacterium
ATSGEVFLRGVVGERFAV

SEQ ID NO: 1041968 - protein, 17 aa, Mycobacterium
ATSIDWSGHAAGALRAA

SEQ ID NO: 1041969 - protein, 19 aa, Mycobacterium
ATSKLRFYTNVLKLGSRNP

SEQ ID NO: 1041970 - protein, 20 aa, Mycobacterium
ATSWAELATKIGVPGGQLQA

SEQ ID NO: 1041971 - protein, 20 aa, Mycobacterium
ATTDPIWTIGPKVHGGCMMA

SEQ ID NO: 1041972 - protein, 25 aa, Mycobacterium
ATTRFSVRMKHEFYSLVERHQDGTP

SEQ ID NO: 1041973 - protein, 19 aa, Mycobacterium
ATTRLRLGTLVTGIHYRHP

SEQ ID NO: 1041974 - protein, 17 aa, Mycobacterium
ATVCGYVPVGTEPGSIP

SEQ ID NO: 1041975 - protein, 20 aa, Mycobacterium
ATVERLEGGLDHLEGTLSSL

SEQ ID NO: 1041976 - protein, 27 aa, Mycobacterium
ATVGTARRLRVAGAGLIRAWRARTSDA

SEQ ID NO: 1041977 - protein, 17 aa, Mycobacterium
ATVIERWVQEYLEATNR

SEQ ID NO: 1041978 - protein, 25 aa, Mycobacterium
ATVLARALVKTGLRLVAAGINPIAL

SEQ ID NO: 1041979 - protein, 19 aa, Mycobacterium
ATVLGRCSYLRDGIAVRND

SEQ ID NO: 1041980 - protein, 24 aa, Mycobacterium
ATVLSRNTFHWVLAFARSGLSTPA

SEQ ID NO: 1041981 - protein, 17 aa, Mycobacterium
ATVSIWMGILLTEKLRG

SEQ ID NO: 1041982 - protein, 17 aa, Mycobacterium
ATVWRLVDPAPRQLPAP

SEQ ID NO: 1041983 - protein, 17 aa, Mycobacterium
ATWGIAAAMTRGDITVT

SEQ ID NO: 1041984 - protein, 18 aa, Mycobacterium
ATWGWLSLATGLAVVDTV

SEQ ID NO: 1041985 - protein, 23 aa, Mycobacterium
ATYSRRLPIRLVEARGTRVRDSS

SEQ ID NO: 1041986 - protein, 18 aa, Mycobacterium
ATYVFPLPARAGVTDFVA

SEQ ID NO: 1041987 - protein, 25 aa, Mycobacterium
AVAAAEVPLAFAVAAGSFRDATRVA

SEQ ID NO: 1041988 - protein, 30 aa, Mycobacterium
AVAAQVVPWQSVLKGLPGLASGLAGGAGAG

SEQ ID NO: 1041989 - protein, 17 aa, Mycobacterium
AVAASDLERLGSTISTA

SEQ ID NO: 1041990 - protein, 25 aa, Mycobacterium
AVAASGRWVPDFLSLPIAIENSLKN

SEQ ID NO: 1041991 - protein, 23 aa, Mycobacterium
AVAEFAFGCGDKVSLDAVGQKAP

SEQ ID NO: 1041992 - protein, 19 aa, Mycobacterium
AVAEFPGFAFFEIQLRLPI

SEQ ID NO: 1041993 - protein, 33 aa, Mycobacterium
AVAERGARAALEFCESFDGVRPAAVRVPQAALA

SEQ ID NO: 1041994 - protein, 19 aa, Mycobacterium
AVAFELGVLASGYTSVISE

SEQ ID NO: 1041995 - protein, 17 aa, Mycobacterium
AVAGGGGRGMRRVNDIS

SEQ ID NO: 1041996 - protein, 17 aa, Mycobacterium
AVALALDSEDAWVVALR

SEQ ID NO: 1041997 - protein, 17 aa, Mycobacterium
AVALEVLQWRSDRDDDS

SEQ ID NO: 1041998 - protein, 24 aa, Mycobacterium
AVALGDRLVLIVGDVVGHGVEAAA

SEQ ID NO: 1041999 - protein, 20 aa, Mycobacterium
AVALGYDFLPGTTVNRYCSS

SEQ ID NO: 1042000 - protein, 18 aa, Mycobacterium
AVALKVARALDVDVGRLF

SEQ ID NO: 1042001 - protein, 19 aa, Mycobacterium
AVANAIALCLGWRLFEPML

SEQ ID NO: 1042002 - protein, 19 aa, Mycobacterium
AVAPLSFGGAGVEAGLGQA

SEQ ID NO: 1042003 - protein, 24 aa, Mycobacterium
AVAPPPERLLVGWTGGPAAITAQI

SEQ ID NO: 1042004 - protein, 29 aa, Mycobacterium
AVAPRVCRRHRLLLGRAGGQLTTHHPGEQ

SEQ ID NO: 1042005 - protein, 18 aa, Mycobacterium
AVAQMAEFGRHAEAMIAE

SEQ ID NO: 1042006 - protein, 18 aa, Mycobacterium
AVAQRIEPPLSLESLYAV

SEQ ID NO: 1042007 - protein, 25 aa, Mycobacterium
AVARGDASAGWCVSIAITSALLVAY

SEQ ID NO: 1042008 - protein, 19 aa, Mycobacterium
AVARLGRHQFPLVITDTVA

SEQ ID NO: 1042009 - protein, 27 aa, Mycobacterium
AVARRLARFGAGWIPWGPDARDVAAGI

SEQ ID NO: 1042010 - protein, 23 aa, Mycobacterium
AVARYVAELLVWDRAVRTDVDDS

SEQ ID NO: 1042011 - protein, 22 aa, Mycobacterium
AVASAFEAARMAMIHPLAVAAN

SEQ ID NO: 1042012 - protein, 23 aa, Mycobacterium
AVASRVGAPLGHDYAVISLSDRL

SEQ ID NO: 1042013 - protein, 18 aa, Mycobacterium
AVAVGYVRDYQAISAQVD

SEQ ID NO: 1042014 - protein, 18 aa, Mycobacterium
AVAWLARKVEGFGVRLRK

SEQ ID NO: 1042015 - protein, 24 aa, Mycobacterium
AVCAELLHRMCPAEGYRDDVVVLA

SEQ ID NO: 1042016 - protein, 23 aa, Mycobacterium
AVCALEPYWEAVRKVYAPFESGL

SEQ ID NO: 1042017 - protein, 18 aa, Mycobacterium
AVCELLWQHGFAGATVLL

SEQ ID NO: 1042018 - protein, 20 aa, Mycobacterium
AVCPHVEWALSSTLHAKANL

SEQ ID NO: 1042019 - protein, 24 aa, Mycobacterium
AVCSARTAAQFGVEPRVAMLSYST

SEQ ID NO: 1042020 - protein, 17 aa, Mycobacterium
AVCTAMLDLYQHEGIIA

SEQ ID NO: 1042021 - protein, 18 aa, Mycobacterium
AVDCERRGVTWAGPVADL

SEQ ID NO: 1042022 - protein, 19 aa, Mycobacterium
AVDELRTAGSWEAAQTHVS

SEQ ID NO: 1042023 - protein, 18 aa, Mycobacterium
AVDFRASMRTRQLNAAQL

SEQ ID NO: 1042024 - protein, 26 aa, Mycobacterium
AVDGGYRLSGSWSFGSGTGHAQYIAA

SEQ ID NO: 1042025 - protein, 26 aa, Mycobacterium
AVDGLNRFSAILARDKDNLGRALDTL

SEQ ID NO: 1042026 - protein, 28 aa, Mycobacterium
AVDPAHPFPFVSGLSLNLAVTVKQPEDG

SEQ ID NO: 1042027 - protein, 29 aa, Mycobacterium
AVDPAHPFPFVSGLSLNLAVTVRQPEDGG

SEQ ID NO: 1042028 - protein, 25 aa, Mycobacterium
AVDRAILRVAVWELLYADDVPEPVA

SEQ ID NO: 1042029 - protein, 23 aa, Mycobacterium
AVDRGRWGCVLGGDPLRRVTAMR

SEQ ID NO: 1042030 - protein, 24 aa, Mycobacterium
AVDWRAVVGQSHFVELPTYAFERR

SEQ ID NO: 1042031 - protein, 25 aa, Mycobacterium
AVEAEYEQMWALDVSTMATYHAGAS

SEQ ID NO: 1042032 - protein, 24 aa, Mycobacterium
AVEDRARKGLSILMAPEGTRLDTT

SEQ ID NO: 1042033 - protein, 19 aa, Mycobacterium
AVEDVFPLPRELVGQGTLF

SEQ ID NO: 1042034 - protein, 21 aa, Mycobacterium
AVEEIVRWASPVVYMRRTLNQ

SEQ ID NO: 1042035 - protein, 20 aa, Mycobacterium
AVELACWDLAAKLNDEPAYG

SEQ ID NO: 1042036 - protein, 18 aa, Mycobacterium
AVELARQGARMVIIADRD

SEQ ID NO: 1042037 - protein, 21 aa, Mycobacterium
AVELFKPLATRATRPEVRGGL

SEQ ID NO: 1042038 - protein, 25 aa, Mycobacterium
AVENALKVAFDWKSRHNQALGIDAG

SEQ ID NO: 1042039 - protein, 22 aa, Mycobacterium
AVEPAILRPSFRNWDHPYRRQI

SEQ ID NO: 1042040 - protein, 20 aa, Mycobacterium
AVEPAVLVLLNLSRDQLDRV

SEQ ID NO: 1042041 - protein, 19 aa, Mycobacterium
AVERVMVVRDRVRTEPPHP

SEQ ID NO: 1042042 - protein, 24 aa, Mycobacterium
AVESGLKVARKWGADVKGVPEGQA

SEQ ID NO: 1042043 - protein, 28 aa, Mycobacterium
AVEVALRSARGFGGPVIVHVVTRKGMGY

SEQ ID NO: 1042044 - protein, 17 aa, Mycobacterium
AVFDAPLCGEIRRAHSP

SEQ ID NO: 1042045 - protein, 23 aa, Mycobacterium
AVFDFLNTRCLTIAGGTEQILLT

SEQ ID NO: 1042046 - protein, 20 aa, Mycobacterium
AVFGGVWSRVSGGVWAVGGV

SEQ ID NO: 1042047 - protein, 34 aa, Mycobacterium; identical to SEQ ID NO: 639940

SEQ ID NO: 1042048 - protein, 25 aa, Mycobacterium
AVGEFSEPFIQLWDPAYTYVGSNIA

SEQ ID NO: 1042049 - protein, 18 aa, Mycobacterium
AVGGELPDLSGLVQAGAV

SEQ ID NO: 1042050 - protein, 17 aa, Mycobacterium
AVGGILWGNGGSGGSGA

SEQ ID NO: 1042051 - protein, 20 aa, Mycobacterium
AVGHGRIPRNLNFRQLTPHA

SEQ ID NO: 1042052 - protein, 25 aa, Mycobacterium
AVGHLRSGMTIGIAGWGSRRKPMAF

SEQ ID NO: 1042053 - protein, 24 aa, Mycobacterium
AVGLARRGSLRAGFDANLVVLDRD

SEQ ID NO: 1042054 - protein, 19 aa, Mycobacterium
AVGLIPSYRSFGVNGRSAV

SEQ ID NO: 1042055 - protein, 19 aa, Mycobacterium
AVGLSRQLYGLTIASERPG

SEQ ID NO: 1042056 - protein, 20 aa, Mycobacterium
AVGNGGRLFGDAGAGGSGGA

SEQ ID NO: 1042057 - protein, 17 aa, Mycobacterium
AVGRALAASGIPRAELF

SEQ ID NO: 1042058 - protein, 20 aa, Mycobacterium
AVGSGHSFTDCACTDGVMVD

SEQ ID NO: 1042059 - protein, 25 aa, Mycobacterium
AVGVARAAYEYALEYACQREQFGRK

SEQ ID NO: 1042060 - protein, 20 aa, Mycobacterium
AVGYPGRLIADYVRGTPDQV

SEQ ID NO: 1042061 - protein, 26 aa, Mycobacterium
AVHHPERLGALVLTSCDAFEHFPPPI

SEQ ID NO: 1042062 - protein, 22 aa, Mycobacterium
AVIAGALGNWLMSRGETVSQTA

SEQ ID NO: 1042063 - protein, 26 aa, Mycobacterium
AVIARELDRYLPFLATTKVLMAAVRA

SEQ ID NO: 1042064 - protein, 20 aa, Mycobacterium
AVIDARRGKMFARLIKNIEV

SEQ ID NO: 1042065 - protein, 21 aa, Mycobacterium
AVIEAGWDKAGLDEELGGMPM

SEQ ID NO: 1042066 - protein, 26 aa, Mycobacterium
AVIISDFLGPINWMRPLRAISARHEV

SEQ ID NO: 1042067 - protein, 17 aa, Mycobacterium
AVILAMGAAARYLHVPG

SEQ ID NO: 1042068 - protein, 26 aa, Mycobacterium
AVKEAVLPFHRFRRADGAAIDSLLGP

SEQ ID NO: 1042069 - protein, 18 aa, Mycobacterium
AVKQLRMVAIGVAGWKSR

SEQ ID NO: 1042070 - protein, 18 aa, Mycobacterium
AVLAPRLSVPDEFGLCRY

SEQ ID NO: 1042071 - protein, 17 aa, Mycobacterium
AVLAVYRPLLEPLGLTH

SEQ ID NO: 1042072 - protein, 18 aa, Mycobacterium
AVLDRLARYPARSVDIDG

SEQ ID NO: 1042073 - protein, 22 aa, Mycobacterium
AVLDRNGLRPSRIWVTEDGLVV

SEQ ID NO: 1042074 - protein, 21 aa, Mycobacterium
AVLEPRADGFRNYVRVGEKAP

SEQ ID NO: 1042075 - protein, 21 aa, Mycobacterium
AVLKAGAAYLPIDPAYPDERI

SEQ ID NO: 1042076 - protein, 20 aa, Mycobacterium
AVLKRYWYHAWWFYPHSIVR

SEQ ID NO: 1042077 - protein, 23 aa, Mycobacterium
AVLKTCRTKLPATMVPAAVMVLD

SEQ ID NO: 1042078 - protein, 17 aa, Mycobacterium
AVLLKLVTRMIRARVFG

SEQ ID NO: 1042079 - protein, 18 aa, Mycobacterium
AVLSVHFARQAAPFFDSV

SEQ ID NO: 1042080 - protein, 34 aa, Mycobacterium; identical to SEQ ID NO: 640188

SEQ ID NO: 1042081 - protein, 25 aa, Mycobacterium
AVMILPVSYWKLNEHEIFQHYRSVG

SEQ ID NO: 1042082 - protein, 18 aa, Mycobacterium
AVMKRVWAGEQISESVRP

SEQ ID NO: 1042083 - protein, 18 aa, Mycobacterium
AVMLVCPDPAPLLDTVLN

SEQ ID NO: 1042084 - protein, 22 aa, Mycobacterium
AVMLVCPEPAPLLRAALDLAAA

SEQ ID NO: 1042085 - protein, 17 aa, Mycobacterium
AVMREWNFGAADRDRTN

SEQ ID NO: 1042086 - protein, 20 aa, Mycobacterium
AVMRRLAAGDGPVYVVDDQI

SEQ ID NO: 1042087 - protein, 21 aa, Mycobacterium
AVMRRLAAGDGPVYVVDDQIG

SEQ ID NO: 1042088 - protein, 28 aa, Mycobacterium
AVMSQLRTALRLQIAAGRSIGEALEALD

SEQ ID NO: 1042089 - protein, 20 aa, Mycobacterium
AVNFPDVLFIAGKYQIKIPP

SEQ ID NO: 1042090 - protein, 21 aa, Mycobacterium
AVNLTGTFLVVREALPALLDN

SEQ ID NO: 1042091 - protein, 23 aa, Mycobacterium
AVNPRLNAIIRRIDALAEGRAAD

SEQ ID NO: 1042092 - protein, 26 aa, Mycobacterium
AVNRARRAIAEFRIRGVSTNIPFLQA

SEQ ID NO: 1042093 - protein, 25 aa, Mycobacterium
AVNRWQRAQMRRWRDGEASASPLYW

SEQ ID NO: 1042094 - protein, 18 aa, Mycobacterium
AVNTAAWYTTATIPTAIF

SEQ ID NO: 1042095 - protein, 24 aa, Mycobacterium
AVNVDTWGGWIWINMDPAAQPLRQ

SEQ ID NO: 1042096 - protein, 22 aa, Mycobacterium
AVNYPLYVIMSLLGLPEADFPR

SEQ ID NO: 1042097 - protein, 24 aa, Mycobacterium
AVNYRLTLRNGVLVYRKASADAST

SEQ ID NO: 1042098 - protein, 17 aa, Mycobacterium
AVPAHRAVATSTAAATV

SEQ ID NO: 1042099 - protein, 22 aa, Mycobacterium
AVPLCFGFHPYLQLPGVPRTEW

SEQ ID NO: 1042100 - protein, 18 aa, Mycobacterium
AVPRAHRFPSGPVSADAI

SEQ ID NO: 1042101 - protein, 18 aa, Mycobacterium
AVPSRWASKWGSSGLAYL

SEQ ID NO: 1042102 - protein, 18 aa, Mycobacterium
AVPSRYGQALAESEIQPL

SEQ ID NO: 1042103 - protein, 22 aa, Mycobacterium
AVQAALLARWMLIGFVHGVMNT

SEQ ID NO: 1042104 - protein, 29 aa, Mycobacterium
AVQGGMIPLCYDWLCGMVVSTAGIPPTRT

SEQ ID NO: 1042105 - protein, 26 aa, Mycobacterium
AVQLILKFIPGMRERGFGHIINVSSC

SEQ ID NO: 1042106 - protein, 19 aa, Mycobacterium
AVQRSAGAVAIGPVLQGLR

SEQ ID NO: 1042107 - protein, 17 aa, Mycobacterium
AVQWLRKNARVEGETAE

SEQ ID NO: 1042108 - protein, 24 aa, Mycobacterium
AVQYRELLSGYALDEIDAAEWKHR

SEQ ID NO: 1042109 - protein, 18 aa, Mycobacterium
AVRAHYAPVFSRLGPYDR

SEQ ID NO: 1042110 - protein, 27 aa, Mycobacterium
AVRDCGVLVCFARRVLEPLGLRKAATD

SEQ ID NO: 1042111 - protein, 18 aa, Mycobacterium
AVRDGRPTVLQSLTEDPA

SEQ ID NO: 1042112 - protein, 25 aa, Mycobacterium
AVRRKLRLADVLAYREELHARRNRF

SEQ ID NO: 1042113 - protein, 20 aa, Mycobacterium
AVRTHFFDSYFIDAVAAGIR

SEQ ID NO: 1042114 - protein, 26 aa, Mycobacterium
AVRVIRTLRRLGIRSVAVYSDADARA

SEQ ID NO: 1042115 - protein, 20 aa, Mycobacterium
AVRVRTMYPPEVGLHAEALV

SEQ ID NO: 1042116 - protein, 19 aa, Mycobacterium
AVSADWGLDEILLPSTGPA

SEQ ID NO: 1042117 - protein, 23 aa, Mycobacterium
AVSAIPAVRVRLVDLQRQMAEGR

SEQ ID NO: 1042118 - protein, 29 aa, Mycobacterium
AVSALRANHPLFRRRRFFNGKPVGRRGEA

SEQ ID NO: 1042119 - protein, 18 aa, Mycobacterium
AVSARLTTRTLFFARSLP

SEQ ID NO: 1042120 - protein, 19 aa, Mycobacterium
AVSELVRFITTPRCIQAMI

SEQ ID NO: 1042121 - protein, 23 aa, Mycobacterium
AVSEVLRLGVAVAAGLESAHRLG

SEQ ID NO: 1042122 - protein, 25 aa, Mycobacterium
AVSHGDFNAVFGVGGGSAIANGATA

SEQ ID NO: 1042123 - protein, 24 aa, Mycobacterium
AVSIELSDGLGLPVLSVASMLARP

SEQ ID NO: 1042124 - protein, 24 aa, Mycobacterium
AVSPEIWTAIGPMLAGVVATGKAT

SEQ ID NO: 1042125 - protein, 18 aa, Mycobacterium
AVSSFGLSGTNAHVVLEQ

SEQ ID NO: 1042126 - protein, 26 aa, Mycobacterium
AVSSQAALFHDQFVQALTTGASSYAS

SEQ ID NO: 1042127 - protein, 24 aa, Mycobacterium
AVSSRYKAPFAFTGGSIARVTIDL

SEQ ID NO: 1042128 - protein, 19 aa, Mycobacterium
AVSVEFGMTGKICLSPEQC

SEQ ID NO: 1042129 - protein, 17 aa, Mycobacterium
AVTAEVGARAGLAVKAA

SEQ ID NO: 1042130 - protein, 18 aa, Mycobacterium
AVTAPADRPELLLEPEAP

SEQ ID NO: 1042131 - protein, 17 aa, Mycobacterium
AVTAYDAVCERLHTASL

SEQ ID NO: 1042132 - protein, 18 aa, Mycobacterium
AVTKAPVGWIPQRDGRVT

SEQ ID NO: 1042133 - protein, 28 aa, Mycobacterium
AVTPWLAATVSFAWRIRLISSATIDARV

SEQ ID NO: 1042134 - protein, 28 aa, Mycobacterium
AVTRARNSGMPVLFWLDPYRPHENELIK

SEQ ID NO: 1042135 - protein, 17 aa, Mycobacterium
AVTRSAVDLVVLSDNLV

SEQ ID NO: 1042136 - protein, 18 aa, Mycobacterium
AVVAARRALPQWAGVTTA

SEQ ID NO: 1042137 - protein, 20 aa, Mycobacterium
AVVADRRLDVEFSVAAGEVL

SEQ ID NO: 1042138 - protein, 17 aa, Mycobacterium
AVVALRDDLDLVLVDVS

SEQ ID NO: 1042139 - protein, 25 aa, Mycobacterium
AVVRAHCRHLATIVTIRGEIDAVNV

SEQ ID NO: 1042140 - protein, 24 aa, Mycobacterium
AVVYFLRKLIWTVPDFTAEPYFQR

SEQ ID NO: 1042141 - protein, 23 aa, Mycobacterium
AVYLADCRKLGITVLPPDVNESL

SEQ ID NO: 1042142 - protein, 26 aa, Mycobacterium
AWAGPPPLWWAQRFGIQPDLAEALVC

SEQ ID NO: 1042143 - protein, 20 aa, Mycobacterium
AWCRERFAATRARLEQLDWM

SEQ ID NO: 1042144 - protein, 29 aa, Mycobacterium
AWELAATRLGRFAGLVAIDRGHPAIADSE

SEQ ID NO: 1042145 - protein, 18 aa, Mycobacterium
AWEMKGRFPDILNNPATG

SEQ ID NO: 1042146 - protein, 23 aa, Mycobacterium
AWEPKTGAVGSLWDVVRDRRLNH

SEQ ID NO: 1042147 - protein, 18 aa, Mycobacterium
AWGLPYAALMAGADLVLP

SEQ ID NO: 1042148 - protein, 21 aa, Mycobacterium
AWIAEGLLGYLPAEAQDRLLD

SEQ ID NO: 1042149 - protein, 20 aa, Mycobacterium
AWIEQMKRIGIYGLAIGEAY

SEQ ID NO: 1042150 - protein, 17 aa, Mycobacterium
AWLACGPAIVALTFGDQ

SEQ ID NO: 1042151 - protein, 19 aa, Mycobacterium
AWLNSWLDRDLGVSGRLSV

SEQ ID NO: 1042152 - protein, 27 aa, Mycobacterium
AWLRDRLSEVLPAYMVPAAFMVIDELP

SEQ ID NO: 1042153 - protein, 18 aa, Mycobacterium
AWLRELTDLPLIVKGICH

SEQ ID NO: 1042154 - protein, 24 aa, Mycobacterium
AWPQISELVAALFAPQTMKELVAA

SEQ ID NO: 1042155 - protein, 21 aa, Mycobacterium
AWRGGEWYVARLFPGPLSADE

SEQ ID NO: 1042156 - protein, 19 aa, Mycobacterium
AWSGSRFAQRPVLPEDIHR

SEQ ID NO: 1042157 - protein, 17 aa, Mycobacterium
AWVPFGGGAKRCLGAAF

SEQ ID NO: 1042158 - protein, 25 aa, Mycobacterium
AWVPLEEVPEVWAAVTSVFRDYGYR

SEQ ID NO: 1042159 - protein, 19 aa, Mycobacterium
AWWFYPHSIVRGGIDKVHI

SEQ ID NO: 1042160 - protein, 18 aa, Mycobacterium
AYAAVLAGNKRYQEASDL

SEQ ID NO: 1042161 - protein, 19 aa, Mycobacterium
AYACSFRITEAVYFVERLV

SEQ ID NO: 1042162 - protein, 23 aa, Mycobacterium
AYAEGLRALYLYAAAHQDDAVAQ

SEQ ID NO: 1042163 - protein, 25 aa, Mycobacterium
AYAGHPRFLVPHIVASAPKVVIQEW

SEQ ID NO: 1042164 - protein, 30 aa, Mycobacterium; identical to SEQ ID NO: 78436

SEQ ID NO: 1042165 - protein, 25 aa, Mycobacterium
AYANRFGYNVVRDFTGHGIGTTFHN

SEQ ID NO: 1042166 - protein, 20 aa, Mycobacterium
AYARSRFTIAAKAAGLPSAI

SEQ ID NO: 1042167 - protein, 18 aa, Mycobacterium
AYDHLIPGRGVGVLLDDG

SEQ ID NO: 1042168 - protein, 19 aa, Mycobacterium
AYDIAALLAAHPVSVNGAE

SEQ ID NO: 1042169 - protein, 18 aa, Mycobacterium
AYDRAWLFTRFVADTYGT

SEQ ID NO: 1042170 - protein, 17 aa, Mycobacterium
AYEGEIFTVPEMSLRPE

SEQ ID NO: 1042171 - protein, 26 aa, Mycobacterium
AYEVNEAFAPVPLAWLCDIGADENRL

SEQ ID NO: 1042172 - protein, 17 aa, Mycobacterium
AYGGTFLQFSDYMRPAV

SEQ ID NO: 1042173 - protein, 30 aa, Mycobacterium
AYGLAAADGVMRWLEEHQRGVAMGTGVVPI

SEQ ID NO: 1042174 - protein, 19 aa, Mycobacterium
AYGPAGFLQYQFVVPTEAV

SEQ ID NO: 1042175 - protein, 18 aa, Mycobacterium
AYGRYMIRVKEMWESIKI

SEQ ID NO: 1042176 - protein, 24 aa, Mycobacterium
AYGWSSLRSRPALRDQVAGALHGA

SEQ ID NO: 1042177 - protein, 17 aa, Mycobacterium
AYHGWTYATDAVSTSTA

SEQ ID NO: 1042178 - protein, 30 aa, Mycobacterium; identical to SEQ ID NO: 640884

SEQ ID NO: 1042179 - protein, 18 aa, Mycobacterium
AYHPRAWQRIRGRLTGLG

SEQ ID NO: 1042180 - protein, 25 aa, Mycobacterium
AYLEGFAWGLSRGYSVLVEMDADGS

SEQ ID NO: 1042181 - protein, 25 aa, Mycobacterium
AYLERATDVVIRWNGTINEILGDGL

SEQ ID NO: 1042182 - protein, 17 aa, Mycobacterium
AYLKKVLQALTFLRGPQ

SEQ ID NO: 1042183 - protein, 27 aa, Mycobacterium
AYLQRMSTVIGRRVWENAGSPEVDTNR

SEQ ID NO: 1042184 - protein, 20 aa, Mycobacterium
AYLRDFRFSGDIDGYAEGEL

SEQ ID NO: 1042185 - protein, 18 aa, Mycobacterium
AYLTEAFQNLGPEIFETM

SEQ ID NO: 1042186 - protein, 19 aa, Mycobacterium
AYMRLPFGHGSDAWLAELA

SEQ ID NO: 1042187 - protein, 26 aa, Mycobacterium
AYNTLRSAGILPDLSVPISSVTNMLL

SEQ ID NO: 1042188 - protein, 20 aa, Mycobacterium
AYPNTRPMCSANCDGAAAAI

SEQ ID NO: 1042189 - protein, 28 aa, Mycobacterium
AYQLLSARAAAFHEQFLQALSGGGASYA

SEQ ID NO: 1042190 - protein, 18 aa, Mycobacterium
AYQVLSAQVAAFHQRFVE

SEQ ID NO: 1042191 - protein, 20 aa, Mycobacterium
AYRKGWLKKINVISSSMVFE

SEQ ID NO: 1042192 - protein, 29 aa, Mycobacterium
AYRRYAIERPHMYRLMFGSTSAHGINAPA

SEQ ID NO: 1042193 - protein, 18 aa, Mycobacterium
AYTPWYLVRYWRLLKFKL

SEQ ID NO: 1042194 - protein, 30 aa, Mycobacterium
AYVAAEAANVWPLQDLLGLINAPTQALLGR

SEQ ID NO: 1042195 - protein, 24 aa, Mycobacterium
AYVASCGADFGAVIDVVDTRTHKI

SEQ ID NO: 1042196 - protein, 24 aa, Mycobacterium
AYVCDINAFGFFPGLNDVMPIIVN

SEQ ID NO: 1042197 - protein, 24 aa, Mycobacterium
AYWSSHARRRFPLPDVLYTHLLGV

SEQ ID NO: 1042198 - protein, 19 aa, Mycobacterium
CAAAVEGLILGSYRFSAFR

SEQ ID NO: 1042199 - protein, 22 aa, Mycobacterium
CAAGFRAEMGVDLNAEIFNGTG

SEQ ID NO: 1042200 - protein, 24 aa, Mycobacterium
CAANPRLGWVKPIGLGSDKRDDYA

SEQ ID NO: 1042201 - protein, 18 aa, Mycobacterium
CAAQSWDIDRVETVKNAA

SEQ ID NO: 1042202 - protein, 17 aa, Mycobacterium
CAARTARAGGGVAGAAD

SEQ ID NO: 1042203 - protein, 17 aa, Mycobacterium
CADEILSLLGGQTTTGR

SEQ ID NO: 1042204 - protein, 28 aa, Mycobacterium
CAESLPSASGSLAWTPLMTQFQLIDKSI

SEQ ID NO: 1042205 - protein, 19 aa, Mycobacterium
CAFDPLTGRFVLVLEDLAA

SEQ ID NO: 1042206 - protein, 18 aa, Mycobacterium
CAHKAQLLASGVSMPDAL

SEQ ID NO: 1042207 - protein, 19 aa, Mycobacterium
CAHPALDRQSQLALTLRLV

SEQ ID NO: 1042208 - protein, 20 aa, Mycobacterium
CAHRRGPYGIAHWNHQVQRW

SEQ ID NO: 1042209 - protein, 19 aa, Mycobacterium
CAICLRVHAQLAELAGELD

SEQ ID NO: 1042210 - protein, 17 aa, Mycobacterium
CAIDAMSSRCFPSYALR

SEQ ID NO: 1042211 - protein, 18 aa, Mycobacterium
CAIEGFEAVRARLRRHGA

SEQ ID NO: 1042212 - protein, 18 aa, Mycobacterium
CAIIPNPTVEELADIAVC

SEQ ID NO: 1042213 - protein, 20 aa, Mycobacterium
CAKTQALVAERGFEITRAAA

SEQ ID NO: 1042214 - protein, 20 aa, Mycobacterium
CALGGPGRRTLFLLSSTDAY

SEQ ID NO: 1042215 - protein, 22 aa, Mycobacterium
CALLGLECVIYMGAVDTARQAL

SEQ ID NO: 1042216 - protein, 17 aa, Mycobacterium
CALLPMGSETLAFLRLP

SEQ ID NO: 1042217 - protein, 18 aa, Mycobacterium
CAPALYALFDSVRELAAP

SEQ ID NO: 1042218 - protein, 20 aa, Mycobacterium
CAPDHPWAREHRNWFTELPD

SEQ ID NO: 1042219 - protein, 22 aa, Mycobacterium
CAPDRIEAFRSWMDAAAVPSSE

SEQ ID NO: 1042220 - protein, 18 aa, Mycobacterium
CAPERRHDMLHDQVAMLA

SEQ ID NO: 1042221 - protein, 19 aa, Mycobacterium
CAQSALDYGWMDSVDTSGG

SEQ ID NO: 1042222 - protein, 23 aa, Mycobacterium
CAREVADVVAPVLGWTVEDIERE

SEQ ID NO: 1042223 - protein, 24 aa, Mycobacterium
CARGRARLARLLSYLDADINAVDM

SEQ ID NO: 1042224 - protein, 18 aa, Mycobacterium
CASDRWAYLPALEQVAAW

SEQ ID NO: 1042225 - protein, 18 aa, Mycobacterium
CATLKSHYLMIVKSNQAK

SEQ ID NO: 1042226 - protein, 19 aa, Mycobacterium
CAVRGPACRDCVVSVLLGV

SEQ ID NO: 1042227 - protein, 20 aa, Mycobacterium
CCGRSRFANAALRGPLLMAQ

SEQ ID NO: 1042228 - protein, 25 aa, Mycobacterium
CCSVPDIGTIWVRRATREELPELYA

SEQ ID NO: 1042229 - protein, 20 aa, Mycobacterium
CCVVGWPTLHGFEYGTERYV

SEQ ID NO: 1042230 - protein, 24 aa, Mycobacterium
CDAFETFPPFPFPAVFTLLRRPRS

SEQ ID NO: 1042231 - protein, 28 aa, Mycobacterium
CDAHRIAWSHLWERLSIEFSNHTEELRV

SEQ ID NO: 1042232 - protein, 19 aa, Mycobacterium
CDAMIRLGAVADVNVGIVT

SEQ ID NO: 1042233 - protein, 21 aa, Mycobacterium
CDAMISIRAEIDRVGSGQWPV

SEQ ID NO: 1042234 - protein, 17 aa, Mycobacterium
CDARYGSSVVGFQDGWR

SEQ ID NO: 1042235 - protein, 25 aa, Mycobacterium
CDASYSTYCLTHWARDRASGRFSVA

SEQ ID NO: 1042236 - protein, 17 aa, Mycobacterium
CDCADPAQLAALIDSTP

SEQ ID NO: 1042237 - protein, 24 aa, Mycobacterium
CDCGSQLDAAMAMVAREGRGVVLY

SEQ ID NO: 1042238 - protein, 19 aa, Mycobacterium
CDDCDAALVPRPVSGRGTV

SEQ ID NO: 1042239 - protein, 19 aa, Mycobacterium
CDGIGYPVELVIGAETVVL

SEQ ID NO: 1042240 - protein, 32 aa, Mycobacterium; identical to SEQ ID NO: 641263

SEQ ID NO: 1042241 - protein, 18 aa, Mycobacterium
CDIFARYDVTFSLGDGLR

SEQ ID NO: 1042242 - protein, 19 aa, Mycobacterium
CDIFARYDVTFSLGDGLRP

SEQ ID NO: 1042243 - protein, 17 aa, Mycobacterium
CDLQRPAAVNQLQVVGQ

SEQ ID NO: 1042244 - protein, 17 aa, Mycobacterium
CDPMEACDIYTRQCSTL

SEQ ID NO: 1042245 - protein, 22 aa, Mycobacterium
CDPPREFAWAVGEPDYPAAVWR

SEQ ID NO: 1042246 - protein, 19 aa, Mycobacterium
CDQALFGWTGWSVGAVVRG

SEQ ID NO: 1042247 - protein, 24 aa, Mycobacterium
CDQLMPEYLRFVKGVVDAQDMSLN

SEQ ID NO: 1042248 - protein, 25 aa, Mycobacterium
CDRPIADVCPVEWARMADRSVLQWD

SEQ ID NO: 1042249 - protein, 23 aa, Mycobacterium
CDSGEVLVPFVGAIVTSVSLDDR

SEQ ID NO: 1042250 - protein, 17 aa, Mycobacterium
CDVLGVGSAHFVGNSMG

SEQ ID NO: 1042251 - protein, 17 aa, Mycobacterium
CDVPIDGCVAVLVSTAE

SEQ ID NO: 1042252 - protein, 18 aa, Mycobacterium
CDVRAAATASGAWAGAEH

SEQ ID NO: 1042253 - protein, 18 aa, Mycobacterium
CDVRPAGRWIIDPDGAVV

SEQ ID NO: 1042254 - protein, 19 aa, Mycobacterium
CDYAPVVMVNWEFFDNQTP

SEQ ID NO: 1042255 - protein, 29 aa, Mycobacterium
CDYPGDPWVVPKFYWTVLGVSAFLAGRQA

SEQ ID NO: 1042256 - protein, 26 aa, Mycobacterium
CEACGNPFAGFGGWLMRRVGKSPSRK

SEQ ID NO: 1042257 - protein, 19 aa, Mycobacterium
CEAFLPAMIESGRGGHVVN

SEQ ID NO: 1042258 - protein, 27 aa, Mycobacterium
CEALYHFAWDEFCDWYVELAKTQLAEG

SEQ ID NO: 1042259 - protein, 18 aa, Mycobacterium
CEDGALTVVGFQWQGDHV

SEQ ID NO: 1042260 - protein, 28 aa, Mycobacterium
CEDIGVDIAFNWDHFFPLFGDPDGAHFE

SEQ ID NO: 1042261 - protein, 35 aa, Mycobacterium
CEECSGRLRKLFHAVGVVFKGSGFYRTDSREATKK

SEQ ID NO: 1042262 - protein, 27 aa, Mycobacterium
CEEEVDRACAPWGLLGEDKQATLVAGI

SEQ ID NO: 1042263 - protein, 17 aa, Mycobacterium
CEHFGPRLVRGRRPVAP

SEQ ID NO: 1042264 - protein, 21 aa, Mycobacterium
CEMTWNWDCLLPDGTIEYNPA

SEQ ID NO: 1042265 - protein, 17 aa, Mycobacterium
CENASRVIVHFYNSTSI

SEQ ID NO: 1042266 - protein, 17 aa, Mycobacterium
CEPVCPVESIYYEDDLP

SEQ ID NO: 1042267 - protein, 25 aa, Mycobacterium
CERCNCAKEAYGWRVETNMHETHTH

SEQ ID NO: 1042268 - protein, 17 aa, Mycobacterium
CERRKLVNFSTVYLDAN

SEQ ID NO: 1042269 - protein, 25 aa, Mycobacterium
CGAARLAGGALFWTDFIYDDHGATG

SEQ ID NO: 1042270 - protein, 18 aa, Mycobacterium
CGCRCAKPSAATPRGTTG

SEQ ID NO: 1042271 - protein, 24 aa, Mycobacterium
CGDACPYFPGVSYRDWTLADPAGQ

SEQ ID NO: 1042272 - protein, 17 aa, Mycobacterium
CGDRLNFRGQFYRHTLM

SEQ ID NO: 1042273 - protein, 18 aa, Mycobacterium
CGELRLADFDHLELSNLN

SEQ ID NO: 1042274 - protein, 23 aa, Mycobacterium
CGELSAKLAVLWFPNQGSEDVHR

SEQ ID NO: 1042275 - protein, 29 aa, Mycobacterium
CGFDTPYPPARLERLWLPGPDRLLDCVER

SEQ ID NO: 1042276 - protein, 17 aa, Mycobacterium
CGGCDRGGYRADARRTR

SEQ ID NO: 1042277 - protein, 26 aa, Mycobacterium
CGHKKSFVCGLHGWTYDQDGNCIHIP

SEQ ID NO: 1042278 - protein, 19 aa, Mycobacterium
CGHVGYPWTEEMVAVARKH

SEQ ID NO: 1042279 - protein, 21 aa, Mycobacterium
CGHVVLVPAISPLPEHRELAR

SEQ ID NO: 1042280 - protein, 25 aa, Mycobacterium
CGLEPNMRWRTFCAELLAIIEKLNV

SEQ ID NO: 1042281 - protein, 17 aa, Mycobacterium
CGLLHPDVKTANIMLTN

SEQ ID NO: 1042282 - protein, 26 aa, Mycobacterium
CGLLSEWRATLIVRESACLDIEHRRE

SEQ ID NO: 1042283 - protein, 24 aa, Mycobacterium
CGLPHALKFLLMLRGGARQTKSQG

SEQ ID NO: 1042284 - protein, 29 aa, Mycobacterium
CGLRPGQKLRIVKYLAYGWSSLRSRPALR

SEQ ID NO: 1042285 - protein, 18 aa, Mycobacterium
CGNGVRVFAHYLRASGLE

SEQ ID NO: 1042286 - protein, 18 aa, Mycobacterium
CGNIGSPVLDVLEEPADL

SEQ ID NO: 1042287 - protein, 19 aa, Mycobacterium
CGPESMLNQAEKVWSAAGI

SEQ ID NO: 1042288 - protein, 17 aa, Mycobacterium
CGSSQWLLRMLVTQTGR

SEQ ID NO: 1042289 - protein, 18 aa, Mycobacterium
CGVCNYCRSGTENLCVQS

SEQ ID NO: 1042290 - protein, 24 aa, Mycobacterium
CGYLPMVELLQYLTGNGFTNYIVS

SEQ ID NO: 1042291 - protein, 23 aa, Mycobacterium
CHEVSGWEVTPMGPFHQWPTGSG

SEQ ID NO: 1042292 - protein, 25 aa, Mycobacterium
CHGLQCGFCTPGMMITARALLDRNL

SEQ ID NO: 1042293 - protein, 23 aa, Mycobacterium
CHPAIRPGGFAAFAVADGNSETL

SEQ ID NO: 1042294 - protein, 17 aa, Mycobacterium
CHTCTRRKTSGTVRNLV

SEQ ID NO: 1042295 - protein, 25 aa, Mycobacterium
CIAAKRFIAHADIYDAFVDKFVEQM

SEQ ID NO: 1042296 - protein, 17 aa, Mycobacterium
CIARRIAAVLSEPAKVI

SEQ ID NO: 1042297 - protein, 20 aa, Mycobacterium
CILHSRLLLPEAMHDEIVDR

SEQ ID NO: 1042298 - protein, 18 aa, Mycobacterium
CINLSPTNAKWFFDNFGS

SEQ ID NO: 1042299 - protein, 24 aa, Mycobacterium
CKGVKEPVLSRVFEYWRNVDPDLG

SEQ ID NO: 1042300 - protein, 19 aa, Mycobacterium
CKLSFAETRVRAQSLVPEL

SEQ ID NO: 1042301 - protein, 21 aa, Mycobacterium
CKNLHLAECSWLVPVGQRDGL

SEQ ID NO: 1042302 - protein, 21 aa, Mycobacterium
CKPDHKLAGNGWQTTKLPNGR

SEQ ID NO: 1042303 - protein, 17 aa, Mycobacterium
CKSNVLYKGALQGDPGS

SEQ ID NO: 1042304 - protein, 17 aa, Mycobacterium
CKSNVLYKGALQGDPVS

SEQ ID NO: 1042305 - protein, 20 aa, Mycobacterium
CLDAGVKVGCFRPPTVPAGT

SEQ ID NO: 1042306 - protein, 26 aa, Mycobacterium
CLDGYPRPGKTVLFLGRYDEPRKGMS

SEQ ID NO: 1042307 - protein, 26 aa, Mycobacterium
CLDITVQWCRDRETFGRPLISRQSVQ

SEQ ID NO: 1042308 - protein, 20 aa, Mycobacterium
CLIGAAGRFGGMFSGADGEQ

SEQ ID NO: 1042309 - protein, 17 aa, Mycobacterium
CLLGVTIVGPRAAELLH

SEQ ID NO: 1042310 - protein, 19 aa, Mycobacterium
CLPDSPDLVQLLLACLARG

SEQ ID NO: 1042311 - protein, 18 aa, Mycobacterium
CLRRGEIEMVTRYEPDVV

SEQ ID NO: 1042312 - protein, 21 aa, Mycobacterium
CLRTFLREHGHFEVKMGCDAG

SEQ ID NO: 1042313 - protein, 20 aa, Mycobacterium
CLSLLSGECDVALAGGSSLC

SEQ ID NO: 1042314 - protein, 25 aa, Mycobacterium
CLTDDRIAYADGWFAETHDDSASIT

SEQ ID NO: 1042315 - protein, 21 aa, Mycobacterium
CLTGLSIRETVLFPIVRPHSN

SEQ ID NO: 1042316 - protein, 18 aa, Mycobacterium
CLVNSVAHALRFRPFASV

SEQ ID NO: 1042317 - protein, 19 aa, Mycobacterium
CLYVVGWDNLVHIVAVDLG

SEQ ID NO: 1042318 - protein, 20 aa, Mycobacterium
CMDNGMPILVFNLLTNGNIA

SEQ ID NO: 1042319 - protein, 17 aa, Mycobacterium
CMEELRRRDDLLLVAGM

SEQ ID NO: 1042320 - protein, 21 aa, Mycobacterium
CMLDADFLIDVGFVVVGPHPY

SEQ ID NO: 1042321 - protein, 23 aa, Mycobacterium
CMSLLKRLIRAHVHGRQVYLVPR

SEQ ID NO: 1042322 - protein, 19 aa, Mycobacterium
CNALPRRGISALRRRAKRR

SEQ ID NO: 1042323 - protein, 20 aa, Mycobacterium
CNGATIRLATGFHIGHALSH

SEQ ID NO: 1042324 - protein, 23 aa, Mycobacterium
CNIPMCRLNWPWSAKSVLIPGPM

SEQ ID NO: 1042325 - protein, 19 aa, Mycobacterium
CNPRSAAVRLRALQRTQHG

SEQ ID NO: 1042326 - protein, 24 aa, Mycobacterium
CNRCPVTIDCLSWALNTGQDSGVW

SEQ ID NO: 1042327 - protein, 20 aa, Mycobacterium
CNRIMTQFAAFLRGVNVGGV

SEQ ID NO: 1042328 - protein, 17 aa, Mycobacterium
CNTLTLWSARAIQSLAQ

SEQ ID NO: 1042329 - protein, 21 aa, Mycobacterium
CNYPPGMLRQFDAVLGTGSLL

SEQ ID NO: 1042330 - protein, 23 aa, Mycobacterium
CPAPCEPACVLGINQDPVTIKQI

SEQ ID NO: 1042331 - protein, 19 aa, Mycobacterium
CPAPFLPNRVQLQTMLDVA

SEQ ID NO: 1042332 - protein, 17 aa, Mycobacterium
CPDRVAAVASFHGSQLA

SEQ ID NO: 1042333 - protein, 20 aa, Mycobacterium
CPEPSELLVAVRACGVCRTD

SEQ ID NO: 1042334 - protein, 17 aa, Mycobacterium
CPGPITTVRYEWKGDHV

SEQ ID NO: 1042335 - protein, 25 aa, Mycobacterium
CPICRKEQLTLVSWVFGDHLGPVSG

SEQ ID NO: 1042336 - protein, 19 aa, Mycobacterium
CPIQRIADYGDWLQRFETA

SEQ ID NO: 1042337 - protein, 20 aa, Mycobacterium
CPKSFWRIDVAPLSRIALHY

SEQ ID NO: 1042338 - protein, 17 aa, Mycobacterium
CPLDAGPYTHGLTDVLV

SEQ ID NO: 1042339 - protein, 19 aa, Mycobacterium
CPNALDFYGQVIGMVAGRQ

SEQ ID NO: 1042340 - protein, 18 aa, Mycobacterium
CPNCRRGDTVNCLRIQLM

SEQ ID NO: 1042341 - protein, 21 aa, Mycobacterium
CPPATLTCWADFLARLREERD

SEQ ID NO: 1042342 - protein, 19 aa, Mycobacterium
CPPDGASNRSPIRYLNDGV

SEQ ID NO: 1042343 - protein, 22 aa, Mycobacterium
CPSWNFSRIGVGGQRFVFEQSA

SEQ ID NO: 1042344 - protein, 19 aa, Mycobacterium
CPTQTRIWWGAYLGTEDEL

SEQ ID NO: 1042345 - protein, 24 aa, Mycobacterium
CQIPRRIAPRPGPSRSSRGCTDSG

SEQ ID NO: 1042346 - protein, 18 aa, Mycobacterium
CQLFHTLPIPWVEAEDIS

SEQ ID NO: 1042347 - protein, 25 aa, Mycobacterium
CQQGFCGTCKVKVLAGQVDHRGRAA

SEQ ID NO: 1042348 - protein, 19 aa, Mycobacterium
CQQRHHLPGLDFVQGDAED

SEQ ID NO: 1042349 - protein, 22 aa, Mycobacterium
CQSILGYVVRWIDQGVGCSKVP

SEQ ID NO: 1042350 - protein, 18 aa, Mycobacterium
CRAFDAAADGFVRGEGAG

SEQ ID NO: 1042351 - protein, 21 aa, Mycobacterium
CRALLSSRGRHIMVAGDEPSS

SEQ ID NO: 1042352 - protein, 18 aa, Mycobacterium
CRDDELFVVGRLKDLVIV

SEQ ID NO: 1042353 - protein, 18 aa, Mycobacterium
CRDGRIVTSTSWRLRIQG

SEQ ID NO: 1042354 - protein, 20 aa, Mycobacterium
CRDSVEWFAQRGILVALGEF

SEQ ID NO: 1042355 - protein, 25 aa, Mycobacterium
CRDTLRLEAGMALYGHELSLETSPY

SEQ ID NO: 1042356 - protein, 23 aa, Mycobacterium
CREQRPPGANARRLAVICAATVL

SEQ ID NO: 1042357 - protein, 18 aa, Mycobacterium
CREYLSMDIAVAVVDGVD

SEQ ID NO: 1042358 - protein, 18 aa, Mycobacterium
CRIHHGVTIGEGRAGEYP

SEQ ID NO: 1042359 - protein, 18 aa, Mycobacterium
CRITVNGVVRAERTADAH

SEQ ID NO: 1042360 - protein, 22 aa, Mycobacterium
CRKGHVRQALRQGGPDAAERVL

SEQ ID NO: 1042361 - protein, 20 aa, Mycobacterium
CRKRELAVELLRVVAESTGN

SEQ ID NO: 1042362 - protein, 17 aa, Mycobacterium
CRLATGCNIPMCRLNWP

SEQ ID NO: 1042363 - protein, 17 aa, Mycobacterium
CRMGICQSCVVDLVQGH

SEQ ID NO: 1042364 - protein, 19 aa, Mycobacterium
CRSTCLPAWGTTSSPGRCR

SEQ ID NO: 1042365 - protein, 19 aa, Mycobacterium
CRVIRRHGRVMVICSDPRH

SEQ ID NO: 1042366 - protein, 31 aa, Mycobacterium
CSAHPLVKAQICSRLAVTELYRRLRDFERDA

SEQ ID NO: 1042367 - protein, 18 aa, Mycobacterium
CSAIHPMAVGSEFLAGLD

SEQ ID NO: 1042368 - protein, 21 aa, Mycobacterium
CSALARRYRDALRENCPQVEF

SEQ ID NO: 1042369 - protein, 18 aa, Mycobacterium
CSCCERGIEQYCKRGATF

SEQ ID NO: 1042370 - protein, 20 aa, Mycobacterium
CSEQERLAAEFAYRFATEHT

SEQ ID NO: 1042371 - protein, 18 aa, Mycobacterium
CSIQRRYQKLVEIAPAQQ

SEQ ID NO: 1042372 - protein, 17 aa, Mycobacterium
CSLQRRYQKLVEEAPAP

SEQ ID NO: 1042373 - protein, 21 aa, Mycobacterium
CSLTFPGYKPSAAGLVGSALF

SEQ ID NO: 1042374 - protein, 26 aa, Mycobacterium
CSPSELMSGALPVARQLFGKDIAPAE

SEQ ID NO: 1042375 - protein, 22 aa, Mycobacterium
CSQLPVAVICDILGVPSRDRNR

SEQ ID NO: 1042376 - protein, 19 aa, Mycobacterium
CTALWRRDQKLFAEVALPE

SEQ ID NO: 1042377 - protein, 24 aa, Mycobacterium
CTAPMEIVGRFLALLELYRSRAVA

SEQ ID NO: 1042378 - protein, 20 aa, Mycobacterium
CTDEVTGMFISLMFAGHHTS

SEQ ID NO: 1042379 - protein, 18 aa, Mycobacterium
CTHCNQCMPTIYSRTRCV

SEQ ID NO: 1042380 - protein, 17 aa, Mycobacterium
CTHYPLAEAAEAIRTMS

SEQ ID NO: 1042381 - protein, 29 aa, Mycobacterium
CTIGDPLLDLGWLLATWRQSDGASVFGHA

SEQ ID NO: 1042382 - protein, 20 aa, Mycobacterium
CTPGALALPSHDEMFSAAHL

SEQ ID NO: 1042383 - protein, 17 aa, Mycobacterium
CTQRVARRLVAAGLPGS

SEQ ID NO: 1042384 - protein, 21 aa, Mycobacterium
CTSYFPKFRALCMAENATHNL

SEQ ID NO: 1042385 - protein, 19 aa, Mycobacterium
CTYREGLSAVRVDGGVAGN

SEQ ID NO: 1042386 - protein, 20 aa, Mycobacterium
CVAADFSVGMLAAGHERRVC

SEQ ID NO: 1042387 - protein, 24 aa, Mycobacterium
CVAAGIPAVTFWAAVPHYVSHPPN

SEQ ID NO: 1042388 - protein, 17 aa, Mycobacterium
CVAQCRPNTAPTVLQTD

SEQ ID NO: 1042389 - protein, 17 aa, Mycobacterium
CVCPGTIVTASFTEQLK

SEQ ID NO: 1042390 - protein, 20 aa, Mycobacterium
CVDLALERFGSVDILINNAG

SEQ ID NO: 1042391 - protein, 28 aa, Mycobacterium
CVEEAFKYPGTHWRFEYSPESYTGTELE

SEQ ID NO: 1042392 - protein, 18 aa, Mycobacterium
CVEECPVDCIYEGGRSLY

SEQ ID NO: 1042393 - protein, 19 aa, Mycobacterium
CVEFSAARPGMLGLQTALS

SEQ ID NO: 1042394 - protein, 25 aa, Mycobacterium
CVGQTRILAPRSRYEEIVEAVSAFV

SEQ ID NO: 1042395 - protein, 17 aa, Mycobacterium
CVGTCHLDGPAVEAHAR

SEQ ID NO: 1042396 - protein, 23 aa, Mycobacterium
CVGVDRFARVRDIAALDFVSAPV

SEQ ID NO: 1042397 - protein, 17 aa, Mycobacterium
CVHELVDALGIPQPLVS

SEQ ID NO: 1042398 - protein, 22 aa, Mycobacterium
CVHFEPRIHRVLGLRDHSALTV

SEQ ID NO: 1042399 - protein, 19 aa, Mycobacterium
CVIGLQWIPENILHFVGTR

SEQ ID NO: 1042400 - protein, 23 aa, Mycobacterium
CVLAKDCPSYGLGPTEPLLAAPL

SEQ ID NO: 1042401 - protein, 18 aa, Mycobacterium
CVLYACAQLPDLAGRHVA

SEQ ID NO: 1042402 - protein, 19 aa, Mycobacterium
CVMRPHLFLQKNQAWNLHR

SEQ ID NO: 1042403 - protein, 19 aa, Mycobacterium
CVPGAKLGVDLWVEEVNPP

SEQ ID NO: 1042404 - protein, 19 aa, Mycobacterium
CVPSMLDMILDLGGDRLGN

SEQ ID NO: 1042405 - protein, 22 aa, Mycobacterium
CVSACPVGAIAPDSRLDSKQLP

SEQ ID NO: 1042406 - protein, 20 aa, Mycobacterium
CVSVQWGQWTVHFDLDASSM

SEQ ID NO: 1042407 - protein, 23 aa, Mycobacterium
CVVKAADGRVVWDNDAYSFLDGP

SEQ ID NO: 1042408 - protein, 26 aa, Mycobacterium
CVWVARLAVDFRQRFNKDVIIDMLCY

SEQ ID NO: 1042409 - protein, 32 aa, Mycobacterium
CWATRPVRAVQRWAACQGKILRAVIATEQQFA

SEQ ID NO: 1042410 - protein, 18 aa, Mycobacterium
CWHLGVLPLQDGGTAVSV

SEQ ID NO: 1042411 - protein, 18 aa, Mycobacterium
CWNTCTEDRCCDCTCDCC

SEQ ID NO: 1042412 - protein, 17 aa, Mycobacterium
CWVAEAWGSDAPSALGY

SEQ ID NO: 1042413 - protein, 18 aa, Mycobacterium
CWYAPELDVVFSGDTLFC

SEQ ID NO: 1042414 - protein, 19 aa, Mycobacterium
CYAALLWLRQQQWVDPSRI

SEQ ID NO: 1042415 - protein, 17 aa, Mycobacterium
CYQGLRHRRGLPVRGQR

SEQ ID NO: 1042416 - protein, 19 aa, Mycobacterium
CYWSHPRALVRGRFSREVY

SEQ ID NO: 1042417 - protein, 21 aa, Mycobacterium
DAAAAAQGWADRVEIVHTSIA

SEQ ID NO: 1042418 - protein, 29 aa, Mycobacterium
DAAAGFDVGDRVGIAWLRYTCGVCNYCRS

SEQ ID NO: 1042419 - protein, 20 aa, Mycobacterium
DAAAQMWSRTALKPADLEVA

SEQ ID NO: 1042420 - protein, 25 aa, Mycobacterium
DAAAVQIMTVWVSKGLQYPVVYLPF

SEQ ID NO: 1042421 - protein, 27 aa, Mycobacterium
DAADGRCWPEFVLGAAYEGPPGLVHGG

SEQ ID NO: 1042422 - protein, 25 aa, Mycobacterium
DAAGRLRIAAAVGINGDVAAKAGAL

SEQ ID NO: 1042423 - protein, 20 aa, Mycobacterium
DAAGVTARFNRNVLAVVNRE

SEQ ID NO: 1042424 - protein, 17 aa, Mycobacterium
DAAIKWYHDHLGLILVH

SEQ ID NO: 1042425 - protein, 18 aa, Mycobacterium
DAAITSVRHPLRWHHPAL

SEQ ID NO: 1042426 - protein, 24 aa, Mycobacterium
DAALARDFLTIWFAQLHSQVAEIR

SEQ ID NO: 1042427 - protein, 23 aa, Mycobacterium
DAALDRFGPPAGDPAWVVKDDHL

SEQ ID NO: 1042428 - protein, 31 aa, Mycobacterium
DAALSAAGYLCWRGKDLATARGWITALRAYN

SEQ ID NO: 1042429 - protein, 19 aa, Mycobacterium
DAANMIASYEFLRLLEHRL

SEQ ID NO: 1042430 - protein, 19 aa, Mycobacterium
DAAPTLGAGLDWKTSLQEL

SEQ ID NO: 1042431 - protein, 18 aa, Mycobacterium
DAAQACNLVHVYPDTVVH

SEQ ID NO: 1042432 - protein, 24 aa, Mycobacterium
DAARRARVAARALAVMPTVAKDHA

SEQ ID NO: 1042433 - protein, 19 aa, Mycobacterium
DAARWARENIDGWHPERLH

SEQ ID NO: 1042434 - protein, 18 aa, Mycobacterium
DAASGRRGKPEPSPVARA

SEQ ID NO: 1042435 - protein, 23 aa, Mycobacterium
DAATRKALLEALLRHVPTGDLDI

SEQ ID NO: 1042436 - protein, 18 aa, Mycobacterium
DADEIYFAALEGIRKVQY

SEQ ID NO: 1042437 - protein, 20 aa, Mycobacterium
DADGLRALFTTWITAPQPDI

SEQ ID NO: 1042438 - protein, 21 aa, Mycobacterium
DADLDRLLAAIAQEQANAEHL

SEQ ID NO: 1042439 - protein, 23 aa, Mycobacterium
DADRAVRVARRIRTGQIAVNGFG

SEQ ID NO: 1042440 - protein, 22 aa, Mycobacterium
DADRYRRLHVIIGDANLSETST

SEQ ID NO: 1042441 - protein, 24 aa, Mycobacterium
DADSHLLGVVAFRALVLADPERLV

SEQ ID NO: 1042442 - protein, 26 aa, Mycobacterium
DADVIRYLRWFTFLVAEELTELEQAT

SEQ ID NO: 1042443 - protein, 26 aa, Mycobacterium
DAEAATPLYLRYVIFGGERLTSSDLI

SEQ ID NO: 1042444 - protein, 21 aa, Mycobacterium
DAEARAGIVRVHLRDRPVAGI

SEQ ID NO: 1042445 - protein, 17 aa, Mycobacterium
DAEIPAAANRDWTGTTR

SEQ ID NO: 1042446 - protein, 23 aa, Mycobacterium
DAEKYRRLHVIVGDSNMCETTTM

SEQ ID NO: 1042447 - protein, 28 aa, Mycobacterium
DAELRIAQAQLVGWLEGLFHGIQTALFA

SEQ ID NO: 1042448 - protein, 25 aa, Mycobacterium
DAENCLRAAVLDFSDNVRRAERAIV

SEQ ID NO: 1042449 - protein, 19 aa, Mycobacterium
DAFDAMFGYPGPTVAAING

SEQ ID NO: 1042450 - protein, 32 aa, Mycobacterium; identical to SEQ ID NO: 642618

SEQ ID NO: 1042451 - protein, 22 aa, Mycobacterium
DAGCGPGRLGRHLAAAGHRVVG

SEQ ID NO: 1042452 - protein, 20 aa, Mycobacterium
DAGDCGACSVLVDGAAVHSC

SEQ ID NO: 1042453 - protein, 18 aa, Mycobacterium
DAGLVLRVAAAAAHAGLP

SEQ ID NO: 1042454 - protein, 18 aa, Mycobacterium
DAGMEVCCGGILGMGETL

SEQ ID NO: 1042455 - protein, 19 aa, Mycobacterium
DAGPDEWGAVPGPLDELSC

SEQ ID NO: 1042456 - protein, 23 aa, Mycobacterium
DAGRQIRDAFVVGDGYSELMTAD

SEQ ID NO: 1042457 - protein, 34 aa, Mycobacterium
DAGSTSMLEAAAAWGSLADELQVAASSFSSVTAG

SEQ ID NO: 1042458 - protein, 21 aa, Mycobacterium
DAGSVWVCHAEGTLGADSAQP

SEQ ID NO: 1042459 - protein, 25 aa, Mycobacterium
DAGTALTARTARTACTAATANGAIT

SEQ ID NO: 1042460 - protein, 20 aa, Mycobacterium
DAGVLAALLLNRISLAPGEA

SEQ ID NO: 1042461 - protein, 25 aa, Mycobacterium
DAGVLRPLPVTAFDVRRAPAALRYL

SEQ ID NO: 1042462 - protein, 20 aa, Mycobacterium
DAGVYRWTVTPGHTAVGAVV

SEQ ID NO: 1042463 - protein, 23 aa, Mycobacterium
DAHARLLVWELIDALRRDGVTVV

SEQ ID NO: 1042464 - protein, 19 aa, Mycobacterium
DAHLYLRRAHSIGRFLGGA

SEQ ID NO: 1042465 - protein, 26 aa, Mycobacterium
DAIARFKRLDGFDVRFLTGTDEHGLK

SEQ ID NO: 1042466 - protein, 22 aa, Mycobacterium
DAIKELFSMSATRYYQVLNALV

SEQ ID NO: 1042467 - protein, 23 aa, Mycobacterium
DAIKERFPQINWSITPGNSSPLS

SEQ ID NO: 1042468 - protein, 28 aa, Mycobacterium
DAIVRPLLRFFFKSWFRVEVSGVENIPS

SEQ ID NO: 1042469 - protein, 26 aa, Mycobacterium
DAKAFARLGIRCFGFSPLRLPPELDF

SEQ ID NO: 1042470 - protein, 31 aa, Mycobacterium; identical to SEQ ID NO: 87302

SEQ ID NO: 1042471 - protein, 21 aa, Mycobacterium
DAKRMFACFDQPDLKATFEIR

SEQ ID NO: 1042472 - protein, 17 aa, Mycobacterium
DALACADAGCQDRGSAH

SEQ ID NO: 1042473 - protein, 24 aa, Mycobacterium
DALARLAPMRAVLSAGAAQLSVAD

SEQ ID NO: 1042474 - protein, 18 aa, Mycobacterium
DALAYARHALGLPATTVN

SEQ ID NO: 1042475 - protein, 24 aa, Mycobacterium
DALGPRFWAEDAIAVMDAAGCQQA

SEQ ID NO: 1042476 - protein, 17 aa, Mycobacterium
DALKLWNVVSGMAELPH

SEQ ID NO: 1042477 - protein, 24 aa, Mycobacterium
DALLGVPVPADFTGSLLASGSADA

SEQ ID NO: 1042478 - protein, 18 aa, Mycobacterium
DALLMFGAIGYTWEHDMH

SEQ ID NO: 1042479 - protein, 31 aa, Mycobacterium
DALLPNFLRVWGPRGAFLPLLRAAATNRDAA

SEQ ID NO: 1042480 - protein, 23 aa, Mycobacterium
DALPHPHWWFDLLTTEPLAFASL

SEQ ID NO: 1042481 - protein, 28 aa, Mycobacterium
DALPRRLADGLPIVFGTKVDSIVHKDDS

SEQ ID NO: 1042482 - protein, 17 aa, Mycobacterium
DALQELTRLAVHQKTGV

SEQ ID NO: 1042483 - protein, 25 aa, Mycobacterium
DALRAHILPVIFEWYVGHEVNGIGA

SEQ ID NO: 1042484 - protein, 19 aa, Mycobacterium
DALRLRHYVLTAAADAAAG

SEQ ID NO: 1042485 - protein, 23 aa, Mycobacterium
DALRLRVVRRATLGRRGIQNLPI

SEQ ID NO: 1042486 - protein, 22 aa, Mycobacterium
DALRPMMRLVVTNGTAKEIAGC

SEQ ID NO: 1042487 - protein, 17 aa, Mycobacterium
DALSVLVRLLASLHDDD

SEQ ID NO: 1042488 - protein, 22 aa, Mycobacterium
DALTSAARDVRGIGAAVDAANL

SEQ ID NO: 1042489 - protein, 25 aa, Mycobacterium
DALVGQCWPAVFAAIGSAVTDSGVP

SEQ ID NO: 1042490 - protein, 17 aa, Mycobacterium
DAMFPARAFDALVAIVA

SEQ ID NO: 1042491 - protein, 20 aa, Mycobacterium
DANFGWSARDACYCYGSFVL

SEQ ID NO: 1042492 - protein, 20 aa, Mycobacterium
DANIGSIMGIGFPPWTGGSA

SEQ ID NO: 1042493 - protein, 25 aa, Mycobacterium
DANTNAGLFLRYVIFGGENLSFADL

SEQ ID NO: 1042494 - protein, 25 aa, Mycobacterium
DAPDGYRLTVDYAVRITGRGLYVHS

SEQ ID NO: 1042495 - protein, 21 aa, Mycobacterium
DAPEFRCFITGGAPMPEALIR

SEQ ID NO: 1042496 - protein, 17 aa, Mycobacterium
DAPKRLGSFMDSRLWRL

SEQ ID NO: 1042497 - protein, 24 aa, Mycobacterium
DAPLPRVSIFLSVFDAHVQRAPVS

SEQ ID NO: 1042498 - protein, 25 aa, Mycobacterium
DAPRNRMGLAYVERLSEVVDDIAAD

SEQ ID NO: 1042499 - protein, 17 aa, Mycobacterium
DAPRTAEVLVEMSAAGL

SEQ ID NO: 1042500 - protein, 27 aa, Mycobacterium
DAPVADYWPEFGVKGKSAITVSDLLRH

SEQ ID NO: 1042501 - protein, 18 aa, Mycobacterium
DAPWKDIEAQGWIAPAEC

SEQ ID NO: 1042502 - protein, 22 aa, Mycobacterium
DAPYAHGWATWFPPDGPPRTGR

SEQ ID NO: 1042503 - protein, 21 aa, Mycobacterium
DAQAGLCAQAGLGAEPEPETG

SEQ ID NO: 1042504 - protein, 30 aa, Mycobacterium
DAQITIFRLGSDRGLARFIDQVARRVEGRV

SEQ ID NO: 1042505 - protein, 25 aa, Mycobacterium
DAQSGSIGLGFAIPVDQAKRIADEL

SEQ ID NO: 1042506 - protein, 23 aa, Mycobacterium
DAQVRERLALGFGSSSFRYAGPA

SEQ ID NO: 1042507 - protein, 20 aa, Mycobacterium
DARAAGWIGRPPHEELQRKV

SEQ ID NO: 1042508 - protein, 17 aa, Mycobacterium
DARFGVGLVSVVVIVAW

SEQ ID NO: 1042509 - protein, 25 aa, Mycobacterium
DARLPARTDQVWGLSWRVPDADAAR

SEQ ID NO: 1042510 - protein, 22 aa, Mycobacterium
DARLRAAVAGAILKGIASQPFI

SEQ ID NO: 1042511 - protein, 20 aa, Mycobacterium
DARLRRRLERVAEHWEARRG

SEQ ID NO: 1042512 - protein, 19 aa, Mycobacterium
DARMAIAAIAVLRVGAVLL

SEQ ID NO: 1042513 - protein, 23 aa, Mycobacterium
DARTDIRPALLVHTSLATVKFVF

SEQ ID NO: 1042514 - protein, 19 aa, Mycobacterium
DARTDVSLVVRMHHDADFV

SEQ ID NO: 1042515 - protein, 26 aa, Mycobacterium
DASASVVCGIGFADLSSFTVLTQTLT

SEQ ID NO: 1042516 - protein, 19 aa, Mycobacterium
DASAWAGVGTPNFVNVPTD

SEQ ID NO: 1042517 - protein, 24 aa, Mycobacterium
DASLRLVAPGGVFLEMGKTDIREA

SEQ ID NO: 1042518 - protein, 18 aa, Mycobacterium
DASLRSWLAFGAEKVAEV

SEQ ID NO: 1042519 - protein, 23 aa, Mycobacterium
DASPAFLGFNLFQHAIARAVIHG

SEQ ID NO: 1042520 - protein, 29 aa, Mycobacterium
DASSWKGRWPLGRGFERFYGFLGGETNQW

SEQ ID NO: 1042521 - protein, 23 aa, Mycobacterium
DASWPASRAELVLADSAPSAVLT

SEQ ID NO: 1042522 - protein, 21 aa, Mycobacterium
DASWTPVSFRRNMSGVDLPSV

SEQ ID NO: 1042523 - protein, 24 aa, Mycobacterium
DATAEFAWGLLIATVHNLAEEHRQ

SEQ ID NO: 1042524 - protein, 25 aa, Mycobacterium
DATAVAGYGARFAGVAFPGETLTVN

SEQ ID NO: 1042525 - protein, 18 aa, Mycobacterium
DATCAAAAAAGRAVSDHP

SEQ ID NO: 1042526 - protein, 18 aa, Mycobacterium
DATIRFYTRVLGMEQETF

SEQ ID NO: 1042527 - protein, 17 aa, Mycobacterium
DATRLKLRRIVESSLIG

SEQ ID NO: 1042528 - protein, 25 aa, Mycobacterium
DATRSRVGLPRMAHVLAKAADAGTA

SEQ ID NO: 1042529 - protein, 22 aa, Mycobacterium
DATRVQVLWSLADREMSVNELA

SEQ ID NO: 1042530 - protein, 24 aa, Mycobacterium
DATVEVAIRLGVDPRKADQMVRGT

SEQ ID NO: 1042531 - protein, 18 aa, Mycobacterium
DAVAAWRTGSDTEPVVLR

SEQ ID NO: 1042532 - protein, 23 aa, Mycobacterium
DAVAEMTVALLLASTRHLLTADA

SEQ ID NO: 1042533 - protein, 20 aa, Mycobacterium
DAVFTAEAWGSDAYTPLAWW

SEQ ID NO: 1042534 - protein, 23 aa, Mycobacterium
DAVGADPCGWVLGGGEDHALVAC

SEQ ID NO: 1042535 - protein, 17 aa, Mycobacterium
DAVGKAFIEVAGPDDEI

SEQ ID NO: 1042536 - protein, 27 aa, Mycobacterium
DAVGRGDFRAPLVIGDRLDTDIEGANA

SEQ ID NO: 1042537 - protein, 19 aa, Mycobacterium
DAVHSGARVIARCRAERVL

SEQ ID NO: 1042538 - protein, 22 aa, Mycobacterium
DAVIYHARFGPTLAETLEKAGG

SEQ ID NO: 1042539 - protein, 25 aa, Mycobacterium
DAVLPLRWTDGGMNRVRVLRGAPSG

SEQ ID NO: 1042540 - protein, 17 aa, Mycobacterium
DAVPYLFEREGTNCENL

SEQ ID NO: 1042541 - protein, 23 aa, Mycobacterium
DAVRPCPPVVIWSLSPPDLRGDD

SEQ ID NO: 1042542 - protein, 21 aa, Mycobacterium
DAVSFAGRIDGAIARLTGLEI

SEQ ID NO: 1042543 - protein, 17 aa, Mycobacterium
DAVSTPFGAVVRTGKVA

SEQ ID NO: 1042544 - protein, 22 aa, Mycobacterium
DAVTGMAGLLAWSQAPTRALGR

SEQ ID NO: 1042545 - protein, 18 aa, Mycobacterium
DAYACGRGTDELEQRLVA

SEQ ID NO: 1042546 - protein, 25 aa, Mycobacterium
DAYKTGRGSIRMRGVVEIEEDSRGR

SEQ ID NO: 1042547 - protein, 19 aa, Mycobacterium
DAYVTWDYCRGYADASLNE

SEQ ID NO: 1042548 - protein, 26 aa, Mycobacterium
DCAEVLDWPAKLRLLEGFRQRENLNW

SEQ ID NO: 1042549 - protein, 19 aa, Mycobacterium
DCAFLADWSGVPVGNEEGE

SEQ ID NO: 1042550 - protein, 26 aa, Mycobacterium
DCARELRESPAWITGFEHRIESPSLG

SEQ ID NO: 1042551 - protein, 17 aa, Mycobacterium
DCAVTDMLVARMPADHV

SEQ ID NO: 1042552 - protein, 26 aa, Mycobacterium
DCGADFRLTDAAAWERFYGSAHSGSW

SEQ ID NO: 1042553 - protein, 18 aa, Mycobacterium
DCKSNVLYKGALQGDPVS

SEQ ID NO: 1042554 - protein, 23 aa, Mycobacterium
DCLGRARAAALVRVNRLGRSSGA

SEQ ID NO: 1042555 - protein, 18 aa, Mycobacterium
DCRDHYERTEMRDQSQFQ

SEQ ID NO: 1042556 - protein, 29 aa, Mycobacterium
DCRTPTIASVHGWCIGGGVDLISAVDMRY

SEQ ID NO: 1042557 - protein, 24 aa, Mycobacterium
DCSDPARLAGWWAEHFGGTAHELL

SEQ ID NO: 1042558 - protein, 22 aa, Mycobacterium
DCTGLLPLASVAAMQGRIAMYH

SEQ ID NO: 1042559 - protein, 23 aa, Mycobacterium
DCTRRLLRHYVMLALTAMLEAPV

SEQ ID NO: 1042560 - protein, 23 aa, Mycobacterium
DCVLGPHGVRCGQQLVGFGQLPT

SEQ ID NO: 1042561 - protein, 18 aa, Mycobacterium
DDAAYAFALSRLSDQNLE

SEQ ID NO: 1042562 - protein, 17 aa, Mycobacterium
DDADFASAAAFGVTYRT

SEQ ID NO: 1042563 - protein, 22 aa, Mycobacterium
DDALMKITHVLRGEDLLPSTPR

SEQ ID NO: 1042564 - protein, 20 aa, Mycobacterium
DDARGDGVVCGRDLADPALV

SEQ ID NO: 1042565 - protein, 31 aa, Mycobacterium; identical to SEQ ID NO: 643414

SEQ ID NO: 1042566 - protein, 19 aa, Mycobacterium
DDATVRFLLTAGAIGSLFK

SEQ ID NO: 1042567 - protein, 22 aa, Mycobacterium
DDCHDGYRWLRLLGYDPEQIVL

SEQ ID NO: 1042568 - protein, 25 aa, Mycobacterium
DDDEIRVPWELKPRRRSNPGHRSSP

SEQ ID NO: 1042569 - protein, 29 aa, Mycobacterium
DDDLAVLGYYEWREGLLRGLAAHHAGMLP

SEQ ID NO: 1042570 - protein, 31 aa, Mycobacterium
DDDPSAGCRECHWCSCSGVRIGEAIEAGKPG

SEQ ID NO: 1042571 - protein, 43 aa, Mycobacterium; identical to SEQ ID NO: 643470

SEQ ID NO: 1042572 - protein, 22 aa, Mycobacterium
DDEPRWSAAESKPKPVHQGLPL

SEQ ID NO: 1042573 - protein, 23 aa, Mycobacterium
DDEVNIAPWLRAAHRHGAKVKWA

SEQ ID NO: 1042574 - protein, 24 aa, Mycobacterium
DDFQRRACAALEGGHGVLVCAPTG

SEQ ID NO: 1042575 - protein, 24 aa, Mycobacterium
DDGFVNVVYRWARTGDLSAALAAA

SEQ ID NO: 1042576 - protein, 24 aa, Mycobacterium
DDGIGLDEFVDWLNESGCPIQRIA

SEQ ID NO: 1042577 - protein, 31 aa, Mycobacterium
DDGPMKPVRLWSRIRRRPIFAAGNSNGDIEM

SEQ ID NO: 1042578 - protein, 22 aa, Mycobacterium
DDGRTVIHLNPFAAQGDNSYFP

SEQ ID NO: 1042579 - protein, 26 aa, Mycobacterium
DDGYLRAAVRPEWPQLVDAIAEVRQA

SEQ ID NO: 1042580 - protein, 17 aa, Mycobacterium
DDIKHAKLLSGKGIHML

SEQ ID NO: 1042581 - protein, 17 aa, Mycobacterium
DDLECVNLASTLNDALD

SEQ ID NO: 1042582 - protein, 24 aa, Mycobacterium
DDLGALSSWYVWAALGLYPITAGT

SEQ ID NO: 1042583 - protein, 20 aa, Mycobacterium
DDLKPLLEFIVAGRLATTVK

SEQ ID NO: 1042584 - protein, 24 aa, Mycobacterium
DDLRLECACPIPWDIDLNETAPIS

SEQ ID NO: 1042585 - protein, 25 aa, Mycobacterium
DDLRLECACPIPWDIDLNGTAPISE

SEQ ID NO: 1042586 - protein, 25 aa, Mycobacterium
DDMPDEPKPVLARQMEIYAGFLEQT

SEQ ID NO: 1042587 - protein, 24 aa, Mycobacterium
DDNISVKLFDDWSNLGSVSDLSAS

SEQ ID NO: 1042588 - protein, 19 aa, Mycobacterium
DDPESWTLATYRRHDGYRA

SEQ ID NO: 1042589 - protein, 17 aa, Mycobacterium
DDPGMIVMHGISFSSTC

SEQ ID NO: 1042590 - protein, 17 aa, Mycobacterium
DDPKVAAILAFAMAVNE

SEQ ID NO: 1042591 - protein, 27 aa, Mycobacterium
DDPLAMYLFDLCTLPLNLAGHCGMSVP

SEQ ID NO: 1042592 - protein, 23 aa, Mycobacterium
DDPRRRLAAAMAKASAGECQSLV

SEQ ID NO: 1042593 - protein, 23 aa, Mycobacterium
DDPRYLGCSIMPGDYPNCAITTA

SEQ ID NO: 1042594 - protein, 35 aa, Mycobacterium
DDQRLRRLLMFVARQEPRLNWAIGRQSEGTVLVTD

SEQ ID NO: 1042595 - protein, 23 aa, Mycobacterium
DDRSDRGPGRFFTMRLALSDIGV

SEQ ID NO: 1042596 - protein, 24 aa, Mycobacterium
DDRVYKRGALALHSLRGRLGDAKF

SEQ ID NO: 1042597 - protein, 32 aa, Mycobacterium
DDRWTMFHSVAFDFSVWELWGALLHGACVVVV

SEQ ID NO: 1042598 - protein, 25 aa, Mycobacterium
DDSAEWKVFLGLLRSRFETDKGKWT

SEQ ID NO: 1042599 - protein, 20 aa, Mycobacterium
DDSLPWLLVDRRAMKVTAVH

SEQ ID NO: 1042600 - protein, 22 aa, Mycobacterium
DDSRRLLQMIGRDMGLDIKRYS

SEQ ID NO: 1042601 - protein, 19 aa, Mycobacterium
DDSVCSGAALAALTAAVTT

SEQ ID NO: 1042602 - protein, 20 aa, Mycobacterium
DDTLPMLTGIRVEISGEKVV

SEQ ID NO: 1042603 - protein, 23 aa, Mycobacterium
DDTLRLASQLVHGLRSDKVVNPR

SEQ ID NO: 1042604 - protein, 25 aa, Mycobacterium
DDTRKSFGIAGARVSDAIKLSVPFL

SEQ ID NO: 1042605 - protein, 17 aa, Mycobacterium
DDTRLGPPLRVVVTAVR

SEQ ID NO: 1042606 - protein, 17 aa, Mycobacterium
DDVEVGWRREDLTRLPE

SEQ ID NO: 1042607 - protein, 24 aa, Mycobacterium
DDVPAEVLGALVVKPMTDVAEIVA

SEQ ID NO: 1042608 - protein, 18 aa, Mycobacterium
DDVRCGFQQVRVVITVTG

SEQ ID NO: 1042609 - protein, 24 aa, Mycobacterium
DDYQVRIGCMWVMSFHSALVGDAD

SEQ ID NO: 1042610 - protein, 22 aa, Mycobacterium
DEAALRPFLLVASFINPHDVVL

SEQ ID NO: 1042611 - protein, 21 aa, Mycobacterium
DEAFKLVKINPLVAWTDQDVQ

SEQ ID NO: 1042612 - protein, 25 aa, Mycobacterium
DEAISATERACWATRPVRAVQRWAA

SEQ ID NO: 1042613 - protein, 19 aa, Mycobacterium
DEALIRMDLAEMLREEGYD

SEQ ID NO: 1042614 - protein, 29 aa, Mycobacterium
DEALRLRELLKFEFLFSARVQFEKDLADE

SEQ ID NO: 1042615 - protein, 20 aa, Mycobacterium
DEAREALADTVIRRGDTPLP

SEQ ID NO: 1042616 - protein, 17 aa, Mycobacterium
DEARGVARIGLANYFAG

SEQ ID NO: 1042617 - protein, 26 aa, Mycobacterium
DEARKAGRRFARLARIVATYRKLVAA

SEQ ID NO: 1042618 - protein, 25 aa, Mycobacterium
DEAYRTQIVAAFGIARDQVLAHQWV

SEQ ID NO: 1042619 - protein, 24 aa, Mycobacterium
DECVTARAALTMFLGRPDQPGRVR

SEQ ID NO: 1042620 - protein, 26 aa, Mycobacterium
DEDKLAVGLSRGWPPKTQRCASSRTR

SEQ ID NO: 1042621 - protein, 18 aa, Mycobacterium
DEDLPEFYGYPAKLSSTW

SEQ ID NO: 1042622 - protein, 23 aa, Mycobacterium
DEDRELLESFDLTYGEDSGDESE

SEQ ID NO: 1042623 - protein, 22 aa, Mycobacterium
DEDWGVGFAKSIAVFLNGQGMG

SEQ ID NO: 1042624 - protein, 18 aa, Mycobacterium
DEEKRVADAITRLNELKS

SEQ ID NO: 1042625 - protein, 25 aa, Mycobacterium
DEFAEGYCLPTILNNALYMDRYPLV

SEQ ID NO: 1042626 - protein, 24 aa, Mycobacterium
DEFDAIRIGRRIVARLNWVKQGPA

SEQ ID NO: 1042627 - protein, 22 aa, Mycobacterium
DEFHPELQFDKPYLLAMANAGP

SEQ ID NO: 1042628 - protein, 18 aa, Mycobacterium
DEFRASKIMTNRAQANDK

SEQ ID NO: 1042629 - protein, 23 aa, Mycobacterium
DEFRLYELIWQRTVASQMADARG

SEQ ID NO: 1042630 - protein, 22 aa, Mycobacterium
DEFTYPLKWGWVDVGEVVDVLL

SEQ ID NO: 1042631 - protein, 25 aa, Mycobacterium
DEGFHAATVRRIRPGEQLVLGDGAG

SEQ ID NO: 1042632 - protein, 17 aa, Mycobacterium
DEGKFRAGADLLMAASN

SEQ ID NO: 1042633 - protein, 23 aa, Mycobacterium
DEGPDLALRWAALLHDIGKPATR

SEQ ID NO: 1042634 - protein, 24 aa, Mycobacterium
DEHYAADTAVCWDDHGVRACFRCE

SEQ ID NO: 1042635 - protein, 19 aa, Mycobacterium
DEIAFRAAVDVVTARHPIL

SEQ ID NO: 1042636 - protein, 19 aa, Mycobacterium
DEIEAAVGLAERDQGIKVI

SEQ ID NO: 1042637 - protein, 22 aa, Mycobacterium
DEIEALWPMVIARATVLLVSDL

SEQ ID NO: 1042638 - protein, 21 aa, Mycobacterium
DEIGSGLAVFHPKGGIVRREL

SEQ ID NO: 1042639 - protein, 21 aa, Mycobacterium
DEIGTPFCVTVDFDSLEDDAV

SEQ ID NO: 1042640 - protein, 20 aa, Mycobacterium
DEIHAPLVFSGARFTPYLTV

SEQ ID NO: 1042641 - protein, 22 aa, Mycobacterium
DEIKQRIMAMAQPDGGDNRPDV

SEQ ID NO: 1042642 - protein, 17 aa, Mycobacterium
DEILALMKRLWEPGWTE

SEQ ID NO: 1042643 - protein, 17 aa, Mycobacterium
DEILIARNDRYWGPPAK

SEQ ID NO: 1042644 - protein, 22 aa, Mycobacterium
DEISLRDGQRFVHRLVAAPTVG

SEQ ID NO: 1042645 - protein, 21 aa, Mycobacterium
DEISTSMGFVVGKLAKAPEGS

SEQ ID NO: 1042646 - protein, 20 aa, Mycobacterium
DEKSRWGLAVQRKGRCRCGT

SEQ ID NO: 1042647 - protein, 19 aa, Mycobacterium
DELARICRGVACRVRPGGR

SEQ ID NO: 1042648 - protein, 24 aa, Mycobacterium
DELESLLRGYGYRPITVAGDDPPR

SEQ ID NO: 1042649 - protein, 20 aa, Mycobacterium
DELFAGPTAIAFVKGEPVDA

SEQ ID NO: 1042650 - protein, 17 aa, Mycobacterium
DELGLWERFAELPFSEV

SEQ ID NO: 1042651 - protein, 17 aa, Mycobacterium
DELGRILGVKGRVLPMC

SEQ ID NO: 1042652 - protein, 20 aa, Mycobacterium
DELIGPDVSREWISELASYE

SEQ ID NO: 1042653 - protein, 32 aa, Mycobacterium
DELIRGGVRDVVLCPGSRNAPLAFALQDADRS

SEQ ID NO: 1042654 - protein, 18 aa, Mycobacterium
DELISGGNIAKFVMVDPY

SEQ ID NO: 1042655 - protein, 21 aa, Mycobacterium
DELLIKIQACDAGNIDAVREF

SEQ ID NO: 1042656 - protein, 24 aa, Mycobacterium
DELLNRWPQWDIGYDSLQLAPTST

SEQ ID NO: 1042657 - protein, 26 aa, Mycobacterium
DELLREFLDWLFARYLEIVDGEPNPL

SEQ ID NO: 1042658 - protein, 18 aa, Mycobacterium
DELMRNGIRVFPITYPAV

SEQ ID NO: 1042659 - protein, 23 aa, Mycobacterium
DELPLPRPKYEIFVYSPRVEGVH

SEQ ID NO: 1042660 - protein, 20 aa, Mycobacterium
DELPPGLADFDLSKLNFPGK

SEQ ID NO: 1042661 - protein, 28 aa, Mycobacterium
DELQTRLAAGPVRFYFRVQIAGPGDSIV

SEQ ID NO: 1042662 - protein, 20 aa, Mycobacterium
DELRAVVITRGFTEHPAGSV

SEQ ID NO: 1042663 - protein, 26 aa, Mycobacterium
DELSYRLRMGAVGLPLQHHLGARLRR

SEQ ID NO: 1042664 - protein, 24 aa, Mycobacterium
DEMKKYALIWAMSVAAKRAEAMLA

SEQ ID NO: 1042665 - protein, 23 aa, Mycobacterium
DEMSAAVAGMFAAHAQAYQVLSQ

SEQ ID NO: 1042666 - protein, 24 aa, Mycobacterium
DENNLGGLSMWSANRDFPGAVGQL

SEQ ID NO: 1042667 - protein, 22 aa, Mycobacterium
DENRAALAVAEVWDNGKPVREA

SEQ ID NO: 1042668 - protein, 25 aa, Mycobacterium
DEPVAVVGMACRFPGGVDSAAALWD

SEQ ID NO: 1042669 - protein, 26 aa, Mycobacterium
DEQGCVLLAVRGLRLGTGTSESGERD

SEQ ID NO: 1042670 - protein, 24 aa, Mycobacterium
DEQKQRWLPGIADGTLTMAFAITE

SEQ ID NO: 1042671 - protein, 25 aa, Mycobacterium
DEQRRLHHTYSFLGIETYRQVSTEP

SEQ ID NO: 1042672 - protein, 19 aa, Mycobacterium
DERALYALCTAKLAHFKAP

SEQ ID NO: 1042673 - protein, 22 aa, Mycobacterium
DERARLMFMLGTLTPDRVTRDA

SEQ ID NO: 1042674 - protein, 22 aa, Mycobacterium
DERDFPATSVRFFASARSQGRK

SEQ ID NO: 1042675 - protein, 23 aa, Mycobacterium
DERDRPLLQLAWDYATEGDEPSG

SEQ ID NO: 1042676 - protein, 19 aa, Mycobacterium
DERELGILVSRLHSHALDL

SEQ ID NO: 1042677 - protein, 23 aa, Mycobacterium
DERGRRFLVAAAKIAYVEIGVAD

SEQ ID NO: 1042678 - protein, 25 aa, Mycobacterium
DERRLFVRMAEVYAGFVSYTDEQIG

SEQ ID NO: 1042679 - protein, 19 aa, Mycobacterium
DERTPFAAVTWFRPDHTID

SEQ ID NO: 1042680 - protein, 24 aa, Mycobacterium
DERTRAKARLVWGDQTLVGIGLAR

SEQ ID NO: 1042681 - protein, 19 aa, Mycobacterium
DESALRVARDIAAKDTRVI

SEQ ID NO: 1042682 - protein, 23 aa, Mycobacterium
DESFCPPGSISRPMEHVAAEIHH

SEQ ID NO: 1042683 - protein, 30 aa, Mycobacterium
DESRLTFLAVRRWFGWSAGRIINLDIGGGS

SEQ ID NO: 1042684 - protein, 24 aa, Mycobacterium
DESYTRWGPIQWMAPETLLTLGAH

SEQ ID NO: 1042685 - protein, 21 aa, Mycobacterium
DETRLHAALTRLRAQAPVALV

SEQ ID NO: 1042686 - protein, 18 aa, Mycobacterium
DETVPCLTQQQALAEAPE

SEQ ID NO: 1042687 - protein, 19 aa, Mycobacterium
DEVAFPMSWLTAVGGGEWP

SEQ ID NO: 1042688 - protein, 25 aa, Mycobacterium
DEVAPRIRNALGFNGYSLGAAPSGA

SEQ ID NO: 1042689 - protein, 21 aa, Mycobacterium
DEVIFGWRSFELYPPQVQVAG

SEQ ID NO: 1042690 - protein, 24 aa, Mycobacterium
DEVLPEKPELILLDNFPVWQTQTA

SEQ ID NO: 1042691 - protein, 25 aa, Mycobacterium
DEVRRFARERSRWLFSNPDMIHLSI

SEQ ID NO: 1042692 - protein, 26 aa, Mycobacterium
DEVRRYIIDVALRWMREFHADGLRLD

SEQ ID NO: 1042693 - protein, 26 aa, Mycobacterium
DEVSAAVAKLFGGYAQQFQALGAQAS

SEQ ID NO: 1042694 - protein, 24 aa, Mycobacterium
DEVSAAVASLFAGYGQAYQSISLQ

SEQ ID NO: 1042695 - protein, 23 aa, Mycobacterium
DEVSAAVASLFGSHGQSFQAVSL

SEQ ID NO: 1042696 - protein, 28 aa, Mycobacterium
DEVSALTAAQFVAHAQMYQAVSAQASAI

SEQ ID NO: 1042697 - protein, 22 aa, Mycobacterium
DEVSTAIAALFSQHAKTYQLLA

SEQ ID NO: 1042698 - protein, 23 aa, Mycobacterium
DEVSTAIAGMFAAHAQAYQALST

SEQ ID NO: 1042699 - protein, 24 aa, Mycobacterium
DEVYRAAAALIELGVKPAARVGIW

SEQ ID NO: 1042700 - protein, 20 aa, Mycobacterium
DEWEAFLGKDEDLYVFDSVA

SEQ ID NO: 1042701 - protein, 17 aa, Mycobacterium
DEYSRIYVYNMRGNQRT

SEQ ID NO: 1042702 - protein, 33 aa, Mycobacterium
DEYVKGLAELGCFGMKIPSEYGGLSMSQVAYNR

SEQ ID NO: 1042703 - protein, 17 aa, Mycobacterium
DEYVQWYRMYGMSMRPV

SEQ ID NO: 1042704 - protein, 19 aa, Mycobacterium
DFAGSTGLTDAWVEVEHGP

SEQ ID NO: 1042705 - protein, 20 aa, Mycobacterium
DFAPGDAMMGIFPNNAFAPT

SEQ ID NO: 1042706 - protein, 25 aa, Mycobacterium
DFCDPEVVEALKFHLRDLAVTFRFG

SEQ ID NO: 1042707 - protein, 19 aa, Mycobacterium
DFDAIWWRLDVWNASAQVA

SEQ ID NO: 1042708 - protein, 21 aa, Mycobacterium
DFDPICCWPKPVTKPHPPLYI

SEQ ID NO: 1042709 - protein, 20 aa, Mycobacterium
DFEIAVGPVAKGAQAVLQFE

SEQ ID NO: 1042710 - protein, 20 aa, Mycobacterium
DFEIGLGLNQHVLLGRRALQ

SEQ ID NO: 1042711 - protein, 20 aa, Mycobacterium
DFESAVGYSRAVRIGPHVAV

SEQ ID NO: 1042712 - protein, 29 aa, Mycobacterium
DFESYPQWHEWIKGVWVLAHYDDGRPSQL

SEQ ID NO: 1042713 - protein, 25 aa, Mycobacterium
DFGKNTWHGLLLLRHVADLVKTGWP

SEQ ID NO: 1042714 - protein, 25 aa, Mycobacterium
DFGKREVMVVHTLLWLDEIRDPDFP

SEQ ID NO: 1042715 - protein, 23 aa, Mycobacterium
DFGWAGPFAERAASEFTLQAWAG

SEQ ID NO: 1042716 - protein, 21 aa, Mycobacterium
DFIADGAIELGGRLPINTHGG

SEQ ID NO: 1042717 - protein, 17 aa, Mycobacterium
DFIAPDTKLCFAGPGGV

SEQ ID NO: 1042718 - protein, 25 aa, Mycobacterium
DFKQYEAGMRFLLDTYINAHASEVV

SEQ ID NO: 1042719 - protein, 20 aa, Mycobacterium
DFMSYLNLWRYLGEQRRALS

SEQ ID NO: 1042720 - protein, 18 aa, Mycobacterium
DFPRMLKLTQELFGSDDS

SEQ ID NO: 1042721 - protein, 19 aa, Mycobacterium
DFQFVDAFATALVEDKILA

SEQ ID NO: 1042722 - protein, 19 aa, Mycobacterium
DFRAGCPVAAVSVEAGEPS

SEQ ID NO: 1042723 - protein, 24 aa, Mycobacterium
DFRGHSFHPARWDYEYTGGDSTGG

SEQ ID NO: 1042724 - protein, 22 aa, Mycobacterium
DFRPGPDCRLGVLVDHLVAGSK

SEQ ID NO: 1042725 - protein, 24 aa, Mycobacterium
DFRPKHKPAVLVVSAIPLAEPVRV

SEQ ID NO: 1042726 - protein, 21 aa, Mycobacterium
DFSTALWAPRTIKRMAQHLVT

SEQ ID NO: 1042727 - protein, 19 aa, Mycobacterium
DFTFVDAFATGLAEEKLVT

SEQ ID NO: 1042728 - protein, 17 aa, Mycobacterium
DFVRAGSLTALAALIEE

SEQ ID NO: 1042729 - protein, 26 aa, Mycobacterium
DFVSSLQLLLTFPFPNFGIKQAVRGD

SEQ ID NO: 1042730 - protein, 26 aa, Mycobacterium
DFWASYCRPCHAFAPTYERSAQTHPD

SEQ ID NO: 1042731 - protein, 19 aa, Mycobacterium
DGAAELFAAEGACVLRPGA

SEQ ID NO: 1042732 - protein, 27 aa, Mycobacterium
DGAALQFPAPVKYVAPIAFNVVPLAGW

SEQ ID NO: 1042733 - protein, 19 aa, Mycobacterium
DGAARTCLWRMVSSGELTS

SEQ ID NO: 1042734 - protein, 24 aa, Mycobacterium
DGAAVLWRASFRFIGRDTEVEIDG

SEQ ID NO: 1042735 - protein, 25 aa, Mycobacterium
DGAHFECWTMLAAWAEQTSRIQIGA

SEQ ID NO: 1042736 - protein, 30 aa, Mycobacterium
DGAMGGAVTVPVNFLAHAGSDGGIGTGGNG

SEQ ID NO: 1042737 - protein, 17 aa, Mycobacterium
DGAQLWFVLDPRSPGSG

SEQ ID NO: 1042738 - protein, 23 aa, Mycobacterium
DGAQSYRVTGRFVGPKPPQYLIF

SEQ ID NO: 1042739 - protein, 19 aa, Mycobacterium
DGASFPWRTIRGEECSAYW

SEQ ID NO: 1042740 - protein, 17 aa, Mycobacterium
DGATAWLVGEEGRGVPT

SEQ ID NO: 1042741 - protein, 19 aa, Mycobacterium
DGATVGRIGTPGGAGGLLY

SEQ ID NO: 1042742 - protein, 20 aa, Mycobacterium
DGAVRFRLLSTMREYGNSRI

SEQ ID NO: 1042743 - protein, 27 aa, Mycobacterium
DGAWRDPRVWWQLRNPFTPSWGEPYLE

SEQ ID NO: 1042744 - protein, 27 aa, Mycobacterium
DGDARWPTFGIRLSARPGIPPTHPVRG

SEQ ID NO: 1042745 - protein, 20 aa, Mycobacterium
DGDDGDPPTGQTGGGGTGGG

SEQ ID NO: 1042746 - protein, 25 aa, Mycobacterium
DGDLFRPTPCPEYDVSGLTGHLLNS

SEQ ID NO: 1042747 - protein, 19 aa, Mycobacterium
DGDTDPVEGWGLYEHGALG

SEQ ID NO: 1042748 - protein, 24 aa, Mycobacterium
DGDTGPTRQGWRGRLRNRMRRSGR

SEQ ID NO: 1042749 - protein, 17 aa, Mycobacterium
DGEAVFAVSPLRYPDTT

SEQ ID NO: 1042750 - protein, 20 aa, Mycobacterium
DGEFDEWQRLFLFTRADTIY

SEQ ID NO: 1042751 - protein, 21 aa, Mycobacterium
DGEGGLRAMRGFLSTSPHDKT

SEQ ID NO: 1042752 - protein, 21 aa, Mycobacterium
DGEILAAYHLVARAEGVFVEP

SEQ ID NO: 1042753 - protein, 30 aa, Mycobacterium; identical to SEQ ID NO: 644864

SEQ ID NO: 1042754 - protein, 21 aa, Mycobacterium
DGFKVVPLVLSWSADPAKVTD

SEQ ID NO: 1042755 - protein, 20 aa, Mycobacterium
DGFVPMLHAYGLDLEDLAKI

SEQ ID NO: 1042756 - protein, 20 aa, Mycobacterium
DGFVSAPGDGRCEVICFSSD

SEQ ID NO: 1042757 - protein, 20 aa, Mycobacterium
DGGAHYGMICDASYSTYCLT

SEQ ID NO: 1042758 - protein, 20 aa, Mycobacterium
DGGEALVEFAGRACYQSWSK

SEQ ID NO: 1042759 - protein, 18 aa, Mycobacterium
DGGGAGWVGNAGNGGAGG

SEQ ID NO: 1042760 - protein, 24 aa, Mycobacterium
DGGGKGVTVTVCVSVAVEVSVLGG

SEQ ID NO: 1042761 - protein, 20 aa, Mycobacterium
DGGHGAKLLGNGGAGGAGGA

SEQ ID NO: 1042762 - protein, 24 aa, Mycobacterium
DGGKIRRLTIVFADLVDSTVLSTR

SEQ ID NO: 1042763 - protein, 18 aa, Mycobacterium
DGGNADWLGNGGGGTGGF

SEQ ID NO: 1042764 - protein, 22 aa, Mycobacterium
DGGNGGGLFNIGRGGDGGNGGN

SEQ ID NO: 1042765 - protein, 24 aa, Mycobacterium
DGGNGGTGAWLLGNGGAGGSGGST

SEQ ID NO: 1042766 - protein, 21 aa, Mycobacterium
DGGPGAMGLTGGTGGHGGDNT

SEQ ID NO: 1042767 - protein, 18 aa, Mycobacterium
DGGQFGFGAEIGISTQKL

SEQ ID NO: 1042768 - protein, 19 aa, Mycobacterium
DGGQFGFGAEIGISTQKLH

SEQ ID NO: 1042769 - protein, 18 aa, Mycobacterium
DGGQGGAAYSYGTGDATG

SEQ ID NO: 1042770 - protein, 24 aa, Mycobacterium
DGGRLSDAAIDWVIDAYTEGRVAP

SEQ ID NO: 1042771 - protein, 21 aa, Mycobacterium
DGGTFDWTQGRFPEFTTPDPS

SEQ ID NO: 1042772 - protein, 24 aa, Mycobacterium
DGGTGGLGGWLWGQAGAAGTGTPL

SEQ ID NO: 1042773 - protein, 21 aa, Mycobacterium
DGGTWFLQRAIGYERAAEMTL

SEQ ID NO: 1042774 - protein, 24 aa, Mycobacterium
DGHIAGAIKLDWRTDLQDPIKRDF

SEQ ID NO: 1042775 - protein, 17 aa, Mycobacterium
DGHPSVFDREWPLRVGD

SEQ ID NO: 1042776 - protein, 24 aa, Mycobacterium
DGHPYLVMPYCRRGSVQTEISRLG

SEQ ID NO: 1042777 - protein, 17 aa, Mycobacterium
DGICVHDPLIMRRALEY

SEQ ID NO: 1042778 - protein, 18 aa, Mycobacterium
DGIEALYYLHPLTGDVVR

SEQ ID NO: 1042779 - protein, 17 aa, Mycobacterium
DGIPAIDLRSGFLECGK

SEQ ID NO: 1042780 - protein, 27 aa, Mycobacterium
DGKDLSWLWDVRFEHFEKIPVVAAGER

SEQ ID NO: 1042781 - protein, 18 aa, Mycobacterium
DGLAMRHGKELTWSQVLM

SEQ ID NO: 1042782 - protein, 26 aa, Mycobacterium
DGLASLPARIAVRWRHTHNFEDAGAG

SEQ ID NO: 1042783 - protein, 28 aa, Mycobacterium
DGLEKCIGCELCAWACPADAIYVEGADN

SEQ ID NO: 1042784 - protein, 24 aa, Mycobacterium
DGLGRYRVVSALSRRGDELIVTGL

SEQ ID NO: 1042785 - protein, 20 aa, Mycobacterium
DGLLREIRLVRALSGTDVPH

SEQ ID NO: 1042786 - protein, 22 aa, Mycobacterium
DGLQGFGGWNSGSGNIGVFNSG

SEQ ID NO: 1042787 - protein, 20 aa, Mycobacterium
DGLRPLRLTLSQLRLRELLV

SEQ ID NO: 1042788 - protein, 17 aa, Mycobacterium
DGLTARVLQRWSVAPVR

SEQ ID NO: 1042789 - protein, 18 aa, Mycobacterium
DGMPIAWRGKLLTGEPWP

SEQ ID NO: 1042790 - protein, 20 aa, Mycobacterium
DGNIGIGLNGDGLRGFEALN

SEQ ID NO: 1042791 - protein, 28 aa, Mycobacterium
DGNLGSGNWRSGNLGNENIGFGNTGNPL

SEQ ID NO: 1042792 - protein, 21 aa, Mycobacterium
DGNPSWGTFYSLDDPWITSAM

SEQ ID NO: 1042793 - protein, 20 aa, Mycobacterium
DGNSRAPGLLGLYDDTVDGN

SEQ ID NO: 1042794 - protein, 20 aa, Mycobacterium
DGPDRVRIGGVIGEAPPQTL

SEQ ID NO: 1042795 - protein, 25 aa, Mycobacterium
DGPENGGRIAGAFGYWRESGRFILF

SEQ ID NO: 1042796 - protein, 21 aa, Mycobacterium
DGPRAAFAAAQRWRRRADHPL

SEQ ID NO: 1042797 - protein, 23 aa, Mycobacterium
DGPRPEQMRVLALTLAAERTVVG

SEQ ID NO: 1042798 - protein, 20 aa, Mycobacterium
DGPVAAVLRRGDAVTTRTMQ

SEQ ID NO: 1042799 - protein, 20 aa, Mycobacterium
DGPVCKLELPERISSGTHST

SEQ ID NO: 1042800 - protein, 19 aa, Mycobacterium
DGPVHICTGAVLHSTSGDL

SEQ ID NO: 1042801 - protein, 19 aa, Mycobacterium
DGQFGKWLQGARDWSISRN

SEQ ID NO: 1042802 - protein, 17 aa, Mycobacterium
DGQGFFGPVLTRMPSGA

SEQ ID NO: 1042803 - protein, 17 aa, Mycobacterium
DGQKRLKNARVLVIGAG

SEQ ID NO: 1042804 - protein, 21 aa, Mycobacterium
DGQMVFFPTWFDSHDYTAMLE

SEQ ID NO: 1042805 - protein, 22 aa, Mycobacterium
DGQMVFFPTWFDSHDYTAMLEW

SEQ ID NO: 1042806 - protein, 25 aa, Mycobacterium
DGQQRLPLPVGIGHHRFVNDVTPEE

SEQ ID NO: 1042807 - protein, 55 aa, Mycobacterium
DGRAPRRARGKLRAAVHRAAGDRGCGGRAPRQRRDLFVGLLVDRRRLVDGQGAVG

SEQ ID NO: 1042808 - protein, 24 aa, Mycobacterium
DGRGAPLMPCGRCRQLLFEHGGPE

SEQ ID NO: 1042809 - protein, 20 aa, Mycobacterium
DGRIHGVHVWTGPANEEPPE

SEQ ID NO: 1042810 - protein, 20 aa, Mycobacterium
DGRLPELIGQLTGSASGGVE

SEQ ID NO: 1042811 - protein, 17 aa, Mycobacterium
DGRLRRASLGGVVGDSA

SEQ ID NO: 1042812 - protein, 22 aa, Mycobacterium
DGRPMLRHRMELGAGSLADDVI

SEQ ID NO: 1042813 - protein, 22 aa, Mycobacterium
DGSCPVSLFVPDTCEPVPGVVM

SEQ ID NO: 1042814 - protein, 19 aa, Mycobacterium
DGSLWPVNGTVFAVTPTLR

SEQ ID NO: 1042815 - protein, 24 aa, Mycobacterium
DGSPWRAKLVPAERLIVVESTLRE

SEQ ID NO: 1042816 - protein, 17 aa, Mycobacterium
DGSRASTHAAVWAVDEA

SEQ ID NO: 1042817 - protein, 38 aa, Mycobacterium
DGSRMYCLLRRLLFLLPPEWVHKLVFAVLRGATAATPV

SEQ ID NO: 1042818 - protein, 18 aa, Mycobacterium
DGSSPLVIRRTYRAAHNI

SEQ ID NO: 1042819 - protein, 19 aa, Mycobacterium
DGSVRICGEAEIDRAQFGL

SEQ ID NO: 1042820 - protein, 17 aa, Mycobacterium
DGSWHIDGVKRFITSGD

SEQ ID NO: 1042821 - protein, 19 aa, Mycobacterium
DGTGFAIAQARLGPGRIHH

SEQ ID NO: 1042822 - protein, 25 aa, Mycobacterium
DGTIPYQRFRGWEIAGRTAGLVGLG

SEQ ID NO: 1042823 - protein, 23 aa, Mycobacterium
DGTLRYLLWSAALLSPRPPQLLV

SEQ ID NO: 1042824 - protein, 23 aa, Mycobacterium
DGTLWSIPIVFDLSAADIDSYGL

SEQ ID NO: 1042825 - protein, 19 aa, Mycobacterium
DGTRLRRRRLDAGDQAGFP

SEQ ID NO: 1042826 - protein, 19 aa, Mycobacterium
DGTSIPYFLVRPTGSDGPG

SEQ ID NO: 1042827 - protein, 26 aa, Mycobacterium
DGTTMFPFRRLFIVAEVGGARRSADV

SEQ ID NO: 1042828 - protein, 19 aa, Mycobacterium
DGVAFAGVAKYPARVKCAL

SEQ ID NO: 1042829 - protein, 34 aa, Mycobacterium; identical to SEQ ID NO: 645413

SEQ ID NO: 1042830 - protein, 20 aa, Mycobacterium
DGVELWKQFAPDDYAKALRR

SEQ ID NO: 1042831 - protein, 21 aa, Mycobacterium
DGVGAVEAWTTPFTRDGQPEK

SEQ ID NO: 1042832 - protein, 24 aa, Mycobacterium
DGVLRPAAGGSWCEWKGRASYFDL

SEQ ID NO: 1042833 - protein, 17 aa, Mycobacterium
DGVRFCAVCGNVSDDER

SEQ ID NO: 1042834 - protein, 17 aa, Mycobacterium
DGVRLCGDPAVGVDVAA

SEQ ID NO: 1042835 - protein, 19 aa, Mycobacterium
DGVVCGRDLADPALVIGNL

SEQ ID NO: 1042836 - protein, 23 aa, Mycobacterium
DGVYRPADVLIWATGFDVNHQLG

SEQ ID NO: 1042837 - protein, 24 aa, Mycobacterium
DGWDQRAPVGWNMKDPTPVAKTVC

SEQ ID NO: 1042838 - protein, 25 aa, Mycobacterium
DGYADLKVRALTIEWADNGNSFENF

SEQ ID NO: 1042839 - protein, 26 aa, Mycobacterium
DHAGKWRVVFFWPKDFTFVCPTEIAA

SEQ ID NO: 1042840 - protein, 18 aa, Mycobacterium
DHEARRASEIDVINGAVG

SEQ ID NO: 1042841 - protein, 25 aa, Mycobacterium
DHFGEIALLSGWRRAATVRASQPSV

SEQ ID NO: 1042842 - protein, 22 aa, Mycobacterium
DHGKAPVRRACYAADRTGHMIL

SEQ ID NO: 1042843 - protein, 18 aa, Mycobacterium
DHGRGTVVAQVMLPAVFG

SEQ ID NO: 1042844 - protein, 20 aa, Mycobacterium
DHICDGRLILGIGSGWKQKD

SEQ ID NO: 1042845 - protein, 17 aa, Mycobacterium
DHIRICDHDFTFQLTAR

SEQ ID NO: 1042846 - protein, 17 aa, Mycobacterium
DHIRPDVVIGIGIPIRN

SEQ ID NO: 1042847 - protein, 23 aa, Mycobacterium
DHLEALARFALSLSDSVGHLTDH

SEQ ID NO: 1042848 - protein, 23 aa, Mycobacterium
DHLELGESLGLIDMARGAKVAGS

SEQ ID NO: 1042849 - protein, 23 aa, Mycobacterium
DHLERRTLDLSRVDYLVLDEADE

SEQ ID NO: 1042850 - protein, 17 aa, Mycobacterium
DHLRSGGSIISVVAENP

SEQ ID NO: 1042851 - protein, 23 aa, Mycobacterium
DHLSEGRAGWNIVTSSDAFTGAN

SEQ ID NO: 1042852 - protein, 18 aa, Mycobacterium
DHLYIAGRIKDLVIIDGR

SEQ ID NO: 1042853 - protein, 18 aa, Mycobacterium
DHPAFYWYAERISEQRAV

SEQ ID NO: 1042854 - protein, 23 aa, Mycobacterium
DHPESLVNWNALAAMSGTIVLLM

SEQ ID NO: 1042855 - protein, 23 aa, Mycobacterium
DHPRARVAFLLDDTKPVAVLTIR

SEQ ID NO: 1042856 - protein, 29 aa, Mycobacterium
DHQEVAALLRWLGNGNFLLLGYQPCEVDD

SEQ ID NO: 1042857 - protein, 23 aa, Mycobacterium
DHQRLGWRHAPVGPALADALGLP

SEQ ID NO: 1042858 - protein, 19 aa, Mycobacterium
DHRLAVVFGAGGERDPGKR

SEQ ID NO: 1042859 - protein, 19 aa, Mycobacterium
DHRSHVVLMGRSWGELASS

SEQ ID NO: 1042860 - protein, 17 aa, Mycobacterium
DHSPPAVAFHYETTNVS

SEQ ID NO: 1042861 - protein, 32 aa, Mycobacterium
DHSVKRIAPRTMLCGYAWRVHVNISDAHFAEL

SEQ ID NO: 1042862 - protein, 23 aa, Mycobacterium
DHTAAIKWPPPVTFSQLRELVRE

SEQ ID NO: 1042863 - protein, 25 aa, Mycobacterium
DHVRYLDAWFEAVGITENVVLVVHD

SEQ ID NO: 1042864 - protein, 18 aa, Mycobacterium
DHWARLTFDGAAAGRDYP

SEQ ID NO: 1042865 - protein, 26 aa, Mycobacterium
DHYHKIHLYDAFGFAESRTVAPGHEP

SEQ ID NO: 1042866 - protein, 22 aa, Mycobacterium
DIAALRAGQRVLIHSGAGAVGR

SEQ ID NO: 1042867 - protein, 20 aa, Mycobacterium
DIAAMQWEKLICNVAYSAPC

SEQ ID NO: 1042868 - protein, 32 aa, Mycobacterium; identical to SEQ ID NO: 645681

SEQ ID NO: 1042869 - protein, 19 aa, Mycobacterium
DIALRRPSLDDVFLSMTTD

SEQ ID NO: 1042870 - protein, 20 aa, Mycobacterium
DIATAVAEFRRAVEIAQSCG

SEQ ID NO: 1042871 - protein, 18 aa, Mycobacterium
DIDFCTGERTLLREQPVL

SEQ ID NO: 1042872 - protein, 18 aa, Mycobacterium
DIDIRWRTVTFALVTHSA

SEQ ID NO: 1042873 - protein, 26 aa, Mycobacterium
DIDLFEVNEAFAPVVLAWAKDTGADL

SEQ ID NO: 1042874 - protein, 22 aa, Mycobacterium
DIDSEIGEVLALEHGAQLTTAD

SEQ ID NO: 1042875 - protein, 18 aa, Mycobacterium
DIEAQGWIAPAECVEVRV

SEQ ID NO: 1042876 - protein, 23 aa, Mycobacterium
DIEEFSRRFVVQVEDGFGSTENA

SEQ ID NO: 1042877 - protein, 19 aa, Mycobacterium
DIFNGAAMRQIMQDQNDYA

SEQ ID NO: 1042878 - protein, 24 aa, Mycobacterium
DIGHIPGAVKIDWHTDLNDPRVRD

SEQ ID NO: 1042879 - protein, 17 aa, Mycobacterium
DIGSFTPIFVMSRITGW

SEQ ID NO: 1042880 - protein, 18 aa, Mycobacterium
DIISHGRLELGIGAGWNE

SEQ ID NO: 1042881 - protein, 27 aa, Mycobacterium
DILATEILDPLGFRWTNFGVAEEDLPL

SEQ ID NO: 1042882 - protein, 19 aa, Mycobacterium
DINNGAFTVVPQGGAGGHG

SEQ ID NO: 1042883 - protein, 28 aa, Mycobacterium
DINVFGRRAGIAAARYARGHDFVDMPAE

SEQ ID NO: 1042884 - protein, 25 aa, Mycobacterium
DINVKIDKGEFVFLIGPSGSGKSTF

SEQ ID NO: 1042885 - protein, 19 aa, Mycobacterium
DIPCGPVRTCVGCRKRELA

SEQ ID NO: 1042886 - protein, 19 aa, Mycobacterium
DIPDARWQPAFTPARPDDF

SEQ ID NO: 1042887 - protein, 25 aa, Mycobacterium
DIPIDETRQILGLAAAEVYNFDLDA

SEQ ID NO: 1042888 - protein, 24 aa, Mycobacterium
DIPISRIPIVLSLGSDSTSLNTAI

SEQ ID NO: 1042889 - protein, 26 aa, Mycobacterium
DIPLAIDHFRYFAGAIRAQEGSLSQI

SEQ ID NO: 1042890 - protein, 24 aa, Mycobacterium
DIPTGGLAWCGAPVAVVQRGFGRP

SEQ ID NO: 1042891 - protein, 23 aa, Mycobacterium
DIQLRPALERALAAACATEPMYA

SEQ ID NO: 1042892 - protein, 21 aa, Mycobacterium
DIRARGRLIVGLDIGSNLFSF

SEQ ID NO: 1042893 - protein, 21 aa, Mycobacterium
DIRFVRLWFTDVLGYLKSVAI

SEQ ID NO: 1042894 - protein, 21 aa, Mycobacterium
DIRGSMERFRVVATPFYVRPR

SEQ ID NO: 1042895 - protein, 17 aa, Mycobacterium
DIRPELVSFTFGAPPPD

SEQ ID NO: 1042896 - protein, 26 aa, Mycobacterium
DISAGCSGFGHALGIAADMIRGGSAA

SEQ ID NO: 1042897 - protein, 36 aa, Mycobacterium
DISDFPTRHNYGLTLWQNRIERILAEWVAELRVRIY

SEQ ID NO: 1042898 - protein, 21 aa, Mycobacterium
DISLLGKARKVVITKDETTLV

SEQ ID NO: 1042899 - protein, 26 aa, Mycobacterium
DISRKRNLVEFGFRLPSAVDNRPLQW

SEQ ID NO: 1042900 - protein, 24 aa, Mycobacterium
DISRPGMLHACFVRSPFAHARING

SEQ ID NO: 1042901 - protein, 20 aa, Mycobacterium
DITATPAWEALRKHHDQIGE

SEQ ID NO: 1042902 - protein, 25 aa, Mycobacterium
DITKEVLNALGITVLAAPGFEADDI

SEQ ID NO: 1042903 - protein, 23 aa, Mycobacterium
DITVNVDGFWMLQALLDIRHVAP

SEQ ID NO: 1042904 - protein, 26 aa, Mycobacterium
DIVALRYRQMRNFWATLMVSQGTPMI

SEQ ID NO: 1042905 - protein, 17 aa, Mycobacterium
DIVIRYITFAPYHMQTM

SEQ ID NO: 1042906 - protein, 24 aa, Mycobacterium
DIVLIRTGWWTRFLMTANKTEPYS

SEQ ID NO: 1042907 - protein, 28 aa, Mycobacterium
DIVPRYRTMRGFKVERRFGWDTHGLPAE

SEQ ID NO: 1042908 - protein, 17 aa, Mycobacterium
DIVVRGGENISPREIEE

SEQ ID NO: 1042909 - protein, 23 aa, Mycobacterium
DIWGRRRLAYEIAKHAEGIYAVI

SEQ ID NO: 1042910 - protein, 18 aa, Mycobacterium
DIYDEFLELAAIRTKAVR

SEQ ID NO: 1042911 - protein, 30 aa, Mycobacterium; identical to SEQ ID NO: 645942

SEQ ID NO: 1042912 - protein, 22 aa, Mycobacterium
DKAGEWCVATLPPAARQPAVSE

SEQ ID NO: 1042913 - protein, 18 aa, Mycobacterium
DKAGLWPYLEKLGFFLVG

SEQ ID NO: 1042914 - protein, 22 aa, Mycobacterium
DKARALRVIDWFLSATTERRYE

SEQ ID NO: 1042915 - protein, 24 aa, Mycobacterium
DKDIPHVGAPIIVKYVSDLRLLGL

SEQ ID NO: 1042916 - protein, 23 aa, Mycobacterium
DKDYQRYGGVEFYSAIADGSPER

SEQ ID NO: 1042917 - protein, 24 aa, Mycobacterium
DKFLENITHHYWKDNGQGVGSLFS

SEQ ID NO: 1042918 - protein, 20 aa, Mycobacterium
DKGKTLRWVIDHLPDQRAAP

SEQ ID NO: 1042919 - protein, 19 aa, Mycobacterium
DKHKLALEREMLGLYVSGH

SEQ ID NO: 1042920 - protein, 23 aa, Mycobacterium
DKHLRSADFFDVERFPQIRVVVT

SEQ ID NO: 1042921 - protein, 24 aa, Mycobacterium
DKIKTGARVHVHWADETVGAITDI

SEQ ID NO: 1042922 - protein, 20 aa, Mycobacterium
DKKPIAINGILGRGKNVVTE

SEQ ID NO: 1042923 - protein, 23 aa, Mycobacterium
DKKRPFYFGALTWYMDRLLELVH

SEQ ID NO: 1042924 - protein, 24 aa, Mycobacterium
DKLDLKPGMTLLDIGCGWGTTMKR

SEQ ID NO: 1042925 - protein, 23 aa, Mycobacterium
DKLSPPWCTIWPVTANHGSKGLA

SEQ ID NO: 1042926 - protein, 22 aa, Mycobacterium
DKLVMRRRLQALDVPVPRYLGI

SEQ ID NO: 1042927 - protein, 25 aa, Mycobacterium
DKPDLRFGLELVECAEFFKDTTFRV

SEQ ID NO: 1042928 - protein, 17 aa, Mycobacterium
DKPKLVFFFDEAHLLFS

SEQ ID NO: 1042929 - protein, 24 aa, Mycobacterium
DKPPGVAETIGWVAALVSLGVADL

SEQ ID NO: 1042930 - protein, 22 aa, Mycobacterium
DKPRDALALALDQERAVTDQVS

SEQ ID NO: 1042931 - protein, 21 aa, Mycobacterium
DKRIPLELCPSSNVQTGAVAS

SEQ ID NO: 1042932 - protein, 23 aa, Mycobacterium
DKRLRRRLLTWRKFSVKPLGCKR

SEQ ID NO: 1042933 - protein, 24 aa, Mycobacterium
DKSELRAIAGLVLVAGFETTVNLL

SEQ ID NO: 1042934 - protein, 21 aa, Mycobacterium
DKTGHPFLQHLLAHRDVTRLK

SEQ ID NO: 1042935 - protein, 19 aa, Mycobacterium
DKVVLGFLGCRDTLPHLQR

SEQ ID NO: 1042936 - protein, 26 aa, Mycobacterium
DKYAYTAVRWKNILRQSALYGACQKW

SEQ ID NO: 1042937 - protein, 24 aa, Mycobacterium
DLAAELRKYWNIDFDDAGAIGRRY

SEQ ID NO: 1042938 - protein, 25 aa, Mycobacterium
DLAARVGAPLVLRGVGVRRVADDRG

SEQ ID NO: 1042939 - protein, 23 aa, Mycobacterium
DLAEILDLAPLVADNGYNAIDRA

SEQ ID NO: 1042940 - protein, 26 aa, Mycobacterium
DLAERRGEPWFDPAGLFLALEGSEGA

SEQ ID NO: 1042941 - protein, 19 aa, Mycobacterium
DLAGALCERLGYAQLADVE

SEQ ID NO: 1042942 - protein, 19 aa, Mycobacterium
DLAITPVKCEAWNPDTGKY

SEQ ID NO: 1042943 - protein, 18 aa, Mycobacterium
DLALQCAPDHPWAREHRN

SEQ ID NO: 1042944 - protein, 21 aa, Mycobacterium
DLAQRLGIDAFEFRRRNVVVP

SEQ ID NO: 1042945 - protein, 21 aa, Mycobacterium
DLARLPPRVWRSVRETRAVLD

SEQ ID NO: 1042946 - protein, 30 aa, Mycobacterium
DLATIWRGGCIIRAKFLNRIKEAFDAEPAL

SEQ ID NO: 1042947 - protein, 17 aa, Mycobacterium
DLAVTFRFGEEVTAVDV

SEQ ID NO: 1042948 - protein, 19 aa, Mycobacterium
DLAYFRVLIHGTRNRALGL

SEQ ID NO: 1042949 - protein, 18 aa, Mycobacterium
DLAYRDAAGYAYFAGRLG

SEQ ID NO: 1042950 - protein, 23 aa, Mycobacterium
DLCEAGAPFGLRPQAILPAYGMA

SEQ ID NO: 1042951 - protein, 23 aa, Mycobacterium
DLCGLPVTVFRCDMILADTSYAG

SEQ ID NO: 1042952 - protein, 19 aa, Mycobacterium
DLDEGFALLSDDFTYWSII

SEQ ID NO: 1042953 - protein, 20 aa, Mycobacterium
DLDENWPGHALRQAGDDPHA

SEQ ID NO: 1042954 - protein, 23 aa, Mycobacterium
DLDERALGIGLRVMVNIIEQAAA

SEQ ID NO: 1042955 - protein, 18 aa, Mycobacterium
DLDMSARGLVEVESHEVD

SEQ ID NO: 1042956 - protein, 17 aa, Mycobacterium
DLDPGVIGYLWRTAKLG

SEQ ID NO: 1042957 - protein, 24 aa, Mycobacterium
DLDRRRGRARSMGGPERLDRHHGQ

SEQ ID NO: 1042958 - protein, 23 aa, Mycobacterium
DLEKLVRIESVWADPGRRAEVHR

SEQ ID NO: 1042959 - protein, 25 aa, Mycobacterium
DLELALRLGASVDRVAEASGVDPWF

SEQ ID NO: 1042960 - protein, 22 aa, Mycobacterium
DLELGFAAAREFSGDSQAVAAI

SEQ ID NO: 1042961 - protein, 27 aa, Mycobacterium
DLELRNRLKIISGLALPPTLIVDYPTP

SEQ ID NO: 1042962 - protein, 19 aa, Mycobacterium
DLERRRISLSLKQANEDYI

SEQ ID NO: 1042963 - protein, 19 aa, Mycobacterium
DLFLGVPFNIASYALLTHM

SEQ ID NO: 1042964 - protein, 18 aa, Mycobacterium
DLFPCGKPQPGYLPVLRA

SEQ ID NO: 1042965 - protein, 23 aa, Mycobacterium
DLFVDCSGFRGLLINEAMNEPFI

SEQ ID NO: 1042966 - protein, 21 aa, Mycobacterium
DLGEGFGIWQLGDDDAMLGIV

SEQ ID NO: 1042967 - protein, 25 aa, Mycobacterium
DLGHKGLLAPLTFISVFGYKAQSAF

SEQ ID NO: 1042968 - protein, 17 aa, Mycobacterium
DLGRVCIPGTVRVEDYS

SEQ ID NO: 1042969 - protein, 19 aa, Mycobacterium
DLGSMRFYRETALAVGFEV

SEQ ID NO: 1042970 - protein, 20 aa, Mycobacterium
DLINSPAVALTGRPLIGNGA

SEQ ID NO: 1042971 - protein, 27 aa, Mycobacterium
DLISRRGVTVLHLVPSMLSTLLLLPQV

SEQ ID NO: 1042972 - protein, 26 aa, Mycobacterium
DLKVGDKVGNAWLWSACGSCEQCRTG

SEQ ID NO: 1042973 - protein, 23 aa, Mycobacterium
DLLASFRGVLGLVMGSAQAELAG

SEQ ID NO: 1042974 - protein, 20 aa, Mycobacterium
DLLHEGRSGIVRVPSQRWDA

SEQ ID NO: 1042975 - protein, 19 aa, Mycobacterium
DLLITHWVTTFALDPPPLP

SEQ ID NO: 1042976 - protein, 18 aa, Mycobacterium
DLLRDVAATEAMFTDHAL

SEQ ID NO: 1042977 - protein, 25 aa, Mycobacterium
DLLRGLRLQHLVAMGESQSAMFLTT

SEQ ID NO: 1042978 - protein, 18 aa, Mycobacterium
DLLRLGSLAFPIAAGTGT

SEQ ID NO: 1042979 - protein, 24 aa, Mycobacterium
DLLTGWRDAWEIGRTVRDNSLQLL

SEQ ID NO: 1042980 - protein, 17 aa, Mycobacterium
DLLWRNRRGELEMSVAM

SEQ ID NO: 1042981 - protein, 22 aa, Mycobacterium
DLMADWIGWLFAFDDVFDESID

SEQ ID NO: 1042982 - protein, 17 aa, Mycobacterium
DLNPGWSGLWSGQPEIL

SEQ ID NO: 1042983 - protein, 29 aa, Mycobacterium
DLNQLWMCGLPGYFPGDLIDFEFSGDTIE

SEQ ID NO: 1042984 - protein, 19 aa, Mycobacterium
DLPDGGAWLYAETVRAIKE

SEQ ID NO: 1042985 - protein, 20 aa, Mycobacterium
DLPEITHFVAGLGSSGTLMG

SEQ ID NO: 1042986 - protein, 20 aa, Mycobacterium
DLPEPERMSGGGLHPGPGAP

SEQ ID NO: 1042987 - protein, 22 aa, Mycobacterium
DLPGHGHSAWRQDGDYSPQHNA

SEQ ID NO: 1042988 - protein, 19 aa, Mycobacterium
DLPRLLLENRCCQPELNVV

SEQ ID NO: 1042989 - protein, 22 aa, Mycobacterium
DLPRLPWWLRPMARFQADDHFI

SEQ ID NO: 1042990 - protein, 19 aa, Mycobacterium
DLPVGVARVLVGDLVTSDY

SEQ ID NO: 1042991 - protein, 33 aa, Mycobacterium; identical to SEQ ID NO: 620729

SEQ ID NO: 1042992 - protein, 18 aa, Mycobacterium
DLQWTWREYLAEAAARAA

SEQ ID NO: 1042993 - protein, 19 aa, Mycobacterium
DLRDKFSIAVEVLPLDLSD

SEQ ID NO: 1042994 - protein, 18 aa, Mycobacterium
DLRPLRVAVDAGNGMAGH

SEQ ID NO: 1042995 - protein, 23 aa, Mycobacterium
DLRRRSAQALRNWVSREQRALTQ

SEQ ID NO: 1042996 - protein, 19 aa, Mycobacterium
DLRSRMFASNLGVEEDEAT

SEQ ID NO: 1042997 - protein, 25 aa, Mycobacterium
DLSFRRNSCCLYYRLPGAGKRGDCP

SEQ ID NO: 1042998 - protein, 20 aa, Mycobacterium
DLSGLPVMVLDPMLATGGSM

SEQ ID NO: 1042999 - protein, 17 aa, Mycobacterium
DLSLAWSFATSTCAKVV

SEQ ID NO: 1043000 - protein, 24 aa, Mycobacterium
DLSSLRFALNGAEGIDVATLERLA

SEQ ID NO: 1043001 - protein, 23 aa, Mycobacterium
DLSSLRFALSGAEPVEPSDVEDL

SEQ ID NO: 1043002 - protein, 25 aa, Mycobacterium
DLSVSRTSFNWGVPVPGHPDHVMYV

SEQ ID NO: 1043003 - protein, 26 aa, Mycobacterium
DLSWQPELWCALVAVVGADPPHLRHE

SEQ ID NO: 1043004 - protein, 18 aa, Mycobacterium
DLTGLPLAGASLLDEATA

SEQ ID NO: 1043005 - protein, 18 aa, Mycobacterium
DLTKARFAGPVVVIELDM

SEQ ID NO: 1043006 - protein, 18 aa, Mycobacterium
DLTPSMKLRRKVVLDKSA

SEQ ID NO: 1043007 - protein, 18 aa, Mycobacterium
DLTRLSQVIVYRRLELPL

SEQ ID NO: 1043008 - protein, 20 aa, Mycobacterium
DLTRRIALRHTVDMVRVTME

SEQ ID NO: 1043009 - protein, 25 aa, Mycobacterium
DLTWLLSHWSCVFGTPACQGTVAGR

SEQ ID NO: 1043010 - protein, 18 aa, Mycobacterium
DLVAEVRRVLGLDCDVRA

SEQ ID NO: 1043011 - protein, 24 aa, Mycobacterium
DLVEAIGVDAARYSLIRSSVDTPI

SEQ ID NO: 1043012 - protein, 24 aa, Mycobacterium
DLVEFLLRVLLSFFVAPNVPSRSD

SEQ ID NO: 1043013 - protein, 25 aa, Mycobacterium
DLVFRLEVLPARAFGVVMRGTARYF

SEQ ID NO: 1043014 - protein, 23 aa, Mycobacterium
DLVGGECSYWACVPSKALLRPVI

SEQ ID NO: 1043015 - protein, 18 aa, Mycobacterium
DLVGLGVDGCRWGAVALR

SEQ ID NO: 1043016 - protein, 18 aa, Mycobacterium
DLVGWRRHIHRYPELGRQ

SEQ ID NO: 1043017 - protein, 25 aa, Mycobacterium
DLVLRRLTEALARDRTRHQVSEVTS

SEQ ID NO: 1043018 - protein, 26 aa, Mycobacterium
DLVVALERLGRWCVPGPVAESIAVAP

SEQ ID NO: 1043019 - protein, 25 aa, Mycobacterium
DLVVGDLRWSLSVSARLASIPYIAI

SEQ ID NO: 1043020 - protein, 29 aa, Mycobacterium
DLVYTGLGALCWIPSISRWADVFASLLRP

SEQ ID NO: 1043021 - protein, 24 aa, Mycobacterium
DLYAARSRVRYAVTDAQAAGFQVE

SEQ ID NO: 1043022 - protein, 20 aa, Mycobacterium
DMFQRRVYFLADLPFVEVYL

SEQ ID NO: 1043023 - protein, 24 aa, Mycobacterium
DMIMELLDAFGIPAAGAAGFEADD

SEQ ID NO: 1043024 - protein, 18 aa, Mycobacterium
DMLAPWEVLDPVSRLVVA

SEQ ID NO: 1043025 - protein, 20 aa, Mycobacterium
DMLASAAADVAGIGSSVGAA

SEQ ID NO: 1043026 - protein, 31 aa, Mycobacterium; identical to SEQ ID NO: 646907

SEQ ID NO: 1043027 - protein, 21 aa, Mycobacterium
DMLVNPWGLWWQELTASDICT

SEQ ID NO: 1043028 - protein, 21 aa, Mycobacterium
DMMRLWVDAEVLRLAGERLRQ

SEQ ID NO: 1043029 - protein, 26 aa, Mycobacterium
DMRCKWRKWLTFQCNWKVAMEAFNET

SEQ ID NO: 1043030 - protein, 19 aa, Mycobacterium
DMRDAFNAYTDAVRSVANA

SEQ ID NO: 1043031 - protein, 24 aa, Mycobacterium
DMTRRLAREEAMLVGGSCGMAVVA

SEQ ID NO: 1043032 - protein, 23 aa, Mycobacterium
DMVLHRCPRPVVVVPNPMLAAEY

SEQ ID NO: 1043033 - protein, 18 aa, Mycobacterium
DNAAVWPGIVGFDDTVIP

SEQ ID NO: 1043034 - protein, 22 aa, Mycobacterium
DNCRRLRDGLSLANAVNCQADC

SEQ ID NO: 1043035 - protein, 23 aa, Mycobacterium
DNDPDIRCCILTGAGDYFCAGMD

SEQ ID NO: 1043036 - protein, 19 aa, Mycobacterium
DNGLHTWQYWGAQLQAMLP

SEQ ID NO: 1043037 - protein, 25 aa, Mycobacterium
DNGRIRYKRVCEVCGEVVEYSDLAR

SEQ ID NO: 1043038 - protein, 23 aa, Mycobacterium
DNGRQRWCVRLVQGGGFAGPLFD

SEQ ID NO: 1043039 - protein, 22 aa, Mycobacterium
DNLRELDCETVVVVTDALTEER

SEQ ID NO: 1043040 - protein, 17 aa, Mycobacterium
DNLRIPSGVAYAIVNRR

SEQ ID NO: 1043041 - protein, 23 aa, Mycobacterium
DNLRLETLAAHWGVTQERPHDAF

SEQ ID NO: 1043042 - protein, 25 aa, Mycobacterium
DNQIWQCPVVLLADVRSVGVQGDNR

SEQ ID NO: 1043043 - protein, 21 aa, Mycobacterium
DNQLRCGVVVPGPPGSVSKTT

SEQ ID NO: 1043044 - protein, 20 aa, Mycobacterium
DNSPGFLGFQLLRPVKGEDR

SEQ ID NO: 1043045 - protein, 25 aa, Mycobacterium
DPAAIRRRIGYVFPGQGGQRPGMGQ

SEQ ID NO: 1043046 - protein, 19 aa, Mycobacterium
DPADKRVALVFSAYPTKHA

SEQ ID NO: 1043047 - protein, 19 aa, Mycobacterium
DPAGEWMPAVIAAADRRLR

SEQ ID NO: 1043048 - protein, 24 aa, Mycobacterium
DPAIWDHPVDHPHVTEPDHHGFGI

SEQ ID NO: 1043049 - protein, 24 aa, Mycobacterium
DPALRAGAVLSVARRAGELGWHTV

SEQ ID NO: 1043050 - protein, 19 aa, Mycobacterium
DPALSLDVFNRISEVTFNY

SEQ ID NO: 1043051 - protein, 25 aa, Mycobacterium
DPAPRRWRSPAPLWGDASFDSVAPA

SEQ ID NO: 1043052 - protein, 24 aa, Mycobacterium
DPARFNGTVLLEWLNVSGGIDAPA

SEQ ID NO: 1043053 - protein, 18 aa, Mycobacterium
DPARPVFFDMCPPNRMIG

SEQ ID NO: 1043054 - protein, 25 aa, Mycobacterium
DPASARGSLRLSLGHTTVEADVDAA

SEQ ID NO: 1043055 - protein, 19 aa, Mycobacterium
DPASVRVWSCFATVGDHLP

SEQ ID NO: 1043056 - protein, 18 aa, Mycobacterium
DPCHQCMGDGRVRARREI

SEQ ID NO: 1043057 - protein, 17 aa, Mycobacterium
DPDARRRRLTGLINASQ

SEQ ID NO: 1043058 - protein, 22 aa, Mycobacterium
DPDAVELPAWYQQNPGLARDLA

SEQ ID NO: 1043059 - protein, 23 aa, Mycobacterium
DPDEAWSRFGGFIMNEATEYSGW

SEQ ID NO: 1043060 - protein, 21 aa, Mycobacterium
DPDFAGSCYVHVQKYVHDMGS

SEQ ID NO: 1043061 - protein, 19 aa, Mycobacterium
DPDIAALLGKELGRQRDTL

SEQ ID NO: 1043062 - protein, 17 aa, Mycobacterium
DPDPGMRLQISAQTGDS

SEQ ID NO: 1043063 - protein, 18 aa, Mycobacterium
DPDPRVGAIFLDDGPVHI

SEQ ID NO: 1043064 - protein, 23 aa, Mycobacterium
DPDSWADFFVRANARYVVLTTKH

SEQ ID NO: 1043065 - protein, 18 aa, Mycobacterium
DPDTARAAIADWLYWQHV

SEQ ID NO: 1043066 - protein, 21 aa, Mycobacterium
DPEAFGGWKQRNSKADHAAVR

SEQ ID NO: 1043067 - protein, 21 aa, Mycobacterium
DPEDGYPIFVDALVNIRQTLT

SEQ ID NO: 1043068 - protein, 23 aa, Mycobacterium
DPEGPYQLLGWSFGGVTAHQVAV

SEQ ID NO: 1043069 - protein, 22 aa, Mycobacterium
DPEHHYTAVIAWMGYDAPNGFS

SEQ ID NO: 1043070 - protein, 20 aa, Mycobacterium
DPEIEACLAAGITQVKVRSV

SEQ ID NO: 1043071 - protein, 18 aa, Mycobacterium
DPEITALARCFAHNDGIQ

SEQ ID NO: 1043072 - protein, 17 aa, Mycobacterium
DPEPAFAASPAVPAGIA

SEQ ID NO: 1043073 - protein, 19 aa, Mycobacterium
DPEPYRLLVGGYRDLVQRI

SEQ ID NO: 1043074 - protein, 21 aa, Mycobacterium
DPETRPPIGELLRGYEETVPH

SEQ ID NO: 1043075 - protein, 23 aa, Mycobacterium
DPEWAKSLQPGWQKQRQRNFHSW

SEQ ID NO: 1043076 - protein, 20 aa, Mycobacterium
DPFAEPGWFRTDDLGALDDS

SEQ ID NO: 1043077 - protein, 21 aa, Mycobacterium
DPFHHMVVIYALFPNVVLSVT

SEQ ID NO: 1043078 - protein, 17 aa, Mycobacterium
DPFPRAGQRGVFERPQV

SEQ ID NO: 1043079 - protein, 24 aa, Mycobacterium
DPFVERALEPWSFGIYAGGQSILI

SEQ ID NO: 1043080 - protein, 18 aa, Mycobacterium
DPGELERLYPRTAAELFS

SEQ ID NO: 1043081 - protein, 24 aa, Mycobacterium
DPGVRMRPTIGLMVHQRIGARLQR

SEQ ID NO: 1043082 - protein, 26 aa, Mycobacterium
DPHAARWVVRVVLSLMYWPAESEDVE

SEQ ID NO: 1043083 - protein, 19 aa, Mycobacterium
DPHPELLRAWDLPATADGL

SEQ ID NO: 1043084 - protein, 25 aa, Mycobacterium
DPICPFAWVTSRWLLEAAQSTHTPV

SEQ ID NO: 1043085 - protein, 24 aa, Mycobacterium
DPIHPLQVGLDWVSAAAHAALRTV

SEQ ID NO: 1043086 - protein, 26 aa, Mycobacterium
DPIIVPGCLDLLFRGEIPDGVDPASL

SEQ ID NO: 1043087 - protein, 18 aa, Mycobacterium
DPIWPKHAIRIIPGPSSM

SEQ ID NO: 1043088 - protein, 19 aa, Mycobacterium
DPIYGLGPRVAQLFAGAFF

SEQ ID NO: 1043089 - protein, 22 aa, Mycobacterium
DPKVPYYSATLFDPRERPTCDA

SEQ ID NO: 1043090 - protein, 22 aa, Mycobacterium
DPLCYVDPYLPIESFRRRDEAR

SEQ ID NO: 1043091 - protein, 25 aa, Mycobacterium
DPLFTRTGAGLAFTPGGLRLASGAV

SEQ ID NO: 1043092 - protein, 20 aa, Mycobacterium
DPLIVSWPAGIAARGEVRDQ

SEQ ID NO: 1043093 - protein, 19 aa, Mycobacterium
DPLMFKLGVGQVIQGWDQG

SEQ ID NO: 1043094 - protein, 23 aa, Mycobacterium
DPMVAICGAVTRADRLKRTHQSM

SEQ ID NO: 1043095 - protein, 27 aa, Mycobacterium
DPNIQPQGRFSWRTMPDNLEDAGVSWK

SEQ ID NO: 1043096 - protein, 24 aa, Mycobacterium
DPPARLGAIAAFLGLSPRDPSASP

SEQ ID NO: 1043097 - protein, 26 aa, Mycobacterium
DPPFEGMWWLYVPMAFDDFAIVLIIQ

SEQ ID NO: 1043098 - protein, 25 aa, Mycobacterium
DPPLTYRDALRIARAVVANPSTQLR

SEQ ID NO: 1043099 - protein, 24 aa, Mycobacterium
DPPRAGEVLLQLSATGLCHSDEHI

SEQ ID NO: 1043100 - protein, 20 aa, Mycobacterium
DPPWSFGPAGERYVIEVRGH

SEQ ID NO: 1043101 - protein, 18 aa, Mycobacterium
DPQGCLTFSLGHDPDKLT

SEQ ID NO: 1043102 - protein, 24 aa, Mycobacterium
DPQHRLFLQCAWHALEDANCDPAK

SEQ ID NO: 1043103 - protein, 25 aa, Mycobacterium
DPQLLLAHGYDHNWVINRADNTELI

SEQ ID NO: 1043104 - protein, 25 aa, Mycobacterium
DPQQRLFLEVAWEALENAGISPQTI

SEQ ID NO: 1043105 - protein, 24 aa, Mycobacterium
DPQQRLLLEVSWEALERTGIDPTT

SEQ ID NO: 1043106 - protein, 25 aa, Mycobacterium
DPQRPTILAIHGWPDNHHLWDPVAE

SEQ ID NO: 1043107 - protein, 23 aa, Mycobacterium
DPRMKANVGIRRRLAPLLENDRN

SEQ ID NO: 1043108 - protein, 25 aa, Mycobacterium
DPRPPMVTSGLRIGTPALASRGFSH

SEQ ID NO: 1043109 - protein, 22 aa, Mycobacterium
DPRQIQTMRALKQCDAMIRLGA

SEQ ID NO: 1043110 - protein, 22 aa, Mycobacterium
DPRRVPIWLPYIRGERTPFHDP

SEQ ID NO: 1043111 - protein, 17 aa, Mycobacterium
DPSEVFTLADAEKLAAF

SEQ ID NO: 1043112 - protein, 17 aa, Mycobacterium
DPSFSEKSLGFKSFSDF

SEQ ID NO: 1043113 - protein, 18 aa, Mycobacterium
DPSQDIWMALAQPAVAGP

SEQ ID NO: 1043114 - protein, 30 aa, Mycobacterium; identical to SEQ ID NO: 647622

SEQ ID NO: 1043115 - protein, 22 aa, Mycobacterium
DPTELRAALATQLPHYMVPTAL

SEQ ID NO: 1043116 - protein, 21 aa, Mycobacterium
DPTFGSWDWRLYSEEAVAEIR

SEQ ID NO: 1043117 - protein, 18 aa, Mycobacterium
DPTGPTRAAVAIQPATGT

SEQ ID NO: 1043118 - protein, 17 aa, Mycobacterium
DPTLVRGPVYERLVDGA

SEQ ID NO: 1043119 - protein, 17 aa, Mycobacterium
DPTPGLYTELDWQVGGP

SEQ ID NO: 1043120 - protein, 18 aa, Mycobacterium
DPTRAVRELGIPKVSVAE

SEQ ID NO: 1043121 - protein, 17 aa, Mycobacterium
DPTWAIDEIVRRYIGKP

SEQ ID NO: 1043122 - protein, 17 aa, Mycobacterium
DPVHTFIETCRRAEQWG

SEQ ID NO: 1043123 - protein, 18 aa, Mycobacterium
DPVKAAAKQLAFVEDRTI

SEQ ID NO: 1043124 - protein, 28 aa, Mycobacterium
DPVLAEWFLRRISLLDSLYMVPSPLIIG

SEQ ID NO: 1043125 - protein, 27 aa, Mycobacterium
DPVRILSPRTAQPGGLSTCLDPSINDF

SEQ ID NO: 1043126 - protein, 17 aa, Mycobacterium
DPVTTGWRDWSVRCAAL

SEQ ID NO: 1043127 - protein, 19 aa, Mycobacterium
DPWGGGIDLLMGCENLPGL

SEQ ID NO: 1043128 - protein, 22 aa, Mycobacterium
DPYAELFCRAVGGSWADVLDGN

SEQ ID NO: 1043129 - protein, 20 aa, Mycobacterium
DPYGAGWLYSVQPTAVGDLL

SEQ ID NO: 1043130 - protein, 22 aa, Mycobacterium
DPYLRAPLTWEVDAPCPVPAPE

SEQ ID NO: 1043131 - protein, 19 aa, Mycobacterium
DQAARAVAAAAIMASPAQR

SEQ ID NO: 1043132 - protein, 23 aa, Mycobacterium
DQAMALLRMLAGRGFLDGPGGQP

SEQ ID NO: 1043133 - protein, 21 aa, Mycobacterium
DQDGMLWFEVMAPMASSAAGR

SEQ ID NO: 1043134 - protein, 19 aa, Mycobacterium
DQGACGSCTVLVDGRRINS

SEQ ID NO: 1043135 - protein, 20 aa, Mycobacterium
DQGENFAFLGGRDWDPSQTT

SEQ ID NO: 1043136 - protein, 23 aa, Mycobacterium
DQGIKVIVLRGAGRAFSGGYDFG

SEQ ID NO: 1043137 - protein, 19 aa, Mycobacterium
DQGYRPGSYGPPSGGQPGY

SEQ ID NO: 1043138 - protein, 20 aa, Mycobacterium
DQGYRPGSYGPPSGGQPGYG

SEQ ID NO: 1043139 - protein, 22 aa, Mycobacterium
DQGYRQGGGYGQPPGGQPGYGG

SEQ ID NO: 1043140 - protein, 18 aa, Mycobacterium
DQHPGLRVGWFEGGIAWV

SEQ ID NO: 1043141 - protein, 17 aa, Mycobacterium
DQKCGIIPNTAGRVQGS

SEQ ID NO: 1043142 - protein, 26 aa, Mycobacterium
DQLDALCALGLQSRVVGAAFPDGSNS

SEQ ID NO: 1043143 - protein, 26 aa, Mycobacterium
DQLETGPNFLGWTRPSTTTSTLTSVT

SEQ ID NO: 1043144 - protein, 22 aa, Mycobacterium
DQLKVFPAATFVIGDTPDQAGE

SEQ ID NO: 1043145 - protein, 26 aa, Mycobacterium
DQLPAYALPLFVRLVQAMAHTTTFKS

SEQ ID NO: 1043146 - protein, 19 aa, Mycobacterium
DQMFVLWTAVNRVSRSGEV

SEQ ID NO: 1043147 - protein, 20 aa, Mycobacterium
DQMLAYNLSPSFNWDTTGMT

SEQ ID NO: 1043148 - protein, 23 aa, Mycobacterium
DQNRRVENIFGRYVSEEVKTHLL

SEQ ID NO: 1043149 - protein, 17 aa, Mycobacterium
DQRDFTLWKGAKPGEPS

SEQ ID NO: 1043150 - protein, 18 aa, Mycobacterium
DQRLCAVPDADMFQAIRD

SEQ ID NO: 1043151 - protein, 19 aa, Mycobacterium
DQRNYRFWADLTDALQTGK

SEQ ID NO: 1043152 - protein, 26 aa, Mycobacterium
DQRWPETRIEPSLTRISALMDLLGSP

SEQ ID NO: 1043153 - protein, 32 aa, Mycobacterium; identical to SEQ ID NO: 647843

SEQ ID NO: 1043154 - protein, 24 aa, Mycobacterium
DQTAVCILEHDWATVVMVDTQDGK

SEQ ID NO: 1043155 - protein, 23 aa, Mycobacterium
DQVATLFRMWLRDAVRRVATGVL

SEQ ID NO: 1043156 - protein, 17 aa, Mycobacterium
DQYCRKLSHLAGVAVAA

SEQ ID NO: 1043157 - protein, 19 aa, Mycobacterium
DRAALPYVVGTIAGDDTVF

SEQ ID NO: 1043158 - protein, 25 aa, Mycobacterium
DRAARFGDRVFLKFGDQQMTYGEAN

SEQ ID NO: 1043159 - protein, 20 aa, Mycobacterium
DRADVFAAIAPIAGTLGVGV

SEQ ID NO: 1043160 - protein, 20 aa, Mycobacterium
DRAGLAIAEDAHWFDPSTIE

SEQ ID NO: 1043161 - protein, 21 aa, Mycobacterium
DRAIVGIEGIFYARYNDDFLI

SEQ ID NO: 1043162 - protein, 21 aa, Mycobacterium
DRAKMLSLLWQSLRRQRELSK

SEQ ID NO: 1043163 - protein, 22 aa, Mycobacterium
DRARALWKTTLIEGLQDGGAAV

SEQ ID NO: 1043164 - protein, 29 aa, Mycobacterium
DRARHIHDFPALWYVPAAGLVYIAAAGQV

SEQ ID NO: 1043165 - protein, 22 aa, Mycobacterium
DRARLGREGVLALSSDEAMELF

SEQ ID NO: 1043166 - protein, 17 aa, Mycobacterium
DRARLTSKYAHAYRALG

SEQ ID NO: 1043167 - protein, 17 aa, Mycobacterium
DRATPMVTVLDGHPHAL

SEQ ID NO: 1043168 - protein, 25 aa, Mycobacterium
DRCNLRCGYCMPAEGLNWLPGEQLL

SEQ ID NO: 1043169 - protein, 17 aa, Mycobacterium
DRCRVPMPWSGTTPPFG

SEQ ID NO: 1043170 - protein, 19 aa, Mycobacterium
DRCYTRLYTELTWLNEFSD

SEQ ID NO: 1043171 - protein, 17 aa, Mycobacterium
DRDAVSFAGRIDGAIAR

SEQ ID NO: 1043172 - protein, 23 aa, Mycobacterium
DRDGFVFGEGGALMVIETEEHAK

SEQ ID NO: 1043173 - protein, 23 aa, Mycobacterium
DRDGVRTPMQWTPDRNAGFSTAN

SEQ ID NO: 1043174 - protein, 24 aa, Mycobacterium
DRDRLKIPFGHELKTGNVMYLDIK

SEQ ID NO: 1043175 - protein, 23 aa, Mycobacterium
DRDWSPKVYGSWNLHRASTGQPL

SEQ ID NO: 1043176 - protein, 25 aa, Mycobacterium
DRELAMKAYLLWLARGCMPGKLMPV

SEQ ID NO: 1043177 - protein, 17 aa, Mycobacterium
DRELWRKLIDSDILSSA

SEQ ID NO: 1043178 - protein, 17 aa, Mycobacterium
DRERVVGIAEEFLAGVG

SEQ ID NO: 1043179 - protein, 25 aa, Mycobacterium
DREVFLASWPREFRALVEQQREGVG

SEQ ID NO: 1043180 - protein, 20 aa, Mycobacterium
DREWRAWRAIIDKTLVLVRQ

SEQ ID NO: 1043181 - protein, 18 aa, Mycobacterium
DRFAELGDPWSGMDGAVG

SEQ ID NO: 1043182 - protein, 20 aa, Mycobacterium
DRFAVSRYTIREALRRLRED

SEQ ID NO: 1043183 - protein, 25 aa, Mycobacterium
DRFGADLPPLEGIYLAAFAGQPVLL

SEQ ID NO: 1043184 - protein, 25 aa, Mycobacterium
DRFTAFVPFAARWPVEVHIYPNRFV

SEQ ID NO: 1043185 - protein, 29 aa, Mycobacterium
DRGALPVKLCYAGPFFRYERPQAGRYRQL

SEQ ID NO: 1043186 - protein, 26 aa, Mycobacterium
DRGCPFAPRCPLVIDECRSDEPELIE

SEQ ID NO: 1043187 - protein, 19 aa, Mycobacterium
DRGGALIALNRTSYVDWVP

SEQ ID NO: 1043188 - protein, 23 aa, Mycobacterium
DRGLRFMSACGVADRNLQTAEIY

SEQ ID NO: 1043189 - protein, 29 aa, Mycobacterium
DRGLSMAHLRGTLDIFARAEFGPSTRTRI

SEQ ID NO: 1043190 - protein, 24 aa, Mycobacterium
DRGMKMGLYYSGGYDWTFNPTVIT

SEQ ID NO: 1043191 - protein, 17 aa, Mycobacterium
DRGVLRASWGVVRDLGH

SEQ ID NO: 1043192 - protein, 21 aa, Mycobacterium
DRHLLRPLREVIWGHDENLLN

SEQ ID NO: 1043193 - protein, 30 aa, Mycobacterium; identical to SEQ ID NO: 648094

SEQ ID NO: 1043194 - protein, 17 aa, Mycobacterium
DRIAVMPARLARISCQS

SEQ ID NO: 1043195 - protein, 18 aa, Mycobacterium
DRIFEIYPTLAGALRPGK

SEQ ID NO: 1043196 - protein, 18 aa, Mycobacterium
DRIGRRPGARWAADLLAA

SEQ ID NO: 1043197 - protein, 20 aa, Mycobacterium
DRIGSLCPIAGVDGAGCCDL

SEQ ID NO: 1043198 - protein, 17 aa, Mycobacterium
DRIRFGTEIVSARFEDD

SEQ ID NO: 1043199 - protein, 22 aa, Mycobacterium
DRITGWGWIPLRANDAGLTGRV

SEQ ID NO: 1043200 - protein, 21 aa, Mycobacterium
DRIVSIEAFEHFGHENYDDFF

SEQ ID NO: 1043201 - protein, 20 aa, Mycobacterium
DRIVSIGAFEHFGRLRYAHF

SEQ ID NO: 1043202 - protein, 20 aa, Mycobacterium
DRIVSLGAFEHFADGAGDAS

SEQ ID NO: 1043203 - protein, 20 aa, Mycobacterium
DRIVTIGAFEAFKMERYAAF

SEQ ID NO: 1043204 - protein, 19 aa, Mycobacterium
DRKVAFKRSYRDVDVLLVD

SEQ ID NO: 1043205 - protein, 25 aa, Mycobacterium
DRKVLRRFGKKPADTKTVLVVRHGS

SEQ ID NO: 1043206 - protein, 19 aa, Mycobacterium
DRLADACAHTLLDSIARVP

SEQ ID NO: 1043207 - protein, 20 aa, Mycobacterium
DRLAEAFAERMHQRVREEFW

SEQ ID NO: 1043208 - protein, 18 aa, Mycobacterium
DRLDMPRSLREFGVDEQG

SEQ ID NO: 1043209 - protein, 22 aa, Mycobacterium
DRLERYCVFPNLGAEPQDAFRF

SEQ ID NO: 1043210 - protein, 21 aa, Mycobacterium
DRLFMTMLHRHCEHVLDTDAL

SEQ ID NO: 1043211 - protein, 17 aa, Mycobacterium
DRLIAMVGALNRMMPRI

SEQ ID NO: 1043212 - protein, 18 aa, Mycobacterium
DRLILGMNYHHIVADFWA

SEQ ID NO: 1043213 - protein, 23 aa, Mycobacterium
DRLKPWEVIAARLGAAAAADLVL

SEQ ID NO: 1043214 - protein, 23 aa, Mycobacterium
DRLREMDFEFPLAGGDEADAGGH

SEQ ID NO: 1043215 - protein, 23 aa, Mycobacterium
DRLRPLRPGHLAYVIYTSGSTGR

SEQ ID NO: 1043216 - protein, 19 aa, Mycobacterium
DRLRQSSWRGLRPDKNPSE

SEQ ID NO: 1043217 - protein, 30 aa, Mycobacterium
DRLRRTSIDAGWLLDYWSDRVYPLLWACVR

SEQ ID NO: 1043218 - protein, 21 aa, Mycobacterium
DRLRVRYVIVSAVSGAMGGSA

SEQ ID NO: 1043219 - protein, 26 aa, Mycobacterium
DRLVTRIDAKLGFPRRDPHGDPIPSS

SEQ ID NO: 1043220 - protein, 17 aa, Mycobacterium
DRMAAFWDQVMRLRDLL

SEQ ID NO: 1043221 - protein, 22 aa, Mycobacterium
DRMGKLLLELTFDSPRRLEMLH

SEQ ID NO: 1043222 - protein, 23 aa, Mycobacterium
DRMLTSRNTLTWVQKYIFPGGLL

SEQ ID NO: 1043223 - protein, 21 aa, Mycobacterium
DRMPFSVPWTRAPRAELPYNT

SEQ ID NO: 1043224 - protein, 18 aa, Mycobacterium
DRMTSAFRSWMAVLELDS

SEQ ID NO: 1043225 - protein, 19 aa, Mycobacterium
DRNGGLRMVRGVKNRFGAA

SEQ ID NO: 1043226 - protein, 23 aa, Mycobacterium
DRPAFKTCVAHGIVLGFDGQKMS

SEQ ID NO: 1043227 - protein, 21 aa, Mycobacterium
DRPALKKACFLTRDPRATERK

SEQ ID NO: 1043228 - protein, 17 aa, Mycobacterium
DRPDHRIIAAPMISLAD

SEQ ID NO: 1043229 - protein, 20 aa, Mycobacterium
DRPDVLVAMNPAALKANIGD

SEQ ID NO: 1043230 - protein, 19 aa, Mycobacterium
DRPEQRWPEAKEWLSERGY

SEQ ID NO: 1043231 - protein, 20 aa, Mycobacterium
DRPTGTFTFAELLAHELSVE

SEQ ID NO: 1043232 - protein, 31 aa, Mycobacterium
DRPVARFGAWYEMFPRSTGGWDDEGKPVHGT

SEQ ID NO: 1043233 - protein, 23 aa, Mycobacterium
DRPYSRWERWVFAHVPFAARLYR

SEQ ID NO: 1043234 - protein, 27 aa, Mycobacterium
DRQGRALDDFATWCALAERYGDDWHRW

SEQ ID NO: 1043235 - protein, 18 aa, Mycobacterium
DRQGWMLAGELALAGVDV

SEQ ID NO: 1043236 - protein, 19 aa, Mycobacterium
DRQIAWLRQMADLCSTMAS

SEQ ID NO: 1043237 - protein, 22 aa, Mycobacterium
DRRAAIQYAVAWAGPDDVVLVA

SEQ ID NO: 1043238 - protein, 23 aa, Mycobacterium
DRRAAIQYAVAWAGPDDVVLVAG

SEQ ID NO: 1043239 - protein, 25 aa, Mycobacterium
DRRFTRTRLRAEVLPLLEEVLGGGV

SEQ ID NO: 1043240 - protein, 18 aa, Mycobacterium
DRRPAIVAGASPGIGAAT

SEQ ID NO: 1043241 - protein, 24 aa, Mycobacterium
DRRPWLRRVGRWLADHPGGGVISC

SEQ ID NO: 1043242 - protein, 18 aa, Mycobacterium
DRRSRRLPGGCRPIRIAD

SEQ ID NO: 1043243 - protein, 18 aa, Mycobacterium
DRRSVRWYTTTGLVDRPV

SEQ ID NO: 1043244 - protein, 21 aa, Mycobacterium
DRSGSMGGWKMVAARRAAGRI

SEQ ID NO: 1043245 - protein, 23 aa, Mycobacterium
DRSSIELMLQLLLDGHDTLRSIL

SEQ ID NO: 1043246 - protein, 32 aa, Mycobacterium
DRSYTADHEWIDIAPGAARPDGPVRVGITSVA

SEQ ID NO: 1043247 - protein, 28 aa, Mycobacterium
DRSYYPWGIPRQFSAVLGSGSLLGYNRR

SEQ ID NO: 1043248 - protein, 18 aa, Mycobacterium
DRTDVVWLEHEENRGSPR

SEQ ID NO: 1043249 - protein, 19 aa, Mycobacterium
DRTGRIGNVVLGFPTLAGY

SEQ ID NO: 1043250 - protein, 28 aa, Mycobacterium
DRTLARRPAWLAACAEVGGGAAPGSAAA

SEQ ID NO: 1043251 - protein, 24 aa, Mycobacterium
DRVAELLDIVGLRRSDASRYPAEF

SEQ ID NO: 1043252 - protein, 20 aa, Mycobacterium
DRVAYILEIAKEMQFMIERI

SEQ ID NO: 1043253 - protein, 19 aa, Mycobacterium
DRVGARPGRCVVITADAAS

SEQ ID NO: 1043254 - protein, 17 aa, Mycobacterium
DRVGCVLGGTSAEKFTD

SEQ ID NO: 1043255 - protein, 24 aa, Mycobacterium
DRVGGFSKDGCWRSYLTCDANLAV

SEQ ID NO: 1043256 - protein, 25 aa, Mycobacterium
DRVGLRIVVEIKRDAVAKVVLNNLY

SEQ ID NO: 1043257 - protein, 25 aa, Mycobacterium
DRVKTWLQFPQWFYLNIPVNTMVVP

SEQ ID NO: 1043258 - protein, 21 aa, Mycobacterium
DRVLPIVPMFHANAWGLPYAA

SEQ ID NO: 1043259 - protein, 24 aa, Mycobacterium
DRVPDAFAGVPCVISGRYRGPAAD

SEQ ID NO: 1043260 - protein, 20 aa, Mycobacterium
DRVQVPVLLVGGWQDVFVQQ

SEQ ID NO: 1043261 - protein, 18 aa, Mycobacterium
DRVRRWVRDRLDRPPPDA

SEQ ID NO: 1043262 - protein, 17 aa, Mycobacterium
DRVYRLAYRLSGNQQDA

SEQ ID NO: 1043263 - protein, 25 aa, Mycobacterium
DRWAYLPALEQVAAWHWSLNHPDAS

SEQ ID NO: 1043264 - protein, 17 aa, Mycobacterium
DRWLRCGRVANRAEPDL

SEQ ID NO: 1043265 - protein, 19 aa, Mycobacterium
DRYLAGSSAMEWEYLLVTA

SEQ ID NO: 1043266 - protein, 22 aa, Mycobacterium
DRYRVRWIPQRAVKGVYYGTPI

SEQ ID NO: 1043267 - protein, 21 aa, Mycobacterium
DRYVDCAPLEPGMALVNRQVF

SEQ ID NO: 1043268 - protein, 24 aa, Mycobacterium
DSAACRQAFEALELMVVIDVAMTE

SEQ ID NO: 1043269 - protein, 20 aa, Mycobacterium
DSAAIERIWQATRYWYQAGM

SEQ ID NO: 1043270 - protein, 28 aa, Mycobacterium
DSAEWKVFLNLLRKRFETDKGKWTKIAK

SEQ ID NO: 1043271 - protein, 29 aa, Mycobacterium
DSAEWKVFLNLLRKRFETDKGKWTKIAKS

SEQ ID NO: 1043272 - protein, 21 aa, Mycobacterium
DSAFDSYEFSRACEALYHFAW

SEQ ID NO: 1043273 - protein, 17 aa, Mycobacterium
DSAFGDWDAVRSHVHDL

SEQ ID NO: 1043274 - protein, 21 aa, Mycobacterium
DSAGEAVAWVGRMEYERFGLP

SEQ ID NO: 1043275 - protein, 26 aa, Mycobacterium
DSAICQIAIILFIRIATCWRTDQHNI

SEQ ID NO: 1043276 - protein, 33 aa, Mycobacterium
DSAICQIAIILFIRIATCWRTDQHNIFRIVRMH

SEQ ID NO: 1043277 - protein, 24 aa, Mycobacterium
DSAIGWPTRLSKARLHLVTGKGGT

SEQ ID NO: 1043278 - protein, 23 aa, Mycobacterium
DSAQWLAAHGWAVEPVRNTLELQ

SEQ ID NO: 1043279 - protein, 18 aa, Mycobacterium
DSARAGFVNAVLRTIADR

SEQ ID NO: 1043280 - protein, 39 aa, Mycobacterium
DSARQAAIALDWLRKHGCQDLASRACVAINHVAVGETNV

SEQ ID NO: 1043281 - protein, 19 aa, Mycobacterium
DSASFASAVGRSFYTQILP

SEQ ID NO: 1043282 - protein, 18 aa, Mycobacterium
DSDGAIWVLGRIDDVMNV

SEQ ID NO: 1043283 - protein, 26 aa, Mycobacterium
DSDPLWKVYVDLGWTELNDPASAVEL

SEQ ID NO: 1043284 - protein, 23 aa, Mycobacterium
DSEAKAIIAWHEFVPAAQAGADE

SEQ ID NO: 1043285 - protein, 20 aa, Mycobacterium
DSEEVLACFVVDPRLEASSG

SEQ ID NO: 1043286 - protein, 25 aa, Mycobacterium
DSEGELRAAVLEFMDSVRRAEDTIA

SEQ ID NO: 1043287 - protein, 36 aa, Mycobacterium; identical to SEQ ID NO: 648704

SEQ ID NO: 1043288 - protein, 21 aa, Mycobacterium
DSFSMPAVWLRLNQVDPGHLW

SEQ ID NO: 1043289 - protein, 17 aa, Mycobacterium
DSGDEWEAFLGKDEDLY

SEQ ID NO: 1043290 - protein, 22 aa, Mycobacterium
DSGDFRWAATLLDHAVFTDSEH

SEQ ID NO: 1043291 - protein, 19 aa, Mycobacterium
DSGEGRWTSIAAIDEGVPT

SEQ ID NO: 1043292 - protein, 19 aa, Mycobacterium
DSGFIGRYTITNSADTAAS

SEQ ID NO: 1043293 - protein, 32 aa, Mycobacterium
DSHARGGAMQLRYISVPALVAYAGGDPWAINQ

SEQ ID NO: 1043294 - protein, 19 aa, Mycobacterium
DSHLLLMWGAANRDPVQFD

SEQ ID NO: 1043295 - protein, 23 aa, Mycobacterium
DSIDPLWWGWRNHMKIFFNNKGV

SEQ ID NO: 1043296 - protein, 22 aa, Mycobacterium
DSILRVLAMHRFAKSPMLVGGQ

SEQ ID NO: 1043297 - protein, 17 aa, Mycobacterium
DSISPDELRAWKAEHPG

SEQ ID NO: 1043298 - protein, 29 aa, Mycobacterium
DSKIASWTEPKGGYFISLDVMPGTARRTV

SEQ ID NO: 1043299 - protein, 20 aa, Mycobacterium
DSKTRIAGVILNRVGSARHE

SEQ ID NO: 1043300 - protein, 20 aa, Mycobacterium
DSLDWPDFVGQLRVENAADT

SEQ ID NO: 1043301 - protein, 17 aa, Mycobacterium
DSLHFALRVVIAGQDGE

SEQ ID NO: 1043302 - protein, 17 aa, Mycobacterium
DSLPADRLIVYATLGTS

SEQ ID NO: 1043303 - protein, 23 aa, Mycobacterium
DSLTCGTSVFLFAGGRRGAAGTL

SEQ ID NO: 1043304 - protein, 17 aa, Mycobacterium
DSMLVKLTCRGRDLSTA

SEQ ID NO: 1043305 - protein, 23 aa, Mycobacterium
DSMRAGLQALAWIARGEAESTAA

SEQ ID NO: 1043306 - protein, 24 aa, Mycobacterium
DSNPRFEGLMTFTLAETLWLAGQG

SEQ ID NO: 1043307 - protein, 23 aa, Mycobacterium
DSPAAKVAIQWATREAELRNAPL

SEQ ID NO: 1043308 - protein, 19 aa, Mycobacterium
DSPEGLIVFLMRRHAAMEL

SEQ ID NO: 1043309 - protein, 20 aa, Mycobacterium
DSPSKAAGYWGLSAKSRATF

SEQ ID NO: 1043310 - protein, 20 aa, Mycobacterium
DSPTVEAFSRMFERDKNELR

SEQ ID NO: 1043311 - protein, 27 aa, Mycobacterium
DSQFGKEVCNLMGLRQLGCSTGTLQDY

SEQ ID NO: 1043312 - protein, 20 aa, Mycobacterium
DSQPWLADREQLRLLLRDVF

SEQ ID NO: 1043313 - protein, 17 aa, Mycobacterium
DSQRGNWPLGFPDDKRP

SEQ ID NO: 1043314 - protein, 22 aa, Mycobacterium
DSRAYRLEWPSGTTVFEIDLAQ

SEQ ID NO: 1043315 - protein, 19 aa, Mycobacterium
DSRCREALDQIPRYLSKSG

SEQ ID NO: 1043316 - protein, 20 aa, Mycobacterium
DSRERRLRTGGRVVPEMSVR

SEQ ID NO: 1043317 - protein, 27 aa, Mycobacterium
DSSGRTRAALRFIRSCSGPLTPETAQA

SEQ ID NO: 1043318 - protein, 20 aa, Mycobacterium
DSSSGWLFVSSWKADADSLR

SEQ ID NO: 1043319 - protein, 22 aa, Mycobacterium
DSTFNLGFADIGIFNAGAANTG

SEQ ID NO: 1043320 - protein, 17 aa, Mycobacterium
DSTRILSNVARRGAHLR

SEQ ID NO: 1043321 - protein, 17 aa, Mycobacterium
DSVRRLDAIGAEIDGAV

SEQ ID NO: 1043322 - protein, 20 aa, Mycobacterium
DSVSCPRSGEVIVREPGHWY

SEQ ID NO: 1043323 - protein, 20 aa, Mycobacterium
DTAELLEWLDAQTKRNLVIT

SEQ ID NO: 1043324 - protein, 18 aa, Mycobacterium
DTAFRQARERFEKSWTHE

SEQ ID NO: 1043325 - protein, 17 aa, Mycobacterium
DTALRVLAPLGLVFDEN

SEQ ID NO: 1043326 - protein, 21 aa, Mycobacterium
DTALTDWQVEFDLPANESITS

SEQ ID NO: 1043327 - protein, 26 aa, Mycobacterium
DTATLRPGLVVLVAFDPADRQQLSLP

SEQ ID NO: 1043328 - protein, 19 aa, Mycobacterium
DTDTCRVVETITGLDEAFA

SEQ ID NO: 1043329 - protein, 24 aa, Mycobacterium
DTEIPSPAAGVLTKIVAKEDDTVE

SEQ ID NO: 1043330 - protein, 20 aa, Mycobacterium
DTELLDFNALAKIFGYPSTT

SEQ ID NO: 1043331 - protein, 23 aa, Mycobacterium
DTEPWRGEPLLNYLRKMVFWAEV

SEQ ID NO: 1043332 - protein, 20 aa, Mycobacterium
DTEVRAMWNLPRPPRPKSNG

SEQ ID NO: 1043333 - protein, 18 aa, Mycobacterium
DTEWAATLQPGWQRRRIT

SEQ ID NO: 1043334 - protein, 24 aa, Mycobacterium
DTFRKLRGSFDLILNTVSANLDMG

SEQ ID NO: 1043335 - protein, 22 aa, Mycobacterium
DTFTGRLPQRFADRAPRVVETD

SEQ ID NO: 1043336 - protein, 17 aa, Mycobacterium
DTGDLGGVPSGVTGGTG

SEQ ID NO: 1043337 - protein, 26 aa, Mycobacterium
DTGKTVCARAAAATGAASTGVALGPT

SEQ ID NO: 1043338 - protein, 23 aa, Mycobacterium
DTGVPRPGLSTVFSPSRSTFGVD

SEQ ID NO: 1043339 - protein, 24 aa, Mycobacterium
DTGVRRIVYLGGFVPECEALSQHL

SEQ ID NO: 1043340 - protein, 21 aa, Mycobacterium
DTHGRSGLLIGTAGDDTFAAV

SEQ ID NO: 1043341 - protein, 24 aa, Mycobacterium
DTHLLRYPLPSAWSNDANVELYLK

SEQ ID NO: 1043342 - protein, 17 aa, Mycobacterium
DTHVAALRRLHRFGESI

SEQ ID NO: 1043343 - protein, 24 aa, Mycobacterium
DTLEAIAERVLWLSTSMVHHANRV

SEQ ID NO: 1043344 - protein, 17 aa, Mycobacterium
DTLGYISLRGMIAASEQ

SEQ ID NO: 1043345 - protein, 21 aa, Mycobacterium
DTLLRGCPRLQIVATSRELLS

SEQ ID NO: 1043346 - protein, 29 aa, Mycobacterium
DTLYLWSALPSWRPTWPTVAVNNSTQCCA

SEQ ID NO: 1043347 - protein, 18 aa, Mycobacterium
DTMGRAWRNGQIDAAVGA

SEQ ID NO: 1043348 - protein, 36 aa, Mycobacterium; identical to SEQ ID NO: 79016

SEQ ID NO: 1043349 - protein, 27 aa, Mycobacterium
DTNVYYRRALMLAACFGRSVEYPQRVV

SEQ ID NO: 1043350 - protein, 20 aa, Mycobacterium
DTQFPALPLFELGYEVAHVG

SEQ ID NO: 1043351 - protein, 30 aa, Mycobacterium; identical to SEQ ID NO: 87610

SEQ ID NO: 1043352 - protein, 26 aa, Mycobacterium
DTRAYRLNWPSGMTVYEIDQPQVIEF

SEQ ID NO: 1043353 - protein, 23 aa, Mycobacterium
DTRCLPRNGGVWAGHNDGYVGVY

SEQ ID NO: 1043354 - protein, 20 aa, Mycobacterium
DTSFSMVMENRWLPMKRTAL

SEQ ID NO: 1043355 - protein, 18 aa, Mycobacterium
DTSGSSCARSCWNSSSVP

SEQ ID NO: 1043356 - protein, 25 aa, Mycobacterium
DTSLFVRPFLKYQIITVVAPNSPLA

SEQ ID NO: 1043357 - protein, 38 aa, Mycobacterium; identical to SEQ ID NO: 649276

SEQ ID NO: 1043358 - protein, 19 aa, Mycobacterium
DTVCPKGGAIIAPDDLAFD

SEQ ID NO: 1043359 - protein, 24 aa, Mycobacterium
DTVDSWDVLPGIYARNRPSRPGTI

SEQ ID NO: 1043360 - protein, 24 aa, Mycobacterium
DTVFYCVANMPGAAPRTSTYALTN

SEQ ID NO: 1043361 - protein, 22 aa, Mycobacterium
DTVGARLLLLRRLAHPDDTRLG

SEQ ID NO: 1043362 - protein, 17 aa, Mycobacterium
DTVIFPALRDVMPAGEF

SEQ ID NO: 1043363 - protein, 30 aa, Mycobacterium; identical to SEQ ID NO: 649330

SEQ ID NO: 1043364 - protein, 18 aa, Mycobacterium
DTVTVILDYCSKHGIAVI

SEQ ID NO: 1043365 - protein, 17 aa, Mycobacterium
DTVVRGRIDAVFEDPDG

SEQ ID NO: 1043366 - protein, 18 aa, Mycobacterium
DTWIPGWRPRDLSTANFP

SEQ ID NO: 1043367 - protein, 19 aa, Mycobacterium
DTYGFNGIDTSQCTGDTVA

SEQ ID NO: 1043368 - protein, 19 aa, Mycobacterium
DTYGFPIELTLEMASEAGL

SEQ ID NO: 1043369 - protein, 28 aa, Mycobacterium
DTYGIYKLDFDIEGAALYNVPALTNRTQ

SEQ ID NO: 1043370 - protein, 17 aa, Mycobacterium
DVAARIVALEAKLAAAH

SEQ ID NO: 1043371 - protein, 18 aa, Mycobacterium
DVAARLSLTAAQVAALCD

SEQ ID NO: 1043372 - protein, 30 aa, Mycobacterium
DVAAVVDLCSRFLPAMVERGRGAVFNVASV

SEQ ID NO: 1043373 - protein, 18 aa, Mycobacterium
DVAAWPATLERLLAIGGP

SEQ ID NO: 1043374 - protein, 17 aa, Mycobacterium
DVAGLRADADFMIWTHA

SEQ ID NO: 1043375 - protein, 19 aa, Mycobacterium
DVASLLLALGERLTRPGGR

SEQ ID NO: 1043376 - protein, 24 aa, Mycobacterium
DVATDVWSVTSWSELNRDGVSVER

SEQ ID NO: 1043377 - protein, 22 aa, Mycobacterium
DVDAALHYLARMLVAGEDPRFV

SEQ ID NO: 1043378 - protein, 18 aa, Mycobacterium
DVDDILWQVPYLPIDPRD

SEQ ID NO: 1043379 - protein, 25 aa, Mycobacterium
DVDEKLWDAAEWSVQVQLNHLHQAG

SEQ ID NO: 1043380 - protein, 19 aa, Mycobacterium
DVDGMRADLVLARTATAHA

SEQ ID NO: 1043381 - protein, 18 aa, Mycobacterium
DVDLSWRQVVAMPEEVAS

SEQ ID NO: 1043382 - protein, 25 aa, Mycobacterium
DVDRSDARHGWAYRSAGAGRSVTVR

SEQ ID NO: 1043383 - protein, 18 aa, Mycobacterium
DVDVSEWPGIDWPATQSM

SEQ ID NO: 1043384 - protein, 17 aa, Mycobacterium
DVEFDWANLPFHYVPNE

SEQ ID NO: 1043385 - protein, 26 aa, Mycobacterium
DVEFYKWTQWIFLQIYNAWFDAAANK

SEQ ID NO: 1043386 - protein, 19 aa, Mycobacterium
DVEGFPYKEIAEIMDTPIG

SEQ ID NO: 1043387 - protein, 26 aa, Mycobacterium
DVEGLRRFHRNLGCGLLGRRIERSPL

SEQ ID NO: 1043388 - protein, 26 aa, Mycobacterium
DVEVLKLSALRGLFSAVVEGPVTFVN

SEQ ID NO: 1043389 - protein, 23 aa, Mycobacterium
DVFKEKLIRRDISMKAFDAGEPQ

SEQ ID NO: 1043390 - protein, 21 aa, Mycobacterium
DVFPFLRDWFSARLDECPPDT

SEQ ID NO: 1043391 - protein, 24 aa, Mycobacterium
DVFSEALAAPLYWIATNAGLDGSV

SEQ ID NO: 1043392 - protein, 18 aa, Mycobacterium
DVGEPWSVEEFELDAPRT

SEQ ID NO: 1043393 - protein, 24 aa, Mycobacterium
DVGLRSSYVASWYAAPLLVAGGRG

SEQ ID NO: 1043394 - protein, 24 aa, Mycobacterium
DVGSVEAFSLFRVSKLNCLITTSD

SEQ ID NO: 1043395 - protein, 26 aa, Mycobacterium
DVGSVLELRADYGVGIVTALVRIEGV

SEQ ID NO: 1043396 - protein, 30 aa, Mycobacterium
DVHLRGAFHVVRPAFGLMCDQLYGRIVLAS

SEQ ID NO: 1043397 - protein, 25 aa, Mycobacterium
DVIARAGFPDGCFQTLLVSASAVEG

SEQ ID NO: 1043398 - protein, 27 aa, Mycobacterium
DVIRKLAEWEAGAGLGNYTRARICASS

SEQ ID NO: 1043399 - protein, 17 aa, Mycobacterium
DVKAIADFSRWYAGDTD

SEQ ID NO: 1043400 - protein, 23 aa, Mycobacterium
DVKGLRLTLTQAAWRVSEDLPAE

SEQ ID NO: 1043401 - protein, 29 aa, Mycobacterium
DVKGPTARYGALFTDVFGLREGDDVRVAG

SEQ ID NO: 1043402 - protein, 18 aa, Mycobacterium
DVLARYVPVLNDLRMRYL

SEQ ID NO: 1043403 - protein, 20 aa, Mycobacterium
DVLEAMGIPHTEIDLILVNG

SEQ ID NO: 1043404 - protein, 17 aa, Mycobacterium
DVLEEFSSFYFDTALSS

SEQ ID NO: 1043405 - protein, 17 aa, Mycobacterium
DVLELSVALALLPVLPG

SEQ ID NO: 1043406 - protein, 24 aa, Mycobacterium
DVLGFKLRDSMRMPPQVVGRPADG

SEQ ID NO: 1043407 - protein, 21 aa, Mycobacterium
DVLLRKTGRVLLPVARTGDDE

SEQ ID NO: 1043408 - protein, 22 aa, Mycobacterium
DVLLRKTGRVLLPVARTGDDEI

SEQ ID NO: 1043409 - protein, 17 aa, Mycobacterium
DVLQWKAAEVAQAIGTT

SEQ ID NO: 1043410 - protein, 27 aa, Mycobacterium
DVLSDFPADRGWDLAGLFNPDPDVPGA

SEQ ID NO: 1043411 - protein, 17 aa, Mycobacterium
DVMPELIRRSIAVKAEV

SEQ ID NO: 1043412 - protein, 18 aa, Mycobacterium
DVMVANAGVFGWGRLWEL

SEQ ID NO: 1043413 - protein, 27 aa, Mycobacterium
DVNRRFAEATARAAARGGTVWVQDYQL

SEQ ID NO: 1043414 - protein, 18 aa, Mycobacterium
DVNSGWKVVEAVPQPDAS

SEQ ID NO: 1043415 - protein, 18 aa, Mycobacterium
DVPLRVAVMGCVVNGPGE

SEQ ID NO: 1043416 - protein, 19 aa, Mycobacterium
DVPPLKGIYSGLGVTDLDV

SEQ ID NO: 1043417 - protein, 22 aa, Mycobacterium
DVPTFRMLAGLSGRVPLVSIVP

SEQ ID NO: 1043418 - protein, 20 aa, Mycobacterium
DVQAAFELACRPVPERVKIA

SEQ ID NO: 1043419 - protein, 17 aa, Mycobacterium
DVQCIVHTHGFHTAALS

SEQ ID NO: 1043420 - protein, 20 aa, Mycobacterium
DVQLVLCAGAPDTPEIANEV

SEQ ID NO: 1043421 - protein, 29 aa, Mycobacterium
DVQPMFRKHPAFLGAMTNFAWTFDDDVEL

SEQ ID NO: 1043422 - protein, 26 aa, Mycobacterium
DVRAALWPLLVGNIIAARGVLRAIRG

SEQ ID NO: 1043423 - protein, 22 aa, Mycobacterium
DVRCAPAAFRFMSQARHIGKVV

SEQ ID NO: 1043424 - protein, 18 aa, Mycobacterium
DVRFMRFIGQEIFPGGQL

SEQ ID NO: 1043425 - protein, 18 aa, Mycobacterium
DVRIVPRDLLAPLPGKAS

SEQ ID NO: 1043426 - protein, 22 aa, Mycobacterium
DVRKALHPSAPVIRTDLDGKQD

SEQ ID NO: 1043427 - protein, 20 aa, Mycobacterium
DVRTARIVTPRVMQLTLRAN

SEQ ID NO: 1043428 - protein, 33 aa, Mycobacterium
DVRWAMRHLPFYGRWYRFLLLWPGADKGLDAAR

SEQ ID NO: 1043429 - protein, 19 aa, Mycobacterium
DVSASFLPASYFDGVTMAG

SEQ ID NO: 1043430 - protein, 22 aa, Mycobacterium
DVSCLKALLEVREEIVAAGHTP

SEQ ID NO: 1043431 - protein, 22 aa, Mycobacterium
DVSDAYPLSALQAGMLFHSRVD

SEQ ID NO: 1043432 - protein, 22 aa, Mycobacterium
DVSELRARIGLSSSALAQRIPT

SEQ ID NO: 1043433 - protein, 19 aa, Mycobacterium
DVSIGTRILAVGYPKSTQD

SEQ ID NO: 1043434 - protein, 24 aa, Mycobacterium
DVSQRLRLLIDWTGDHLAEVEVND

SEQ ID NO: 1043435 - protein, 17 aa, Mycobacterium
DVTRAEFEYAVTHEGAL

SEQ ID NO: 1043436 - protein, 22 aa, Mycobacterium
DVVAVGEAYHGWTYATDAVSTS

SEQ ID NO: 1043437 - protein, 31 aa, Mycobacterium; identical to SEQ ID NO: 649849

SEQ ID NO: 1043438 - protein, 23 aa, Mycobacterium
DVVGEGFLIGRICTGAISAGVMK

SEQ ID NO: 1043439 - protein, 25 aa, Mycobacterium
DVVLSVPVSATWIDIRFTLPANTVD

SEQ ID NO: 1043440 - protein, 19 aa, Mycobacterium
DVVLWRCEPAGGRVLDQAY

SEQ ID NO: 1043441 - protein, 27 aa, Mycobacterium
DVVRAVPLVGEVCYHFMHSVKAGIKDS

SEQ ID NO: 1043442 - protein, 17 aa, Mycobacterium
DVVRTGASFEVISPHDP

SEQ ID NO: 1043443 - protein, 35 aa, Mycobacterium; identical to SEQ ID NO: 649873

SEQ ID NO: 1043444 - protein, 25 aa, Mycobacterium
DVVVAGRPSERWGQEVVAVVALDPD

SEQ ID NO: 1043445 - protein, 24 aa, Mycobacterium
DVVVCATGLFGPRKLPDIAGLTDF

SEQ ID NO: 1043446 - protein, 17 aa, Mycobacterium
DVWRLFDSLHFALRVVI

SEQ ID NO: 1043447 - protein, 33 aa, Mycobacterium
DVYDSAVAWARRYLECPPRALAAAKAVINNVFE

SEQ ID NO: 1043448 - protein, 20 aa, Mycobacterium
DVYYCVVDARAWLRDPAPLF

SEQ ID NO: 1043449 - protein, 23 aa, Mycobacterium
DWAAKGTLLLGVRVVIAESFERI

SEQ ID NO: 1043450 - protein, 23 aa, Mycobacterium
DWCRYYRRNGWSYGPTRDDARKL

SEQ ID NO: 1043451 - protein, 24 aa, Mycobacterium
DWDDELLSFFSIPRAMLPAIASSS

SEQ ID NO: 1043452 - protein, 22 aa, Mycobacterium
DWDEVRQRFDLISREMPMFRQR

SEQ ID NO: 1043453 - protein, 19 aa, Mycobacterium
DWFRPKAMRALKVRVDELA

SEQ ID NO: 1043454 - protein, 25 aa, Mycobacterium
DWHERETYDFFGIIFDGHPSLTRIE

SEQ ID NO: 1043455 - protein, 20 aa, Mycobacterium
DWLEMSRALLSRIGDHARGL

SEQ ID NO: 1043456 - protein, 19 aa, Mycobacterium
DWLGEHGWRASATTSAELL

SEQ ID NO: 1043457 - protein, 18 aa, Mycobacterium
DWPSALRQRGFDAGQPTA

SEQ ID NO: 1043458 - protein, 19 aa, Mycobacterium
DWPVPAAAAAVIGPTGVLA

SEQ ID NO: 1043459 - protein, 18 aa, Mycobacterium
DWVRINGFGTPWWADDIA

SEQ ID NO: 1043460 - protein, 17 aa, Mycobacterium
DWWGRWLGRWTAEEHLH

SEQ ID NO: 1043461 - protein, 21 aa, Mycobacterium
DYAAGCPIVAAALGRTESPSA

SEQ ID NO: 1043462 - protein, 17 aa, Mycobacterium
DYARMWIQAATTMSVYD

SEQ ID NO: 1043463 - protein, 21 aa, Mycobacterium
DYFDSLIGWERYRASQFGIAH

SEQ ID NO: 1043464 - protein, 19 aa, Mycobacterium
DYGCMAGIYTAAAQYFTGV

SEQ ID NO: 1043465 - protein, 17 aa, Mycobacterium
DYLLPRQRDRAALSDDE

SEQ ID NO: 1043466 - protein, 19 aa, Mycobacterium
DYLLQVIARFARYLRESSS

SEQ ID NO: 1043467 - protein, 25 aa, Mycobacterium
DYLPDPRPDAALSIPGYPAQGDAIP

SEQ ID NO: 1043468 - protein, 25 aa, Mycobacterium
DYLRRMGELFAPFTKIAAGNPFAAA

SEQ ID NO: 1043469 - protein, 26 aa, Mycobacterium
DYNNGFLWRGDNQGLIFGEPGFGNST

SEQ ID NO: 1043470 - protein, 20 aa, Mycobacterium
DYPPPGGYRGGYPDEARFQP

SEQ ID NO: 1043471 - protein, 29 aa, Mycobacterium
DYPRGNLAFRWFLADGVPARPEVKLVKLA

SEQ ID NO: 1043472 - protein, 17 aa, Mycobacterium
DYREFHIDWDLAAAEKG

SEQ ID NO: 1043473 - protein, 19 aa, Mycobacterium
DYSAACGIAPQHQALDHPV

SEQ ID NO: 1043474 - protein, 19 aa, Mycobacterium
DYSEAIALARLGWAALAVG

SEQ ID NO: 1043475 - protein, 20 aa, Mycobacterium
DYSGLRVCEYLPGKAMVMQM

SEQ ID NO: 1043476 - protein, 25 aa, Mycobacterium
DYSVWEIFGALLGAGRLVVVPEHVV

SEQ ID NO: 1043477 - protein, 21 aa, Mycobacterium
DYVRHCFDAIVPDELFTELPY

SEQ ID NO: 1043478 - protein, 25 aa, Mycobacterium
DYWYRSIRQTVQFERAIRTAFNSGC

SEQ ID NO: 1043479 - protein, 19 aa, Mycobacterium
EAAAKMLAGKPFKKEAAIA

SEQ ID NO: 1043480 - protein, 17 aa, Mycobacterium
EAAARRALSESLLVHPY

SEQ ID NO: 1043481 - protein, 19 aa, Mycobacterium
EAADDWLALLEAFDQPHRP

SEQ ID NO: 1043482 - protein, 24 aa, Mycobacterium
EAAELHEIYKLGVVPIPTNRPMVR

SEQ ID NO: 1043483 - protein, 26 aa, Mycobacterium
EAAERLGVLGLPFLFFIDAAQGRAGV

SEQ ID NO: 1043484 - protein, 21 aa, Mycobacterium
EAAGDWKPLADFYAPDATYGW

SEQ ID NO: 1043485 - protein, 24 aa, Mycobacterium
EAAKGVAMPLRLISPAPCTNCHGS

SEQ ID NO: 1043486 - protein, 20 aa, Mycobacterium
EAAMSLAAPTGYRTIAVGIA

SEQ ID NO: 1043487 - protein, 23 aa, Mycobacterium
EAANASPLLGISQDMLNAVNGPT

SEQ ID NO: 1043488 - protein, 22 aa, Mycobacterium
EAAQAAIVHPAMVAANRNELVA

SEQ ID NO: 1043489 - protein, 24 aa, Mycobacterium
EAAQRISQSVPWPLIREQTPSDAC

SEQ ID NO: 1043490 - protein, 24 aa, Mycobacterium
EAARARLAAIPVTVETLTAIIARG

SEQ ID NO: 1043491 - protein, 20 aa, Mycobacterium
EAARHIRSAALGLIALGVQA

SEQ ID NO: 1043492 - protein, 20 aa, Mycobacterium
EAARRLGRRTLVLVPNTAVQ

SEQ ID NO: 1043493 - protein, 23 aa, Mycobacterium
EAARSRVGLTHFAAPTPGRRIGL

SEQ ID NO: 1043494 - protein, 20 aa, Mycobacterium
EAASGLGVRTVFGAELSLGP

SEQ ID NO: 1043495 - protein, 26 aa, Mycobacterium
EAATFGIAYLTAWHSLCEVGRLSPGE

SEQ ID NO: 1043496 - protein, 25 aa, Mycobacterium
EAAYPGRFLLGIGVGHPEAITEYHS

SEQ ID NO: 1043497 - protein, 19 aa, Mycobacterium
EAAYRRVRKAAKLAKAAAK

SEQ ID NO: 1043498 - protein, 20 aa, Mycobacterium
EACRDELIEVVRLLEQGGLN

SEQ ID NO: 1043499 - protein, 21 aa, Mycobacterium
EADGRRPRILVAKMGQDGHDR

SEQ ID NO: 1043500 - protein, 20 aa, Mycobacterium
EADGWLRPGATILEATSGNT

SEQ ID NO: 1043501 - protein, 26 aa, Mycobacterium
EADPGQRLVLSWGWEGHGDPAPGEST

SEQ ID NO: 1043502 - protein, 18 aa, Mycobacterium
EADPQPWTKMSFATAQDS

SEQ ID NO: 1043503 - protein, 19 aa, Mycobacterium
EADVFFARRQVHIVNPRIL

SEQ ID NO: 1043504 - protein, 20 aa, Mycobacterium
EADVLWDLASRLEGRMSAIG

SEQ ID NO: 1043505 - protein, 20 aa, Mycobacterium
EADYARMWIQAATTMSAYQV

SEQ ID NO: 1043506 - protein, 23 aa, Mycobacterium
EADYARMWVQAAGVMQLYQQQAN

SEQ ID NO: 1043507 - protein, 22 aa, Mycobacterium
EAEALFLPAHDPLASAVVAEAH

SEQ ID NO: 1043508 - protein, 22 aa, Mycobacterium
EAECRRWIQCYSTVLRGRSEAT

SEQ ID NO: 1043509 - protein, 21 aa, Mycobacterium
EAEELYRACGYTRLPAPQPSE

SEQ ID NO: 1043510 - protein, 17 aa, Mycobacterium
EAEGAKADARRKVRDSG

SEQ ID NO: 1043511 - protein, 22 aa, Mycobacterium
EAEGVRLFRFDRIVVARELDEP

SEQ ID NO: 1043512 - protein, 19 aa, Mycobacterium
EAELFRLQTEFVRLQEWVR

SEQ ID NO: 1043513 - protein, 24 aa, Mycobacterium
EAERIGLVDLVFPRASFDSTDGGW

SEQ ID NO: 1043514 - protein, 22 aa, Mycobacterium
EAERRKALDVGYDLDQVLTTED

SEQ ID NO: 1043515 - protein, 18 aa, Mycobacterium
EAFADFLSGFHIVDEHFR

SEQ ID NO: 1043516 - protein, 20 aa, Mycobacterium
EAFEAVRCLRDPQSQKRLAI

SEQ ID NO: 1043517 - protein, 23 aa, Mycobacterium
EAFGTGAAECLGRARAALESSDD

SEQ ID NO: 1043518 - protein, 26 aa, Mycobacterium
EAFLKRHRFSSFFVDYFITPLVAAVW

SEQ ID NO: 1043519 - protein, 23 aa, Mycobacterium
EAFYSLVSGAGWSINTGRAAPRD

SEQ ID NO: 1043520 - protein, 29 aa, Mycobacterium
EAGALLFPGARGWITYLWVPPFASEKVRR

SEQ ID NO: 1043521 - protein, 26 aa, Mycobacterium
EAGARFAFVCAVDMPGLTVDLIDDLV

SEQ ID NO: 1043522 - protein, 19 aa, Mycobacterium
EAGARWILDLGPGDILTRL

SEQ ID NO: 1043523 - protein, 20 aa, Mycobacterium
EAGFRSGYLDVYQWTFERED

SEQ ID NO: 1043524 - protein, 19 aa, Mycobacterium
EAGLPRRGAPDAIVVVRDA

SEQ ID NO: 1043525 - protein, 25 aa, Mycobacterium
EAGLRAGGRVVGLVGTIGIRIDGAD

SEQ ID NO: 1043526 - protein, 20 aa, Mycobacterium
EAGPMLAAYLVPAAAQVDLE

SEQ ID NO: 1043527 - protein, 25 aa, Mycobacterium
EAGPRVRTAVLAKLYPTRSHTGAAQ

SEQ ID NO: 1043528 - protein, 25 aa, Mycobacterium
EAGRPVPVRIYRAAPTPAPVVVYCH

SEQ ID NO: 1043529 - protein, 20 aa, Mycobacterium
EAGVDCFVAGSAVYGAQDPA

SEQ ID NO: 1043530 - protein, 20 aa, Mycobacterium
EAGVDLALINYYFGSKRGLV

SEQ ID NO: 1043531 - protein, 24 aa, Mycobacterium
EAHKAEFARGVAFAQERAQREARL

SEQ ID NO: 1043532 - protein, 29 aa, Mycobacterium
EAHLISPWGTWEWMAPAAAGAALPVSGTS

SEQ ID NO: 1043533 - protein, 28 aa, Mycobacterium
EAIAREVRRGGLPLQRLVNGESMGAVAR

SEQ ID NO: 1043534 - protein, 22 aa, Mycobacterium
EAIASFARLWVEDAHWQAAEQV

SEQ ID NO: 1043535 - protein, 39 aa, Mycobacterium; identical to SEQ ID NO: 650539

SEQ ID NO: 1043536 - protein, 25 aa, Mycobacterium
EAIDAEIPLLVVITEVIPVQDTAYA

SEQ ID NO: 1043537 - protein, 23 aa, Mycobacterium
EAIRASGLSAGIIDAGLSRGLAG

SEQ ID NO: 1043538 - protein, 27 aa, Mycobacterium
EAIRGLSKVAALEWGRDNIRVNVIRPF

SEQ ID NO: 1043539 - protein, 20 aa, Mycobacterium
EAIRTGRRQFGFAFTDPGSV

SEQ ID NO: 1043540 - protein, 18 aa, Mycobacterium
EAIVDGWFHTGDLGSVDD

SEQ ID NO: 1043541 - protein, 21 aa, Mycobacterium
EAIVDRIDYIVSLGETVMSPL

SEQ ID NO: 1043542 - protein, 19 aa, Mycobacterium
EAKPLLGKPTAWLFGSEPH

SEQ ID NO: 1043543 - protein, 24 aa, Mycobacterium
EALADGVVRPVVFLAYSGQARWRD

SEQ ID NO: 1043544 - protein, 20 aa, Mycobacterium
EALALAESWDNGKPIREALN

SEQ ID NO: 1043545 - protein, 17 aa, Mycobacterium
EALDDYSAILLESIADR

SEQ ID NO: 1043546 - protein, 21 aa, Mycobacterium
EALDRCGMVLGFVDGNHENFE

SEQ ID NO: 1043547 - protein, 19 aa, Mycobacterium
EALELTWRSLGEIGNLSSA

SEQ ID NO: 1043548 - protein, 19 aa, Mycobacterium
EALERSGIDPTGLRGSATG

SEQ ID NO: 1043549 - protein, 34 aa, Mycobacterium
EALETWPLSMFERFLPRHLEIIYEINRRFLHEVR

SEQ ID NO: 1043550 - protein, 20 aa, Mycobacterium
EALFTLGDRPEQRWPEAKEW

SEQ ID NO: 1043551 - protein, 19 aa, Mycobacterium
EALGDAGATKVLWENSAAF

SEQ ID NO: 1043552 - protein, 18 aa, Mycobacterium
EALGRALGSGRVFTTDLR

SEQ ID NO: 1043553 - protein, 18 aa, Mycobacterium
EALKATSATLAFDATGGG

SEQ ID NO: 1043554 - protein, 24 aa, Mycobacterium
EALKPYYRFLCKRPCTNDDYLQTF

SEQ ID NO: 1043555 - protein, 25 aa, Mycobacterium
EALLLEFLGEAAVTVPELGTFVAPL

SEQ ID NO: 1043556 - protein, 17 aa, Mycobacterium
EALNARADECWSQIQKL

SEQ ID NO: 1043557 - protein, 19 aa, Mycobacterium
EALPRIQLWPLTADGDYGE

SEQ ID NO: 1043558 - protein, 24 aa, Mycobacterium
EALPSRPVQVIGFTSVPGAGDNFL

SEQ ID NO: 1043559 - protein, 24 aa, Mycobacterium
EALQKLATHCPVAILSGRDLADVI

SEQ ID NO: 1043560 - protein, 19 aa, Mycobacterium
EALQLPLWGGLGEEDRLRA

SEQ ID NO: 1043561 - protein, 17 aa, Mycobacterium
EALRPARLLVSGSAALP

SEQ ID NO: 1043562 - protein, 21 aa, Mycobacterium
EALRRRTLVTAAQYLALGIDP

SEQ ID NO: 1043563 - protein, 17 aa, Mycobacterium
EALRRWASSLQTTAEMG

SEQ ID NO: 1043564 - protein, 18 aa, Mycobacterium
EALTESVRRVSSIALVHD

SEQ ID NO: 1043565 - protein, 21 aa, Mycobacterium
EALTNWYVRRSRSRFWQEDVD

SEQ ID NO: 1043566 - protein, 17 aa, Mycobacterium
EALTPGLQQVFGMAEGL

SEQ ID NO: 1043567 - protein, 19 aa, Mycobacterium
EALVPLVLAGTTHRETPRL

SEQ ID NO: 1043568 - protein, 20 aa, Mycobacterium
EALYGRFTAHHAFLARMHLN

SEQ ID NO: 1043569 - protein, 21 aa, Mycobacterium
EAMPSRYGQALAESEVQPIGQ

SEQ ID NO: 1043570 - protein, 23 aa, Mycobacterium
EAMPSRYGQALAESEVQPIGQPE

SEQ ID NO: 1043571 - protein, 17 aa, Mycobacterium
EAMRLAIEQSMLVKGTT

SEQ ID NO: 1043572 - protein, 26 aa, Mycobacterium
EAMVKKLSIRLGVPCFPDDPLHFTGS

SEQ ID NO: 1043573 - protein, 20 aa, Mycobacterium
EANFMLIGAAFYRDQYRRTA

SEQ ID NO: 1043574 - protein, 26 aa, Mycobacterium
EANIAPWLRAAHRYGAKVKWAEVDIE

SEQ ID NO: 1043575 - protein, 33 aa, Mycobacterium; identical to SEQ ID NO: 650798

SEQ ID NO: 1043576 - protein, 25 aa, Mycobacterium
EAPAYRWPLVPALALVAAMPALGAA

SEQ ID NO: 1043577 - protein, 32 aa, Mycobacterium; identical to SEQ ID NO: 650804

SEQ ID NO: 1043578 - protein, 19 aa, Mycobacterium
EAPEATAATAAPRVLAAAT

SEQ ID NO: 1043579 - protein, 20 aa, Mycobacterium
EAPVLFAMGHFLGSDRVAGL

SEQ ID NO: 1043580 - protein, 24 aa, Mycobacterium
EAQERYARKVSWGVDVVSDAGTER

SEQ ID NO: 1043581 - protein, 21 aa, Mycobacterium
EAQLDRFLLKLNVGLPSRESE

SEQ ID NO: 1043582 - protein, 22 aa, Mycobacterium
EAQRAAKLAGYRGAMYPWQSGS

SEQ ID NO: 1043583 - protein, 26 aa, Mycobacterium
EARAAGLKAANTWHASRAIQEAREAC

SEQ ID NO: 1043584 - protein, 28 aa, Mycobacterium
EARAALANLGYRGFWMGYFAARSAPLGQ

SEQ ID NO: 1043585 - protein, 21 aa, Mycobacterium
EARGAIHAPSFRERVRYRSVQ

SEQ ID NO: 1043586 - protein, 27 aa, Mycobacterium
EARGVPMTAGCVVPRGDVLELLDDIKD

SEQ ID NO: 1043587 - protein, 28 aa, Mycobacterium
EARIEIEMIRLLTLKAAYLMDTVGNKHA

SEQ ID NO: 1043588 - protein, 24 aa, Mycobacterium
EARPRAGILRAREFVMKDSYSFDI

SEQ ID NO: 1043589 - protein, 27 aa, Mycobacterium
EARRECTGFIFNRVWAAIKRESLAVVA

SEQ ID NO: 1043590 - protein, 33 aa, Mycobacterium; identical to SEQ ID NO: 650957

SEQ ID NO: 1043591 - protein, 26 aa, Mycobacterium
EASVHGHTAWGVGIAPSITTASLRAV

SEQ ID NO: 1043592 - protein, 18 aa, Mycobacterium
EASWSIFVSARWQVDTPQ

SEQ ID NO: 1043593 - protein, 21 aa, Mycobacterium
EASYFGPSFMINWLHNSYGGY

SEQ ID NO: 1043594 - protein, 21 aa, Mycobacterium
EASYHRWRYQFGGLKAKDADK

SEQ ID NO: 1043595 - protein, 24 aa, Mycobacterium
EATAEAFAGGWFHSGDLVRMDEDG

SEQ ID NO: 1043596 - protein, 18 aa, Mycobacterium
EATISFFTHHGLTVVGRD

SEQ ID NO: 1043597 - protein, 18 aa, Mycobacterium
EATPRFHSKIVELNLLAP

SEQ ID NO: 1043598 - protein, 18 aa, Mycobacterium
EAVASWAVSEPGRGWDPV

SEQ ID NO: 1043599 - protein, 24 aa, Mycobacterium
EAVAVKDGRIVAVGAHDDVVRENL

SEQ ID NO: 1043600 - protein, 23 aa, Mycobacterium
EAVFRKGAYCAAYSGFEGVDHHG

SEQ ID NO: 1043601 - protein, 26 aa, Mycobacterium
EAVGACSRGLMSRADVDAIERAICPG

SEQ ID NO: 1043602 - protein, 29 aa, Mycobacterium
EAVGGPSTWRLGGAINCGKAQPGQVAPVS

SEQ ID NO: 1043603 - protein, 19 aa, Mycobacterium
EAVGHFLSAFVAITPLDPS

SEQ ID NO: 1043604 - protein, 17 aa, Mycobacterium
EAVGLMAGHSAVVTHPA

SEQ ID NO: 1043605 - protein, 17 aa, Mycobacterium
EAVKVTSMIPASTLQQL

SEQ ID NO: 1043606 - protein, 20 aa, Mycobacterium
EAVLAAARRLRIIAATPQAR

SEQ ID NO: 1043607 - protein, 18 aa, Mycobacterium
EAVLPRLDVPPLLDELVG

SEQ ID NO: 1043608 - protein, 17 aa, Mycobacterium
EAVLRCEDMPAYLSTSL

SEQ ID NO: 1043609 - protein, 22 aa, Mycobacterium
EAVPPPAPMPFGLMPPPPAPAA

SEQ ID NO: 1043610 - protein, 25 aa, Mycobacterium
EAVSGWATKQPKVWWNTGTSTPPIH

SEQ ID NO: 1043611 - protein, 23 aa, Mycobacterium
EAVTGLDLVEWQLRVAAGEKLGF

SEQ ID NO: 1043612 - protein, 17 aa, Mycobacterium
EAWQRHVGGNGWRGDDL

SEQ ID NO: 1043613 - protein, 19 aa, Mycobacterium
ECAQLSAVVIRANTNGDNP

SEQ ID NO: 1043614 - protein, 21 aa, Mycobacterium
ECLRSILGGARVDYHGRHVAS

SEQ ID NO: 1043615 - protein, 23 aa, Mycobacterium
ECMSTGFSVWASRMAVEYLLTAA

SEQ ID NO: 1043616 - protein, 26 aa, Mycobacterium
ECPFMEFTPGYVLRVIDELPKQGSRK

SEQ ID NO: 1043617 - protein, 25 aa, Mycobacterium
ECRGRRLAADLLRIVSTWQLDADPS

SEQ ID NO: 1043618 - protein, 17 aa, Mycobacterium
ECRRLRPDSATGLAPLR

SEQ ID NO: 1043619 - protein, 23 aa, Mycobacterium
ECVGEFRDGVWLIELGDLSNGEL

SEQ ID NO: 1043620 - protein, 17 aa, Mycobacterium
ECYQAAVSVGTNPTFSG

SEQ ID NO: 1043621 - protein, 19 aa, Mycobacterium
EDAIRLRGLMTHMVHADAP

SEQ ID NO: 1043622 - protein, 23 aa, Mycobacterium
EDAPAGQVLDHWLTSARRDDAAR

SEQ ID NO: 1043623 - protein, 26 aa, Mycobacterium
EDAWRGELPPALALQIVERHGYDIAP

SEQ ID NO: 1043624 - protein, 21 aa, Mycobacterium
EDCHFCSQSGLFSSPVRSAWL

SEQ ID NO: 1043625 - protein, 24 aa, Mycobacterium
EDEKLPPRRAVLTAEVDDAIYRPD

SEQ ID NO: 1043626 - protein, 18 aa, Mycobacterium
EDEQHAILLNLVRSHIAT

SEQ ID NO: 1043627 - protein, 21 aa, Mycobacterium
EDERIGVLSFPLGKQQRPATK

SEQ ID NO: 1043628 - protein, 20 aa, Mycobacterium
EDFAGLVVSGDDAWDTINEY

SEQ ID NO: 1043629 - protein, 26 aa, Mycobacterium
EDFHCGDEVYGLIGFDRDGAAADYVA

SEQ ID NO: 1043630 - protein, 25 aa, Mycobacterium
EDFTAALADRGWLGMTVPVEYGGHG

SEQ ID NO: 1043631 - protein, 19 aa, Mycobacterium
EDGEKRIPLDVAEGDTVIY

SEQ ID NO: 1043632 - protein, 18 aa, Mycobacterium
EDGFYFIVDRVKDMIVTG

SEQ ID NO: 1043633 - protein, 25 aa, Mycobacterium
EDGQLPKMRAIVGFAAETGDANGDV

SEQ ID NO: 1043634 - protein, 19 aa, Mycobacterium
EDGRVFTGMSFGAVGQTLG

SEQ ID NO: 1043635 - protein, 25 aa, Mycobacterium
EDGWVRAQLLHYMRSAPDFYFDEMA

SEQ ID NO: 1043636 - protein, 18 aa, Mycobacterium
EDHLDWHGTMAAYTEAKA

SEQ ID NO: 1043637 - protein, 26 aa, Mycobacterium
EDHRSRVGRLWAGFNAVAVDNPHAWI

SEQ ID NO: 1043638 - protein, 24 aa, Mycobacterium
EDIAEAALYFAGERSRYVTGTVLP

SEQ ID NO: 1043639 - protein, 17 aa, Mycobacterium
EDIKVATPIHAMGGDQD

SEQ ID NO: 1043640 - protein, 24 aa, Mycobacterium
EDIYYYYDCIYCAADVASPTGYLP

SEQ ID NO: 1043641 - protein, 21 aa, Mycobacterium
EDKNIRIAPSFPSLPDLSDAV

SEQ ID NO: 1043642 - protein, 18 aa, Mycobacterium
EDLINRWTWIPFGAGRHR

SEQ ID NO: 1043643 - protein, 23 aa, Mycobacterium
EDLLDSWAGTMIVVSHDRYLLER

SEQ ID NO: 1043644 - protein, 23 aa, Mycobacterium
EDLLRLLDKWFPGEQVHGVGPSM

SEQ ID NO: 1043645 - protein, 21 aa, Mycobacterium
EDLQAAIALGGEMGRRFAELD

SEQ ID NO: 1043646 - protein, 22 aa, Mycobacterium
EDLRTTLGPARRIVHARGMELF

SEQ ID NO: 1043647 - protein, 17 aa, Mycobacterium
EDLRYGPDVTTIATVPA

SEQ ID NO: 1043648 - protein, 17 aa, Mycobacterium
EDLVFRVNYLGGDMPTF

SEQ ID NO: 1043649 - protein, 17 aa, Mycobacterium
EDMPAYLSTSLFAFWIV

SEQ ID NO: 1043650 - protein, 28 aa, Mycobacterium
EDNRAWRLYRRLGFTDILRGYYFAGDPR

SEQ ID NO: 1043651 - protein, 19 aa, Mycobacterium
EDPARGFLPTGGRVLQVAE

SEQ ID NO: 1043652 - protein, 19 aa, Mycobacterium
EDQGPRRIAVSSFGMSGTN

SEQ ID NO: 1043653 - protein, 20 aa, Mycobacterium
EDRGRRWPVIISGTITDASG

SEQ ID NO: 1043654 - protein, 27 aa, Mycobacterium
EDRICIPVPFYHCFGMVMGNLAATSHG

SEQ ID NO: 1043655 - protein, 23 aa, Mycobacterium
EDRRIPIPETRHMTLHSDTKIDR

SEQ ID NO: 1043656 - protein, 20 aa, Mycobacterium
EDSMTLYGFVDGETRDLFLT

SEQ ID NO: 1043657 - protein, 24 aa, Mycobacterium
EDSRPLRGWQRRAMVKYLASQPRD

SEQ ID NO: 1043658 - protein, 21 aa, Mycobacterium
EDVAKLSYYGLYALQHRGQEA

SEQ ID NO: 1043659 - protein, 23 aa, Mycobacterium
EDVDPRVSLAIGGLAVIEGPVPE

SEQ ID NO: 1043660 - protein, 18 aa, Mycobacterium
EDVNRNFAGVYAYLRANP

SEQ ID NO: 1043661 - protein, 24 aa, Mycobacterium
EDVRGRVGLPITVGVARTEFLAKV

SEQ ID NO: 1043662 - protein, 34 aa, Mycobacterium
EDWMACTYHGRILWRPGALPAFSDDRWEFYDLFR

SEQ ID NO: 1043663 - protein, 19 aa, Mycobacterium
EDYRTFWTQFGKVVKEGLL

SEQ ID NO: 1043664 - protein, 20 aa, Mycobacterium
EEAARGCVDLALERFGSVDI

SEQ ID NO: 1043665 - protein, 21 aa, Mycobacterium
EEAPWGIKVVMIEPASINSGA

SEQ ID NO: 1043666 - protein, 23 aa, Mycobacterium
EEFARAGYDYVGFDTQHGYLDDA

SEQ ID NO: 1043667 - protein, 20 aa, Mycobacterium
EEFLALKVEGILECAELMVV

SEQ ID NO: 1043668 - protein, 20 aa, Mycobacterium
EEGLLRLGAEAVEQRINEAL

SEQ ID NO: 1043669 - protein, 24 aa, Mycobacterium
EEIGSAIGVANEFAAGSISDVAAA

SEQ ID NO: 1043670 - protein, 19 aa, Mycobacterium
EEIIRELAERRVLVGERGS

SEQ ID NO: 1043671 - protein, 22 aa, Mycobacterium
EEILGRPVLDPDADFFRIGGHS

SEQ ID NO: 1043672 - protein, 20 aa, Mycobacterium
EEIVLRLRALLRRTGVTTVD

SEQ ID NO: 1043673 - protein, 25 aa, Mycobacterium
EEIYARYQAFTSFTAHVRGPVDIDA

SEQ ID NO: 1043674 - protein, 17 aa, Mycobacterium
EEKFVREARLCRKYGAA

SEQ ID NO: 1043675 - protein, 21 aa, Mycobacterium
EEKKLFSRMVEVFAGFLSCTD

SEQ ID NO: 1043676 - protein, 24 aa, Mycobacterium
EEKLPRYIGGVLARLQEVWMGRQI

SEQ ID NO: 1043677 - protein, 20 aa, Mycobacterium
EELDRRLDVLAMAKVEATDD

SEQ ID NO: 1043678 - protein, 20 aa, Mycobacterium
EELGQGLLLVAVGASRSLED

SEQ ID NO: 1043679 - protein, 20 aa, Mycobacterium
EELIVALPLATPGVAVGDHF

SEQ ID NO: 1043680 - protein, 18 aa, Mycobacterium
EELLECWTAAGLGIHHKP

SEQ ID NO: 1043681 - protein, 19 aa, Mycobacterium
EELLPMLAAMGMDTSRVGF

SEQ ID NO: 1043682 - protein, 17 aa, Mycobacterium
EELMPEGLVELTALDVD

SEQ ID NO: 1043683 - protein, 18 aa, Mycobacterium
EELMPEGLVELTALDVDP

SEQ ID NO: 1043684 - protein, 23 aa, Mycobacterium
EELRDAVSKHWVIDEIRPARIHA

SEQ ID NO: 1043685 - protein, 19 aa, Mycobacterium
EELWQRLGHTTSLAHGPFP

SEQ ID NO: 1043686 - protein, 17 aa, Mycobacterium
EEMLEMAACGAKVLMLR

SEQ ID NO: 1043687 - protein, 23 aa, Mycobacterium
EEMWAQDVAAMFGYHSGASVVAA

SEQ ID NO: 1043688 - protein, 21 aa, Mycobacterium
EEPARLLSQFIHGIKRLPVAW

SEQ ID NO: 1043689 - protein, 25 aa, Mycobacterium
EEPIAVVGMGCRFPGGISGPEALWQ

SEQ ID NO: 1043690 - protein, 20 aa, Mycobacterium
EEQARRLVIRGFFGEIISKI

SEQ ID NO: 1043691 - protein, 23 aa, Mycobacterium
EERRLSRNHWGYLDETAGDVDNH

SEQ ID NO: 1043692 - protein, 20 aa, Mycobacterium
EERYRLCSTVHTKIAVVKSI

SEQ ID NO: 1043693 - protein, 18 aa, Mycobacterium
EESVFRIDHYLGKETVQN

SEQ ID NO: 1043694 - protein, 17 aa, Mycobacterium
EETHPLWIVRRTMVDLI

SEQ ID NO: 1043695 - protein, 29 aa, Mycobacterium
EEVAPWLDLACKLGVLAAALSDEPPVSLS

SEQ ID NO: 1043696 - protein, 19 aa, Mycobacterium
EEVGLPVTFSLVVGNVGEP

SEQ ID NO: 1043697 - protein, 20 aa, Mycobacterium
EEVLGFMFLMVIAGNETTTK

SEQ ID NO: 1043698 - protein, 28 aa, Mycobacterium
EEVMLGLRLRQGLPLAHLDAGERERAQA

SEQ ID NO: 1043699 - protein, 24 aa, Mycobacterium
EEVREYMAQLGFRTINEAVGQAGA

SEQ ID NO: 1043700 - protein, 20 aa, Mycobacterium
EEWAETWPAEGLTYPKALAD

SEQ ID NO: 1043701 - protein, 25 aa, Mycobacterium
EEWGSRAIAVFGHRPYVGVSANLVA

SEQ ID NO: 1043702 - protein, 22 aa, Mycobacterium
EEYCKQRLGLDAALGSIDRSKL

SEQ ID NO: 1043703 - protein, 20 aa, Mycobacterium
EFAKRMVGSAAIVYTHNDPV

SEQ ID NO: 1043704 - protein, 22 aa, Mycobacterium
EFDGRIITVPFSFKEIDDDGLI

SEQ ID NO: 1043705 - protein, 26 aa, Mycobacterium
EFDSRAVGPGGLFLALPGARADGHDH

SEQ ID NO: 1043706 - protein, 20 aa, Mycobacterium
EFEKKLDWIRGFVREEVEPL

SEQ ID NO: 1043707 - protein, 17 aa, Mycobacterium
EFERFLAQQAEKKFDDD

SEQ ID NO: 1043708 - protein, 21 aa, Mycobacterium
EFGCAAPSDAALICVPPYHIA

SEQ ID NO: 1043709 - protein, 20 aa, Mycobacterium
EFGVTCTFHGHRRLSPDEVA

SEQ ID NO: 1043710 - protein, 24 aa, Mycobacterium
EFIAEAVATLGARRHDGFQVHHVA

SEQ ID NO: 1043711 - protein, 26 aa, Mycobacterium
EFIAWEPFSHMAFRFNECSTQAVAAF

SEQ ID NO: 1043712 - protein, 18 aa, Mycobacterium
EFKNRVGAIPDAELDDFW

SEQ ID NO: 1043713 - protein, 24 aa, Mycobacterium
EFLARLCKTAMWIDHGEIKLSGGI

SEQ ID NO: 1043714 - protein, 29 aa, Mycobacterium
EFLGARFDAGLAWVHFPVGFGGLDLPHTY

SEQ ID NO: 1043715 - protein, 19 aa, Mycobacterium
EFLRTMILSLVAMTHPDQL

SEQ ID NO: 1043716 - protein, 20 aa, Mycobacterium
EFPGCTSATVGRLAHVQLPD

SEQ ID NO: 1043717 - protein, 21 aa, Mycobacterium
EFPTRIISTLLGLPREDLDLF

SEQ ID NO: 1043718 - protein, 19 aa, Mycobacterium
EFQIVFSSLFPGGEGRLRL

SEQ ID NO: 1043719 - protein, 18 aa, Mycobacterium
EFSRACEALYHFAWDEFC

SEQ ID NO: 1043720 - protein, 24 aa, Mycobacterium
EFSSVKVGDLLPEKTYPLTRQDLV

SEQ ID NO: 1043721 - protein, 21 aa, Mycobacterium
EFTAPHFASAWAHANNTPFQW

SEQ ID NO: 1043722 - protein, 18 aa, Mycobacterium
EFTPFPPPQQSWQLSKRT

SEQ ID NO: 1043723 - protein, 20 aa, Mycobacterium
EFTPLAWQHAVEGWKQIGAP

SEQ ID NO: 1043724 - protein, 24 aa, Mycobacterium
EFTRTGFTGGLNWYRNFDRNWETT

SEQ ID NO: 1043725 - protein, 23 aa, Mycobacterium
EFTVESGKLWLLQTRSAERSAQA

SEQ ID NO: 1043726 - protein, 27 aa, Mycobacterium
EFVDRLVKRAATIVVGPTRDWDTDLGP

SEQ ID NO: 1043727 - protein, 19 aa, Mycobacterium
EFVERVIAQQAERGNKIDA

SEQ ID NO: 1043728 - protein, 17 aa, Mycobacterium
EFVKPHLALYIGGMGAK

SEQ ID NO: 1043729 - protein, 23 aa, Mycobacterium
EFVVELLQWAAAKLERYERARRR

SEQ ID NO: 1043730 - protein, 28 aa, Mycobacterium
EFWDEIFRELSIPYLPVRWRPDNPDSIV

SEQ ID NO: 1043731 - protein, 20 aa, Mycobacterium
EFYALLAARQAERASLPSPQ

SEQ ID NO: 1043732 - protein, 26 aa, Mycobacterium
EFYGYPAKLSSTWLRANFITSLDGGA

SEQ ID NO: 1043733 - protein, 21 aa, Mycobacterium
EGADFDHLLVIGGGRYTNQLR

SEQ ID NO: 1043734 - protein, 25 aa, Mycobacterium
EGAEARYLWPSVFTQVADEYDRRYG

SEQ ID NO: 1043735 - protein, 19 aa, Mycobacterium
EGAGMKVAFARLAQQISGF

SEQ ID NO: 1043736 - protein, 25 aa, Mycobacterium
EGALGRGKEAFVTRARELAAKYGDR

SEQ ID NO: 1043737 - protein, 25 aa, Mycobacterium
EGAPSRLFLRYVIFGGEMLTFADLI

SEQ ID NO: 1043738 - protein, 20 aa, Mycobacterium
EGCSFINVLLELGADPPPGG

SEQ ID NO: 1043739 - protein, 24 aa, Mycobacterium
EGDGGDGGNAFLIGNGGNGGAAAA

SEQ ID NO: 1043740 - protein, 23 aa, Mycobacterium
EGDPDQWASAPFEPTERDGRLYG

SEQ ID NO: 1043741 - protein, 24 aa, Mycobacterium
EGDVPKVGVVLVRIDIAPSNKAAR

SEQ ID NO: 1043742 - protein, 20 aa, Mycobacterium
EGEHCRRCGAVMRREKFMNR

SEQ ID NO: 1043743 - protein, 18 aa, Mycobacterium
EGELPRLFVVTRQAQRVR

SEQ ID NO: 1043744 - protein, 23 aa, Mycobacterium
EGELRPQLLDRFGLTVDVHASRD

SEQ ID NO: 1043745 - protein, 23 aa, Mycobacterium
EGFARPGARRSRADFEICATAQV

SEQ ID NO: 1043746 - protein, 26 aa, Mycobacterium
EGFGYIPWGVFLPRTARLLAADKLAD

SEQ ID NO: 1043747 - protein, 25 aa, Mycobacterium
EGGAGGKGGLLFGAGGEGGAGGTGG

SEQ ID NO: 1043748 - protein, 25 aa, Mycobacterium
EGGFPELSCDGLVAGTSGAPWVSAG

SEQ ID NO: 1043749 - protein, 20 aa, Mycobacterium
EGGLMACLAYTWKQVVTTPL

SEQ ID NO: 1043750 - protein, 17 aa, Mycobacterium
EGGWLLSGTKVWTSGAH

SEQ ID NO: 1043751 - protein, 25 aa, Mycobacterium
EGHSRMAPVYLYRFDYSTPLLKLLL

SEQ ID NO: 1043752 - protein, 24 aa, Mycobacterium
EGIDWCKRHLEVLGAGYQLSKEAV

SEQ ID NO: 1043753 - protein, 23 aa, Mycobacterium
EGIIAAAAIRCMGGAIQAQLAPK

SEQ ID NO: 1043754 - protein, 23 aa, Mycobacterium
EGIPKLRIEEAAARTQARIDSGQ

SEQ ID NO: 1043755 - protein, 26 aa, Mycobacterium
EGIRGFEVLEALPFDERRLRQALNAL

SEQ ID NO: 1043756 - protein, 25 aa, Mycobacterium
EGKGWRWHTWHLYPLHPGGSGGTVV

SEQ ID NO: 1043757 - protein, 23 aa, Mycobacterium
EGKRSYAAAVHRATRPGATLLMS

SEQ ID NO: 1043758 - protein, 24 aa, Mycobacterium
EGLADGVVRPVVFLVYSGQARWRN

SEQ ID NO: 1043759 - protein, 25 aa, Mycobacterium
EGLGEIEDLHIWTAESVRSERLDFR

SEQ ID NO: 1043760 - protein, 18 aa, Mycobacterium
EGLGQTRQRVCATPPPQP

SEQ ID NO: 1043761 - protein, 21 aa, Mycobacterium
EGLPAGSALLVVKRGPNAGSR

SEQ ID NO: 1043762 - protein, 18 aa, Mycobacterium
EGLYAVVVDREMSALLDG

SEQ ID NO: 1043763 - protein, 18 aa, Mycobacterium
EGMLRCGLQAAAQRLPFL

SEQ ID NO: 1043764 - protein, 17 aa, Mycobacterium
EGNRLGPTINFRGIDNS

SEQ ID NO: 1043765 - protein, 19 aa, Mycobacterium
EGPAVKRGVMASAAAKKAA

SEQ ID NO: 1043766 - protein, 27 aa, Mycobacterium
EGPEVQLGISLGRRWWGQHVTSEALDL

SEQ ID NO: 1043767 - protein, 17 aa, Mycobacterium
EGPFAIQELTLPLALAG

SEQ ID NO: 1043768 - protein, 19 aa, Mycobacterium
EGPQLKVGIGLDVGPAYVG

SEQ ID NO: 1043769 - protein, 20 aa, Mycobacterium
EGPRPVAALLAGLPPADRAS

SEQ ID NO: 1043770 - protein, 18 aa, Mycobacterium
EGPWLRTGDSGFITDGKM

SEQ ID NO: 1043771 - protein, 20 aa, Mycobacterium
EGQLGKWSRMDAELVAEHAE

SEQ ID NO: 1043772 - protein, 25 aa, Mycobacterium
EGQLSRWTRFSAHRVATMDPTRRLA

SEQ ID NO: 1043773 - protein, 25 aa, Mycobacterium
EGRKTRIYCPDWVGLFRWLKPALST

SEQ ID NO: 1043774 - protein, 20 aa, Mycobacterium
EGRLRRLDCSQMTDGGAGLV

SEQ ID NO: 1043775 - protein, 25 aa, Mycobacterium
EGRPVIIITEYFLRSVFEDNSREEP

SEQ ID NO: 1043776 - protein, 19 aa, Mycobacterium
EGRRQRLTVTYQRRGYTPA

SEQ ID NO: 1043777 - protein, 19 aa, Mycobacterium
EGRRTLVIFDEIHHGGNAK

SEQ ID NO: 1043778 - protein, 24 aa, Mycobacterium
EGRSSVATWLFGIVKNTASRYRRR

SEQ ID NO: 1043779 - protein, 20 aa, Mycobacterium
EGSITYNEWSFAQAQHLNMA

SEQ ID NO: 1043780 - protein, 22 aa, Mycobacterium
EGTEFRAGVNVGVDITAEQLRA

SEQ ID NO: 1043781 - protein, 18 aa, Mycobacterium
EGTGPWIAHWEPGPSTQP

SEQ ID NO: 1043782 - protein, 24 aa, Mycobacterium
EGTNLKAWLYRILTNTYINSYRKK

SEQ ID NO: 1043783 - protein, 19 aa, Mycobacterium
EGVDVPRLSVGIYATSAST

SEQ ID NO: 1043784 - protein, 18 aa, Mycobacterium
EGVKAADVFAEFGENIEM

SEQ ID NO: 1043785 - protein, 20 aa, Mycobacterium
EGVKAEFPDQMLAYNCSPSF

SEQ ID NO: 1043786 - protein, 21 aa, Mycobacterium
EGVLRVFELHPLFNPAGYVVA

SEQ ID NO: 1043787 - protein, 22 aa, Mycobacterium
EGVPARLLVGSHLHWNVTDHSD

SEQ ID NO: 1043788 - protein, 20 aa, Mycobacterium
EGVPPAARRPEPTLPVPAGW

SEQ ID NO: 1043789 - protein, 26 aa, Mycobacterium
EGVRLLRSGGVIVVHRAALGDRAGDP

SEQ ID NO: 1043790 - protein, 25 aa, Mycobacterium
EGVVWGIDSFDQWGVELGKTQAKAL

SEQ ID NO: 1043791 - protein, 24 aa, Mycobacterium
EGVYRFLLKRNRRFYGVAYTLDNV

SEQ ID NO: 1043792 - protein, 17 aa, Mycobacterium
EGYCPGDDPQLVAEAIV

SEQ ID NO: 1043793 - protein, 19 aa, Mycobacterium
EGYGAASIEGIRSSSSNPP

SEQ ID NO: 1043794 - protein, 20 aa, Mycobacterium
EHAMALLLAAARQIPAADAS

SEQ ID NO: 1043795 - protein, 18 aa, Mycobacterium
EHANMFGLWLCPLGTDLP

SEQ ID NO: 1043796 - protein, 19 aa, Mycobacterium
EHELRFILEDAGSRMIFAP

SEQ ID NO: 1043797 - protein, 25 aa, Mycobacterium
EHGDIPLGIYCRASLAQYMDAERLF

SEQ ID NO: 1043798 - protein, 23 aa, Mycobacterium
EHGVWLRPFRNLVYAMPPYICAP

SEQ ID NO: 1043799 - protein, 20 aa, Mycobacterium
EHIADTFIAMGWELAEGPEV

SEQ ID NO: 1043800 - protein, 21 aa, Mycobacterium
EHIADTFIAMGWELVDGPEVE

SEQ ID NO: 1043801 - protein, 17 aa, Mycobacterium
EHILLRTVRCVSGTVEL

SEQ ID NO: 1043802 - protein, 24 aa, Mycobacterium
EHIRRLGITAMQFVPSQLAVVLEE

SEQ ID NO: 1043803 - protein, 17 aa, Mycobacterium
EHIRVFPLSNWTEFDIW

SEQ ID NO: 1043804 - protein, 19 aa, Mycobacterium
EHLAHALVILMTVGGIPSI

SEQ ID NO: 1043805 - protein, 18 aa, Mycobacterium
EHLALRCGRSEHTRRAYL

SEQ ID NO: 1043806 - protein, 29 aa, Mycobacterium
EHLECSRPARARQGGWCAGNRDLFGGAAD

SEQ ID NO: 1043807 - protein, 17 aa, Mycobacterium
EHLKTWSRATGIVLDGP

SEQ ID NO: 1043808 - protein, 19 aa, Mycobacterium
EHLLDVWRRPDLAPGGRAP

SEQ ID NO: 1043809 - protein, 23 aa, Mycobacterium
EHLLIERAYRLGVTAPEMTVLVG

SEQ ID NO: 1043810 - protein, 18 aa, Mycobacterium
EHLRLPLREVIWGADASL

SEQ ID NO: 1043811 - protein, 17 aa, Mycobacterium
EHLSAIIDLTFVTPAVN

SEQ ID NO: 1043812 - protein, 25 aa, Mycobacterium
EHLSALRAIPRLAVVRPADANETAY

SEQ ID NO: 1043813 - protein, 22 aa, Mycobacterium
EHNFRAGNIVPLLNSQKKSDRI

SEQ ID NO: 1043814 - protein, 23 aa, Mycobacterium
EHPEIFKQYFGTVIPAGDNKFSA

SEQ ID NO: 1043815 - protein, 18 aa, Mycobacterium
EHPFPVWTERGGPATIVP

SEQ ID NO: 1043816 - protein, 24 aa, Mycobacterium
EHPYRPITPESIRRAAQLKDDLPV

SEQ ID NO: 1043817 - protein, 19 aa, Mycobacterium
EHRFPAALDDGWAAVQWIA

SEQ ID NO: 1043818 - protein, 17 aa, Mycobacterium
EHRGNVMVITINRPEAR

SEQ ID NO: 1043819 - protein, 30 aa, Mycobacterium
EHRLEKICRMIMLYHLDRGWADHLAYLADI

SEQ ID NO: 1043820 - protein, 18 aa, Mycobacterium
EHRSCAKTQALVAERGFE

SEQ ID NO: 1043821 - protein, 19 aa, Mycobacterium
EHRVGSIAMYRQLRDDPNQ

SEQ ID NO: 1043822 - protein, 26 aa, Mycobacterium
EHYEKLEGVPLTFAGKVNRLAIMVRG

SEQ ID NO: 1043823 - protein, 19 aa, Mycobacterium
EIADALLAALERRHEVADA

SEQ ID NO: 1043824 - protein, 21 aa, Mycobacterium
EIAEGWQPVFFYPEKAASAWS

SEQ ID NO: 1043825 - protein, 18 aa, Mycobacterium
EIAELITMLIRFRTQAVA

SEQ ID NO: 1043826 - protein, 21 aa, Mycobacterium
EIAEQLLRVLARRLRRTSNNL

SEQ ID NO: 1043827 - protein, 24 aa, Mycobacterium
EIAERAGVSKPVLYQHFSSKLELY

SEQ ID NO: 1043828 - protein, 18 aa, Mycobacterium
EIAILGRHAHGFDPRDLS

SEQ ID NO: 1043829 - protein, 19 aa, Mycobacterium
EIALARGPRFDRVQTTPVP

SEQ ID NO: 1043830 - protein, 20 aa, Mycobacterium
EIAPPPVIVSVVNWADCLVA

SEQ ID NO: 1043831 - protein, 27 aa, Mycobacterium
EIAQTVARWLVLYLRRPCGQTQFAAPV

SEQ ID NO: 1043832 - protein, 18 aa, Mycobacterium
EIASRFGVRLSKDDVFES

SEQ ID NO: 1043833 - protein, 30 aa, Mycobacterium; identical to SEQ ID NO: 652784

SEQ ID NO: 1043834 - protein, 19 aa, Mycobacterium
EIDGQLFIDMRFIEGTDLG

SEQ ID NO: 1043835 - protein, 25 aa, Mycobacterium
EIDKVFVVACGTAYHSGLLAKYAIE

SEQ ID NO: 1043836 - protein, 17 aa, Mycobacterium
EIDSAAIERIWQATRYW

SEQ ID NO: 1043837 - protein, 23 aa, Mycobacterium
EIEAIKQLKARYCRYLDTKRWDD

SEQ ID NO: 1043838 - protein, 25 aa, Mycobacterium
EIELAGQEAFVWIGLHEPDEKQMQD

SEQ ID NO: 1043839 - protein, 20 aa, Mycobacterium
EIGACKILASQVLKSIGLRA

SEQ ID NO: 1043840 - protein, 27 aa, Mycobacterium
EIGGVGGRGGGAWAQSPTGTPNVTGGA

SEQ ID NO: 1043841 - protein, 19 aa, Mycobacterium
EIGQPLLNEYVWGRQFGEN

SEQ ID NO: 1043842 - protein, 17 aa, Mycobacterium
EIKFRSVLEEPTYEDGV

SEQ ID NO: 1043843 - protein, 19 aa, Mycobacterium
EIKPYKWESTRGVGNSFGN

SEQ ID NO: 1043844 - protein, 25 aa, Mycobacterium
EILEYHWGPDWVCWDADQTFQQRGQ

SEQ ID NO: 1043845 - protein, 18 aa, Mycobacterium
EILPHFDTLLVMSVEPGF

SEQ ID NO: 1043846 - protein, 22 aa, Mycobacterium
EINLRAGDYVNMGLARHAELPT

SEQ ID NO: 1043847 - protein, 18 aa, Mycobacterium
EINSARMFAGAGSGPMLS

SEQ ID NO: 1043848 - protein, 19 aa, Mycobacterium
EINSLRIFAGTGSGPMLAA

SEQ ID NO: 1043849 - protein, 18 aa, Mycobacterium
EINSLRMFTGAGSAPMLQ

SEQ ID NO: 1043850 - protein, 17 aa, Mycobacterium
EINWIRNFFPPFPPLPF

SEQ ID NO: 1043851 - protein, 25 aa, Mycobacterium
EIPADRPALEAALAILRDITAGATN

SEQ ID NO: 1043852 - protein, 20 aa, Mycobacterium
EIPERVNVIRVMMMELNRIS

SEQ ID NO: 1043853 - protein, 22 aa, Mycobacterium
EIQRARSALRRDVSRLISTETE

SEQ ID NO: 1043854 - protein, 24 aa, Mycobacterium
EIRKARKSIAQFKLREGMPVGVRA

SEQ ID NO: 1043855 - protein, 19 aa, Mycobacterium
EIRMLRVLGADLVGMSTMH

SEQ ID NO: 1043856 - protein, 21 aa, Mycobacterium
EIRTFSGLLQRFGRGKGCDIC

SEQ ID NO: 1043857 - protein, 24 aa, Mycobacterium
EISAPGVTVAHGWASELAEAEPWL

SEQ ID NO: 1043858 - protein, 25 aa, Mycobacterium
EISRATPPIKWPTVIRHPKTGEEIL

SEQ ID NO: 1043859 - protein, 20 aa, Mycobacterium
EIVAAAAADMDGIGSPITAA

SEQ ID NO: 1043860 - protein, 24 aa, Mycobacterium
EIVCAGRPLLEWCVRRRLDDEPRI

SEQ ID NO: 1043861 - protein, 18 aa, Mycobacterium
EIVERWRAAGVRMADERD

SEQ ID NO: 1043862 - protein, 21 aa, Mycobacterium
EIVVHAATELRDIGSSVNTAN

SEQ ID NO: 1043863 - protein, 20 aa, Mycobacterium
EIYQRLSSQLSTFHDQFAAA

SEQ ID NO: 1043864 - protein, 18 aa, Mycobacterium
EKAAELLVSTNRKLDKAA

SEQ ID NO: 1043865 - protein, 18 aa, Mycobacterium
EKALPVPVFAQTMAQVTI

SEQ ID NO: 1043866 - protein, 25 aa, Mycobacterium
EKATPELVAFMVRYTSGYLCVPLDG

SEQ ID NO: 1043867 - protein, 19 aa, Mycobacterium
EKDKASGDFVWDEDESEAL

SEQ ID NO: 1043868 - protein, 19 aa, Mycobacterium
EKDQVVAHLLNLILTGKLR

SEQ ID NO: 1043869 - protein, 19 aa, Mycobacterium
EKELERARLASVRAAAVNA

SEQ ID NO: 1043870 - protein, 17 aa, Mycobacterium
EKFGFLLEALTFGAPPH

SEQ ID NO: 1043871 - protein, 18 aa, Mycobacterium
EKFREVLETEYLKRPLID

SEQ ID NO: 1043872 - protein, 23 aa, Mycobacterium
EKGLRDVMRYHVSMTSSINFPDE

SEQ ID NO: 1043873 - protein, 18 aa, Mycobacterium
EKGPRLGVLGVVVEIDGR

SEQ ID NO: 1043874 - protein, 25 aa, Mycobacterium
EKHCYDVPICWSLRSIFDALDGVDK

SEQ ID NO: 1043875 - protein, 23 aa, Mycobacterium
EKKALLRLAGRYGVGEDAIDDLL

SEQ ID NO: 1043876 - protein, 24 aa, Mycobacterium
EKLDYLVDLGIDFVELMPVNSFAG

SEQ ID NO: 1043877 - protein, 17 aa, Mycobacterium
EKLEAFANFGFPESHAL

SEQ ID NO: 1043878 - protein, 18 aa, Mycobacterium
EKLLELLPNRVITDSIGS

SEQ ID NO: 1043879 - protein, 18 aa, Mycobacterium
EKLMGFGHRVYRAEDPRA

SEQ ID NO: 1043880 - protein, 19 aa, Mycobacterium
EKLRKAAGLLNLEDLADSA

SEQ ID NO: 1043881 - protein, 17 aa, Mycobacterium
EKMEKAVSVAREDLSMI

SEQ ID NO: 1043882 - protein, 25 aa, Mycobacterium
EKMRRAGYKLARREGAREGRWTLLD

SEQ ID NO: 1043883 - protein, 18 aa, Mycobacterium
EKNFKWIARSADGWITTP

SEQ ID NO: 1043884 - protein, 20 aa, Mycobacterium
EKPEAIFFNLEFPHNAVHLR

SEQ ID NO: 1043885 - protein, 36 aa, Mycobacterium; identical to SEQ ID NO: 653220

SEQ ID NO: 1043886 - protein, 17 aa, Mycobacterium
EKTGADVSIIFVPPKFA

SEQ ID NO: 1043887 - protein, 26 aa, Mycobacterium
EKVLCGLRAHWLRRLCANMLCKLGVF

SEQ ID NO: 1043888 - protein, 18 aa, Mycobacterium
EKVMGFGHRVYRNGDSRV

SEQ ID NO: 1043889 - protein, 45 aa, Mycobacterium
EKWPRVRVSGPMVHRAMTGWQRLHFRFGLPAPLLEPLAVERLYLD

SEQ ID NO: 1043890 - protein, 23 aa, Mycobacterium
ELAAIPDRFTKTVLASANSYASA

SEQ ID NO: 1043891 - protein, 19 aa, Mycobacterium
ELAARIEAMPWQWVGQELP

SEQ ID NO: 1043892 - protein, 18 aa, Mycobacterium
ELAARLQAVLTVMAAEPG

SEQ ID NO: 1043893 - protein, 20 aa, Mycobacterium
ELADAIGTYGRFELTVNARV

SEQ ID NO: 1043894 - protein, 17 aa, Mycobacterium
ELADCGRILEIGCGTGN

SEQ ID NO: 1043895 - protein, 20 aa, Mycobacterium
ELADLLKLLGADRIIMGSDY

SEQ ID NO: 1043896 - protein, 21 aa, Mycobacterium
ELADLLPGCAGLEVVDSIRGH

SEQ ID NO: 1043897 - protein, 27 aa, Mycobacterium
ELAEAALAIRAGALWVAANVDKTLPTE

SEQ ID NO: 1043898 - protein, 23 aa, Mycobacterium
ELAEAGHLVRFWALPAGPDGPRM

SEQ ID NO: 1043899 - protein, 17 aa, Mycobacterium
ELAEAIAGIVLIGLLTR

SEQ ID NO: 1043900 - protein, 20 aa, Mycobacterium
ELAEVFGRELARFPQHVESA

SEQ ID NO: 1043901 - protein, 17 aa, Mycobacterium
ELAGFTAIRRWAKQFYP

SEQ ID NO: 1043902 - protein, 23 aa, Mycobacterium
ELAGLRLALMHGRLSADEKEAAM

SEQ ID NO: 1043903 - protein, 19 aa, Mycobacterium
ELAIDWPLVDGAPPSLSER

SEQ ID NO: 1043904 - protein, 22 aa, Mycobacterium
ELAPKLAAAGSRLAAARQAADK

SEQ ID NO: 1043905 - protein, 21 aa, Mycobacterium
ELAPRFSVALMELGATVCTAR

SEQ ID NO: 1043906 - protein, 23 aa, Mycobacterium
ELAQRGWPVFLVSTVTRENLQPL

SEQ ID NO: 1043907 - protein, 22 aa, Mycobacterium
ELARRAAQVIGERTGIAEHDVA

SEQ ID NO: 1043908 - protein, 19 aa, Mycobacterium
ELAVKTGRPLIGINDGAGA

SEQ ID NO: 1043909 - protein, 19 aa, Mycobacterium
ELAVRARSAGVLEVPAGGP

SEQ ID NO: 1043910 - protein, 18 aa, Mycobacterium
ELCRIPVVVLTTSSAEED

SEQ ID NO: 1043911 - protein, 22 aa, Mycobacterium
ELDDCAFPLLSGVEIGSDANKI

SEQ ID NO: 1043912 - protein, 23 aa, Mycobacterium
ELDELRVRYAIAPLLPADAAAGD

SEQ ID NO: 1043913 - protein, 18 aa, Mycobacterium
ELDERRAAVLASIEEQGK

SEQ ID NO: 1043914 - protein, 19 aa, Mycobacterium
ELDIPVVAGGVLDHRTALH

SEQ ID NO: 1043915 - protein, 25 aa, Mycobacterium
ELDNCPPLVVLTGRPDDAWLASWSR

SEQ ID NO: 1043916 - protein, 18 aa, Mycobacterium
ELECGVLEFPDGRLEAST

SEQ ID NO: 1043917 - protein, 18 aa, Mycobacterium
ELEFKPGTRFEYSNSNYL

SEQ ID NO: 1043918 - protein, 24 aa, Mycobacterium
ELEGIRVLRSFDECMALRSHASAA

SEQ ID NO: 1043919 - protein, 26 aa, Mycobacterium
ELEKRRAHVPWVTWGTTAMVARSVAK

SEQ ID NO: 1043920 - protein, 18 aa, Mycobacterium
ELFAMSAVCVRAEAQRVA

SEQ ID NO: 1043921 - protein, 19 aa, Mycobacterium
ELFELAAQCLAPGARLVFN

SEQ ID NO: 1043922 - protein, 26 aa, Mycobacterium
ELGATWSRWGQTLFPIGVLYDPFVER

SEQ ID NO: 1043923 - protein, 18 aa, Mycobacterium
ELGEVVWIVDLNRQSLDR

SEQ ID NO: 1043924 - protein, 20 aa, Mycobacterium
ELGKPAALLRAARASLGRKV

SEQ ID NO: 1043925 - protein, 17 aa, Mycobacterium
ELGLAVSVQDLFQYQTP

SEQ ID NO: 1043926 - protein, 20 aa, Mycobacterium
ELGVEAFELVVVNLYPFSQT

SEQ ID NO: 1043927 - protein, 25 aa, Mycobacterium
ELHSLDLAEVLAFAHGRPTAATVRH

SEQ ID NO: 1043928 - protein, 19 aa, Mycobacterium
ELHSRYEVRLEQYALTIAV

SEQ ID NO: 1043929 - protein, 24 aa, Mycobacterium
ELIADCTDIPPGVVNIVTSSEHGL

SEQ ID NO: 1043930 - protein, 20 aa, Mycobacterium
ELIGEISDDLLARFKSIPLL

SEQ ID NO: 1043931 - protein, 17 aa, Mycobacterium
ELIGQGLDRVMFTGGTE

SEQ ID NO: 1043932 - protein, 18 aa, Mycobacterium
ELINRGGEKISPERVEGV

SEQ ID NO: 1043933 - protein, 20 aa, Mycobacterium
ELINWAFDVVNWAIDWAVSW

SEQ ID NO: 1043934 - protein, 18 aa, Mycobacterium
ELIQDAWLSRASKKRAES

SEQ ID NO: 1043935 - protein, 26 aa, Mycobacterium
ELIREYPQLAAFEFAIRAEDGIAVDA

SEQ ID NO: 1043936 - protein, 18 aa, Mycobacterium
ELIRRVRTELPFQTIMTG

SEQ ID NO: 1043937 - protein, 21 aa, Mycobacterium
ELKRAESILQRRTDRLAFDRR

SEQ ID NO: 1043938 - protein, 26 aa, Mycobacterium
ELLAAERARLRFLLVDDAQQLDPQAA

SEQ ID NO: 1043939 - protein, 24 aa, Mycobacterium
ELLAHCYRMTGSVHDAEDLVQETL

SEQ ID NO: 1043940 - protein, 17 aa, Mycobacterium
ELLCMLLPSLGMTNDTV

SEQ ID NO: 1043941 - protein, 21 aa, Mycobacterium
ELLDVPFRSAVAFIDTTLAGI

SEQ ID NO: 1043942 - protein, 21 aa, Mycobacterium
ELLEAATVVWCAGMRANSLAE

SEQ ID NO: 1043943 - protein, 26 aa, Mycobacterium
ELLEELKGLWFYYAGVYKGLPLDDRT

SEQ ID NO: 1043944 - protein, 26 aa, Mycobacterium
ELLESADLLLAHLVLRPFLDAYHIVA

SEQ ID NO: 1043945 - protein, 30 aa, Mycobacterium
ELLPERTPHVLGCIYSVFTEGYWATGGPSA

SEQ ID NO: 1043946 - protein, 18 aa, Mycobacterium
ELLRCVDDIHAPQQIWRH

SEQ ID NO: 1043947 - protein, 23 aa, Mycobacterium
ELLRSRVFFDWFDAVGVDDIPAV

SEQ ID NO: 1043948 - protein, 18 aa, Mycobacterium
ELLVLLASELAAAVYVEP

SEQ ID NO: 1043949 - protein, 22 aa, Mycobacterium
ELLVRGGVVFSGYWRNEQATDE

SEQ ID NO: 1043950 - protein, 26 aa, Mycobacterium
ELLVSWLPQYHDFGLIFMALQALYLG

SEQ ID NO: 1043951 - protein, 18 aa, Mycobacterium
ELMPFRLAVLHAAWMIDT

SEQ ID NO: 1043952 - protein, 19 aa, Mycobacterium
ELNLLALLASHGMLLALDL

SEQ ID NO: 1043953 - protein, 23 aa, Mycobacterium
ELNLPRRDLRMLAAQLGSDVPFA

SEQ ID NO: 1043954 - protein, 17 aa, Mycobacterium
ELPEELVTLALTHRSYA

SEQ ID NO: 1043955 - protein, 19 aa, Mycobacterium
ELPEVARVVVIDGKGDGGW

SEQ ID NO: 1043956 - protein, 21 aa, Mycobacterium
ELPFMCLMTDRIIDLGAGAAN

SEQ ID NO: 1043957 - protein, 20 aa, Mycobacterium
ELPPGGRLGLYGFGGSAHIT

SEQ ID NO: 1043958 - protein, 18 aa, Mycobacterium
ELPPRAGQPSAWPQWAEP

SEQ ID NO: 1043959 - protein, 24 aa, Mycobacterium
ELPRDFPGPALGSFRGGRVRIALT

SEQ ID NO: 1043960 - protein, 19 aa, Mycobacterium
ELPRLQPKSALCRRPTSRP

SEQ ID NO: 1043961 - protein, 18 aa, Mycobacterium
ELPSRLAYADERRLAEVA

SEQ ID NO: 1043962 - protein, 17 aa, Mycobacterium
ELPTPWPREVLDDLLAV

SEQ ID NO: 1043963 - protein, 20 aa, Mycobacterium
ELPVVDGLLRYRLPDGSALD

SEQ ID NO: 1043964 - protein, 20 aa, Mycobacterium
ELQFGSNHLGHFALTAHVLP

SEQ ID NO: 1043965 - protein, 23 aa, Mycobacterium
ELQTRPPVVTVMGHVDHGKTRLL

SEQ ID NO: 1043966 - protein, 19 aa, Mycobacterium
ELQVGPGVFVPRPETEAVL

SEQ ID NO: 1043967 - protein, 20 aa, Mycobacterium
ELRAEVGLPVYFGNRNWEPY

SEQ ID NO: 1043968 - protein, 26 aa, Mycobacterium
ELRAFCARLLGIAAQRVRVIMRDTGG

SEQ ID NO: 1043969 - protein, 26 aa, Mycobacterium
ELRAPESVQINWVYRGGRADLVSADR

SEQ ID NO: 1043970 - protein, 17 aa, Mycobacterium
ELREAFVERGIQHGPAF

SEQ ID NO: 1043971 - protein, 27 aa, Mycobacterium
ELRELRSSGAVFGLLDIDDEFFVILRP

SEQ ID NO: 1043972 - protein, 18 aa, Mycobacterium
ELRGAAAEAAKRLDEALA

SEQ ID NO: 1043973 - protein, 25 aa, Mycobacterium
ELRGRGRGGVRLAVAMTVAAGHPGS

SEQ ID NO: 1043974 - protein, 20 aa, Mycobacterium
ELRIGCERVNEKAPKDRDIA

SEQ ID NO: 1043975 - protein, 26 aa, Mycobacterium
ELRQAWLDLHESWLIVKAAQIGIADD

SEQ ID NO: 1043976 - protein, 19 aa, Mycobacterium
ELRSFYRIRQSWAGKAVLL

SEQ ID NO: 1043977 - protein, 19 aa, Mycobacterium
ELSAAYGIEPDSSRIDYYR

SEQ ID NO: 1043978 - protein, 18 aa, Mycobacterium
ELSAELQSAAAGFASLTS

SEQ ID NO: 1043979 - protein, 21 aa, Mycobacterium
ELSASPGFRRAGLPAVPGALA

SEQ ID NO: 1043980 - protein, 24 aa, Mycobacterium
ELSRAVFSKGIFPAVDPLASSSTI

SEQ ID NO: 1043981 - protein, 19 aa, Mycobacterium
ELSSRLQLDAVLFAGEALQ

SEQ ID NO: 1043982 - protein, 26 aa, Mycobacterium
ELTAARAARLKWWTTELQVRTADRCL

SEQ ID NO: 1043983 - protein, 24 aa, Mycobacterium
ELTERPDLFPAWDSLSEAQQKLFA

SEQ ID NO: 1043984 - protein, 17 aa, Mycobacterium
ELTGFALQRIYLERVAK

SEQ ID NO: 1043985 - protein, 19 aa, Mycobacterium
ELTLRNSVVYDRFAETAVL

SEQ ID NO: 1043986 - protein, 18 aa, Mycobacterium
ELTPAYRGGPTLRNHDTI

SEQ ID NO: 1043987 - protein, 17 aa, Mycobacterium
ELTSEGIVIPLPDNIGV

SEQ ID NO: 1043988 - protein, 17 aa, Mycobacterium
ELTSGLRLRGVDLAVGT

SEQ ID NO: 1043989 - protein, 25 aa, Mycobacterium
ELVIKAEAIGVNFIDTYFRSGSYPR

SEQ ID NO: 1043990 - protein, 20 aa, Mycobacterium
ELVRQLAVVHGRVTLSSGKE

SEQ ID NO: 1043991 - protein, 22 aa, Mycobacterium
ELVSKLLAGPRPEMAHSVRNLL

SEQ ID NO: 1043992 - protein, 23 aa, Mycobacterium
ELVSRAKAVGALTVLDACQSVPH

SEQ ID NO: 1043993 - protein, 18 aa, Mycobacterium
ELVTLALTHRSYAYENGG

SEQ ID NO: 1043994 - protein, 17 aa, Mycobacterium
ELVWAPAAFRYVMMVLR

SEQ ID NO: 1043995 - protein, 18 aa, Mycobacterium
ELVYAVLNLYPYNPGHLM

SEQ ID NO: 1043996 - protein, 18 aa, Mycobacterium
ELWFGAHPGDPAWLETDG

SEQ ID NO: 1043997 - protein, 24 aa, Mycobacterium
ELWQLAFEVVNGYRGELCTQKTPA

SEQ ID NO: 1043998 - protein, 19 aa, Mycobacterium
ELYESPAPTSGRPRKTPAQ

SEQ ID NO: 1043999 - protein, 28 aa, Mycobacterium
ELYVCGRIKDLLILAGRNIYPQDIEDSL

SEQ ID NO: 1044000 - protein, 20 aa, Mycobacterium
ELYWMLTLVPYRERGHILLA

SEQ ID NO: 1044001 - protein, 18 aa, Mycobacterium
EMAAMLLGLCDVESKVAA

SEQ ID NO: 1044002 - protein, 19 aa, Mycobacterium
EMAFKIAGSQVLKKAAAAA

SEQ ID NO: 1044003 - protein, 31 aa, Mycobacterium
EMDGHFPKPWALGIHNVWLRIVPTTITERRL

SEQ ID NO: 1044004 - protein, 20 aa, Mycobacterium
EMGFPGALSTTVTYTLDQNN

SEQ ID NO: 1044005 - protein, 20 aa, Mycobacterium
EMHLHLACYQAFDDIGSVIH

SEQ ID NO: 1044006 - protein, 18 aa, Mycobacterium
EMIDTCRRLLDTYHDVLR

SEQ ID NO: 1044007 - protein, 20 aa, Mycobacterium
EMIDVIKLVLGGGMVEFHGQ

SEQ ID NO: 1044008 - protein, 24 aa, Mycobacterium
EMIRYCASAQWFARTARKPFTIGD

SEQ ID NO: 1044009 - protein, 19 aa, Mycobacterium
EMLARADSVGVFQVESRAQ

SEQ ID NO: 1044010 - protein, 24 aa, Mycobacterium
EMLEVLRASLPRTLALLGTAEEIP

SEQ ID NO: 1044011 - protein, 21 aa, Mycobacterium
EMLRPLRFLLTAPVTALGSSD

SEQ ID NO: 1044012 - protein, 23 aa, Mycobacterium
EMLTMGFAEDVERILSETPEYKQ

SEQ ID NO: 1044013 - protein, 29 aa, Mycobacterium
EMNNGIFYRGVGQGNFYFSITTPDLTLPP

SEQ ID NO: 1044014 - protein, 18 aa, Mycobacterium
EMNWRILKFKPRTESAPT

SEQ ID NO: 1044015 - protein, 22 aa, Mycobacterium
EMQARLPKAVFKSVLATIDKGA

SEQ ID NO: 1044016 - protein, 19 aa, Mycobacterium
EMQDCNFLNSVVPREELEA

SEQ ID NO: 1044017 - protein, 19 aa, Mycobacterium
EMQNGFLLLMRVGDGSHLA

SEQ ID NO: 1044018 - protein, 21 aa, Mycobacterium
EMQRTEGFTALIDANRGCFAA

SEQ ID NO: 1044019 - protein, 19 aa, Mycobacterium
EMRLPWDAAKQRRFDRLIA

SEQ ID NO: 1044020 - protein, 19 aa, Mycobacterium
EMRQAALAARFRLGPQALD

SEQ ID NO: 1044021 - protein, 17 aa, Mycobacterium
EMTKLGVVMGGDTETFP

SEQ ID NO: 1044022 - protein, 18 aa, Mycobacterium
EMTRELAERGVLTGERGS

SEQ ID NO: 1044023 - protein, 18 aa, Mycobacterium
EMVAAAAADLTNIGSSMT

SEQ ID NO: 1044024 - protein, 17 aa, Mycobacterium
EMVTRYELGAADTYAQV

SEQ ID NO: 1044025 - protein, 20 aa, Mycobacterium
EMWAQDAMAMYGYAGSSAAA

SEQ ID NO: 1044026 - protein, 19 aa, Mycobacterium
EMYRLVETFGYGWSDIQRF

SEQ ID NO: 1044027 - protein, 26 aa, Mycobacterium
ENAVWRNFFLCGAAELRDGKFGTAVQ

SEQ ID NO: 1044028 - protein, 17 aa, Mycobacterium
ENFRPGTLEKWDLGYDV

SEQ ID NO: 1044029 - protein, 23 aa, Mycobacterium
ENFSPRVMDHFGLSADVLLQANP

SEQ ID NO: 1044030 - protein, 27 aa, Mycobacterium
ENGLPLTLWLARFLKFIQTEIFPGGHP

SEQ ID NO: 1044031 - protein, 30 aa, Mycobacterium
ENGNWAWRYDGIRAFPDFAVLWDVDALAAP

SEQ ID NO: 1044032 - protein, 17 aa, Mycobacterium
ENIKDELISGGNIAKFV

SEQ ID NO: 1044033 - protein, 26 aa, Mycobacterium
ENKYRLVFEKLRLRPGDRLLDVGCGW

SEQ ID NO: 1044034 - protein, 17 aa, Mycobacterium
ENLAGLSGRVLEIGAGM

SEQ ID NO: 1044035 - protein, 17 aa, Mycobacterium
ENLCPKSLYTGWDADGG

SEQ ID NO: 1044036 - protein, 23 aa, Mycobacterium
ENLPDAISLVLSHRAPHRVVVFD

SEQ ID NO: 1044037 - protein, 26 aa, Mycobacterium
ENLPGLRWPGLSLQGGRLAWSAVRDG

SEQ ID NO: 1044038 - protein, 24 aa, Mycobacterium
ENLSFADLLPWIDAHDDARPELIN

SEQ ID NO: 1044039 - protein, 19 aa, Mycobacterium
ENMARLLMVARERYYLFRH

SEQ ID NO: 1044040 - protein, 19 aa, Mycobacterium
ENMRARMNAALGITEQGFN

SEQ ID NO: 1044041 - protein, 23 aa, Mycobacterium
ENPAGSVLIEFGRTKVMCTASVT

SEQ ID NO: 1044042 - protein, 22 aa, Mycobacterium
ENQLEWLARALAQRPVSEPLFD

SEQ ID NO: 1044043 - protein, 25 aa, Mycobacterium
ENRGGPPRLRFVAVGRHQNGELTSE

SEQ ID NO: 1044044 - protein, 24 aa, Mycobacterium
ENRSGVVCPIHLGLMRGALESWGA

SEQ ID NO: 1044045 - protein, 24 aa, Mycobacterium
ENSACLSCGSALGFSLDQMALMVI

SEQ ID NO: 1044046 - protein, 18 aa, Mycobacterium
ENSLHWIRDVTFDEDRQR

SEQ ID NO: 1044047 - protein, 17 aa, Mycobacterium
ENYMRWISDADHSAPRP

SEQ ID NO: 1044048 - protein, 17 aa, Mycobacterium
EPAAGRPAALEVTTIAE

SEQ ID NO: 1044049 - protein, 19 aa, Mycobacterium
EPAFRHTPPGYGPVPVLKN

SEQ ID NO: 1044050 - protein, 18 aa, Mycobacterium
EPAIKIARQHGVWAHVDA

SEQ ID NO: 1044051 - protein, 17 aa, Mycobacterium
EPALCRTQYYINRAFAA

SEQ ID NO: 1044052 - protein, 18 aa, Mycobacterium
EPALPAMLSRLVIMGGMF

SEQ ID NO: 1044053 - protein, 26 aa, Mycobacterium
EPAPQLVSRYCMDRRDSVNSFHSSSS

SEQ ID NO: 1044054 - protein, 17 aa, Mycobacterium
EPARLPFWRGDDVGRPA

SEQ ID NO: 1044055 - protein, 21 aa, Mycobacterium
EPATLMAHVKLALKETILTTE

SEQ ID NO: 1044056 - protein, 22 aa, Mycobacterium
EPAVRWWPIAVSVARDTGILSV

SEQ ID NO: 1044057 - protein, 20 aa, Mycobacterium
EPCSALDPISTMAIEDLISE

SEQ ID NO: 1044058 - protein, 25 aa, Mycobacterium
EPDERGMRTVMCIMNGQLRPVLVRD

SEQ ID NO: 1044059 - protein, 24 aa, Mycobacterium
EPDLACSGLRFAYDGLIPLPDGAR

SEQ ID NO: 1044060 - protein, 19 aa, Mycobacterium
EPDVPLRSFAMLTDHEIEE

SEQ ID NO: 1044061 - protein, 30 aa, Mycobacterium; identical to SEQ ID NO: 654588

SEQ ID NO: 1044062 - protein, 23 aa, Mycobacterium
EPERVGVLFLRMVLFVEKVLCGL

SEQ ID NO: 1044063 - protein, 27 aa, Mycobacterium
EPFEPRLSLQWWVRVESLAKAAGDAVR

SEQ ID NO: 1044064 - protein, 19 aa, Mycobacterium
EPFTGVARHHVEWTNYLTP

SEQ ID NO: 1044065 - protein, 25 aa, Mycobacterium
EPGEICVSGPLLAGGYWNKPDDTAQ

SEQ ID NO: 1044066 - protein, 25 aa, Mycobacterium
EPGELSVHYPFPIDDLVAVDDALKY

SEQ ID NO: 1044067 - protein, 25 aa, Mycobacterium
EPGFGVPWIYNYLGAPWKTQRTVNR

SEQ ID NO: 1044068 - protein, 20 aa, Mycobacterium
EPGHFLYDGFVHARDLGEKD

SEQ ID NO: 1044069 - protein, 20 aa, Mycobacterium
EPGHGLRIGYFAQEHDTLDN

SEQ ID NO: 1044070 - protein, 24 aa, Mycobacterium
EPGHICPISMTYAVVPALRYNPEL

SEQ ID NO: 1044071 - protein, 20 aa, Mycobacterium
EPGKFVKAADWVGREEAEAE

SEQ ID NO: 1044072 - protein, 19 aa, Mycobacterium
EPGLRKLLRDNLAAGRLHF

SEQ ID NO: 1044073 - protein, 21 aa, Mycobacterium
EPGMASPLLFALSSTSADGLR

SEQ ID NO: 1044074 - protein, 25 aa, Mycobacterium
EPGRIFAFDVHSIFIPVSRWQYDIV

SEQ ID NO: 1044075 - protein, 19 aa, Mycobacterium
EPHPVLPTTPWQHGQHWIS

SEQ ID NO: 1044076 - protein, 24 aa, Mycobacterium
EPHYGPPPLLLRMVEAGQLGKKSG

SEQ ID NO: 1044077 - protein, 20 aa, Mycobacterium
EPIPEEAFERIVNSLELEDY

SEQ ID NO: 1044078 - protein, 20 aa, Mycobacterium
EPIPQNWTAIPAMMLSAKDC

SEQ ID NO: 1044079 - protein, 17 aa, Mycobacterium
EPISALLAVAALDDLDE

SEQ ID NO: 1044080 - protein, 17 aa, Mycobacterium
EPITTWAPKSAGALAYR

SEQ ID NO: 1044081 - protein, 18 aa, Mycobacterium
EPKHMAWAQIPTASNGSS

SEQ ID NO: 1044082 - protein, 22 aa, Mycobacterium
EPKHYYRALALAVRDRMQQRWI

SEQ ID NO: 1044083 - protein, 19 aa, Mycobacterium
EPKIPLGRMGRPEELTGLY

SEQ ID NO: 1044084 - protein, 23 aa, Mycobacterium
EPKWDGFRSICFRDNDEVELGSR

SEQ ID NO: 1044085 - protein, 25 aa, Mycobacterium
EPLAFASLDRWSGTVGEYLNTMFDP

SEQ ID NO: 1044086 - protein, 25 aa, Mycobacterium
EPLAKMAGYHLGWWDVNGVPVDGSS

SEQ ID NO: 1044087 - protein, 24 aa, Mycobacterium
EPLIHIVGTGGLLPIKIPIIDIAA

SEQ ID NO: 1044088 - protein, 23 aa, Mycobacterium
EPLLRRRRGAWVGWAGVVENDVD

SEQ ID NO: 1044089 - protein, 19 aa, Mycobacterium
EPLSLRPYYIKTLRIWGDN

SEQ ID NO: 1044090 - protein, 19 aa, Mycobacterium
EPLSSRTAFFSSVTGSRLD

SEQ ID NO: 1044091 - protein, 22 aa, Mycobacterium
EPMIPIYIFYSMFGFQRTGDSF

SEQ ID NO: 1044092 - protein, 19 aa, Mycobacterium
EPMRPWKTEQLGGGYQISS

SEQ ID NO: 1044093 - protein, 22 aa, Mycobacterium
EPPLPFADKAFDLVISRHPITV

SEQ ID NO: 1044094 - protein, 21 aa, Mycobacterium
EPQRMCLARTLLAQPQVLLLD

SEQ ID NO: 1044095 - protein, 20 aa, Mycobacterium
EPRERLALMMALLARPRLWK

SEQ ID NO: 1044096 - protein, 23 aa, Mycobacterium
EPRKAAIAEGGWVLPYLPKPWGR

SEQ ID NO: 1044097 - protein, 20 aa, Mycobacterium
EPRKVFDLLEHSPIEVAVLT

SEQ ID NO: 1044098 - protein, 22 aa, Mycobacterium
EPRKWARNLIREMSADRLRERL

SEQ ID NO: 1044099 - protein, 41 aa, Mycobacterium
EPRLRECHSLRYVFCGGEPLPIALCRRVAEALPHAEMVNYY

SEQ ID NO: 1044100 - protein, 20 aa, Mycobacterium
EPRQRVMLPPWAAGSPGHNA

SEQ ID NO: 1044101 - protein, 31 aa, Mycobacterium; identical to SEQ ID NO: 305237

SEQ ID NO: 1044102 - protein, 20 aa, Mycobacterium
EPTFRRSVIYIVEHNDGGTL

SEQ ID NO: 1044103 - protein, 17 aa, Mycobacterium
EPTRRVRMMRWGFVPSW

SEQ ID NO: 1044104 - protein, 18 aa, Mycobacterium
EPTVCNLLGRLGMPANVQ

SEQ ID NO: 1044105 - protein, 20 aa, Mycobacterium
EPVAVVGIGCRLPGNVSGPD

SEQ ID NO: 1044106 - protein, 21 aa, Mycobacterium
EPVAVVGMGCRYPGGIATPEG

SEQ ID NO: 1044107 - protein, 18 aa, Mycobacterium
EPVEWKRDQALKFGATHV

SEQ ID NO: 1044108 - protein, 27 aa, Mycobacterium
EPVGVVGAIVPWNFPFEVTINKLGQAL

SEQ ID NO: 1044109 - protein, 24 aa, Mycobacterium
EPVLKLLKITGDWQKFKGLPGAEG

SEQ ID NO: 1044110 - protein, 28 aa, Mycobacterium
EPWEELAVKLMLKWPNLYYSTSAFAPKY

SEQ ID NO: 1044111 - protein, 23 aa, Mycobacterium
EQAAAIRQDIDWISHAENPAGPR

SEQ ID NO: 1044112 - protein, 23 aa, Mycobacterium
EQALERLDRALAHTAILGVQTNV

SEQ ID NO: 1044113 - protein, 24 aa, Mycobacterium
EQAQRLSARLARIGEVQCDHDRVC

SEQ ID NO: 1044114 - protein, 26 aa, Mycobacterium
EQASAFHLQFVQAMTAGAGAYAGAEA

SEQ ID NO: 1044115 - protein, 25 aa, Mycobacterium
EQFIKRLGTYAAIFTVPNFLELDYW

SEQ ID NO: 1044116 - protein, 18 aa, Mycobacterium
EQFYRSAIYGDPVEVTGS

SEQ ID NO: 1044117 - protein, 25 aa, Mycobacterium
EQGDPRFSDVSSRIFGTPHDVDVGA

SEQ ID NO: 1044118 - protein, 21 aa, Mycobacterium
EQHPIPEWIVVGAGTGGTSAT

SEQ ID NO: 1044119 - protein, 19 aa, Mycobacterium
EQLGILARFAGAALVAKED

SEQ ID NO: 1044120 - protein, 32 aa, Mycobacterium; identical to SEQ ID NO: 655049

SEQ ID NO: 1044121 - protein, 26 aa, Mycobacterium
EQLLKQLLNRVQWIYAGIASDTGTVI

SEQ ID NO: 1044122 - protein, 19 aa, Mycobacterium
EQLVGAVLDYLGTHLTELL

SEQ ID NO: 1044123 - protein, 22 aa, Mycobacterium
EQLWAQDVAVMAGYHAGVSAIA

SEQ ID NO: 1044124 - protein, 17 aa, Mycobacterium
EQMCGRWKVKHPDLVEL

SEQ ID NO: 1044125 - protein, 27 aa, Mycobacterium
EQMWAQDVAAMFGYRSGAESIAAALTP

SEQ ID NO: 1044126 - protein, 28 aa, Mycobacterium
EQPETDFPRWFGRNWRRQAMLRYGENPH

SEQ ID NO: 1044127 - protein, 17 aa, Mycobacterium
EQPTVAAPRSWEELDDP

SEQ ID NO: 1044128 - protein, 20 aa, Mycobacterium
EQPWQPDIVHAHDWLVAHPA

SEQ ID NO: 1044129 - protein, 21 aa, Mycobacterium
EQQRLRRIVDAVARQEPGLSW

SEQ ID NO: 1044130 - protein, 20 aa, Mycobacterium
EQQRRICLIPQSAHGTNAAS

SEQ ID NO: 1044131 - protein, 25 aa, Mycobacterium
EQQSWIIMRRGRFGIACNLGTEATT

SEQ ID NO: 1044132 - protein, 22 aa, Mycobacterium
EQRFARHYVHAGMIGWDGHKMS

SEQ ID NO: 1044133 - protein, 17 aa, Mycobacterium
EQRIPLIAKAIEASSVH

SEQ ID NO: 1044134 - protein, 18 aa, Mycobacterium
EQVRKFLARHHLAVEDIG

SEQ ID NO: 1044135 - protein, 18 aa, Mycobacterium
EQVSCAFGGHGESLPERT

SEQ ID NO: 1044136 - protein, 20 aa, Mycobacterium
ERAAPWWVILYRTGQTLAPQ

SEQ ID NO: 1044137 - protein, 17 aa, Mycobacterium
ERACAGAGCPIKVRLLV

SEQ ID NO: 1044138 - protein, 22 aa, Mycobacterium
ERAEAQLGYLLDRAHTAAIVWS

SEQ ID NO: 1044139 - protein, 25 aa, Mycobacterium
ERAEPWGVWGGEIFERGSIVNRKRP

SEQ ID NO: 1044140 - protein, 18 aa, Mycobacterium
ERAPAPALHRLTVGALRA

SEQ ID NO: 1044141 - protein, 17 aa, Mycobacterium
ERAQMRALGLLKGACAQ

SEQ ID NO: 1044142 - protein, 18 aa, Mycobacterium
ERARGAVVSGALNPAQQV

SEQ ID NO: 1044143 - protein, 24 aa, Mycobacterium
ERARYWPKLVDMYPSWTCIPPMRT

SEQ ID NO: 1044144 - protein, 24 aa, Mycobacterium
ERAVFVLREVFGFDYEEIADAVGK

SEQ ID NO: 1044145 - protein, 17 aa, Mycobacterium
ERDGQWVLASGVQAMVE

SEQ ID NO: 1044146 - protein, 21 aa, Mycobacterium
ERDGRTWLRAGAGIIEASQPE

SEQ ID NO: 1044147 - protein, 24 aa, Mycobacterium
ERDRPLWLMWVVEGLAEGKVALVM

SEQ ID NO: 1044148 - protein, 19 aa, Mycobacterium
EREAWPGGRAGRLDIDGYR

SEQ ID NO: 1044149 - protein, 31 aa, Mycobacterium; identical to SEQ ID NO: 621057

SEQ ID NO: 1044150 - protein, 18 aa, Mycobacterium
ERERHRYLTAQEVRMLAT

SEQ ID NO: 1044151 - protein, 20 aa, Mycobacterium
ERESGELYLFSGRLENSVFI

SEQ ID NO: 1044152 - protein, 18 aa, Mycobacterium
ERFAELPFSEVRKATLDT

SEQ ID NO: 1044153 - protein, 23 aa, Mycobacterium
ERFARRIAAHIVRRRAHTPFTST

SEQ ID NO: 1044154 - protein, 23 aa, Mycobacterium
ERFNAALAPLGWAPTCMQPSYGL

SEQ ID NO: 1044155 - protein, 17 aa, Mycobacterium
ERFPDVRAAGPGNRRDT

SEQ ID NO: 1044156 - protein, 20 aa, Mycobacterium
ERFSTLKARLGDAFEVIEID

SEQ ID NO: 1044157 - protein, 23 aa, Mycobacterium
ERFTGVAAQLGWEVEKRINKDVR

SEQ ID NO: 1044158 - protein, 23 aa, Mycobacterium
ERGEWTAAGLTDCYLRRIREIDQ

SEQ ID NO: 1044159 - protein, 23 aa, Mycobacterium
ERGKQSAVALCVWHDAVRLGDTR

SEQ ID NO: 1044160 - protein, 26 aa, Mycobacterium
ERGRSARAWLFTVARNMIIDDRRSAR

SEQ ID NO: 1044161 - protein, 28 aa, Mycobacterium
ERGRVKQLLLKIGWPAEDLAGYVNGEAH

SEQ ID NO: 1044162 - protein, 18 aa, Mycobacterium
ERGTRVAVLAVDPSSPFS

SEQ ID NO: 1044163 - protein, 18 aa, Mycobacterium
ERGVRIGAQVGYRDLAGF

SEQ ID NO: 1044164 - protein, 19 aa, Mycobacterium
ERGYFLDRSFRMHPAVCHA

SEQ ID NO: 1044165 - protein, 17 aa, Mycobacterium
ERHAKAGVMTPVSACAS

SEQ ID NO: 1044166 - protein, 19 aa, Mycobacterium
ERHEDGFFYIKGRSSEMII

SEQ ID NO: 1044167 - protein, 22 aa, Mycobacterium
ERHEFDEVLSIIASRLQSTSQG

SEQ ID NO: 1044168 - protein, 18 aa, Mycobacterium
ERHGRPPYWQPPVLPELE

SEQ ID NO: 1044169 - protein, 19 aa, Mycobacterium
ERHKNRPVLFLGDTTLTGG

SEQ ID NO: 1044170 - protein, 24 aa, Mycobacterium
ERIGFAARHIWDGSAGRVLAHATS

SEQ ID NO: 1044171 - protein, 23 aa, Mycobacterium
ERILRGRTGALIVLGHDENVEAI

SEQ ID NO: 1044172 - protein, 21 aa, Mycobacterium
ERIPVPPNWGGYLIAAEVVEF

SEQ ID NO: 1044173 - protein, 26 aa, Mycobacterium
ERIRACPRFAQRLRRYPFDLGAPQWV

SEQ ID NO: 1044174 - protein, 20 aa, Mycobacterium
ERKDRMFGTWHYWWQAHLLD

SEQ ID NO: 1044175 - protein, 32 aa, Mycobacterium; identical to SEQ ID NO: 655467

SEQ ID NO: 1044176 - protein, 24 aa, Mycobacterium
ERLARSTGGISVRAPGPAGGDDMP

SEQ ID NO: 1044177 - protein, 24 aa, Mycobacterium
ERLATEGARFGLRRDAIVPAYGMA

SEQ ID NO: 1044178 - protein, 19 aa, Mycobacterium
ERLHRCLVDSPEFARLLRE

SEQ ID NO: 1044179 - protein, 24 aa, Mycobacterium
ERLHTRIAAVMGYADRSAVDASMP

SEQ ID NO: 1044180 - protein, 18 aa, Mycobacterium
ERLLGERGFSLGHFPQSF

SEQ ID NO: 1044181 - protein, 17 aa, Mycobacterium
ERLLRSRLAQLRPGDPI

SEQ ID NO: 1044182 - protein, 17 aa, Mycobacterium
ERLQQVQSWLFNQPNTS

SEQ ID NO: 1044183 - protein, 17 aa, Mycobacterium
ERLRSGTSLAEVADYLG

SEQ ID NO: 1044184 - protein, 25 aa, Mycobacterium
ERLVTQAHLEWFSRKQVDWIHRLRS

SEQ ID NO: 1044185 - protein, 24 aa, Mycobacterium
ERLWRVGVTAAVLWVLDGNARARR

SEQ ID NO: 1044186 - protein, 20 aa, Mycobacterium
ERMGVVLQMRDFVSAGTLTG

SEQ ID NO: 1044187 - protein, 28 aa, Mycobacterium
ERMQEVSARWRAHGFDVDMVGLVYFGDR

SEQ ID NO: 1044188 - protein, 23 aa, Mycobacterium
ERMSARRFWVRYAAESAGSLTLD

SEQ ID NO: 1044189 - protein, 25 aa, Mycobacterium
ERNLSVALNEVFAAFNPLDPQNLDV

SEQ ID NO: 1044190 - protein, 27 aa, Mycobacterium
ERNWGTGFSEHWWWGQAHDFDNADASV

SEQ ID NO: 1044191 - protein, 26 aa, Mycobacterium
ERPACIKAMIEKVVDRMYAEIDDNRF

SEQ ID NO: 1044192 - protein, 41 aa, Mycobacterium; identical to SEQ ID NO: 655593

SEQ ID NO: 1044193 - protein, 24 aa, Mycobacterium
ERPERRRSGGAFSTYRISVGKRHK

SEQ ID NO: 1044194 - protein, 25 aa, Mycobacterium
ERPFPLDLVPRVISAAEWSRLERGI

SEQ ID NO: 1044195 - protein, 27 aa, Mycobacterium
ERPGTAADEIVRWATPVTSFQRTALED

SEQ ID NO: 1044196 - protein, 21 aa, Mycobacterium
ERPRGRTVWLTGLSGAGKSSV

SEQ ID NO: 1044197 - protein, 26 aa, Mycobacterium
ERPRSCSHVPEWARRWQRLLFDNGWL

SEQ ID NO: 1044198 - protein, 28 aa, Mycobacterium
ERQGRAGSRVSIRWEIPCETAPGQYRIV

SEQ ID NO: 1044199 - protein, 22 aa, Mycobacterium
ERQHPRPIAAGLYGDLSQILAA

SEQ ID NO: 1044200 - protein, 21 aa, Mycobacterium
ERQLKTLPLVERFYQADRSVA

SEQ ID NO: 1044201 - protein, 19 aa, Mycobacterium
ERRKEICGRAYRILTEEVG

SEQ ID NO: 1044202 - protein, 24 aa, Mycobacterium
ERRLFAEMMWEYRFGDRHTAMTVL

SEQ ID NO: 1044203 - protein, 24 aa, Mycobacterium
ERRTSWKVFARRLPAGRRYGVVAG

SEQ ID NO: 1044204 - protein, 24 aa, Mycobacterium
ERRVREGLIEIGRKLDIPPLATND

SEQ ID NO: 1044205 - protein, 18 aa, Mycobacterium
ERRVRLLVFDNCEHVRDA

SEQ ID NO: 1044206 - protein, 26 aa, Mycobacterium
ERRYRTWIRWNAAIMVHRAQRPGVGV

SEQ ID NO: 1044207 - protein, 20 aa, Mycobacterium
ERSDMRFGQVQTRLTENADS

SEQ ID NO: 1044208 - protein, 21 aa, Mycobacterium
ERSLVAFCRNLAAQIEEPVLA

SEQ ID NO: 1044209 - protein, 22 aa, Mycobacterium
ERSRMRCAAFVIRHADLVGLGG

SEQ ID NO: 1044210 - protein, 21 aa, Mycobacterium
ERTGNVCLATLGLNLFSRGVD

SEQ ID NO: 1044211 - protein, 22 aa, Mycobacterium
ERTKRIRLGTGVISLAYHNPLW

SEQ ID NO: 1044212 - protein, 19 aa, Mycobacterium
ERTLLAGDFVRGFVGLDSQ

SEQ ID NO: 1044213 - protein, 22 aa, Mycobacterium
ERTRAIARMGSFFSDRRMAGLR

SEQ ID NO: 1044214 - protein, 25 aa, Mycobacterium
ERVAASDPRFGWAKQVEYTVFGLEN

SEQ ID NO: 1044215 - protein, 17 aa, Mycobacterium
ERVALALLTYVEERTDG

SEQ ID NO: 1044216 - protein, 17 aa, Mycobacterium
ERVAPSILMGRREGLKR

SEQ ID NO: 1044217 - protein, 25 aa, Mycobacterium
ERVHGRLRLGPGWVSHILQDLAVRL

SEQ ID NO: 1044218 - protein, 26 aa, Mycobacterium
ERVLGRPAFQVLAGLCGAGPRSATEL

SEQ ID NO: 1044219 - protein, 26 aa, Mycobacterium
ERVLVHPRPRLSVMAVGGELVDISRT

SEQ ID NO: 1044220 - protein, 25 aa, Mycobacterium
ERVLWPAVSLISAWTGRSLPDSTAC

SEQ ID NO: 1044221 - protein, 17 aa, Mycobacterium
ERVVETFAPAHVVEFFA

SEQ ID NO: 1044222 - protein, 22 aa, Mycobacterium
ERWKETAFQSAWLLAAAGCDDS

SEQ ID NO: 1044223 - protein, 23 aa, Mycobacterium
ERWRSGAVQPVFAGPMRTMVTWE

SEQ ID NO: 1044224 - protein, 23 aa, Mycobacterium
ERYADARGRLCAALSARGVAAHG

SEQ ID NO: 1044225 - protein, 21 aa, Mycobacterium
ERYARCLGSAVNPVLRQGNSD

SEQ ID NO: 1044226 - protein, 18 aa, Mycobacterium
ERYFRDAPLMIVGEGTNE

SEQ ID NO: 1044227 - protein, 26 aa, Mycobacterium
ESAASFQAAHARFVAAAAKVNTLLDI

SEQ ID NO: 1044228 - protein, 18 aa, Mycobacterium
ESADVLAWRQRTLTGRRW

SEQ ID NO: 1044229 - protein, 26 aa, Mycobacterium
ESAENGRSWSRWSFIGAGAPTALTVR

SEQ ID NO: 1044230 - protein, 25 aa, Mycobacterium
ESAHPGRFLLGVGVGHPEHTQEYQK

SEQ ID NO: 1044231 - protein, 25 aa, Mycobacterium
ESALDPATRCWELGPDGQWTASPQE

SEQ ID NO: 1044232 - protein, 30 aa, Mycobacterium
ESALFAADLARMYIRYAERHGWTVTVLGET

SEQ ID NO: 1044233 - protein, 21 aa, Mycobacterium
ESARLLGQIDVVFSNAGIVVA

SEQ ID NO: 1044234 - protein, 26 aa, Mycobacterium
ESCGQAFAEFVDWSLLDVLRGAAGAP

SEQ ID NO: 1044235 - protein, 26 aa, Mycobacterium
ESDFATTRIFVRRLEQVLVAMTTDTD

SEQ ID NO: 1044236 - protein, 26 aa, Mycobacterium
ESDLALAGGCALLLEPNGSVSLSSQG

SEQ ID NO: 1044237 - protein, 24 aa, Mycobacterium
ESDQPASILILFAPGAPREDYFEG

SEQ ID NO: 1044238 - protein, 22 aa, Mycobacterium
ESDQRTAAVLARNIEALGLAGA

SEQ ID NO: 1044239 - protein, 21 aa, Mycobacterium
ESDWNARNLFTGWVDVGLTEK

SEQ ID NO: 1044240 - protein, 20 aa, Mycobacterium
ESEPMVIGKAFAVKVNANIG

SEQ ID NO: 1044241 - protein, 25 aa, Mycobacterium
ESFCKLLAAEDLLALAWPEEHGGGG

SEQ ID NO: 1044242 - protein, 20 aa, Mycobacterium
ESFGLPGLAAYCREAIHANA

SEQ ID NO: 1044243 - protein, 23 aa, Mycobacterium
ESFTEVHPLPGRDLMAVVDGAPA

SEQ ID NO: 1044244 - protein, 23 aa, Mycobacterium
ESGFKMSVRMIANHMGFHIDPMI

SEQ ID NO: 1044245 - protein, 25 aa, Mycobacterium
ESGMPRLYREAPLMGIWEGSGNVSA

SEQ ID NO: 1044246 - protein, 18 aa, Mycobacterium
ESGWTFDHFYPIFSDPTG

SEQ ID NO: 1044247 - protein, 24 aa, Mycobacterium
ESGYPRIVKRWRRGTPLSDAEMIF

SEQ ID NO: 1044248 - protein, 19 aa, Mycobacterium
ESIADRLAEAFAERMHQRV

SEQ ID NO: 1044249 - protein, 25 aa, Mycobacterium
ESKTVIGLNMLRLWDDRGTLEPWIA

SEQ ID NO: 1044250 - protein, 24 aa, Mycobacterium
ESLGLLTHRFRIWGSSDLRRWLPM

SEQ ID NO: 1044251 - protein, 20 aa, Mycobacterium
ESLHRLRGLGPRMVLPGHGP

SEQ ID NO: 1044252 - protein, 22 aa, Mycobacterium
ESLLRELVCADAARPIDITTDS

SEQ ID NO: 1044253 - protein, 29 aa, Mycobacterium
ESLPLASIFKLYVLHALAYAVRNGTVSWD

SEQ ID NO: 1044254 - protein, 17 aa, Mycobacterium
ESLPLSGWMTIETTPLR

SEQ ID NO: 1044255 - protein, 18 aa, Mycobacterium
ESLPPVLEVVARTRSGVI

SEQ ID NO: 1044256 - protein, 19 aa, Mycobacterium
ESLPRNALGKVLKKQLLSE

SEQ ID NO: 1044257 - protein, 19 aa, Mycobacterium
ESLSREFRGLLDRVPPADT

SEQ ID NO: 1044258 - protein, 21 aa, Mycobacterium
ESMAGFKTEFGKLIDSLPDTR

SEQ ID NO: 1044259 - protein, 23 aa, Mycobacterium
ESMVRASVVPWVLSAQSRQALVA

SEQ ID NO: 1044260 - protein, 26 aa, Mycobacterium
ESNNEYWRRFGVVPDWAGKRVLDVGC

SEQ ID NO: 1044261 - protein, 27 aa, Mycobacterium
ESPAILLRFCTAPSPSVRSRRRPLAEW

SEQ ID NO: 1044262 - protein, 18 aa, Mycobacterium
ESPIVFLRLRKAARKNGL

SEQ ID NO: 1044263 - protein, 18 aa, Mycobacterium
ESQARGTPVFGLFLTAGT

SEQ ID NO: 1044264 - protein, 27 aa, Mycobacterium
ESQCGWCKDRFGLSWQIVPDRLHELLS

SEQ ID NO: 1044265 - protein, 20 aa, Mycobacterium
ESRPTVPLEDVYPVPDATTR

SEQ ID NO: 1044266 - protein, 20 aa, Mycobacterium
ESRYGAAVGKALVHDHNARA

SEQ ID NO: 1044267 - protein, 18 aa, Mycobacterium
ESSLPPIFSALISTRPQA

SEQ ID NO: 1044268 - protein, 31 aa, Mycobacterium; identical to SEQ ID NO: 305516

SEQ ID NO: 1044269 - protein, 29 aa, Mycobacterium
ESSVPPGRLGWNWARFAFNGWKALGWMDA

SEQ ID NO: 1044270 - protein, 22 aa, Mycobacterium
ESSVRTAFHYVRTGVTVIPDEL

SEQ ID NO: 1044271 - protein, 25 aa, Mycobacterium
ESTATFEWAFRWLDAHRPAESAPVL

SEQ ID NO: 1044272 - protein, 17 aa, Mycobacterium
ESTMRFILSAKSAYVNG

SEQ ID NO: 1044273 - protein, 24 aa, Mycobacterium
ESTVGDAFARMFGGSIVPQEVEAL

SEQ ID NO: 1044274 - protein, 18 aa, Mycobacterium
ESTWPEFFDAIRSAGYTR

SEQ ID NO: 1044275 - protein, 22 aa, Mycobacterium
ESVAGIPSYRDVLPGALQTSGT

SEQ ID NO: 1044276 - protein, 19 aa, Mycobacterium
ESVEPGFSLAVEHRGDYRL

SEQ ID NO: 1044277 - protein, 19 aa, Mycobacterium
ESVGFLFNVSVEAVPAPQV

SEQ ID NO: 1044278 - protein, 17 aa, Mycobacterium
ESVKYAKERQSFGQPIG

SEQ ID NO: 1044279 - protein, 17 aa, Mycobacterium
ESVPIKGFLSFDEGVVQ

SEQ ID NO: 1044280 - protein, 17 aa, Mycobacterium
ESYLEILESALLDCYLS

SEQ ID NO: 1044281 - protein, 27 aa, Mycobacterium
ETAAPGFVHVRWDAVDMWLEEGRRLVH

SEQ ID NO: 1044282 - protein, 19 aa, Mycobacterium
ETAELLYGTALLAEGGALE

SEQ ID NO: 1044283 - protein, 19 aa, Mycobacterium
ETAELLYGTALLAEGGAPD

SEQ ID NO: 1044284 - protein, 25 aa, Mycobacterium
ETAEYSLRGANLWDEVKDRMDRPGG

SEQ ID NO: 1044285 - protein, 26 aa, Mycobacterium
ETAGRPRPPSAPAWFVDAAPGLRQFL

SEQ ID NO: 1044286 - protein, 18 aa, Mycobacterium
ETAILSRELGFAVRVIVN

SEQ ID NO: 1044287 - protein, 17 aa, Mycobacterium
ETAMLRRRLERGSAEAT

SEQ ID NO: 1044288 - protein, 25 aa, Mycobacterium
ETATRLGLDLTHVIMRDNSYDMVGF

SEQ ID NO: 1044289 - protein, 31 aa, Mycobacterium; identical to SEQ ID NO: 656259

SEQ ID NO: 1044290 - protein, 17 aa, Mycobacterium
ETAYCLGVEKLLGITDE

SEQ ID NO: 1044291 - protein, 24 aa, Mycobacterium
ETDQVFGWVAFEFGLYRYGLQARL

SEQ ID NO: 1044292 - protein, 27 aa, Mycobacterium
ETDRPFLMPVEDVFTITGRGTVVTGRV

SEQ ID NO: 1044293 - protein, 22 aa, Mycobacterium
ETEGVGAFIAWGRAATPPPATV

SEQ ID NO: 1044294 - protein, 24 aa, Mycobacterium
ETELGPLVPCWHGDIPVATQDSME

SEQ ID NO: 1044295 - protein, 18 aa, Mycobacterium
ETERMAIVHFTLRSKTRL

SEQ ID NO: 1044296 - protein, 28 aa, Mycobacterium
ETFDAVCCFGALYLMPEPFRIAREMVRV

SEQ ID NO: 1044297 - protein, 18 aa, Mycobacterium
ETFRDWLRHEIAKSSDAG

SEQ ID NO: 1044298 - protein, 25 aa, Mycobacterium
ETHLRPPPSASRSWPVAPVRFEAIM

SEQ ID NO: 1044299 - protein, 18 aa, Mycobacterium
ETHRARAVILAMGAAARY

SEQ ID NO: 1044300 - protein, 28 aa, Mycobacterium
ETIAAGPSMVRWARANGWSARPEAGARE

SEQ ID NO: 1044301 - protein, 20 aa, Mycobacterium
ETIKSALLTAYRHTQGHQTD

SEQ ID NO: 1044302 - protein, 26 aa, Mycobacterium
ETKVAWDFIHATGFLGGQITLQTTWS

SEQ ID NO: 1044303 - protein, 20 aa, Mycobacterium
ETLDEGRIARIWLNRPEAHN

SEQ ID NO: 1044304 - protein, 23 aa, Mycobacterium
ETLNLANLPGYRVGGTIHIIVNN

SEQ ID NO: 1044305 - protein, 17 aa, Mycobacterium
ETLPTMPPWHVQENKWR

SEQ ID NO: 1044306 - protein, 25 aa, Mycobacterium
ETLRLHPPLIILMRVAKGEFQVEGY

SEQ ID NO: 1044307 - protein, 25 aa, Mycobacterium
ETMVKAYAGFRSFREGTNLKAWLYR

SEQ ID NO: 1044308 - protein, 18 aa, Mycobacterium
ETPAAVVAFASWPQQAVL

SEQ ID NO: 1044309 - protein, 18 aa, Mycobacterium
ETPACFEPALDYVVVKAP

SEQ ID NO: 1044310 - protein, 19 aa, Mycobacterium
ETPACFEPALDYVVVKAPR

SEQ ID NO: 1044311 - protein, 20 aa, Mycobacterium
ETPACFEPTLDYVVVKAPRF

SEQ ID NO: 1044312 - protein, 23 aa, Mycobacterium
ETPEFTGYLIGALYRDPALGELS

SEQ ID NO: 1044313 - protein, 17 aa, Mycobacterium
ETPEYIAPGETSGQPVS

SEQ ID NO: 1044314 - protein, 21 aa, Mycobacterium
ETPTIATLVAWANEAGLGREV

SEQ ID NO: 1044315 - protein, 21 aa, Mycobacterium
ETRARKVLVATEVGMLHQLRR

SEQ ID NO: 1044316 - protein, 17 aa, Mycobacterium
ETRCVSMVADLFHAEGL

SEQ ID NO: 1044317 - protein, 18 aa, Mycobacterium
ETRKRRRGILGYDDLLLR

SEQ ID NO: 1044318 - protein, 25 aa, Mycobacterium
ETRYWSVALESIWHECLEPDSRHSS

SEQ ID NO: 1044319 - protein, 17 aa, Mycobacterium
ETSMMRYLRELADKDIA

SEQ ID NO: 1044320 - protein, 25 aa, Mycobacterium
ETTKGEAECARWVAEQLAEVGYQTE

SEQ ID NO: 1044321 - protein, 23 aa, Mycobacterium
ETTKRYMHHYNFPPFSTGETGRV

SEQ ID NO: 1044322 - protein, 20 aa, Mycobacterium
ETTPQHWDAILGINVGGVIS

SEQ ID NO: 1044323 - protein, 23 aa, Mycobacterium
ETTRPLVICDLGMPRDVDPAVAG

SEQ ID NO: 1044324 - protein, 21 aa, Mycobacterium
ETTTRLIGWAGKVLAEHPDQR

SEQ ID NO: 1044325 - protein, 24 aa, Mycobacterium
ETVIAVLTGDGWLGPASESMEAAV

SEQ ID NO: 1044326 - protein, 20 aa, Mycobacterium
ETVLRAKVDAAWNLHELTRD

SEQ ID NO: 1044327 - protein, 23 aa, Mycobacterium
ETVTEARCGIGYLHTGIEKNLEY

SEQ ID NO: 1044328 - protein, 19 aa, Mycobacterium
ETYAVLRFSGDRGAGAVAA

SEQ ID NO: 1044329 - protein, 17 aa, Mycobacterium
ETYGALFDRLKDGKISQ

SEQ ID NO: 1044330 - protein, 17 aa, Mycobacterium
ETYHILLAGTAADFCAK

SEQ ID NO: 1044331 - protein, 18 aa, Mycobacterium
ETYLCRTLPWPAYLTEAF

SEQ ID NO: 1044332 - protein, 17 aa, Mycobacterium
EVAAFVCHGHVTKDDYE

SEQ ID NO: 1044333 - protein, 19 aa, Mycobacterium
EVACPFHDWRWGGDGRCKL

SEQ ID NO: 1044334 - protein, 28 aa, Mycobacterium
EVAEVWRRGSVIGSWLLDLTAIALHESP

SEQ ID NO: 1044335 - protein, 20 aa, Mycobacterium
EVALEKLIFGTDSALNGALN

SEQ ID NO: 1044336 - protein, 31 aa, Mycobacterium; identical to SEQ ID NO: 656595

SEQ ID NO: 1044337 - protein, 17 aa, Mycobacterium
EVANAQAALRIEQVEQM

SEQ ID NO: 1044338 - protein, 24 aa, Mycobacterium
EVAPILCAGVTVYKGLKVTDTRPG

SEQ ID NO: 1044339 - protein, 23 aa, Mycobacterium
EVARMAARLVGAVLIGQDRAEVA

SEQ ID NO: 1044340 - protein, 23 aa, Mycobacterium
EVARRACAAGADLINDTWAGVDP

SEQ ID NO: 1044341 - protein, 27 aa, Mycobacterium
EVARYLFRRVVSWGRSSNVFLRNGARL

SEQ ID NO: 1044342 - protein, 21 aa, Mycobacterium
EVASVALFLACDLSSYMTGTV

SEQ ID NO: 1044343 - protein, 26 aa, Mycobacterium
EVAVCSTGLIGDRLPMDKVLAGVEHI

SEQ ID NO: 1044344 - protein, 19 aa, Mycobacterium
EVDAKPKPAIDAGRSTWYT

SEQ ID NO: 1044345 - protein, 21 aa, Mycobacterium
EVEAPAGGQCRIFDGELDENW

SEQ ID NO: 1044346 - protein, 19 aa, Mycobacterium
EVEFDPAYHELMRTAIGHG

SEQ ID NO: 1044347 - protein, 24 aa, Mycobacterium
EVEGGVIRVAEGWAHGPEVDKGAK

SEQ ID NO: 1044348 - protein, 19 aa, Mycobacterium
EVEKAYQLLAPESRSAAIA

SEQ ID NO: 1044349 - protein, 27 aa, Mycobacterium
EVEPLEVVFPGCEFLPLNDERRRIVDP

SEQ ID NO: 1044350 - protein, 20 aa, Mycobacterium
EVEPRMLLVHFLRDQLRLTG

SEQ ID NO: 1044351 - protein, 20 aa, Mycobacterium
EVERSWRPSGLPPIGDVTRP

SEQ ID NO: 1044352 - protein, 22 aa, Mycobacterium
EVEVPGVLTARIIQGATALEAQ

SEQ ID NO: 1044353 - protein, 28 aa, Mycobacterium
EVFEGLKAYRWADGSIVSFRAWANAARL

SEQ ID NO: 1044354 - protein, 17 aa, Mycobacterium
EVFPFVFTAARLTEHHT

SEQ ID NO: 1044355 - protein, 19 aa, Mycobacterium
EVGLGRRWVMSGWGRAEAA

SEQ ID NO: 1044356 - protein, 18 aa, Mycobacterium
EVGLRYYPAALFEVISQV

SEQ ID NO: 1044357 - protein, 26 aa, Mycobacterium
EVGRSGRLKGAGFYEYPEGKRAGLWP

SEQ ID NO: 1044358 - protein, 20 aa, Mycobacterium
EVHLCYPPGLLGAFPPVDSN

SEQ ID NO: 1044359 - protein, 19 aa, Mycobacterium
EVIAAQLLRRSCAAAGTSA

SEQ ID NO: 1044360 - protein, 20 aa, Mycobacterium
EVIARFDPVLGLEVHVELST

SEQ ID NO: 1044361 - protein, 24 aa, Mycobacterium
EVIEKMRVAGRIAAGALVEAGKAV

SEQ ID NO: 1044362 - protein, 25 aa, Mycobacterium
EVIELRPDIDWDKGKTLHWVIDRLH

SEQ ID NO: 1044363 - protein, 26 aa, Mycobacterium
EVIELRPDIDWDKGKTLHWVIDRLHH

SEQ ID NO: 1044364 - protein, 19 aa, Mycobacterium
EVIPGGISKDGRQLTLVIG

SEQ ID NO: 1044365 - protein, 19 aa, Mycobacterium
EVIRKEYGQDLAFTVEVEV

SEQ ID NO: 1044366 - protein, 24 aa, Mycobacterium
EVIRKEYGQDLAFTVEVEVRPKIA

SEQ ID NO: 1044367 - protein, 27 aa, Mycobacterium
EVKRVLRPGGYFAYADIRPCTEIAEWE

SEQ ID NO: 1044368 - protein, 18 aa, Mycobacterium
EVLACTEAGIPVIVVPGV

SEQ ID NO: 1044369 - protein, 19 aa, Mycobacterium
EVLARCNRPLPLHPGAVTY

SEQ ID NO: 1044370 - protein, 18 aa, Mycobacterium
EVLCSTAIRTRETLARSG

SEQ ID NO: 1044371 - protein, 19 aa, Mycobacterium
EVLDALQELTWLAVHQKTG

SEQ ID NO: 1044372 - protein, 23 aa, Mycobacterium
EVLPNYSGGLGILAGDHLKAASD

SEQ ID NO: 1044373 - protein, 23 aa, Mycobacterium
EVLQCPFHGWQWNQLGRNVCIPY

SEQ ID NO: 1044374 - protein, 20 aa, Mycobacterium
EVLQRIPSIDVVFIGHQRGE

SEQ ID NO: 1044375 - protein, 22 aa, Mycobacterium
EVLRILRRRSLAALRAQVEPIS

SEQ ID NO: 1044376 - protein, 25 aa, Mycobacterium
EVLRRELRRPSWRRKTVALGTNTDP

SEQ ID NO: 1044377 - protein, 24 aa, Mycobacterium
EVLVIAALARQNGLAAQHSYMLGS

SEQ ID NO: 1044378 - protein, 18 aa, Mycobacterium
EVLVLAAALTIPDPRERP

SEQ ID NO: 1044379 - protein, 20 aa, Mycobacterium
EVMGGSGISMPSRRYVQLAN

SEQ ID NO: 1044380 - protein, 19 aa, Mycobacterium
EVMPRLNARIANKPGGPHK

SEQ ID NO: 1044381 - protein, 21 aa, Mycobacterium
EVMRVLKPGGRFVFAGEPTTV

SEQ ID NO: 1044382 - protein, 19 aa, Mycobacterium
EVNAGVYAFEITALQSALS

SEQ ID NO: 1044383 - protein, 18 aa, Mycobacterium
EVNRGCVAAHSGAERLGS

SEQ ID NO: 1044384 - protein, 24 aa, Mycobacterium
EVPGAMGRLGVWSGDGPQLDLHQP

SEQ ID NO: 1044385 - protein, 20 aa, Mycobacterium
EVPLDCVMELVLWLREGQWG

SEQ ID NO: 1044386 - protein, 24 aa, Mycobacterium
EVPSRAYVSAFGFKGPDQQKPAGV

SEQ ID NO: 1044387 - protein, 34 aa, Mycobacterium; identical to SEQ ID NO: 96427

SEQ ID NO: 1044388 - protein, 18 aa, Mycobacterium
EVQRREGQDWARVADDGD

SEQ ID NO: 1044389 - protein, 25 aa, Mycobacterium
EVQTGIGRTGAFFAHQHDSITPDVV

SEQ ID NO: 1044390 - protein, 20 aa, Mycobacterium
EVQTRVMAMLTRREVEVLRL

SEQ ID NO: 1044391 - protein, 28 aa, Mycobacterium
EVQVGYGRLGKWFWGFEQQGVVPDIVAI

SEQ ID NO: 1044392 - protein, 19 aa, Mycobacterium
EVRAAALGCESLREDLWRL

SEQ ID NO: 1044393 - protein, 17 aa, Mycobacterium
EVRAHALAIGDDLVGRG

SEQ ID NO: 1044394 - protein, 19 aa, Mycobacterium
EVREGILAPSAWSEDDTPE

SEQ ID NO: 1044395 - protein, 20 aa, Mycobacterium
EVRELWSTFMQKWIAYTAKI

SEQ ID NO: 1044396 - protein, 20 aa, Mycobacterium
EVRGWLAANLVGEFATLKGL

SEQ ID NO: 1044397 - protein, 19 aa, Mycobacterium
EVRHECLEYALAHDERFGI

SEQ ID NO: 1044398 - protein, 19 aa, Mycobacterium
EVRHRIAFLPNYDMSMARF

SEQ ID NO: 1044399 - protein, 21 aa, Mycobacterium
EVRLRLPWDPSNVTIGDMVHG

SEQ ID NO: 1044400 - protein, 19 aa, Mycobacterium
EVRLSRYSYLVSLLPPQII

SEQ ID NO: 1044401 - protein, 23 aa, Mycobacterium
EVRSMDRPGLLALLTRALERAGA

SEQ ID NO: 1044402 - protein, 23 aa, Mycobacterium
EVRVPAKALWRAQTQRAVENFPI

SEQ ID NO: 1044403 - protein, 22 aa, Mycobacterium
EVSALQAALFTAYGTYYQQVSA

SEQ ID NO: 1044404 - protein, 22 aa, Mycobacterium
EVSALTAAQFAGHAQMYQAVSA

SEQ ID NO: 1044405 - protein, 23 aa, Mycobacterium
EVSAQLAAVFGDYARQFQALSAR

SEQ ID NO: 1044406 - protein, 18 aa, Mycobacterium
EVSARIGSDLVMSASARL

SEQ ID NO: 1044407 - protein, 23 aa, Mycobacterium
EVSGPLLRREFRLGNSAMVPLRT

SEQ ID NO: 1044408 - protein, 27 aa, Mycobacterium
EVSSFSRPATWWSKAGGPFVALTQRII

SEQ ID NO: 1044409 - protein, 19 aa, Mycobacterium
EVSSRVIPGSGLAVERIGE

SEQ ID NO: 1044410 - protein, 30 aa, Mycobacterium
EVSTAISQLFGAHCQEFQVVSAQLRGFHDQ

SEQ ID NO: 1044411 - protein, 21 aa, Mycobacterium
EVSTAVAALFGGHAQEYQALV

SEQ ID NO: 1044412 - protein, 22 aa, Mycobacterium
EVSTLVAVACRELLLTEDVRAR

SEQ ID NO: 1044413 - protein, 28 aa, Mycobacterium
EVSVAIAGLLRLHGQQYQQFGAHLSEFH

SEQ ID NO: 1044414 - protein, 24 aa, Mycobacterium
EVTADAGGLGGNIGVAATAIGGGN

SEQ ID NO: 1044415 - protein, 17 aa, Mycobacterium
EVTEPPQGVAVFDTAPT

SEQ ID NO: 1044416 - protein, 24 aa, Mycobacterium
EVTQRFEAELGRRSGLATEGLSAV

SEQ ID NO: 1044417 - protein, 17 aa, Mycobacterium
EVTRGGRRAVWSIWGID

SEQ ID NO: 1044418 - protein, 22 aa, Mycobacterium
EVVAMRDLERWSSEETCEALGI

SEQ ID NO: 1044419 - protein, 17 aa, Mycobacterium
EVVARFCGRELILDTKL

SEQ ID NO: 1044420 - protein, 26 aa, Mycobacterium
EVVLDPRLRAAASWPAGVAAGRRVRR

SEQ ID NO: 1044421 - protein, 24 aa, Mycobacterium
EVVNPDAGLVLREVGLEVMGSARR

SEQ ID NO: 1044422 - protein, 20 aa, Mycobacterium
EVYDYLRLLYARAGTPHCPT

SEQ ID NO: 1044423 - protein, 21 aa, Mycobacterium
EWEKACAWDPVTNSRRRYPWG

SEQ ID NO: 1044424 - protein, 24 aa, Mycobacterium
EWERKLEVVADIRPELVSFTFGAP

SEQ ID NO: 1044425 - protein, 20 aa, Mycobacterium
EWLRRKLARKEKVMGFGHRV

SEQ ID NO: 1044426 - protein, 27 aa, Mycobacterium
EWMLQTRLKALRIFERKPMPNWGSNLA

SEQ ID NO: 1044427 - protein, 27 aa, Mycobacterium
EWPEHPRFLMCTPLSHAGAAFFTPTLV

SEQ ID NO: 1044428 - protein, 23 aa, Mycobacterium
EWSERWPEFVASFTAATRAEDGN

SEQ ID NO: 1044429 - protein, 18 aa, Mycobacterium
EWVLPPEDIPFIYPDERI

SEQ ID NO: 1044430 - protein, 20 aa, Mycobacterium
EWYPGAHGFAVPDNPPYDEA

SEQ ID NO: 1044431 - protein, 20 aa, Mycobacterium
EYAAANGWLERSGIMGLISD

SEQ ID NO: 1044432 - protein, 24 aa, Mycobacterium
EYAEVQPLKGARISGSLHMTVQTA

SEQ ID NO: 1044433 - protein, 20 aa, Mycobacterium
EYALWWRIGYHPAVVEGLRR

SEQ ID NO: 1044434 - protein, 19 aa, Mycobacterium
EYASRLGLHSAPSSFVPPT

SEQ ID NO: 1044435 - protein, 17 aa, Mycobacterium
EYDVELFSQSTAGRLAA

SEQ ID NO: 1044436 - protein, 22 aa, Mycobacterium
EYELDCIIYASGFEITTQISHR

SEQ ID NO: 1044437 - protein, 27 aa, Mycobacterium
EYEVVLEEFLDGLQGGSGRTLDAAAKA

SEQ ID NO: 1044438 - protein, 18 aa, Mycobacterium
EYGLELKGTFMPRPPSAG

SEQ ID NO: 1044439 - protein, 18 aa, Mycobacterium
EYGPAFRGLQAVWESGDE

SEQ ID NO: 1044440 - protein, 18 aa, Mycobacterium
EYLMRHFATESGKSKGQF

SEQ ID NO: 1044441 - protein, 23 aa, Mycobacterium
EYLPDDVDAFLAMHDLTKNDIGA

SEQ ID NO: 1044442 - protein, 19 aa, Mycobacterium
EYPKGITVPAIVDVSTGAV

SEQ ID NO: 1044443 - protein, 25 aa, Mycobacterium
EYQRRLRAANALDFDDLIGETVGIL

SEQ ID NO: 1044444 - protein, 17 aa, Mycobacterium
EYRRCLDLLDDCDPTAR

SEQ ID NO: 1044445 - protein, 18 aa, Mycobacterium
EYVDAMAPTTGWAGSEDE

SEQ ID NO: 1044446 - protein, 21 aa, Mycobacterium
EYWYRNIRQTVQFDQAVRSAC

SEQ ID NO: 1044447 - protein, 23 aa, Mycobacterium
EYYRLRGASIYDVPEGGVPVYTA

SEQ ID NO: 1044448 - protein, 19 aa, Mycobacterium
FAAAAGFPKPILHGLCTYG

SEQ ID NO: 1044449 - protein, 18 aa, Mycobacterium
FAAADAFRNSVHSAHAQH

SEQ ID NO: 1044450 - protein, 36 aa, Mycobacterium
FAAADFELGMMWREVYKLRQPVLLIWGREDRVNPLD

SEQ ID NO: 1044451 - protein, 23 aa, Mycobacterium
FAAAGIQLLAPRSRPCVATALTL

SEQ ID NO: 1044452 - protein, 21 aa, Mycobacterium
FAAASLKTAFTQIGERFKTAN

SEQ ID NO: 1044453 - protein, 20 aa, Mycobacterium
FAAGCTRIEQGIRNGFSGNH

SEQ ID NO: 1044454 - protein, 20 aa, Mycobacterium
FAAGDIEKVMSLFDDNIEWV

SEQ ID NO: 1044455 - protein, 18 aa, Mycobacterium
FAAIPLDISDFPTRHNYG

SEQ ID NO: 1044456 - protein, 18 aa, Mycobacterium
FAAQALAVMREWNFGAAD

SEQ ID NO: 1044457 - protein, 24 aa, Mycobacterium
FAAQCVAVHCALGSDPKGAVAALL

SEQ ID NO: 1044458 - protein, 17 aa, Mycobacterium
FAARRSSVLVVHGDDGL

SEQ ID NO: 1044459 - protein, 18 aa, Mycobacterium
FAARRSSVLVVHGDDGLD

SEQ ID NO: 1044460 - protein, 17 aa, Mycobacterium
FAASSWLGSLRSRGGTV

SEQ ID NO: 1044461 - protein, 35 aa, Mycobacterium; identical to SEQ ID NO: 621148

SEQ ID NO: 1044462 - protein, 17 aa, Mycobacterium
FAAVWNAVVAELNGEPN

SEQ ID NO: 1044463 - protein, 21 aa, Mycobacterium
FACGGGRPAGRQVGYFIEPTV

SEQ ID NO: 1044464 - protein, 19 aa, Mycobacterium
FADDARVLLVFGGSQGAVS

SEQ ID NO: 1044465 - protein, 26 aa, Mycobacterium
FADFPRYPINLLADINAVMGIPFVHA

SEQ ID NO: 1044466 - protein, 21 aa, Mycobacterium
FADGLTYLGFVPFAMTSTKIG

SEQ ID NO: 1044467 - protein, 20 aa, Mycobacterium
FADHLARVGLYPDAPKLPAV

SEQ ID NO: 1044468 - protein, 17 aa, Mycobacterium
FADLPAPHARLVIEAWR

SEQ ID NO: 1044469 - protein, 18 aa, Mycobacterium
FADREGREPLVLGAVKTN

SEQ ID NO: 1044470 - protein, 19 aa, Mycobacterium
FADRLAREFPAVDVDPDPI

SEQ ID NO: 1044471 - protein, 19 aa, Mycobacterium
FADSPCRDFFLWCSSPQSP

SEQ ID NO: 1044472 - protein, 23 aa, Mycobacterium
FADTPGGSALRLLVRHDDAEREF

SEQ ID NO: 1044473 - protein, 19 aa, Mycobacterium
FADVAASLSREFRGADRLY

SEQ ID NO: 1044474 - protein, 17 aa, Mycobacterium
FADYLMWVSRDDGVLVC

SEQ ID NO: 1044475 - protein, 22 aa, Mycobacterium
FAEHAPRFALDQAHSLAEPADS

SEQ ID NO: 1044476 - protein, 18 aa, Mycobacterium
FAEHLLTHYGVRRLLLTS

SEQ ID NO: 1044477 - protein, 18 aa, Mycobacterium
FAELEPDFQRAYKELAKQ

SEQ ID NO: 1044478 - protein, 23 aa, Mycobacterium
FAERCPPESVVAAYDSPPADFAK

SEQ ID NO: 1044479 - protein, 20 aa, Mycobacterium
FAERENRIIIAYSPLAQGLL

SEQ ID NO: 1044480 - protein, 17 aa, Mycobacterium
FAERKKLASLAFQHTAE

SEQ ID NO: 1044481 - protein, 17 aa, Mycobacterium
FAESVFDSVMYVSFQEL

SEQ ID NO: 1044482 - protein, 19 aa, Mycobacterium
FAFRPGPVFTNLMLADEIN

SEQ ID NO: 1044483 - protein, 17 aa, Mycobacterium
FAFSVADLDGATRLRHA

SEQ ID NO: 1044484 - protein, 21 aa, Mycobacterium
FAGGKGGHGGLLYGNGGAGGI

SEQ ID NO: 1044485 - protein, 17 aa, Mycobacterium
FAGGTPEEFARKRDVLA

SEQ ID NO: 1044486 - protein, 17 aa, Mycobacterium
FAGIFGVGLPRGLREQA

SEQ ID NO: 1044487 - protein, 17 aa, Mycobacterium
FAGKVNRLAIMVRGNLA

SEQ ID NO: 1044488 - protein, 23 aa, Mycobacterium
FAGPEFRRFALSSGVEARHTALP

SEQ ID NO: 1044489 - protein, 19 aa, Mycobacterium
FAGSLLRDHGLLLPIEPDT

SEQ ID NO: 1044490 - protein, 18 aa, Mycobacterium
FAGSWGYQVTSYYAPTSR

SEQ ID NO: 1044491 - protein, 19 aa, Mycobacterium
FAGTSGRTLSRAQVFQQFA

SEQ ID NO: 1044492 - protein, 17 aa, Mycobacterium
FAHGRPTAATVRHFLSH

SEQ ID NO: 1044493 - protein, 17 aa, Mycobacterium
FAHKLRQKRLMTLIHLW

SEQ ID NO: 1044494 - protein, 17 aa, Mycobacterium
FAHPVLLERSRAAELAT

SEQ ID NO: 1044495 - protein, 29 aa, Mycobacterium
FAIAQARLGPGRIHHCMRALGGAERALAL

SEQ ID NO: 1044496 - protein, 21 aa, Mycobacterium
FAIDVEWTLLASLARLGRPDG

SEQ ID NO: 1044497 - protein, 21 aa, Mycobacterium
FAIELGRLGGLAVLNGEGLIG

SEQ ID NO: 1044498 - protein, 18 aa, Mycobacterium
FAISAVLSVHFARQAAPF

SEQ ID NO: 1044499 - protein, 18 aa, Mycobacterium
FAKAAYRINRVEDVGLGI

SEQ ID NO: 1044500 - protein, 21 aa, Mycobacterium
FAKAWYKLLHRDMGPVSRYLG

SEQ ID NO: 1044501 - protein, 26 aa, Mycobacterium
FAKLNPRVPRIWNVVRLPPQMALASC

SEQ ID NO: 1044502 - protein, 24 aa, Mycobacterium
FAKLREPLEVPGLLDVQTDSFEWL

SEQ ID NO: 1044503 - protein, 20 aa, Mycobacterium
FALAITNRAVLAVYRPLLEP

SEQ ID NO: 1044504 - protein, 18 aa, Mycobacterium
FALMCGDLSVPVTFAVGR

SEQ ID NO: 1044505 - protein, 20 aa, Mycobacterium
FALPICRRPGAKTVTALGGG

SEQ ID NO: 1044506 - protein, 25 aa, Mycobacterium
FALTEARIGVAPAIISLTLLPKLSA

SEQ ID NO: 1044507 - protein, 26 aa, Mycobacterium
FALTYPRRLGFGLGTSVVSLSWRTGD

SEQ ID NO: 1044508 - protein, 29 aa, Mycobacterium
FANKKGGADWVEWGGCGMVHPNVLRAAGI

SEQ ID NO: 1044509 - protein, 19 aa, Mycobacterium
FANSSVCYWSHPRALVRGR

SEQ ID NO: 1044510 - protein, 18 aa, Mycobacterium
FANVAAQIVALRLVTASG

SEQ ID NO: 1044511 - protein, 19 aa, Mycobacterium
FAPDCMVGNECELLDKIFY

SEQ ID NO: 1044512 - protein, 18 aa, Mycobacterium
FAPLNSWPDNVSLDKARR

SEQ ID NO: 1044513 - protein, 27 aa, Mycobacterium
FAQHRVWDRVLFDAGLSVITWPKQYGG

SEQ ID NO: 1044514 - protein, 20 aa, Mycobacterium
FAQKRFCGAEGIENVTNASA

SEQ ID NO: 1044515 - protein, 29 aa, Mycobacterium
FAQPYPAWRELFDNLLPAHIVKDVPGGFA

SEQ ID NO: 1044516 - protein, 27 aa, Mycobacterium
FAQQALHAFRKFGFQLVIVATVQNATT

SEQ ID NO: 1044517 - protein, 20 aa, Mycobacterium
FAQSSTVLFLGRHVGYPVAL

SEQ ID NO: 1044518 - protein, 21 aa, Mycobacterium
FARDLSRLCDLARARGLDSDP

SEQ ID NO: 1044519 - protein, 17 aa, Mycobacterium
FAREHLGSLDGVPSVRA

SEQ ID NO: 1044520 - protein, 19 aa, Mycobacterium
FAREQHLDMAKIITSAGPA

SEQ ID NO: 1044521 - protein, 18 aa, Mycobacterium
FARIWPFIVAHEAEPVRA

SEQ ID NO: 1044522 - protein, 23 aa, Mycobacterium
FARPMGPRMMCGETDILEQLEEE

SEQ ID NO: 1044523 - protein, 19 aa, Mycobacterium
FARQKRLGVIPADAELTER

SEQ ID NO: 1044524 - protein, 25 aa, Mycobacterium
FARQRYWGEPFPIVYDADGRPHALD

SEQ ID NO: 1044525 - protein, 17 aa, Mycobacterium
FARQYEQVMLLRAAVGT

SEQ ID NO: 1044526 - protein, 26 aa, Mycobacterium
FARVPGRRGGTHFPFLENPQTFNDVV

SEQ ID NO: 1044527 - protein, 19 aa, Mycobacterium
FARVVGGSFARIQFTPDLV

SEQ ID NO: 1044528 - protein, 23 aa, Mycobacterium
FASAARNLANIGVTINAANANAI

SEQ ID NO: 1044529 - protein, 17 aa, Mycobacterium
FASAESRMANRAELVAV

SEQ ID NO: 1044530 - protein, 20 aa, Mycobacterium
FASAVGRSFYTQILPSNTVS

SEQ ID NO: 1044531 - protein, 21 aa, Mycobacterium
FATCCRALGIAVYDRKRPADL

SEQ ID NO: 1044532 - protein, 22 aa, Mycobacterium
FATDHLRLVGLHSHIGSQIFDV

SEQ ID NO: 1044533 - protein, 24 aa, Mycobacterium
FATELRNLLARCAERGVDPMELER

SEQ ID NO: 1044534 - protein, 17 aa, Mycobacterium
FATFLDAIDAVRRVAEH

SEQ ID NO: 1044535 - protein, 22 aa, Mycobacterium
FATTVPTEFQSLVVHDATGDPV

SEQ ID NO: 1044536 - protein, 17 aa, Mycobacterium
FAVGDRVVGLFPEGTGT

SEQ ID NO: 1044537 - protein, 18 aa, Mycobacterium
FAVTKNGRHSLTHYDTVE

SEQ ID NO: 1044538 - protein, 25 aa, Mycobacterium
FAYPLPVAVICRLLGVPLEDEPQFS

SEQ ID NO: 1044539 - protein, 17 aa, Mycobacterium
FCAGAYLGSADAAAGYD

SEQ ID NO: 1044540 - protein, 17 aa, Mycobacterium
FCAQAAVRRTPLLLDGM

SEQ ID NO: 1044541 - protein, 23 aa, Mycobacterium
FCCLFCGAAKLGAVAVPLNTRLA

SEQ ID NO: 1044542 - protein, 19 aa, Mycobacterium
FCDLPGVMQHFTIPISFFD

SEQ ID NO: 1044543 - protein, 19 aa, Mycobacterium
FCTALGCRAPLIVVTNSAT

SEQ ID NO: 1044544 - protein, 19 aa, Mycobacterium
FCVTRCGYCDFNTYTPAEL

SEQ ID NO: 1044545 - protein, 18 aa, Mycobacterium
FDAAAAHHFGCGFAPSGW

SEQ ID NO: 1044546 - protein, 24 aa, Mycobacterium
FDAALVVDVIERFRVTNFTATPTM

SEQ ID NO: 1044547 - protein, 17 aa, Mycobacterium
FDAARAAIVHPLQVAAN

SEQ ID NO: 1044548 - protein, 27 aa, Mycobacterium
FDAGRPTAWIAEGLFGYLPPEAQDRLL

SEQ ID NO: 1044549 - protein, 18 aa, Mycobacterium
FDAIGITVLEGYRLTETA

SEQ ID NO: 1044550 - protein, 20 aa, Mycobacterium
FDALCAHLATMHPSRYLTLI

SEQ ID NO: 1044551 - protein, 17 aa, Mycobacterium
FDALGRWLLARTTQVSA

SEQ ID NO: 1044552 - protein, 27 aa, Mycobacterium
FDASGVRLAIVASTWHTKICDALLAGA

SEQ ID NO: 1044553 - protein, 17 aa, Mycobacterium
FDAVCFTSSSTVRNLVG

SEQ ID NO: 1044554 - protein, 20 aa, Mycobacterium
FDAVIAVHLKGHFATMRHAA

SEQ ID NO: 1044555 - protein, 22 aa, Mycobacterium
FDAVSALGYLAACTDRVQLASG

SEQ ID NO: 1044556 - protein, 17 aa, Mycobacterium
FDDAGAIGRRYRRQDEI

SEQ ID NO: 1044557 - protein, 18 aa, Mycobacterium
FDDARPVLERASARETAA

SEQ ID NO: 1044558 - protein, 18 aa, Mycobacterium
FDDLSVGQVFDWAPALTL

SEQ ID NO: 1044559 - protein, 23 aa, Mycobacterium
FDDRIDPRFPVFSAASLAEALPG

SEQ ID NO: 1044560 - protein, 26 aa, Mycobacterium
FDDSRLRWLRAGEVPTLGNWFRAAGY

SEQ ID NO: 1044561 - protein, 26 aa, Mycobacterium
FDDVFKRMWELYLAYSEAGFRSGYLD

SEQ ID NO: 1044562 - protein, 24 aa, Mycobacterium
FDEAFKLVKINPLAAWSDDEVQDY

SEQ ID NO: 1044563 - protein, 22 aa, Mycobacterium
FDEASWRGAELVALHAWTDAEI

SEQ ID NO: 1044564 - protein, 22 aa, Mycobacterium
FDEQANIRWARALEQAGVHVAY

SEQ ID NO: 1044565 - protein, 28 aa, Mycobacterium
FDFGRPEVRNFLVANALYWIEQFHIDGL

SEQ ID NO: 1044566 - protein, 25 aa, Mycobacterium
FDGHIERFENFHGFEVAGQPPAGGV

SEQ ID NO: 1044567 - protein, 18 aa, Mycobacterium
FDGIWLPEHCGTPYGMTP

SEQ ID NO: 1044568 - protein, 25 aa, Mycobacterium
FDGKKAVVFDDRWASAREDLVKLWL

SEQ ID NO: 1044569 - protein, 18 aa, Mycobacterium
FDGQPAWSGKPEVAAAAE

SEQ ID NO: 1044570 - protein, 31 aa, Mycobacterium; identical to SEQ ID NO: 658241

SEQ ID NO: 1044571 - protein, 18 aa, Mycobacterium
FDGVDAWPSAIAANAAGE

SEQ ID NO: 1044572 - protein, 19 aa, Mycobacterium
FDIAALLAEAVDQAGVGDD

SEQ ID NO: 1044573 - protein, 37 aa, Mycobacterium; identical to SEQ ID NO: 658269

SEQ ID NO: 1044574 - protein, 24 aa, Mycobacterium
FDKDRDGFVFGEAGALLLIETEEH

SEQ ID NO: 1044575 - protein, 25 aa, Mycobacterium
FDKIDQRLTVLGIDNTITYKAGEPK

SEQ ID NO: 1044576 - protein, 22 aa, Mycobacterium
FDLAFRCVQLLQARGAVGPPSA

SEQ ID NO: 1044577 - protein, 17 aa, Mycobacterium
FDLCAMVGHPEWIDEQS

SEQ ID NO: 1044578 - protein, 23 aa, Mycobacterium
FDLIHRLWLDLGHEVRYVQNVTD

SEQ ID NO: 1044579 - protein, 25 aa, Mycobacterium
FDLTNELPLRITVIRTRADELVLLL

SEQ ID NO: 1044580 - protein, 18 aa, Mycobacterium
FDMDPSRPILHGLLGDID

SEQ ID NO: 1044581 - protein, 18 aa, Mycobacterium
FDNDWALVHVTVNRVKLE

SEQ ID NO: 1044582 - protein, 20 aa, Mycobacterium
FDNFCDILLRVADARAQVSS

SEQ ID NO: 1044583 - protein, 19 aa, Mycobacterium
FDNLMRLDSRFFLEDSAGI

SEQ ID NO: 1044584 - protein, 24 aa, Mycobacterium
FDNLMRLDSRFFLEDSAGIPARGG

SEQ ID NO: 1044585 - protein, 17 aa, Mycobacterium
FDPARIWGADNHEPESA

SEQ ID NO: 1044586 - protein, 25 aa, Mycobacterium
FDPRERPTCDAAYWVDNLRNTVQFA

SEQ ID NO: 1044587 - protein, 18 aa, Mycobacterium
FDPSQGVIPEPAPVDNPP

SEQ ID NO: 1044588 - protein, 29 aa, Mycobacterium
FDPTVEAVFWAAERDHGAVNWMVNDLGMC

SEQ ID NO: 1044589 - protein, 18 aa, Mycobacterium
FDPVLGLEVHVELSTATK

SEQ ID NO: 1044590 - protein, 17 aa, Mycobacterium
FDQEHRKPYGVDFVHNT

SEQ ID NO: 1044591 - protein, 20 aa, Mycobacterium
FDRECPGGAGAQVRGDPVVP

SEQ ID NO: 1044592 - protein, 18 aa, Mycobacterium
FDRPTPRVLGWRDHRADP

SEQ ID NO: 1044593 - protein, 20 aa, Mycobacterium
FDRVIGINLRGAWLCTKHAA

SEQ ID NO: 1044594 - protein, 18 aa, Mycobacterium
FDSELCRIPVVVLTTSSA

SEQ ID NO: 1044595 - protein, 19 aa, Mycobacterium
FDSILGRLPQDVSLEGEDT

SEQ ID NO: 1044596 - protein, 26 aa, Mycobacterium
FDTPFPYWKRFAGYEGGVADPLIVSW

SEQ ID NO: 1044597 - protein, 24 aa, Mycobacterium
FDTVVDCAFYHTFGTAPELQRSYV

SEQ ID NO: 1044598 - protein, 17 aa, Mycobacterium
FDVNLWAPLMWTSLVVK

SEQ ID NO: 1044599 - protein, 30 aa, Mycobacterium; identical to SEQ ID NO: 658492

SEQ ID NO: 1044600 - protein, 18 aa, Mycobacterium
FEAALAATVHPVAVAANR

SEQ ID NO: 1044601 - protein, 24 aa, Mycobacterium
FEAMTIDCPDEFVGAITQLMAGRK

SEQ ID NO: 1044602 - protein, 17 aa, Mycobacterium
FEAPTITGLAHRVGAAT

SEQ ID NO: 1044603 - protein, 24 aa, Mycobacterium
FEARFRFVEEMIRLGADALTDGHH

SEQ ID NO: 1044604 - protein, 19 aa, Mycobacterium
FEDHIAWILQDKFNDPIAH

SEQ ID NO: 1044605 - protein, 22 aa, Mycobacterium
FEEAAHAVMHWGMQRGAGLAVW

SEQ ID NO: 1044606 - protein, 20 aa, Mycobacterium
FEEACAVLTGLLSQPSTTFD

SEQ ID NO: 1044607 - protein, 29 aa, Mycobacterium
FEEIQIPVGPRLGSVVVEVEHLDKGFGGR

SEQ ID NO: 1044608 - protein, 18 aa, Mycobacterium
FEFRCARCNKPYTDSLPQ

SEQ ID NO: 1044609 - protein, 29 aa, Mycobacterium
FEGELAIVIGRPCKDVSAAQAVDNILGYT

SEQ ID NO: 1044610 - protein, 34 aa, Mycobacterium
FEGKSVRSAHAVFCRAVIVGPPLELVLDVVHEGR

SEQ ID NO: 1044611 - protein, 18 aa, Mycobacterium
FEGPVHRANFYAVDCSPV

SEQ ID NO: 1044612 - protein, 19 aa, Mycobacterium
FEGQQGWVRLDRVLDVPEE

SEQ ID NO: 1044613 - protein, 17 aa, Mycobacterium
FEHFEKIPVVAAGERGT

SEQ ID NO: 1044614 - protein, 20 aa, Mycobacterium
FEHFEKIPVVAAGERGTDLA

SEQ ID NO: 1044615 - protein, 26 aa, Mycobacterium
FEHFGRLRYAHFFKMAYQALPADGIM

SEQ ID NO: 1044616 - protein, 24 aa, Mycobacterium
FEIKEFKSGAARMALEAGVPIVPH

SEQ ID NO: 1044617 - protein, 18 aa, Mycobacterium
FEIKIHRIAAVAIAVLCE

SEQ ID NO: 1044618 - protein, 26 aa, Mycobacterium
FEKTLRFWLERGVDGFRIDVAHGMAK

SEQ ID NO: 1044619 - protein, 26 aa, Mycobacterium
FELAELVSRVGAVLRRRGRLPRVVQV

SEQ ID NO: 1044620 - protein, 23 aa, Mycobacterium
FELKEFKTGAARMALDADVPIVP

SEQ ID NO: 1044621 - protein, 18 aa, Mycobacterium
FELLRFLMRNPRRALSRT

SEQ ID NO: 1044622 - protein, 21 aa, Mycobacterium
FELSEHFSRHFGVFREAQAGA

SEQ ID NO: 1044623 - protein, 26 aa, Mycobacterium
FENAKFGIFIHWGLYSVPGWAPLEAD

SEQ ID NO: 1044624 - protein, 27 aa, Mycobacterium
FENFARTWLDYRLKLLEATDRFGPFQR

SEQ ID NO: 1044625 - protein, 19 aa, Mycobacterium
FENHGNFGSGFLNAGSFSS

SEQ ID NO: 1044626 - protein, 27 aa, Mycobacterium
FEPAPQLVSRYCMDRRDSVNSFDSSSS

SEQ ID NO: 1044627 - protein, 20 aa, Mycobacterium
FEPKPDWRNPFSYQPEIWDY

SEQ ID NO: 1044628 - protein, 21 aa, Mycobacterium
FEPRDSALVRHCLDTGDPFGV

SEQ ID NO: 1044629 - protein, 18 aa, Mycobacterium
FEPTLDYVVVKAPRFAFE

SEQ ID NO: 1044630 - protein, 19 aa, Mycobacterium
FEQARRRFETSWNRENGAH

SEQ ID NO: 1044631 - protein, 22 aa, Mycobacterium
FEQHLRAVLDYPLGDTEAIAPV

SEQ ID NO: 1044632 - protein, 33 aa, Mycobacterium; identical to SEQ ID NO: 658726

SEQ ID NO: 1044633 - protein, 25 aa, Mycobacterium
FESFLPRYLTTRVYAAMLESAASEL

SEQ ID NO: 1044634 - protein, 20 aa, Mycobacterium
FESHCGWPSFFDPSASEAVI

SEQ ID NO: 1044635 - protein, 19 aa, Mycobacterium
FETACTWDGFDALHAAVTD

SEQ ID NO: 1044636 - protein, 18 aa, Mycobacterium
FETLLALAGYYFAVGDLA

SEQ ID NO: 1044637 - protein, 17 aa, Mycobacterium
FEVLRAIVADFVATHEP

SEQ ID NO: 1044638 - protein, 23 aa, Mycobacterium
FEWHSRPGAFSRLSPPWQPMRLV

SEQ ID NO: 1044639 - protein, 26 aa, Mycobacterium
FEWLIGSPCWRAAAASRGDLKPVGGL

SEQ ID NO: 1044640 - protein, 22 aa, Mycobacterium
FEWLIGSQRWRESAAQRGDATP

SEQ ID NO: 1044641 - protein, 17 aa, Mycobacterium
FFAAPGSWTVRALSKAG

SEQ ID NO: 1044642 - protein, 17 aa, Mycobacterium
FFAYAISAAVDWLYSGL

SEQ ID NO: 1044643 - protein, 18 aa, Mycobacterium
FFCVVDLHAITLPQDPEA

SEQ ID NO: 1044644 - protein, 19 aa, Mycobacterium
FFDGFPRNAHPMPVLSSVV

SEQ ID NO: 1044645 - protein, 19 aa, Mycobacterium
FFDRRNACANCFATEFTTV

SEQ ID NO: 1044646 - protein, 18 aa, Mycobacterium
FFECSAHMPFIEEPDRFD

SEQ ID NO: 1044647 - protein, 23 aa, Mycobacterium
FFEGVMMPELFMADAMGASGKPL

SEQ ID NO: 1044648 - protein, 17 aa, Mycobacterium
FFGRPLKASMFFSPGGV

SEQ ID NO: 1044649 - protein, 25 aa, Mycobacterium
FFHRGQDFVYHWALGDRLPADAGLA

SEQ ID NO: 1044650 - protein, 18 aa, Mycobacterium
FFHSISIERHGAVSGRGA

SEQ ID NO: 1044651 - protein, 30 aa, Mycobacterium; identical to SEQ ID NO: 621199

SEQ ID NO: 1044652 - protein, 25 aa, Mycobacterium
FFLPKIAAGDLHFSIGYSEPGAGTD

SEQ ID NO: 1044653 - protein, 23 aa, Mycobacterium
FFNNYRPQFYFRTTDVTGVVTLP

SEQ ID NO: 1044654 - protein, 17 aa, Mycobacterium
FFPAGDRALLARFADRW

SEQ ID NO: 1044655 - protein, 25 aa, Mycobacterium
FFPSVREYSTLYGLSDRRQAMLGGH

SEQ ID NO: 1044656 - protein, 19 aa, Mycobacterium
FFRALDYTLPWDVDGVEDA

SEQ ID NO: 1044657 - protein, 24 aa, Mycobacterium
FFRHFPTKEAVLFQDYENQLEWLA

SEQ ID NO: 1044658 - protein, 25 aa, Mycobacterium
FFSRGGALKSSWYGDCLPERDFPTL

SEQ ID NO: 1044659 - protein, 18 aa, Mycobacterium
FFTSGEFNSGVGSSGTLN

SEQ ID NO: 1044660 - protein, 23 aa, Mycobacterium
FFVPDPKYSSAMLPGGQVQEFKA

SEQ ID NO: 1044661 - protein, 19 aa, Mycobacterium
FFYIKGRSSEMIISGGVNI

SEQ ID NO: 1044662 - protein, 21 aa, Mycobacterium
FGAGIRPPWSLGEPQPELATL

SEQ ID NO: 1044663 - protein, 29 aa, Mycobacterium
FGAHLSEFHARFTQMLSAGANEYSQAEAA

SEQ ID NO: 1044664 - protein, 23 aa, Mycobacterium
FGAKDFDVHTALRYMVNAATRGG

SEQ ID NO: 1044665 - protein, 18 aa, Mycobacterium
FGAPQGRAVFWFHGTPGA

SEQ ID NO: 1044666 - protein, 21 aa, Mycobacterium
FGARCGWFPLPPVGALNKAHR

SEQ ID NO: 1044667 - protein, 17 aa, Mycobacterium
FGARHADAMFTLHSSLR

SEQ ID NO: 1044668 - protein, 24 aa, Mycobacterium
FGASGPRSSWRATDAVLYAMSGSL

SEQ ID NO: 1044669 - protein, 20 aa, Mycobacterium
FGASSAFGGPCRTPVAERLA

SEQ ID NO: 1044670 - protein, 18 aa, Mycobacterium
FGAYPAVIARELDRYLPF

SEQ ID NO: 1044671 - protein, 31 aa, Mycobacterium
FGCQAQRPGSWWKNFGAKMHYRASAMLCNPP

SEQ ID NO: 1044672 - protein, 19 aa, Mycobacterium
FGDADGFWAAVLHRTAERR

SEQ ID NO: 1044673 - protein, 22 aa, Mycobacterium
FGDGPLVVGICAEYNALPEIGH

SEQ ID NO: 1044674 - protein, 17 aa, Mycobacterium
FGDRVMILMLNRTEFVE

SEQ ID NO: 1044675 - protein, 18 aa, Mycobacterium
FGDSEFDTVISAIGVMFA

SEQ ID NO: 1044676 - protein, 18 aa, Mycobacterium
FGDTEPWHISRTLTNAVL

SEQ ID NO: 1044677 - protein, 18 aa, Mycobacterium
FGDVASWRDQMGHQVRVE

SEQ ID NO: 1044678 - protein, 19 aa, Mycobacterium
FGDVRRGYVYTRQPDNQWL

SEQ ID NO: 1044679 - protein, 26 aa, Mycobacterium
FGDYFKRGAIELAWALLTNSVADGGY

SEQ ID NO: 1044680 - protein, 23 aa, Mycobacterium
FGDYRCRADQAGVFCVNYAHQSA

SEQ ID NO: 1044681 - protein, 21 aa, Mycobacterium
FGEALPVRVCPLRTDPWNVAT

SEQ ID NO: 1044682 - protein, 22 aa, Mycobacterium
FGEAVKLGDRIAILTTGSKVVQ

SEQ ID NO: 1044683 - protein, 17 aa, Mycobacterium
FGEEFPRTCGAARLAGG

SEQ ID NO: 1044684 - protein, 24 aa, Mycobacterium
FGEGPRWFEGLLWFSDMLGEAVHT

SEQ ID NO: 1044685 - protein, 26 aa, Mycobacterium
FGEPLLALRIPWYVTVLDLGPAGAVY

SEQ ID NO: 1044686 - protein, 26 aa, Mycobacterium
FGFSPLRLPPELDFATLFHGVDERVP

SEQ ID NO: 1044687 - protein, 20 aa, Mycobacterium
FGGATIRLTRDAGWGNAMRW

SEQ ID NO: 1044688 - protein, 17 aa, Mycobacterium
FGGFGLAGGGGTGGSGG

SEQ ID NO: 1044689 - protein, 27 aa, Mycobacterium
FGGGAKRCLGAAFSMRELVTVLHVLLR

SEQ ID NO: 1044690 - protein, 18 aa, Mycobacterium
FGGGFQHWGETMMTDGQW

SEQ ID NO: 1044691 - protein, 34 aa, Mycobacterium; identical to SEQ ID NO: 659099

SEQ ID NO: 1044692 - protein, 17 aa, Mycobacterium
FGGLKPVHALADCGRVV

SEQ ID NO: 1044693 - protein, 18 aa, Mycobacterium
FGGLPAYQQRLGRKVRFM

SEQ ID NO: 1044694 - protein, 23 aa, Mycobacterium
FGGQAGTPLAVYAANNSLTATQL

SEQ ID NO: 1044695 - protein, 25 aa, Mycobacterium
FGGRSGWSPTRWGSNSTRSAVWPNT

SEQ ID NO: 1044696 - protein, 25 aa, Mycobacterium
FGGSAYPQMLLRVGWAPINADPLPA

SEQ ID NO: 1044697 - protein, 17 aa, Mycobacterium
FGGSGAALGLFGGTGGN

SEQ ID NO: 1044698 - protein, 22 aa, Mycobacterium
FGGTGGNGGLLFGDGGTGGAAG

SEQ ID NO: 1044699 - protein, 19 aa, Mycobacterium
FGGVVPEIASRAHLEALGP

SEQ ID NO: 1044700 - protein, 17 aa, Mycobacterium
FGHAVKTFYRDAFAKHQ

SEQ ID NO: 1044701 - protein, 19 aa, Mycobacterium
FGHGSDAWLAELAALPLVH

SEQ ID NO: 1044702 - protein, 19 aa, Mycobacterium
FGIPEVKRGLAAGGGGLLR

SEQ ID NO: 1044703 - protein, 26 aa, Mycobacterium
FGISGEATFDYGVAFDRSRKVAEGRV

SEQ ID NO: 1044704 - protein, 24 aa, Mycobacterium
FGLDRWYQQLTRLWASLASDPHPS

SEQ ID NO: 1044705 - protein, 18 aa, Mycobacterium
FGLHPDKVLAELKEAQEL

SEQ ID NO: 1044706 - protein, 26 aa, Mycobacterium
FGLIPEFIGRLPVVASVTNLDKESLV

SEQ ID NO: 1044707 - protein, 18 aa, Mycobacterium
FGLLRAGAIPVMCLPGHR

SEQ ID NO: 1044708 - protein, 17 aa, Mycobacterium
FGLPEAKRGFIAAAGGV

SEQ ID NO: 1044709 - protein, 19 aa, Mycobacterium
FGMAPTYPFEFMADVKANR

SEQ ID NO: 1044710 - protein, 24 aa, Mycobacterium
FGMSEERVRLISPFVGGAFGSAGR

SEQ ID NO: 1044711 - protein, 24 aa, Mycobacterium
FGNGNRGNLNWGSGNLGNANVGFG

SEQ ID NO: 1044712 - protein, 25 aa, Mycobacterium
FGPEHQPRIALRADMDALPMAERTG

SEQ ID NO: 1044713 - protein, 17 aa, Mycobacterium
FGPFAGWSPKFLKRGHL

SEQ ID NO: 1044714 - protein, 18 aa, Mycobacterium
FGPGGARGGGRRGGPGRG

SEQ ID NO: 1044715 - protein, 30 aa, Mycobacterium; identical to SEQ ID NO: 659254

SEQ ID NO: 1044716 - protein, 25 aa, Mycobacterium
FGPLARTRIRPHFFPFTEPSAEVDV

SEQ ID NO: 1044717 - protein, 18 aa, Mycobacterium
FGPLEARDELAACEILAD

SEQ ID NO: 1044718 - protein, 17 aa, Mycobacterium
FGPTLAETLEKAGGEPQ

SEQ ID NO: 1044719 - protein, 25 aa, Mycobacterium
FGPVARGGLRWSDRRDDFRTEILGL

SEQ ID NO: 1044720 - protein, 20 aa, Mycobacterium
FGPYHLKRLLGRGGMGEVYE

SEQ ID NO: 1044721 - protein, 17 aa, Mycobacterium
FGPYLSSASNPWGEGIN

SEQ ID NO: 1044722 - protein, 19 aa, Mycobacterium
FGQRFPDRLFDVGIAEQHA

SEQ ID NO: 1044723 - protein, 22 aa, Mycobacterium
FGRFTPRARSAVVAAQNAAHQG

SEQ ID NO: 1044724 - protein, 22 aa, Mycobacterium
FGRGADFARPLTVIAGAATRWV

SEQ ID NO: 1044725 - protein, 20 aa, Mycobacterium
FGRIEGRPVGIVANQPTHFA

SEQ ID NO: 1044726 - protein, 17 aa, Mycobacterium
FGRRIRAGLQRRLERRI

SEQ ID NO: 1044727 - protein, 23 aa, Mycobacterium
FGRWELPAFMQIVAGLAEAMRDG

SEQ ID NO: 1044728 - protein, 27 aa, Mycobacterium
FGSAAYWKRHVRDAVRFADSIRFAQSA

SEQ ID NO: 1044729 - protein, 25 aa, Mycobacterium
FGSAQLSRRGFIGAGIAGGLALAGC

SEQ ID NO: 1044730 - protein, 25 aa, Mycobacterium
FGSCQAIWRLEHGYLAGSDPRRDGQ

SEQ ID NO: 1044731 - protein, 22 aa, Mycobacterium
FGSERIVAAPVTFVDIAGLVKG

SEQ ID NO: 1044732 - protein, 17 aa, Mycobacterium
FGSGFLNAGSFSSGYRN

SEQ ID NO: 1044733 - protein, 18 aa, Mycobacterium
FGSIPRYTALKEHADVDV

SEQ ID NO: 1044734 - protein, 19 aa, Mycobacterium
FGSPTRFGSVAAQLREFLD

SEQ ID NO: 1044735 - protein, 24 aa, Mycobacterium
FGSSGLRTTVQFIGPLSVVDNVLA

SEQ ID NO: 1044736 - protein, 19 aa, Mycobacterium
FGSVTSGLVGSSWQGAAAT

SEQ ID NO: 1044737 - protein, 28 aa, Mycobacterium
FGTDEQKLRWAVPILRAQITASLGMSEP

SEQ ID NO: 1044738 - protein, 28 aa, Mycobacterium
FGTGGAGGTGGWLIGHSGTNGIGGTGGA

SEQ ID NO: 1044739 - protein, 17 aa, Mycobacterium
FGTNHLGHFALTGLLLD

SEQ ID NO: 1044740 - protein, 32 aa, Mycobacterium; identical to SEQ ID NO: 79733

SEQ ID NO: 1044741 - protein, 26 aa, Mycobacterium
FGTTQRFGVPMGFGGPHAGYLSVHAK

SEQ ID NO: 1044742 - protein, 19 aa, Mycobacterium
FGVAAPRIAASALTPPVPG

SEQ ID NO: 1044743 - protein, 17 aa, Mycobacterium
FGVLEQVAILVALGHQL

SEQ ID NO: 1044744 - protein, 23 aa, Mycobacterium
FGVLSRFTAFVAIDPERSEAGPI

SEQ ID NO: 1044745 - protein, 18 aa, Mycobacterium
FGVPLFFGGPHAGYMAVR

SEQ ID NO: 1044746 - protein, 17 aa, Mycobacterium
FGVRRIAGINAWNGTIG

SEQ ID NO: 1044747 - protein, 18 aa, Mycobacterium
FGVRVLDAFEEAPQSRAH

SEQ ID NO: 1044748 - protein, 22 aa, Mycobacterium
FGVTQQPAWAFISANGEVEVVK

SEQ ID NO: 1044749 - protein, 19 aa, Mycobacterium
FGVVAVCLAELAAQHAHTA

SEQ ID NO: 1044750 - protein, 17 aa, Mycobacterium
FGWKSSFGSGKGKDAIT

SEQ ID NO: 1044751 - protein, 24 aa, Mycobacterium
FGYFKDPWLRRAFDRSGVLSFVLS

SEQ ID NO: 1044752 - protein, 19 aa, Mycobacterium
FGYHISHLDLPQITNGSSS

SEQ ID NO: 1044753 - protein, 24 aa, Mycobacterium
FGYRVSRYELDLEYKVAINRLSGT

SEQ ID NO: 1044754 - protein, 18 aa, Mycobacterium
FGYVVARAVVSARETLLR

SEQ ID NO: 1044755 - protein, 26 aa, Mycobacterium
FHAALEFWSALHGFVLLEMTGLMEEI

SEQ ID NO: 1044756 - protein, 17 aa, Mycobacterium
FHAKAIVLATGGSGRMY

SEQ ID NO: 1044757 - protein, 19 aa, Mycobacterium
FHAMYPRIDEWIAVRRKVD

SEQ ID NO: 1044758 - protein, 23 aa, Mycobacterium
FHEAVHWDIPVAELSTDDAGQTT

SEQ ID NO: 1044759 - protein, 17 aa, Mycobacterium
FHHRYRIAPPVIATQAR

SEQ ID NO: 1044760 - protein, 18 aa, Mycobacterium
FHLDFKALIPNNIIALQT

SEQ ID NO: 1044761 - protein, 26 aa, Mycobacterium
FHQPRPPWLMSRCAPAPVGRTAAPGA

SEQ ID NO: 1044762 - protein, 18 aa, Mycobacterium
FHQVRRLVAVMTKASLTA

SEQ ID NO: 1044763 - protein, 20 aa, Mycobacterium
FHRGRLLAMGPRCLMTSMEL

SEQ ID NO: 1044764 - protein, 23 aa, Mycobacterium
FHRMAVDAFASLAADAIEAAQQT

SEQ ID NO: 1044765 - protein, 17 aa, Mycobacterium
FHVQPHWEDRVRLLTRA

SEQ ID NO: 1044766 - protein, 18 aa, Mycobacterium
FIAGFVAYAKFLVRQGAD

SEQ ID NO: 1044767 - protein, 19 aa, Mycobacterium
FIAPSRFHVVPVLAYSADI

SEQ ID NO: 1044768 - protein, 18 aa, Mycobacterium
FIDERPQLLTARTSADRG

SEQ ID NO: 1044769 - protein, 26 aa, Mycobacterium
FIEGYNLNMAIPWIAAERGYIDAVVD

SEQ ID NO: 1044770 - protein, 24 aa, Mycobacterium
FIELLAWQFASPVRWIETQDLLFI

SEQ ID NO: 1044771 - protein, 18 aa, Mycobacterium
FIETCRRAEQWGYDAVFA

SEQ ID NO: 1044772 - protein, 23 aa, Mycobacterium
FIEVRRAGIALAREVERRAPEAV

SEQ ID NO: 1044773 - protein, 18 aa, Mycobacterium
FIGINGGPPFPFTEAVSF

SEQ ID NO: 1044774 - protein, 19 aa, Mycobacterium
FIHELLFEHLHVVEVVVGE

SEQ ID NO: 1044775 - protein, 25 aa, Mycobacterium
FIIGRIKDLLIIYGRNHSPDDIEAT

SEQ ID NO: 1044776 - protein, 25 aa, Mycobacterium
FIIGRIKDLLIVYGRNHSPDDIEAT

SEQ ID NO: 1044777 - protein, 24 aa, Mycobacterium
FILAEIFPGGWLPTIPTVEEHATA

SEQ ID NO: 1044778 - protein, 19 aa, Mycobacterium
FILGEVFRRITGRTVGQYL

SEQ ID NO: 1044779 - protein, 26 aa, Mycobacterium
FIPEGLLNYLALLGWAIADDHDLFSL

SEQ ID NO: 1044780 - protein, 24 aa, Mycobacterium
FIPPGEPWRNGYVESFSSRIRDEC

SEQ ID NO: 1044781 - protein, 19 aa, Mycobacterium
FIPVSRWQYDIVGADGGCR

SEQ ID NO: 1044782 - protein, 22 aa, Mycobacterium
FISPRDRMGFFPDGPGFTEIPE

SEQ ID NO: 1044783 - protein, 26 aa, Mycobacterium
FISVFGYKAQSAFFKHANIGVSDQQI

SEQ ID NO: 1044784 - protein, 23 aa, Mycobacterium
FITVARFFGLRGPYDNDLDSSSP

SEQ ID NO: 1044785 - protein, 21 aa, Mycobacterium
FIVTDIFPGGRLPMIETVEEH

SEQ ID NO: 1044786 - protein, 23 aa, Mycobacterium
FIVTEIFPGGRLPSIEKVADHSS

SEQ ID NO: 1044787 - protein, 19 aa, Mycobacterium
FIVTEIFPGGRLPSTGMMV

SEQ ID NO: 1044788 - protein, 20 aa, Mycobacterium
FKAHCRYCDKPVGDSIATLQ

SEQ ID NO: 1044789 - protein, 22 aa, Mycobacterium
FKCPRSVAFEAQLPRTDTGKLY

SEQ ID NO: 1044790 - protein, 17 aa, Mycobacterium
FKDHLYIAGRIKDLVII

SEQ ID NO: 1044791 - protein, 20 aa, Mycobacterium
FKDHLYIAGRIKDLVIIDGR

SEQ ID NO: 1044792 - protein, 21 aa, Mycobacterium
FKDPVKGFFRALDYTLPWDVD

SEQ ID NO: 1044793 - protein, 25 aa, Mycobacterium
FKEGERLWISWAMANREPQVFPDPD

SEQ ID NO: 1044794 - protein, 19 aa, Mycobacterium
FKGDERWRNLPTPSGNTFD

SEQ ID NO: 1044795 - protein, 19 aa, Mycobacterium
FKGPPSWNVGYKSIRSSNT

SEQ ID NO: 1044796 - protein, 24 aa, Mycobacterium
FKGRNVEIPDHFRTYVSQKLSRLE

SEQ ID NO: 1044797 - protein, 20 aa, Mycobacterium
FKGVKGYEAYAAREASATAV

SEQ ID NO: 1044798 - protein, 23 aa, Mycobacterium
FKHLHKAGLRRVFVGLETGSYDQ

SEQ ID NO: 1044799 - protein, 21 aa, Mycobacterium
FKHVAEMFAELEATALRSYPR

SEQ ID NO: 1044800 - protein, 18 aa, Mycobacterium
FKITNRLDLLLAHAVVRG

SEQ ID NO: 1044801 - protein, 29 aa, Mycobacterium
FKLAKDDGVEFVDVRFCDLPGVMQHFTIP

SEQ ID NO: 1044802 - protein, 17 aa, Mycobacterium
FKLGVGQVIQGWDQGVQ

SEQ ID NO: 1044803 - protein, 28 aa, Mycobacterium
FKPLYGSSLVTGWARLHGYPVGILANAR

SEQ ID NO: 1044804 - protein, 17 aa, Mycobacterium
FKQKSAYLFGATHGAGS

SEQ ID NO: 1044805 - protein, 22 aa, Mycobacterium
FKRFSNITFEDWQRVIDVNLNG

SEQ ID NO: 1044806 - protein, 18 aa, Mycobacterium
FKRGLKMFLSPDGHAVRF

SEQ ID NO: 1044807 - protein, 21 aa, Mycobacterium
FKSKHKYYYCGDQVTAEPEYV

SEQ ID NO: 1044808 - protein, 18 aa, Mycobacterium
FKTIQPWLTDGIAHVPFW

SEQ ID NO: 1044809 - protein, 18 aa, Mycobacterium
FKTYHPFDGDGMLHVVGF

SEQ ID NO: 1044810 - protein, 25 aa, Mycobacterium
FKVDFAIEGAVPWTNPQARRAGTVH

SEQ ID NO: 1044811 - protein, 21 aa, Mycobacterium
FKVDFAIEGDIPWTNPDCRRA

SEQ ID NO: 1044812 - protein, 20 aa, Mycobacterium
FKVHLDAFNLLPYLTGEVEE

SEQ ID NO: 1044813 - protein, 17 aa, Mycobacterium
FKVIVDRPRYINLVMCC

SEQ ID NO: 1044814 - protein, 19 aa, Mycobacterium
FKVPEQIGIWDVLPTNDAG

SEQ ID NO: 1044815 - protein, 17 aa, Mycobacterium
FLAEAGFSLHDVIADGK

SEQ ID NO: 1044816 - protein, 17 aa, Mycobacterium
FLAEAGFSLHDVLANGT

SEQ ID NO: 1044817 - protein, 25 aa, Mycobacterium
FLAGGKRFRPLFTVLSAQVGPNPGA

SEQ ID NO: 1044818 - protein, 25 aa, Mycobacterium
FLAHLPGYQGWQWAAVVASYVGADR

SEQ ID NO: 1044819 - protein, 19 aa, Mycobacterium
FLAIAGRRVQLEIFNKFNI

SEQ ID NO: 1044820 - protein, 26 aa, Mycobacterium
FLAPLPLAAITPRWVARRLVGMAAGG

SEQ ID NO: 1044821 - protein, 18 aa, Mycobacterium
FLATRIGGQWGGAFGTMP

SEQ ID NO: 1044822 - protein, 21 aa, Mycobacterium
FLCAFKDIIDRSAAAGDPCGV

SEQ ID NO: 1044823 - protein, 20 aa, Mycobacterium
FLDIIHNFIVFDAGVKKTCR

SEQ ID NO: 1044824 - protein, 17 aa, Mycobacterium
FLDRNLIGHIPLIGGGL

SEQ ID NO: 1044825 - protein, 18 aa, Mycobacterium
FLEGCGRTDFPGGDSDEI

SEQ ID NO: 1044826 - protein, 30 aa, Mycobacterium; identical to SEQ ID NO: 659895

SEQ ID NO: 1044827 - protein, 18 aa, Mycobacterium
FLELAAIRTKAVRQGDPL

SEQ ID NO: 1044828 - protein, 24 aa, Mycobacterium
FLETVPIAPIWLCPLRLRDSDGWP

SEQ ID NO: 1044829 - protein, 25 aa, Mycobacterium
FLEYDRELFKAATAERLAAELVATI

SEQ ID NO: 1044830 - protein, 24 aa, Mycobacterium
FLGRFPLELINPFPRPSDAEEART

SEQ ID NO: 1044831 - protein, 23 aa, Mycobacterium
FLHADRLYSGRIVDEIDRDTVWA

SEQ ID NO: 1044832 - protein, 17 aa, Mycobacterium
FLHDFAGIGARWTPANI

SEQ ID NO: 1044833 - protein, 23 aa, Mycobacterium
FLHRVRSRVGAVVVGDWTPRFAA

SEQ ID NO: 1044834 - protein, 19 aa, Mycobacterium
FLIKRTRTIPVDRGAGAGA

SEQ ID NO: 1044835 - protein, 18 aa, Mycobacterium
FLIMPKLIPALIAGCTVS

SEQ ID NO: 1044836 - protein, 18 aa, Mycobacterium
FLKRVRKVVDDEFPGRLL

SEQ ID NO: 1044837 - protein, 18 aa, Mycobacterium
FLLGRPLIGNGADGTAAN

SEQ ID NO: 1044838 - protein, 20 aa, Mycobacterium
FLLNTGRLAHQWHTLTKTGK

SEQ ID NO: 1044839 - protein, 22 aa, Mycobacterium
FLLPSNMVTPFLGMLDTAAVAD

SEQ ID NO: 1044840 - protein, 18 aa, Mycobacterium
FLLQRPLLTAIRRTEPTV

SEQ ID NO: 1044841 - protein, 24 aa, Mycobacterium
FLMSVGDLVIAWLLQRQAAVAVAA

SEQ ID NO: 1044842 - protein, 18 aa, Mycobacterium
FLNHHWAFDAARTTEEDR

SEQ ID NO: 1044843 - protein, 25 aa, Mycobacterium
FLPELGLRRENIVFISGIGCSSRFP

SEQ ID NO: 1044844 - protein, 18 aa, Mycobacterium
FLPFPFDSVIVGGPSMAY

SEQ ID NO: 1044845 - protein, 27 aa, Mycobacterium
FLPLLRRAAGRIVVIASIGDRFTPPFG

SEQ ID NO: 1044846 - protein, 20 aa, Mycobacterium
FLQRPARWLQMLATSSHAFS

SEQ ID NO: 1044847 - protein, 19 aa, Mycobacterium
FLQRPARWMQLLASNCQVF

SEQ ID NO: 1044848 - protein, 19 aa, Mycobacterium
FLQRVWRLVIDENTGEILV

SEQ ID NO: 1044849 - protein, 22 aa, Mycobacterium
FLRASDIARAITFVAETPRGGF

SEQ ID NO: 1044850 - protein, 17 aa, Mycobacterium
FLRHFDSKLGRGPAISA

SEQ ID NO: 1044851 - protein, 20 aa, Mycobacterium
FLRWGQGAFDDFKVVPPGTG

SEQ ID NO: 1044852 - protein, 18 aa, Mycobacterium
FLSGQLWESAGSPEVDPD

SEQ ID NO: 1044853 - protein, 17 aa, Mycobacterium
FLSTWDWADYLHRFRRF

SEQ ID NO: 1044854 - protein, 18 aa, Mycobacterium
FLTDRMIFDSQLTKEVCN

SEQ ID NO: 1044855 - protein, 21 aa, Mycobacterium
FLTEFPGLRLIGLDRDPSALD

SEQ ID NO: 1044856 - protein, 24 aa, Mycobacterium
FLTVARKFWDSWAPGAVLADIENG

SEQ ID NO: 1044857 - protein, 18 aa, Mycobacterium
FLVHAAMALVVDLGRMVD

SEQ ID NO: 1044858 - protein, 24 aa, Mycobacterium
FLVSLAFLAFSGWRSRLGCRTGGV

SEQ ID NO: 1044859 - protein, 17 aa, Mycobacterium
FMADQDLDLIITSGGLG

SEQ ID NO: 1044860 - protein, 21 aa, Mycobacterium
FMAVCRKWDVLATVIGEVTEG

SEQ ID NO: 1044861 - protein, 28 aa, Mycobacterium
FMEVAKLRAGRLLWSELVAKFEPKNSKS

SEQ ID NO: 1044862 - protein, 18 aa, Mycobacterium
FMRLWWGGVNQLRSELIP

SEQ ID NO: 1044863 - protein, 27 aa, Mycobacterium
FMSSTARLKCPFTSLGVAPEAASSYLL

SEQ ID NO: 1044864 - protein, 17 aa, Mycobacterium
FMVVGGLIDAPAVVLDG

SEQ ID NO: 1044865 - protein, 29 aa, Mycobacterium
FNAFPASYWRRWSICKSVVLRVELSGAGR

SEQ ID NO: 1044866 - protein, 25 aa, Mycobacterium
FNALIEVGQALAANLVGGFSLPTLA

SEQ ID NO: 1044867 - protein, 17 aa, Mycobacterium
FNAVFRGDYAPVVIREG

SEQ ID NO: 1044868 - protein, 24 aa, Mycobacterium
FNCLAPGMWPAWWLSNDDPGRSGE

SEQ ID NO: 1044869 - protein, 25 aa, Mycobacterium
FNDYRIIACACSRVQASVSMPHRKM

SEQ ID NO: 1044870 - protein, 17 aa, Mycobacterium
FNLIDRWWQAPASGLAA

SEQ ID NO: 1044871 - protein, 18 aa, Mycobacterium
FNLQWKPLGGFPVTAGWF

SEQ ID NO: 1044872 - protein, 24 aa, Mycobacterium
FNNELGHPWTVLRATRSTDYLILE

SEQ ID NO: 1044873 - protein, 20 aa, Mycobacterium
FNPPFSVPISPRLRDAAAAL

SEQ ID NO: 1044874 - protein, 24 aa, Mycobacterium
FNQLWVCGLPGYGPGDLIDFEFSG

SEQ ID NO: 1044875 - protein, 18 aa, Mycobacterium
FNRAHAGQVMPYFGQEFL

SEQ ID NO: 1044876 - protein, 25 aa, Mycobacterium
FNSRLRKECLNRNYWTDLLEAKVVI

SEQ ID NO: 1044877 - protein, 17 aa, Mycobacterium
FNSVLALELHNDKPMSP

SEQ ID NO: 1044878 - protein, 19 aa, Mycobacterium
FNYAVVVEFCERLTQLLPD

SEQ ID NO: 1044879 - protein, 18 aa, Mycobacterium
FPAAVSWQRTSDEMRQDL

SEQ ID NO: 1044880 - protein, 25 aa, Mycobacterium
FPADYAGKWVIFFSHPADFTPVCTS

SEQ ID NO: 1044881 - protein, 18 aa, Mycobacterium
FPAPIFVIVLKGLTIRGS

SEQ ID NO: 1044882 - protein, 17 aa, Mycobacterium
FPAPQLSTSDGRGPVLV

SEQ ID NO: 1044883 - protein, 32 aa, Mycobacterium
FPATARLTGRWLRGRLPTAYDWTRGLPWVDKK

SEQ ID NO: 1044884 - protein, 17 aa, Mycobacterium
FPAVFTLLRRPRSIKTL

SEQ ID NO: 1044885 - protein, 30 aa, Mycobacterium
FPDLKICLSEGRIGWVAGLLDRLDHMLSYH

SEQ ID NO: 1044886 - protein, 26 aa, Mycobacterium
FPDQMLAYNCSPSFNWKKHLDDETIA

SEQ ID NO: 1044887 - protein, 20 aa, Mycobacterium
FPDVRAAGAGSRRDTRVLRG

SEQ ID NO: 1044888 - protein, 18 aa, Mycobacterium
FPEEFARTQASAFRSGTD

SEQ ID NO: 1044889 - protein, 21 aa, Mycobacterium
FPEGTFPAIVAVLTNVFDGAA

SEQ ID NO: 1044890 - protein, 21 aa, Mycobacterium
FPELVIVCGHVGYPWTEEMVA

SEQ ID NO: 1044891 - protein, 23 aa, Mycobacterium
FPESYNRRALMRFVTSVKSGSDY

SEQ ID NO: 1044892 - protein, 26 aa, Mycobacterium
FPFLAPEDWNLPTGRFAGATTPDAFR

SEQ ID NO: 1044893 - protein, 17 aa, Mycobacterium
FPGGVLGVALNLDEHSV

SEQ ID NO: 1044894 - protein, 18 aa, Mycobacterium
FPGLSLPSMGLDFYGSTP

SEQ ID NO: 1044895 - protein, 19 aa, Mycobacterium
FPGRLLLAEANQWPADVVE

SEQ ID NO: 1044896 - protein, 17 aa, Mycobacterium
FPGTGFLELVIRAGDVV

SEQ ID NO: 1044897 - protein, 17 aa, Mycobacterium
FPGVISEPVVPPVKASA

SEQ ID NO: 1044898 - protein, 17 aa, Mycobacterium
FPGVQWLPYEARVQISM

SEQ ID NO: 1044899 - protein, 24 aa, Mycobacterium
FPHHCAYGAAKWALRGLTQTAAAE

SEQ ID NO: 1044900 - protein, 18 aa, Mycobacterium
FPHMRFPSDWTAYDQDND

SEQ ID NO: 1044901 - protein, 33 aa, Mycobacterium; identical to SEQ ID NO: 660486

SEQ ID NO: 1044902 - protein, 23 aa, Mycobacterium
FPLACPPSAPAEHVASFIETNLS

SEQ ID NO: 1044903 - protein, 17 aa, Mycobacterium
FPLMPRIFMAVRRESRF

SEQ ID NO: 1044904 - protein, 24 aa, Mycobacterium
FPLPRELVGQGTLFLLKVVGESMV

SEQ ID NO: 1044905 - protein, 17 aa, Mycobacterium
FPLRDRVAAMVPDVPVR

SEQ ID NO: 1044906 - protein, 21 aa, Mycobacterium
FPLWQAGRFAAPALMAGNVGL

SEQ ID NO: 1044907 - protein, 20 aa, Mycobacterium
FPPAGTLTGIAKRELRGVPT

SEQ ID NO: 1044908 - protein, 17 aa, Mycobacterium
FPPERITLHGNNKSVAE

SEQ ID NO: 1044909 - protein, 19 aa, Mycobacterium
FPQQPALELDGWAVARPLP

SEQ ID NO: 1044910 - protein, 17 aa, Mycobacterium
FPQVCSRPAQSLPGGGA

SEQ ID NO: 1044911 - protein, 19 aa, Mycobacterium
FPRDLRIIDTIEIGSSVRD

SEQ ID NO: 1044912 - protein, 22 aa, Mycobacterium
FPRLRAGVACGRAVSRAGDWFG

SEQ ID NO: 1044913 - protein, 22 aa, Mycobacterium
FPRTDGCRIVLCSSARATIGGR

SEQ ID NO: 1044914 - protein, 20 aa, Mycobacterium
FPSINWAPIEWSNIKDQEEE

SEQ ID NO: 1044915 - protein, 20 aa, Mycobacterium
FPTDRGWDGASLFDPDPDAV

SEQ ID NO: 1044916 - protein, 24 aa, Mycobacterium
FPTIIDMWLPLSWSLNMVNRSMGH

SEQ ID NO: 1044917 - protein, 18 aa, Mycobacterium
FPTLIDLYLQGRLPLDKF

SEQ ID NO: 1044918 - protein, 18 aa, Mycobacterium
FPTPEMERRILLSRVPEL

SEQ ID NO: 1044919 - protein, 19 aa, Mycobacterium
FPTTLNSLLIIALSPVLQP

SEQ ID NO: 1044920 - protein, 17 aa, Mycobacterium
FPVFAGRKDTVVKVAGK

SEQ ID NO: 1044921 - protein, 17 aa, Mycobacterium
FPVWTERGGPATIVPMF

SEQ ID NO: 1044922 - protein, 24 aa, Mycobacterium
FQAEARQLLDLMIHSVYSNKDSFL

SEQ ID NO: 1044923 - protein, 19 aa, Mycobacterium
FQALLGFRSLFSGDPLQDT

SEQ ID NO: 1044924 - protein, 19 aa, Mycobacterium
FQALTDRPLIGNGVAGAPG

SEQ ID NO: 1044925 - protein, 19 aa, Mycobacterium
FQDAISWGRAERAGGELSA

SEQ ID NO: 1044926 - protein, 19 aa, Mycobacterium
FQDGVDGAGGAGGQGGIGG

SEQ ID NO: 1044927 - protein, 25 aa, Mycobacterium
FQDKALEGFTMFALNQGEVCTCPSR

SEQ ID NO: 1044928 - protein, 31 aa, Mycobacterium
FQEFAGLPVRRVWRPTTFYTMVLQQLTDHRT

SEQ ID NO: 1044929 - protein, 20 aa, Mycobacterium
FQGLCANGFPNCFIESIAQA

SEQ ID NO: 1044930 - protein, 20 aa, Mycobacterium
FQLGSMWYISLDYINHQTSL

SEQ ID NO: 1044931 - protein, 18 aa, Mycobacterium
FQLLRPVKGEDRYFVVTH

SEQ ID NO: 1044932 - protein, 21 aa, Mycobacterium
FQMMGLCQILRDGVIPPNRSL

SEQ ID NO: 1044933 - protein, 25 aa, Mycobacterium
FQPESKTLYLARWLNRGQRAFQLAT

SEQ ID NO: 1044934 - protein, 17 aa, Mycobacterium
FQQMFWRGGPTPTADFN

SEQ ID NO: 1044935 - protein, 17 aa, Mycobacterium
FQRLVELHERIQVDGRF

SEQ ID NO: 1044936 - protein, 18 aa, Mycobacterium
FQSGICRHSNGGPPQCRR

SEQ ID NO: 1044937 - protein, 17 aa, Mycobacterium
FQSLVVHDATGDPVRIL

SEQ ID NO: 1044938 - protein, 19 aa, Mycobacterium
FQSRRGLARHYALRLTDSI

SEQ ID NO: 1044939 - protein, 20 aa, Mycobacterium
FQVLCEAGLLPGALIRNVGL

SEQ ID NO: 1044940 - protein, 17 aa, Mycobacterium
FQVLPWVTDAGHHHSAR

SEQ ID NO: 1044941 - protein, 25 aa, Mycobacterium
FRALSACNRLVCLLSDIGPELLKNQ

SEQ ID NO: 1044942 - protein, 17 aa, Mycobacterium
FRDARDIADGEIIMAYG

SEQ ID NO: 1044943 - protein, 17 aa, Mycobacterium
FRDLTRLSAAGIPTIAL

SEQ ID NO: 1044944 - protein, 19 aa, Mycobacterium
FRESAARALLLPRRHPGRR

SEQ ID NO: 1044945 - protein, 21 aa, Mycobacterium
FRFDLAATLARELHDVDRLSA

SEQ ID NO: 1044946 - protein, 21 aa, Mycobacterium
FRFGCVCGGASLYAPQAQNNL

SEQ ID NO: 1044947 - protein, 33 aa, Mycobacterium; identical to SEQ ID NO: 660833

SEQ ID NO: 1044948 - protein, 17 aa, Mycobacterium
FRGERLVNSMFTLSTLV

SEQ ID NO: 1044949 - protein, 18 aa, Mycobacterium
FRGGEPAGLLGGPLDGGP

SEQ ID NO: 1044950 - protein, 17 aa, Mycobacterium
FRGIVGLAVTGSGAARA

SEQ ID NO: 1044951 - protein, 20 aa, Mycobacterium
FRIGGHSLAALRVIMRVRER

SEQ ID NO: 1044952 - protein, 21 aa, Mycobacterium
FRLDWSSPHDVGRKAIAQNAA

SEQ ID NO: 1044953 - protein, 17 aa, Mycobacterium
FRLPPYRRYTLRTYFRP

SEQ ID NO: 1044954 - protein, 26 aa, Mycobacterium
FRNARELREAVPLIPLDQLLVETDAP

SEQ ID NO: 1044955 - protein, 26 aa, Mycobacterium
FRNLLCELDRATAMGIFTERLNALCA

SEQ ID NO: 1044956 - protein, 18 aa, Mycobacterium
FRNRGRHLITGSRQHPHR

SEQ ID NO: 1044957 - protein, 19 aa, Mycobacterium
FRPDLRVPLITIITETDLF

SEQ ID NO: 1044958 - protein, 20 aa, Mycobacterium
FRPGTCERLGIGPDDCAAGN

SEQ ID NO: 1044959 - protein, 27 aa, Mycobacterium
FRPGTLEKWDLGYDVLRERNPGIILVR

SEQ ID NO: 1044960 - protein, 17 aa, Mycobacterium
FRPMKLIGRDGVEIDEL

SEQ ID NO: 1044961 - protein, 20 aa, Mycobacterium
FRQFEEWDVRIVPRDLLAPL

SEQ ID NO: 1044962 - protein, 17 aa, Mycobacterium
FRRFGMDIIAASVRHAQ

SEQ ID NO: 1044963 - protein, 17 aa, Mycobacterium
FRRLMRADIFGAHSSII

SEQ ID NO: 1044964 - protein, 18 aa, Mycobacterium
FRRSHLEALTTQRTLARL

SEQ ID NO: 1044965 - protein, 17 aa, Mycobacterium
FRSEKNTNWEGALRIPE

SEQ ID NO: 1044966 - protein, 17 aa, Mycobacterium
FRSLVGVVAVMADKDVN

SEQ ID NO: 1044967 - protein, 25 aa, Mycobacterium
FRSVIPYLAGQAWLTMDFLGFGLSD

SEQ ID NO: 1044968 - protein, 17 aa, Mycobacterium
FRSWMAVLELDSSLHGQ

SEQ ID NO: 1044969 - protein, 20 aa, Mycobacterium
FRTAEGTKLFLAVTSSPVAF

SEQ ID NO: 1044970 - protein, 19 aa, Mycobacterium
FRTLCREFGSTRGNLLRPA

SEQ ID NO: 1044971 - protein, 30 aa, Mycobacterium
FRVAIGLTETHTWWRVDWNTLQDATVPIAL

SEQ ID NO: 1044972 - protein, 19 aa, Mycobacterium
FRVGVLPTLRAVRAIAGYS

SEQ ID NO: 1044973 - protein, 18 aa, Mycobacterium
FRVLRPGGRLHLVDVGGD

SEQ ID NO: 1044974 - protein, 27 aa, Mycobacterium
FRVPCLPSDRLLNLLIYIKGYLDGTLT

SEQ ID NO: 1044975 - protein, 20 aa, Mycobacterium
FRVQIYALIVMIWTSAAAND

SEQ ID NO: 1044976 - protein, 19 aa, Mycobacterium
FRVVAGRITEVWNCGYQQG

SEQ ID NO: 1044977 - protein, 19 aa, Mycobacterium
FRYGLKASLNGYLGAHPRA

SEQ ID NO: 1044978 - protein, 17 aa, Mycobacterium
FRYNTIITEETSAGRYS

SEQ ID NO: 1044979 - protein, 18 aa, Mycobacterium
FRYQDRIFTVPVVSLPIV

SEQ ID NO: 1044980 - protein, 20 aa, Mycobacterium
FSAAQAWNGLAAELRLAASS

SEQ ID NO: 1044981 - protein, 29 aa, Mycobacterium
FSAVRYGFVPRRFRLLLVAVGARKLAEPE

SEQ ID NO: 1044982 - protein, 25 aa, Mycobacterium
FSDPTGPCLEGWTTLTALAQATTRL

SEQ ID NO: 1044983 - protein, 25 aa, Mycobacterium
FSDQPRAPIPLSLNGTGRVGRPGTE

SEQ ID NO: 1044984 - protein, 20 aa, Mycobacterium
FSDVLKAMGVYPGLDGAAPV

SEQ ID NO: 1044985 - protein, 17 aa, Mycobacterium
FSEAPLVLMEFVDGLVV

SEQ ID NO: 1044986 - protein, 22 aa, Mycobacterium
FSEAYKVAALDVMNKVRALNQF

SEQ ID NO: 1044987 - protein, 18 aa, Mycobacterium
FSECGAGLVVDEVDADLM

SEQ ID NO: 1044988 - protein, 23 aa, Mycobacterium
FSEDPRRGAAILNRPDLVILRGR

SEQ ID NO: 1044989 - protein, 17 aa, Mycobacterium
FSEGELFIIGRIKDLLI

SEQ ID NO: 1044990 - protein, 18 aa, Mycobacterium
FSEGGGMLVVERLSDAQR

SEQ ID NO: 1044991 - protein, 19 aa, Mycobacterium
FSEHAQSYQALSAQMAAFH

SEQ ID NO: 1044992 - protein, 24 aa, Mycobacterium
FSEPCTDCRGSGSIIEHPCDECKG

SEQ ID NO: 1044993 - protein, 19 aa, Mycobacterium
FSESFSYSSAAEVFEEIKR

SEQ ID NO: 1044994 - protein, 17 aa, Mycobacterium
FSGKAQIGKGMWAMTEL

SEQ ID NO: 1044995 - protein, 18 aa, Mycobacterium
FSGKILAPAHLPQEQSQR

SEQ ID NO: 1044996 - protein, 20 aa, Mycobacterium
FSGWRSTRQRVWGQMDDGRC

SEQ ID NO: 1044997 - protein, 17 aa, Mycobacterium
FSHPETPEYIAPGETSG

SEQ ID NO: 1044998 - protein, 20 aa, Mycobacterium
FSHPQSQYFVVGRMAQDQVA

SEQ ID NO: 1044999 - protein, 17 aa, Mycobacterium
FSHVPWLSSQLLGAVEA

SEQ ID NO: 1045000 - protein, 20 aa, Mycobacterium
FSIAALRAEPVDRYGVGTSL

SEQ ID NO: 1045001 - protein, 27 aa, Mycobacterium
FSIEPGIYFPGRWGARIEDIVVVTENG

SEQ ID NO: 1045002 - protein, 31 aa, Mycobacterium
FSISATLWSCIPRSWCLRRYSELFCKTRVVT

SEQ ID NO: 1045003 - protein, 21 aa, Mycobacterium
FSLAEICRGLGISRATGHAIL

SEQ ID NO: 1045004 - protein, 23 aa, Mycobacterium
FSLEAPEGMRFLSRGRVFTGEEQ

SEQ ID NO: 1045005 - protein, 25 aa, Mycobacterium
FSLGDSRFPPAPAHSASRTTASVGS

SEQ ID NO: 1045006 - protein, 17 aa, Mycobacterium
FSNTRPAARRYFNTDAE

SEQ ID NO: 1045007 - protein, 27 aa, Mycobacterium
FSPDGCGKLLRYGAEFETLRDRSDAYL

SEQ ID NO: 1045008 - protein, 32 aa, Mycobacterium; identical to SEQ ID NO: 661264

SEQ ID NO: 1045009 - protein, 20 aa, Mycobacterium
FSPLRHWNAGPGKRIAVIGL

SEQ ID NO: 1045010 - protein, 20 aa, Mycobacterium
FSQGLSNFWSATTASVNQFI

SEQ ID NO: 1045011 - protein, 26 aa, Mycobacterium
FSRCSDCGRIYWAGSHHARLAGLVQA

SEQ ID NO: 1045012 - protein, 21 aa, Mycobacterium
FSRFRRAVTDTGLYKDSDRLA

SEQ ID NO: 1045013 - protein, 17 aa, Mycobacterium
FSRISDVLLPFLVTRQL

SEQ ID NO: 1045014 - protein, 31 aa, Mycobacterium; identical to SEQ ID NO: 661321

SEQ ID NO: 1045015 - protein, 23 aa, Mycobacterium
FSSGMAAADCALRAMLRPGDHVV

SEQ ID NO: 1045016 - protein, 24 aa, Mycobacterium
FSSKLELYLAVLNRHVDKLVAGVQ

SEQ ID NO: 1045017 - protein, 19 aa, Mycobacterium
FSSQLDVILAHVSQIQAVD

SEQ ID NO: 1045018 - protein, 25 aa, Mycobacterium
FSSVTAGLASGAWQGPASAAMSAVA

SEQ ID NO: 1045019 - protein, 18 aa, Mycobacterium
FSTARLVTLVGVGGVGKT

SEQ ID NO: 1045020 - protein, 17 aa, Mycobacterium
FSTGVAALRAITQTGTG

SEQ ID NO: 1045021 - protein, 30 aa, Mycobacterium; identical to SEQ ID NO: 661359

SEQ ID NO: 1045022 - protein, 17 aa, Mycobacterium
FSTRRLVDCIKQGSTDF

SEQ ID NO: 1045023 - protein, 21 aa, Mycobacterium
FSVARRLALLLTFKRCLPAIG

SEQ ID NO: 1045024 - protein, 24 aa, Mycobacterium
FSVARRLALLLTFKRCLPAIGPSA

SEQ ID NO: 1045025 - protein, 20 aa, Mycobacterium
FSVDFYDKFGYDRPVYTLSH

SEQ ID NO: 1045026 - protein, 23 aa, Mycobacterium
FSVLRAERPVSWHPPVEDALIQD

SEQ ID NO: 1045027 - protein, 17 aa, Mycobacterium
FSVPHGRANGIFLPHVL

SEQ ID NO: 1045028 - protein, 18 aa, Mycobacterium
FSVVAFTAHGPFVLAQWA

SEQ ID NO: 1045029 - protein, 26 aa, Mycobacterium
FTAAAKAFESWRWFTPSERQRALLRL

SEQ ID NO: 1045030 - protein, 17 aa, Mycobacterium
FTAEAIWEMPPYAGWYQ

SEQ ID NO: 1045031 - protein, 20 aa, Mycobacterium
FTAFCGHRFDVRQANCSVSS

SEQ ID NO: 1045032 - protein, 18 aa, Mycobacterium
FTAGDAGYEFALESISKI

SEQ ID NO: 1045033 - protein, 21 aa, Mycobacterium
FTAQLLPRPIGLIIGLQLSAN

SEQ ID NO: 1045034 - protein, 22 aa, Mycobacterium
FTAVRCKVSLAGDADEATLNEI

SEQ ID NO: 1045035 - protein, 24 aa, Mycobacterium
FTDAARADWLWRVVGESGHVAVLS

SEQ ID NO: 1045036 - protein, 25 aa, Mycobacterium
FTDDGTALWGFLEYDVELFSQSTAG

SEQ ID NO: 1045037 - protein, 17 aa, Mycobacterium
FTDGWFRTGDLGAIDDD

SEQ ID NO: 1045038 - protein, 26 aa, Mycobacterium
FTEILPTPFLPAGVFDLWGLAADDPR

SEQ ID NO: 1045039 - protein, 17 aa, Mycobacterium
FTETGAIKAKSVIIAAG

SEQ ID NO: 1045040 - protein, 27 aa, Mycobacterium
FTGLAPRDLCALWPVPATSVPHAASPA

SEQ ID NO: 1045041 - protein, 17 aa, Mycobacterium
FTGLEIRADRIVLSPHW

SEQ ID NO: 1045042 - protein, 17 aa, Mycobacterium
FTHIAVPVMTRLKQPER

SEQ ID NO: 1045043 - protein, 19 aa, Mycobacterium
FTHLLGYALVQAVKKFPNM

SEQ ID NO: 1045044 - protein, 19 aa, Mycobacterium
FTHTVLLRLPSGIDRSSIE

SEQ ID NO: 1045045 - protein, 21 aa, Mycobacterium
FTKKLWSAAGLPIGPHAVLRP

SEQ ID NO: 1045046 - protein, 21 aa, Mycobacterium
FTKQRVAGFAGHMSEAANHIL

SEQ ID NO: 1045047 - protein, 18 aa, Mycobacterium
FTLFGHPDVRSLNGGRNL

SEQ ID NO: 1045048 - protein, 20 aa, Mycobacterium
FTPEGLYPVTGVKNLTFDTS

SEQ ID NO: 1045049 - protein, 26 aa, Mycobacterium
FTPPAPRYKTGVLAKYVKLVGSAAIG

SEQ ID NO: 1045050 - protein, 17 aa, Mycobacterium
FTPSPSLGIPALRQLAA

SEQ ID NO: 1045051 - protein, 19 aa, Mycobacterium
FTQFVDWIRCAAGSCVLSG

SEQ ID NO: 1045052 - protein, 19 aa, Mycobacterium
FTQGIPTTAGMAIHRDFRP

SEQ ID NO: 1045053 - protein, 19 aa, Mycobacterium
FTQGRALAELEFDGPAEIP

SEQ ID NO: 1045054 - protein, 21 aa, Mycobacterium
FTRAALPGMVERGAGAVLNIA

SEQ ID NO: 1045055 - protein, 26 aa, Mycobacterium
FTRDSSIWIGPRFVIPSLAMRARVRE

SEQ ID NO: 1045056 - protein, 17 aa, Mycobacterium
FTRHDFDGPVSFVDFTI

SEQ ID NO: 1045057 - protein, 30 aa, Mycobacterium; identical to SEQ ID NO: 661605

SEQ ID NO: 1045058 - protein, 25 aa, Mycobacterium
FTSDIKNLLPLFAVFKPTVVVSVPR

SEQ ID NO: 1045059 - protein, 20 aa, Mycobacterium
FTSDPVFRQRYWARNHVGWR

SEQ ID NO: 1045060 - protein, 30 aa, Mycobacterium; identical to SEQ ID NO: 199394

SEQ ID NO: 1045061 - protein, 18 aa, Mycobacterium
FTSRWPHEPVDFTGETGR

SEQ ID NO: 1045062 - protein, 20 aa, Mycobacterium
FTSSKVMCWVALDRGAKLAE

SEQ ID NO: 1045063 - protein, 20 aa, Mycobacterium
FTTHLVHRFQFLTKTIAAQC

SEQ ID NO: 1045064 - protein, 25 aa, Mycobacterium
FTTISMYPRMWVASGVDYPTLLATM

SEQ ID NO: 1045065 - protein, 20 aa, Mycobacterium
FTTLRMIYQEMLANYHVGQT

SEQ ID NO: 1045066 - protein, 17 aa, Mycobacterium
FTTQVLFTPEQLWPFTC

SEQ ID NO: 1045067 - protein, 18 aa, Mycobacterium
FTTTWPLVTGTAMSQTES

SEQ ID NO: 1045068 - protein, 20 aa, Mycobacterium
FTTVIWRKLVLNALAGLMAL

SEQ ID NO: 1045069 - protein, 18 aa, Mycobacterium
FTVADAYQGKGIGSFLVG

SEQ ID NO: 1045070 - protein, 23 aa, Mycobacterium
FTVAEPGWTMFMVSHFHYDPVWW

SEQ ID NO: 1045071 - protein, 26 aa, Mycobacterium
FTVEVEVRPKIALPDFSTLKVVVDPV

SEQ ID NO: 1045072 - protein, 22 aa, Mycobacterium
FTVLDGLLAFYATIGSMQNIQS

SEQ ID NO: 1045073 - protein, 28 aa, Mycobacterium
FVAADPSCGWGWLPYRAAPERAVAAVAD

SEQ ID NO: 1045074 - protein, 17 aa, Mycobacterium
FVAARPAVQLHWTGDDD

SEQ ID NO: 1045075 - protein, 17 aa, Mycobacterium
FVAEMKAAGLSRLLEAK

SEQ ID NO: 1045076 - protein, 19 aa, Mycobacterium
FVAEWTMTAEDRWLQFSSV

SEQ ID NO: 1045077 - protein, 28 aa, Mycobacterium
FVASEANVIWKLRYTMRSQIFSRGLPLP

SEQ ID NO: 1045078 - protein, 26 aa, Mycobacterium
FVDAAEGLGGWFRLGRIANQQKAWVH

SEQ ID NO: 1045079 - protein, 17 aa, Mycobacterium
FVDMALAVGDYVGDYVG

SEQ ID NO: 1045080 - protein, 19 aa, Mycobacterium
FVEFASGLSAAEWGTPSLC

SEQ ID NO: 1045081 - protein, 18 aa, Mycobacterium
FVGELRAGLRAADCALFV

SEQ ID NO: 1045082 - protein, 17 aa, Mycobacterium
FVGFRAREIILSLFESI

SEQ ID NO: 1045083 - protein, 19 aa, Mycobacterium
FVHFQWRAQHDDLKNLPFP

SEQ ID NO: 1045084 - protein, 17 aa, Mycobacterium
FVIFLREGFPVNILNPV

SEQ ID NO: 1045085 - protein, 21 aa, Mycobacterium
FVIGASNRFAHAATLAIAEAP

SEQ ID NO: 1045086 - protein, 29 aa, Mycobacterium
FVIGHDWGAPVAWTFAWLYPQRCAGVVGI

SEQ ID NO: 1045087 - protein, 17 aa, Mycobacterium
FVILRCLDNPQAPDVEV

SEQ ID NO: 1045088 - protein, 23 aa, Mycobacterium
FVILRPAPSGTRLLLSDATAALD

SEQ ID NO: 1045089 - protein, 17 aa, Mycobacterium
FVLALPPGHPMADRHGV

SEQ ID NO: 1045090 - protein, 31 aa, Mycobacterium; identical to SEQ ID NO: 661822

SEQ ID NO: 1045091 - protein, 25 aa, Mycobacterium
FVMPTTCPECGTPLAPEKEGDADIR

SEQ ID NO: 1045092 - protein, 23 aa, Mycobacterium
FVMPTTCPECGTTLAPEKEGDAD

SEQ ID NO: 1045093 - protein, 25 aa, Mycobacterium
FVNVYRVVSNLGVFDFGGPEQTMRA

SEQ ID NO: 1045094 - protein, 25 aa, Mycobacterium
FVPAFSGLFAPYWRSDARGAIVGLS

SEQ ID NO: 1045095 - protein, 19 aa, Mycobacterium
FVPGVGRIAGPTIGVLGQN

SEQ ID NO: 1045096 - protein, 18 aa, Mycobacterium
FVPPKFAKDAIIEAIDAE

SEQ ID NO: 1045097 - protein, 26 aa, Mycobacterium
FVQDPLRWLRCLTQYRGTNSGAPNFA

SEQ ID NO: 1045098 - protein, 22 aa, Mycobacterium
FVRGEGAGVVVLKRLTDALRDQ

SEQ ID NO: 1045099 - protein, 21 aa, Mycobacterium
FVRGEGAGVVVLKRLTDAQQD

SEQ ID NO: 1045100 - protein, 21 aa, Mycobacterium
FVRHLPPQLVEAFRSTLEEVI

SEQ ID NO: 1045101 - protein, 30 aa, Mycobacterium
FVRSRPGLDLPDLELIFAPAPFYDEGLPAH

SEQ ID NO: 1045102 - protein, 26 aa, Mycobacterium
FVSEGKCLRSTFMYLGWLCGAGPNNA

SEQ ID NO: 1045103 - protein, 24 aa, Mycobacterium
FVSGCAALSKGFREGAVSARSAAI

SEQ ID NO: 1045104 - protein, 26 aa, Mycobacterium
FVSGPGDRPAWSMIFEDLGHRRRPAP

SEQ ID NO: 1045105 - protein, 18 aa, Mycobacterium
FVSQLGFAVAPRVRDAIE

SEQ ID NO: 1045106 - protein, 22 aa, Mycobacterium
FVSRVGAVLPQTSWGVRAAGDP

SEQ ID NO: 1045107 - protein, 18 aa, Mycobacterium
FVTIGFNTTVDFGNGAVS

SEQ ID NO: 1045108 - protein, 19 aa, Mycobacterium
FVTLCKTLGKPVNFVPVID

SEQ ID NO: 1045109 - protein, 25 aa, Mycobacterium
FVTNGSVHACPWGVGSMLTELKHVL

SEQ ID NO: 1045110 - protein, 18 aa, Mycobacterium
FVVDITMWIDLADGARSD

SEQ ID NO: 1045111 - protein, 19 aa, Mycobacterium
FVVGMSLGGLTAIRLGALA

SEQ ID NO: 1045112 - protein, 17 aa, Mycobacterium
FWAPLSLSAEQKRSIGD

SEQ ID NO: 1045113 - protein, 19 aa, Mycobacterium
FWAQDATAMYCYASTSTSF

SEQ ID NO: 1045114 - protein, 24 aa, Mycobacterium
FWDTELWMYPNLLLAHPEIARNII

SEQ ID NO: 1045115 - protein, 19 aa, Mycobacterium
FWGGAGSVACQEFITQLGR

SEQ ID NO: 1045116 - protein, 21 aa, Mycobacterium
FWLDYADGMQPYFSVPATGIE

SEQ ID NO: 1045117 - protein, 18 aa, Mycobacterium
FWLLERFAPALGSRWATE

SEQ ID NO: 1045118 - protein, 22 aa, Mycobacterium
FWLREDTELVAPWAGDVVASTG

SEQ ID NO: 1045119 - protein, 17 aa, Mycobacterium
FWMLPLDDSLPWLLVDR

SEQ ID NO: 1045120 - protein, 25 aa, Mycobacterium
FWPDFPADGLYKFRVHGADGVVSER

SEQ ID NO: 1045121 - protein, 20 aa, Mycobacterium
FWRHQLQGLIPCLFPATRSG

SEQ ID NO: 1045122 - protein, 21 aa, Mycobacterium
FWSELPEVFAALDADRDVRAI

SEQ ID NO: 1045123 - protein, 19 aa, Mycobacterium
FWTGTRRTLDTAGRVEKFY

SEQ ID NO: 1045124 - protein, 28 aa, Mycobacterium
FYAEVAPRLGGPIAPCYHAAVDAQTGAF

SEQ ID NO: 1045125 - protein, 18 aa, Mycobacterium
FYAQCAIDAGVAFVNALP

SEQ ID NO: 1045126 - protein, 18 aa, Mycobacterium
FYDSCRVLPQGDEEPTQL

SEQ ID NO: 1045127 - protein, 19 aa, Mycobacterium
FYERDGWNFDGTRRTEIIG

SEQ ID NO: 1045128 - protein, 19 aa, Mycobacterium
FYNLGLAGRAMRRIGAIEF

SEQ ID NO: 1045129 - protein, 22 aa, Mycobacterium
FYRELVGLPLFETFGDSFGSNG

SEQ ID NO: 1045130 - protein, 18 aa, Mycobacterium
FYRRVRAAAEKITSDVEM

SEQ ID NO: 1045131 - protein, 18 aa, Mycobacterium
FYWAHATFFMLVVKVAEY

SEQ ID NO: 1045132 - protein, 19 aa, Mycobacterium
GAAAAPYVAWLGATATQAE

SEQ ID NO: 1045133 - protein, 19 aa, Mycobacterium
GAAAGRGGMGMAPVGHGGH

SEQ ID NO: 1045134 - protein, 19 aa, Mycobacterium
GAAALWFALETSLPVIVDA

SEQ ID NO: 1045135 - protein, 22 aa, Mycobacterium
GAAAWSRPIGTQALFRPNFDDD

SEQ ID NO: 1045136 - protein, 33 aa, Mycobacterium
GAADFPRYPINFLADLNAFLGIQSLHGQYPSLT

SEQ ID NO: 1045137 - protein, 25 aa, Mycobacterium
GAADQCPLLAVGHAYSQWLDNSDRS

SEQ ID NO: 1045138 - protein, 22 aa, Mycobacterium
GAAEAQVGWAAWNPQRRARVLM

SEQ ID NO: 1045139 - protein, 17 aa, Mycobacterium
GAAELEALLTTVQAGPW

SEQ ID NO: 1045140 - protein, 26 aa, Mycobacterium
GAAELRARLRLAVMRRRRARKGTLEF

SEQ ID NO: 1045141 - protein, 24 aa, Mycobacterium
GAAGDLASGVGLPGGAGGHAGLFG

SEQ ID NO: 1045142 - protein, 23 aa, Mycobacterium
GAAGGEGGWFSADGGAGGSGGHG

SEQ ID NO: 1045143 - protein, 18 aa, Mycobacterium
GAAGLIVISAAPDRGSSA

SEQ ID NO: 1045144 - protein, 19 aa, Mycobacterium
GAAGLLWGTAGAGGAGGSA

SEQ ID NO: 1045145 - protein, 26 aa, Mycobacterium
GAAGSGGMFGQMGDAGDGGDAGTGGE

SEQ ID NO: 1045146 - protein, 19 aa, Mycobacterium
GAAKHARKVAGWGADAMIV

SEQ ID NO: 1045147 - protein, 17 aa, Mycobacterium
GAALAALTAAVTTESGD

SEQ ID NO: 1045148 - protein, 18 aa, Mycobacterium
GAALGRLLIADALAQLSG

SEQ ID NO: 1045149 - protein, 19 aa, Mycobacterium
GAALPYKRRLFGQIVAAAV

SEQ ID NO: 1045150 - protein, 20 aa, Mycobacterium
GAALRIAFRALTLAGVHGGE

SEQ ID NO: 1045151 - protein, 17 aa, Mycobacterium
GAAPKLGVVGVLKGPLR

SEQ ID NO: 1045152 - protein, 26 aa, Mycobacterium
GAAQRAGLELLTFGGRFVEIGKADVY

SEQ ID NO: 1045153 - protein, 17 aa, Mycobacterium
GAAQVIGSGGSGGAAGT

SEQ ID NO: 1045154 - protein, 22 aa, Mycobacterium
GAARISHSLGLIGPSISVDTAC

SEQ ID NO: 1045155 - protein, 17 aa, Mycobacterium
GAARLAARSALQTHGAI

SEQ ID NO: 1045156 - protein, 19 aa, Mycobacterium
GAASEWPNYGYGNVGQGNV

SEQ ID NO: 1045157 - protein, 24 aa, Mycobacterium
GAAVHSCVFPAFRAAGRTVTTVAG

SEQ ID NO: 1045158 - protein, 19 aa, Mycobacterium
GAAVQRLAVVAGMDGGVEA

SEQ ID NO: 1045159 - protein, 22 aa, Mycobacterium
GAAVSPRRGGNCNPAPSTLLLA

SEQ ID NO: 1045160 - protein, 21 aa, Mycobacterium
GACLNREMSRFIDAVRADIDL

SEQ ID NO: 1045161 - protein, 21 aa, Mycobacterium
GACNPPLAHRAIGVNRQIGTL

SEQ ID NO: 1045162 - protein, 18 aa, Mycobacterium
GACRARGLLDAIIGAAAG

SEQ ID NO: 1045163 - protein, 18 aa, Mycobacterium
GACRGGGCEFAMAFDMRY

SEQ ID NO: 1045164 - protein, 21 aa, Mycobacterium
GADAAYVCRGRVCDLPVTGTD

SEQ ID NO: 1045165 - protein, 23 aa, Mycobacterium
GADDVSQAFAALLSSHGAQYQAL

SEQ ID NO: 1045166 - protein, 27 aa, Mycobacterium
GADEISAAVAALFSGHALDYQALSTQM

SEQ ID NO: 1045167 - protein, 25 aa, Mycobacterium
GADEVSAAIAAFFGAHAQAYQALSE

SEQ ID NO: 1045168 - protein, 24 aa, Mycobacterium
GADEVSAAIAAVFSGHGQAYQVLS

SEQ ID NO: 1045169 - protein, 24 aa, Mycobacterium
GADEVSAAISFLFGAHAQAYQALS

SEQ ID NO: 1045170 - protein, 56 aa, Mycobacterium
GADEVSAAVAALFSSHARAYQALSVQAGQFHQWFTQTLSGAGLAYASAEAANVSPL

SEQ ID NO: 1045171 - protein, 30 aa, Mycobacterium
GADEVSAAVAAVFCAHAQDYQALSAEATQF

SEQ ID NO: 1045172 - protein, 25 aa, Mycobacterium
GADEVSAVIAALFAAHGQAYQTLSA

SEQ ID NO: 1045173 - protein, 26 aa, Mycobacterium
GADEVSTAIAALFGSHGQAFQALSAQ

SEQ ID NO: 1045174 - protein, 25 aa, Mycobacterium
GADEVSVAMAALFSGHGQAYQTLSA

SEQ ID NO: 1045175 - protein, 17 aa, Mycobacterium
GADFALREFECGHMVPQ

SEQ ID NO: 1045176 - protein, 24 aa, Mycobacterium
GADFRKWCGAAGFRSFEVIALAAG

SEQ ID NO: 1045177 - protein, 21 aa, Mycobacterium
GADGLGGPAFDGARGADGNPG

SEQ ID NO: 1045178 - protein, 26 aa, Mycobacterium
GADGRRWRALFDWTSQRFDMLAEDIM

SEQ ID NO: 1045179 - protein, 26 aa, Mycobacterium
GADIAVGSAERFGVPLFFGGPHAGYM

SEQ ID NO: 1045180 - protein, 19 aa, Mycobacterium
GADIVMIKPALGYLDVVAA

SEQ ID NO: 1045181 - protein, 28 aa, Mycobacterium
GADLDWRAAFAGLRARTVTLPTYSFARQ

SEQ ID NO: 1045182 - protein, 23 aa, Mycobacterium
GADPAHQGLHMWLAEFPQPRPPR

SEQ ID NO: 1045183 - protein, 26 aa, Mycobacterium
GADQDFTYRFSVPNAGTYWAHPHVGL

SEQ ID NO: 1045184 - protein, 21 aa, Mycobacterium
GADSGMLAALYVLAALGEQSR

SEQ ID NO: 1045185 - protein, 17 aa, Mycobacterium
GAEAGDFYVANKGDDTV

SEQ ID NO: 1045186 - protein, 35 aa, Mycobacterium; identical to SEQ ID NO: 662483

SEQ ID NO: 1045187 - protein, 25 aa, Mycobacterium
GAEYVYRFAPLVGIYGGTHEVFRNM

SEQ ID NO: 1045188 - protein, 17 aa, Mycobacterium
GAFHSQFIQALTGSGSA

SEQ ID NO: 1045189 - protein, 20 aa, Mycobacterium
GAGALAIRLACHHPEVPVGV

SEQ ID NO: 1045190 - protein, 17 aa, Mycobacterium
GAGALVLERLTDAQRLG

SEQ ID NO: 1045191 - protein, 24 aa, Mycobacterium
GAGAVGGTGGWLLGDGGAGGDGGD

SEQ ID NO: 1045192 - protein, 30 aa, Mycobacterium; identical to SEQ ID NO: 662541

SEQ ID NO: 1045193 - protein, 22 aa, Mycobacterium
GAGEAGGLLFGDGGTGAAATAT

SEQ ID NO: 1045194 - protein, 19 aa, Mycobacterium
GAGGAGMRAAVEAGPRVRT

SEQ ID NO: 1045195 - protein, 20 aa, Mycobacterium
GAGGDARLVGSGGNGGNGGF

SEQ ID NO: 1045196 - protein, 29 aa, Mycobacterium
GAGGDGGVGGRLFGSGGVGGSGGAGGVVG

SEQ ID NO: 1045197 - protein, 20 aa, Mycobacterium
GAGGHAGLFGIGGAGGEGGN

SEQ ID NO: 1045198 - protein, 19 aa, Mycobacterium
GAGGHGGINTGTRGTASAS

SEQ ID NO: 1045199 - protein, 23 aa, Mycobacterium
GAGGHGSALFGADGANGNGGAGG

SEQ ID NO: 1045200 - protein, 25 aa, Mycobacterium
GAGGIRGPIGLGYRVPGIVISPFSR

SEQ ID NO: 1045201 - protein, 18 aa, Mycobacterium
GAGGLIFGGGGAGGVGGL

SEQ ID NO: 1045202 - protein, 18 aa, Mycobacterium
GAGGLLIGDGGKGFSSAT

SEQ ID NO: 1045203 - protein, 19 aa, Mycobacterium
GAGGLVLGNGGAGGNGGQG

SEQ ID NO: 1045204 - protein, 26 aa, Mycobacterium
GAGGNGGAGGWLFGNGGTGGTGGDAV

SEQ ID NO: 1045205 - protein, 21 aa, Mycobacterium
GAGGNGGWVVGNGGGGDGGLS

SEQ ID NO: 1045206 - protein, 24 aa, Mycobacterium
GAGGQGGNSFQFVPSAAGGAGQSG

SEQ ID NO: 1045207 - protein, 19 aa, Mycobacterium
GAGGSAWLLGTGGTGGAGG

SEQ ID NO: 1045208 - protein, 18 aa, Mycobacterium
GAGGSGWAGGAGGAGGNG

SEQ ID NO: 1045209 - protein, 26 aa, Mycobacterium
GAGISRPTFYFYFPSKEAVLLTLLDR

SEQ ID NO: 1045210 - protein, 20 aa, Mycobacterium
GAGLPELATQLSAALSASLS

SEQ ID NO: 1045211 - protein, 19 aa, Mycobacterium
GAGMGGLLLVYPNVIAVER

SEQ ID NO: 1045212 - protein, 25 aa, Mycobacterium
GAGNFNLALARAYKAVADATGGNGI

SEQ ID NO: 1045213 - protein, 25 aa, Mycobacterium
GAGNIARITAIGGGTVTSSATNGGA

SEQ ID NO: 1045214 - protein, 25 aa, Mycobacterium
GAGPGQRVALVFGRCAQAVTAILAV

SEQ ID NO: 1045215 - protein, 25 aa, Mycobacterium
GAGPGRGAGDWAMRELVVLHEVAHH

SEQ ID NO: 1045216 - protein, 26 aa, Mycobacterium
GAGSLSIRGGGYGGLGGNGGTGGAGG

SEQ ID NO: 1045217 - protein, 21 aa, Mycobacterium
GAGTFPWVLAITTPYSDEAQR

SEQ ID NO: 1045218 - protein, 21 aa, Mycobacterium
GAGTQCSRSGPMTAGAVNEAG

SEQ ID NO: 1045219 - protein, 17 aa, Mycobacterium
GAGTRMKLARNMLTFTI

SEQ ID NO: 1045220 - protein, 29 aa, Mycobacterium
GAGYEDLAWFCVRAWRFGAPASYGAGGLG

SEQ ID NO: 1045221 - protein, 18 aa, Mycobacterium
GAHYPGDFIVEYIGQTRG

SEQ ID NO: 1045222 - protein, 39 aa, Mycobacterium; identical to SEQ ID NO: 662740

SEQ ID NO: 1045223 - protein, 19 aa, Mycobacterium
GAIGRLVTRQLIAAGHTVS

SEQ ID NO: 1045224 - protein, 26 aa, Mycobacterium
GAINGHVRAGGFGLVSACDIVVAGPA

SEQ ID NO: 1045225 - protein, 23 aa, Mycobacterium
GAIPVMCLPGHRLAELHHFAEVS

SEQ ID NO: 1045226 - protein, 19 aa, Mycobacterium
GAIVAFPVTQWTRWRQPVI

SEQ ID NO: 1045227 - protein, 18 aa, Mycobacterium
GAKNVLLVFFPLAFTGIC

SEQ ID NO: 1045228 - protein, 17 aa, Mycobacterium
GALAMAWTGPGADAAVN

SEQ ID NO: 1045229 - protein, 19 aa, Mycobacterium
GALDPVKFLVSWQRGDSMT

SEQ ID NO: 1045230 - protein, 17 aa, Mycobacterium
GALEGLDNLTFVINCNL

SEQ ID NO: 1045231 - protein, 24 aa, Mycobacterium
GALGRLEDLSAWVASCQGQCPPRQ

SEQ ID NO: 1045232 - protein, 26 aa, Mycobacterium
GALGRMLLGSVCSALLHHAHCPVAVV

SEQ ID NO: 1045233 - protein, 19 aa, Mycobacterium
GALGSLPGALGSAIPSLGG

SEQ ID NO: 1045234 - protein, 17 aa, Mycobacterium
GALIHRLIRTGRSLFTA

SEQ ID NO: 1045235 - protein, 17 aa, Mycobacterium
GALKLGRELGKGAVIVV

SEQ ID NO: 1045236 - protein, 17 aa, Mycobacterium
GALLANDVNGLWVTHNS

SEQ ID NO: 1045237 - protein, 23 aa, Mycobacterium
GALLDALTEFGMRGIDLTRIESR

SEQ ID NO: 1045238 - protein, 17 aa, Mycobacterium
GALLVRVARSHLRVGSF

SEQ ID NO: 1045239 - protein, 18 aa, Mycobacterium
GALPLLVGGSMLYVQSLL

SEQ ID NO: 1045240 - protein, 23 aa, Mycobacterium
GALPRGATKWLASGMQRTPELAR

SEQ ID NO: 1045241 - protein, 20 aa, Mycobacterium
GALQRGLPVLGICRGAQVLN

SEQ ID NO: 1045242 - protein, 26 aa, Mycobacterium
GALRIPEMIRWPGKISAGVVSNEIIQ

SEQ ID NO: 1045243 - protein, 22 aa, Mycobacterium
GALRRWAQAILNRRRDGEIYQT

SEQ ID NO: 1045244 - protein, 18 aa, Mycobacterium
GALSNWVAGQAEIYGTRG

SEQ ID NO: 1045245 - protein, 24 aa, Mycobacterium
GALSPFGEVVFPLAADDLPYLHPV

SEQ ID NO: 1045246 - protein, 25 aa, Mycobacterium
GALTEPRQALTLLIDAYVATSFANP

SEQ ID NO: 1045247 - protein, 28 aa, Mycobacterium
GAMADPGSVSYLFSRKGVVTLEKNGLTE

SEQ ID NO: 1045248 - protein, 19 aa, Mycobacterium
GAMAPHVSVWIGRESQAIA

SEQ ID NO: 1045249 - protein, 24 aa, Mycobacterium
GAMSAVTCSFLFLCSGYYNYDQGY

SEQ ID NO: 1045250 - protein, 19 aa, Mycobacterium
GAMTPMFVGFRAREIILSL

SEQ ID NO: 1045251 - protein, 18 aa, Mycobacterium
GAMYPRRNVATFWRKRTW

SEQ ID NO: 1045252 - protein, 19 aa, Mycobacterium
GAMYRMMTLAVLRAGIDPA

SEQ ID NO: 1045253 - protein, 24 aa, Mycobacterium
GANAEIAWEHNIGVLGGRFRVLAP

SEQ ID NO: 1045254 - protein, 23 aa, Mycobacterium
GANGGAAGWLIGNGGAGGSGTPG

SEQ ID NO: 1045255 - protein, 23 aa, Mycobacterium
GANGGDGGILFGNGGAGGSGAVN

SEQ ID NO: 1045256 - protein, 21 aa, Mycobacterium
GANGGNGGWLIGSGGDGAAGG

SEQ ID NO: 1045257 - protein, 25 aa, Mycobacterium
GANMADCHPILFLRMMERVKSGAKL

SEQ ID NO: 1045258 - protein, 18 aa, Mycobacterium
GANVIPIQLPVGSEGDFE

SEQ ID NO: 1045259 - protein, 21 aa, Mycobacterium
GAPEALGAWHAMIEEPIGRAI

SEQ ID NO: 1045260 - protein, 22 aa, Mycobacterium
GAPGGDGGILFGSGGAGGSGAG

SEQ ID NO: 1045261 - protein, 18 aa, Mycobacterium
GAPGQWWQQQVVLGLQRR

SEQ ID NO: 1045262 - protein, 30 aa, Mycobacterium
GAPSMPGGLGGRGGLLWGDGGKGGDGGAPV

SEQ ID NO: 1045263 - protein, 20 aa, Mycobacterium
GAPVYDAWGYLLAEAGTGGA

SEQ ID NO: 1045264 - protein, 27 aa, Mycobacterium
GAQAEAFHAQFAQLMANGAGTYASAEA

SEQ ID NO: 1045265 - protein, 23 aa, Mycobacterium
GAQLRAALSGSLGTAVPGLSALI

SEQ ID NO: 1045266 - protein, 20 aa, Mycobacterium
GAQPQAAKLTEWLKLALDEP

SEQ ID NO: 1045267 - protein, 23 aa, Mycobacterium
GAQPRDWFEVSLIPTTRELTTLG

SEQ ID NO: 1045268 - protein, 19 aa, Mycobacterium
GAREHALLLALARDPQVSG

SEQ ID NO: 1045269 - protein, 19 aa, Mycobacterium
GAREMVPIYLRPGVGANVD

SEQ ID NO: 1045270 - protein, 18 aa, Mycobacterium
GARFCGGVFAISAVVQHE

SEQ ID NO: 1045271 - protein, 24 aa, Mycobacterium
GARGAGGDAGLLIGDSGAGGSGGP

SEQ ID NO: 1045272 - protein, 19 aa, Mycobacterium
GARGRRLDVRQARTVVHQT

SEQ ID NO: 1045273 - protein, 21 aa, Mycobacterium
GARGTGKCQQAWCPVCALTAL

SEQ ID NO: 1045274 - protein, 20 aa, Mycobacterium
GARGYAHIGVIEALRERGYE

SEQ ID NO: 1045275 - protein, 30 aa, Mycobacterium; identical to SEQ ID NO: 663173

SEQ ID NO: 1045276 - protein, 17 aa, Mycobacterium
GARPRGPGMERSDLLEA

SEQ ID NO: 1045277 - protein, 23 aa, Mycobacterium
GARTRAAGGYAEIARIGSNVDAL

SEQ ID NO: 1045278 - protein, 26 aa, Mycobacterium
GARVVKAHVPLSEMFGYVGDLRSKTQ

SEQ ID NO: 1045279 - protein, 24 aa, Mycobacterium
GASAIPLGPDLIGKGGAGGPGGLF

SEQ ID NO: 1045280 - protein, 18 aa, Mycobacterium
GASAPYVAWLRASAIRAE

SEQ ID NO: 1045281 - protein, 18 aa, Mycobacterium
GASAQHPVVLPVAEDIPA

SEQ ID NO: 1045282 - protein, 23 aa, Mycobacterium
GASGGRGGLLSGAQGVTGTAGDG

SEQ ID NO: 1045283 - protein, 24 aa, Mycobacterium
GASLARLEVLAVLNAVLDRYQKIA

SEQ ID NO: 1045284 - protein, 24 aa, Mycobacterium
GASLPRRHQLVLSRGPYHYDDEVR

SEQ ID NO: 1045285 - protein, 20 aa, Mycobacterium
GASMGGMIAQIFAARFAERT

SEQ ID NO: 1045286 - protein, 19 aa, Mycobacterium
GASPEIASALGLSEGAPVL

SEQ ID NO: 1045287 - protein, 25 aa, Mycobacterium
GASRSCGDWPYTAMLNAGLCHLTGF

SEQ ID NO: 1045288 - protein, 20 aa, Mycobacterium
GASVLKQLVAYVGLEHFLAG

SEQ ID NO: 1045289 - protein, 34 aa, Mycobacterium; identical to SEQ ID NO: 663272

SEQ ID NO: 1045290 - protein, 17 aa, Mycobacterium
GATGLKPRGPSDFLCEL

SEQ ID NO: 1045291 - protein, 26 aa, Mycobacterium
GATHATELFAVFDIYRTRFGALLTAA

SEQ ID NO: 1045292 - protein, 21 aa, Mycobacterium
GATKRFGLTVTLAERERQLAI

SEQ ID NO: 1045293 - protein, 18 aa, Mycobacterium
GATKVLWENSAAFYRLAE

SEQ ID NO: 1045294 - protein, 17 aa, Mycobacterium
GATLLMSCFCDANPPNE

SEQ ID NO: 1045295 - protein, 17 aa, Mycobacterium
GATLVSLAKGIELGTLM

SEQ ID NO: 1045296 - protein, 18 aa, Mycobacterium
GATTRPDTLLGWLQSDLA

SEQ ID NO: 1045297 - protein, 24 aa, Mycobacterium
GATVKTGAEYPVFPEYGDDVYYAV

SEQ ID NO: 1045298 - protein, 19 aa, Mycobacterium
GATWGAVKYQFGDIDGFWA

SEQ ID NO: 1045299 - protein, 18 aa, Mycobacterium
GAVATAFEAARTAIVSPV

SEQ ID NO: 1045300 - protein, 26 aa, Mycobacterium
GAVELGIKWLSLYAFSTENWKRSAEE

SEQ ID NO: 1045301 - protein, 26 aa, Mycobacterium
GAVELTGAWPGLRCDVDTPADLAAAR

SEQ ID NO: 1045302 - protein, 19 aa, Mycobacterium
GAVIEMIHLATLYHDDVMD

SEQ ID NO: 1045303 - protein, 27 aa, Mycobacterium
GAVIYFPRKVIWFLPDFTVECYHDQLR

SEQ ID NO: 1045304 - protein, 18 aa, Mycobacterium
GAVLCNLATHLDDPAQRL

SEQ ID NO: 1045305 - protein, 17 aa, Mycobacterium
GAVLMVVMRVRQPGFFL

SEQ ID NO: 1045306 - protein, 24 aa, Mycobacterium
GAVRLKMTPHWSGPAQVVDRIDGA

SEQ ID NO: 1045307 - protein, 17 aa, Mycobacterium
GAVRVIVDRDRCEGNAV

SEQ ID NO: 1045308 - protein, 18 aa, Mycobacterium
GAVSRAHRGVLFLDECAE

SEQ ID NO: 1045309 - protein, 19 aa, Mycobacterium
GAVSVRLGPTVLRTSTAAA

SEQ ID NO: 1045310 - protein, 21 aa, Mycobacterium
GAVTLPIGVLFAVVRGSTALA

SEQ ID NO: 1045311 - protein, 22 aa, Mycobacterium
GAVVLLMWAGILAYLDRCDYDY

SEQ ID NO: 1045312 - protein, 26 aa, Mycobacterium
GAWGGEVPTALAAPMALSAAASSPAA

SEQ ID NO: 1045313 - protein, 24 aa, Mycobacterium
GAWKDYTERGGRPFGEFAAFCYHQ

SEQ ID NO: 1045314 - protein, 18 aa, Mycobacterium
GAYHGWGFHEDGAASGLR

SEQ ID NO: 1045315 - protein, 25 aa, Mycobacterium
GAYLLSRAPGALGLHTALTGAPFSG

SEQ ID NO: 1045316 - protein, 17 aa, Mycobacterium
GCADPLYRRAVRVSMGH

SEQ ID NO: 1045317 - protein, 23 aa, Mycobacterium
GCADSRVAAEIIFDQGLGDMFVV

SEQ ID NO: 1045318 - protein, 20 aa, Mycobacterium
GCAEAMKGQGARVSVTEIDP

SEQ ID NO: 1045319 - protein, 17 aa, Mycobacterium
GCAGLEVVDSIRGHDGF

SEQ ID NO: 1045320 - protein, 31 aa, Mycobacterium; identical to SEQ ID NO: 663489

SEQ ID NO: 1045321 - protein, 19 aa, Mycobacterium
GCDLMVCRYNDGIGHPFWF

SEQ ID NO: 1045322 - protein, 17 aa, Mycobacterium
GCDRGGYRADARRTRTR

SEQ ID NO: 1045323 - protein, 18 aa, Mycobacterium
GCELHLVEPLGFDLSEPK

SEQ ID NO: 1045324 - protein, 26 aa, Mycobacterium
GCERIRKTPMPFAYAVHLRRALVLYC

SEQ ID NO: 1045325 - protein, 22 aa, Mycobacterium
GCGDGFLSARLVDRVPDVTALD

SEQ ID NO: 1045326 - protein, 22 aa, Mycobacterium
GCGLWPGAVTRLDAPVIPHMGW

SEQ ID NO: 1045327 - protein, 20 aa, Mycobacterium
GCGYAELSLALAAEGYTVVG

SEQ ID NO: 1045328 - protein, 24 aa, Mycobacterium
GCIAGCLHLAFDYERDHPFLQSGT

SEQ ID NO: 1045329 - protein, 18 aa, Mycobacterium
GCIASLIRAPPSFRYVSS

SEQ ID NO: 1045330 - protein, 20 aa, Mycobacterium
GCISLSPADAEWYFNTVNVG

SEQ ID NO: 1045331 - protein, 20 aa, Mycobacterium
GCLRRGVGVLGARQTHEPVR

SEQ ID NO: 1045332 - protein, 24 aa, Mycobacterium
GCMSLLKRLIRAHVHGRQVYLVPR

SEQ ID NO: 1045333 - protein, 17 aa, Mycobacterium
GCNRNRASLVGQLAMVV

SEQ ID NO: 1045334 - protein, 17 aa, Mycobacterium
GCQEVMLGYSDSNKDGG

SEQ ID NO: 1045335 - protein, 19 aa, Mycobacterium
GCQSDKFAAIAPVAGTLLT

SEQ ID NO: 1045336 - protein, 24 aa, Mycobacterium
GCSHALVCRYHGWIYRLDGSLSHV

SEQ ID NO: 1045337 - protein, 20 aa, Mycobacterium
GCSSIAAGLTSGWRGPAAVP

SEQ ID NO: 1045338 - protein, 17 aa, Mycobacterium
GCSSWYLNDDWVPEVWP

SEQ ID NO: 1045339 - protein, 18 aa, Mycobacterium
GDAAVSLMDAFRSADEVL

SEQ ID NO: 1045340 - protein, 18 aa, Mycobacterium
GDAEERAADFIKANVSKP

SEQ ID NO: 1045341 - protein, 22 aa, Mycobacterium
GDAGDIAYPYYLVNGRIPAAPT

SEQ ID NO: 1045342 - protein, 18 aa, Mycobacterium
GDAGMFGNGGAGGAGGDR

SEQ ID NO: 1045343 - protein, 20 aa, Mycobacterium
GDAIPAWRPALAAQVAPASG

SEQ ID NO: 1045344 - protein, 23 aa, Mycobacterium
GDALRYPARYLFVFLEHHGMLSV

SEQ ID NO: 1045345 - protein, 20 aa, Mycobacterium
GDARIGRLLFSTHLANPVVV

SEQ ID NO: 1045346 - protein, 23 aa, Mycobacterium
GDASIRFQMGLSMADALAKLGAV

SEQ ID NO: 1045347 - protein, 26 aa, Mycobacterium
GDASLWGREITSLLVAGMTADHVLER

SEQ ID NO: 1045348 - protein, 18 aa, Mycobacterium
GDAVRCGLSALPADYSGI

SEQ ID NO: 1045349 - protein, 17 aa, Mycobacterium
GDCEVSKIIVLDDLTAT

SEQ ID NO: 1045350 - protein, 22 aa, Mycobacterium
GDCLPERDFPTLIDLYLQGRLP

SEQ ID NO: 1045351 - protein, 24 aa, Mycobacterium
GDCPRGCGHMGPPADPECVLDSLS

SEQ ID NO: 1045352 - protein, 27 aa, Mycobacterium
GDDAESRQGFDLTLEHWAAHDGLSALS

SEQ ID NO: 1045353 - protein, 18 aa, Mycobacterium
GDDGWRDVIDVNLSGAYY

SEQ ID NO: 1045354 - protein, 25 aa, Mycobacterium
GDDIAEVLALLGVRPVWDEASRRVV

SEQ ID NO: 1045355 - protein, 24 aa, Mycobacterium
GDDIRARFVVMASGPFHRPKLPGI

SEQ ID NO: 1045356 - protein, 32 aa, Mycobacterium; identical to SEQ ID NO: 663744

SEQ ID NO: 1045357 - protein, 24 aa, Mycobacterium
GDDRKSLTFALRFRAPDRTLTEDD

SEQ ID NO: 1045358 - protein, 19 aa, Mycobacterium
GDEAILFGPGTRGEPTAQD

SEQ ID NO: 1045359 - protein, 27 aa, Mycobacterium
GDEDFWLKVGIDPIRIMTGAGNLYTLR

SEQ ID NO: 1045360 - protein, 21 aa, Mycobacterium
GDEIKRLINGATYLFTNDYEW

SEQ ID NO: 1045361 - protein, 30 aa, Mycobacterium; identical to SEQ ID NO: 663772

SEQ ID NO: 1045362 - protein, 17 aa, Mycobacterium
GDELVKALMHSDLARVY

SEQ ID NO: 1045363 - protein, 23 aa, Mycobacterium
GDEMLWRMTHPDKDFRAVSDVET

SEQ ID NO: 1045364 - protein, 21 aa, Mycobacterium
GDEVLLRLFGKAVELAFLAVP

SEQ ID NO: 1045365 - protein, 26 aa, Mycobacterium
GDEVQIGKFRLVFLTGPKQGDDDGGT

SEQ ID NO: 1045366 - protein, 24 aa, Mycobacterium
GDEVSAAIASFFAAHGQAYQTMAG

SEQ ID NO: 1045367 - protein, 28 aa, Mycobacterium
GDEVSLAIPRVFGAYGRDYQAFGVQAAE

SEQ ID NO: 1045368 - protein, 22 aa, Mycobacterium
GDFARRGLDSELAPLYAQALVG

SEQ ID NO: 1045369 - protein, 17 aa, Mycobacterium
GDFGGVWYWNRYPGLQC

SEQ ID NO: 1045370 - protein, 23 aa, Mycobacterium
GDFVKIDFGALVAGYHSDMTRTF

SEQ ID NO: 1045371 - protein, 23 aa, Mycobacterium
GDGEQRLHLVLADLGRVRQLGDA

SEQ ID NO: 1045372 - protein, 23 aa, Mycobacterium
GDGFARYWLHNGWVTMGGEKMSK

SEQ ID NO: 1045373 - protein, 27 aa, Mycobacterium
GDGGAGGRGGWLFGDAGAGGQGGLGGD

SEQ ID NO: 1045374 - protein, 24 aa, Mycobacterium
GDGGAGGVGGWLSGNAGAGGAGGP

SEQ ID NO: 1045375 - protein, 18 aa, Mycobacterium
GDGGDCAESNGGIGSGGR

SEQ ID NO: 1045376 - protein, 24 aa, Mycobacterium
GDGGDGGTGGWLYGNGGHGGTGAT

SEQ ID NO: 1045377 - protein, 17 aa, Mycobacterium
GDGGDWAGPEALKEMDP

SEQ ID NO: 1045378 - protein, 17 aa, Mycobacterium
GDGGFGVIGGQGGGGGF

SEQ ID NO: 1045379 - protein, 18 aa, Mycobacterium
GDGGFLFSAQELETATRL

SEQ ID NO: 1045380 - protein, 17 aa, Mycobacterium
GDGGLFFSSGGAGGEGG

SEQ ID NO: 1045381 - protein, 26 aa, Mycobacterium
GDGGLGGRVGFLFGDGGLGGQGGDGG

SEQ ID NO: 1045382 - protein, 24 aa, Mycobacterium
GDGGNAGALFGIGAGGHGGNAGSG

SEQ ID NO: 1045383 - protein, 24 aa, Mycobacterium
GDGGNAPLLGRGGAGGVGGASDGF

SEQ ID NO: 1045384 - protein, 26 aa, Mycobacterium
GDGGNATDLMIGNGGNGGTGGSGAAG

SEQ ID NO: 1045385 - protein, 30 aa, Mycobacterium; identical to SEQ ID NO: 663865

SEQ ID NO: 1045386 - protein, 27 aa, Mycobacterium
GDGGTGQGGISFLAPGGQTGGDGSTGG

SEQ ID NO: 1045387 - protein, 20 aa, Mycobacterium
GDGGTSWGGAAAGAGGDAGL

SEQ ID NO: 1045388 - protein, 26 aa, Mycobacterium
GDGGVGGGGGWLFGDGGVGGIGGNLL

SEQ ID NO: 1045389 - protein, 17 aa, Mycobacterium
GDGGWLLTGQKVWTSAA

SEQ ID NO: 1045390 - protein, 17 aa, Mycobacterium
GDGGWLYGNGGNGGSGA

SEQ ID NO: 1045391 - protein, 21 aa, Mycobacterium
GDGLGGSSCCYGFGAHTDLEW

SEQ ID NO: 1045392 - protein, 20 aa, Mycobacterium
GDGLRTGLCDEVTDAVVKIT

SEQ ID NO: 1045393 - protein, 21 aa, Mycobacterium
GDGLRTGLCDEVTDAVVKITP

SEQ ID NO: 1045394 - protein, 27 aa, Mycobacterium
GDGNLGFGLTGDNLVGFGNAYYDSTTG

SEQ ID NO: 1045395 - protein, 20 aa, Mycobacterium
GDGWRVMREALAFERVGIAR

SEQ ID NO: 1045396 - protein, 26 aa, Mycobacterium
GDHGSGCRELDASLEWHDGVREFLQS

SEQ ID NO: 1045397 - protein, 19 aa, Mycobacterium
GDHRLRIIHELSSQSPVPA

SEQ ID NO: 1045398 - protein, 17 aa, Mycobacterium
GDIARLFPEGGTVGVDE

SEQ ID NO: 1045399 - protein, 17 aa, Mycobacterium
GDIARVFLGSNSGRIIR

SEQ ID NO: 1045400 - protein, 19 aa, Mycobacterium
GDICLVWAEQMLRESGVED

SEQ ID NO: 1045401 - protein, 17 aa, Mycobacterium
GDIDGFWAAVLHRTAER

SEQ ID NO: 1045402 - protein, 17 aa, Mycobacterium
GDIDGLERVRFTSPHPA

SEQ ID NO: 1045403 - protein, 25 aa, Mycobacterium
GDIDRGGVFAAFFGTIALLSVEDQA

SEQ ID NO: 1045404 - protein, 19 aa, Mycobacterium
GDIDRPFWDAIVVVRHPSR

SEQ ID NO: 1045405 - protein, 22 aa, Mycobacterium
GDIFYLGGALGFESLEHTITYS

SEQ ID NO: 1045406 - protein, 24 aa, Mycobacterium
GDIIPRLVADGMAVVYDFSNNEVP

SEQ ID NO: 1045407 - protein, 26 aa, Mycobacterium
GDILTRLTAPVIRGSGIGIVPAATRG

SEQ ID NO: 1045408 - protein, 23 aa, Mycobacterium
GDIPTLLTGVEWLDTARAAGVDA

SEQ ID NO: 1045409 - protein, 18 aa, Mycobacterium
GDISRAYMRLPFGHGSDA

SEQ ID NO: 1045410 - protein, 20 aa, Mycobacterium
GDKLWARMEVHSVDERFGAD

SEQ ID NO: 1045411 - protein, 25 aa, Mycobacterium
GDKSSWWAAYALWVFTLFGHPDVRS

SEQ ID NO: 1045412 - protein, 17 aa, Mycobacterium
GDLAAAWRSLQAGTPPK

SEQ ID NO: 1045413 - protein, 19 aa, Mycobacterium
GDLAPLWSDEVLKAAIDAA

SEQ ID NO: 1045414 - protein, 25 aa, Mycobacterium
GDLARGIRTCMEHPAALNGDFNLST

SEQ ID NO: 1045415 - protein, 19 aa, Mycobacterium
GDLFLKQEQLFSVVEAGAV

SEQ ID NO: 1045416 - protein, 32 aa, Mycobacterium
GDLGEAAVCPRFRVGLLRPRTEIVVLDLRSEG

SEQ ID NO: 1045417 - protein, 24 aa, Mycobacterium
GDLKILDSYCRHMGGDLSEGTIKG

SEQ ID NO: 1045418 - protein, 31 aa, Mycobacterium
GDLLFIGCTPIVWNGPIANWIAACDAMIALD

SEQ ID NO: 1045419 - protein, 21 aa, Mycobacterium
GDLLITHWVTTFALDPPPLPI

SEQ ID NO: 1045420 - protein, 18 aa, Mycobacterium
GDLLRPVLGVPRHPLRPA

SEQ ID NO: 1045421 - protein, 22 aa, Mycobacterium
GDLLSRPGVFVFGSNDYFGPRL

SEQ ID NO: 1045422 - protein, 18 aa, Mycobacterium
GDLNWPSSWTPRRSQLPR

SEQ ID NO: 1045423 - protein, 17 aa, Mycobacterium
GDLPKIPAQLTVTATAS

SEQ ID NO: 1045424 - protein, 22 aa, Mycobacterium
GDLQHRLGRMVASTAAFGANEN

SEQ ID NO: 1045425 - protein, 25 aa, Mycobacterium
GDLYFSCTIPNLIVGTVGNGKDLDF

SEQ ID NO: 1045426 - protein, 21 aa, Mycobacterium
GDLYGNFRRGYAVDHDRELAK

SEQ ID NO: 1045427 - protein, 18 aa, Mycobacterium
GDMQLELISPVRGENIYS

SEQ ID NO: 1045428 - protein, 19 aa, Mycobacterium
GDNLVGIGPLHFNSADLAG

SEQ ID NO: 1045429 - protein, 21 aa, Mycobacterium
GDPAGGLVYAFGAPIAANIAL

SEQ ID NO: 1045430 - protein, 22 aa, Mycobacterium
GDPDWRAAVSLVLAEQILAELA

SEQ ID NO: 1045431 - protein, 27 aa, Mycobacterium
GDPGESRFYLSLGDELMRRFNGAALES

SEQ ID NO: 1045432 - protein, 25 aa, Mycobacterium
GDPLPAERWREYCLSSVTTHDLPPT

SEQ ID NO: 1045433 - protein, 25 aa, Mycobacterium
GDPMGFVNAVGYPLAADVALITVAS

SEQ ID NO: 1045434 - protein, 25 aa, Mycobacterium
GDPPYRGLVSMSFAWPTDDTGGYPA

SEQ ID NO: 1045435 - protein, 27 aa, Mycobacterium
GDPRLHLRAAGFLEVLRRDFGAAGFVP

SEQ ID NO: 1045436 - protein, 25 aa, Mycobacterium
GDPSVDLIPAWNLLSAPARGQFRTM

SEQ ID NO: 1045437 - protein, 20 aa, Mycobacterium
GDPWTKIVPGVRPFRKAMQH

SEQ ID NO: 1045438 - protein, 24 aa, Mycobacterium
GDPYRMASQLGMRPWRVQKAQKQA

SEQ ID NO: 1045439 - protein, 22 aa, Mycobacterium
GDQLMFRKLFESVIKGHVKVLV

SEQ ID NO: 1045440 - protein, 19 aa, Mycobacterium
GDQSLSEWSLHAEGVLAPA

SEQ ID NO: 1045441 - protein, 20 aa, Mycobacterium
GDQSWSRAMLNGGVRIDGPA

SEQ ID NO: 1045442 - protein, 19 aa, Mycobacterium
GDQVLRLAAQYADTVSIAC

SEQ ID NO: 1045443 - protein, 24 aa, Mycobacterium
GDQVSAAVAALFAAHAQGYQSIST

SEQ ID NO: 1045444 - protein, 23 aa, Mycobacterium
GDRARTTQLCRLFAAMTRHHHLA

SEQ ID NO: 1045445 - protein, 22 aa, Mycobacterium
GDRFRVPSPYVRFEQHETRLSC

SEQ ID NO: 1045446 - protein, 19 aa, Mycobacterium
GDRMWEFLDRLTSIALPRI

SEQ ID NO: 1045447 - protein, 23 aa, Mycobacterium
GDRNVVSVGFNWTMGNHVVPPKP

SEQ ID NO: 1045448 - protein, 21 aa, Mycobacterium
GDRPIPSWLQVVGGRQRILIH

SEQ ID NO: 1045449 - protein, 17 aa, Mycobacterium
GDRRLVLAEARLAAYTR

SEQ ID NO: 1045450 - protein, 18 aa, Mycobacterium
GDRVAVWHGDCAALHALF

SEQ ID NO: 1045451 - protein, 18 aa, Mycobacterium
GDSAGVLRQNGIGGHGGA

SEQ ID NO: 1045452 - protein, 19 aa, Mycobacterium
GDSGRWLDLCAGPGGKTAL

SEQ ID NO: 1045453 - protein, 17 aa, Mycobacterium
GDSLLLGTDLVKDTDRL

SEQ ID NO: 1045454 - protein, 23 aa, Mycobacterium
GDSRLDLAWSLLGYDGEEPRADG

SEQ ID NO: 1045455 - protein, 23 aa, Mycobacterium
GDSYKFDFAMIWYHASTKPSPFC

SEQ ID NO: 1045456 - protein, 20 aa, Mycobacterium
GDTARVFAIDAKSGATLGTY

SEQ ID NO: 1045457 - protein, 21 aa, Mycobacterium
GDTGLDGLLGVPGSNGQTGEI

SEQ ID NO: 1045458 - protein, 20 aa, Mycobacterium
GDTILGLSLAHGGHLTHGMR

SEQ ID NO: 1045459 - protein, 17 aa, Mycobacterium
GDTNFGFGNIGDLNLGS

SEQ ID NO: 1045460 - protein, 20 aa, Mycobacterium
GDTPLPVRTPLPVQLPEPMV

SEQ ID NO: 1045461 - protein, 19 aa, Mycobacterium
GDVAGAFGAIVDAPAVIAN

SEQ ID NO: 1045462 - protein, 31 aa, Mycobacterium; identical to SEQ ID NO: 664344

SEQ ID NO: 1045463 - protein, 19 aa, Mycobacterium
GDVIPEVLGPVVDLRDGSE

SEQ ID NO: 1045464 - protein, 18 aa, Mycobacterium
GDVIVFKGPPSWNVGYKS

SEQ ID NO: 1045465 - protein, 25 aa, Mycobacterium
GDVRGRGAMIAMELVKSGTAEPDAA

SEQ ID NO: 1045466 - protein, 21 aa, Mycobacterium
GDWDVPIGGMGSVTAGLAAAA

SEQ ID NO: 1045467 - protein, 29 aa, Mycobacterium
GDYNNGLLWRGDYQGNLGAFNYTVTVPTT

SEQ ID NO: 1045468 - protein, 21 aa, Mycobacterium
GDYRWAATLLDHIVFTDEQHA

SEQ ID NO: 1045469 - protein, 20 aa, Mycobacterium
GEAAQFLRWTAAQAPEAAGY

SEQ ID NO: 1045470 - protein, 22 aa, Mycobacterium
GEAAQSWPVVSADAGAPATLKE

SEQ ID NO: 1045471 - protein, 21 aa, Mycobacterium
GEAASLMWRHYLAGQTPSPES

SEQ ID NO: 1045472 - protein, 21 aa, Mycobacterium
GEAGLPDIAWFAADGSEMADE

SEQ ID NO: 1045473 - protein, 25 aa, Mycobacterium
GEALLSGLLRAGRQVKDLVVAERVP

SEQ ID NO: 1045474 - protein, 24 aa, Mycobacterium
GEALRRIGEGAAMIRSKGEAGTGD

SEQ ID NO: 1045475 - protein, 22 aa, Mycobacterium
GEAPENWQLIISDIADSELPDG

SEQ ID NO: 1045476 - protein, 18 aa, Mycobacterium
GEARVLVATDIAARGVHV

SEQ ID NO: 1045477 - protein, 22 aa, Mycobacterium
GEATYRFPLVIAPRYTTGHPVG

SEQ ID NO: 1045478 - protein, 20 aa, Mycobacterium
GEAVNAIARMYADTDVAVAR

SEQ ID NO: 1045479 - protein, 18 aa, Mycobacterium
GEAYAKYNIRRSVKDREL

SEQ ID NO: 1045480 - protein, 17 aa, Mycobacterium
GECLNMPGQSWAVHLQP

SEQ ID NO: 1045481 - protein, 32 aa, Mycobacterium
GECQSLVFLHGLQLFGAMGFTWGNDLQFALKR

SEQ ID NO: 1045482 - protein, 25 aa, Mycobacterium
GEDLSWLWDVRFEHFAEAFKTTPVV

SEQ ID NO: 1045483 - protein, 26 aa, Mycobacterium
GEDTVTVILDYCSKHGIAVIPCGGGT

SEQ ID NO: 1045484 - protein, 18 aa, Mycobacterium
GEEALGWVRARNEPTKAQ

SEQ ID NO: 1045485 - protein, 19 aa, Mycobacterium
GEEFARILSQRGYQVVLVA

SEQ ID NO: 1045486 - protein, 20 aa, Mycobacterium
GEEYHLNWNGRNGFARIAGE

SEQ ID NO: 1045487 - protein, 18 aa, Mycobacterium
GEFARAGYEIEDVVIDHR

SEQ ID NO: 1045488 - protein, 20 aa, Mycobacterium
GEFSADRGWNLAELFDPDPD

SEQ ID NO: 1045489 - protein, 23 aa, Mycobacterium
GEGKRLYPLTADRAKPAVPFGGA

SEQ ID NO: 1045490 - protein, 23 aa, Mycobacterium
GEGLKRVSLELGGKSAAIILDDA

SEQ ID NO: 1045491 - protein, 19 aa, Mycobacterium
GEGNPSWIPAASPASPESL

SEQ ID NO: 1045492 - protein, 25 aa, Mycobacterium
GEGPALALLPGWSLTAQIFRHQLAG

SEQ ID NO: 1045493 - protein, 17 aa, Mycobacterium
GEGWRHLSDWPPKTTDH

SEQ ID NO: 1045494 - protein, 24 aa, Mycobacterium
GEHADRLAALMITYPSTHGVYEHD

SEQ ID NO: 1045495 - protein, 23 aa, Mycobacterium
GEHEAALRIVDWLDAAGAQHARI

SEQ ID NO: 1045496 - protein, 26 aa, Mycobacterium
GEHIVCPWHGWQWRGDGTNALIPYSK

SEQ ID NO: 1045497 - protein, 20 aa, Mycobacterium
GEHQLDWLHRLRREMPNLQE

SEQ ID NO: 1045498 - protein, 19 aa, Mycobacterium
GEIFSCFSMTEPQGGADPR

SEQ ID NO: 1045499 - protein, 25 aa, Mycobacterium
GEILERSLVHLGLKHYFLVDFPQEP

SEQ ID NO: 1045500 - protein, 17 aa, Mycobacterium
GEIRLVLHGGHIAVNGR

SEQ ID NO: 1045501 - protein, 17 aa, Mycobacterium
GEIVDRFVVGASGSGAA

SEQ ID NO: 1045502 - protein, 24 aa, Mycobacterium
GEIWVCGDNVAIGYWNKPEESERT

SEQ ID NO: 1045503 - protein, 26 aa, Mycobacterium
GEKKTFRIAAHWADHLNIVAALDELP

SEQ ID NO: 1045504 - protein, 25 aa, Mycobacterium
GEKLELRRVAIFGGTVETYLHRRAA

SEQ ID NO: 1045505 - protein, 17 aa, Mycobacterium
GEKRFAQMVPHAVYGWL

SEQ ID NO: 1045506 - protein, 18 aa, Mycobacterium
GELALLRLACEAADAALS

SEQ ID NO: 1045507 - protein, 17 aa, Mycobacterium
GELAVALHANFPPERIT

SEQ ID NO: 1045508 - protein, 17 aa, Mycobacterium
GELCGMAPLGITASNDV

SEQ ID NO: 1045509 - protein, 18 aa, Mycobacterium
GELDRLANQWGRTLAAHG

SEQ ID NO: 1045510 - protein, 23 aa, Mycobacterium
GELFADEVIETFGDPVWIISQGP

SEQ ID NO: 1045511 - protein, 17 aa, Mycobacterium
GELFASFDVDAFEVPHG

SEQ ID NO: 1045512 - protein, 25 aa, Mycobacterium
GELGEPFTTVGLCCYRDGFDSVAWH

SEQ ID NO: 1045513 - protein, 18 aa, Mycobacterium
GELLEWAEIHGGLHRSGT

SEQ ID NO: 1045514 - protein, 21 aa, Mycobacterium
GELLGRISWSRVGTVVAKGVL

SEQ ID NO: 1045515 - protein, 20 aa, Mycobacterium
GELNAAAVRSMWPTVREKVR

SEQ ID NO: 1045516 - protein, 21 aa, Mycobacterium
GELPDLSGLVQAGAVLMGGVG

SEQ ID NO: 1045517 - protein, 17 aa, Mycobacterium
GELPTWQWESLIGESTR

SEQ ID NO: 1045518 - protein, 25 aa, Mycobacterium
GELPTWQWESLISKSTRLVAVTSAS

SEQ ID NO: 1045519 - protein, 17 aa, Mycobacterium
GELQRIRVAQALASDPS

SEQ ID NO: 1045520 - protein, 21 aa, Mycobacterium
GELRPAFDDIRPLRHGSIDDA

SEQ ID NO: 1045521 - protein, 19 aa, Mycobacterium
GELRQATILEVQRARTVID

SEQ ID NO: 1045522 - protein, 25 aa, Mycobacterium
GELRYPELADWGIPTAEAIVEVRQA

SEQ ID NO: 1045523 - protein, 24 aa, Mycobacterium
GELTQLAGVFGFAECIDLLANHTA

SEQ ID NO: 1045524 - protein, 20 aa, Mycobacterium
GELWIGGACVGMGYRGPPAL

SEQ ID NO: 1045525 - protein, 23 aa, Mycobacterium
GEMFSALGSVHWALTASSAPRAP

SEQ ID NO: 1045526 - protein, 20 aa, Mycobacterium
GEMHPVVAIYSTFLNRAFDQ

SEQ ID NO: 1045527 - protein, 19 aa, Mycobacterium
GEMRARLRGLDAAAQTSSG

SEQ ID NO: 1045528 - protein, 20 aa, Mycobacterium
GENIPAWLVFDQRYRDRYIF

SEQ ID NO: 1045529 - protein, 18 aa, Mycobacterium
GENVFFCATGVTDGDLLK

SEQ ID NO: 1045530 - protein, 19 aa, Mycobacterium
GEPELRPDDLLRVDGQGRG

SEQ ID NO: 1045531 - protein, 19 aa, Mycobacterium
GEPGAGVVVGRARPVGKTV

SEQ ID NO: 1045532 - protein, 17 aa, Mycobacterium
GEPGAREYLVLGGGLNR

SEQ ID NO: 1045533 - protein, 17 aa, Mycobacterium
GEPGCATNTYLDRSVLP

SEQ ID NO: 1045534 - protein, 19 aa, Mycobacterium
GEPGLLLSRVNRLQPFDGY

SEQ ID NO: 1045535 - protein, 23 aa, Mycobacterium
GEPGVLAAPAARVPRAAPEALAE

SEQ ID NO: 1045536 - protein, 20 aa, Mycobacterium
GEPHAISAMHGRGVANLLDT

SEQ ID NO: 1045537 - protein, 25 aa, Mycobacterium
GEPIAPTRGAPLCGFRQTSRILAGL

SEQ ID NO: 1045538 - protein, 21 aa, Mycobacterium
GEPMKAIPAFREPGPRLEVMD

SEQ ID NO: 1045539 - protein, 23 aa, Mycobacterium
GEPPEAACPLGMATAYAANAAEG

SEQ ID NO: 1045540 - protein, 24 aa, Mycobacterium
GEQELRGLLGAFMFTGPQLDQPAG

SEQ ID NO: 1045541 - protein, 18 aa, Mycobacterium
GEQRPGSVRALRRDEIGQ

SEQ ID NO: 1045542 - protein, 22 aa, Mycobacterium
GEQRVAVGIASGFGAARLAPGH

SEQ ID NO: 1045543 - protein, 22 aa, Mycobacterium
GERGSAGAYLIGWDPLLQPGLP

SEQ ID NO: 1045544 - protein, 25 aa, Mycobacterium
GERSWRIPATAFWQSHRDAAKVCSG

SEQ ID NO: 1045545 - protein, 23 aa, Mycobacterium
GERTGNVCLVTLGLNLFSRGVDP

SEQ ID NO: 1045546 - protein, 17 aa, Mycobacterium
GERVIPQWVKIRNVDGF

SEQ ID NO: 1045547 - protein, 26 aa, Mycobacterium
GESATAFQAAHARFVEAAGKVHTLLD

SEQ ID NO: 1045548 - protein, 20 aa, Mycobacterium
GESLNRLGYHMERDQIPEMV

SEQ ID NO: 1045549 - protein, 25 aa, Mycobacterium
GESVAEGTVTRWLKKVGDSVQVDEA
